United States Patent 10,706,955 (BIOINFORMATIC PROCESSES FOR DETERMINATION OF PEPTIDE BINDING) - sequence listing, part 82

SEQ ID NO: 3123176 - protein, 11 aa, Giardia lamblia
LTNAKKYTGIS

SEQ ID NO: 3123177 - protein, 10 aa, Giardia lamblia
LTNDAERLRG

SEQ ID NO: 3123178 - protein, 11 aa, Giardia lamblia
LTNDPASGCRA

SEQ ID NO: 3123179 - protein, 7 aa, Giardia lamblia
LTNEAAQ

SEQ ID NO: 3123180 - protein, 5 aa, Giardia lamblia
LTNER

SEQ ID NO: 3123181 - protein, 11 aa, Giardia lamblia
LTNGRPGSMGS

SEQ ID NO: 3123182 - protein, 6 aa, Giardia lamblia
LTNKDG

SEQ ID NO: 3123183 - protein, 7 aa, Giardia lamblia
LTNKDGL

SEQ ID NO: 3123184 - protein, 15 aa, Giardia lamblia
LTNKEKSSETDRAEN

SEQ ID NO: 3123185 - protein, 15 aa, Giardia lamblia
LTNKNKIEAQANADV

SEQ ID NO: 3123186 - protein, 8 aa, Giardia lamblia
LTNNAGET

SEQ ID NO: 3123187 - protein, 14 aa, Giardia lamblia
LTNNKVPEVTEDRE

SEQ ID NO: 3123188 - protein, 7 aa, Giardia lamblia
LTNPGLA

SEQ ID NO: 3123189 - protein, 97 aa, Giardia lamblia
LTNPPETYAPSTFSPSGTQLTTTFPQSTEVVEGDPSFASSGKKSRSASKTGRAKTPKEKTSRAKTPKAKTPKTKTPKTKGKSLRDAESTEYYDPPTA

SEQ ID NO: 3123190 - protein, 11 aa, Giardia lamblia
LTNPQASAALT

SEQ ID NO: 3123191 - protein, 9 aa, Giardia lamblia
LTNSPGHIT

SEQ ID NO: 3123192 - protein, 9 aa, Giardia lamblia
LTNTRTRAL

SEQ ID NO: 3123193 - protein, 4 aa, Giardia lamblia
LTPA

SEQ ID NO: 3123194 - protein, 5 aa, Giardia lamblia
LTPAA

SEQ ID NO: 3123195 - protein, 18 aa, Giardia lamblia
LTPAADDNREESSKESSK

SEQ ID NO: 3123196 - protein, 11 aa, Giardia lamblia
LTPADPSSPNL

SEQ ID NO: 3123197 - protein, 11 aa, Giardia lamblia
LTPADQRESPC

SEQ ID NO: 3123198 - protein, 8 aa, Giardia lamblia
LTPAEQEK

SEQ ID NO: 3123199 - protein, 10 aa, Giardia lamblia
LTPDEEDMTG

SEQ ID NO: 3123200 - protein, 17 aa, Giardia lamblia
LTPDGTGLAEKTCKGHT

SEQ ID NO: 3123201 - protein, 7 aa, Giardia lamblia
LTPDLSG

SEQ ID NO: 3123202 - protein, 10 aa, Giardia lamblia
LTPDQERMTS

SEQ ID NO: 3123203 - protein, 6 aa, Giardia lamblia
LTPDTH

SEQ ID NO: 3123204 - protein, 4 aa, Giardia lamblia
LTPE

SEQ ID NO: 3123205 - protein, 5 aa, Giardia lamblia
LTPEE

SEQ ID NO: 3123206 - protein, 6 aa, Giardia lamblia
LTPEQL

SEQ ID NO: 3123207 - protein, 27 aa, Giardia lamblia
LTPGQELRGTAPTEKESQRNLDLLLAI

SEQ ID NO: 3123208 - protein, 27 aa, Giardia lamblia
LTPGQELRGTAPTEKESQRNLDLLLAV

SEQ ID NO: 3123209 - protein, 10 aa, Giardia lamblia
LTPIEQTDPH

SEQ ID NO: 3123210 - protein, 4 aa, Giardia lamblia
LTPK

SEQ ID NO: 3123211 - protein, 9 aa, Giardia lamblia
LTPKDTAIP

SEQ ID NO: 3123212 - protein, 10 aa, Giardia lamblia
LTPNESIQEP

SEQ ID NO: 3123213 - protein, 5 aa, Giardia lamblia
LTPNH

SEQ ID NO: 3123214 - protein, 6 aa, Giardia lamblia
LTPNIN

SEQ ID NO: 3123215 - protein, 24 aa, Giardia lamblia
LTPNVDTPPEKQKPKEKRYKLTPR

SEQ ID NO: 3123216 - protein, 6 aa, Giardia lamblia
LTPPDA

SEQ ID NO: 3123217 - protein, 62 aa, Giardia lamblia
LTPPETPPRPTKSTKGKKGKKGAKGKKGRPSTGAKSNTASRPSTTRKLTTPPQTAMPGKRRP

SEQ ID NO: 3123218 - protein, 7 aa, Giardia lamblia
LTPPGAE

SEQ ID NO: 3123219 - protein, 7 aa, Giardia lamblia
LTPPQGI

SEQ ID NO: 3123220 - protein, 10 aa, Giardia lamblia
LTPPSHLGSK

SEQ ID NO: 3123221 - protein, 45 aa, Giardia lamblia
LTPQPSLATAQPSTQPSPQQAPPAYAPAAGPYASMQSNAYNTSYN

SEQ ID NO: 3123222 - protein, 12 aa, Giardia lamblia
LTPQSRGSHSDI

SEQ ID NO: 3123223 - protein, 8 aa, Giardia lamblia
LTPRTRDR

SEQ ID NO: 3123224 - protein, 8 aa, Giardia lamblia
LTPSGETS

SEQ ID NO: 3123225 - protein, 9 aa, Giardia lamblia
LTPSKRGKN

SEQ ID NO: 3123226 - protein, 5 aa, Giardia lamblia
LTPST

SEQ ID NO: 3123227 - protein, 17 aa, Giardia lamblia
LTPTGKQASPSGASPLQ

SEQ ID NO: 3123228 - protein, 14 aa, Giardia lamblia
LTPTNTAPSFSADS

SEQ ID NO: 3123229 - protein, 20 aa, Giardia lamblia
LTPYQQEAHPAPAVGPPTLE

SEQ ID NO: 3123230 - protein, 9 aa, Giardia lamblia
LTQEEEDTV

SEQ ID NO: 3123231 - protein, 7 aa, Giardia lamblia
LTQPQAP

SEQ ID NO: 3123232 - protein, 14 aa, Giardia lamblia
LTQQNNQMKNTTDN

SEQ ID NO: 3123233 - protein, 6 aa, Giardia lamblia
LTQRRT

SEQ ID NO: 3123234 - protein, 6 aa, Giardia lamblia
LTQRTM

SEQ ID NO: 3123235 - protein, 4 aa, Giardia lamblia
LTQS

SEQ ID NO: 3123236 - protein, 5 aa, Giardia lamblia
LTQSR

SEQ ID NO: 3123237 - protein, 6 aa, Giardia lamblia
LTRAEK

SEQ ID NO: 3123238 - protein, 9 aa, Giardia lamblia
LTRASEAGY

SEQ ID NO: 3123239 - protein, 17 aa, Giardia lamblia
LTRATAASGGTTAPDVR

SEQ ID NO: 3123240 - protein, 12 aa, Giardia lamblia
LTREEESSCSRP

SEQ ID NO: 3123241 - protein, 7 aa, Giardia lamblia
LTREEPS

SEQ ID NO: 3123242 - protein, 11 aa, Giardia lamblia
LTREKRELEAK

SEQ ID NO: 3123243 - protein, 24 aa, Giardia lamblia
LTRESSSTPETASVSAREAIPTRT

SEQ ID NO: 3123244 - protein, 7 aa, Giardia lamblia
LTRGKSE

SEQ ID NO: 3123245 - protein, 11 aa, Giardia lamblia
LTRKEDENTKL

SEQ ID NO: 3123246 - protein, 6 aa, Giardia lamblia
LTRQDP

SEQ ID NO: 3123247 - protein, 5 aa, Giardia lamblia
LTRSG

SEQ ID NO: 3123248 - protein, 17 aa, Giardia lamblia
LTRSTTSSRISRPSSGY

SEQ ID NO: 3123249 - protein, 4 aa, Giardia lamblia
LTSD

SEQ ID NO: 3123250 - protein, 5 aa, Giardia lamblia
LTSDC

SEQ ID NO: 3123251 - protein, 8 aa, Giardia lamblia
LTSDDTRK

SEQ ID NO: 3123252 - protein, 8 aa, Giardia lamblia
LTSDQQLA

SEQ ID NO: 3123253 - protein, 9 aa, Giardia lamblia
LTSEDTKDC

SEQ ID NO: 3123254 - protein, 12 aa, Giardia lamblia
LTSGSSTSDASY

SEQ ID NO: 3123255 - protein, 34 aa, Giardia lamblia
LTSGTTPHSSPVNRHQPSPNAAALKGSEATEDAE

SEQ ID NO: 3123256 - protein, 6 aa, Giardia lamblia
LTSIAS

SEQ ID NO: 3123257 - protein, 4 aa, Giardia lamblia
LTSK

SEQ ID NO: 3123258 - protein, 10 aa, Giardia lamblia
LTSKESKGTF

SEQ ID NO: 3123259 - protein, 6 aa, Giardia lamblia
LTSLSE

SEQ ID NO: 3123260 - protein, 12 aa, Giardia lamblia
LTSPGERRAPQS

SEQ ID NO: 3123261 - protein, 9 aa, Giardia lamblia
LTSPGTATK

SEQ ID NO: 3123262 - protein, 5 aa, Giardia lamblia
LTSPQ

SEQ ID NO: 3123263 - protein, 8 aa, Giardia lamblia
LTSQLTPE

SEQ ID NO: 3123264 - protein, 5 aa, Giardia lamblia
LTSQQ

SEQ ID NO: 3123265 - protein, 9 aa, Giardia lamblia
LTSQQTSDV

SEQ ID NO: 3123266 - protein, 5 aa, Giardia lamblia
LTSRE

SEQ ID NO: 3123267 - protein, 31 aa, Giardia lamblia
LTSSERSKRIPTVSSEHGTSSILTAPGTILA

SEQ ID NO: 3123268 - protein, 9 aa, Giardia lamblia
LTSSNGGNA

SEQ ID NO: 3123269 - protein, 11 aa, Giardia lamblia
LTSSNKDPGLM

SEQ ID NO: 3123270 - protein, 14 aa, Giardia lamblia
LTSSNLKKKNDTSE

SEQ ID NO: 3123271 - protein, 8 aa, Giardia lamblia
LTSSNPNI

SEQ ID NO: 3123272 - protein, 7 aa, Giardia lamblia
LTSSNTF

SEQ ID NO: 3123273 - protein, 9 aa, Giardia lamblia
LTSSPPRYN

SEQ ID NO: 3123274 - protein, 10 aa, Giardia lamblia
LTSSQPTIRP

SEQ ID NO: 3123275 - protein, 5 aa, Giardia lamblia
LTSSR

SEQ ID NO: 3123276 - protein, 8 aa, Giardia lamblia
LTSSSNRE

SEQ ID NO: 3123277 - protein, 19 aa, Giardia lamblia
LTSSSTQTDRQTSHVPTDI

SEQ ID NO: 3123278 - protein, 7 aa, Giardia lamblia
LTSSTPL

SEQ ID NO: 3123279 - protein, 40 aa, Giardia lamblia
LTSSTSGKHSQLHPGATSVPNTGKHDERRRPGTDIDPRLG

SEQ ID NO: 3123280 - protein, 12 aa, Giardia lamblia
LTSTESQRISDP

SEQ ID NO: 3123281 - protein, 6 aa, Giardia lamblia
LTSTGD

SEQ ID NO: 3123282 - protein, 7 aa, Giardia lamblia
LTSTPEH

SEQ ID NO: 3123283 - protein, 46 aa, Giardia lamblia
LTSTRNFGTETDRPRDRSDDRVAKDVRKRKKADPGATQVTKTSVQL

SEQ ID NO: 3123284 - protein, 9 aa, Giardia lamblia
LTSTSDAEG

SEQ ID NO: 3123285 - protein, 10 aa, Giardia lamblia
LTSTYSNSRI

SEQ ID NO: 3123286 - protein, 4 aa, Giardia lamblia
LTSV

SEQ ID NO: 3123287 - protein, 5 aa, Giardia lamblia
LTTAA

SEQ ID NO: 3123288 - protein, 17 aa, Giardia lamblia
LTTDKSESSQEAAPGTL

SEQ ID NO: 3123289 - protein, 4 aa, Giardia lamblia
LTTG

SEQ ID NO: 3123290 - protein, 11 aa, Giardia lamblia
LTTGATDPLLP

SEQ ID NO: 3123291 - protein, 7 aa, Giardia lamblia
LTTGPDL

SEQ ID NO: 3123292 - protein, 22 aa, Giardia lamblia
LTTGQKPSSATTATDTNKQSLA

SEQ ID NO: 3123293 - protein, 6 aa, Giardia lamblia
LTTHPE

SEQ ID NO: 3123294 - protein, 6 aa, Giardia lamblia
LTTHPP

SEQ ID NO: 3123295 - protein, 5 aa, Giardia lamblia
LTTIT

SEQ ID NO: 3123296 - protein, 18 aa, Giardia lamblia
LTTKADTLAARTDISERE

SEQ ID NO: 3123297 - protein, 9 aa, Giardia lamblia
LTTKDREAG

SEQ ID NO: 3123298 - protein, 9 aa, Giardia lamblia
LTTKNSVAS

SEQ ID NO: 3123299 - protein, 11 aa, Giardia lamblia
LTTMNPDESVS

SEQ ID NO: 3123300 - protein, 9 aa, Giardia lamblia
LTTNEYKTA

SEQ ID NO: 3123301 - protein, 14 aa, Giardia lamblia
LTTPRDQESTHRTK

SEQ ID NO: 3123302 - protein, 4 aa, Giardia lamblia
LTTQ

SEQ ID NO: 3123303 - protein, 7 aa, Giardia lamblia
LTTQNAS

SEQ ID NO: 3123304 - protein, 9 aa, Giardia lamblia
LTTQTGPDV

SEQ ID NO: 3123305 - protein, 10 aa, Giardia lamblia
LTTRPDQKHK

SEQ ID NO: 3123306 - protein, 13 aa, Giardia lamblia
LTTRSNNTRTEHY

SEQ ID NO: 3123307 - protein, 4 aa, Giardia lamblia
LTTS

SEQ ID NO: 3123308 - protein, 10 aa, Giardia lamblia
LTTSAVTAST

SEQ ID NO: 3123309 - protein, 5 aa, Giardia lamblia
LTTSG

SEQ ID NO: 3123310 - protein, 7 aa, Giardia lamblia
LTTSPTL

SEQ ID NO: 3123311 - protein, 7 aa, Giardia lamblia
LTTSSKK

SEQ ID NO: 3123312 - protein, 33 aa, Giardia lamblia
LTTSTQGRKSEVSPRPRFTSSSNVSRSQRTKDT

SEQ ID NO: 3123313 - protein, 16 aa, Giardia lamblia
LTTTGPSSRAISSYKP

SEQ ID NO: 3123314 - protein, 6 aa, Giardia lamblia
LTTTRS

SEQ ID NO: 3123315 - protein, 12 aa, Giardia lamblia
LTVDDDEKDVED

SEQ ID NO: 3123316 - protein, 7 aa, Giardia lamblia
LTVSSDP

SEQ ID NO: 3123317 - protein, 10 aa, Giardia lamblia
LTYETSEQTL

SEQ ID NO: 3123318 - protein, 39 aa, Giardia lamblia
LVDETPEEHMEAEQSGSHESANQQPTEECAEEPLEEQPE

SEQ ID NO: 3123319 - protein, 8 aa, Giardia lamblia
LVDSSGKT

SEQ ID NO: 3123320 - protein, 35 aa, Giardia lamblia
LVETTGDEEPANIDPSTLSQTEPRSLNYPKSSSKP

SEQ ID NO: 3123321 - protein, 20 aa, Giardia lamblia
LVNSSSHDPSISRNQSVNGT

SEQ ID NO: 3123322 - protein, 5 aa, Giardia lamblia
LVPPE

SEQ ID NO: 3123323 - protein, 5 aa, Giardia lamblia
LVPQE

SEQ ID NO: 3123324 - protein, 12 aa, Giardia lamblia
LVQSPKGVTASS

SEQ ID NO: 3123325 - protein, 15 aa, Giardia lamblia
LVQSSSSMTRSQTGI

SEQ ID NO: 3123326 - protein, 7 aa, Giardia lamblia
LVRPDGK

SEQ ID NO: 3123327 - protein, 10 aa, Giardia lamblia
LVRSTSRNKW

SEQ ID NO: 3123328 - protein, 9 aa, Giardia lamblia
LVSPTTGSM

SEQ ID NO: 3123329 - protein, 13 aa, Giardia lamblia
LVSRTRSDRGRNY

SEQ ID NO: 3123330 - protein, 12 aa, Giardia lamblia
LVSTPSGSTAYA

SEQ ID NO: 3123331 - protein, 4 aa, Giardia lamblia
LVTQ

SEQ ID NO: 3123332 - protein, 8 aa, Giardia lamblia
LYDGSPDS

SEQ ID NO: 3123333 - protein, 13 aa, Giardia lamblia
LYDPADPAEPPKI

SEQ ID NO: 3123334 - protein, 9 aa, Giardia lamblia
LYDSEDKWT

SEQ ID NO: 3123335 - protein, 4 aa, Giardia lamblia
LYGN

SEQ ID NO: 3123336 - protein, 31 aa, Giardia lamblia
LYKKGKDSLLAQGKRRYDRKQRGFGGQTKPI

SEQ ID NO: 3123337 - protein, 11 aa, Giardia lamblia
LYNGESVGEFK

SEQ ID NO: 3123338 - protein, 4 aa, Giardia lamblia
LYPD

SEQ ID NO: 3123339 - protein, 4 aa, Giardia lamblia
LYPG

SEQ ID NO: 3123340 - protein, 12 aa, Giardia lamblia
LYPGQAEGITSS

SEQ ID NO: 3123341 - protein, 5 aa, Giardia lamblia
LYPKG

SEQ ID NO: 3123342 - protein, 6 aa, Giardia lamblia
LYPPPD

SEQ ID NO: 3123343 - protein, 11 aa, Giardia lamblia
LYSPGAKRANL

SEQ ID NO: 3123344 - protein, 11 aa, Giardia lamblia
LYSSQSSSSSV

SEQ ID NO: 3123345 - protein, 5 aa, Giardia lamblia
MADGS

SEQ ID NO: 3123346 - protein, 11 aa, Giardia lamblia
MADTPKKPVPL

SEQ ID NO: 3123347 - protein, 12 aa, Giardia lamblia
MAEDSRAKGSSY

SEQ ID NO: 3123348 - protein, 13 aa, Giardia lamblia
MAEENEASTYNPH

SEQ ID NO: 3123349 - protein, 6 aa, Giardia lamblia
MAEQAS

SEQ ID NO: 3123350 - protein, 18 aa, Giardia lamblia
MAEQSKKSDPTKLPGGEN

SEQ ID NO: 3123351 - protein, 6 aa, Giardia lamblia
MAERAS

SEQ ID NO: 3123352 - protein, 9 aa, Giardia lamblia
MAGSTSEVS

SEQ ID NO: 3123353 - protein, 8 aa, Giardia lamblia
MAGTSGQD

SEQ ID NO: 3123354 - protein, 9 aa, Giardia lamblia
MAKDREIDE

SEQ ID NO: 3123355 - protein, 15 aa, Giardia lamblia
MAKDSLQTSRSFGPE

SEQ ID NO: 3123356 - protein, 11 aa, Giardia lamblia
MANSTEAEVDR

SEQ ID NO: 3123357 - protein, 28 aa, Giardia lamblia
MAPASIRQASAAGEPPEEAAKEPNPASI

SEQ ID NO: 3123358 - protein, 17 aa, Giardia lamblia
MAPENRDRYQEDSGSFA

SEQ ID NO: 3123359 - protein, 9 aa, Giardia lamblia
MAPKSGLHS

SEQ ID NO: 3123360 - protein, 19 aa, Giardia lamblia
MAPPPIKRSASENPSDDAL

SEQ ID NO: 3123361 - protein, 9 aa, Giardia lamblia
MAPQPLNSS

SEQ ID NO: 3123362 - protein, 18 aa, Giardia lamblia
MAPSSTRSAFASDTASVS

SEQ ID NO: 3123363 - protein, 10 aa, Giardia lamblia
MASQNNTVAS

SEQ ID NO: 3123364 - protein, 8 aa, Giardia lamblia
MASQQQKE

SEQ ID NO: 3123365 - protein, 4 aa, Giardia lamblia
MATD

SEQ ID NO: 3123366 - protein, 7 aa, Giardia lamblia
MATDTTY

SEQ ID NO: 3123367 - protein, 4 aa, Giardia lamblia
MATG

SEQ ID NO: 3123368 - protein, 30 aa, Giardia lamblia
MCGSRSVSKSGSRLTSRTGSRAISRTTSEI

SEQ ID NO: 3123369 - protein, 17 aa, Giardia lamblia
MCSKESELQATPYVPST

SEQ ID NO: 3123370 - protein, 10 aa, Giardia lamblia
MDAEPSRIST

SEQ ID NO: 3123371 - protein, 7 aa, Giardia lamblia
MDAERAR

SEQ ID NO: 3123372 - protein, 19 aa, Giardia lamblia
MDDDEEAVPLENKTSAYSK

SEQ ID NO: 3123373 - protein, 4 aa, Giardia lamblia
MDDE

SEQ ID NO: 3123374 - protein, 4 aa, Giardia lamblia
MDDG

SEQ ID NO: 3123375 - protein, 12 aa, Giardia lamblia
MDDNEEGENQPR

SEQ ID NO: 3123376 - protein, 4 aa, Giardia lamblia
MDDP

SEQ ID NO: 3123377 - protein, 17 aa, Giardia lamblia
MDDTSSAFSSGTSMANL

SEQ ID NO: 3123378 - protein, 8 aa, Giardia lamblia
MDENPHTQ

SEQ ID NO: 3123379 - protein, 4 aa, Giardia lamblia
MDEQ

SEQ ID NO: 3123380 - protein, 15 aa, Giardia lamblia
MDEQHPSSQSTPYSI

SEQ ID NO: 3123381 - protein, 5 aa, Giardia lamblia
MDESS

SEQ ID NO: 3123382 - protein, 8 aa, Giardia lamblia
MDETTTAL

SEQ ID NO: 3123383 - protein, 5 aa, Giardia lamblia
MDGNS

SEQ ID NO: 3123384 - protein, 6 aa, Giardia lamblia
MDGNVS

SEQ ID NO: 3123385 - protein, 7 aa, Giardia lamblia
MDGRGAD

SEQ ID NO: 3123386 - protein, 15 aa, Giardia lamblia
MDHTDGSSDNGVFTS

SEQ ID NO: 3123387 - protein, 15 aa, Giardia lamblia
MDKKEAEAKKAGVPF

SEQ ID NO: 3123388 - protein, 8 aa, Giardia lamblia
MDNKKTEL

SEQ ID NO: 3123389 - protein, 11 aa, Giardia lamblia
MDPASEAPPPW

SEQ ID NO: 3123390 - protein, 9 aa, Giardia lamblia
MDPEDEEYK

SEQ ID NO: 3123391 - protein, 5 aa, Giardia lamblia
MDPES

SEQ ID NO: 3123392 - protein, 7 aa, Giardia lamblia
MDPPANT

SEQ ID NO: 3123393 - protein, 26 aa, Giardia lamblia
MDPPPRFTKRTRESGNAISRFFHNIF

SEQ ID NO: 3123394 - protein, 11 aa, Giardia lamblia
MDPRANNPNLR

SEQ ID NO: 3123395 - protein, 5 aa, Giardia lamblia
MDQDG

SEQ ID NO: 3123396 - protein, 10 aa, Giardia lamblia
MDRDRSTAPV

SEQ ID NO: 3123397 - protein, 4 aa, Giardia lamblia
MDRK

SEQ ID NO: 3123398 - protein, 11 aa, Giardia lamblia
MDRRSSAHNYN

SEQ ID NO: 3123399 - protein, 9 aa, Giardia lamblia
MDSGGEAYT

SEQ ID NO: 3123400 - protein, 24 aa, Giardia lamblia
MDSGSFTDSLTREHTSVSASALKS

SEQ ID NO: 3123401 - protein, 6 aa, Giardia lamblia
MDSHQR

SEQ ID NO: 3123402 - protein, 14 aa, Giardia lamblia
MDSKPTDTKTEDIS

SEQ ID NO: 3123403 - protein, 9 aa, Giardia lamblia
MDSSDDEWN

SEQ ID NO: 3123404 - protein, 7 aa, Giardia lamblia
MDSSITT

SEQ ID NO: 3123405 - protein, 12 aa, Giardia lamblia
MDSSSKGVPATT

SEQ ID NO: 3123406 - protein, 11 aa, Giardia lamblia
MDTPDSGRPYY

SEQ ID NO: 3123407 - protein, 26 aa, Giardia lamblia
MDTQQESQIQQPTSATTHLTTSQQEE

SEQ ID NO: 3123408 - protein, 12 aa, Giardia lamblia
MDYSTQEARNTL

SEQ ID NO: 3123409 - protein, 15 aa, Giardia lamblia
MEAKENKTQRAKKLK

SEQ ID NO: 3123410 - protein, 8 aa, Giardia lamblia
MEAQPHER

SEQ ID NO: 3123411 - protein, 4 aa, Giardia lamblia
MEDA

SEQ ID NO: 3123412 - protein, 12 aa, Giardia lamblia
MEDPEVPEEIRS

SEQ ID NO: 3123413 - protein, 14 aa, Giardia lamblia
MEDPSNDKKESNKA

SEQ ID NO: 3123414 - protein, 11 aa, Giardia lamblia
MEDRSGRTPLD

SEQ ID NO: 3123415 - protein, 6 aa, Giardia lamblia
MEEADS

SEQ ID NO: 3123416 - protein, 9 aa, Giardia lamblia
MEEESPREV

SEQ ID NO: 3123417 - protein, 11 aa, Giardia lamblia
MEEQARRDGVS

SEQ ID NO: 3123418 - protein, 11 aa, Giardia lamblia
MEESGPRTPSE

SEQ ID NO: 3123419 - protein, 29 aa, Giardia lamblia
MEGSHGKTSNLSPKTLDARAQSLQARTGY

SEQ ID NO: 3123420 - protein, 18 aa, Giardia lamblia
MEGYGGELSASDLAKPFN

SEQ ID NO: 3123421 - protein, 14 aa, Giardia lamblia
MEKGESAAENEKLK

SEQ ID NO: 3123422 - protein, 7 aa, Giardia lamblia
MEKPDSG

SEQ ID NO: 3123423 - protein, 13 aa, Giardia lamblia
MEKRRKGVYGPVA

SEQ ID NO: 3123424 - protein, 5 aa, Giardia lamblia
MEKRT

SEQ ID NO: 3123425 - protein, 8 aa, Giardia lamblia
MENDAAEA

SEQ ID NO: 3123426 - protein, 32 aa, Giardia lamblia
MENDTDQAADSARNTVTPSKDIPISEHTTGVA

SEQ ID NO: 3123427 - protein, 11 aa, Giardia lamblia
MENEPEPGTTS

SEQ ID NO: 3123428 - protein, 10 aa, Giardia lamblia
MENGASTGHA

SEQ ID NO: 3123429 - protein, 7 aa, Giardia lamblia
MENPGLQ

SEQ ID NO: 3123430 - protein, 15 aa, Giardia lamblia
MEPEPNPSHGATNPS

SEQ ID NO: 3123431 - protein, 13 aa, Giardia lamblia
MEPGPDERKKPSW

SEQ ID NO: 3123432 - protein, 12 aa, Giardia lamblia
MEPKEQKRLQEG

SEQ ID NO: 3123433 - protein, 7 aa, Giardia lamblia
MEPNNRP

SEQ ID NO: 3123434 - protein, 4 aa, Giardia lamblia
MEQH

SEQ ID NO: 3123435 - protein, 6 aa, Giardia lamblia
MEQQAP

SEQ ID NO: 3123436 - protein, 13 aa, Giardia lamblia
MERAQGSAGSSTP

SEQ ID NO: 3123437 - protein, 21 aa, Giardia lamblia
MERDKEKKTAKQQADDAKKLA

SEQ ID NO: 3123438 - protein, 7 aa, Giardia lamblia
MERGDDE

SEQ ID NO: 3123439 - protein, 4 aa, Giardia lamblia
MERP

SEQ ID NO: 3123440 - protein, 9 aa, Giardia lamblia
MESGKASIN

SEQ ID NO: 3123441 - protein, 8 aa, Giardia lamblia
MESKARDD

SEQ ID NO: 3123442 - protein, 13 aa, Giardia lamblia
MESKSRAERQRMN

SEQ ID NO: 3123443 - protein, 41 aa, Giardia lamblia
MESNDDSKSTDAVSSAASNLLSSSSKGERKRARSRSGLSIP

SEQ ID NO: 3123444 - protein, 9 aa, Giardia lamblia
MESPSPLGL

SEQ ID NO: 3123445 - protein, 15 aa, Giardia lamblia
MESSKGSSRFKTRVL

SEQ ID NO: 3123446 - protein, 49 aa, Giardia lamblia
MESSQISRKSVSNKPISTTASAVESTRASQALEEGSKTVTGQASSGDYE

SEQ ID NO: 3123447 - protein, 6 aa, Giardia lamblia
MESTAT

SEQ ID NO: 3123448 - protein, 6 aa, Giardia lamblia
MESTEA

SEQ ID NO: 3123449 - protein, 5 aa, Giardia lamblia
METQD

SEQ ID NO: 3123450 - protein, 8 aa, Giardia lamblia
METQSATM

SEQ ID NO: 3123451 - protein, 21 aa, Giardia lamblia
METTESDAANQRYSKLQGEQE

SEQ ID NO: 3123452 - protein, 5 aa, Giardia lamblia
METTG

SEQ ID NO: 3123453 - protein, 7 aa, Giardia lamblia
MGADPQE

SEQ ID NO: 3123454 - protein, 13 aa, Giardia lamblia
MGDHRSYTRSVEE

SEQ ID NO: 3123455 - protein, 6 aa, Giardia lamblia
MGDPEY

SEQ ID NO: 3123456 - protein, 8 aa, Giardia lamblia
MGDTRAYE

SEQ ID NO: 3123457 - protein, 5 aa, Giardia lamblia
MGELS

SEQ ID NO: 3123458 - protein, 44 aa, Giardia lamblia
MGEPSQSAADLKPQKGGRASRAGSKQSSVRRTPKLETASFSNST

SEQ ID NO: 3123459 - protein, 4 aa, Giardia lamblia
MGES

SEQ ID NO: 3123460 - protein, 14 aa, Giardia lamblia
MGGPSADGLASTSD

SEQ ID NO: 3123461 - protein, 9 aa, Giardia lamblia
MGHGSNCQV

SEQ ID NO: 3123462 - protein, 15 aa, Giardia lamblia
MGKDGRPTAGRERKT

SEQ ID NO: 3123463 - protein, 25 aa, Giardia lamblia
MGKHSERSAMSTMKNDSDGAKDSDL

SEQ ID NO: 3123464 - protein, 10 aa, Giardia lamblia
MGKTTADGTT

SEQ ID NO: 3123465 - protein, 6 aa, Giardia lamblia
MGNKNA

SEQ ID NO: 3123466 - protein, 4 aa, Giardia lamblia
MGNR

SEQ ID NO: 3123467 - protein, 4 aa, Giardia lamblia
MGNS

SEQ ID NO: 3123468 - protein, 12 aa, Giardia lamblia
MGPAEKDTNDRF

SEQ ID NO: 3123469 - protein, 7 aa, Giardia lamblia
MGPQDSV

SEQ ID NO: 3123470 - protein, 21 aa, Giardia lamblia
MGPTKAGLSGIATASNLTTQD

SEQ ID NO: 3123471 - protein, 6 aa, Giardia lamblia
MGPWDG

SEQ ID NO: 3123472 - protein, 22 aa, Giardia lamblia
MGQAGQGAYNRTSSDPTVRSGS

SEQ ID NO: 3123473 - protein, 9 aa, Giardia lamblia
MGQQDDEGF

SEQ ID NO: 3123474 - protein, 10 aa, Giardia lamblia
MGRPTENTQQ

SEQ ID NO: 3123475 - protein, 5 aa, Giardia lamblia
MGSDY

SEQ ID NO: 3123476 - protein, 14 aa, Giardia lamblia
MGTNQGLESASTAA

SEQ ID NO: 3123477 - protein, 7 aa, Giardia lamblia
MGTPESD

SEQ ID NO: 3123478 - protein, 24 aa, Giardia lamblia
MGTSSDKAKKAPQAKDEPHEETTN

SEQ ID NO: 3123479 - protein, 21 aa, Giardia lamblia
MGTSTQQRNISPTASRSSYVD

SEQ ID NO: 3123480 - protein, 10 aa, Giardia lamblia
MGVQENDGGT

SEQ ID NO: 3123481 - protein, 9 aa, Giardia lamblia
MHGENKDKL

SEQ ID NO: 3123482 - protein, 5 aa, Giardia lamblia
MHPDR

SEQ ID NO: 3123483 - protein, 14 aa, Giardia lamblia
MHPGSKASTRTKDQ

SEQ ID NO: 3123484 - protein, 7 aa, Giardia lamblia
MHPNNSP

SEQ ID NO: 3123485 - protein, 51 aa, Giardia lamblia
MHQTDGGAKRASSTGPNSRGNTTVAGMSTNASINPNANRGSAGGLSNDNKQ

SEQ ID NO: 3123486 - protein, 10 aa, Giardia lamblia
MHRRESKTKK

SEQ ID NO: 3123487 - protein, 4 aa, Giardia lamblia
MHTE

SEQ ID NO: 3123488 - protein, 13 aa, Giardia lamblia
MHTPKRSTVPKPS

SEQ ID NO: 3123489 - protein, 6 aa, Giardia lamblia
MISGTA

SEQ ID NO: 3123490 - protein, 7 aa, Giardia lamblia
MKAGKRH

SEQ ID NO: 3123491 - protein, 11 aa, Giardia lamblia
MKAKRKRLESL

SEQ ID NO: 3123492 - protein, 13 aa, Giardia lamblia
MKAQGAHPKRVGV

SEQ ID NO: 3123493 - protein, 8 aa, Giardia lamblia
MKATSTDS

SEQ ID NO: 3123494 - protein, 7 aa, Giardia lamblia
MKDDNGW

SEQ ID NO: 3123495 - protein, 5 aa, Giardia lamblia
MKDDR

SEQ ID NO: 3123496 - protein, 7 aa, Giardia lamblia
MKDKNGI

SEQ ID NO: 3123497 - protein, 9 aa, Giardia lamblia
MKDNANLDV

SEQ ID NO: 3123498 - protein, 5 aa, Giardia lamblia
MKDPA

SEQ ID NO: 3123499 - protein, 8 aa, Giardia lamblia
MKDRGGDT

SEQ ID NO: 3123500 - protein, 8 aa, Giardia lamblia
MKDRNGET

SEQ ID NO: 3123501 - protein, 15 aa, Giardia lamblia
MKDSGISEEAAPRAL

SEQ ID NO: 3123502 - protein, 8 aa, Giardia lamblia
MKDSNGKT

SEQ ID NO: 3123503 - protein, 14 aa, Giardia lamblia
MKDYAAQRSAEHAE

SEQ ID NO: 3123504 - protein, 7 aa, Giardia lamblia
MKEASAD

SEQ ID NO: 3123505 - protein, 16 aa, Giardia lamblia
MKEPKAPTRELPTPTL

SEQ ID NO: 3123506 - protein, 7 aa, Giardia lamblia
MKERSEK

SEQ ID NO: 3123507 - protein, 20 aa, Giardia lamblia
MKGETKNGVSTNSASEGRDE

SEQ ID NO: 3123508 - protein, 9 aa, Giardia lamblia
MKGPGSAGR

SEQ ID NO: 3123509 - protein, 6 aa, Giardia lamblia
MKGRDG

SEQ ID NO: 3123510 - protein, 9 aa, Giardia lamblia
MKGSKYARA

SEQ ID NO: 3123511 - protein, 31 aa, Giardia lamblia
MKGSSSEIASPGAGTRRGRRRAPARSQVGPP

SEQ ID NO: 3123512 - protein, 9 aa, Giardia lamblia
MKGTRAYQP

SEQ ID NO: 3123513 - protein, 7 aa, Giardia lamblia
MKKSSGW

SEQ ID NO: 3123514 - protein, 7 aa, Giardia lamblia
MKNGETA

SEQ ID NO: 3123515 - protein, 7 aa, Giardia lamblia
MKNKNGV

SEQ ID NO: 3123516 - protein, 17 aa, Giardia lamblia
MKNTKPPRIEDVRDKKK

SEQ ID NO: 3123517 - protein, 7 aa, Giardia lamblia
MKNTTAT

SEQ ID NO: 3123518 - protein, 8 aa, Giardia lamblia
MKPGSQVD

SEQ ID NO: 3123519 - protein, 49 aa, Giardia lamblia
MKPLGEQKSLADYERGSSVPKNLPRWPSKKVTKGISPIAPTDPSTSTTS

SEQ ID NO: 3123520 - protein, 8 aa, Giardia lamblia
MKPNPKTD

SEQ ID NO: 3123521 - protein, 15 aa, Giardia lamblia
MKPREPQPNKYDEEQ

SEQ ID NO: 3123522 - protein, 56 aa, Giardia lamblia
MKQNQLRKEEKKRKIEAGEEVSEDEPTEEEEEFDETGRRKRTTPKPKPFKDAPKVP

SEQ ID NO: 3123523 - protein, 15 aa, Giardia lamblia
MKRYSQTGQPGSSRQ

SEQ ID NO: 3123524 - protein, 45 aa, Giardia lamblia
MKSAERRERRSESFDGSSQHLKKSRKPRTASHSREKKDVSTNANS

SEQ ID NO: 3123525 - protein, 6 aa, Giardia lamblia
MKSEDE

SEQ ID NO: 3123526 - protein, 11 aa, Giardia lamblia
MKSEGAEEGRL

SEQ ID NO: 3123527 - protein, 5 aa, Giardia lamblia
MKSHA

SEQ ID NO: 3123528 - protein, 12 aa, Giardia lamblia
MKSPDSKQPRLV

SEQ ID NO: 3123529 - protein, 9 aa, Giardia lamblia
MKSQTGRTA

SEQ ID NO: 3123530 - protein, 4 aa, Giardia lamblia
MKTG

SEQ ID NO: 3123531 - protein, 8 aa, Giardia lamblia
MKTRNGST

SEQ ID NO: 3123532 - protein, 12 aa, Giardia lamblia
MKTSSAKNLPLP

SEQ ID NO: 3123533 - protein, 5 aa, Giardia lamblia
MKTST

SEQ ID NO: 3123534 - protein, 8 aa, Giardia lamblia
MLPGDERP

SEQ ID NO: 3123535 - protein, 4 aa, Giardia lamblia
MLPT

SEQ ID NO: 3123536 - protein, 4 aa, Giardia lamblia
MNDA

SEQ ID NO: 3123537 - protein, 4 aa, Giardia lamblia
MNDP

SEQ ID NO: 3123538 - protein, 5 aa, Giardia lamblia
MNEPT

SEQ ID NO: 3123539 - protein, 9 aa, Giardia lamblia
MNERSSRSH

SEQ ID NO: 3123540 - protein, 17 aa, Giardia lamblia
MNESSADDDAKDESSSL

SEQ ID NO: 3123541 - protein, 5 aa, Giardia lamblia
MNETD

SEQ ID NO: 3123542 - protein, 12 aa, Giardia lamblia
MNETENPASLKD

SEQ ID NO: 3123543 - protein, 32 aa, Giardia lamblia
MNGESDRDPQDQARGDSVPQDKVSSEKGGQLT

SEQ ID NO: 3123544 - protein, 7 aa, Giardia lamblia
MNGSTSH

SEQ ID NO: 3123545 - protein, 8 aa, Giardia lamblia
MNITNDGA

SEQ ID NO: 3123546 - protein, 12 aa, Giardia lamblia
MNKGHDGSGADS

SEQ ID NO: 3123547 - protein, 5 aa, Giardia lamblia
MNKNK

SEQ ID NO: 3123548 - protein, 4 aa, Giardia lamblia
MNNQ

SEQ ID NO: 3123549 - protein, 8 aa, Giardia lamblia
MNNSSAAT

SEQ ID NO: 3123550 - protein, 12 aa, Giardia lamblia
MNPDINLDDSFT

SEQ ID NO: 3123551 - protein, 26 aa, Giardia lamblia
MNPPASVSVEPTLQDEEDLGEDATEF

SEQ ID NO: 3123552 - protein, 4 aa, Giardia lamblia
MNPT

SEQ ID NO: 3123553 - protein, 9 aa, Giardia lamblia
MNPTETRGT

SEQ ID NO: 3123554 - protein, 8 aa, Giardia lamblia
MNQASSRS

SEQ ID NO: 3123555 - protein, 5 aa, Giardia lamblia
MNQPQ

SEQ ID NO: 3123556 - protein, 9 aa, Giardia lamblia
MNQQSDPTI

SEQ ID NO: 3123557 - protein, 19 aa, Giardia lamblia
MNQRSTSSKRAKTPSEPRT

SEQ ID NO: 3123558 - protein, 5 aa, Giardia lamblia
MNRGT

SEQ ID NO: 3123559 - protein, 6 aa, Giardia lamblia
MNRSSN

SEQ ID NO: 3123560 - protein, 5 aa, Giardia lamblia
MNSDS

SEQ ID NO: 3123561 - protein, 11 aa, Giardia lamblia
MNSEGAAAGAL

SEQ ID NO: 3123562 - protein, 19 aa, Giardia lamblia
MNSGAEVKEAAKREKEAEL

SEQ ID NO: 3123563 - protein, 11 aa, Giardia lamblia
MNSGETSGPNV

SEQ ID NO: 3123564 - protein, 8 aa, Giardia lamblia
MNSRYPKD

SEQ ID NO: 3123565 - protein, 6 aa, Giardia lamblia
MNSTSG

SEQ ID NO: 3123566 - protein, 18 aa, Giardia lamblia
MNTSTSNSALSTRSPVSA

SEQ ID NO: 3123567 - protein, 7 aa, Giardia lamblia
MPAGRSI

SEQ ID NO: 3123568 - protein, 17 aa, Giardia lamblia
MPAPQATMAPGLNDLLS

SEQ ID NO: 3123569 - protein, 12 aa, Giardia lamblia
MPAQEKKEDTYR

SEQ ID NO: 3123570 - protein, 5 aa, Giardia lamblia
MPDEM

SEQ ID NO: 3123571 - protein, 12 aa, Giardia lamblia
MPDERAAQRSHS

SEQ ID NO: 3123572 - protein, 10 aa, Giardia lamblia
MPDIDKGEQH

SEQ ID NO: 3123573 - protein, 13 aa, Giardia lamblia
MPDTDFSSDDVNE

SEQ ID NO: 3123574 - protein, 4 aa, Giardia lamblia
MPDY

SEQ ID NO: 3123575 - protein, 7 aa, Giardia lamblia
MPEAPEK

SEQ ID NO: 3123576 - protein, 7 aa, Giardia lamblia
MPEASPD

SEQ ID NO: 3123577 - protein, 15 aa, Giardia lamblia
MPEENNGHQDYNQNQ

SEQ ID NO: 3123578 - protein, 35 aa, Giardia lamblia
MPEGADFGDEEDDDNKDEEDGPDEEKKESGEEKAE

SEQ ID NO: 3123579 - protein, 5 aa, Giardia lamblia
MPENQ

SEQ ID NO: 3123580 - protein, 16 aa, Giardia lamblia
MPENVDDEESNGRRCE

SEQ ID NO: 3123581 - protein, 10 aa, Giardia lamblia
MPESPEDTKR

SEQ ID NO: 3123582 - protein, 5 aa, Giardia lamblia
MPGGQ

SEQ ID NO: 3123583 - protein, 11 aa, Giardia lamblia
MPGGQQDTVTD

SEQ ID NO: 3123584 - protein, 19 aa, Giardia lamblia
MPGHNAPPASHSDVLGCED

SEQ ID NO: 3123585 - protein, 5 aa, Giardia lamblia
MPKAE

SEQ ID NO: 3123586 - protein, 6 aa, Giardia lamblia
MPKEQT

SEQ ID NO: 3123587 - protein, 32 aa, Giardia lamblia
MPKTSGKEKPAKVPKATPRSSAQPSDGHGEYS

SEQ ID NO: 3123588 - protein, 5 aa, Giardia lamblia
MPNGP

SEQ ID NO: 3123589 - protein, 8 aa, Giardia lamblia
MPNMPSPV

SEQ ID NO: 3123590 - protein, 5 aa, Giardia lamblia
MPNPD

SEQ ID NO: 3123591 - protein, 5 aa, Giardia lamblia
MPPEA

SEQ ID NO: 3123592 - protein, 35 aa, Giardia lamblia
MPPHRAGSNLGGREKDDPQPESSKTSSITPAPNVQ

SEQ ID NO: 3123593 - protein, 21 aa, Giardia lamblia
MPPKPQSSGQASTNQANPIGL

SEQ ID NO: 3123594 - protein, 5 aa, Giardia lamblia
MPPLQ

SEQ ID NO: 3123595 - protein, 7 aa, Giardia lamblia
MPPPSQQ

SEQ ID NO: 3123596 - protein, 4 aa, Giardia lamblia
MPPR

SEQ ID NO: 3123597 - protein, 14 aa, Giardia lamblia
MPPRGAVRDASTPF

SEQ ID NO: 3123598 - protein, 5 aa, Giardia lamblia
MPPSF

SEQ ID NO: 3123599 - protein, 6 aa, Giardia lamblia
MPPTRT

SEQ ID NO: 3123600 - protein, 5 aa, Giardia lamblia
MPQQD

SEQ ID NO: 3123601 - protein, 24 aa, Giardia lamblia
MPRKASVEDLSSDSPEDSRECTSR

SEQ ID NO: 3123602 - protein, 10 aa, Giardia lamblia
MPRKDGLTSE

SEQ ID NO: 3123603 - protein, 4 aa, Giardia lamblia
MPRP

SEQ ID NO: 3123604 - protein, 8 aa, Giardia lamblia
MPRPAGAI

SEQ ID NO: 3123605 - protein, 18 aa, Giardia lamblia
MPRSGPPPISDSQQHPIS

SEQ ID NO: 3123606 - protein, 19 aa, Giardia lamblia
MPRSPTTARPSAEPADDTT

SEQ ID NO: 3123607 - protein, 31 aa, Giardia lamblia
MPSAGSKLKQYSARSSQLDSNLTPRYQNTGR

SEQ ID NO: 3123608 - protein, 5 aa, Giardia lamblia
MPSNT

SEQ ID NO: 3123609 - protein, 12 aa, Giardia lamblia
MPSPIRKRGTLG

SEQ ID NO: 3123610 - protein, 8 aa, Giardia lamblia
MPSPTNSH

SEQ ID NO: 3123611 - protein, 4 aa, Giardia lamblia
MPSQ

SEQ ID NO: 3123612 - protein, 12 aa, Giardia lamblia
MPSRRAKAQRWP

SEQ ID NO: 3123613 - protein, 27 aa, Giardia lamblia
MPSSGGGDAFNGNGGDAGNMDSDGGMP

SEQ ID NO: 3123614 - protein, 5 aa, Giardia lamblia
MPTDL

SEQ ID NO: 3123615 - protein, 15 aa, Giardia lamblia
MPTDSSFSESAPAIS

SEQ ID NO: 3123616 - protein, 12 aa, Giardia lamblia
MPTELSAENPGL

SEQ ID NO: 3123617 - protein, 14 aa, Giardia lamblia
MPTRASPISQTNSA

SEQ ID NO: 3123618 - protein, 5 aa, Giardia lamblia
MPTST

SEQ ID NO: 3123619 - protein, 6 aa, Giardia lamblia
MPTTGT

SEQ ID NO: 3123620 - protein, 13 aa, Giardia lamblia
MPTTSKRPADHPV

SEQ ID NO: 3123621 - protein, 8 aa, Giardia lamblia
MPVAPSQV

SEQ ID NO: 3123622 - protein, 33 aa, Giardia lamblia
MPVGPGPQQYQQFGNQQGSQMPPPIQPQGQLGA

SEQ ID NO: 3123623 - protein, 7 aa, Giardia lamblia
MQANEDS

SEQ ID NO: 3123624 - protein, 10 aa, Giardia lamblia
MQARKTTQEK

SEQ ID NO: 3123625 - protein, 8 aa, Giardia lamblia
MQDDEGRT

SEQ ID NO: 3123626 - protein, 7 aa, Giardia lamblia
MQDGNGV

SEQ ID NO: 3123627 - protein, 7 aa, Giardia lamblia
MQDISGN

SEQ ID NO: 3123628 - protein, 6 aa, Giardia lamblia
MQDKAG

SEQ ID NO: 3123629 - protein, 5 aa, Giardia lamblia
MQDND

SEQ ID NO: 3123630 - protein, 7 aa, Giardia lamblia
MQDNYGN

SEQ ID NO: 3123631 - protein, 10 aa, Giardia lamblia
MQDPQSAKQI

SEQ ID NO: 3123632 - protein, 4 aa, Giardia lamblia
MQEV

SEQ ID NO: 3123633 - protein, 14 aa, Giardia lamblia
MQGAVSSEKVPDGC

SEQ ID NO: 3123634 - protein, 9 aa, Giardia lamblia
MQGQERDDL

SEQ ID NO: 3123635 - protein, 10 aa, Giardia lamblia
MQGSTAPKPI

SEQ ID NO: 3123636 - protein, 4 aa, Giardia lamblia
MQGV

SEQ ID NO: 3123637 - protein, 8 aa, Giardia lamblia
MQKATGET

SEQ ID NO: 3123638 - protein, 8 aa, Giardia lamblia
MQKGTGRW

SEQ ID NO: 3123639 - protein, 7 aa, Giardia lamblia
MQKPNGV

SEQ ID NO: 3123640 - protein, 8 aa, Giardia lamblia
MQKTDGTT

SEQ ID NO: 3123641 - protein, 7 aa, Giardia lamblia
MQNTDGY

SEQ ID NO: 3123642 - protein, 6 aa, Giardia lamblia
MQNTGG

SEQ ID NO: 3123643 - protein, 6 aa, Giardia lamblia
MQPAGP

SEQ ID NO: 3123644 - protein, 9 aa, Giardia lamblia
MQPNDPPPW

SEQ ID NO: 3123645 - protein, 10 aa, Giardia lamblia
MQPPAPASDI

SEQ ID NO: 3123646 - protein, 15 aa, Giardia lamblia
MQPQDKAERDTLERE

SEQ ID NO: 3123647 - protein, 23 aa, Giardia lamblia
MQPQPQAQQRQSSRRYSEGTRQD

SEQ ID NO: 3123648 - protein, 7 aa, Giardia lamblia
MQPSEQA

SEQ ID NO: 3123649 - protein, 10 aa, Giardia lamblia
MQQADKNTIQ

SEQ ID NO: 3123650 - protein, 6 aa, Giardia lamblia
MQQDTT

SEQ ID NO: 3123651 - protein, 16 aa, Giardia lamblia
MQQESQADAAATAKDM

SEQ ID NO: 3123652 - protein, 5 aa, Giardia lamblia
MQQEV

SEQ ID NO: 3123653 - protein, 9 aa, Giardia lamblia
MQQKDSEAA

SEQ ID NO: 3123654 - protein, 55 aa, Giardia lamblia
MQQTRAKDAAHSDNGETCTQGSSRQRQRPLSASKSKPKGRINSRASSRSASRNSS

SEQ ID NO: 3123655 - protein, 4 aa, Giardia lamblia
MQRA

SEQ ID NO: 3123656 - protein, 9 aa, Giardia lamblia
MQRASDDCS

SEQ ID NO: 3123657 - protein, 8 aa, Giardia lamblia
MQRREGST

SEQ ID NO: 3123658 - protein, 79 aa, Giardia lamblia
MQRTGESQPYMEKNPRSRSEKRASSTPKTPKTSRDSAASPVVEEKTQPTADNTKKASQDTTLRQGKFKKGDDSVNLDSD

SEQ ID NO: 3123659 - protein, 9 aa, Giardia lamblia
MQSDTENSV

SEQ ID NO: 3123660 - protein, 4 aa, Giardia lamblia
MQSE

SEQ ID NO: 3123661 - protein, 10 aa, Giardia lamblia
MQSPTTEDAR

SEQ ID NO: 3123662 - protein, 6 aa, Giardia lamblia
MQSQTL

SEQ ID NO: 3123663 - protein, 8 aa, Giardia lamblia
MQSSNGTT

SEQ ID NO: 3123664 - protein, 9 aa, Giardia lamblia
MQSVEAAAK

SEQ ID NO: 3123665 - protein, 6 aa, Giardia lamblia
MQTESG

SEQ ID NO: 3123666 - protein, 5 aa, Giardia lamblia
MQTGQ

SEQ ID NO: 3123667 - protein, 8 aa, Giardia lamblia
MQTGTGET

SEQ ID NO: 3123668 - protein, 9 aa, Giardia lamblia
MQTKTGSTA

SEQ ID NO: 3123669 - protein, 7 aa, Giardia lamblia
MQTSTQE

SEQ ID NO: 3123670 - protein, 13 aa, Giardia lamblia
MQTTGDGEYEAGE

SEQ ID NO: 3123671 - protein, 19 aa, Giardia lamblia
MQTTSNGCYKSGKNDYPFP

SEQ ID NO: 3123672 - protein, 6 aa, Giardia lamblia
MQVTPQ

SEQ ID NO: 3123673 - protein, 12 aa, Giardia lamblia
MRAPRGSKSRLI

SEQ ID NO: 3123674 - protein, 13 aa, Giardia lamblia
MRDEIDAKITAGL

SEQ ID NO: 3123675 - protein, 9 aa, Giardia lamblia
MRDKDGENA

SEQ ID NO: 3123676 - protein, 8 aa, Giardia lamblia
MRDKYDET

SEQ ID NO: 3123677 - protein, 8 aa, Giardia lamblia
MRDSSGYT

SEQ ID NO: 3123678 - protein, 8 aa, Giardia lamblia
MRDTAGKR

SEQ ID NO: 3123679 - protein, 6 aa, Giardia lamblia
MREEQE

SEQ ID NO: 3123680 - protein, 10 aa, Giardia lamblia
MREGGNEEIK

SEQ ID NO: 3123681 - protein, 8 aa, Giardia lamblia
MRENSGKI

SEQ ID NO: 3123682 - protein, 61 aa, Giardia lamblia
MRGGAHAQTPASAPTPAPPAPSEPASSSAGHKPADDKPVEEPPAEASKPAEPTPKVEEVKP

SEQ ID NO: 3123683 - protein, 7 aa, Giardia lamblia
MRGGYGS

SEQ ID NO: 3123684 - protein, 23 aa, Giardia lamblia
MRNNQGRRPRGKAASKPQKPKFP

SEQ ID NO: 3123685 - protein, 10 aa, Giardia lamblia
MRPASQQLTR

SEQ ID NO: 3123686 - protein, 25 aa, Giardia lamblia
MRPDSVYQAPDSQYVRPGKDTKQDY

SEQ ID NO: 3123687 - protein, 9 aa, Giardia lamblia
MRPKNPTSL

SEQ ID NO: 3123688 - protein, 15 aa, Giardia lamblia
MRPNSANSVGLSTND

SEQ ID NO: 3123689 - protein, 38 aa, Giardia lamblia
MRPPLGNEQVPTDSPAPFSKNPVGPPSQAGQLDKYRQS

SEQ ID NO: 3123690 - protein, 8 aa, Giardia lamblia
MRPQTDDR

SEQ ID NO: 3123691 - protein, 11 aa, Giardia lamblia
MRPSIEASDVT

SEQ ID NO: 3123692 - protein, 7 aa, Giardia lamblia
MRPSPKW

SEQ ID NO: 3123693 - protein, 23 aa, Giardia lamblia
MRPTSGTQSHAQEQVPSKNPYSM

SEQ ID NO: 3123694 - protein, 37 aa, Giardia lamblia
MRQATKGRGKKSTIKRRAANAKQHESAPRAERIHPGT

SEQ ID NO: 3123695 - protein, 14 aa, Giardia lamblia
MRQKEERAKLAEEA

SEQ ID NO: 3123696 - protein, 8 aa, Giardia lamblia
MRQKEQAY

SEQ ID NO: 3123697 - protein, 8 aa, Giardia lamblia
MRRKDGRT

SEQ ID NO: 3123698 - protein, 8 aa, Giardia lamblia
MRRNDHQR

SEQ ID NO: 3123699 - protein, 4 aa, Giardia lamblia
MRRS

SEQ ID NO: 3123700 - protein, 9 aa, Giardia lamblia
MRRTTDNRN

SEQ ID NO: 3123701 - protein, 8 aa, Giardia lamblia
MRSGAGES

SEQ ID NO: 3123702 - protein, 9 aa, Giardia lamblia
MRSKQTPKY

SEQ ID NO: 3123703 - protein, 15 aa, Giardia lamblia
MRSPQRQKNKPYTEA

SEQ ID NO: 3123704 - protein, 11 aa, Giardia lamblia
MRTGASPSLSS

SEQ ID NO: 3123705 - protein, 7 aa, Giardia lamblia
MSAEDKK

SEQ ID NO: 3123706 - protein, 4 aa, Giardia lamblia
MSAG

SEQ ID NO: 3123707 - protein, 32 aa, Giardia lamblia
MSAPSAGSSSNAGEAGSEPSKQFTCPSAASSL

SEQ ID NO: 3123708 - protein, 12 aa, Giardia lamblia
MSASRSSSTQQP

SEQ ID NO: 3123709 - protein, 16 aa, Giardia lamblia
MSATSASNKSTERRAL

SEQ ID NO: 3123710 - protein, 8 aa, Giardia lamblia
MSCSNGRT

SEQ ID NO: 3123711 - protein, 11 aa, Giardia lamblia
MSDDESSASSA

SEQ ID NO: 3123712 - protein, 6 aa, Giardia lamblia
MSDKDE

SEQ ID NO: 3123713 - protein, 24 aa, Giardia lamblia
MSDPRVAKGSTWAREAGGSNYGRS

SEQ ID NO: 3123714 - protein, 9 aa, Giardia lamblia
MSDRNDEIT

SEQ ID NO: 3123715 - protein, 22 aa, Giardia lamblia
MSDTGKLTTDAKDHGPSAQVSL

SEQ ID NO: 3123716 - protein, 5 aa, Giardia lamblia
MSEDQ

SEQ ID NO: 3123717 - protein, 9 aa, Giardia lamblia
MSEEERAEL

SEQ ID NO: 3123718 - protein, 8 aa, Giardia lamblia
MSEEERRE

SEQ ID NO: 3123719 - protein, 4 aa, Giardia lamblia
MSEG

SEQ ID NO: 3123720 - protein, 11 aa, Giardia lamblia
MSESAKASAEG

SEQ ID NO: 3123721 - protein, 19 aa, Giardia lamblia
MSESPVDNQTFNEDTTARD

SEQ ID NO: 3123722 - protein, 6 aa, Giardia lamblia
MSGDDE

SEQ ID NO: 3123723 - protein, 9 aa, Giardia lamblia
MSGDQQSLG

SEQ ID NO: 3123724 - protein, 8 aa, Giardia lamblia
MSGGESNV

SEQ ID NO: 3123725 - protein, 9 aa, Giardia lamblia
MSGGTDDAS

SEQ ID NO: 3123726 - protein, 7 aa, Giardia lamblia
MSGKSTA

SEQ ID NO: 3123727 - protein, 34 aa, Giardia lamblia
MSGLEDSDEAVSPSNLNSTNSKQPKSQTNGRDYR

SEQ ID NO: 3123728 - protein, 6 aa, Giardia lamblia
MSGPTT

SEQ ID NO: 3123729 - protein, 29 aa, Giardia lamblia
MSGSTTSQSKPKKPDGSPSNLIPSSSTSS

SEQ ID NO: 3123730 - protein, 16 aa, Giardia lamblia
MSKATPCNTAHCSSAL

SEQ ID NO: 3123731 - protein, 9 aa, Giardia lamblia
MSKPSNENP

SEQ ID NO: 3123732 - protein, 10 aa, Giardia lamblia
MSKSKKNFKT

SEQ ID NO: 3123733 - protein, 11 aa, Giardia lamblia
MSLQPEKKHTL

SEQ ID NO: 3123734 - protein, 14 aa, Giardia lamblia
MSLTSDKPLSSRSP

SEQ ID NO: 3123735 - protein, 16 aa, Giardia lamblia
MSNESYEGYEDPEEPF

SEQ ID NO: 3123736 - protein, 6 aa, Giardia lamblia
MSNNDG

SEQ ID NO: 3123737 - protein, 22 aa, Giardia lamblia
MSNRSTVHRNSTLADPSQPDLH

SEQ ID NO: 3123738 - protein, 13 aa, Giardia lamblia
MSNRTTTESIPRL

SEQ ID NO: 3123739 - protein, 4 aa, Giardia lamblia
MSPC

SEQ ID NO: 3123740 - protein, 7 aa, Giardia lamblia
MSPKEAD

SEQ ID NO: 3123741 - protein, 6 aa, Giardia lamblia
MSPNAA

SEQ ID NO: 3123742 - protein, 4 aa, Giardia lamblia
MSPP

SEQ ID NO: 3123743 - protein, 16 aa, Giardia lamblia
MSPPRVVPKPPSKKYN

SEQ ID NO: 3123744 - protein, 15 aa, Giardia lamblia
MSPVAGSGSFRNNRP

SEQ ID NO: 3123745 - protein, 9 aa, Giardia lamblia
MSQGDTKEI

SEQ ID NO: 3123746 - protein, 27 aa, Giardia lamblia
MSQPDTSREASSRPYAPTTLNPGINST

SEQ ID NO: 3123747 - protein, 26 aa, Giardia lamblia
MSRDETINAPGEGVSGDGAGADPAEL

SEQ ID NO: 3123748 - protein, 40 aa, Giardia lamblia
MSRKDNKKYSGSHIKTRSKKAEKRDEMRHRGNAKKKPGDK

SEQ ID NO: 3123749 - protein, 6 aa, Giardia lamblia
MSRKEK

SEQ ID NO: 3123750 - protein, 16 aa, Giardia lamblia
MSRPSEDAVPSHPRRK

SEQ ID NO: 3123751 - protein, 8 aa, Giardia lamblia
MSRSGEKK

SEQ ID NO: 3123752 - protein, 18 aa, Giardia lamblia
MSRTTSRYTNTDKQNLSQ

SEQ ID NO: 3123753 - protein, 51 aa, Giardia lamblia
MSSADDSDHCSQEHDDTPPLAPEKDTSEEGAGNPTEPSEMDDEGSVDEDGV

SEQ ID NO: 3123754 - protein, 8 aa, Giardia lamblia
MSSAYASA

SEQ ID NO: 3123755 - protein, 13 aa, Giardia lamblia
MSSEASDLKKDRA

SEQ ID NO: 3123756 - protein, 5 aa, Giardia lamblia
MSSEE

SEQ ID NO: 3123757 - protein, 4 aa, Giardia lamblia
MSSM

SEQ ID NO: 3123758 - protein, 6 aa, Giardia lamblia
MSSNGD

SEQ ID NO: 3123759 - protein, 8 aa, Giardia lamblia
MSSPGKSP

SEQ ID NO: 3123760 - protein, 29 aa, Giardia lamblia
MSSQASQQPGNQRGPPQGALRNRPRKTGA

SEQ ID NO: 3123761 - protein, 11 aa, Giardia lamblia
MSSQPDAASLS

SEQ ID NO: 3123762 - protein, 30 aa, Giardia lamblia
MSSSDSTQASESRPRKREKIDKELRTDKPV

SEQ ID NO: 3123763 - protein, 6 aa, Giardia lamblia
MSSSEL

SEQ ID NO: 3123764 - protein, 35 aa, Giardia lamblia
MSSSRTGSRMGSRAGSRAGSRASSRTGSRSSTATI

SEQ ID NO: 3123765 - protein, 10 aa, Giardia lamblia
MSTKPQDRSD

SEQ ID NO: 3123766 - protein, 4 aa, Giardia lamblia
MSTM

SEQ ID NO: 3123767 - protein, 7 aa, Giardia lamblia
MSTPTTI

SEQ ID NO: 3123768 - protein, 7 aa, Giardia lamblia
MSTPVGE

SEQ ID NO: 3123769 - protein, 5 aa, Giardia lamblia
MSTRN

SEQ ID NO: 3123770 - protein, 5 aa, Giardia lamblia
MSTSK

SEQ ID NO: 3123771 - protein, 20 aa, Giardia lamblia
MSTSNSTTSCVSQTSQATHS

SEQ ID NO: 3123772 - protein, 12 aa, Giardia lamblia
MSTSPKDPRGPT

SEQ ID NO: 3123773 - protein, 20 aa, Giardia lamblia
MSTSRSGSPSLKGESPTTKN

SEQ ID NO: 3123774 - protein, 17 aa, Giardia lamblia
MSTSSAAASNDSQGTLQ

SEQ ID NO: 3123775 - protein, 10 aa, Giardia lamblia
MSTSTKSSVA

SEQ ID NO: 3123776 - protein, 10 aa, Giardia lamblia
MSTSTRCRSE

SEQ ID NO: 3123777 - protein, 8 aa, Giardia lamblia
MSTTQPEL

SEQ ID NO: 3123778 - protein, 14 aa, Giardia lamblia
MSVPEQSSTGRPQS

SEQ ID NO: 3123779 - protein, 12 aa, Giardia lamblia
MSVQSGKQAGAT

SEQ ID NO: 3123780 - protein, 4 aa, Giardia lamblia
MSVT

SEQ ID NO: 3123781 - protein, 14 aa, Giardia lamblia
MSYENTAASIRNSG

SEQ ID NO: 3123782 - protein, 7 aa, Giardia lamblia
MTAEKSD

SEQ ID NO: 3123783 - protein, 5 aa, Giardia lamblia
MTAQE

SEQ ID NO: 3123784 - protein, 10 aa, Giardia lamblia
MTASENSYQS

SEQ ID NO: 3123785 - protein, 12 aa, Giardia lamblia
MTASYKTASIPN

SEQ ID NO: 3123786 - protein, 8 aa, Giardia lamblia
MTDATGRT

SEQ ID NO: 3123787 - protein, 19 aa, Giardia lamblia
MTDTSSTYDEYDDYEGLEN

SEQ ID NO: 3123788 - protein, 4 aa, Giardia lamblia
MTEA

SEQ ID NO: 3123789 - protein, 8 aa, Giardia lamblia
MTEDWGGK

SEQ ID NO: 3123790 - protein, 4 aa, Giardia lamblia
MTEE

SEQ ID NO: 3123791 - protein, 20 aa, Giardia lamblia
MTETQASGGSTKQASSPIPI

SEQ ID NO: 3123792 - protein, 5 aa, Giardia lamblia
MTGAS

SEQ ID NO: 3123793 - protein, 13 aa, Giardia lamblia
MTGPSSVGKENQM

SEQ ID NO: 3123794 - protein, 32 aa, Giardia lamblia
MTGSDKDGTRNRRTASAASSAVSSATKGSDDF

SEQ ID NO: 3123795 - protein, 28 aa, Giardia lamblia
MTKEEEKTLGWEDPSKLQASRDGKNAGD

SEQ ID NO: 3123796 - protein, 6 aa, Giardia lamblia
MTKPDG

SEQ ID NO: 3123797 - protein, 7 aa, Giardia lamblia
MTKSREE

SEQ ID NO: 3123798 - protein, 4 aa, Giardia lamblia
MTMS

SEQ ID NO: 3123799 - protein, 4 aa, Giardia lamblia
MTNE

SEQ ID NO: 3123800 - protein, 15 aa, Giardia lamblia
MTNKMKTSDSADGNN

SEQ ID NO: 3123801 - protein, 9 aa, Giardia lamblia
MTNNKGKAA

SEQ ID NO: 3123802 - protein, 8 aa, Giardia lamblia
MTNNRGQT

SEQ ID NO: 3123803 - protein, 6 aa, Giardia lamblia
MTNSRK

SEQ ID NO: 3123804 - protein, 4 aa, Giardia lamblia
MTPE

SEQ ID NO: 3123805 - protein, 4 aa, Giardia lamblia
MTPN

SEQ ID NO: 3123806 - protein, 5 aa, Giardia lamblia
MTPQS

SEQ ID NO: 3123807 - protein, 6 aa, Giardia lamblia
MTPSDL

SEQ ID NO: 3123808 - protein, 29 aa, Giardia lamblia
MTPTSGALSPRRARSCENTPPKDEAVTSE

SEQ ID NO: 3123809 - protein, 11 aa, Giardia lamblia
MTPTTAEWDER

SEQ ID NO: 3123810 - protein, 10 aa, Giardia lamblia
MTRPPPEFAE

SEQ ID NO: 3123811 - protein, 20 aa, Giardia lamblia
MTRQSESQGDSVQDDRQDAV

SEQ ID NO: 3123812 - protein, 7 aa, Giardia lamblia
MTRRNGR

SEQ ID NO: 3123813 - protein, 14 aa, Giardia lamblia
MTSEANSVGSSRVT

SEQ ID NO: 3123814 - protein, 10 aa, Giardia lamblia
MTSINPKKSV

SEQ ID NO: 3123815 - protein, 5 aa, Giardia lamblia
MTSPR

SEQ ID NO: 3123816 - protein, 13 aa, Giardia lamblia
MTSSPRPGECGSP

SEQ ID NO: 3123817 - protein, 5 aa, Giardia lamblia
MTSSS

SEQ ID NO: 3123818 - protein, 6 aa, Giardia lamblia
MTSVGK

SEQ ID NO: 3123819 - protein, 14 aa, Giardia lamblia
MTTGTGKTALDYAK

SEQ ID NO: 3123820 - protein, 6 aa, Giardia lamblia
MTTNQG

SEQ ID NO: 3123821 - protein, 11 aa, Giardia lamblia
MTTSSLSEGYK

SEQ ID NO: 3123822 - protein, 12 aa, Giardia lamblia
MVGQSKSQLDSA

SEQ ID NO: 3123823 - protein, 8 aa, Giardia lamblia
MVPTGNSS

SEQ ID NO: 3123824 - protein, 9 aa, Giardia lamblia
MVSQDDESI

SEQ ID NO: 3123825 - protein, 13 aa, Giardia lamblia
MYEESAKPQTHPT

SEQ ID NO: 3123826 - protein, 7 aa, Giardia lamblia
MYSDNEG

SEQ ID NO: 3123827 - protein, 7 aa, Giardia lamblia
MYSNGET

SEQ ID NO: 3123828 - protein, 4 aa, Giardia lamblia
MYTD

SEQ ID NO: 3123829 - protein, 7 aa, Giardia lamblia
NAADPQS

SEQ ID NO: 3123830 - protein, 7 aa, Giardia lamblia
NAADTDI

SEQ ID NO: 3123831 - protein, 6 aa, Giardia lamblia
NAAESD

SEQ ID NO: 3123832 - protein, 21 aa, Giardia lamblia
NAAESGHEKKDCKLKGPPAHL

SEQ ID NO: 3123833 - protein, 15 aa, Giardia lamblia
NAAETTAAEEDEAGL

SEQ ID NO: 3123834 - protein, 7 aa, Giardia lamblia
NAAGNPV

SEQ ID NO: 3123835 - protein, 9 aa, Giardia lamblia
NAAKDEEIA

SEQ ID NO: 3123836 - protein, 6 aa, Giardia lamblia
NAALNK

SEQ ID NO: 3123837 - protein, 12 aa, Giardia lamblia
NAANSGHPGTPI

SEQ ID NO: 3123838 - protein, 14 aa, Giardia lamblia
NAANTIQNNARTHP

SEQ ID NO: 3123839 - protein, 9 aa, Giardia lamblia
NAAPPTEEA

SEQ ID NO: 3123840 - protein, 9 aa, Giardia lamblia
NAAPQSEAD

SEQ ID NO: 3123841 - protein, 16 aa, Giardia lamblia
NAAPSLEDGGNGDKPL

SEQ ID NO: 3123842 - protein, 9 aa, Giardia lamblia
NAAQPKRLK

SEQ ID NO: 3123843 - protein, 8 aa, Giardia lamblia
NAAQPTKS

SEQ ID NO: 3123844 - protein, 7 aa, Giardia lamblia
NAARTGV

SEQ ID NO: 3123845 - protein, 22 aa, Giardia lamblia
NAASIRNAKKKWKGSKDNDGNT

SEQ ID NO: 3123846 - protein, 7 aa, Giardia lamblia
NAATAQE

SEQ ID NO: 3123847 - protein, 5 aa, Giardia lamblia
NAATP

SEQ ID NO: 3123848 - protein, 12 aa, Giardia lamblia
NAATSPDTKNGD

SEQ ID NO: 3123849 - protein, 9 aa, Giardia lamblia
NAATTASSN

SEQ ID NO: 3123850 - protein, 7 aa, Giardia lamblia
NAATTSI

SEQ ID NO: 3123851 - protein, 12 aa, Giardia lamblia
NADANANKDNTI

SEQ ID NO: 3123852 - protein, 8 aa, Giardia lamblia
NADARDDV

SEQ ID NO: 3123853 - protein, 5 aa, Giardia lamblia
NADDI

SEQ ID NO: 3123854 - protein, 6 aa, Giardia lamblia
NADEET

SEQ ID NO: 3123855 - protein, 9 aa, Giardia lamblia
NADEGIPAT

SEQ ID NO: 3123856 - protein, 10 aa, Giardia lamblia
NADESSQHIE

SEQ ID NO: 3123857 - protein, 7 aa, Giardia lamblia
NADEYVS

SEQ ID NO: 3123858 - protein, 7 aa, Giardia lamblia
NADGNVE

SEQ ID NO: 3123859 - protein, 6 aa, Giardia lamblia
NADGVS

SEQ ID NO: 3123860 - protein, 5 aa, Giardia lamblia
NADKY

SEQ ID NO: 3123861 - protein, 6 aa, Giardia lamblia
NADLGT

SEQ ID NO: 3123862 - protein, 7 aa, Giardia lamblia
NADNGYQ

SEQ ID NO: 3123863 - protein, 13 aa, Giardia lamblia
NADNTQKEEDLNA

SEQ ID NO: 3123864 - protein, 14 aa, Giardia lamblia
NADPESSPKSYTAY

SEQ ID NO: 3123865 - protein, 20 aa, Giardia lamblia
NADPSESTANQTYGPEPDKY

SEQ ID NO: 3123866 - protein, 10 aa, Giardia lamblia
NADQEPAPKR

SEQ ID NO: 3123867 - protein, 12 aa, Giardia lamblia
NADQKQKQLEER

SEQ ID NO: 3123868 - protein, 6 aa, Giardia lamblia
NADSET

SEQ ID NO: 3123869 - protein, 7 aa, Giardia lamblia
NADTINS

SEQ ID NO: 3123870 - protein, 10 aa, Giardia lamblia
NADTLQKRYE

SEQ ID NO: 3123871 - protein, 9 aa, Giardia lamblia
NAEAECQRR

SEQ ID NO: 3123872 - protein, 6 aa, Giardia lamblia
NAEAEL

SEQ ID NO: 3123873 - protein, 9 aa, Giardia lamblia
NAEDALTEN

SEQ ID NO: 3123874 - protein, 9 aa, Giardia lamblia
NAEDFPSPN

SEQ ID NO: 3123875 - protein, 7 aa, Giardia lamblia
NAEDSLT

SEQ ID NO: 3123876 - protein, 7 aa, Giardia lamblia
NAEEGTQ

SEQ ID NO: 3123877 - protein, 8 aa, Giardia lamblia
NAEESNKR

SEQ ID NO: 3123878 - protein, 7 aa, Giardia lamblia
NAEGETA

SEQ ID NO: 3123879 - protein, 8 aa, Giardia lamblia
NAEGTLSG

SEQ ID NO: 3123880 - protein, 5 aa, Giardia lamblia
NAEHR

SEQ ID NO: 3123881 - protein, 6 aa, Giardia lamblia
NAEKLP

SEQ ID NO: 3123882 - protein, 9 aa, Giardia lamblia
NAEKYPPDM

SEQ ID NO: 3123883 - protein, 9 aa, Giardia lamblia
NAELNKSTS

SEQ ID NO: 3123884 - protein, 7 aa, Giardia lamblia
NAENERL

SEQ ID NO: 3123885 - protein, 8 aa, Giardia lamblia
NAENGDLS

SEQ ID NO: 3123886 - protein, 4 aa, Giardia lamblia
NAEQ

SEQ ID NO: 3123887 - protein, 8 aa, Giardia lamblia
NAEQAQNL

SEQ ID NO: 3123888 - protein, 11 aa, Giardia lamblia
NAEQKREAKNN

SEQ ID NO: 3123889 - protein, 9 aa, Giardia lamblia
NAEQTAKRV

SEQ ID NO: 3123890 - protein, 13 aa, Giardia lamblia
NAERQANKKLTDD

SEQ ID NO: 3123891 - protein, 5 aa, Giardia lamblia
NAESL

SEQ ID NO: 3123892 - protein, 8 aa, Giardia lamblia
NAESPQRS

SEQ ID NO: 3123893 - protein, 8 aa, Giardia lamblia
NAESSTKH

SEQ ID NO: 3123894 - protein, 6 aa, Giardia lamblia
NAEVER

SEQ ID NO: 3123895 - protein, 18 aa, Giardia lamblia
NAEYQNQELHKDNDQIRS

SEQ ID NO: 3123896 - protein, 5 aa, Giardia lamblia
NAFTG

SEQ ID NO: 3123897 - protein, 5 aa, Giardia lamblia
NAGDA

SEQ ID NO: 3123898 - protein, 6 aa, Giardia lamblia
NAGKHP

SEQ ID NO: 3123899 - protein, 6 aa, Giardia lamblia
NAGKST

SEQ ID NO: 3123900 - protein, 7 aa, Giardia lamblia
NAGKTDF

SEQ ID NO: 3123901 - protein, 8 aa, Giardia lamblia
NAGMTGAG

SEQ ID NO: 3123902 - protein, 6 aa, Giardia lamblia
NAGPDE

SEQ ID NO: 3123903 - protein, 9 aa, Giardia lamblia
NAGPNTNGS

SEQ ID NO: 3123904 - protein, 6 aa, Giardia lamblia
NAGSTF

SEQ ID NO: 3123905 - protein, 7 aa, Giardia lamblia
NAGVRET

SEQ ID NO: 3123906 - protein, 8 aa, Giardia lamblia
NAHAGKDE

SEQ ID NO: 3123907 - protein, 23 aa, Giardia lamblia
NAHANNKSRHSLPSEQRPTHDAH

SEQ ID NO: 3123908 - protein, 30 aa, Giardia lamblia
NAHDGHSMPEKDLTTSDISATVATKKEAPN

SEQ ID NO: 3123909 - protein, 5 aa, Giardia lamblia
NAHSK

SEQ ID NO: 3123910 - protein, 7 aa, Giardia lamblia
NAHSTDK

SEQ ID NO: 3123911 - protein, 4 aa, Giardia lamblia
NAHT

SEQ ID NO: 3123912 - protein, 4 aa, Giardia lamblia
NAID

SEQ ID NO: 3123913 - protein, 8 aa, Giardia lamblia
NAIDSERV

SEQ ID NO: 3123914 - protein, 11 aa, Giardia lamblia
NAITEGARSIT

SEQ ID NO: 3123915 - protein, 8 aa, Giardia lamblia
NAITPGTP

SEQ ID NO: 3123916 - protein, 7 aa, Giardia lamblia
NAITSRG

SEQ ID NO: 3123917 - protein, 7 aa, Giardia lamblia
NAKAELR

SEQ ID NO: 3123918 - protein, 10 aa, Giardia lamblia
NAKDKDGNNF

SEQ ID NO: 3123919 - protein, 8 aa, Giardia lamblia
NAKEADLS

SEQ ID NO: 3123920 - protein, 9 aa, Giardia lamblia
NAKEQEATI

SEQ ID NO: 3123921 - protein, 9 aa, Giardia lamblia
NAKIGTTEL

SEQ ID NO: 3123922 - protein, 16 aa, Giardia lamblia
NAKKAFDDHSEQSTAH

SEQ ID NO: 3123923 - protein, 10 aa, Giardia lamblia
NAKRPSSPSL

SEQ ID NO: 3123924 - protein, 13 aa, Giardia lamblia
NAKRTEPNPPYQT

SEQ ID NO: 3123925 - protein, 16 aa, Giardia lamblia
NAKRVDDENLAGKSEL

SEQ ID NO: 3123926 - protein, 12 aa, Giardia lamblia
NAKSAKSKETLN

SEQ ID NO: 3123927 - protein, 46 aa, Giardia lamblia
NAKSSSATTNKEDENIVTSSAATTATKGTAQQPSGEEEQKPTSQLG

SEQ ID NO: 3123928 - protein, 31 aa, Giardia lamblia
NAKVSLKSRPSSGRPSGQRGSVDDLPPHHSP

SEQ ID NO: 3123929 - protein, 9 aa, Giardia lamblia
NALAQGEEH

SEQ ID NO: 3123930 - protein, 10 aa, Giardia lamblia
NALENAKNTI

SEQ ID NO: 3123931 - protein, 5 aa, Giardia lamblia
NALGR

SEQ ID NO: 3123932 - protein, 7 aa, Giardia lamblia
NALNDDR

SEQ ID NO: 3123933 - protein, 6 aa, Giardia lamblia
NALNSS

SEQ ID NO: 3123934 - protein, 5 aa, Giardia lamblia
NALPR

SEQ ID NO: 3123935 - protein, 5 aa, Giardia lamblia
NALQK

SEQ ID NO: 3123936 - protein, 12 aa, Giardia lamblia
NALQSNKKTFQK

SEQ ID NO: 3123937 - protein, 15 aa, Giardia lamblia
NAMPPKDNSRKSRSL

SEQ ID NO: 3123938 - protein, 23 aa, Giardia lamblia
NANANFSASPVATAAKASVESAR

SEQ ID NO: 3123939 - protein, 17 aa, Giardia lamblia
NANASKPKGPVLPPPGV

SEQ ID NO: 3123940 - protein, 16 aa, Giardia lamblia
NANDSMARSSTNYMGE

SEQ ID NO: 3123941 - protein, 9 aa, Giardia lamblia
NANKKQMAK

SEQ ID NO: 3123942 - protein, 22 aa, Giardia lamblia
NANNKSCGGTPDEVDNDNETPE

SEQ ID NO: 3123943 - protein, 7 aa, Giardia lamblia
NANNYDD

SEQ ID NO: 3123944 - protein, 8 aa, Giardia lamblia
NANPERVQ

SEQ ID NO: 3123945 - protein, 9 aa, Giardia lamblia
NANPRGGQD

SEQ ID NO: 3123946 - protein, 33 aa, Giardia lamblia
NANQSPPRIPPRSEKSRKPSASEREDCGPSITD

SEQ ID NO: 3123947 - protein, 9 aa, Giardia lamblia
NANQTFPRS

SEQ ID NO: 3123948 - protein, 4 aa, Giardia lamblia
NANR

SEQ ID NO: 3123949 - protein, 8 aa, Giardia lamblia
NANTGGCC

SEQ ID NO: 3123950 - protein, 10 aa, Giardia lamblia
NAPGRKPREV

SEQ ID NO: 3123951 - protein, 16 aa, Giardia lamblia
NAPKTKLATNEAEAAT

SEQ ID NO: 3123952 - protein, 9 aa, Giardia lamblia
NAPPDYSPF

SEQ ID NO: 3123953 - protein, 43 aa, Giardia lamblia
NAPPSRDAKRSTVSSIQRGDPPLSTGSDDINSKLSDAAASGMT

SEQ ID NO: 3123954 - protein, 9 aa, Giardia lamblia
NAPPTTREG

SEQ ID NO: 3123955 - protein, 15 aa, Giardia lamblia
NAPRNATCRSVGETK

SEQ ID NO: 3123956 - protein, 23 aa, Giardia lamblia
NAPSQATSRTSFPDAESNNSCTA

SEQ ID NO: 3123957 - protein, 10 aa, Giardia lamblia
NAPTAQKTKL

SEQ ID NO: 3123958 - protein, 6 aa, Giardia lamblia
NAPTEA

SEQ ID NO: 3123959 - protein, 7 aa, Giardia lamblia
NAPTTES

SEQ ID NO: 3123960 - protein, 17 aa, Giardia lamblia
NAPVNEQASVSMSIASD

SEQ ID NO: 3123961 - protein, 10 aa, Giardia lamblia
NAQAEQQQQQ

SEQ ID NO: 3123962 - protein, 7 aa, Giardia lamblia
NAQASLD

SEQ ID NO: 3123963 - protein, 4 aa, Giardia lamblia
NAQE

SEQ ID NO: 3123964 - protein, 12 aa, Giardia lamblia
NAQENPRPQDPT

SEQ ID NO: 3123965 - protein, 7 aa, Giardia lamblia
NAQERTA

SEQ ID NO: 3123966 - protein, 6 aa, Giardia lamblia
NAQGED

SEQ ID NO: 3123967 - protein, 6 aa, Giardia lamblia
NAQGQT

SEQ ID NO: 3123968 - protein, 5 aa, Giardia lamblia
NAQIR

SEQ ID NO: 3123969 - protein, 9 aa, Giardia lamblia
NAQKQRDKF

SEQ ID NO: 3123970 - protein, 6 aa, Giardia lamblia
NAQLAA

SEQ ID NO: 3123971 - protein, 11 aa, Giardia lamblia
NAQNKTHKQEV

SEQ ID NO: 3123972 - protein, 4 aa, Giardia lamblia
NAQQ

SEQ ID NO: 3123973 - protein, 7 aa, Giardia lamblia
NAQQYSP

SEQ ID NO: 3123974 - protein, 8 aa, Giardia lamblia
NAQREQDM

SEQ ID NO: 3123975 - protein, 28 aa, Giardia lamblia
NAQRGDSAALSQEVNQEAEGDDDDPDNL

SEQ ID NO: 3123976 - protein, 14 aa, Giardia lamblia
NAQRIASLKEMLGD

SEQ ID NO: 3123977 - protein, 15 aa, Giardia lamblia
NAQTTYQQKKATRRY

SEQ ID NO: 3123978 - protein, 10 aa, Giardia lamblia
NARAKEKSTV

SEQ ID NO: 3123979 - protein, 21 aa, Giardia lamblia
NARGQMPTNSKISKPAIAYKV

SEQ ID NO: 3123980 - protein, 15 aa, Giardia lamblia
NARLAEETRKHNRQM

SEQ ID NO: 3123981 - protein, 5 aa, Giardia lamblia
NARLR

SEQ ID NO: 3123982 - protein, 4 aa, Giardia lamblia
NARP

SEQ ID NO: 3123983 - protein, 6 aa, Giardia lamblia
NARPKS

SEQ ID NO: 3123984 - protein, 7 aa, Giardia lamblia
NARPNVD

SEQ ID NO: 3123985 - protein, 10 aa, Giardia lamblia
NARPSSSELA

SEQ ID NO: 3123986 - protein, 6 aa, Giardia lamblia
NARQRA

SEQ ID NO: 3123987 - protein, 23 aa, Giardia lamblia
NARQRDKREQQAHMQSANPAAET

SEQ ID NO: 3123988 - protein, 9 aa, Giardia lamblia
NARRHPPNI

SEQ ID NO: 3123989 - protein, 9 aa, Giardia lamblia
NARSDQYYN

SEQ ID NO: 3123990 - protein, 21 aa, Giardia lamblia
NARTHVRKQADDSRDMTGLSG

SEQ ID NO: 3123991 - protein, 9 aa, Giardia lamblia
NARTTSLET

SEQ ID NO: 3123992 - protein, 10 aa, Giardia lamblia
NASANADKEH

SEQ ID NO: 3123993 - protein, 8 aa, Giardia lamblia
NASANSTA

SEQ ID NO: 3123994 - protein, 10 aa, Giardia lamblia
NASAPSENAF

SEQ ID NO: 3123995 - protein, 5 aa, Giardia lamblia
NASAS

SEQ ID NO: 3123996 - protein, 13 aa, Giardia lamblia
NASASDEQKRQFS

SEQ ID NO: 3123997 - protein, 8 aa, Giardia lamblia
NASASPLS

SEQ ID NO: 3123998 - protein, 18 aa, Giardia lamblia
NASASRDASARRSLSAQK

SEQ ID NO: 3123999 - protein, 5 aa, Giardia lamblia
NASDC

SEQ ID NO: 3124000 - protein, 18 aa, Giardia lamblia
NASDEEEDEEDADVTTPR

SEQ ID NO: 3124001 - protein, 9 aa, Giardia lamblia
NASEANDVY

SEQ ID NO: 3124002 - protein, 6 aa, Giardia lamblia
NASECT

SEQ ID NO: 3124003 - protein, 7 aa, Giardia lamblia
NASETEA

SEQ ID NO: 3124004 - protein, 9 aa, Giardia lamblia
NASGAEEIP

SEQ ID NO: 3124005 - protein, 6 aa, Giardia lamblia
NASGLT

SEQ ID NO: 3124006 - protein, 6 aa, Giardia lamblia
NASIED

SEQ ID NO: 3124007 - protein, 19 aa, Giardia lamblia
NASKRIGPLEEDTSDTTTL

SEQ ID NO: 3124008 - protein, 18 aa, Giardia lamblia
NASKTNNNYPTDQSGPLV

SEQ ID NO: 3124009 - protein, 14 aa, Giardia lamblia
NASLEKDAQLAQQK

SEQ ID NO: 3124010 - protein, 11 aa, Giardia lamblia
NASLGTDCTGR

SEQ ID NO: 3124011 - protein, 8 aa, Giardia lamblia
NASLQESV

SEQ ID NO: 3124012 - protein, 8 aa, Giardia lamblia
NASLSQDA

SEQ ID NO: 3124013 - protein, 11 aa, Giardia lamblia
NASMEEDPIQS

SEQ ID NO: 3124014 - protein, 6 aa, Giardia lamblia
NASNYQ

SEQ ID NO: 3124015 - protein, 11 aa, Giardia lamblia
NASPLTAEKAD

SEQ ID NO: 3124016 - protein, 24 aa, Giardia lamblia
NASQTDIADSQLTTDNTPDGDAPG

SEQ ID NO: 3124017 - protein, 4 aa, Giardia lamblia
NASS

SEQ ID NO: 3124018 - protein, 7 aa, Giardia lamblia
NASSEES

SEQ ID NO: 3124019 - protein, 5 aa, Giardia lamblia
NASSH

SEQ ID NO: 3124020 - protein, 9 aa, Giardia lamblia
NASSKHPKD

SEQ ID NO: 3124021 - protein, 5 aa, Giardia lamblia
NASSM

SEQ ID NO: 3124022 - protein, 9 aa, Giardia lamblia
NASSRWGSG

SEQ ID NO: 3124023 - protein, 7 aa, Giardia lamblia
NASTAPC

SEQ ID NO: 3124024 - protein, 6 aa, Giardia lamblia
NASTAT

SEQ ID NO: 3124025 - protein, 25 aa, Giardia lamblia
NASTQTTEQSRAQHTDDNCGAVDVV

SEQ ID NO: 3124026 - protein, 9 aa, Giardia lamblia
NASTYTHED

SEQ ID NO: 3124027 - protein, 7 aa, Giardia lamblia
NASVPDK

SEQ ID NO: 3124028 - protein, 8 aa, Giardia lamblia
NASVSNTA

SEQ ID NO: 3124029 - protein, 7 aa, Giardia lamblia
NASVSSD

SEQ ID NO: 3124030 - protein, 12 aa, Giardia lamblia
NASVTTPNPDAD

SEQ ID NO: 3124031 - protein, 4 aa, Giardia lamblia
NASY

SEQ ID NO: 3124032 - protein, 5 aa, Giardia lamblia
NASYS

SEQ ID NO: 3124033 - protein, 4 aa, Giardia lamblia
NATA

SEQ ID NO: 3124034 - protein, 8 aa, Giardia lamblia
NATASGDF

SEQ ID NO: 3124035 - protein, 10 aa, Giardia lamblia
NATDASGNTA

SEQ ID NO: 3124036 - protein, 11 aa, Giardia lamblia
NATDGTKQSTP

SEQ ID NO: 3124037 - protein, 16 aa, Giardia lamblia
NATDTADTTDTTDTVD

SEQ ID NO: 3124038 - protein, 14 aa, Giardia lamblia
NATELDDPEWLQQL

SEQ ID NO: 3124039 - protein, 7 aa, Giardia lamblia
NATESSL

SEQ ID NO: 3124040 - protein, 5 aa, Giardia lamblia
NATGV

SEQ ID NO: 3124041 - protein, 15 aa, Giardia lamblia
NATIGKERKAWGNKT

SEQ ID NO: 3124042 - protein, 12 aa, Giardia lamblia
NATKEKLAETTA

SEQ ID NO: 3124043 - protein, 12 aa, Giardia lamblia
NATLSKTTPQES

SEQ ID NO: 3124044 - protein, 16 aa, Giardia lamblia
NATNGCTTEEQTREDL

SEQ ID NO: 3124045 - protein, 5 aa, Giardia lamblia
NATPA

SEQ ID NO: 3124046 - protein, 11 aa, Giardia lamblia
NATPIGTNEGE

SEQ ID NO: 3124047 - protein, 9 aa, Giardia lamblia
NATPLSPAD

SEQ ID NO: 3124048 - protein, 15 aa, Giardia lamblia
NATPRASSKPAQGIA

SEQ ID NO: 3124049 - protein, 11 aa, Giardia lamblia
NATPSTTKVES

SEQ ID NO: 3124050 - protein, 7 aa, Giardia lamblia
NATQQSK

SEQ ID NO: 3124051 - protein, 5 aa, Giardia lamblia
NATQS

SEQ ID NO: 3124052 - protein, 8 aa, Giardia lamblia
NATSEALA

SEQ ID NO: 3124053 - protein, 25 aa, Giardia lamblia
NATSIEPPSVSPEDAPSHSSTLSGG

SEQ ID NO: 3124054 - protein, 5 aa, Giardia lamblia
NATST

SEQ ID NO: 3124055 - protein, 4 aa, Giardia lamblia
NATT

SEQ ID NO: 3124056 - protein, 7 aa, Giardia lamblia
NATTEVY

SEQ ID NO: 3124057 - protein, 8 aa, Giardia lamblia
NATTVTED

SEQ ID NO: 3124058 - protein, 7 aa, Giardia lamblia
NAVDKTQ

SEQ ID NO: 3124059 - protein, 14 aa, Giardia lamblia
NAVETPNMSEEAQI

SEQ ID NO: 3124060 - protein, 8 aa, Giardia lamblia
NAVNPGPN

SEQ ID NO: 3124061 - protein, 15 aa, Giardia lamblia
NAVPETRPVPSITPR

SEQ ID NO: 3124062 - protein, 10 aa, Giardia lamblia
NAVQDSSSCS

SEQ ID NO: 3124063 - protein, 15 aa, Giardia lamblia
NAVSKKEKTAQEALD

SEQ ID NO: 3124064 - protein, 14 aa, Giardia lamblia
NAVSPSDQPQQTIY

SEQ ID NO: 3124065 - protein, 25 aa, Giardia lamblia
NAVSTGDPVGHAASEESTDGSALEG

SEQ ID NO: 3124066 - protein, 4 aa, Giardia lamblia
NAVT

SEQ ID NO: 3124067 - protein, 16 aa, Giardia lamblia
NAYTEEKDKKREEGNF

SEQ ID NO: 3124068 - protein, 7 aa, Giardia lamblia
NAYTNAD

SEQ ID NO: 3124069 - protein, 6 aa, Giardia lamblia
NCDPNG

SEQ ID NO: 3124070 - protein, 7 aa, Giardia lamblia
NCGDSRT

SEQ ID NO: 3124071 - protein, 6 aa, Giardia lamblia
NCGHGK

SEQ ID NO: 3124072 - protein, 7 aa, Giardia lamblia
NCGTGRK

SEQ ID NO: 3124073 - protein, 5 aa, Giardia lamblia
NCKGI

SEQ ID NO: 3124074 - protein, 4 aa, Giardia lamblia
NCNT

SEQ ID NO: 3124075 - protein, 5 aa, Giardia lamblia
NCPRN

SEQ ID NO: 3124076 - protein, 7 aa, Giardia lamblia
NCQNGGA

SEQ ID NO: 3124077 - protein, 15 aa, Giardia lamblia
NCQTAGSSSDDNLAR

SEQ ID NO: 3124078 - protein, 10 aa, Giardia lamblia
NCRTESGQTA

SEQ ID NO: 3124079 - protein, 6 aa, Giardia lamblia
NCSTDI

SEQ ID NO: 3124080 - protein, 12 aa, Giardia lamblia
NCTGNANNTDVS

SEQ ID NO: 3124081 - protein, 10 aa, Giardia lamblia
NCTTENADVP

SEQ ID NO: 3124082 - protein, 7 aa, Giardia lamblia
NDAAQRS

SEQ ID NO: 3124083 - protein, 12 aa, Giardia lamblia
NDADSAQKGKVT

SEQ ID NO: 3124084 - protein, 6 aa, Giardia lamblia
NDAEQQ

SEQ ID NO: 3124085 - protein, 7 aa, Giardia lamblia
NDAKGQA

SEQ ID NO: 3124086 - protein, 29 aa, Giardia lamblia
NDALRDPYRASVKGAGHTGRDAGMYEGIF

SEQ ID NO: 3124087 - protein, 6 aa, Giardia lamblia
NDANDM

SEQ ID NO: 3124088 - protein, 15 aa, Giardia lamblia
NDAPPAQTDAKGKLV

SEQ ID NO: 3124089 - protein, 6 aa, Giardia lamblia
NDATYK

SEQ ID NO: 3124090 - protein, 9 aa, Giardia lamblia
NDAVDTSNK

SEQ ID NO: 3124091 - protein, 47 aa, Giardia lamblia
NDDANEGDSDSSYSYYSTDNDNDDNDDIPDPAPDGETHSAVPDPATN

SEQ ID NO: 3124092 - protein, 8 aa, Giardia lamblia
NDDELDDL

SEQ ID NO: 3124093 - protein, 21 aa, Giardia lamblia
NDDGVPSAVEPSSAAPVLPRA

SEQ ID NO: 3124094 - protein, 5 aa, Giardia lamblia
NDDHT

SEQ ID NO: 3124095 - protein, 4 aa, Giardia lamblia
NDDI

SEQ ID NO: 3124096 - protein, 4 aa, Giardia lamblia
NDDL

SEQ ID NO: 3124097 - protein, 5 aa, Giardia lamblia
NDDPK

SEQ ID NO: 3124098 - protein, 9 aa, Giardia lamblia
NDDQQRSTD

SEQ ID NO: 3124099 - protein, 7 aa, Giardia lamblia
NDDSRAD

SEQ ID NO: 3124100 - protein, 13 aa, Giardia lamblia
NDDSSDALPGALS

SEQ ID NO: 3124101 - protein, 6 aa, Giardia lamblia
NDDTFS

SEQ ID NO: 3124102 - protein, 5 aa, Giardia lamblia
NDDTV

SEQ ID NO: 3124103 - protein, 9 aa, Giardia lamblia
NDDVSSIGK

SEQ ID NO: 3124104 - protein, 11 aa, Giardia lamblia
NDDYSNDPLRN

SEQ ID NO: 3124105 - protein, 11 aa, Giardia lamblia
NDEDKNKRKDA

SEQ ID NO: 3124106 - protein, 7 aa, Giardia lamblia
NDEDNDD

SEQ ID NO: 3124107 - protein, 11 aa, Giardia lamblia
NDEEQHDSKDY

SEQ ID NO: 3124108 - protein, 10 aa, Giardia lamblia
NDEIAEKTAR

SEQ ID NO: 3124109 - protein, 5 aa, Giardia lamblia
NDEIE

SEQ ID NO: 3124110 - protein, 9 aa, Giardia lamblia
NDELDARER

SEQ ID NO: 3124111 - protein, 15 aa, Giardia lamblia
NDENEKRAGPRASTQ

SEQ ID NO: 3124112 - protein, 7 aa, Giardia lamblia
NDEQRNK

SEQ ID NO: 3124113 - protein, 4 aa, Giardia lamblia
NDET

SEQ ID NO: 3124114 - protein, 5 aa, Giardia lamblia
NDETH

SEQ ID NO: 3124115 - protein, 6 aa, Giardia lamblia
NDETKV

SEQ ID NO: 3124116 - protein, 6 aa, Giardia lamblia
NDETRA

SEQ ID NO: 3124117 - protein, 7 aa, Giardia lamblia
NDEWPGT

SEQ ID NO: 3124118 - protein, 21 aa, Giardia lamblia
NDFDSQKRSAEIANQTSPTAG

SEQ ID NO: 3124119 - protein, 7 aa, Giardia lamblia
NDFESGK

SEQ ID NO: 3124120 - protein, 14 aa, Giardia lamblia
NDFKGSRDLDGDTG

SEQ ID NO: 3124121 - protein, 13 aa, Giardia lamblia
NDFPSFSPQDMQK

SEQ ID NO: 3124122 - protein, 6 aa, Giardia lamblia
NDFTKE

SEQ ID NO: 3124123 - protein, 8 aa, Giardia lamblia
NDGASAGM

SEQ ID NO: 3124124 - protein, 11 aa, Giardia lamblia
NDGDPTLPGRG

SEQ ID NO: 3124125 - protein, 4 aa, Giardia lamblia
NDGF

SEQ ID NO: 3124126 - protein, 6 aa, Giardia lamblia
NDGGET

SEQ ID NO: 3124127 - protein, 5 aa, Giardia lamblia
NDGHR

SEQ ID NO: 3124128 - protein, 6 aa, Giardia lamblia
NDGIRK

SEQ ID NO: 3124129 - protein, 7 aa, Giardia lamblia
NDGLTAA

SEQ ID NO: 3124130 - protein, 20 aa, Giardia lamblia
NDGMEKNQREADEVKERNAA

SEQ ID NO: 3124131 - protein, 7 aa, Giardia lamblia
NDGSDGR

SEQ ID NO: 3124132 - protein, 5 aa, Giardia lamblia
NDGSL

SEQ ID NO: 3124133 - protein, 4 aa, Giardia lamblia
NDGY

SEQ ID NO: 3124134 - protein, 5 aa, Giardia lamblia
NDGYS

SEQ ID NO: 3124135 - protein, 4 aa, Giardia lamblia
NDHR

SEQ ID NO: 3124136 - protein, 4 aa, Giardia lamblia
NDIE

SEQ ID NO: 3124137 - protein, 9 aa, Giardia lamblia
NDIESQRKA

SEQ ID NO: 3124138 - protein, 8 aa, Giardia lamblia
NDINPNYD

SEQ ID NO: 3124139 - protein, 35 aa, Giardia lamblia
NDIPSRDNRDRSMTIGPEDTGMRASPSTAVSDRYD

SEQ ID NO: 3124140 - protein, 9 aa, Giardia lamblia
NDITNKSAA

SEQ ID NO: 3124141 - protein, 42 aa, Giardia lamblia
NDITSANSNRLEAGTNGDMTPGSASAANGPHASMRQTNSIKN

SEQ ID NO: 3124142 - protein, 10 aa, Giardia lamblia
NDITTKEQQT

SEQ ID NO: 3124143 - protein, 5 aa, Giardia lamblia
NDKAL

SEQ ID NO: 3124144 - protein, 9 aa, Giardia lamblia
NDKDAEIKT

SEQ ID NO: 3124145 - protein, 4 aa, Giardia lamblia
NDKG

SEQ ID NO: 3124146 - protein, 13 aa, Giardia lamblia
NDKRSRSKSDAWS

SEQ ID NO: 3124147 - protein, 13 aa, Giardia lamblia
NDKSDSDRTENEY

SEQ ID NO: 3124148 - protein, 10 aa, Giardia lamblia
NDKSTHTKMT

SEQ ID NO: 3124149 - protein, 5 aa, Giardia lamblia
NDKTL

SEQ ID NO: 3124150 - protein, 10 aa, Giardia lamblia
NDKTRETEEL

SEQ ID NO: 3124151 - protein, 7 aa, Giardia lamblia
NDLGSSP

SEQ ID NO: 3124152 - protein, 8 aa, Giardia lamblia
NDLKDARP

SEQ ID NO: 3124153 - protein, 11 aa, Giardia lamblia
NDLKSNTTDYA

SEQ ID NO: 3124154 - protein, 14 aa, Giardia lamblia
NDLPAGTSSFGPSS

SEQ ID NO: 3124155 - protein, 13 aa, Giardia lamblia
NDLPEEHRSPSAY

SEQ ID NO: 3124156 - protein, 4 aa, Giardia lamblia
NDLT

SEQ ID NO: 3124157 - protein, 6 aa, Giardia lamblia
NDLTDT

SEQ ID NO: 3124158 - protein, 12 aa, Giardia lamblia
NDMSGPNTAQSS

SEQ ID NO: 3124159 - protein, 9 aa, Giardia lamblia
NDNASQEQI

SEQ ID NO: 3124160 - protein, 8 aa, Giardia lamblia
NDNDPDSG

SEQ ID NO: 3124161 - protein, 5 aa, Giardia lamblia
NDNGK

SEQ ID NO: 3124162 - protein, 8 aa, Giardia lamblia
NDNGKPSI

SEQ ID NO: 3124163 - protein, 7 aa, Giardia lamblia
NDNNHST

SEQ ID NO: 3124164 - protein, 12 aa, Giardia lamblia
NDNPEDETVPNK

SEQ ID NO: 3124165 - protein, 8 aa, Giardia lamblia
NDNQRRDM

SEQ ID NO: 3124166 - protein, 6 aa, Giardia lamblia
NDNSGL

SEQ ID NO: 3124167 - protein, 17 aa, Giardia lamblia
NDNSPSHSVTSEKPYKS

SEQ ID NO: 3124168 - protein, 11 aa, Giardia lamblia
NDNSSSVSAAG

SEQ ID NO: 3124169 - protein, 8 aa, Giardia lamblia
NDNTFDQE

SEQ ID NO: 3124170 - protein, 22 aa, Giardia lamblia
NDPAAKEEADKPKEPAADTSSL

SEQ ID NO: 3124171 - protein, 8 aa, Giardia lamblia
NDPAVDKG

SEQ ID NO: 3124172 - protein, 4 aa, Giardia lamblia
NDPD

SEQ ID NO: 3124173 - protein, 9 aa, Giardia lamblia
NDPDSAYTE

SEQ ID NO: 3124174 - protein, 7 aa, Giardia lamblia
NDPDVAQ

SEQ ID NO: 3124175 - protein, 5 aa, Giardia lamblia
NDPEL

SEQ ID NO: 3124176 - protein, 9 aa, Giardia lamblia
NDPGNNSLA

SEQ ID NO: 3124177 - protein, 8 aa, Giardia lamblia
NDPLPKPE

SEQ ID NO: 3124178 - protein, 5 aa, Giardia lamblia
NDPLT

SEQ ID NO: 3124179 - protein, 6 aa, Giardia lamblia
NDPNAI

SEQ ID NO: 3124180 - protein, 9 aa, Giardia lamblia
NDPNERPSA

SEQ ID NO: 3124181 - protein, 6 aa, Giardia lamblia
NDPNGS

SEQ ID NO: 3124182 - protein, 9 aa, Giardia lamblia
NDPNIPQQT

SEQ ID NO: 3124183 - protein, 5 aa, Giardia lamblia
NDPPG

SEQ ID NO: 3124184 - protein, 6 aa, Giardia lamblia
NDPPIG

SEQ ID NO: 3124185 - protein, 37 aa, Giardia lamblia
NDPPPPPVEEAPPPPQGKKSRKNSKQGSRKSSKSKKK

SEQ ID NO: 3124186 - protein, 5 aa, Giardia lamblia
NDPSL

SEQ ID NO: 3124187 - protein, 4 aa, Giardia lamblia
NDPT

SEQ ID NO: 3124188 - protein, 4 aa, Giardia lamblia
NDPV

SEQ ID NO: 3124189 - protein, 5 aa, Giardia lamblia
NDPVG

SEQ ID NO: 3124190 - protein, 4 aa, Giardia lamblia
NDQD

SEQ ID NO: 3124191 - protein, 10 aa, Giardia lamblia
NDQERGAESP

SEQ ID NO: 3124192 - protein, 6 aa, Giardia lamblia
NDQGEL

SEQ ID NO: 3124193 - protein, 5 aa, Giardia lamblia
NDQQR

SEQ ID NO: 3124194 - protein, 8 aa, Giardia lamblia
NDQQVKEV

SEQ ID NO: 3124195 - protein, 9 aa, Giardia lamblia
NDQRRATEL

SEQ ID NO: 3124196 - protein, 8 aa, Giardia lamblia
NDQYCGPS

SEQ ID NO: 3124197 - protein, 9 aa, Giardia lamblia
NDRAEAMQQ

SEQ ID NO: 3124198 - protein, 14 aa, Giardia lamblia
NDRDNSLSSVATDE

SEQ ID NO: 3124199 - protein, 4 aa, Giardia lamblia
NDRG

SEQ ID NO: 3124200 - protein, 6 aa, Giardia lamblia
NDRGEN

SEQ ID NO: 3124201 - protein, 9 aa, Giardia lamblia
NDRGTSGSF

SEQ ID NO: 3124202 - protein, 7 aa, Giardia lamblia
NDRHGQT

SEQ ID NO: 3124203 - protein, 9 aa, Giardia lamblia
NDRKPEAEE

SEQ ID NO: 3124204 - protein, 4 aa, Giardia lamblia
NDRL

SEQ ID NO: 3124205 - protein, 11 aa, Giardia lamblia
NDRLSDSFTTE

SEQ ID NO: 3124206 - protein, 8 aa, Giardia lamblia
NDRPGVDG

SEQ ID NO: 3124207 - protein, 8 aa, Giardia lamblia
NDRRHGPG

SEQ ID NO: 3124208 - protein, 4 aa, Giardia lamblia
NDRS

SEQ ID NO: 3124209 - protein, 10 aa, Giardia lamblia
NDRSSSCHPR

SEQ ID NO: 3124210 - protein, 6 aa, Giardia lamblia
NDRTDT

SEQ ID NO: 3124211 - protein, 10 aa, Giardia lamblia
NDSAKTAPSI

SEQ ID NO: 3124212 - protein, 13 aa, Giardia lamblia
NDSDCVDSSDQLS

SEQ ID NO: 3124213 - protein, 7 aa, Giardia lamblia
NDSDETY

SEQ ID NO: 3124214 - protein, 26 aa, Giardia lamblia
NDSDSCGKVPEGGTSTYTGTSRNSYP

SEQ ID NO: 3124215 - protein, 22 aa, Giardia lamblia
NDSDSSDDEFGDNDQDPRGSLS

SEQ ID NO: 3124216 - protein, 5 aa, Giardia lamblia
NDSEK

SEQ ID NO: 3124217 - protein, 7 aa, Giardia lamblia
NDSEKHL

SEQ ID NO: 3124218 - protein, 5 aa, Giardia lamblia
NDSET

SEQ ID NO: 3124219 - protein, 5 aa, Giardia lamblia
NDSEV

SEQ ID NO: 3124220 - protein, 12 aa, Giardia lamblia
NDSFESEDNDLG

SEQ ID NO: 3124221 - protein, 8 aa, Giardia lamblia
NDSGEELQ

SEQ ID NO: 3124222 - protein, 18 aa, Giardia lamblia
NDSGSSDRYGQGPNFEPE

SEQ ID NO: 3124223 - protein, 20 aa, Giardia lamblia
NDSKQSSAISTVKSSPGKSG

SEQ ID NO: 3124224 - protein, 20 aa, Giardia lamblia
NDSKTDTNSLDVSEDGDVGK

SEQ ID NO: 3124225 - protein, 7 aa, Giardia lamblia
NDSQKHA

SEQ ID NO: 3124226 - protein, 17 aa, Giardia lamblia
NDSRQNLPNQSELHESK

SEQ ID NO: 3124227 - protein, 8 aa, Giardia lamblia
NDSRTGIK

SEQ ID NO: 3124228 - protein, 8 aa, Giardia lamblia
NDSRVEST

SEQ ID NO: 3124229 - protein, 10 aa, Giardia lamblia
NDSSESITPQ

SEQ ID NO: 3124230 - protein, 5 aa, Giardia lamblia
NDSST

SEQ ID NO: 3124231 - protein, 6 aa, Giardia lamblia
NDSSTL

SEQ ID NO: 3124232 - protein, 11 aa, Giardia lamblia
NDSSYIGSGGL

SEQ ID NO: 3124233 - protein, 8 aa, Giardia lamblia
NDSTDEKF

SEQ ID NO: 3124234 - protein, 6 aa, Giardia lamblia
NDSTDS

SEQ ID NO: 3124235 - protein, 11 aa, Giardia lamblia
NDSTGGTATIE

SEQ ID NO: 3124236 - protein, 5 aa, Giardia lamblia
NDSTI

SEQ ID NO: 3124237 - protein, 6 aa, Giardia lamblia
NDSTKH

SEQ ID NO: 3124238 - protein, 5 aa, Giardia lamblia
NDSTP

SEQ ID NO: 3124239 - protein, 7 aa, Giardia lamblia
NDSTTSA

SEQ ID NO: 3124240 - protein, 8 aa, Giardia lamblia
NDSVPVYP

SEQ ID NO: 3124241 - protein, 8 aa, Giardia lamblia
NDTDAQRT

SEQ ID NO: 3124242 - protein, 4 aa, Giardia lamblia
NDTE

SEQ ID NO: 3124243 - protein, 5 aa, Giardia lamblia
NDTGA

SEQ ID NO: 3124244 - protein, 12 aa, Giardia lamblia
NDTGADFDDFEA

SEQ ID NO: 3124245 - protein, 29 aa, Giardia lamblia
NDTGGEAWNSSTEHDATGPASTFNDEGNP

SEQ ID NO: 3124246 - protein, 12 aa, Giardia lamblia
NDTHERTLKQTN

SEQ ID NO: 3124247 - protein, 14 aa, Giardia lamblia
NDTLPEPDVNPHYT

SEQ ID NO: 3124248 - protein, 16 aa, Giardia lamblia
NDTMGGTDPMDQTRGK

SEQ ID NO: 3124249 - protein, 13 aa, Giardia lamblia
NDTRASEKKASDM

SEQ ID NO: 3124250 - protein, 15 aa, Giardia lamblia
NDTREQREETRRSIT

SEQ ID NO: 3124251 - protein, 17 aa, Giardia lamblia
NDTRSEPQQETPDLGTP

SEQ ID NO: 3124252 - protein, 17 aa, Giardia lamblia
NDTSAADGQAGEEERAR

SEQ ID NO: 3124253 - protein, 8 aa, Giardia lamblia
NDTSPASD

SEQ ID NO: 3124254 - protein, 7 aa, Giardia lamblia
NDTSQEI

SEQ ID NO: 3124255 - protein, 21 aa, Giardia lamblia
NDTTSDRRSNKVSASEAFSQK

SEQ ID NO: 3124256 - protein, 25 aa, Giardia lamblia
NDVPGPSQYTNIQPNLSKAGHTDNI

SEQ ID NO: 3124257 - protein, 9 aa, Giardia lamblia
NDVPPDADL

SEQ ID NO: 3124258 - protein, 5 aa, Giardia lamblia
NDVSS

SEQ ID NO: 3124259 - protein, 8 aa, Giardia lamblia
NDVTEATP

SEQ ID NO: 3124260 - protein, 10 aa, Giardia lamblia
NDVTSNPYYT

SEQ ID NO: 3124261 - protein, 4 aa, Giardia lamblia
NDYA

SEQ ID NO: 3124262 - protein, 10 aa, Giardia lamblia
NDYNDQNSKQ

SEQ ID NO: 3124263 - protein, 11 aa, Giardia lamblia
NDYPSAIGGDD

SEQ ID NO: 3124264 - protein, 4 aa, Giardia lamblia
NDYS

SEQ ID NO: 3124265 - protein, 13 aa, Giardia lamblia
NDYTQPTAGPSDD

SEQ ID NO: 3124266 - protein, 6 aa, Giardia lamblia
NEAANH

SEQ ID NO: 3124267 - protein, 18 aa, Giardia lamblia
NEAARPKSKESTKAEEQR

SEQ ID NO: 3124268 - protein, 16 aa, Giardia lamblia
NEADMNGARGVTNEGF

SEQ ID NO: 3124269 - protein, 10 aa, Giardia lamblia
NEADTKGCQE

SEQ ID NO: 3124270 - protein, 7 aa, Giardia lamblia
NEAEAPV

SEQ ID NO: 3124271 - protein, 6 aa, Giardia lamblia
NEAEEL

SEQ ID NO: 3124272 - protein, 14 aa, Giardia lamblia
NEAEIDSKAEADKK

SEQ ID NO: 3124273 - protein, 5 aa, Giardia lamblia
NEAEL

SEQ ID NO: 3124274 - protein, 10 aa, Giardia lamblia
NEAEPSTPMS

SEQ ID NO: 3124275 - protein, 9 aa, Giardia lamblia
NEAEVSSTR

SEQ ID NO: 3124276 - protein, 5 aa, Giardia lamblia
NEAGQ

SEQ ID NO: 3124277 - protein, 5 aa, Giardia lamblia
NEAGV

SEQ ID NO: 3124278 - protein, 6 aa, Giardia lamblia
NEAHLS

SEQ ID NO: 3124279 - protein, 5 aa, Giardia lamblia
NEAIY

SEQ ID NO: 3124280 - protein, 4 aa, Giardia lamblia
NEAL

SEQ ID NO: 3124281 - protein, 16 aa, Giardia lamblia
NEALQGSKDGAEEAQD

SEQ ID NO: 3124282 - protein, 10 aa, Giardia lamblia
NEANASLRQS

SEQ ID NO: 3124283 - protein, 13 aa, Giardia lamblia
NEANSTGYDGSSP

SEQ ID NO: 3124284 - protein, 15 aa, Giardia lamblia
NEAPDAPASQEDGVY

SEQ ID NO: 3124285 - protein, 7 aa, Giardia lamblia
NEAQRHQ

SEQ ID NO: 3124286 - protein, 16 aa, Giardia lamblia
NEARRRAGAAESEANY

SEQ ID NO: 3124287 - protein, 15 aa, Giardia lamblia
NEARTSDYEQQGKEL

SEQ ID NO: 3124288 - protein, 8 aa, Giardia lamblia
NEASKQKP

SEQ ID NO: 3124289 - protein, 13 aa, Giardia lamblia
NEATADPAPTESM

SEQ ID NO: 3124290 - protein, 6 aa, Giardia lamblia
NEATEL

SEQ ID NO: 3124291 - protein, 10 aa, Giardia lamblia
NEATGFEDAT

SEQ ID NO: 3124292 - protein, 13 aa, Giardia lamblia
NEATNEKANIPGG

SEQ ID NO: 3124293 - protein, 17 aa, Giardia lamblia
NECGIESHSQGFYFIAS

SEQ ID NO: 3124294 - protein, 6 aa, Giardia lamblia
NECLET

SEQ ID NO: 3124295 - protein, 9 aa, Giardia lamblia
NECNAESRQ

SEQ ID NO: 3124296 - protein, 16 aa, Giardia lamblia
NECPTCSGKAGDQDPS

SEQ ID NO: 3124297 - protein, 6 aa, Giardia lamblia
NECTDR

SEQ ID NO: 3124298 - protein, 9 aa, Giardia lamblia
NEDDDNYDS

SEQ ID NO: 3124299 - protein, 9 aa, Giardia lamblia
NEDDQQNAS

SEQ ID NO: 3124300 - protein, 5 aa, Giardia lamblia
NEDGL

SEQ ID NO: 3124301 - protein, 9 aa, Giardia lamblia
NEDLAGSRG

SEQ ID NO: 3124302 - protein, 18 aa, Giardia lamblia
NEDMNQNRRRVSSTQGEV

SEQ ID NO: 3124303 - protein, 30 aa, Giardia lamblia
NEDNAMGSDTSFPPSQSSQDPSSSTTDDLS

SEQ ID NO: 3124304 - protein, 13 aa, Giardia lamblia
NEDPAQSPPGYES

SEQ ID NO: 3124305 - protein, 17 aa, Giardia lamblia
NEDPTQAATDLDKYRET

SEQ ID NO: 3124306 - protein, 6 aa, Giardia lamblia
NEDRDS

SEQ ID NO: 3124307 - protein, 7 aa, Giardia lamblia
NEDSDSL

SEQ ID NO: 3124308 - protein, 11 aa, Giardia lamblia
NEDSPERASTC

SEQ ID NO: 3124309 - protein, 6 aa, Giardia lamblia
NEDSRK

SEQ ID NO: 3124310 - protein, 8 aa, Giardia lamblia
NEDTTSMG

SEQ ID NO: 3124311 - protein, 8 aa, Giardia lamblia
NEEALEPV

SEQ ID NO: 3124312 - protein, 6 aa, Giardia lamblia
NEEDSI

SEQ ID NO: 3124313 - protein, 21 aa, Giardia lamblia
NEEEQSSYHDKAELAKARRAI

SEQ ID NO: 3124314 - protein, 11 aa, Giardia lamblia
NEEERAEATET

SEQ ID NO: 3124315 - protein, 5 aa, Giardia lamblia
NEEGP

SEQ ID NO: 3124316 - protein, 8 aa, Giardia lamblia
NEEHSTNS

SEQ ID NO: 3124317 - protein, 4 aa, Giardia lamblia
NEEI

SEQ ID NO: 3124318 - protein, 16 aa, Giardia lamblia
NEEIARRRQELERRRD

SEQ ID NO: 3124319 - protein, 13 aa, Giardia lamblia
NEEKPNEEKGFTR

SEQ ID NO: 3124320 - protein, 9 aa, Giardia lamblia
NEELPSREG

SEQ ID NO: 3124321 - protein, 8 aa, Giardia lamblia
NEENRNLR

SEQ ID NO: 3124322 - protein, 23 aa, Giardia lamblia
NEEQDTLRDQEHDTISTTSRCTL

SEQ ID NO: 3124323 - protein, 5 aa, Giardia lamblia
NEERA

SEQ ID NO: 3124324 - protein, 7 aa, Giardia lamblia
NEEREAL

SEQ ID NO: 3124325 - protein, 5 aa, Giardia lamblia
NEERR

SEQ ID NO: 3124326 - protein, 20 aa, Giardia lamblia
NEESREGKSGPRGVKGSERM

SEQ ID NO: 3124327 - protein, 7 aa, Giardia lamblia
NEETQNY

SEQ ID NO: 3124328 - protein, 6 aa, Giardia lamblia
NEFNNG

SEQ ID NO: 3124329 - protein, 5 aa, Giardia lamblia
NEGAS

SEQ ID NO: 3124330 - protein, 12 aa, Giardia lamblia
NEGDRDKASAIA

SEQ ID NO: 3124331 - protein, 14 aa, Giardia lamblia
NEGEPGSSKLNGTI

SEQ ID NO: 3124332 - protein, 6 aa, Giardia lamblia
NEGGGS

SEQ ID NO: 3124333 - protein, 6 aa, Giardia lamblia
NEGKTA

SEQ ID NO: 3124334 - protein, 8 aa, Giardia lamblia
NEGPELNT

SEQ ID NO: 3124335 - protein, 6 aa, Giardia lamblia
NEGPHY

SEQ ID NO: 3124336 - protein, 5 aa, Giardia lamblia
NEGPV

SEQ ID NO: 3124337 - protein, 8 aa, Giardia lamblia
NEGTLPNE

SEQ ID NO: 3124338 - protein, 14 aa, Giardia lamblia
NEGVGTEDLEPAMS

SEQ ID NO: 3124339 - protein, 18 aa, Giardia lamblia
NEGVQAGATSSKPEADVQ

SEQ ID NO: 3124340 - protein, 5 aa, Giardia lamblia
NEGYN

SEQ ID NO: 3124341 - protein, 6 aa, Giardia lamblia
NEHAKP

SEQ ID NO: 3124342 - protein, 6 aa, Giardia lamblia
NEHGPY

SEQ ID NO: 3124343 - protein, 10 aa, Giardia lamblia
NEHLPKPKDI

SEQ ID NO: 3124344 - protein, 10 aa, Giardia lamblia
NEHNKRISEQ

SEQ ID NO: 3124345 - protein, 4 aa, Giardia lamblia
NEHR

SEQ ID NO: 3124346 - protein, 5 aa, Giardia lamblia
NEHTD

SEQ ID NO: 3124347 - protein, 7 aa, Giardia lamblia
NEHTSAY

SEQ ID NO: 3124348 - protein, 10 aa, Giardia lamblia
NEIDCKSTPV

SEQ ID NO: 3124349 - protein, 6 aa, Giardia lamblia
NEIEEK

SEQ ID NO: 3124350 - protein, 13 aa, Giardia lamblia
NEIQKKTTPSYRA

SEQ ID NO: 3124351 - protein, 14 aa, Giardia lamblia
NEIRARSNQKSQTV

SEQ ID NO: 3124352 - protein, 9 aa, Giardia lamblia
NEKAQKELN

SEQ ID NO: 3124353 - protein, 5 aa, Giardia lamblia
NEKAS

SEQ ID NO: 3124354 - protein, 7 aa, Giardia lamblia
NEKDKVK

SEQ ID NO: 3124355 - protein, 7 aa, Giardia lamblia
NEKDTLD

SEQ ID NO: 3124356 - protein, 4 aa, Giardia lamblia
NEKE

SEQ ID NO: 3124357 - protein, 4 aa, Giardia lamblia
NEKG

SEQ ID NO: 3124358 - protein, 10 aa, Giardia lamblia
NEKGSRDRES

SEQ ID NO: 3124359 - protein, 4 aa, Giardia lamblia
NEKL

SEQ ID NO: 3124360 - protein, 6 aa, Giardia lamblia
NEKNIE

SEQ ID NO: 3124361 - protein, 7 aa, Giardia lamblia
NEKNNDL

SEQ ID NO: 3124362 - protein, 5 aa, Giardia lamblia
NEKNS

SEQ ID NO: 3124363 - protein, 9 aa, Giardia lamblia
NEKQSEVPD

SEQ ID NO: 3124364 - protein, 9 aa, Giardia lamblia
NEKQSYETM

SEQ ID NO: 3124365 - protein, 12 aa, Giardia lamblia
NEKQTVFSSATS

SEQ ID NO: 3124366 - protein, 4 aa, Giardia lamblia
NEKT

SEQ ID NO: 3124367 - protein, 8 aa, Giardia lamblia
NEKTPRAV

SEQ ID NO: 3124368 - protein, 5 aa, Giardia lamblia
NEKTS

SEQ ID NO: 3124369 - protein, 8 aa, Giardia lamblia
NEKTSTQL

SEQ ID NO: 3124370 - protein, 12 aa, Giardia lamblia
NEKWNENRRLGD

SEQ ID NO: 3124371 - protein, 19 aa, Giardia lamblia
NEKYGTSSMSLPDDSLSKS

SEQ ID NO: 3124372 - protein, 5 aa, Giardia lamblia
NELAG

SEQ ID NO: 3124373 - protein, 11 aa, Giardia lamblia
NELAQKSKEDA

SEQ ID NO: 3124374 - protein, 9 aa, Giardia lamblia
NELESRQAQ

SEQ ID NO: 3124375 - protein, 18 aa, Giardia lamblia
NELKTKRRSGAAALASSS

SEQ ID NO: 3124376 - protein, 8 aa, Giardia lamblia
NELPPDTK

SEQ ID NO: 3124377 - protein, 18 aa, Giardia lamblia
NELQNVASSTSPKVEATI

SEQ ID NO: 3124378 - protein, 8 aa, Giardia lamblia
NELQQTSN

SEQ ID NO: 3124379 - protein, 7 aa, Giardia lamblia
NEMSDAD

SEQ ID NO: 3124380 - protein, 4 aa, Giardia lamblia
NEMT

SEQ ID NO: 3124381 - protein, 10 aa, Giardia lamblia
NENDPEPFED

SEQ ID NO: 3124382 - protein, 6 aa, Giardia lamblia
NENKTL

SEQ ID NO: 3124383 - protein, 5 aa, Giardia lamblia
NENKY

SEQ ID NO: 3124384 - protein, 8 aa, Giardia lamblia
NENNQLRE

SEQ ID NO: 3124385 - protein, 6 aa, Giardia lamblia
NENPDI

SEQ ID NO: 3124386 - protein, 5 aa, Giardia lamblia
NENRK

SEQ ID NO: 3124387 - protein, 8 aa, Giardia lamblia
NENSGLGV

SEQ ID NO: 3124388 - protein, 12 aa, Giardia lamblia
NENSRMEGGGAL

SEQ ID NO: 3124389 - protein, 5 aa, Giardia lamblia
NEPAN

SEQ ID NO: 3124390 - protein, 8 aa, Giardia lamblia
NEPASEHI

SEQ ID NO: 3124391 - protein, 10 aa, Giardia lamblia
NEPDRDQDCP

SEQ ID NO: 3124392 - protein, 12 aa, Giardia lamblia
NEPGTGTDDYNA

SEQ ID NO: 3124393 - protein, 9 aa, Giardia lamblia
NEPQTTDVD

SEQ ID NO: 3124394 - protein, 20 aa, Giardia lamblia
NEPRCTSESNSVMSDAPSTH

SEQ ID NO: 3124395 - protein, 7 aa, Giardia lamblia
NEPSSDV

SEQ ID NO: 3124396 - protein, 14 aa, Giardia lamblia
NEPTRASKSLQSLS

SEQ ID NO: 3124397 - protein, 6 aa, Giardia lamblia
NEPVSS

SEQ ID NO: 3124398 - protein, 4 aa, Giardia lamblia
NEQE

SEQ ID NO: 3124399 - protein, 36 aa, Giardia lamblia
NEQEAQRSKADALDDERFNPYEGYERRGETEPSYAK

SEQ ID NO: 3124400 - protein, 5 aa, Giardia lamblia
NEQEL

SEQ ID NO: 3124401 - protein, 4 aa, Giardia lamblia
NEQF

SEQ ID NO: 3124402 - protein, 9 aa, Giardia lamblia
NEQGQEFSQ

SEQ ID NO: 3124403 - protein, 7 aa, Giardia lamblia
NEQHEPD

SEQ ID NO: 3124404 - protein, 12 aa, Giardia lamblia
NEQIESSSISQP

SEQ ID NO: 3124405 - protein, 4 aa, Giardia lamblia
NEQL

SEQ ID NO: 3124406 - protein, 4 aa, Giardia lamblia
NEQN

SEQ ID NO: 3124407 - protein, 9 aa, Giardia lamblia
NEQPTSDAV

SEQ ID NO: 3124408 - protein, 4 aa, Giardia lamblia
NEQQ

SEQ ID NO: 3124409 - protein, 6 aa, Giardia lamblia
NEQQEC

SEQ ID NO: 3124410 - protein, 4 aa, Giardia lamblia
NEQR

SEQ ID NO: 3124411 - protein, 4 aa, Giardia lamblia
NEQS

SEQ ID NO: 3124412 - protein, 8 aa, Giardia lamblia
NERAGDMP

SEQ ID NO: 3124413 - protein, 9 aa, Giardia lamblia
NERDALNTE

SEQ ID NO: 3124414 - protein, 11 aa, Giardia lamblia
NERDSDGGPWS

SEQ ID NO: 3124415 - protein, 6 aa, Giardia lamblia
NERGRT

SEQ ID NO: 3124416 - protein, 10 aa, Giardia lamblia
NERGVQDGLD

SEQ ID NO: 3124417 - protein, 4 aa, Giardia lamblia
NERI

SEQ ID NO: 3124418 - protein, 4 aa, Giardia lamblia
NERL

SEQ ID NO: 3124419 - protein, 14 aa, Giardia lamblia
NERLSRANTKLTDE

SEQ ID NO: 3124420 - protein, 4 aa, Giardia lamblia
NERN

SEQ ID NO: 3124421 - protein, 12 aa, Giardia lamblia
NERNARPSSTAV

SEQ ID NO: 3124422 - protein, 12 aa, Giardia lamblia
NERPRPKKQWYN

SEQ ID NO: 3124423 - protein, 4 aa, Giardia lamblia
NERR

SEQ ID NO: 3124424 - protein, 5 aa, Giardia lamblia
NERSQ

SEQ ID NO: 3124425 - protein, 4 aa, Giardia lamblia
NERT

SEQ ID NO: 3124426 - protein, 7 aa, Giardia lamblia
NERTRSK

SEQ ID NO: 3124427 - protein, 6 aa, Giardia lamblia
NERTTM

SEQ ID NO: 3124428 - protein, 5 aa, Giardia lamblia
NERVN

SEQ ID NO: 3124429 - protein, 7 aa, Giardia lamblia
NERYKSK

SEQ ID NO: 3124430 - protein, 7 aa, Giardia lamblia
NESADTT

SEQ ID NO: 3124431 - protein, 10 aa, Giardia lamblia
NESAHTPREL

SEQ ID NO: 3124432 - protein, 11 aa, Giardia lamblia
NESAQTNTNQR

SEQ ID NO: 3124433 - protein, 7 aa, Giardia lamblia
NESDAIP

SEQ ID NO: 3124434 - protein, 8 aa, Giardia lamblia
NESDDGNT

SEQ ID NO: 3124435 - protein, 5 aa, Giardia lamblia
NESDV

SEQ ID NO: 3124436 - protein, 13 aa, Giardia lamblia
NESEEELQNTTGV

SEQ ID NO: 3124437 - protein, 8 aa, Giardia lamblia
NESGLTSN

SEQ ID NO: 3124438 - protein, 19 aa, Giardia lamblia
NESGNPTPTKAPTGASPPQ

SEQ ID NO: 3124439 - protein, 8 aa, Giardia lamblia
NESGTSLT

SEQ ID NO: 3124440 - protein, 5 aa, Giardia lamblia
NESLG

SEQ ID NO: 3124441 - protein, 15 aa, Giardia lamblia
NESPNPEASDTHSSV

SEQ ID NO: 3124442 - protein, 6 aa, Giardia lamblia
NESPVT

SEQ ID NO: 3124443 - protein, 7 aa, Giardia lamblia
NESQKQR

SEQ ID NO: 3124444 - protein, 9 aa, Giardia lamblia
NESQLPQEL

SEQ ID NO: 3124445 - protein, 9 aa, Giardia lamblia
NESSPASDV

SEQ ID NO: 3124446 - protein, 4 aa, Giardia lamblia
NEST

SEQ ID NO: 3124447 - protein, 13 aa, Giardia lamblia
NESTIQDNNGNTA

SEQ ID NO: 3124448 - protein, 7 aa, Giardia lamblia
NESTPPI

SEQ ID NO: 3124449 - protein, 8 aa, Giardia lamblia
NESTTGTV

SEQ ID NO: 3124450 - protein, 5 aa, Giardia lamblia
NESVS

SEQ ID NO: 3124451 - protein, 5 aa, Giardia lamblia
NESYQ

SEQ ID NO: 3124452 - protein, 9 aa, Giardia lamblia
NETDKQGYT

SEQ ID NO: 3124453 - protein, 5 aa, Giardia lamblia
NETGK

SEQ ID NO: 3124454 - protein, 12 aa, Giardia lamblia
NETGRPQSMDDH

SEQ ID NO: 3124455 - protein, 6 aa, Giardia lamblia
NETGTR

SEQ ID NO: 3124456 - protein, 11 aa, Giardia lamblia
NETHGSSELSP

SEQ ID NO: 3124457 - protein, 22 aa, Giardia lamblia
NETNSSQHKSHSGPTQDYGSSI

SEQ ID NO: 3124458 - protein, 8 aa, Giardia lamblia
NETQKRDA

SEQ ID NO: 3124459 - protein, 7 aa, Giardia lamblia
NETQQRA

SEQ ID NO: 3124460 - protein, 8 aa, Giardia lamblia
NETREEAS

SEQ ID NO: 3124461 - protein, 6 aa, Giardia lamblia
NETSEE

SEQ ID NO: 3124462 - protein, 30 aa, Giardia lamblia
NETSKAPNTIEQHTSSHITKAQEDNGTLGS

SEQ ID NO: 3124463 - protein, 5 aa, Giardia lamblia
NETSN

SEQ ID NO: 3124464 - protein, 16 aa, Giardia lamblia
NETSNLKTQDLSENAH

SEQ ID NO: 3124465 - protein, 8 aa, Giardia lamblia
NETSPASD

SEQ ID NO: 3124466 - protein, 16 aa, Giardia lamblia
NETTGDIEDTTGRTIG

SEQ ID NO: 3124467 - protein, 11 aa, Giardia lamblia
NETTSQGREKE

SEQ ID NO: 3124468 - protein, 4 aa, Giardia lamblia
NEVE

SEQ ID NO: 3124469 - protein, 6 aa, Giardia lamblia
NEVEYN

SEQ ID NO: 3124470 - protein, 34 aa, Giardia lamblia
NEVKGEARRNELEAADRSVEPSQPLTQNSPAFTT

SEQ ID NO: 3124471 - protein, 17 aa, Giardia lamblia
NEVNRQRAKDDAERRAS

SEQ ID NO: 3124472 - protein, 5 aa, Giardia lamblia
NEVNS

SEQ ID NO: 3124473 - protein, 18 aa, Giardia lamblia
NEVSDTQDHVPSYKDPVG

SEQ ID NO: 3124474 - protein, 6 aa, Giardia lamblia
NEVSKV

SEQ ID NO: 3124475 - protein, 4 aa, Giardia lamblia
NEWS

SEQ ID NO: 3124476 - protein, 8 aa, Giardia lamblia
NEYAESLR

SEQ ID NO: 3124477 - protein, 12 aa, Giardia lamblia
NEYDRPDDYKEQ

SEQ ID NO: 3124478 - protein, 7 aa, Giardia lamblia
NEYGNTP

SEQ ID NO: 3124479 - protein, 7 aa, Giardia lamblia
NEYKENM

SEQ ID NO: 3124480 - protein, 7 aa, Giardia lamblia
NEYPATA

SEQ ID NO: 3124481 - protein, 7 aa, Giardia lamblia
NEYSPAH

SEQ ID NO: 3124482 - protein, 8 aa, Giardia lamblia
NEYTEKAN

SEQ ID NO: 3124483 - protein, 13 aa, Giardia lamblia
NFAPNHKKHRSME

SEQ ID NO: 3124484 - protein, 8 aa, Giardia lamblia
NFDSKSGI

SEQ ID NO: 3124485 - protein, 12 aa, Giardia lamblia
NFEQTKQDMETK

SEQ ID NO: 3124486 - protein, 6 aa, Giardia lamblia
NFGPNT

SEQ ID NO: 3124487 - protein, 7 aa, Giardia lamblia
NFGPQDR

SEQ ID NO: 3124488 - protein, 7 aa, Giardia lamblia
NFKQPES

SEQ ID NO: 3124489 - protein, 5 aa, Giardia lamblia
NFNGE

SEQ ID NO: 3124490 - protein, 7 aa, Giardia lamblia
NFPAGGG

SEQ ID NO: 3124491 - protein, 12 aa, Giardia lamblia
NFPDEGSLHTDD

SEQ ID NO: 3124492 - protein, 36 aa, Giardia lamblia
NFPKQSSTKELPYTNTNVRQGCNSRQQTATAQPNRL

SEQ ID NO: 3124493 - protein, 4 aa, Giardia lamblia
NFPS

SEQ ID NO: 3124494 - protein, 9 aa, Giardia lamblia
NFPTGGSMN

SEQ ID NO: 3124495 - protein, 8 aa, Giardia lamblia
NFQSESNK

SEQ ID NO: 3124496 - protein, 5 aa, Giardia lamblia
NFREE

SEQ ID NO: 3124497 - protein, 7 aa, Giardia lamblia
NFSGGQV

SEQ ID NO: 3124498 - protein, 6 aa, Giardia lamblia
NFSHRA

SEQ ID NO: 3124499 - protein, 30 aa, Giardia lamblia
NFSSDTPEESDTQSGTEGNEHSEEDDTREH

SEQ ID NO: 3124500 - protein, 4 aa, Giardia lamblia
NFTD

SEQ ID NO: 3124501 - protein, 12 aa, Giardia lamblia
NFTEDSKSHYKG

SEQ ID NO: 3124502 - protein, 5 aa, Giardia lamblia
NFTRT

SEQ ID NO: 3124503 - protein, 14 aa, Giardia lamblia
NFTSSQAGQPRYSE

SEQ ID NO: 3124504 - protein, 24 aa, Giardia lamblia
NGADDDRRGSIGDDLEADGYNPHV

SEQ ID NO: 3124505 - protein, 6 aa, Giardia lamblia
NGAELS

SEQ ID NO: 3124506 - protein, 17 aa, Giardia lamblia
NGAIEKSKQAAKDPGSL

SEQ ID NO: 3124507 - protein, 7 aa, Giardia lamblia
NGAITKQ

SEQ ID NO: 3124508 - protein, 6 aa, Giardia lamblia
NGAKQI

SEQ ID NO: 3124509 - protein, 14 aa, Giardia lamblia
NGALSGSLKPADIK

SEQ ID NO: 3124510 - protein, 7 aa, Giardia lamblia
NGANCGS

SEQ ID NO: 3124511 - protein, 6 aa, Giardia lamblia
NGANNR

SEQ ID NO: 3124512 - protein, 7 aa, Giardia lamblia
NGANTRG

SEQ ID NO: 3124513 - protein, 4 aa, Giardia lamblia
NGAP

SEQ ID NO: 3124514 - protein, 9 aa, Giardia lamblia
NGAPASQGV

SEQ ID NO: 3124515 - protein, 9 aa, Giardia lamblia
NGAPYSTGL

SEQ ID NO: 3124516 - protein, 18 aa, Giardia lamblia
NGAQRQPDDQGPREDYDG

SEQ ID NO: 3124517 - protein, 8 aa, Giardia lamblia
NGARDSLP

SEQ ID NO: 3124518 - protein, 8 aa, Giardia lamblia
NGASIPSD

SEQ ID NO: 3124519 - protein, 5 aa, Giardia lamblia
NGASP

SEQ ID NO: 3124520 - protein, 5 aa, Giardia lamblia
NGASR

SEQ ID NO: 3124521 - protein, 6 aa, Giardia lamblia
NGASSA

SEQ ID NO: 3124522 - protein, 26 aa, Giardia lamblia
NGASSSQSSKRHTEAHTLPSKPANES

SEQ ID NO: 3124523 - protein, 10 aa, Giardia lamblia
NGASTGPFSP

SEQ ID NO: 3124524 - protein, 7 aa, Giardia lamblia
NGATARG

SEQ ID NO: 3124525 - protein, 6 aa, Giardia lamblia
NGATIT

SEQ ID NO: 3124526 - protein, 8 aa, Giardia lamblia
NGAWTGET

SEQ ID NO: 3124527 - protein, 8 aa, Giardia lamblia
NGAYPTSN

SEQ ID NO: 3124528 - protein, 19 aa, Giardia lamblia
NGCDEPCDKNGGVRNLNPA

SEQ ID NO: 3124529 - protein, 13 aa, Giardia lamblia
NGCPNPQSQSSID

SEQ ID NO: 3124530 - protein, 4 aa, Giardia lamblia
NGCT

SEQ ID NO: 3124531 - protein, 6 aa, Giardia lamblia
NGCTTK

SEQ ID NO: 3124532 - protein, 8 aa, Giardia lamblia
NGDANQVK

SEQ ID NO: 3124533 - protein, 5 aa, Giardia lamblia
NGDAR

SEQ ID NO: 3124534 - protein, 4 aa, Giardia lamblia
NGDE

SEQ ID NO: 3124535 - protein, 9 aa, Giardia lamblia
NGDEVADPT

SEQ ID NO: 3124536 - protein, 9 aa, Giardia lamblia
NGDGNITTA

SEQ ID NO: 3124537 - protein, 6 aa, Giardia lamblia
NGDGYV

SEQ ID NO: 3124538 - protein, 7 aa, Giardia lamblia
NGDNDQF

SEQ ID NO: 3124539 - protein, 8 aa, Giardia lamblia
NGDNPDHE

SEQ ID NO: 3124540 - protein, 8 aa, Giardia lamblia
NGDQYIPS

SEQ ID NO: 3124541 - protein, 6 aa, Giardia lamblia
NGDREK

SEQ ID NO: 3124542 - protein, 23 aa, Giardia lamblia
NGDSHDPSSSTGLSAERKKAKTL

SEQ ID NO: 3124543 - protein, 5 aa, Giardia lamblia
NGDSR

SEQ ID NO: 3124544 - protein, 5 aa, Giardia lamblia
NGDTA

SEQ ID NO: 3124545 - protein, 6 aa, Giardia lamblia
NGDTAL

SEQ ID NO: 3124546 - protein, 5 aa, Giardia lamblia
NGDTD

SEQ ID NO: 3124547 - protein, 5 aa, Giardia lamblia
NGEAK

SEQ ID NO: 3124548 - protein, 25 aa, Giardia lamblia
NGEGYTRRQRGAKKSRAVTSDDPIP

SEQ ID NO: 3124549 - protein, 5 aa, Giardia lamblia
NGEKD

SEQ ID NO: 3124550 - protein, 13 aa, Giardia lamblia
NGELETSASPLGG

SEQ ID NO: 3124551 - protein, 15 aa, Giardia lamblia
NGELSRAKAGQARLQ

SEQ ID NO: 3124552 - protein, 11 aa, Giardia lamblia
NGELSSGTNEI

SEQ ID NO: 3124553 - protein, 7 aa, Giardia lamblia
NGENSLV

SEQ ID NO: 3124554 - protein, 6 aa, Giardia lamblia
NGEPKQ

SEQ ID NO: 3124555 - protein, 41 aa, Giardia lamblia
NGERKKKSLVEDTETPEEANEEDEGRKKRKRKVKPEPPTEH

SEQ ID NO: 3124556 - protein, 15 aa, Giardia lamblia
NGERLEETKKINSSL

SEQ ID NO: 3124557 - protein, 4 aa, Giardia lamblia
NGES

SEQ ID NO: 3124558 - protein, 9 aa, Giardia lamblia
NGESFSGGE

SEQ ID NO: 3124559 - protein, 10 aa, Giardia lamblia
NGESKSVTDS

SEQ ID NO: 3124560 - protein, 5 aa, Giardia lamblia
NGEVD

SEQ ID NO: 3124561 - protein, 14 aa, Giardia lamblia
NGEVHTDGNSGQAS

SEQ ID NO: 3124562 - protein, 4 aa, Giardia lamblia
NGFS

SEQ ID NO: 3124563 - protein, 4 aa, Giardia lamblia
NGFT

SEQ ID NO: 3124564 - protein, 6 aa, Giardia lamblia
NGGDPS

SEQ ID NO: 3124565 - protein, 14 aa, Giardia lamblia
NGGGGGYAVCLRRI

SEQ ID NO: 3124566 - protein, 16 aa, Giardia lamblia
NGGGGPGGTCSATSKA

SEQ ID NO: 3124567 - protein, 6 aa, Giardia lamblia
NGGKDN

SEQ ID NO: 3124568 - protein, 4 aa, Giardia lamblia
NGGL

SEQ ID NO: 3124569 - protein, 5 aa, Giardia lamblia
NGGNM

SEQ ID NO: 3124570 - protein, 8 aa, Giardia lamblia
NGGPEPSN

SEQ ID NO: 3124571 - protein, 7 aa, Giardia lamblia
NGGQAHR

SEQ ID NO: 3124572 - protein, 24 aa, Giardia lamblia
NGGQGQAPMTISSSSGGPYSYSSA

SEQ ID NO: 3124573 - protein, 11 aa, Giardia lamblia
NGGSRRESDAS

SEQ ID NO: 3124574 - protein, 5 aa, Giardia lamblia
NGGTL

SEQ ID NO: 3124575 - protein, 8 aa, Giardia lamblia
NGGYDGEE

SEQ ID NO: 3124576 - protein, 16 aa, Giardia lamblia
NGGYQPPAANQKLSAA

SEQ ID NO: 3124577 - protein, 5 aa, Giardia lamblia
NGHAD

SEQ ID NO: 3124578 - protein, 4 aa, Giardia lamblia
NGHD

SEQ ID NO: 3124579 - protein, 4 aa, Giardia lamblia
NGHE

SEQ ID NO: 3124580 - protein, 4 aa, Giardia lamblia
NGHL

SEQ ID NO: 3124581 - protein, 7 aa, Giardia lamblia
NGHPANA

SEQ ID NO: 3124582 - protein, 6 aa, Giardia lamblia
NGHPGA

SEQ ID NO: 3124583 - protein, 16 aa, Giardia lamblia
NGHRSNEEKALEEVER

SEQ ID NO: 3124584 - protein, 4 aa, Giardia lamblia
NGHS

SEQ ID NO: 3124585 - protein, 5 aa, Giardia lamblia
NGHSD

SEQ ID NO: 3124586 - protein, 5 aa, Giardia lamblia
NGHTA

SEQ ID NO: 3124587 - protein, 5 aa, Giardia lamblia
NGHTD

SEQ ID NO: 3124588 - protein, 6 aa, Giardia lamblia
NGHTEA

SEQ ID NO: 3124589 - protein, 8 aa, Giardia lamblia
NGIARQSD

SEQ ID NO: 3124590 - protein, 22 aa, Giardia lamblia
NGIDTPVEQASAPPVSPTKTIS

SEQ ID NO: 3124591 - protein, 8 aa, Giardia lamblia
NGIGKSTA

SEQ ID NO: 3124592 - protein, 11 aa, Giardia lamblia
NGIGSSSDKAL

SEQ ID NO: 3124593 - protein, 12 aa, Giardia lamblia
NGISTDGGDIDS

SEQ ID NO: 3124594 - protein, 9 aa, Giardia lamblia
NGKAVKMPS

SEQ ID NO: 3124595 - protein, 4 aa, Giardia lamblia
NGKD

SEQ ID NO: 3124596 - protein, 9 aa, Giardia lamblia
NGKDPMSKR

SEQ ID NO: 3124597 - protein, 8 aa, Giardia lamblia
NGKEISTK

SEQ ID NO: 3124598 - protein, 5 aa, Giardia lamblia
NGKHS

SEQ ID NO: 3124599 - protein, 6 aa, Giardia lamblia
NGKNAI

SEQ ID NO: 3124600 - protein, 9 aa, Giardia lamblia
NGKNNEADH

SEQ ID NO: 3124601 - protein, 5 aa, Giardia lamblia
NGKPN

SEQ ID NO: 3124602 - protein, 9 aa, Giardia lamblia
NGKRAGADH

SEQ ID NO: 3124603 - protein, 5 aa, Giardia lamblia
NGKRL

SEQ ID NO: 3124604 - protein, 13 aa, Giardia lamblia
NGKRRAHLNPNGF

SEQ ID NO: 3124605 - protein, 10 aa, Giardia lamblia
NGKSSIVEGQ

SEQ ID NO: 3124606 - protein, 7 aa, Giardia lamblia
NGKTAEV

SEQ ID NO: 3124607 - protein, 8 aa, Giardia lamblia
NGLKPNDT

SEQ ID NO: 3124608 - protein, 11 aa, Giardia lamblia
NGLKSTEASSL

SEQ ID NO: 3124609 - protein, 9 aa, Giardia lamblia
NGLPPDTSG

SEQ ID NO: 3124610 - protein, 9 aa, Giardia lamblia
NGLQSNNGM

SEQ ID NO: 3124611 - protein, 19 aa, Giardia lamblia
NGLQTDSHHESQDSPKVRV

SEQ ID NO: 3124612 - protein, 4 aa, Giardia lamblia
NGLR

SEQ ID NO: 3124613 - protein, 9 aa, Giardia lamblia
NGLRNGNGT

SEQ ID NO: 3124614 - protein, 7 aa, Giardia lamblia
NGLTDAE

SEQ ID NO: 3124615 - protein, 13 aa, Giardia lamblia
NGMKATKRSLPSF

SEQ ID NO: 3124616 - protein, 9 aa, Giardia lamblia
NGMKSSTEL

SEQ ID NO: 3124617 - protein, 4 aa, Giardia lamblia
NGMQ

SEQ ID NO: 3124618 - protein, 5 aa, Giardia lamblia
NGMTG

SEQ ID NO: 3124619 - protein, 5 aa, Giardia lamblia
NGNAS

SEQ ID NO: 3124620 - protein, 5 aa, Giardia lamblia
NGNAY

SEQ ID NO: 3124621 - protein, 10 aa, Giardia lamblia
NGNESISRSV

SEQ ID NO: 3124622 - protein, 5 aa, Giardia lamblia
NGNHG

SEQ ID NO: 3124623 - protein, 4 aa, Giardia lamblia
NGNI

SEQ ID NO: 3124624 - protein, 5 aa, Giardia lamblia
NGNIV

SEQ ID NO: 3124625 - protein, 5 aa, Giardia lamblia
NGNLD

SEQ ID NO: 3124626 - protein, 7 aa, Giardia lamblia
NGNLTEA

SEQ ID NO: 3124627 - protein, 5 aa, Giardia lamblia
NGNPE

SEQ ID NO: 3124628 - protein, 6 aa, Giardia lamblia
NGNPTV

SEQ ID NO: 3124629 - protein, 9 aa, Giardia lamblia
NGNRYPGAV

SEQ ID NO: 3124630 - protein, 8 aa, Giardia lamblia
NGNSCTDT

SEQ ID NO: 3124631 - protein, 8 aa, Giardia lamblia
NGNTSVKH

SEQ ID NO: 3124632 - protein, 4 aa, Giardia lamblia
NGNV

SEQ ID NO: 3124633 - protein, 18 aa, Giardia lamblia
NGPANAGSEANPSKGGME

SEQ ID NO: 3124634 - protein, 14 aa, Giardia lamblia
NGPEAQDAGTADDE

SEQ ID NO: 3124635 - protein, 8 aa, Giardia lamblia
NGPEPAEN

SEQ ID NO: 3124636 - protein, 7 aa, Giardia lamblia
NGPKGLM

SEQ ID NO: 3124637 - protein, 9 aa, Giardia lamblia
NGPTVTQDV

SEQ ID NO: 3124638 - protein, 19 aa, Giardia lamblia
NGPVSQQEVDKRTPPRTVR

SEQ ID NO: 3124639 - protein, 14 aa, Giardia lamblia
NGQARTSAQARQVE

SEQ ID NO: 3124640 - protein, 4 aa, Giardia lamblia
NGQD

SEQ ID NO: 3124641 - protein, 8 aa, Giardia lamblia
NGQEKAAQ

SEQ ID NO: 3124642 - protein, 9 aa, Giardia lamblia
NGQKTHGSS

SEQ ID NO: 3124643 - protein, 8 aa, Giardia lamblia
NGQNKTAC

SEQ ID NO: 3124644 - protein, 21 aa, Giardia lamblia
NGQRATSRPPLQRTYGEEPQA

SEQ ID NO: 3124645 - protein, 4 aa, Giardia lamblia
NGQT

SEQ ID NO: 3124646 - protein, 4 aa, Giardia lamblia
NGQV

SEQ ID NO: 3124647 - protein, 7 aa, Giardia lamblia
NGRAETF

SEQ ID NO: 3124648 - protein, 8 aa, Giardia lamblia
NGRAGLDK

SEQ ID NO: 3124649 - protein, 7 aa, Giardia lamblia
NGRAPTA

SEQ ID NO: 3124650 - protein, 10 aa, Giardia lamblia
NGRDSADASI

SEQ ID NO: 3124651 - protein, 5 aa, Giardia lamblia
NGRDV

SEQ ID NO: 3124652 - protein, 4 aa, Giardia lamblia
NGRE

SEQ ID NO: 3124653 - protein, 5 aa, Giardia lamblia
NGREK

SEQ ID NO: 3124654 - protein, 5 aa, Giardia lamblia
NGRKS

SEQ ID NO: 3124655 - protein, 4 aa, Giardia lamblia
NGRL

SEQ ID NO: 3124656 - protein, 10 aa, Giardia lamblia
NGRQIGGGGL

SEQ ID NO: 3124657 - protein, 26 aa, Giardia lamblia
NGRSTKETPWEEDNDQVGCNSDGSIA

SEQ ID NO: 3124658 - protein, 4 aa, Giardia lamblia
NGRT

SEQ ID NO: 3124659 - protein, 6 aa, Giardia lamblia
NGRTGK

SEQ ID NO: 3124660 - protein, 4 aa, Giardia lamblia
NGRV

SEQ ID NO: 3124661 - protein, 9 aa, Giardia lamblia
NGRVYGSEA

SEQ ID NO: 3124662 - protein, 4 aa, Giardia lamblia
NGSA

SEQ ID NO: 3124663 - protein, 8 aa, Giardia lamblia
NGSEETNI

SEQ ID NO: 3124664 - protein, 7 aa, Giardia lamblia
NGSFNTR

SEQ ID NO: 3124665 - protein, 4 aa, Giardia lamblia
NGSI

SEQ ID NO: 3124666 - protein, 13 aa, Giardia lamblia
NGSIANSISGGNR

SEQ ID NO: 3124667 - protein, 5 aa, Giardia lamblia
NGSIN

SEQ ID NO: 3124668 - protein, 13 aa, Giardia lamblia
NGSISGAEAGCQA

SEQ ID NO: 3124669 - protein, 4 aa, Giardia lamblia
NGSL

SEQ ID NO: 3124670 - protein, 6 aa, Giardia lamblia
NGSLSA

SEQ ID NO: 3124671 - protein, 11 aa, Giardia lamblia
NGSMDASLGPG

SEQ ID NO: 3124672 - protein, 6 aa, Giardia lamblia
NGSNVR

SEQ ID NO: 3124673 - protein, 10 aa, Giardia lamblia
NGSPGPLPPN

SEQ ID NO: 3124674 - protein, 10 aa, Giardia lamblia
NGSPNLDGES

SEQ ID NO: 3124675 - protein, 5 aa, Giardia lamblia
NGSPQ

SEQ ID NO: 3124676 - protein, 8 aa, Giardia lamblia
NGSQGNNS

SEQ ID NO: 3124677 - protein, 25 aa, Giardia lamblia
NGSREGFSGNNRGGCKPHKMLLVNG

SEQ ID NO: 3124678 - protein, 7 aa, Giardia lamblia
NGSSPLD

SEQ ID NO: 3124679 - protein, 11 aa, Giardia lamblia
NGSSSRPDTAK

SEQ ID NO: 3124680 - protein, 10 aa, Giardia lamblia
NGSSVKSTLG

SEQ ID NO: 3124681 - protein, 5 aa, Giardia lamblia
NGSTR

SEQ ID NO: 3124682 - protein, 11 aa, Giardia lamblia
NGTDGPKPASI

SEQ ID NO: 3124683 - protein, 8 aa, Giardia lamblia
NGTDSKLM

SEQ ID NO: 3124684 - protein, 7 aa, Giardia lamblia
NGTEATV

SEQ ID NO: 3124685 - protein, 5 aa, Giardia lamblia
NGTGN

SEQ ID NO: 3124686 - protein, 6 aa, Giardia lamblia
NGTINP

SEQ ID NO: 3124687 - protein, 5 aa, Giardia lamblia
NGTIT

SEQ ID NO: 3124688 - protein, 20 aa, Giardia lamblia
NGTKSSDTPMPIENPSDTIG

SEQ ID NO: 3124689 - protein, 5 aa, Giardia lamblia
NGTNF

SEQ ID NO: 3124690 - protein, 6 aa, Giardia lamblia
NGTNTY

SEQ ID NO: 3124691 - protein, 5 aa, Giardia lamblia
NGTPE

SEQ ID NO: 3124692 - protein, 10 aa, Giardia lamblia
NGTPLQQPHS

SEQ ID NO: 3124693 - protein, 11 aa, Giardia lamblia
NGTPPVPGSSS

SEQ ID NO: 3124694 - protein, 6 aa, Giardia lamblia
NGTRTQ

SEQ ID NO: 3124695 - protein, 6 aa, Giardia lamblia
NGTSNM

SEQ ID NO: 3124696 - protein, 5 aa, Giardia lamblia
NGTST

SEQ ID NO: 3124697 - protein, 4 aa, Giardia lamblia
NGTT

SEQ ID NO: 3124698 - protein, 4 aa, Giardia lamblia
NGTV

SEQ ID NO: 3124699 - protein, 9 aa, Giardia lamblia
NGTVAEGSE

SEQ ID NO: 3124700 - protein, 5 aa, Giardia lamblia
NGTVN

SEQ ID NO: 3124701 - protein, 10 aa, Giardia lamblia
NGTYDQQAQD

SEQ ID NO: 3124702 - protein, 12 aa, Giardia lamblia
NGVGGKTADAIK

SEQ ID NO: 3124703 - protein, 14 aa, Giardia lamblia
NGVGGSSSSSASVA

SEQ ID NO: 3124704 - protein, 9 aa, Giardia lamblia
NGVKRDTYQ

SEQ ID NO: 3124705 - protein, 5 aa, Giardia lamblia
NGVSS

SEQ ID NO: 3124706 - protein, 5 aa, Giardia lamblia
NGVTD

SEQ ID NO: 3124707 - protein, 5 aa, Giardia lamblia
NGVTP

SEQ ID NO: 3124708 - protein, 8 aa, Giardia lamblia
NGWRPKDN

SEQ ID NO: 3124709 - protein, 20 aa, Giardia lamblia
NGYDQPVSDSDDSQPPEYEI

SEQ ID NO: 3124710 - protein, 4 aa, Giardia lamblia
NGYE

SEQ ID NO: 3124711 - protein, 4 aa, Giardia lamblia
NGYS

SEQ ID NO: 3124712 - protein, 5 aa, Giardia lamblia
NGYSE

SEQ ID NO: 3124713 - protein, 11 aa, Giardia lamblia
NGYSGSKGSKP

SEQ ID NO: 3124714 - protein, 5 aa, Giardia lamblia
NGYSN

SEQ ID NO: 3124715 - protein, 11 aa, Giardia lamblia
NGYSPGPDSRL

SEQ ID NO: 3124716 - protein, 7 aa, Giardia lamblia
NGYSSPK

SEQ ID NO: 3124717 - protein, 4 aa, Giardia lamblia
NGYT

SEQ ID NO: 3124718 - protein, 8 aa, Giardia lamblia
NHAPTSAN

SEQ ID NO: 3124719 - protein, 8 aa, Giardia lamblia
NHCPNKSE

SEQ ID NO: 3124720 - protein, 9 aa, Giardia lamblia
NHDESPDAY

SEQ ID NO: 3124721 - protein, 9 aa, Giardia lamblia
NHDPGKSYP

SEQ ID NO: 3124722 - protein, 7 aa, Giardia lamblia
NHDPKNA

SEQ ID NO: 3124723 - protein, 5 aa, Giardia lamblia
NHDQK

SEQ ID NO: 3124724 - protein, 10 aa, Giardia lamblia
NHDTATCTTR

SEQ ID NO: 3124725 - protein, 6 aa, Giardia lamblia
NHEDEK

SEQ ID NO: 3124726 - protein, 5 aa, Giardia lamblia
NHEGH

SEQ ID NO: 3124727 - protein, 10 aa, Giardia lamblia
NHENSEDTSV

SEQ ID NO: 3124728 - protein, 7 aa, Giardia lamblia
NHESRQI

SEQ ID NO: 3124729 - protein, 16 aa, Giardia lamblia
NHETESVNSNYSLPAE

SEQ ID NO: 3124730 - protein, 33 aa, Giardia lamblia
NHETKEHDSVQSQGPVAEDKSVDVEGGEEPLRK

SEQ ID NO: 3124731 - protein, 5 aa, Giardia lamblia
NHFEH

SEQ ID NO: 3124732 - protein, 8 aa, Giardia lamblia
NHFGQNGG

SEQ ID NO: 3124733 - protein, 11 aa, Giardia lamblia
NHGCGYQGGPC

SEQ ID NO: 3124734 - protein, 6 aa, Giardia lamblia
NHGRSR

SEQ ID NO: 3124735 - protein, 5 aa, Giardia lamblia
NHGTT

SEQ ID NO: 3124736 - protein, 8 aa, Giardia lamblia
NHHPEKNN

SEQ ID NO: 3124737 - protein, 7 aa, Giardia lamblia
NHINGGE

SEQ ID NO: 3124738 - protein, 7 aa, Giardia lamblia
NHKATSA

SEQ ID NO: 3124739 - protein, 36 aa, Giardia lamblia
NHKTEDDSSDSNDDDDGSSIGSDEPQHGKHSKHSKD

SEQ ID NO: 3124740 - protein, 17 aa, Giardia lamblia
NHLTDKSLSDLKSTSLR

SEQ ID NO: 3124741 - protein, 7 aa, Giardia lamblia
NHNPGTI

SEQ ID NO: 3124742 - protein, 5 aa, Giardia lamblia
NHNTA

SEQ ID NO: 3124743 - protein, 9 aa, Giardia lamblia
NHPEAGIDT

SEQ ID NO: 3124744 - protein, 18 aa, Giardia lamblia
NHPEAYSSVKQANESSKK

SEQ ID NO: 3124745 - protein, 6 aa, Giardia lamblia
NHPEEY

SEQ ID NO: 3124746 - protein, 20 aa, Giardia lamblia
NHPHKKQSKQSHGARAQTSY

SEQ ID NO: 3124747 - protein, 9 aa, Giardia lamblia
NHPQRGPFH

SEQ ID NO: 3124748 - protein, 6 aa, Giardia lamblia
NHQSSS

SEQ ID NO: 3124749 - protein, 6 aa, Giardia lamblia
NHREVS

SEQ ID NO: 3124750 - protein, 10 aa, Giardia lamblia
NHRKEEDTRQ

SEQ ID NO: 3124751 - protein, 5 aa, Giardia lamblia
NHSGF

SEQ ID NO: 3124752 - protein, 8 aa, Giardia lamblia
NHSGQEIS

SEQ ID NO: 3124753 - protein, 8 aa, Giardia lamblia
NHSITNPV

SEQ ID NO: 3124754 - protein, 4 aa, Giardia lamblia
NHSN

SEQ ID NO: 3124755 - protein, 12 aa, Giardia lamblia
NHSPADSAAELE

SEQ ID NO: 3124756 - protein, 9 aa, Giardia lamblia
NHSPTPDMV

SEQ ID NO: 3124757 - protein, 9 aa, Giardia lamblia
NHTGKINPQ

SEQ ID NO: 3124758 - protein, 12 aa, Giardia lamblia
NHTGRNLRGRRS

SEQ ID NO: 3124759 - protein, 18 aa, Giardia lamblia
NHTSQPRSSTIPKTTGSQ

SEQ ID NO: 3124760 - protein, 8 aa, Giardia lamblia
NHYPPTEL

SEQ ID NO: 3124761 - protein, 8 aa, Giardia lamblia
NHYTGGHA

SEQ ID NO: 3124762 - protein, 10 aa, Giardia lamblia
NIAPSQAGID

SEQ ID NO: 3124763 - protein, 10 aa, Giardia lamblia
NIATEDDRKR

SEQ ID NO: 3124764 - protein, 5 aa, Giardia lamblia
NICPS

SEQ ID NO: 3124765 - protein, 7 aa, Giardia lamblia
NIDNTER

SEQ ID NO: 3124766 - protein, 8 aa, Giardia lamblia
NIDSSYYN

SEQ ID NO: 3124767 - protein, 5 aa, Giardia lamblia
NIGEE

SEQ ID NO: 3124768 - protein, 7 aa, Giardia lamblia
NIGETQT

SEQ ID NO: 3124769 - protein, 5 aa, Giardia lamblia
NIGNY

SEQ ID NO: 3124770 - protein, 6 aa, Giardia lamblia
NIGPGA

SEQ ID NO: 3124771 - protein, 4 aa, Giardia lamblia
NIGT

SEQ ID NO: 3124772 - protein, 7 aa, Giardia lamblia
NIHTPHD

SEQ ID NO: 3124773 - protein, 18 aa, Giardia lamblia
NIKAPAQQDYASLDPATA

SEQ ID NO: 3124774 - protein, 9 aa, Giardia lamblia
NIKEDDMKN

SEQ ID NO: 3124775 - protein, 5 aa, Giardia lamblia
NIKEP

SEQ ID NO: 3124776 - protein, 9 aa, Giardia lamblia
NIKLPNGDT

SEQ ID NO: 3124777 - protein, 4 aa, Giardia lamblia
NIKP

SEQ ID NO: 3124778 - protein, 7 aa, Giardia lamblia
NIKPKTL

SEQ ID NO: 3124779 - protein, 4 aa, Giardia lamblia
NINK

SEQ ID NO: 3124780 - protein, 13 aa, Giardia lamblia
NIPARSADSRPTI

SEQ ID NO: 3124781 - protein, 12 aa, Giardia lamblia
NIPATNKAVSRQ

SEQ ID NO: 3124782 - protein, 7 aa, Giardia lamblia
NIPDQFT

SEQ ID NO: 3124783 - protein, 19 aa, Giardia lamblia
NIPGPTPSNPSVTQQSEQQ

SEQ ID NO: 3124784 - protein, 9 aa, Giardia lamblia
NIPGYNAKA

SEQ ID NO: 3124785 - protein, 6 aa, Giardia lamblia
NIPKTD

SEQ ID NO: 3124786 - protein, 11 aa, Giardia lamblia
NIPSTEESQEQ

SEQ ID NO: 3124787 - protein, 7 aa, Giardia lamblia
NIPSTTL

SEQ ID NO: 3124788 - protein, 7 aa, Giardia lamblia
NIPTADN

SEQ ID NO: 3124789 - protein, 10 aa, Giardia lamblia
NIPTDSRPDT

SEQ ID NO: 3124790 - protein, 4 aa, Giardia lamblia
NIPV

SEQ ID NO: 3124791 - protein, 7 aa, Giardia lamblia
NIQPGSR

SEQ ID NO: 3124792 - protein, 5 aa, Giardia lamblia
NIQPS

SEQ ID NO: 3124793 - protein, 12 aa, Giardia lamblia
NIQRRQAIPEAE

SEQ ID NO: 3124794 - protein, 9 aa, Giardia lamblia
NIRASSPSH

SEQ ID NO: 3124795 - protein, 5 aa, Giardia lamblia
NIRDG

SEQ ID NO: 3124796 - protein, 12 aa, Giardia lamblia
NIRSRSPSTQLA

SEQ ID NO: 3124797 - protein, 16 aa, Giardia lamblia
NIRTRKTELEQSKRAS

SEQ ID NO: 3124798 - protein, 13 aa, Giardia lamblia
NISAENPQTTEYK

SEQ ID NO: 3124799 - protein, 13 aa, Giardia lamblia
NISKEQRKKLETY

SEQ ID NO: 3124800 - protein, 6 aa, Giardia lamblia
NISPGD

SEQ ID NO: 3124801 - protein, 13 aa, Giardia lamblia
NISPSKKCNSTDP

SEQ ID NO: 3124802 - protein, 5 aa, Giardia lamblia
NITDD

SEQ ID NO: 3124803 - protein, 5 aa, Giardia lamblia
NITEA

SEQ ID NO: 3124804 - protein, 15 aa, Giardia lamblia
NITESGTSRKGPRTE

SEQ ID NO: 3124805 - protein, 9 aa, Giardia lamblia
NITPPISNS

SEQ ID NO: 3124806 - protein, 8 aa, Giardia lamblia
NITPPTAP

SEQ ID NO: 3124807 - protein, 8 aa, Giardia lamblia
NITQRDEQ

SEQ ID NO: 3124808 - protein, 26 aa, Giardia lamblia
NITSNDNITENRAPQPLTSDMSSASS

SEQ ID NO: 3124809 - protein, 17 aa, Giardia lamblia
NITSNRDKETAPPELPG

SEQ ID NO: 3124810 - protein, 14 aa, Giardia lamblia
NITSTPGKAPTSIP

SEQ ID NO: 3124811 - protein, 17 aa, Giardia lamblia
NITTPRRLSSGGLSENK

SEQ ID NO: 3124812 - protein, 23 aa, Giardia lamblia
NIYGPDDVKSAALTANNSGYPDM

SEQ ID NO: 3124813 - protein, 16 aa, Giardia lamblia
NKAASSTVSRRSSDLP

SEQ ID NO: 3124814 - protein, 8 aa, Giardia lamblia
NKADGSLA

SEQ ID NO: 3124815 - protein, 6 aa, Giardia lamblia
NKADPT

SEQ ID NO: 3124816 - protein, 4 aa, Giardia lamblia
NKAE

SEQ ID NO: 3124817 - protein, 9 aa, Giardia lamblia
NKAEDAAAF

SEQ ID NO: 3124818 - protein, 8 aa, Giardia lamblia
NKAESAET

SEQ ID NO: 3124819 - protein, 9 aa, Giardia lamblia
NKAETKDSK

SEQ ID NO: 3124820 - protein, 6 aa, Giardia lamblia
NKAGRT

SEQ ID NO: 3124821 - protein, 8 aa, Giardia lamblia
NKAKRCQD

SEQ ID NO: 3124822 - protein, 11 aa, Giardia lamblia
NKAQMNSSKAP

SEQ ID NO: 3124823 - protein, 7 aa, Giardia lamblia
NKARAAD

SEQ ID NO: 3124824 - protein, 6 aa, Giardia lamblia
NKAREE

SEQ ID NO: 3124825 - protein, 10 aa, Giardia lamblia
NKARETDKGV

SEQ ID NO: 3124826 - protein, 7 aa, Giardia lamblia
NKASPSY

SEQ ID NO: 3124827 - protein, 5 aa, Giardia lamblia
NKCEE

SEQ ID NO: 3124828 - protein, 4 aa, Giardia lamblia
NKCK

SEQ ID NO: 3124829 - protein, 6 aa, Giardia lamblia
NKDEEI

SEQ ID NO: 3124830 - protein, 8 aa, Giardia lamblia
NKDEETEF

SEQ ID NO: 3124831 - protein, 6 aa, Giardia lamblia
NKDESD

SEQ ID NO: 3124832 - protein, 7 aa, Giardia lamblia
NKDGGRE

SEQ ID NO: 3124833 - protein, 8 aa, Giardia lamblia
NKDGKGVG

SEQ ID NO: 3124834 - protein, 6 aa, Giardia lamblia
NKDGKT

SEQ ID NO: 3124835 - protein, 5 aa, Giardia lamblia
NKDGL

SEQ ID NO: 3124836 - protein, 5 aa, Giardia lamblia
NKDGM

SEQ ID NO: 3124837 - protein, 6 aa, Giardia lamblia
NKDGQT

SEQ ID NO: 3124838 - protein, 9 aa, Giardia lamblia
NKDKAEHAY

SEQ ID NO: 3124839 - protein, 9 aa, Giardia lamblia
NKDKEMTTR

SEQ ID NO: 3124840 - protein, 8 aa, Giardia lamblia
NKDKETFE

SEQ ID NO: 3124841 - protein, 12 aa, Giardia lamblia
NKDKLGDDKPLR

SEQ ID NO: 3124842 - protein, 57 aa, Giardia lamblia
NKDNSCTTYGTASVNGDSQSESRTRVSSRQGSRASSRSRQRRSDASVDSNRTGRVDS

SEQ ID NO: 3124843 - protein, 16 aa, Giardia lamblia
NKDPHTDGAAPTADNN

SEQ ID NO: 3124844 - protein, 5 aa, Giardia lamblia
NKDRY

SEQ ID NO: 3124845 - protein, 4 aa, Giardia lamblia
NKDS

SEQ ID NO: 3124846 - protein, 9 aa, Giardia lamblia
NKDSAEQVY

SEQ ID NO: 3124847 - protein, 6 aa, Giardia lamblia
NKDSIA

SEQ ID NO: 3124848 - protein, 29 aa, Giardia lamblia
NKDSYNSLGYSGYNQNRPGSPQKSSGRAN

SEQ ID NO: 3124849 - protein, 4 aa, Giardia lamblia
NKDT

SEQ ID NO: 3124850 - protein, 6 aa, Giardia lamblia
NKDTIE

SEQ ID NO: 3124851 - protein, 15 aa, Giardia lamblia
NKDTQEAEVRPRPSI

SEQ ID NO: 3124852 - protein, 4 aa, Giardia lamblia
NKEE

SEQ ID NO: 3124853 - protein, 9 aa, Giardia lamblia
NKEEENAAL

SEQ ID NO: 3124854 - protein, 7 aa, Giardia lamblia
NKEEGDA

SEQ ID NO: 3124855 - protein, 5 aa, Giardia lamblia
NKEFY

SEQ ID NO: 3124856 - protein, 8 aa, Giardia lamblia
NKEGESNI

SEQ ID NO: 3124857 - protein, 9 aa, Giardia lamblia
NKEGNITAR

SEQ ID NO: 3124858 - protein, 6 aa, Giardia lamblia
NKEHDA

SEQ ID NO: 3124859 - protein, 6 aa, Giardia lamblia
NKEHNY

SEQ ID NO: 3124860 - protein, 4 aa, Giardia lamblia
NKEK

SEQ ID NO: 3124861 - protein, 12 aa, Giardia lamblia
NKEKANKTISDL

SEQ ID NO: 3124862 - protein, 6 aa, Giardia lamblia
NKEPNV

SEQ ID NO: 3124863 - protein, 23 aa, Giardia lamblia
NKEPSSVTGDTESSRSEMGTSHS

SEQ ID NO: 3124864 - protein, 8 aa, Giardia lamblia
NKEQEQTI

SEQ ID NO: 3124865 - protein, 16 aa, Giardia lamblia
NKEQKHAGTTPRSTAF

SEQ ID NO: 3124866 - protein, 4 aa, Giardia lamblia
NKER

SEQ ID NO: 3124867 - protein, 14 aa, Giardia lamblia
NKERGLRTKHNNTA

SEQ ID NO: 3124868 - protein, 26 aa, Giardia lamblia
NKERQSPNPVANDQSNGRPGDLPSGL

SEQ ID NO: 3124869 - protein, 4 aa, Giardia lamblia
NKES

SEQ ID NO: 3124870 - protein, 14 aa, Giardia lamblia
NKESIKEKEERTLQ

SEQ ID NO: 3124871 - protein, 6 aa, Giardia lamblia
NKESTA

SEQ ID NO: 3124872 - protein, 9 aa, Giardia lamblia
NKESTSDPR

SEQ ID NO: 3124873 - protein, 6 aa, Giardia lamblia
NKETGK

SEQ ID NO: 3124874 - protein, 6 aa, Giardia lamblia
NKETGY

SEQ ID NO: 3124875 - protein, 7 aa, Giardia lamblia
NKFTGQH

SEQ ID NO: 3124876 - protein, 4 aa, Giardia lamblia
NKGA

SEQ ID NO: 3124877 - protein, 7 aa, Giardia lamblia
NKGAIDQ

SEQ ID NO: 3124878 - protein, 8 aa, Giardia lamblia
NKGARDPV

SEQ ID NO: 3124879 - protein, 7 aa, Giardia lamblia
NKGDLSG

SEQ ID NO: 3124880 - protein, 4 aa, Giardia lamblia
NKGE

SEQ ID NO: 3124881 - protein, 4 aa, Giardia lamblia
NKGG

SEQ ID NO: 3124882 - protein, 8 aa, Giardia lamblia
NKGGGQTV

SEQ ID NO: 3124883 - protein, 4 aa, Giardia lamblia
NKGQ

SEQ ID NO: 3124884 - protein, 9 aa, Giardia lamblia
NKGSVDLPD

SEQ ID NO: 3124885 - protein, 8 aa, Giardia lamblia
NKGTEDGQ

SEQ ID NO: 3124886 - protein, 8 aa, Giardia lamblia
NKGTRDPV

SEQ ID NO: 3124887 - protein, 9 aa, Giardia lamblia
NKGVTISEQ

SEQ ID NO: 3124888 - protein, 9 aa, Giardia lamblia
NKHDADEIA

SEQ ID NO: 3124889 - protein, 7 aa, Giardia lamblia
NKHDASQ

SEQ ID NO: 3124890 - protein, 6 aa, Giardia lamblia
NKHDYV

SEQ ID NO: 3124891 - protein, 5 aa, Giardia lamblia
NKHEI

SEQ ID NO: 3124892 - protein, 4 aa, Giardia lamblia
NKHL

SEQ ID NO: 3124893 - protein, 11 aa, Giardia lamblia
NKIEKSSALAK

SEQ ID NO: 3124894 - protein, 6 aa, Giardia lamblia
NKIGNI

SEQ ID NO: 3124895 - protein, 4 aa, Giardia lamblia
NKIR

SEQ ID NO: 3124896 - protein, 7 aa, Giardia lamblia
NKISDSP

SEQ ID NO: 3124897 - protein, 10 aa, Giardia lamblia
NKISGTLTTS

SEQ ID NO: 3124898 - protein, 15 aa, Giardia lamblia
NKISSTGQQQDEQEV

SEQ ID NO: 3124899 - protein, 7 aa, Giardia lamblia
NKITEEK

SEQ ID NO: 3124900 - protein, 4 aa, Giardia lamblia
NKKA

SEQ ID NO: 3124901 - protein, 10 aa, Giardia lamblia
NKKASDDPDT

SEQ ID NO: 3124902 - protein, 9 aa, Giardia lamblia
NKKASKVSD

SEQ ID NO: 3124903 - protein, 9 aa, Giardia lamblia
NKKESKFNT

SEQ ID NO: 3124904 - protein, 9 aa, Giardia lamblia
NKKGATATY

SEQ ID NO: 3124905 - protein, 7 aa, Giardia lamblia
NKKGETA

SEQ ID NO: 3124906 - protein, 20 aa, Giardia lamblia
NKKGQESHVIPSDSSATYDE

SEQ ID NO: 3124907 - protein, 17 aa, Giardia lamblia
NKKHQQTVNEAAAESRE

SEQ ID NO: 3124908 - protein, 12 aa, Giardia lamblia
NKKIDSSDFSRR

SEQ ID NO: 3124909 - protein, 7 aa, Giardia lamblia
NKKKPVA

SEQ ID NO: 3124910 - protein, 10 aa, Giardia lamblia
NKKRKTRKLP

SEQ ID NO: 3124911 - protein, 8 aa, Giardia lamblia
NKKRPQKH

SEQ ID NO: 3124912 - protein, 9 aa, Giardia lamblia
NKKSSLSQK

SEQ ID NO: 3124913 - protein, 6 aa, Giardia lamblia
NKKSYS

SEQ ID NO: 3124914 - protein, 38 aa, Giardia lamblia
NKKTALDVTTQQSQRSLSASAHGAPHRRHSKTRPVNKT

SEQ ID NO: 3124915 - protein, 6 aa, Giardia lamblia
NKKVCS

SEQ ID NO: 3124916 - protein, 6 aa, Giardia lamblia
NKLAQD

SEQ ID NO: 3124917 - protein, 6 aa, Giardia lamblia
NKLDTL

SEQ ID NO: 3124918 - protein, 23 aa, Giardia lamblia
NKLGEATIKQDELEDTISDAQIK

SEQ ID NO: 3124919 - protein, 10 aa, Giardia lamblia
NKLKDEGNDL

SEQ ID NO: 3124920 - protein, 6 aa, Giardia lamblia
NKLNND

SEQ ID NO: 3124921 - protein, 9 aa, Giardia lamblia
NKLPPPDSI

SEQ ID NO: 3124922 - protein, 7 aa, Giardia lamblia
NKLRPDD

SEQ ID NO: 3124923 - protein, 6 aa, Giardia lamblia
NKLRSA

SEQ ID NO: 3124924 - protein, 14 aa, Giardia lamblia
NKLSAKAETNLTAN

SEQ ID NO: 3124925 - protein, 14 aa, Giardia lamblia
NKLSPSAEPDLSSR

SEQ ID NO: 3124926 - protein, 5 aa, Giardia lamblia
NKLSR

SEQ ID NO: 3124927 - protein, 8 aa, Giardia lamblia
NKLTPPKT

SEQ ID NO: 3124928 - protein, 6 aa, Giardia lamblia
NKMNQR

SEQ ID NO: 3124929 - protein, 8 aa, Giardia lamblia
NKMTTESG

SEQ ID NO: 3124930 - protein, 8 aa, Giardia lamblia
NKNEHPRA

SEQ ID NO: 3124931 - protein, 7 aa, Giardia lamblia
NKNGDAL

SEQ ID NO: 3124932 - protein, 8 aa, Giardia lamblia
NKNGEKAL

SEQ ID NO: 3124933 - protein, 7 aa, Giardia lamblia
NKNGLEA

SEQ ID NO: 3124934 - protein, 7 aa, Giardia lamblia
NKNGTIE

SEQ ID NO: 3124935 - protein, 6 aa, Giardia lamblia
NKNKQR

SEQ ID NO: 3124936 - protein, 7 aa, Giardia lamblia
NKNKSLT

SEQ ID NO: 3124937 - protein, 12 aa, Giardia lamblia
NKNNIDFGKDFY

SEQ ID NO: 3124938 - protein, 6 aa, Giardia lamblia
NKNRNI

SEQ ID NO: 3124939 - protein, 13 aa, Giardia lamblia
NKNSAKVKAVTNN

SEQ ID NO: 3124940 - protein, 16 aa, Giardia lamblia
NKNSLRNQLHGLSEIR

SEQ ID NO: 3124941 - protein, 15 aa, Giardia lamblia
NKPAISNFPPPDERR

SEQ ID NO: 3124942 - protein, 5 aa, Giardia lamblia
NKPAR

SEQ ID NO: 3124943 - protein, 6 aa, Giardia lamblia
NKPARG

SEQ ID NO: 3124944 - protein, 7 aa, Giardia lamblia
NKPASIH

SEQ ID NO: 3124945 - protein, 6 aa, Giardia lamblia
NKPDFH

SEQ ID NO: 3124946 - protein, 9 aa, Giardia lamblia
NKPDGQTIG

SEQ ID NO: 3124947 - protein, 8 aa, Giardia lamblia
NKPENQSL

SEQ ID NO: 3124948 - protein, 9 aa, Giardia lamblia
NKPGLRPPL

SEQ ID NO: 3124949 - protein, 8 aa, Giardia lamblia
NKPGTNVT

SEQ ID NO: 3124950 - protein, 6 aa, Giardia lamblia
NKPGYD

SEQ ID NO: 3124951 - protein, 5 aa, Giardia lamblia
NKPLD

SEQ ID NO: 3124952 - protein, 8 aa, Giardia lamblia
NKPNTDLA

SEQ ID NO: 3124953 - protein, 8 aa, Giardia lamblia
NKPPDYFG

SEQ ID NO: 3124954 - protein, 7 aa, Giardia lamblia
NKPPEIC

SEQ ID NO: 3124955 - protein, 7 aa, Giardia lamblia
NKPPHAD

SEQ ID NO: 3124956 - protein, 14 aa, Giardia lamblia
NKPPRPKRQQPADF

SEQ ID NO: 3124957 - protein, 6 aa, Giardia lamblia
NKPQVS

SEQ ID NO: 3124958 - protein, 4 aa, Giardia lamblia
NKPS

SEQ ID NO: 3124959 - protein, 10 aa, Giardia lamblia
NKPSPARKRA

SEQ ID NO: 3124960 - protein, 8 aa, Giardia lamblia
NKPTRPEH

SEQ ID NO: 3124961 - protein, 4 aa, Giardia lamblia
NKPV

SEQ ID NO: 3124962 - protein, 4 aa, Giardia lamblia
NKQA

SEQ ID NO: 3124963 - protein, 10 aa, Giardia lamblia
NKQAADLQQQ

SEQ ID NO: 3124964 - protein, 13 aa, Giardia lamblia
NKQAASRSLEDAQ

SEQ ID NO: 3124965 - protein, 16 aa, Giardia lamblia
NKQAFEPNTPIQESPY

SEQ ID NO: 3124966 - protein, 6 aa, Giardia lamblia
NKQAKD

SEQ ID NO: 3124967 - protein, 17 aa, Giardia lamblia
NKQDAKARKLEEEELRS

SEQ ID NO: 3124968 - protein, 8 aa, Giardia lamblia
NKQDERLK

SEQ ID NO: 3124969 - protein, 10 aa, Giardia lamblia
NKQEAEQESG

SEQ ID NO: 3124970 - protein, 6 aa, Giardia lamblia
NKQGKY

SEQ ID NO: 3124971 - protein, 7 aa, Giardia lamblia
NKQLSTQ

SEQ ID NO: 3124972 - protein, 13 aa, Giardia lamblia
NKQNDTTPQNSYS

SEQ ID NO: 3124973 - protein, 9 aa, Giardia lamblia
NKQPFTPYG

SEQ ID NO: 3124974 - protein, 4 aa, Giardia lamblia
NKQR

SEQ ID NO: 3124975 - protein, 8 aa, Giardia lamblia
NKQSGEAS

SEQ ID NO: 3124976 - protein, 7 aa, Giardia lamblia
NKQSLEQ

SEQ ID NO: 3124977 - protein, 24 aa, Giardia lamblia
NKQSPEPTGQVKPGAKSKAPPIEA

SEQ ID NO: 3124978 - protein, 12 aa, Giardia lamblia
NKQTSADEDVLS

SEQ ID NO: 3124979 - protein, 15 aa, Giardia lamblia
NKQYESSGQGGAGEE

SEQ ID NO: 3124980 - protein, 4 aa, Giardia lamblia
NKRE

SEQ ID NO: 3124981 - protein, 10 aa, Giardia lamblia
NKREEQEGAT

SEQ ID NO: 3124982 - protein, 5 aa, Giardia lamblia
NKREK

SEQ ID NO: 3124983 - protein, 6 aa, Giardia lamblia
NKRFSE

SEQ ID NO: 3124984 - protein, 6 aa, Giardia lamblia
NKRGKT

SEQ ID NO: 3124985 - protein, 10 aa, Giardia lamblia
NKRKQSQENL

SEQ ID NO: 3124986 - protein, 7 aa, Giardia lamblia
NKRLDER

SEQ ID NO: 3124987 - protein, 7 aa, Giardia lamblia
NKRLQQQ

SEQ ID NO: 3124988 - protein, 7 aa, Giardia lamblia
NKRLTAE

SEQ ID NO: 3124989 - protein, 7 aa, Giardia lamblia
NKRNGKS

SEQ ID NO: 3124990 - protein, 51 aa, Giardia lamblia
NKRNQFNTSSTSRRSSESERGANHAMQRSSSSGAWKATQHSSWDDSRNGEM

SEQ ID NO: 3124991 - protein, 58 aa, Giardia lamblia
NKRNSRTPISQRGRDQEQKEREEREREEREREERERLETEESAAPASQSAKTKAKTVL

SEQ ID NO: 3124992 - protein, 14 aa, Giardia lamblia
NKRNTSLEAEKEQL

SEQ ID NO: 3124993 - protein, 7 aa, Giardia lamblia
NKRRYNE

SEQ ID NO: 3124994 - protein, 6 aa, Giardia lamblia
NKRSAL

SEQ ID NO: 3124995 - protein, 12 aa, Giardia lamblia
NKRSDNAIASTE

SEQ ID NO: 3124996 - protein, 29 aa, Giardia lamblia
NKRTSAASAPLPASTSKSKGTIDPGSSTR

SEQ ID NO: 3124997 - protein, 10 aa, Giardia lamblia
NKRVNPDKTV

SEQ ID NO: 3124998 - protein, 14 aa, Giardia lamblia
NKRVSGELARAEQR

SEQ ID NO: 3124999 - protein, 8 aa, Giardia lamblia
NKSAHTKY

SEQ ID NO: 3125000 - protein, 6 aa, Giardia lamblia
NKSAPV

SEQ ID NO: 3125001 - protein, 25 aa, Giardia lamblia
NKSDAFSAGPANPDPSPDDKPLTMD

SEQ ID NO: 3125002 - protein, 7 aa, Giardia lamblia
NKSDSNQ

SEQ ID NO: 3125003 - protein, 16 aa, Giardia lamblia
NKSGADGDSAMGATKS

SEQ ID NO: 3125004 - protein, 9 aa, Giardia lamblia
NKSGAVPEL

SEQ ID NO: 3125005 - protein, 8 aa, Giardia lamblia
NKSGSQSI

SEQ ID NO: 3125006 - protein, 18 aa, Giardia lamblia
NKSIESETHSYTLKGHNS

SEQ ID NO: 3125007 - protein, 7 aa, Giardia lamblia
NKSLKTE

SEQ ID NO: 3125008 - protein, 8 aa, Giardia lamblia
NKSLPPDT

SEQ ID NO: 3125009 - protein, 18 aa, Giardia lamblia
NKSNEALERANTAKDKEL

SEQ ID NO: 3125010 - protein, 7 aa, Giardia lamblia
NKSPQQI

SEQ ID NO: 3125011 - protein, 18 aa, Giardia lamblia
NKSQTSAEGSSDASTLST

SEQ ID NO: 3125012 - protein, 8 aa, Giardia lamblia
NKSRKQQA

SEQ ID NO: 3125013 - protein, 5 aa, Giardia lamblia
NKSTE

SEQ ID NO: 3125014 - protein, 9 aa, Giardia lamblia
NKSTGGTLG

SEQ ID NO: 3125015 - protein, 17 aa, Giardia lamblia
NKSTPEEARQSSRENQE

SEQ ID NO: 3125016 - protein, 5 aa, Giardia lamblia
NKSYD

SEQ ID NO: 3125017 - protein, 12 aa, Giardia lamblia
NKSYGVSTAPPL

SEQ ID NO: 3125018 - protein, 10 aa, Giardia lamblia
NKSYKDSQGE

SEQ ID NO: 3125019 - protein, 7 aa, Giardia lamblia
NKSYTEK

SEQ ID NO: 3125020 - protein, 8 aa, Giardia lamblia
NKTANARQ

SEQ ID NO: 3125021 - protein, 42 aa, Giardia lamblia
NKTAYTASSFRKSTAASSSSKRTSAHKPRSPQSARQSALETY

SEQ ID NO: 3125022 - protein, 5 aa, Giardia lamblia
NKTGY

SEQ ID NO: 3125023 - protein, 5 aa, Giardia lamblia
NKTIR

SEQ ID NO: 3125024 - protein, 6 aa, Giardia lamblia
NKTLDE

SEQ ID NO: 3125025 - protein, 7 aa, Giardia lamblia
NKTNANE

SEQ ID NO: 3125026 - protein, 10 aa, Giardia lamblia
NKTNSLSSQN

SEQ ID NO: 3125027 - protein, 6 aa, Giardia lamblia
NKTPDI

SEQ ID NO: 3125028 - protein, 5 aa, Giardia lamblia
NKTPM

SEQ ID NO: 3125029 - protein, 17 aa, Giardia lamblia
NKTPRKKPSKSKNPMWD

SEQ ID NO: 3125030 - protein, 5 aa, Giardia lamblia
NKTRF

SEQ ID NO: 3125031 - protein, 15 aa, Giardia lamblia
NKTRQPADKIPEDIA

SEQ ID NO: 3125032 - protein, 11 aa, Giardia lamblia
NKTSEQAQSAF

SEQ ID NO: 3125033 - protein, 8 aa, Giardia lamblia
NKTSPASD

SEQ ID NO: 3125034 - protein, 7 aa, Giardia lamblia
NKTSTYS

SEQ ID NO: 3125035 - protein, 6 aa, Giardia lamblia
NKTTGF

SEQ ID NO: 3125036 - protein, 5 aa, Giardia lamblia
NKTTH

SEQ ID NO: 3125037 - protein, 7 aa, Giardia lamblia
NKTTIDQ

SEQ ID NO: 3125038 - protein, 9 aa, Giardia lamblia
NKTTPNYTS

SEQ ID NO: 3125039 - protein, 9 aa, Giardia lamblia
NKVAQSVGL

SEQ ID NO: 3125040 - protein, 10 aa, Giardia lamblia
NKVDEANGVT

SEQ ID NO: 3125041 - protein, 9 aa, Giardia lamblia
NKVDPTGQT

SEQ ID NO: 3125042 - protein, 5 aa, Giardia lamblia
NKVDQ

SEQ ID NO: 3125043 - protein, 4 aa, Giardia lamblia
NKVG

SEQ ID NO: 3125044 - protein, 17 aa, Giardia lamblia
NKVGALSSAGRRDKRGV

SEQ ID NO: 3125045 - protein, 16 aa, Giardia lamblia
NKVGDKEQFEAKKKEL

SEQ ID NO: 3125046 - protein, 9 aa, Giardia lamblia
NKVPGDDKD

SEQ ID NO: 3125047 - protein, 4 aa, Giardia lamblia
NKVQ

SEQ ID NO: 3125048 - protein, 10 aa, Giardia lamblia
NKVSASQGLQ

SEQ ID NO: 3125049 - protein, 6 aa, Giardia lamblia
NKYADG

SEQ ID NO: 3125050 - protein, 6 aa, Giardia lamblia
NKYATP

SEQ ID NO: 3125051 - protein, 6 aa, Giardia lamblia
NKYNVS

SEQ ID NO: 3125052 - protein, 8 aa, Giardia lamblia
NKYPSKQA

SEQ ID NO: 3125053 - protein, 8 aa, Giardia lamblia
NKYSAKTS

SEQ ID NO: 3125054 - protein, 10 aa, Giardia lamblia
NLAASADAES

SEQ ID NO: 3125055 - protein, 6 aa, Giardia lamblia
NLAESA

SEQ ID NO: 3125056 - protein, 7 aa, Giardia lamblia
NLANGNS

SEQ ID NO: 3125057 - protein, 12 aa, Giardia lamblia
NLANSSQANPLT

SEQ ID NO: 3125058 - protein, 43 aa, Giardia lamblia
NLDAPSAIPTRGYGSRSQSSPHSSISSASGLDDAEDPRNSECG

SEQ ID NO: 3125059 - protein, 11 aa, Giardia lamblia
NLDDKARDIST

SEQ ID NO: 3125060 - protein, 11 aa, Giardia lamblia
NLDEDPVEARQ

SEQ ID NO: 3125061 - protein, 11 aa, Giardia lamblia
NLDEEDADQYH

SEQ ID NO: 3125062 - protein, 7 aa, Giardia lamblia
NLDKNEE

SEQ ID NO: 3125063 - protein, 7 aa, Giardia lamblia
NLDNAST

SEQ ID NO: 3125064 - protein, 4 aa, Giardia lamblia
NLDQ

SEQ ID NO: 3125065 - protein, 14 aa, Giardia lamblia
NLDQAGSYNARGQT

SEQ ID NO: 3125066 - protein, 16 aa, Giardia lamblia
NLDRRSKDTLGPPGGR

SEQ ID NO: 3125067 - protein, 5 aa, Giardia lamblia
NLDSD

SEQ ID NO: 3125068 - protein, 6 aa, Giardia lamblia
NLDSND

SEQ ID NO: 3125069 - protein, 10 aa, Giardia lamblia
NLDSRAATRH

SEQ ID NO: 3125070 - protein, 20 aa, Giardia lamblia
NLDSSTTSAGLSSSAVNNEA

SEQ ID NO: 3125071 - protein, 8 aa, Giardia lamblia
NLEADETG

SEQ ID NO: 3125072 - protein, 5 aa, Giardia lamblia
NLEKP

SEQ ID NO: 3125073 - protein, 12 aa, Giardia lamblia
NLENRSGKRTHK

SEQ ID NO: 3125074 - protein, 7 aa, Giardia lamblia
NLEPQDV

SEQ ID NO: 3125075 - protein, 5 aa, Giardia lamblia
NLEQE

SEQ ID NO: 3125076 - protein, 8 aa, Giardia lamblia
NLEQQRNE

SEQ ID NO: 3125077 - protein, 8 aa, Giardia lamblia
NLERNNKK

SEQ ID NO: 3125078 - protein, 14 aa, Giardia lamblia
NLETGDATEEPAKA

SEQ ID NO: 3125079 - protein, 17 aa, Giardia lamblia
NLGDTGNTTQAAAVQDG

SEQ ID NO: 3125080 - protein, 15 aa, Giardia lamblia
NLGEPSQARSDDDRM

SEQ ID NO: 3125081 - protein, 5 aa, Giardia lamblia
NLGGD

SEQ ID NO: 3125082 - protein, 6 aa, Giardia lamblia
NLGKAS

SEQ ID NO: 3125083 - protein, 6 aa, Giardia lamblia
NLGNQR

SEQ ID NO: 3125084 - protein, 5 aa, Giardia lamblia
NLGPH

SEQ ID NO: 3125085 - protein, 5 aa, Giardia lamblia
NLGPP

SEQ ID NO: 3125086 - protein, 7 aa, Giardia lamblia
NLHTQSN

SEQ ID NO: 3125087 - protein, 5 aa, Giardia lamblia
NLKDR

SEQ ID NO: 3125088 - protein, 11 aa, Giardia lamblia
NLKKTKSEEEV

SEQ ID NO: 3125089 - protein, 4 aa, Giardia lamblia
NLKP

SEQ ID NO: 3125090 - protein, 9 aa, Giardia lamblia
NLKQKAKDC

SEQ ID NO: 3125091 - protein, 11 aa, Giardia lamblia
NLKTQEQDAER

SEQ ID NO: 3125092 - protein, 30 aa, Giardia lamblia
NLNNNTSDRSHALQGTAPTGIHQDDDNSDE

SEQ ID NO: 3125093 - protein, 5 aa, Giardia lamblia
NLNNV

SEQ ID NO: 3125094 - protein, 4 aa, Giardia lamblia
NLNP

SEQ ID NO: 3125095 - protein, 4 aa, Giardia lamblia
NLNV

SEQ ID NO: 3125096 - protein, 6 aa, Giardia lamblia
NLPEEL

SEQ ID NO: 3125097 - protein, 11 aa, Giardia lamblia
NLPGITTGQDY

SEQ ID NO: 3125098 - protein, 15 aa, Giardia lamblia
NLPHSPSRKKPSGYQ

SEQ ID NO: 3125099 - protein, 16 aa, Giardia lamblia
NLPKESKGSSPQEGRA

SEQ ID NO: 3125100 - protein, 9 aa, Giardia lamblia
NLPPEAKQA

SEQ ID NO: 3125101 - protein, 8 aa, Giardia lamblia
NLPPPITD

SEQ ID NO: 3125102 - protein, 17 aa, Giardia lamblia
NLPPSGRSSANTPGSYL

SEQ ID NO: 3125103 - protein, 7 aa, Giardia lamblia
NLPQGER

SEQ ID NO: 3125104 - protein, 61 aa, Giardia lamblia
NLPSQSDKSAPAQSVPEEDSGVKNKKPAEQLSNSDTDLRNENDQKSTDRTEEEPAQEQQKT

SEQ ID NO: 3125105 - protein, 7 aa, Giardia lamblia
NLPTTRS

SEQ ID NO: 3125106 - protein, 8 aa, Giardia lamblia
NLPYQPTD

SEQ ID NO: 3125107 - protein, 16 aa, Giardia lamblia
NLQANSDLGQNYSNGI

SEQ ID NO: 3125108 - protein, 9 aa, Giardia lamblia
NLQDDEGNT

SEQ ID NO: 3125109 - protein, 5 aa, Giardia lamblia
NLQED

SEQ ID NO: 3125110 - protein, 5 aa, Giardia lamblia
NLQET

SEQ ID NO: 3125111 - protein, 19 aa, Giardia lamblia
NLQGNHTAYPSEAVGVDED

SEQ ID NO: 3125112 - protein, 19 aa, Giardia lamblia
NLQPGNSHAPTNNDEDEVD

SEQ ID NO: 3125113 - protein, 12 aa, Giardia lamblia
NLQQGSKDSFCS

SEQ ID NO: 3125114 - protein, 11 aa, Giardia lamblia
NLQSSTSFPDN

SEQ ID NO: 3125115 - protein, 18 aa, Giardia lamblia
NLQTTSPRRSNYVTPGQA

SEQ ID NO: 3125116 - protein, 7 aa, Giardia lamblia
NLRANAT

SEQ ID NO: 3125117 - protein, 10 aa, Giardia lamblia
NLREANTELR

SEQ ID NO: 3125118 - protein, 10 aa, Giardia lamblia
NLREDVPPSA

SEQ ID NO: 3125119 - protein, 7 aa, Giardia lamblia
NLREGTG

SEQ ID NO: 3125120 - protein, 31 aa, Giardia lamblia
NLRKQGPGSKKSDHSEAKACSTLESGSHVPE

SEQ ID NO: 3125121 - protein, 13 aa, Giardia lamblia
NLRPETGDVESTT

SEQ ID NO: 3125122 - protein, 9 aa, Giardia lamblia
NLRQSANSL

SEQ ID NO: 3125123 - protein, 5 aa, Giardia lamblia
NLRRS

SEQ ID NO: 3125124 - protein, 6 aa, Giardia lamblia
NLRSSY

SEQ ID NO: 3125125 - protein, 31 aa, Giardia lamblia
NLSASEADITKTNSLPCSPQTAQAKARDYTR

SEQ ID NO: 3125126 - protein, 19 aa, Giardia lamblia
NLSDSSSLARVSSSHAPVD

SEQ ID NO: 3125127 - protein, 6 aa, Giardia lamblia
NLSGGE

SEQ ID NO: 3125128 - protein, 6 aa, Giardia lamblia
NLSGSI

SEQ ID NO: 3125129 - protein, 36 aa, Giardia lamblia
NLSGTEDAEQGDSATAFRPSESRSTGPSNSKYTSFA

SEQ ID NO: 3125130 - protein, 4 aa, Giardia lamblia
NLSK

SEQ ID NO: 3125131 - protein, 8 aa, Giardia lamblia
NLSKERNS

SEQ ID NO: 3125132 - protein, 10 aa, Giardia lamblia
NLSNGQGNTA

SEQ ID NO: 3125133 - protein, 8 aa, Giardia lamblia
NLSNNKTP

SEQ ID NO: 3125134 - protein, 6 aa, Giardia lamblia
NLSQQS

SEQ ID NO: 3125135 - protein, 14 aa, Giardia lamblia
NLSRERDRTKAMEQ

SEQ ID NO: 3125136 - protein, 5 aa, Giardia lamblia
NLSSH

SEQ ID NO: 3125137 - protein, 12 aa, Giardia lamblia
NLSSSEGREPMT

SEQ ID NO: 3125138 - protein, 19 aa, Giardia lamblia
NLSTTSDSCTQSESSNENN

SEQ ID NO: 3125139 - protein, 4 aa, Giardia lamblia
NLTD

SEQ ID NO: 3125140 - protein, 14 aa, Giardia lamblia
NLTDGGTFPPQSKL

SEQ ID NO: 3125141 - protein, 26 aa, Giardia lamblia
NLTDKKGRKCEAYARTETVRRILAKL

SEQ ID NO: 3125142 - protein, 8 aa, Giardia lamblia
NLTDTRPN

SEQ ID NO: 3125143 - protein, 4 aa, Giardia lamblia
NLTG

SEQ ID NO: 3125144 - protein, 6 aa, Giardia lamblia
NLTGLK

SEQ ID NO: 3125145 - protein, 9 aa, Giardia lamblia
NLTKKGQTQ

SEQ ID NO: 3125146 - protein, 10 aa, Giardia lamblia
NLTNGKGETS

SEQ ID NO: 3125147 - protein, 7 aa, Giardia lamblia
NLTNYQR

SEQ ID NO: 3125148 - protein, 4 aa, Giardia lamblia
NLTP

SEQ ID NO: 3125149 - protein, 20 aa, Giardia lamblia
NLTPSRQKTTNFEDNPRKQN

SEQ ID NO: 3125150 - protein, 5 aa, Giardia lamblia
NLTQL

SEQ ID NO: 3125151 - protein, 6 aa, Giardia lamblia
NLTRKP

SEQ ID NO: 3125152 - protein, 10 aa, Giardia lamblia
NLTTTNGSSA

SEQ ID NO: 3125153 - protein, 10 aa, Giardia lamblia
NLVDSKRKRA

SEQ ID NO: 3125154 - protein, 6 aa, Giardia lamblia
NMAGNP

SEQ ID NO: 3125155 - protein, 11 aa, Giardia lamblia
NMASGQTGPMT

SEQ ID NO: 3125156 - protein, 8 aa, Giardia lamblia
NMDGSSNN

SEQ ID NO: 3125157 - protein, 5 aa, Giardia lamblia
NMDPG

SEQ ID NO: 3125158 - protein, 7 aa, Giardia lamblia
NMDQQPR

SEQ ID NO: 3125159 - protein, 5 aa, Giardia lamblia
NMDSG

SEQ ID NO: 3125160 - protein, 14 aa, Giardia lamblia
NMEPSKEALDDRRN

SEQ ID NO: 3125161 - protein, 9 aa, Giardia lamblia
NMESGRKTD

SEQ ID NO: 3125162 - protein, 4 aa, Giardia lamblia
NMPA

SEQ ID NO: 3125163 - protein, 12 aa, Giardia lamblia
NMPSTPNHRLRD

SEQ ID NO: 3125164 - protein, 4 aa, Giardia lamblia
NMPT

SEQ ID NO: 3125165 - protein, 7 aa, Giardia lamblia
NMQDNRG

SEQ ID NO: 3125166 - protein, 10 aa, Giardia lamblia
NMQGKSLTSL

SEQ ID NO: 3125167 - protein, 9 aa, Giardia lamblia
NMQKDNDRR

SEQ ID NO: 3125168 - protein, 7 aa, Giardia lamblia
NMRNDPN

SEQ ID NO: 3125169 - protein, 5 aa, Giardia lamblia
NMRNK

SEQ ID NO: 3125170 - protein, 10 aa, Giardia lamblia
NMSESLSQHT

SEQ ID NO: 3125171 - protein, 9 aa, Giardia lamblia
NMTDKNGRN

SEQ ID NO: 3125172 - protein, 5 aa, Giardia lamblia
NMTEG

SEQ ID NO: 3125173 - protein, 20 aa, Giardia lamblia
NMTGSQPLASHSGEDVCSSQ

SEQ ID NO: 3125174 - protein, 5 aa, Giardia lamblia
NMTPS

SEQ ID NO: 3125175 - protein, 8 aa, Giardia lamblia
NMTSPSNL

SEQ ID NO: 3125176 - protein, 7 aa, Giardia lamblia
NNAADSA

SEQ ID NO: 3125177 - protein, 5 aa, Giardia lamblia
NNAAG

SEQ ID NO: 3125178 - protein, 8 aa, Giardia lamblia
NNAATNPV

SEQ ID NO: 3125179 - protein, 13 aa, Giardia lamblia
NNACTPSATSLSG

SEQ ID NO: 3125180 - protein, 6 aa, Giardia lamblia
NNAEQA

SEQ ID NO: 3125181 - protein, 7 aa, Giardia lamblia
NNAETSM

SEQ ID NO: 3125182 - protein, 7 aa, Giardia lamblia
NNAGQTA

SEQ ID NO: 3125183 - protein, 10 aa, Giardia lamblia
NNAKPPATNV

SEQ ID NO: 3125184 - protein, 8 aa, Giardia lamblia
NNARRTSN

SEQ ID NO: 3125185 - protein, 6 aa, Giardia lamblia
NNASDN

SEQ ID NO: 3125186 - protein, 8 aa, Giardia lamblia
NNASGIGA

SEQ ID NO: 3125187 - protein, 19 aa, Giardia lamblia
NNASPAPSPRHTSSWANTP

SEQ ID NO: 3125188 - protein, 6 aa, Giardia lamblia
NNASSK

SEQ ID NO: 3125189 - protein, 10 aa, Giardia lamblia
NNASTNPTDF

SEQ ID NO: 3125190 - protein, 8 aa, Giardia lamblia
NNATLSNR

SEQ ID NO: 3125191 - protein, 27 aa, Giardia lamblia
NNATTSATRAGRKELTEDHYSNGANRR

SEQ ID NO: 3125192 - protein, 4 aa, Giardia lamblia
NNDA

SEQ ID NO: 3125193 - protein, 5 aa, Giardia lamblia
NNDAC

SEQ ID NO: 3125194 - protein, 5 aa, Giardia lamblia
NNDAI

SEQ ID NO: 3125195 - protein, 8 aa, Giardia lamblia
NNDEAQVR

SEQ ID NO: 3125196 - protein, 8 aa, Giardia lamblia
NNDENTAY

SEQ ID NO: 3125197 - protein, 6 aa, Giardia lamblia
NNDETG

SEQ ID NO: 3125198 - protein, 6 aa, Giardia lamblia
NNDGET

SEQ ID NO: 3125199 - protein, 6 aa, Giardia lamblia
NNDNRS

SEQ ID NO: 3125200 - protein, 7 aa, Giardia lamblia
NNDPEQV

SEQ ID NO: 3125201 - protein, 7 aa, Giardia lamblia
NNDPTRE

SEQ ID NO: 3125202 - protein, 6 aa, Giardia lamblia
NNDRHS

SEQ ID NO: 3125203 - protein, 11 aa, Giardia lamblia
NNDTAEPETLS

SEQ ID NO: 3125204 - protein, 18 aa, Giardia lamblia
NNEDGSVSGVVQGPKEQV

SEQ ID NO: 3125205 - protein, 4 aa, Giardia lamblia
NNEE

SEQ ID NO: 3125206 - protein, 4 aa, Giardia lamblia
NNEF

SEQ ID NO: 3125207 - protein, 5 aa, Giardia lamblia
NNEGH

SEQ ID NO: 3125208 - protein, 7 aa, Giardia lamblia
NNEKNIR

SEQ ID NO: 3125209 - protein, 11 aa, Giardia lamblia
NNEKSNDKQAS

SEQ ID NO: 3125210 - protein, 5 aa, Giardia lamblia
NNELK

SEQ ID NO: 3125211 - protein, 5 aa, Giardia lamblia
NNELS

SEQ ID NO: 3125212 - protein, 11 aa, Giardia lamblia
NNEPPSPEDLA

SEQ ID NO: 3125213 - protein, 6 aa, Giardia lamblia
NNEQGM

SEQ ID NO: 3125214 - protein, 4 aa, Giardia lamblia
NNER

SEQ ID NO: 3125215 - protein, 8 aa, Giardia lamblia
NNESPPMS

SEQ ID NO: 3125216 - protein, 9 aa, Giardia lamblia
NNESSDISN

SEQ ID NO: 3125217 - protein, 4 aa, Giardia lamblia
NNEV

SEQ ID NO: 3125218 - protein, 5 aa, Giardia lamblia
NNEVD

SEQ ID NO: 3125219 - protein, 7 aa, Giardia lamblia
NNEVSGC

SEQ ID NO: 3125220 - protein, 5 aa, Giardia lamblia
NNEYA

SEQ ID NO: 3125221 - protein, 17 aa, Giardia lamblia
NNGEPSSLNTASYNGNG

SEQ ID NO: 3125222 - protein, 17 aa, Giardia lamblia
NNGFDSQTSSPSHTSGI

SEQ ID NO: 3125223 - protein, 10 aa, Giardia lamblia
NNGGSPTPHY

SEQ ID NO: 3125224 - protein, 6 aa, Giardia lamblia
NNGNAD

SEQ ID NO: 3125225 - protein, 10 aa, Giardia lamblia
NNGPEAGQEV

SEQ ID NO: 3125226 - protein, 4 aa, Giardia lamblia
NNGS

SEQ ID NO: 3125227 - protein, 4 aa, Giardia lamblia
NNHA

SEQ ID NO: 3125228 - protein, 5 aa, Giardia lamblia
NNHAD

SEQ ID NO: 3125229 - protein, 6 aa, Giardia lamblia
NNHDGA

SEQ ID NO: 3125230 - protein, 18 aa, Giardia lamblia
NNHGPGLDERYASLNPCQ

SEQ ID NO: 3125231 - protein, 5 aa, Giardia lamblia
NNHPG

SEQ ID NO: 3125232 - protein, 4 aa, Giardia lamblia
NNID

SEQ ID NO: 3125233 - protein, 6 aa, Giardia lamblia
NNIDKG

SEQ ID NO: 3125234 - protein, 6 aa, Giardia lamblia
NNINDN

SEQ ID NO: 3125235 - protein, 14 aa, Giardia lamblia
NNIQNQDKQDRTYL

SEQ ID NO: 3125236 - protein, 4 aa, Giardia lamblia
NNIS

SEQ ID NO: 3125237 - protein, 13 aa, Giardia lamblia
NNISNSKDSIKDS

SEQ ID NO: 3125238 - protein, 6 aa, Giardia lamblia
NNKADA

SEQ ID NO: 3125239 - protein, 7 aa, Giardia lamblia
NNKAREL

SEQ ID NO: 3125240 - protein, 8 aa, Giardia lamblia
NNKGETAL

SEQ ID NO: 3125241 - protein, 7 aa, Giardia lamblia
NNKPDSV

SEQ ID NO: 3125242 - protein, 8 aa, Giardia lamblia
NNKPGAGL

SEQ ID NO: 3125243 - protein, 4 aa, Giardia lamblia
NNLA

SEQ ID NO: 3125244 - protein, 14 aa, Giardia lamblia
NNLEDESLKDGKNM

SEQ ID NO: 3125245 - protein, 5 aa, Giardia lamblia
NNLEE

SEQ ID NO: 3125246 - protein, 7 aa, Giardia lamblia
NNLKAGE

SEQ ID NO: 3125247 - protein, 4 aa, Giardia lamblia
NNLN

SEQ ID NO: 3125248 - protein, 6 aa, Giardia lamblia
NNLPNG

SEQ ID NO: 3125249 - protein, 7 aa, Giardia lamblia
NNLPTAN

SEQ ID NO: 3125250 - protein, 6 aa, Giardia lamblia
NNLQQS

SEQ ID NO: 3125251 - protein, 9 aa, Giardia lamblia
NNLQSTPPN

SEQ ID NO: 3125252 - protein, 11 aa, Giardia lamblia
NNLSADDKKVE

SEQ ID NO: 3125253 - protein, 5 aa, Giardia lamblia
NNLTA

SEQ ID NO: 3125254 - protein, 8 aa, Giardia lamblia
NNMKDTGT

SEQ ID NO: 3125255 - protein, 9 aa, Giardia lamblia
NNMSSAKAK

SEQ ID NO: 3125256 - protein, 16 aa, Giardia lamblia
NNNADLAKELKKILYK

SEQ ID NO: 3125257 - protein, 4 aa, Giardia lamblia
NNND

SEQ ID NO: 3125258 - protein, 6 aa, Giardia lamblia
NNNGAT

SEQ ID NO: 3125259 - protein, 5 aa, Giardia lamblia
NNNGY

SEQ ID NO: 3125260 - protein, 4 aa, Giardia lamblia
NNNI

SEQ ID NO: 3125261 - protein, 4 aa, Giardia lamblia
NNNL

SEQ ID NO: 3125262 - protein, 5 aa, Giardia lamblia
NNNLT

SEQ ID NO: 3125263 - protein, 4 aa, Giardia lamblia
NNNP

SEQ ID NO: 3125264 - protein, 8 aa, Giardia lamblia
NNNQPATG

SEQ ID NO: 3125265 - protein, 14 aa, Giardia lamblia
NNNRRSIGGNTDTY

SEQ ID NO: 3125266 - protein, 5 aa, Giardia lamblia
NNNSG

SEQ ID NO: 3125267 - protein, 22 aa, Giardia lamblia
NNNSLNAGGGATGAKSQIGPND

SEQ ID NO: 3125268 - protein, 21 aa, Giardia lamblia
NNNSTSVSNTDSLRKKHASDC

SEQ ID NO: 3125269 - protein, 7 aa, Giardia lamblia
NNNTASI

SEQ ID NO: 3125270 - protein, 6 aa, Giardia lamblia
NNNVEA

SEQ ID NO: 3125271 - protein, 8 aa, Giardia lamblia
NNPAHRDA

SEQ ID NO: 3125272 - protein, 7 aa, Giardia lamblia
NNPAPKA

SEQ ID NO: 3125273 - protein, 12 aa, Giardia lamblia
NNPDDVPADAGQ

SEQ ID NO: 3125274 - protein, 9 aa, Giardia lamblia
NNPEASPND

SEQ ID NO: 3125275 - protein, 10 aa, Giardia lamblia
NNPGDSQEKH

SEQ ID NO: 3125276 - protein, 5 aa, Giardia lamblia
NNPGE

SEQ ID NO: 3125277 - protein, 5 aa, Giardia lamblia
NNPKI

SEQ ID NO: 3125278 - protein, 20 aa, Giardia lamblia
NNPLSDKKERADLIFGSDLV

SEQ ID NO: 3125279 - protein, 6 aa, Giardia lamblia
NNPNDI

SEQ ID NO: 3125280 - protein, 5 aa, Giardia lamblia
NNPNI

SEQ ID NO: 3125281 - protein, 20 aa, Giardia lamblia
NNPQFQPNNPSAYPQSQTPI

SEQ ID NO: 3125282 - protein, 6 aa, Giardia lamblia
NNPRSF

SEQ ID NO: 3125283 - protein, 4 aa, Giardia lamblia
NNPS

SEQ ID NO: 3125284 - protein, 7 aa, Giardia lamblia
NNPSTFR

SEQ ID NO: 3125285 - protein, 9 aa, Giardia lamblia
NNPTGKSTQ

SEQ ID NO: 3125286 - protein, 6 aa, Giardia lamblia
NNPTLQ

SEQ ID NO: 3125287 - protein, 9 aa, Giardia lamblia
NNPTTPTPI

SEQ ID NO: 3125288 - protein, 13 aa, Giardia lamblia
NNPVGMRGREGSL

SEQ ID NO: 3125289 - protein, 4 aa, Giardia lamblia
NNPW

SEQ ID NO: 3125290 - protein, 8 aa, Giardia lamblia
NNPYSQSA

SEQ ID NO: 3125291 - protein, 5 aa, Giardia lamblia
NNQGT

SEQ ID NO: 3125292 - protein, 4 aa, Giardia lamblia
NNQR

SEQ ID NO: 3125293 - protein, 22 aa, Giardia lamblia
NNQRPPPPVNQYQSNVKQPGIM

SEQ ID NO: 3125294 - protein, 18 aa, Giardia lamblia
NNQRSQGLYTDDPPTPCE

SEQ ID NO: 3125295 - protein, 4 aa, Giardia lamblia
NNQV

SEQ ID NO: 3125296 - protein, 6 aa, Giardia lamblia
NNQYPE

SEQ ID NO: 3125297 - protein, 8 aa, Giardia lamblia
NNRAPENL

SEQ ID NO: 3125298 - protein, 9 aa, Giardia lamblia
NNRELANTK

SEQ ID NO: 3125299 - protein, 7 aa, Giardia lamblia
NNREVSN

SEQ ID NO: 3125300 - protein, 5 aa, Giardia lamblia
NNRGK

SEQ ID NO: 3125301 - protein, 9 aa, Giardia lamblia
NNRKADSEL

SEQ ID NO: 3125302 - protein, 5 aa, Giardia lamblia
NNRLS

SEQ ID NO: 3125303 - protein, 6 aa, Giardia lamblia
NNRNGS

SEQ ID NO: 3125304 - protein, 16 aa, Giardia lamblia
NNRNKEKSGSSETVKK

SEQ ID NO: 3125305 - protein, 7 aa, Giardia lamblia
NNRPDIA

SEQ ID NO: 3125306 - protein, 5 aa, Giardia lamblia
NNRPF

SEQ ID NO: 3125307 - protein, 11 aa, Giardia lamblia
NNRQADRATEQ

SEQ ID NO: 3125308 - protein, 6 aa, Giardia lamblia
NNRQTA

SEQ ID NO: 3125309 - protein, 4 aa, Giardia lamblia
NNRR

SEQ ID NO: 3125310 - protein, 22 aa, Giardia lamblia
NNRSRERTRASRTSRGSKSSGI

SEQ ID NO: 3125311 - protein, 4 aa, Giardia lamblia
NNRY

SEQ ID NO: 3125312 - protein, 4 aa, Giardia lamblia
NNSA

SEQ ID NO: 3125313 - protein, 15 aa, Giardia lamblia
NNSAVESSPGPADYT

SEQ ID NO: 3125314 - protein, 9 aa, Giardia lamblia
NNSDDSTTD

SEQ ID NO: 3125315 - protein, 5 aa, Giardia lamblia
NNSDM

SEQ ID NO: 3125316 - protein, 8 aa, Giardia lamblia
NNSDSEPV

SEQ ID NO: 3125317 - protein, 8 aa, Giardia lamblia
NNSGKSHL

SEQ ID NO: 3125318 - protein, 5 aa, Giardia lamblia
NNSGN

SEQ ID NO: 3125319 - protein, 5 aa, Giardia lamblia
NNSID

SEQ ID NO: 3125320 - protein, 6 aa, Giardia lamblia
NNSIDS

SEQ ID NO: 3125321 - protein, 4 aa, Giardia lamblia
NNSL

SEQ ID NO: 3125322 - protein, 11 aa, Giardia lamblia
NNSLQKASETL

SEQ ID NO: 3125323 - protein, 10 aa, Giardia lamblia
NNSQKHEDVS

SEQ ID NO: 3125324 - protein, 8 aa, Giardia lamblia
NNSRAAEW

SEQ ID NO: 3125325 - protein, 5 aa, Giardia lamblia
NNSSK

SEQ ID NO: 3125326 - protein, 7 aa, Giardia lamblia
NNSSTAQ

SEQ ID NO: 3125327 - protein, 6 aa, Giardia lamblia
NNSTDL

SEQ ID NO: 3125328 - protein, 19 aa, Giardia lamblia
NNSTITPSNQQQQARPPTL

SEQ ID NO: 3125329 - protein, 5 aa, Giardia lamblia
NNTAE

SEQ ID NO: 3125330 - protein, 12 aa, Giardia lamblia
NNTASSTLSAEA

SEQ ID NO: 3125331 - protein, 4 aa, Giardia lamblia
NNTD

SEQ ID NO: 3125332 - protein, 5 aa, Giardia lamblia
NNTEY

SEQ ID NO: 3125333 - protein, 6 aa, Giardia lamblia
NNTNAK

SEQ ID NO: 3125334 - protein, 5 aa, Giardia lamblia
NNTPL

SEQ ID NO: 3125335 - protein, 5 aa, Giardia lamblia
NNTQM

SEQ ID NO: 3125336 - protein, 5 aa, Giardia lamblia
NNTTP

SEQ ID NO: 3125337 - protein, 19 aa, Giardia lamblia
NNTVKSARLPGSPDDAGFD

SEQ ID NO: 3125338 - protein, 15 aa, Giardia lamblia
NNVEAGKQVENDESL

SEQ ID NO: 3125339 - protein, 9 aa, Giardia lamblia
NNVNKEPNL

SEQ ID NO: 3125340 - protein, 5 aa, Giardia lamblia
NNVPG

SEQ ID NO: 3125341 - protein, 4 aa, Giardia lamblia
NNVT

SEQ ID NO: 3125342 - protein, 5 aa, Giardia lamblia
NNYDT

SEQ ID NO: 3125343 - protein, 5 aa, Giardia lamblia
NNYGD

SEQ ID NO: 3125344 - protein, 13 aa, Giardia lamblia
NNYGSNAANDGEI

SEQ ID NO: 3125345 - protein, 16 aa, Giardia lamblia
NNYGSTGLSEKPTELC

SEQ ID NO: 3125346 - protein, 5 aa, Giardia lamblia
NPADR

SEQ ID NO: 3125347 - protein, 34 aa, Giardia lamblia
NPADYSDSKKYQKADTSHFSTEVSDESTLRTEPT

SEQ ID NO: 3125348 - protein, 20 aa, Giardia lamblia
NPAEQQQQKQQPAPKPPQAQ

SEQ ID NO: 3125349 - protein, 5 aa, Giardia lamblia
NPAKL

SEQ ID NO: 3125350 - protein, 8 aa, Giardia lamblia
NPAKRFSA

SEQ ID NO: 3125351 - protein, 8 aa, Giardia lamblia
NPANDSYD

SEQ ID NO: 3125352 - protein, 7 aa, Giardia lamblia
NPANRPS

SEQ ID NO: 3125353 - protein, 9 aa, Giardia lamblia
NPANSRPNI

SEQ ID NO: 3125354 - protein, 6 aa, Giardia lamblia
NPANTN

SEQ ID NO: 3125355 - protein, 8 aa, Giardia lamblia
NPAPPSLN

SEQ ID NO: 3125356 - protein, 8 aa, Giardia lamblia
NPAPRKIS

SEQ ID NO: 3125357 - protein, 9 aa, Giardia lamblia
NPASEQPSS

SEQ ID NO: 3125358 - protein, 8 aa, Giardia lamblia
NPASTSSS

SEQ ID NO: 3125359 - protein, 9 aa, Giardia lamblia
NPATGRDCD

SEQ ID NO: 3125360 - protein, 9 aa, Giardia lamblia
NPATRKSPS

SEQ ID NO: 3125361 - protein, 21 aa, Giardia lamblia
NPATSKGPSTGSKDIDSSNLQ

SEQ ID NO: 3125362 - protein, 4 aa, Giardia lamblia
NPCP

SEQ ID NO: 3125363 - protein, 15 aa, Giardia lamblia
NPCPRDSSTVRQSTP

SEQ ID NO: 3125364 - protein, 10 aa, Giardia lamblia
NPCRSKAASA

SEQ ID NO: 3125365 - protein, 6 aa, Giardia lamblia
NPDAAE

SEQ ID NO: 3125366 - protein, 6 aa, Giardia lamblia
NPDAIK

SEQ ID NO: 3125367 - protein, 6 aa, Giardia lamblia
NPDAYK

SEQ ID NO: 3125368 - protein, 6 aa, Giardia lamblia
NPDDLA

SEQ ID NO: 3125369 - protein, 9 aa, Giardia lamblia
NPDDQYSSN

SEQ ID NO: 3125370 - protein, 5 aa, Giardia lamblia
NPDDR

SEQ ID NO: 3125371 - protein, 6 aa, Giardia lamblia
NPDEGV

SEQ ID NO: 3125372 - protein, 6 aa, Giardia lamblia
NPDERP

SEQ ID NO: 3125373 - protein, 11 aa, Giardia lamblia
NPDESKYKVTG

SEQ ID NO: 3125374 - protein, 4 aa, Giardia lamblia
NPDG

SEQ ID NO: 3125375 - protein, 14 aa, Giardia lamblia
NPDGSRPAPPQQYI

SEQ ID NO: 3125376 - protein, 10 aa, Giardia lamblia
NPDIKSTQQH

SEQ ID NO: 3125377 - protein, 9 aa, Giardia lamblia
NPDKDTPTD

SEQ ID NO: 3125378 - protein, 10 aa, Giardia lamblia
NPDKIGSTIQ

SEQ ID NO: 3125379 - protein, 11 aa, Giardia lamblia
NPDLKSSMDSL

SEQ ID NO: 3125380 - protein, 10 aa, Giardia lamblia
NPDPKKRPTA

SEQ ID NO: 3125381 - protein, 10 aa, Giardia lamblia
NPDQRVEATR

SEQ ID NO: 3125382 - protein, 4 aa, Giardia lamblia
NPDS

SEQ ID NO: 3125383 - protein, 9 aa, Giardia lamblia
NPDSYMGSK

SEQ ID NO: 3125384 - protein, 6 aa, Giardia lamblia
NPDTLD

SEQ ID NO: 3125385 - protein, 7 aa, Giardia lamblia
NPDTPVQ

SEQ ID NO: 3125386 - protein, 9 aa, Giardia lamblia
NPEAKSTLV

SEQ ID NO: 3125387 - protein, 8 aa, Giardia lamblia
NPEARASV

SEQ ID NO: 3125388 - protein, 17 aa, Giardia lamblia
NPEEASGNVVSKSRMDQ

SEQ ID NO: 3125389 - protein, 8 aa, Giardia lamblia
NPEELSAN

SEQ ID NO: 3125390 - protein, 5 aa, Giardia lamblia
NPEFA

SEQ ID NO: 3125391 - protein, 7 aa, Giardia lamblia
NPEGITE

SEQ ID NO: 3125392 - protein, 5 aa, Giardia lamblia
NPEGN

SEQ ID NO: 3125393 - protein, 4 aa, Giardia lamblia
NPEI

SEQ ID NO: 3125394 - protein, 4 aa, Giardia lamblia
NPEK

SEQ ID NO: 3125395 - protein, 6 aa, Giardia lamblia
NPEKNV

SEQ ID NO: 3125396 - protein, 7 aa, Giardia lamblia
NPEPLSG

SEQ ID NO: 3125397 - protein, 18 aa, Giardia lamblia
NPEPQEFNSSFDSDGSID

SEQ ID NO: 3125398 - protein, 10 aa, Giardia lamblia
NPEPSGDKTE

SEQ ID NO: 3125399 - protein, 8 aa, Giardia lamblia
NPEQLTAE

SEQ ID NO: 3125400 - protein, 6 aa, Giardia lamblia
NPEQQC

SEQ ID NO: 3125401 - protein, 15 aa, Giardia lamblia
NPEQQPASAPGTKVP

SEQ ID NO: 3125402 - protein, 5 aa, Giardia lamblia
NPEQT

SEQ ID NO: 3125403 - protein, 7 aa, Giardia lamblia
NPESASK

SEQ ID NO: 3125404 - protein, 5 aa, Giardia lamblia
NPEVV

SEQ ID NO: 3125405 - protein, 12 aa, Giardia lamblia
NPEYGQTRRPPL

SEQ ID NO: 3125406 - protein, 5 aa, Giardia lamblia
NPEYS

SEQ ID NO: 3125407 - protein, 21 aa, Giardia lamblia
NPFAPPEAVAPAKGPLLPSQE

SEQ ID NO: 3125408 - protein, 8 aa, Giardia lamblia
NPFATEKE

SEQ ID NO: 3125409 - protein, 6 aa, Giardia lamblia
NPFSTQ

SEQ ID NO: 3125410 - protein, 8 aa, Giardia lamblia
NPGDPAAV

SEQ ID NO: 3125411 - protein, 6 aa, Giardia lamblia
NPGDTP

SEQ ID NO: 3125412 - protein, 6 aa, Giardia lamblia
NPGETL

SEQ ID NO: 3125413 - protein, 8 aa, Giardia lamblia
NPGGMSPA

SEQ ID NO: 3125414 - protein, 8 aa, Giardia lamblia
NPGGRPLL

SEQ ID NO: 3125415 - protein, 19 aa, Giardia lamblia
NPGKPPTLATQPPASAFER

SEQ ID NO: 3125416 - protein, 4 aa, Giardia lamblia
NPGM

SEQ ID NO: 3125417 - protein, 6 aa, Giardia lamblia
NPGNLS

SEQ ID NO: 3125418 - protein, 6 aa, Giardia lamblia
NPGPAF

SEQ ID NO: 3125419 - protein, 8 aa, Giardia lamblia
NPGPTSRR

SEQ ID NO: 3125420 - protein, 6 aa, Giardia lamblia
NPGQPL

SEQ ID NO: 3125421 - protein, 5 aa, Giardia lamblia
NPGRE

SEQ ID NO: 3125422 - protein, 7 aa, Giardia lamblia
NPGRQGL

SEQ ID NO: 3125423 - protein, 7 aa, Giardia lamblia
NPGTAYH

SEQ ID NO: 3125424 - protein, 4 aa, Giardia lamblia
NPGV

SEQ ID NO: 3125425 - protein, 5 aa, Giardia lamblia
NPHDQ

SEQ ID NO: 3125426 - protein, 5 aa, Giardia lamblia
NPHEL

SEQ ID NO: 3125427 - protein, 10 aa, Giardia lamblia
NPHKRPLSPT

SEQ ID NO: 3125428 - protein, 12 aa, Giardia lamblia
NPHNTAPKVDDK

SEQ ID NO: 3125429 - protein, 13 aa, Giardia lamblia
NPHPPLDTATEPV

SEQ ID NO: 3125430 - protein, 24 aa, Giardia lamblia
NPIAEESSSMNSSASHPNPRDGGE

SEQ ID NO: 3125431 - protein, 6 aa, Giardia lamblia
NPIDET

SEQ ID NO: 3125432 - protein, 54 aa, Giardia lamblia
NPIPGSDSEETLASASEDARSQSHSTNTDLDKSSGSESVDSADAKATTATKTLR

SEQ ID NO: 3125433 - protein, 5 aa, Giardia lamblia
NPIPQ

SEQ ID NO: 3125434 - protein, 5 aa, Giardia lamblia
NPIRQ

SEQ ID NO: 3125435 - protein, 6 aa, Giardia lamblia
NPITIG

SEQ ID NO: 3125436 - protein, 7 aa, Giardia lamblia
NPKALQQ

SEQ ID NO: 3125437 - protein, 16 aa, Giardia lamblia
NPKEAARLEKKAKSAG

SEQ ID NO: 3125438 - protein, 6 aa, Giardia lamblia
NPKEID

SEQ ID NO: 3125439 - protein, 8 aa, Giardia lamblia
NPKGIKPD

SEQ ID NO: 3125440 - protein, 7 aa, Giardia lamblia
NPKHNQE

SEQ ID NO: 3125441 - protein, 5 aa, Giardia lamblia
NPKKA

SEQ ID NO: 3125442 - protein, 8 aa, Giardia lamblia
NPKKTEPV

SEQ ID NO: 3125443 - protein, 5 aa, Giardia lamblia
NPKPR

SEQ ID NO: 3125444 - protein, 18 aa, Giardia lamblia
NPKPRNGHSIQNSLGPSY

SEQ ID NO: 3125445 - protein, 6 aa, Giardia lamblia
NPKQLK

SEQ ID NO: 3125446 - protein, 9 aa, Giardia lamblia
NPKQTSGAN

SEQ ID NO: 3125447 - protein, 7 aa, Giardia lamblia
NPKRSGH

SEQ ID NO: 3125448 - protein, 5 aa, Giardia lamblia
NPKRT

SEQ ID NO: 3125449 - protein, 6 aa, Giardia lamblia
NPKSLS

SEQ ID NO: 3125450 - protein, 6 aa, Giardia lamblia
NPKSQL

SEQ ID NO: 3125451 - protein, 8 aa, Giardia lamblia
NPKSRPHL

SEQ ID NO: 3125452 - protein, 7 aa, Giardia lamblia
NPKTQTS

SEQ ID NO: 3125453 - protein, 14 aa, Giardia lamblia
NPKVEAEKREEAEA

SEQ ID NO: 3125454 - protein, 11 aa, Giardia lamblia
NPLDDDERNRL

SEQ ID NO: 3125455 - protein, 8 aa, Giardia lamblia
NPLESKDG

SEQ ID NO: 3125456 - protein, 14 aa, Giardia lamblia
NPLGGSGGNGPKQL

SEQ ID NO: 3125457 - protein, 5 aa, Giardia lamblia
NPLGL

SEQ ID NO: 3125458 - protein, 8 aa, Giardia lamblia
NPLGLTEG

SEQ ID NO: 3125459 - protein, 5 aa, Giardia lamblia
NPLGS

SEQ ID NO: 3125460 - protein, 9 aa, Giardia lamblia
NPLKNPPLK

SEQ ID NO: 3125461 - protein, 11 aa, Giardia lamblia
NPLLPDPSTYL

SEQ ID NO: 3125462 - protein, 13 aa, Giardia lamblia
NPLPENLETPGYA

SEQ ID NO: 3125463 - protein, 8 aa, Giardia lamblia
NPLPPSVP

SEQ ID NO: 3125464 - protein, 4 aa, Giardia lamblia
NPLQ

SEQ ID NO: 3125465 - protein, 12 aa, Giardia lamblia
NPLQSPGDEFEK

SEQ ID NO: 3125466 - protein, 5 aa, Giardia lamblia
NPLSD

SEQ ID NO: 3125467 - protein, 13 aa, Giardia lamblia
NPLTAASTLEPIS

SEQ ID NO: 3125468 - protein, 8 aa, Giardia lamblia
NPLTNESI

SEQ ID NO: 3125469 - protein, 14 aa, Giardia lamblia
NPLYSNPPLSTKTL

SEQ ID NO: 3125470 - protein, 21 aa, Giardia lamblia
NPNAPDGNGGPGSLDKAEKAA

SEQ ID NO: 3125471 - protein, 6 aa, Giardia lamblia
NPNAPF

SEQ ID NO: 3125472 - protein, 12 aa, Giardia lamblia
NPNDTMETSDVS

SEQ ID NO: 3125473 - protein, 7 aa, Giardia lamblia
NPNFSSV

SEQ ID NO: 3125474 - protein, 6 aa, Giardia lamblia
NPNGED

SEQ ID NO: 3125475 - protein, 20 aa, Giardia lamblia
NPNGNPNGSQPDKKASSGIA

SEQ ID NO: 3125476 - protein, 5 aa, Giardia lamblia
NPNIK

SEQ ID NO: 3125477 - protein, 8 aa, Giardia lamblia
NPNKFADK

SEQ ID NO: 3125478 - protein, 4 aa, Giardia lamblia
NPNN

SEQ ID NO: 3125479 - protein, 5 aa, Giardia lamblia
NPNNA

SEQ ID NO: 3125480 - protein, 7 aa, Giardia lamblia
NPNPTTA

SEQ ID NO: 3125481 - protein, 5 aa, Giardia lamblia
NPNPV

SEQ ID NO: 3125482 - protein, 4 aa, Giardia lamblia
NPNQ

SEQ ID NO: 3125483 - protein, 10 aa, Giardia lamblia
NPNTGRTPAQ

SEQ ID NO: 3125484 - protein, 5 aa, Giardia lamblia
NPPAL

SEQ ID NO: 3125485 - protein, 7 aa, Giardia lamblia
NPPALPP

SEQ ID NO: 3125486 - protein, 10 aa, Giardia lamblia
NPPCESPPWA

SEQ ID NO: 3125487 - protein, 16 aa, Giardia lamblia
NPPDSGDSQASRGHSY

SEQ ID NO: 3125488 - protein, 4 aa, Giardia lamblia
NPPG

SEQ ID NO: 3125489 - protein, 12 aa, Giardia lamblia
NPPGQESGYWGN

SEQ ID NO: 3125490 - protein, 12 aa, Giardia lamblia
NPPKSDDEDKKH

SEQ ID NO: 3125491 - protein, 12 aa, Giardia lamblia
NPPPGFADTEKE

SEQ ID NO: 3125492 - protein, 11 aa, Giardia lamblia
NPPPGTQHKPG

SEQ ID NO: 3125493 - protein, 54 aa, Giardia lamblia
NPPPKEVDDEGIDEEAEEKEEAEEEQIEDPEKSIEEEADEEAGEEKKEDMATDR

SEQ ID NO: 3125494 - protein, 14 aa, Giardia lamblia
NPPPKTSTSSLKSC

SEQ ID NO: 3125495 - protein, 6 aa, Giardia lamblia
NPPPTK

SEQ ID NO: 3125496 - protein, 26 aa, Giardia lamblia
NPPPWQKPRASTPVDTKVSPVPPNQP

SEQ ID NO: 3125497 - protein, 5 aa, Giardia lamblia
NPPQF

SEQ ID NO: 3125498 - protein, 4 aa, Giardia lamblia
NPPR

SEQ ID NO: 3125499 - protein, 6 aa, Giardia lamblia
NPPSRK

SEQ ID NO: 3125500 - protein, 11 aa, Giardia lamblia
NPPTASKTPLS

SEQ ID NO: 3125501 - protein, 6 aa, Giardia lamblia
NPPTLE

SEQ ID NO: 3125502 - protein, 7 aa, Giardia lamblia
NPPVEYT

SEQ ID NO: 3125503 - protein, 13 aa, Giardia lamblia
NPPVPVPSVQPNM

SEQ ID NO: 3125504 - protein, 4 aa, Giardia lamblia
NPQC

SEQ ID NO: 3125505 - protein, 5 aa, Giardia lamblia
NPQEL

SEQ ID NO: 3125506 - protein, 7 aa, Giardia lamblia
NPQERIS

SEQ ID NO: 3125507 - protein, 12 aa, Giardia lamblia
NPQESSSKGMDN

SEQ ID NO: 3125508 - protein, 12 aa, Giardia lamblia
NPQGETSDMDRS

SEQ ID NO: 3125509 - protein, 4 aa, Giardia lamblia
NPQH

SEQ ID NO: 3125510 - protein, 10 aa, Giardia lamblia
NPQKPKRSIE

SEQ ID NO: 3125511 - protein, 5 aa, Giardia lamblia
NPQME

SEQ ID NO: 3125512 - protein, 6 aa, Giardia lamblia
NPQQAI

SEQ ID NO: 3125513 - protein, 13 aa, Giardia lamblia
NPQSSEDAKTIEN

SEQ ID NO: 3125514 - protein, 8 aa, Giardia lamblia
NPQSYPRQ

SEQ ID NO: 3125515 - protein, 8 aa, Giardia lamblia
NPQTRQIQ

SEQ ID NO: 3125516 - protein, 5 aa, Giardia lamblia
NPQYS

SEQ ID NO: 3125517 - protein, 4 aa, Giardia lamblia
NPRA

SEQ ID NO: 3125518 - protein, 7 aa, Giardia lamblia
NPRGEKK

SEQ ID NO: 3125519 - protein, 22 aa, Giardia lamblia
NPRGRTVQGDKDTPAGKDGELS

SEQ ID NO: 3125520 - protein, 4 aa, Giardia lamblia
NPRI

SEQ ID NO: 3125521 - protein, 8 aa, Giardia lamblia
NPRPKADK

SEQ ID NO: 3125522 - protein, 6 aa, Giardia lamblia
NPRQGY

SEQ ID NO: 3125523 - protein, 5 aa, Giardia lamblia
NPRRD

SEQ ID NO: 3125524 - protein, 4 aa, Giardia lamblia
NPRS

SEQ ID NO: 3125525 - protein, 6 aa, Giardia lamblia
NPRSRS

SEQ ID NO: 3125526 - protein, 12 aa, Giardia lamblia
NPRSSSNSALGE

SEQ ID NO: 3125527 - protein, 24 aa, Giardia lamblia
NPRSVSPSRKASVPAEPASPTRCT

SEQ ID NO: 3125528 - protein, 6 aa, Giardia lamblia
NPRYTA

SEQ ID NO: 3125529 - protein, 10 aa, Giardia lamblia
NPSAPCSPTL

SEQ ID NO: 3125530 - protein, 5 aa, Giardia lamblia
NPSCS

SEQ ID NO: 3125531 - protein, 11 aa, Giardia lamblia
NPSCSIPDGSQ

SEQ ID NO: 3125532 - protein, 4 aa, Giardia lamblia
NPSD

SEQ ID NO: 3125533 - protein, 5 aa, Giardia lamblia
NPSDC

SEQ ID NO: 3125534 - protein, 10 aa, Giardia lamblia
NPSDQPQEAL

SEQ ID NO: 3125535 - protein, 10 aa, Giardia lamblia
NPSDRPSAEQ

SEQ ID NO: 3125536 - protein, 14 aa, Giardia lamblia
NPSEILPDADSYDT

SEQ ID NO: 3125537 - protein, 5 aa, Giardia lamblia
NPSEP

SEQ ID NO: 3125538 - protein, 5 aa, Giardia lamblia
NPSFS

SEQ ID NO: 3125539 - protein, 11 aa, Giardia lamblia
NPSFSKGKIST

SEQ ID NO: 3125540 - protein, 7 aa, Giardia lamblia
NPSGKTA

SEQ ID NO: 3125541 - protein, 8 aa, Giardia lamblia
NPSGYKST

SEQ ID NO: 3125542 - protein, 6 aa, Giardia lamblia
NPSIPG

SEQ ID NO: 3125543 - protein, 35 aa, Giardia lamblia
NPSKSKPQRKRLSSSSGTGLPMSGSRSSVSPEGIE

SEQ ID NO: 3125544 - protein, 8 aa, Giardia lamblia
NPSLRPDY

SEQ ID NO: 3125545 - protein, 4 aa, Giardia lamblia
NPSM

SEQ ID NO: 3125546 - protein, 8 aa, Giardia lamblia
NPSPDEVE

SEQ ID NO: 3125547 - protein, 10 aa, Giardia lamblia
NPSQFSPDQG

SEQ ID NO: 3125548 - protein, 5 aa, Giardia lamblia
NPSRI

SEQ ID NO: 3125549 - protein, 5 aa, Giardia lamblia
NPSRQ

SEQ ID NO: 3125550 - protein, 10 aa, Giardia lamblia
NPSSASTGTA

SEQ ID NO: 3125551 - protein, 8 aa, Giardia lamblia
NPSSLYTN

SEQ ID NO: 3125552 - protein, 6 aa, Giardia lamblia
NPSSPV

SEQ ID NO: 3125553 - protein, 7 aa, Giardia lamblia
NPSSQGY

SEQ ID NO: 3125554 - protein, 9 aa, Giardia lamblia
NPSSSGDEV

SEQ ID NO: 3125555 - protein, 15 aa, Giardia lamblia
NPSTEAAAKAGTPSF

SEQ ID NO: 3125556 - protein, 25 aa, Giardia lamblia
NPSTRDGAPGVSGWQRRTDPAHTGE

SEQ ID NO: 3125557 - protein, 12 aa, Giardia lamblia
NPSYKAYATAED

SEQ ID NO: 3125558 - protein, 34 aa, Giardia lamblia
NPSYPKSTSPKVSEKPLSKSSVRHNAGSSAPQFS

SEQ ID NO: 3125559 - protein, 11 aa, Giardia lamblia
NPTAEDARTQV

SEQ ID NO: 3125560 - protein, 5 aa, Giardia lamblia
NPTAV

SEQ ID NO: 3125561 - protein, 5 aa, Giardia lamblia
NPTDD

SEQ ID NO: 3125562 - protein, 6 aa, Giardia lamblia
NPTDSA

SEQ ID NO: 3125563 - protein, 5 aa, Giardia lamblia
NPTEK

SEQ ID NO: 3125564 - protein, 6 aa, Giardia lamblia
NPTETL

SEQ ID NO: 3125565 - protein, 8 aa, Giardia lamblia
NPTIDDQS

SEQ ID NO: 3125566 - protein, 6 aa, Giardia lamblia
NPTKIK

SEQ ID NO: 3125567 - protein, 16 aa, Giardia lamblia
NPTNLSPSSSQTSQVL

SEQ ID NO: 3125568 - protein, 7 aa, Giardia lamblia
NPTSSSV

SEQ ID NO: 3125569 - protein, 9 aa, Giardia lamblia
NPTSTQIKS

SEQ ID NO: 3125570 - protein, 6 aa, Giardia lamblia
NPTTGE

SEQ ID NO: 3125571 - protein, 13 aa, Giardia lamblia
NPTTTHKSNQTLG

SEQ ID NO: 3125572 - protein, 67 aa, Giardia lamblia
NPTYDDNVAPQRPVQHSPPPPQQQQQSDEKPKDSVKEDRIPEPRSPERPKSAIQRDEPTDPRSVPDP

SEQ ID NO: 3125573 - protein, 7 aa, Giardia lamblia
NPTYDNS

SEQ ID NO: 3125574 - protein, 9 aa, Giardia lamblia
NPVGASHNN

SEQ ID NO: 3125575 - protein, 6 aa, Giardia lamblia
NPVKKN

SEQ ID NO: 3125576 - protein, 15 aa, Giardia lamblia
NPVQRDSKQRGTYIP

SEQ ID NO: 3125577 - protein, 7 aa, Giardia lamblia
NPVQTSQ

SEQ ID NO: 3125578 - protein, 6 aa, Giardia lamblia
NPVSGQ

SEQ ID NO: 3125579 - protein, 11 aa, Giardia lamblia
NPVTAASDHGI

SEQ ID NO: 3125580 - protein, 8 aa, Giardia lamblia
NPVTGANK

SEQ ID NO: 3125581 - protein, 5 aa, Giardia lamblia
NPVYQ

SEQ ID NO: 3125582 - protein, 6 aa, Giardia lamblia
NPYNDK

SEQ ID NO: 3125583 - protein, 4 aa, Giardia lamblia
NPYP

SEQ ID NO: 3125584 - protein, 7 aa, Giardia lamblia
NPYPPNR

SEQ ID NO: 3125585 - protein, 4 aa, Giardia lamblia
NPYS

SEQ ID NO: 3125586 - protein, 10 aa, Giardia lamblia
NQAAAGVSPE

SEQ ID NO: 3125587 - protein, 8 aa, Giardia lamblia
NQAASIAD

SEQ ID NO: 3125588 - protein, 19 aa, Giardia lamblia
NQADNSQSSGQRYEDIEDR

SEQ ID NO: 3125589 - protein, 8 aa, Giardia lamblia
NQAKNYEQ

SEQ ID NO: 3125590 - protein, 5 aa, Giardia lamblia
NQAKV

SEQ ID NO: 3125591 - protein, 6 aa, Giardia lamblia
NQAQTA

SEQ ID NO: 3125592 - protein, 7 aa, Giardia lamblia
NQASANA

SEQ ID NO: 3125593 - protein, 9 aa, Giardia lamblia
NQASDALNT

SEQ ID NO: 3125594 - protein, 4 aa, Giardia lamblia
NQAT

SEQ ID NO: 3125595 - protein, 4 aa, Giardia lamblia
NQDE

SEQ ID NO: 3125596 - protein, 6 aa, Giardia lamblia
NQDGSY

SEQ ID NO: 3125597 - protein, 6 aa, Giardia lamblia
NQDLSN

SEQ ID NO: 3125598 - protein, 15 aa, Giardia lamblia
NQDPANAGVDTRCTS

SEQ ID NO: 3125599 - protein, 10 aa, Giardia lamblia
NQDQLDPKHT

SEQ ID NO: 3125600 - protein, 6 aa, Giardia lamblia
NQDSPQ

SEQ ID NO: 3125601 - protein, 12 aa, Giardia lamblia
NQEDNVDGSGNE

SEQ ID NO: 3125602 - protein, 6 aa, Giardia lamblia
NQEEYD

SEQ ID NO: 3125603 - protein, 14 aa, Giardia lamblia
NQEGAHSAKSAPKV

SEQ ID NO: 3125604 - protein, 6 aa, Giardia lamblia
NQEKEA

SEQ ID NO: 3125605 - protein, 5 aa, Giardia lamblia
NQELR

SEQ ID NO: 3125606 - protein, 5 aa, Giardia lamblia
NQEQE

SEQ ID NO: 3125607 - protein, 6 aa, Giardia lamblia
NQEQSF

SEQ ID NO: 3125608 - protein, 31 aa, Giardia lamblia
NQESGGAPDQRSQSPRQTDLSVEPDKDGNTT

SEQ ID NO: 3125609 - protein, 10 aa, Giardia lamblia
NQETENPKFD

SEQ ID NO: 3125610 - protein, 5 aa, Giardia lamblia
NQFNR

SEQ ID NO: 3125611 - protein, 7 aa, Giardia lamblia
NQFPPTS

SEQ ID NO: 3125612 - protein, 7 aa, Giardia lamblia
NQGAGVR

SEQ ID NO: 3125613 - protein, 6 aa, Giardia lamblia
NQGDAS

SEQ ID NO: 3125614 - protein, 4 aa, Giardia lamblia
NQGN

SEQ ID NO: 3125615 - protein, 7 aa, Giardia lamblia
NQGPPHG

SEQ ID NO: 3125616 - protein, 8 aa, Giardia lamblia
NQGSMGTT

SEQ ID NO: 3125617 - protein, 13 aa, Giardia lamblia
NQGSNESPLRDAS

SEQ ID NO: 3125618 - protein, 11 aa, Giardia lamblia
NQGSSTGTTVI

SEQ ID NO: 3125619 - protein, 9 aa, Giardia lamblia
NQGVSSMPP

SEQ ID NO: 3125620 - protein, 10 aa, Giardia lamblia
NQHDNVDTAH

SEQ ID NO: 3125621 - protein, 27 aa, Giardia lamblia
NQIEDAAREANRLSGSSSRGNGYGYGG

SEQ ID NO: 3125622 - protein, 4 aa, Giardia lamblia
NQIG

SEQ ID NO: 3125623 - protein, 11 aa, Giardia lamblia
NQIRSSKTSLD

SEQ ID NO: 3125624 - protein, 27 aa, Giardia lamblia
NQIRTQQAAQLNEPSPINNDPHHDSVE

SEQ ID NO: 3125625 - protein, 12 aa, Giardia lamblia
NQISRDTSGSIR

SEQ ID NO: 3125626 - protein, 7 aa, Giardia lamblia
NQKKQNI

SEQ ID NO: 3125627 - protein, 6 aa, Giardia lamblia
NQKNAD

SEQ ID NO: 3125628 - protein, 13 aa, Giardia lamblia
NQKQQQQQQPIDS

SEQ ID NO: 3125629 - protein, 5 aa, Giardia lamblia
NQKRY

SEQ ID NO: 3125630 - protein, 14 aa, Giardia lamblia
NQKTSTADGTIGRP

SEQ ID NO: 3125631 - protein, 8 aa, Giardia lamblia
NQKTTITE

SEQ ID NO: 3125632 - protein, 8 aa, Giardia lamblia
NQKYKNHT

SEQ ID NO: 3125633 - protein, 4 aa, Giardia lamblia
NQLP

SEQ ID NO: 3125634 - protein, 7 aa, Giardia lamblia
NQLPANP

SEQ ID NO: 3125635 - protein, 17 aa, Giardia lamblia
NQLSDKEKKNDDGDTAL

SEQ ID NO: 3125636 - protein, 9 aa, Giardia lamblia
NQLSERDAT

SEQ ID NO: 3125637 - protein, 22 aa, Giardia lamblia
NQLYPTDSKGREYYASADGNEI

SEQ ID NO: 3125638 - protein, 8 aa, Giardia lamblia
NQMSANQI

SEQ ID NO: 3125639 - protein, 7 aa, Giardia lamblia
NQMSRER

SEQ ID NO: 3125640 - protein, 4 aa, Giardia lamblia
NQNG

SEQ ID NO: 3125641 - protein, 4 aa, Giardia lamblia
NQPA

SEQ ID NO: 3125642 - protein, 6 aa, Giardia lamblia
NQPAHS

SEQ ID NO: 3125643 - protein, 5 aa, Giardia lamblia
NQPES

SEQ ID NO: 3125644 - protein, 6 aa, Giardia lamblia
NQPLPR

SEQ ID NO: 3125645 - protein, 7 aa, Giardia lamblia
NQPPAQL

SEQ ID NO: 3125646 - protein, 5 aa, Giardia lamblia
NQPQS

SEQ ID NO: 3125647 - protein, 6 aa, Giardia lamblia
NQPRGA

SEQ ID NO: 3125648 - protein, 7 aa, Giardia lamblia
NQPRPVM

SEQ ID NO: 3125649 - protein, 15 aa, Giardia lamblia
NQPSTKTIQKEKQKI

SEQ ID NO: 3125650 - protein, 20 aa, Giardia lamblia
NQQAKKAKSNPNSIDNDEAV

SEQ ID NO: 3125651 - protein, 7 aa, Giardia lamblia
NQQAQIE

SEQ ID NO: 3125652 - protein, 4 aa, Giardia lamblia
NQQC

SEQ ID NO: 3125653 - protein, 47 aa, Giardia lamblia
NQQGNQLDAPSSASKAGTDRALTKGPSLLSASTSGHRDNGATSLNDE

SEQ ID NO: 3125654 - protein, 20 aa, Giardia lamblia
NQQITRESCHSTKSNSEEPL

SEQ ID NO: 3125655 - protein, 4 aa, Giardia lamblia
NQQL

SEQ ID NO: 3125656 - protein, 5 aa, Giardia lamblia
NQQRS

SEQ ID NO: 3125657 - protein, 7 aa, Giardia lamblia
NQQSPSP

SEQ ID NO: 3125658 - protein, 12 aa, Giardia lamblia
NQQSRLSGARPS

SEQ ID NO: 3125659 - protein, 8 aa, Giardia lamblia
NQRAARPG

SEQ ID NO: 3125660 - protein, 10 aa, Giardia lamblia
NQRKQYSSGR

SEQ ID NO: 3125661 - protein, 28 aa, Giardia lamblia
NQRPSATTETPNENQRTNTAGCMQESAG

SEQ ID NO: 3125662 - protein, 7 aa, Giardia lamblia
NQRQDSM

SEQ ID NO: 3125663 - protein, 4 aa, Giardia lamblia
NQRR

SEQ ID NO: 3125664 - protein, 12 aa, Giardia lamblia
NQRRTPTSGNQL

SEQ ID NO: 3125665 - protein, 7 aa, Giardia lamblia
NQRSNVP

SEQ ID NO: 3125666 - protein, 20 aa, Giardia lamblia
NQRTEQKRVDDEQAEITDDD

SEQ ID NO: 3125667 - protein, 14 aa, Giardia lamblia
NQRTSKEHKRPDSI

SEQ ID NO: 3125668 - protein, 6 aa, Giardia lamblia
NQSDDS

SEQ ID NO: 3125669 - protein, 6 aa, Giardia lamblia
NQSDPT

SEQ ID NO: 3125670 - protein, 7 aa, Giardia lamblia
NQSDTPI

SEQ ID NO: 3125671 - protein, 10 aa, Giardia lamblia
NQSFSQRTGE

SEQ ID NO: 3125672 - protein, 16 aa, Giardia lamblia
NQSGPTVATPPSKRRN

SEQ ID NO: 3125673 - protein, 7 aa, Giardia lamblia
NQSIETE

SEQ ID NO: 3125674 - protein, 13 aa, Giardia lamblia
NQSISQQPAIASG

SEQ ID NO: 3125675 - protein, 4 aa, Giardia lamblia
NQSL

SEQ ID NO: 3125676 - protein, 7 aa, Giardia lamblia
NQSLPNN

SEQ ID NO: 3125677 - protein, 10 aa, Giardia lamblia
NQSLTATKEL

SEQ ID NO: 3125678 - protein, 21 aa, Giardia lamblia
NQSMQSTDAFNTSTMSTGNIP

SEQ ID NO: 3125679 - protein, 13 aa, Giardia lamblia
NQSPAQSGDAQTV

SEQ ID NO: 3125680 - protein, 17 aa, Giardia lamblia
NQSQAVADGHDSGVLDS

SEQ ID NO: 3125681 - protein, 7 aa, Giardia lamblia
NQSQHQE

SEQ ID NO: 3125682 - protein, 5 aa, Giardia lamblia
NQSTS

SEQ ID NO: 3125683 - protein, 24 aa, Giardia lamblia
NQSTSTVKNHGTVTSPAEALPVSS

SEQ ID NO: 3125684 - protein, 11 aa, Giardia lamblia
NQTAYSSNASL

SEQ ID NO: 3125685 - protein, 9 aa, Giardia lamblia
NQTDPQRPK

SEQ ID NO: 3125686 - protein, 5 aa, Giardia lamblia
NQTDS

SEQ ID NO: 3125687 - protein, 4 aa, Giardia lamblia
NQTE

SEQ ID NO: 3125688 - protein, 7 aa, Giardia lamblia
NQTEDAN

SEQ ID NO: 3125689 - protein, 6 aa, Giardia lamblia
NQTPQK

SEQ ID NO: 3125690 - protein, 12 aa, Giardia lamblia
NQTRGYSPWDTG

SEQ ID NO: 3125691 - protein, 6 aa, Giardia lamblia
NQTSEI

SEQ ID NO: 3125692 - protein, 6 aa, Giardia lamblia
NQTTGA

SEQ ID NO: 3125693 - protein, 16 aa, Giardia lamblia
NQVAEGEKLKRETSDA

SEQ ID NO: 3125694 - protein, 7 aa, Giardia lamblia
NQVAKTA

SEQ ID NO: 3125695 - protein, 7 aa, Giardia lamblia
NQVPPSN

SEQ ID NO: 3125696 - protein, 7 aa, Giardia lamblia
NQVQNGD

SEQ ID NO: 3125697 - protein, 13 aa, Giardia lamblia
NQVSDSSTDVNSH

SEQ ID NO: 3125698 - protein, 5 aa, Giardia lamblia
NQVTR

SEQ ID NO: 3125699 - protein, 4 aa, Giardia lamblia
NQWG

SEQ ID NO: 3125700 - protein, 6 aa, Giardia lamblia
NQYSAA

SEQ ID NO: 3125701 - protein, 5 aa, Giardia lamblia
NRAED

SEQ ID NO: 3125702 - protein, 7 aa, Giardia lamblia
NRAGETP

SEQ ID NO: 3125703 - protein, 4 aa, Giardia lamblia
NRAI

SEQ ID NO: 3125704 - protein, 7 aa, Giardia lamblia
NRALESQ

SEQ ID NO: 3125705 - protein, 9 aa, Giardia lamblia
NRAMKDGTT

SEQ ID NO: 3125706 - protein, 7 aa, Giardia lamblia
NRAPGTT

SEQ ID NO: 3125707 - protein, 6 aa, Giardia lamblia
NRAPTW

SEQ ID NO: 3125708 - protein, 13 aa, Giardia lamblia
NRASAPSTPGTQL

SEQ ID NO: 3125709 - protein, 13 aa, Giardia lamblia
NRAVPEPRKLNDN

SEQ ID NO: 3125710 - protein, 9 aa, Giardia lamblia
NRCSNSYYK

SEQ ID NO: 3125711 - protein, 4 aa, Giardia lamblia
NRDK

SEQ ID NO: 3125712 - protein, 6 aa, Giardia lamblia
NRDLDS

SEQ ID NO: 3125713 - protein, 4 aa, Giardia lamblia
NRDT

SEQ ID NO: 3125714 - protein, 6 aa, Giardia lamblia
NRDTRL

SEQ ID NO: 3125715 - protein, 10 aa, Giardia lamblia
NREATQGETE

SEQ ID NO: 3125716 - protein, 22 aa, Giardia lamblia
NREFGVPRSDAACTGNLPPRSL

SEQ ID NO: 3125717 - protein, 24 aa, Giardia lamblia
NREISAEQDHRQSGVNRGKNLTQS

SEQ ID NO: 3125718 - protein, 5 aa, Giardia lamblia
NREKY

SEQ ID NO: 3125719 - protein, 5 aa, Giardia lamblia
NRELR

SEQ ID NO: 3125720 - protein, 12 aa, Giardia lamblia
NRENRSASEIRD

SEQ ID NO: 3125721 - protein, 19 aa, Giardia lamblia
NREPSGTPYSDPVDDDGVQ

SEQ ID NO: 3125722 - protein, 11 aa, Giardia lamblia
NREPSRTEKEA

SEQ ID NO: 3125723 - protein, 8 aa, Giardia lamblia
NREQGSPV

SEQ ID NO: 3125724 - protein, 6 aa, Giardia lamblia
NRESGR

SEQ ID NO: 3125725 - protein, 15 aa, Giardia lamblia
NRESIGDRGSVSSSF

SEQ ID NO: 3125726 - protein, 13 aa, Giardia lamblia
NREVSADDAKGVN

SEQ ID NO: 3125727 - protein, 4 aa, Giardia lamblia
NRGA

SEQ ID NO: 3125728 - protein, 8 aa, Giardia lamblia
NRGAPQSH

SEQ ID NO: 3125729 - protein, 9 aa, Giardia lamblia
NRGELQEEE

SEQ ID NO: 3125730 - protein, 6 aa, Giardia lamblia
NRGGEI

SEQ ID NO: 3125731 - protein, 6 aa, Giardia lamblia
NRGLSG

SEQ ID NO: 3125732 - protein, 7 aa, Giardia lamblia
NRGPSTH

SEQ ID NO: 3125733 - protein, 4 aa, Giardia lamblia
NRGR

SEQ ID NO: 3125734 - protein, 5 aa, Giardia lamblia
NRGYT

SEQ ID NO: 3125735 - protein, 9 aa, Giardia lamblia
NRHPASGMG

SEQ ID NO: 3125736 - protein, 5 aa, Giardia lamblia
NRHYQ

SEQ ID NO: 3125737 - protein, 20 aa, Giardia lamblia
NRIDSPQGEISLTEDDTVET

SEQ ID NO: 3125738 - protein, 13 aa, Giardia lamblia
NRIDTVPHTARSV

SEQ ID NO: 3125739 - protein, 5 aa, Giardia lamblia
NRIED

SEQ ID NO: 3125740 - protein, 8 aa, Giardia lamblia
NRIEGSEE

SEQ ID NO: 3125741 - protein, 5 aa, Giardia lamblia
NRIET

SEQ ID NO: 3125742 - protein, 17 aa, Giardia lamblia
NRIKARGQELQKASSCL

SEQ ID NO: 3125743 - protein, 8 aa, Giardia lamblia
NRIQQKDE

SEQ ID NO: 3125744 - protein, 6 aa, Giardia lamblia
NRIQRE

SEQ ID NO: 3125745 - protein, 4 aa, Giardia lamblia
NRIS

SEQ ID NO: 3125746 - protein, 11 aa, Giardia lamblia
NRISAEERARL

SEQ ID NO: 3125747 - protein, 5 aa, Giardia lamblia
NRKEL

SEQ ID NO: 3125748 - protein, 8 aa, Giardia lamblia
NRKPISDD

SEQ ID NO: 3125749 - protein, 5 aa, Giardia lamblia
NRKSI

SEQ ID NO: 3125750 - protein, 6 aa, Giardia lamblia
NRKSLA

SEQ ID NO: 3125751 - protein, 11 aa, Giardia lamblia
NRKSLQTATTA

SEQ ID NO: 3125752 - protein, 14 aa, Giardia lamblia
NRKSYQSASATFRG

SEQ ID NO: 3125753 - protein, 7 aa, Giardia lamblia
NRKTDFT

SEQ ID NO: 3125754 - protein, 7 aa, Giardia lamblia
NRKTLAE

SEQ ID NO: 3125755 - protein, 8 aa, Giardia lamblia
NRKTNETV

SEQ ID NO: 3125756 - protein, 6 aa, Giardia lamblia
NRLDEH

SEQ ID NO: 3125757 - protein, 7 aa, Giardia lamblia
NRLGNAG

SEQ ID NO: 3125758 - protein, 6 aa, Giardia lamblia
NRLNQE

SEQ ID NO: 3125759 - protein, 16 aa, Giardia lamblia
NRLSGADALGQGPRLK

SEQ ID NO: 3125760 - protein, 6 aa, Giardia lamblia
NRLSTE

SEQ ID NO: 3125761 - protein, 7 aa, Giardia lamblia
NRLTSTG

SEQ ID NO: 3125762 - protein, 10 aa, Giardia lamblia
NRMQAGTLSQ

SEQ ID NO: 3125763 - protein, 25 aa, Giardia lamblia
NRNAKSTPEPVSTLAPKSARPASPS

SEQ ID NO: 3125764 - protein, 7 aa, Giardia lamblia
NRNETPL

SEQ ID NO: 3125765 - protein, 8 aa, Giardia lamblia
NRNGIAEK

SEQ ID NO: 3125766 - protein, 6 aa, Giardia lamblia
NRNNGS

SEQ ID NO: 3125767 - protein, 13 aa, Giardia lamblia
NRNQEMREQPIAE

SEQ ID NO: 3125768 - protein, 8 aa, Giardia lamblia
NRNRDADI

SEQ ID NO: 3125769 - protein, 8 aa, Giardia lamblia
NRNSPITA

SEQ ID NO: 3125770 - protein, 8 aa, Giardia lamblia
NRNVDTGV

SEQ ID NO: 3125771 - protein, 5 aa, Giardia lamblia
NRPCS

SEQ ID NO: 3125772 - protein, 7 aa, Giardia lamblia
NRPDAQR

SEQ ID NO: 3125773 - protein, 6 aa, Giardia lamblia
NRPDTI

SEQ ID NO: 3125774 - protein, 6 aa, Giardia lamblia
NRPGSL

SEQ ID NO: 3125775 - protein, 6 aa, Giardia lamblia
NRPGVS

SEQ ID NO: 3125776 - protein, 5 aa, Giardia lamblia
NRPHY

SEQ ID NO: 3125777 - protein, 4 aa, Giardia lamblia
NRPN

SEQ ID NO: 3125778 - protein, 6 aa, Giardia lamblia
NRPNSS

SEQ ID NO: 3125779 - protein, 10 aa, Giardia lamblia
NRPNSSVDRH

SEQ ID NO: 3125780 - protein, 5 aa, Giardia lamblia
NRPNV

SEQ ID NO: 3125781 - protein, 10 aa, Giardia lamblia
NRPPPSQHSR

SEQ ID NO: 3125782 - protein, 10 aa, Giardia lamblia
NRPPRDTTET

SEQ ID NO: 3125783 - protein, 6 aa, Giardia lamblia
NRPREA

SEQ ID NO: 3125784 - protein, 4 aa, Giardia lamblia
NRPS

SEQ ID NO: 3125785 - protein, 5 aa, Giardia lamblia
NRPSE

SEQ ID NO: 3125786 - protein, 11 aa, Giardia lamblia
NRPTKSAVQQE

SEQ ID NO: 3125787 - protein, 10 aa, Giardia lamblia
NRQAGPEEPL

SEQ ID NO: 3125788 - protein, 22 aa, Giardia lamblia
NRQAPSHSATSLRARNSNKPLS

SEQ ID NO: 3125789 - protein, 8 aa, Giardia lamblia
NRQDGTGW

SEQ ID NO: 3125790 - protein, 7 aa, Giardia lamblia
NRQGLAQ

SEQ ID NO: 3125791 - protein, 11 aa, Giardia lamblia
NRQLPGGSNGF

SEQ ID NO: 3125792 - protein, 5 aa, Giardia lamblia
NRQSI

SEQ ID NO: 3125793 - protein, 11 aa, Giardia lamblia
NRRASAYTTND

SEQ ID NO: 3125794 - protein, 9 aa, Giardia lamblia
NRRDLENSK

SEQ ID NO: 3125795 - protein, 5 aa, Giardia lamblia
NRRIT

SEQ ID NO: 3125796 - protein, 4 aa, Giardia lamblia
NRRL

SEQ ID NO: 3125797 - protein, 7 aa, Giardia lamblia
NRRLTQP

SEQ ID NO: 3125798 - protein, 13 aa, Giardia lamblia
NRRPRAADKGDLA

SEQ ID NO: 3125799 - protein, 16 aa, Giardia lamblia
NRRSPRPTRSARSREL

SEQ ID NO: 3125800 - protein, 5 aa, Giardia lamblia
NRRSV

SEQ ID NO: 3125801 - protein, 5 aa, Giardia lamblia
NRRVE

SEQ ID NO: 3125802 - protein, 9 aa, Giardia lamblia
NRSEKFSEE

SEQ ID NO: 3125803 - protein, 8 aa, Giardia lamblia
NRSEPAFS

SEQ ID NO: 3125804 - protein, 9 aa, Giardia lamblia
NRSEQPADL

SEQ ID NO: 3125805 - protein, 10 aa, Giardia lamblia
NRSESPKSTP

SEQ ID NO: 3125806 - protein, 22 aa, Giardia lamblia
NRSFESSTNYADQTASRLTNGS

SEQ ID NO: 3125807 - protein, 21 aa, Giardia lamblia
NRSGAESLTLDPPSLSQSGGY

SEQ ID NO: 3125808 - protein, 7 aa, Giardia lamblia
NRSGDKQ

SEQ ID NO: 3125809 - protein, 5 aa, Giardia lamblia
NRSGL

SEQ ID NO: 3125810 - protein, 5 aa, Giardia lamblia
NRSGQ

SEQ ID NO: 3125811 - protein, 5 aa, Giardia lamblia
NRSRY

SEQ ID NO: 3125812 - protein, 5 aa, Giardia lamblia
NRSSF

SEQ ID NO: 3125813 - protein, 8 aa, Giardia lamblia
NRSTGKPA

SEQ ID NO: 3125814 - protein, 4 aa, Giardia lamblia
NRSV

SEQ ID NO: 3125815 - protein, 6 aa, Giardia lamblia
NRSYPT

SEQ ID NO: 3125816 - protein, 4 aa, Giardia lamblia
NRTA

SEQ ID NO: 3125817 - protein, 8 aa, Giardia lamblia
NRTATETV

SEQ ID NO: 3125818 - protein, 8 aa, Giardia lamblia
NRTDGPCT

SEQ ID NO: 3125819 - protein, 6 aa, Giardia lamblia
NRTGQW

SEQ ID NO: 3125820 - protein, 13 aa, Giardia lamblia
NRTGTAKPKGLTA

SEQ ID NO: 3125821 - protein, 4 aa, Giardia lamblia
NRTI

SEQ ID NO: 3125822 - protein, 5 aa, Giardia lamblia
NRTIP

SEQ ID NO: 3125823 - protein, 6 aa, Giardia lamblia
NRTKSL

SEQ ID NO: 3125824 - protein, 5 aa, Giardia lamblia
NRTQQ

SEQ ID NO: 3125825 - protein, 8 aa, Giardia lamblia
NRTSLRSE

SEQ ID NO: 3125826 - protein, 8 aa, Giardia lamblia
NRTTGAMN

SEQ ID NO: 3125827 - protein, 11 aa, Giardia lamblia
NRTYDGETPER

SEQ ID NO: 3125828 - protein, 9 aa, Giardia lamblia
NRVDSNGST

SEQ ID NO: 3125829 - protein, 12 aa, Giardia lamblia
NRVQDKDKPGQF

SEQ ID NO: 3125830 - protein, 15 aa, Giardia lamblia
NRVREEAEQAIRDAR

SEQ ID NO: 3125831 - protein, 9 aa, Giardia lamblia
NRWTSTGNE

SEQ ID NO: 3125832 - protein, 12 aa, Giardia lamblia
NRYAKERDREYA

SEQ ID NO: 3125833 - protein, 6 aa, Giardia lamblia
NRYDAK

SEQ ID NO: 3125834 - protein, 8 aa, Giardia lamblia
NSAEKLEN

SEQ ID NO: 3125835 - protein, 7 aa, Giardia lamblia
NSAELTK

SEQ ID NO: 3125836 - protein, 6 aa, Giardia lamblia
NSAEST

SEQ ID NO: 3125837 - protein, 10 aa, Giardia lamblia
NSAETNDELG

SEQ ID NO: 3125838 - protein, 4 aa, Giardia lamblia
NSAF

SEQ ID NO: 3125839 - protein, 4 aa, Giardia lamblia
NSAG

SEQ ID NO: 3125840 - protein, 8 aa, Giardia lamblia
NSAKIEGK

SEQ ID NO: 3125841 - protein, 22 aa, Giardia lamblia
NSAKSADDTGQPNQPTESSSIK

SEQ ID NO: 3125842 - protein, 6 aa, Giardia lamblia
NSANAS

SEQ ID NO: 3125843 - protein, 8 aa, Giardia lamblia
NSAPNRAT

SEQ ID NO: 3125844 - protein, 8 aa, Giardia lamblia
NSAQQNTS

SEQ ID NO: 3125845 - protein, 8 aa, Giardia lamblia
NSAQQTLT

SEQ ID NO: 3125846 - protein, 9 aa, Giardia lamblia
NSARGTPAN

SEQ ID NO: 3125847 - protein, 9 aa, Giardia lamblia
NSARTNTTG

SEQ ID NO: 3125848 - protein, 9 aa, Giardia lamblia
NSASETADL

SEQ ID NO: 3125849 - protein, 15 aa, Giardia lamblia
NSASINEVEANKKIQ

SEQ ID NO: 3125850 - protein, 40 aa, Giardia lamblia
NSATGSVVDGRGSYLSTGNYGASSASRKAYEDNINNDNGA

SEQ ID NO: 3125851 - protein, 34 aa, Giardia lamblia
NSAVSSSNLNPQKKNQTKTQRTASKPARNHALSA

SEQ ID NO: 3125852 - protein, 8 aa, Giardia lamblia
NSCIGPKK

SEQ ID NO: 3125853 - protein, 9 aa, Giardia lamblia
NSCSTHQRP

SEQ ID NO: 3125854 - protein, 27 aa, Giardia lamblia
NSCTSSRAADEDVACNPGDEPKTGPAE

SEQ ID NO: 3125855 - protein, 4 aa, Giardia lamblia
NSDA

SEQ ID NO: 3125856 - protein, 9 aa, Giardia lamblia
NSDAGGGSM

SEQ ID NO: 3125857 - protein, 13 aa, Giardia lamblia
NSDAGSRNSPTIK

SEQ ID NO: 3125858 - protein, 10 aa, Giardia lamblia
NSDASEGASD

SEQ ID NO: 3125859 - protein, 7 aa, Giardia lamblia
NSDDDGF

SEQ ID NO: 3125860 - protein, 12 aa, Giardia lamblia
NSDDRKLGVPPV

SEQ ID NO: 3125861 - protein, 10 aa, Giardia lamblia
NSDEAARFAK

SEQ ID NO: 3125862 - protein, 7 aa, Giardia lamblia
NSDEYKR

SEQ ID NO: 3125863 - protein, 4 aa, Giardia lamblia
NSDG

SEQ ID NO: 3125864 - protein, 6 aa, Giardia lamblia
NSDGAE

SEQ ID NO: 3125865 - protein, 18 aa, Giardia lamblia
NSDGTLTLESRGRQRTKI

SEQ ID NO: 3125866 - protein, 23 aa, Giardia lamblia
NSDHPTSVPATSLPTPSYSGSAH

SEQ ID NO: 3125867 - protein, 5 aa, Giardia lamblia
NSDIA

SEQ ID NO: 3125868 - protein, 5 aa, Giardia lamblia
NSDIE

SEQ ID NO: 3125869 - protein, 9 aa, Giardia lamblia
NSDKTPGEY

SEQ ID NO: 3125870 - protein, 11 aa, Giardia lamblia
NSDLRGQSTAL

SEQ ID NO: 3125871 - protein, 10 aa, Giardia lamblia
NSDNDIKGKI

SEQ ID NO: 3125872 - protein, 5 aa, Giardia lamblia
NSDNK

SEQ ID NO: 3125873 - protein, 9 aa, Giardia lamblia
NSDPGEETL

SEQ ID NO: 3125874 - protein, 7 aa, Giardia lamblia
NSDPKFK

SEQ ID NO: 3125875 - protein, 8 aa, Giardia lamblia
NSDRSASR

SEQ ID NO: 3125876 - protein, 9 aa, Giardia lamblia
NSDSAAYEA

SEQ ID NO: 3125877 - protein, 6 aa, Giardia lamblia
NSDSDD

SEQ ID NO: 3125878 - protein, 7 aa, Giardia lamblia
NSDSEEL

SEQ ID NO: 3125879 - protein, 6 aa, Giardia lamblia
NSDSSY

SEQ ID NO: 3125880 - protein, 8 aa, Giardia lamblia
NSDSTPTW

SEQ ID NO: 3125881 - protein, 12 aa, Giardia lamblia
NSDYSGGEHDGS

SEQ ID NO: 3125882 - protein, 6 aa, Giardia lamblia
NSEADG

SEQ ID NO: 3125883 - protein, 12 aa, Giardia lamblia
NSEADGAGATNI

SEQ ID NO: 3125884 - protein, 10 aa, Giardia lamblia
NSEAEHTINS

SEQ ID NO: 3125885 - protein, 4 aa, Giardia lamblia
NSED

SEQ ID NO: 3125886 - protein, 33 aa, Giardia lamblia
NSEDETEAISPRTPNCPETPGSRRITPRSQSTV

SEQ ID NO: 3125887 - protein, 6 aa, Giardia lamblia
NSEDVS

SEQ ID NO: 3125888 - protein, 6 aa, Giardia lamblia
NSEGKT

SEQ ID NO: 3125889 - protein, 5 aa, Giardia lamblia
NSEIA

SEQ ID NO: 3125890 - protein, 6 aa, Giardia lamblia
NSEIET

SEQ ID NO: 3125891 - protein, 7 aa, Giardia lamblia
NSEISEL

SEQ ID NO: 3125892 - protein, 7 aa, Giardia lamblia
NSEITEL

SEQ ID NO: 3125893 - protein, 4 aa, Giardia lamblia
NSEN

SEQ ID NO: 3125894 - protein, 6 aa, Giardia lamblia
NSEPIG

SEQ ID NO: 3125895 - protein, 11 aa, Giardia lamblia
NSEPMKDKPYT

SEQ ID NO: 3125896 - protein, 9 aa, Giardia lamblia
NSEPYGKKS

SEQ ID NO: 3125897 - protein, 19 aa, Giardia lamblia
NSERGKTKPYYTYNPGTSM

SEQ ID NO: 3125898 - protein, 7 aa, Giardia lamblia
NSERPDC

SEQ ID NO: 3125899 - protein, 7 aa, Giardia lamblia
NSESVSY

SEQ ID NO: 3125900 - protein, 7 aa, Giardia lamblia
NSETSNV

SEQ ID NO: 3125901 - protein, 10 aa, Giardia lamblia
NSEVDGSDHR

SEQ ID NO: 3125902 - protein, 5 aa, Giardia lamblia
NSEYH

SEQ ID NO: 3125903 - protein, 14 aa, Giardia lamblia
NSFEGDDNEDEDDA

SEQ ID NO: 3125904 - protein, 4 aa, Giardia lamblia
NSFI

SEQ ID NO: 3125905 - protein, 10 aa, Giardia lamblia
NSFNNPEGEY

SEQ ID NO: 3125906 - protein, 6 aa, Giardia lamblia
NSFQPG

SEQ ID NO: 3125907 - protein, 7 aa, Giardia lamblia
NSFSSPS

SEQ ID NO: 3125908 - protein, 12 aa, Giardia lamblia
NSGAAPPPSLPS

SEQ ID NO: 3125909 - protein, 6 aa, Giardia lamblia
NSGDRE

SEQ ID NO: 3125910 - protein, 7 aa, Giardia lamblia
NSGGTMN

SEQ ID NO: 3125911 - protein, 7 aa, Giardia lamblia
NSGGYNT

SEQ ID NO: 3125912 - protein, 13 aa, Giardia lamblia
NSGHNLHEDDPNT

SEQ ID NO: 3125913 - protein, 11 aa, Giardia lamblia
NSGIGGNSGIP

SEQ ID NO: 3125914 - protein, 13 aa, Giardia lamblia
NSGIHGVNDPEHV

SEQ ID NO: 3125915 - protein, 7 aa, Giardia lamblia
NSGKELS

SEQ ID NO: 3125916 - protein, 6 aa, Giardia lamblia
NSGKTT

SEQ ID NO: 3125917 - protein, 4 aa, Giardia lamblia
NSGN

SEQ ID NO: 3125918 - protein, 9 aa, Giardia lamblia
NSGNVGTAR

SEQ ID NO: 3125919 - protein, 9 aa, Giardia lamblia
NSGPGSSIR

SEQ ID NO: 3125920 - protein, 7 aa, Giardia lamblia
NSGSDLQ

SEQ ID NO: 3125921 - protein, 8 aa, Giardia lamblia
NSGSGKTT

SEQ ID NO: 3125922 - protein, 13 aa, Giardia lamblia
NSGSSASVRNRST

SEQ ID NO: 3125923 - protein, 5 aa, Giardia lamblia
NSGVA

SEQ ID NO: 3125924 - protein, 6 aa, Giardia lamblia
NSHAEA

SEQ ID NO: 3125925 - protein, 7 aa, Giardia lamblia
NSHDSSI

SEQ ID NO: 3125926 - protein, 6 aa, Giardia lamblia
NSHFTR

SEQ ID NO: 3125927 - protein, 13 aa, Giardia lamblia
NSHGPDPAKAGKL

SEQ ID NO: 3125928 - protein, 10 aa, Giardia lamblia
NSHGPDPSLD

SEQ ID NO: 3125929 - protein, 7 aa, Giardia lamblia
NSHGVSA

SEQ ID NO: 3125930 - protein, 10 aa, Giardia lamblia
NSIAGSRRIA

SEQ ID NO: 3125931 - protein, 5 aa, Giardia lamblia
NSIAT

SEQ ID NO: 3125932 - protein, 11 aa, Giardia lamblia
NSIDSNSLSQM

SEQ ID NO: 3125933 - protein, 5 aa, Giardia lamblia
NSIEQ

SEQ ID NO: 3125934 - protein, 7 aa, Giardia lamblia
NSIEQDH

SEQ ID NO: 3125935 - protein, 5 aa, Giardia lamblia
NSIGS

SEQ ID NO: 3125936 - protein, 8 aa, Giardia lamblia
NSINETTK

SEQ ID NO: 3125937 - protein, 22 aa, Giardia lamblia
NSINSRGASRATSPNHGARSSG

SEQ ID NO: 3125938 - protein, 14 aa, Giardia lamblia
NSIPVKTANDCPVA

SEQ ID NO: 3125939 - protein, 14 aa, Giardia lamblia
NSIRSRKISNTETD

SEQ ID NO: 3125940 - protein, 7 aa, Giardia lamblia
NSISHTG

SEQ ID NO: 3125941 - protein, 21 aa, Giardia lamblia
NSISQIKKTTDLGRSSDVPRV

SEQ ID NO: 3125942 - protein, 5 aa, Giardia lamblia
NSITT

SEQ ID NO: 3125943 - protein, 5 aa, Giardia lamblia
NSKAA

SEQ ID NO: 3125944 - protein, 7 aa, Giardia lamblia
NSKADIS

SEQ ID NO: 3125945 - protein, 5 aa, Giardia lamblia
NSKAY

SEQ ID NO: 3125946 - protein, 9 aa, Giardia lamblia
NSKDANTIE

SEQ ID NO: 3125947 - protein, 25 aa, Giardia lamblia
NSKDSKDNKGNKQQKARDGQEDKHD

SEQ ID NO: 3125948 - protein, 6 aa, Giardia lamblia
NSKEEL

SEQ ID NO: 3125949 - protein, 8 aa, Giardia lamblia
NSKGFGDF

SEQ ID NO: 3125950 - protein, 8 aa, Giardia lamblia
NSKGQDCR

SEQ ID NO: 3125951 - protein, 7 aa, Giardia lamblia
NSKHDAS

SEQ ID NO: 3125952 - protein, 8 aa, Giardia lamblia
NSKHNCPK

SEQ ID NO: 3125953 - protein, 17 aa, Giardia lamblia
NSKHTASSKAKAKVTHT

SEQ ID NO: 3125954 - protein, 5 aa, Giardia lamblia
NSKKS

SEQ ID NO: 3125955 - protein, 9 aa, Giardia lamblia
NSKLDASRI

SEQ ID NO: 3125956 - protein, 9 aa, Giardia lamblia
NSKLSADAA

SEQ ID NO: 3125957 - protein, 7 aa, Giardia lamblia
NSKSPAM

SEQ ID NO: 3125958 - protein, 34 aa, Giardia lamblia
NSKSQSSVEKGAHTQDTGTCDEKDDNNELVISEV

SEQ ID NO: 3125959 - protein, 8 aa, Giardia lamblia
NSKSSTWH

SEQ ID NO: 3125960 - protein, 9 aa, Giardia lamblia
NSKTGSPMN

SEQ ID NO: 3125961 - protein, 6 aa, Giardia lamblia
NSKTHN

SEQ ID NO: 3125962 - protein, 5 aa, Giardia lamblia
NSKTL

SEQ ID NO: 3125963 - protein, 9 aa, Giardia lamblia
NSKVTSAEI

SEQ ID NO: 3125964 - protein, 7 aa, Giardia lamblia
NSLAPSN

SEQ ID NO: 3125965 - protein, 5 aa, Giardia lamblia
NSLDA

SEQ ID NO: 3125966 - protein, 11 aa, Giardia lamblia
NSLDTNGQQNH

SEQ ID NO: 3125967 - protein, 5 aa, Giardia lamblia
NSLED

SEQ ID NO: 3125968 - protein, 4 aa, Giardia lamblia
NSLG

SEQ ID NO: 3125969 - protein, 8 aa, Giardia lamblia
NSLGQNAE

SEQ ID NO: 3125970 - protein, 25 aa, Giardia lamblia
NSLGTATASSTQDLEGVNDSSAMGS

SEQ ID NO: 3125971 - protein, 11 aa, Giardia lamblia
NSLNPSDARTD

SEQ ID NO: 3125972 - protein, 6 aa, Giardia lamblia
NSLQRG

SEQ ID NO: 3125973 - protein, 6 aa, Giardia lamblia
NSLRPN

SEQ ID NO: 3125974 - protein, 9 aa, Giardia lamblia
NSLSEARRK

SEQ ID NO: 3125975 - protein, 14 aa, Giardia lamblia
NSLSNDAANTHSTE

SEQ ID NO: 3125976 - protein, 14 aa, Giardia lamblia
NSLSPEASPPSPGV

SEQ ID NO: 3125977 - protein, 11 aa, Giardia lamblia
NSLSPPSLEGL

SEQ ID NO: 3125978 - protein, 7 aa, Giardia lamblia
NSLSSRS

SEQ ID NO: 3125979 - protein, 4 aa, Giardia lamblia
NSME

SEQ ID NO: 3125980 - protein, 4 aa, Giardia lamblia
NSMG

SEQ ID NO: 3125981 - protein, 30 aa, Giardia lamblia
NSMKAEGEKVRQKGQVVDGDTGAKANEGAH

SEQ ID NO: 3125982 - protein, 6 aa, Giardia lamblia
NSMPPR

SEQ ID NO: 3125983 - protein, 7 aa, Giardia lamblia
NSMSDEE

SEQ ID NO: 3125984 - protein, 9 aa, Giardia lamblia
NSNAESKID

SEQ ID NO: 3125985 - protein, 6 aa, Giardia lamblia
NSNAPD

SEQ ID NO: 3125986 - protein, 14 aa, Giardia lamblia
NSNASDKAIYDENG

SEQ ID NO: 3125987 - protein, 6 aa, Giardia lamblia
NSNDKR

SEQ ID NO: 3125988 - protein, 12 aa, Giardia lamblia
NSNEHSTSPMFP

SEQ ID NO: 3125989 - protein, 6 aa, Giardia lamblia
NSNETE

SEQ ID NO: 3125990 - protein, 13 aa, Giardia lamblia
NSNHNAFTSHPKS

SEQ ID NO: 3125991 - protein, 5 aa, Giardia lamblia
NSNNV

SEQ ID NO: 3125992 - protein, 4 aa, Giardia lamblia
NSNP

SEQ ID NO: 3125993 - protein, 9 aa, Giardia lamblia
NSNPITNTQ

SEQ ID NO: 3125994 - protein, 7 aa, Giardia lamblia
NSNPKIE

SEQ ID NO: 3125995 - protein, 29 aa, Giardia lamblia
NSNPTGKQYQYSTTNSIKPHGEFDSDGLD

SEQ ID NO: 3125996 - protein, 15 aa, Giardia lamblia
NSNQSNSGTIGLDGT

SEQ ID NO: 3125997 - protein, 15 aa, Giardia lamblia
NSNRRYSSTAFGGPG

SEQ ID NO: 3125998 - protein, 8 aa, Giardia lamblia
NSNSVSAQ

SEQ ID NO: 3125999 - protein, 11 aa, Giardia lamblia
NSNSYSSDDNI

SEQ ID NO: 3126000 - protein, 7 aa, Giardia lamblia
NSNTEGE

SEQ ID NO: 3126001 - protein, 9 aa, Giardia lamblia
NSNVTEEGY

SEQ ID NO: 3126002 - protein, 8 aa, Giardia lamblia
NSPASRSV

SEQ ID NO: 3126003 - protein, 4 aa, Giardia lamblia
NSPD

SEQ ID NO: 3126004 - protein, 7 aa, Giardia lamblia
NSPDDSH

SEQ ID NO: 3126005 - protein, 6 aa, Giardia lamblia
NSPDKL

SEQ ID NO: 3126006 - protein, 4 aa, Giardia lamblia
NSPE

SEQ ID NO: 3126007 - protein, 7 aa, Giardia lamblia
NSPEGEY

SEQ ID NO: 3126008 - protein, 6 aa, Giardia lamblia
NSPEYK

SEQ ID NO: 3126009 - protein, 7 aa, Giardia lamblia
NSPGIRP

SEQ ID NO: 3126010 - protein, 9 aa, Giardia lamblia
NSPGSRVTP

SEQ ID NO: 3126011 - protein, 8 aa, Giardia lamblia
NSPHGAAH

SEQ ID NO: 3126012 - protein, 5 aa, Giardia lamblia
NSPQL

SEQ ID NO: 3126013 - protein, 35 aa, Giardia lamblia
NSPQQTSRLDSDSDSDYITQTPTVKQRKVQGNDSV

SEQ ID NO: 3126014 - protein, 9 aa, Giardia lamblia
NSPQSHAGD

SEQ ID NO: 3126015 - protein, 5 aa, Giardia lamblia
NSPRF

SEQ ID NO: 3126016 - protein, 7 aa, Giardia lamblia
NSPSALT

SEQ ID NO: 3126017 - protein, 8 aa, Giardia lamblia
NSPSTGVS

SEQ ID NO: 3126018 - protein, 23 aa, Giardia lamblia
NSPTGSTNPASRTSSVSAPSNID

SEQ ID NO: 3126019 - protein, 6 aa, Giardia lamblia
NSPTYP

SEQ ID NO: 3126020 - protein, 7 aa, Giardia lamblia
NSPVPYI

SEQ ID NO: 3126021 - protein, 16 aa, Giardia lamblia
NSPVRRSPEQRKPKPN

SEQ ID NO: 3126022 - protein, 6 aa, Giardia lamblia
NSQATR

SEQ ID NO: 3126023 - protein, 6 aa, Giardia lamblia
NSQCKA

SEQ ID NO: 3126024 - protein, 11 aa, Giardia lamblia
NSQDMRKRSRE

SEQ ID NO: 3126025 - protein, 8 aa, Giardia lamblia
NSQEPSEE

SEQ ID NO: 3126026 - protein, 12 aa, Giardia lamblia
NSQGSSEGYTEA

SEQ ID NO: 3126027 - protein, 9 aa, Giardia lamblia
NSQKLSGDQ

SEQ ID NO: 3126028 - protein, 4 aa, Giardia lamblia
NSQL

SEQ ID NO: 3126029 - protein, 13 aa, Giardia lamblia
NSQNGSQDEEDRT

SEQ ID NO: 3126030 - protein, 7 aa, Giardia lamblia
NSQNSLS

SEQ ID NO: 3126031 - protein, 17 aa, Giardia lamblia
NSQPIVPPTGIKGSARL

SEQ ID NO: 3126032 - protein, 8 aa, Giardia lamblia
NSQRNGSL

SEQ ID NO: 3126033 - protein, 6 aa, Giardia lamblia
NSQVSH

SEQ ID NO: 3126034 - protein, 7 aa, Giardia lamblia
NSRDIYG

SEQ ID NO: 3126035 - protein, 6 aa, Giardia lamblia
NSRDRI

SEQ ID NO: 3126036 - protein, 8 aa, Giardia lamblia
NSREKDMK

SEQ ID NO: 3126037 - protein, 15 aa, Giardia lamblia
NSRKESADRASSEAD

SEQ ID NO: 3126038 - protein, 12 aa, Giardia lamblia
NSRLTKSQDKLQ

SEQ ID NO: 3126039 - protein, 6 aa, Giardia lamblia
NSRNKP

SEQ ID NO: 3126040 - protein, 4 aa, Giardia lamblia
NSRP

SEQ ID NO: 3126041 - protein, 13 aa, Giardia lamblia
NSRPLRSSSNGDG

SEQ ID NO: 3126042 - protein, 10 aa, Giardia lamblia
NSRQFNPGLQ

SEQ ID NO: 3126043 - protein, 11 aa, Giardia lamblia
NSRQPSTSAST

SEQ ID NO: 3126044 - protein, 7 aa, Giardia lamblia
NSRSNRA

SEQ ID NO: 3126045 - protein, 25 aa, Giardia lamblia
NSRSQPTSALQDSNKSLQRPKINPT

SEQ ID NO: 3126046 - protein, 26 aa, Giardia lamblia
NSRSQSGSHLSERERINRERERLQKE

SEQ ID NO: 3126047 - protein, 7 aa, Giardia lamblia
NSRTPGA

SEQ ID NO: 3126048 - protein, 20 aa, Giardia lamblia
NSRTPGADDCNDHQAAPRSH

SEQ ID NO: 3126049 - protein, 12 aa, Giardia lamblia
NSRVDNGGKDST

SEQ ID NO: 3126050 - protein, 13 aa, Giardia lamblia
NSSAAHQQQGQTT

SEQ ID NO: 3126051 - protein, 6 aa, Giardia lamblia
NSSASL

SEQ ID NO: 3126052 - protein, 12 aa, Giardia lamblia
NSSATSEIGDEV

SEQ ID NO: 3126053 - protein, 9 aa, Giardia lamblia
NSSCESKKK

SEQ ID NO: 3126054 - protein, 4 aa, Giardia lamblia
NSSD

SEQ ID NO: 3126055 - protein, 17 aa, Giardia lamblia
NSSDPPGYKTPPPPSFI

SEQ ID NO: 3126056 - protein, 10 aa, Giardia lamblia
NSSDSSMNSS

SEQ ID NO: 3126057 - protein, 7 aa, Giardia lamblia
NSSDTQL

SEQ ID NO: 3126058 - protein, 6 aa, Giardia lamblia
NSSEFD

SEQ ID NO: 3126059 - protein, 7 aa, Giardia lamblia
NSSGPCS

SEQ ID NO: 3126060 - protein, 8 aa, Giardia lamblia
NSSGTRSS

SEQ ID NO: 3126061 - protein, 16 aa, Giardia lamblia
NSSHQAFSADKPLPKQ

SEQ ID NO: 3126062 - protein, 6 aa, Giardia lamblia
NSSHTS

SEQ ID NO: 3126063 - protein, 4 aa, Giardia lamblia
NSSK

SEQ ID NO: 3126064 - protein, 5 aa, Giardia lamblia
NSSKC

SEQ ID NO: 3126065 - protein, 6 aa, Giardia lamblia
NSSKCG

SEQ ID NO: 3126066 - protein, 4 aa, Giardia lamblia
NSSL

SEQ ID NO: 3126067 - protein, 15 aa, Giardia lamblia
NSSLELEKRSKKEQL

SEQ ID NO: 3126068 - protein, 8 aa, Giardia lamblia
NSSLTTAS

SEQ ID NO: 3126069 - protein, 7 aa, Giardia lamblia
NSSMNTA

SEQ ID NO: 3126070 - protein, 4 aa, Giardia lamblia
NSSN

SEQ ID NO: 3126071 - protein, 31 aa, Giardia lamblia
NSSPASNKPLVNQQPAIDQDPKDDGDTAQQL

SEQ ID NO: 3126072 - protein, 11 aa, Giardia lamblia
NSSPPDDDEAA

SEQ ID NO: 3126073 - protein, 8 aa, Giardia lamblia
NSSPSHTL

SEQ ID NO: 3126074 - protein, 10 aa, Giardia lamblia
NSSQRSSVTG

SEQ ID NO: 3126075 - protein, 4 aa, Giardia lamblia
NSSS

SEQ ID NO: 3126076 - protein, 9 aa, Giardia lamblia
NSSSAPTAV

SEQ ID NO: 3126077 - protein, 14 aa, Giardia lamblia
NSSSDNEEGADIEE

SEQ ID NO: 3126078 - protein, 9 aa, Giardia lamblia
NSSSNKIKE

SEQ ID NO: 3126079 - protein, 18 aa, Giardia lamblia
NSSSPTRRDIGRKGEEIA

SEQ ID NO: 3126080 - protein, 7 aa, Giardia lamblia
NSSSSNQ

SEQ ID NO: 3126081 - protein, 7 aa, Giardia lamblia
NSSSSNY

SEQ ID NO: 3126082 - protein, 39 aa, Giardia lamblia
NSSSTSRSSSVNSAANSSDISTSSDLGNSSEKSPSISRS

SEQ ID NO: 3126083 - protein, 12 aa, Giardia lamblia
NSSTAHKDMKTT

SEQ ID NO: 3126084 - protein, 8 aa, Giardia lamblia
NSSTAVQP

SEQ ID NO: 3126085 - protein, 18 aa, Giardia lamblia
NSSTGTWEYDTRKQDALE

SEQ ID NO: 3126086 - protein, 6 aa, Giardia lamblia
NSSTIQ

SEQ ID NO: 3126087 - protein, 8 aa, Giardia lamblia
NSSTSMNT

SEQ ID NO: 3126088 - protein, 11 aa, Giardia lamblia
NSSVSNTTDQA

SEQ ID NO: 3126089 - protein, 18 aa, Giardia lamblia
NSSYSSKISELKNQSQET

SEQ ID NO: 3126090 - protein, 25 aa, Giardia lamblia
NSTARQHQSALPDPIERNPDNFDFF

SEQ ID NO: 3126091 - protein, 11 aa, Giardia lamblia
NSTDSITDNTY

SEQ ID NO: 3126092 - protein, 4 aa, Giardia lamblia
NSTE

SEQ ID NO: 3126093 - protein, 9 aa, Giardia lamblia
NSTELPDHT

SEQ ID NO: 3126094 - protein, 4 aa, Giardia lamblia
NSTG

SEQ ID NO: 3126095 - protein, 23 aa, Giardia lamblia
NSTGNSYRQAKAKRKSGSFSGGS

SEQ ID NO: 3126096 - protein, 7 aa, Giardia lamblia
NSTIQDN

SEQ ID NO: 3126097 - protein, 6 aa, Giardia lamblia
NSTKAS

SEQ ID NO: 3126098 - protein, 5 aa, Giardia lamblia
NSTLL

SEQ ID NO: 3126099 - protein, 8 aa, Giardia lamblia
NSTLSSSV

SEQ ID NO: 3126100 - protein, 4 aa, Giardia lamblia
NSTM

SEQ ID NO: 3126101 - protein, 12 aa, Giardia lamblia
NSTMGSEENSRV

SEQ ID NO: 3126102 - protein, 8 aa, Giardia lamblia
NSTPHGPI

SEQ ID NO: 3126103 - protein, 5 aa, Giardia lamblia
NSTPI

SEQ ID NO: 3126104 - protein, 10 aa, Giardia lamblia
NSTPREYNNQ

SEQ ID NO: 3126105 - protein, 13 aa, Giardia lamblia
NSTPYSSSKYSFA

SEQ ID NO: 3126106 - protein, 7 aa, Giardia lamblia
NSTPYTT

SEQ ID NO: 3126107 - protein, 8 aa, Giardia lamblia
NSTRAPQV

SEQ ID NO: 3126108 - protein, 15 aa, Giardia lamblia
NSTRNPTPSRSKHPI

SEQ ID NO: 3126109 - protein, 14 aa, Giardia lamblia
NSTRQSPSNTTKES

SEQ ID NO: 3126110 - protein, 7 aa, Giardia lamblia
NSTRYNS

SEQ ID NO: 3126111 - protein, 10 aa, Giardia lamblia
NSTSDTQATL

SEQ ID NO: 3126112 - protein, 8 aa, Giardia lamblia
NSTSEPCR

SEQ ID NO: 3126113 - protein, 8 aa, Giardia lamblia
NSTSISEE

SEQ ID NO: 3126114 - protein, 6 aa, Giardia lamblia
NSTSRY

SEQ ID NO: 3126115 - protein, 8 aa, Giardia lamblia
NSTSSQQK

SEQ ID NO: 3126116 - protein, 28 aa, Giardia lamblia
NSTTTAQPLQPSSQQPEDVQSGSNSAQL

SEQ ID NO: 3126117 - protein, 6 aa, Giardia lamblia
NSVAAE

SEQ ID NO: 3126118 - protein, 7 aa, Giardia lamblia
NSVEDSK

SEQ ID NO: 3126119 - protein, 12 aa, Giardia lamblia
NSVGAERKKGFS

SEQ ID NO: 3126120 - protein, 10 aa, Giardia lamblia
NSVKPSPNPV

SEQ ID NO: 3126121 - protein, 8 aa, Giardia lamblia
NSVPEQTS

SEQ ID NO: 3126122 - protein, 8 aa, Giardia lamblia
NSVPSKLR

SEQ ID NO: 3126123 - protein, 4 aa, Giardia lamblia
NSVQ

SEQ ID NO: 3126124 - protein, 32 aa, Giardia lamblia
NSVQPADVYEGRPNRYREQPSSMHISSIQSSM

SEQ ID NO: 3126125 - protein, 4 aa, Giardia lamblia
NSVS

SEQ ID NO: 3126126 - protein, 7 aa, Giardia lamblia
NSVSGTI

SEQ ID NO: 3126127 - protein, 6 aa, Giardia lamblia
NSYGAA

SEQ ID NO: 3126128 - protein, 6 aa, Giardia lamblia
NSYKST

SEQ ID NO: 3126129 - protein, 12 aa, Giardia lamblia
NSYNDKQEPEPL

SEQ ID NO: 3126130 - protein, 22 aa, Giardia lamblia
NSYQPPTKESKDSPEETESLRA

SEQ ID NO: 3126131 - protein, 10 aa, Giardia lamblia
NSYRGTNEDI

SEQ ID NO: 3126132 - protein, 4 aa, Giardia lamblia
NSYS

SEQ ID NO: 3126133 - protein, 15 aa, Giardia lamblia
NSYSEQLEASELEGK

SEQ ID NO: 3126134 - protein, 4 aa, Giardia lamblia
NSYT

SEQ ID NO: 3126135 - protein, 6 aa, Giardia lamblia
NTAAES

SEQ ID NO: 3126136 - protein, 7 aa, Giardia lamblia
NTADPQS

SEQ ID NO: 3126137 - protein, 28 aa, Giardia lamblia
NTADYTGTFNRSGSTQAYPAHEAQPGYM

SEQ ID NO: 3126138 - protein, 4 aa, Giardia lamblia
NTAE

SEQ ID NO: 3126139 - protein, 7 aa, Giardia lamblia
NTAEFTQ

SEQ ID NO: 3126140 - protein, 14 aa, Giardia lamblia
NTAEGNEEILAILS

SEQ ID NO: 3126141 - protein, 19 aa, Giardia lamblia
NTAFNPDGEMSSAYGDDLP

SEQ ID NO: 3126142 - protein, 7 aa, Giardia lamblia
NTAGDLT

SEQ ID NO: 3126143 - protein, 13 aa, Giardia lamblia
NTAGESPAGNTND

SEQ ID NO: 3126144 - protein, 8 aa, Giardia lamblia
NTAGGDRA

SEQ ID NO: 3126145 - protein, 5 aa, Giardia lamblia
NTAPK

SEQ ID NO: 3126146 - protein, 8 aa, Giardia lamblia
NTASPDVG

SEQ ID NO: 3126147 - protein, 13 aa, Giardia lamblia
NTAYYASGSPMPS

SEQ ID NO: 3126148 - protein, 14 aa, Giardia lamblia
NTDASGGSPRARRQ

SEQ ID NO: 3126149 - protein, 7 aa, Giardia lamblia
NTDATGP

SEQ ID NO: 3126150 - protein, 5 aa, Giardia lamblia
NTDGT

SEQ ID NO: 3126151 - protein, 15 aa, Giardia lamblia
NTDGVSSATSSQEVA

SEQ ID NO: 3126152 - protein, 8 aa, Giardia lamblia
NTDNSISS

SEQ ID NO: 3126153 - protein, 6 aa, Giardia lamblia
NTDNTI

SEQ ID NO: 3126154 - protein, 7 aa, Giardia lamblia
NTDPASF

SEQ ID NO: 3126155 - protein, 7 aa, Giardia lamblia
NTDQKSD

SEQ ID NO: 3126156 - protein, 25 aa, Giardia lamblia
NTDRDTEVVQSAGQRYTENLSRAQD

SEQ ID NO: 3126157 - protein, 11 aa, Giardia lamblia
NTDSRSEAGRG

SEQ ID NO: 3126158 - protein, 5 aa, Giardia lamblia
NTDTC

SEQ ID NO: 3126159 - protein, 6 aa, Giardia lamblia
NTDTSK

SEQ ID NO: 3126160 - protein, 9 aa, Giardia lamblia
NTDTSKEKL

SEQ ID NO: 3126161 - protein, 5 aa, Giardia lamblia
NTDVS

SEQ ID NO: 3126162 - protein, 49 aa, Giardia lamblia
NTEATTKTSTGSRQVTSKDYLSDNPYAPRSSSVDELNEGASPNRRPTVP

SEQ ID NO: 3126163 - protein, 5 aa, Giardia lamblia
NTEED

SEQ ID NO: 3126164 - protein, 17 aa, Giardia lamblia
NTEEGKQKKLDSNEMVQ

SEQ ID NO: 3126165 - protein, 7 aa, Giardia lamblia
NTEGPDI

SEQ ID NO: 3126166 - protein, 5 aa, Giardia lamblia
NTEGQ

SEQ ID NO: 3126167 - protein, 5 aa, Giardia lamblia
NTEHR

SEQ ID NO: 3126168 - protein, 9 aa, Giardia lamblia
NTEKDTKAA

SEQ ID NO: 3126169 - protein, 7 aa, Giardia lamblia
NTEKQLN

SEQ ID NO: 3126170 - protein, 13 aa, Giardia lamblia
NTEKRSMGGAETA

SEQ ID NO: 3126171 - protein, 4 aa, Giardia lamblia
NTEL

SEQ ID NO: 3126172 - protein, 10 aa, Giardia lamblia
NTEMQKRTEE

SEQ ID NO: 3126173 - protein, 7 aa, Giardia lamblia
NTENTLV

SEQ ID NO: 3126174 - protein, 5 aa, Giardia lamblia
NTEQA

SEQ ID NO: 3126175 - protein, 9 aa, Giardia lamblia
NTEQEISEK

SEQ ID NO: 3126176 - protein, 9 aa, Giardia lamblia
NTEQKRTQR

SEQ ID NO: 3126177 - protein, 14 aa, Giardia lamblia
NTETDKATSTSEAL

SEQ ID NO: 3126178 - protein, 5 aa, Giardia lamblia
NTEVD

SEQ ID NO: 3126179 - protein, 6 aa, Giardia lamblia
NTFERQ

SEQ ID NO: 3126180 - protein, 13 aa, Giardia lamblia
NTFSATPKTETIE

SEQ ID NO: 3126181 - protein, 6 aa, Giardia lamblia
NTFSKG

SEQ ID NO: 3126182 - protein, 6 aa, Giardia lamblia
NTFSTP

SEQ ID NO: 3126183 - protein, 11 aa, Giardia lamblia
NTGDDSGTGVG

SEQ ID NO: 3126184 - protein, 6 aa, Giardia lamblia
NTGEDF

SEQ ID NO: 3126185 - protein, 6 aa, Giardia lamblia
NTGEIQ

SEQ ID NO: 3126186 - protein, 8 aa, Giardia lamblia
NTGFENEK

SEQ ID NO: 3126187 - protein, 13 aa, Giardia lamblia
NTGGQKSKATSIG

SEQ ID NO: 3126188 - protein, 8 aa, Giardia lamblia
NTGGRKLP

SEQ ID NO: 3126189 - protein, 10 aa, Giardia lamblia
NTGHRRREIS

SEQ ID NO: 3126190 - protein, 5 aa, Giardia lamblia
NTGKE

SEQ ID NO: 3126191 - protein, 8 aa, Giardia lamblia
NTGKHDFS

SEQ ID NO: 3126192 - protein, 5 aa, Giardia lamblia
NTGKT

SEQ ID NO: 3126193 - protein, 5 aa, Giardia lamblia
NTGPS

SEQ ID NO: 3126194 - protein, 24 aa, Giardia lamblia
NTGRAQSKKWSKELYSGAKTPSID

SEQ ID NO: 3126195 - protein, 27 aa, Giardia lamblia
NTGTSSTSNNRQMSQPRTQSENSFSST

SEQ ID NO: 3126196 - protein, 4 aa, Giardia lamblia
NTGY

SEQ ID NO: 3126197 - protein, 5 aa, Giardia lamblia
NTHFT

SEQ ID NO: 3126198 - protein, 4 aa, Giardia lamblia
NTID

SEQ ID NO: 3126199 - protein, 8 aa, Giardia lamblia
NTIDTSTR

SEQ ID NO: 3126200 - protein, 10 aa, Giardia lamblia
NTIEDQRQAR

SEQ ID NO: 3126201 - protein, 6 aa, Giardia lamblia
NTIEGR

SEQ ID NO: 3126202 - protein, 8 aa, Giardia lamblia
NTIGSSSH

SEQ ID NO: 3126203 - protein, 6 aa, Giardia lamblia
NTIKSK

SEQ ID NO: 3126204 - protein, 6 aa, Giardia lamblia
NTINAS

SEQ ID NO: 3126205 - protein, 12 aa, Giardia lamblia
NTISTSAPSLNS

SEQ ID NO: 3126206 - protein, 4 aa, Giardia lamblia
NTKA

SEQ ID NO: 3126207 - protein, 6 aa, Giardia lamblia
NTKASM

SEQ ID NO: 3126208 - protein, 9 aa, Giardia lamblia
NTKFSSGAG

SEQ ID NO: 3126209 - protein, 25 aa, Giardia lamblia
NTKHKATKSTRGRKNKLKKRENVRE

SEQ ID NO: 3126210 - protein, 12 aa, Giardia lamblia
NTKKDIQSAPEK

SEQ ID NO: 3126211 - protein, 9 aa, Giardia lamblia
NTKKKSDAS

SEQ ID NO: 3126212 - protein, 6 aa, Giardia lamblia
NTKLPD

SEQ ID NO: 3126213 - protein, 9 aa, Giardia lamblia
NTKLTRGAK

SEQ ID NO: 3126214 - protein, 22 aa, Giardia lamblia
NTKLTSTAETRNMASERTLTSS

SEQ ID NO: 3126215 - protein, 4 aa, Giardia lamblia
NTKP

SEQ ID NO: 3126216 - protein, 7 aa, Giardia lamblia
NTKQDGC

SEQ ID NO: 3126217 - protein, 30 aa, Giardia lamblia
NTKQTSTQKPQDQAHSSRKKTEQRVKSVED

SEQ ID NO: 3126218 - protein, 7 aa, Giardia lamblia
NTKQVPV

SEQ ID NO: 3126219 - protein, 6 aa, Giardia lamblia
NTKSQI

SEQ ID NO: 3126220 - protein, 11 aa, Giardia lamblia
NTKYDEPLSPT

SEQ ID NO: 3126221 - protein, 17 aa, Giardia lamblia
NTLAPANRLASSGGIRG

SEQ ID NO: 3126222 - protein, 9 aa, Giardia lamblia
NTLATSTGD

SEQ ID NO: 3126223 - protein, 6 aa, Giardia lamblia
NTLGGG

SEQ ID NO: 3126224 - protein, 4 aa, Giardia lamblia
NTLM

SEQ ID NO: 3126225 - protein, 4 aa, Giardia lamblia
NTLP

SEQ ID NO: 3126226 - protein, 4 aa, Giardia lamblia
NTLQ

SEQ ID NO: 3126227 - protein, 9 aa, Giardia lamblia
NTLQSASQI

SEQ ID NO: 3126228 - protein, 36 aa, Giardia lamblia
NTLQSEKCSSGPLPFKGAEASSAVSALGRDSSLEDA

SEQ ID NO: 3126229 - protein, 5 aa, Giardia lamblia
NTLRE

SEQ ID NO: 3126230 - protein, 8 aa, Giardia lamblia
NTLTSTGY

SEQ ID NO: 3126231 - protein, 10 aa, Giardia lamblia
NTNDTGPAFT

SEQ ID NO: 3126232 - protein, 19 aa, Giardia lamblia
NTNEATQLKVSSEQALRAE

SEQ ID NO: 3126233 - protein, 18 aa, Giardia lamblia
NTNGGGSINATITGSTHY

SEQ ID NO: 3126234 - protein, 14 aa, Giardia lamblia
NTNGKLQPPQSDED

SEQ ID NO: 3126235 - protein, 9 aa, Giardia lamblia
NTNNLQPEI

SEQ ID NO: 3126236 - protein, 6 aa, Giardia lamblia
NTNNTK

SEQ ID NO: 3126237 - protein, 33 aa, Giardia lamblia
NTNPGPGAYNQDIRPTKASAPSYSLSGRPENAA

SEQ ID NO: 3126238 - protein, 10 aa, Giardia lamblia
NTNPGPGTYE

SEQ ID NO: 3126239 - protein, 6 aa, Giardia lamblia
NTNPNH

SEQ ID NO: 3126240 - protein, 10 aa, Giardia lamblia
NTNPTEEIDD

SEQ ID NO: 3126241 - protein, 16 aa, Giardia lamblia
NTNQSMSKLEKQARTI

SEQ ID NO: 3126242 - protein, 4 aa, Giardia lamblia
NTNS

SEQ ID NO: 3126243 - protein, 12 aa, Giardia lamblia
NTNSAEKQNAEF

SEQ ID NO: 3126244 - protein, 14 aa, Giardia lamblia
NTNSAYRKHRPHQA

SEQ ID NO: 3126245 - protein, 7 aa, Giardia lamblia
NTPAPGL

SEQ ID NO: 3126246 - protein, 23 aa, Giardia lamblia
NTPHQSSQPAQTAVRPSSVKKSR

SEQ ID NO: 3126247 - protein, 5 aa, Giardia lamblia
NTPKG

SEQ ID NO: 3126248 - protein, 9 aa, Giardia lamblia
NTPKPEGTI

SEQ ID NO: 3126249 - protein, 12 aa, Giardia lamblia
NTPLEANETEEE

SEQ ID NO: 3126250 - protein, 13 aa, Giardia lamblia
NTPMDKAYPSSTV

SEQ ID NO: 3126251 - protein, 4 aa, Giardia lamblia
NTPN

SEQ ID NO: 3126252 - protein, 17 aa, Giardia lamblia
NTPPRQADLPPSRGGVG

SEQ ID NO: 3126253 - protein, 21 aa, Giardia lamblia
NTPQNTLGVTTSKPKSSTPIR

SEQ ID NO: 3126254 - protein, 6 aa, Giardia lamblia
NTPRND

SEQ ID NO: 3126255 - protein, 19 aa, Giardia lamblia
NTPRTANSSFTSRNSSANS

SEQ ID NO: 3126256 - protein, 10 aa, Giardia lamblia
NTPSAKEELS

SEQ ID NO: 3126257 - protein, 15 aa, Giardia lamblia
NTPSKSYMTDEKNAG

SEQ ID NO: 3126258 - protein, 19 aa, Giardia lamblia
NTPSNGSTSKYSYRNPEDP

SEQ ID NO: 3126259 - protein, 26 aa, Giardia lamblia
NTPSSLSAISPEEGCDRVRDEGSSLD

SEQ ID NO: 3126260 - protein, 6 aa, Giardia lamblia
NTPSWP

SEQ ID NO: 3126261 - protein, 12 aa, Giardia lamblia
NTPTTGSDREQN

SEQ ID NO: 3126262 - protein, 9 aa, Giardia lamblia
NTPVPRDTL

SEQ ID NO: 3126263 - protein, 11 aa, Giardia lamblia
NTPVTDGAGTT

SEQ ID NO: 3126264 - protein, 7 aa, Giardia lamblia
NTQASAA

SEQ ID NO: 3126265 - protein, 5 aa, Giardia lamblia
NTQGY

SEQ ID NO: 3126266 - protein, 8 aa, Giardia lamblia
NTQKDGTT

SEQ ID NO: 3126267 - protein, 14 aa, Giardia lamblia
NTQKEKSGDEANGP

SEQ ID NO: 3126268 - protein, 5 aa, Giardia lamblia
NTQLA

SEQ ID NO: 3126269 - protein, 31 aa, Giardia lamblia
NTQLSSSRAPSGPSTEKSDGGVTPQGHIGSS

SEQ ID NO: 3126270 - protein, 4 aa, Giardia lamblia
NTQN

SEQ ID NO: 3126271 - protein, 7 aa, Giardia lamblia
NTQQKPL

SEQ ID NO: 3126272 - protein, 7 aa, Giardia lamblia
NTQRATE

SEQ ID NO: 3126273 - protein, 7 aa, Giardia lamblia
NTQSAKV

SEQ ID NO: 3126274 - protein, 15 aa, Giardia lamblia
NTQSERDSAKRNSKY

SEQ ID NO: 3126275 - protein, 5 aa, Giardia lamblia
NTQTG

SEQ ID NO: 3126276 - protein, 31 aa, Giardia lamblia
NTQTTMQSAPLTTTKTNKLHGKSKHKSKKSI

SEQ ID NO: 3126277 - protein, 8 aa, Giardia lamblia
NTRADKNQ

SEQ ID NO: 3126278 - protein, 8 aa, Giardia lamblia
NTRKYSGY

SEQ ID NO: 3126279 - protein, 4 aa, Giardia lamblia
NTRL

SEQ ID NO: 3126280 - protein, 8 aa, Giardia lamblia
NTRSTNPS

SEQ ID NO: 3126281 - protein, 23 aa, Giardia lamblia
NTSADSSSQLQKISTRQQESVQR

SEQ ID NO: 3126282 - protein, 15 aa, Giardia lamblia
NTSAPPTDTQGGRQI

SEQ ID NO: 3126283 - protein, 12 aa, Giardia lamblia
NTSAQHSNYQAN

SEQ ID NO: 3126284 - protein, 6 aa, Giardia lamblia
NTSARD

SEQ ID NO: 3126285 - protein, 8 aa, Giardia lamblia
NTSARKHS

SEQ ID NO: 3126286 - protein, 6 aa, Giardia lamblia
NTSDNS

SEQ ID NO: 3126287 - protein, 11 aa, Giardia lamblia
NTSEQENSRRV

SEQ ID NO: 3126288 - protein, 5 aa, Giardia lamblia
NTSFG

SEQ ID NO: 3126289 - protein, 18 aa, Giardia lamblia
NTSFKGAPELVSESGPIY

SEQ ID NO: 3126290 - protein, 6 aa, Giardia lamblia
NTSGAY

SEQ ID NO: 3126291 - protein, 7 aa, Giardia lamblia
NTSGISN

SEQ ID NO: 3126292 - protein, 7 aa, Giardia lamblia
NTSGPIS

SEQ ID NO: 3126293 - protein, 27 aa, Giardia lamblia
NTSIEQSVTRATSINDQRSNNHDYTTS

SEQ ID NO: 3126294 - protein, 7 aa, Giardia lamblia
NTSKELR

SEQ ID NO: 3126295 - protein, 16 aa, Giardia lamblia
NTSKKHQADLRTAKED

SEQ ID NO: 3126296 - protein, 5 aa, Giardia lamblia
NTSLK

SEQ ID NO: 3126297 - protein, 5 aa, Giardia lamblia
NTSLP

SEQ ID NO: 3126298 - protein, 23 aa, Giardia lamblia
NTSLSESANAQCTATSVRDSLSS

SEQ ID NO: 3126299 - protein, 14 aa, Giardia lamblia
NTSMQSNNTSFSQQ

SEQ ID NO: 3126300 - protein, 6 aa, Giardia lamblia
NTSPDA

SEQ ID NO: 3126301 - protein, 8 aa, Giardia lamblia
NTSPSLAG

SEQ ID NO: 3126302 - protein, 16 aa, Giardia lamblia
NTSQYNAQQVADENDH

SEQ ID NO: 3126303 - protein, 16 aa, Giardia lamblia
NTSRASVLQSQSASFS

SEQ ID NO: 3126304 - protein, 30 aa, Giardia lamblia
NTSRSASRDTTIRNANDSYGSGKASDHQSL

SEQ ID NO: 3126305 - protein, 53 aa, Giardia lamblia
NTSSDEESQSTSGAFSAKHTNNSAQDESDESELSSYTSASEEHSGTTFPNEAS

SEQ ID NO: 3126306 - protein, 7 aa, Giardia lamblia
NTSSKWE

SEQ ID NO: 3126307 - protein, 8 aa, Giardia lamblia
NTSSSTSL

SEQ ID NO: 3126308 - protein, 9 aa, Giardia lamblia
NTSSSTVRT

SEQ ID NO: 3126309 - protein, 8 aa, Giardia lamblia
NTSTEEAR

SEQ ID NO: 3126310 - protein, 9 aa, Giardia lamblia
NTSTGTQSS

SEQ ID NO: 3126311 - protein, 5 aa, Giardia lamblia
NTSTN

SEQ ID NO: 3126312 - protein, 9 aa, Giardia lamblia
NTSVRAPAD

SEQ ID NO: 3126313 - protein, 8 aa, Giardia lamblia
NTSYASQA

SEQ ID NO: 3126314 - protein, 6 aa, Giardia lamblia
NTSYDG

SEQ ID NO: 3126315 - protein, 5 aa, Giardia lamblia
NTSYP

SEQ ID NO: 3126316 - protein, 11 aa, Giardia lamblia
NTTAENLSSPN

SEQ ID NO: 3126317 - protein, 5 aa, Giardia lamblia
NTTDP

SEQ ID NO: 3126318 - protein, 12 aa, Giardia lamblia
NTTEAQQKSIEG

SEQ ID NO: 3126319 - protein, 6 aa, Giardia lamblia
NTTEES

SEQ ID NO: 3126320 - protein, 7 aa, Giardia lamblia
NTTEPPS

SEQ ID NO: 3126321 - protein, 6 aa, Giardia lamblia
NTTERH

SEQ ID NO: 3126322 - protein, 8 aa, Giardia lamblia
NTTGDSFS

SEQ ID NO: 3126323 - protein, 5 aa, Giardia lamblia
NTTGH

SEQ ID NO: 3126324 - protein, 6 aa, Giardia lamblia
NTTGQT

SEQ ID NO: 3126325 - protein, 5 aa, Giardia lamblia
NTTLT

SEQ ID NO: 3126326 - protein, 9 aa, Giardia lamblia
NTTMGTPSY

SEQ ID NO: 3126327 - protein, 18 aa, Giardia lamblia
NTTNNPNNELSETSATIY

SEQ ID NO: 3126328 - protein, 14 aa, Giardia lamblia
NTTNPAEDGKNIKA

SEQ ID NO: 3126329 - protein, 9 aa, Giardia lamblia
NTTNPNTYL

SEQ ID NO: 3126330 - protein, 12 aa, Giardia lamblia
NTTNSITLQEGS

SEQ ID NO: 3126331 - protein, 25 aa, Giardia lamblia
NTTPAKQHSLTGTLASSTFSTSGVS

SEQ ID NO: 3126332 - protein, 13 aa, Giardia lamblia
NTTPLPANDPQIT

SEQ ID NO: 3126333 - protein, 17 aa, Giardia lamblia
NTTPPDDEDVLSENSGI

SEQ ID NO: 3126334 - protein, 8 aa, Giardia lamblia
NTTQYTEN

SEQ ID NO: 3126335 - protein, 8 aa, Giardia lamblia
NTTTPPGI

SEQ ID NO: 3126336 - protein, 7 aa, Giardia lamblia
NTVAPPT

SEQ ID NO: 3126337 - protein, 22 aa, Giardia lamblia
NTVAQQGESPHARSDGEASSII

SEQ ID NO: 3126338 - protein, 12 aa, Giardia lamblia
NTVEERRQVGQT

SEQ ID NO: 3126339 - protein, 4 aa, Giardia lamblia
NTVI

SEQ ID NO: 3126340 - protein, 4 aa, Giardia lamblia
NTVK

SEQ ID NO: 3126341 - protein, 26 aa, Giardia lamblia
NTVKHSTPSDIRPATAKPPKEPEGDI

SEQ ID NO: 3126342 - protein, 4 aa, Giardia lamblia
NTVN

SEQ ID NO: 3126343 - protein, 8 aa, Giardia lamblia
NTVPPGGS

SEQ ID NO: 3126344 - protein, 6 aa, Giardia lamblia
NTVPRA

SEQ ID NO: 3126345 - protein, 4 aa, Giardia lamblia
NTVQ

SEQ ID NO: 3126346 - protein, 7 aa, Giardia lamblia
NTVSEAS

SEQ ID NO: 3126347 - protein, 5 aa, Giardia lamblia
NTVSG

SEQ ID NO: 3126348 - protein, 9 aa, Giardia lamblia
NTVSPEKEP

SEQ ID NO: 3126349 - protein, 13 aa, Giardia lamblia
NTVTKASSDLETT

SEQ ID NO: 3126350 - protein, 6 aa, Giardia lamblia
NTVTSK

SEQ ID NO: 3126351 - protein, 5 aa, Giardia lamblia
NTYGR

SEQ ID NO: 3126352 - protein, 4 aa, Giardia lamblia
NTYL

SEQ ID NO: 3126353 - protein, 9 aa, Giardia lamblia
NTYNDSKRY

SEQ ID NO: 3126354 - protein, 10 aa, Giardia lamblia
NTYNTSNLNR

SEQ ID NO: 3126355 - protein, 5 aa, Giardia lamblia
NTYQH

SEQ ID NO: 3126356 - protein, 5 aa, Giardia lamblia
NVAND

SEQ ID NO: 3126357 - protein, 23 aa, Giardia lamblia
NVAPYNPMTDAPTTGEVYQSTEE

SEQ ID NO: 3126358 - protein, 16 aa, Giardia lamblia
NVASFSDTSSESSASF

SEQ ID NO: 3126359 - protein, 22 aa, Giardia lamblia
NVASGGSGDHEEDAMDPSGPVI

SEQ ID NO: 3126360 - protein, 10 aa, Giardia lamblia
NVDAQGCTGK

SEQ ID NO: 3126361 - protein, 9 aa, Giardia lamblia
NVDESNPNM

SEQ ID NO: 3126362 - protein, 15 aa, Giardia lamblia
NVDLPSKSQQQDPEQ

SEQ ID NO: 3126363 - protein, 21 aa, Giardia lamblia
NVDNAKRLEDAERENKALEES

SEQ ID NO: 3126364 - protein, 28 aa, Giardia lamblia
NVDPGKTNGIKAGYGPPDAQSETRETDR

SEQ ID NO: 3126365 - protein, 7 aa, Giardia lamblia
NVDQVQQ

SEQ ID NO: 3126366 - protein, 6 aa, Giardia lamblia
NVDRGA

SEQ ID NO: 3126367 - protein, 15 aa, Giardia lamblia
NVDSTPSRAKHMEKT

SEQ ID NO: 3126368 - protein, 9 aa, Giardia lamblia
NVEATSDMT

SEQ ID NO: 3126369 - protein, 4 aa, Giardia lamblia
NVEG

SEQ ID NO: 3126370 - protein, 24 aa, Giardia lamblia
NVEKAEKDEIINEPSIKRSGPVQS

SEQ ID NO: 3126371 - protein, 10 aa, Giardia lamblia
NVEKGDAGAN

SEQ ID NO: 3126372 - protein, 6 aa, Giardia lamblia
NVETNL

SEQ ID NO: 3126373 - protein, 5 aa, Giardia lamblia
NVGKG

SEQ ID NO: 3126374 - protein, 6 aa, Giardia lamblia
NVHPPE

SEQ ID NO: 3126375 - protein, 12 aa, Giardia lamblia
NVKAHSTSRPFS

SEQ ID NO: 3126376 - protein, 9 aa, Giardia lamblia
NVKARDAVG

SEQ ID NO: 3126377 - protein, 10 aa, Giardia lamblia
NVKDGEPYRM

SEQ ID NO: 3126378 - protein, 13 aa, Giardia lamblia
NVKGNDGLRPAEL

SEQ ID NO: 3126379 - protein, 6 aa, Giardia lamblia
NVKSAR

SEQ ID NO: 3126380 - protein, 8 aa, Giardia lamblia
NVNGDESR

SEQ ID NO: 3126381 - protein, 6 aa, Giardia lamblia
NVNTPP

SEQ ID NO: 3126382 - protein, 6 aa, Giardia lamblia
NVPEES

SEQ ID NO: 3126383 - protein, 5 aa, Giardia lamblia
NVPES

SEQ ID NO: 3126384 - protein, 9 aa, Giardia lamblia
NVPETSDYA

SEQ ID NO: 3126385 - protein, 5 aa, Giardia lamblia
NVPGG

SEQ ID NO: 3126386 - protein, 8 aa, Giardia lamblia
NVPGKETK

SEQ ID NO: 3126387 - protein, 4 aa, Giardia lamblia
NVPP

SEQ ID NO: 3126388 - protein, 11 aa, Giardia lamblia
NVPPADTLPNT

SEQ ID NO: 3126389 - protein, 11 aa, Giardia lamblia
NVPQDKEGNIT

SEQ ID NO: 3126390 - protein, 22 aa, Giardia lamblia
NVPRAAPQSYFSTGSPAPIPKG

SEQ ID NO: 3126391 - protein, 6 aa, Giardia lamblia
NVPRDS

SEQ ID NO: 3126392 - protein, 9 aa, Giardia lamblia
NVPRPGNVA

SEQ ID NO: 3126393 - protein, 16 aa, Giardia lamblia
NVPSKAVQAKKTLGIN

SEQ ID NO: 3126394 - protein, 18 aa, Giardia lamblia
NVPTTEGAQLHNDPGDIT

SEQ ID NO: 3126395 - protein, 4 aa, Giardia lamblia
NVQE

SEQ ID NO: 3126396 - protein, 9 aa, Giardia lamblia
NVQSGPDTI

SEQ ID NO: 3126397 - protein, 15 aa, Giardia lamblia
NVRAPSSLASTAKSF

SEQ ID NO: 3126398 - protein, 8 aa, Giardia lamblia
NVREEDYK

SEQ ID NO: 3126399 - protein, 5 aa, Giardia lamblia
NVSDQ

SEQ ID NO: 3126400 - protein, 5 aa, Giardia lamblia
NVSDT

SEQ ID NO: 3126401 - protein, 8 aa, Giardia lamblia
NVSESKNV

SEQ ID NO: 3126402 - protein, 5 aa, Giardia lamblia
NVSGY

SEQ ID NO: 3126403 - protein, 15 aa, Giardia lamblia
NVSLRGDSTSGQGRA

SEQ ID NO: 3126404 - protein, 12 aa, Giardia lamblia
NVSPELDNPDGV

SEQ ID NO: 3126405 - protein, 10 aa, Giardia lamblia
NVSPEPSPSI

SEQ ID NO: 3126406 - protein, 7 aa, Giardia lamblia
NVSPRED

SEQ ID NO: 3126407 - protein, 49 aa, Giardia lamblia
NVSPSQHTDKLGKVESPNSTSGAPKKGSPALPVEKSPQSFGRATSTLKA

SEQ ID NO: 3126408 - protein, 8 aa, Giardia lamblia
NVSPSSVD

SEQ ID NO: 3126409 - protein, 20 aa, Giardia lamblia
NVSRSDDSDVYEYSSDSVSI

SEQ ID NO: 3126410 - protein, 4 aa, Giardia lamblia
NVSS

SEQ ID NO: 3126411 - protein, 24 aa, Giardia lamblia
NVSSITGPRPARKNRQQGSTAISK

SEQ ID NO: 3126412 - protein, 8 aa, Giardia lamblia
NVTATASL

SEQ ID NO: 3126413 - protein, 9 aa, Giardia lamblia
NVTDENYAS

SEQ ID NO: 3126414 - protein, 7 aa, Giardia lamblia
NVTGESV

SEQ ID NO: 3126415 - protein, 5 aa, Giardia lamblia
NVTGS

SEQ ID NO: 3126416 - protein, 5 aa, Giardia lamblia
NVTGT

SEQ ID NO: 3126417 - protein, 6 aa, Giardia lamblia
NVTPKG

SEQ ID NO: 3126418 - protein, 15 aa, Giardia lamblia
NVTPPNHLTGDTSIT

SEQ ID NO: 3126419 - protein, 6 aa, Giardia lamblia
NVTPQG

SEQ ID NO: 3126420 - protein, 8 aa, Giardia lamblia
NVTRPQPC

SEQ ID NO: 3126421 - protein, 8 aa, Giardia lamblia
NVTSGRDG

SEQ ID NO: 3126422 - protein, 12 aa, Giardia lamblia
NVTTGSSLSKSQ

SEQ ID NO: 3126423 - protein, 4 aa, Giardia lamblia
NVVS

SEQ ID NO: 3126424 - protein, 12 aa, Giardia lamblia
NVYDNTPPTAIQ

SEQ ID NO: 3126425 - protein, 8 aa, Giardia lamblia
NWAPEEDE

SEQ ID NO: 3126426 - protein, 5 aa, Giardia lamblia
NWKER

SEQ ID NO: 3126427 - protein, 8 aa, Giardia lamblia
NWSRPPTE

SEQ ID NO: 3126428 - protein, 10 aa, Giardia lamblia
NWSSYTNKHE

SEQ ID NO: 3126429 - protein, 8 aa, Giardia lamblia
NYASAKSL

SEQ ID NO: 3126430 - protein, 11 aa, Giardia lamblia
NYDDQSDYSTL

SEQ ID NO: 3126431 - protein, 9 aa, Giardia lamblia
NYDDTRRDI

SEQ ID NO: 3126432 - protein, 13 aa, Giardia lamblia
NYDKGDLSRLSSS

SEQ ID NO: 3126433 - protein, 5 aa, Giardia lamblia
NYDKK

SEQ ID NO: 3126434 - protein, 14 aa, Giardia lamblia
NYDTELDEDGLPPV

SEQ ID NO: 3126435 - protein, 6 aa, Giardia lamblia
NYEAAA

SEQ ID NO: 3126436 - protein, 6 aa, Giardia lamblia
NYEAEN

SEQ ID NO: 3126437 - protein, 10 aa, Giardia lamblia
NYESTTEDGI

SEQ ID NO: 3126438 - protein, 9 aa, Giardia lamblia
NYGEGAKKL

SEQ ID NO: 3126439 - protein, 16 aa, Giardia lamblia
NYGFQDSSKPNEHDND

SEQ ID NO: 3126440 - protein, 11 aa, Giardia lamblia
NYIGQRDEQGM

SEQ ID NO: 3126441 - protein, 8 aa, Giardia lamblia
NYKPGESI

SEQ ID NO: 3126442 - protein, 6 aa, Giardia lamblia
NYNNSQ

SEQ ID NO: 3126443 - protein, 8 aa, Giardia lamblia
NYPAEPPA

SEQ ID NO: 3126444 - protein, 14 aa, Giardia lamblia
NYPAKVADKAGHGG

SEQ ID NO: 3126445 - protein, 4 aa, Giardia lamblia
NYPD

SEQ ID NO: 3126446 - protein, 13 aa, Giardia lamblia
NYPHETSVDRERR

SEQ ID NO: 3126447 - protein, 7 aa, Giardia lamblia
NYPPGTT

SEQ ID NO: 3126448 - protein, 7 aa, Giardia lamblia
NYPPNSD

SEQ ID NO: 3126449 - protein, 12 aa, Giardia lamblia
NYPSSTINNPTT

SEQ ID NO: 3126450 - protein, 10 aa, Giardia lamblia
NYQRKKDQEL

SEQ ID NO: 3126451 - protein, 7 aa, Giardia lamblia
NYQRTTR

SEQ ID NO: 3126452 - protein, 4 aa, Giardia lamblia
NYRA

SEQ ID NO: 3126453 - protein, 5 aa, Giardia lamblia
NYRAA

SEQ ID NO: 3126454 - protein, 13 aa, Giardia lamblia
NYSIDSTNVSHQA

SEQ ID NO: 3126455 - protein, 26 aa, Giardia lamblia
NYSNDGNVQSYNGTNPPARHTRSAVR

SEQ ID NO: 3126456 - protein, 8 aa, Giardia lamblia
NYSPDKKV

SEQ ID NO: 3126457 - protein, 4 aa, Giardia lamblia
NYSS

SEQ ID NO: 3126458 - protein, 5 aa, Giardia lamblia
NYSTS

SEQ ID NO: 3126459 - protein, 7 aa, Giardia lamblia
NYSYRTK

SEQ ID NO: 3126460 - protein, 10 aa, Giardia lamblia
NYSYRTKNSA

SEQ ID NO: 3126461 - protein, 12 aa, Giardia lamblia
NYTESDVEEANK

SEQ ID NO: 3126462 - protein, 8 aa, Giardia lamblia
NYTKAGEA

SEQ ID NO: 3126463 - protein, 4 aa, Giardia lamblia
NYTN

SEQ ID NO: 3126464 - protein, 6 aa, Giardia lamblia
NYTPQE

SEQ ID NO: 3126465 - protein, 8 aa, Giardia lamblia
NYTSTGTT

SEQ ID NO: 3126466 - protein, 22 aa, Giardia lamblia
NYYDPDGNEDLKDAYEKSRSAK

SEQ ID NO: 3126467 - protein, 11 aa, Giardia lamblia
PAAAAQNAATV

SEQ ID NO: 3126468 - protein, 18 aa, Giardia lamblia
PAAAKQDSTHQTNSSYSH

SEQ ID NO: 3126469 - protein, 5 aa, Giardia lamblia
PAAAP

SEQ ID NO: 3126470 - protein, 14 aa, Giardia lamblia
PAAASQTPKSPLVA

SEQ ID NO: 3126471 - protein, 12 aa, Giardia lamblia
PAADIKKPATED

SEQ ID NO: 3126472 - protein, 13 aa, Giardia lamblia
PAAEMTDSSVTNH

SEQ ID NO: 3126473 - protein, 8 aa, Giardia lamblia
PAAERERA

SEQ ID NO: 3126474 - protein, 7 aa, Giardia lamblia
PAAGTGC

SEQ ID NO: 3126475 - protein, 7 aa, Giardia lamblia
PAAHRGP

SEQ ID NO: 3126476 - protein, 6 aa, Giardia lamblia
PAAIQT

SEQ ID NO: 3126477 - protein, 8 aa, Giardia lamblia
PAAKIPGN

SEQ ID NO: 3126478 - protein, 4 aa, Giardia lamblia
PAAP

SEQ ID NO: 3126479 - protein, 5 aa, Giardia lamblia
PAAPR

SEQ ID NO: 3126480 - protein, 8 aa, Giardia lamblia
PAARPRAS

SEQ ID NO: 3126481 - protein, 22 aa, Giardia lamblia
PAARSALEDEAVGRGAKGGRRH

SEQ ID NO: 3126482 - protein, 22 aa, Giardia lamblia
PAARSALKDEAVGRGAKGGRRH

SEQ ID NO: 3126483 - protein, 8 aa, Giardia lamblia
PAASAPVV

SEQ ID NO: 3126484 - protein, 14 aa, Giardia lamblia
PAASPPVAPPTSTQ

SEQ ID NO: 3126485 - protein, 10 aa, Giardia lamblia
PAATAPPAPA

SEQ ID NO: 3126486 - protein, 11 aa, Giardia lamblia
PAATDSSSGSL

SEQ ID NO: 3126487 - protein, 19 aa, Giardia lamblia
PAAVPTKRGMEPLAPGTYL

SEQ ID NO: 3126488 - protein, 12 aa, Giardia lamblia
PACNDGSQGQDY

SEQ ID NO: 3126489 - protein, 4 aa, Giardia lamblia
PADA

SEQ ID NO: 3126490 - protein, 10 aa, Giardia lamblia
PADAPSTGTV

SEQ ID NO: 3126491 - protein, 12 aa, Giardia lamblia
PADASMSMTSQP

SEQ ID NO: 3126492 - protein, 5 aa, Giardia lamblia
PADDN

SEQ ID NO: 3126493 - protein, 7 aa, Giardia lamblia
PADENGQ

SEQ ID NO: 3126494 - protein, 8 aa, Giardia lamblia
PADESQQY

SEQ ID NO: 3126495 - protein, 20 aa, Giardia lamblia
PADGAKAQQKPGKDQKEVSD

SEQ ID NO: 3126496 - protein, 11 aa, Giardia lamblia
PADHTGSTAVK

SEQ ID NO: 3126497 - protein, 6 aa, Giardia lamblia
PADKAA

SEQ ID NO: 3126498 - protein, 8 aa, Giardia lamblia
PADKQAAV

SEQ ID NO: 3126499 - protein, 13 aa, Giardia lamblia
PADMHENGRIYMI

SEQ ID NO: 3126500 - protein, 7 aa, Giardia lamblia
PADPNDT

SEQ ID NO: 3126501 - protein, 5 aa, Giardia lamblia
PADQN

SEQ ID NO: 3126502 - protein, 4 aa, Giardia lamblia
PADT

SEQ ID NO: 3126503 - protein, 6 aa, Giardia lamblia
PADTEW

SEQ ID NO: 3126504 - protein, 14 aa, Giardia lamblia
PAEAAKSSASTRTI

SEQ ID NO: 3126505 - protein, 10 aa, Giardia lamblia
PAEAQESVAP

SEQ ID NO: 3126506 - protein, 17 aa, Giardia lamblia
PAEEKPEAKKSSNADLF

SEQ ID NO: 3126507 - protein, 9 aa, Giardia lamblia
PAEGNPKHA

SEQ ID NO: 3126508 - protein, 6 aa, Giardia lamblia
PAELAT

SEQ ID NO: 3126509 - protein, 10 aa, Giardia lamblia
PAEPAPRTRY

SEQ ID NO: 3126510 - protein, 11 aa, Giardia lamblia
PAEPIPNRSGS

SEQ ID NO: 3126511 - protein, 11 aa, Giardia lamblia
PAEPPDSQRAM

SEQ ID NO: 3126512 - protein, 16 aa, Giardia lamblia
PAEQYNLDSGREKPVD

SEQ ID NO: 3126513 - protein, 4 aa, Giardia lamblia
PAER

SEQ ID NO: 3126514 - protein, 9 aa, Giardia lamblia
PAERPSATQ

SEQ ID NO: 3126515 - protein, 9 aa, Giardia lamblia
PAERRAGRA

SEQ ID NO: 3126516 - protein, 6 aa, Giardia lamblia
PAESPS

SEQ ID NO: 3126517 - protein, 8 aa, Giardia lamblia
PAETPETW

SEQ ID NO: 3126518 - protein, 13 aa, Giardia lamblia
PAETTEKECSPNT

SEQ ID NO: 3126519 - protein, 12 aa, Giardia lamblia
PAETVADTTAIS

SEQ ID NO: 3126520 - protein, 31 aa, Giardia lamblia
PAEVSPPEQHDQGNYGTHYDNSGNNDPYQQG

SEQ ID NO: 3126521 - protein, 4 aa, Giardia lamblia
PAEY

SEQ ID NO: 3126522 - protein, 16 aa, Giardia lamblia
PAFAPDGSAIYSATGD

SEQ ID NO: 3126523 - protein, 4 aa, Giardia lamblia
PAFS

SEQ ID NO: 3126524 - protein, 35 aa, Giardia lamblia
PAFSESSSTIGSSAEYSNRLSNNSTSYSHTDRGLK

SEQ ID NO: 3126525 - protein, 7 aa, Giardia lamblia
PAFSSEL

SEQ ID NO: 3126526 - protein, 24 aa, Giardia lamblia
PAGANSSPPALSATQEQPINDSER

SEQ ID NO: 3126527 - protein, 11 aa, Giardia lamblia
PAGFSRTTKQV

SEQ ID NO: 3126528 - protein, 10 aa, Giardia lamblia
PAGHSSRHAS

SEQ ID NO: 3126529 - protein, 13 aa, Giardia lamblia
PAGLRNSQPDPSL

SEQ ID NO: 3126530 - protein, 10 aa, Giardia lamblia
PAGRQIQGGR

SEQ ID NO: 3126531 - protein, 5 aa, Giardia lamblia
PAGSA

SEQ ID NO: 3126532 - protein, 13 aa, Giardia lamblia
PAGSAHNTGTKPV

SEQ ID NO: 3126533 - protein, 7 aa, Giardia lamblia
PAGSHGA

SEQ ID NO: 3126534 - protein, 18 aa, Giardia lamblia
PAGSPNSAKSASKTSIQA

SEQ ID NO: 3126535 - protein, 7 aa, Giardia lamblia
PAGTGKT

SEQ ID NO: 3126536 - protein, 11 aa, Giardia lamblia
PAGTGKTTTLS

SEQ ID NO: 3126537 - protein, 4 aa, Giardia lamblia
PAGY

SEQ ID NO: 3126538 - protein, 17 aa, Giardia lamblia
PAGYEESAANVKNDDLA

SEQ ID NO: 3126539 - protein, 5 aa, Giardia lamblia
PAGYG

SEQ ID NO: 3126540 - protein, 10 aa, Giardia lamblia
PAHRDASSVV

SEQ ID NO: 3126541 - protein, 25 aa, Giardia lamblia
PAHTAQHSSDSTSSYDDGSSRSSGF

SEQ ID NO: 3126542 - protein, 10 aa, Giardia lamblia
PAKATESGPQ

SEQ ID NO: 3126543 - protein, 8 aa, Giardia lamblia
PAKDPSNV

SEQ ID NO: 3126544 - protein, 31 aa, Giardia lamblia
PAKDQDEPSYDPNKEQAYDEDPNVSSNTDNL

SEQ ID NO: 3126545 - protein, 9 aa, Giardia lamblia
PAKGDRQDW

SEQ ID NO: 3126546 - protein, 7 aa, Giardia lamblia
PAKGGIA

SEQ ID NO: 3126547 - protein, 9 aa, Giardia lamblia
PAKGTSDIS

SEQ ID NO: 3126548 - protein, 15 aa, Giardia lamblia
PAKGYKRANLTPEEE

SEQ ID NO: 3126549 - protein, 6 aa, Giardia lamblia
PAKHGG

SEQ ID NO: 3126550 - protein, 21 aa, Giardia lamblia
PAKKQNTGEPVESAHSSQPSY

SEQ ID NO: 3126551 - protein, 12 aa, Giardia lamblia
PAKNPTDLSRDS

SEQ ID NO: 3126552 - protein, 7 aa, Giardia lamblia
PAKPISS

SEQ ID NO: 3126553 - protein, 10 aa, Giardia lamblia
PAKPSPGAHE

SEQ ID NO: 3126554 - protein, 5 aa, Giardia lamblia
PAKQT

SEQ ID NO: 3126555 - protein, 6 aa, Giardia lamblia
PAKRPG

SEQ ID NO: 3126556 - protein, 7 aa, Giardia lamblia
PAKRPSF

SEQ ID NO: 3126557 - protein, 20 aa, Giardia lamblia
PAKRSGPVRDDSVDPTGRIR

SEQ ID NO: 3126558 - protein, 8 aa, Giardia lamblia
PAKTEATR

SEQ ID NO: 3126559 - protein, 8 aa, Giardia lamblia
PAKTTCKT

SEQ ID NO: 3126560 - protein, 23 aa, Giardia lamblia
PALAGGSPSSSVSESVPERPPAR

SEQ ID NO: 3126561 - protein, 17 aa, Giardia lamblia
PALDADPLTASREGYAA

SEQ ID NO: 3126562 - protein, 7 aa, Giardia lamblia
PALDDSK

SEQ ID NO: 3126563 - protein, 5 aa, Giardia lamblia
PALEE

SEQ ID NO: 3126564 - protein, 10 aa, Giardia lamblia
PALEKAEKAL

SEQ ID NO: 3126565 - protein, 7 aa, Giardia lamblia
PALKKRN

SEQ ID NO: 3126566 - protein, 46 aa, Giardia lamblia
PALPNANSPAHGGGKFSSQRPQGFTSESNRSERDAAGGNVEDGEED

SEQ ID NO: 3126567 - protein, 6 aa, Giardia lamblia
PALPRA

SEQ ID NO: 3126568 - protein, 7 aa, Giardia lamblia
PALPSET

SEQ ID NO: 3126569 - protein, 5 aa, Giardia lamblia
PALQS

SEQ ID NO: 3126570 - protein, 4 aa, Giardia lamblia
PALS

SEQ ID NO: 3126571 - protein, 6 aa, Giardia lamblia
PALSKK

SEQ ID NO: 3126572 - protein, 6 aa, Giardia lamblia
PALSPS

SEQ ID NO: 3126573 - protein, 18 aa, Giardia lamblia
PALTQGGDAKARGYHEEK

SEQ ID NO: 3126574 - protein, 11 aa, Giardia lamblia
PALTSAAGRSA

SEQ ID NO: 3126575 - protein, 7 aa, Giardia lamblia
PAMGGTC

SEQ ID NO: 3126576 - protein, 6 aa, Giardia lamblia
PAMPAS

SEQ ID NO: 3126577 - protein, 19 aa, Giardia lamblia
PANALGDRSAHGSGKLSKQ

SEQ ID NO: 3126578 - protein, 36 aa, Giardia lamblia
PANDQSDAYRPPGPPEATEDDRGTDGYAESDSSTTD

SEQ ID NO: 3126579 - protein, 9 aa, Giardia lamblia
PANENAQKK

SEQ ID NO: 3126580 - protein, 9 aa, Giardia lamblia
PANENMPED

SEQ ID NO: 3126581 - protein, 5 aa, Giardia lamblia
PANIN

SEQ ID NO: 3126582 - protein, 12 aa, Giardia lamblia
PANIPDKSKHTG

SEQ ID NO: 3126583 - protein, 10 aa, Giardia lamblia
PANIQPQHKD

SEQ ID NO: 3126584 - protein, 8 aa, Giardia lamblia
PANKPPVS

SEQ ID NO: 3126585 - protein, 12 aa, Giardia lamblia
PANLGPGQNQQG

SEQ ID NO: 3126586 - protein, 11 aa, Giardia lamblia
PANQGPDPITK

SEQ ID NO: 3126587 - protein, 8 aa, Giardia lamblia
PANRPTAA

SEQ ID NO: 3126588 - protein, 52 aa, Giardia lamblia
PANSQTSSTSSLSGDKGLRSKPQERLGSAKAPGSAGALAPLSGSRVKPQALA

SEQ ID NO: 3126589 - protein, 6 aa, Giardia lamblia
PANSST

SEQ ID NO: 3126590 - protein, 5 aa, Giardia lamblia
PANTY

SEQ ID NO: 3126591 - protein, 8 aa, Giardia lamblia
PANVDPPD

SEQ ID NO: 3126592 - protein, 7 aa, Giardia lamblia
PAPAAIQ

SEQ ID NO: 3126593 - protein, 5 aa, Giardia lamblia
PAPAG

SEQ ID NO: 3126594 - protein, 14 aa, Giardia lamblia
PAPAPAPKPSGYLP

SEQ ID NO: 3126595 - protein, 16 aa, Giardia lamblia
PAPARPADASYSAPSS

SEQ ID NO: 3126596 - protein, 35 aa, Giardia lamblia
PAPATPSSAVRVPGSACTAPPPAAGPPEAAPAESV

SEQ ID NO: 3126597 - protein, 18 aa, Giardia lamblia
PAPCEKADAARIFSESFY

SEQ ID NO: 3126598 - protein, 7 aa, Giardia lamblia
PAPCPQA

SEQ ID NO: 3126599 - protein, 4 aa, Giardia lamblia
PAPE

SEQ ID NO: 3126600 - protein, 6 aa, Giardia lamblia
PAPENP

SEQ ID NO: 3126601 - protein, 5 aa, Giardia lamblia
PAPES

SEQ ID NO: 3126602 - protein, 35 aa, Giardia lamblia
PAPESPKREDKKTSPLAEKLSPKQKRTSPGKSGFE

SEQ ID NO: 3126603 - protein, 7 aa, Giardia lamblia
PAPESYA

SEQ ID NO: 3126604 - protein, 9 aa, Giardia lamblia
PAPGAYDAY

SEQ ID NO: 3126605 - protein, 9 aa, Giardia lamblia
PAPKATDPL

SEQ ID NO: 3126606 - protein, 5 aa, Giardia lamblia
PAPLA

SEQ ID NO: 3126607 - protein, 12 aa, Giardia lamblia
PAPLDPTRATYT

SEQ ID NO: 3126608 - protein, 6 aa, Giardia lamblia
PAPLQT

SEQ ID NO: 3126609 - protein, 7 aa, Giardia lamblia
PAPMPTR

SEQ ID NO: 3126610 - protein, 7 aa, Giardia lamblia
PAPMYTD

SEQ ID NO: 3126611 - protein, 4 aa, Giardia lamblia
PAPN

SEQ ID NO: 3126612 - protein, 18 aa, Giardia lamblia
PAPNALGPKIGPYGLPPK

SEQ ID NO: 3126613 - protein, 5 aa, Giardia lamblia
PAPPD

SEQ ID NO: 3126614 - protein, 7 aa, Giardia lamblia
PAPPNSK

SEQ ID NO: 3126615 - protein, 10 aa, Giardia lamblia
PAPQAEPDVE

SEQ ID NO: 3126616 - protein, 14 aa, Giardia lamblia
PAPSHDGSRESRTI

SEQ ID NO: 3126617 - protein, 35 aa, Giardia lamblia
PAPSVTNSNTVVSARDGASSLPPPTTTNSGISTAP

SEQ ID NO: 3126618 - protein, 4 aa, Giardia lamblia
PAPT

SEQ ID NO: 3126619 - protein, 8 aa, Giardia lamblia
PAPTDNEG

SEQ ID NO: 3126620 - protein, 5 aa, Giardia lamblia
PAPVH

SEQ ID NO: 3126621 - protein, 4 aa, Giardia lamblia
PAPY

SEQ ID NO: 3126622 - protein, 11 aa, Giardia lamblia
PAPYVPPPQGI

SEQ ID NO: 3126623 - protein, 9 aa, Giardia lamblia
PAQASHGIS

SEQ ID NO: 3126624 - protein, 10 aa, Giardia lamblia
PAQDALQGSM

SEQ ID NO: 3126625 - protein, 8 aa, Giardia lamblia
PAQDPQST

SEQ ID NO: 3126626 - protein, 32 aa, Giardia lamblia
PAQDQSLSDDQDTETSESTDAPQHHPFDGSDT

SEQ ID NO: 3126627 - protein, 4 aa, Giardia lamblia
PAQE

SEQ ID NO: 3126628 - protein, 22 aa, Giardia lamblia
PAQHEGSNPSHSASSIGAKPSV

SEQ ID NO: 3126629 - protein, 11 aa, Giardia lamblia
PAQHPDTSIPL

SEQ ID NO: 3126630 - protein, 12 aa, Giardia lamblia
PAQITTSQAPLD

SEQ ID NO: 3126631 - protein, 4 aa, Giardia lamblia
PAQK

SEQ ID NO: 3126632 - protein, 10 aa, Giardia lamblia
PAQNQPTTAR

SEQ ID NO: 3126633 - protein, 14 aa, Giardia lamblia
PAQPCNTKPEININ

SEQ ID NO: 3126634 - protein, 5 aa, Giardia lamblia
PAQPD

SEQ ID NO: 3126635 - protein, 10 aa, Giardia lamblia
PAQPSKPKID

SEQ ID NO: 3126636 - protein, 5 aa, Giardia lamblia
PAQRK

SEQ ID NO: 3126637 - protein, 30 aa, Giardia lamblia
PAQSHKNQVDPEDRLQPRSDGPKPPQSQEA

SEQ ID NO: 3126638 - protein, 4 aa, Giardia lamblia
PAQT

SEQ ID NO: 3126639 - protein, 7 aa, Giardia lamblia
PARPLEQ

SEQ ID NO: 3126640 - protein, 4 aa, Giardia lamblia
PARQ

SEQ ID NO: 3126641 - protein, 8 aa, Giardia lamblia
PARSLGPL

SEQ ID NO: 3126642 - protein, 10 aa, Giardia lamblia
PARSSCSSTQ

SEQ ID NO: 3126643 - protein, 6 aa, Giardia lamblia
PARTAK

SEQ ID NO: 3126644 - protein, 4 aa, Giardia lamblia
PARY

SEQ ID NO: 3126645 - protein, 5 aa, Giardia lamblia
PASAI

SEQ ID NO: 3126646 - protein, 7 aa, Giardia lamblia
PASARLS

SEQ ID NO: 3126647 - protein, 10 aa, Giardia lamblia
PASATEQSIT

SEQ ID NO: 3126648 - protein, 4 aa, Giardia lamblia
PASD

SEQ ID NO: 3126649 - protein, 14 aa, Giardia lamblia
PASDATNELTAQKE

SEQ ID NO: 3126650 - protein, 10 aa, Giardia lamblia
PASDPRSEEN

SEQ ID NO: 3126651 - protein, 4 aa, Giardia lamblia
PASE

SEQ ID NO: 3126652 - protein, 7 aa, Giardia lamblia
PASEDFR

SEQ ID NO: 3126653 - protein, 29 aa, Giardia lamblia
PASEEPRSPLTAGAKAELDYQSAPSAPLD

SEQ ID NO: 3126654 - protein, 5 aa, Giardia lamblia
PASGD

SEQ ID NO: 3126655 - protein, 5 aa, Giardia lamblia
PASGF

SEQ ID NO: 3126656 - protein, 6 aa, Giardia lamblia
PASGGM

SEQ ID NO: 3126657 - protein, 10 aa, Giardia lamblia
PASGSTQSIY

SEQ ID NO: 3126658 - protein, 9 aa, Giardia lamblia
PASGTVQAG

SEQ ID NO: 3126659 - protein, 7 aa, Giardia lamblia
PASGTVS

SEQ ID NO: 3126660 - protein, 4 aa, Giardia lamblia
PASK

SEQ ID NO: 3126661 - protein, 4 aa, Giardia lamblia
PASL

SEQ ID NO: 3126662 - protein, 6 aa, Giardia lamblia
PASLED

SEQ ID NO: 3126663 - protein, 7 aa, Giardia lamblia
PASLQES

SEQ ID NO: 3126664 - protein, 9 aa, Giardia lamblia
PASNAGARK

SEQ ID NO: 3126665 - protein, 9 aa, Giardia lamblia
PASNPTYGG

SEQ ID NO: 3126666 - protein, 6 aa, Giardia lamblia
PASPIS

SEQ ID NO: 3126667 - protein, 20 aa, Giardia lamblia
PASPLPSGPKDITTPLSTGQ

SEQ ID NO: 3126668 - protein, 21 aa, Giardia lamblia
PASPTLRNAAQRKGVGKGNRC

SEQ ID NO: 3126669 - protein, 6 aa, Giardia lamblia
PASQDE

SEQ ID NO: 3126670 - protein, 19 aa, Giardia lamblia
PASRKSVRESTGKSESTLN

SEQ ID NO: 3126671 - protein, 14 aa, Giardia lamblia
PASRQRNPSRQSWE

SEQ ID NO: 3126672 - protein, 7 aa, Giardia lamblia
PASRQSL

SEQ ID NO: 3126673 - protein, 11 aa, Giardia lamblia
PASSDPSSGLT

SEQ ID NO: 3126674 - protein, 35 aa, Giardia lamblia
PASSLTGMDTPPRHYGEDSDGVQMDEHSGNAAGAH

SEQ ID NO: 3126675 - protein, 8 aa, Giardia lamblia
PASTGAAS

SEQ ID NO: 3126676 - protein, 9 aa, Giardia lamblia
PASTNYDET

SEQ ID NO: 3126677 - protein, 8 aa, Giardia lamblia
PASVDTEN

SEQ ID NO: 3126678 - protein, 9 aa, Giardia lamblia
PASVPSGPN

SEQ ID NO: 3126679 - protein, 4 aa, Giardia lamblia
PATD

SEQ ID NO: 3126680 - protein, 6 aa, Giardia lamblia
PATDDV

SEQ ID NO: 3126681 - protein, 7 aa, Giardia lamblia
PATEEAC

SEQ ID NO: 3126682 - protein, 13 aa, Giardia lamblia
PATEESQSKISAE

SEQ ID NO: 3126683 - protein, 5 aa, Giardia lamblia
PATFP

SEQ ID NO: 3126684 - protein, 5 aa, Giardia lamblia
PATGD

SEQ ID NO: 3126685 - protein, 15 aa, Giardia lamblia
PATGEWNDGALSSAA

SEQ ID NO: 3126686 - protein, 15 aa, Giardia lamblia
PATGGSDGTPGDSYD

SEQ ID NO: 3126687 - protein, 7 aa, Giardia lamblia
PATGSAY

SEQ ID NO: 3126688 - protein, 7 aa, Giardia lamblia
PATGTGC

SEQ ID NO: 3126689 - protein, 5 aa, Giardia lamblia
PATLS

SEQ ID NO: 3126690 - protein, 15 aa, Giardia lamblia
PATNAAGKPLTRGTS

SEQ ID NO: 3126691 - protein, 8 aa, Giardia lamblia
PATPEFES

SEQ ID NO: 3126692 - protein, 8 aa, Giardia lamblia
PATPNDRR

SEQ ID NO: 3126693 - protein, 10 aa, Giardia lamblia
PATPPNQDKI

SEQ ID NO: 3126694 - protein, 7 aa, Giardia lamblia
PATPSSA

SEQ ID NO: 3126695 - protein, 7 aa, Giardia lamblia
PATQKAH

SEQ ID NO: 3126696 - protein, 5 aa, Giardia lamblia
PATRI

SEQ ID NO: 3126697 - protein, 5 aa, Giardia lamblia
PATSL

SEQ ID NO: 3126698 - protein, 11 aa, Giardia lamblia
PATSSDLSGEH

SEQ ID NO: 3126699 - protein, 13 aa, Giardia lamblia
PATTDLSSQPSKA

SEQ ID NO: 3126700 - protein, 8 aa, Giardia lamblia
PATTLGSA

SEQ ID NO: 3126701 - protein, 9 aa, Giardia lamblia
PATTNPFSA

SEQ ID NO: 3126702 - protein, 14 aa, Giardia lamblia
PATVEGKNLSETAA

SEQ ID NO: 3126703 - protein, 5 aa, Giardia lamblia
PAVAP

SEQ ID NO: 3126704 - protein, 5 aa, Giardia lamblia
PAVEQ

SEQ ID NO: 3126705 - protein, 6 aa, Giardia lamblia
PAVGNN

SEQ ID NO: 3126706 - protein, 9 aa, Giardia lamblia
PAVNGGAPV

SEQ ID NO: 3126707 - protein, 10 aa, Giardia lamblia
PAVPNDPATV

SEQ ID NO: 3126708 - protein, 6 aa, Giardia lamblia
PAVPNK

SEQ ID NO: 3126709 - protein, 8 aa, Giardia lamblia
PAVPPAPL

SEQ ID NO: 3126710 - protein, 12 aa, Giardia lamblia
PAVQKQDSVTYR

SEQ ID NO: 3126711 - protein, 7 aa, Giardia lamblia
PAVSEPD

SEQ ID NO: 3126712 - protein, 21 aa, Giardia lamblia
PAYHDTDGALSCPDSATEEDM

SEQ ID NO: 3126713 - protein, 5 aa, Giardia lamblia
PAYKN

SEQ ID NO: 3126714 - protein, 7 aa, Giardia lamblia
PAYQPST

SEQ ID NO: 3126715 - protein, 5 aa, Giardia lamblia
PAYSS

SEQ ID NO: 3126716 - protein, 11 aa, Giardia lamblia
PAYTGTQSYQA

SEQ ID NO: 3126717 - protein, 17 aa, Giardia lamblia
PCASSSLKEDESVPQNY

SEQ ID NO: 3126718 - protein, 8 aa, Giardia lamblia
PCEDEQRS

SEQ ID NO: 3126719 - protein, 21 aa, Giardia lamblia
PCGPSSEPQEDQERVSDLPQA

SEQ ID NO: 3126720 - protein, 6 aa, Giardia lamblia
PCNPCP

SEQ ID NO: 3126721 - protein, 15 aa, Giardia lamblia
PCPDMSSTSYSTAPT

SEQ ID NO: 3126722 - protein, 26 aa, Giardia lamblia
PCPDRSGASDNTPRRAAARPASSTER

SEQ ID NO: 3126723 - protein, 10 aa, Giardia lamblia
PCPQNGEDPD

SEQ ID NO: 3126724 - protein, 12 aa, Giardia lamblia
PCPSCKKSRSEL

SEQ ID NO: 3126725 - protein, 5 aa, Giardia lamblia
PCQTP

SEQ ID NO: 3126726 - protein, 5 aa, Giardia lamblia
PCSED

SEQ ID NO: 3126727 - protein, 11 aa, Giardia lamblia
PCSGDGTLRKA

SEQ ID NO: 3126728 - protein, 6 aa, Giardia lamblia
PCSGKS

SEQ ID NO: 3126729 - protein, 13 aa, Giardia lamblia
PCSKAKNKAAEKI

SEQ ID NO: 3126730 - protein, 10 aa, Giardia lamblia
PCSQITPNSH

SEQ ID NO: 3126731 - protein, 11 aa, Giardia lamblia
PCTEEKTRAIG

SEQ ID NO: 3126732 - protein, 7 aa, Giardia lamblia
PCVPPEK

SEQ ID NO: 3126733 - protein, 4 aa, Giardia lamblia
PDAA

SEQ ID NO: 3126734 - protein, 10 aa, Giardia lamblia
PDAAAAGARG

SEQ ID NO: 3126735 - protein, 9 aa, Giardia lamblia
PDAGGATRC

SEQ ID NO: 3126736 - protein, 6 aa, Giardia lamblia
PDAGSN

SEQ ID NO: 3126737 - protein, 8 aa, Giardia lamblia
PDAHNDSY

SEQ ID NO: 3126738 - protein, 8 aa, Giardia lamblia
PDALNTED

SEQ ID NO: 3126739 - protein, 6 aa, Giardia lamblia
PDAPLD

SEQ ID NO: 3126740 - protein, 8 aa, Giardia lamblia
PDAPLPGM

SEQ ID NO: 3126741 - protein, 6 aa, Giardia lamblia
PDAPRT

SEQ ID NO: 3126742 - protein, 8 aa, Giardia lamblia
PDAPTVSD

SEQ ID NO: 3126743 - protein, 10 aa, Giardia lamblia
PDASDFNTNN

SEQ ID NO: 3126744 - protein, 8 aa, Giardia lamblia
PDASSLSA

SEQ ID NO: 3126745 - protein, 7 aa, Giardia lamblia
PDATEER

SEQ ID NO: 3126746 - protein, 4 aa, Giardia lamblia
PDAV

SEQ ID NO: 3126747 - protein, 7 aa, Giardia lamblia
PDAVPPL

SEQ ID NO: 3126748 - protein, 8 aa, Giardia lamblia
PDCGGPVS

SEQ ID NO: 3126749 - protein, 5 aa, Giardia lamblia
PDCKG

SEQ ID NO: 3126750 - protein, 6 aa, Giardia lamblia
PDDAER

SEQ ID NO: 3126751 - protein, 32 aa, Giardia lamblia
PDDMPAAKSIDQAPKPANCISTDPDSSQRPAV

SEQ ID NO: 3126752 - protein, 17 aa, Giardia lamblia
PDDPQDQSGSKTTRSHV

SEQ ID NO: 3126753 - protein, 7 aa, Giardia lamblia
PDDSEFD

SEQ ID NO: 3126754 - protein, 12 aa, Giardia lamblia
PDDSGDSKWASQ

SEQ ID NO: 3126755 - protein, 5 aa, Giardia lamblia
PDDST

SEQ ID NO: 3126756 - protein, 11 aa, Giardia lamblia
PDDTDMGNSEV

SEQ ID NO: 3126757 - protein, 4 aa, Giardia lamblia
PDEA

SEQ ID NO: 3126758 - protein, 29 aa, Giardia lamblia
PDEDDGNDTDSLSKTHDDTEPELKRRGSL

SEQ ID NO: 3126759 - protein, 8 aa, Giardia lamblia
PDEEIKER

SEQ ID NO: 3126760 - protein, 5 aa, Giardia lamblia
PDEFD

SEQ ID NO: 3126761 - protein, 7 aa, Giardia lamblia
PDEGSIM

SEQ ID NO: 3126762 - protein, 6 aa, Giardia lamblia
PDEGYE

SEQ ID NO: 3126763 - protein, 13 aa, Giardia lamblia
PDEHASADLSGSA

SEQ ID NO: 3126764 - protein, 7 aa, Giardia lamblia
PDEKEKI

SEQ ID NO: 3126765 - protein, 5 aa, Giardia lamblia
PDEKK

SEQ ID NO: 3126766 - protein, 6 aa, Giardia lamblia
PDEKPQ

SEQ ID NO: 3126767 - protein, 12 aa, Giardia lamblia
PDELASKTSMQT

SEQ ID NO: 3126768 - protein, 4 aa, Giardia lamblia
PDEN

SEQ ID NO: 3126769 - protein, 6 aa, Giardia lamblia
PDENGR

SEQ ID NO: 3126770 - protein, 4 aa, Giardia lamblia
PDEQ

SEQ ID NO: 3126771 - protein, 4 aa, Giardia lamblia
PDER

SEQ ID NO: 3126772 - protein, 8 aa, Giardia lamblia
PDERASDG

SEQ ID NO: 3126773 - protein, 5 aa, Giardia lamblia
PDERG

SEQ ID NO: 3126774 - protein, 8 aa, Giardia lamblia
PDESEYNR

SEQ ID NO: 3126775 - protein, 12 aa, Giardia lamblia
PDESTASTTSKS

SEQ ID NO: 3126776 - protein, 8 aa, Giardia lamblia
PDETGKEW

SEQ ID NO: 3126777 - protein, 5 aa, Giardia lamblia
PDETN

SEQ ID NO: 3126778 - protein, 5 aa, Giardia lamblia
PDEVD

SEQ ID NO: 3126779 - protein, 7 aa, Giardia lamblia
PDEVSPG

SEQ ID NO: 3126780 - protein, 4 aa, Giardia lamblia
PDFD

SEQ ID NO: 3126781 - protein, 6 aa, Giardia lamblia
PDFPTS

SEQ ID NO: 3126782 - protein, 11 aa, Giardia lamblia
PDFRSKGTGLY

SEQ ID NO: 3126783 - protein, 12 aa, Giardia lamblia
PDFSNAPQTDVK

SEQ ID NO: 3126784 - protein, 8 aa, Giardia lamblia
PDFSSRSP

SEQ ID NO: 3126785 - protein, 7 aa, Giardia lamblia
PDGEVPR

SEQ ID NO: 3126786 - protein, 16 aa, Giardia lamblia
PDGKEAGEQNINPPVD

SEQ ID NO: 3126787 - protein, 10 aa, Giardia lamblia
PDGKTTEIPA

SEQ ID NO: 3126788 - protein, 4 aa, Giardia lamblia
PDGN

SEQ ID NO: 3126789 - protein, 8 aa, Giardia lamblia
PDGPPTIN

SEQ ID NO: 3126790 - protein, 7 aa, Giardia lamblia
PDGQGLS

SEQ ID NO: 3126791 - protein, 6 aa, Giardia lamblia
PDGRKY

SEQ ID NO: 3126792 - protein, 6 aa, Giardia lamblia
PDGRVH

SEQ ID NO: 3126793 - protein, 9 aa, Giardia lamblia
PDGSCPPDK

SEQ ID NO: 3126794 - protein, 6 aa, Giardia lamblia
PDGSDP

SEQ ID NO: 3126795 - protein, 6 aa, Giardia lamblia
PDGSGT

SEQ ID NO: 3126796 - protein, 5 aa, Giardia lamblia
PDGSL

SEQ ID NO: 3126797 - protein, 9 aa, Giardia lamblia
PDGSRNKPL

SEQ ID NO: 3126798 - protein, 7 aa, Giardia lamblia
PDGTAQT

SEQ ID NO: 3126799 - protein, 16 aa, Giardia lamblia
PDGTPSAVPSENATAL

SEQ ID NO: 3126800 - protein, 6 aa, Giardia lamblia
PDGTSI

SEQ ID NO: 3126801 - protein, 11 aa, Giardia lamblia
PDGTTVATGCT

SEQ ID NO: 3126802 - protein, 5 aa, Giardia lamblia
PDGTY

SEQ ID NO: 3126803 - protein, 7 aa, Giardia lamblia
PDGVSTQ

SEQ ID NO: 3126804 - protein, 9 aa, Giardia lamblia
PDHERETSK

SEQ ID NO: 3126805 - protein, 6 aa, Giardia lamblia
PDHHKR

SEQ ID NO: 3126806 - protein, 11 aa, Giardia lamblia
PDHLPGGQPAS

SEQ ID NO: 3126807 - protein, 12 aa, Giardia lamblia
PDHNPLAGTPAP

SEQ ID NO: 3126808 - protein, 19 aa, Giardia lamblia
PDHSIGEVSSKEPYSVDEH

SEQ ID NO: 3126809 - protein, 14 aa, Giardia lamblia
PDIDGSGKLKQPSE

SEQ ID NO: 3126810 - protein, 14 aa, Giardia lamblia
PDIEEPSKARKGTS

SEQ ID NO: 3126811 - protein, 10 aa, Giardia lamblia
PDIPPDRPYA

SEQ ID NO: 3126812 - protein, 15 aa, Giardia lamblia
PDISSTTPTNSDALP

SEQ ID NO: 3126813 - protein, 6 aa, Giardia lamblia
PDITSS

SEQ ID NO: 3126814 - protein, 7 aa, Giardia lamblia
PDKAGNM

SEQ ID NO: 3126815 - protein, 8 aa, Giardia lamblia
PDKDARKL

SEQ ID NO: 3126816 - protein, 11 aa, Giardia lamblia
PDKGQQSVQDE

SEQ ID NO: 3126817 - protein, 11 aa, Giardia lamblia
PDKHIGAPSTV

SEQ ID NO: 3126818 - protein, 4 aa, Giardia lamblia
PDKL

SEQ ID NO: 3126819 - protein, 11 aa, Giardia lamblia
PDKNRDNPERA

SEQ ID NO: 3126820 - protein, 14 aa, Giardia lamblia
PDKNRDNRQEAEAR

SEQ ID NO: 3126821 - protein, 7 aa, Giardia lamblia
PDKPQTH

SEQ ID NO: 3126822 - protein, 4 aa, Giardia lamblia
PDKR

SEQ ID NO: 3126823 - protein, 35 aa, Giardia lamblia
PDKRARKSALRSGEGDDLDVQDDEGCKEDAEASRI

SEQ ID NO: 3126824 - protein, 4 aa, Giardia lamblia
PDKS

SEQ ID NO: 3126825 - protein, 8 aa, Giardia lamblia
PDKSNKGK

SEQ ID NO: 3126826 - protein, 4 aa, Giardia lamblia
PDKT

SEQ ID NO: 3126827 - protein, 8 aa, Giardia lamblia
PDKTRRLG

SEQ ID NO: 3126828 - protein, 12 aa, Giardia lamblia
PDLASKKPLGVT

SEQ ID NO: 3126829 - protein, 11 aa, Giardia lamblia
PDLETPSNAFR

SEQ ID NO: 3126830 - protein, 12 aa, Giardia lamblia
PDLETRKPYPAV

SEQ ID NO: 3126831 - protein, 4 aa, Giardia lamblia
PDLG

SEQ ID NO: 3126832 - protein, 7 aa, Giardia lamblia
PDLGKNT

SEQ ID NO: 3126833 - protein, 7 aa, Giardia lamblia
PDLNPRG

SEQ ID NO: 3126834 - protein, 12 aa, Giardia lamblia
PDLRPSAEDIHE

SEQ ID NO: 3126835 - protein, 13 aa, Giardia lamblia
PDLSSSSWTAGIG

SEQ ID NO: 3126836 - protein, 6 aa, Giardia lamblia
PDLSTN

SEQ ID NO: 3126837 - protein, 11 aa, Giardia lamblia
PDLTEEQKHEI

SEQ ID NO: 3126838 - protein, 8 aa, Giardia lamblia
PDMEENDA

SEQ ID NO: 3126839 - protein, 5 aa, Giardia lamblia
PDNCG

SEQ ID NO: 3126840 - protein, 15 aa, Giardia lamblia
PDNEREKPDYTKKNG

SEQ ID NO: 3126841 - protein, 6 aa, Giardia lamblia
PDNGYP

SEQ ID NO: 3126842 - protein, 4 aa, Giardia lamblia
PDNI

SEQ ID NO: 3126843 - protein, 4 aa, Giardia lamblia
PDNL

SEQ ID NO: 3126844 - protein, 16 aa, Giardia lamblia
PDNPETAYLGEESRAA

SEQ ID NO: 3126845 - protein, 7 aa, Giardia lamblia
PDNPMND

SEQ ID NO: 3126846 - protein, 6 aa, Giardia lamblia
PDNPRD

SEQ ID NO: 3126847 - protein, 6 aa, Giardia lamblia
PDNQRR

SEQ ID NO: 3126848 - protein, 4 aa, Giardia lamblia
PDNT

SEQ ID NO: 3126849 - protein, 15 aa, Giardia lamblia
PDPAKLSKDDPTVSS

SEQ ID NO: 3126850 - protein, 6 aa, Giardia lamblia
PDPDQS

SEQ ID NO: 3126851 - protein, 8 aa, Giardia lamblia
PDPETGKA

SEQ ID NO: 3126852 - protein, 13 aa, Giardia lamblia
PDPGEEQGGTYTG

SEQ ID NO: 3126853 - protein, 8 aa, Giardia lamblia
PDPGSPSG

SEQ ID NO: 3126854 - protein, 11 aa, Giardia lamblia
PDPKARPTAEQ

SEQ ID NO: 3126855 - protein, 7 aa, Giardia lamblia
PDPKEYS

SEQ ID NO: 3126856 - protein, 7 aa, Giardia lamblia
PDPLQRP

SEQ ID NO: 3126857 - protein, 15 aa, Giardia lamblia
PDPMPPGADNSPAEH

SEQ ID NO: 3126858 - protein, 8 aa, Giardia lamblia
PDPNVDGR

SEQ ID NO: 3126859 - protein, 11 aa, Giardia lamblia
PDPNVTSKEVE

SEQ ID NO: 3126860 - protein, 6 aa, Giardia lamblia
PDPPFL

SEQ ID NO: 3126861 - protein, 7 aa, Giardia lamblia
PDPPGAP

SEQ ID NO: 3126862 - protein, 9 aa, Giardia lamblia
PDPQGMSEA

SEQ ID NO: 3126863 - protein, 5 aa, Giardia lamblia
PDPQL

SEQ ID NO: 3126864 - protein, 5 aa, Giardia lamblia
PDPRL

SEQ ID NO: 3126865 - protein, 8 aa, Giardia lamblia
PDPRTRPD

SEQ ID NO: 3126866 - protein, 9 aa, Giardia lamblia
PDPSARSSV

SEQ ID NO: 3126867 - protein, 6 aa, Giardia lamblia
PDPSCA

SEQ ID NO: 3126868 - protein, 7 aa, Giardia lamblia
PDPSFNA

SEQ ID NO: 3126869 - protein, 15 aa, Giardia lamblia
PDPSPADSKAEQYPL

SEQ ID NO: 3126870 - protein, 17 aa, Giardia lamblia
PDPSQLGGSNDGESDRL

SEQ ID NO: 3126871 - protein, 8 aa, Giardia lamblia
PDPSSANE

SEQ ID NO: 3126872 - protein, 6 aa, Giardia lamblia
PDPSYL

SEQ ID NO: 3126873 - protein, 76 aa, Giardia lamblia
PDPTEAPEPAAPLATTQSAKQATKPSLKNTIRPAPEKQPVGRPTHSMPDKPKAAAGLAKPELPNGQTGTGASAKNL

SEQ ID NO: 3126874 - protein, 6 aa, Giardia lamblia
PDPTGR

SEQ ID NO: 3126875 - protein, 8 aa, Giardia lamblia
PDPTHNEN

SEQ ID NO: 3126876 - protein, 12 aa, Giardia lamblia
PDPTNTTDDPSG

SEQ ID NO: 3126877 - protein, 7 aa, Giardia lamblia
PDPVKRP

SEQ ID NO: 3126878 - protein, 4 aa, Giardia lamblia
PDQA

SEQ ID NO: 3126879 - protein, 6 aa, Giardia lamblia
PDQAPS

SEQ ID NO: 3126880 - protein, 8 aa, Giardia lamblia
PDQGDTLD

SEQ ID NO: 3126881 - protein, 7 aa, Giardia lamblia
PDQGNEF

SEQ ID NO: 3126882 - protein, 11 aa, Giardia lamblia
PDQGYRPTAGD

SEQ ID NO: 3126883 - protein, 7 aa, Giardia lamblia
PDQINTS

SEQ ID NO: 3126884 - protein, 20 aa, Giardia lamblia
PDQKAEATTDFTPSSDEFSQ

SEQ ID NO: 3126885 - protein, 7 aa, Giardia lamblia
PDQKDER

SEQ ID NO: 3126886 - protein, 6 aa, Giardia lamblia
PDQLGG

SEQ ID NO: 3126887 - protein, 8 aa, Giardia lamblia
PDQPLDGD

SEQ ID NO: 3126888 - protein, 5 aa, Giardia lamblia
PDQRM

SEQ ID NO: 3126889 - protein, 8 aa, Giardia lamblia
PDQSKPED

SEQ ID NO: 3126890 - protein, 24 aa, Giardia lamblia
PDQSVCSTEQPQPAVGTEQQDDIN

SEQ ID NO: 3126891 - protein, 16 aa, Giardia lamblia
PDQTAPSQQHAHRSPP

SEQ ID NO: 3126892 - protein, 9 aa, Giardia lamblia
PDQTTPDGM

SEQ ID NO: 3126893 - protein, 42 aa, Giardia lamblia
PDQYTEEEQHSTDGQPAQDEQVSPPSSSIDIERNKQRLKEKE

SEQ ID NO: 3126894 - protein, 4 aa, Giardia lamblia
PDRA

SEQ ID NO: 3126895 - protein, 11 aa, Giardia lamblia
PDRATDSPDPK

SEQ ID NO: 3126896 - protein, 8 aa, Giardia lamblia
PDREADTG

SEQ ID NO: 3126897 - protein, 5 aa, Giardia lamblia
PDRKA

SEQ ID NO: 3126898 - protein, 6 aa, Giardia lamblia
PDRKGN

SEQ ID NO: 3126899 - protein, 6 aa, Giardia lamblia
PDRKTV

SEQ ID NO: 3126900 - protein, 5 aa, Giardia lamblia
PDRRS

SEQ ID NO: 3126901 - protein, 5 aa, Giardia lamblia
PDRTE

SEQ ID NO: 3126902 - protein, 9 aa, Giardia lamblia
PDRTTKSGA

SEQ ID NO: 3126903 - protein, 15 aa, Giardia lamblia
PDSAEHAATLDPSNY

SEQ ID NO: 3126904 - protein, 7 aa, Giardia lamblia
PDSATDK

SEQ ID NO: 3126905 - protein, 6 aa, Giardia lamblia
PDSGDL

SEQ ID NO: 3126906 - protein, 5 aa, Giardia lamblia
PDSGS

SEQ ID NO: 3126907 - protein, 10 aa, Giardia lamblia
PDSKPYDSGQ

SEQ ID NO: 3126908 - protein, 4 aa, Giardia lamblia
PDSL

SEQ ID NO: 3126909 - protein, 5 aa, Giardia lamblia
PDSLQ

SEQ ID NO: 3126910 - protein, 7 aa, Giardia lamblia
PDSNREF

SEQ ID NO: 3126911 - protein, 7 aa, Giardia lamblia
PDSPQSE

SEQ ID NO: 3126912 - protein, 5 aa, Giardia lamblia
PDSQD

SEQ ID NO: 3126913 - protein, 14 aa, Giardia lamblia
PDSQEFRGTPIAPT

SEQ ID NO: 3126914 - protein, 9 aa, Giardia lamblia
PDSSAYKEA

SEQ ID NO: 3126915 - protein, 6 aa, Giardia lamblia
PDSSDA

SEQ ID NO: 3126916 - protein, 24 aa, Giardia lamblia
PDSSNEKGCQEPIPEQPKDKRPQP

SEQ ID NO: 3126917 - protein, 18 aa, Giardia lamblia
PDSSNYRHNYEGDDDMPA

SEQ ID NO: 3126918 - protein, 5 aa, Giardia lamblia
PDSSQ

SEQ ID NO: 3126919 - protein, 8 aa, Giardia lamblia
PDSTDRTY

SEQ ID NO: 3126920 - protein, 10 aa, Giardia lamblia
PDSTETRGLQ

SEQ ID NO: 3126921 - protein, 8 aa, Giardia lamblia
PDSTPNEL

SEQ ID NO: 3126922 - protein, 8 aa, Giardia lamblia
PDSTTHSL

SEQ ID NO: 3126923 - protein, 5 aa, Giardia lamblia
PDSTV

SEQ ID NO: 3126924 - protein, 25 aa, Giardia lamblia
PDTALTGDGDSSQLRDCTRSTDSSL

SEQ ID NO: 3126925 - protein, 4 aa, Giardia lamblia
PDTD

SEQ ID NO: 3126926 - protein, 9 aa, Giardia lamblia
PDTDDDGDG

SEQ ID NO: 3126927 - protein, 34 aa, Giardia lamblia
PDTGIQGTTPPKAPGSANKGASALSKANPYDDNT

SEQ ID NO: 3126928 - protein, 6 aa, Giardia lamblia
PDTGKK

SEQ ID NO: 3126929 - protein, 13 aa, Giardia lamblia
PDTLSSDTSEQLK

SEQ ID NO: 3126930 - protein, 10 aa, Giardia lamblia
PDTPSSSQLA

SEQ ID NO: 3126931 - protein, 5 aa, Giardia lamblia
PDTPV

SEQ ID NO: 3126932 - protein, 4 aa, Giardia lamblia
PDTR

SEQ ID NO: 3126933 - protein, 16 aa, Giardia lamblia
PDTSEQREEITKSLPG

SEQ ID NO: 3126934 - protein, 6 aa, Giardia lamblia
PDTSYN

SEQ ID NO: 3126935 - protein, 11 aa, Giardia lamblia
PDTYEANIDGG

SEQ ID NO: 3126936 - protein, 8 aa, Giardia lamblia
PDVEGGPS

SEQ ID NO: 3126937 - protein, 12 aa, Giardia lamblia
PDVPTAPLSYTP

SEQ ID NO: 3126938 - protein, 4 aa, Giardia lamblia
PDVS

SEQ ID NO: 3126939 - protein, 15 aa, Giardia lamblia
PDVVKGGPKVDENGN

SEQ ID NO: 3126940 - protein, 4 aa, Giardia lamblia
PDVY

SEQ ID NO: 3126941 - protein, 8 aa, Giardia lamblia
PDYNSRPT

SEQ ID NO: 3126942 - protein, 9 aa, Giardia lamblia
PEAAQHGPA

SEQ ID NO: 3126943 - protein, 12 aa, Giardia lamblia
PEAAQPPATENT

SEQ ID NO: 3126944 - protein, 5 aa, Giardia lamblia
PEAEH

SEQ ID NO: 3126945 - protein, 8 aa, Giardia lamblia
PEAETIER

SEQ ID NO: 3126946 - protein, 5 aa, Giardia lamblia
PEAFP

SEQ ID NO: 3126947 - protein, 14 aa, Giardia lamblia
PEAGKQSSLKNPTL

SEQ ID NO: 3126948 - protein, 4 aa, Giardia lamblia
PEAI

SEQ ID NO: 3126949 - protein, 7 aa, Giardia lamblia
PEALSNN

SEQ ID NO: 3126950 - protein, 6 aa, Giardia lamblia
PEAPQA

SEQ ID NO: 3126951 - protein, 17 aa, Giardia lamblia
PEAQPRKYLSPEKLTND

SEQ ID NO: 3126952 - protein, 4 aa, Giardia lamblia
PEAR

SEQ ID NO: 3126953 - protein, 6 aa, Giardia lamblia
PEARIT

SEQ ID NO: 3126954 - protein, 8 aa, Giardia lamblia
PEASKKVQ

SEQ ID NO: 3126955 - protein, 12 aa, Giardia lamblia
PEASNDRSMDRH

SEQ ID NO: 3126956 - protein, 7 aa, Giardia lamblia
PEASNGY

SEQ ID NO: 3126957 - protein, 7 aa, Giardia lamblia
PEASTQR

SEQ ID NO: 3126958 - protein, 4 aa, Giardia lamblia
PEAT

SEQ ID NO: 3126959 - protein, 6 aa, Giardia lamblia
PEATGY

SEQ ID NO: 3126960 - protein, 7 aa, Giardia lamblia
PEATKAE

SEQ ID NO: 3126961 - protein, 6 aa, Giardia lamblia
PEATSS

SEQ ID NO: 3126962 - protein, 4 aa, Giardia lamblia
PEAV

SEQ ID NO: 3126963 - protein, 10 aa, Giardia lamblia
PECAPNASEP

SEQ ID NO: 3126964 - protein, 16 aa, Giardia lamblia
PECDGGSRKNQLNRAS

SEQ ID NO: 3126965 - protein, 9 aa, Giardia lamblia
PEDDSQSLR

SEQ ID NO: 3126966 - protein, 4 aa, Giardia lamblia
PEDE

SEQ ID NO: 3126967 - protein, 4 aa, Giardia lamblia
PEDF

SEQ ID NO: 3126968 - protein, 8 aa, Giardia lamblia
PEDIEERS

SEQ ID NO: 3126969 - protein, 5 aa, Giardia lamblia
PEDIS

SEQ ID NO: 3126970 - protein, 43 aa, Giardia lamblia
PEDKKSSLAQKSEVQASPSLEQSEQEQKGQGSDIQGTGELRQS

SEQ ID NO: 3126971 - protein, 5 aa, Giardia lamblia
PEDKL

SEQ ID NO: 3126972 - protein, 7 aa, Giardia lamblia
PEDKSYK

SEQ ID NO: 3126973 - protein, 53 aa, Giardia lamblia
PEDNAYNDPQELHNDEPKLEAGPIDDEPQDQPVDTCKDEAPRPENPDNDDVQP

SEQ ID NO: 3126974 - protein, 5 aa, Giardia lamblia
PEDPN

SEQ ID NO: 3126975 - protein, 13 aa, Giardia lamblia
PEDPPTKTQPDYL

SEQ ID NO: 3126976 - protein, 6 aa, Giardia lamblia
PEDPRL

SEQ ID NO: 3126977 - protein, 20 aa, Giardia lamblia
PEDQAEVYNERNDEVREAFC

SEQ ID NO: 3126978 - protein, 7 aa, Giardia lamblia
PEDQDTQ

SEQ ID NO: 3126979 - protein, 39 aa, Giardia lamblia
PEDQSQTHSRSAPESCEEDGIKVPESNVSTLSSVAMDES

SEQ ID NO: 3126980 - protein, 4 aa, Giardia lamblia
PEDR

SEQ ID NO: 3126981 - protein, 7 aa, Giardia lamblia
PEDRITA

SEQ ID NO: 3126982 - protein, 17 aa, Giardia lamblia
PEDRKEQSIQLLEQYER

SEQ ID NO: 3126983 - protein, 8 aa, Giardia lamblia
PEDRPSAA

SEQ ID NO: 3126984 - protein, 5 aa, Giardia lamblia
PEDSQ

SEQ ID NO: 3126985 - protein, 6 aa, Giardia lamblia
PEDSRD

SEQ ID NO: 3126986 - protein, 7 aa, Giardia lamblia
PEDTDRL

SEQ ID NO: 3126987 - protein, 9 aa, Giardia lamblia
PEDTDYSGT

SEQ ID NO: 3126988 - protein, 7 aa, Giardia lamblia
PEDTIPD

SEQ ID NO: 3126989 - protein, 8 aa, Giardia lamblia
PEDTRRNF

SEQ ID NO: 3126990 - protein, 6 aa, Giardia lamblia
PEDTVD

SEQ ID NO: 3126991 - protein, 13 aa, Giardia lamblia
PEDTVPSKSRSRP

SEQ ID NO: 3126992 - protein, 4 aa, Giardia lamblia
PEDV

SEQ ID NO: 3126993 - protein, 6 aa, Giardia lamblia
PEDYPA

SEQ ID NO: 3126994 - protein, 5 aa, Giardia lamblia
PEEAE

SEQ ID NO: 3126995 - protein, 6 aa, Giardia lamblia
PEEDRN

SEQ ID NO: 3126996 - protein, 12 aa, Giardia lamblia
PEEEISKSTEPV

SEQ ID NO: 3126997 - protein, 89 aa, Giardia lamblia
PEEEQVEEEPLEDVPEEELNDGEEKGEGEDAEEAEEKAEEDGDQEAHEDDAEGDDLGEDNHQAGEDNEEDKGEAEEAEEELHSDQSIEE

SEQ ID NO: 3126998 - protein, 10 aa, Giardia lamblia
PEEGHRKHKH

SEQ ID NO: 3126999 - protein, 11 aa, Giardia lamblia
PEEGPVSGYGK

SEQ ID NO: 3127000 - protein, 6 aa, Giardia lamblia
PEEIPW

SEQ ID NO: 3127001 - protein, 10 aa, Giardia lamblia
PEELKASSPV

SEQ ID NO: 3127002 - protein, 8 aa, Giardia lamblia
PEEQNGRV

SEQ ID NO: 3127003 - protein, 6 aa, Giardia lamblia
PEEQPA

SEQ ID NO: 3127004 - protein, 9 aa, Giardia lamblia
PEESNYQEA

SEQ ID NO: 3127005 - protein, 5 aa, Giardia lamblia
PEESP

SEQ ID NO: 3127006 - protein, 16 aa, Giardia lamblia
PEESQKADAKTAVRDV

SEQ ID NO: 3127007 - protein, 15 aa, Giardia lamblia
PEETDINDNSCISFA

SEQ ID NO: 3127008 - protein, 7 aa, Giardia lamblia
PEETEES

SEQ ID NO: 3127009 - protein, 5 aa, Giardia lamblia
PEETG

SEQ ID NO: 3127010 - protein, 16 aa, Giardia lamblia
PEETLGPPQGKTKQSA

SEQ ID NO: 3127011 - protein, 8 aa, Giardia lamblia
PEETSEEA

SEQ ID NO: 3127012 - protein, 8 aa, Giardia lamblia
PEEVNGER

SEQ ID NO: 3127013 - protein, 6 aa, Giardia lamblia
PEFDSE

SEQ ID NO: 3127014 - protein, 5 aa, Giardia lamblia
PEGDG

SEQ ID NO: 3127015 - protein, 8 aa, Giardia lamblia
PEGDQAEL

SEQ ID NO: 3127016 - protein, 10 aa, Giardia lamblia
PEGNESRLSD

SEQ ID NO: 3127017 - protein, 5 aa, Giardia lamblia
PEGNR

SEQ ID NO: 3127018 - protein, 6 aa, Giardia lamblia
PEGNTD

SEQ ID NO: 3127019 - protein, 8 aa, Giardia lamblia
PEGPAERP

SEQ ID NO: 3127020 - protein, 8 aa, Giardia lamblia
PEGPAERS

SEQ ID NO: 3127021 - protein, 10 aa, Giardia lamblia
PEGSPVSERA

SEQ ID NO: 3127022 - protein, 7 aa, Giardia lamblia
PEGTEPA

SEQ ID NO: 3127023 - protein, 7 aa, Giardia lamblia
PEGTTSI

SEQ ID NO: 3127024 - protein, 4 aa, Giardia lamblia
PEHA

SEQ ID NO: 3127025 - protein, 10 aa, Giardia lamblia
PEHGNVDDTR

SEQ ID NO: 3127026 - protein, 12 aa, Giardia lamblia
PEIAGPSATKAA

SEQ ID NO: 3127027 - protein, 4 aa, Giardia lamblia
PEIE

SEQ ID NO: 3127028 - protein, 4 aa, Giardia lamblia
PEIK

SEQ ID NO: 3127029 - protein, 10 aa, Giardia lamblia
PEISDDDDIS

SEQ ID NO: 3127030 - protein, 12 aa, Giardia lamblia
PEKATLDQNERS

SEQ ID NO: 3127031 - protein, 10 aa, Giardia lamblia
PEKDHPGKPM

SEQ ID NO: 3127032 - protein, 33 aa, Giardia lamblia
PEKDTSEEGAGKSSPAESPQTDDEGSVDEDGVT

SEQ ID NO: 3127033 - protein, 7 aa, Giardia lamblia
PEKEESE

SEQ ID NO: 3127034 - protein, 8 aa, Giardia lamblia
PEKEETIR

SEQ ID NO: 3127035 - protein, 5 aa, Giardia lamblia
PEKEI

SEQ ID NO: 3127036 - protein, 12 aa, Giardia lamblia
PEKFSGARSERE

SEQ ID NO: 3127037 - protein, 10 aa, Giardia lamblia
PEKGETGVPH

SEQ ID NO: 3127038 - protein, 6 aa, Giardia lamblia
PEKGSN

SEQ ID NO: 3127039 - protein, 10 aa, Giardia lamblia
PEKITRPPLS

SEQ ID NO: 3127040 - protein, 7 aa, Giardia lamblia
PEKKPTV

SEQ ID NO: 3127041 - protein, 5 aa, Giardia lamblia
PEKNG

SEQ ID NO: 3127042 - protein, 7 aa, Giardia lamblia
PEKNLTN

SEQ ID NO: 3127043 - protein, 10 aa, Giardia lamblia
PEKNNAVEAS

SEQ ID NO: 3127044 - protein, 6 aa, Giardia lamblia
PEKPNY

SEQ ID NO: 3127045 - protein, 6 aa, Giardia lamblia
PEKPVP

SEQ ID NO: 3127046 - protein, 10 aa, Giardia lamblia
PEKQLESGQI

SEQ ID NO: 3127047 - protein, 4 aa, Giardia lamblia
PEKR

SEQ ID NO: 3127048 - protein, 10 aa, Giardia lamblia
PEKRNKDDTY

SEQ ID NO: 3127049 - protein, 9 aa, Giardia lamblia
PEKRPSTTE

SEQ ID NO: 3127050 - protein, 9 aa, Giardia lamblia
PEKSNENAI

SEQ ID NO: 3127051 - protein, 7 aa, Giardia lamblia
PEKVDRE

SEQ ID NO: 3127052 - protein, 10 aa, Giardia lamblia
PELDGPSLTK

SEQ ID NO: 3127053 - protein, 18 aa, Giardia lamblia
PELDPEQIEGMGKGHSMS

SEQ ID NO: 3127054 - protein, 4 aa, Giardia lamblia
PELE

SEQ ID NO: 3127055 - protein, 12 aa, Giardia lamblia
PELNKDSQLSND

SEQ ID NO: 3127056 - protein, 4 aa, Giardia lamblia
PELP

SEQ ID NO: 3127057 - protein, 15 aa, Giardia lamblia
PELPEEEDVEGSQSL

SEQ ID NO: 3127058 - protein, 7 aa, Giardia lamblia
PELPGYS

SEQ ID NO: 3127059 - protein, 10 aa, Giardia lamblia
PELPSTLSQG

SEQ ID NO: 3127060 - protein, 8 aa, Giardia lamblia
PELQQGDG

SEQ ID NO: 3127061 - protein, 4 aa, Giardia lamblia
PELR

SEQ ID NO: 3127062 - protein, 8 aa, Giardia lamblia
PELSAGQR

SEQ ID NO: 3127063 - protein, 6 aa, Giardia lamblia
PELSTS

SEQ ID NO: 3127064 - protein, 6 aa, Giardia lamblia
PELTPH

SEQ ID NO: 3127065 - protein, 5 aa, Giardia lamblia
PEMQQ

SEQ ID NO: 3127066 - protein, 5 aa, Giardia lamblia
PEMSN

SEQ ID NO: 3127067 - protein, 12 aa, Giardia lamblia
PENERPKPGQQI

SEQ ID NO: 3127068 - protein, 5 aa, Giardia lamblia
PENEV

SEQ ID NO: 3127069 - protein, 14 aa, Giardia lamblia
PENIGQEDKDRRVQ

SEQ ID NO: 3127070 - protein, 5 aa, Giardia lamblia
PENMK

SEQ ID NO: 3127071 - protein, 6 aa, Giardia lamblia
PENNDQ

SEQ ID NO: 3127072 - protein, 9 aa, Giardia lamblia
PENNPSASI

SEQ ID NO: 3127073 - protein, 5 aa, Giardia lamblia
PENQH

SEQ ID NO: 3127074 - protein, 4 aa, Giardia lamblia
PENT

SEQ ID NO: 3127075 - protein, 4 aa, Giardia lamblia
PEPF

SEQ ID NO: 3127076 - protein, 11 aa, Giardia lamblia
PEPGSEDNGRV

SEQ ID NO: 3127077 - protein, 4 aa, Giardia lamblia
PEPI

SEQ ID NO: 3127078 - protein, 36 aa, Giardia lamblia
PEPPINMGPSPNMNYESGLSDEGNSGNYQGSQDNNY

SEQ ID NO: 3127079 - protein, 6 aa, Giardia lamblia
PEPPPV

SEQ ID NO: 3127080 - protein, 6 aa, Giardia lamblia
PEPSET

SEQ ID NO: 3127081 - protein, 5 aa, Giardia lamblia
PEPSI

SEQ ID NO: 3127082 - protein, 27 aa, Giardia lamblia
PEPSTLSISASKSQKPDQDGHSSDDDV

SEQ ID NO: 3127083 - protein, 5 aa, Giardia lamblia
PEPYR

SEQ ID NO: 3127084 - protein, 6 aa, Giardia lamblia
PEPYRR

SEQ ID NO: 3127085 - protein, 19 aa, Giardia lamblia
PEQLETNSNGDSVPGATNT

SEQ ID NO: 3127086 - protein, 5 aa, Giardia lamblia
PEQNL

SEQ ID NO: 3127087 - protein, 10 aa, Giardia lamblia
PEQPNPGIHQ

SEQ ID NO: 3127088 - protein, 14 aa, Giardia lamblia
PEQPRTAPAPQRKM

SEQ ID NO: 3127089 - protein, 5 aa, Giardia lamblia
PEQQA

SEQ ID NO: 3127090 - protein, 6 aa, Giardia lamblia
PEQQRG

SEQ ID NO: 3127091 - protein, 8 aa, Giardia lamblia
PEQTGQHG

SEQ ID NO: 3127092 - protein, 5 aa, Giardia lamblia
PEQYS

SEQ ID NO: 3127093 - protein, 6 aa, Giardia lamblia
PERASR

SEQ ID NO: 3127094 - protein, 4 aa, Giardia lamblia
PERD

SEQ ID NO: 3127095 - protein, 9 aa, Giardia lamblia
PERDSNGMG

SEQ ID NO: 3127096 - protein, 4 aa, Giardia lamblia
PERE

SEQ ID NO: 3127097 - protein, 17 aa, Giardia lamblia
PERFPDSSKVLRHDPTI

SEQ ID NO: 3127098 - protein, 12 aa, Giardia lamblia
PERGERGPRQME

SEQ ID NO: 3127099 - protein, 14 aa, Giardia lamblia
PERKRARTTSRIGS

SEQ ID NO: 3127100 - protein, 17 aa, Giardia lamblia
PERLPTKTTSPGLRGSI

SEQ ID NO: 3127101 - protein, 4 aa, Giardia lamblia
PERP

SEQ ID NO: 3127102 - protein, 7 aa, Giardia lamblia
PERPGPC

SEQ ID NO: 3127103 - protein, 8 aa, Giardia lamblia
PERPPFRP

SEQ ID NO: 3127104 - protein, 35 aa, Giardia lamblia
PERRRSSRQSANITNSEPSEPSRVSDKLSTSESIP

SEQ ID NO: 3127105 - protein, 8 aa, Giardia lamblia
PERSADQC

SEQ ID NO: 3127106 - protein, 5 aa, Giardia lamblia
PERVN

SEQ ID NO: 3127107 - protein, 10 aa, Giardia lamblia
PESDSESEDL

SEQ ID NO: 3127108 - protein, 30 aa, Giardia lamblia
PESGLESTTESEGDTNTNTEEKLTKTPGRG

SEQ ID NO: 3127109 - protein, 6 aa, Giardia lamblia
PESGND

SEQ ID NO: 3127110 - protein, 4 aa, Giardia lamblia
PESK

SEQ ID NO: 3127111 - protein, 9 aa, Giardia lamblia
PESKPLSDE

SEQ ID NO: 3127112 - protein, 4 aa, Giardia lamblia
PESL

SEQ ID NO: 3127113 - protein, 14 aa, Giardia lamblia
PESQSGYTRATGPE

SEQ ID NO: 3127114 - protein, 5 aa, Giardia lamblia
PESQY

SEQ ID NO: 3127115 - protein, 10 aa, Giardia lamblia
PESRLSATEA

SEQ ID NO: 3127116 - protein, 4 aa, Giardia lamblia
PESS

SEQ ID NO: 3127117 - protein, 4 aa, Giardia lamblia
PETA

SEQ ID NO: 3127118 - protein, 18 aa, Giardia lamblia
PETAQEIGATTESGLRPA

SEQ ID NO: 3127119 - protein, 12 aa, Giardia lamblia
PETETDKEPFED

SEQ ID NO: 3127120 - protein, 7 aa, Giardia lamblia
PETGEQR

SEQ ID NO: 3127121 - protein, 7 aa, Giardia lamblia
PETGQGI

SEQ ID NO: 3127122 - protein, 4 aa, Giardia lamblia
PETL

SEQ ID NO: 3127123 - protein, 11 aa, Giardia lamblia
PETNQESDTFK

SEQ ID NO: 3127124 - protein, 20 aa, Giardia lamblia
PETPGSDSGQHRGSQSSYNT

SEQ ID NO: 3127125 - protein, 5 aa, Giardia lamblia
PETSE

SEQ ID NO: 3127126 - protein, 11 aa, Giardia lamblia
PETSNNDNEQF

SEQ ID NO: 3127127 - protein, 8 aa, Giardia lamblia
PETSYTDR

SEQ ID NO: 3127128 - protein, 4 aa, Giardia lamblia
PETT

SEQ ID NO: 3127129 - protein, 5 aa, Giardia lamblia
PETTG

SEQ ID NO: 3127130 - protein, 7 aa, Giardia lamblia
PETTMSS

SEQ ID NO: 3127131 - protein, 36 aa, Giardia lamblia
PETTQAAVGRADALRSGTFPGNVRNQAASIAASQDF

SEQ ID NO: 3127132 - protein, 5 aa, Giardia lamblia
PETYE

SEQ ID NO: 3127133 - protein, 12 aa, Giardia lamblia
PEVAPASNTPIA

SEQ ID NO: 3127134 - protein, 18 aa, Giardia lamblia
PEVESNDRPTKSSQLTSN

SEQ ID NO: 3127135 - protein, 4 aa, Giardia lamblia
PEVK

SEQ ID NO: 3127136 - protein, 7 aa, Giardia lamblia
PEVPDAE

SEQ ID NO: 3127137 - protein, 62 aa, Giardia lamblia
PEVPPEEETSTSKAKKGSAKEDKKRGDKTSAKTSAKTSAKTSRRGSIRGGEPSETPNPDSIT

SEQ ID NO: 3127138 - protein, 6 aa, Giardia lamblia
PEVQPS

SEQ ID NO: 3127139 - protein, 6 aa, Giardia lamblia
PEVSGA

SEQ ID NO: 3127140 - protein, 14 aa, Giardia lamblia
PEVSQASKPSSISD

SEQ ID NO: 3127141 - protein, 4 aa, Giardia lamblia
PEVT

SEQ ID NO: 3127142 - protein, 5 aa, Giardia lamblia
PEYDV

SEQ ID NO: 3127143 - protein, 8 aa, Giardia lamblia
PEYIDSGS

SEQ ID NO: 3127144 - protein, 8 aa, Giardia lamblia
PEYNGSPG

SEQ ID NO: 3127145 - protein, 4 aa, Giardia lamblia
PEYP

SEQ ID NO: 3127146 - protein, 9 aa, Giardia lamblia
PEYRQSSSS

SEQ ID NO: 3127147 - protein, 9 aa, Giardia lamblia
PEYRRQGVS

SEQ ID NO: 3127148 - protein, 4 aa, Giardia lamblia
PEYS

SEQ ID NO: 3127149 - protein, 7 aa, Giardia lamblia
PEYTPDY

SEQ ID NO: 3127150 - protein, 11 aa, Giardia lamblia
PEYVPSGRLPR

SEQ ID NO: 3127151 - protein, 8 aa, Giardia lamblia
PFAPPEER

SEQ ID NO: 3127152 - protein, 11 aa, Giardia lamblia
PFDDSSPEQDE

SEQ ID NO: 3127153 - protein, 8 aa, Giardia lamblia
PFDEEDHT

SEQ ID NO: 3127154 - protein, 10 aa, Giardia lamblia
PFDGSTPNHL

SEQ ID NO: 3127155 - protein, 5 aa, Giardia lamblia
PFDSN

SEQ ID NO: 3127156 - protein, 12 aa, Giardia lamblia
PFGDPIPSSDAH

SEQ ID NO: 3127157 - protein, 11 aa, Giardia lamblia
PFGSDNPRDSV

SEQ ID NO: 3127158 - protein, 19 aa, Giardia lamblia
PFGTTSKQGTEPSNTSIER

SEQ ID NO: 3127159 - protein, 7 aa, Giardia lamblia
PFHGSKD

SEQ ID NO: 3127160 - protein, 7 aa, Giardia lamblia
PFHNGED

SEQ ID NO: 3127161 - protein, 16 aa, Giardia lamblia
PFKPGARGGAYTNPNM

SEQ ID NO: 3127162 - protein, 7 aa, Giardia lamblia
PFKPPKV

SEQ ID NO: 3127163 - protein, 12 aa, Giardia lamblia
PFKSALSNDTLD

SEQ ID NO: 3127164 - protein, 6 aa, Giardia lamblia
PFKTGQ

SEQ ID NO: 3127165 - protein, 9 aa, Giardia lamblia
PFNNDPPVP

SEQ ID NO: 3127166 - protein, 4 aa, Giardia lamblia
PFNQ

SEQ ID NO: 3127167 - protein, 6 aa, Giardia lamblia
PFPDPT

SEQ ID NO: 3127168 - protein, 10 aa, Giardia lamblia
PFPESRRPEV

SEQ ID NO: 3127169 - protein, 5 aa, Giardia lamblia
PFPGL

SEQ ID NO: 3127170 - protein, 10 aa, Giardia lamblia
PFPPGSSVSG

SEQ ID NO: 3127171 - protein, 13 aa, Giardia lamblia
PFPPTTSSQVKGT

SEQ ID NO: 3127172 - protein, 15 aa, Giardia lamblia
PFPQDADVAGKTREE

SEQ ID NO: 3127173 - protein, 13 aa, Giardia lamblia
PFPTRSLGGRKTA

SEQ ID NO: 3127174 - protein, 5 aa, Giardia lamblia
PFQRP

SEQ ID NO: 3127175 - protein, 31 aa, Giardia lamblia
PFQRSDPFGSSGYPEDMRGPRPRHNTGPSVE

SEQ ID NO: 3127176 - protein, 9 aa, Giardia lamblia
PFRQGGVPE

SEQ ID NO: 3127177 - protein, 12 aa, Giardia lamblia
PFRRRKPPTSLD

SEQ ID NO: 3127178 - protein, 17 aa, Giardia lamblia
PFSAQPAQPVYKPPPPL

SEQ ID NO: 3127179 - protein, 6 aa, Giardia lamblia
PFSSQQ

SEQ ID NO: 3127180 - protein, 5 aa, Giardia lamblia
PFTET

SEQ ID NO: 3127181 - protein, 4 aa, Giardia lamblia
PFTP

SEQ ID NO: 3127182 - protein, 5 aa, Giardia lamblia
PFTPA

SEQ ID NO: 3127183 - protein, 11 aa, Giardia lamblia
PFTSRKSTKMN

SEQ ID NO: 3127184 - protein, 9 aa, Giardia lamblia
PFTSTSSSE

SEQ ID NO: 3127185 - protein, 32 aa, Giardia lamblia
PFTTAGEQQEANLNAGASATPRKPDSDEDSPL

SEQ ID NO: 3127186 - protein, 6 aa, Giardia lamblia
PFTTGR

SEQ ID NO: 3127187 - protein, 5 aa, Giardia lamblia
PGADA

SEQ ID NO: 3127188 - protein, 10 aa, Giardia lamblia
PGADPTSYSF

SEQ ID NO: 3127189 - protein, 5 aa, Giardia lamblia
PGAGA

SEQ ID NO: 3127190 - protein, 6 aa, Giardia lamblia
PGAIPK

SEQ ID NO: 3127191 - protein, 9 aa, Giardia lamblia
PGAKNPPIF

SEQ ID NO: 3127192 - protein, 14 aa, Giardia lamblia
PGAPPKRTRTGTLH

SEQ ID NO: 3127193 - protein, 8 aa, Giardia lamblia
PGAPSVSK

SEQ ID NO: 3127194 - protein, 9 aa, Giardia lamblia
PGARVGPPL

SEQ ID NO: 3127195 - protein, 4 aa, Giardia lamblia
PGAS

SEQ ID NO: 3127196 - protein, 8 aa, Giardia lamblia
PGATAGDR

SEQ ID NO: 3127197 - protein, 8 aa, Giardia lamblia
PGATDSEA

SEQ ID NO: 3127198 - protein, 10 aa, Giardia lamblia
PGAVTASDEQ

SEQ ID NO: 3127199 - protein, 5 aa, Giardia lamblia
PGCAK

SEQ ID NO: 3127200 - protein, 8 aa, Giardia lamblia
PGCGKSAV

SEQ ID NO: 3127201 - protein, 9 aa, Giardia lamblia
PGCGKSQIG

SEQ ID NO: 3127202 - protein, 5 aa, Giardia lamblia
PGCST

SEQ ID NO: 3127203 - protein, 4 aa, Giardia lamblia
PGCT

SEQ ID NO: 3127204 - protein, 4 aa, Giardia lamblia
PGDC

SEQ ID NO: 3127205 - protein, 9 aa, Giardia lamblia
PGDDERDQL

SEQ ID NO: 3127206 - protein, 4 aa, Giardia lamblia
PGDE

SEQ ID NO: 3127207 - protein, 13 aa, Giardia lamblia
PGDGVTKPQAGKK

SEQ ID NO: 3127208 - protein, 10 aa, Giardia lamblia
PGDSESETWN

SEQ ID NO: 3127209 - protein, 5 aa, Giardia lamblia
PGDTA

SEQ ID NO: 3127210 - protein, 9 aa, Giardia lamblia
PGDTSRQIP

SEQ ID NO: 3127211 - protein, 4 aa, Giardia lamblia
PGDV

SEQ ID NO: 3127212 - protein, 5 aa, Giardia lamblia
PGDVR

SEQ ID NO: 3127213 - protein, 5 aa, Giardia lamblia
PGDVT

SEQ ID NO: 3127214 - protein, 13 aa, Giardia lamblia
PGEAKLQKADGTT

SEQ ID NO: 3127215 - protein, 10 aa, Giardia lamblia
PGEASVKNPV

SEQ ID NO: 3127216 - protein, 9 aa, Giardia lamblia
PGEDGKDVD

SEQ ID NO: 3127217 - protein, 18 aa, Giardia lamblia
PGEDPSTKGSSAHAPRGR

SEQ ID NO: 3127218 - protein, 4 aa, Giardia lamblia
PGEG

SEQ ID NO: 3127219 - protein, 9 aa, Giardia lamblia
PGENNPRLE

SEQ ID NO: 3127220 - protein, 6 aa, Giardia lamblia
PGEQLS

SEQ ID NO: 3127221 - protein, 8 aa, Giardia lamblia
PGEQPADD

SEQ ID NO: 3127222 - protein, 8 aa, Giardia lamblia
PGERPTAK

SEQ ID NO: 3127223 - protein, 17 aa, Giardia lamblia
PGESASSLSQPSISPSV

SEQ ID NO: 3127224 - protein, 7 aa, Giardia lamblia
PGESDVV

SEQ ID NO: 3127225 - protein, 10 aa, Giardia lamblia
PGETDEDHAQ

SEQ ID NO: 3127226 - protein, 12 aa, Giardia lamblia
PGEVSRSNENVI

SEQ ID NO: 3127227 - protein, 7 aa, Giardia lamblia
PGEYDSQ

SEQ ID NO: 3127228 - protein, 4 aa, Giardia lamblia
PGFA

SEQ ID NO: 3127229 - protein, 25 aa, Giardia lamblia
PGFDTTKDQIESDANKYTIQSPGSS

SEQ ID NO: 3127230 - protein, 5 aa, Giardia lamblia
PGFGG

SEQ ID NO: 3127231 - protein, 10 aa, Giardia lamblia
PGFRGKTSEV

SEQ ID NO: 3127232 - protein, 5 aa, Giardia lamblia
PGFTE

SEQ ID NO: 3127233 - protein, 4 aa, Giardia lamblia
PGGA

SEQ ID NO: 3127234 - protein, 12 aa, Giardia lamblia
PGGCDPNVHPSK

SEQ ID NO: 3127235 - protein, 5 aa, Giardia lamblia
PGGDM

SEQ ID NO: 3127236 - protein, 7 aa, Giardia lamblia
PGGEELK

SEQ ID NO: 3127237 - protein, 10 aa, Giardia lamblia
PGGGQQAPPI

SEQ ID NO: 3127238 - protein, 12 aa, Giardia lamblia
PGGHGEGHTTSE

SEQ ID NO: 3127239 - protein, 7 aa, Giardia lamblia
PGGPGWK

SEQ ID NO: 3127240 - protein, 13 aa, Giardia lamblia
PGGSTDAAAVASS

SEQ ID NO: 3127241 - protein, 4 aa, Giardia lamblia
PGGT

SEQ ID NO: 3127242 - protein, 21 aa, Giardia lamblia
PGGTGLQQPQQHPKENELEKN

SEQ ID NO: 3127243 - protein, 7 aa, Giardia lamblia
PGGYSEK

SEQ ID NO: 3127244 - protein, 5 aa, Giardia lamblia
PGHED

SEQ ID NO: 3127245 - protein, 5 aa, Giardia lamblia
PGHES

SEQ ID NO: 3127246 - protein, 6 aa, Giardia lamblia
PGHGES

SEQ ID NO: 3127247 - protein, 10 aa, Giardia lamblia
PGHGETSPMT

SEQ ID NO: 3127248 - protein, 6 aa, Giardia lamblia
PGHHED

SEQ ID NO: 3127249 - protein, 4 aa, Giardia lamblia
PGHS

SEQ ID NO: 3127250 - protein, 4 aa, Giardia lamblia
PGHT

SEQ ID NO: 3127251 - protein, 6 aa, Giardia lamblia
PGHTPG

SEQ ID NO: 3127252 - protein, 7 aa, Giardia lamblia
PGHTPGS

SEQ ID NO: 3127253 - protein, 9 aa, Giardia lamblia
PGHTTDPMY

SEQ ID NO: 3127254 - protein, 12 aa, Giardia lamblia
PGIGDTRGYDYD

SEQ ID NO: 3127255 - protein, 4 aa, Giardia lamblia
PGIS

SEQ ID NO: 3127256 - protein, 4 aa, Giardia lamblia
PGIT

SEQ ID NO: 3127257 - protein, 6 aa, Giardia lamblia
PGITPQ

SEQ ID NO: 3127258 - protein, 10 aa, Giardia lamblia
PGKAPTSVPD

SEQ ID NO: 3127259 - protein, 10 aa, Giardia lamblia
PGKDGEAEKD

SEQ ID NO: 3127260 - protein, 6 aa, Giardia lamblia
PGKGKT

SEQ ID NO: 3127261 - protein, 6 aa, Giardia lamblia
PGKGLD

SEQ ID NO: 3127262 - protein, 7 aa, Giardia lamblia
PGKKGTI

SEQ ID NO: 3127263 - protein, 5 aa, Giardia lamblia
PGLAK

SEQ ID NO: 3127264 - protein, 5 aa, Giardia lamblia
PGLGK

SEQ ID NO: 3127265 - protein, 5 aa, Giardia lamblia
PGLGN

SEQ ID NO: 3127266 - protein, 16 aa, Giardia lamblia
PGLGSCASSDSTAFPS

SEQ ID NO: 3127267 - protein, 6 aa, Giardia lamblia
PGLNQE

SEQ ID NO: 3127268 - protein, 12 aa, Giardia lamblia
PGLQSSSKRMAR

SEQ ID NO: 3127269 - protein, 8 aa, Giardia lamblia
PGLTNTST

SEQ ID NO: 3127270 - protein, 11 aa, Giardia lamblia
PGMPGGSMESL

SEQ ID NO: 3127271 - protein, 24 aa, Giardia lamblia
PGMPSGGYGQPQMGYGAPQQPMYG

SEQ ID NO: 3127272 - protein, 11 aa, Giardia lamblia
PGMTEEKKNRY

SEQ ID NO: 3127273 - protein, 7 aa, Giardia lamblia
PGMTPTD

SEQ ID NO: 3127274 - protein, 4 aa, Giardia lamblia
PGNF

SEQ ID NO: 3127275 - protein, 10 aa, Giardia lamblia
PGNGPNGNRQ

SEQ ID NO: 3127276 - protein, 6 aa, Giardia lamblia
PGNGTL

SEQ ID NO: 3127277 - protein, 10 aa, Giardia lamblia
PGNKQTTTSN

SEQ ID NO: 3127278 - protein, 9 aa, Giardia lamblia
PGNNGGDGL

SEQ ID NO: 3127279 - protein, 8 aa, Giardia lamblia
PGNPSGSV

SEQ ID NO: 3127280 - protein, 4 aa, Giardia lamblia
PGNQ

SEQ ID NO: 3127281 - protein, 16 aa, Giardia lamblia
PGNQARKTKLSSSQNL

SEQ ID NO: 3127282 - protein, 5 aa, Giardia lamblia
PGNQV

SEQ ID NO: 3127283 - protein, 5 aa, Giardia lamblia
PGNRF

SEQ ID NO: 3127284 - protein, 13 aa, Giardia lamblia
PGNRGTDQTAQQE

SEQ ID NO: 3127285 - protein, 11 aa, Giardia lamblia
PGNTDAQSSRR

SEQ ID NO: 3127286 - protein, 9 aa, Giardia lamblia
PGNTGFNDE

SEQ ID NO: 3127287 - protein, 5 aa, Giardia lamblia
PGNVD

SEQ ID NO: 3127288 - protein, 7 aa, Giardia lamblia
PGPAGYT

SEQ ID NO: 3127289 - protein, 18 aa, Giardia lamblia
PGPAVQPVPQPKDPERQV

SEQ ID NO: 3127290 - protein, 5 aa, Giardia lamblia
PGPCT

SEQ ID NO: 3127291 - protein, 6 aa, Giardia lamblia
PGPDRL

SEQ ID NO: 3127292 - protein, 20 aa, Giardia lamblia
PGPEPEETEEDITEEEQARQ

SEQ ID NO: 3127293 - protein, 17 aa, Giardia lamblia
PGPGGYCPKSTNDGPRF

SEQ ID NO: 3127294 - protein, 8 aa, Giardia lamblia
PGPGLTSH

SEQ ID NO: 3127295 - protein, 20 aa, Giardia lamblia
PGPIEEGGAGVPGAQPCDAG

SEQ ID NO: 3127296 - protein, 6 aa, Giardia lamblia
PGPPAG

SEQ ID NO: 3127297 - protein, 5 aa, Giardia lamblia
PGPRW

SEQ ID NO: 3127298 - protein, 21 aa, Giardia lamblia
PGPRYSRSRATSGSSSGSSTC

SEQ ID NO: 3127299 - protein, 11 aa, Giardia lamblia
PGPSHYNPNAE

SEQ ID NO: 3127300 - protein, 8 aa, Giardia lamblia
PGPSYVPS

SEQ ID NO: 3127301 - protein, 12 aa, Giardia lamblia
PGPVPQKPEYVR

SEQ ID NO: 3127302 - protein, 29 aa, Giardia lamblia
PGQAAKGGSNEYLTTQGTGREDPLREPQG

SEQ ID NO: 3127303 - protein, 6 aa, Giardia lamblia
PGQATV

SEQ ID NO: 3127304 - protein, 11 aa, Giardia lamblia
PGQDPAAYAPV

SEQ ID NO: 3127305 - protein, 5 aa, Giardia lamblia
PGQEF

SEQ ID NO: 3127306 - protein, 4 aa, Giardia lamblia
PGQF

SEQ ID NO: 3127307 - protein, 6 aa, Giardia lamblia
PGQGID

SEQ ID NO: 3127308 - protein, 5 aa, Giardia lamblia
PGQQF

SEQ ID NO: 3127309 - protein, 5 aa, Giardia lamblia
PGQSK

SEQ ID NO: 3127310 - protein, 9 aa, Giardia lamblia
PGQTTDGNG

SEQ ID NO: 3127311 - protein, 13 aa, Giardia lamblia
PGRDDNRSKGDTY

SEQ ID NO: 3127312 - protein, 9 aa, Giardia lamblia
PGRGSGSVA

SEQ ID NO: 3127313 - protein, 7 aa, Giardia lamblia
PGRHHSR

SEQ ID NO: 3127314 - protein, 4 aa, Giardia lamblia
PGRI

SEQ ID NO: 3127315 - protein, 9 aa, Giardia lamblia
PGRNATSIR

SEQ ID NO: 3127316 - protein, 4 aa, Giardia lamblia
PGRP

SEQ ID NO: 3127317 - protein, 5 aa, Giardia lamblia
PGRPT

SEQ ID NO: 3127318 - protein, 25 aa, Giardia lamblia
PGRRPSTSQTPSLAPGSRRQSIHEP

SEQ ID NO: 3127319 - protein, 8 aa, Giardia lamblia
PGRRPTAR

SEQ ID NO: 3127320 - protein, 6 aa, Giardia lamblia
PGRSIT

SEQ ID NO: 3127321 - protein, 8 aa, Giardia lamblia
PGRSTQKK

SEQ ID NO: 3127322 - protein, 6 aa, Giardia lamblia
PGRTES

SEQ ID NO: 3127323 - protein, 19 aa, Giardia lamblia
PGSATVATAAANAAATAAV

SEQ ID NO: 3127324 - protein, 8 aa, Giardia lamblia
PGSDPSNT

SEQ ID NO: 3127325 - protein, 5 aa, Giardia lamblia
PGSET

SEQ ID NO: 3127326 - protein, 7 aa, Giardia lamblia
PGSGGES

SEQ ID NO: 3127327 - protein, 13 aa, Giardia lamblia
PGSGISKHSQSGL

SEQ ID NO: 3127328 - protein, 6 aa, Giardia lamblia
PGSHPG

SEQ ID NO: 3127329 - protein, 7 aa, Giardia lamblia
PGSIPTA

SEQ ID NO: 3127330 - protein, 12 aa, Giardia lamblia
PGSKEYAPPGYN

SEQ ID NO: 3127331 - protein, 19 aa, Giardia lamblia
PGSLTGSIKEHEPGYADDS

SEQ ID NO: 3127332 - protein, 7 aa, Giardia lamblia
PGSMGTD

SEQ ID NO: 3127333 - protein, 9 aa, Giardia lamblia
PGSMKTPQS

SEQ ID NO: 3127334 - protein, 10 aa, Giardia lamblia
PGSMPPPPAL

SEQ ID NO: 3127335 - protein, 7 aa, Giardia lamblia
PGSNLSN

SEQ ID NO: 3127336 - protein, 6 aa, Giardia lamblia
PGSNTY

SEQ ID NO: 3127337 - protein, 8 aa, Giardia lamblia
PGSPNTSF

SEQ ID NO: 3127338 - protein, 7 aa, Giardia lamblia
PGSQEGP

SEQ ID NO: 3127339 - protein, 12 aa, Giardia lamblia
PGSQPGSNEGTR

SEQ ID NO: 3127340 - protein, 8 aa, Giardia lamblia
PGSQPHEA

SEQ ID NO: 3127341 - protein, 6 aa, Giardia lamblia
PGSSTT

SEQ ID NO: 3127342 - protein, 4 aa, Giardia lamblia
PGST

SEQ ID NO: 3127343 - protein, 19 aa, Giardia lamblia
PGSTAQPQSRPRARGSCAR

SEQ ID NO: 3127344 - protein, 10 aa, Giardia lamblia
PGSVAGESEH

SEQ ID NO: 3127345 - protein, 10 aa, Giardia lamblia
PGSVGSSTSY

SEQ ID NO: 3127346 - protein, 5 aa, Giardia lamblia
PGSWS

SEQ ID NO: 3127347 - protein, 21 aa, Giardia lamblia
PGTASPSCCEENNSQAGSPCA

SEQ ID NO: 3127348 - protein, 36 aa, Giardia lamblia
PGTDSAVEEAADTYKPRSVDSSFSGPTDDDEPTGER

SEQ ID NO: 3127349 - protein, 7 aa, Giardia lamblia
PGTESPH

SEQ ID NO: 3127350 - protein, 5 aa, Giardia lamblia
PGTEV

SEQ ID NO: 3127351 - protein, 7 aa, Giardia lamblia
PGTGKTA

SEQ ID NO: 3127352 - protein, 4 aa, Giardia lamblia
PGTL

SEQ ID NO: 3127353 - protein, 5 aa, Giardia lamblia
PGTQR

SEQ ID NO: 3127354 - protein, 4 aa, Giardia lamblia
PGTT

SEQ ID NO: 3127355 - protein, 9 aa, Giardia lamblia
PGTVPPPMY

SEQ ID NO: 3127356 - protein, 22 aa, Giardia lamblia
PGTYQSTDTDMRSTHVEKSDTA

SEQ ID NO: 3127357 - protein, 5 aa, Giardia lamblia
PGVGK

SEQ ID NO: 3127358 - protein, 10 aa, Giardia lamblia
PGVKKGQGNT

SEQ ID NO: 3127359 - protein, 7 aa, Giardia lamblia
PGVPPRE

SEQ ID NO: 3127360 - protein, 6 aa, Giardia lamblia
PGVSKS

SEQ ID NO: 3127361 - protein, 12 aa, Giardia lamblia
PGYAGRSELPDN

SEQ ID NO: 3127362 - protein, 15 aa, Giardia lamblia
PGYDVADDEPTEASG

SEQ ID NO: 3127363 - protein, 6 aa, Giardia lamblia
PGYGDV

SEQ ID NO: 3127364 - protein, 53 aa, Giardia lamblia
PGYGNEEDESDEEDEYSDESDEDEARDYDADDSALSDSESEEGSDNDADSLDE

SEQ ID NO: 3127365 - protein, 5 aa, Giardia lamblia
PGYPS

SEQ ID NO: 3127366 - protein, 4 aa, Giardia lamblia
PGYR

SEQ ID NO: 3127367 - protein, 10 aa, Giardia lamblia
PGYSAEGASF

SEQ ID NO: 3127368 - protein, 6 aa, Giardia lamblia
PGYTSS

SEQ ID NO: 3127369 - protein, 7 aa, Giardia lamblia
PHADPDA

SEQ ID NO: 3127370 - protein, 6 aa, Giardia lamblia
PHAGDE

SEQ ID NO: 3127371 - protein, 23 aa, Giardia lamblia
PHASHGPMASTKLTSSSTSSTLV

SEQ ID NO: 3127372 - protein, 136 aa, Giardia lamblia
PHATGGVKRPARSASTAADTRGPQGSRASSASQPSRTSSVRASSRISDSRALDTSKRPASVTRRESTAPAPGMRAGSTRPSKSAVRGTSGTPTLSTHTSPGISGRSASQRPRTSSAAEGRRGPNAMGSRTGTSSMG

SEQ ID NO: 3127373 - protein, 6 aa, Giardia lamblia
PHDDGH

SEQ ID NO: 3127374 - protein, 12 aa, Giardia lamblia
PHDGAGSKATAQ

SEQ ID NO: 3127375 - protein, 11 aa, Giardia lamblia
PHEGNKEHRRY

SEQ ID NO: 3127376 - protein, 4 aa, Giardia lamblia
PHEP

SEQ ID NO: 3127377 - protein, 23 aa, Giardia lamblia
PHERGSNLSGDRDRQGTVDHGQN

SEQ ID NO: 3127378 - protein, 10 aa, Giardia lamblia
PHERKAKSRL

SEQ ID NO: 3127379 - protein, 5 aa, Giardia lamblia
PHGAA

SEQ ID NO: 3127380 - protein, 11 aa, Giardia lamblia
PHGARAKKHPL

SEQ ID NO: 3127381 - protein, 7 aa, Giardia lamblia
PHGASTR

SEQ ID NO: 3127382 - protein, 6 aa, Giardia lamblia
PHGGAG

SEQ ID NO: 3127383 - protein, 11 aa, Giardia lamblia
PHGGDRVTSES

SEQ ID NO: 3127384 - protein, 6 aa, Giardia lamblia
PHGLSN

SEQ ID NO: 3127385 - protein, 6 aa, Giardia lamblia
PHGNSG

SEQ ID NO: 3127386 - protein, 11 aa, Giardia lamblia
PHHRQSDDGPL

SEQ ID NO: 3127387 - protein, 7 aa, Giardia lamblia
PHISQNS

SEQ ID NO: 3127388 - protein, 10 aa, Giardia lamblia
PHKEPDRSAT

SEQ ID NO: 3127389 - protein, 14 aa, Giardia lamblia
PHKSEVQLGQKSSA

SEQ ID NO: 3127390 - protein, 31 aa, Giardia lamblia
PHLQGSEPLSRTSSPSSVSSTRYNLTTGSQS

SEQ ID NO: 3127391 - protein, 19 aa, Giardia lamblia
PHLTEPSYRRASVGGGELG

SEQ ID NO: 3127392 - protein, 10 aa, Giardia lamblia
PHNGSKKGAI

SEQ ID NO: 3127393 - protein, 8 aa, Giardia lamblia
PHNRGESH

SEQ ID NO: 3127394 - protein, 7 aa, Giardia lamblia
PHNRSSS

SEQ ID NO: 3127395 - protein, 5 aa, Giardia lamblia
PHNTS

SEQ ID NO: 3127396 - protein, 5 aa, Giardia lamblia
PHPAL

SEQ ID NO: 3127397 - protein, 8 aa, Giardia lamblia
PHPDSNDR

SEQ ID NO: 3127398 - protein, 14 aa, Giardia lamblia
PHPEDSKEQKSKLE

SEQ ID NO: 3127399 - protein, 5 aa, Giardia lamblia
PHPGF

SEQ ID NO: 3127400 - protein, 24 aa, Giardia lamblia
PHPSPRTEVADNSDVDRHPGITGN

SEQ ID NO: 3127401 - protein, 7 aa, Giardia lamblia
PHPSYKQ

SEQ ID NO: 3127402 - protein, 5 aa, Giardia lamblia
PHPVG

SEQ ID NO: 3127403 - protein, 9 aa, Giardia lamblia
PHQNNNYNQ

SEQ ID NO: 3127404 - protein, 6 aa, Giardia lamblia
PHREPT

SEQ ID NO: 3127405 - protein, 56 aa, Giardia lamblia
PHRERGYRSYKQGDNRRGDGRDFRRGDNKDFRRGERGDRGYYNSHNNNDPRQNRIK

SEQ ID NO: 3127406 - protein, 4 aa, Giardia lamblia
PHRG

SEQ ID NO: 3127407 - protein, 14 aa, Giardia lamblia
PHRHTRGNNPRDGL

SEQ ID NO: 3127408 - protein, 15 aa, Giardia lamblia
PHRPLGGGSSMDSSQ

SEQ ID NO: 3127409 - protein, 6 aa, Giardia lamblia
PHSAPH

SEQ ID NO: 3127410 - protein, 10 aa, Giardia lamblia
PHSSGTAEGL

SEQ ID NO: 3127411 - protein, 7 aa, Giardia lamblia
PHSSLTD

SEQ ID NO: 3127412 - protein, 16 aa, Giardia lamblia
PHSTGRPVPTPQTDNL

SEQ ID NO: 3127413 - protein, 10 aa, Giardia lamblia
PHSTSSPEEC

SEQ ID NO: 3127414 - protein, 4 aa, Giardia lamblia
PHTA

SEQ ID NO: 3127415 - protein, 10 aa, Giardia lamblia
PHTPPSWSHS

SEQ ID NO: 3127416 - protein, 8 aa, Giardia lamblia
PHTSNPQE

SEQ ID NO: 3127417 - protein, 4 aa, Giardia lamblia
PHVE

SEQ ID NO: 3127418 - protein, 8 aa, Giardia lamblia
PHVERSKE

SEQ ID NO: 3127419 - protein, 6 aa, Giardia lamblia
PHVPYR

SEQ ID NO: 3127420 - protein, 10 aa, Giardia lamblia
PHYNSSNDPQ

SEQ ID NO: 3127421 - protein, 16 aa, Giardia lamblia
PIAAERAATSQSARSV

SEQ ID NO: 3127422 - protein, 20 aa, Giardia lamblia
PIAAPTSSSCAPNDLYNQTS

SEQ ID NO: 3127423 - protein, 5 aa, Giardia lamblia
PIADK

SEQ ID NO: 3127424 - protein, 9 aa, Giardia lamblia
PIAGPTPTK

SEQ ID NO: 3127425 - protein, 9 aa, Giardia lamblia
PIAHSQQTS

SEQ ID NO: 3127426 - protein, 8 aa, Giardia lamblia
PIAPGAGK

SEQ ID NO: 3127427 - protein, 15 aa, Giardia lamblia
PIAPGPASKGTPLTY

SEQ ID NO: 3127428 - protein, 10 aa, Giardia lamblia
PIDDAHDSTL

SEQ ID NO: 3127429 - protein, 6 aa, Giardia lamblia
PIDENG

SEQ ID NO: 3127430 - protein, 4 aa, Giardia lamblia
PIDN

SEQ ID NO: 3127431 - protein, 14 aa, Giardia lamblia
PIDPKSVKASFTNQ

SEQ ID NO: 3127432 - protein, 23 aa, Giardia lamblia
PIDRDEHERENTKVGYSDLGGLG

SEQ ID NO: 3127433 - protein, 6 aa, Giardia lamblia
PIDSKR

SEQ ID NO: 3127434 - protein, 16 aa, Giardia lamblia
PIEPSKSRRSSGTVPQ

SEQ ID NO: 3127435 - protein, 19 aa, Giardia lamblia
PIEPSRQLTRTASPYEHTG

SEQ ID NO: 3127436 - protein, 13 aa, Giardia lamblia
PIESPGKSSSMPI

SEQ ID NO: 3127437 - protein, 5 aa, Giardia lamblia
PIEST

SEQ ID NO: 3127438 - protein, 5 aa, Giardia lamblia
PIGAG

SEQ ID NO: 3127439 - protein, 7 aa, Giardia lamblia
PIGAGKS

SEQ ID NO: 3127440 - protein, 8 aa, Giardia lamblia
PIGDPAGH

SEQ ID NO: 3127441 - protein, 12 aa, Giardia lamblia
PIGEQSNSSVQN

SEQ ID NO: 3127442 - protein, 16 aa, Giardia lamblia
PIGPSQSVSMASPGMG

SEQ ID NO: 3127443 - protein, 23 aa, Giardia lamblia
PIGSEASSPQHSGTHTHTSPNCA

SEQ ID NO: 3127444 - protein, 17 aa, Giardia lamblia
PIGSEGDPGTIASDQGI

SEQ ID NO: 3127445 - protein, 5 aa, Giardia lamblia
PIHGG

SEQ ID NO: 3127446 - protein, 4 aa, Giardia lamblia
PIHT

SEQ ID NO: 3127447 - protein, 11 aa, Giardia lamblia
PIIPEEDDIPK

SEQ ID NO: 3127448 - protein, 10 aa, Giardia lamblia
PIKEEGKPYR

SEQ ID NO: 3127449 - protein, 6 aa, Giardia lamblia
PIKENT

SEQ ID NO: 3127450 - protein, 13 aa, Giardia lamblia
PIKEPSKSNMESM

SEQ ID NO: 3127451 - protein, 23 aa, Giardia lamblia
PIKERPASSNPAVRAGGELEPTE

SEQ ID NO: 3127452 - protein, 16 aa, Giardia lamblia
PIKKDGEQKTSVRKPT

SEQ ID NO: 3127453 - protein, 7 aa, Giardia lamblia
PIKPDDQ

SEQ ID NO: 3127454 - protein, 8 aa, Giardia lamblia
PIKPPPPH

SEQ ID NO: 3127455 - protein, 12 aa, Giardia lamblia
PINAASRKPGCT

SEQ ID NO: 3127456 - protein, 4 aa, Giardia lamblia
PINP

SEQ ID NO: 3127457 - protein, 13 aa, Giardia lamblia
PINPKELSQNQRD

SEQ ID NO: 3127458 - protein, 6 aa, Giardia lamblia
PINPQD

SEQ ID NO: 3127459 - protein, 35 aa, Giardia lamblia
PINPTYASASTFASPMSPAGRRQAFPASEGVSPSL

SEQ ID NO: 3127460 - protein, 7 aa, Giardia lamblia
PIPASPQ

SEQ ID NO: 3127461 - protein, 10 aa, Giardia lamblia
PIPDNETNVY

SEQ ID NO: 3127462 - protein, 7 aa, Giardia lamblia
PIPEPIT

SEQ ID NO: 3127463 - protein, 8 aa, Giardia lamblia
PIPESNQE

SEQ ID NO: 3127464 - protein, 6 aa, Giardia lamblia
PIPGYT

SEQ ID NO: 3127465 - protein, 17 aa, Giardia lamblia
PIPQENGLDSINDSIDS

SEQ ID NO: 3127466 - protein, 5 aa, Giardia lamblia
PIPQG

SEQ ID NO: 3127467 - protein, 13 aa, Giardia lamblia
PIPRRDSAAGLMP

SEQ ID NO: 3127468 - protein, 5 aa, Giardia lamblia
PIPSL

SEQ ID NO: 3127469 - protein, 6 aa, Giardia lamblia
PIPTAP

SEQ ID NO: 3127470 - protein, 6 aa, Giardia lamblia
PIPTGH

SEQ ID NO: 3127471 - protein, 73 aa, Giardia lamblia
PIPTGPVESATSPKADRQDRSSRSREASQPQVRSSPPSQTVASPHARQVGGSEQPKSGGPSAHLPSGTSPGAI

SEQ ID NO: 3127472 - protein, 6 aa, Giardia lamblia
PIPTRE

SEQ ID NO: 3127473 - protein, 5 aa, Giardia lamblia
PIPVP

SEQ ID NO: 3127474 - protein, 4 aa, Giardia lamblia
PIPY

SEQ ID NO: 3127475 - protein, 7 aa, Giardia lamblia
PIQPAAS

SEQ ID NO: 3127476 - protein, 5 aa, Giardia lamblia
PIQQP

SEQ ID NO: 3127477 - protein, 9 aa, Giardia lamblia
PIQTNPELG

SEQ ID NO: 3127478 - protein, 16 aa, Giardia lamblia
PIRPESAVHNETSTTE

SEQ ID NO: 3127479 - protein, 19 aa, Giardia lamblia
PIRRQEAAGVTDPSTIRPP

SEQ ID NO: 3127480 - protein, 20 aa, Giardia lamblia
PISDSDHDDSGHLHTPRNND

SEQ ID NO: 3127481 - protein, 7 aa, Giardia lamblia
PISDSGV

SEQ ID NO: 3127482 - protein, 4 aa, Giardia lamblia
PISK

SEQ ID NO: 3127483 - protein, 9 aa, Giardia lamblia
PISKNPKLR

SEQ ID NO: 3127484 - protein, 7 aa, Giardia lamblia
PISPPTI

SEQ ID NO: 3127485 - protein, 22 aa, Giardia lamblia
PISPSRSSPSRSSPLRQSSKSS

SEQ ID NO: 3127486 - protein, 4 aa, Giardia lamblia
PISQ

SEQ ID NO: 3127487 - protein, 5 aa, Giardia lamblia
PISQE

SEQ ID NO: 3127488 - protein, 6 aa, Giardia lamblia
PISRPT

SEQ ID NO: 3127489 - protein, 12 aa, Giardia lamblia
PISRSSFGKTEF

SEQ ID NO: 3127490 - protein, 5 aa, Giardia lamblia
PISST

SEQ ID NO: 3127491 - protein, 4 aa, Giardia lamblia
PITE

SEQ ID NO: 3127492 - protein, 14 aa, Giardia lamblia
PITPSTHSNYGAPI

SEQ ID NO: 3127493 - protein, 29 aa, Giardia lamblia
PKADSTNTTTSNAPSSLANRKASIRPPSA

SEQ ID NO: 3127494 - protein, 6 aa, Giardia lamblia
PKAEQV

SEQ ID NO: 3127495 - protein, 7 aa, Giardia lamblia
PKAGAFA

SEQ ID NO: 3127496 - protein, 6 aa, Giardia lamblia
PKAISD

SEQ ID NO: 3127497 - protein, 9 aa, Giardia lamblia
PKAPADESL

SEQ ID NO: 3127498 - protein, 13 aa, Giardia lamblia
PKAPVSPSTTQSF

SEQ ID NO: 3127499 - protein, 14 aa, Giardia lamblia
PKAQRKRSKLTTFN

SEQ ID NO: 3127500 - protein, 5 aa, Giardia lamblia
PKARE

SEQ ID NO: 3127501 - protein, 28 aa, Giardia lamblia
PKATSTLNNTAVQPPAMSRGAPSIDTDV

SEQ ID NO: 3127502 - protein, 11 aa, Giardia lamblia
PKAVEGAPAAY

SEQ ID NO: 3127503 - protein, 8 aa, Giardia lamblia
PKDAEGRA

SEQ ID NO: 3127504 - protein, 12 aa, Giardia lamblia
PKDDSKRKGTDI

SEQ ID NO: 3127505 - protein, 8 aa, Giardia lamblia
PKDEAPTD

SEQ ID NO: 3127506 - protein, 7 aa, Giardia lamblia
PKDGPVL

SEQ ID NO: 3127507 - protein, 8 aa, Giardia lamblia
PKDGTEQS

SEQ ID NO: 3127508 - protein, 4 aa, Giardia lamblia
PKDI

SEQ ID NO: 3127509 - protein, 4 aa, Giardia lamblia
PKDK

SEQ ID NO: 3127510 - protein, 6 aa, Giardia lamblia
PKDKPR

SEQ ID NO: 3127511 - protein, 14 aa, Giardia lamblia
PKDLNARSTSGDEY

SEQ ID NO: 3127512 - protein, 4 aa, Giardia lamblia
PKDR

SEQ ID NO: 3127513 - protein, 5 aa, Giardia lamblia
PKDRI

SEQ ID NO: 3127514 - protein, 30 aa, Giardia lamblia
PKDRREDSPSARLHQDTEAELKARSENAHL

SEQ ID NO: 3127515 - protein, 9 aa, Giardia lamblia
PKDRRGSLR

SEQ ID NO: 3127516 - protein, 16 aa, Giardia lamblia
PKDRSPPQQADPITSL

SEQ ID NO: 3127517 - protein, 8 aa, Giardia lamblia
PKDSPYES

SEQ ID NO: 3127518 - protein, 7 aa, Giardia lamblia
PKDTAQL

SEQ ID NO: 3127519 - protein, 6 aa, Giardia lamblia
PKDTKD

SEQ ID NO: 3127520 - protein, 5 aa, Giardia lamblia
PKDVE

SEQ ID NO: 3127521 - protein, 6 aa, Giardia lamblia
PKEAGM

SEQ ID NO: 3127522 - protein, 7 aa, Giardia lamblia
PKEAKAQ

SEQ ID NO: 3127523 - protein, 15 aa, Giardia lamblia
PKECPESSSEKPAVS

SEQ ID NO: 3127524 - protein, 6 aa, Giardia lamblia
PKEDSR

SEQ ID NO: 3127525 - protein, 6 aa, Giardia lamblia
PKEEDI

SEQ ID NO: 3127526 - protein, 13 aa, Giardia lamblia
PKEFASSGDMPAE

SEQ ID NO: 3127527 - protein, 7 aa, Giardia lamblia
PKEGGIQ

SEQ ID NO: 3127528 - protein, 13 aa, Giardia lamblia
PKEHGAKSTSGKT

SEQ ID NO: 3127529 - protein, 4 aa, Giardia lamblia
PKEI

SEQ ID NO: 3127530 - protein, 21 aa, Giardia lamblia
PKEKTITTTEKSKYGAGCTPA

SEQ ID NO: 3127531 - protein, 11 aa, Giardia lamblia
PKENEKDLKTT

SEQ ID NO: 3127532 - protein, 9 aa, Giardia lamblia
PKEPRRPKR

SEQ ID NO: 3127533 - protein, 7 aa, Giardia lamblia
PKERAQY

SEQ ID NO: 3127534 - protein, 5 aa, Giardia lamblia
PKERT

SEQ ID NO: 3127535 - protein, 34 aa, Giardia lamblia
PKESAEEKLLTSGSSNSGSSQGPRDSVERPSSLP

SEQ ID NO: 3127536 - protein, 14 aa, Giardia lamblia
PKESAISTARDRGI

SEQ ID NO: 3127537 - protein, 6 aa, Giardia lamblia
PKESEM

SEQ ID NO: 3127538 - protein, 12 aa, Giardia lamblia
PKESGMLNSEGH

SEQ ID NO: 3127539 - protein, 9 aa, Giardia lamblia
PKESTLKDA

SEQ ID NO: 3127540 - protein, 16 aa, Giardia lamblia
PKETQQGHSNSLQASD

SEQ ID NO: 3127541 - protein, 12 aa, Giardia lamblia
PKFKARSRTPRN

SEQ ID NO: 3127542 - protein, 15 aa, Giardia lamblia
PKFTTYSDPEPSVGS

SEQ ID NO: 3127543 - protein, 11 aa, Giardia lamblia
PKGATVEPSSL

SEQ ID NO: 3127544 - protein, 32 aa, Giardia lamblia
PKGELKGSSITGPVAKEAADRWPKISTTAECV

SEQ ID NO: 3127545 - protein, 7 aa, Giardia lamblia
PKGEYDE

SEQ ID NO: 3127546 - protein, 6 aa, Giardia lamblia
PKGKRH

SEQ ID NO: 3127547 - protein, 8 aa, Giardia lamblia
PKGVDGTK

SEQ ID NO: 3127548 - protein, 9 aa, Giardia lamblia
PKGVGKTTL

SEQ ID NO: 3127549 - protein, 9 aa, Giardia lamblia
PKHTVPDAT

SEQ ID NO: 3127550 - protein, 7 aa, Giardia lamblia
PKIPAQD

SEQ ID NO: 3127551 - protein, 5 aa, Giardia lamblia
PKIPG

SEQ ID NO: 3127552 - protein, 5 aa, Giardia lamblia
PKIPN

SEQ ID NO: 3127553 - protein, 12 aa, Giardia lamblia
PKIQPDSKVYGD

SEQ ID NO: 3127554 - protein, 7 aa, Giardia lamblia
PKISETS

SEQ ID NO: 3127555 - protein, 13 aa, Giardia lamblia
PKITQRMTKSNKP

SEQ ID NO: 3127556 - protein, 6 aa, Giardia lamblia
PKKGRH

SEQ ID NO: 3127557 - protein, 8 aa, Giardia lamblia
PKKHRGKK

SEQ ID NO: 3127558 - protein, 7 aa, Giardia lamblia
PKKLDGR

SEQ ID NO: 3127559 - protein, 8 aa, Giardia lamblia
PKKPVVKH

SEQ ID NO: 3127560 - protein, 8 aa, Giardia lamblia
PKKQRTSS

SEQ ID NO: 3127561 - protein, 7 aa, Giardia lamblia
PKKRPTA

SEQ ID NO: 3127562 - protein, 8 aa, Giardia lamblia
PKKSTDSE

SEQ ID NO: 3127563 - protein, 6 aa, Giardia lamblia
PKKTRR

SEQ ID NO: 3127564 - protein, 14 aa, Giardia lamblia
PKLATEGKTPPSQV

SEQ ID NO: 3127565 - protein, 10 aa, Giardia lamblia
PKLEERSKGA

SEQ ID NO: 3127566 - protein, 5 aa, Giardia lamblia
PKLQQ

SEQ ID NO: 3127567 - protein, 6 aa, Giardia lamblia
PKLQTR

SEQ ID NO: 3127568 - protein, 11 aa, Giardia lamblia
PKLSDPDYNPY

SEQ ID NO: 3127569 - protein, 17 aa, Giardia lamblia
PKMDPNPRTVTRTPGKL

SEQ ID NO: 3127570 - protein, 63 aa, Giardia lamblia
PKMQSAKSTKKRSQPQKPQTPQKSPHQSGAVTVSPRKRLSNSNYEPCPPKGESYSPTDSPPLI

SEQ ID NO: 3127571 - protein, 4 aa, Giardia lamblia
PKNA

SEQ ID NO: 3127572 - protein, 9 aa, Giardia lamblia
PKNEAEKKY

SEQ ID NO: 3127573 - protein, 6 aa, Giardia lamblia
PKNEAY

SEQ ID NO: 3127574 - protein, 6 aa, Giardia lamblia
PKNNDS

SEQ ID NO: 3127575 - protein, 5 aa, Giardia lamblia
PKNNM

SEQ ID NO: 3127576 - protein, 32 aa, Giardia lamblia
PKNPLNEAKPKQLKTASTTFTKQSVKANDETL

SEQ ID NO: 3127577 - protein, 10 aa, Giardia lamblia
PKNSEMGTEE

SEQ ID NO: 3127578 - protein, 10 aa, Giardia lamblia
PKNTYSSSAV

SEQ ID NO: 3127579 - protein, 7 aa, Giardia lamblia
PKNVADT

SEQ ID NO: 3127580 - protein, 5 aa, Giardia lamblia
PKPGA

SEQ ID NO: 3127581 - protein, 4 aa, Giardia lamblia
PKPI

SEQ ID NO: 3127582 - protein, 30 aa, Giardia lamblia
PKPIGSREGTQTGVTEASNIDEKSNSPLDL

SEQ ID NO: 3127583 - protein, 7 aa, Giardia lamblia
PKPNNEI

SEQ ID NO: 3127584 - protein, 7 aa, Giardia lamblia
PKPPINT

SEQ ID NO: 3127585 - protein, 7 aa, Giardia lamblia
PKPPSFS

SEQ ID NO: 3127586 - protein, 8 aa, Giardia lamblia
PKPPTLPR

SEQ ID NO: 3127587 - protein, 15 aa, Giardia lamblia
PKPRHTAAHNPGAHR

SEQ ID NO: 3127588 - protein, 9 aa, Giardia lamblia
PKPVQEPKQ

SEQ ID NO: 3127589 - protein, 8 aa, Giardia lamblia
PKPVSRKQ

SEQ ID NO: 3127590 - protein, 9 aa, Giardia lamblia
PKQAPTATA

SEQ ID NO: 3127591 - protein, 34 aa, Giardia lamblia
PKQASCSKAKADSKKSSSSGVSGTPSSLTTEPRL

SEQ ID NO: 3127592 - protein, 26 aa, Giardia lamblia
PKQDALEDAKNKLAEKERALQAAQDE

SEQ ID NO: 3127593 - protein, 6 aa, Giardia lamblia
PKQNRY

SEQ ID NO: 3127594 - protein, 11 aa, Giardia lamblia
PKQPATGADLT

SEQ ID NO: 3127595 - protein, 5 aa, Giardia lamblia
PKQRI

SEQ ID NO: 3127596 - protein, 13 aa, Giardia lamblia
PKRAAVREAESNF

SEQ ID NO: 3127597 - protein, 6 aa, Giardia lamblia
PKRASK

SEQ ID NO: 3127598 - protein, 26 aa, Giardia lamblia
PKRLRSPQHKRGKTDKSNRSPTSTLE

SEQ ID NO: 3127599 - protein, 8 aa, Giardia lamblia
PKRPPSDC

SEQ ID NO: 3127600 - protein, 9 aa, Giardia lamblia
PKRRPQSAA

SEQ ID NO: 3127601 - protein, 10 aa, Giardia lamblia
PKRSASQAAE

SEQ ID NO: 3127602 - protein, 19 aa, Giardia lamblia
PKRTKKIRSSSKRRKDKEK

SEQ ID NO: 3127603 - protein, 6 aa, Giardia lamblia
PKRTTI

SEQ ID NO: 3127604 - protein, 9 aa, Giardia lamblia
PKSAGSLNC

SEQ ID NO: 3127605 - protein, 8 aa, Giardia lamblia
PKSAPTLE

SEQ ID NO: 3127606 - protein, 4 aa, Giardia lamblia
PKSD

SEQ ID NO: 3127607 - protein, 5 aa, Giardia lamblia
PKSEV

SEQ ID NO: 3127608 - protein, 5 aa, Giardia lamblia
PKSGF

SEQ ID NO: 3127609 - protein, 7 aa, Giardia lamblia
PKSGGRW

SEQ ID NO: 3127610 - protein, 9 aa, Giardia lamblia
PKSLSSQEP

SEQ ID NO: 3127611 - protein, 17 aa, Giardia lamblia
PKSNHFSPGFTDEERNA

SEQ ID NO: 3127612 - protein, 9 aa, Giardia lamblia
PKSNPFERA

SEQ ID NO: 3127613 - protein, 9 aa, Giardia lamblia
PKSQTPARI

SEQ ID NO: 3127614 - protein, 22 aa, Giardia lamblia
PKSRSFSEEPGPPEKPRYPKAR

SEQ ID NO: 3127615 - protein, 14 aa, Giardia lamblia
PKSSDRERQKQNLE

SEQ ID NO: 3127616 - protein, 8 aa, Giardia lamblia
PKSSEKIY

SEQ ID NO: 3127617 - protein, 8 aa, Giardia lamblia
PKSSQNEL

SEQ ID NO: 3127618 - protein, 9 aa, Giardia lamblia
PKSTSIPAS

SEQ ID NO: 3127619 - protein, 11 aa, Giardia lamblia
PKSYTPQPYTP

SEQ ID NO: 3127620 - protein, 9 aa, Giardia lamblia
PKTADIASY

SEQ ID NO: 3127621 - protein, 8 aa, Giardia lamblia
PKTAKPRI

SEQ ID NO: 3127622 - protein, 6 aa, Giardia lamblia
PKTEAS

SEQ ID NO: 3127623 - protein, 12 aa, Giardia lamblia
PKTGPSAEETLK

SEQ ID NO: 3127624 - protein, 6 aa, Giardia lamblia
PKTGSI

SEQ ID NO: 3127625 - protein, 10 aa, Giardia lamblia
PKTKSISNIS

SEQ ID NO: 3127626 - protein, 5 aa, Giardia lamblia
PKTKT

SEQ ID NO: 3127627 - protein, 7 aa, Giardia lamblia
PKTLTSE

SEQ ID NO: 3127628 - protein, 5 aa, Giardia lamblia
PKTMS

SEQ ID NO: 3127629 - protein, 18 aa, Giardia lamblia
PKTNSAPDIDADAPEAEL

SEQ ID NO: 3127630 - protein, 8 aa, Giardia lamblia
PKTQDRVA

SEQ ID NO: 3127631 - protein, 15 aa, Giardia lamblia
PKTQLSDASRQQETA

SEQ ID NO: 3127632 - protein, 14 aa, Giardia lamblia
PKTRLGSKMGASEL

SEQ ID NO: 3127633 - protein, 12 aa, Giardia lamblia
PKTRQRASAPDD

SEQ ID NO: 3127634 - protein, 8 aa, Giardia lamblia
PKTRTTEE

SEQ ID NO: 3127635 - protein, 7 aa, Giardia lamblia
PKTSEQT

SEQ ID NO: 3127636 - protein, 7 aa, Giardia lamblia
PKTSTIQ

SEQ ID NO: 3127637 - protein, 10 aa, Giardia lamblia
PKTVRSTGSV

SEQ ID NO: 3127638 - protein, 15 aa, Giardia lamblia
PKTYDSVEGGEPKYD

SEQ ID NO: 3127639 - protein, 7 aa, Giardia lamblia
PKVDEGM

SEQ ID NO: 3127640 - protein, 7 aa, Giardia lamblia
PKVMEGE

SEQ ID NO: 3127641 - protein, 13 aa, Giardia lamblia
PKVNPSSGTKSVR

SEQ ID NO: 3127642 - protein, 4 aa, Giardia lamblia
PKVP

SEQ ID NO: 3127643 - protein, 9 aa, Giardia lamblia
PKVPDASGY

SEQ ID NO: 3127644 - protein, 8 aa, Giardia lamblia
PKVRDTPI

SEQ ID NO: 3127645 - protein, 9 aa, Giardia lamblia
PKVVDPEKH

SEQ ID NO: 3127646 - protein, 7 aa, Giardia lamblia
PLAAPSA

SEQ ID NO: 3127647 - protein, 12 aa, Giardia lamblia
PLAAPTAKRGMA

SEQ ID NO: 3127648 - protein, 25 aa, Giardia lamblia
PLADHNQVKSKAFSQRPSARSLPGN

SEQ ID NO: 3127649 - protein, 8 aa, Giardia lamblia
PLADSSGC

SEQ ID NO: 3127650 - protein, 4 aa, Giardia lamblia
PLAN

SEQ ID NO: 3127651 - protein, 63 aa, Giardia lamblia
PLANQSMSQPTCSQAGSKLSSDGHNLSGNPSGVPKDSQLTNATMSSGVRTGTFSKDKISPSAK

SEQ ID NO: 3127652 - protein, 10 aa, Giardia lamblia
PLANSTSANA

SEQ ID NO: 3127653 - protein, 5 aa, Giardia lamblia
PLAPG

SEQ ID NO: 3127654 - protein, 5 aa, Giardia lamblia
PLAPK

SEQ ID NO: 3127655 - protein, 4 aa, Giardia lamblia
PLAR

SEQ ID NO: 3127656 - protein, 17 aa, Giardia lamblia
PLATKPKPASEKDSAIY

SEQ ID NO: 3127657 - protein, 16 aa, Giardia lamblia
PLATRESGMRDSNGRT

SEQ ID NO: 3127658 - protein, 4 aa, Giardia lamblia
PLDA

SEQ ID NO: 3127659 - protein, 9 aa, Giardia lamblia
PLDNTPITV

SEQ ID NO: 3127660 - protein, 18 aa, Giardia lamblia
PLDPEREYRDDNEKFTAN

SEQ ID NO: 3127661 - protein, 6 aa, Giardia lamblia
PLDSAS

SEQ ID NO: 3127662 - protein, 4 aa, Giardia lamblia
PLDT

SEQ ID NO: 3127663 - protein, 11 aa, Giardia lamblia
PLEDSNQETRV

SEQ ID NO: 3127664 - protein, 11 aa, Giardia lamblia
PLEGTASTLRP

SEQ ID NO: 3127665 - protein, 19 aa, Giardia lamblia
PLENGADMPTLESLGIATD

SEQ ID NO: 3127666 - protein, 10 aa, Giardia lamblia
PLEPPPGSCR

SEQ ID NO: 3127667 - protein, 5 aa, Giardia lamblia
PLEPT

SEQ ID NO: 3127668 - protein, 15 aa, Giardia lamblia
PLERTLSISDTLLTD

SEQ ID NO: 3127669 - protein, 5 aa, Giardia lamblia
PLGAN

SEQ ID NO: 3127670 - protein, 5 aa, Giardia lamblia
PLGAQ

SEQ ID NO: 3127671 - protein, 11 aa, Giardia lamblia
PLGASPPPNES

SEQ ID NO: 3127672 - protein, 5 aa, Giardia lamblia
PLGDD

SEQ ID NO: 3127673 - protein, 15 aa, Giardia lamblia
PLGEPPEWSRGSRNA

SEQ ID NO: 3127674 - protein, 10 aa, Giardia lamblia
PLGNGASGNY

SEQ ID NO: 3127675 - protein, 17 aa, Giardia lamblia
PLGNPRGHQGEISDHPD

SEQ ID NO: 3127676 - protein, 10 aa, Giardia lamblia
PLGNSDKAVT

SEQ ID NO: 3127677 - protein, 20 aa, Giardia lamblia
PLGPPEGSSVASPRSGQNIR

SEQ ID NO: 3127678 - protein, 7 aa, Giardia lamblia
PLGRGPV

SEQ ID NO: 3127679 - protein, 16 aa, Giardia lamblia
PLGTGELASSSWDGTT

SEQ ID NO: 3127680 - protein, 19 aa, Giardia lamblia
PLGYEDTGDLPTTPTSPFS

SEQ ID NO: 3127681 - protein, 10 aa, Giardia lamblia
PLHGEEDGFT

SEQ ID NO: 3127682 - protein, 12 aa, Giardia lamblia
PLHRSGSTPMKA

SEQ ID NO: 3127683 - protein, 6 aa, Giardia lamblia
PLKGKG

SEQ ID NO: 3127684 - protein, 5 aa, Giardia lamblia
PLKPL

SEQ ID NO: 3127685 - protein, 6 aa, Giardia lamblia
PLKPSS

SEQ ID NO: 3127686 - protein, 27 aa, Giardia lamblia
PLKSSKPSKSSNSQETGSKADKTVRAQ

SEQ ID NO: 3127687 - protein, 5 aa, Giardia lamblia
PLLSQ

SEQ ID NO: 3127688 - protein, 7 aa, Giardia lamblia
PLMPQTE

SEQ ID NO: 3127689 - protein, 4 aa, Giardia lamblia
PLNK

SEQ ID NO: 3127690 - protein, 5 aa, Giardia lamblia
PLNPT

SEQ ID NO: 3127691 - protein, 17 aa, Giardia lamblia
PLNSLGPSTGPSDNSHV

SEQ ID NO: 3127692 - protein, 27 aa, Giardia lamblia
PLNSSTSNTNISNSNGRGKSAQATGPI

SEQ ID NO: 3127693 - protein, 4 aa, Giardia lamblia
PLNT

SEQ ID NO: 3127694 - protein, 11 aa, Giardia lamblia
PLNTSDPEGLP

SEQ ID NO: 3127695 - protein, 4 aa, Giardia lamblia
PLPA

SEQ ID NO: 3127696 - protein, 38 aa, Giardia lamblia
PLPAPPQLTGSETSVAPALSESKEESSDDSSSMLENKD

SEQ ID NO: 3127697 - protein, 40 aa, Giardia lamblia
PLPEKGPELPDPPATPSENKPSDNKPGKEGHKSKETSGGW

SEQ ID NO: 3127698 - protein, 6 aa, Giardia lamblia
PLPEKR

SEQ ID NO: 3127699 - protein, 4 aa, Giardia lamblia
PLPG

SEQ ID NO: 3127700 - protein, 10 aa, Giardia lamblia
PLPGETNHAN

SEQ ID NO: 3127701 - protein, 7 aa, Giardia lamblia
PLPGGAA

SEQ ID NO: 3127702 - protein, 13 aa, Giardia lamblia
PLPGGGRNDIPTR

SEQ ID NO: 3127703 - protein, 6 aa, Giardia lamblia
PLPGKK

SEQ ID NO: 3127704 - protein, 6 aa, Giardia lamblia
PLPGPY

SEQ ID NO: 3127705 - protein, 13 aa, Giardia lamblia
PLPGSNPAKGSLG

SEQ ID NO: 3127706 - protein, 8 aa, Giardia lamblia
PLPIPDDG

SEQ ID NO: 3127707 - protein, 11 aa, Giardia lamblia
PLPKKTGTTVL

SEQ ID NO: 3127708 - protein, 30 aa, Giardia lamblia
PLPKSEDTSRATSSSQPLQSREGSHRTHKR

SEQ ID NO: 3127709 - protein, 4 aa, Giardia lamblia
PLPL

SEQ ID NO: 3127710 - protein, 4 aa, Giardia lamblia
PLPM

SEQ ID NO: 3127711 - protein, 14 aa, Giardia lamblia
PLPMNNTQRSTTRI

SEQ ID NO: 3127712 - protein, 8 aa, Giardia lamblia
PLPPELEE

SEQ ID NO: 3127713 - protein, 12 aa, Giardia lamblia
PLPPEPDHVDPS

SEQ ID NO: 3127714 - protein, 11 aa, Giardia lamblia
PLPPHGPPQLQ

SEQ ID NO: 3127715 - protein, 12 aa, Giardia lamblia
PLPPKPDYGPVE

SEQ ID NO: 3127716 - protein, 6 aa, Giardia lamblia
PLPPPL

SEQ ID NO: 3127717 - protein, 17 aa, Giardia lamblia
PLPPPMEVPSDETPIKK

SEQ ID NO: 3127718 - protein, 7 aa, Giardia lamblia
PLPRGGA

SEQ ID NO: 3127719 - protein, 10 aa, Giardia lamblia
PLPSNPPNMP

SEQ ID NO: 3127720 - protein, 8 aa, Giardia lamblia
PLPSSVSE

SEQ ID NO: 3127721 - protein, 73 aa, Giardia lamblia
PLPTDKNKQPIASQASQEKSDSDYIDSRGGNDDQSDSYSYSYSSTGNSGNGDGNSSSSEDESSSDSDAGEERV

SEQ ID NO: 3127722 - protein, 6 aa, Giardia lamblia
PLPTDP

SEQ ID NO: 3127723 - protein, 10 aa, Giardia lamblia
PLPVPDAQSG

SEQ ID NO: 3127724 - protein, 12 aa, Giardia lamblia
PLQEASKAQTRE

SEQ ID NO: 3127725 - protein, 12 aa, Giardia lamblia
PLQEGQKASGGF

SEQ ID NO: 3127726 - protein, 12 aa, Giardia lamblia
PLQGKQTATGDV

SEQ ID NO: 3127727 - protein, 9 aa, Giardia lamblia
PLQHTAEEQ

SEQ ID NO: 3127728 - protein, 13 aa, Giardia lamblia
PLQKQDPKRTALE

SEQ ID NO: 3127729 - protein, 6 aa, Giardia lamblia
PLQSHS

SEQ ID NO: 3127730 - protein, 5 aa, Giardia lamblia
PLQSS

SEQ ID NO: 3127731 - protein, 12 aa, Giardia lamblia
PLQTGQKTTGNV

SEQ ID NO: 3127732 - protein, 9 aa, Giardia lamblia
PLQTTTTTS

SEQ ID NO: 3127733 - protein, 4 aa, Giardia lamblia
PLRA

SEQ ID NO: 3127734 - protein, 29 aa, Giardia lamblia
PLRAGSTKLASSEKGNSQPDGASRTTTIN

SEQ ID NO: 3127735 - protein, 8 aa, Giardia lamblia
PLRDRPKV

SEQ ID NO: 3127736 - protein, 5 aa, Giardia lamblia
PLRGT

SEQ ID NO: 3127737 - protein, 10 aa, Giardia lamblia
PLRKDADGHS

SEQ ID NO: 3127738 - protein, 66 aa, Giardia lamblia
PLRPGDASRPKKAAKRGSSKSKVSHNSMRSASDSTIETPQWSDSVSSNISSTKKKATRLRSDDANL

SEQ ID NO: 3127739 - protein, 5 aa, Giardia lamblia
PLRRP

SEQ ID NO: 3127740 - protein, 4 aa, Giardia lamblia
PLSA

SEQ ID NO: 3127741 - protein, 5 aa, Giardia lamblia
PLSAE

SEQ ID NO: 3127742 - protein, 7 aa, Giardia lamblia
PLSASPD

SEQ ID NO: 3127743 - protein, 19 aa, Giardia lamblia
PLSDSPAKGYIDTDDPTTI

SEQ ID NO: 3127744 - protein, 6 aa, Giardia lamblia
PLSEES

SEQ ID NO: 3127745 - protein, 11 aa, Giardia lamblia
PLSELQTKKGF

SEQ ID NO: 3127746 - protein, 5 aa, Giardia lamblia
PLSET

SEQ ID NO: 3127747 - protein, 4 aa, Giardia lamblia
PLSG

SEQ ID NO: 3127748 - protein, 9 aa, Giardia lamblia
PLSGKSQSI

SEQ ID NO: 3127749 - protein, 8 aa, Giardia lamblia
PLSGYERD

SEQ ID NO: 3127750 - protein, 9 aa, Giardia lamblia
PLSLSPTAD

SEQ ID NO: 3127751 - protein, 4 aa, Giardia lamblia
PLSP

SEQ ID NO: 3127752 - protein, 6 aa, Giardia lamblia
PLSPEK

SEQ ID NO: 3127753 - protein, 6 aa, Giardia lamblia
PLSPEN

SEQ ID NO: 3127754 - protein, 10 aa, Giardia lamblia
PLSPKQIEEL

SEQ ID NO: 3127755 - protein, 8 aa, Giardia lamblia
PLSPPSEQ

SEQ ID NO: 3127756 - protein, 12 aa, Giardia lamblia
PLSPQRSPSPLP

SEQ ID NO: 3127757 - protein, 8 aa, Giardia lamblia
PLSQADSD

SEQ ID NO: 3127758 - protein, 5 aa, Giardia lamblia
PLSQN

SEQ ID NO: 3127759 - protein, 8 aa, Giardia lamblia
PLSRPGKA

SEQ ID NO: 3127760 - protein, 18 aa, Giardia lamblia
PLSSEATPKKSDATAEKP

SEQ ID NO: 3127761 - protein, 9 aa, Giardia lamblia
PLSSNGTGQ

SEQ ID NO: 3127762 - protein, 15 aa, Giardia lamblia
PLSTPSEKECCTPES

SEQ ID NO: 3127763 - protein, 5 aa, Giardia lamblia
PLSTS

SEQ ID NO: 3127764 - protein, 10 aa, Giardia lamblia
PLTASGGRKI

SEQ ID NO: 3127765 - protein, 18 aa, Giardia lamblia
PLTASSAYYRTGEGSGSK

SEQ ID NO: 3127766 - protein, 10 aa, Giardia lamblia
PLTATKETIT

SEQ ID NO: 3127767 - protein, 31 aa, Giardia lamblia
PLTDSVAPSPPNKSSRTYQPPLSAKSGQKIS

SEQ ID NO: 3127768 - protein, 11 aa, Giardia lamblia
PLTDTSSVEEK

SEQ ID NO: 3127769 - protein, 11 aa, Giardia lamblia
PLTEADEHGRT

SEQ ID NO: 3127770 - protein, 10 aa, Giardia lamblia
PLTEEEKRKL

SEQ ID NO: 3127771 - protein, 4 aa, Giardia lamblia
PLTG

SEQ ID NO: 3127772 - protein, 32 aa, Giardia lamblia
PLTGKQQTCGSQPSEVKSKEAGRRSTTTKGNS

SEQ ID NO: 3127773 - protein, 5 aa, Giardia lamblia
PLTPE

SEQ ID NO: 3127774 - protein, 10 aa, Giardia lamblia
PLTPERGEKN

SEQ ID NO: 3127775 - protein, 7 aa, Giardia lamblia
PLTPQSR

SEQ ID NO: 3127776 - protein, 10 aa, Giardia lamblia
PLTSDESLSS

SEQ ID NO: 3127777 - protein, 6 aa, Giardia lamblia
PLTSTE

SEQ ID NO: 3127778 - protein, 26 aa, Giardia lamblia
PLTTTAGDSLSPPSKDLTSAESTPLP

SEQ ID NO: 3127779 - protein, 7 aa, Giardia lamblia
PLVPEGS

SEQ ID NO: 3127780 - protein, 6 aa, Giardia lamblia
PLVPPV

SEQ ID NO: 3127781 - protein, 5 aa, Giardia lamblia
PLVSD

SEQ ID NO: 3127782 - protein, 4 aa, Giardia lamblia
PLYA

SEQ ID NO: 3127783 - protein, 15 aa, Giardia lamblia
PLYPRNPIKKGSWDD

SEQ ID NO: 3127784 - protein, 14 aa, Giardia lamblia
PLYPTESVSGRDDT

SEQ ID NO: 3127785 - protein, 13 aa, Giardia lamblia
PMATTAKQPGVYP

SEQ ID NO: 3127786 - protein, 9 aa, Giardia lamblia
PMDTTTKSD

SEQ ID NO: 3127787 - protein, 5 aa, Giardia lamblia
PMEAV

SEQ ID NO: 3127788 - protein, 8 aa, Giardia lamblia
PMETGSTV

SEQ ID NO: 3127789 - protein, 10 aa, Giardia lamblia
PMFPGSSTMN

SEQ ID NO: 3127790 - protein, 9 aa, Giardia lamblia
PMGAAPSMQ

SEQ ID NO: 3127791 - protein, 20 aa, Giardia lamblia
PMGGGKGGSDFDPKGKSDNE

SEQ ID NO: 3127792 - protein, 10 aa, Giardia lamblia
PMGKNQPNNL

SEQ ID NO: 3127793 - protein, 7 aa, Giardia lamblia
PMHSPTN

SEQ ID NO: 3127794 - protein, 17 aa, Giardia lamblia
PMIPGGTSAPAPQAVPQ

SEQ ID NO: 3127795 - protein, 17 aa, Giardia lamblia
PMKNDATETSITAQQTM

SEQ ID NO: 3127796 - protein, 4 aa, Giardia lamblia
PMLP

SEQ ID NO: 3127797 - protein, 13 aa, Giardia lamblia
PMNKPTKPSNNHA

SEQ ID NO: 3127798 - protein, 10 aa, Giardia lamblia
PMNNERRPVS

SEQ ID NO: 3127799 - protein, 8 aa, Giardia lamblia
PMNTTGRG

SEQ ID NO: 3127800 - protein, 7 aa, Giardia lamblia
PMQSPGT

SEQ ID NO: 3127801 - protein, 10 aa, Giardia lamblia
PMSADSVRSN

SEQ ID NO: 3127802 - protein, 4 aa, Giardia lamblia
PMSI

SEQ ID NO: 3127803 - protein, 28 aa, Giardia lamblia
PMSPEASDKLQDGGSKTGQRRTRPGSHR

SEQ ID NO: 3127804 - protein, 10 aa, Giardia lamblia
PMSPQTIDGR

SEQ ID NO: 3127805 - protein, 10 aa, Giardia lamblia
PMSPRGKANG

SEQ ID NO: 3127806 - protein, 10 aa, Giardia lamblia
PMSSGTHRAV

SEQ ID NO: 3127807 - protein, 10 aa, Giardia lamblia
PMTAPKVGDR

SEQ ID NO: 3127808 - protein, 12 aa, Giardia lamblia
PMTPKPGDSRYR

SEQ ID NO: 3127809 - protein, 42 aa, Giardia lamblia
PMTTEDSSWQGGAAALQDSLDEPRTIPPVAEGSQKPNTADGY

SEQ ID NO: 3127810 - protein, 6 aa, Giardia lamblia
PNAAET

SEQ ID NO: 3127811 - protein, 10 aa, Giardia lamblia
PNADDAKSIV

SEQ ID NO: 3127812 - protein, 25 aa, Giardia lamblia
PNAIGNAETGSTDQVDQELSSSSSF

SEQ ID NO: 3127813 - protein, 12 aa, Giardia lamblia
PNAKGDRTNKNK

SEQ ID NO: 3127814 - protein, 7 aa, Giardia lamblia
PNALGET

SEQ ID NO: 3127815 - protein, 15 aa, Giardia lamblia
PNANTYARAGMPQAS

SEQ ID NO: 3127816 - protein, 7 aa, Giardia lamblia
PNAPADA

SEQ ID NO: 3127817 - protein, 13 aa, Giardia lamblia
PNAPHCAETGKQI

SEQ ID NO: 3127818 - protein, 12 aa, Giardia lamblia
PNAPSSDRRVIT

SEQ ID NO: 3127819 - protein, 9 aa, Giardia lamblia
PNAQRQEVH

SEQ ID NO: 3127820 - protein, 8 aa, Giardia lamblia
PNAQTGGY

SEQ ID NO: 3127821 - protein, 14 aa, Giardia lamblia
PNARGGRRLTSEKY

SEQ ID NO: 3127822 - protein, 8 aa, Giardia lamblia
PNARPSAA

SEQ ID NO: 3127823 - protein, 13 aa, Giardia lamblia
PNASESGKAIQDQ

SEQ ID NO: 3127824 - protein, 9 aa, Giardia lamblia
PNCKEERDT

SEQ ID NO: 3127825 - protein, 7 aa, Giardia lamblia
PNDAEVT

SEQ ID NO: 3127826 - protein, 8 aa, Giardia lamblia
PNDGASRT

SEQ ID NO: 3127827 - protein, 13 aa, Giardia lamblia
PNDKSSISSSPLQ

SEQ ID NO: 3127828 - protein, 8 aa, Giardia lamblia
PNDSPGYK

SEQ ID NO: 3127829 - protein, 28 aa, Giardia lamblia
PNEAAATAKSDEDQEITPVNTKTLDEPL

SEQ ID NO: 3127830 - protein, 22 aa, Giardia lamblia
PNEALDEPVTTNNTLLMHAIRF

SEQ ID NO: 3127831 - protein, 14 aa, Giardia lamblia
PNEPPILQTSRGDS

SEQ ID NO: 3127832 - protein, 7 aa, Giardia lamblia
PNEPVRQ

SEQ ID NO: 3127833 - protein, 9 aa, Giardia lamblia
PNFGKPARE

SEQ ID NO: 3127834 - protein, 5 aa, Giardia lamblia
PNFSG

SEQ ID NO: 3127835 - protein, 4 aa, Giardia lamblia
PNGD

SEQ ID NO: 3127836 - protein, 7 aa, Giardia lamblia
PNGDKKA

SEQ ID NO: 3127837 - protein, 7 aa, Giardia lamblia
PNGDPKL

SEQ ID NO: 3127838 - protein, 6 aa, Giardia lamblia
PNGDSP

SEQ ID NO: 3127839 - protein, 6 aa, Giardia lamblia
PNGGTK

SEQ ID NO: 3127840 - protein, 6 aa, Giardia lamblia
PNGHGQ

SEQ ID NO: 3127841 - protein, 9 aa, Giardia lamblia
PNGSGKTNI

SEQ ID NO: 3127842 - protein, 5 aa, Giardia lamblia
PNGSP

SEQ ID NO: 3127843 - protein, 9 aa, Giardia lamblia
PNGTTIQPA

SEQ ID NO: 3127844 - protein, 9 aa, Giardia lamblia
PNGTYSTEL

SEQ ID NO: 3127845 - protein, 8 aa, Giardia lamblia
PNHDDHNS

SEQ ID NO: 3127846 - protein, 5 aa, Giardia lamblia
PNHDR

SEQ ID NO: 3127847 - protein, 6 aa, Giardia lamblia
PNHPPL

SEQ ID NO: 3127848 - protein, 30 aa, Giardia lamblia
PNHRPSTSKAASVTKKPSSASRPPKTRNRT

SEQ ID NO: 3127849 - protein, 4 aa, Giardia lamblia
PNHT

SEQ ID NO: 3127850 - protein, 4 aa, Giardia lamblia
PNIE

SEQ ID NO: 3127851 - protein, 5 aa, Giardia lamblia
PNIEG

SEQ ID NO: 3127852 - protein, 14 aa, Giardia lamblia
PNIKQTEPRKPDVY

SEQ ID NO: 3127853 - protein, 4 aa, Giardia lamblia
PNIS

SEQ ID NO: 3127854 - protein, 10 aa, Giardia lamblia
PNISGQGIVP

SEQ ID NO: 3127855 - protein, 11 aa, Giardia lamblia
PNKHDTTGNPL

SEQ ID NO: 3127856 - protein, 13 aa, Giardia lamblia
PNKHKAGMRSSMS

SEQ ID NO: 3127857 - protein, 6 aa, Giardia lamblia
PNKPGG

SEQ ID NO: 3127858 - protein, 10 aa, Giardia lamblia
PNKRSMNSRA

SEQ ID NO: 3127859 - protein, 10 aa, Giardia lamblia
PNLAGGYSPL

SEQ ID NO: 3127860 - protein, 12 aa, Giardia lamblia
PNLEEKRNATHQ

SEQ ID NO: 3127861 - protein, 8 aa, Giardia lamblia
PNLGPGYS

SEQ ID NO: 3127862 - protein, 7 aa, Giardia lamblia
PNLKSRE

SEQ ID NO: 3127863 - protein, 4 aa, Giardia lamblia
PNLP

SEQ ID NO: 3127864 - protein, 23 aa, Giardia lamblia
PNLPELTKDEVSAQARVSSRSAR

SEQ ID NO: 3127865 - protein, 10 aa, Giardia lamblia
PNLPSQDSQM

SEQ ID NO: 3127866 - protein, 9 aa, Giardia lamblia
PNLQSPAQH

SEQ ID NO: 3127867 - protein, 16 aa, Giardia lamblia
PNLRQNRGTQPRAKQY

SEQ ID NO: 3127868 - protein, 5 aa, Giardia lamblia
PNLSA

SEQ ID NO: 3127869 - protein, 12 aa, Giardia lamblia
PNLSHRTRQDNP

SEQ ID NO: 3127870 - protein, 6 aa, Giardia lamblia
PNLTNA

SEQ ID NO: 3127871 - protein, 6 aa, Giardia lamblia
PNLTSV

SEQ ID NO: 3127872 - protein, 22 aa, Giardia lamblia
PNMEPPPEATSKRPKRPQAETV

SEQ ID NO: 3127873 - protein, 4 aa, Giardia lamblia
PNMG

SEQ ID NO: 3127874 - protein, 10 aa, Giardia lamblia
PNNISREQLR

SEQ ID NO: 3127875 - protein, 5 aa, Giardia lamblia
PNNMG

SEQ ID NO: 3127876 - protein, 5 aa, Giardia lamblia
PNNNF

SEQ ID NO: 3127877 - protein, 14 aa, Giardia lamblia
PNNPTGSTLTESDI

SEQ ID NO: 3127878 - protein, 7 aa, Giardia lamblia
PNNSTTV

SEQ ID NO: 3127879 - protein, 6 aa, Giardia lamblia
PNNTGF

SEQ ID NO: 3127880 - protein, 6 aa, Giardia lamblia
PNPAPV

SEQ ID NO: 3127881 - protein, 6 aa, Giardia lamblia
PNPDEY

SEQ ID NO: 3127882 - protein, 6 aa, Giardia lamblia
PNPDHR

SEQ ID NO: 3127883 - protein, 5 aa, Giardia lamblia
PNPEL

SEQ ID NO: 3127884 - protein, 4 aa, Giardia lamblia
PNPI

SEQ ID NO: 3127885 - protein, 5 aa, Giardia lamblia
PNPIN

SEQ ID NO: 3127886 - protein, 7 aa, Giardia lamblia
PNPKARM

SEQ ID NO: 3127887 - protein, 10 aa, Giardia lamblia
PNPKYSPENA

SEQ ID NO: 3127888 - protein, 5 aa, Giardia lamblia
PNPLP

SEQ ID NO: 3127889 - protein, 8 aa, Giardia lamblia
PNPNRPMK

SEQ ID NO: 3127890 - protein, 12 aa, Giardia lamblia
PNPQIQAGAKPR

SEQ ID NO: 3127891 - protein, 5 aa, Giardia lamblia
PNPRY

SEQ ID NO: 3127892 - protein, 11 aa, Giardia lamblia
PNPSARPSATD

SEQ ID NO: 3127893 - protein, 7 aa, Giardia lamblia
PNPSFRG

SEQ ID NO: 3127894 - protein, 22 aa, Giardia lamblia
PNPSPPDINSESSKSQPCNPEN

SEQ ID NO: 3127895 - protein, 5 aa, Giardia lamblia
PNPSR

SEQ ID NO: 3127896 - protein, 29 aa, Giardia lamblia
PNPSVSAKSSRNANGPRPENDPSKAFTSS

SEQ ID NO: 3127897 - protein, 15 aa, Giardia lamblia
PNPSVSTSQTPASIK

SEQ ID NO: 3127898 - protein, 7 aa, Giardia lamblia
PNPTATI

SEQ ID NO: 3127899 - protein, 7 aa, Giardia lamblia
PNPTTAV

SEQ ID NO: 3127900 - protein, 7 aa, Giardia lamblia
PNQDLSS

SEQ ID NO: 3127901 - protein, 5 aa, Giardia lamblia
PNQEY

SEQ ID NO: 3127902 - protein, 5 aa, Giardia lamblia
PNQNE

SEQ ID NO: 3127903 - protein, 10 aa, Giardia lamblia
PNQNTRQDIE

SEQ ID NO: 3127904 - protein, 6 aa, Giardia lamblia
PNQPQY

SEQ ID NO: 3127905 - protein, 9 aa, Giardia lamblia
PNQTPPPYA

SEQ ID NO: 3127906 - protein, 6 aa, Giardia lamblia
PNREEL

SEQ ID NO: 3127907 - protein, 4 aa, Giardia lamblia
PNRQ

SEQ ID NO: 3127908 - protein, 32 aa, Giardia lamblia
PNRSKSTRNVLDEPGQKGDLKNPKPSAPDRIY

SEQ ID NO: 3127909 - protein, 13 aa, Giardia lamblia
PNSDDHSGSLSPE

SEQ ID NO: 3127910 - protein, 9 aa, Giardia lamblia
PNSDNEGDL

SEQ ID NO: 3127911 - protein, 12 aa, Giardia lamblia
PNSDSNHQGNRS

SEQ ID NO: 3127912 - protein, 5 aa, Giardia lamblia
PNSEA

SEQ ID NO: 3127913 - protein, 8 aa, Giardia lamblia
PNSEEKTI

SEQ ID NO: 3127914 - protein, 8 aa, Giardia lamblia
PNSGNKTT

SEQ ID NO: 3127915 - protein, 23 aa, Giardia lamblia
PNSGRGSSGKAFTSKNRPANLST

SEQ ID NO: 3127916 - protein, 8 aa, Giardia lamblia
PNSLARST

SEQ ID NO: 3127917 - protein, 13 aa, Giardia lamblia
PNSLSGPQSTAGV

SEQ ID NO: 3127918 - protein, 12 aa, Giardia lamblia
PNSLSNTLSEPL

SEQ ID NO: 3127919 - protein, 8 aa, Giardia lamblia
PNSNENRV

SEQ ID NO: 3127920 - protein, 6 aa, Giardia lamblia
PNSPLS

SEQ ID NO: 3127921 - protein, 5 aa, Giardia lamblia
PNSSK

SEQ ID NO: 3127922 - protein, 8 aa, Giardia lamblia
PNSSPVPD

SEQ ID NO: 3127923 - protein, 9 aa, Giardia lamblia
PNSSSNAAI

SEQ ID NO: 3127924 - protein, 15 aa, Giardia lamblia
PNSTEGAFSAKGSSV

SEQ ID NO: 3127925 - protein, 17 aa, Giardia lamblia
PNSTRPNRTMTPQEEDR

SEQ ID NO: 3127926 - protein, 38 aa, Giardia lamblia
PNSTTSKGSYSYGSYRDDDSIDRSPHTTYRTSSNSTTH

SEQ ID NO: 3127927 - protein, 15 aa, Giardia lamblia
PNTDLNKSSPDDGRL

SEQ ID NO: 3127928 - protein, 13 aa, Giardia lamblia
PNTEKEDEDCHGT

SEQ ID NO: 3127929 - protein, 12 aa, Giardia lamblia
PNTHNTQPIDQP

SEQ ID NO: 3127930 - protein, 15 aa, Giardia lamblia
PNTLSTGQKSSSSFH

SEQ ID NO: 3127931 - protein, 4 aa, Giardia lamblia
PNTQ

SEQ ID NO: 3127932 - protein, 9 aa, Giardia lamblia
PNTQAPMAA

SEQ ID NO: 3127933 - protein, 5 aa, Giardia lamblia
PNTQS

SEQ ID NO: 3127934 - protein, 14 aa, Giardia lamblia
PNTSSDSRSKNLAT

SEQ ID NO: 3127935 - protein, 4 aa, Giardia lamblia
PNTV

SEQ ID NO: 3127936 - protein, 5 aa, Giardia lamblia
PNVED

SEQ ID NO: 3127937 - protein, 13 aa, Giardia lamblia
PNVGSTGQAPLPL

SEQ ID NO: 3127938 - protein, 4 aa, Giardia lamblia
PNVS

SEQ ID NO: 3127939 - protein, 4 aa, Giardia lamblia
PNWK

SEQ ID NO: 3127940 - protein, 9 aa, Giardia lamblia
PNWRNTGLN

SEQ ID NO: 3127941 - protein, 8 aa, Giardia lamblia
PNYSTSTL

SEQ ID NO: 3127942 - protein, 7 aa, Giardia lamblia
PNYTRTE

SEQ ID NO: 3127943 - protein, 4 aa, Giardia lamblia
PPAA

SEQ ID NO: 3127944 - protein, 8 aa, Giardia lamblia
PPAATSEE

SEQ ID NO: 3127945 - protein, 4 aa, Giardia lamblia
PPAE

SEQ ID NO: 3127946 - protein, 7 aa, Giardia lamblia
PPAGATS

SEQ ID NO: 3127947 - protein, 5 aa, Giardia lamblia
PPAGD

SEQ ID NO: 3127948 - protein, 6 aa, Giardia lamblia
PPAGES

SEQ ID NO: 3127949 - protein, 12 aa, Giardia lamblia
PPAKDSGARSVK

SEQ ID NO: 3127950 - protein, 37 aa, Giardia lamblia
PPAKRAKSSGKASSKTCLSRATSDHDIQANDPESEVK

SEQ ID NO: 3127951 - protein, 11 aa, Giardia lamblia
PPALADQQSIG

SEQ ID NO: 3127952 - protein, 12 aa, Giardia lamblia
PPALPPTTRMSQ

SEQ ID NO: 3127953 - protein, 18 aa, Giardia lamblia
PPALTPMPSSYSSAGMPN

SEQ ID NO: 3127954 - protein, 16 aa, Giardia lamblia
PPANTAHACSGQQPVL

SEQ ID NO: 3127955 - protein, 6 aa, Giardia lamblia
PPAPEK

SEQ ID NO: 3127956 - protein, 5 aa, Giardia lamblia
PPAPM

SEQ ID NO: 3127957 - protein, 5 aa, Giardia lamblia
PPARS

SEQ ID NO: 3127958 - protein, 8 aa, Giardia lamblia
PPASAAAL

SEQ ID NO: 3127959 - protein, 10 aa, Giardia lamblia
PPATGHSGGG

SEQ ID NO: 3127960 - protein, 16 aa, Giardia lamblia
PPAVPQQHGKNPPISS

SEQ ID NO: 3127961 - protein, 10 aa, Giardia lamblia
PPAYSANPEE

SEQ ID NO: 3127962 - protein, 6 aa, Giardia lamblia
PPCGSK

SEQ ID NO: 3127963 - protein, 28 aa, Giardia lamblia
PPCSRTSKQRLPQPLAAKTETQPRSNTG

SEQ ID NO: 3127964 - protein, 10 aa, Giardia lamblia
PPCTENGSLT

SEQ ID NO: 3127965 - protein, 10 aa, Giardia lamblia
PPDADNLAES

SEQ ID NO: 3127966 - protein, 14 aa, Giardia lamblia
PPDATEYGNPFGNG

SEQ ID NO: 3127967 - protein, 7 aa, Giardia lamblia
PPDESSS

SEQ ID NO: 3127968 - protein, 4 aa, Giardia lamblia
PPDG

SEQ ID NO: 3127969 - protein, 9 aa, Giardia lamblia
PPDGLDKER

SEQ ID NO: 3127970 - protein, 5 aa, Giardia lamblia
PPDGV

SEQ ID NO: 3127971 - protein, 8 aa, Giardia lamblia
PPDLPSQD

SEQ ID NO: 3127972 - protein, 7 aa, Giardia lamblia
PPDLREP

SEQ ID NO: 3127973 - protein, 9 aa, Giardia lamblia
PPDPPENAA

SEQ ID NO: 3127974 - protein, 11 aa, Giardia lamblia
PPDPSTTAGTH

SEQ ID NO: 3127975 - protein, 4 aa, Giardia lamblia
PPDQ

SEQ ID NO: 3127976 - protein, 8 aa, Giardia lamblia
PPDQEIPA

SEQ ID NO: 3127977 - protein, 10 aa, Giardia lamblia
PPDQQYATAA

SEQ ID NO: 3127978 - protein, 4 aa, Giardia lamblia
PPDS

SEQ ID NO: 3127979 - protein, 21 aa, Giardia lamblia
PPDSSREPELKRSYQSNPTAS

SEQ ID NO: 3127980 - protein, 11 aa, Giardia lamblia
PPDSTHNEEHI

SEQ ID NO: 3127981 - protein, 5 aa, Giardia lamblia
PPDVV

SEQ ID NO: 3127982 - protein, 12 aa, Giardia lamblia
PPEATETYEPDV

SEQ ID NO: 3127983 - protein, 9 aa, Giardia lamblia
PPECSPGNT

SEQ ID NO: 3127984 - protein, 8 aa, Giardia lamblia
PPEDREKL

SEQ ID NO: 3127985 - protein, 9 aa, Giardia lamblia
PPEKRDPKE

SEQ ID NO: 3127986 - protein, 8 aa, Giardia lamblia
PPEPARGL

SEQ ID NO: 3127987 - protein, 6 aa, Giardia lamblia
PPEPKS

SEQ ID NO: 3127988 - protein, 8 aa, Giardia lamblia
PPEPSEIP

SEQ ID NO: 3127989 - protein, 5 aa, Giardia lamblia
PPEQC

SEQ ID NO: 3127990 - protein, 6 aa, Giardia lamblia
PPEQWP

SEQ ID NO: 3127991 - protein, 8 aa, Giardia lamblia
PPERPPAN

SEQ ID NO: 3127992 - protein, 9 aa, Giardia lamblia
PPESPSDLT

SEQ ID NO: 3127993 - protein, 6 aa, Giardia lamblia
PPETTY

SEQ ID NO: 3127994 - protein, 18 aa, Giardia lamblia
PPETWGGTEDVSGEADCK

SEQ ID NO: 3127995 - protein, 6 aa, Giardia lamblia
PPEYAD

SEQ ID NO: 3127996 - protein, 4 aa, Giardia lamblia
PPFE

SEQ ID NO: 3127997 - protein, 5 aa, Giardia lamblia
PPFNE

SEQ ID NO: 3127998 - protein, 8 aa, Giardia lamblia
PPFNSTNV

SEQ ID NO: 3127999 - protein, 5 aa, Giardia lamblia
PPFQQ

SEQ ID NO: 3128000 - protein, 5 aa, Giardia lamblia
PPFTS

SEQ ID NO: 3128001 - protein, 40 aa, Giardia lamblia
PPGGPAETGAPPPPGPAGRPQAGPEVPEHPQDGPGGAGQR

SEQ ID NO: 3128002 - protein, 13 aa, Giardia lamblia
PPGGSRFYSGPGY

SEQ ID NO: 3128003 - protein, 6 aa, Giardia lamblia
PPGKRY

SEQ ID NO: 3128004 - protein, 11 aa, Giardia lamblia
PPGPDPHQYET

SEQ ID NO: 3128005 - protein, 22 aa, Giardia lamblia
PPGPRSGKSSARSAPHQRVPSS

SEQ ID NO: 3128006 - protein, 7 aa, Giardia lamblia
PPGSSEE

SEQ ID NO: 3128007 - protein, 7 aa, Giardia lamblia
PPGTGKT

SEQ ID NO: 3128008 - protein, 17 aa, Giardia lamblia
PPHCSTADREVLHKLIA

SEQ ID NO: 3128009 - protein, 11 aa, Giardia lamblia
PPHDSVSQPMP

SEQ ID NO: 3128010 - protein, 5 aa, Giardia lamblia
PPHNI

SEQ ID NO: 3128011 - protein, 4 aa, Giardia lamblia
PPHT

SEQ ID NO: 3128012 - protein, 21 aa, Giardia lamblia
PPIKPPSNHQTPRRSRSKPVA

SEQ ID NO: 3128013 - protein, 4 aa, Giardia lamblia
PPIQ

SEQ ID NO: 3128014 - protein, 6 aa, Giardia lamblia
PPIQKR

SEQ ID NO: 3128015 - protein, 10 aa, Giardia lamblia
PPISADEITN

SEQ ID NO: 3128016 - protein, 13 aa, Giardia lamblia
PPISKSYESSIAQ

SEQ ID NO: 3128017 - protein, 5 aa, Giardia lamblia
PPISL

SEQ ID NO: 3128018 - protein, 12 aa, Giardia lamblia
PPISPQKPVNPR

SEQ ID NO: 3128019 - protein, 4 aa, Giardia lamblia
PPIT

SEQ ID NO: 3128020 - protein, 4 aa, Giardia lamblia
PPIY

SEQ ID NO: 3128021 - protein, 5 aa, Giardia lamblia
PPIYP

SEQ ID NO: 3128022 - protein, 12 aa, Giardia lamblia
PPKATLALTTLH

SEQ ID NO: 3128023 - protein, 8 aa, Giardia lamblia
PPKENHSH

SEQ ID NO: 3128024 - protein, 5 aa, Giardia lamblia
PPKGE

SEQ ID NO: 3128025 - protein, 5 aa, Giardia lamblia
PPKGL

SEQ ID NO: 3128026 - protein, 10 aa, Giardia lamblia
PPKKVRRASN

SEQ ID NO: 3128027 - protein, 9 aa, Giardia lamblia
PPKNDEPDV

SEQ ID NO: 3128028 - protein, 4 aa, Giardia lamblia
PPKQ

SEQ ID NO: 3128029 - protein, 8 aa, Giardia lamblia
PPKRKRKT

SEQ ID NO: 3128030 - protein, 6 aa, Giardia lamblia
PPKRTH

SEQ ID NO: 3128031 - protein, 42 aa, Giardia lamblia
PPKSVKHEEGEGEDVEPEEENSDGEEELEEEDVEVDESDRIE

SEQ ID NO: 3128032 - protein, 7 aa, Giardia lamblia
PPKTDME

SEQ ID NO: 3128033 - protein, 4 aa, Giardia lamblia
PPKY

SEQ ID NO: 3128034 - protein, 11 aa, Giardia lamblia
PPLATEKDQDG

SEQ ID NO: 3128035 - protein, 22 aa, Giardia lamblia
PPLATTNPADDALPASQSASKV

SEQ ID NO: 3128036 - protein, 10 aa, Giardia lamblia
PPLEPQDDGS

SEQ ID NO: 3128037 - protein, 16 aa, Giardia lamblia
PPLETSNQPERKVRNN

SEQ ID NO: 3128038 - protein, 15 aa, Giardia lamblia
PPLEVSRTESPDFGA

SEQ ID NO: 3128039 - protein, 8 aa, Giardia lamblia
PPLGPGAQ

SEQ ID NO: 3128040 - protein, 20 aa, Giardia lamblia
PPLLETGQASNLQQQQAQQL

SEQ ID NO: 3128041 - protein, 4 aa, Giardia lamblia
PPLN

SEQ ID NO: 3128042 - protein, 7 aa, Giardia lamblia
PPLPPGA

SEQ ID NO: 3128043 - protein, 6 aa, Giardia lamblia
PPLPSY

SEQ ID NO: 3128044 - protein, 16 aa, Giardia lamblia
PPLPTDTPTVSTLEPS

SEQ ID NO: 3128045 - protein, 5 aa, Giardia lamblia
PPLQT

SEQ ID NO: 3128046 - protein, 17 aa, Giardia lamblia
PPLSASSSSSSSSDEGE

SEQ ID NO: 3128047 - protein, 6 aa, Giardia lamblia
PPLSEP

SEQ ID NO: 3128048 - protein, 16 aa, Giardia lamblia
PPLSGKNKQAKAKRSL

SEQ ID NO: 3128049 - protein, 7 aa, Giardia lamblia
PPLSKSQ

SEQ ID NO: 3128050 - protein, 8 aa, Giardia lamblia
PPLSSGHG

SEQ ID NO: 3128051 - protein, 8 aa, Giardia lamblia
PPLTQPSA

SEQ ID NO: 3128052 - protein, 34 aa, Giardia lamblia
PPMDMSGDDTGNKMGNQLNPRKAKATAPNDDPAT

SEQ ID NO: 3128053 - protein, 6 aa, Giardia lamblia
PPMGAG

SEQ ID NO: 3128054 - protein, 57 aa, Giardia lamblia
PPMGPPASNVPPAIDKAADELGAKPGATSQTSIISGSAGGSGTSKSSGGSGSSTNTI

SEQ ID NO: 3128055 - protein, 32 aa, Giardia lamblia
PPMQATAAKEKQKKAKASQATNQGTKGTLQTE

SEQ ID NO: 3128056 - protein, 13 aa, Giardia lamblia
PPNFQRLASSELN

SEQ ID NO: 3128057 - protein, 8 aa, Giardia lamblia
PPNGEHPK

SEQ ID NO: 3128058 - protein, 4 aa, Giardia lamblia
PPNI

SEQ ID NO: 3128059 - protein, 6 aa, Giardia lamblia
PPNISP

SEQ ID NO: 3128060 - protein, 6 aa, Giardia lamblia
PPNKLN

SEQ ID NO: 3128061 - protein, 4 aa, Giardia lamblia
PPNL

SEQ ID NO: 3128062 - protein, 12 aa, Giardia lamblia
PPNLKNRRHNRK

SEQ ID NO: 3128063 - protein, 14 aa, Giardia lamblia
PPNLPPESIPQDPY

SEQ ID NO: 3128064 - protein, 5 aa, Giardia lamblia
PPNNA

SEQ ID NO: 3128065 - protein, 22 aa, Giardia lamblia
PPNPGVYSGPEPGAMDQSSGPV

SEQ ID NO: 3128066 - protein, 5 aa, Giardia lamblia
PPNPL

SEQ ID NO: 3128067 - protein, 23 aa, Giardia lamblia
PPNPTPASVPPNLTEKEKRGFSR

SEQ ID NO: 3128068 - protein, 6 aa, Giardia lamblia
PPNRNP

SEQ ID NO: 3128069 - protein, 4 aa, Giardia lamblia
PPNT

SEQ ID NO: 3128070 - protein, 14 aa, Giardia lamblia
PPNTPILAQLDRLC

SEQ ID NO: 3128071 - protein, 5 aa, Giardia lamblia
PPNVT

SEQ ID NO: 3128072 - protein, 7 aa, Giardia lamblia
PPPATEW

SEQ ID NO: 3128073 - protein, 4 aa, Giardia lamblia
PPPD

SEQ ID NO: 3128074 - protein, 19 aa, Giardia lamblia
PPPESNAPCDSEVDPDEYD

SEQ ID NO: 3128075 - protein, 5 aa, Giardia lamblia
PPPEV

SEQ ID NO: 3128076 - protein, 5 aa, Giardia lamblia
PPPGI

SEQ ID NO: 3128077 - protein, 7 aa, Giardia lamblia
PPPGMTK

SEQ ID NO: 3128078 - protein, 13 aa, Giardia lamblia
PPPGPYSPPVQTS

SEQ ID NO: 3128079 - protein, 4 aa, Giardia lamblia
PPPI

SEQ ID NO: 3128080 - protein, 10 aa, Giardia lamblia
PPPKKPLGSA

SEQ ID NO: 3128081 - protein, 7 aa, Giardia lamblia
PPPLPDG

SEQ ID NO: 3128082 - protein, 7 aa, Giardia lamblia
PPPPDIA

SEQ ID NO: 3128083 - protein, 5 aa, Giardia lamblia
PPPPK

SEQ ID NO: 3128084 - protein, 15 aa, Giardia lamblia
PPPPPRVPPPSTSSR

SEQ ID NO: 3128085 - protein, 6 aa, Giardia lamblia
PPPQFS

SEQ ID NO: 3128086 - protein, 6 aa, Giardia lamblia
PPPRAY

SEQ ID NO: 3128087 - protein, 8 aa, Giardia lamblia
PPPSSKLP

SEQ ID NO: 3128088 - protein, 15 aa, Giardia lamblia
PPPSTQDPDGQSNPL

SEQ ID NO: 3128089 - protein, 22 aa, Giardia lamblia
PPPTDKADMDWTEKEGYGQTPK

SEQ ID NO: 3128090 - protein, 8 aa, Giardia lamblia
PPPTPSAI

SEQ ID NO: 3128091 - protein, 15 aa, Giardia lamblia
PPPTVQDGGLGSRGF

SEQ ID NO: 3128092 - protein, 5 aa, Giardia lamblia
PPPVS

SEQ ID NO: 3128093 - protein, 7 aa, Giardia lamblia
PPPVTPD

SEQ ID NO: 3128094 - protein, 6 aa, Giardia lamblia
PPPYTE

SEQ ID NO: 3128095 - protein, 13 aa, Giardia lamblia
PPPYVEDDGEYDE

SEQ ID NO: 3128096 - protein, 7 aa, Giardia lamblia
PPQDARG

SEQ ID NO: 3128097 - protein, 7 aa, Giardia lamblia
PPQDLDK

SEQ ID NO: 3128098 - protein, 5 aa, Giardia lamblia
PPQKH

SEQ ID NO: 3128099 - protein, 8 aa, Giardia lamblia
PPQNTYST

SEQ ID NO: 3128100 - protein, 5 aa, Giardia lamblia
PPQQS

SEQ ID NO: 3128101 - protein, 4 aa, Giardia lamblia
PPQR

SEQ ID NO: 3128102 - protein, 9 aa, Giardia lamblia
PPQSASAIA

SEQ ID NO: 3128103 - protein, 8 aa, Giardia lamblia
PPQSNHSE

SEQ ID NO: 3128104 - protein, 8 aa, Giardia lamblia
PPQTDTQE

SEQ ID NO: 3128105 - protein, 9 aa, Giardia lamblia
PPQTSPSIA

SEQ ID NO: 3128106 - protein, 31 aa, Giardia lamblia
PPQYPRSAPQQAEGLSSDAEKQKNSQQNHEC

SEQ ID NO: 3128107 - protein, 8 aa, Giardia lamblia
PPREVEPE

SEQ ID NO: 3128108 - protein, 23 aa, Giardia lamblia
PPRGLSTKEELADMPREKAADKV

SEQ ID NO: 3128109 - protein, 15 aa, Giardia lamblia
PPRHTETKRPAESVV

SEQ ID NO: 3128110 - protein, 5 aa, Giardia lamblia
PPRKE

SEQ ID NO: 3128111 - protein, 6 aa, Giardia lamblia
PPRLTT

SEQ ID NO: 3128112 - protein, 14 aa, Giardia lamblia
PPRPDDPNDSCPPI

SEQ ID NO: 3128113 - protein, 12 aa, Giardia lamblia
PPRPDSTGSNSA

SEQ ID NO: 3128114 - protein, 8 aa, Giardia lamblia
PPRPGEPS

SEQ ID NO: 3128115 - protein, 12 aa, Giardia lamblia
PPRQTDSSPTLS

SEQ ID NO: 3128116 - protein, 7 aa, Giardia lamblia
PPRRPSL

SEQ ID NO: 3128117 - protein, 4 aa, Giardia lamblia
PPRS

SEQ ID NO: 3128118 - protein, 7 aa, Giardia lamblia
PPRSPEL

SEQ ID NO: 3128119 - protein, 10 aa, Giardia lamblia
PPSADAPAGK

SEQ ID NO: 3128120 - protein, 10 aa, Giardia lamblia
PPSAPGRVTR

SEQ ID NO: 3128121 - protein, 21 aa, Giardia lamblia
PPSARGQPKIIPEDPASDDEI

SEQ ID NO: 3128122 - protein, 8 aa, Giardia lamblia
PPSATNNE

SEQ ID NO: 3128123 - protein, 15 aa, Giardia lamblia
PPSDGEQDSSSSIRD

SEQ ID NO: 3128124 - protein, 11 aa, Giardia lamblia
PPSDGHPKGRT

SEQ ID NO: 3128125 - protein, 5 aa, Giardia lamblia
PPSES

SEQ ID NO: 3128126 - protein, 12 aa, Giardia lamblia
PPSKHQVRRNPK

SEQ ID NO: 3128127 - protein, 7 aa, Giardia lamblia
PPSKNPI

SEQ ID NO: 3128128 - protein, 10 aa, Giardia lamblia
PPSKSVETSL

SEQ ID NO: 3128129 - protein, 5 aa, Giardia lamblia
PPSLK

SEQ ID NO: 3128130 - protein, 7 aa, Giardia lamblia
PPSLKGS

SEQ ID NO: 3128131 - protein, 7 aa, Giardia lamblia
PPSLTAE

SEQ ID NO: 3128132 - protein, 8 aa, Giardia lamblia
PPSPHNHI

SEQ ID NO: 3128133 - protein, 25 aa, Giardia lamblia
PPSPRCSASAPESTISSSKKASVES

SEQ ID NO: 3128134 - protein, 4 aa, Giardia lamblia
PPSR

SEQ ID NO: 3128135 - protein, 5 aa, Giardia lamblia
PPSSF

SEQ ID NO: 3128136 - protein, 18 aa, Giardia lamblia
PPSSTTNTGATGSSARPN

SEQ ID NO: 3128137 - protein, 15 aa, Giardia lamblia
PPSTHAAAEAMDAAE

SEQ ID NO: 3128138 - protein, 5 aa, Giardia lamblia
PPSTN

SEQ ID NO: 3128139 - protein, 16 aa, Giardia lamblia
PPSTQAGRKSRSSTTI

SEQ ID NO: 3128140 - protein, 5 aa, Giardia lamblia
PPSVP

SEQ ID NO: 3128141 - protein, 11 aa, Giardia lamblia
PPTADSRPTGH

SEQ ID NO: 3128142 - protein, 11 aa, Giardia lamblia
PPTDSAALPDE

SEQ ID NO: 3128143 - protein, 11 aa, Giardia lamblia
PPTDTTKSLYT

SEQ ID NO: 3128144 - protein, 27 aa, Giardia lamblia
PPTGIGADSRQGSISSTGPGQRSRGAW

SEQ ID NO: 3128145 - protein, 6 aa, Giardia lamblia
PPTGIQ

SEQ ID NO: 3128146 - protein, 5 aa, Giardia lamblia
PPTKK

SEQ ID NO: 3128147 - protein, 42 aa, Giardia lamblia
PPTLNPEASLSPNARKVDGAEAVSSNTDDGCYNDQTKVASGG

SEQ ID NO: 3128148 - protein, 42 aa, Giardia lamblia
PPTNATFSGTATAGPLGTTTYSSLASTRGLSGTAIGGTTTTL

SEQ ID NO: 3128149 - protein, 6 aa, Giardia lamblia
PPTPCT

SEQ ID NO: 3128150 - protein, 8 aa, Giardia lamblia
PPTQQASY

SEQ ID NO: 3128151 - protein, 5 aa, Giardia lamblia
PPTRD

SEQ ID NO: 3128152 - protein, 5 aa, Giardia lamblia
PPTRH

SEQ ID NO: 3128153 - protein, 31 aa, Giardia lamblia
PPTTDNSNESMYEDKRQQSYEEPNAQANYEQ

SEQ ID NO: 3128154 - protein, 5 aa, Giardia lamblia
PPTTQ

SEQ ID NO: 3128155 - protein, 5 aa, Giardia lamblia
PPTTR

SEQ ID NO: 3128156 - protein, 18 aa, Giardia lamblia
PPTVSTKGSQQAPTCSNP

SEQ ID NO: 3128157 - protein, 7 aa, Giardia lamblia
PPVAPSP

SEQ ID NO: 3128158 - protein, 5 aa, Giardia lamblia
PPVDP

SEQ ID NO: 3128159 - protein, 6 aa, Giardia lamblia
PPVETM

SEQ ID NO: 3128160 - protein, 8 aa, Giardia lamblia
PPVKTEKR

SEQ ID NO: 3128161 - protein, 9 aa, Giardia lamblia
PPVNGEEKT

SEQ ID NO: 3128162 - protein, 4 aa, Giardia lamblia
PPVP

SEQ ID NO: 3128163 - protein, 7 aa, Giardia lamblia
PPVPCSS

SEQ ID NO: 3128164 - protein, 5 aa, Giardia lamblia
PPVPE

SEQ ID NO: 3128165 - protein, 7 aa, Giardia lamblia
PPVPSAI

SEQ ID NO: 3128166 - protein, 17 aa, Giardia lamblia
PPVQAQGGAQPGSQGPI

SEQ ID NO: 3128167 - protein, 12 aa, Giardia lamblia
PPVQPTEEMRKY

SEQ ID NO: 3128168 - protein, 6 aa, Giardia lamblia
PPVSES

SEQ ID NO: 3128169 - protein, 8 aa, Giardia lamblia
PPVSHQST

SEQ ID NO: 3128170 - protein, 6 aa, Giardia lamblia
PPVSTE

SEQ ID NO: 3128171 - protein, 7 aa, Giardia lamblia
PPYDNSS

SEQ ID NO: 3128172 - protein, 8 aa, Giardia lamblia
PPYGTGGS

SEQ ID NO: 3128173 - protein, 16 aa, Giardia lamblia
PPYSPQGEKDSPPNSD

SEQ ID NO: 3128174 - protein, 5 aa, Giardia lamblia
PQADQ

SEQ ID NO: 3128175 - protein, 5 aa, Giardia lamblia
PQAEE

SEQ ID NO: 3128176 - protein, 5 aa, Giardia lamblia
PQAET

SEQ ID NO: 3128177 - protein, 17 aa, Giardia lamblia
PQAIGGTEHIPTPGTAN

SEQ ID NO: 3128178 - protein, 7 aa, Giardia lamblia
PQAISPR

SEQ ID NO: 3128179 - protein, 6 aa, Giardia lamblia
PQANPS

SEQ ID NO: 3128180 - protein, 9 aa, Giardia lamblia
PQAPAPAIA

SEQ ID NO: 3128181 - protein, 27 aa, Giardia lamblia
PQAPGAPSFDAKPANPEPPAPKEPEKV

SEQ ID NO: 3128182 - protein, 18 aa, Giardia lamblia
PQAPPQPLQPDAGRAPST

SEQ ID NO: 3128183 - protein, 8 aa, Giardia lamblia
PQAPSPSF

SEQ ID NO: 3128184 - protein, 6 aa, Giardia lamblia
PQAQEP

SEQ ID NO: 3128185 - protein, 33 aa, Giardia lamblia
PQARAETKAEPQGLGKAEQQTRLQSELQNDSHR

SEQ ID NO: 3128186 - protein, 10 aa, Giardia lamblia
PQARAGTQHA

SEQ ID NO: 3128187 - protein, 18 aa, Giardia lamblia
PQARFSANSDTDPSAKIN

SEQ ID NO: 3128188 - protein, 8 aa, Giardia lamblia
PQATQSNF

SEQ ID NO: 3128189 - protein, 10 aa, Giardia lamblia
PQAVAASQQK

SEQ ID NO: 3128190 - protein, 19 aa, Giardia lamblia
PQCTGKFSDPINTSTQASN

SEQ ID NO: 3128191 - protein, 16 aa, Giardia lamblia
PQDASDDVYEPNENKN

SEQ ID NO: 3128192 - protein, 7 aa, Giardia lamblia
PQDFSNH

SEQ ID NO: 3128193 - protein, 4 aa, Giardia lamblia
PQDI

SEQ ID NO: 3128194 - protein, 11 aa, Giardia lamblia
PQDKYSANSDP

SEQ ID NO: 3128195 - protein, 14 aa, Giardia lamblia
PQDNQQATQAQPPV

SEQ ID NO: 3128196 - protein, 4 aa, Giardia lamblia
PQDR

SEQ ID NO: 3128197 - protein, 5 aa, Giardia lamblia
PQDRE

SEQ ID NO: 3128198 - protein, 4 aa, Giardia lamblia
PQDS

SEQ ID NO: 3128199 - protein, 13 aa, Giardia lamblia
PQDSPEDVRDDED

SEQ ID NO: 3128200 - protein, 9 aa, Giardia lamblia
PQDSPNSRS

SEQ ID NO: 3128201 - protein, 7 aa, Giardia lamblia
PQDYQKK

SEQ ID NO: 3128202 - protein, 8 aa, Giardia lamblia
PQEADSAE

SEQ ID NO: 3128203 - protein, 11 aa, Giardia lamblia
PQEAKKKTAKF

SEQ ID NO: 3128204 - protein, 12 aa, Giardia lamblia
PQEARMKDQNGM

SEQ ID NO: 3128205 - protein, 6 aa, Giardia lamblia
PQEDEG

SEQ ID NO: 3128206 - protein, 10 aa, Giardia lamblia
PQEEIDRSDR

SEQ ID NO: 3128207 - protein, 8 aa, Giardia lamblia
PQEEKTGY

SEQ ID NO: 3128208 - protein, 6 aa, Giardia lamblia
PQEGSV

SEQ ID NO: 3128209 - protein, 8 aa, Giardia lamblia
PQESQLPI

SEQ ID NO: 3128210 - protein, 6 aa, Giardia lamblia
PQESRE

SEQ ID NO: 3128211 - protein, 31 aa, Giardia lamblia
PQFEEPETASISSQEKNVSFSTAATKLESDT

SEQ ID NO: 3128212 - protein, 4 aa, Giardia lamblia
PQGA

SEQ ID NO: 3128213 - protein, 8 aa, Giardia lamblia
PQGDATDT

SEQ ID NO: 3128214 - protein, 5 aa, Giardia lamblia
PQGDP

SEQ ID NO: 3128215 - protein, 14 aa, Giardia lamblia
PQGNPQGSPELEGS

SEQ ID NO: 3128216 - protein, 8 aa, Giardia lamblia
PQGQTKPC

SEQ ID NO: 3128217 - protein, 6 aa, Giardia lamblia
PQGREA

SEQ ID NO: 3128218 - protein, 6 aa, Giardia lamblia
PQGSPL

SEQ ID NO: 3128219 - protein, 8 aa, Giardia lamblia
PQGTTSDA

SEQ ID NO: 3128220 - protein, 11 aa, Giardia lamblia
PQHRQSEPSLI

SEQ ID NO: 3128221 - protein, 4 aa, Giardia lamblia
PQHS

SEQ ID NO: 3128222 - protein, 18 aa, Giardia lamblia
PQHSSNKDGFQGGDADIS

SEQ ID NO: 3128223 - protein, 27 aa, Giardia lamblia
PQIKRRRGRTVSGGTSASTRNRKTKQA

SEQ ID NO: 3128224 - protein, 5 aa, Giardia lamblia
PQINK

SEQ ID NO: 3128225 - protein, 7 aa, Giardia lamblia
PQIPEKT

SEQ ID NO: 3128226 - protein, 10 aa, Giardia lamblia
PQITSEQSQL

SEQ ID NO: 3128227 - protein, 9 aa, Giardia lamblia
PQKDNTDMG

SEQ ID NO: 3128228 - protein, 14 aa, Giardia lamblia
PQKDSSEGKAEEHT

SEQ ID NO: 3128229 - protein, 5 aa, Giardia lamblia
PQKEF

SEQ ID NO: 3128230 - protein, 5 aa, Giardia lamblia
PQKET

SEQ ID NO: 3128231 - protein, 5 aa, Giardia lamblia
PQKHK

SEQ ID NO: 3128232 - protein, 9 aa, Giardia lamblia
PQKLNQRPP

SEQ ID NO: 3128233 - protein, 8 aa, Giardia lamblia
PQKRITAE

SEQ ID NO: 3128234 - protein, 17 aa, Giardia lamblia
PQKSQNKKRIKEILTKA

SEQ ID NO: 3128235 - protein, 6 aa, Giardia lamblia
PQLPGS

SEQ ID NO: 3128236 - protein, 4 aa, Giardia lamblia
PQLS

SEQ ID NO: 3128237 - protein, 23 aa, Giardia lamblia
PQLSGSQRPQLNDKARPRSPYDS

SEQ ID NO: 3128238 - protein, 5 aa, Giardia lamblia
PQNIP

SEQ ID NO: 3128239 - protein, 15 aa, Giardia lamblia
PQNPAPDNAKGAANL

SEQ ID NO: 3128240 - protein, 8 aa, Giardia lamblia
PQNPNRKD

SEQ ID NO: 3128241 - protein, 8 aa, Giardia lamblia
PQNQPGTE

SEQ ID NO: 3128242 - protein, 7 aa, Giardia lamblia
PQNRDAP

SEQ ID NO: 3128243 - protein, 6 aa, Giardia lamblia
PQNSCS

SEQ ID NO: 3128244 - protein, 9 aa, Giardia lamblia
PQNSGRDPF

SEQ ID NO: 3128245 - protein, 5 aa, Giardia lamblia
PQNTY

SEQ ID NO: 3128246 - protein, 5 aa, Giardia lamblia
PQNVY

SEQ ID NO: 3128247 - protein, 7 aa, Giardia lamblia
PQPAKTL

SEQ ID NO: 3128248 - protein, 10 aa, Giardia lamblia
PQPESHPRDY

SEQ ID NO: 3128249 - protein, 5 aa, Giardia lamblia
PQPFA

SEQ ID NO: 3128250 - protein, 14 aa, Giardia lamblia
PQPHKASKYSEHPS

SEQ ID NO: 3128251 - protein, 11 aa, Giardia lamblia
PQPKTDNETVQ

SEQ ID NO: 3128252 - protein, 4 aa, Giardia lamblia
PQPL

SEQ ID NO: 3128253 - protein, 6 aa, Giardia lamblia
PQPPQP

SEQ ID NO: 3128254 - protein, 8 aa, Giardia lamblia
PQPPQTLH

SEQ ID NO: 3128255 - protein, 5 aa, Giardia lamblia
PQPSD

SEQ ID NO: 3128256 - protein, 9 aa, Giardia lamblia
PQPYPTSYY

SEQ ID NO: 3128257 - protein, 5 aa, Giardia lamblia
PQPYQ

SEQ ID NO: 3128258 - protein, 19 aa, Giardia lamblia
PQQDALPKQPSPAGRLPAP

SEQ ID NO: 3128259 - protein, 7 aa, Giardia lamblia
PQQENGY

SEQ ID NO: 3128260 - protein, 4 aa, Giardia lamblia
PQQG

SEQ ID NO: 3128261 - protein, 5 aa, Giardia lamblia
PQQHN

SEQ ID NO: 3128262 - protein, 5 aa, Giardia lamblia
PQQKD

SEQ ID NO: 3128263 - protein, 12 aa, Giardia lamblia
PQQNQKSQQAIK

SEQ ID NO: 3128264 - protein, 10 aa, Giardia lamblia
PQQNTGHSAA

SEQ ID NO: 3128265 - protein, 8 aa, Giardia lamblia
PQQNTRHP

SEQ ID NO: 3128266 - protein, 11 aa, Giardia lamblia
PQQPMGSNTTP

SEQ ID NO: 3128267 - protein, 13 aa, Giardia lamblia
PQQPSPAPEQKVE

SEQ ID NO: 3128268 - protein, 18 aa, Giardia lamblia
PQQRRQSNSLTKPETLSE

SEQ ID NO: 3128269 - protein, 11 aa, Giardia lamblia
PQRDAFGSQPP

SEQ ID NO: 3128270 - protein, 20 aa, Giardia lamblia
PQRETGAESVGTSAANMPTY

SEQ ID NO: 3128271 - protein, 4 aa, Giardia lamblia
PQRN

SEQ ID NO: 3128272 - protein, 8 aa, Giardia lamblia
PQRPPHAD

SEQ ID NO: 3128273 - protein, 6 aa, Giardia lamblia
PQRQRY

SEQ ID NO: 3128274 - protein, 9 aa, Giardia lamblia
PQRRPSAGE

SEQ ID NO: 3128275 - protein, 5 aa, Giardia lamblia
PQRTI

SEQ ID NO: 3128276 - protein, 22 aa, Giardia lamblia
PQRYAEAQGPNRLGESAIPDRA

SEQ ID NO: 3128277 - protein, 7 aa, Giardia lamblia
PQSFGEY

SEQ ID NO: 3128278 - protein, 5 aa, Giardia lamblia
PQSFY

SEQ ID NO: 3128279 - protein, 12 aa, Giardia lamblia
PQSGGRDPIVSE

SEQ ID NO: 3128280 - protein, 11 aa, Giardia lamblia
PQSHPARDSQD

SEQ ID NO: 3128281 - protein, 17 aa, Giardia lamblia
PQSKYDTHGKVPGLEDP

SEQ ID NO: 3128282 - protein, 49 aa, Giardia lamblia
PQSPARRPHTHSSNLNARERYTESKALTASATTPANELEQSASMEATGV

SEQ ID NO: 3128283 - protein, 13 aa, Giardia lamblia
PQSQGGYAIPNGP

SEQ ID NO: 3128284 - protein, 18 aa, Giardia lamblia
PQSSSSLSSSSKTVENAM

SEQ ID NO: 3128285 - protein, 10 aa, Giardia lamblia
PQSSVQNRAA

SEQ ID NO: 3128286 - protein, 4 aa, Giardia lamblia
PQST

SEQ ID NO: 3128287 - protein, 8 aa, Giardia lamblia
PQSTDVDG

SEQ ID NO: 3128288 - protein, 8 aa, Giardia lamblia
PQSTNETA

SEQ ID NO: 3128289 - protein, 6 aa, Giardia lamblia
PQSTPV

SEQ ID NO: 3128290 - protein, 8 aa, Giardia lamblia
PQSTSVPT

SEQ ID NO: 3128291 - protein, 8 aa, Giardia lamblia
PQSTVAPK

SEQ ID NO: 3128292 - protein, 5 aa, Giardia lamblia
PQSVS

SEQ ID NO: 3128293 - protein, 4 aa, Giardia lamblia
PQSY

SEQ ID NO: 3128294 - protein, 7 aa, Giardia lamblia
PQSYTAA

SEQ ID NO: 3128295 - protein, 8 aa, Giardia lamblia
PQTALSQD

SEQ ID NO: 3128296 - protein, 10 aa, Giardia lamblia
PQTAPPGTRI

SEQ ID NO: 3128297 - protein, 11 aa, Giardia lamblia
PQTDEERSVQT

SEQ ID NO: 3128298 - protein, 10 aa, Giardia lamblia
PQTIAPSFKG

SEQ ID NO: 3128299 - protein, 8 aa, Giardia lamblia
PQTIRGTD

SEQ ID NO: 3128300 - protein, 8 aa, Giardia lamblia
PQTPDEDF

SEQ ID NO: 3128301 - protein, 8 aa, Giardia lamblia
PQTPPRPV

SEQ ID NO: 3128302 - protein, 5 aa, Giardia lamblia
PQTRR

SEQ ID NO: 3128303 - protein, 7 aa, Giardia lamblia
PQTRRHT

SEQ ID NO: 3128304 - protein, 9 aa, Giardia lamblia
PQTSMGDDD

SEQ ID NO: 3128305 - protein, 5 aa, Giardia lamblia
PQTSQ

SEQ ID NO: 3128306 - protein, 10 aa, Giardia lamblia
PQTTKPQVQV

SEQ ID NO: 3128307 - protein, 22 aa, Giardia lamblia
PQVDTCKSDSSPLLTRSSTSDQ

SEQ ID NO: 3128308 - protein, 12 aa, Giardia lamblia
PQVPPKKFAGDT

SEQ ID NO: 3128309 - protein, 11 aa, Giardia lamblia
PQVSEPPHASA

SEQ ID NO: 3128310 - protein, 10 aa, Giardia lamblia
PQVSPKELDA

SEQ ID NO: 3128311 - protein, 13 aa, Giardia lamblia
PQWDQGAPPVPPP

SEQ ID NO: 3128312 - protein, 8 aa, Giardia lamblia
PQYDNDSY

SEQ ID NO: 3128313 - protein, 5 aa, Giardia lamblia
PQYDS

SEQ ID NO: 3128314 - protein, 6 aa, Giardia lamblia
PQYSNG

SEQ ID NO: 3128315 - protein, 17 aa, Giardia lamblia
PQYTSSDKCGSHLSPQV

SEQ ID NO: 3128316 - protein, 24 aa, Giardia lamblia
PRADSTDEDLPHAEELHSDVINSE

SEQ ID NO: 3128317 - protein, 4 aa, Giardia lamblia
PRAE

SEQ ID NO: 3128318 - protein, 5 aa, Giardia lamblia
PRAGH

SEQ ID NO: 3128319 - protein, 11 aa, Giardia lamblia
PRAGKSTGPVD

SEQ ID NO: 3128320 - protein, 5 aa, Giardia lamblia
PRAGT

SEQ ID NO: 3128321 - protein, 4 aa, Giardia lamblia
PRAK

SEQ ID NO: 3128322 - protein, 22 aa, Giardia lamblia
PRAPQSNGGPLRQGLEQSNQSK

SEQ ID NO: 3128323 - protein, 10 aa, Giardia lamblia
PRARESNSEY

SEQ ID NO: 3128324 - protein, 10 aa, Giardia lamblia
PRARRGSINP

SEQ ID NO: 3128325 - protein, 20 aa, Giardia lamblia
PRATPLQDEDIGSEAQAAIR

SEQ ID NO: 3128326 - protein, 8 aa, Giardia lamblia
PRAYNTGA

SEQ ID NO: 3128327 - protein, 5 aa, Giardia lamblia
PRCKE

SEQ ID NO: 3128328 - protein, 8 aa, Giardia lamblia
PRDAPNLS

SEQ ID NO: 3128329 - protein, 14 aa, Giardia lamblia
PRDAPSQDSRQGNE

SEQ ID NO: 3128330 - protein, 9 aa, Giardia lamblia
PRDHRDASA

SEQ ID NO: 3128331 - protein, 4 aa, Giardia lamblia
PRDP

SEQ ID NO: 3128332 - protein, 5 aa, Giardia lamblia
PRDPL

SEQ ID NO: 3128333 - protein, 11 aa, Giardia lamblia
PRDTDDERARK

SEQ ID NO: 3128334 - protein, 12 aa, Giardia lamblia
PREAGQATTSGW

SEQ ID NO: 3128335 - protein, 6 aa, Giardia lamblia
PREGDL

SEQ ID NO: 3128336 - protein, 8 aa, Giardia lamblia
PREGEGAT

SEQ ID NO: 3128337 - protein, 13 aa, Giardia lamblia
PREGGFAYKPGSL

SEQ ID NO: 3128338 - protein, 17 aa, Giardia lamblia
PREGKAFGKAARANTIN

SEQ ID NO: 3128339 - protein, 6 aa, Giardia lamblia
PREGQI

SEQ ID NO: 3128340 - protein, 17 aa, Giardia lamblia
PREKPPVVSPAAKPRDL

SEQ ID NO: 3128341 - protein, 5 aa, Giardia lamblia
PREPE

SEQ ID NO: 3128342 - protein, 16 aa, Giardia lamblia
PREPSASGSRRRSSTV

SEQ ID NO: 3128343 - protein, 11 aa, Giardia lamblia
PREQSAADARI

SEQ ID NO: 3128344 - protein, 7 aa, Giardia lamblia
PRERRAI

SEQ ID NO: 3128345 - protein, 8 aa, Giardia lamblia
PRESPHAL

SEQ ID NO: 3128346 - protein, 7 aa, Giardia lamblia
PRETEIS

SEQ ID NO: 3128347 - protein, 4 aa, Giardia lamblia
PRFN

SEQ ID NO: 3128348 - protein, 4 aa, Giardia lamblia
PRGA

SEQ ID NO: 3128349 - protein, 6 aa, Giardia lamblia
PRGDPV

SEQ ID NO: 3128350 - protein, 14 aa, Giardia lamblia
PRGEAEGKPSKDEL

SEQ ID NO: 3128351 - protein, 4 aa, Giardia lamblia
PRGR

SEQ ID NO: 3128352 - protein, 18 aa, Giardia lamblia
PRGRQEDTERESSTHPDM

SEQ ID NO: 3128353 - protein, 8 aa, Giardia lamblia
PRGSGRHT

SEQ ID NO: 3128354 - protein, 13 aa, Giardia lamblia
PRGSRESSESAQH

SEQ ID NO: 3128355 - protein, 7 aa, Giardia lamblia
PRGSTSL

SEQ ID NO: 3128356 - protein, 7 aa, Giardia lamblia
PRGTSPL

SEQ ID NO: 3128357 - protein, 5 aa, Giardia lamblia
PRGVR

SEQ ID NO: 3128358 - protein, 10 aa, Giardia lamblia
PRHAPDPGDF

SEQ ID NO: 3128359 - protein, 4 aa, Giardia lamblia
PRHI

SEQ ID NO: 3128360 - protein, 4 aa, Giardia lamblia
PRHP

SEQ ID NO: 3128361 - protein, 20 aa, Giardia lamblia
PRHSSPTKQPAALSSDTDLN

SEQ ID NO: 3128362 - protein, 16 aa, Giardia lamblia
PRIPSAPTKKNLSGIP

SEQ ID NO: 3128363 - protein, 38 aa, Giardia lamblia
PRISRPSPSRSSPRPALSGSTVSKPTTSTQDKQHTTVD

SEQ ID NO: 3128364 - protein, 9 aa, Giardia lamblia
PRKASPHET

SEQ ID NO: 3128365 - protein, 13 aa, Giardia lamblia
PRKDGTVKLPNGA

SEQ ID NO: 3128366 - protein, 10 aa, Giardia lamblia
PRKGQINPAT

SEQ ID NO: 3128367 - protein, 7 aa, Giardia lamblia
PRKHGGI

SEQ ID NO: 3128368 - protein, 4 aa, Giardia lamblia
PRKP

SEQ ID NO: 3128369 - protein, 19 aa, Giardia lamblia
PRKRPTAAEALEHPWLKHV

SEQ ID NO: 3128370 - protein, 8 aa, Giardia lamblia
PRKSSAYT

SEQ ID NO: 3128371 - protein, 9 aa, Giardia lamblia
PRKTRRGNR

SEQ ID NO: 3128372 - protein, 4 aa, Giardia lamblia
PRLA

SEQ ID NO: 3128373 - protein, 12 aa, Giardia lamblia
PRLENDPTKPDF

SEQ ID NO: 3128374 - protein, 4 aa, Giardia lamblia
PRLG

SEQ ID NO: 3128375 - protein, 10 aa, Giardia lamblia
PRLGEDQPRY

SEQ ID NO: 3128376 - protein, 17 aa, Giardia lamblia
PRLSDKKNKTNAHMFEL

SEQ ID NO: 3128377 - protein, 13 aa, Giardia lamblia
PRMATLPDTPDIS

SEQ ID NO: 3128378 - protein, 6 aa, Giardia lamblia
PRMGHP

SEQ ID NO: 3128379 - protein, 7 aa, Giardia lamblia
PRNEKQS

SEQ ID NO: 3128380 - protein, 8 aa, Giardia lamblia
PRNIPDDS

SEQ ID NO: 3128381 - protein, 5 aa, Giardia lamblia
PRNQQ

SEQ ID NO: 3128382 - protein, 65 aa, Giardia lamblia
PRNTLDPLPSKALPPAMEADTSNNDQFTSKDKLEQGPCEPVPTQEDGPPANKQEDKEDGCDFSEP

SEQ ID NO: 3128383 - protein, 18 aa, Giardia lamblia
PRPDATVDAASYTRGTIG

SEQ ID NO: 3128384 - protein, 7 aa, Giardia lamblia
PRPDNKV

SEQ ID NO: 3128385 - protein, 9 aa, Giardia lamblia
PRPDPTPEL

SEQ ID NO: 3128386 - protein, 11 aa, Giardia lamblia
PRPERRPSTDD

SEQ ID NO: 3128387 - protein, 10 aa, Giardia lamblia
PRPGAEHDAT

SEQ ID NO: 3128388 - protein, 7 aa, Giardia lamblia
PRPGKGV

SEQ ID NO: 3128389 - protein, 5 aa, Giardia lamblia
PRPLP

SEQ ID NO: 3128390 - protein, 6 aa, Giardia lamblia
PRPMAG

SEQ ID NO: 3128391 - protein, 5 aa, Giardia lamblia
PRPPP

SEQ ID NO: 3128392 - protein, 4 aa, Giardia lamblia
PRPS

SEQ ID NO: 3128393 - protein, 14 aa, Giardia lamblia
PRPSHKESSRDEIP

SEQ ID NO: 3128394 - protein, 9 aa, Giardia lamblia
PRPTNGPHG

SEQ ID NO: 3128395 - protein, 9 aa, Giardia lamblia
PRPTTGATP

SEQ ID NO: 3128396 - protein, 14 aa, Giardia lamblia
PRPVKKATKETPTF

SEQ ID NO: 3128397 - protein, 10 aa, Giardia lamblia
PRPVSEEDDT

SEQ ID NO: 3128398 - protein, 10 aa, Giardia lamblia
PRQAGGSNTA

SEQ ID NO: 3128399 - protein, 10 aa, Giardia lamblia
PRQGEGNQSY

SEQ ID NO: 3128400 - protein, 14 aa, Giardia lamblia
PRQGTLTDTQKEQI

SEQ ID NO: 3128401 - protein, 11 aa, Giardia lamblia
PRQMATDTSSV

SEQ ID NO: 3128402 - protein, 8 aa, Giardia lamblia
PRQRREAP

SEQ ID NO: 3128403 - protein, 25 aa, Giardia lamblia
PRRDKGPPRSNSTGISLNSNSSLKA

SEQ ID NO: 3128404 - protein, 9 aa, Giardia lamblia
PRREPPQIA

SEQ ID NO: 3128405 - protein, 6 aa, Giardia lamblia
PRRPEG

SEQ ID NO: 3128406 - protein, 10 aa, Giardia lamblia
PRRPGSSQRA

SEQ ID NO: 3128407 - protein, 13 aa, Giardia lamblia
PRRQKPNVSNAEA

SEQ ID NO: 3128408 - protein, 7 aa, Giardia lamblia
PRRRSAA

SEQ ID NO: 3128409 - protein, 10 aa, Giardia lamblia
PRSALQKKKY

SEQ ID NO: 3128410 - protein, 10 aa, Giardia lamblia
PRSAQSPAAP

SEQ ID NO: 3128411 - protein, 8 aa, Giardia lamblia
PRSDDQAR

SEQ ID NO: 3128412 - protein, 5 aa, Giardia lamblia
PRSDF

SEQ ID NO: 3128413 - protein, 5 aa, Giardia lamblia
PRSDG

SEQ ID NO: 3128414 - protein, 7 aa, Giardia lamblia
PRSEDCA

SEQ ID NO: 3128415 - protein, 15 aa, Giardia lamblia
PRSESQAAALRASPD

SEQ ID NO: 3128416 - protein, 7 aa, Giardia lamblia
PRSGHGE

SEQ ID NO: 3128417 - protein, 6 aa, Giardia lamblia
PRSLEA

SEQ ID NO: 3128418 - protein, 15 aa, Giardia lamblia
PRSMSSGATAMSPAQ

SEQ ID NO: 3128419 - protein, 10 aa, Giardia lamblia
PRSNDDDCKS

SEQ ID NO: 3128420 - protein, 11 aa, Giardia lamblia
PRSNSASTDNA

SEQ ID NO: 3128421 - protein, 23 aa, Giardia lamblia
PRSPESRSVPAPSHRIPSPQPYT

SEQ ID NO: 3128422 - protein, 7 aa, Giardia lamblia
PRSPTHS

SEQ ID NO: 3128423 - protein, 12 aa, Giardia lamblia
PRSRKAADKRAL

SEQ ID NO: 3128424 - protein, 10 aa, Giardia lamblia
PRSRTKDPRV

SEQ ID NO: 3128425 - protein, 12 aa, Giardia lamblia
PRSSGASLSPHD

SEQ ID NO: 3128426 - protein, 5 aa, Giardia lamblia
PRSSS

SEQ ID NO: 3128427 - protein, 11 aa, Giardia lamblia
PRSSSTKQIRN

SEQ ID NO: 3128428 - protein, 7 aa, Giardia lamblia
PRSTNAD

SEQ ID NO: 3128429 - protein, 19 aa, Giardia lamblia
PRSTPTKLSATNSPIAGVP

SEQ ID NO: 3128430 - protein, 11 aa, Giardia lamblia
PRSYSASAGHL

SEQ ID NO: 3128431 - protein, 7 aa, Giardia lamblia
PRTAAST

SEQ ID NO: 3128432 - protein, 5 aa, Giardia lamblia
PRTAP

SEQ ID NO: 3128433 - protein, 4 aa, Giardia lamblia
PRTC

SEQ ID NO: 3128434 - protein, 5 aa, Giardia lamblia
PRTGI

SEQ ID NO: 3128435 - protein, 7 aa, Giardia lamblia
PRTPNMS

SEQ ID NO: 3128436 - protein, 5 aa, Giardia lamblia
PRTQP

SEQ ID NO: 3128437 - protein, 4 aa, Giardia lamblia
PRTS

SEQ ID NO: 3128438 - protein, 18 aa, Giardia lamblia
PRTSATSTSGELSREDRC

SEQ ID NO: 3128439 - protein, 10 aa, Giardia lamblia
PRTSSSVPEL

SEQ ID NO: 3128440 - protein, 5 aa, Giardia lamblia
PRTVA

SEQ ID NO: 3128441 - protein, 14 aa, Giardia lamblia
PRTYDEDNPPYGPY

SEQ ID NO: 3128442 - protein, 5 aa, Giardia lamblia
PRVDQ

SEQ ID NO: 3128443 - protein, 7 aa, Giardia lamblia
PRVGEQR

SEQ ID NO: 3128444 - protein, 13 aa, Giardia lamblia
PRVPTASSRKSVK

SEQ ID NO: 3128445 - protein, 7 aa, Giardia lamblia
PRVSGSR

SEQ ID NO: 3128446 - protein, 10 aa, Giardia lamblia
PRVSSSPRPA

SEQ ID NO: 3128447 - protein, 4 aa, Giardia lamblia
PRYA

SEQ ID NO: 3128448 - protein, 19 aa, Giardia lamblia
PRYPTPDSVGVTASSTNEL

SEQ ID NO: 3128449 - protein, 12 aa, Giardia lamblia
PRYRTQGQHDNH

SEQ ID NO: 3128450 - protein, 12 aa, Giardia lamblia
PRYSSVDQNDLD

SEQ ID NO: 3128451 - protein, 9 aa, Giardia lamblia
PSAADSSQK

SEQ ID NO: 3128452 - protein, 15 aa, Giardia lamblia
PSAADSSTGAGDAAD

SEQ ID NO: 3128453 - protein, 32 aa, Giardia lamblia
PSAESGGKRSHSAGADSNSTTSDYDEDDSLDE

SEQ ID NO: 3128454 - protein, 7 aa, Giardia lamblia
PSAEYRP

SEQ ID NO: 3128455 - protein, 7 aa, Giardia lamblia
PSAFPEA

SEQ ID NO: 3128456 - protein, 23 aa, Giardia lamblia
PSAFSKPSDNAAQAGAQLNTQNL

SEQ ID NO: 3128457 - protein, 5 aa, Giardia lamblia
PSAIN

SEQ ID NO: 3128458 - protein, 29 aa, Giardia lamblia
PSALPKAHAPDTRKSSASGNSRTKCSTHV

SEQ ID NO: 3128459 - protein, 6 aa, Giardia lamblia
PSALPS

SEQ ID NO: 3128460 - protein, 7 aa, Giardia lamblia
PSALPTW

SEQ ID NO: 3128461 - protein, 8 aa, Giardia lamblia
PSANAHAN

SEQ ID NO: 3128462 - protein, 7 aa, Giardia lamblia
PSANGVS

SEQ ID NO: 3128463 - protein, 9 aa, Giardia lamblia
PSANITKGD

SEQ ID NO: 3128464 - protein, 4 aa, Giardia lamblia
PSAP

SEQ ID NO: 3128465 - protein, 20 aa, Giardia lamblia
PSAPLQKTGPREIKHLVLYS

SEQ ID NO: 3128466 - protein, 10 aa, Giardia lamblia
PSAPPAATLA

SEQ ID NO: 3128467 - protein, 8 aa, Giardia lamblia
PSAPQDLS

SEQ ID NO: 3128468 - protein, 12 aa, Giardia lamblia
PSARDPRPELGP

SEQ ID NO: 3128469 - protein, 6 aa, Giardia lamblia
PSASLA

SEQ ID NO: 3128470 - protein, 10 aa, Giardia lamblia
PSASSSTRWT

SEQ ID NO: 3128471 - protein, 8 aa, Giardia lamblia
PSASTTQF

SEQ ID NO: 3128472 - protein, 10 aa, Giardia lamblia
PSATLPTPPL

SEQ ID NO: 3128473 - protein, 5 aa, Giardia lamblia
PSATN

SEQ ID NO: 3128474 - protein, 6 aa, Giardia lamblia
PSAVQN

SEQ ID NO: 3128475 - protein, 12 aa, Giardia lamblia
PSCQKDDCEEEH

SEQ ID NO: 3128476 - protein, 5 aa, Giardia lamblia
PSCRP

SEQ ID NO: 3128477 - protein, 28 aa, Giardia lamblia
PSCTRSKEPARPPVSARTASRIDTGSSQ

SEQ ID NO: 3128478 - protein, 5 aa, Giardia lamblia
PSDAE

SEQ ID NO: 3128479 - protein, 9 aa, Giardia lamblia
PSDAPPSLA

SEQ ID NO: 3128480 - protein, 11 aa, Giardia lamblia
PSDARSNREKR

SEQ ID NO: 3128481 - protein, 8 aa, Giardia lamblia
PSDASEIT

SEQ ID NO: 3128482 - protein, 22 aa, Giardia lamblia
PSDDDDDDSDRKHSKDEDTDDE

SEQ ID NO: 3128483 - protein, 10 aa, Giardia lamblia
PSDDKPKPTQ

SEQ ID NO: 3128484 - protein, 7 aa, Giardia lamblia
PSDDTKA

SEQ ID NO: 3128485 - protein, 6 aa, Giardia lamblia
PSDEPS

SEQ ID NO: 3128486 - protein, 8 aa, Giardia lamblia
PSDEPVNI

SEQ ID NO: 3128487 - protein, 10 aa, Giardia lamblia
PSDESHSFPS

SEQ ID NO: 3128488 - protein, 10 aa, Giardia lamblia
PSDGASSKGV

SEQ ID NO: 3128489 - protein, 14 aa, Giardia lamblia
PSDGHSSRVPCGHL

SEQ ID NO: 3128490 - protein, 36 aa, Giardia lamblia
PSDGTELSMRTSSPSGVLRKSSNPEQYKKHAEELNR

SEQ ID NO: 3128491 - protein, 4 aa, Giardia lamblia
PSDI

SEQ ID NO: 3128492 - protein, 15 aa, Giardia lamblia
PSDIESSIKDGANEL

SEQ ID NO: 3128493 - protein, 16 aa, Giardia lamblia
PSDLQPQLPGSHPPPL

SEQ ID NO: 3128494 - protein, 14 aa, Giardia lamblia
PSDLQQKARAPEAS

SEQ ID NO: 3128495 - protein, 9 aa, Giardia lamblia
PSDNAHEKL

SEQ ID NO: 3128496 - protein, 17 aa, Giardia lamblia
PSDPTEPPKAKRTKAVP

SEQ ID NO: 3128497 - protein, 6 aa, Giardia lamblia
PSDPVP

SEQ ID NO: 3128498 - protein, 7 aa, Giardia lamblia
PSDQEAR

SEQ ID NO: 3128499 - protein, 5 aa, Giardia lamblia
PSDQQ

SEQ ID NO: 3128500 - protein, 7 aa, Giardia lamblia
PSDRDGL

SEQ ID NO: 3128501 - protein, 5 aa, Giardia lamblia
PSDSF

SEQ ID NO: 3128502 - protein, 6 aa, Giardia lamblia
PSDSIS

SEQ ID NO: 3128503 - protein, 8 aa, Giardia lamblia
PSDSPFSK

SEQ ID NO: 3128504 - protein, 5 aa, Giardia lamblia
PSDTE

SEQ ID NO: 3128505 - protein, 17 aa, Giardia lamblia
PSDTKSMSTSASSAIKA

SEQ ID NO: 3128506 - protein, 10 aa, Giardia lamblia
PSDVANRGEQ

SEQ ID NO: 3128507 - protein, 9 aa, Giardia lamblia
PSDVSDPTL

SEQ ID NO: 3128508 - protein, 4 aa, Giardia lamblia
PSDY

SEQ ID NO: 3128509 - protein, 4 aa, Giardia lamblia
PSEA

SEQ ID NO: 3128510 - protein, 6 aa, Giardia lamblia
PSEAPE

SEQ ID NO: 3128511 - protein, 9 aa, Giardia lamblia
PSEEDKRRC

SEQ ID NO: 3128512 - protein, 9 aa, Giardia lamblia
PSEEGYAAL

SEQ ID NO: 3128513 - protein, 9 aa, Giardia lamblia
PSEEHEQSW

SEQ ID NO: 3128514 - protein, 7 aa, Giardia lamblia
PSEETCA

SEQ ID NO: 3128515 - protein, 6 aa, Giardia lamblia
PSEETL

SEQ ID NO: 3128516 - protein, 6 aa, Giardia lamblia
PSEITD

SEQ ID NO: 3128517 - protein, 22 aa, Giardia lamblia
PSEKAVSTKNSRVGSTSAIQPA

SEQ ID NO: 3128518 - protein, 8 aa, Giardia lamblia
PSEKFPEP

SEQ ID NO: 3128519 - protein, 14 aa, Giardia lamblia
PSELGSGGADSGTI

SEQ ID NO: 3128520 - protein, 5 aa, Giardia lamblia
PSELQ

SEQ ID NO: 3128521 - protein, 8 aa, Giardia lamblia
PSELSSEA

SEQ ID NO: 3128522 - protein, 4 aa, Giardia lamblia
PSEN

SEQ ID NO: 3128523 - protein, 7 aa, Giardia lamblia
PSEQEYT

SEQ ID NO: 3128524 - protein, 6 aa, Giardia lamblia
PSERDE

SEQ ID NO: 3128525 - protein, 7 aa, Giardia lamblia
PSESDTI

SEQ ID NO: 3128526 - protein, 5 aa, Giardia lamblia
PSESI

SEQ ID NO: 3128527 - protein, 6 aa, Giardia lamblia
PSESTM

SEQ ID NO: 3128528 - protein, 11 aa, Giardia lamblia
PSETESKQSYV

SEQ ID NO: 3128529 - protein, 5 aa, Giardia lamblia
PSEVP

SEQ ID NO: 3128530 - protein, 5 aa, Giardia lamblia
PSEVS

SEQ ID NO: 3128531 - protein, 5 aa, Giardia lamblia
PSFAR

SEQ ID NO: 3128532 - protein, 8 aa, Giardia lamblia
PSFDSQTK

SEQ ID NO: 3128533 - protein, 12 aa, Giardia lamblia
PSFGSPSVGLAS

SEQ ID NO: 3128534 - protein, 32 aa, Giardia lamblia
PSFQGGEGLPGQQFSSQSSWASQQVSAPAPTL

SEQ ID NO: 3128535 - protein, 4 aa, Giardia lamblia
PSGA

SEQ ID NO: 3128536 - protein, 6 aa, Giardia lamblia
PSGAEK

SEQ ID NO: 3128537 - protein, 4 aa, Giardia lamblia
PSGE

SEQ ID NO: 3128538 - protein, 4 aa, Giardia lamblia
PSGK

SEQ ID NO: 3128539 - protein, 4 aa, Giardia lamblia
PSGL

SEQ ID NO: 3128540 - protein, 16 aa, Giardia lamblia
PSGNDSHEVSASSPDH

SEQ ID NO: 3128541 - protein, 27 aa, Giardia lamblia
PSGNKRSSEVGSSTYSHPISKDADISS

SEQ ID NO: 3128542 - protein, 7 aa, Giardia lamblia
PSGNPFT

SEQ ID NO: 3128543 - protein, 9 aa, Giardia lamblia
PSGNPLSDP

SEQ ID NO: 3128544 - protein, 5 aa, Giardia lamblia
PSGPF

SEQ ID NO: 3128545 - protein, 10 aa, Giardia lamblia
PSGPGSDSLF

SEQ ID NO: 3128546 - protein, 14 aa, Giardia lamblia
PSGPLPKPPAHESL

SEQ ID NO: 3128547 - protein, 13 aa, Giardia lamblia
PSGSSADVPVQDS

SEQ ID NO: 3128548 - protein, 7 aa, Giardia lamblia
PSGSTKP

SEQ ID NO: 3128549 - protein, 7 aa, Giardia lamblia
PSGSVTE

SEQ ID NO: 3128550 - protein, 7 aa, Giardia lamblia
PSGTEPK

SEQ ID NO: 3128551 - protein, 15 aa, Giardia lamblia
PSGYAVGGDKRSYKE

SEQ ID NO: 3128552 - protein, 26 aa, Giardia lamblia
PSHASSARQGDAPPPSSYSKEGSEEI

SEQ ID NO: 3128553 - protein, 6 aa, Giardia lamblia
PSHDLT

SEQ ID NO: 3128554 - protein, 9 aa, Giardia lamblia
PSHDSQHQT

SEQ ID NO: 3128555 - protein, 4 aa, Giardia lamblia
PSHG

SEQ ID NO: 3128556 - protein, 6 aa, Giardia lamblia
PSHGLT

SEQ ID NO: 3128557 - protein, 7 aa, Giardia lamblia
PSHGRSG

SEQ ID NO: 3128558 - protein, 8 aa, Giardia lamblia
PSHMTERG

SEQ ID NO: 3128559 - protein, 5 aa, Giardia lamblia
PSHNS

SEQ ID NO: 3128560 - protein, 24 aa, Giardia lamblia
PSHPVSKDLSTEKLQKAEESSSSE

SEQ ID NO: 3128561 - protein, 4 aa, Giardia lamblia
PSHQ

SEQ ID NO: 3128562 - protein, 5 aa, Giardia lamblia
PSHSN

SEQ ID NO: 3128563 - protein, 5 aa, Giardia lamblia
PSHSS

SEQ ID NO: 3128564 - protein, 7 aa, Giardia lamblia
PSHSTIT

SEQ ID NO: 3128565 - protein, 8 aa, Giardia lamblia
PSHSTPME

SEQ ID NO: 3128566 - protein, 5 aa, Giardia lamblia
PSHTQ

SEQ ID NO: 3128567 - protein, 13 aa, Giardia lamblia
PSIAPRNGERPCK

SEQ ID NO: 3128568 - protein, 13 aa, Giardia lamblia
PSIASNNRAGSVT

SEQ ID NO: 3128569 - protein, 7 aa, Giardia lamblia
PSIDAPA

SEQ ID NO: 3128570 - protein, 35 aa, Giardia lamblia
PSIETDSDRFATNQTSKQPTPASTLESAPASSSAV

SEQ ID NO: 3128571 - protein, 5 aa, Giardia lamblia
PSIHT

SEQ ID NO: 3128572 - protein, 6 aa, Giardia lamblia
PSIKEK

SEQ ID NO: 3128573 - protein, 7 aa, Giardia lamblia
PSIPPSK

SEQ ID NO: 3128574 - protein, 10 aa, Giardia lamblia
PSISISQEEY

SEQ ID NO: 3128575 - protein, 5 aa, Giardia lamblia
PSIST

SEQ ID NO: 3128576 - protein, 6 aa, Giardia lamblia
PSISTA

SEQ ID NO: 3128577 - protein, 6 aa, Giardia lamblia
PSIYGP

SEQ ID NO: 3128578 - protein, 4 aa, Giardia lamblia
PSKA

SEQ ID NO: 3128579 - protein, 8 aa, Giardia lamblia
PSKAQFSQ

SEQ ID NO: 3128580 - protein, 4 aa, Giardia lamblia
PSKD

SEQ ID NO: 3128581 - protein, 13 aa, Giardia lamblia
PSKDLAQGKDGEF

SEQ ID NO: 3128582 - protein, 6 aa, Giardia lamblia
PSKDQL

SEQ ID NO: 3128583 - protein, 7 aa, Giardia lamblia
PSKDRQA

SEQ ID NO: 3128584 - protein, 10 aa, Giardia lamblia
PSKEKTSGSV

SEQ ID NO: 3128585 - protein, 34 aa, Giardia lamblia
PSKETPPRSSADRTGNKKDDYDGDTNCHEEGRPL

SEQ ID NO: 3128586 - protein, 5 aa, Giardia lamblia
PSKFG

SEQ ID NO: 3128587 - protein, 7 aa, Giardia lamblia
PSKGARN

SEQ ID NO: 3128588 - protein, 4 aa, Giardia lamblia
PSKI

SEQ ID NO: 3128589 - protein, 7 aa, Giardia lamblia
PSKKNGL

SEQ ID NO: 3128590 - protein, 7 aa, Giardia lamblia
PSKLEED

SEQ ID NO: 3128591 - protein, 7 aa, Giardia lamblia
PSKPIGD

SEQ ID NO: 3128592 - protein, 9 aa, Giardia lamblia
PSKPPPPIN

SEQ ID NO: 3128593 - protein, 10 aa, Giardia lamblia
PSKRLEGQLP

SEQ ID NO: 3128594 - protein, 6 aa, Giardia lamblia
PSKSEF

SEQ ID NO: 3128595 - protein, 11 aa, Giardia lamblia
PSKSKQEGDGV

SEQ ID NO: 3128596 - protein, 32 aa, Giardia lamblia
PSKSPQDNSVDELTTSTSDPALITDGDGVKEP

SEQ ID NO: 3128597 - protein, 12 aa, Giardia lamblia
PSKTSSRPTPSA

SEQ ID NO: 3128598 - protein, 11 aa, Giardia lamblia
PSKVSADKNTE

SEQ ID NO: 3128599 - protein, 7 aa, Giardia lamblia
PSLAGES

SEQ ID NO: 3128600 - protein, 10 aa, Giardia lamblia
PSLATGTDDV

SEQ ID NO: 3128601 - protein, 17 aa, Giardia lamblia
PSLDSQTSDGEQARKFL

SEQ ID NO: 3128602 - protein, 7 aa, Giardia lamblia
PSLDTHA

SEQ ID NO: 3128603 - protein, 8 aa, Giardia lamblia
PSLGQSDA

SEQ ID NO: 3128604 - protein, 10 aa, Giardia lamblia
PSLKREQAEA

SEQ ID NO: 3128605 - protein, 4 aa, Giardia lamblia
PSLN

SEQ ID NO: 3128606 - protein, 7 aa, Giardia lamblia
PSLPEDK

SEQ ID NO: 3128607 - protein, 12 aa, Giardia lamblia
PSLPETGVSTET

SEQ ID NO: 3128608 - protein, 7 aa, Giardia lamblia
PSLPNTL

SEQ ID NO: 3128609 - protein, 5 aa, Giardia lamblia
PSLPQ

SEQ ID NO: 3128610 - protein, 8 aa, Giardia lamblia
PSLPQVGD

SEQ ID NO: 3128611 - protein, 11 aa, Giardia lamblia
PSLRADQPGTL

SEQ ID NO: 3128612 - protein, 58 aa, Giardia lamblia
PSLRATPKSFDGARLDGTPSSPHTGSLANSGTASSDPRQGKATSMQGVADDADSPERR

SEQ ID NO: 3128613 - protein, 7 aa, Giardia lamblia
PSLRPTG

SEQ ID NO: 3128614 - protein, 11 aa, Giardia lamblia
PSLSGADGSEV

SEQ ID NO: 3128615 - protein, 8 aa, Giardia lamblia
PSLSGDSK

SEQ ID NO: 3128616 - protein, 10 aa, Giardia lamblia
PSLSTTQEKA

SEQ ID NO: 3128617 - protein, 26 aa, Giardia lamblia
PSLTPNCQSAQSQQALRTPRRTPTLT

SEQ ID NO: 3128618 - protein, 9 aa, Giardia lamblia
PSLTSVQAT

SEQ ID NO: 3128619 - protein, 24 aa, Giardia lamblia
PSLTSVSRSATTPPRTKKKSEPVP

SEQ ID NO: 3128620 - protein, 105 aa, Giardia lamblia
PSLYGAPQGYGAPAQSYGAPQQPQQPGYGASAPGYGAPVQSYGAPAQQPYGAPQQQQYGGQQPQAQMGYGQPSPYGASQSSYGGGVGQGQQSYGMPQAGAPSYGG

SEQ ID NO: 3128621 - protein, 4 aa, Giardia lamblia
PSMS

SEQ ID NO: 3128622 - protein, 19 aa, Giardia lamblia
PSMSASRRRSSTSSSSSFS

SEQ ID NO: 3128623 - protein, 5 aa, Giardia lamblia
PSNDM

SEQ ID NO: 3128624 - protein, 15 aa, Giardia lamblia
PSNKGLGPEHNKQTR

SEQ ID NO: 3128625 - protein, 5 aa, Giardia lamblia
PSNLD

SEQ ID NO: 3128626 - protein, 10 aa, Giardia lamblia
PSNLTTNTSG

SEQ ID NO: 3128627 - protein, 4 aa, Giardia lamblia
PSNN

SEQ ID NO: 3128628 - protein, 5 aa, Giardia lamblia
PSNPA

SEQ ID NO: 3128629 - protein, 6 aa, Giardia lamblia
PSNRRL

SEQ ID NO: 3128630 - protein, 7 aa, Giardia lamblia
PSNTATD

SEQ ID NO: 3128631 - protein, 4 aa, Giardia lamblia
PSNV

SEQ ID NO: 3128632 - protein, 4 aa, Giardia lamblia
PSNY

SEQ ID NO: 3128633 - protein, 4 aa, Giardia lamblia
PSPA

SEQ ID NO: 3128634 - protein, 8 aa, Giardia lamblia
PSPATNGV

SEQ ID NO: 3128635 - protein, 6 aa, Giardia lamblia
PSPATR

SEQ ID NO: 3128636 - protein, 5 aa, Giardia lamblia
PSPEI

SEQ ID NO: 3128637 - protein, 5 aa, Giardia lamblia
PSPEQ

SEQ ID NO: 3128638 - protein, 5 aa, Giardia lamblia
PSPER

SEQ ID NO: 3128639 - protein, 12 aa, Giardia lamblia
PSPGPPGSPPEA

SEQ ID NO: 3128640 - protein, 7 aa, Giardia lamblia
PSPGSQH

SEQ ID NO: 3128641 - protein, 6 aa, Giardia lamblia
PSPGTI

SEQ ID NO: 3128642 - protein, 4 aa, Giardia lamblia
PSPI

SEQ ID NO: 3128643 - protein, 6 aa, Giardia lamblia
PSPKIT

SEQ ID NO: 3128644 - protein, 6 aa, Giardia lamblia
PSPKLV

SEQ ID NO: 3128645 - protein, 24 aa, Giardia lamblia
PSPLAKHRGKQLQTSGYGLRWPLR

SEQ ID NO: 3128646 - protein, 6 aa, Giardia lamblia
PSPLKE

SEQ ID NO: 3128647 - protein, 13 aa, Giardia lamblia
PSPLPLNTPEPQL

SEQ ID NO: 3128648 - protein, 7 aa, Giardia lamblia
PSPMSYD

SEQ ID NO: 3128649 - protein, 7 aa, Giardia lamblia
PSPNALK

SEQ ID NO: 3128650 - protein, 17 aa, Giardia lamblia
PSPPDSPKPGEANPREV

SEQ ID NO: 3128651 - protein, 23 aa, Giardia lamblia
PSPPRGHPGRSPSLSPSRRPSIP

SEQ ID NO: 3128652 - protein, 4 aa, Giardia lamblia
PSPQ

SEQ ID NO: 3128653 - protein, 25 aa, Giardia lamblia
PSPREARAAKEKQKTLVDSSGKREI

SEQ ID NO: 3128654 - protein, 6 aa, Giardia lamblia
PSPRGS

SEQ ID NO: 3128655 - protein, 12 aa, Giardia lamblia
PSPRRQVKTGYR

SEQ ID NO: 3128656 - protein, 4 aa, Giardia lamblia
PSPS

SEQ ID NO: 3128657 - protein, 5 aa, Giardia lamblia
PSPSL

SEQ ID NO: 3128658 - protein, 8 aa, Giardia lamblia
PSPSSNPF

SEQ ID NO: 3128659 - protein, 10 aa, Giardia lamblia
PSPSSTWKPE

SEQ ID NO: 3128660 - protein, 9 aa, Giardia lamblia
PSPSTEAGA

SEQ ID NO: 3128661 - protein, 6 aa, Giardia lamblia
PSPVQQ

SEQ ID NO: 3128662 - protein, 5 aa, Giardia lamblia
PSPYL

SEQ ID NO: 3128663 - protein, 7 aa, Giardia lamblia
PSQAANY

SEQ ID NO: 3128664 - protein, 13 aa, Giardia lamblia
PSQAPDDSPTSIS

SEQ ID NO: 3128665 - protein, 17 aa, Giardia lamblia
PSQDATHHRIGSQNATP

SEQ ID NO: 3128666 - protein, 12 aa, Giardia lamblia
PSQDGVETSESV

SEQ ID NO: 3128667 - protein, 8 aa, Giardia lamblia
PSQDLDKN

SEQ ID NO: 3128668 - protein, 7 aa, Giardia lamblia
PSQGGKS

SEQ ID NO: 3128669 - protein, 8 aa, Giardia lamblia
PSQHKKGW

SEQ ID NO: 3128670 - protein, 6 aa, Giardia lamblia
PSQKDP

SEQ ID NO: 3128671 - protein, 11 aa, Giardia lamblia
PSQPLTPTRSK

SEQ ID NO: 3128672 - protein, 24 aa, Giardia lamblia
PSQPTKLQNMEKGPHERESECSGI

SEQ ID NO: 3128673 - protein, 22 aa, Giardia lamblia
PSQQGNARATSASTSTRHSRRT

SEQ ID NO: 3128674 - protein, 20 aa, Giardia lamblia
PSQRASSIPDHQNAHSNTQT

SEQ ID NO: 3128675 - protein, 6 aa, Giardia lamblia
PSQRET

SEQ ID NO: 3128676 - protein, 7 aa, Giardia lamblia
PSQRPSA

SEQ ID NO: 3128677 - protein, 13 aa, Giardia lamblia
PSQRQAGCSRTIK

SEQ ID NO: 3128678 - protein, 30 aa, Giardia lamblia
PSQRTSEIGSQRKANTSDYPTTPTIGSPGI

SEQ ID NO: 3128679 - protein, 7 aa, Giardia lamblia
PSQTAMP

SEQ ID NO: 3128680 - protein, 7 aa, Giardia lamblia
PSQTPWE

SEQ ID NO: 3128681 - protein, 8 aa, Giardia lamblia
PSRASTAS

SEQ ID NO: 3128682 - protein, 4 aa, Giardia lamblia
PSRC

SEQ ID NO: 3128683 - protein, 14 aa, Giardia lamblia
PSRDRGQPTKEPQE

SEQ ID NO: 3128684 - protein, 37 aa, Giardia lamblia
PSREGKQAKRTNNLAEGQPPDPLTENYDGSDSEQSVV

SEQ ID NO: 3128685 - protein, 13 aa, Giardia lamblia
PSREKTKNASKQF

SEQ ID NO: 3128686 - protein, 18 aa, Giardia lamblia
PSRGFGKTREERKQQEEV

SEQ ID NO: 3128687 - protein, 5 aa, Giardia lamblia
PSRKG

SEQ ID NO: 3128688 - protein, 6 aa, Giardia lamblia
PSRKQH

SEQ ID NO: 3128689 - protein, 7 aa, Giardia lamblia
PSRMDPN

SEQ ID NO: 3128690 - protein, 5 aa, Giardia lamblia
PSRNA

SEQ ID NO: 3128691 - protein, 17 aa, Giardia lamblia
PSRRRRSIKSRQGSELS

SEQ ID NO: 3128692 - protein, 8 aa, Giardia lamblia
PSRSDQGV

SEQ ID NO: 3128693 - protein, 7 aa, Giardia lamblia
PSRSEGE

SEQ ID NO: 3128694 - protein, 9 aa, Giardia lamblia
PSRSGTPTY

SEQ ID NO: 3128695 - protein, 5 aa, Giardia lamblia
PSRSL

SEQ ID NO: 3128696 - protein, 18 aa, Giardia lamblia
PSRSNTVVPRKADDEARA

SEQ ID NO: 3128697 - protein, 8 aa, Giardia lamblia
PSRTPAET

SEQ ID NO: 3128698 - protein, 4 aa, Giardia lamblia
PSRV

SEQ ID NO: 3128699 - protein, 7 aa, Giardia lamblia
PSRYSDG

SEQ ID NO: 3128700 - protein, 4 aa, Giardia lamblia
PSSA

SEQ ID NO: 3128701 - protein, 85 aa, Giardia lamblia
PSSAANVTSASANAAPSLPPPRRYSQPPQDNQPQPAAAAYQDRSPNSQRRQGWGEPAHPTAQDRDSRSHQLNKQSSGPSLSRGSQ

SEQ ID NO: 3128702 - protein, 7 aa, Giardia lamblia
PSSAAPG

SEQ ID NO: 3128703 - protein, 9 aa, Giardia lamblia
PSSAEEVES

SEQ ID NO: 3128704 - protein, 14 aa, Giardia lamblia
PSSAKKPRRRSKSV

SEQ ID NO: 3128705 - protein, 8 aa, Giardia lamblia
PSSALSGQ

SEQ ID NO: 3128706 - protein, 16 aa, Giardia lamblia
PSSASEIGLRDNEGQT

SEQ ID NO: 3128707 - protein, 5 aa, Giardia lamblia
PSSCE

SEQ ID NO: 3128708 - protein, 4 aa, Giardia lamblia
PSSD

SEQ ID NO: 3128709 - protein, 10 aa, Giardia lamblia
PSSDRSGLDG

SEQ ID NO: 3128710 - protein, 15 aa, Giardia lamblia
PSSEEISNEVNSTVS

SEQ ID NO: 3128711 - protein, 5 aa, Giardia lamblia
PSSEL

SEQ ID NO: 3128712 - protein, 5 aa, Giardia lamblia
PSSER

SEQ ID NO: 3128713 - protein, 4 aa, Giardia lamblia
PSSF

SEQ ID NO: 3128714 - protein, 13 aa, Giardia lamblia
PSSFEQSPNRDTG

SEQ ID NO: 3128715 - protein, 22 aa, Giardia lamblia
PSSGEFETRITPESGPDARARE

SEQ ID NO: 3128716 - protein, 6 aa, Giardia lamblia
PSSGKN

SEQ ID NO: 3128717 - protein, 30 aa, Giardia lamblia
PSSGPSPAEDTGSTAASAGDSNTKQPSIVK

SEQ ID NO: 3128718 - protein, 5 aa, Giardia lamblia
PSSGY

SEQ ID NO: 3128719 - protein, 14 aa, Giardia lamblia
PSSIEEENRELRNQ

SEQ ID NO: 3128720 - protein, 5 aa, Giardia lamblia
PSSIV

SEQ ID NO: 3128721 - protein, 5 aa, Giardia lamblia
PSSKV

SEQ ID NO: 3128722 - protein, 4 aa, Giardia lamblia
PSSL

SEQ ID NO: 3128723 - protein, 6 aa, Giardia lamblia
PSSLEE

SEQ ID NO: 3128724 - protein, 10 aa, Giardia lamblia
PSSLPAAPLE

SEQ ID NO: 3128725 - protein, 11 aa, Giardia lamblia
PSSLQEAERTT

SEQ ID NO: 3128726 - protein, 10 aa, Giardia lamblia
PSSNAQSYRE

SEQ ID NO: 3128727 - protein, 17 aa, Giardia lamblia
PSSNPYMSAPASSFPSQ

SEQ ID NO: 3128728 - protein, 4 aa, Giardia lamblia
PSSP

SEQ ID NO: 3128729 - protein, 15 aa, Giardia lamblia
PSSPECDEWLGKLNS

SEQ ID NO: 3128730 - protein, 7 aa, Giardia lamblia
PSSPISV

SEQ ID NO: 3128731 - protein, 5 aa, Giardia lamblia
PSSQY

SEQ ID NO: 3128732 - protein, 4 aa, Giardia lamblia
PSSR

SEQ ID NO: 3128733 - protein, 11 aa, Giardia lamblia
PSSSPDRSYSS

SEQ ID NO: 3128734 - protein, 15 aa, Giardia lamblia
PSSSPLEESLPTDRF

SEQ ID NO: 3128735 - protein, 12 aa, Giardia lamblia
PSSSPMKRSPPL

SEQ ID NO: 3128736 - protein, 29 aa, Giardia lamblia
PSSSQRDQTPIQSPTLPSPRHSRAPSGIP

SEQ ID NO: 3128737 - protein, 8 aa, Giardia lamblia
PSSSSTEL

SEQ ID NO: 3128738 - protein, 8 aa, Giardia lamblia
PSSTDAKP

SEQ ID NO: 3128739 - protein, 12 aa, Giardia lamblia
PSSTNSSISNSQ

SEQ ID NO: 3128740 - protein, 7 aa, Giardia lamblia
PSSTQAE

SEQ ID NO: 3128741 - protein, 37 aa, Giardia lamblia
PSSTTTQPEAQPVKQPSDAGTQSSDVSQRKSGSLEEV

SEQ ID NO: 3128742 - protein, 14 aa, Giardia lamblia
PSSTTTQRKEGLLS

SEQ ID NO: 3128743 - protein, 7 aa, Giardia lamblia
PSSYAKG

SEQ ID NO: 3128744 - protein, 10 aa, Giardia lamblia
PSTAPKATIE

SEQ ID NO: 3128745 - protein, 14 aa, Giardia lamblia
PSTAVTSPGGTDGG

SEQ ID NO: 3128746 - protein, 9 aa, Giardia lamblia
PSTDMSARN

SEQ ID NO: 3128747 - protein, 7 aa, Giardia lamblia
PSTDSGF

SEQ ID NO: 3128748 - protein, 5 aa, Giardia lamblia
PSTEA

SEQ ID NO: 3128749 - protein, 9 aa, Giardia lamblia
PSTEEPEEV

SEQ ID NO: 3128750 - protein, 5 aa, Giardia lamblia
PSTEG

SEQ ID NO: 3128751 - protein, 5 aa, Giardia lamblia
PSTEI

SEQ ID NO: 3128752 - protein, 39 aa, Giardia lamblia
PSTGGPRRHQGTRVEASTSYLSSDPNGLRASSVRGRPMT

SEQ ID NO: 3128753 - protein, 12 aa, Giardia lamblia
PSTGKASLPPAE

SEQ ID NO: 3128754 - protein, 5 aa, Giardia lamblia
PSTHV

SEQ ID NO: 3128755 - protein, 4 aa, Giardia lamblia
PSTI

SEQ ID NO: 3128756 - protein, 6 aa, Giardia lamblia
PSTIRQ

SEQ ID NO: 3128757 - protein, 23 aa, Giardia lamblia
PSTKFSDDSVTKSSSTRSPGSVQ

SEQ ID NO: 3128758 - protein, 8 aa, Giardia lamblia
PSTLGGPK

SEQ ID NO: 3128759 - protein, 7 aa, Giardia lamblia
PSTLQYT

SEQ ID NO: 3128760 - protein, 7 aa, Giardia lamblia
PSTLSTC

SEQ ID NO: 3128761 - protein, 7 aa, Giardia lamblia
PSTNKLT

SEQ ID NO: 3128762 - protein, 11 aa, Giardia lamblia
PSTPASNPLTD

SEQ ID NO: 3128763 - protein, 5 aa, Giardia lamblia
PSTPM

SEQ ID NO: 3128764 - protein, 7 aa, Giardia lamblia
PSTQASA

SEQ ID NO: 3128765 - protein, 12 aa, Giardia lamblia
PSTQDACKKGLR

SEQ ID NO: 3128766 - protein, 7 aa, Giardia lamblia
PSTQQGC

SEQ ID NO: 3128767 - protein, 13 aa, Giardia lamblia
PSTSAVAQPPPIL

SEQ ID NO: 3128768 - protein, 7 aa, Giardia lamblia
PSTSGDP

SEQ ID NO: 3128769 - protein, 5 aa, Giardia lamblia
PSTSL

SEQ ID NO: 3128770 - protein, 5 aa, Giardia lamblia
PSTSS

SEQ ID NO: 3128771 - protein, 31 aa, Giardia lamblia
PSTSSLNQEIPNVEQQQQQQYVPKDRTALPR

SEQ ID NO: 3128772 - protein, 10 aa, Giardia lamblia
PSTTEADPTA

SEQ ID NO: 3128773 - protein, 22 aa, Giardia lamblia
PSTTSTEDRIKSEGKVRDTTRG

SEQ ID NO: 3128774 - protein, 11 aa, Giardia lamblia
PSVAEGEPSQD

SEQ ID NO: 3128775 - protein, 14 aa, Giardia lamblia
PSVANYSTKGSDTL

SEQ ID NO: 3128776 - protein, 5 aa, Giardia lamblia
PSVAS

SEQ ID NO: 3128777 - protein, 11 aa, Giardia lamblia
PSVDNAAPKQY

SEQ ID NO: 3128778 - protein, 6 aa, Giardia lamblia
PSVDQK

SEQ ID NO: 3128779 - protein, 4 aa, Giardia lamblia
PSVE

SEQ ID NO: 3128780 - protein, 11 aa, Giardia lamblia
PSVGDTLSDPI

SEQ ID NO: 3128781 - protein, 6 aa, Giardia lamblia
PSVGKS

SEQ ID NO: 3128782 - protein, 7 aa, Giardia lamblia
PSVGKSS

SEQ ID NO: 3128783 - protein, 7 aa, Giardia lamblia
PSVGPEV

SEQ ID NO: 3128784 - protein, 17 aa, Giardia lamblia
PSVKGTDGSTETPASTK

SEQ ID NO: 3128785 - protein, 15 aa, Giardia lamblia
PSVNASTNSAPSNTI

SEQ ID NO: 3128786 - protein, 13 aa, Giardia lamblia
PSVNPGALPRSCA

SEQ ID NO: 3128787 - protein, 13 aa, Giardia lamblia
PSVPEKTSKDRAL

SEQ ID NO: 3128788 - protein, 5 aa, Giardia lamblia
PSVPY

SEQ ID NO: 3128789 - protein, 7 aa, Giardia lamblia
PSVQPQS

SEQ ID NO: 3128790 - protein, 16 aa, Giardia lamblia
PSVQSGSGAGTTEDNL

SEQ ID NO: 3128791 - protein, 9 aa, Giardia lamblia
PSVSASDRF

SEQ ID NO: 3128792 - protein, 10 aa, Giardia lamblia
PSVSGPHDTT

SEQ ID NO: 3128793 - protein, 12 aa, Giardia lamblia
PSVSKKGHNAST

SEQ ID NO: 3128794 - protein, 5 aa, Giardia lamblia
PSVSP

SEQ ID NO: 3128795 - protein, 6 aa, Giardia lamblia
PSVTEA

SEQ ID NO: 3128796 - protein, 10 aa, Giardia lamblia
PSVTTEPYKE

SEQ ID NO: 3128797 - protein, 13 aa, Giardia lamblia
PSVTTSPHNGGNA

SEQ ID NO: 3128798 - protein, 4 aa, Giardia lamblia
PSVY

SEQ ID NO: 3128799 - protein, 4 aa, Giardia lamblia
PSWG

SEQ ID NO: 3128800 - protein, 12 aa, Giardia lamblia
PSYASQDVAREK

SEQ ID NO: 3128801 - protein, 5 aa, Giardia lamblia
PSYDE

SEQ ID NO: 3128802 - protein, 11 aa, Giardia lamblia
PSYDKSHRAGT

SEQ ID NO: 3128803 - protein, 17 aa, Giardia lamblia
PSYLKRDSGATKRQLHS

SEQ ID NO: 3128804 - protein, 4 aa, Giardia lamblia
PSYN

SEQ ID NO: 3128805 - protein, 9 aa, Giardia lamblia
PSYNPQDSN

SEQ ID NO: 3128806 - protein, 10 aa, Giardia lamblia
PSYPDTQRLK

SEQ ID NO: 3128807 - protein, 12 aa, Giardia lamblia
PSYRNKARNRSS

SEQ ID NO: 3128808 - protein, 13 aa, Giardia lamblia
PSYRQRYQGGHPD

SEQ ID NO: 3128809 - protein, 8 aa, Giardia lamblia
PSYSRTKT

SEQ ID NO: 3128810 - protein, 7 aa, Giardia lamblia
PSYSSES

SEQ ID NO: 3128811 - protein, 6 aa, Giardia lamblia
PSYTGT

SEQ ID NO: 3128812 - protein, 6 aa, Giardia lamblia
PSYTKN

SEQ ID NO: 3128813 - protein, 7 aa, Giardia lamblia
PSYTRQD

SEQ ID NO: 3128814 - protein, 5 aa, Giardia lamblia
PTAAN

SEQ ID NO: 3128815 - protein, 12 aa, Giardia lamblia
PTAARSKESEIE

SEQ ID NO: 3128816 - protein, 5 aa, Giardia lamblia
PTACS

SEQ ID NO: 3128817 - protein, 23 aa, Giardia lamblia
PTADPCTTCRETENSKISSNAVP

SEQ ID NO: 3128818 - protein, 6 aa, Giardia lamblia
PTADTY

SEQ ID NO: 3128819 - protein, 4 aa, Giardia lamblia
PTAE

SEQ ID NO: 3128820 - protein, 13 aa, Giardia lamblia
PTAEPLGSTGSNM

SEQ ID NO: 3128821 - protein, 4 aa, Giardia lamblia
PTAG

SEQ ID NO: 3128822 - protein, 6 aa, Giardia lamblia
PTAHGS

SEQ ID NO: 3128823 - protein, 5 aa, Giardia lamblia
PTALP

SEQ ID NO: 3128824 - protein, 9 aa, Giardia lamblia
PTANDESEL

SEQ ID NO: 3128825 - protein, 20 aa, Giardia lamblia
PTANEGFKGKFSETQDEYRP

SEQ ID NO: 3128826 - protein, 6 aa, Giardia lamblia
PTAQQI

SEQ ID NO: 3128827 - protein, 8 aa, Giardia lamblia
PTASEANR

SEQ ID NO: 3128828 - protein, 16 aa, Giardia lamblia
PTASRTPSLPDQPQSV

SEQ ID NO: 3128829 - protein, 11 aa, Giardia lamblia
PTATDGGKRRI

SEQ ID NO: 3128830 - protein, 9 aa, Giardia lamblia
PTAVNDDKT

SEQ ID NO: 3128831 - protein, 6 aa, Giardia lamblia
PTAVPD

SEQ ID NO: 3128832 - protein, 5 aa, Giardia lamblia
PTCEG

SEQ ID NO: 3128833 - protein, 8 aa, Giardia lamblia
PTCRGGSC

SEQ ID NO: 3128834 - protein, 4 aa, Giardia lamblia
PTDA

SEQ ID NO: 3128835 - protein, 7 aa, Giardia lamblia
PTDANPN

SEQ ID NO: 3128836 - protein, 9 aa, Giardia lamblia
PTDEDGYYH

SEQ ID NO: 3128837 - protein, 5 aa, Giardia lamblia
PTDEI

SEQ ID NO: 3128838 - protein, 7 aa, Giardia lamblia
PTDEKGV

SEQ ID NO: 3128839 - protein, 12 aa, Giardia lamblia
PTDERKVDAASN

SEQ ID NO: 3128840 - protein, 14 aa, Giardia lamblia
PTDETKNSAEMPIT

SEQ ID NO: 3128841 - protein, 12 aa, Giardia lamblia
PTDGNPESPPPL

SEQ ID NO: 3128842 - protein, 7 aa, Giardia lamblia
PTDKNGF

SEQ ID NO: 3128843 - protein, 4 aa, Giardia lamblia
PTDL

SEQ ID NO: 3128844 - protein, 28 aa, Giardia lamblia
PTDLSDKCKEKEKEREKERERENDKCSS

SEQ ID NO: 3128845 - protein, 7 aa, Giardia lamblia
PTDNKGV

SEQ ID NO: 3128846 - protein, 4 aa, Giardia lamblia
PTDP

SEQ ID NO: 3128847 - protein, 5 aa, Giardia lamblia
PTDPF

SEQ ID NO: 3128848 - protein, 5 aa, Giardia lamblia
PTDPH

SEQ ID NO: 3128849 - protein, 6 aa, Giardia lamblia
PTDPTE

SEQ ID NO: 3128850 - protein, 4 aa, Giardia lamblia
PTDQ

SEQ ID NO: 3128851 - protein, 18 aa, Giardia lamblia
PTDQAPSAVKERENEHPC

SEQ ID NO: 3128852 - protein, 8 aa, Giardia lamblia
PTDQLSTE

SEQ ID NO: 3128853 - protein, 12 aa, Giardia lamblia
PTDRGYQQSQRG

SEQ ID NO: 3128854 - protein, 6 aa, Giardia lamblia
PTDRSY

SEQ ID NO: 3128855 - protein, 33 aa, Giardia lamblia
PTDSAVDKRRAFSATPSSPRSEEPARAQRLATT

SEQ ID NO: 3128856 - protein, 11 aa, Giardia lamblia
PTDSKRTKKHG

SEQ ID NO: 3128857 - protein, 7 aa, Giardia lamblia
PTDTFGD

SEQ ID NO: 3128858 - protein, 7 aa, Giardia lamblia
PTDTLSP

SEQ ID NO: 3128859 - protein, 7 aa, Giardia lamblia
PTDTQGL

SEQ ID NO: 3128860 - protein, 4 aa, Giardia lamblia
PTDV

SEQ ID NO: 3128861 - protein, 6 aa, Giardia lamblia
PTDVTA

SEQ ID NO: 3128862 - protein, 4 aa, Giardia lamblia
PTDY

SEQ ID NO: 3128863 - protein, 4 aa, Giardia lamblia
PTEA

SEQ ID NO: 3128864 - protein, 5 aa, Giardia lamblia
PTEAG

SEQ ID NO: 3128865 - protein, 4 aa, Giardia lamblia
PTED

SEQ ID NO: 3128866 - protein, 10 aa, Giardia lamblia
PTEGAAPVKT

SEQ ID NO: 3128867 - protein, 5 aa, Giardia lamblia
PTEPL

SEQ ID NO: 3128868 - protein, 4 aa, Giardia lamblia
PTER

SEQ ID NO: 3128869 - protein, 8 aa, Giardia lamblia
PTERPTAA

SEQ ID NO: 3128870 - protein, 8 aa, Giardia lamblia
PTESGPEN

SEQ ID NO: 3128871 - protein, 4 aa, Giardia lamblia
PTET

SEQ ID NO: 3128872 - protein, 9 aa, Giardia lamblia
PTETTTPGF

SEQ ID NO: 3128873 - protein, 7 aa, Giardia lamblia
PTEVPDS

SEQ ID NO: 3128874 - protein, 4 aa, Giardia lamblia
PTFP

SEQ ID NO: 3128875 - protein, 5 aa, Giardia lamblia
PTFSP

SEQ ID NO: 3128876 - protein, 13 aa, Giardia lamblia
PTFTQPQGPTGAT

SEQ ID NO: 3128877 - protein, 7 aa, Giardia lamblia
PTGAGKT

SEQ ID NO: 3128878 - protein, 4 aa, Giardia lamblia
PTGD

SEQ ID NO: 3128879 - protein, 5 aa, Giardia lamblia
PTGDF

SEQ ID NO: 3128880 - protein, 10 aa, Giardia lamblia
PTGDNTEIDK

SEQ ID NO: 3128881 - protein, 10 aa, Giardia lamblia
PTGDRSGQQL

SEQ ID NO: 3128882 - protein, 4 aa, Giardia lamblia
PTGE

SEQ ID NO: 3128883 - protein, 5 aa, Giardia lamblia
PTGEN

SEQ ID NO: 3128884 - protein, 9 aa, Giardia lamblia
PTGGKSAKR

SEQ ID NO: 3128885 - protein, 12 aa, Giardia lamblia
PTGHASRNPIDT

SEQ ID NO: 3128886 - protein, 8 aa, Giardia lamblia
PTGHNTRH

SEQ ID NO: 3128887 - protein, 5 aa, Giardia lamblia
PTGKL

SEQ ID NO: 3128888 - protein, 11 aa, Giardia lamblia
PTGMQNSASQA

SEQ ID NO: 3128889 - protein, 10 aa, Giardia lamblia
PTGPKRRSAV

SEQ ID NO: 3128890 - protein, 10 aa, Giardia lamblia
PTGSANSASI

SEQ ID NO: 3128891 - protein, 9 aa, Giardia lamblia
PTGSGKSGA

SEQ ID NO: 3128892 - protein, 7 aa, Giardia lamblia
PTGSGKT

SEQ ID NO: 3128893 - protein, 10 aa, Giardia lamblia
PTGSGKTTCS

SEQ ID NO: 3128894 - protein, 20 aa, Giardia lamblia
PTGTLGRSTSSLVESNPKYD

SEQ ID NO: 3128895 - protein, 8 aa, Giardia lamblia
PTGTSKTS

SEQ ID NO: 3128896 - protein, 5 aa, Giardia lamblia
PTGYL

SEQ ID NO: 3128897 - protein, 5 aa, Giardia lamblia
PTHAS

SEQ ID NO: 3128898 - protein, 11 aa, Giardia lamblia
PTHGGRRRTQC

SEQ ID NO: 3128899 - protein, 28 aa, Giardia lamblia
PTHGPTASIYTGKTSRTRMTAKEAAERR

SEQ ID NO: 3128900 - protein, 6 aa, Giardia lamblia
PTHRTD

SEQ ID NO: 3128901 - protein, 5 aa, Giardia lamblia
PTHSA

SEQ ID NO: 3128902 - protein, 10 aa, Giardia lamblia
PTHSPGFSVG

SEQ ID NO: 3128903 - protein, 43 aa, Giardia lamblia
PTIAGSLKSSSRPTSSTSQKNVASNLTAPKEQAGETSTPNSRV

SEQ ID NO: 3128904 - protein, 5 aa, Giardia lamblia
PTIDR

SEQ ID NO: 3128905 - protein, 4 aa, Giardia lamblia
PTIQ

SEQ ID NO: 3128906 - protein, 5 aa, Giardia lamblia
PTITD

SEQ ID NO: 3128907 - protein, 7 aa, Giardia lamblia
PTKAPRQ

SEQ ID NO: 3128908 - protein, 11 aa, Giardia lamblia
PTKATPAPAPA

SEQ ID NO: 3128909 - protein, 7 aa, Giardia lamblia
PTKDDTI

SEQ ID NO: 3128910 - protein, 4 aa, Giardia lamblia
PTKE

SEQ ID NO: 3128911 - protein, 8 aa, Giardia lamblia
PTKEEEDR

SEQ ID NO: 3128912 - protein, 6 aa, Giardia lamblia
PTKEKV

SEQ ID NO: 3128913 - protein, 8 aa, Giardia lamblia
PTKELSNQ

SEQ ID NO: 3128914 - protein, 7 aa, Giardia lamblia
PTKENQI

SEQ ID NO: 3128915 - protein, 18 aa, Giardia lamblia
PTKGNQSEIAGFSGSPGH

SEQ ID NO: 3128916 - protein, 5 aa, Giardia lamblia
PTKGS

SEQ ID NO: 3128917 - protein, 24 aa, Giardia lamblia
PTKLSASNYQTDVTPGPGAYNSTG

SEQ ID NO: 3128918 - protein, 4 aa, Giardia lamblia
PTKP

SEQ ID NO: 3128919 - protein, 9 aa, Giardia lamblia
PTKPKLPGH

SEQ ID NO: 3128920 - protein, 6 aa, Giardia lamblia
PTKPPN

SEQ ID NO: 3128921 - protein, 5 aa, Giardia lamblia
PTKRD

SEQ ID NO: 3128922 - protein, 7 aa, Giardia lamblia
PTKRPDI

SEQ ID NO: 3128923 - protein, 5 aa, Giardia lamblia
PTLET

SEQ ID NO: 3128924 - protein, 4 aa, Giardia lamblia
PTLH

SEQ ID NO: 3128925 - protein, 5 aa, Giardia lamblia
PTLPD

SEQ ID NO: 3128926 - protein, 33 aa, Giardia lamblia
PTLPNDAKRGKTRPKQDLASACSKSKKMPTSGS

SEQ ID NO: 3128927 - protein, 13 aa, Giardia lamblia
PTLQGEERTDKDR

SEQ ID NO: 3128928 - protein, 5 aa, Giardia lamblia
PTLQT

SEQ ID NO: 3128929 - protein, 9 aa, Giardia lamblia
PTLRQRSDF

SEQ ID NO: 3128930 - protein, 9 aa, Giardia lamblia
PTLSQRTQR

SEQ ID NO: 3128931 - protein, 5 aa, Giardia lamblia
PTLSR

SEQ ID NO: 3128932 - protein, 47 aa, Giardia lamblia
PTLTAEGATRQTSARTAPQESHRQTAPAPPPRRGATPAARSASAAPI

SEQ ID NO: 3128933 - protein, 14 aa, Giardia lamblia
PTLTRTPPARTNHG

SEQ ID NO: 3128934 - protein, 4 aa, Giardia lamblia
PTMP

SEQ ID NO: 3128935 - protein, 10 aa, Giardia lamblia
PTMSASEKQV

SEQ ID NO: 3128936 - protein, 12 aa, Giardia lamblia
PTMTSSQGSEVH

SEQ ID NO: 3128937 - protein, 11 aa, Giardia lamblia
PTNASSPIESP

SEQ ID NO: 3128938 - protein, 7 aa, Giardia lamblia
PTNENGV

SEQ ID NO: 3128939 - protein, 12 aa, Giardia lamblia
PTNETTDHTGTT

SEQ ID NO: 3128940 - protein, 5 aa, Giardia lamblia
PTNKH

SEQ ID NO: 3128941 - protein, 8 aa, Giardia lamblia
PTNPESGT

SEQ ID NO: 3128942 - protein, 7 aa, Giardia lamblia
PTNPNMS

SEQ ID NO: 3128943 - protein, 5 aa, Giardia lamblia
PTNRP

SEQ ID NO: 3128944 - protein, 22 aa, Giardia lamblia
PTNSTQTSSSFTKSIKTPRPQN

SEQ ID NO: 3128945 - protein, 24 aa, Giardia lamblia
PTNTEKPTVELEPDISTKLPPGNF

SEQ ID NO: 3128946 - protein, 14 aa, Giardia lamblia
PTNTNDPPAEQPDE

SEQ ID NO: 3128947 - protein, 5 aa, Giardia lamblia
PTNTT

SEQ ID NO: 3128948 - protein, 10 aa, Giardia lamblia
PTNVANQSSH

SEQ ID NO: 3128949 - protein, 30 aa, Giardia lamblia
PTNVSAPMSTQDQVDPSTGNEKPNTGADPA

SEQ ID NO: 3128950 - protein, 7 aa, Giardia lamblia
PTPAYDI

SEQ ID NO: 3128951 - protein, 5 aa, Giardia lamblia
PTPDR

SEQ ID NO: 3128952 - protein, 7 aa, Giardia lamblia
PTPEQAH

SEQ ID NO: 3128953 - protein, 11 aa, Giardia lamblia
PTPKVAPPTSA

SEQ ID NO: 3128954 - protein, 5 aa, Giardia lamblia
PTPNP

SEQ ID NO: 3128955 - protein, 6 aa, Giardia lamblia
PTPQEY

SEQ ID NO: 3128956 - protein, 6 aa, Giardia lamblia
PTPRVS

SEQ ID NO: 3128957 - protein, 15 aa, Giardia lamblia
PTPSLQNNKARYPPL

SEQ ID NO: 3128958 - protein, 9 aa, Giardia lamblia
PTPSPPAVP

SEQ ID NO: 3128959 - protein, 10 aa, Giardia lamblia
PTPSVEGKVG

SEQ ID NO: 3128960 - protein, 4 aa, Giardia lamblia
PTPT

SEQ ID NO: 3128961 - protein, 4 aa, Giardia lamblia
PTPY

SEQ ID NO: 3128962 - protein, 14 aa, Giardia lamblia
PTPYSKPSIKPPQY

SEQ ID NO: 3128963 - protein, 5 aa, Giardia lamblia
PTPYT

SEQ ID NO: 3128964 - protein, 4 aa, Giardia lamblia
PTQF

SEQ ID NO: 3128965 - protein, 10 aa, Giardia lamblia
PTQGGSSAIP

SEQ ID NO: 3128966 - protein, 8 aa, Giardia lamblia
PTQPAAPA

SEQ ID NO: 3128967 - protein, 9 aa, Giardia lamblia
PTQPVKGSA

SEQ ID NO: 3128968 - protein, 7 aa, Giardia lamblia
PTQQERL

SEQ ID NO: 3128969 - protein, 7 aa, Giardia lamblia
PTQRIST

SEQ ID NO: 3128970 - protein, 7 aa, Giardia lamblia
PTQSQIG

SEQ ID NO: 3128971 - protein, 13 aa, Giardia lamblia
PTQTGAVTTDGET

SEQ ID NO: 3128972 - protein, 15 aa, Giardia lamblia
PTRALKSASQPLNAY

SEQ ID NO: 3128973 - protein, 5 aa, Giardia lamblia
PTRAT

SEQ ID NO: 3128974 - protein, 7 aa, Giardia lamblia
PTREKGT

SEQ ID NO: 3128975 - protein, 7 aa, Giardia lamblia
PTRETPI

SEQ ID NO: 3128976 - protein, 15 aa, Giardia lamblia
PTRGRVESPVRKESL

SEQ ID NO: 3128977 - protein, 12 aa, Giardia lamblia
PTRGSPSPPRDL

SEQ ID NO: 3128978 - protein, 9 aa, Giardia lamblia
PTRKSQANL

SEQ ID NO: 3128979 - protein, 25 aa, Giardia lamblia
PTRMTGTSYKVKPSLDSTTRTDPAA

SEQ ID NO: 3128980 - protein, 7 aa, Giardia lamblia
PTRNVSK

SEQ ID NO: 3128981 - protein, 8 aa, Giardia lamblia
PTRPHAPP

SEQ ID NO: 3128982 - protein, 17 aa, Giardia lamblia
PTRSSPLRSSRSVNSRL

SEQ ID NO: 3128983 - protein, 22 aa, Giardia lamblia
PTRVSERTPKGQGIINKWIDYP

SEQ ID NO: 3128984 - protein, 5 aa, Giardia lamblia
PTRYE

SEQ ID NO: 3128985 - protein, 5 aa, Giardia lamblia
PTSDE

SEQ ID NO: 3128986 - protein, 4 aa, Giardia lamblia
PTSE

SEQ ID NO: 3128987 - protein, 7 aa, Giardia lamblia
PTSESAL

SEQ ID NO: 3128988 - protein, 12 aa, Giardia lamblia
PTSGAAQGGAAK

SEQ ID NO: 3128989 - protein, 9 aa, Giardia lamblia
PTSGVSASA

SEQ ID NO: 3128990 - protein, 9 aa, Giardia lamblia
PTSIASPED

SEQ ID NO: 3128991 - protein, 16 aa, Giardia lamblia
PTSKNSQGNDVGTQYR

SEQ ID NO: 3128992 - protein, 10 aa, Giardia lamblia
PTSKTELKSP

SEQ ID NO: 3128993 - protein, 4 aa, Giardia lamblia
PTSL

SEQ ID NO: 3128994 - protein, 12 aa, Giardia lamblia
PTSLRRSDTFDK

SEQ ID NO: 3128995 - protein, 5 aa, Giardia lamblia
PTSMS

SEQ ID NO: 3128996 - protein, 12 aa, Giardia lamblia
PTSNSSMTSPVT

SEQ ID NO: 3128997 - protein, 11 aa, Giardia lamblia
PTSPGSTVQSS

SEQ ID NO: 3128998 - protein, 12 aa, Giardia lamblia
PTSPRKPPYKRV

SEQ ID NO: 3128999 - protein, 10 aa, Giardia lamblia
PTSPTTPLPK

SEQ ID NO: 3129000 - protein, 5 aa, Giardia lamblia
PTSRL

SEQ ID NO: 3129001 - protein, 5 aa, Giardia lamblia
PTSSA

SEQ ID NO: 3129002 - protein, 12 aa, Giardia lamblia
PTSSPLEDPNDA

SEQ ID NO: 3129003 - protein, 10 aa, Giardia lamblia
PTSSSMPDNS

SEQ ID NO: 3129004 - protein, 20 aa, Giardia lamblia
PTSSTPQSAAVQKKPSQSLR

SEQ ID NO: 3129005 - protein, 16 aa, Giardia lamblia
PTSSVPAKPCPNEEPV

SEQ ID NO: 3129006 - protein, 11 aa, Giardia lamblia
PTSTSYRDLSS

SEQ ID NO: 3129007 - protein, 7 aa, Giardia lamblia
PTSVEKK

SEQ ID NO: 3129008 - protein, 8 aa, Giardia lamblia
PTSWPGGG

SEQ ID NO: 3129009 - protein, 29 aa, Giardia lamblia
PTTAAASASSSFVGTTGVGGDDASTEGLS

SEQ ID NO: 3129010 - protein, 9 aa, Giardia lamblia
PTTAKFAGA

SEQ ID NO: 3129011 - protein, 5 aa, Giardia lamblia
PTTDA

SEQ ID NO: 3129012 - protein, 4 aa, Giardia lamblia
PTTE

SEQ ID NO: 3129013 - protein, 5 aa, Giardia lamblia
PTTGN

SEQ ID NO: 3129014 - protein, 4 aa, Giardia lamblia
PTTL

SEQ ID NO: 3129015 - protein, 10 aa, Giardia lamblia
PTTLQDTTAP

SEQ ID NO: 3129016 - protein, 7 aa, Giardia lamblia
PTTNKKV

SEQ ID NO: 3129017 - protein, 8 aa, Giardia lamblia
PTTNPTST

SEQ ID NO: 3129018 - protein, 7 aa, Giardia lamblia
PTTNQTA

SEQ ID NO: 3129019 - protein, 7 aa, Giardia lamblia
PTTPAED

SEQ ID NO: 3129020 - protein, 7 aa, Giardia lamblia
PTTPKTR

SEQ ID NO: 3129021 - protein, 15 aa, Giardia lamblia
PTTPLARETSTRNSS

SEQ ID NO: 3129022 - protein, 6 aa, Giardia lamblia
PTTPTC

SEQ ID NO: 3129023 - protein, 10 aa, Giardia lamblia
PTTSEANGAY

SEQ ID NO: 3129024 - protein, 6 aa, Giardia lamblia
PTTSEP

SEQ ID NO: 3129025 - protein, 11 aa, Giardia lamblia
PTTSGTGSEVT

SEQ ID NO: 3129026 - protein, 7 aa, Giardia lamblia
PTTSNST

SEQ ID NO: 3129027 - protein, 6 aa, Giardia lamblia
PTTSSV

SEQ ID NO: 3129028 - protein, 16 aa, Giardia lamblia
PTTTIAPASGKGPQVT

SEQ ID NO: 3129029 - protein, 5 aa, Giardia lamblia
PTTTM

SEQ ID NO: 3129030 - protein, 7 aa, Giardia lamblia
PTTTPVD

SEQ ID NO: 3129031 - protein, 7 aa, Giardia lamblia
PTTTQPK

SEQ ID NO: 3129032 - protein, 22 aa, Giardia lamblia
PTTTQTETEDVRKEFSDSHKSV

SEQ ID NO: 3129033 - protein, 10 aa, Giardia lamblia
PTVASPPAVH

SEQ ID NO: 3129034 - protein, 11 aa, Giardia lamblia
PTVEERPVTPP

SEQ ID NO: 3129035 - protein, 5 aa, Giardia lamblia
PTVPQ

SEQ ID NO: 3129036 - protein, 8 aa, Giardia lamblia
PTVSDTST

SEQ ID NO: 3129037 - protein, 7 aa, Giardia lamblia
PTVTPGI

SEQ ID NO: 3129038 - protein, 10 aa, Giardia lamblia
PTVTQSKISA

SEQ ID NO: 3129039 - protein, 12 aa, Giardia lamblia
PTVTTDKPEGQI

SEQ ID NO: 3129040 - protein, 4 aa, Giardia lamblia
PTVV

SEQ ID NO: 3129041 - protein, 43 aa, Giardia lamblia
PTYAESNPVDSVKHNPAGKEPDHTLEPKASHHPPDPPLATSND

SEQ ID NO: 3129042 - protein, 19 aa, Giardia lamblia
PTYAESSDDEDDTNYADSV

SEQ ID NO: 3129043 - protein, 19 aa, Giardia lamblia
PTYDEPSDDLASRPTNNKH

SEQ ID NO: 3129044 - protein, 4 aa, Giardia lamblia
PTYE

SEQ ID NO: 3129045 - protein, 19 aa, Giardia lamblia
PTYEQPPKRPQRNLQHGDP

SEQ ID NO: 3129046 - protein, 6 aa, Giardia lamblia
PTYPRP

SEQ ID NO: 3129047 - protein, 11 aa, Giardia lamblia
PTYSVTTDDGV

SEQ ID NO: 3129048 - protein, 7 aa, Giardia lamblia
PVANTAT

SEQ ID NO: 3129049 - protein, 7 aa, Giardia lamblia
PVASDAA

SEQ ID NO: 3129050 - protein, 7 aa, Giardia lamblia
PVASPAL

SEQ ID NO: 3129051 - protein, 10 aa, Giardia lamblia
PVASPHQTTE

SEQ ID NO: 3129052 - protein, 5 aa, Giardia lamblia
PVASS

SEQ ID NO: 3129053 - protein, 15 aa, Giardia lamblia
PVASSTSQNHSYDID

SEQ ID NO: 3129054 - protein, 10 aa, Giardia lamblia
PVATPNGPAS

SEQ ID NO: 3129055 - protein, 7 aa, Giardia lamblia
PVDARDA

SEQ ID NO: 3129056 - protein, 7 aa, Giardia lamblia
PVDDEAD

SEQ ID NO: 3129057 - protein, 6 aa, Giardia lamblia
PVDDIG

SEQ ID NO: 3129058 - protein, 9 aa, Giardia lamblia
PVDENSATY

SEQ ID NO: 3129059 - protein, 8 aa, Giardia lamblia
PVDKGTYK

SEQ ID NO: 3129060 - protein, 10 aa, Giardia lamblia
PVDNRYSSAI

SEQ ID NO: 3129061 - protein, 8 aa, Giardia lamblia
PVDNSNYN

SEQ ID NO: 3129062 - protein, 8 aa, Giardia lamblia
PVDPREHK

SEQ ID NO: 3129063 - protein, 4 aa, Giardia lamblia
PVEC

SEQ ID NO: 3129064 - protein, 8 aa, Giardia lamblia
PVEGPGLD

SEQ ID NO: 3129065 - protein, 4 aa, Giardia lamblia
PVEK

SEQ ID NO: 3129066 - protein, 9 aa, Giardia lamblia
PVEKESNEV

SEQ ID NO: 3129067 - protein, 14 aa, Giardia lamblia
PVEKGAGSATSECL

SEQ ID NO: 3129068 - protein, 4 aa, Giardia lamblia
PVEQ

SEQ ID NO: 3129069 - protein, 6 aa, Giardia lamblia
PVESRR

SEQ ID NO: 3129070 - protein, 9 aa, Giardia lamblia
PVEVNPPDY

SEQ ID NO: 3129071 - protein, 10 aa, Giardia lamblia
PVGENEDVSS

SEQ ID NO: 3129072 - protein, 11 aa, Giardia lamblia
PVGGSSNKLDP

SEQ ID NO: 3129073 - protein, 12 aa, Giardia lamblia
PVGSLYPSPREY

SEQ ID NO: 3129074 - protein, 13 aa, Giardia lamblia
PVGSTTSPTAQRL

SEQ ID NO: 3129075 - protein, 4 aa, Giardia lamblia
PVHD

SEQ ID NO: 3129076 - protein, 17 aa, Giardia lamblia
PVKATDSTLRSASTSSF

SEQ ID NO: 3129077 - protein, 9 aa, Giardia lamblia
PVKGNQSCK

SEQ ID NO: 3129078 - protein, 39 aa, Giardia lamblia
PVKPSTSSATQRVKPAPPQRPTITESAHKSAPTKPTKPS

SEQ ID NO: 3129079 - protein, 5 aa, Giardia lamblia
PVKQP

SEQ ID NO: 3129080 - protein, 7 aa, Giardia lamblia
PVKRDGN

SEQ ID NO: 3129081 - protein, 7 aa, Giardia lamblia
PVKSDAH

SEQ ID NO: 3129082 - protein, 7 aa, Giardia lamblia
PVLGQGA

SEQ ID NO: 3129083 - protein, 51 aa, Giardia lamblia
PVLNSRNTNPGPGAYNAEQYKTTGSDAPASSLASRHADNVKNTNPGPGAYE

SEQ ID NO: 3129084 - protein, 8 aa, Giardia lamblia
PVLPTKDG

SEQ ID NO: 3129085 - protein, 7 aa, Giardia lamblia
PVNKAPV

SEQ ID NO: 3129086 - protein, 6 aa, Giardia lamblia
PVNPHR

SEQ ID NO: 3129087 - protein, 10 aa, Giardia lamblia
PVNREDAEQH

SEQ ID NO: 3129088 - protein, 10 aa, Giardia lamblia
PVNSTTNFHE

SEQ ID NO: 3129089 - protein, 11 aa, Giardia lamblia
PVNTPEQDQRM

SEQ ID NO: 3129090 - protein, 7 aa, Giardia lamblia
PVPAEPA

SEQ ID NO: 3129091 - protein, 7 aa, Giardia lamblia
PVPAKPD

SEQ ID NO: 3129092 - protein, 14 aa, Giardia lamblia
PVPANSRDCTGTKD

SEQ ID NO: 3129093 - protein, 19 aa, Giardia lamblia
PVPAPAPAPKTTNFNSLLD

SEQ ID NO: 3129094 - protein, 12 aa, Giardia lamblia
PVPAPLSGLSNR

SEQ ID NO: 3129095 - protein, 7 aa, Giardia lamblia
PVPATDG

SEQ ID NO: 3129096 - protein, 5 aa, Giardia lamblia
PVPAV

SEQ ID NO: 3129097 - protein, 5 aa, Giardia lamblia
PVPEA

SEQ ID NO: 3129098 - protein, 23 aa, Giardia lamblia
PVPEGGNQPEAIDGASDNDPMDY

SEQ ID NO: 3129099 - protein, 9 aa, Giardia lamblia
PVPKTPSDL

SEQ ID NO: 3129100 - protein, 11 aa, Giardia lamblia
PVPNQDETKDT

SEQ ID NO: 3129101 - protein, 11 aa, Giardia lamblia
PVPPEGTEGDS

SEQ ID NO: 3129102 - protein, 10 aa, Giardia lamblia
PVPPNEPSKL

SEQ ID NO: 3129103 - protein, 9 aa, Giardia lamblia
PVPPTPSTI

SEQ ID NO: 3129104 - protein, 9 aa, Giardia lamblia
PVPPTSDPA

SEQ ID NO: 3129105 - protein, 6 aa, Giardia lamblia
PVPTPD

SEQ ID NO: 3129106 - protein, 8 aa, Giardia lamblia
PVPTRSAT

SEQ ID NO: 3129107 - protein, 6 aa, Giardia lamblia
PVPTVT

SEQ ID NO: 3129108 - protein, 6 aa, Giardia lamblia
PVPVDN

SEQ ID NO: 3129109 - protein, 9 aa, Giardia lamblia
PVQDAEPIE

SEQ ID NO: 3129110 - protein, 15 aa, Giardia lamblia
PVQGLPAHKDGQSCK

SEQ ID NO: 3129111 - protein, 9 aa, Giardia lamblia
PVQPATMQP

SEQ ID NO: 3129112 - protein, 10 aa, Giardia lamblia
PVQQATESFV

SEQ ID NO: 3129113 - protein, 9 aa, Giardia lamblia
PVQRSDDEV

SEQ ID NO: 3129114 - protein, 26 aa, Giardia lamblia
PVQSTGSSLGISGSYNNPHQSTFKGN

SEQ ID NO: 3129115 - protein, 26 aa, Giardia lamblia
PVRGTSQNNNDSSSLYPAPNGGNDGL

SEQ ID NO: 3129116 - protein, 5 aa, Giardia lamblia
PVRSA

SEQ ID NO: 3129117 - protein, 7 aa, Giardia lamblia
PVSAGQT

SEQ ID NO: 3129118 - protein, 12 aa, Giardia lamblia
PVSAKDDDKGLT

SEQ ID NO: 3129119 - protein, 12 aa, Giardia lamblia
PVSEAAKKRFSP

SEQ ID NO: 3129120 - protein, 11 aa, Giardia lamblia
PVSEASPLQQY

SEQ ID NO: 3129121 - protein, 6 aa, Giardia lamblia
PVSEKD

SEQ ID NO: 3129122 - protein, 17 aa, Giardia lamblia
PVSGNAPPLSGISNRQK

SEQ ID NO: 3129123 - protein, 4 aa, Giardia lamblia
PVSI

SEQ ID NO: 3129124 - protein, 10 aa, Giardia lamblia
PVSKHPLDPA

SEQ ID NO: 3129125 - protein, 8 aa, Giardia lamblia
PVSNNEDS

SEQ ID NO: 3129126 - protein, 11 aa, Giardia lamblia
PVSPDEDGNTP

SEQ ID NO: 3129127 - protein, 5 aa, Giardia lamblia
PVSPG

SEQ ID NO: 3129128 - protein, 5 aa, Giardia lamblia
PVSPQ

SEQ ID NO: 3129129 - protein, 20 aa, Giardia lamblia
PVSPSSTSSNLTSSISGSFT

SEQ ID NO: 3129130 - protein, 5 aa, Giardia lamblia
PVSQS

SEQ ID NO: 3129131 - protein, 4 aa, Giardia lamblia
PVSS

SEQ ID NO: 3129132 - protein, 9 aa, Giardia lamblia
PVSSDYSES

SEQ ID NO: 3129133 - protein, 9 aa, Giardia lamblia
PVSSPLSLS

SEQ ID NO: 3129134 - protein, 13 aa, Giardia lamblia
PVSSPRTSIPNTI

SEQ ID NO: 3129135 - protein, 29 aa, Giardia lamblia
PVSSSPDTDHSLGNEPNESEDDDTDEDAF

SEQ ID NO: 3129136 - protein, 4 aa, Giardia lamblia
PVST

SEQ ID NO: 3129137 - protein, 24 aa, Giardia lamblia
PVSTRKLSETLPGRPDSGTSRPGK

SEQ ID NO: 3129138 - protein, 6 aa, Giardia lamblia
PVTAPR

SEQ ID NO: 3129139 - protein, 11 aa, Giardia lamblia
PVTAPRDSMNN

SEQ ID NO: 3129140 - protein, 6 aa, Giardia lamblia
PVTDGN

SEQ ID NO: 3129141 - protein, 4 aa, Giardia lamblia
PVTE

SEQ ID NO: 3129142 - protein, 9 aa, Giardia lamblia
PVTEVDKEH

SEQ ID NO: 3129143 - protein, 25 aa, Giardia lamblia
PVTGSLTSSTAALATAPLDGSMPSS

SEQ ID NO: 3129144 - protein, 19 aa, Giardia lamblia
PVTGSSPGPGTPRQEAEVS

SEQ ID NO: 3129145 - protein, 14 aa, Giardia lamblia
PVTPDRSAGSDSDV

SEQ ID NO: 3129146 - protein, 21 aa, Giardia lamblia
PVTPQKPPDSALHRASSKRDM

SEQ ID NO: 3129147 - protein, 6 aa, Giardia lamblia
PVTSEQ

SEQ ID NO: 3129148 - protein, 15 aa, Giardia lamblia
PVTTEVRDGKEIKTK

SEQ ID NO: 3129149 - protein, 13 aa, Giardia lamblia
PVTVSAKKNTYLQ

SEQ ID NO: 3129150 - protein, 11 aa, Giardia lamblia
PVVDSDGNTQL

SEQ ID NO: 3129151 - protein, 5 aa, Giardia lamblia
PVVND

SEQ ID NO: 3129152 - protein, 5 aa, Giardia lamblia
PVYPG

SEQ ID NO: 3129153 - protein, 23 aa, Giardia lamblia
PVYPQSSPNKAIPQKQSDLPTDI

SEQ ID NO: 3129154 - protein, 6 aa, Giardia lamblia
PWDDES

SEQ ID NO: 3129155 - protein, 6 aa, Giardia lamblia
PWGGPG

SEQ ID NO: 3129156 - protein, 12 aa, Giardia lamblia
PWPEPKDSSETM

SEQ ID NO: 3129157 - protein, 5 aa, Giardia lamblia
PWPKY

SEQ ID NO: 3129158 - protein, 37 aa, Giardia lamblia
PWRAAESSLGDGSSLNSPDRPQRRHERTEAGHPQTTS

SEQ ID NO: 3129159 - protein, 10 aa, Giardia lamblia
PYADKGVADQ

SEQ ID NO: 3129160 - protein, 5 aa, Giardia lamblia
PYAGE

SEQ ID NO: 3129161 - protein, 10 aa, Giardia lamblia
PYAPGTDQIG

SEQ ID NO: 3129162 - protein, 9 aa, Giardia lamblia
PYAPSPNPY

SEQ ID NO: 3129163 - protein, 5 aa, Giardia lamblia
PYDKD

SEQ ID NO: 3129164 - protein, 4 aa, Giardia lamblia
PYDQ

SEQ ID NO: 3129165 - protein, 5 aa, Giardia lamblia
PYDSR

SEQ ID NO: 3129166 - protein, 15 aa, Giardia lamblia
PYDTEKSLSSGSGRR

SEQ ID NO: 3129167 - protein, 10 aa, Giardia lamblia
PYDYDDPQAV

SEQ ID NO: 3129168 - protein, 13 aa, Giardia lamblia
PYEARAQANDGTT

SEQ ID NO: 3129169 - protein, 8 aa, Giardia lamblia
PYEDEDSY

SEQ ID NO: 3129170 - protein, 28 aa, Giardia lamblia
PYEDGRKYYPSTGSSAEKAVKTEKSSKV

SEQ ID NO: 3129171 - protein, 5 aa, Giardia lamblia
PYEGD

SEQ ID NO: 3129172 - protein, 9 aa, Giardia lamblia
PYEGKISDQ

SEQ ID NO: 3129173 - protein, 11 aa, Giardia lamblia
PYEGTTPHSIP

SEQ ID NO: 3129174 - protein, 22 aa, Giardia lamblia
PYEKPEARSRPPTHTECRDTND

SEQ ID NO: 3129175 - protein, 5 aa, Giardia lamblia
PYESN

SEQ ID NO: 3129176 - protein, 4 aa, Giardia lamblia
PYFG

SEQ ID NO: 3129177 - protein, 5 aa, Giardia lamblia
PYGGA

SEQ ID NO: 3129178 - protein, 8 aa, Giardia lamblia
PYGGEADA

SEQ ID NO: 3129179 - protein, 6 aa, Giardia lamblia
PYGHPT

SEQ ID NO: 3129180 - protein, 8 aa, Giardia lamblia
PYGSERFT

SEQ ID NO: 3129181 - protein, 5 aa, Giardia lamblia
PYHKV

SEQ ID NO: 3129182 - protein, 5 aa, Giardia lamblia
PYIPQ

SEQ ID NO: 3129183 - protein, 13 aa, Giardia lamblia
PYKQGKTPNLSSA

SEQ ID NO: 3129184 - protein, 16 aa, Giardia lamblia
PYKRKRNGLQSEDEEI

SEQ ID NO: 3129185 - protein, 8 aa, Giardia lamblia
PYNDAPGL

SEQ ID NO: 3129186 - protein, 4 aa, Giardia lamblia
PYNE

SEQ ID NO: 3129187 - protein, 9 aa, Giardia lamblia
PYNKENGAL

SEQ ID NO: 3129188 - protein, 7 aa, Giardia lamblia
PYPDGRE

SEQ ID NO: 3129189 - protein, 4 aa, Giardia lamblia
PYPG

SEQ ID NO: 3129190 - protein, 11 aa, Giardia lamblia
PYPKRLPGQRT

SEQ ID NO: 3129191 - protein, 5 aa, Giardia lamblia
PYPQR

SEQ ID NO: 3129192 - protein, 9 aa, Giardia lamblia
PYPTKADAS

SEQ ID NO: 3129193 - protein, 6 aa, Giardia lamblia
PYPVGS

SEQ ID NO: 3129194 - protein, 5 aa, Giardia lamblia
PYQSG

SEQ ID NO: 3129195 - protein, 14 aa, Giardia lamblia
PYQSLKPPKCPSLR

SEQ ID NO: 3129196 - protein, 10 aa, Giardia lamblia
PYQSTYASKA

SEQ ID NO: 3129197 - protein, 27 aa, Giardia lamblia
PYQYNQTQPHSKTVKAKTQSTTGKQRN

SEQ ID NO: 3129198 - protein, 4 aa, Giardia lamblia
PYRA

SEQ ID NO: 3129199 - protein, 5 aa, Giardia lamblia
PYRAD

SEQ ID NO: 3129200 - protein, 13 aa, Giardia lamblia
PYRAPDGNNSCSE

SEQ ID NO: 3129201 - protein, 11 aa, Giardia lamblia
PYSARSPNKQM

SEQ ID NO: 3129202 - protein, 8 aa, Giardia lamblia
PYSQRTYR

SEQ ID NO: 3129203 - protein, 13 aa, Giardia lamblia
PYSSSSAVPATST

SEQ ID NO: 3129204 - protein, 7 aa, Giardia lamblia
PYSTAEQ

SEQ ID NO: 3129205 - protein, 6 aa, Giardia lamblia
PYTAPI

SEQ ID NO: 3129206 - protein, 12 aa, Giardia lamblia
PYTDKDPSQAEA

SEQ ID NO: 3129207 - protein, 5 aa, Giardia lamblia
PYTGA

SEQ ID NO: 3129208 - protein, 11 aa, Giardia lamblia
PYTGDDVGTGS

SEQ ID NO: 3129209 - protein, 13 aa, Giardia lamblia
PYTKNAKGQGPAW

SEQ ID NO: 3129210 - protein, 10 aa, Giardia lamblia
PYTNTGALSH

SEQ ID NO: 3129211 - protein, 10 aa, Giardia lamblia
PYTPPSDGRF

SEQ ID NO: 3129212 - protein, 16 aa, Giardia lamblia
PYTRAPAPWNKYTPED

SEQ ID NO: 3129213 - protein, 5 aa, Giardia lamblia
PYTSF

SEQ ID NO: 3129214 - protein, 9 aa, Giardia lamblia
PYTTVAPES

SEQ ID NO: 3129215 - protein, 9 aa, Giardia lamblia
PYYDPGTST

SEQ ID NO: 3129216 - protein, 8 aa, Giardia lamblia
QAAADNEA

SEQ ID NO: 3129217 - protein, 7 aa, Giardia lamblia
QAAAERE

SEQ ID NO: 3129218 - protein, 6 aa, Giardia lamblia
QAAAPQ

SEQ ID NO: 3129219 - protein, 6 aa, Giardia lamblia
QAAARI

SEQ ID NO: 3129220 - protein, 11 aa, Giardia lamblia
QAAASQDEAYA

SEQ ID NO: 3129221 - protein, 9 aa, Giardia lamblia
QAAATQAAL

SEQ ID NO: 3129222 - protein, 11 aa, Giardia lamblia
QAADDSKAREL

SEQ ID NO: 3129223 - protein, 9 aa, Giardia lamblia
QAADESGRK

SEQ ID NO: 3129224 - protein, 14 aa, Giardia lamblia
QAAGSGVSRVDERK

SEQ ID NO: 3129225 - protein, 8 aa, Giardia lamblia
QAAHAPEQ

SEQ ID NO: 3129226 - protein, 12 aa, Giardia lamblia
QAAKEASERELR

SEQ ID NO: 3129227 - protein, 8 aa, Giardia lamblia
QAAKEGRL

SEQ ID NO: 3129228 - protein, 15 aa, Giardia lamblia
QAAKHPEDLPLTNTE

SEQ ID NO: 3129229 - protein, 10 aa, Giardia lamblia
QAAKNNEIAR

SEQ ID NO: 3129230 - protein, 7 aa, Giardia lamblia
QAANRAR

SEQ ID NO: 3129231 - protein, 6 aa, Giardia lamblia
QAAPDC

SEQ ID NO: 3129232 - protein, 6 aa, Giardia lamblia
QAAPHK

SEQ ID NO: 3129233 - protein, 6 aa, Giardia lamblia
QAAPLD

SEQ ID NO: 3129234 - protein, 8 aa, Giardia lamblia
QAAPSAVP

SEQ ID NO: 3129235 - protein, 7 aa, Giardia lamblia
QAAPTAP

SEQ ID NO: 3129236 - protein, 12 aa, Giardia lamblia
QAAQNEQQELAD

SEQ ID NO: 3129237 - protein, 5 aa, Giardia lamblia
QAARR

SEQ ID NO: 3129238 - protein, 7 aa, Giardia lamblia
QAASGDP

SEQ ID NO: 3129239 - protein, 7 aa, Giardia lamblia
QAASSGS

SEQ ID NO: 3129240 - protein, 4 aa, Giardia lamblia
QAAT

SEQ ID NO: 3129241 - protein, 14 aa, Giardia lamblia
QAATLDRADHQAAV

SEQ ID NO: 3129242 - protein, 14 aa, Giardia lamblia
QADAGAEELSDSRQ

SEQ ID NO: 3129243 - protein, 6 aa, Giardia lamblia
QADDGL

SEQ ID NO: 3129244 - protein, 20 aa, Giardia lamblia
QADESAKWTKRGVALFAALN

SEQ ID NO: 3129245 - protein, 7 aa, Giardia lamblia
QADGPAL

SEQ ID NO: 3129246 - protein, 15 aa, Giardia lamblia
QADGPIRYYLNLPLS

SEQ ID NO: 3129247 - protein, 15 aa, Giardia lamblia
QADNLNDNTDHKEVE

SEQ ID NO: 3129248 - protein, 13 aa, Giardia lamblia
QADPGRRGPAQQH

SEQ ID NO: 3129249 - protein, 17 aa, Giardia lamblia
QADQISSESIKKNPHLA

SEQ ID NO: 3129250 - protein, 25 aa, Giardia lamblia
QADSATEISVTQDGRRPLSAASEGV

SEQ ID NO: 3129251 - protein, 6 aa, Giardia lamblia
QADSDK

SEQ ID NO: 3129252 - protein, 10 aa, Giardia lamblia
QAEDGSEEIT

SEQ ID NO: 3129253 - protein, 34 aa, Giardia lamblia
QAEEARREEEARKRAAYERDRSHYEYNKDQADRL

SEQ ID NO: 3129254 - protein, 5 aa, Giardia lamblia
QAEEH

SEQ ID NO: 3129255 - protein, 4 aa, Giardia lamblia
QAEH

SEQ ID NO: 3129256 - protein, 11 aa, Giardia lamblia
QAEHKAREHSH

SEQ ID NO: 3129257 - protein, 5 aa, Giardia lamblia
QAEKE

SEQ ID NO: 3129258 - protein, 4 aa, Giardia lamblia
QAEN

SEQ ID NO: 3129259 - protein, 5 aa, Giardia lamblia
QAENL

SEQ ID NO: 3129260 - protein, 7 aa, Giardia lamblia
QAENRDL

SEQ ID NO: 3129261 - protein, 30 aa, Giardia lamblia
QAERRKDENRRTHRHEEVPSAASRVVHSVD

SEQ ID NO: 3129262 - protein, 7 aa, Giardia lamblia
QAETTVV

SEQ ID NO: 3129263 - protein, 8 aa, Giardia lamblia
QAEVSSDA

SEQ ID NO: 3129264 - protein, 4 aa, Giardia lamblia
QAFA

SEQ ID NO: 3129265 - protein, 14 aa, Giardia lamblia
QAFSPGSKPPLPSI

SEQ ID NO: 3129266 - protein, 5 aa, Giardia lamblia
QAGEI

SEQ ID NO: 3129267 - protein, 8 aa, Giardia lamblia
QAGETSPF

SEQ ID NO: 3129268 - protein, 7 aa, Giardia lamblia
QAGGNQR

SEQ ID NO: 3129269 - protein, 15 aa, Giardia lamblia
QAGGPKPQVPGQTEW

SEQ ID NO: 3129270 - protein, 9 aa, Giardia lamblia
QAGGYSAPK

SEQ ID NO: 3129271 - protein, 11 aa, Giardia lamblia
QAGHVNKAGET

SEQ ID NO: 3129272 - protein, 6 aa, Giardia lamblia
QAGKDG

SEQ ID NO: 3129273 - protein, 5 aa, Giardia lamblia
QAGKE

SEQ ID NO: 3129274 - protein, 7 aa, Giardia lamblia
QAGKGQT

SEQ ID NO: 3129275 - protein, 10 aa, Giardia lamblia
QAGKQDHHGK

SEQ ID NO: 3129276 - protein, 9 aa, Giardia lamblia
QAGLANRAG

SEQ ID NO: 3129277 - protein, 11 aa, Giardia lamblia
QAGLSKGKIQV

SEQ ID NO: 3129278 - protein, 4 aa, Giardia lamblia
QAGM

SEQ ID NO: 3129279 - protein, 8 aa, Giardia lamblia
QAGNLKKG

SEQ ID NO: 3129280 - protein, 10 aa, Giardia lamblia
QAGNRNPYDS

SEQ ID NO: 3129281 - protein, 6 aa, Giardia lamblia
QAGPFQ

SEQ ID NO: 3129282 - protein, 16 aa, Giardia lamblia
QAGPKRTIQQSKNSWS

SEQ ID NO: 3129283 - protein, 5 aa, Giardia lamblia
QAGPR

SEQ ID NO: 3129284 - protein, 9 aa, Giardia lamblia
QAGQGGTNG

SEQ ID NO: 3129285 - protein, 9 aa, Giardia lamblia
QAGQISSRG

SEQ ID NO: 3129286 - protein, 9 aa, Giardia lamblia
QAGQLTEAV

SEQ ID NO: 3129287 - protein, 7 aa, Giardia lamblia
QAGQRAS

SEQ ID NO: 3129288 - protein, 10 aa, Giardia lamblia
QAGRADSHRK

SEQ ID NO: 3129289 - protein, 10 aa, Giardia lamblia
QAGRVDTLGN

SEQ ID NO: 3129290 - protein, 6 aa, Giardia lamblia
QAGRVT

SEQ ID NO: 3129291 - protein, 5 aa, Giardia lamblia
QAGSI

SEQ ID NO: 3129292 - protein, 7 aa, Giardia lamblia
QAGSING

SEQ ID NO: 3129293 - protein, 9 aa, Giardia lamblia
QAGSYNSAG

SEQ ID NO: 3129294 - protein, 8 aa, Giardia lamblia
QAGTAGSC

SEQ ID NO: 3129295 - protein, 13 aa, Giardia lamblia
QAGTERDDEGNDS

SEQ ID NO: 3129296 - protein, 9 aa, Giardia lamblia
QAGTLDKAG

SEQ ID NO: 3129297 - protein, 43 aa, Giardia lamblia
QAGTPNQSQLGKGYMSSASTRTPASSSFAAGDDSRRSATEQPR

SEQ ID NO: 3129298 - protein, 11 aa, Giardia lamblia
QAGTRSATQAT

SEQ ID NO: 3129299 - protein, 9 aa, Giardia lamblia
QAGVHDGRG

SEQ ID NO: 3129300 - protein, 5 aa, Giardia lamblia
QAGYE

SEQ ID NO: 3129301 - protein, 7 aa, Giardia lamblia
QAHEGDL

SEQ ID NO: 3129302 - protein, 17 aa, Giardia lamblia
QAHEQSSHHTEGTVPNT

SEQ ID NO: 3129303 - protein, 7 aa, Giardia lamblia
QAHERRE

SEQ ID NO: 3129304 - protein, 9 aa, Giardia lamblia
QAHKGPGYV

SEQ ID NO: 3129305 - protein, 8 aa, Giardia lamblia
QAHSRDAT

SEQ ID NO: 3129306 - protein, 36 aa, Giardia lamblia
QAIEPKASGADTEADPKGDSTKETQGASAGKIEGSH

SEQ ID NO: 3129307 - protein, 15 aa, Giardia lamblia
QAIERARNGAGDGVD

SEQ ID NO: 3129308 - protein, 7 aa, Giardia lamblia
QAIPSRN

SEQ ID NO: 3129309 - protein, 13 aa, Giardia lamblia
QAIQASKTKGFQR

SEQ ID NO: 3129310 - protein, 12 aa, Giardia lamblia
QAIQGAATGANA

SEQ ID NO: 3129311 - protein, 20 aa, Giardia lamblia
QAITPGTAPKTDDASRPITQ

SEQ ID NO: 3129312 - protein, 6 aa, Giardia lamblia
QAITTK

SEQ ID NO: 3129313 - protein, 23 aa, Giardia lamblia
QAKAEPAKSDNTSDAAPKEADKS

SEQ ID NO: 3129314 - protein, 9 aa, Giardia lamblia
QAKAGDNVR

SEQ ID NO: 3129315 - protein, 4 aa, Giardia lamblia
QAKD

SEQ ID NO: 3129316 - protein, 22 aa, Giardia lamblia
QAKDQEDLRNNTSIKRREEELE

SEQ ID NO: 3129317 - protein, 8 aa, Giardia lamblia
QAKDQQYA

SEQ ID NO: 3129318 - protein, 10 aa, Giardia lamblia
QAKDTPGCST

SEQ ID NO: 3129319 - protein, 9 aa, Giardia lamblia
QAKEASLAQ

SEQ ID NO: 3129320 - protein, 21 aa, Giardia lamblia
QAKEEERRAELARTNDPTERR

SEQ ID NO: 3129321 - protein, 4 aa, Giardia lamblia
QAKG

SEQ ID NO: 3129322 - protein, 4 aa, Giardia lamblia
QAKK

SEQ ID NO: 3129323 - protein, 12 aa, Giardia lamblia
QAKKASTRPRRD

SEQ ID NO: 3129324 - protein, 8 aa, Giardia lamblia
QAKLDGTT

SEQ ID NO: 3129325 - protein, 12 aa, Giardia lamblia
QAKNNTSPKRYQ

SEQ ID NO: 3129326 - protein, 10 aa, Giardia lamblia
QAKRMGQRSP

SEQ ID NO: 3129327 - protein, 12 aa, Giardia lamblia
QAKSHPKSRGAL

SEQ ID NO: 3129328 - protein, 8 aa, Giardia lamblia
QAKSMEDY

SEQ ID NO: 3129329 - protein, 14 aa, Giardia lamblia
QAKSTELLQILGGE

SEQ ID NO: 3129330 - protein, 7 aa, Giardia lamblia
QAKSYEA

SEQ ID NO: 3129331 - protein, 4 aa, Giardia lamblia
QAKT

SEQ ID NO: 3129332 - protein, 19 aa, Giardia lamblia
QAKTASASLSSIASRPRPQ

SEQ ID NO: 3129333 - protein, 7 aa, Giardia lamblia
QAKTTEI

SEQ ID NO: 3129334 - protein, 12 aa, Giardia lamblia
QALADARSKLEE

SEQ ID NO: 3129335 - protein, 18 aa, Giardia lamblia
QALDEDKNDMGSSKEEIY

SEQ ID NO: 3129336 - protein, 7 aa, Giardia lamblia
QALEGEN

SEQ ID NO: 3129337 - protein, 16 aa, Giardia lamblia
QALEQQNSELREKNKK

SEQ ID NO: 3129338 - protein, 11 aa, Giardia lamblia
QALGGNSMNTD

SEQ ID NO: 3129339 - protein, 10 aa, Giardia lamblia
QALKDTSFER

SEQ ID NO: 3129340 - protein, 6 aa, Giardia lamblia
QALPGN

SEQ ID NO: 3129341 - protein, 19 aa, Giardia lamblia
QALQSSSGSTGSASTPNRH

SEQ ID NO: 3129342 - protein, 20 aa, Giardia lamblia
QALRDESNGPKHSKDTSVEL

SEQ ID NO: 3129343 - protein, 13 aa, Giardia lamblia
QALRSKPSSTVTE

SEQ ID NO: 3129344 - protein, 12 aa, Giardia lamblia
QALSPRSSNPIT

SEQ ID NO: 3129345 - protein, 6 aa, Giardia lamblia
QALSSS

SEQ ID NO: 3129346 - protein, 18 aa, Giardia lamblia
QALSTSKKGSASFASTTK

SEQ ID NO: 3129347 - protein, 4 aa, Giardia lamblia
QALT

SEQ ID NO: 3129348 - protein, 24 aa, Giardia lamblia
QANDNDNDNNDEETSNNSKSYPTL

SEQ ID NO: 3129349 - protein, 5 aa, Giardia lamblia
QANET

SEQ ID NO: 3129350 - protein, 5 aa, Giardia lamblia
QANGK

SEQ ID NO: 3129351 - protein, 10 aa, Giardia lamblia
QANGKTVKDW

SEQ ID NO: 3129352 - protein, 7 aa, Giardia lamblia
QANPTAP

SEQ ID NO: 3129353 - protein, 8 aa, Giardia lamblia
QANRPPTT

SEQ ID NO: 3129354 - protein, 6 aa, Giardia lamblia
QANRRQ

SEQ ID NO: 3129355 - protein, 9 aa, Giardia lamblia
QANSQGIPE

SEQ ID NO: 3129356 - protein, 8 aa, Giardia lamblia
QANTGTPE

SEQ ID NO: 3129357 - protein, 7 aa, Giardia lamblia
QAPDGKD

SEQ ID NO: 3129358 - protein, 6 aa, Giardia lamblia
QAPDKL

SEQ ID NO: 3129359 - protein, 7 aa, Giardia lamblia
QAPDSPT

SEQ ID NO: 3129360 - protein, 13 aa, Giardia lamblia
QAPDSRESLDRRD

SEQ ID NO: 3129361 - protein, 9 aa, Giardia lamblia
QAPEGSDSG

SEQ ID NO: 3129362 - protein, 16 aa, Giardia lamblia
QAPIGVSSQAAYNTDS

SEQ ID NO: 3129363 - protein, 9 aa, Giardia lamblia
QAPKAVSEL

SEQ ID NO: 3129364 - protein, 8 aa, Giardia lamblia
QAPPEAVQ

SEQ ID NO: 3129365 - protein, 18 aa, Giardia lamblia
QAPPLDRSLSKSTPDDVP

SEQ ID NO: 3129366 - protein, 6 aa, Giardia lamblia
QAPPQP

SEQ ID NO: 3129367 - protein, 10 aa, Giardia lamblia
QAPQIEKEKK

SEQ ID NO: 3129368 - protein, 9 aa, Giardia lamblia
QAPRQPSQH

SEQ ID NO: 3129369 - protein, 11 aa, Giardia lamblia
QAPSELETKQL

SEQ ID NO: 3129370 - protein, 13 aa, Giardia lamblia
QAPSHHYTNSSPV

SEQ ID NO: 3129371 - protein, 14 aa, Giardia lamblia
QAPSNLSARRSAQS

SEQ ID NO: 3129372 - protein, 16 aa, Giardia lamblia
QAPTAAEETNTNDRDF

SEQ ID NO: 3129373 - protein, 19 aa, Giardia lamblia
QAPTQESPEFTDPDSVAGM

SEQ ID NO: 3129374 - protein, 4 aa, Giardia lamblia
QAPY

SEQ ID NO: 3129375 - protein, 8 aa, Giardia lamblia
QAQAQTQL

SEQ ID NO: 3129376 - protein, 8 aa, Giardia lamblia
QAQEQLSQ

SEQ ID NO: 3129377 - protein, 7 aa, Giardia lamblia
QAQGLSE

SEQ ID NO: 3129378 - protein, 6 aa, Giardia lamblia
QAQKNF

SEQ ID NO: 3129379 - protein, 23 aa, Giardia lamblia
QAQLSDDAEVRIDKGDDRSFSTG

SEQ ID NO: 3129380 - protein, 7 aa, Giardia lamblia
QAQNAEP

SEQ ID NO: 3129381 - protein, 6 aa, Giardia lamblia
QAQNKS

SEQ ID NO: 3129382 - protein, 7 aa, Giardia lamblia
QAQPQAN

SEQ ID NO: 3129383 - protein, 56 aa, Giardia lamblia
QAQQPQSQTGPGRSSSTIKNQTNLVGGPSSSPRFSKPSTIIDGTQSPQRKATEHTP

SEQ ID NO: 3129384 - protein, 23 aa, Giardia lamblia
QAQQREHPKPVEETKKEERTKEP

SEQ ID NO: 3129385 - protein, 6 aa, Giardia lamblia
QAQSQL

SEQ ID NO: 3129386 - protein, 6 aa, Giardia lamblia
QAQSWP

SEQ ID NO: 3129387 - protein, 16 aa, Giardia lamblia
QAQTRADSEQKALESL

SEQ ID NO: 3129388 - protein, 9 aa, Giardia lamblia
QAQVAEQKK

SEQ ID NO: 3129389 - protein, 10 aa, Giardia lamblia
QAQVPAKQYN

SEQ ID NO: 3129390 - protein, 8 aa, Giardia lamblia
QAQWEGEM

SEQ ID NO: 3129391 - protein, 15 aa, Giardia lamblia
QARAQASRAEEATGE

SEQ ID NO: 3129392 - protein, 6 aa, Giardia lamblia
QARASQ

SEQ ID NO: 3129393 - protein, 9 aa, Giardia lamblia
QARCQDNRG

SEQ ID NO: 3129394 - protein, 31 aa, Giardia lamblia
QARCTGGLAGEQAQRDGSQSQRNRPWTEDEE

SEQ ID NO: 3129395 - protein, 10 aa, Giardia lamblia
QARDTTIQEQ

SEQ ID NO: 3129396 - protein, 8 aa, Giardia lamblia
QAREGSAE

SEQ ID NO: 3129397 - protein, 11 aa, Giardia lamblia
QARKADNEGKT

SEQ ID NO: 3129398 - protein, 18 aa, Giardia lamblia
QARMSGASTLSSITNRQS

SEQ ID NO: 3129399 - protein, 5 aa, Giardia lamblia
QARNP

SEQ ID NO: 3129400 - protein, 5 aa, Giardia lamblia
QARPH

SEQ ID NO: 3129401 - protein, 12 aa, Giardia lamblia
QARPKTAGTISE

SEQ ID NO: 3129402 - protein, 6 aa, Giardia lamblia
QARPLA

SEQ ID NO: 3129403 - protein, 19 aa, Giardia lamblia
QARQSSLRKKNEPRPLGPI

SEQ ID NO: 3129404 - protein, 16 aa, Giardia lamblia
QARTPHPGQPPERAVY

SEQ ID NO: 3129405 - protein, 15 aa, Giardia lamblia
QASAGKLERIYSTKE

SEQ ID NO: 3129406 - protein, 57 aa, Giardia lamblia
QASAPAGSSVSAGADVGTATIGGGRSGSANATAKSVSGGGASTGASTIGSAASLTNT

SEQ ID NO: 3129407 - protein, 14 aa, Giardia lamblia
QASDEHAAGSRELE

SEQ ID NO: 3129408 - protein, 13 aa, Giardia lamblia
QASEAASYTHKEQ

SEQ ID NO: 3129409 - protein, 5 aa, Giardia lamblia
QASES

SEQ ID NO: 3129410 - protein, 41 aa, Giardia lamblia
QASGKEGAAGEPDVEAKSTAPASPTKSPSGSPSKPSTQVGA

SEQ ID NO: 3129411 - protein, 10 aa, Giardia lamblia
QASKAQQYRD

SEQ ID NO: 3129412 - protein, 9 aa, Giardia lamblia
QASKDAIDQ

SEQ ID NO: 3129413 - protein, 8 aa, Giardia lamblia
QASKEASL

SEQ ID NO: 3129414 - protein, 11 aa, Giardia lamblia
QASLDETAEGI

SEQ ID NO: 3129415 - protein, 21 aa, Giardia lamblia
QASLDGLATGDVEDGGSSCKL

SEQ ID NO: 3129416 - protein, 4 aa, Giardia lamblia
QASM

SEQ ID NO: 3129417 - protein, 8 aa, Giardia lamblia
QASNGATS

SEQ ID NO: 3129418 - protein, 7 aa, Giardia lamblia
QASNGGV

SEQ ID NO: 3129419 - protein, 7 aa, Giardia lamblia
QASNSNL

SEQ ID NO: 3129420 - protein, 15 aa, Giardia lamblia
QASPHQGGESYGEQR

SEQ ID NO: 3129421 - protein, 8 aa, Giardia lamblia
QASPSLPR

SEQ ID NO: 3129422 - protein, 9 aa, Giardia lamblia
QASPTSSVP

SEQ ID NO: 3129423 - protein, 16 aa, Giardia lamblia
QASQGDTKAEQNLERT

SEQ ID NO: 3129424 - protein, 26 aa, Giardia lamblia
QASQIESLQKKNEELRNAGPNSSDTV

SEQ ID NO: 3129425 - protein, 9 aa, Giardia lamblia
QASQQYQQQ

SEQ ID NO: 3129426 - protein, 17 aa, Giardia lamblia
QASRAPEPLASSGSLMS

SEQ ID NO: 3129427 - protein, 8 aa, Giardia lamblia
QASRPVTP

SEQ ID NO: 3129428 - protein, 6 aa, Giardia lamblia
QASSAA

SEQ ID NO: 3129429 - protein, 7 aa, Giardia lamblia
QASSEGD

SEQ ID NO: 3129430 - protein, 10 aa, Giardia lamblia
QASSGNTTAL

SEQ ID NO: 3129431 - protein, 10 aa, Giardia lamblia
QASSPDQKEN

SEQ ID NO: 3129432 - protein, 7 aa, Giardia lamblia
QASSPSA

SEQ ID NO: 3129433 - protein, 8 aa, Giardia lamblia
QASTAAYN

SEQ ID NO: 3129434 - protein, 13 aa, Giardia lamblia
QASTKSADDGPRL

SEQ ID NO: 3129435 - protein, 6 aa, Giardia lamblia
QASTQG

SEQ ID NO: 3129436 - protein, 21 aa, Giardia lamblia
QASYDESIANRTRLESEIEET

SEQ ID NO: 3129437 - protein, 7 aa, Giardia lamblia
QASYNQA

SEQ ID NO: 3129438 - protein, 14 aa, Giardia lamblia
QATAAKISETGDTA

SEQ ID NO: 3129439 - protein, 7 aa, Giardia lamblia
QATANVG

SEQ ID NO: 3129440 - protein, 9 aa, Giardia lamblia
QATDETSRL

SEQ ID NO: 3129441 - protein, 9 aa, Giardia lamblia
QATGEQAHS

SEQ ID NO: 3129442 - protein, 18 aa, Giardia lamblia
QATGNVKGLGRQRDCPYS

SEQ ID NO: 3129443 - protein, 12 aa, Giardia lamblia
QATGVDNKASLQ

SEQ ID NO: 3129444 - protein, 15 aa, Giardia lamblia
QATHPTSPPPAPSNI

SEQ ID NO: 3129445 - protein, 6 aa, Giardia lamblia
QATNAA

SEQ ID NO: 3129446 - protein, 7 aa, Giardia lamblia
QATNPAY

SEQ ID NO: 3129447 - protein, 18 aa, Giardia lamblia
QATNQASCCGSTSCHAAK

SEQ ID NO: 3129448 - protein, 6 aa, Giardia lamblia
QATNTG

SEQ ID NO: 3129449 - protein, 7 aa, Giardia lamblia
QATPFTP

SEQ ID NO: 3129450 - protein, 9 aa, Giardia lamblia
QATPPHPYA

SEQ ID NO: 3129451 - protein, 5 aa, Giardia lamblia
QATPV

SEQ ID NO: 3129452 - protein, 5 aa, Giardia lamblia
QATRN

SEQ ID NO: 3129453 - protein, 5 aa, Giardia lamblia
QATSE

SEQ ID NO: 3129454 - protein, 34 aa, Giardia lamblia
QATSSGTSPAQESSGSSDEKKAIDQSSLNEPQTI

SEQ ID NO: 3129455 - protein, 14 aa, Giardia lamblia
QATTESINSSLTTS

SEQ ID NO: 3129456 - protein, 7 aa, Giardia lamblia
QATTQCG

SEQ ID NO: 3129457 - protein, 25 aa, Giardia lamblia
QATTSSEAQGLKPPAVEADQSRFEP

SEQ ID NO: 3129458 - protein, 14 aa, Giardia lamblia
QATTTRTSPHVQPK

SEQ ID NO: 3129459 - protein, 6 aa, Giardia lamblia
QATTYA

SEQ ID NO: 3129460 - protein, 29 aa, Giardia lamblia
QAVEDALRDADDSKPSSTLGSGRAKELAK

SEQ ID NO: 3129461 - protein, 7 aa, Giardia lamblia
QAVGDTA

SEQ ID NO: 3129462 - protein, 18 aa, Giardia lamblia
QAVSAGGYDTKTFSAKGV

SEQ ID NO: 3129463 - protein, 5 aa, Giardia lamblia
QAVTP

SEQ ID NO: 3129464 - protein, 10 aa, Giardia lamblia
QAVTTSGKAL

SEQ ID NO: 3129465 - protein, 5 aa, Giardia lamblia
QAYAQ

SEQ ID NO: 3129466 - protein, 6 aa, Giardia lamblia
QAYDGQ

SEQ ID NO: 3129467 - protein, 8 aa, Giardia lamblia
QAYEPKSP

SEQ ID NO: 3129468 - protein, 15 aa, Giardia lamblia
QAYQERARAEKEELK

SEQ ID NO: 3129469 - protein, 6 aa, Giardia lamblia
QCDTTN

SEQ ID NO: 3129470 - protein, 6 aa, Giardia lamblia
QCEGEL

SEQ ID NO: 3129471 - protein, 19 aa, Giardia lamblia
QCNTARDQSKQQKQAIRGG

SEQ ID NO: 3129472 - protein, 11 aa, Giardia lamblia
QCPKDQNADTL

SEQ ID NO: 3129473 - protein, 11 aa, Giardia lamblia
QCSASQSPTMF

SEQ ID NO: 3129474 - protein, 10 aa, Giardia lamblia
QCSKDDQQVR

SEQ ID NO: 3129475 - protein, 11 aa, Giardia lamblia
QCSSSSRSEMI

SEQ ID NO: 3129476 - protein, 11 aa, Giardia lamblia
QCTDSTRDSDI

SEQ ID NO: 3129477 - protein, 7 aa, Giardia lamblia
QCTERTG

SEQ ID NO: 3129478 - protein, 9 aa, Giardia lamblia
QCTGANPRY

SEQ ID NO: 3129479 - protein, 14 aa, Giardia lamblia
QCTNTSEAPHNGNC

SEQ ID NO: 3129480 - protein, 5 aa, Giardia lamblia
QCTRD

SEQ ID NO: 3129481 - protein, 7 aa, Giardia lamblia
QDADGNT

SEQ ID NO: 3129482 - protein, 9 aa, Giardia lamblia
QDADSKPLE

SEQ ID NO: 3129483 - protein, 5 aa, Giardia lamblia
QDAEG

SEQ ID NO: 3129484 - protein, 8 aa, Giardia lamblia
QDAENECE

SEQ ID NO: 3129485 - protein, 14 aa, Giardia lamblia
QDAHGQTAEPAGPV

SEQ ID NO: 3129486 - protein, 6 aa, Giardia lamblia
QDAHSN

SEQ ID NO: 3129487 - protein, 10 aa, Giardia lamblia
QDAMNSDKGG

SEQ ID NO: 3129488 - protein, 11 aa, Giardia lamblia
QDAPRGKSEKI

SEQ ID NO: 3129489 - protein, 10 aa, Giardia lamblia
QDAPSSKTSL

SEQ ID NO: 3129490 - protein, 8 aa, Giardia lamblia
QDAPTIQA

SEQ ID NO: 3129491 - protein, 4 aa, Giardia lamblia
QDAQ

SEQ ID NO: 3129492 - protein, 38 aa, Giardia lamblia
QDAQTTLQNDTISTARSGRVNGQFDSGTTTNQKSQIQH

SEQ ID NO: 3129493 - protein, 7 aa, Giardia lamblia
QDARGKT

SEQ ID NO: 3129494 - protein, 7 aa, Giardia lamblia
QDASGQT

SEQ ID NO: 3129495 - protein, 9 aa, Giardia lamblia
QDASTSAAD

SEQ ID NO: 3129496 - protein, 7 aa, Giardia lamblia
QDASVSK

SEQ ID NO: 3129497 - protein, 10 aa, Giardia lamblia
QDASYTENSA

SEQ ID NO: 3129498 - protein, 8 aa, Giardia lamblia
QDATGKPI

SEQ ID NO: 3129499 - protein, 11 aa, Giardia lamblia
QDAVDARGQLD

SEQ ID NO: 3129500 - protein, 6 aa, Giardia lamblia
QDCDGD

SEQ ID NO: 3129501 - protein, 6 aa, Giardia lamblia
QDCEGR

SEQ ID NO: 3129502 - protein, 13 aa, Giardia lamblia
QDDDDTDLQSKTM

SEQ ID NO: 3129503 - protein, 8 aa, Giardia lamblia
QDDDVTDT

SEQ ID NO: 3129504 - protein, 8 aa, Giardia lamblia
QDDENYKM

SEQ ID NO: 3129505 - protein, 4 aa, Giardia lamblia
QDDK

SEQ ID NO: 3129506 - protein, 15 aa, Giardia lamblia
QDDNLEMSEASATAA

SEQ ID NO: 3129507 - protein, 8 aa, Giardia lamblia
QDDPDEAA

SEQ ID NO: 3129508 - protein, 7 aa, Giardia lamblia
QDDQDSA

SEQ ID NO: 3129509 - protein, 12 aa, Giardia lamblia
QDDQPLSSAVEE

SEQ ID NO: 3129510 - protein, 13 aa, Giardia lamblia
QDDYPNPVTTATQ

SEQ ID NO: 3129511 - protein, 17 aa, Giardia lamblia
QDEDSISLGESGSVQVT

SEQ ID NO: 3129512 - protein, 16 aa, Giardia lamblia
QDEENMEEKKRWEEEE

SEQ ID NO: 3129513 - protein, 5 aa, Giardia lamblia
QDEET

SEQ ID NO: 3129514 - protein, 5 aa, Giardia lamblia
QDEFS

SEQ ID NO: 3129515 - protein, 8 aa, Giardia lamblia
QDEGGGGT

SEQ ID NO: 3129516 - protein, 6 aa, Giardia lamblia
QDEISR

SEQ ID NO: 3129517 - protein, 11 aa, Giardia lamblia
QDEKIEEASYQ

SEQ ID NO: 3129518 - protein, 7 aa, Giardia lamblia
QDENGTT

SEQ ID NO: 3129519 - protein, 9 aa, Giardia lamblia
QDENQSLST

SEQ ID NO: 3129520 - protein, 6 aa, Giardia lamblia
QDEPSM

SEQ ID NO: 3129521 - protein, 4 aa, Giardia lamblia
QDEQ

SEQ ID NO: 3129522 - protein, 13 aa, Giardia lamblia
QDEQDPSATVTAS

SEQ ID NO: 3129523 - protein, 4 aa, Giardia lamblia
QDER

SEQ ID NO: 3129524 - protein, 27 aa, Giardia lamblia
QDERDRRMTTQDLEPGSSMTSTTTSTA

SEQ ID NO: 3129525 - protein, 5 aa, Giardia lamblia
QDERG

SEQ ID NO: 3129526 - protein, 4 aa, Giardia lamblia
QDES

SEQ ID NO: 3129527 - protein, 15 aa, Giardia lamblia
QDESSADESSPSDCC

SEQ ID NO: 3129528 - protein, 15 aa, Giardia lamblia
QDETEPAETRKAETK

SEQ ID NO: 3129529 - protein, 8 aa, Giardia lamblia
QDETKTDV

SEQ ID NO: 3129530 - protein, 10 aa, Giardia lamblia
QDETVGDGTT

SEQ ID NO: 3129531 - protein, 7 aa, Giardia lamblia
QDEYEDL

SEQ ID NO: 3129532 - protein, 14 aa, Giardia lamblia
QDFSPKDRVSKGGL

SEQ ID NO: 3129533 - protein, 9 aa, Giardia lamblia
QDGAITKKK

SEQ ID NO: 3129534 - protein, 5 aa, Giardia lamblia
QDGDT

SEQ ID NO: 3129535 - protein, 8 aa, Giardia lamblia
QDGDTQMP

SEQ ID NO: 3129536 - protein, 7 aa, Giardia lamblia
QDGKGST

SEQ ID NO: 3129537 - protein, 5 aa, Giardia lamblia
QDGLG

SEQ ID NO: 3129538 - protein, 7 aa, Giardia lamblia
QDGNGTT

SEQ ID NO: 3129539 - protein, 4 aa, Giardia lamblia
QDGS

SEQ ID NO: 3129540 - protein, 18 aa, Giardia lamblia
QDGSGSRVAPPASGTFTT

SEQ ID NO: 3129541 - protein, 6 aa, Giardia lamblia
QDGTGV

SEQ ID NO: 3129542 - protein, 28 aa, Giardia lamblia
QDGVEKDDMQPDRAYSGSEVDSSADPTV

SEQ ID NO: 3129543 - protein, 6 aa, Giardia lamblia
QDHNDP

SEQ ID NO: 3129544 - protein, 9 aa, Giardia lamblia
QDHSKYRLT

SEQ ID NO: 3129545 - protein, 11 aa, Giardia lamblia
QDIDGAMSGDA

SEQ ID NO: 3129546 - protein, 7 aa, Giardia lamblia
QDIPARL

SEQ ID NO: 3129547 - protein, 17 aa, Giardia lamblia
QDKDSTLISKKSSSSYI

SEQ ID NO: 3129548 - protein, 6 aa, Giardia lamblia
QDKEGL

SEQ ID NO: 3129549 - protein, 7 aa, Giardia lamblia
QDKEGLT

SEQ ID NO: 3129550 - protein, 7 aa, Giardia lamblia
QDKEKYA

SEQ ID NO: 3129551 - protein, 8 aa, Giardia lamblia
QDKETGER

SEQ ID NO: 3129552 - protein, 8 aa, Giardia lamblia
QDKGNGKY

SEQ ID NO: 3129553 - protein, 4 aa, Giardia lamblia
QDKH

SEQ ID NO: 3129554 - protein, 9 aa, Giardia lamblia
QDKKEHVQK

SEQ ID NO: 3129555 - protein, 8 aa, Giardia lamblia
QDKNHEAA

SEQ ID NO: 3129556 - protein, 9 aa, Giardia lamblia
QDKNSNTRL

SEQ ID NO: 3129557 - protein, 7 aa, Giardia lamblia
QDKRGRT

SEQ ID NO: 3129558 - protein, 8 aa, Giardia lamblia
QDKRGRTA

SEQ ID NO: 3129559 - protein, 9 aa, Giardia lamblia
QDKRGRTAL

SEQ ID NO: 3129560 - protein, 6 aa, Giardia lamblia
QDKRPT

SEQ ID NO: 3129561 - protein, 5 aa, Giardia lamblia
QDLAE

SEQ ID NO: 3129562 - protein, 5 aa, Giardia lamblia
QDLEA

SEQ ID NO: 3129563 - protein, 10 aa, Giardia lamblia
QDLNEEYKRE

SEQ ID NO: 3129564 - protein, 13 aa, Giardia lamblia
QDLPKAMSTTDLT

SEQ ID NO: 3129565 - protein, 13 aa, Giardia lamblia
QDLPQNAPITKDN

SEQ ID NO: 3129566 - protein, 6 aa, Giardia lamblia
QDLPRR

SEQ ID NO: 3129567 - protein, 5 aa, Giardia lamblia
QDLPS

SEQ ID NO: 3129568 - protein, 12 aa, Giardia lamblia
QDLPVDDSSMAE

SEQ ID NO: 3129569 - protein, 9 aa, Giardia lamblia
QDLQDKKGI

SEQ ID NO: 3129570 - protein, 20 aa, Giardia lamblia
QDLQSPKGSSSGATRTPRTA

SEQ ID NO: 3129571 - protein, 15 aa, Giardia lamblia
QDLSGKATVQSTDDA

SEQ ID NO: 3129572 - protein, 6 aa, Giardia lamblia
QDLSGR

SEQ ID NO: 3129573 - protein, 17 aa, Giardia lamblia
QDLTATYQSTSNVGSHS

SEQ ID NO: 3129574 - protein, 8 aa, Giardia lamblia
QDLTPEQL

SEQ ID NO: 3129575 - protein, 8 aa, Giardia lamblia
QDLYQTPS

SEQ ID NO: 3129576 - protein, 7 aa, Giardia lamblia
QDNDPAL

SEQ ID NO: 3129577 - protein, 8 aa, Giardia lamblia
QDNEGRTA

SEQ ID NO: 3129578 - protein, 10 aa, Giardia lamblia
QDNEIGDGTT

SEQ ID NO: 3129579 - protein, 11 aa, Giardia lamblia
QDNERALNTSV

SEQ ID NO: 3129580 - protein, 7 aa, Giardia lamblia
QDNESTV

SEQ ID NO: 3129581 - protein, 9 aa, Giardia lamblia
QDNEYNEEE

SEQ ID NO: 3129582 - protein, 6 aa, Giardia lamblia
QDNGRG

SEQ ID NO: 3129583 - protein, 8 aa, Giardia lamblia
QDNNDRNS

SEQ ID NO: 3129584 - protein, 5 aa, Giardia lamblia
QDNNG

SEQ ID NO: 3129585 - protein, 13 aa, Giardia lamblia
QDNPDWENLNSTE

SEQ ID NO: 3129586 - protein, 15 aa, Giardia lamblia
QDNPFGDDQSQEANL

SEQ ID NO: 3129587 - protein, 5 aa, Giardia lamblia
QDNPK

SEQ ID NO: 3129588 - protein, 8 aa, Giardia lamblia
QDNQGKTA

SEQ ID NO: 3129589 - protein, 16 aa, Giardia lamblia
QDNTGQTRAVSDDAND

SEQ ID NO: 3129590 - protein, 22 aa, Giardia lamblia
QDPAESKEPEVYKATESPTNER

SEQ ID NO: 3129591 - protein, 7 aa, Giardia lamblia
QDPDGSH

SEQ ID NO: 3129592 - protein, 10 aa, Giardia lamblia
QDPDKRPSAS

SEQ ID NO: 3129593 - protein, 7 aa, Giardia lamblia
QDPEGKT

SEQ ID NO: 3129594 - protein, 5 aa, Giardia lamblia
QDPER

SEQ ID NO: 3129595 - protein, 14 aa, Giardia lamblia
QDPKRYKSNISTTS

SEQ ID NO: 3129596 - protein, 8 aa, Giardia lamblia
QDPLPSSD

SEQ ID NO: 3129597 - protein, 6 aa, Giardia lamblia
QDPNGI

SEQ ID NO: 3129598 - protein, 8 aa, Giardia lamblia
QDPNTQFN

SEQ ID NO: 3129599 - protein, 5 aa, Giardia lamblia
QDPPG

SEQ ID NO: 3129600 - protein, 37 aa, Giardia lamblia
QDPPTRTTTPRRMKSPGKMAKDDDQSIGRRSPALDTS

SEQ ID NO: 3129601 - protein, 7 aa, Giardia lamblia
QDPSSYT

SEQ ID NO: 3129602 - protein, 4 aa, Giardia lamblia
QDPY

SEQ ID NO: 3129603 - protein, 13 aa, Giardia lamblia
QDQADDYDSADEL

SEQ ID NO: 3129604 - protein, 4 aa, Giardia lamblia
QDQD

SEQ ID NO: 3129605 - protein, 5 aa, Giardia lamblia
QDQED

SEQ ID NO: 3129606 - protein, 8 aa, Giardia lamblia
QDQKPFGE

SEQ ID NO: 3129607 - protein, 6 aa, Giardia lamblia
QDQLED

SEQ ID NO: 3129608 - protein, 7 aa, Giardia lamblia
QDQNREV

SEQ ID NO: 3129609 - protein, 10 aa, Giardia lamblia
QDQNSSLEKM

SEQ ID NO: 3129610 - protein, 6 aa, Giardia lamblia
QDQPLN

SEQ ID NO: 3129611 - protein, 4 aa, Giardia lamblia
QDQR

SEQ ID NO: 3129612 - protein, 6 aa, Giardia lamblia
QDQVPD

SEQ ID NO: 3129613 - protein, 6 aa, Giardia lamblia
QDQYGR

SEQ ID NO: 3129614 - protein, 10 aa, Giardia lamblia
QDRAGAAQTA

SEQ ID NO: 3129615 - protein, 7 aa, Giardia lamblia
QDRAGRT

SEQ ID NO: 3129616 - protein, 10 aa, Giardia lamblia
QDREVGDGTT

SEQ ID NO: 3129617 - protein, 6 aa, Giardia lamblia
QDRGSE

SEQ ID NO: 3129618 - protein, 8 aa, Giardia lamblia
QDRHGDQS

SEQ ID NO: 3129619 - protein, 12 aa, Giardia lamblia
QDRKAASRTPIS

SEQ ID NO: 3129620 - protein, 6 aa, Giardia lamblia
QDRKRD

SEQ ID NO: 3129621 - protein, 18 aa, Giardia lamblia
QDRNHKNQQSKAENKNLN

SEQ ID NO: 3129622 - protein, 4 aa, Giardia lamblia
QDRT

SEQ ID NO: 3129623 - protein, 14 aa, Giardia lamblia
QDRTEKAEQLASGL

SEQ ID NO: 3129624 - protein, 14 aa, Giardia lamblia
QDRTRRNKQDKSRA

SEQ ID NO: 3129625 - protein, 12 aa, Giardia lamblia
QDRVQRRSSSYY

SEQ ID NO: 3129626 - protein, 7 aa, Giardia lamblia
QDSAASS

SEQ ID NO: 3129627 - protein, 5 aa, Giardia lamblia
QDSDG

SEQ ID NO: 3129628 - protein, 12 aa, Giardia lamblia
QDSEEDLDDAEE

SEQ ID NO: 3129629 - protein, 8 aa, Giardia lamblia
QDSEKAYE

SEQ ID NO: 3129630 - protein, 7 aa, Giardia lamblia
QDSETQH

SEQ ID NO: 3129631 - protein, 5 aa, Giardia lamblia
QDSGG

SEQ ID NO: 3129632 - protein, 8 aa, Giardia lamblia
QDSGNNTA

SEQ ID NO: 3129633 - protein, 9 aa, Giardia lamblia
QDSGSTSLS

SEQ ID NO: 3129634 - protein, 7 aa, Giardia lamblia
QDSIDDK

SEQ ID NO: 3129635 - protein, 11 aa, Giardia lamblia
QDSKQTQKRID

SEQ ID NO: 3129636 - protein, 4 aa, Giardia lamblia
QDSL

SEQ ID NO: 3129637 - protein, 10 aa, Giardia lamblia
QDSLKQPDFN

SEQ ID NO: 3129638 - protein, 11 aa, Giardia lamblia
QDSLSTNITSG

SEQ ID NO: 3129639 - protein, 6 aa, Giardia lamblia
QDSNGC

SEQ ID NO: 3129640 - protein, 7 aa, Giardia lamblia
QDSNSGS

SEQ ID NO: 3129641 - protein, 6 aa, Giardia lamblia
QDSPAR

SEQ ID NO: 3129642 - protein, 10 aa, Giardia lamblia
QDSPDPSLQS

SEQ ID NO: 3129643 - protein, 8 aa, Giardia lamblia
QDSPQSSQ

SEQ ID NO: 3129644 - protein, 7 aa, Giardia lamblia
QDSPSLI

SEQ ID NO: 3129645 - protein, 8 aa, Giardia lamblia
QDSRADIE

SEQ ID NO: 3129646 - protein, 7 aa, Giardia lamblia
QDSRGRT

SEQ ID NO: 3129647 - protein, 8 aa, Giardia lamblia
QDSSGGED

SEQ ID NO: 3129648 - protein, 7 aa, Giardia lamblia
QDSTPHL

SEQ ID NO: 3129649 - protein, 9 aa, Giardia lamblia
QDTAADNER

SEQ ID NO: 3129650 - protein, 8 aa, Giardia lamblia
QDTDGNSA

SEQ ID NO: 3129651 - protein, 6 aa, Giardia lamblia
QDTEEA

SEQ ID NO: 3129652 - protein, 9 aa, Giardia lamblia
QDTEERRRR

SEQ ID NO: 3129653 - protein, 25 aa, Giardia lamblia
QDTEKSGAFYSSPQQSMAAAGDLKT

SEQ ID NO: 3129654 - protein, 11 aa, Giardia lamblia
QDTEVRNTERE

SEQ ID NO: 3129655 - protein, 4 aa, Giardia lamblia
QDTG

SEQ ID NO: 3129656 - protein, 7 aa, Giardia lamblia
QDTHEDL

SEQ ID NO: 3129657 - protein, 12 aa, Giardia lamblia
QDTKKDYSTPYT

SEQ ID NO: 3129658 - protein, 10 aa, Giardia lamblia
QDTKSADPSL

SEQ ID NO: 3129659 - protein, 6 aa, Giardia lamblia
QDTLGQ

SEQ ID NO: 3129660 - protein, 14 aa, Giardia lamblia
QDTLSSSCANSPRE

SEQ ID NO: 3129661 - protein, 8 aa, Giardia lamblia
QDTPGAQL

SEQ ID NO: 3129662 - protein, 10 aa, Giardia lamblia
QDTPVSTGHK

SEQ ID NO: 3129663 - protein, 9 aa, Giardia lamblia
QDTRENARH

SEQ ID NO: 3129664 - protein, 10 aa, Giardia lamblia
QDTTEALKTT

SEQ ID NO: 3129665 - protein, 21 aa, Giardia lamblia
QDTTTSEETFSSSNQDDSPMP

SEQ ID NO: 3129666 - protein, 8 aa, Giardia lamblia
QDTTWKPY

SEQ ID NO: 3129667 - protein, 6 aa, Giardia lamblia
QDVEGR

SEQ ID NO: 3129668 - protein, 13 aa, Giardia lamblia
QDVSPQLTQHSQQ

SEQ ID NO: 3129669 - protein, 6 aa, Giardia lamblia
QDYDGK

SEQ ID NO: 3129670 - protein, 14 aa, Giardia lamblia
QDYDTTAKGYSPEQ

SEQ ID NO: 3129671 - protein, 7 aa, Giardia lamblia
QDYKGRT

SEQ ID NO: 3129672 - protein, 5 aa, Giardia lamblia
QDYQG

SEQ ID NO: 3129673 - protein, 14 aa, Giardia lamblia
QDYSGKDSVSEEVP

SEQ ID NO: 3129674 - protein, 6 aa, Giardia lamblia
QDYTGK

SEQ ID NO: 3129675 - protein, 12 aa, Giardia lamblia
QEAAAAYSVGKT

SEQ ID NO: 3129676 - protein, 13 aa, Giardia lamblia
QEAAELKNKEVDA

SEQ ID NO: 3129677 - protein, 5 aa, Giardia lamblia
QEAAR

SEQ ID NO: 3129678 - protein, 22 aa, Giardia lamblia
QEADREEEETRRRAKAEEERQI

SEQ ID NO: 3129679 - protein, 40 aa, Giardia lamblia
QEAEKNERSAARARAELKRASSVSRKRPSSGYGMGQSGQL

SEQ ID NO: 3129680 - protein, 13 aa, Giardia lamblia
QEAEKSAKENDGV

SEQ ID NO: 3129681 - protein, 7 aa, Giardia lamblia
QEAEPQT

SEQ ID NO: 3129682 - protein, 4 aa, Giardia lamblia
QEAG

SEQ ID NO: 3129683 - protein, 10 aa, Giardia lamblia
QEAKPQHPQT

SEQ ID NO: 3129684 - protein, 4 aa, Giardia lamblia
QEAM

SEQ ID NO: 3129685 - protein, 7 aa, Giardia lamblia
QEAPDKS

SEQ ID NO: 3129686 - protein, 8 aa, Giardia lamblia
QEAPQPRE

SEQ ID NO: 3129687 - protein, 6 aa, Giardia lamblia
QEAPTN

SEQ ID NO: 3129688 - protein, 7 aa, Giardia lamblia
QEAQQNA

SEQ ID NO: 3129689 - protein, 7 aa, Giardia lamblia
QEARAEA

SEQ ID NO: 3129690 - protein, 10 aa, Giardia lamblia
QEARARAKEV

SEQ ID NO: 3129691 - protein, 10 aa, Giardia lamblia
QEARELEQQR

SEQ ID NO: 3129692 - protein, 9 aa, Giardia lamblia
QEARKQGAF

SEQ ID NO: 3129693 - protein, 8 aa, Giardia lamblia
QEASTASR

SEQ ID NO: 3129694 - protein, 9 aa, Giardia lamblia
QEATATNLT

SEQ ID NO: 3129695 - protein, 6 aa, Giardia lamblia
QEATNA

SEQ ID NO: 3129696 - protein, 13 aa, Giardia lamblia
QEATNVDNSWDDA

SEQ ID NO: 3129697 - protein, 33 aa, Giardia lamblia
QEATRTSSKEQRRPSPTQVPARGKGADAKKEVR

SEQ ID NO: 3129698 - protein, 5 aa, Giardia lamblia
QEATT

SEQ ID NO: 3129699 - protein, 6 aa, Giardia lamblia
QECAGA

SEQ ID NO: 3129700 - protein, 4 aa, Giardia lamblia
QECE

SEQ ID NO: 3129701 - protein, 12 aa, Giardia lamblia
QECRDPKPTYQT

SEQ ID NO: 3129702 - protein, 4 aa, Giardia lamblia
QEDD

SEQ ID NO: 3129703 - protein, 4 aa, Giardia lamblia
QEDE

SEQ ID NO: 3129704 - protein, 8 aa, Giardia lamblia
QEDGDRQL

SEQ ID NO: 3129705 - protein, 8 aa, Giardia lamblia
QEDKTAVT

SEQ ID NO: 3129706 - protein, 5 aa, Giardia lamblia
QEDLQ

SEQ ID NO: 3129707 - protein, 5 aa, Giardia lamblia
QEDMS

SEQ ID NO: 3129708 - protein, 6 aa, Giardia lamblia
QEDPAS

SEQ ID NO: 3129709 - protein, 7 aa, Giardia lamblia
QEDPVGS

SEQ ID NO: 3129710 - protein, 5 aa, Giardia lamblia
QEDQE

SEQ ID NO: 3129711 - protein, 7 aa, Giardia lamblia
QEDSEGA

SEQ ID NO: 3129712 - protein, 14 aa, Giardia lamblia
QEDSREVGMQDEQG

SEQ ID NO: 3129713 - protein, 6 aa, Giardia lamblia
QEDTEL

SEQ ID NO: 3129714 - protein, 13 aa, Giardia lamblia
QEDVSGDAENNKL

SEQ ID NO: 3129715 - protein, 8 aa, Giardia lamblia
QEEADRIY

SEQ ID NO: 3129716 - protein, 5 aa, Giardia lamblia
QEEAS

SEQ ID NO: 3129717 - protein, 10 aa, Giardia lamblia
QEEHAANESD

SEQ ID NO: 3129718 - protein, 5 aa, Giardia lamblia
QEEID

SEQ ID NO: 3129719 - protein, 5 aa, Giardia lamblia
QEEIE

SEQ ID NO: 3129720 - protein, 6 aa, Giardia lamblia
QEEITK

SEQ ID NO: 3129721 - protein, 4 aa, Giardia lamblia
QEEK

SEQ ID NO: 3129722 - protein, 5 aa, Giardia lamblia
QEEKY

SEQ ID NO: 3129723 - protein, 6 aa, Giardia lamblia
QEELNA

SEQ ID NO: 3129724 - protein, 23 aa, Giardia lamblia
QEEMHTDTANSWPDPGQGTEAEF

SEQ ID NO: 3129725 - protein, 4 aa, Giardia lamblia
QEEN

SEQ ID NO: 3129726 - protein, 10 aa, Giardia lamblia
QEENASEFKR

SEQ ID NO: 3129727 - protein, 10 aa, Giardia lamblia
QEENEDSDET

SEQ ID NO: 3129728 - protein, 12 aa, Giardia lamblia
QEENSKLRDSYA

SEQ ID NO: 3129729 - protein, 23 aa, Giardia lamblia
QEENSTVEGQAVSEKNEQLTTTD

SEQ ID NO: 3129730 - protein, 6 aa, Giardia lamblia
QEEPAS

SEQ ID NO: 3129731 - protein, 7 aa, Giardia lamblia
QEEQLSS

SEQ ID NO: 3129732 - protein, 5 aa, Giardia lamblia
QEERR

SEQ ID NO: 3129733 - protein, 4 aa, Giardia lamblia
QEES

SEQ ID NO: 3129734 - protein, 10 aa, Giardia lamblia
QEETSTCSET

SEQ ID NO: 3129735 - protein, 4 aa, Giardia lamblia
QEEV

SEQ ID NO: 3129736 - protein, 19 aa, Giardia lamblia
QEFENTKAELSKVQASEAA

SEQ ID NO: 3129737 - protein, 6 aa, Giardia lamblia
QEFSTA

SEQ ID NO: 3129738 - protein, 10 aa, Giardia lamblia
QEGAQDAYGK

SEQ ID NO: 3129739 - protein, 12 aa, Giardia lamblia
QEGAVKNAAGEL

SEQ ID NO: 3129740 - protein, 5 aa, Giardia lamblia
QEGHK

SEQ ID NO: 3129741 - protein, 10 aa, Giardia lamblia
QEGLPPYDSA

SEQ ID NO: 3129742 - protein, 23 aa, Giardia lamblia
QEGREELRDSPMHDQNDDASSCY

SEQ ID NO: 3129743 - protein, 12 aa, Giardia lamblia
QEGVTSTQSLSS

SEQ ID NO: 3129744 - protein, 8 aa, Giardia lamblia
QEHDDTSP

SEQ ID NO: 3129745 - protein, 6 aa, Giardia lamblia
QEHESD

SEQ ID NO: 3129746 - protein, 6 aa, Giardia lamblia
QEHGDV

SEQ ID NO: 3129747 - protein, 8 aa, Giardia lamblia
QEHPQTAE

SEQ ID NO: 3129748 - protein, 7 aa, Giardia lamblia
QEHRGAG

SEQ ID NO: 3129749 - protein, 9 aa, Giardia lamblia
QEHSALRPS

SEQ ID NO: 3129750 - protein, 4 aa, Giardia lamblia
QEIA

SEQ ID NO: 3129751 - protein, 5 aa, Giardia lamblia
QEIAR

SEQ ID NO: 3129752 - protein, 14 aa, Giardia lamblia
QEIEDTLKEQDEQL

SEQ ID NO: 3129753 - protein, 4 aa, Giardia lamblia
QEIN

SEQ ID NO: 3129754 - protein, 8 aa, Giardia lamblia
QEINNSRR

SEQ ID NO: 3129755 - protein, 6 aa, Giardia lamblia
QEITPT

SEQ ID NO: 3129756 - protein, 16 aa, Giardia lamblia
QEITRSSRASSAPGVR

SEQ ID NO: 3129757 - protein, 7 aa, Giardia lamblia
QEKDALD

SEQ ID NO: 3129758 - protein, 5 aa, Giardia lamblia
QEKDM

SEQ ID NO: 3129759 - protein, 9 aa, Giardia lamblia
QEKDPFAGA

SEQ ID NO: 3129760 - protein, 9 aa, Giardia lamblia
QEKGLQPEE

SEQ ID NO: 3129761 - protein, 6 aa, Giardia lamblia
QEKGTC

SEQ ID NO: 3129762 - protein, 5 aa, Giardia lamblia
QEKGV

SEQ ID NO: 3129763 - protein, 4 aa, Giardia lamblia
QEKH

SEQ ID NO: 3129764 - protein, 7 aa, Giardia lamblia
QEKHQRL

SEQ ID NO: 3129765 - protein, 8 aa, Giardia lamblia
QEKKQEKL

SEQ ID NO: 3129766 - protein, 15 aa, Giardia lamblia
QEKPRLSSAPPAVPE

SEQ ID NO: 3129767 - protein, 13 aa, Giardia lamblia
QEKPSRTAKANKG

SEQ ID NO: 3129768 - protein, 16 aa, Giardia lamblia
QEKPTLSSKNVAASTP

SEQ ID NO: 3129769 - protein, 5 aa, Giardia lamblia
QEKRD

SEQ ID NO: 3129770 - protein, 7 aa, Giardia lamblia
QEKSTGI

SEQ ID NO: 3129771 - protein, 5 aa, Giardia lamblia
QEKTG

SEQ ID NO: 3129772 - protein, 8 aa, Giardia lamblia
QELATSAS

SEQ ID NO: 3129773 - protein, 7 aa, Giardia lamblia
QELEERE

SEQ ID NO: 3129774 - protein, 11 aa, Giardia lamblia
QELEGQATGIP

SEQ ID NO: 3129775 - protein, 20 aa, Giardia lamblia
QELEQQLTERERQKAEEAYQ

SEQ ID NO: 3129776 - protein, 11 aa, Giardia lamblia
QELGASLATEK

SEQ ID NO: 3129777 - protein, 5 aa, Giardia lamblia
QELGR

SEQ ID NO: 3129778 - protein, 11 aa, Giardia lamblia
QELKQAPSPKL

SEQ ID NO: 3129779 - protein, 24 aa, Giardia lamblia
QELNQNDSEQLTKQLKEKEDQISN

SEQ ID NO: 3129780 - protein, 12 aa, Giardia lamblia
QELNSSTAQDER

SEQ ID NO: 3129781 - protein, 6 aa, Giardia lamblia
QELQAK

SEQ ID NO: 3129782 - protein, 12 aa, Giardia lamblia
QELQATKGELEA

SEQ ID NO: 3129783 - protein, 4 aa, Giardia lamblia
QELR

SEQ ID NO: 3129784 - protein, 6 aa, Giardia lamblia
QELSGE

SEQ ID NO: 3129785 - protein, 9 aa, Giardia lamblia
QELSQQASL

SEQ ID NO: 3129786 - protein, 19 aa, Giardia lamblia
QELSSTAEALAETNCNSGA

SEQ ID NO: 3129787 - protein, 10 aa, Giardia lamblia
QELSSVSSDK

SEQ ID NO: 3129788 - protein, 4 aa, Giardia lamblia
QELT

SEQ ID NO: 3129789 - protein, 5 aa, Giardia lamblia
QEMHP

SEQ ID NO: 3129790 - protein, 5 aa, Giardia lamblia
QEMKE

SEQ ID NO: 3129791 - protein, 4 aa, Giardia lamblia
QENC

SEQ ID NO: 3129792 - protein, 24 aa, Giardia lamblia
QENEALPSSKPNIAERGGSGATSD

SEQ ID NO: 3129793 - protein, 7 aa, Giardia lamblia
QENEDLR

SEQ ID NO: 3129794 - protein, 5 aa, Giardia lamblia
QENEY

SEQ ID NO: 3129795 - protein, 6 aa, Giardia lamblia
QENKTL

SEQ ID NO: 3129796 - protein, 8 aa, Giardia lamblia
QENNASPA

SEQ ID NO: 3129797 - protein, 6 aa, Giardia lamblia
QENNLA

SEQ ID NO: 3129798 - protein, 4 aa, Giardia lamblia
QENP

SEQ ID NO: 3129799 - protein, 11 aa, Giardia lamblia
QENQCQSAEGN

SEQ ID NO: 3129800 - protein, 8 aa, Giardia lamblia
QENSNNDL

SEQ ID NO: 3129801 - protein, 7 aa, Giardia lamblia
QENSTER

SEQ ID NO: 3129802 - protein, 26 aa, Giardia lamblia
QENVNGGGTRCKSCSSGNGSRNTSDG

SEQ ID NO: 3129803 - protein, 22 aa, Giardia lamblia
QEPATLAKATPRGEVPPIEQKS

SEQ ID NO: 3129804 - protein, 5 aa, Giardia lamblia
QEPEL

SEQ ID NO: 3129805 - protein, 7 aa, Giardia lamblia
QEPIEPQ

SEQ ID NO: 3129806 - protein, 6 aa, Giardia lamblia
QEPLPK

SEQ ID NO: 3129807 - protein, 20 aa, Giardia lamblia
QEPPDAQAEHPEGQNKGASV

SEQ ID NO: 3129808 - protein, 8 aa, Giardia lamblia
QEPPNSVV

SEQ ID NO: 3129809 - protein, 7 aa, Giardia lamblia
QEPPQLS

SEQ ID NO: 3129810 - protein, 5 aa, Giardia lamblia
QEPRG

SEQ ID NO: 3129811 - protein, 11 aa, Giardia lamblia
QEPRPIRSGSA

SEQ ID NO: 3129812 - protein, 4 aa, Giardia lamblia
QEPV

SEQ ID NO: 3129813 - protein, 18 aa, Giardia lamblia
QEQAAAGSEATVEKETRS

SEQ ID NO: 3129814 - protein, 11 aa, Giardia lamblia
QEQAQKPRLQS

SEQ ID NO: 3129815 - protein, 7 aa, Giardia lamblia
QEQEIDS

SEQ ID NO: 3129816 - protein, 8 aa, Giardia lamblia
QEQENPFS

SEQ ID NO: 3129817 - protein, 11 aa, Giardia lamblia
QEQEQRNERLE

SEQ ID NO: 3129818 - protein, 7 aa, Giardia lamblia
QEQETQV

SEQ ID NO: 3129819 - protein, 9 aa, Giardia lamblia
QEQGNPETL

SEQ ID NO: 3129820 - protein, 10 aa, Giardia lamblia
QEQKEARRAY

SEQ ID NO: 3129821 - protein, 4 aa, Giardia lamblia
QEQP

SEQ ID NO: 3129822 - protein, 11 aa, Giardia lamblia
QEQQGKEQLRE

SEQ ID NO: 3129823 - protein, 11 aa, Giardia lamblia
QEQRARLETQK

SEQ ID NO: 3129824 - protein, 9 aa, Giardia lamblia
QEQRDARDA

SEQ ID NO: 3129825 - protein, 7 aa, Giardia lamblia
QEQTGGD

SEQ ID NO: 3129826 - protein, 11 aa, Giardia lamblia
QEQVANDKHPE

SEQ ID NO: 3129827 - protein, 23 aa, Giardia lamblia
QEQYDEAVNEKKRLQDEADLTGR

SEQ ID NO: 3129828 - protein, 6 aa, Giardia lamblia
QEQYEA

SEQ ID NO: 3129829 - protein, 10 aa, Giardia lamblia
QEQYGSSVGD

SEQ ID NO: 3129830 - protein, 13 aa, Giardia lamblia
QERAGKAINENKR

SEQ ID NO: 3129831 - protein, 28 aa, Giardia lamblia
QERAREEQKTKANKAENLEQQSDDVPTL

SEQ ID NO: 3129832 - protein, 7 aa, Giardia lamblia
QERDDEI

SEQ ID NO: 3129833 - protein, 9 aa, Giardia lamblia
QERDDYEEQ

SEQ ID NO: 3129834 - protein, 5 aa, Giardia lamblia
QEREA

SEQ ID NO: 3129835 - protein, 6 aa, Giardia lamblia
QEREHT

SEQ ID NO: 3129836 - protein, 11 aa, Giardia lamblia
QERERSHEGAL

SEQ ID NO: 3129837 - protein, 10 aa, Giardia lamblia
QERGASLGQE

SEQ ID NO: 3129838 - protein, 5 aa, Giardia lamblia
QERGG

SEQ ID NO: 3129839 - protein, 5 aa, Giardia lamblia
QERGQ

SEQ ID NO: 3129840 - protein, 10 aa, Giardia lamblia
QERKPLDNGS

SEQ ID NO: 3129841 - protein, 9 aa, Giardia lamblia
QERNEEKRE

SEQ ID NO: 3129842 - protein, 7 aa, Giardia lamblia
QERPENP

SEQ ID NO: 3129843 - protein, 15 aa, Giardia lamblia
QERPFTDRDDFKKGT

SEQ ID NO: 3129844 - protein, 7 aa, Giardia lamblia
QERPSAQ

SEQ ID NO: 3129845 - protein, 13 aa, Giardia lamblia
QERQARADQREDF

SEQ ID NO: 3129846 - protein, 9 aa, Giardia lamblia
QERQRQIEE

SEQ ID NO: 3129847 - protein, 6 aa, Giardia lamblia
QERRDK

SEQ ID NO: 3129848 - protein, 7 aa, Giardia lamblia
QERRNSV

SEQ ID NO: 3129849 - protein, 9 aa, Giardia lamblia
QERSEGKQS

SEQ ID NO: 3129850 - protein, 19 aa, Giardia lamblia
QERTVEDARKVRDSRHTDE

SEQ ID NO: 3129851 - protein, 6 aa, Giardia lamblia
QERYQT

SEQ ID NO: 3129852 - protein, 6 aa, Giardia lamblia
QERYTS

SEQ ID NO: 3129853 - protein, 5 aa, Giardia lamblia
QESAF

SEQ ID NO: 3129854 - protein, 13 aa, Giardia lamblia
QESATSGPNQSLG

SEQ ID NO: 3129855 - protein, 5 aa, Giardia lamblia
QESCE

SEQ ID NO: 3129856 - protein, 15 aa, Giardia lamblia
QESDEDSFMDDLEDF

SEQ ID NO: 3129857 - protein, 4 aa, Giardia lamblia
QESE

SEQ ID NO: 3129858 - protein, 15 aa, Giardia lamblia
QESEALSRKPSTYYG

SEQ ID NO: 3129859 - protein, 6 aa, Giardia lamblia
QESERY

SEQ ID NO: 3129860 - protein, 7 aa, Giardia lamblia
QESETTI

SEQ ID NO: 3129861 - protein, 14 aa, Giardia lamblia
QESGKTSSAAEEAL

SEQ ID NO: 3129862 - protein, 24 aa, Giardia lamblia
QESGLPRPYGGRAPFAPADPAPNI

SEQ ID NO: 3129863 - protein, 13 aa, Giardia lamblia
QESGRAGRDSEPA

SEQ ID NO: 3129864 - protein, 10 aa, Giardia lamblia
QESKDEALAN

SEQ ID NO: 3129865 - protein, 9 aa, Giardia lamblia
QESKDVSDP

SEQ ID NO: 3129866 - protein, 28 aa, Giardia lamblia
QESLDKANEDLAQKTDECGKAISETGNL

SEQ ID NO: 3129867 - protein, 7 aa, Giardia lamblia
QESPDAP

SEQ ID NO: 3129868 - protein, 8 aa, Giardia lamblia
QESPVERE

SEQ ID NO: 3129869 - protein, 5 aa, Giardia lamblia
QESQL

SEQ ID NO: 3129870 - protein, 5 aa, Giardia lamblia
QESRH

SEQ ID NO: 3129871 - protein, 6 aa, Giardia lamblia
QESRKE

SEQ ID NO: 3129872 - protein, 6 aa, Giardia lamblia
QESRRK

SEQ ID NO: 3129873 - protein, 6 aa, Giardia lamblia
QESSFP

SEQ ID NO: 3129874 - protein, 7 aa, Giardia lamblia
QESTKDN

SEQ ID NO: 3129875 - protein, 9 aa, Giardia lamblia
QESTRISAN

SEQ ID NO: 3129876 - protein, 18 aa, Giardia lamblia
QESTVNTLQKQQNPAHDQ

SEQ ID NO: 3129877 - protein, 9 aa, Giardia lamblia
QETAGTSRR

SEQ ID NO: 3129878 - protein, 12 aa, Giardia lamblia
QETERREADIQG

SEQ ID NO: 3129879 - protein, 4 aa, Giardia lamblia
QETL

SEQ ID NO: 3129880 - protein, 10 aa, Giardia lamblia
QETLEERGAA

SEQ ID NO: 3129881 - protein, 7 aa, Giardia lamblia
QETLESK

SEQ ID NO: 3129882 - protein, 11 aa, Giardia lamblia
QETLKKSELQA

SEQ ID NO: 3129883 - protein, 5 aa, Giardia lamblia
QETLN

SEQ ID NO: 3129884 - protein, 5 aa, Giardia lamblia
QETPG

SEQ ID NO: 3129885 - protein, 7 aa, Giardia lamblia
QETQDEA

SEQ ID NO: 3129886 - protein, 15 aa, Giardia lamblia
QETQKYDKEHQASLT

SEQ ID NO: 3129887 - protein, 5 aa, Giardia lamblia
QETRG

SEQ ID NO: 3129888 - protein, 7 aa, Giardia lamblia
QETRHLE

SEQ ID NO: 3129889 - protein, 8 aa, Giardia lamblia
QETSAGEK

SEQ ID NO: 3129890 - protein, 4 aa, Giardia lamblia
QETT

SEQ ID NO: 3129891 - protein, 7 aa, Giardia lamblia
QETTASL

SEQ ID NO: 3129892 - protein, 6 aa, Giardia lamblia
QETVEE

SEQ ID NO: 3129893 - protein, 6 aa, Giardia lamblia
QEVDNL

SEQ ID NO: 3129894 - protein, 5 aa, Giardia lamblia
QEVHS

SEQ ID NO: 3129895 - protein, 19 aa, Giardia lamblia
QEVSQEQSSDQDDAKPARL

SEQ ID NO: 3129896 - protein, 5 aa, Giardia lamblia
QEVSS

SEQ ID NO: 3129897 - protein, 9 aa, Giardia lamblia
QEVTPTEQR

SEQ ID NO: 3129898 - protein, 10 aa, Giardia lamblia
QEVTSTASDL

SEQ ID NO: 3129899 - protein, 4 aa, Giardia lamblia
QEVY

SEQ ID NO: 3129900 - protein, 4 aa, Giardia lamblia
QEYD

SEQ ID NO: 3129901 - protein, 9 aa, Giardia lamblia
QEYENRGKR

SEQ ID NO: 3129902 - protein, 9 aa, Giardia lamblia
QEYEPTPEG

SEQ ID NO: 3129903 - protein, 15 aa, Giardia lamblia
QEYQENGASIANRKC

SEQ ID NO: 3129904 - protein, 10 aa, Giardia lamblia
QEYTQRGGVR

SEQ ID NO: 3129905 - protein, 14 aa, Giardia lamblia
QFAEPDKTNPVLPS

SEQ ID NO: 3129906 - protein, 5 aa, Giardia lamblia
QFAPR

SEQ ID NO: 3129907 - protein, 7 aa, Giardia lamblia
QFATGDD

SEQ ID NO: 3129908 - protein, 13 aa, Giardia lamblia
QFDPSEEDGEIED

SEQ ID NO: 3129909 - protein, 21 aa, Giardia lamblia
QFEAPEDSEAALSAQDTRVTI

SEQ ID NO: 3129910 - protein, 7 aa, Giardia lamblia
QFGGGKS

SEQ ID NO: 3129911 - protein, 5 aa, Giardia lamblia
QFNRY

SEQ ID NO: 3129912 - protein, 9 aa, Giardia lamblia
QFNSTNASV

SEQ ID NO: 3129913 - protein, 8 aa, Giardia lamblia
QFPTSSSR

SEQ ID NO: 3129914 - protein, 8 aa, Giardia lamblia
QFQQTTEG

SEQ ID NO: 3129915 - protein, 7 aa, Giardia lamblia
QFSEDKG

SEQ ID NO: 3129916 - protein, 7 aa, Giardia lamblia
QFSTTGY

SEQ ID NO: 3129917 - protein, 16 aa, Giardia lamblia
QGADEEAGSEDENNMY

SEQ ID NO: 3129918 - protein, 7 aa, Giardia lamblia
QGAESSF

SEQ ID NO: 3129919 - protein, 15 aa, Giardia lamblia
QGAGSEHSLSASDHR

SEQ ID NO: 3129920 - protein, 9 aa, Giardia lamblia
QGALQDAEG

SEQ ID NO: 3129921 - protein, 8 aa, Giardia lamblia
QGAPRTIP

SEQ ID NO: 3129922 - protein, 13 aa, Giardia lamblia
QGAPTTSAQGTFK

SEQ ID NO: 3129923 - protein, 6 aa, Giardia lamblia
QGAQAT

SEQ ID NO: 3129924 - protein, 25 aa, Giardia lamblia
QGAQGSSTTSMTSDSTAISGASTSN

SEQ ID NO: 3129925 - protein, 6 aa, Giardia lamblia
QGARGD

SEQ ID NO: 3129926 - protein, 10 aa, Giardia lamblia
QGASVEPALA

SEQ ID NO: 3129927 - protein, 6 aa, Giardia lamblia
QGATDP

SEQ ID NO: 3129928 - protein, 10 aa, Giardia lamblia
QGATGNKIPV

SEQ ID NO: 3129929 - protein, 10 aa, Giardia lamblia
QGATSSAPLT

SEQ ID NO: 3129930 - protein, 4 aa, Giardia lamblia
QGAY

SEQ ID NO: 3129931 - protein, 7 aa, Giardia lamblia
QGAYTTP

SEQ ID NO: 3129932 - protein, 4 aa, Giardia lamblia
QGCD

SEQ ID NO: 3129933 - protein, 11 aa, Giardia lamblia
QGCHGGDAKGC

SEQ ID NO: 3129934 - protein, 12 aa, Giardia lamblia
QGCSTSESTNTQ

SEQ ID NO: 3129935 - protein, 9 aa, Giardia lamblia
QGCTTGSGK

SEQ ID NO: 3129936 - protein, 6 aa, Giardia lamblia
QGDAET

SEQ ID NO: 3129937 - protein, 15 aa, Giardia lamblia
QGDEEYDEEEYEEES

SEQ ID NO: 3129938 - protein, 8 aa, Giardia lamblia
QGDEIGKG

SEQ ID NO: 3129939 - protein, 8 aa, Giardia lamblia
QGDENLAA

SEQ ID NO: 3129940 - protein, 6 aa, Giardia lamblia
QGDFGT

SEQ ID NO: 3129941 - protein, 4 aa, Giardia lamblia
QGDM

SEQ ID NO: 3129942 - protein, 6 aa, Giardia lamblia
QGDPGD

SEQ ID NO: 3129943 - protein, 7 aa, Giardia lamblia
QGDQETV

SEQ ID NO: 3129944 - protein, 6 aa, Giardia lamblia
QGDRPI

SEQ ID NO: 3129945 - protein, 10 aa, Giardia lamblia
QGEAHRRGGD

SEQ ID NO: 3129946 - protein, 15 aa, Giardia lamblia
QGEDQAKVDVTGEQI

SEQ ID NO: 3129947 - protein, 15 aa, Giardia lamblia
QGEEATGQRNDPKEG

SEQ ID NO: 3129948 - protein, 6 aa, Giardia lamblia
QGEEDY

SEQ ID NO: 3129949 - protein, 15 aa, Giardia lamblia
QGEERLAKRKEEERL

SEQ ID NO: 3129950 - protein, 55 aa, Giardia lamblia
QGEHTLDNGTDGALHEEAKRHPRNGAGTRGRGVGSSSWSTSTRATWRPDRRDRRK

SEQ ID NO: 3129951 - protein, 8 aa, Giardia lamblia
QGENPKGF

SEQ ID NO: 3129952 - protein, 12 aa, Giardia lamblia
QGERPSKPMYTK

SEQ ID NO: 3129953 - protein, 8 aa, Giardia lamblia
QGERQDKI

SEQ ID NO: 3129954 - protein, 4 aa, Giardia lamblia
QGES

SEQ ID NO: 3129955 - protein, 6 aa, Giardia lamblia
QGESEK

SEQ ID NO: 3129956 - protein, 7 aa, Giardia lamblia
QGETEQS

SEQ ID NO: 3129957 - protein, 16 aa, Giardia lamblia
QGETLSRATADSNKKL

SEQ ID NO: 3129958 - protein, 31 aa, Giardia lamblia
QGETMPTPPAPPQAAPTITDTSKVKKTKTAF

SEQ ID NO: 3129959 - protein, 10 aa, Giardia lamblia
QGEVVGTDTL

SEQ ID NO: 3129960 - protein, 6 aa, Giardia lamblia
QGEYDK

SEQ ID NO: 3129961 - protein, 4 aa, Giardia lamblia
QGFK

SEQ ID NO: 3129962 - protein, 4 aa, Giardia lamblia
QGFT

SEQ ID NO: 3129963 - protein, 15 aa, Giardia lamblia
QGGDTGSGVEGPLKP

SEQ ID NO: 3129964 - protein, 4 aa, Giardia lamblia
QGGE

SEQ ID NO: 3129965 - protein, 10 aa, Giardia lamblia
QGGEKGDIGE

SEQ ID NO: 3129966 - protein, 6 aa, Giardia lamblia
QGGKYR

SEQ ID NO: 3129967 - protein, 4 aa, Giardia lamblia
QGGM

SEQ ID NO: 3129968 - protein, 10 aa, Giardia lamblia
QGGMQRHDGK

SEQ ID NO: 3129969 - protein, 5 aa, Giardia lamblia
QGGNI

SEQ ID NO: 3129970 - protein, 10 aa, Giardia lamblia
QGGQKATGDV

SEQ ID NO: 3129971 - protein, 10 aa, Giardia lamblia
QGGQKATGNV

SEQ ID NO: 3129972 - protein, 7 aa, Giardia lamblia
QGGQREF

SEQ ID NO: 3129973 - protein, 24 aa, Giardia lamblia
QGGSGTPASTLQNKVSTSQQTSEM

SEQ ID NO: 3129974 - protein, 6 aa, Giardia lamblia
QGGTKM

SEQ ID NO: 3129975 - protein, 4 aa, Giardia lamblia
QGGY

SEQ ID NO: 3129976 - protein, 14 aa, Giardia lamblia
QGHDTSMSQQSGMS

SEQ ID NO: 3129977 - protein, 4 aa, Giardia lamblia
QGHK

SEQ ID NO: 3129978 - protein, 5 aa, Giardia lamblia
QGHPL

SEQ ID NO: 3129979 - protein, 5 aa, Giardia lamblia
QGHQG

SEQ ID NO: 3129980 - protein, 4 aa, Giardia lamblia
QGHR

SEQ ID NO: 3129981 - protein, 4 aa, Giardia lamblia
QGHT

SEQ ID NO: 3129982 - protein, 5 aa, Giardia lamblia
QGHTE

SEQ ID NO: 3129983 - protein, 10 aa, Giardia lamblia
QGHVDSDGRT

SEQ ID NO: 3129984 - protein, 5 aa, Giardia lamblia
QGHVG

SEQ ID NO: 3129985 - protein, 13 aa, Giardia lamblia
QGIAEDNLPSLED

SEQ ID NO: 3129986 - protein, 8 aa, Giardia lamblia
QGIDGRAL

SEQ ID NO: 3129987 - protein, 16 aa, Giardia lamblia
QGIGVEDAASKAAKQA

SEQ ID NO: 3129988 - protein, 4 aa, Giardia lamblia
QGIP

SEQ ID NO: 3129989 - protein, 8 aa, Giardia lamblia
QGIPGSAT

SEQ ID NO: 3129990 - protein, 8 aa, Giardia lamblia
QGIPQDKI

SEQ ID NO: 3129991 - protein, 5 aa, Giardia lamblia
QGISP

SEQ ID NO: 3129992 - protein, 8 aa, Giardia lamblia
QGITDDEY

SEQ ID NO: 3129993 - protein, 5 aa, Giardia lamblia
QGITP

SEQ ID NO: 3129994 - protein, 8 aa, Giardia lamblia
QGKEGKIS

SEQ ID NO: 3129995 - protein, 6 aa, Giardia lamblia
QGKNIE

SEQ ID NO: 3129996 - protein, 7 aa, Giardia lamblia
QGKNWDV

SEQ ID NO: 3129997 - protein, 7 aa, Giardia lamblia
QGKPIST

SEQ ID NO: 3129998 - protein, 9 aa, Giardia lamblia
QGKRRSDGA

SEQ ID NO: 3129999 - protein, 15 aa, Giardia lamblia
QGKSLASAVAENAAA

SEQ ID NO: 3130000 - protein, 5 aa, Giardia lamblia
QGKSV

SEQ ID NO: 3130001 - protein, 5 aa, Giardia lamblia
QGKTD

SEQ ID NO: 3130002 - protein, 9 aa, Giardia lamblia
QGKTSETNA

SEQ ID NO: 3130003 - protein, 9 aa, Giardia lamblia
QGKYGDGEA

SEQ ID NO: 3130004 - protein, 6 aa, Giardia lamblia
QGLDDA

SEQ ID NO: 3130005 - protein, 4 aa, Giardia lamblia
QGLE

SEQ ID NO: 3130006 - protein, 6 aa, Giardia lamblia
QGLGPV

SEQ ID NO: 3130007 - protein, 6 aa, Giardia lamblia
QGLGRR

SEQ ID NO: 3130008 - protein, 9 aa, Giardia lamblia
QGLPQHRPT

SEQ ID NO: 3130009 - protein, 27 aa, Giardia lamblia
QGLQQKPAQLPSPTRSALPKDAESPKT

SEQ ID NO: 3130010 - protein, 4 aa, Giardia lamblia
QGLS

SEQ ID NO: 3130011 - protein, 9 aa, Giardia lamblia
QGLSARTRG

SEQ ID NO: 3130012 - protein, 19 aa, Giardia lamblia
QGNASQLPQSPSQRESSLG

SEQ ID NO: 3130013 - protein, 6 aa, Giardia lamblia
QGNDAT

SEQ ID NO: 3130014 - protein, 14 aa, Giardia lamblia
QGNEARQEVHRLCR

SEQ ID NO: 3130015 - protein, 6 aa, Giardia lamblia
QGNKAD

SEQ ID NO: 3130016 - protein, 8 aa, Giardia lamblia
QGNLPATS

SEQ ID NO: 3130017 - protein, 4 aa, Giardia lamblia
QGNM

SEQ ID NO: 3130018 - protein, 4 aa, Giardia lamblia
QGNN

SEQ ID NO: 3130019 - protein, 5 aa, Giardia lamblia
QGNSR

SEQ ID NO: 3130020 - protein, 5 aa, Giardia lamblia
QGNTE

SEQ ID NO: 3130021 - protein, 4 aa, Giardia lamblia
QGNY

SEQ ID NO: 3130022 - protein, 5 aa, Giardia lamblia
QGPAF

SEQ ID NO: 3130023 - protein, 20 aa, Giardia lamblia
QGPAGTGKTESTKALGGKLG

SEQ ID NO: 3130024 - protein, 7 aa, Giardia lamblia
QGPASSV

SEQ ID NO: 3130025 - protein, 10 aa, Giardia lamblia
QGPGLGGGTG

SEQ ID NO: 3130026 - protein, 7 aa, Giardia lamblia
QGPIGRQ

SEQ ID NO: 3130027 - protein, 5 aa, Giardia lamblia
QGPKI

SEQ ID NO: 3130028 - protein, 4 aa, Giardia lamblia
QGPL

SEQ ID NO: 3130029 - protein, 7 aa, Giardia lamblia
QGPLDRD

SEQ ID NO: 3130030 - protein, 4 aa, Giardia lamblia
QGPN

SEQ ID NO: 3130031 - protein, 6 aa, Giardia lamblia
QGPNGE

SEQ ID NO: 3130032 - protein, 7 aa, Giardia lamblia
QGPPGCG

SEQ ID NO: 3130033 - protein, 16 aa, Giardia lamblia
QGPPRNDKIEKTRDAE

SEQ ID NO: 3130034 - protein, 5 aa, Giardia lamblia
QGPQA

SEQ ID NO: 3130035 - protein, 5 aa, Giardia lamblia
QGPRA

SEQ ID NO: 3130036 - protein, 10 aa, Giardia lamblia
QGPSRRNNYQ

SEQ ID NO: 3130037 - protein, 10 aa, Giardia lamblia
QGPTGDPGLP

SEQ ID NO: 3130038 - protein, 4 aa, Giardia lamblia
QGQA

SEQ ID NO: 3130039 - protein, 13 aa, Giardia lamblia
QGQDEDGDEDNGL

SEQ ID NO: 3130040 - protein, 7 aa, Giardia lamblia
QGQEPQA

SEQ ID NO: 3130041 - protein, 4 aa, Giardia lamblia
QGQG

SEQ ID NO: 3130042 - protein, 4 aa, Giardia lamblia
QGQL

SEQ ID NO: 3130043 - protein, 23 aa, Giardia lamblia
QGQNNYQAVERTSPTDKEDRSLS

SEQ ID NO: 3130044 - protein, 10 aa, Giardia lamblia
QGQSDPNTMK

SEQ ID NO: 3130045 - protein, 8 aa, Giardia lamblia
QGQSPVAE

SEQ ID NO: 3130046 - protein, 5 aa, Giardia lamblia
QGQST

SEQ ID NO: 3130047 - protein, 4 aa, Giardia lamblia
QGQT

SEQ ID NO: 3130048 - protein, 13 aa, Giardia lamblia
QGQTADAAEAQFG

SEQ ID NO: 3130049 - protein, 13 aa, Giardia lamblia
QGRGSSDPVIEDG

SEQ ID NO: 3130050 - protein, 11 aa, Giardia lamblia
QGRMQDSNGKT

SEQ ID NO: 3130051 - protein, 8 aa, Giardia lamblia
QGRPGIQP

SEQ ID NO: 3130052 - protein, 27 aa, Giardia lamblia
QGRQNLQDSDTQVDSSSHPKRRSAKQQ

SEQ ID NO: 3130053 - protein, 5 aa, Giardia lamblia
QGRSG

SEQ ID NO: 3130054 - protein, 8 aa, Giardia lamblia
QGRTTSRG

SEQ ID NO: 3130055 - protein, 14 aa, Giardia lamblia
QGSAMHGTNGLRDL

SEQ ID NO: 3130056 - protein, 10 aa, Giardia lamblia
QGSASARDFD

SEQ ID NO: 3130057 - protein, 5 aa, Giardia lamblia
QGSDK

SEQ ID NO: 3130058 - protein, 14 aa, Giardia lamblia
QGSESASDGDADEE

SEQ ID NO: 3130059 - protein, 4 aa, Giardia lamblia
QGSF

SEQ ID NO: 3130060 - protein, 15 aa, Giardia lamblia
QGSGNSGSSSSAAID

SEQ ID NO: 3130061 - protein, 10 aa, Giardia lamblia
QGSGPPPCAP

SEQ ID NO: 3130062 - protein, 4 aa, Giardia lamblia
QGSI

SEQ ID NO: 3130063 - protein, 15 aa, Giardia lamblia
QGSKSLSEHATSPST

SEQ ID NO: 3130064 - protein, 6 aa, Giardia lamblia
QGSLDS

SEQ ID NO: 3130065 - protein, 14 aa, Giardia lamblia
QGSLSSASSRLSRL

SEQ ID NO: 3130066 - protein, 7 aa, Giardia lamblia
QGSPLEL

SEQ ID NO: 3130067 - protein, 13 aa, Giardia lamblia
QGSQLGKADSNSR

SEQ ID NO: 3130068 - protein, 13 aa, Giardia lamblia
QGSRESTSSIAGQ

SEQ ID NO: 3130069 - protein, 8 aa, Giardia lamblia
QGSRPRVD

SEQ ID NO: 3130070 - protein, 4 aa, Giardia lamblia
QGSS

SEQ ID NO: 3130071 - protein, 9 aa, Giardia lamblia
QGSSLKAEL

SEQ ID NO: 3130072 - protein, 8 aa, Giardia lamblia
QGSSPDKI

SEQ ID NO: 3130073 - protein, 10 aa, Giardia lamblia
QGSSRADTEH

SEQ ID NO: 3130074 - protein, 13 aa, Giardia lamblia
QGSSRKDGDSSSV

SEQ ID NO: 3130075 - protein, 45 aa, Giardia lamblia
QGSSVASTEQGHKRTGSYTSALATSAVSQSTKSDSQQKKQKPYNK

SEQ ID NO: 3130076 - protein, 16 aa, Giardia lamblia
QGSTISGNASQLDEKY

SEQ ID NO: 3130077 - protein, 9 aa, Giardia lamblia
QGSTQGEDI

SEQ ID NO: 3130078 - protein, 4 aa, Giardia lamblia
QGSV

SEQ ID NO: 3130079 - protein, 53 aa, Giardia lamblia
QGSVDRDKEPKEPLQSPNSLKSQPDSGKKKKKRNIASAKSIKEPQQNSKEPNI

SEQ ID NO: 3130080 - protein, 9 aa, Giardia lamblia
QGSVQSSSV

SEQ ID NO: 3130081 - protein, 9 aa, Giardia lamblia
QGSVTDQPS

SEQ ID NO: 3130082 - protein, 7 aa, Giardia lamblia
QGTFSQS

SEQ ID NO: 3130083 - protein, 4 aa, Giardia lamblia
QGTG

SEQ ID NO: 3130084 - protein, 54 aa, Giardia lamblia
QGTIDPKSTDVVPSEDSMQSRSEKQKSGRFSRAGSKQSSVRRTPKLDNASFSNS

SEQ ID NO: 3130085 - protein, 4 aa, Giardia lamblia
QGTL

SEQ ID NO: 3130086 - protein, 74 aa, Giardia lamblia
QGTLEGRGEPADVAQTEGLARPGVSREEKAVGGAIGEAQRENVSQDGELGVATDDGDGPMGEPKGGSGGAEHDK

SEQ ID NO: 3130087 - protein, 16 aa, Giardia lamblia
QGTMDPSYKYTPTHYP

SEQ ID NO: 3130088 - protein, 7 aa, Giardia lamblia
QGTNTLA

SEQ ID NO: 3130089 - protein, 5 aa, Giardia lamblia
QGTPD

SEQ ID NO: 3130090 - protein, 5 aa, Giardia lamblia
QGTPF

SEQ ID NO: 3130091 - protein, 5 aa, Giardia lamblia
QGTQD

SEQ ID NO: 3130092 - protein, 17 aa, Giardia lamblia
QGTSENQDPNGSSTSDN

SEQ ID NO: 3130093 - protein, 5 aa, Giardia lamblia
QGTSL

SEQ ID NO: 3130094 - protein, 6 aa, Giardia lamblia
QGTTST

SEQ ID NO: 3130095 - protein, 11 aa, Giardia lamblia
QGTVPQSNPRC

SEQ ID NO: 3130096 - protein, 11 aa, Giardia lamblia
QGVAESPATVP

SEQ ID NO: 3130097 - protein, 5 aa, Giardia lamblia
QGVPE

SEQ ID NO: 3130098 - protein, 7 aa, Giardia lamblia
QGVQPTV

SEQ ID NO: 3130099 - protein, 12 aa, Giardia lamblia
QGVRDSDGKTAL

SEQ ID NO: 3130100 - protein, 8 aa, Giardia lamblia
QGVSDSQR

SEQ ID NO: 3130101 - protein, 7 aa, Giardia lamblia
QGVSESV

SEQ ID NO: 3130102 - protein, 7 aa, Giardia lamblia
QGWEQAN

SEQ ID NO: 3130103 - protein, 11 aa, Giardia lamblia
QGYDEDSPVEQ

SEQ ID NO: 3130104 - protein, 53 aa, Giardia lamblia
QGYQGQPSASLYSAGQPPVSAVGGQGFGQSGGMYGQGVPQPASGAPGPYGSSV

SEQ ID NO: 3130105 - protein, 11 aa, Giardia lamblia
QGYSLDNADSC

SEQ ID NO: 3130106 - protein, 12 aa, Giardia lamblia
QGYSRPSSYNDA

SEQ ID NO: 3130107 - protein, 5 aa, Giardia lamblia
QGYTD

SEQ ID NO: 3130108 - protein, 10 aa, Giardia lamblia
QGYTPTVKSS

SEQ ID NO: 3130109 - protein, 25 aa, Giardia lamblia
QHAAEEAQKQREQEEARERARVPHG

SEQ ID NO: 3130110 - protein, 11 aa, Giardia lamblia
QHARTAGSNMR

SEQ ID NO: 3130111 - protein, 8 aa, Giardia lamblia
QHASGCSR

SEQ ID NO: 3130112 - protein, 8 aa, Giardia lamblia
QHASNARK

SEQ ID NO: 3130113 - protein, 8 aa, Giardia lamblia
QHASTGNW

SEQ ID NO: 3130114 - protein, 8 aa, Giardia lamblia
QHDGGDLK

SEQ ID NO: 3130115 - protein, 9 aa, Giardia lamblia
QHDPRTAGR

SEQ ID NO: 3130116 - protein, 5 aa, Giardia lamblia
QHDSY

SEQ ID NO: 3130117 - protein, 5 aa, Giardia lamblia
QHEKD

SEQ ID NO: 3130118 - protein, 4 aa, Giardia lamblia
QHEL

SEQ ID NO: 3130119 - protein, 4 aa, Giardia lamblia
QHES

SEQ ID NO: 3130120 - protein, 11 aa, Giardia lamblia
QHFDGAGGQAL

SEQ ID NO: 3130121 - protein, 6 aa, Giardia lamblia
QHGKTE

SEQ ID NO: 3130122 - protein, 14 aa, Giardia lamblia
QHGLSSPSQEEKMH

SEQ ID NO: 3130123 - protein, 13 aa, Giardia lamblia
QHGNKECADCTSR

SEQ ID NO: 3130124 - protein, 7 aa, Giardia lamblia
QHGRPRL

SEQ ID NO: 3130125 - protein, 22 aa, Giardia lamblia
QHGSLGTGQDLNAQDAIRPKES

SEQ ID NO: 3130126 - protein, 8 aa, Giardia lamblia
QHIPTKEE

SEQ ID NO: 3130127 - protein, 11 aa, Giardia lamblia
QHISAQSKVPE

SEQ ID NO: 3130128 - protein, 9 aa, Giardia lamblia
QHKQKTAPR

SEQ ID NO: 3130129 - protein, 4 aa, Giardia lamblia
QHKR

SEQ ID NO: 3130130 - protein, 20 aa, Giardia lamblia
QHLRQENDKLKSDKTKLKNA

SEQ ID NO: 3130131 - protein, 9 aa, Giardia lamblia
QHNGTEPNT

SEQ ID NO: 3130132 - protein, 7 aa, Giardia lamblia
QHNTPGL

SEQ ID NO: 3130133 - protein, 19 aa, Giardia lamblia
QHPDAAVPPPWGPAEVSSS

SEQ ID NO: 3130134 - protein, 25 aa, Giardia lamblia
QHPGNQSSLLPTPSSASHAKPPSLV

SEQ ID NO: 3130135 - protein, 10 aa, Giardia lamblia
QHPLGDPSVS

SEQ ID NO: 3130136 - protein, 10 aa, Giardia lamblia
QHPPGSSFRP

SEQ ID NO: 3130137 - protein, 10 aa, Giardia lamblia
QHPPSSGMNS

SEQ ID NO: 3130138 - protein, 9 aa, Giardia lamblia
QHPQHSEYH

SEQ ID NO: 3130139 - protein, 6 aa, Giardia lamblia
QHPQNV

SEQ ID NO: 3130140 - protein, 6 aa, Giardia lamblia
QHPTSY

SEQ ID NO: 3130141 - protein, 7 aa, Giardia lamblia
QHQASRP

SEQ ID NO: 3130142 - protein, 11 aa, Giardia lamblia
QHQTATKARTV

SEQ ID NO: 3130143 - protein, 4 aa, Giardia lamblia
QHRT

SEQ ID NO: 3130144 - protein, 10 aa, Giardia lamblia
QHSDHPSLAH

SEQ ID NO: 3130145 - protein, 5 aa, Giardia lamblia
QHSEG

SEQ ID NO: 3130146 - protein, 6 aa, Giardia lamblia
QHSEGE

SEQ ID NO: 3130147 - protein, 8 aa, Giardia lamblia
QHSGAVEA

SEQ ID NO: 3130148 - protein, 6 aa, Giardia lamblia
QHSPDL

SEQ ID NO: 3130149 - protein, 25 aa, Giardia lamblia
QHSSGRTAADYANSEDLRDIILEYT

SEQ ID NO: 3130150 - protein, 13 aa, Giardia lamblia
QHSTGKGLASAGH

SEQ ID NO: 3130151 - protein, 13 aa, Giardia lamblia
QHSTQSSAIESSL

SEQ ID NO: 3130152 - protein, 9 aa, Giardia lamblia
QHSTSALTP

SEQ ID NO: 3130153 - protein, 12 aa, Giardia lamblia
QHTHPPDRTRIP

SEQ ID NO: 3130154 - protein, 11 aa, Giardia lamblia
QHTNAGGSLRN

SEQ ID NO: 3130155 - protein, 7 aa, Giardia lamblia
QHTRASQ

SEQ ID NO: 3130156 - protein, 11 aa, Giardia lamblia
QHTSNSPRRQG

SEQ ID NO: 3130157 - protein, 18 aa, Giardia lamblia
QHYGDPREPPHIGTESPL

SEQ ID NO: 3130158 - protein, 8 aa, Giardia lamblia
QHYNGSTI

SEQ ID NO: 3130159 - protein, 10 aa, Giardia lamblia
QIAEEQRRIE

SEQ ID NO: 3130160 - protein, 5 aa, Giardia lamblia
QIAEN

SEQ ID NO: 3130161 - protein, 13 aa, Giardia lamblia
QIAGGEPEEHPGS

SEQ ID NO: 3130162 - protein, 4 aa, Giardia lamblia
QIAP

SEQ ID NO: 3130163 - protein, 6 aa, Giardia lamblia
QIDDDV

SEQ ID NO: 3130164 - protein, 10 aa, Giardia lamblia
QIDDSRLDEL

SEQ ID NO: 3130165 - protein, 7 aa, Giardia lamblia
QIDERPS

SEQ ID NO: 3130166 - protein, 4 aa, Giardia lamblia
QIDP

SEQ ID NO: 3130167 - protein, 16 aa, Giardia lamblia
QIDPSPVQKSSSPPDL

SEQ ID NO: 3130168 - protein, 9 aa, Giardia lamblia
QIDQQDQAL

SEQ ID NO: 3130169 - protein, 5 aa, Giardia lamblia
QIDRE

SEQ ID NO: 3130170 - protein, 12 aa, Giardia lamblia
QIDTSSDPPPLK

SEQ ID NO: 3130171 - protein, 9 aa, Giardia lamblia
QIEDERSNL

SEQ ID NO: 3130172 - protein, 6 aa, Giardia lamblia
QIEGDL

SEQ ID NO: 3130173 - protein, 6 aa, Giardia lamblia
QIENAS

SEQ ID NO: 3130174 - protein, 6 aa, Giardia lamblia
QIENRD

SEQ ID NO: 3130175 - protein, 12 aa, Giardia lamblia
QIEQDEKRYNEK

SEQ ID NO: 3130176 - protein, 9 aa, Giardia lamblia
QIEQEEREK

SEQ ID NO: 3130177 - protein, 17 aa, Giardia lamblia
QIESNSTTSSAIDTTNS

SEQ ID NO: 3130178 - protein, 13 aa, Giardia lamblia
QIESPSRLQTPTM

SEQ ID NO: 3130179 - protein, 15 aa, Giardia lamblia
QIEYQEREGKAEQRV

SEQ ID NO: 3130180 - protein, 9 aa, Giardia lamblia
QIGDASPEF

SEQ ID NO: 3130181 - protein, 10 aa, Giardia lamblia
QIGEAESRRK

SEQ ID NO: 3130182 - protein, 17 aa, Giardia lamblia
QIGETAVEREKNASATL

SEQ ID NO: 3130183 - protein, 7 aa, Giardia lamblia
QIGETEE

SEQ ID NO: 3130184 - protein, 22 aa, Giardia lamblia
QIGKTQNNEATEMSSPTLSEAD

SEQ ID NO: 3130185 - protein, 10 aa, Giardia lamblia
QIGSSNPNLA

SEQ ID NO: 3130186 - protein, 32 aa, Giardia lamblia
QIKDDGSQTQQKNQDCEGTSTAPLPKREAPTT

SEQ ID NO: 3130187 - protein, 8 aa, Giardia lamblia
QIKGEPYG

SEQ ID NO: 3130188 - protein, 13 aa, Giardia lamblia
QIKPAAPAYSLSG

SEQ ID NO: 3130189 - protein, 13 aa, Giardia lamblia
QIKQQNKDIDEKK

SEQ ID NO: 3130190 - protein, 7 aa, Giardia lamblia
QINDKER

SEQ ID NO: 3130191 - protein, 6 aa, Giardia lamblia
QINPNS

SEQ ID NO: 3130192 - protein, 8 aa, Giardia lamblia
QINTDQES

SEQ ID NO: 3130193 - protein, 13 aa, Giardia lamblia
QIPGKEEQGSTTR

SEQ ID NO: 3130194 - protein, 4 aa, Giardia lamblia
QIPS

SEQ ID NO: 3130195 - protein, 16 aa, Giardia lamblia
QIPTSAELDEYWVDFA

SEQ ID NO: 3130196 - protein, 9 aa, Giardia lamblia
QIQDEYDTK

SEQ ID NO: 3130197 - protein, 8 aa, Giardia lamblia
QIQDSNGY

SEQ ID NO: 3130198 - protein, 11 aa, Giardia lamblia
QIQKQGGKAKP

SEQ ID NO: 3130199 - protein, 5 aa, Giardia lamblia
QIQRK

SEQ ID NO: 3130200 - protein, 13 aa, Giardia lamblia
QIQSSAKLRTSRI

SEQ ID NO: 3130201 - protein, 13 aa, Giardia lamblia
QIQTNSARNSRTL

SEQ ID NO: 3130202 - protein, 9 aa, Giardia lamblia
QISAGRTGH

SEQ ID NO: 3130203 - protein, 6 aa, Giardia lamblia
QISANA

SEQ ID NO: 3130204 - protein, 15 aa, Giardia lamblia
QISASKTKRSLSTYS

SEQ ID NO: 3130205 - protein, 11 aa, Giardia lamblia
QISKSAKSLTD

SEQ ID NO: 3130206 - protein, 9 aa, Giardia lamblia
QISNQNGNT

SEQ ID NO: 3130207 - protein, 4 aa, Giardia lamblia
QIST

SEQ ID NO: 3130208 - protein, 12 aa, Giardia lamblia
QISTSDLGYPAH

SEQ ID NO: 3130209 - protein, 4 aa, Giardia lamblia
QITD

SEQ ID NO: 3130210 - protein, 9 aa, Giardia lamblia
QITNAQANL

SEQ ID NO: 3130211 - protein, 5 aa, Giardia lamblia
QITSE

SEQ ID NO: 3130212 - protein, 11 aa, Giardia lamblia
QKADEDHKPYA

SEQ ID NO: 3130213 - protein, 9 aa, Giardia lamblia
QKADGSSEN

SEQ ID NO: 3130214 - protein, 10 aa, Giardia lamblia
QKAEGKALRT

SEQ ID NO: 3130215 - protein, 4 aa, Giardia lamblia
QKAG

SEQ ID NO: 3130216 - protein, 9 aa, Giardia lamblia
QKAGTASLV

SEQ ID NO: 3130217 - protein, 4 aa, Giardia lamblia
QKAI

SEQ ID NO: 3130218 - protein, 10 aa, Giardia lamblia
QKAKTDRLEN

SEQ ID NO: 3130219 - protein, 6 aa, Giardia lamblia
QKALAN

SEQ ID NO: 3130220 - protein, 7 aa, Giardia lamblia
QKANDSF

SEQ ID NO: 3130221 - protein, 31 aa, Giardia lamblia
QKAQQPTTEELEKKGPERSPDHLRRSSKEKS

SEQ ID NO: 3130222 - protein, 10 aa, Giardia lamblia
QKAQSLDYSE

SEQ ID NO: 3130223 - protein, 14 aa, Giardia lamblia
QKARNPEAKPVPYP

SEQ ID NO: 3130224 - protein, 6 aa, Giardia lamblia
QKASDC

SEQ ID NO: 3130225 - protein, 6 aa, Giardia lamblia
QKATED

SEQ ID NO: 3130226 - protein, 12 aa, Giardia lamblia
QKATQPQARDGD

SEQ ID NO: 3130227 - protein, 8 aa, Giardia lamblia
QKATRAAN

SEQ ID NO: 3130228 - protein, 5 aa, Giardia lamblia
QKATS

SEQ ID NO: 3130229 - protein, 9 aa, Giardia lamblia
QKAVDNKGL

SEQ ID NO: 3130230 - protein, 6 aa, Giardia lamblia
QKDAEN

SEQ ID NO: 3130231 - protein, 4 aa, Giardia lamblia
QKDD

SEQ ID NO: 3130232 - protein, 7 aa, Giardia lamblia
QKDDEIA

SEQ ID NO: 3130233 - protein, 9 aa, Giardia lamblia
QKDKELERL

SEQ ID NO: 3130234 - protein, 7 aa, Giardia lamblia
QKDNPGM

SEQ ID NO: 3130235 - protein, 7 aa, Giardia lamblia
QKDQEIE

SEQ ID NO: 3130236 - protein, 10 aa, Giardia lamblia
QKDRHETSNL

SEQ ID NO: 3130237 - protein, 15 aa, Giardia lamblia
QKDRPEMLSPADTDA

SEQ ID NO: 3130238 - protein, 9 aa, Giardia lamblia
QKDSELAEK

SEQ ID NO: 3130239 - protein, 6 aa, Giardia lamblia
QKDSNG

SEQ ID NO: 3130240 - protein, 7 aa, Giardia lamblia
QKDSYRG

SEQ ID NO: 3130241 - protein, 6 aa, Giardia lamblia
QKDTWG

SEQ ID NO: 3130242 - protein, 8 aa, Giardia lamblia
QKDYSSKQ

SEQ ID NO: 3130243 - protein, 9 aa, Giardia lamblia
QKEAAPLQS

SEQ ID NO: 3130244 - protein, 9 aa, Giardia lamblia
QKEADERAA

SEQ ID NO: 3130245 - protein, 6 aa, Giardia lamblia
QKEAEI

SEQ ID NO: 3130246 - protein, 7 aa, Giardia lamblia
QKEALAE

SEQ ID NO: 3130247 - protein, 6 aa, Giardia lamblia
QKEARE

SEQ ID NO: 3130248 - protein, 6 aa, Giardia lamblia
QKEEEL

SEQ ID NO: 3130249 - protein, 12 aa, Giardia lamblia
QKEGEARKAQQC

SEQ ID NO: 3130250 - protein, 19 aa, Giardia lamblia
QKEGKNPGIAAVDVKITLS

SEQ ID NO: 3130251 - protein, 4 aa, Giardia lamblia
QKEH

SEQ ID NO: 3130252 - protein, 6 aa, Giardia lamblia
QKEIDE

SEQ ID NO: 3130253 - protein, 8 aa, Giardia lamblia
QKEKDYYA

SEQ ID NO: 3130254 - protein, 7 aa, Giardia lamblia
QKEKELS

SEQ ID NO: 3130255 - protein, 9 aa, Giardia lamblia
QKEKEREKL

SEQ ID NO: 3130256 - protein, 8 aa, Giardia lamblia
QKEKETAI

SEQ ID NO: 3130257 - protein, 6 aa, Giardia lamblia
QKELGV

SEQ ID NO: 3130258 - protein, 10 aa, Giardia lamblia
QKELKDRKNH

SEQ ID NO: 3130259 - protein, 14 aa, Giardia lamblia
QKENDRLKQYTGKM

SEQ ID NO: 3130260 - protein, 6 aa, Giardia lamblia
QKENEV

SEQ ID NO: 3130261 - protein, 6 aa, Giardia lamblia
QKENYE

SEQ ID NO: 3130262 - protein, 8 aa, Giardia lamblia
QKEQQEAA

SEQ ID NO: 3130263 - protein, 12 aa, Giardia lamblia
QKEQTLAASGNL

SEQ ID NO: 3130264 - protein, 8 aa, Giardia lamblia
QKESDEHI

SEQ ID NO: 3130265 - protein, 10 aa, Giardia lamblia
QKESKTDARL

SEQ ID NO: 3130266 - protein, 10 aa, Giardia lamblia
QKESLEDELA

SEQ ID NO: 3130267 - protein, 8 aa, Giardia lamblia
QKETAPTM

SEQ ID NO: 3130268 - protein, 7 aa, Giardia lamblia
QKETAQK

SEQ ID NO: 3130269 - protein, 9 aa, Giardia lamblia
QKEVETQKY

SEQ ID NO: 3130270 - protein, 13 aa, Giardia lamblia
QKFTNAPANCAEE

SEQ ID NO: 3130271 - protein, 9 aa, Giardia lamblia
QKGAVQEPN

SEQ ID NO: 3130272 - protein, 7 aa, Giardia lamblia
QKGDAGL

SEQ ID NO: 3130273 - protein, 7 aa, Giardia lamblia
QKGEIEA

SEQ ID NO: 3130274 - protein, 11 aa, Giardia lamblia
QKGETSSQAEI

SEQ ID NO: 3130275 - protein, 6 aa, Giardia lamblia
QKGGNL

SEQ ID NO: 3130276 - protein, 7 aa, Giardia lamblia
QKGHADS

SEQ ID NO: 3130277 - protein, 20 aa, Giardia lamblia
QKGHEKELKSLSGEEDDLKD

SEQ ID NO: 3130278 - protein, 6 aa, Giardia lamblia
QKGHKQ

SEQ ID NO: 3130279 - protein, 8 aa, Giardia lamblia
QKGLTSSR

SEQ ID NO: 3130280 - protein, 9 aa, Giardia lamblia
QKGNESRAV

SEQ ID NO: 3130281 - protein, 45 aa, Giardia lamblia
QKGNGGTANSSTNKGGGRPPSTRGTKDVLTTNDQQSSKEDTASNT

SEQ ID NO: 3130282 - protein, 19 aa, Giardia lamblia
QKGPDHRPEHKSTDFRGSS

SEQ ID NO: 3130283 - protein, 11 aa, Giardia lamblia
QKGPPQAAEKG

SEQ ID NO: 3130284 - protein, 9 aa, Giardia lamblia
QKGQQDRHG

SEQ ID NO: 3130285 - protein, 23 aa, Giardia lamblia
QKGQVTEDEGEEDDGDDHGAEEM

SEQ ID NO: 3130286 - protein, 11 aa, Giardia lamblia
QKGRRDARGRT

SEQ ID NO: 3130287 - protein, 8 aa, Giardia lamblia
QKGSPERK

SEQ ID NO: 3130288 - protein, 87 aa, Giardia lamblia
QKGTRRNNNNGANRFQDNRRSDRNEGSGSSGSNNVNNRRKNEQHRGHDNDGGYRNRNRNRQQSSAQADSEYRHRGTGGRPPGRFANA

SEQ ID NO: 3130289 - protein, 17 aa, Giardia lamblia
QKGTSEDSEIPIQPTDP

SEQ ID NO: 3130290 - protein, 4 aa, Giardia lamblia
QKGV

SEQ ID NO: 3130291 - protein, 11 aa, Giardia lamblia
QKGWSAEAELN

SEQ ID NO: 3130292 - protein, 33 aa, Giardia lamblia
QKHAQGPEGPSPGVQRGAIRGRPRRNSSGRGTL

SEQ ID NO: 3130293 - protein, 7 aa, Giardia lamblia
QKHEKNL

SEQ ID NO: 3130294 - protein, 6 aa, Giardia lamblia
QKHETE

SEQ ID NO: 3130295 - protein, 12 aa, Giardia lamblia
QKHHDTEAEDGI

SEQ ID NO: 3130296 - protein, 5 aa, Giardia lamblia
QKHPC

SEQ ID NO: 3130297 - protein, 7 aa, Giardia lamblia
QKHRDAQ

SEQ ID NO: 3130298 - protein, 16 aa, Giardia lamblia
QKHRPEHDANTTATNT

SEQ ID NO: 3130299 - protein, 8 aa, Giardia lamblia
QKHSYTDL

SEQ ID NO: 3130300 - protein, 9 aa, Giardia lamblia
QKHTRETIS

SEQ ID NO: 3130301 - protein, 6 aa, Giardia lamblia
QKIAEE

SEQ ID NO: 3130302 - protein, 5 aa, Giardia lamblia
QKISN

SEQ ID NO: 3130303 - protein, 29 aa, Giardia lamblia
QKKAASRGKLTSSGSATNISSKVPDAQVT

SEQ ID NO: 3130304 - protein, 6 aa, Giardia lamblia
QKKAIE

SEQ ID NO: 3130305 - protein, 9 aa, Giardia lamblia
QKKALEDQI

SEQ ID NO: 3130306 - protein, 8 aa, Giardia lamblia
QKKDEQVA

SEQ ID NO: 3130307 - protein, 18 aa, Giardia lamblia
QKKDGEGRRSLSSKTKTI

SEQ ID NO: 3130308 - protein, 10 aa, Giardia lamblia
QKKDHKDNRW

SEQ ID NO: 3130309 - protein, 8 aa, Giardia lamblia
QKKEAERL

SEQ ID NO: 3130310 - protein, 8 aa, Giardia lamblia
QKKENIPE

SEQ ID NO: 3130311 - protein, 9 aa, Giardia lamblia
QKKKARAGK

SEQ ID NO: 3130312 - protein, 14 aa, Giardia lamblia
QKKNQDYAAAQRSI

SEQ ID NO: 3130313 - protein, 11 aa, Giardia lamblia
QKKPADNEPFD

SEQ ID NO: 3130314 - protein, 23 aa, Giardia lamblia
QKKPAERGHSKTKNANEKNDPIA

SEQ ID NO: 3130315 - protein, 5 aa, Giardia lamblia
QKKPY

SEQ ID NO: 3130316 - protein, 27 aa, Giardia lamblia
QKKSERRDQELAAEASQHPVPSGPARA

SEQ ID NO: 3130317 - protein, 7 aa, Giardia lamblia
QKLDGET

SEQ ID NO: 3130318 - protein, 12 aa, Giardia lamblia
QKLEQEKKSVRQ

SEQ ID NO: 3130319 - protein, 4 aa, Giardia lamblia
QKLG

SEQ ID NO: 3130320 - protein, 5 aa, Giardia lamblia
QKLGE

SEQ ID NO: 3130321 - protein, 14 aa, Giardia lamblia
QKLGGSQTRRQGGS

SEQ ID NO: 3130322 - protein, 19 aa, Giardia lamblia
QKLKQGLTSKTDNQDDYPD

SEQ ID NO: 3130323 - protein, 6 aa, Giardia lamblia
QKLRES

SEQ ID NO: 3130324 - protein, 4 aa, Giardia lamblia
QKLS

SEQ ID NO: 3130325 - protein, 7 aa, Giardia lamblia
QKLSDTT

SEQ ID NO: 3130326 - protein, 14 aa, Giardia lamblia
QKLSSSCSEDIADR

SEQ ID NO: 3130327 - protein, 17 aa, Giardia lamblia
QKNAEVEAQNIAGDVSN

SEQ ID NO: 3130328 - protein, 7 aa, Giardia lamblia
QKNAGNN

SEQ ID NO: 3130329 - protein, 8 aa, Giardia lamblia
QKNAPQEL

SEQ ID NO: 3130330 - protein, 7 aa, Giardia lamblia
QKNARSS

SEQ ID NO: 3130331 - protein, 5 aa, Giardia lamblia
QKNAT

SEQ ID NO: 3130332 - protein, 9 aa, Giardia lamblia
QKNEQGRFP

SEQ ID NO: 3130333 - protein, 9 aa, Giardia lamblia
QKNETAQER

SEQ ID NO: 3130334 - protein, 7 aa, Giardia lamblia
QKNKQEM

SEQ ID NO: 3130335 - protein, 5 aa, Giardia lamblia
QKNLP

SEQ ID NO: 3130336 - protein, 9 aa, Giardia lamblia
QKNQELEQC

SEQ ID NO: 3130337 - protein, 5 aa, Giardia lamblia
QKNQL

SEQ ID NO: 3130338 - protein, 8 aa, Giardia lamblia
QKNRPGKT

SEQ ID NO: 3130339 - protein, 4 aa, Giardia lamblia
QKNS

SEQ ID NO: 3130340 - protein, 17 aa, Giardia lamblia
QKNSEEPVSKPAPNKAT

SEQ ID NO: 3130341 - protein, 13 aa, Giardia lamblia
QKNSLVGSTADLR

SEQ ID NO: 3130342 - protein, 6 aa, Giardia lamblia
QKNSNE

SEQ ID NO: 3130343 - protein, 17 aa, Giardia lamblia
QKNSQQQQQQFSKATEE

SEQ ID NO: 3130344 - protein, 10 aa, Giardia lamblia
QKNSSADNIA

SEQ ID NO: 3130345 - protein, 6 aa, Giardia lamblia
QKNSVN

SEQ ID NO: 3130346 - protein, 5 aa, Giardia lamblia
QKNTH

SEQ ID NO: 3130347 - protein, 12 aa, Giardia lamblia
QKPDPGSQARDY

SEQ ID NO: 3130348 - protein, 7 aa, Giardia lamblia
QKPGGTI

SEQ ID NO: 3130349 - protein, 26 aa, Giardia lamblia
QKPGPSADSILTGDSNLSAMGESAAV

SEQ ID NO: 3130350 - protein, 10 aa, Giardia lamblia
QKPHDGQKDN

SEQ ID NO: 3130351 - protein, 6 aa, Giardia lamblia
QKPHSY

SEQ ID NO: 3130352 - protein, 14 aa, Giardia lamblia
QKPKKLKRTKEVGE

SEQ ID NO: 3130353 - protein, 15 aa, Giardia lamblia
QKPNEETSDSSPKIE

SEQ ID NO: 3130354 - protein, 7 aa, Giardia lamblia
QKPPSGA

SEQ ID NO: 3130355 - protein, 12 aa, Giardia lamblia
QKPRQGRHASRN

SEQ ID NO: 3130356 - protein, 7 aa, Giardia lamblia
QKPRRIA

SEQ ID NO: 3130357 - protein, 5 aa, Giardia lamblia
QKPTD

SEQ ID NO: 3130358 - protein, 13 aa, Giardia lamblia
QKPTEQPGTREES

SEQ ID NO: 3130359 - protein, 6 aa, Giardia lamblia
QKPTLE

SEQ ID NO: 3130360 - protein, 7 aa, Giardia lamblia
QKPTPFY

SEQ ID NO: 3130361 - protein, 5 aa, Giardia lamblia
QKPVD

SEQ ID NO: 3130362 - protein, 7 aa, Giardia lamblia
QKPVTIS

SEQ ID NO: 3130363 - protein, 25 aa, Giardia lamblia
QKQDSPADAQDASADESQPPVKRRP

SEQ ID NO: 3130364 - protein, 8 aa, Giardia lamblia
QKQEKSFS

SEQ ID NO: 3130365 - protein, 7 aa, Giardia lamblia
QKQHDQE

SEQ ID NO: 3130366 - protein, 7 aa, Giardia lamblia
QKQISNS

SEQ ID NO: 3130367 - protein, 11 aa, Giardia lamblia
QKQKSQVTTAE

SEQ ID NO: 3130368 - protein, 7 aa, Giardia lamblia
QKQLSDL

SEQ ID NO: 3130369 - protein, 6 aa, Giardia lamblia
QKQQAK

SEQ ID NO: 3130370 - protein, 8 aa, Giardia lamblia
QKQQASTE

SEQ ID NO: 3130371 - protein, 17 aa, Giardia lamblia
QKQQEGAGDSSSAQDGK

SEQ ID NO: 3130372 - protein, 8 aa, Giardia lamblia
QKQQIGGL

SEQ ID NO: 3130373 - protein, 10 aa, Giardia lamblia
QKQQNELHRN

SEQ ID NO: 3130374 - protein, 16 aa, Giardia lamblia
QKQREALKKEEEANAE

SEQ ID NO: 3130375 - protein, 9 aa, Giardia lamblia
QKQRPLSAI

SEQ ID NO: 3130376 - protein, 4 aa, Giardia lamblia
QKQV

SEQ ID NO: 3130377 - protein, 10 aa, Giardia lamblia
QKRASISAEK

SEQ ID NO: 3130378 - protein, 7 aa, Giardia lamblia
QKRDEAL

SEQ ID NO: 3130379 - protein, 18 aa, Giardia lamblia
QKRDTGNSSKHGDNLDAK

SEQ ID NO: 3130380 - protein, 14 aa, Giardia lamblia
QKRESAPLSENSQP

SEQ ID NO: 3130381 - protein, 4 aa, Giardia lamblia
QKRI

SEQ ID NO: 3130382 - protein, 23 aa, Giardia lamblia
QKRKEERERIKQEKKEAKERELE

SEQ ID NO: 3130383 - protein, 6 aa, Giardia lamblia
QKRKPV

SEQ ID NO: 3130384 - protein, 6 aa, Giardia lamblia
QKRKYM

SEQ ID NO: 3130385 - protein, 9 aa, Giardia lamblia
QKRNSKGQL

SEQ ID NO: 3130386 - protein, 8 aa, Giardia lamblia
QKRQMQDS

SEQ ID NO: 3130387 - protein, 6 aa, Giardia lamblia
QKRQSR

SEQ ID NO: 3130388 - protein, 9 aa, Giardia lamblia
QKRREQESA

SEQ ID NO: 3130389 - protein, 10 aa, Giardia lamblia
QKRRSGNSRG

SEQ ID NO: 3130390 - protein, 9 aa, Giardia lamblia
QKRTRDERI

SEQ ID NO: 3130391 - protein, 14 aa, Giardia lamblia
QKRTSAKESGPQAK

SEQ ID NO: 3130392 - protein, 5 aa, Giardia lamblia
QKRVS

SEQ ID NO: 3130393 - protein, 21 aa, Giardia lamblia
QKSEAKSAWQKGRTPPPIAPA

SEQ ID NO: 3130394 - protein, 5 aa, Giardia lamblia
QKSGC

SEQ ID NO: 3130395 - protein, 9 aa, Giardia lamblia
QKSGDVYGA

SEQ ID NO: 3130396 - protein, 5 aa, Giardia lamblia
QKSGG

SEQ ID NO: 3130397 - protein, 6 aa, Giardia lamblia
QKSIES

SEQ ID NO: 3130398 - protein, 8 aa, Giardia lamblia
QKSISSNI

SEQ ID NO: 3130399 - protein, 6 aa, Giardia lamblia
QKSLQS

SEQ ID NO: 3130400 - protein, 7 aa, Giardia lamblia
QKSMQSM

SEQ ID NO: 3130401 - protein, 9 aa, Giardia lamblia
QKSNPKITR

SEQ ID NO: 3130402 - protein, 17 aa, Giardia lamblia
QKSQNTLQSSSPKTGRS

SEQ ID NO: 3130403 - protein, 14 aa, Giardia lamblia
QKSQREAYPESAAH

SEQ ID NO: 3130404 - protein, 6 aa, Giardia lamblia
QKSRPH

SEQ ID NO: 3130405 - protein, 28 aa, Giardia lamblia
QKSSCQGTEYTPDVATDYSSSPSAPVRP

SEQ ID NO: 3130406 - protein, 9 aa, Giardia lamblia
QKSSDIKSK

SEQ ID NO: 3130407 - protein, 9 aa, Giardia lamblia
QKSSDLEQA

SEQ ID NO: 3130408 - protein, 7 aa, Giardia lamblia
QKSSRTS

SEQ ID NO: 3130409 - protein, 8 aa, Giardia lamblia
QKSSSHEL

SEQ ID NO: 3130410 - protein, 9 aa, Giardia lamblia
QKSTEAQQK

SEQ ID NO: 3130411 - protein, 8 aa, Giardia lamblia
QKSTKRIV

SEQ ID NO: 3130412 - protein, 5 aa, Giardia lamblia
QKSTL

SEQ ID NO: 3130413 - protein, 7 aa, Giardia lamblia
QKSTTPV

SEQ ID NO: 3130414 - protein, 11 aa, Giardia lamblia
QKSVDERGETG

SEQ ID NO: 3130415 - protein, 5 aa, Giardia lamblia
QKSVG

SEQ ID NO: 3130416 - protein, 8 aa, Giardia lamblia
QKTAEADV

SEQ ID NO: 3130417 - protein, 8 aa, Giardia lamblia
QKTDGGTA

SEQ ID NO: 3130418 - protein, 8 aa, Giardia lamblia
QKTDGTTS

SEQ ID NO: 3130419 - protein, 8 aa, Giardia lamblia
QKTDSIAA

SEQ ID NO: 3130420 - protein, 7 aa, Giardia lamblia
QKTFTSM

SEQ ID NO: 3130421 - protein, 7 aa, Giardia lamblia
QKTGEFR

SEQ ID NO: 3130422 - protein, 6 aa, Giardia lamblia
QKTHSM

SEQ ID NO: 3130423 - protein, 8 aa, Giardia lamblia
QKTKDYPA

SEQ ID NO: 3130424 - protein, 7 aa, Giardia lamblia
QKTKRSS

SEQ ID NO: 3130425 - protein, 6 aa, Giardia lamblia
QKTKSP

SEQ ID NO: 3130426 - protein, 7 aa, Giardia lamblia
QKTMPPA

SEQ ID NO: 3130427 - protein, 9 aa, Giardia lamblia
QKTNTTEVE

SEQ ID NO: 3130428 - protein, 8 aa, Giardia lamblia
QKTPRRSK

SEQ ID NO: 3130429 - protein, 6 aa, Giardia lamblia
QKTQSL

SEQ ID NO: 3130430 - protein, 5 aa, Giardia lamblia
QKTQV

SEQ ID NO: 3130431 - protein, 7 aa, Giardia lamblia
QKTQVNS

SEQ ID NO: 3130432 - protein, 22 aa, Giardia lamblia
QKTRRSKVSGESIESSHTETYS

SEQ ID NO: 3130433 - protein, 22 aa, Giardia lamblia
QKTSNASEDGKKELDEGAEEDE

SEQ ID NO: 3130434 - protein, 10 aa, Giardia lamblia
QKTSRQDLDG

SEQ ID NO: 3130435 - protein, 5 aa, Giardia lamblia
QKTYK

SEQ ID NO: 3130436 - protein, 20 aa, Giardia lamblia
QKVAAQDSSNAQMSTETAGA

SEQ ID NO: 3130437 - protein, 17 aa, Giardia lamblia
QKVEQQNQESQAHAPAA

SEQ ID NO: 3130438 - protein, 4 aa, Giardia lamblia
QKVN

SEQ ID NO: 3130439 - protein, 14 aa, Giardia lamblia
QKVRRTQPTSAHLE

SEQ ID NO: 3130440 - protein, 6 aa, Giardia lamblia
QKVTEQ

SEQ ID NO: 3130441 - protein, 8 aa, Giardia lamblia
QKYAQGEE

SEQ ID NO: 3130442 - protein, 12 aa, Giardia lamblia
QKYDSTPHIDTQ

SEQ ID NO: 3130443 - protein, 6 aa, Giardia lamblia
QKYPEA

SEQ ID NO: 3130444 - protein, 4 aa, Giardia lamblia
QKYT

SEQ ID NO: 3130445 - protein, 6 aa, Giardia lamblia
QKYTQY

SEQ ID NO: 3130446 - protein, 6 aa, Giardia lamblia
QLAADP

SEQ ID NO: 3130447 - protein, 19 aa, Giardia lamblia
QLADADDLQSQLKSREEKI

SEQ ID NO: 3130448 - protein, 10 aa, Giardia lamblia
QLADKTRDLD

SEQ ID NO: 3130449 - protein, 11 aa, Giardia lamblia
QLADVEKDRDS

SEQ ID NO: 3130450 - protein, 8 aa, Giardia lamblia
QLADYQTR

SEQ ID NO: 3130451 - protein, 9 aa, Giardia lamblia
QLAEQSAIQ

SEQ ID NO: 3130452 - protein, 6 aa, Giardia lamblia
QLAESR

SEQ ID NO: 3130453 - protein, 8 aa, Giardia lamblia
QLAPDSKN

SEQ ID NO: 3130454 - protein, 6 aa, Giardia lamblia
QLAPSV

SEQ ID NO: 3130455 - protein, 10 aa, Giardia lamblia
QLAQTKDEKV

SEQ ID NO: 3130456 - protein, 9 aa, Giardia lamblia
QLASATATL

SEQ ID NO: 3130457 - protein, 9 aa, Giardia lamblia
QLASKDSFP

SEQ ID NO: 3130458 - protein, 8 aa, Giardia lamblia
QLASSERA

SEQ ID NO: 3130459 - protein, 11 aa, Giardia lamblia
QLATPNSGLSD

SEQ ID NO: 3130460 - protein, 4 aa, Giardia lamblia
QLDA

SEQ ID NO: 3130461 - protein, 10 aa, Giardia lamblia
QLDAPSANQI

SEQ ID NO: 3130462 - protein, 5 aa, Giardia lamblia
QLDGS

SEQ ID NO: 3130463 - protein, 4 aa, Giardia lamblia
QLDP

SEQ ID NO: 3130464 - protein, 12 aa, Giardia lamblia
QLDPQALQSTPV

SEQ ID NO: 3130465 - protein, 5 aa, Giardia lamblia
QLDQQ

SEQ ID NO: 3130466 - protein, 17 aa, Giardia lamblia
QLDRAKNEGGSTKEASA

SEQ ID NO: 3130467 - protein, 8 aa, Giardia lamblia
QLDSTDRE

SEQ ID NO: 3130468 - protein, 11 aa, Giardia lamblia
QLEAKSSADAV

SEQ ID NO: 3130469 - protein, 18 aa, Giardia lamblia
QLEASQPPARDISSCSSE

SEQ ID NO: 3130470 - protein, 8 aa, Giardia lamblia
QLEDNRTL

SEQ ID NO: 3130471 - protein, 13 aa, Giardia lamblia
QLEEADDEQQNIE

SEQ ID NO: 3130472 - protein, 18 aa, Giardia lamblia
QLEEAEANTRRIKNTQRS

SEQ ID NO: 3130473 - protein, 16 aa, Giardia lamblia
QLEEARANLRTKDREL

SEQ ID NO: 3130474 - protein, 5 aa, Giardia lamblia
QLEGK

SEQ ID NO: 3130475 - protein, 5 aa, Giardia lamblia
QLEGY

SEQ ID NO: 3130476 - protein, 15 aa, Giardia lamblia
QLEKASAYASEDNGR

SEQ ID NO: 3130477 - protein, 5 aa, Giardia lamblia
QLEKD

SEQ ID NO: 3130478 - protein, 13 aa, Giardia lamblia
QLEKQTEATDQMS

SEQ ID NO: 3130479 - protein, 30 aa, Giardia lamblia
QLEQPLSSPVSVTNTDKSGTTPNTTSESAK

SEQ ID NO: 3130480 - protein, 11 aa, Giardia lamblia
QLEQSEKSALS

SEQ ID NO: 3130481 - protein, 4 aa, Giardia lamblia
QLER

SEQ ID NO: 3130482 - protein, 8 aa, Giardia lamblia
QLERGKQD

SEQ ID NO: 3130483 - protein, 11 aa, Giardia lamblia
QLERSNPDVER

SEQ ID NO: 3130484 - protein, 13 aa, Giardia lamblia
QLETADAELKRRQ

SEQ ID NO: 3130485 - protein, 5 aa, Giardia lamblia
QLETT

SEQ ID NO: 3130486 - protein, 12 aa, Giardia lamblia
QLEYTEAAKTYK

SEQ ID NO: 3130487 - protein, 6 aa, Giardia lamblia
QLGENI

SEQ ID NO: 3130488 - protein, 25 aa, Giardia lamblia
QLGGNSAERTALARTRGSSQDQQQQ

SEQ ID NO: 3130489 - protein, 24 aa, Giardia lamblia
QLGGPGPTTGRRLPSAADPEPPAS

SEQ ID NO: 3130490 - protein, 4 aa, Giardia lamblia
QLGP

SEQ ID NO: 3130491 - protein, 8 aa, Giardia lamblia
QLGPEEPL

SEQ ID NO: 3130492 - protein, 6 aa, Giardia lamblia
QLGQQQ

SEQ ID NO: 3130493 - protein, 5 aa, Giardia lamblia
QLHSD

SEQ ID NO: 3130494 - protein, 7 aa, Giardia lamblia
QLKDGTT

SEQ ID NO: 3130495 - protein, 14 aa, Giardia lamblia
QLKEDNIDREQQEK

SEQ ID NO: 3130496 - protein, 9 aa, Giardia lamblia
QLKERDERI

SEQ ID NO: 3130497 - protein, 13 aa, Giardia lamblia
QLKERQNARSKSF

SEQ ID NO: 3130498 - protein, 19 aa, Giardia lamblia
QLKHEKNRSKIQSEKAQKE

SEQ ID NO: 3130499 - protein, 18 aa, Giardia lamblia
QLKKKQQLEGKRPDSPTT

SEQ ID NO: 3130500 - protein, 25 aa, Giardia lamblia
QLKPAKAEKVEDPAGSGSCSQRPPQ

SEQ ID NO: 3130501 - protein, 5 aa, Giardia lamblia
QLKPN

SEQ ID NO: 3130502 - protein, 12 aa, Giardia lamblia
QLKQQRTKNNSL

SEQ ID NO: 3130503 - protein, 4 aa, Giardia lamblia
QLLP

SEQ ID NO: 3130504 - protein, 4 aa, Giardia lamblia
QLND

SEQ ID NO: 3130505 - protein, 6 aa, Giardia lamblia
QLNDAK

SEQ ID NO: 3130506 - protein, 7 aa, Giardia lamblia
QLNPPAD

SEQ ID NO: 3130507 - protein, 24 aa, Giardia lamblia
QLNSYNKKSRSQSLEQSASPKNRL

SEQ ID NO: 3130508 - protein, 5 aa, Giardia lamblia
QLPAY

SEQ ID NO: 3130509 - protein, 4 aa, Giardia lamblia
QLPD

SEQ ID NO: 3130510 - protein, 6 aa, Giardia lamblia
QLPDRA

SEQ ID NO: 3130511 - protein, 5 aa, Giardia lamblia
QLPGS

SEQ ID NO: 3130512 - protein, 4 aa, Giardia lamblia
QLPH

SEQ ID NO: 3130513 - protein, 5 aa, Giardia lamblia
QLPKR

SEQ ID NO: 3130514 - protein, 8 aa, Giardia lamblia
QLPNPQNI

SEQ ID NO: 3130515 - protein, 4 aa, Giardia lamblia
QLPP

SEQ ID NO: 3130516 - protein, 6 aa, Giardia lamblia
QLPPTH

SEQ ID NO: 3130517 - protein, 16 aa, Giardia lamblia
QLPPVSSNRGLSAVRS

SEQ ID NO: 3130518 - protein, 15 aa, Giardia lamblia
QLPTPLSSEQLNTAT

SEQ ID NO: 3130519 - protein, 10 aa, Giardia lamblia
QLPTYSGSGH

SEQ ID NO: 3130520 - protein, 8 aa, Giardia lamblia
QLQDANTK

SEQ ID NO: 3130521 - protein, 16 aa, Giardia lamblia
QLQGTAATHTKQSAEA

SEQ ID NO: 3130522 - protein, 5 aa, Giardia lamblia
QLQHP

SEQ ID NO: 3130523 - protein, 8 aa, Giardia lamblia
QLQSSTNH

SEQ ID NO: 3130524 - protein, 6 aa, Giardia lamblia
QLQTAT

SEQ ID NO: 3130525 - protein, 9 aa, Giardia lamblia
QLQTNSGTT

SEQ ID NO: 3130526 - protein, 8 aa, Giardia lamblia
QLRDSSGY

SEQ ID NO: 3130527 - protein, 7 aa, Giardia lamblia
QLRGSTT

SEQ ID NO: 3130528 - protein, 8 aa, Giardia lamblia
QLRNPTSL

SEQ ID NO: 3130529 - protein, 9 aa, Giardia lamblia
QLRQENSGL

SEQ ID NO: 3130530 - protein, 12 aa, Giardia lamblia
QLRSASDSLRTT

SEQ ID NO: 3130531 - protein, 6 aa, Giardia lamblia
QLRSGR

SEQ ID NO: 3130532 - protein, 10 aa, Giardia lamblia
QLRTTEEELN

SEQ ID NO: 3130533 - protein, 4 aa, Giardia lamblia
QLSA

SEQ ID NO: 3130534 - protein, 20 aa, Giardia lamblia
QLSARGPVEEPVPEAEDAPH

SEQ ID NO: 3130535 - protein, 11 aa, Giardia lamblia
QLSATGEDING

SEQ ID NO: 3130536 - protein, 12 aa, Giardia lamblia
QLSDKAEKVRQL

SEQ ID NO: 3130537 - protein, 8 aa, Giardia lamblia
QLSDRDDD

SEQ ID NO: 3130538 - protein, 8 aa, Giardia lamblia
QLSEAGPL

SEQ ID NO: 3130539 - protein, 9 aa, Giardia lamblia
QLSESKPFS

SEQ ID NO: 3130540 - protein, 11 aa, Giardia lamblia
QLSETKSYHPT

SEQ ID NO: 3130541 - protein, 7 aa, Giardia lamblia
QLSGGEL

SEQ ID NO: 3130542 - protein, 20 aa, Giardia lamblia
QLSGSGEKVGAKNPVDPQSI

SEQ ID NO: 3130543 - protein, 4 aa, Giardia lamblia
QLSP

SEQ ID NO: 3130544 - protein, 5 aa, Giardia lamblia
QLSPE

SEQ ID NO: 3130545 - protein, 9 aa, Giardia lamblia
QLSQEEANA

SEQ ID NO: 3130546 - protein, 7 aa, Giardia lamblia
QLSQKGI

SEQ ID NO: 3130547 - protein, 10 aa, Giardia lamblia
QLSQQSRSDV

SEQ ID NO: 3130548 - protein, 12 aa, Giardia lamblia
QLSQSKKQMTSL

SEQ ID NO: 3130549 - protein, 25 aa, Giardia lamblia
QLSSASKGYHSGTVAKPNSRAGMER

SEQ ID NO: 3130550 - protein, 8 aa, Giardia lamblia
QLSSPSLS

SEQ ID NO: 3130551 - protein, 11 aa, Giardia lamblia
QLSTDPLSQEK

SEQ ID NO: 3130552 - protein, 25 aa, Giardia lamblia
QLSTEDSHSSKAGLHADSAQVTTAT

SEQ ID NO: 3130553 - protein, 43 aa, Giardia lamblia
QLSTPHPTPSSAPSSKGVGQRTKGALSPIQRPSGKASDMGTRK

SEQ ID NO: 3130554 - protein, 12 aa, Giardia lamblia
QLTAADARYKEA

SEQ ID NO: 3130555 - protein, 12 aa, Giardia lamblia
QLTDAKREIEQM

SEQ ID NO: 3130556 - protein, 6 aa, Giardia lamblia
QLTDKE

SEQ ID NO: 3130557 - protein, 4 aa, Giardia lamblia
QLTE

SEQ ID NO: 3130558 - protein, 14 aa, Giardia lamblia
QLTEPSRPPQTPEH

SEQ ID NO: 3130559 - protein, 10 aa, Giardia lamblia
QLTERQTSIE

SEQ ID NO: 3130560 - protein, 14 aa, Giardia lamblia
QLTGDAVKEGNPPD

SEQ ID NO: 3130561 - protein, 4 aa, Giardia lamblia
QLTH

SEQ ID NO: 3130562 - protein, 11 aa, Giardia lamblia
QLTNKNNQTAL

SEQ ID NO: 3130563 - protein, 16 aa, Giardia lamblia
QLTNTEENITTEDSAR

SEQ ID NO: 3130564 - protein, 20 aa, Giardia lamblia
QLTQASSTTGHEESLPPIST

SEQ ID NO: 3130565 - protein, 4 aa, Giardia lamblia
QLTT

SEQ ID NO: 3130566 - protein, 5 aa, Giardia lamblia
QLTTY

SEQ ID NO: 3130567 - protein, 4 aa, Giardia lamblia
QLYS

SEQ ID NO: 3130568 - protein, 5 aa, Giardia lamblia
QLYSP

SEQ ID NO: 3130569 - protein, 7 aa, Giardia lamblia
QMADNKK

SEQ ID NO: 3130570 - protein, 14 aa, Giardia lamblia
QMANQKASSEKTQL

SEQ ID NO: 3130571 - protein, 5 aa, Giardia lamblia
QMAPG

SEQ ID NO: 3130572 - protein, 4 aa, Giardia lamblia
QMDP

SEQ ID NO: 3130573 - protein, 10 aa, Giardia lamblia
QMDSAKAKYD

SEQ ID NO: 3130574 - protein, 58 aa, Giardia lamblia
QMDTTARRPRSTGTGRSRSSTGRTDPSTPVQGAPQGAPRGPLSGLPSPSPTWLQRRTS

SEQ ID NO: 3130575 - protein, 5 aa, Giardia lamblia
QMEQP

SEQ ID NO: 3130576 - protein, 13 aa, Giardia lamblia
QMGLGTSLSEKSF

SEQ ID NO: 3130577 - protein, 5 aa, Giardia lamblia
QMNSG

SEQ ID NO: 3130578 - protein, 5 aa, Giardia lamblia
QMPPF

SEQ ID NO: 3130579 - protein, 8 aa, Giardia lamblia
QMQDHRGR

SEQ ID NO: 3130580 - protein, 6 aa, Giardia lamblia
QMQRNS

SEQ ID NO: 3130581 - protein, 15 aa, Giardia lamblia
QMRAEEELRNQERIE

SEQ ID NO: 3130582 - protein, 6 aa, Giardia lamblia
QMRNSL

SEQ ID NO: 3130583 - protein, 13 aa, Giardia lamblia
QMSNAEKRRAGGF

SEQ ID NO: 3130584 - protein, 6 aa, Giardia lamblia
QMSNPK

SEQ ID NO: 3130585 - protein, 8 aa, Giardia lamblia
QMSPEQEE

SEQ ID NO: 3130586 - protein, 4 aa, Giardia lamblia
QMSS

SEQ ID NO: 3130587 - protein, 11 aa, Giardia lamblia
QMTQNWRPQSR

SEQ ID NO: 3130588 - protein, 10 aa, Giardia lamblia
QMTRRDGTTA

SEQ ID NO: 3130589 - protein, 4 aa, Giardia lamblia
QMTT

SEQ ID NO: 3130590 - protein, 6 aa, Giardia lamblia
QMVDGN

SEQ ID NO: 3130591 - protein, 17 aa, Giardia lamblia
QMYSNDDYSAPASTSVD

SEQ ID NO: 3130592 - protein, 5 aa, Giardia lamblia
QNADY

SEQ ID NO: 3130593 - protein, 10 aa, Giardia lamblia
QNADYLKSDK

SEQ ID NO: 3130594 - protein, 6 aa, Giardia lamblia
QNAEAV

SEQ ID NO: 3130595 - protein, 5 aa, Giardia lamblia
QNAGG

SEQ ID NO: 3130596 - protein, 11 aa, Giardia lamblia
QNAKDGEAGMT

SEQ ID NO: 3130597 - protein, 8 aa, Giardia lamblia
QNAKEKIQ

SEQ ID NO: 3130598 - protein, 4 aa, Giardia lamblia
QNAL

SEQ ID NO: 3130599 - protein, 8 aa, Giardia lamblia
QNANALAT

SEQ ID NO: 3130600 - protein, 6 aa, Giardia lamblia
QNANKR

SEQ ID NO: 3130601 - protein, 4 aa, Giardia lamblia
QNAQ

SEQ ID NO: 3130602 - protein, 28 aa, Giardia lamblia
QNASEDQANAHLSPESKRGSSGQAIETN

SEQ ID NO: 3130603 - protein, 19 aa, Giardia lamblia
QNAYSPEKAERAKNEGNEL

SEQ ID NO: 3130604 - protein, 6 aa, Giardia lamblia
QNCTES

SEQ ID NO: 3130605 - protein, 7 aa, Giardia lamblia
QNDEGKT

SEQ ID NO: 3130606 - protein, 5 aa, Giardia lamblia
QNDEL

SEQ ID NO: 3130607 - protein, 9 aa, Giardia lamblia
QNDGDDPVQ

SEQ ID NO: 3130608 - protein, 23 aa, Giardia lamblia
QNDNKSLLGQTYDSTAQEPSLST

SEQ ID NO: 3130609 - protein, 6 aa, Giardia lamblia
QNDPEM

SEQ ID NO: 3130610 - protein, 5 aa, Giardia lamblia
QNDPH

SEQ ID NO: 3130611 - protein, 9 aa, Giardia lamblia
QNDPYSLSS

SEQ ID NO: 3130612 - protein, 6 aa, Giardia lamblia
QNDQAA

SEQ ID NO: 3130613 - protein, 8 aa, Giardia lamblia
QNEGGGGT

SEQ ID NO: 3130614 - protein, 12 aa, Giardia lamblia
QNEIASGDGPAS

SEQ ID NO: 3130615 - protein, 9 aa, Giardia lamblia
QNEKPKYPP

SEQ ID NO: 3130616 - protein, 9 aa, Giardia lamblia
QNELPPEAK

SEQ ID NO: 3130617 - protein, 4 aa, Giardia lamblia
QNEP

SEQ ID NO: 3130618 - protein, 4 aa, Giardia lamblia
QNES

SEQ ID NO: 3130619 - protein, 6 aa, Giardia lamblia
QNESQR

SEQ ID NO: 3130620 - protein, 7 aa, Giardia lamblia
QNETEAG

SEQ ID NO: 3130621 - protein, 6 aa, Giardia lamblia
QNETHE

SEQ ID NO: 3130622 - protein, 15 aa, Giardia lamblia
QNETNDASPRSPSPV

SEQ ID NO: 3130623 - protein, 14 aa, Giardia lamblia
QNETYARNKKTMET

SEQ ID NO: 3130624 - protein, 4 aa, Giardia lamblia
QNEV

SEQ ID NO: 3130625 - protein, 10 aa, Giardia lamblia
QNEVSGDDAT

SEQ ID NO: 3130626 - protein, 4 aa, Giardia lamblia
QNEY

SEQ ID NO: 3130627 - protein, 4 aa, Giardia lamblia
QNGD

SEQ ID NO: 3130628 - protein, 4 aa, Giardia lamblia
QNGF

SEQ ID NO: 3130629 - protein, 4 aa, Giardia lamblia
QNGH

SEQ ID NO: 3130630 - protein, 5 aa, Giardia lamblia
QNGHA

SEQ ID NO: 3130631 - protein, 5 aa, Giardia lamblia
QNGHP

SEQ ID NO: 3130632 - protein, 6 aa, Giardia lamblia
QNGHTR

SEQ ID NO: 3130633 - protein, 11 aa, Giardia lamblia
QNGKAGHSTSH

SEQ ID NO: 3130634 - protein, 6 aa, Giardia lamblia
QNGNTD

SEQ ID NO: 3130635 - protein, 7 aa, Giardia lamblia
QNGRDEA

SEQ ID NO: 3130636 - protein, 7 aa, Giardia lamblia
QNGRDET

SEQ ID NO: 3130637 - protein, 10 aa, Giardia lamblia
QNGSDDTKRA

SEQ ID NO: 3130638 - protein, 10 aa, Giardia lamblia
QNGSKRQRYT

SEQ ID NO: 3130639 - protein, 6 aa, Giardia lamblia
QNGSVD

SEQ ID NO: 3130640 - protein, 6 aa, Giardia lamblia
QNGSYE

SEQ ID NO: 3130641 - protein, 23 aa, Giardia lamblia
QNGYSENTVDSDGSLSAANLTSS

SEQ ID NO: 3130642 - protein, 4 aa, Giardia lamblia
QNHG

SEQ ID NO: 3130643 - protein, 5 aa, Giardia lamblia
QNHPD

SEQ ID NO: 3130644 - protein, 8 aa, Giardia lamblia
QNIADSSQ

SEQ ID NO: 3130645 - protein, 4 aa, Giardia lamblia
QNIE

SEQ ID NO: 3130646 - protein, 47 aa, Giardia lamblia
QNKDAAATRVAQPPSLRTAPVPTVSQTMQPEARTIESKPSSTSPASD

SEQ ID NO: 3130647 - protein, 8 aa, Giardia lamblia
QNKENPRE

SEQ ID NO: 3130648 - protein, 5 aa, Giardia lamblia
QNKNE

SEQ ID NO: 3130649 - protein, 5 aa, Giardia lamblia
QNKNS

SEQ ID NO: 3130650 - protein, 12 aa, Giardia lamblia
QNKQTEHQTKTA

SEQ ID NO: 3130651 - protein, 11 aa, Giardia lamblia
QNKRKVGDPAS

SEQ ID NO: 3130652 - protein, 25 aa, Giardia lamblia
QNKSPRSARAKSNESLKKANKPAGK

SEQ ID NO: 3130653 - protein, 6 aa, Giardia lamblia
QNKTLE

SEQ ID NO: 3130654 - protein, 15 aa, Giardia lamblia
QNLDSSRALTRELEG

SEQ ID NO: 3130655 - protein, 98 aa, Giardia lamblia
QNLEAGEAVGQEPEAKETKHQQEPNDALSGSASQHPERLDRSASNAHQVPRKAKHGGNGGKAPSNKMHKSSDSPSPNAASSKRRKDTTNMTDKKSNVF

SEQ ID NO: 3130656 - protein, 44 aa, Giardia lamblia
QNLPEESVAATSQTDMGHSDTNRTVTKTAERSSAPHLPTEESLR

SEQ ID NO: 3130657 - protein, 9 aa, Giardia lamblia
QNLPPESES

SEQ ID NO: 3130658 - protein, 32 aa, Giardia lamblia
QNLPQPHYNPNYNPPNSKPAFEPRVETTDEDD

SEQ ID NO: 3130659 - protein, 6 aa, Giardia lamblia
QNLSQV

SEQ ID NO: 3130660 - protein, 15 aa, Giardia lamblia
QNMQTDARTALPGSG

SEQ ID NO: 3130661 - protein, 6 aa, Giardia lamblia
QNMSTK

SEQ ID NO: 3130662 - protein, 4 aa, Giardia lamblia
QNNA

SEQ ID NO: 3130663 - protein, 7 aa, Giardia lamblia
QNNAGET

SEQ ID NO: 3130664 - protein, 5 aa, Giardia lamblia
QNNIS

SEQ ID NO: 3130665 - protein, 4 aa, Giardia lamblia
QNNK

SEQ ID NO: 3130666 - protein, 8 aa, Giardia lamblia
QNNSATNC

SEQ ID NO: 3130667 - protein, 7 aa, Giardia lamblia
QNNSQQV

SEQ ID NO: 3130668 - protein, 7 aa, Giardia lamblia
QNNSTRA

SEQ ID NO: 3130669 - protein, 6 aa, Giardia lamblia
QNNVSD

SEQ ID NO: 3130670 - protein, 7 aa, Giardia lamblia
QNPATKD

SEQ ID NO: 3130671 - protein, 6 aa, Giardia lamblia
QNPAVR

SEQ ID NO: 3130672 - protein, 9 aa, Giardia lamblia
QNPDCGEEH

SEQ ID NO: 3130673 - protein, 8 aa, Giardia lamblia
QNPDGVTP

SEQ ID NO: 3130674 - protein, 14 aa, Giardia lamblia
QNPEQTYSGSTEPV

SEQ ID NO: 3130675 - protein, 4 aa, Giardia lamblia
QNPH

SEQ ID NO: 3130676 - protein, 6 aa, Giardia lamblia
QNPHEC

SEQ ID NO: 3130677 - protein, 6 aa, Giardia lamblia
QNPKDA

SEQ ID NO: 3130678 - protein, 4 aa, Giardia lamblia
QNPN

SEQ ID NO: 3130679 - protein, 7 aa, Giardia lamblia
QNPNEHD

SEQ ID NO: 3130680 - protein, 9 aa, Giardia lamblia
QNPNETKKS

SEQ ID NO: 3130681 - protein, 10 aa, Giardia lamblia
QNPPPQSITA

SEQ ID NO: 3130682 - protein, 23 aa, Giardia lamblia
QNPQYKPKGSTAPPDELQPPRAM

SEQ ID NO: 3130683 - protein, 8 aa, Giardia lamblia
QNPSPPLL

SEQ ID NO: 3130684 - protein, 17 aa, Giardia lamblia
QNPTSASATVTTKVGQA

SEQ ID NO: 3130685 - protein, 12 aa, Giardia lamblia
QNQLGSPRQPED

SEQ ID NO: 3130686 - protein, 13 aa, Giardia lamblia
QNQLSEMRKYVPV

SEQ ID NO: 3130687 - protein, 7 aa, Giardia lamblia
QNQMPEE

SEQ ID NO: 3130688 - protein, 27 aa, Giardia lamblia
QNQQQTASITSQSNAPDDSNVLESNPS

SEQ ID NO: 3130689 - protein, 15 aa, Giardia lamblia
QNQSKSRYQSKSQSK

SEQ ID NO: 3130690 - protein, 17 aa, Giardia lamblia
QNQYTAGSASQLNTSGL

SEQ ID NO: 3130691 - protein, 8 aa, Giardia lamblia
QNRDVQKD

SEQ ID NO: 3130692 - protein, 9 aa, Giardia lamblia
QNREMSSTA

SEQ ID NO: 3130693 - protein, 10 aa, Giardia lamblia
QNREQKDELN

SEQ ID NO: 3130694 - protein, 8 aa, Giardia lamblia
QNRERQGE

SEQ ID NO: 3130695 - protein, 7 aa, Giardia lamblia
QNRGADQ

SEQ ID NO: 3130696 - protein, 12 aa, Giardia lamblia
QNRHGVGAEPSH

SEQ ID NO: 3130697 - protein, 9 aa, Giardia lamblia
QNRIPEGYE

SEQ ID NO: 3130698 - protein, 22 aa, Giardia lamblia
QNRKDHRNGIKKPKKSAYTSHK

SEQ ID NO: 3130699 - protein, 6 aa, Giardia lamblia
QNRQGR

SEQ ID NO: 3130700 - protein, 12 aa, Giardia lamblia
QNRRRHSSGTGA

SEQ ID NO: 3130701 - protein, 7 aa, Giardia lamblia
QNRSGKE

SEQ ID NO: 3130702 - protein, 9 aa, Giardia lamblia
QNRTTAPTM

SEQ ID NO: 3130703 - protein, 6 aa, Giardia lamblia
QNSAAP

SEQ ID NO: 3130704 - protein, 16 aa, Giardia lamblia
QNSAVPGQQATKTPSF

SEQ ID NO: 3130705 - protein, 5 aa, Giardia lamblia
QNSCD

SEQ ID NO: 3130706 - protein, 11 aa, Giardia lamblia
QNSDERQQNAN

SEQ ID NO: 3130707 - protein, 11 aa, Giardia lamblia
QNSDNSSLATE

SEQ ID NO: 3130708 - protein, 5 aa, Giardia lamblia
QNSDS

SEQ ID NO: 3130709 - protein, 14 aa, Giardia lamblia
QNSELKSKQTEEKN

SEQ ID NO: 3130710 - protein, 6 aa, Giardia lamblia
QNSEQL

SEQ ID NO: 3130711 - protein, 5 aa, Giardia lamblia
QNSHR

SEQ ID NO: 3130712 - protein, 4 aa, Giardia lamblia
QNSI

SEQ ID NO: 3130713 - protein, 15 aa, Giardia lamblia
QNSLGSKPAPKSRQI

SEQ ID NO: 3130714 - protein, 10 aa, Giardia lamblia
QNSNQGDDTP

SEQ ID NO: 3130715 - protein, 12 aa, Giardia lamblia
QNSQGQKRRKCS

SEQ ID NO: 3130716 - protein, 4 aa, Giardia lamblia
QNSR

SEQ ID NO: 3130717 - protein, 16 aa, Giardia lamblia
QNSRSASRADSRSVKR

SEQ ID NO: 3130718 - protein, 7 aa, Giardia lamblia
QNSSPIA

SEQ ID NO: 3130719 - protein, 8 aa, Giardia lamblia
QNSSRLTA

SEQ ID NO: 3130720 - protein, 13 aa, Giardia lamblia
QNSSSPSPALMWM

SEQ ID NO: 3130721 - protein, 7 aa, Giardia lamblia
QNSSVDA

SEQ ID NO: 3130722 - protein, 7 aa, Giardia lamblia
QNSTASY

SEQ ID NO: 3130723 - protein, 9 aa, Giardia lamblia
QNSTGRDLS

SEQ ID NO: 3130724 - protein, 15 aa, Giardia lamblia
QNSTNRALGDATATY

SEQ ID NO: 3130725 - protein, 5 aa, Giardia lamblia
QNSVT

SEQ ID NO: 3130726 - protein, 8 aa, Giardia lamblia
QNTAPHQL

SEQ ID NO: 3130727 - protein, 13 aa, Giardia lamblia
QNTAQATNQDRTT

SEQ ID NO: 3130728 - protein, 9 aa, Giardia lamblia
QNTASRGKS

SEQ ID NO: 3130729 - protein, 10 aa, Giardia lamblia
QNTDLQKTER

SEQ ID NO: 3130730 - protein, 17 aa, Giardia lamblia
QNTGTKSNEPESNESSY

SEQ ID NO: 3130731 - protein, 6 aa, Giardia lamblia
QNTGTV

SEQ ID NO: 3130732 - protein, 5 aa, Giardia lamblia
QNTHA

SEQ ID NO: 3130733 - protein, 6 aa, Giardia lamblia
QNTHKS

SEQ ID NO: 3130734 - protein, 5 aa, Giardia lamblia
QNTIG

SEQ ID NO: 3130735 - protein, 10 aa, Giardia lamblia
QNTITNTAKV

SEQ ID NO: 3130736 - protein, 4 aa, Giardia lamblia
QNTL

SEQ ID NO: 3130737 - protein, 21 aa, Giardia lamblia
QNTPSTAPSHPTTSGSHTSQS

SEQ ID NO: 3130738 - protein, 10 aa, Giardia lamblia
QNTQGDDPRI

SEQ ID NO: 3130739 - protein, 15 aa, Giardia lamblia
QNTSLAAELSDTQKA

SEQ ID NO: 3130740 - protein, 9 aa, Giardia lamblia
QNTTTVEEA

SEQ ID NO: 3130741 - protein, 34 aa, Giardia lamblia
QNVTYTTSNQPTMAGESRAAITAPSTRQNSDGTV

SEQ ID NO: 3130742 - protein, 6 aa, Giardia lamblia
QNYDKN

SEQ ID NO: 3130743 - protein, 21 aa, Giardia lamblia
QNYKPVDNTEQPDLKNNEKNE

SEQ ID NO: 3130744 - protein, 5 aa, Giardia lamblia
QNYTH

SEQ ID NO: 3130745 - protein, 5 aa, Giardia lamblia
QNYYG

SEQ ID NO: 3130746 - protein, 5 aa, Giardia lamblia
QPAEL

SEQ ID NO: 3130747 - protein, 34 aa, Giardia lamblia
QPAELSKKALKKAAKEAEKQAKRAENKSKQAGVD

SEQ ID NO: 3130748 - protein, 5 aa, Giardia lamblia
QPAGK

SEQ ID NO: 3130749 - protein, 4 aa, Giardia lamblia
QPAI

SEQ ID NO: 3130750 - protein, 10 aa, Giardia lamblia
QPAKEYEANT

SEQ ID NO: 3130751 - protein, 15 aa, Giardia lamblia
QPAKNMVDDDSANAS

SEQ ID NO: 3130752 - protein, 13 aa, Giardia lamblia
QPALEGLSSPLSA

SEQ ID NO: 3130753 - protein, 8 aa, Giardia lamblia
QPALSAGS

SEQ ID NO: 3130754 - protein, 12 aa, Giardia lamblia
QPALTPLKQKKA

SEQ ID NO: 3130755 - protein, 11 aa, Giardia lamblia
QPANTSTSREL

SEQ ID NO: 3130756 - protein, 6 aa, Giardia lamblia
QPANTV

SEQ ID NO: 3130757 - protein, 10 aa, Giardia lamblia
QPASNTCSQQ

SEQ ID NO: 3130758 - protein, 26 aa, Giardia lamblia
QPASSSAPLTSGAPPQASLPQKEPAR

SEQ ID NO: 3130759 - protein, 7 aa, Giardia lamblia
QPCAPPT

SEQ ID NO: 3130760 - protein, 11 aa, Giardia lamblia
QPCPQSQTKEH

SEQ ID NO: 3130761 - protein, 13 aa, Giardia lamblia
QPDAFTDGTHSSV

SEQ ID NO: 3130762 - protein, 37 aa, Giardia lamblia
QPDAYSSAERDSGPEKKRQKASSRAFRAKRGSSPANF

SEQ ID NO: 3130763 - protein, 6 aa, Giardia lamblia
QPDEVK

SEQ ID NO: 3130764 - protein, 5 aa, Giardia lamblia
QPDGQ

SEQ ID NO: 3130765 - protein, 11 aa, Giardia lamblia
QPDISYSPEVK

SEQ ID NO: 3130766 - protein, 16 aa, Giardia lamblia
QPDRDDGDAGVSGDNG

SEQ ID NO: 3130767 - protein, 13 aa, Giardia lamblia
QPDSVVDSQSDEP

SEQ ID NO: 3130768 - protein, 11 aa, Giardia lamblia
QPDTGAPKLLE

SEQ ID NO: 3130769 - protein, 6 aa, Giardia lamblia
QPDVID

SEQ ID NO: 3130770 - protein, 5 aa, Giardia lamblia
QPEEG

SEQ ID NO: 3130771 - protein, 6 aa, Giardia lamblia
QPEGRE

SEQ ID NO: 3130772 - protein, 13 aa, Giardia lamblia
QPEGSVSDSSQGV

SEQ ID NO: 3130773 - protein, 21 aa, Giardia lamblia
QPELGSGSTFLPPQSASMTGH

SEQ ID NO: 3130774 - protein, 21 aa, Giardia lamblia
QPELSGTAAPLKLTDSSPSLS

SEQ ID NO: 3130775 - protein, 10 aa, Giardia lamblia
QPEPGASTEG

SEQ ID NO: 3130776 - protein, 8 aa, Giardia lamblia
QPEPTPLR

SEQ ID NO: 3130777 - protein, 15 aa, Giardia lamblia
QPEQAFSGDKPLQES

SEQ ID NO: 3130778 - protein, 7 aa, Giardia lamblia
QPEQKEI

SEQ ID NO: 3130779 - protein, 9 aa, Giardia lamblia
QPERSSTAA

SEQ ID NO: 3130780 - protein, 9 aa, Giardia lamblia
QPESTQHAE

SEQ ID NO: 3130781 - protein, 4 aa, Giardia lamblia
QPET

SEQ ID NO: 3130782 - protein, 7 aa, Giardia lamblia
QPETNRS

SEQ ID NO: 3130783 - protein, 9 aa, Giardia lamblia
QPEYPDANI

SEQ ID NO: 3130784 - protein, 4 aa, Giardia lamblia
QPFG

SEQ ID NO: 3130785 - protein, 16 aa, Giardia lamblia
QPFGMSGQSSAADATF

SEQ ID NO: 3130786 - protein, 6 aa, Giardia lamblia
QPFSEQ

SEQ ID NO: 3130787 - protein, 6 aa, Giardia lamblia
QPFTDQ

SEQ ID NO: 3130788 - protein, 6 aa, Giardia lamblia
QPGERS

SEQ ID NO: 3130789 - protein, 12 aa, Giardia lamblia
QPGHGREKPPQR

SEQ ID NO: 3130790 - protein, 9 aa, Giardia lamblia
QPGNSSMSV

SEQ ID NO: 3130791 - protein, 6 aa, Giardia lamblia
QPGQQP

SEQ ID NO: 3130792 - protein, 6 aa, Giardia lamblia
QPGQRI

SEQ ID NO: 3130793 - protein, 8 aa, Giardia lamblia
QPGRETDA

SEQ ID NO: 3130794 - protein, 14 aa, Giardia lamblia
QPGRNGTQLRGPGY

SEQ ID NO: 3130795 - protein, 6 aa, Giardia lamblia
QPGSEK

SEQ ID NO: 3130796 - protein, 28 aa, Giardia lamblia
QPGSPGSSLSRPEDGHVPREKGGNDAAI

SEQ ID NO: 3130797 - protein, 29 aa, Giardia lamblia
QPGSPPSPPSLMDEKGGASTMGKSHNGMT

SEQ ID NO: 3130798 - protein, 8 aa, Giardia lamblia
QPGTTADS

SEQ ID NO: 3130799 - protein, 7 aa, Giardia lamblia
QPGVQDG

SEQ ID NO: 3130800 - protein, 15 aa, Giardia lamblia
QPHGELKSSIQSAAP

SEQ ID NO: 3130801 - protein, 8 aa, Giardia lamblia
QPHGNGTT

SEQ ID NO: 3130802 - protein, 112 aa, Giardia lamblia
QPHIPQAAPQAAGGYGEVTQGHVDNTGVEGTGYNAWGQNNDGYGGYNAQNTGYGGGYDSGAGGYGGYGNYGGYDSGTTGGYDSGATGGYGGYDNTSGGYGGYDNTSGGGYGG

SEQ ID NO: 3130803 - protein, 4 aa, Giardia lamblia
QPHL

SEQ ID NO: 3130804 - protein, 6 aa, Giardia lamblia
QPHQTY

SEQ ID NO: 3130805 - protein, 20 aa, Giardia lamblia
QPHSAIDGRGHPENGATGYL

SEQ ID NO: 3130806 - protein, 6 aa, Giardia lamblia
QPHSKQ

SEQ ID NO: 3130807 - protein, 7 aa, Giardia lamblia
QPINRSS

SEQ ID NO: 3130808 - protein, 7 aa, Giardia lamblia
QPIPPSA

SEQ ID NO: 3130809 - protein, 12 aa, Giardia lamblia
QPIPTDTNLFKN

SEQ ID NO: 3130810 - protein, 9 aa, Giardia lamblia
QPISNTYSR

SEQ ID NO: 3130811 - protein, 39 aa, Giardia lamblia
QPISSNNPISQGGLQAPASQADNGTLAPLPSALPPQQHY

SEQ ID NO: 3130812 - protein, 7 aa, Giardia lamblia
QPISTTD

SEQ ID NO: 3130813 - protein, 16 aa, Giardia lamblia
QPKARGPNVKTYTQEE

SEQ ID NO: 3130814 - protein, 25 aa, Giardia lamblia
QPKDNKDTKDGDAEDSSQNSTGNDK

SEQ ID NO: 3130815 - protein, 17 aa, Giardia lamblia
QPKDSGGGGGSKDGKQQ

SEQ ID NO: 3130816 - protein, 6 aa, Giardia lamblia
QPKEHQ

SEQ ID NO: 3130817 - protein, 44 aa, Giardia lamblia
QPKHPVKKRSVSKSTASSKVERRKKPQVVTQNRPASRAAGARTQ

SEQ ID NO: 3130818 - protein, 16 aa, Giardia lamblia
QPKNIDAKSRQEELAR

SEQ ID NO: 3130819 - protein, 18 aa, Giardia lamblia
QPKNLAPGQCDTSGRAAC

SEQ ID NO: 3130820 - protein, 6 aa, Giardia lamblia
QPKNQL

SEQ ID NO: 3130821 - protein, 5 aa, Giardia lamblia
QPKPV

SEQ ID NO: 3130822 - protein, 6 aa, Giardia lamblia
QPKQTE

SEQ ID NO: 3130823 - protein, 8 aa, Giardia lamblia
QPKSGQEK

SEQ ID NO: 3130824 - protein, 6 aa, Giardia lamblia
QPKSPL

SEQ ID NO: 3130825 - protein, 8 aa, Giardia lamblia
QPKTGKAL

SEQ ID NO: 3130826 - protein, 4 aa, Giardia lamblia
QPLE

SEQ ID NO: 3130827 - protein, 15 aa, Giardia lamblia
QPLGSNQQNKQSTIR

SEQ ID NO: 3130828 - protein, 8 aa, Giardia lamblia
QPLPEGHK

SEQ ID NO: 3130829 - protein, 7 aa, Giardia lamblia
QPLPPNL

SEQ ID NO: 3130830 - protein, 12 aa, Giardia lamblia
QPLPTEERARYD

SEQ ID NO: 3130831 - protein, 5 aa, Giardia lamblia
QPLSS

SEQ ID NO: 3130832 - protein, 5 aa, Giardia lamblia
QPLTG

SEQ ID NO: 3130833 - protein, 6 aa, Giardia lamblia
QPLTTD

SEQ ID NO: 3130834 - protein, 11 aa, Giardia lamblia
QPMASSPPAML

SEQ ID NO: 3130835 - protein, 12 aa, Giardia lamblia
QPMDGTSGSLPS

SEQ ID NO: 3130836 - protein, 10 aa, Giardia lamblia
QPMPTDLPAP

SEQ ID NO: 3130837 - protein, 6 aa, Giardia lamblia
QPNETN

SEQ ID NO: 3130838 - protein, 5 aa, Giardia lamblia
QPNKL

SEQ ID NO: 3130839 - protein, 5 aa, Giardia lamblia
QPNLD

SEQ ID NO: 3130840 - protein, 7 aa, Giardia lamblia
QPNMPRS

SEQ ID NO: 3130841 - protein, 7 aa, Giardia lamblia
QPNPEEL

SEQ ID NO: 3130842 - protein, 5 aa, Giardia lamblia
QPNRC

SEQ ID NO: 3130843 - protein, 13 aa, Giardia lamblia
QPNRGTLDGPQVA

SEQ ID NO: 3130844 - protein, 7 aa, Giardia lamblia
QPPAGSY

SEQ ID NO: 3130845 - protein, 6 aa, Giardia lamblia
QPPAPI

SEQ ID NO: 3130846 - protein, 8 aa, Giardia lamblia
QPPAQQFS

SEQ ID NO: 3130847 - protein, 15 aa, Giardia lamblia
QPPCIDGSDTVSLSS

SEQ ID NO: 3130848 - protein, 6 aa, Giardia lamblia
QPPETH

SEQ ID NO: 3130849 - protein, 9 aa, Giardia lamblia
QPPGRKSAL

SEQ ID NO: 3130850 - protein, 15 aa, Giardia lamblia
QPPKKAKRPADDVSY

SEQ ID NO: 3130851 - protein, 11 aa, Giardia lamblia
QPPKPESKGSF

SEQ ID NO: 3130852 - protein, 4 aa, Giardia lamblia
QPPL

SEQ ID NO: 3130853 - protein, 8 aa, Giardia lamblia
QPPLPQHL

SEQ ID NO: 3130854 - protein, 5 aa, Giardia lamblia
QPPMK

SEQ ID NO: 3130855 - protein, 11 aa, Giardia lamblia
QPPMPKQDPDL

SEQ ID NO: 3130856 - protein, 4 aa, Giardia lamblia
QPPN

SEQ ID NO: 3130857 - protein, 10 aa, Giardia lamblia
QPPNYEKDIA

SEQ ID NO: 3130858 - protein, 5 aa, Giardia lamblia
QPPPI

SEQ ID NO: 3130859 - protein, 5 aa, Giardia lamblia
QPPPL

SEQ ID NO: 3130860 - protein, 14 aa, Giardia lamblia
QPPPQQENQEQGQD

SEQ ID NO: 3130861 - protein, 8 aa, Giardia lamblia
QPPQNSSV

SEQ ID NO: 3130862 - protein, 21 aa, Giardia lamblia
QPPQPMHSSGPQQPYSQPQNV

SEQ ID NO: 3130863 - protein, 21 aa, Giardia lamblia
QPPRSRVSPSTRHSYSSMGSY

SEQ ID NO: 3130864 - protein, 4 aa, Giardia lamblia
QPPS

SEQ ID NO: 3130865 - protein, 6 aa, Giardia lamblia
QPPSGL

SEQ ID NO: 3130866 - protein, 12 aa, Giardia lamblia
QPPSNADRTSEM

SEQ ID NO: 3130867 - protein, 6 aa, Giardia lamblia
QPPSSG

SEQ ID NO: 3130868 - protein, 6 aa, Giardia lamblia
QPPSVI

SEQ ID NO: 3130869 - protein, 4 aa, Giardia lamblia
QPPT

SEQ ID NO: 3130870 - protein, 6 aa, Giardia lamblia
QPPTLS

SEQ ID NO: 3130871 - protein, 13 aa, Giardia lamblia
QPPTTGPQAPNMY

SEQ ID NO: 3130872 - protein, 10 aa, Giardia lamblia
QPPTTSAEKA

SEQ ID NO: 3130873 - protein, 25 aa, Giardia lamblia
QPPVQQQTQQQVQQQRNASDRLSQT

SEQ ID NO: 3130874 - protein, 4 aa, Giardia lamblia
QPQA

SEQ ID NO: 3130875 - protein, 13 aa, Giardia lamblia
QPQKPRVPRPSEK

SEQ ID NO: 3130876 - protein, 25 aa, Giardia lamblia
QPQLSSSSSNVLSTSGTLSTPTLEA

SEQ ID NO: 3130877 - protein, 22 aa, Giardia lamblia
QPQPQPQSQSQPGAELEGSLAE

SEQ ID NO: 3130878 - protein, 10 aa, Giardia lamblia
QPQQTTADSV

SEQ ID NO: 3130879 - protein, 34 aa, Giardia lamblia
QPQRGAGSRGPPNARGGKYRDSEERSSDATDDES

SEQ ID NO: 3130880 - protein, 13 aa, Giardia lamblia
QPQRHSPDAQTAS

SEQ ID NO: 3130881 - protein, 8 aa, Giardia lamblia
QPQSQHIP

SEQ ID NO: 3130882 - protein, 13 aa, Giardia lamblia
QPRAAPKGTPAAI

SEQ ID NO: 3130883 - protein, 9 aa, Giardia lamblia
QPRDLPPPE

SEQ ID NO: 3130884 - protein, 8 aa, Giardia lamblia
QPRDSRGS

SEQ ID NO: 3130885 - protein, 20 aa, Giardia lamblia
QPRKPSNLNNPIKRPADPSA

SEQ ID NO: 3130886 - protein, 5 aa, Giardia lamblia
QPRPQ

SEQ ID NO: 3130887 - protein, 20 aa, Giardia lamblia
QPRQRGQPQQARQFQTPYRN

SEQ ID NO: 3130888 - protein, 5 aa, Giardia lamblia
QPRQS

SEQ ID NO: 3130889 - protein, 15 aa, Giardia lamblia
QPRSASGESGSREDY

SEQ ID NO: 3130890 - protein, 18 aa, Giardia lamblia
QPRSGDAPDADDARPKYN

SEQ ID NO: 3130891 - protein, 4 aa, Giardia lamblia
QPRT

SEQ ID NO: 3130892 - protein, 5 aa, Giardia lamblia
QPRTA

SEQ ID NO: 3130893 - protein, 9 aa, Giardia lamblia
QPRTVNSNR

SEQ ID NO: 3130894 - protein, 14 aa, Giardia lamblia
QPSAESPDPGPEQQ

SEQ ID NO: 3130895 - protein, 14 aa, Giardia lamblia
QPSAQPPSNSTSTE

SEQ ID NO: 3130896 - protein, 11 aa, Giardia lamblia
QPSASQQQYQS

SEQ ID NO: 3130897 - protein, 5 aa, Giardia lamblia
QPSAT

SEQ ID NO: 3130898 - protein, 7 aa, Giardia lamblia
QPSGPYI

SEQ ID NO: 3130899 - protein, 20 aa, Giardia lamblia
QPSHQSANQRRRPQSADSAL

SEQ ID NO: 3130900 - protein, 4 aa, Giardia lamblia
QPSI

SEQ ID NO: 3130901 - protein, 9 aa, Giardia lamblia
QPSLPSLNN

SEQ ID NO: 3130902 - protein, 15 aa, Giardia lamblia
QPSNIEDISAEEKPL

SEQ ID NO: 3130903 - protein, 8 aa, Giardia lamblia
QPSPAQPA

SEQ ID NO: 3130904 - protein, 12 aa, Giardia lamblia
QPSPGQSPSVSV

SEQ ID NO: 3130905 - protein, 12 aa, Giardia lamblia
QPSRPRADGAAH

SEQ ID NO: 3130906 - protein, 11 aa, Giardia lamblia
QPSRPYGESRV

SEQ ID NO: 3130907 - protein, 10 aa, Giardia lamblia
QPSRTGEPVP

SEQ ID NO: 3130908 - protein, 5 aa, Giardia lamblia
QPSSE

SEQ ID NO: 3130909 - protein, 6 aa, Giardia lamblia
QPSSKL

SEQ ID NO: 3130910 - protein, 7 aa, Giardia lamblia
QPSTPTY

SEQ ID NO: 3130911 - protein, 4 aa, Giardia lamblia
QPTA

SEQ ID NO: 3130912 - protein, 7 aa, Giardia lamblia
QPTAGSQ

SEQ ID NO: 3130913 - protein, 6 aa, Giardia lamblia
QPTDIE

SEQ ID NO: 3130914 - protein, 23 aa, Giardia lamblia
QPTDIQASGVGNSISSGAMQSRA

SEQ ID NO: 3130915 - protein, 8 aa, Giardia lamblia
QPTGPSLS

SEQ ID NO: 3130916 - protein, 5 aa, Giardia lamblia
QPTIA

SEQ ID NO: 3130917 - protein, 5 aa, Giardia lamblia
QPTLS

SEQ ID NO: 3130918 - protein, 5 aa, Giardia lamblia
QPTNE

SEQ ID NO: 3130919 - protein, 4 aa, Giardia lamblia
QPTP

SEQ ID NO: 3130920 - protein, 9 aa, Giardia lamblia
QPTSKKGVT

SEQ ID NO: 3130921 - protein, 5 aa, Giardia lamblia
QPTSY

SEQ ID NO: 3130922 - protein, 4 aa, Giardia lamblia
QPTV

SEQ ID NO: 3130923 - protein, 5 aa, Giardia lamblia
QPVAS

SEQ ID NO: 3130924 - protein, 7 aa, Giardia lamblia
QPVDPSA

SEQ ID NO: 3130925 - protein, 29 aa, Giardia lamblia
QPVEDSASSVTTSAVSAAPPAPTKANPYL

SEQ ID NO: 3130926 - protein, 7 aa, Giardia lamblia
QPVETSS

SEQ ID NO: 3130927 - protein, 4 aa, Giardia lamblia
QPVI

SEQ ID NO: 3130928 - protein, 6 aa, Giardia lamblia
QPVNPE

SEQ ID NO: 3130929 - protein, 10 aa, Giardia lamblia
QPVNTGSQQY

SEQ ID NO: 3130930 - protein, 6 aa, Giardia lamblia
QPVPSS

SEQ ID NO: 3130931 - protein, 11 aa, Giardia lamblia
QPVQESNRDYA

SEQ ID NO: 3130932 - protein, 8 aa, Giardia lamblia
QPVRAGSN

SEQ ID NO: 3130933 - protein, 34 aa, Giardia lamblia
QPVSASNCQPDKCAGCPSKGSCGSSTESPDNRAI

SEQ ID NO: 3130934 - protein, 10 aa, Giardia lamblia
QPVSNSTQQP

SEQ ID NO: 3130935 - protein, 4 aa, Giardia lamblia
QPVT

SEQ ID NO: 3130936 - protein, 5 aa, Giardia lamblia
QPYFP

SEQ ID NO: 3130937 - protein, 5 aa, Giardia lamblia
QPYQQ

SEQ ID NO: 3130938 - protein, 10 aa, Giardia lamblia
QPYSSSATPL

SEQ ID NO: 3130939 - protein, 8 aa, Giardia lamblia
QPYSTEPD

SEQ ID NO: 3130940 - protein, 24 aa, Giardia lamblia
QPYSTEPTSPIRKSNNLSPPHDES

SEQ ID NO: 3130941 - protein, 10 aa, Giardia lamblia
QQAAQKNPDE

SEQ ID NO: 3130942 - protein, 5 aa, Giardia lamblia
QQAAR

SEQ ID NO: 3130943 - protein, 22 aa, Giardia lamblia
QQAISKTTAPSMANAKANSRRL

SEQ ID NO: 3130944 - protein, 8 aa, Giardia lamblia
QQALPGNL

SEQ ID NO: 3130945 - protein, 8 aa, Giardia lamblia
QQANAREE

SEQ ID NO: 3130946 - protein, 7 aa, Giardia lamblia
QQANPQL

SEQ ID NO: 3130947 - protein, 8 aa, Giardia lamblia
QQAPESFN

SEQ ID NO: 3130948 - protein, 11 aa, Giardia lamblia
QQAPQQTMPPQ

SEQ ID NO: 3130949 - protein, 7 aa, Giardia lamblia
QQAQQQA

SEQ ID NO: 3130950 - protein, 6 aa, Giardia lamblia
QQASPK

SEQ ID NO: 3130951 - protein, 5 aa, Giardia lamblia
QQASR

SEQ ID NO: 3130952 - protein, 18 aa, Giardia lamblia
QQAVKNGSFDRAESDLEG

SEQ ID NO: 3130953 - protein, 4 aa, Giardia lamblia
QQCS

SEQ ID NO: 3130954 - protein, 6 aa, Giardia lamblia
QQCSDL

SEQ ID NO: 3130955 - protein, 14 aa, Giardia lamblia
QQDAKNAKKLTRQQ

SEQ ID NO: 3130956 - protein, 8 aa, Giardia lamblia
QQDARIST

SEQ ID NO: 3130957 - protein, 4 aa, Giardia lamblia
QQDD

SEQ ID NO: 3130958 - protein, 5 aa, Giardia lamblia
QQDEI

SEQ ID NO: 3130959 - protein, 16 aa, Giardia lamblia
QQDHRRSKHVRPQASS

SEQ ID NO: 3130960 - protein, 11 aa, Giardia lamblia
QQDKSQLNTEI

SEQ ID NO: 3130961 - protein, 5 aa, Giardia lamblia
QQDND

SEQ ID NO: 3130962 - protein, 7 aa, Giardia lamblia
QQDNENV

SEQ ID NO: 3130963 - protein, 7 aa, Giardia lamblia
QQDQLSA

SEQ ID NO: 3130964 - protein, 9 aa, Giardia lamblia
QQDREDQER

SEQ ID NO: 3130965 - protein, 7 aa, Giardia lamblia
QQDSIRT

SEQ ID NO: 3130966 - protein, 8 aa, Giardia lamblia
QQDSRVQL

SEQ ID NO: 3130967 - protein, 8 aa, Giardia lamblia
QQDTSGRT

SEQ ID NO: 3130968 - protein, 7 aa, Giardia lamblia
QQDVDGR

SEQ ID NO: 3130969 - protein, 6 aa, Giardia lamblia
QQDYTG

SEQ ID NO: 3130970 - protein, 10 aa, Giardia lamblia
QQEAHRSTAE

SEQ ID NO: 3130971 - protein, 14 aa, Giardia lamblia
QQEESDAALGNGGL

SEQ ID NO: 3130972 - protein, 5 aa, Giardia lamblia
QQEFS

SEQ ID NO: 3130973 - protein, 4 aa, Giardia lamblia
QQEH

SEQ ID NO: 3130974 - protein, 11 aa, Giardia lamblia
QQEHPDEASNL

SEQ ID NO: 3130975 - protein, 9 aa, Giardia lamblia
QQEISTGQE

SEQ ID NO: 3130976 - protein, 4 aa, Giardia lamblia
QQEP

SEQ ID NO: 3130977 - protein, 10 aa, Giardia lamblia
QQEPSRTITY

SEQ ID NO: 3130978 - protein, 4 aa, Giardia lamblia
QQEQ

SEQ ID NO: 3130979 - protein, 17 aa, Giardia lamblia
QQEQTDQDSSARISEDD

SEQ ID NO: 3130980 - protein, 12 aa, Giardia lamblia
QQESGLTSYTGN

SEQ ID NO: 3130981 - protein, 17 aa, Giardia lamblia
QQETDDLKEKPKGKDLY

SEQ ID NO: 3130982 - protein, 25 aa, Giardia lamblia
QQETSGNLSKSPSKISSRPASARLD

SEQ ID NO: 3130983 - protein, 4 aa, Giardia lamblia
QQFA

SEQ ID NO: 3130984 - protein, 4 aa, Giardia lamblia
QQFR

SEQ ID NO: 3130985 - protein, 37 aa, Giardia lamblia
QQGHEYSARSSTSYTARRSYADNKSQPLYQDPIQQKP

SEQ ID NO: 3130986 - protein, 7 aa, Giardia lamblia
QQGHGRP

SEQ ID NO: 3130987 - protein, 7 aa, Giardia lamblia
QQGHTGP

SEQ ID NO: 3130988 - protein, 6 aa, Giardia lamblia
QQGLPD

SEQ ID NO: 3130989 - protein, 6 aa, Giardia lamblia
QQGPKS

SEQ ID NO: 3130990 - protein, 7 aa, Giardia lamblia
QQGRGQE

SEQ ID NO: 3130991 - protein, 7 aa, Giardia lamblia
QQGSEPI

SEQ ID NO: 3130992 - protein, 7 aa, Giardia lamblia
QQGSMAD

SEQ ID NO: 3130993 - protein, 17 aa, Giardia lamblia
QQGSNSPTDNLTNNGTP

SEQ ID NO: 3130994 - protein, 16 aa, Giardia lamblia
QQHEDATGAGKNVPPV

SEQ ID NO: 3130995 - protein, 11 aa, Giardia lamblia
QQHGRGDRNGC

SEQ ID NO: 3130996 - protein, 5 aa, Giardia lamblia
QQHTA

SEQ ID NO: 3130997 - protein, 16 aa, Giardia lamblia
QQIDPDVSASSSDSFH

SEQ ID NO: 3130998 - protein, 16 aa, Giardia lamblia
QQIKESLDRETSLREE

SEQ ID NO: 3130999 - protein, 4 aa, Giardia lamblia
QQIP

SEQ ID NO: 3131000 - protein, 6 aa, Giardia lamblia
QQISSR

SEQ ID NO: 3131001 - protein, 11 aa, Giardia lamblia
QQKDELKGKNY

SEQ ID NO: 3131002 - protein, 8 aa, Giardia lamblia
QQKDKELR

SEQ ID NO: 3131003 - protein, 14 aa, Giardia lamblia
QQKEKRVSGVAEPL

SEQ ID NO: 3131004 - protein, 5 aa, Giardia lamblia
QQKGA

SEQ ID NO: 3131005 - protein, 10 aa, Giardia lamblia
QQKLPRSRYT

SEQ ID NO: 3131006 - protein, 12 aa, Giardia lamblia
QQKNAQDSRSAG

SEQ ID NO: 3131007 - protein, 6 aa, Giardia lamblia
QQKNIK

SEQ ID NO: 3131008 - protein, 11 aa, Giardia lamblia
QQKNQKPHEGY

SEQ ID NO: 3131009 - protein, 11 aa, Giardia lamblia
QQKPAPRKPTI

SEQ ID NO: 3131010 - protein, 13 aa, Giardia lamblia
QQKPSLDAADHDT

SEQ ID NO: 3131011 - protein, 11 aa, Giardia lamblia
QQKQQGGCGNT

SEQ ID NO: 3131012 - protein, 11 aa, Giardia lamblia
QQKRKQDVQGR

SEQ ID NO: 3131013 - protein, 10 aa, Giardia lamblia
QQKRTKDQAH

SEQ ID NO: 3131014 - protein, 8 aa, Giardia lamblia
QQKRYESN

SEQ ID NO: 3131015 - protein, 22 aa, Giardia lamblia
QQKSGTKGPSSSGPSSSPTNTT

SEQ ID NO: 3131016 - protein, 8 aa, Giardia lamblia
QQKSQFNS

SEQ ID NO: 3131017 - protein, 9 aa, Giardia lamblia
QQKSTYEQN

SEQ ID NO: 3131018 - protein, 13 aa, Giardia lamblia
QQKTKAEPPVQSA

SEQ ID NO: 3131019 - protein, 4 aa, Giardia lamblia
QQLA

SEQ ID NO: 3131020 - protein, 5 aa, Giardia lamblia
QQLAS

SEQ ID NO: 3131021 - protein, 10 aa, Giardia lamblia
QQLDERSQQV

SEQ ID NO: 3131022 - protein, 12 aa, Giardia lamblia
QQLESDKSELRQ

SEQ ID NO: 3131023 - protein, 5 aa, Giardia lamblia
QQLPP

SEQ ID NO: 3131024 - protein, 22 aa, Giardia lamblia
QQLPQSDESSKSTRAPSPTRNA

SEQ ID NO: 3131025 - protein, 21 aa, Giardia lamblia
QQLQQPKRPATGSKVSQPKRT

SEQ ID NO: 3131026 - protein, 16 aa, Giardia lamblia
QQLRDKSAISSTSQQR

SEQ ID NO: 3131027 - protein, 9 aa, Giardia lamblia
QQLRHDSPS

SEQ ID NO: 3131028 - protein, 5 aa, Giardia lamblia
QQLSA

SEQ ID NO: 3131029 - protein, 15 aa, Giardia lamblia
QQLSDPGPNQSGKVN

SEQ ID NO: 3131030 - protein, 38 aa, Giardia lamblia
QQLSTQPQPFSGPAQIPPPGRQHYQSTPPTPDSAHSVN

SEQ ID NO: 3131031 - protein, 6 aa, Giardia lamblia
QQLTET

SEQ ID NO: 3131032 - protein, 7 aa, Giardia lamblia
QQMDPRE

SEQ ID NO: 3131033 - protein, 5 aa, Giardia lamblia
QQNAP

SEQ ID NO: 3131034 - protein, 7 aa, Giardia lamblia
QQNASVR

SEQ ID NO: 3131035 - protein, 4 aa, Giardia lamblia
QQNI

SEQ ID NO: 3131036 - protein, 10 aa, Giardia lamblia
QQNIPRTGFP

SEQ ID NO: 3131037 - protein, 7 aa, Giardia lamblia
QQNPVEE

SEQ ID NO: 3131038 - protein, 11 aa, Giardia lamblia
QQNQRTNVDEQ

SEQ ID NO: 3131039 - protein, 8 aa, Giardia lamblia
QQNRQQAK

SEQ ID NO: 3131040 - protein, 6 aa, Giardia lamblia
QQNRTS

SEQ ID NO: 3131041 - protein, 9 aa, Giardia lamblia
QQPAQEYSP

SEQ ID NO: 3131042 - protein, 8 aa, Giardia lamblia
QQPASAQA

SEQ ID NO: 3131043 - protein, 12 aa, Giardia lamblia
QQPEKLHPQHEA

SEQ ID NO: 3131044 - protein, 6 aa, Giardia lamblia
QQPKDA

SEQ ID NO: 3131045 - protein, 6 aa, Giardia lamblia
QQPLTS

SEQ ID NO: 3131046 - protein, 15 aa, Giardia lamblia
QQPMPPSDAVTESSL

SEQ ID NO: 3131047 - protein, 4 aa, Giardia lamblia
QQPP

SEQ ID NO: 3131048 - protein, 24 aa, Giardia lamblia
QQPPALGGTGSSSSSKSKGSDATT

SEQ ID NO: 3131049 - protein, 19 aa, Giardia lamblia
QQPPATQQMAPAAQPAAPI

SEQ ID NO: 3131050 - protein, 22 aa, Giardia lamblia
QQPSARYTDTSPCTISPTDSPI

SEQ ID NO: 3131051 - protein, 23 aa, Giardia lamblia
QQPSKIQSKPDYTTLSDEKYNRL

SEQ ID NO: 3131052 - protein, 9 aa, Giardia lamblia
QQPSSSIGR

SEQ ID NO: 3131053 - protein, 14 aa, Giardia lamblia
QQPSVQLQGRDNYA

SEQ ID NO: 3131054 - protein, 7 aa, Giardia lamblia
QQPTDVN

SEQ ID NO: 3131055 - protein, 48 aa, Giardia lamblia
QQPTEMGDEVQKEPAPEDPKLSGSPLASGVTQNSVSTHSPGTQSFSPE

SEQ ID NO: 3131056 - protein, 12 aa, Giardia lamblia
QQQAKKDNKMAE

SEQ ID NO: 3131057 - protein, 5 aa, Giardia lamblia
QQQAW

SEQ ID NO: 3131058 - protein, 8 aa, Giardia lamblia
QQQDARRR

SEQ ID NO: 3131059 - protein, 5 aa, Giardia lamblia
QQQEL

SEQ ID NO: 3131060 - protein, 8 aa, Giardia lamblia
QQQHDEEV

SEQ ID NO: 3131061 - protein, 18 aa, Giardia lamblia
QQQHQEVGSASETRTGIK

SEQ ID NO: 3131062 - protein, 7 aa, Giardia lamblia
QQQKRHR

SEQ ID NO: 3131063 - protein, 10 aa, Giardia lamblia
QQQLEQQRQH

SEQ ID NO: 3131064 - protein, 24 aa, Giardia lamblia
QQQNQQEDQHKQSSDATVAATNQG

SEQ ID NO: 3131065 - protein, 29 aa, Giardia lamblia
QQQPRPRQSSGASGTPQAANQRERNPDEL

SEQ ID NO: 3131066 - protein, 14 aa, Giardia lamblia
QQQQDTPHDTKSKK

SEQ ID NO: 3131067 - protein, 5 aa, Giardia lamblia
QQQQE

SEQ ID NO: 3131068 - protein, 10 aa, Giardia lamblia
QQQQQQQPQA

SEQ ID NO: 3131069 - protein, 26 aa, Giardia lamblia
QQQQQQQQKSSAQVYRPKSVKRSTTN

SEQ ID NO: 3131070 - protein, 15 aa, Giardia lamblia
QQQQQQQQQVQQQPY

SEQ ID NO: 3131071 - protein, 11 aa, Giardia lamblia
QQQRERERQRE

SEQ ID NO: 3131072 - protein, 5 aa, Giardia lamblia
QQQRL

SEQ ID NO: 3131073 - protein, 18 aa, Giardia lamblia
QQQSSGHMSARGPPPTHQ

SEQ ID NO: 3131074 - protein, 6 aa, Giardia lamblia
QQQTEK

SEQ ID NO: 3131075 - protein, 141 aa, Giardia lamblia
QQQTPQMSQAQQQAHTSARMSQSNRMSSSYSSGSSPGMSRSAQPRGSMSSRGSDYVQSRTPTQQGSVGTRPVSGPSRYAPAASPMTNRGSFSGQSGPRTPTLSNRPHGSQSPSSAYRPISAGRPAQQGFSGTQSGRYSFGG

SEQ ID NO: 3131076 - protein, 5 aa, Giardia lamblia
QQQYK

SEQ ID NO: 3131077 - protein, 18 aa, Giardia lamblia
QQRAELKQKNALAEQRRN

SEQ ID NO: 3131078 - protein, 6 aa, Giardia lamblia
QQRASL

SEQ ID NO: 3131079 - protein, 11 aa, Giardia lamblia
QQRDTQAKRAM

SEQ ID NO: 3131080 - protein, 6 aa, Giardia lamblia
QQRDYR

SEQ ID NO: 3131081 - protein, 14 aa, Giardia lamblia
QQREMQSARRQLER

SEQ ID NO: 3131082 - protein, 14 aa, Giardia lamblia
QQREQQIRAREEQV

SEQ ID NO: 3131083 - protein, 12 aa, Giardia lamblia
QQRGPSSFKREE

SEQ ID NO: 3131084 - protein, 22 aa, Giardia lamblia
QQRGSANGRYIGSPSRRPSPHL

SEQ ID NO: 3131085 - protein, 4 aa, Giardia lamblia
QQRI

SEQ ID NO: 3131086 - protein, 5 aa, Giardia lamblia
QQRMQ

SEQ ID NO: 3131087 - protein, 16 aa, Giardia lamblia
QQRNDQASEDHSRRAS

SEQ ID NO: 3131088 - protein, 33 aa, Giardia lamblia
QQRPASSSAARYRAGKSVAQEAGNDVSMSTDTS

SEQ ID NO: 3131089 - protein, 8 aa, Giardia lamblia
QQRQQGLY

SEQ ID NO: 3131090 - protein, 13 aa, Giardia lamblia
QQRREEHQRREKL

SEQ ID NO: 3131091 - protein, 11 aa, Giardia lamblia
QQRRKSATAEQ

SEQ ID NO: 3131092 - protein, 24 aa, Giardia lamblia
QQRSRETSENYSHGPSDAPPHATA

SEQ ID NO: 3131093 - protein, 6 aa, Giardia lamblia
QQRSRR

SEQ ID NO: 3131094 - protein, 5 aa, Giardia lamblia
QQRVD

SEQ ID NO: 3131095 - protein, 4 aa, Giardia lamblia
QQSA

SEQ ID NO: 3131096 - protein, 7 aa, Giardia lamblia
QQSCDNA

SEQ ID NO: 3131097 - protein, 5 aa, Giardia lamblia
QQSEV

SEQ ID NO: 3131098 - protein, 5 aa, Giardia lamblia
QQSHA

SEQ ID NO: 3131099 - protein, 7 aa, Giardia lamblia
QQSIAPS

SEQ ID NO: 3131100 - protein, 6 aa, Giardia lamblia
QQSIDN

SEQ ID NO: 3131101 - protein, 8 aa, Giardia lamblia
QQSITNNE

SEQ ID NO: 3131102 - protein, 29 aa, Giardia lamblia
QQSKGRETPVESDPGFTSPALSTTSVQPN

SEQ ID NO: 3131103 - protein, 20 aa, Giardia lamblia
QQSKIQSQEAKARDTTTSTH

SEQ ID NO: 3131104 - protein, 10 aa, Giardia lamblia
QQSPPGGQKA

SEQ ID NO: 3131105 - protein, 9 aa, Giardia lamblia
QQSPQDHSI

SEQ ID NO: 3131106 - protein, 10 aa, Giardia lamblia
QQSSAPDNID

SEQ ID NO: 3131107 - protein, 12 aa, Giardia lamblia
QQSSHVKQTEHA

SEQ ID NO: 3131108 - protein, 6 aa, Giardia lamblia
QQSSLA

SEQ ID NO: 3131109 - protein, 9 aa, Giardia lamblia
QQSSQPRTD

SEQ ID NO: 3131110 - protein, 6 aa, Giardia lamblia
QQSVDT

SEQ ID NO: 3131111 - protein, 8 aa, Giardia lamblia
QQTATAAD

SEQ ID NO: 3131112 - protein, 9 aa, Giardia lamblia
QQTDEVESV

SEQ ID NO: 3131113 - protein, 13 aa, Giardia lamblia
QQTDKNESACPPT

SEQ ID NO: 3131114 - protein, 6 aa, Giardia lamblia
QQTERV

SEQ ID NO: 3131115 - protein, 31 aa, Giardia lamblia
QQTGGDTSRLSAKSHSVAGDVGSHPNGVEAT

SEQ ID NO: 3131116 - protein, 12 aa, Giardia lamblia
QQTGPGDQDDDS

SEQ ID NO: 3131117 - protein, 5 aa, Giardia lamblia
QQTGS

SEQ ID NO: 3131118 - protein, 5 aa, Giardia lamblia
QQTKI

SEQ ID NO: 3131119 - protein, 6 aa, Giardia lamblia
QQTNEY

SEQ ID NO: 3131120 - protein, 7 aa, Giardia lamblia
QQTPLYP

SEQ ID NO: 3131121 - protein, 15 aa, Giardia lamblia
QQTREDLKEAEKEAE

SEQ ID NO: 3131122 - protein, 8 aa, Giardia lamblia
QQTRRRDF

SEQ ID NO: 3131123 - protein, 7 aa, Giardia lamblia
QQTRTTL

SEQ ID NO: 3131124 - protein, 8 aa, Giardia lamblia
QQTSNSLK

SEQ ID NO: 3131125 - protein, 19 aa, Giardia lamblia
QQVPAPVPVASGPSGAGPI

SEQ ID NO: 3131126 - protein, 4 aa, Giardia lamblia
QQVS

SEQ ID NO: 3131127 - protein, 4 aa, Giardia lamblia
QQWE

SEQ ID NO: 3131128 - protein, 6 aa, Giardia lamblia
QRAADL

SEQ ID NO: 3131129 - protein, 10 aa, Giardia lamblia
QRAEDEDGIK

SEQ ID NO: 3131130 - protein, 8 aa, Giardia lamblia
QRAGTCAS

SEQ ID NO: 3131131 - protein, 10 aa, Giardia lamblia
QRAKEEADDM

SEQ ID NO: 3131132 - protein, 6 aa, Giardia lamblia
QRANNR

SEQ ID NO: 3131133 - protein, 14 aa, Giardia lamblia
QRANQDGSGGRPTA

SEQ ID NO: 3131134 - protein, 10 aa, Giardia lamblia
QRAPGRSTLR

SEQ ID NO: 3131135 - protein, 21 aa, Giardia lamblia
QRAPQGKDNDDHSHRFKDNPN

SEQ ID NO: 3131136 - protein, 6 aa, Giardia lamblia
QRAQEQ

SEQ ID NO: 3131137 - protein, 4 aa, Giardia lamblia
QRAR

SEQ ID NO: 3131138 - protein, 12 aa, Giardia lamblia
QRASSSTAENCA

SEQ ID NO: 3131139 - protein, 11 aa, Giardia lamblia
QRASTDSTRLS

SEQ ID NO: 3131140 - protein, 8 aa, Giardia lamblia
QRATNDGV

SEQ ID NO: 3131141 - protein, 8 aa, Giardia lamblia
QRATRATD

SEQ ID NO: 3131142 - protein, 7 aa, Giardia lamblia
QRATVTS

SEQ ID NO: 3131143 - protein, 5 aa, Giardia lamblia
QRCRS

SEQ ID NO: 3131144 - protein, 18 aa, Giardia lamblia
QRDARSSDYPQSSLQASQ

SEQ ID NO: 3131145 - protein, 10 aa, Giardia lamblia
QRDEERSALQ

SEQ ID NO: 3131146 - protein, 5 aa, Giardia lamblia
QRDEN

SEQ ID NO: 3131147 - protein, 7 aa, Giardia lamblia
QRDGAGK

SEQ ID NO: 3131148 - protein, 19 aa, Giardia lamblia
QRDIRSAAERATEKEKRAA

SEQ ID NO: 3131149 - protein, 7 aa, Giardia lamblia
QRDQNQR

SEQ ID NO: 3131150 - protein, 5 aa, Giardia lamblia
QRDQR

SEQ ID NO: 3131151 - protein, 5 aa, Giardia lamblia
QRDRI

SEQ ID NO: 3131152 - protein, 5 aa, Giardia lamblia
QRDSI

SEQ ID NO: 3131153 - protein, 5 aa, Giardia lamblia
QRDSV

SEQ ID NO: 3131154 - protein, 4 aa, Giardia lamblia
QRDT

SEQ ID NO: 3131155 - protein, 7 aa, Giardia lamblia
QRDTPTF

SEQ ID NO: 3131156 - protein, 14 aa, Giardia lamblia
QRDTRGQKTQTWGT

SEQ ID NO: 3131157 - protein, 5 aa, Giardia lamblia
QREEF

SEQ ID NO: 3131158 - protein, 24 aa, Giardia lamblia
QREEHAKEGAEQYGSKRSRNYTQD

SEQ ID NO: 3131159 - protein, 5 aa, Giardia lamblia
QREER

SEQ ID NO: 3131160 - protein, 11 aa, Giardia lamblia
QREGRKPDMRG

SEQ ID NO: 3131161 - protein, 5 aa, Giardia lamblia
QREKE

SEQ ID NO: 3131162 - protein, 19 aa, Giardia lamblia
QREKEREERAREQAEARRL

SEQ ID NO: 3131163 - protein, 12 aa, Giardia lamblia
QRENSDPTNLEK

SEQ ID NO: 3131164 - protein, 5 aa, Giardia lamblia
QREQK

SEQ ID NO: 3131165 - protein, 10 aa, Giardia lamblia
QREQQLAKEQ

SEQ ID NO: 3131166 - protein, 8 aa, Giardia lamblia
QRERDTRF

SEQ ID NO: 3131167 - protein, 7 aa, Giardia lamblia
QRESYMP

SEQ ID NO: 3131168 - protein, 6 aa, Giardia lamblia
QRETAT

SEQ ID NO: 3131169 - protein, 18 aa, Giardia lamblia
QRETLKRTSSAPASLGSP

SEQ ID NO: 3131170 - protein, 7 aa, Giardia lamblia
QREVRGN

SEQ ID NO: 3131171 - protein, 10 aa, Giardia lamblia
QRGAEYKAGD

SEQ ID NO: 3131172 - protein, 15 aa, Giardia lamblia
QRGATNSDADEANGY

SEQ ID NO: 3131173 - protein, 8 aa, Giardia lamblia
QRGAVTAD

SEQ ID NO: 3131174 - protein, 4 aa, Giardia lamblia
QRGD

SEQ ID NO: 3131175 - protein, 23 aa, Giardia lamblia
QRGDSIQADLNDDAEVNSKPPSL

SEQ ID NO: 3131176 - protein, 13 aa, Giardia lamblia
QRGEGGVEDSRRG

SEQ ID NO: 3131177 - protein, 9 aa, Giardia lamblia
QRGENLENS

SEQ ID NO: 3131178 - protein, 9 aa, Giardia lamblia
QRGGEHYQG

SEQ ID NO: 3131179 - protein, 6 aa, Giardia lamblia
QRGGGY

SEQ ID NO: 3131180 - protein, 6 aa, Giardia lamblia
QRGHQG

SEQ ID NO: 3131181 - protein, 6 aa, Giardia lamblia
QRGNAD

SEQ ID NO: 3131182 - protein, 6 aa, Giardia lamblia
QRGNDE

SEQ ID NO: 3131183 - protein, 8 aa, Giardia lamblia
QRGPAAAR

SEQ ID NO: 3131184 - protein, 7 aa, Giardia lamblia
QRGPCQR

SEQ ID NO: 3131185 - protein, 10 aa, Giardia lamblia
QRGQQDCEAT

SEQ ID NO: 3131186 - protein, 5 aa, Giardia lamblia
QRGQT

SEQ ID NO: 3131187 - protein, 10 aa, Giardia lamblia
QRGRQNASGY

SEQ ID NO: 3131188 - protein, 10 aa, Giardia lamblia
QRGRSASNKR

SEQ ID NO: 3131189 - protein, 6 aa, Giardia lamblia
QRGRTE

SEQ ID NO: 3131190 - protein, 12 aa, Giardia lamblia
QRGSIPSASPIS

SEQ ID NO: 3131191 - protein, 6 aa, Giardia lamblia
QRGSND

SEQ ID NO: 3131192 - protein, 14 aa, Giardia lamblia
QRGVRAERRRSRRY

SEQ ID NO: 3131193 - protein, 5 aa, Giardia lamblia
QRHQL

SEQ ID NO: 3131194 - protein, 10 aa, Giardia lamblia
QRHTDEPIRP

SEQ ID NO: 3131195 - protein, 12 aa, Giardia lamblia
QRINDADAELAT

SEQ ID NO: 3131196 - protein, 19 aa, Giardia lamblia
QRITDSQQATMTSQSSDRQ

SEQ ID NO: 3131197 - protein, 5 aa, Giardia lamblia
QRITG

SEQ ID NO: 3131198 - protein, 12 aa, Giardia lamblia
QRITRDGSADLD

SEQ ID NO: 3131199 - protein, 20 aa, Giardia lamblia
QRKAGAAAQSVPGGGSRPPM

SEQ ID NO: 3131200 - protein, 5 aa, Giardia lamblia
QRKDI

SEQ ID NO: 3131201 - protein, 5 aa, Giardia lamblia
QRKEA

SEQ ID NO: 3131202 - protein, 9 aa, Giardia lamblia
QRKGHQSLS

SEQ ID NO: 3131203 - protein, 4 aa, Giardia lamblia
QRKK

SEQ ID NO: 3131204 - protein, 9 aa, Giardia lamblia
QRKPGDTDE

SEQ ID NO: 3131205 - protein, 12 aa, Giardia lamblia
QRKPRKSSKSVP

SEQ ID NO: 3131206 - protein, 11 aa, Giardia lamblia
QRKSPADSLTP

SEQ ID NO: 3131207 - protein, 9 aa, Giardia lamblia
QRKSPDDFT

SEQ ID NO: 3131208 - protein, 6 aa, Giardia lamblia
QRKTLQ

SEQ ID NO: 3131209 - protein, 10 aa, Giardia lamblia
QRLESQEDTY

SEQ ID NO: 3131210 - protein, 4 aa, Giardia lamblia
QRLQ

SEQ ID NO: 3131211 - protein, 9 aa, Giardia lamblia
QRLRKEEDM

SEQ ID NO: 3131212 - protein, 8 aa, Giardia lamblia
QRLSDTRA

SEQ ID NO: 3131213 - protein, 7 aa, Giardia lamblia
QRMRPPD

SEQ ID NO: 3131214 - protein, 8 aa, Giardia lamblia
QRNDEGYS

SEQ ID NO: 3131215 - protein, 6 aa, Giardia lamblia
QRNPKV

SEQ ID NO: 3131216 - protein, 4 aa, Giardia lamblia
QRNR

SEQ ID NO: 3131217 - protein, 8 aa, Giardia lamblia
QRNREGKT

SEQ ID NO: 3131218 - protein, 5 aa, Giardia lamblia
QRNSY

SEQ ID NO: 3131219 - protein, 6 aa, Giardia lamblia
QRPAND

SEQ ID NO: 3131220 - protein, 4 aa, Giardia lamblia
QRPD

SEQ ID NO: 3131221 - protein, 6 aa, Giardia lamblia
QRPDQP

SEQ ID NO: 3131222 - protein, 6 aa, Giardia lamblia
QRPEEV

SEQ ID NO: 3131223 - protein, 6 aa, Giardia lamblia
QRPEQD

SEQ ID NO: 3131224 - protein, 6 aa, Giardia lamblia
QRPHNV

SEQ ID NO: 3131225 - protein, 7 aa, Giardia lamblia
QRPQQRR

SEQ ID NO: 3131226 - protein, 4 aa, Giardia lamblia
QRPR

SEQ ID NO: 3131227 - protein, 5 aa, Giardia lamblia
QRPRI

SEQ ID NO: 3131228 - protein, 9 aa, Giardia lamblia
QRPRRPDSS

SEQ ID NO: 3131229 - protein, 5 aa, Giardia lamblia
QRPRS

SEQ ID NO: 3131230 - protein, 6 aa, Giardia lamblia
QRPSAA

SEQ ID NO: 3131231 - protein, 8 aa, Giardia lamblia
QRPSSNRA

SEQ ID NO: 3131232 - protein, 6 aa, Giardia lamblia
QRPSTV

SEQ ID NO: 3131233 - protein, 6 aa, Giardia lamblia
QRPSVN

SEQ ID NO: 3131234 - protein, 8 aa, Giardia lamblia
QRPSVRTS

SEQ ID NO: 3131235 - protein, 5 aa, Giardia lamblia
QRQAT

SEQ ID NO: 3131236 - protein, 4 aa, Giardia lamblia
QRQD

SEQ ID NO: 3131237 - protein, 5 aa, Giardia lamblia
QRQEE

SEQ ID NO: 3131238 - protein, 7 aa, Giardia lamblia
QRQKLGQ

SEQ ID NO: 3131239 - protein, 7 aa, Giardia lamblia
QRQKVQE

SEQ ID NO: 3131240 - protein, 7 aa, Giardia lamblia
QRQNGET

SEQ ID NO: 3131241 - protein, 5 aa, Giardia lamblia
QRQNL

SEQ ID NO: 3131242 - protein, 8 aa, Giardia lamblia
QRQPEGAS

SEQ ID NO: 3131243 - protein, 28 aa, Giardia lamblia
QRQQAEQEDDGDEQKKPRAQDSGAGATF

SEQ ID NO: 3131244 - protein, 7 aa, Giardia lamblia
QRQRARS

SEQ ID NO: 3131245 - protein, 7 aa, Giardia lamblia
QRQRKEV

SEQ ID NO: 3131246 - protein, 17 aa, Giardia lamblia
QRQSKGTEKHRDNYRRD

SEQ ID NO: 3131247 - protein, 7 aa, Giardia lamblia
QRQTPLG

SEQ ID NO: 3131248 - protein, 6 aa, Giardia lamblia
QRQTSI

SEQ ID NO: 3131249 - protein, 8 aa, Giardia lamblia
QRRAEEAA

SEQ ID NO: 3131250 - protein, 23 aa, Giardia lamblia
QRRAGSQDPQPPQRPEPEARHLA

SEQ ID NO: 3131251 - protein, 8 aa, Giardia lamblia
QRRDTGVG

SEQ ID NO: 3131252 - protein, 7 aa, Giardia lamblia
QRREEEL

SEQ ID NO: 3131253 - protein, 10 aa, Giardia lamblia
QRREGGMELP

SEQ ID NO: 3131254 - protein, 6 aa, Giardia lamblia
QRRKAA

SEQ ID NO: 3131255 - protein, 20 aa, Giardia lamblia
QRRPGGQDPQPPQRPEPEAR

SEQ ID NO: 3131256 - protein, 7 aa, Giardia lamblia
QRRRNTA

SEQ ID NO: 3131257 - protein, 5 aa, Giardia lamblia
QRRSS

SEQ ID NO: 3131258 - protein, 13 aa, Giardia lamblia
QRRSSSDDSSDSD

SEQ ID NO: 3131259 - protein, 6 aa, Giardia lamblia
QRRTEV

SEQ ID NO: 3131260 - protein, 31 aa, Giardia lamblia
QRRTGPRQVKKQSVYQSDTKKTSFYNEDGEI

SEQ ID NO: 3131261 - protein, 10 aa, Giardia lamblia
QRSARRKRPI

SEQ ID NO: 3131262 - protein, 8 aa, Giardia lamblia
QRSDGETA

SEQ ID NO: 3131263 - protein, 5 aa, Giardia lamblia
QRSDL

SEQ ID NO: 3131264 - protein, 8 aa, Giardia lamblia
QRSDSFER

SEQ ID NO: 3131265 - protein, 8 aa, Giardia lamblia
QRSGKYTD

SEQ ID NO: 3131266 - protein, 9 aa, Giardia lamblia
QRSGRAGRL

SEQ ID NO: 3131267 - protein, 9 aa, Giardia lamblia
QRSGSKANA

SEQ ID NO: 3131268 - protein, 11 aa, Giardia lamblia
QRSGSSQQAGA

SEQ ID NO: 3131269 - protein, 7 aa, Giardia lamblia
QRSIAQE

SEQ ID NO: 3131270 - protein, 9 aa, Giardia lamblia
QRSLEKGDA

SEQ ID NO: 3131271 - protein, 8 aa, Giardia lamblia
QRSNLTDS

SEQ ID NO: 3131272 - protein, 8 aa, Giardia lamblia
QRSPYSME

SEQ ID NO: 3131273 - protein, 5 aa, Giardia lamblia
QRSSA

SEQ ID NO: 3131274 - protein, 8 aa, Giardia lamblia
QRSSELRE

SEQ ID NO: 3131275 - protein, 9 aa, Giardia lamblia
QRSSKGQTA

SEQ ID NO: 3131276 - protein, 5 aa, Giardia lamblia
QRSSP

SEQ ID NO: 3131277 - protein, 20 aa, Giardia lamblia
QRSSPDTKKQGKQTINPLPD

SEQ ID NO: 3131278 - protein, 16 aa, Giardia lamblia
QRSSTKVESQSSLTEN

SEQ ID NO: 3131279 - protein, 10 aa, Giardia lamblia
QRSTSAGVYT

SEQ ID NO: 3131280 - protein, 7 aa, Giardia lamblia
QRSTTCD

SEQ ID NO: 3131281 - protein, 15 aa, Giardia lamblia
QRSVPDSASDPEFDE

SEQ ID NO: 3131282 - protein, 5 aa, Giardia lamblia
QRSWE

SEQ ID NO: 3131283 - protein, 21 aa, Giardia lamblia
QRTAEQDDEYGLTGMDTERFE

SEQ ID NO: 3131284 - protein, 13 aa, Giardia lamblia
QRTARIETADPKI

SEQ ID NO: 3131285 - protein, 5 aa, Giardia lamblia
QRTDD

SEQ ID NO: 3131286 - protein, 5 aa, Giardia lamblia
QRTDG

SEQ ID NO: 3131287 - protein, 13 aa, Giardia lamblia
QRTGPTSASANGL

SEQ ID NO: 3131288 - protein, 7 aa, Giardia lamblia
QRTGSID

SEQ ID NO: 3131289 - protein, 5 aa, Giardia lamblia
QRTGT

SEQ ID NO: 3131290 - protein, 31 aa, Giardia lamblia
QRTKEKKANQQAQKDETALASSPKGRADDSS

SEQ ID NO: 3131291 - protein, 10 aa, Giardia lamblia
QRTLTESASS

SEQ ID NO: 3131292 - protein, 21 aa, Giardia lamblia
QRTPREREPPNTQTSAPCSPP

SEQ ID NO: 3131293 - protein, 8 aa, Giardia lamblia
QRTRDYGE

SEQ ID NO: 3131294 - protein, 10 aa, Giardia lamblia
QRTREAYERD

SEQ ID NO: 3131295 - protein, 15 aa, Giardia lamblia
QRTRESLQEKKERRL

SEQ ID NO: 3131296 - protein, 6 aa, Giardia lamblia
QRTSLQ

SEQ ID NO: 3131297 - protein, 13 aa, Giardia lamblia
QRTSSAPGKPQIA

SEQ ID NO: 3131298 - protein, 7 aa, Giardia lamblia
QRTSSGF

SEQ ID NO: 3131299 - protein, 11 aa, Giardia lamblia
QRTSSSPLSGK

SEQ ID NO: 3131300 - protein, 5 aa, Giardia lamblia
QRTTS

SEQ ID NO: 3131301 - protein, 7 aa, Giardia lamblia
QRTYEAG

SEQ ID NO: 3131302 - protein, 10 aa, Giardia lamblia
QRVAGVGTGY

SEQ ID NO: 3131303 - protein, 6 aa, Giardia lamblia
QRVNRG

SEQ ID NO: 3131304 - protein, 9 aa, Giardia lamblia
QRVSDSKTV

SEQ ID NO: 3131305 - protein, 12 aa, Giardia lamblia
QRVSHGSARSVS

SEQ ID NO: 3131306 - protein, 5 aa, Giardia lamblia
QRYDG

SEQ ID NO: 3131307 - protein, 6 aa, Giardia lamblia
QRYRTD

SEQ ID NO: 3131308 - protein, 8 aa, Giardia lamblia
QRYSSTIE

SEQ ID NO: 3131309 - protein, 13 aa, Giardia lamblia
QRYTPKEDSYRTE

SEQ ID NO: 3131310 - protein, 6 aa, Giardia lamblia
QSAADS

SEQ ID NO: 3131311 - protein, 6 aa, Giardia lamblia
QSAAEE

SEQ ID NO: 3131312 - protein, 8 aa, Giardia lamblia
QSACDQSY

SEQ ID NO: 3131313 - protein, 9 aa, Giardia lamblia
QSADSQIPA

SEQ ID NO: 3131314 - protein, 8 aa, Giardia lamblia
QSADTLGS

SEQ ID NO: 3131315 - protein, 5 aa, Giardia lamblia
QSAEE

SEQ ID NO: 3131316 - protein, 7 aa, Giardia lamblia
QSAEEEI

SEQ ID NO: 3131317 - protein, 6 aa, Giardia lamblia
QSAEPG

SEQ ID NO: 3131318 - protein, 7 aa, Giardia lamblia
QSAHSSG

SEQ ID NO: 3131319 - protein, 17 aa, Giardia lamblia
QSALQDSAAAGPMQTPS

SEQ ID NO: 3131320 - protein, 5 aa, Giardia lamblia
QSAMN

SEQ ID NO: 3131321 - protein, 10 aa, Giardia lamblia
QSAPKTYMNE

SEQ ID NO: 3131322 - protein, 8 aa, Giardia lamblia
QSAPPRYA

SEQ ID NO: 3131323 - protein, 9 aa, Giardia lamblia
QSAPQAMGK

SEQ ID NO: 3131324 - protein, 4 aa, Giardia lamblia
QSAQ

SEQ ID NO: 3131325 - protein, 5 aa, Giardia lamblia
QSAQT

SEQ ID NO: 3131326 - protein, 10 aa, Giardia lamblia
QSARTTKTNV

SEQ ID NO: 3131327 - protein, 6 aa, Giardia lamblia
QSASGA

SEQ ID NO: 3131328 - protein, 9 aa, Giardia lamblia
QSASPTFRR

SEQ ID NO: 3131329 - protein, 16 aa, Giardia lamblia
QSASSKMARSEPSTSE

SEQ ID NO: 3131330 - protein, 6 aa, Giardia lamblia
QSATLN

SEQ ID NO: 3131331 - protein, 7 aa, Giardia lamblia
QSCPNGR

SEQ ID NO: 3131332 - protein, 23 aa, Giardia lamblia
QSCRNELQQQPDSVATDKPLKNS

SEQ ID NO: 3131333 - protein, 4 aa, Giardia lamblia
QSCT

SEQ ID NO: 3131334 - protein, 5 aa, Giardia lamblia
QSDAE

SEQ ID NO: 3131335 - protein, 8 aa, Giardia lamblia
QSDEDADV

SEQ ID NO: 3131336 - protein, 8 aa, Giardia lamblia
QSDEGIPD

SEQ ID NO: 3131337 - protein, 6 aa, Giardia lamblia
QSDEGY

SEQ ID NO: 3131338 - protein, 8 aa, Giardia lamblia
QSDIQTDN

SEQ ID NO: 3131339 - protein, 9 aa, Giardia lamblia
QSDKSALEH

SEQ ID NO: 3131340 - protein, 6 aa, Giardia lamblia
QSDKSI

SEQ ID NO: 3131341 - protein, 4 aa, Giardia lamblia
QSDL

SEQ ID NO: 3131342 - protein, 6 aa, Giardia lamblia
QSDLPD

SEQ ID NO: 3131343 - protein, 9 aa, Giardia lamblia
QSDNPNMRD

SEQ ID NO: 3131344 - protein, 8 aa, Giardia lamblia
QSDNSGKA

SEQ ID NO: 3131345 - protein, 14 aa, Giardia lamblia
QSDPAVSALNDPNW

SEQ ID NO: 3131346 - protein, 6 aa, Giardia lamblia
QSDPVK

SEQ ID NO: 3131347 - protein, 15 aa, Giardia lamblia
QSDQPQGHAPIHGSE

SEQ ID NO: 3131348 - protein, 6 aa, Giardia lamblia
QSDQTN

SEQ ID NO: 3131349 - protein, 8 aa, Giardia lamblia
QSDRITSS

SEQ ID NO: 3131350 - protein, 7 aa, Giardia lamblia
QSDRPTF

SEQ ID NO: 3131351 - protein, 23 aa, Giardia lamblia
QSDRSDGEENATAPTKESKGIEA

SEQ ID NO: 3131352 - protein, 9 aa, Giardia lamblia
QSDSRDGEE

SEQ ID NO: 3131353 - protein, 9 aa, Giardia lamblia
QSDTLSHPS

SEQ ID NO: 3131354 - protein, 8 aa, Giardia lamblia
QSDTQSAT

SEQ ID NO: 3131355 - protein, 6 aa, Giardia lamblia
QSDYET

SEQ ID NO: 3131356 - protein, 4 aa, Giardia lamblia
QSEA

SEQ ID NO: 3131357 - protein, 8 aa, Giardia lamblia
QSEADASI

SEQ ID NO: 3131358 - protein, 7 aa, Giardia lamblia
QSEADSL

SEQ ID NO: 3131359 - protein, 6 aa, Giardia lamblia
QSEARM

SEQ ID NO: 3131360 - protein, 7 aa, Giardia lamblia
QSEDSGA

SEQ ID NO: 3131361 - protein, 11 aa, Giardia lamblia
QSEEPPSLNPF

SEQ ID NO: 3131362 - protein, 4 aa, Giardia lamblia
QSEG

SEQ ID NO: 3131363 - protein, 10 aa, Giardia lamblia
QSEGPYSPNV

SEQ ID NO: 3131364 - protein, 14 aa, Giardia lamblia
QSEGTVKQAPTAEN

SEQ ID NO: 3131365 - protein, 4 aa, Giardia lamblia
QSEK

SEQ ID NO: 3131366 - protein, 6 aa, Giardia lamblia
QSEKRE

SEQ ID NO: 3131367 - protein, 9 aa, Giardia lamblia
QSENPEPHK

SEQ ID NO: 3131368 - protein, 5 aa, Giardia lamblia
QSEPQ

SEQ ID NO: 3131369 - protein, 6 aa, Giardia lamblia
QSEPTL

SEQ ID NO: 3131370 - protein, 8 aa, Giardia lamblia
QSEQVQES

SEQ ID NO: 3131371 - protein, 10 aa, Giardia lamblia
QSESEDDCTI

SEQ ID NO: 3131372 - protein, 26 aa, Giardia lamblia
QSESPLHPRSKSAPHSTSAVEAPRPK

SEQ ID NO: 3131373 - protein, 24 aa, Giardia lamblia
QSESRENSREGSTISPLSDTQVEG

SEQ ID NO: 3131374 - protein, 9 aa, Giardia lamblia
QSETADKDA

SEQ ID NO: 3131375 - protein, 10 aa, Giardia lamblia
QSETIGRRTE

SEQ ID NO: 3131376 - protein, 7 aa, Giardia lamblia
QSEYSAA

SEQ ID NO: 3131377 - protein, 16 aa, Giardia lamblia
QSGDAANTNIPLPPVT

SEQ ID NO: 3131378 - protein, 19 aa, Giardia lamblia
QSGEEAVTPQDERKDLDES

SEQ ID NO: 3131379 - protein, 7 aa, Giardia lamblia
QSGEYDV

SEQ ID NO: 3131380 - protein, 4 aa, Giardia lamblia
QSGF

SEQ ID NO: 3131381 - protein, 16 aa, Giardia lamblia
QSGGSKQPTGKGMPPQ

SEQ ID NO: 3131382 - protein, 6 aa, Giardia lamblia
QSGGTS

SEQ ID NO: 3131383 - protein, 5 aa, Giardia lamblia
QSGHD

SEQ ID NO: 3131384 - protein, 14 aa, Giardia lamblia
QSGHDSAQSRARYD

SEQ ID NO: 3131385 - protein, 6 aa, Giardia lamblia
QSGISA

SEQ ID NO: 3131386 - protein, 10 aa, Giardia lamblia
QSGKARSQSC

SEQ ID NO: 3131387 - protein, 5 aa, Giardia lamblia
QSGKD

SEQ ID NO: 3131388 - protein, 8 aa, Giardia lamblia
QSGKKEGI

SEQ ID NO: 3131389 - protein, 11 aa, Giardia lamblia
QSGKTDTRGRT

SEQ ID NO: 3131390 - protein, 5 aa, Giardia lamblia
QSGLA

SEQ ID NO: 3131391 - protein, 7 aa, Giardia lamblia
QSGLNKT

SEQ ID NO: 3131392 - protein, 11 aa, Giardia lamblia
QSGLSDEEREA

SEQ ID NO: 3131393 - protein, 10 aa, Giardia lamblia
QSGNYTPAQT

SEQ ID NO: 3131394 - protein, 8 aa, Giardia lamblia
QSGPAISG

SEQ ID NO: 3131395 - protein, 8 aa, Giardia lamblia
QSGPDQHG

SEQ ID NO: 3131396 - protein, 8 aa, Giardia lamblia
QSGPEKRA

SEQ ID NO: 3131397 - protein, 12 aa, Giardia lamblia
QSGQDDAPDYSS

SEQ ID NO: 3131398 - protein, 12 aa, Giardia lamblia
QSGREKRYSDAI

SEQ ID NO: 3131399 - protein, 8 aa, Giardia lamblia
QSGSASNP

SEQ ID NO: 3131400 - protein, 5 aa, Giardia lamblia
QSGSD

SEQ ID NO: 3131401 - protein, 6 aa, Giardia lamblia
QSGSLV

SEQ ID NO: 3131402 - protein, 9 aa, Giardia lamblia
QSGSPRSTL

SEQ ID NO: 3131403 - protein, 9 aa, Giardia lamblia
QSGSSQSIV

SEQ ID NO: 3131404 - protein, 14 aa, Giardia lamblia
QSGTQESASDGNAI

SEQ ID NO: 3131405 - protein, 5 aa, Giardia lamblia
QSHGE

SEQ ID NO: 3131406 - protein, 7 aa, Giardia lamblia
QSHMDGS

SEQ ID NO: 3131407 - protein, 13 aa, Giardia lamblia
QSHRKESASEPTL

SEQ ID NO: 3131408 - protein, 8 aa, Giardia lamblia
QSIAATSQ

SEQ ID NO: 3131409 - protein, 13 aa, Giardia lamblia
QSIARPNVSSNPS

SEQ ID NO: 3131410 - protein, 7 aa, Giardia lamblia
QSIDNSN

SEQ ID NO: 3131411 - protein, 13 aa, Giardia lamblia
QSIEGQSEEEDGV

SEQ ID NO: 3131412 - protein, 5 aa, Giardia lamblia
QSIGR

SEQ ID NO: 3131413 - protein, 12 aa, Giardia lamblia
QSIKSAPNSTEL

SEQ ID NO: 3131414 - protein, 16 aa, Giardia lamblia
QSINDANETDKNITHS

SEQ ID NO: 3131415 - protein, 10 aa, Giardia lamblia
QSIPDSLPQH

SEQ ID NO: 3131416 - protein, 5 aa, Giardia lamblia
QSIPH

SEQ ID NO: 3131417 - protein, 25 aa, Giardia lamblia
QSIRSGHTARDTATESKKQSSSLDL

SEQ ID NO: 3131418 - protein, 4 aa, Giardia lamblia
QSIS

SEQ ID NO: 3131419 - protein, 7 aa, Giardia lamblia
QSISPTA

SEQ ID NO: 3131420 - protein, 7 aa, Giardia lamblia
QSISRSK

SEQ ID NO: 3131421 - protein, 11 aa, Giardia lamblia
QSKARADTLEE

SEQ ID NO: 3131422 - protein, 9 aa, Giardia lamblia
QSKDASAAE

SEQ ID NO: 3131423 - protein, 11 aa, Giardia lamblia
QSKDATGIHAP

SEQ ID NO: 3131424 - protein, 11 aa, Giardia lamblia
QSKDQHSRSSS

SEQ ID NO: 3131425 - protein, 9 aa, Giardia lamblia
QSKEANKVN

SEQ ID NO: 3131426 - protein, 5 aa, Giardia lamblia
QSKEI

SEQ ID NO: 3131427 - protein, 5 aa, Giardia lamblia
QSKET

SEQ ID NO: 3131428 - protein, 13 aa, Giardia lamblia
QSKGRKQPEGPFY

SEQ ID NO: 3131429 - protein, 18 aa, Giardia lamblia
QSKLASTTRGVTSITASK

SEQ ID NO: 3131430 - protein, 8 aa, Giardia lamblia
QSKPIQSH

SEQ ID NO: 3131431 - protein, 9 aa, Giardia lamblia
QSKPRTHPQ

SEQ ID NO: 3131432 - protein, 17 aa, Giardia lamblia
QSKQSKKNVHFMSILPF

SEQ ID NO: 3131433 - protein, 13 aa, Giardia lamblia
QSKQVEEEERRRY

SEQ ID NO: 3131434 - protein, 9 aa, Giardia lamblia
QSKRGAWSE

SEQ ID NO: 3131435 - protein, 5 aa, Giardia lamblia
QSKSK

SEQ ID NO: 3131436 - protein, 21 aa, Giardia lamblia
QSKSPPLPEPLTKTQAPISPP

SEQ ID NO: 3131437 - protein, 5 aa, Giardia lamblia
QSKSR

SEQ ID NO: 3131438 - protein, 8 aa, Giardia lamblia
QSKSTNAY

SEQ ID NO: 3131439 - protein, 7 aa, Giardia lamblia
QSKTQMT

SEQ ID NO: 3131440 - protein, 7 aa, Giardia lamblia
QSKYGQT

SEQ ID NO: 3131441 - protein, 16 aa, Giardia lamblia
QSLDGQDVTEAEREEA

SEQ ID NO: 3131442 - protein, 13 aa, Giardia lamblia
QSLEGPSDSSFTG

SEQ ID NO: 3131443 - protein, 5 aa, Giardia lamblia
QSLEK

SEQ ID NO: 3131444 - protein, 10 aa, Giardia lamblia
QSLESQYGDT

SEQ ID NO: 3131445 - protein, 8 aa, Giardia lamblia
QSLESTAV

SEQ ID NO: 3131446 - protein, 9 aa, Giardia lamblia
QSLGDTAPL

SEQ ID NO: 3131447 - protein, 8 aa, Giardia lamblia
QSLGRTAS

SEQ ID NO: 3131448 - protein, 4 aa, Giardia lamblia
QSLK

SEQ ID NO: 3131449 - protein, 11 aa, Giardia lamblia
QSLKSESLATN

SEQ ID NO: 3131450 - protein, 4 aa, Giardia lamblia
QSLP

SEQ ID NO: 3131451 - protein, 5 aa, Giardia lamblia
QSLPA

SEQ ID NO: 3131452 - protein, 9 aa, Giardia lamblia
QSLPPESES

SEQ ID NO: 3131453 - protein, 8 aa, Giardia lamblia
QSLPTATP

SEQ ID NO: 3131454 - protein, 8 aa, Giardia lamblia
QSLQSGTQ

SEQ ID NO: 3131455 - protein, 16 aa, Giardia lamblia
QSLSKTQSARSGSAAS

SEQ ID NO: 3131456 - protein, 10 aa, Giardia lamblia
QSLSSENDTL

SEQ ID NO: 3131457 - protein, 6 aa, Giardia lamblia
QSLSTF

SEQ ID NO: 3131458 - protein, 4 aa, Giardia lamblia
QSLT

SEQ ID NO: 3131459 - protein, 19 aa, Giardia lamblia
QSMEDSVSSLTAGNKLNPA

SEQ ID NO: 3131460 - protein, 7 aa, Giardia lamblia
QSMGSNV

SEQ ID NO: 3131461 - protein, 22 aa, Giardia lamblia
QSMPPKQPKLPPQERDAGRSIS

SEQ ID NO: 3131462 - protein, 6 aa, Giardia lamblia
QSMSGT

SEQ ID NO: 3131463 - protein, 15 aa, Giardia lamblia
QSMSPEDHQPEETQG

SEQ ID NO: 3131464 - protein, 10 aa, Giardia lamblia
QSMSQTGEVR

SEQ ID NO: 3131465 - protein, 8 aa, Giardia lamblia
QSMTPSYS

SEQ ID NO: 3131466 - protein, 11 aa, Giardia lamblia
QSNCTTGALER

SEQ ID NO: 3131467 - protein, 5 aa, Giardia lamblia
QSNEG

SEQ ID NO: 3131468 - protein, 9 aa, Giardia lamblia
QSNEPTAAE

SEQ ID NO: 3131469 - protein, 11 aa, Giardia lamblia
QSNIPPSPLPA

SEQ ID NO: 3131470 - protein, 14 aa, Giardia lamblia
QSNKPSTANPSEIT

SEQ ID NO: 3131471 - protein, 7 aa, Giardia lamblia
QSNNQNS

SEQ ID NO: 3131472 - protein, 35 aa, Giardia lamblia
QSNNSKRKDDEQKKHSGRPGGQGEFRITRDRFARH

SEQ ID NO: 3131473 - protein, 17 aa, Giardia lamblia
QSNPLANEIQNEPNTDH

SEQ ID NO: 3131474 - protein, 10 aa, Giardia lamblia
QSNPRTPVSK

SEQ ID NO: 3131475 - protein, 7 aa, Giardia lamblia
QSNPSLG

SEQ ID NO: 3131476 - protein, 30 aa, Giardia lamblia
QSNPSTTLGAGTKRAASGRSSTQKSRRSVS

SEQ ID NO: 3131477 - protein, 6 aa, Giardia lamblia
QSNRNR

SEQ ID NO: 3131478 - protein, 18 aa, Giardia lamblia
QSNTIESDHPLDKRNSRV

SEQ ID NO: 3131479 - protein, 10 aa, Giardia lamblia
QSNVPQSSTL

SEQ ID NO: 3131480 - protein, 8 aa, Giardia lamblia
QSPDCPSL

SEQ ID NO: 3131481 - protein, 7 aa, Giardia lamblia
QSPDETA

SEQ ID NO: 3131482 - protein, 10 aa, Giardia lamblia
QSPDGSTISD

SEQ ID NO: 3131483 - protein, 4 aa, Giardia lamblia
QSPE

SEQ ID NO: 3131484 - protein, 5 aa, Giardia lamblia
QSPEH

SEQ ID NO: 3131485 - protein, 11 aa, Giardia lamblia
QSPGLTAGPAI

SEQ ID NO: 3131486 - protein, 5 aa, Giardia lamblia
QSPHY

SEQ ID NO: 3131487 - protein, 9 aa, Giardia lamblia
QSPKRQSYA

SEQ ID NO: 3131488 - protein, 13 aa, Giardia lamblia
QSPKSARAEPAIS

SEQ ID NO: 3131489 - protein, 10 aa, Giardia lamblia
QSPKTDTHEL

SEQ ID NO: 3131490 - protein, 4 aa, Giardia lamblia
QSPQ

SEQ ID NO: 3131491 - protein, 16 aa, Giardia lamblia
QSPQREAPPAQPSAGV

SEQ ID NO: 3131492 - protein, 6 aa, Giardia lamblia
QSPQTW

SEQ ID NO: 3131493 - protein, 8 aa, Giardia lamblia
QSPREAPV

SEQ ID NO: 3131494 - protein, 14 aa, Giardia lamblia
QSPSEPKPKHNNTN

SEQ ID NO: 3131495 - protein, 8 aa, Giardia lamblia
QSPSNPHS

SEQ ID NO: 3131496 - protein, 19 aa, Giardia lamblia
QSPSPPSISTNQGLNTDST

SEQ ID NO: 3131497 - protein, 26 aa, Giardia lamblia
QSPSVPEHSVRPQDGSVPLTQSSSLN

SEQ ID NO: 3131498 - protein, 12 aa, Giardia lamblia
QSPVQSSLSSST

SEQ ID NO: 3131499 - protein, 5 aa, Giardia lamblia
QSPWH

SEQ ID NO: 3131500 - protein, 12 aa, Giardia lamblia
QSQANSSDTTHT

SEQ ID NO: 3131501 - protein, 48 aa, Giardia lamblia
QSQERAHTSSSQISNASQKSTLGLEKSSKKCSSSTVKQMQAPNTITPQ

SEQ ID NO: 3131502 - protein, 9 aa, Giardia lamblia
QSQGAVSSS

SEQ ID NO: 3131503 - protein, 12 aa, Giardia lamblia
QSQGKRSHIPYR

SEQ ID NO: 3131504 - protein, 7 aa, Giardia lamblia
QSQGVAQ

SEQ ID NO: 3131505 - protein, 21 aa, Giardia lamblia
QSQINPARKELQGDSNGSATM

SEQ ID NO: 3131506 - protein, 25 aa, Giardia lamblia
QSQKPLPETAAPKDEEAPAALPERT

SEQ ID NO: 3131507 - protein, 20 aa, Giardia lamblia
QSQQDTQESRVRSRPSSTRQ

SEQ ID NO: 3131508 - protein, 16 aa, Giardia lamblia
QSQSKSAEFLVNHGAQ

SEQ ID NO: 3131509 - protein, 8 aa, Giardia lamblia
QSQSQFSD

SEQ ID NO: 3131510 - protein, 12 aa, Giardia lamblia
QSQTAAQEQNTN

SEQ ID NO: 3131511 - protein, 7 aa, Giardia lamblia
QSQTAQL

SEQ ID NO: 3131512 - protein, 4 aa, Giardia lamblia
QSQV

SEQ ID NO: 3131513 - protein, 13 aa, Giardia lamblia
QSQVGASSMPEPA

SEQ ID NO: 3131514 - protein, 4 aa, Giardia lamblia
QSQY

SEQ ID NO: 3131515 - protein, 7 aa, Giardia lamblia
QSQYGNF

SEQ ID NO: 3131516 - protein, 22 aa, Giardia lamblia
QSRAPFTGDEESTGQSGLDGDK

SEQ ID NO: 3131517 - protein, 5 aa, Giardia lamblia
QSRDF

SEQ ID NO: 3131518 - protein, 6 aa, Giardia lamblia
QSRDME

SEQ ID NO: 3131519 - protein, 9 aa, Giardia lamblia
QSRDSKGET

SEQ ID NO: 3131520 - protein, 4 aa, Giardia lamblia
QSRG

SEQ ID NO: 3131521 - protein, 6 aa, Giardia lamblia
QSRGAG

SEQ ID NO: 3131522 - protein, 11 aa, Giardia lamblia
QSRGASERRSS

SEQ ID NO: 3131523 - protein, 5 aa, Giardia lamblia
QSRGK

SEQ ID NO: 3131524 - protein, 10 aa, Giardia lamblia
QSRHQTESGY

SEQ ID NO: 3131525 - protein, 6 aa, Giardia lamblia
QSRNDA

SEQ ID NO: 3131526 - protein, 8 aa, Giardia lamblia
QSRNKNLA

SEQ ID NO: 3131527 - protein, 4 aa, Giardia lamblia
QSRP

SEQ ID NO: 3131528 - protein, 16 aa, Giardia lamblia
QSRPASPMSVTQQEGE

SEQ ID NO: 3131529 - protein, 8 aa, Giardia lamblia
QSRPGSRL

SEQ ID NO: 3131530 - protein, 9 aa, Giardia lamblia
QSRRFGGTQ

SEQ ID NO: 3131531 - protein, 7 aa, Giardia lamblia
QSRRMDD

SEQ ID NO: 3131532 - protein, 11 aa, Giardia lamblia
QSRTGGEIDSG

SEQ ID NO: 3131533 - protein, 5 aa, Giardia lamblia
QSRTT

SEQ ID NO: 3131534 - protein, 27 aa, Giardia lamblia
QSSADSKPSEQDRDALQRSETSCPQTR

SEQ ID NO: 3131535 - protein, 6 aa, Giardia lamblia
QSSDAY

SEQ ID NO: 3131536 - protein, 9 aa, Giardia lamblia
QSSDPNVTF

SEQ ID NO: 3131537 - protein, 9 aa, Giardia lamblia
QSSGQARSG

SEQ ID NO: 3131538 - protein, 6 aa, Giardia lamblia
QSSHRG

SEQ ID NO: 3131539 - protein, 6 aa, Giardia lamblia
QSSIDQ

SEQ ID NO: 3131540 - protein, 6 aa, Giardia lamblia
QSSIEP

SEQ ID NO: 3131541 - protein, 8 aa, Giardia lamblia
QSSKAGVK

SEQ ID NO: 3131542 - protein, 11 aa, Giardia lamblia
QSSKASPGGFN

SEQ ID NO: 3131543 - protein, 11 aa, Giardia lamblia
QSSKENAEALQ

SEQ ID NO: 3131544 - protein, 8 aa, Giardia lamblia
QSSKGFQH

SEQ ID NO: 3131545 - protein, 9 aa, Giardia lamblia
QSSKIDPDT

SEQ ID NO: 3131546 - protein, 46 aa, Giardia lamblia
QSSKNLPTKPQGPATGVGGTRSRKSSASSSQANSRKSSISGPEETR

SEQ ID NO: 3131547 - protein, 29 aa, Giardia lamblia
QSSKTENSNAFSKPTKPDEAITPHKSQSG

SEQ ID NO: 3131548 - protein, 11 aa, Giardia lamblia
QSSMSASNTAL

SEQ ID NO: 3131549 - protein, 5 aa, Giardia lamblia
QSSNA

SEQ ID NO: 3131550 - protein, 11 aa, Giardia lamblia
QSSNKPQNVQT

SEQ ID NO: 3131551 - protein, 7 aa, Giardia lamblia
QSSNSPI

SEQ ID NO: 3131552 - protein, 10 aa, Giardia lamblia
QSSPFSGRVN

SEQ ID NO: 3131553 - protein, 17 aa, Giardia lamblia
QSSPSLQTQQAGNPVSK

SEQ ID NO: 3131554 - protein, 11 aa, Giardia lamblia
QSSQERGKQTP

SEQ ID NO: 3131555 - protein, 18 aa, Giardia lamblia
QSSQPGEDASSLTDSDGM

SEQ ID NO: 3131556 - protein, 5 aa, Giardia lamblia
QSSRL

SEQ ID NO: 3131557 - protein, 48 aa, Giardia lamblia
QSSRNGSRANSRTNSRSNSRGGTQSRPLSGSAFGRSSMQSTAKMDGSM

SEQ ID NO: 3131558 - protein, 11 aa, Giardia lamblia
QSSSANKVASS

SEQ ID NO: 3131559 - protein, 10 aa, Giardia lamblia
QSSSGADLED

SEQ ID NO: 3131560 - protein, 11 aa, Giardia lamblia
QSSSKREDSFD

SEQ ID NO: 3131561 - protein, 10 aa, Giardia lamblia
QSSSPSRPLS

SEQ ID NO: 3131562 - protein, 7 aa, Giardia lamblia
QSSSQTL

SEQ ID NO: 3131563 - protein, 5 aa, Giardia lamblia
QSSSV

SEQ ID NO: 3131564 - protein, 4 aa, Giardia lamblia
QSST

SEQ ID NO: 3131565 - protein, 11 aa, Giardia lamblia
QSTASKDATMQ

SEQ ID NO: 3131566 - protein, 26 aa, Giardia lamblia
QSTDDHEQKDISKAIRQAKTERDAIR

SEQ ID NO: 3131567 - protein, 5 aa, Giardia lamblia
QSTDG

SEQ ID NO: 3131568 - protein, 27 aa, Giardia lamblia
QSTEEQKEVIPPEAEPDTSTVQPTQVE

SEQ ID NO: 3131569 - protein, 5 aa, Giardia lamblia
QSTGE

SEQ ID NO: 3131570 - protein, 4 aa, Giardia lamblia
QSTI

SEQ ID NO: 3131571 - protein, 4 aa, Giardia lamblia
QSTP

SEQ ID NO: 3131572 - protein, 5 aa, Giardia lamblia
QSTPF

SEQ ID NO: 3131573 - protein, 21 aa, Giardia lamblia
QSTPSSTLTPVPASGAFPPLP

SEQ ID NO: 3131574 - protein, 14 aa, Giardia lamblia
QSTPWSAKSQRDSR

SEQ ID NO: 3131575 - protein, 5 aa, Giardia lamblia
QSTRN

SEQ ID NO: 3131576 - protein, 18 aa, Giardia lamblia
QSTSGSSVLGSSKNNPTI

SEQ ID NO: 3131577 - protein, 6 aa, Giardia lamblia
QSTSGW

SEQ ID NO: 3131578 - protein, 7 aa, Giardia lamblia
QSTSSRL

SEQ ID NO: 3131579 - protein, 19 aa, Giardia lamblia
QSTSTKLHSNADVDNQPAR

SEQ ID NO: 3131580 - protein, 15 aa, Giardia lamblia
QSTTNSEAKRKNWET

SEQ ID NO: 3131581 - protein, 8 aa, Giardia lamblia
QSTTPQSV

SEQ ID NO: 3131582 - protein, 6 aa, Giardia lamblia
QSTTRK

SEQ ID NO: 3131583 - protein, 4 aa, Giardia lamblia
QSTV

SEQ ID NO: 3131584 - protein, 12 aa, Giardia lamblia
QSTVSDDPQPSD

SEQ ID NO: 3131585 - protein, 8 aa, Giardia lamblia
QSVDTSDR

SEQ ID NO: 3131586 - protein, 40 aa, Giardia lamblia
QSVESAPRKDAKEKSPKKSNKDTNKPETTLKEEPLENDAP

SEQ ID NO: 3131587 - protein, 10 aa, Giardia lamblia
QSVGEPSTQM

SEQ ID NO: 3131588 - protein, 15 aa, Giardia lamblia
QSVKSHNASKESGLA

SEQ ID NO: 3131589 - protein, 4 aa, Giardia lamblia
QSVP

SEQ ID NO: 3131590 - protein, 5 aa, Giardia lamblia
QSVSV

SEQ ID NO: 3131591 - protein, 7 aa, Giardia lamblia
QSVTPSS

SEQ ID NO: 3131592 - protein, 6 aa, Giardia lamblia
QSYEDM

SEQ ID NO: 3131593 - protein, 14 aa, Giardia lamblia
QSYENRVKDSQRLD

SEQ ID NO: 3131594 - protein, 9 aa, Giardia lamblia
QSYGTVNDE

SEQ ID NO: 3131595 - protein, 5 aa, Giardia lamblia
QSYKA

SEQ ID NO: 3131596 - protein, 4 aa, Giardia lamblia
QSYM

SEQ ID NO: 3131597 - protein, 16 aa, Giardia lamblia
QSYQPPGSAPFPSTMP

SEQ ID NO: 3131598 - protein, 36 aa, Giardia lamblia
QSYRSASTELEASQQTHRYTQENNTAVEGASFTAED

SEQ ID NO: 3131599 - protein, 7 aa, Giardia lamblia
QSYSNFT

SEQ ID NO: 3131600 - protein, 12 aa, Giardia lamblia
QSYSPTNPSRAD

SEQ ID NO: 3131601 - protein, 17 aa, Giardia lamblia
QSYTKRSTLDDPYSETL

SEQ ID NO: 3131602 - protein, 9 aa, Giardia lamblia
QSYTQKLDT

SEQ ID NO: 3131603 - protein, 6 aa, Giardia lamblia
QTAAAQ

SEQ ID NO: 3131604 - protein, 16 aa, Giardia lamblia
QTAAELPPAPAAQEVP

SEQ ID NO: 3131605 - protein, 8 aa, Giardia lamblia
QTAARDSF

SEQ ID NO: 3131606 - protein, 8 aa, Giardia lamblia
QTAGKGSH

SEQ ID NO: 3131607 - protein, 10 aa, Giardia lamblia
QTAGLDSDTK

SEQ ID NO: 3131608 - protein, 5 aa, Giardia lamblia
QTAGR

SEQ ID NO: 3131609 - protein, 5 aa, Giardia lamblia
QTAHT

SEQ ID NO: 3131610 - protein, 8 aa, Giardia lamblia
QTAKGETY

SEQ ID NO: 3131611 - protein, 36 aa, Giardia lamblia
QTAMSGSNSVNTSGRTTRMSNSANATFGGDKADKNL

SEQ ID NO: 3131612 - protein, 9 aa, Giardia lamblia
QTANEYKSQ

SEQ ID NO: 3131613 - protein, 10 aa, Giardia lamblia
QTANSQLAQQ

SEQ ID NO: 3131614 - protein, 10 aa, Giardia lamblia
QTAPAPPLTV

SEQ ID NO: 3131615 - protein, 5 aa, Giardia lamblia
QTAPE

SEQ ID NO: 3131616 - protein, 21 aa, Giardia lamblia
QTAPKPVTDAPGRSTGPGYAI

SEQ ID NO: 3131617 - protein, 10 aa, Giardia lamblia
QTAPSAREIS

SEQ ID NO: 3131618 - protein, 4 aa, Giardia lamblia
QTAQ

SEQ ID NO: 3131619 - protein, 9 aa, Giardia lamblia
QTARAKTLA

SEQ ID NO: 3131620 - protein, 18 aa, Giardia lamblia
QTARGTGRLTEEMRQALR

SEQ ID NO: 3131621 - protein, 6 aa, Giardia lamblia
QTARGV

SEQ ID NO: 3131622 - protein, 8 aa, Giardia lamblia
QTARQQQI

SEQ ID NO: 3131623 - protein, 9 aa, Giardia lamblia
QTARSGAFG

SEQ ID NO: 3131624 - protein, 8 aa, Giardia lamblia
QTASGKTH

SEQ ID NO: 3131625 - protein, 15 aa, Giardia lamblia
QTASSSDLSPNPALD

SEQ ID NO: 3131626 - protein, 6 aa, Giardia lamblia
QTATPV

SEQ ID NO: 3131627 - protein, 19 aa, Giardia lamblia
QTATQQEKGHQLPKQVTES

SEQ ID NO: 3131628 - protein, 4 aa, Giardia lamblia
QTAW

SEQ ID NO: 3131629 - protein, 22 aa, Giardia lamblia
QTCDKEKQAQSEQASQETKDAL

SEQ ID NO: 3131630 - protein, 12 aa, Giardia lamblia
QTCEAVNSESRG

SEQ ID NO: 3131631 - protein, 10 aa, Giardia lamblia
QTDAGSKTID

SEQ ID NO: 3131632 - protein, 9 aa, Giardia lamblia
QTDATGNLV

SEQ ID NO: 3131633 - protein, 9 aa, Giardia lamblia
QTDDETGSV

SEQ ID NO: 3131634 - protein, 16 aa, Giardia lamblia
QTDDQISQQDSKQPIE

SEQ ID NO: 3131635 - protein, 8 aa, Giardia lamblia
QTDEAQLE

SEQ ID NO: 3131636 - protein, 15 aa, Giardia lamblia
QTDEPPLTSTDEVED

SEQ ID NO: 3131637 - protein, 6 aa, Giardia lamblia
QTDETH

SEQ ID NO: 3131638 - protein, 4 aa, Giardia lamblia
QTDG

SEQ ID NO: 3131639 - protein, 7 aa, Giardia lamblia
QTDGGVS

SEQ ID NO: 3131640 - protein, 15 aa, Giardia lamblia
QTDKRPAISDSDTIQ

SEQ ID NO: 3131641 - protein, 17 aa, Giardia lamblia
QTDPDEAKQKTEKRTIA

SEQ ID NO: 3131642 - protein, 11 aa, Giardia lamblia
QTDPETERSIR

SEQ ID NO: 3131643 - protein, 5 aa, Giardia lamblia
QTDPQ

SEQ ID NO: 3131644 - protein, 9 aa, Giardia lamblia
QTDPSGSYQ

SEQ ID NO: 3131645 - protein, 6 aa, Giardia lamblia
QTDQLG

SEQ ID NO: 3131646 - protein, 4 aa, Giardia lamblia
QTDR

SEQ ID NO: 3131647 - protein, 6 aa, Giardia lamblia
QTDRRL

SEQ ID NO: 3131648 - protein, 4 aa, Giardia lamblia
QTDY

SEQ ID NO: 3131649 - protein, 5 aa, Giardia lamblia
QTEAI

SEQ ID NO: 3131650 - protein, 5 aa, Giardia lamblia
QTEAL

SEQ ID NO: 3131651 - protein, 7 aa, Giardia lamblia
QTEDGER

SEQ ID NO: 3131652 - protein, 7 aa, Giardia lamblia
QTEDGRT

SEQ ID NO: 3131653 - protein, 5 aa, Giardia lamblia
QTEGR

SEQ ID NO: 3131654 - protein, 14 aa, Giardia lamblia
QTELTQKAESAKAA

SEQ ID NO: 3131655 - protein, 11 aa, Giardia lamblia
QTENEEKTAEI

SEQ ID NO: 3131656 - protein, 12 aa, Giardia lamblia
QTEQDTQKRKEV

SEQ ID NO: 3131657 - protein, 22 aa, Giardia lamblia
QTEREAAEASRKAYKAEQRQEF

SEQ ID NO: 3131658 - protein, 11 aa, Giardia lamblia
QTERNAAEQHL

SEQ ID NO: 3131659 - protein, 22 aa, Giardia lamblia
QTETELSGPAPQLAQSTLPAPD

SEQ ID NO: 3131660 - protein, 5 aa, Giardia lamblia
QTEYS

SEQ ID NO: 3131661 - protein, 19 aa, Giardia lamblia
QTGAGKSYTMTGPSIDSFT

SEQ ID NO: 3131662 - protein, 5 aa, Giardia lamblia
QTGEP

SEQ ID NO: 3131663 - protein, 16 aa, Giardia lamblia
QTGHQSKNSFIPTSTA

SEQ ID NO: 3131664 - protein, 5 aa, Giardia lamblia
QTGHR

SEQ ID NO: 3131665 - protein, 23 aa, Giardia lamblia
QTGHSPSYPKHSQYSNNTFHSPT

SEQ ID NO: 3131666 - protein, 5 aa, Giardia lamblia
QTGLD

SEQ ID NO: 3131667 - protein, 5 aa, Giardia lamblia
QTGLP

SEQ ID NO: 3131668 - protein, 6 aa, Giardia lamblia
QTGNTE

SEQ ID NO: 3131669 - protein, 12 aa, Giardia lamblia
QTGRGRPRKQAN

SEQ ID NO: 3131670 - protein, 6 aa, Giardia lamblia
QTGSAG

SEQ ID NO: 3131671 - protein, 24 aa, Giardia lamblia
QTGSEKPADADATETNASNAKSQV

SEQ ID NO: 3131672 - protein, 8 aa, Giardia lamblia
QTGSGKSY

SEQ ID NO: 3131673 - protein, 18 aa, Giardia lamblia
QTGSGKSYTSFGPPDDPL

SEQ ID NO: 3131674 - protein, 9 aa, Giardia lamblia
QTGSGKTHT

SEQ ID NO: 3131675 - protein, 9 aa, Giardia lamblia
QTGSPQAAA

SEQ ID NO: 3131676 - protein, 14 aa, Giardia lamblia
QTGSQGPASSQPDK

SEQ ID NO: 3131677 - protein, 12 aa, Giardia lamblia
QTGYEGKAIQES

SEQ ID NO: 3131678 - protein, 5 aa, Giardia lamblia
QTHAP

SEQ ID NO: 3131679 - protein, 7 aa, Giardia lamblia
QTHDTSA

SEQ ID NO: 3131680 - protein, 19 aa, Giardia lamblia
QTHGGKGKTSTSVSPGLEQ

SEQ ID NO: 3131681 - protein, 7 aa, Giardia lamblia
QTHPPID

SEQ ID NO: 3131682 - protein, 16 aa, Giardia lamblia
QTHSPLPAKASEDSPC

SEQ ID NO: 3131683 - protein, 6 aa, Giardia lamblia
QTIDSD

SEQ ID NO: 3131684 - protein, 15 aa, Giardia lamblia
QTIGENRVKSAGLDP

SEQ ID NO: 3131685 - protein, 12 aa, Giardia lamblia
QTIKTAKSPLTS

SEQ ID NO: 3131686 - protein, 20 aa, Giardia lamblia
QTINSGSYKLESGTYSFNEG

SEQ ID NO: 3131687 - protein, 9 aa, Giardia lamblia
QTKAPTCAE

SEQ ID NO: 3131688 - protein, 11 aa, Giardia lamblia
QTKASVNEEDR

SEQ ID NO: 3131689 - protein, 15 aa, Giardia lamblia
QTKEGATIESDATEN

SEQ ID NO: 3131690 - protein, 5 aa, Giardia lamblia
QTKEY

SEQ ID NO: 3131691 - protein, 9 aa, Giardia lamblia
QTKGCTGAD

SEQ ID NO: 3131692 - protein, 9 aa, Giardia lamblia
QTKGDEAAL

SEQ ID NO: 3131693 - protein, 24 aa, Giardia lamblia
QTKGDVDPESETDEKSGEKVTTPK

SEQ ID NO: 3131694 - protein, 24 aa, Giardia lamblia
QTKGSPPRPTQKRVASKAKMPEDL

SEQ ID NO: 3131695 - protein, 4 aa, Giardia lamblia
QTKI

SEQ ID NO: 3131696 - protein, 10 aa, Giardia lamblia
QTKKSEIDNI

SEQ ID NO: 3131697 - protein, 12 aa, Giardia lamblia
QTKNQDVSVEGT

SEQ ID NO: 3131698 - protein, 6 aa, Giardia lamblia
QTKNQT

SEQ ID NO: 3131699 - protein, 7 aa, Giardia lamblia
QTKRKDN

SEQ ID NO: 3131700 - protein, 24 aa, Giardia lamblia
QTKSNPRSKGAPQATSVTENSLRE

SEQ ID NO: 3131701 - protein, 8 aa, Giardia lamblia
QTKSPTFN

SEQ ID NO: 3131702 - protein, 4 aa, Giardia lamblia
QTLE

SEQ ID NO: 3131703 - protein, 8 aa, Giardia lamblia
QTLGGRIE

SEQ ID NO: 3131704 - protein, 8 aa, Giardia lamblia
QTLKDGTT

SEQ ID NO: 3131705 - protein, 17 aa, Giardia lamblia
QTMDKPDDLTRSATETA

SEQ ID NO: 3131706 - protein, 15 aa, Giardia lamblia
QTNAEAGHSSIEDAE

SEQ ID NO: 3131707 - protein, 46 aa, Giardia lamblia
QTNGSSSKSSSSGNRRASNTNNKGGKCTSSEREVGRSETSIRRRHP

SEQ ID NO: 3131708 - protein, 4 aa, Giardia lamblia
QTNI

SEQ ID NO: 3131709 - protein, 6 aa, Giardia lamblia
QTNNAL

SEQ ID NO: 3131710 - protein, 8 aa, Giardia lamblia
QTNNDGNT

SEQ ID NO: 3131711 - protein, 5 aa, Giardia lamblia
QTNNK

SEQ ID NO: 3131712 - protein, 6 aa, Giardia lamblia
QTNPNK

SEQ ID NO: 3131713 - protein, 12 aa, Giardia lamblia
QTNTEDRSSPQV

SEQ ID NO: 3131714 - protein, 16 aa, Giardia lamblia
QTNTGNPPETTGGSAM

SEQ ID NO: 3131715 - protein, 11 aa, Giardia lamblia
QTNTSTYSSPS

SEQ ID NO: 3131716 - protein, 4 aa, Giardia lamblia
QTNY

SEQ ID NO: 3131717 - protein, 16 aa, Giardia lamblia
QTPAEGRRRHANDQGG

SEQ ID NO: 3131718 - protein, 6 aa, Giardia lamblia
QTPDGM

SEQ ID NO: 3131719 - protein, 9 aa, Giardia lamblia
QTPDLKSYE

SEQ ID NO: 3131720 - protein, 5 aa, Giardia lamblia
QTPEG

SEQ ID NO: 3131721 - protein, 6 aa, Giardia lamblia
QTPEKL

SEQ ID NO: 3131722 - protein, 12 aa, Giardia lamblia
QTPEKSSMKSSN

SEQ ID NO: 3131723 - protein, 12 aa, Giardia lamblia
QTPFSDDAHHRD

SEQ ID NO: 3131724 - protein, 18 aa, Giardia lamblia
QTPFSSTHRVTSRDTKQN

SEQ ID NO: 3131725 - protein, 7 aa, Giardia lamblia
QTPHASS

SEQ ID NO: 3131726 - protein, 7 aa, Giardia lamblia
QTPHGLE

SEQ ID NO: 3131727 - protein, 12 aa, Giardia lamblia
QTPKPGTDSSCS

SEQ ID NO: 3131728 - protein, 46 aa, Giardia lamblia
QTPKSQLGRHTPSRSTTSSVNVKGGRTNELPTLKPGRQAVRPVTEM

SEQ ID NO: 3131729 - protein, 34 aa, Giardia lamblia
QTPKTLTKSTNSNPIYTSRSESQRRSQSQTQYSR

SEQ ID NO: 3131730 - protein, 7 aa, Giardia lamblia
QTPLPEN

SEQ ID NO: 3131731 - protein, 6 aa, Giardia lamblia
QTPNSN

SEQ ID NO: 3131732 - protein, 8 aa, Giardia lamblia
QTPPGGLQ

SEQ ID NO: 3131733 - protein, 30 aa, Giardia lamblia
QTPQRRATSSGTTYERRRKRPKSASSPRMR

SEQ ID NO: 3131734 - protein, 6 aa, Giardia lamblia
QTPQTY

SEQ ID NO: 3131735 - protein, 37 aa, Giardia lamblia
QTPSHSESQLSEDQPREDKHRRGSHSKEPLSSSTDLN

SEQ ID NO: 3131736 - protein, 5 aa, Giardia lamblia
QTPTG

SEQ ID NO: 3131737 - protein, 6 aa, Giardia lamblia
QTPTHN

SEQ ID NO: 3131738 - protein, 17 aa, Giardia lamblia
QTPTPADRAQRKWHDDG

SEQ ID NO: 3131739 - protein, 14 aa, Giardia lamblia
QTPTPIPSTSMSED

SEQ ID NO: 3131740 - protein, 4 aa, Giardia lamblia
QTPY

SEQ ID NO: 3131741 - protein, 4 aa, Giardia lamblia
QTQA

SEQ ID NO: 3131742 - protein, 12 aa, Giardia lamblia
QTQGRKENRGDT

SEQ ID NO: 3131743 - protein, 29 aa, Giardia lamblia
QTQPTASKPPRSSVRKQGHRRSSQEPSML

SEQ ID NO: 3131744 - protein, 9 aa, Giardia lamblia
QTQRTRSGS

SEQ ID NO: 3131745 - protein, 10 aa, Giardia lamblia
QTQSPISPQD

SEQ ID NO: 3131746 - protein, 4 aa, Giardia lamblia
QTQT

SEQ ID NO: 3131747 - protein, 13 aa, Giardia lamblia
QTQTDTATEPDIN

SEQ ID NO: 3131748 - protein, 6 aa, Giardia lamblia
QTRAAA

SEQ ID NO: 3131749 - protein, 9 aa, Giardia lamblia
QTRDLPRDQ

SEQ ID NO: 3131750 - protein, 7 aa, Giardia lamblia
QTRDPNC

SEQ ID NO: 3131751 - protein, 4 aa, Giardia lamblia
QTRE

SEQ ID NO: 3131752 - protein, 9 aa, Giardia lamblia
QTREDSIQT

SEQ ID NO: 3131753 - protein, 11 aa, Giardia lamblia
QTRGAGTSIDG

SEQ ID NO: 3131754 - protein, 7 aa, Giardia lamblia
QTRNNED

SEQ ID NO: 3131755 - protein, 9 aa, Giardia lamblia
QTRPKQSQA

SEQ ID NO: 3131756 - protein, 4 aa, Giardia lamblia
QTRQ

SEQ ID NO: 3131757 - protein, 4 aa, Giardia lamblia
QTRR

SEQ ID NO: 3131758 - protein, 6 aa, Giardia lamblia
QTRRGT

SEQ ID NO: 3131759 - protein, 5 aa, Giardia lamblia
QTRRN

SEQ ID NO: 3131760 - protein, 19 aa, Giardia lamblia
QTRSKDAEGCEQRSGVAAK

SEQ ID NO: 3131761 - protein, 7 aa, Giardia lamblia
QTRTDAM

SEQ ID NO: 3131762 - protein, 7 aa, Giardia lamblia
QTRYDGK

SEQ ID NO: 3131763 - protein, 16 aa, Giardia lamblia
QTRYYNDTDNLNKSEK

SEQ ID NO: 3131764 - protein, 11 aa, Giardia lamblia
QTSAGKSFSSI

SEQ ID NO: 3131765 - protein, 14 aa, Giardia lamblia
QTSAPLPKPDRAPS

SEQ ID NO: 3131766 - protein, 5 aa, Giardia lamblia
QTSAR

SEQ ID NO: 3131767 - protein, 4 aa, Giardia lamblia
QTSD

SEQ ID NO: 3131768 - protein, 12 aa, Giardia lamblia
QTSDPENCTPET

SEQ ID NO: 3131769 - protein, 7 aa, Giardia lamblia
QTSEAQV

SEQ ID NO: 3131770 - protein, 10 aa, Giardia lamblia
QTSEQAKDLG

SEQ ID NO: 3131771 - protein, 8 aa, Giardia lamblia
QTSGPAAD

SEQ ID NO: 3131772 - protein, 8 aa, Giardia lamblia
QTSGREEK

SEQ ID NO: 3131773 - protein, 5 aa, Giardia lamblia
QTSHS

SEQ ID NO: 3131774 - protein, 27 aa, Giardia lamblia
QTSKQASSTTQTSSISVRSSSQHDSAG

SEQ ID NO: 3131775 - protein, 15 aa, Giardia lamblia
QTSLTDRVAKNQEAL

SEQ ID NO: 3131776 - protein, 22 aa, Giardia lamblia
QTSLTSTRRRHRSSKTTEALES

SEQ ID NO: 3131777 - protein, 8 aa, Giardia lamblia
QTSPKEAI

SEQ ID NO: 3131778 - protein, 9 aa, Giardia lamblia
QTSPNTPDC

SEQ ID NO: 3131779 - protein, 9 aa, Giardia lamblia
QTSQPTASV

SEQ ID NO: 3131780 - protein, 17 aa, Giardia lamblia
QTSRPISATAVSPSHNA

SEQ ID NO: 3131781 - protein, 16 aa, Giardia lamblia
QTTCKSCSGTGERITD

SEQ ID NO: 3131782 - protein, 7 aa, Giardia lamblia
QTTEGQT

SEQ ID NO: 3131783 - protein, 11 aa, Giardia lamblia
QTTGRGSSGVG

SEQ ID NO: 3131784 - protein, 4 aa, Giardia lamblia
QTTH

SEQ ID NO: 3131785 - protein, 6 aa, Giardia lamblia
QTTNSA

SEQ ID NO: 3131786 - protein, 13 aa, Giardia lamblia
QTTPLSNKQTSTL

SEQ ID NO: 3131787 - protein, 7 aa, Giardia lamblia
QTTPLSS

SEQ ID NO: 3131788 - protein, 7 aa, Giardia lamblia
QTTQTGF

SEQ ID NO: 3131789 - protein, 6 aa, Giardia lamblia
QTTRAI

SEQ ID NO: 3131790 - protein, 8 aa, Giardia lamblia
QTTRNSSK

SEQ ID NO: 3131791 - protein, 11 aa, Giardia lamblia
QTTSATSSGIH

SEQ ID NO: 3131792 - protein, 7 aa, Giardia lamblia
QTTTEEF

SEQ ID NO: 3131793 - protein, 11 aa, Giardia lamblia
QTTTIPAPTSN

SEQ ID NO: 3131794 - protein, 8 aa, Giardia lamblia
QTTVGRRA

SEQ ID NO: 3131795 - protein, 5 aa, Giardia lamblia
QTVDG

SEQ ID NO: 3131796 - protein, 7 aa, Giardia lamblia
QTVEEDE

SEQ ID NO: 3131797 - protein, 10 aa, Giardia lamblia
QTVGEEALGG

SEQ ID NO: 3131798 - protein, 4 aa, Giardia lamblia
QTVS

SEQ ID NO: 3131799 - protein, 26 aa, Giardia lamblia
QTVSASGISGERKPLRRTQGTPGRNL

SEQ ID NO: 3131800 - protein, 22 aa, Giardia lamblia
QTVSNPPKVKSMQPENLGQEDA

SEQ ID NO: 3131801 - protein, 5 aa, Giardia lamblia
QTVSQ

SEQ ID NO: 3131802 - protein, 5 aa, Giardia lamblia
QTVST

SEQ ID NO: 3131803 - protein, 11 aa, Giardia lamblia
QTVTDGECSCK

SEQ ID NO: 3131804 - protein, 42 aa, Giardia lamblia
QTVTISSSDIANKPLSMPSGPLTSSKKNVPRSTSVESKGSLL

SEQ ID NO: 3131805 - protein, 24 aa, Giardia lamblia
QTVTKAASHDGHKNKKNARRVERQ

SEQ ID NO: 3131806 - protein, 5 aa, Giardia lamblia
QTYGD

SEQ ID NO: 3131807 - protein, 15 aa, Giardia lamblia
QTYRTNTVAPGPHSL

SEQ ID NO: 3131808 - protein, 9 aa, Giardia lamblia
QVAAEQETI

SEQ ID NO: 3131809 - protein, 13 aa, Giardia lamblia
QVAAGSSAAYGET

SEQ ID NO: 3131810 - protein, 8 aa, Giardia lamblia
QVAPDGKT

SEQ ID NO: 3131811 - protein, 13 aa, Giardia lamblia
QVATASPTHYRTP

SEQ ID NO: 3131812 - protein, 4 aa, Giardia lamblia
QVAY

SEQ ID NO: 3131813 - protein, 8 aa, Giardia lamblia
QVDNSNKT

SEQ ID NO: 3131814 - protein, 11 aa, Giardia lamblia
QVDRDPNITEE

SEQ ID NO: 3131815 - protein, 6 aa, Giardia lamblia
QVDTTV

SEQ ID NO: 3131816 - protein, 21 aa, Giardia lamblia
QVEEEAQEQDRQALGTDGEDE

SEQ ID NO: 3131817 - protein, 12 aa, Giardia lamblia
QVEEKKKQDNIR

SEQ ID NO: 3131818 - protein, 16 aa, Giardia lamblia
QVEGDRCGRHPAPPDG

SEQ ID NO: 3131819 - protein, 21 aa, Giardia lamblia
QVEQRSKSTQQGKSKEEKQTL

SEQ ID NO: 3131820 - protein, 7 aa, Giardia lamblia
QVESDRQ

SEQ ID NO: 3131821 - protein, 5 aa, Giardia lamblia
QVESR

SEQ ID NO: 3131822 - protein, 18 aa, Giardia lamblia
QVETARSKTGQRGDNVPN

SEQ ID NO: 3131823 - protein, 14 aa, Giardia lamblia
QVETPRRDEDDGRV

SEQ ID NO: 3131824 - protein, 7 aa, Giardia lamblia
QVGDGRR

SEQ ID NO: 3131825 - protein, 5 aa, Giardia lamblia
QVGEQ

SEQ ID NO: 3131826 - protein, 27 aa, Giardia lamblia
QVGNEDGNDEVSVTDKGTQQDAKGAHE

SEQ ID NO: 3131827 - protein, 11 aa, Giardia lamblia
QVGRTDKRGRT

SEQ ID NO: 3131828 - protein, 15 aa, Giardia lamblia
QVGSGGIRAGAREKS

SEQ ID NO: 3131829 - protein, 15 aa, Giardia lamblia
QVGSKASRLQERGAQ

SEQ ID NO: 3131830 - protein, 8 aa, Giardia lamblia
QVKARAAA

SEQ ID NO: 3131831 - protein, 12 aa, Giardia lamblia
QVKDVKKGDQPT

SEQ ID NO: 3131832 - protein, 6 aa, Giardia lamblia
QVKESK

SEQ ID NO: 3131833 - protein, 13 aa, Giardia lamblia
QVKPETDEYITGD

SEQ ID NO: 3131834 - protein, 11 aa, Giardia lamblia
QVKRDKKGNTQ

SEQ ID NO: 3131835 - protein, 11 aa, Giardia lamblia
QVNPSNPPEKI

SEQ ID NO: 3131836 - protein, 6 aa, Giardia lamblia
QVNTGE

SEQ ID NO: 3131837 - protein, 7 aa, Giardia lamblia
QVPEDTE

SEQ ID NO: 3131838 - protein, 10 aa, Giardia lamblia
QVPEGSCSPE

SEQ ID NO: 3131839 - protein, 15 aa, Giardia lamblia
QVPGCGNPAGSADTF

SEQ ID NO: 3131840 - protein, 5 aa, Giardia lamblia
QVPGV

SEQ ID NO: 3131841 - protein, 5 aa, Giardia lamblia
QVPQE

SEQ ID NO: 3131842 - protein, 6 aa, Giardia lamblia
QVPSEN

SEQ ID NO: 3131843 - protein, 12 aa, Giardia lamblia
QVPSKDGSEKTV

SEQ ID NO: 3131844 - protein, 4 aa, Giardia lamblia
QVPT

SEQ ID NO: 3131845 - protein, 12 aa, Giardia lamblia
QVQASPPAIPED

SEQ ID NO: 3131846 - protein, 17 aa, Giardia lamblia
QVQDKSCDPYSKETRHK

SEQ ID NO: 3131847 - protein, 4 aa, Giardia lamblia
QVQG

SEQ ID NO: 3131848 - protein, 15 aa, Giardia lamblia
QVQGSGRGCHPAPPD

SEQ ID NO: 3131849 - protein, 6 aa, Giardia lamblia
QVQPSS

SEQ ID NO: 3131850 - protein, 9 aa, Giardia lamblia
QVQQRSGLE

SEQ ID NO: 3131851 - protein, 7 aa, Giardia lamblia
QVRDEPS

SEQ ID NO: 3131852 - protein, 4 aa, Giardia lamblia
QVRE

SEQ ID NO: 3131853 - protein, 6 aa, Giardia lamblia
QVRPTK

SEQ ID NO: 3131854 - protein, 7 aa, Giardia lamblia
QVSANDE

SEQ ID NO: 3131855 - protein, 10 aa, Giardia lamblia
QVSDDEDEYS

SEQ ID NO: 3131856 - protein, 8 aa, Giardia lamblia
QVSDSEHA

SEQ ID NO: 3131857 - protein, 4 aa, Giardia lamblia
QVSE

SEQ ID NO: 3131858 - protein, 15 aa, Giardia lamblia
QVSEESQAKTKLNKN

SEQ ID NO: 3131859 - protein, 8 aa, Giardia lamblia
QVSEGHPD

SEQ ID NO: 3131860 - protein, 6 aa, Giardia lamblia
QVSKTD

SEQ ID NO: 3131861 - protein, 8 aa, Giardia lamblia
QVSNDTDD

SEQ ID NO: 3131862 - protein, 8 aa, Giardia lamblia
QVSNGKAA

SEQ ID NO: 3131863 - protein, 7 aa, Giardia lamblia
QVSNKDS

SEQ ID NO: 3131864 - protein, 10 aa, Giardia lamblia
QVSNNGSSTI

SEQ ID NO: 3131865 - protein, 11 aa, Giardia lamblia
QVSPGEPVGPL

SEQ ID NO: 3131866 - protein, 12 aa, Giardia lamblia
QVSPGKGSEYDV

SEQ ID NO: 3131867 - protein, 16 aa, Giardia lamblia
QVSPVSGSLSSQTTCQ

SEQ ID NO: 3131868 - protein, 6 aa, Giardia lamblia
QVSQAS

SEQ ID NO: 3131869 - protein, 8 aa, Giardia lamblia
QVSQRDEI

SEQ ID NO: 3131870 - protein, 5 aa, Giardia lamblia
QVSRE

SEQ ID NO: 3131871 - protein, 31 aa, Giardia lamblia
QVSSGRRAGVGGRSQKDQEGRQRKHKARVSD

SEQ ID NO: 3131872 - protein, 19 aa, Giardia lamblia
QVSSITTKQVQQNNKCSGM

SEQ ID NO: 3131873 - protein, 63 aa, Giardia lamblia
QVSSTSTGALPHASSSQQSSRISRKTPISATASSERGKTVSATARPEHNGPVHTAAKQASTIA

SEQ ID NO: 3131874 - protein, 5 aa, Giardia lamblia
QVTDN

SEQ ID NO: 3131875 - protein, 8 aa, Giardia lamblia
QVTEQART

SEQ ID NO: 3131876 - protein, 7 aa, Giardia lamblia
QVTERTQ

SEQ ID NO: 3131877 - protein, 6 aa, Giardia lamblia
QVTESE

SEQ ID NO: 3131878 - protein, 20 aa, Giardia lamblia
QVTESKKRKQAVEEAIEQTK

SEQ ID NO: 3131879 - protein, 5 aa, Giardia lamblia
QVTNP

SEQ ID NO: 3131880 - protein, 15 aa, Giardia lamblia
QVTNSKAEKEVSNEV

SEQ ID NO: 3131881 - protein, 4 aa, Giardia lamblia
QVTT

SEQ ID NO: 3131882 - protein, 4 aa, Giardia lamblia
QVVP

SEQ ID NO: 3131883 - protein, 5 aa, Giardia lamblia
QWGER

SEQ ID NO: 3131884 - protein, 10 aa, Giardia lamblia
QWPNEKSCER

SEQ ID NO: 3131885 - protein, 14 aa, Giardia lamblia
QYAASDYGKKDING

SEQ ID NO: 3131886 - protein, 12 aa, Giardia lamblia
QYAGSVNEEGHT

SEQ ID NO: 3131887 - protein, 11 aa, Giardia lamblia
QYAGTRDADGY

SEQ ID NO: 3131888 - protein, 11 aa, Giardia lamblia
QYANTTAGTPF

SEQ ID NO: 3131889 - protein, 7 aa, Giardia lamblia
QYASKHR

SEQ ID NO: 3131890 - protein, 9 aa, Giardia lamblia
QYASSDSAQ

SEQ ID NO: 3131891 - protein, 5 aa, Giardia lamblia
QYATN

SEQ ID NO: 3131892 - protein, 7 aa, Giardia lamblia
QYDDTRR

SEQ ID NO: 3131893 - protein, 8 aa, Giardia lamblia
QYDEDGKT

SEQ ID NO: 3131894 - protein, 6 aa, Giardia lamblia
QYDEEV

SEQ ID NO: 3131895 - protein, 9 aa, Giardia lamblia
QYDRTDAEL

SEQ ID NO: 3131896 - protein, 9 aa, Giardia lamblia
QYDTGKKAI

SEQ ID NO: 3131897 - protein, 15 aa, Giardia lamblia
QYEADSNYPTSNDPP

SEQ ID NO: 3131898 - protein, 9 aa, Giardia lamblia
QYETKSREQ

SEQ ID NO: 3131899 - protein, 15 aa, Giardia lamblia
QYGGDESGTTEGNEL

SEQ ID NO: 3131900 - protein, 24 aa, Giardia lamblia
QYGGSGLPMGKKTSQKLSSPDGDW

SEQ ID NO: 3131901 - protein, 5 aa, Giardia lamblia
QYGHT

SEQ ID NO: 3131902 - protein, 19 aa, Giardia lamblia
QYGPTESGSPHSSASTLPD

SEQ ID NO: 3131903 - protein, 6 aa, Giardia lamblia
QYGQQD

SEQ ID NO: 3131904 - protein, 10 aa, Giardia lamblia
QYGRRDDNGM

SEQ ID NO: 3131905 - protein, 6 aa, Giardia lamblia
QYGTPI

SEQ ID NO: 3131906 - protein, 12 aa, Giardia lamblia
QYIDKGPNASGQ

SEQ ID NO: 3131907 - protein, 19 aa, Giardia lamblia
QYNETKQKIEESTTDTKRW

SEQ ID NO: 3131908 - protein, 6 aa, Giardia lamblia
QYNGTI

SEQ ID NO: 3131909 - protein, 4 aa, Giardia lamblia
QYNN

SEQ ID NO: 3131910 - protein, 7 aa, Giardia lamblia
QYNPRDI

SEQ ID NO: 3131911 - protein, 6 aa, Giardia lamblia
QYPDLP

SEQ ID NO: 3131912 - protein, 16 aa, Giardia lamblia
QYPHTASNGAYTNTAE

SEQ ID NO: 3131913 - protein, 5 aa, Giardia lamblia
QYQSQ

SEQ ID NO: 3131914 - protein, 13 aa, Giardia lamblia
QYRKENRLQQRPT

SEQ ID NO: 3131915 - protein, 4 aa, Giardia lamblia
QYRR

SEQ ID NO: 3131916 - protein, 20 aa, Giardia lamblia
QYRSPSPKQPFQPTPTPAFS

SEQ ID NO: 3131917 - protein, 6 aa, Giardia lamblia
QYSDKS

SEQ ID NO: 3131918 - protein, 7 aa, Giardia lamblia
QYSPQRE

SEQ ID NO: 3131919 - protein, 5 aa, Giardia lamblia
QYSSE

SEQ ID NO: 3131920 - protein, 10 aa, Giardia lamblia
QYSSSKVSEC

SEQ ID NO: 3131921 - protein, 4 aa, Giardia lamblia
QYTD

SEQ ID NO: 3131922 - protein, 7 aa, Giardia lamblia
QYTKESV

SEQ ID NO: 3131923 - protein, 5 aa, Giardia lamblia
QYTPE

SEQ ID NO: 3131924 - protein, 5 aa, Giardia lamblia
QYTQP

SEQ ID NO: 3131925 - protein, 9 aa, Giardia lamblia
QYVDDNDNT

SEQ ID NO: 3131926 - protein, 5 aa, Giardia lamblia
QYYPE

SEQ ID NO: 3131927 - protein, 19 aa, Giardia lamblia
RAAATSTPAPSKLGQHHSE

SEQ ID NO: 3131928 - protein, 7 aa, Giardia lamblia
RAADQSN

SEQ ID NO: 3131929 - protein, 9 aa, Giardia lamblia
RAAEDQGAG

SEQ ID NO: 3131930 - protein, 13 aa, Giardia lamblia
RAAEETASAEYKN

SEQ ID NO: 3131931 - protein, 62 aa, Giardia lamblia
RAAEGIDKVPKSNPTGGPPKPGSRRGQRNVKGSSGKPHLQGKSRGSDRLQKGTSQPQGPSRV

SEQ ID NO: 3131932 - protein, 8 aa, Giardia lamblia
RAAEQQAF

SEQ ID NO: 3131933 - protein, 22 aa, Giardia lamblia
RAAGNAGKNVSEELERKDAELQ

SEQ ID NO: 3131934 - protein, 13 aa, Giardia lamblia
RAALRSGKADELA

SEQ ID NO: 3131935 - protein, 9 aa, Giardia lamblia
RAALSDEGI

SEQ ID NO: 3131936 - protein, 17 aa, Giardia lamblia
RAAPAPQATGEDPQTLP

SEQ ID NO: 3131937 - protein, 6 aa, Giardia lamblia
RAAPGE

SEQ ID NO: 3131938 - protein, 13 aa, Giardia lamblia
RAAPNSATSDYHG

SEQ ID NO: 3131939 - protein, 66 aa, Giardia lamblia
RAAPPSTAYSGPGRKKSSSSKQAHAKNTPKQTGKKKMRSGTPKKQRIPEPPQLQPPVRHKDTSLKD

SEQ ID NO: 3131940 - protein, 4 aa, Giardia lamblia
RAAQ

SEQ ID NO: 3131941 - protein, 39 aa, Giardia lamblia
RAAQAAAKSPQARKSVTSPNIPMDSGAERGPAKAKKIPV

SEQ ID NO: 3131942 - protein, 5 aa, Giardia lamblia
RAAQR

SEQ ID NO: 3131943 - protein, 8 aa, Giardia lamblia
RAAQTEST

SEQ ID NO: 3131944 - protein, 25 aa, Giardia lamblia
RAASKSATRTVSKKPEGCTTNCTEE

SEQ ID NO: 3131945 - protein, 7 aa, Giardia lamblia
RAASKVN

SEQ ID NO: 3131946 - protein, 8 aa, Giardia lamblia
RAASLNKT

SEQ ID NO: 3131947 - protein, 14 aa, Giardia lamblia
RAASQAVSGDQTID

SEQ ID NO: 3131948 - protein, 51 aa, Giardia lamblia
RAASRSGSLCGSNYGSQSMNTSRSASRSASPSISRTASRSISRSASPSLPI

SEQ ID NO: 3131949 - protein, 9 aa, Giardia lamblia
RAATGSDYY

SEQ ID NO: 3131950 - protein, 9 aa, Giardia lamblia
RAATSGQAF

SEQ ID NO: 3131951 - protein, 14 aa, Giardia lamblia
RAAVPSADNPATAD

SEQ ID NO: 3131952 - protein, 6 aa, Giardia lamblia
RACEEA

SEQ ID NO: 3131953 - protein, 4 aa, Giardia lamblia
RACS

SEQ ID NO: 3131954 - protein, 17 aa, Giardia lamblia
RACSPPEMDDDKHCKGN

SEQ ID NO: 3131955 - protein, 4 aa, Giardia lamblia
RADA

SEQ ID NO: 3131956 - protein, 6 aa, Giardia lamblia
RADAEG

SEQ ID NO: 3131957 - protein, 18 aa, Giardia lamblia
RADAGEAALRDKRRLEDE

SEQ ID NO: 3131958 - protein, 13 aa, Giardia lamblia
RADASSNVERSDT

SEQ ID NO: 3131959 - protein, 4 aa, Giardia lamblia
RADD

SEQ ID NO: 3131960 - protein, 5 aa, Giardia lamblia
RADDK

SEQ ID NO: 3131961 - protein, 9 aa, Giardia lamblia
RADDPTVQG

SEQ ID NO: 3131962 - protein, 8 aa, Giardia lamblia
RADDQDVG

SEQ ID NO: 3131963 - protein, 9 aa, Giardia lamblia
RADGKRPGG

SEQ ID NO: 3131964 - protein, 7 aa, Giardia lamblia
RADGTDR

SEQ ID NO: 3131965 - protein, 4 aa, Giardia lamblia
RADH

SEQ ID NO: 3131966 - protein, 9 aa, Giardia lamblia
RADIPNKTL

SEQ ID NO: 3131967 - protein, 9 aa, Giardia lamblia
RADNETAQN

SEQ ID NO: 3131968 - protein, 4 aa, Giardia lamblia
RADQ

SEQ ID NO: 3131969 - protein, 7 aa, Giardia lamblia
RADRPTQ

SEQ ID NO: 3131970 - protein, 6 aa, Giardia lamblia
RADSTR

SEQ ID NO: 3131971 - protein, 6 aa, Giardia lamblia
RADVEK

SEQ ID NO: 3131972 - protein, 8 aa, Giardia lamblia
RAEDDEFR

SEQ ID NO: 3131973 - protein, 15 aa, Giardia lamblia
RAEDPATKSTIDNTE

SEQ ID NO: 3131974 - protein, 4 aa, Giardia lamblia
RAEE

SEQ ID NO: 3131975 - protein, 22 aa, Giardia lamblia
RAEEARQARAAKYKKLEDEARK

SEQ ID NO: 3131976 - protein, 10 aa, Giardia lamblia
RAEEQEKEIQ

SEQ ID NO: 3131977 - protein, 8 aa, Giardia lamblia
RAEGAARS

SEQ ID NO: 3131978 - protein, 8 aa, Giardia lamblia
RAEGSNSM

SEQ ID NO: 3131979 - protein, 6 aa, Giardia lamblia
RAEIRT

SEQ ID NO: 3131980 - protein, 7 aa, Giardia lamblia
RAEKARL

SEQ ID NO: 3131981 - protein, 4 aa, Giardia lamblia
RAEL

SEQ ID NO: 3131982 - protein, 8 aa, Giardia lamblia
RAENGHKT

SEQ ID NO: 3131983 - protein, 14 aa, Giardia lamblia
RAENPQPNKPHPYV

SEQ ID NO: 3131984 - protein, 9 aa, Giardia lamblia
RAENQGLRS

SEQ ID NO: 3131985 - protein, 7 aa, Giardia lamblia
RAENREL

SEQ ID NO: 3131986 - protein, 7 aa, Giardia lamblia
RAEPGSV

SEQ ID NO: 3131987 - protein, 8 aa, Giardia lamblia
RAEPSPKR

SEQ ID NO: 3131988 - protein, 7 aa, Giardia lamblia
RAEPTPL

SEQ ID NO: 3131989 - protein, 13 aa, Giardia lamblia
RAERAAAARNRKR

SEQ ID NO: 3131990 - protein, 5 aa, Giardia lamblia
RAERE

SEQ ID NO: 3131991 - protein, 8 aa, Giardia lamblia
RAERQREM

SEQ ID NO: 3131992 - protein, 12 aa, Giardia lamblia
RAESQGATLTRG

SEQ ID NO: 3131993 - protein, 8 aa, Giardia lamblia
RAESSAPV

SEQ ID NO: 3131994 - protein, 15 aa, Giardia lamblia
RAESTQNASKQLPPP

SEQ ID NO: 3131995 - protein, 5 aa, Giardia lamblia
RAETQ

SEQ ID NO: 3131996 - protein, 4 aa, Giardia lamblia
RAEY

SEQ ID NO: 3131997 - protein, 8 aa, Giardia lamblia
RAFPRNAD

SEQ ID NO: 3131998 - protein, 9 aa, Giardia lamblia
RAGAEYSSA

SEQ ID NO: 3131999 - protein, 7 aa, Giardia lamblia
RAGAGDV

SEQ ID NO: 3132000 - protein, 8 aa, Giardia lamblia
RAGATESA

SEQ ID NO: 3132001 - protein, 10 aa, Giardia lamblia
RAGEQDMDGR

SEQ ID NO: 3132002 - protein, 5 aa, Giardia lamblia
RAGES

SEQ ID NO: 3132003 - protein, 13 aa, Giardia lamblia
RAGETSNTKSSSI

SEQ ID NO: 3132004 - protein, 20 aa, Giardia lamblia
RAGGCVSPAPQMYTTINANM

SEQ ID NO: 3132005 - protein, 9 aa, Giardia lamblia
RAGGQEPDE

SEQ ID NO: 3132006 - protein, 8 aa, Giardia lamblia
RAGHPPAE

SEQ ID NO: 3132007 - protein, 5 aa, Giardia lamblia
RAGHR

SEQ ID NO: 3132008 - protein, 7 aa, Giardia lamblia
RAGKAED

SEQ ID NO: 3132009 - protein, 5 aa, Giardia lamblia
RAGKI

SEQ ID NO: 3132010 - protein, 4 aa, Giardia lamblia
RAGL

SEQ ID NO: 3132011 - protein, 8 aa, Giardia lamblia
RAGNGNPE

SEQ ID NO: 3132012 - protein, 6 aa, Giardia lamblia
RAGNYL

SEQ ID NO: 3132013 - protein, 6 aa, Giardia lamblia
RAGPDV

SEQ ID NO: 3132014 - protein, 36 aa, Giardia lamblia
RAGPSNKSTDSEHRQPFPRQSAPEHEKPLTPTRSPY

SEQ ID NO: 3132015 - protein, 8 aa, Giardia lamblia
RAGQRLRQ

SEQ ID NO: 3132016 - protein, 9 aa, Giardia lamblia
RAGRAVGDI

SEQ ID NO: 3132017 - protein, 7 aa, Giardia lamblia
RAGRDGV

SEQ ID NO: 3132018 - protein, 12 aa, Giardia lamblia
RAGRDTSESAAY

SEQ ID NO: 3132019 - protein, 5 aa, Giardia lamblia
RAGRF

SEQ ID NO: 3132020 - protein, 7 aa, Giardia lamblia
RAGRPQY

SEQ ID NO: 3132021 - protein, 10 aa, Giardia lamblia
RAGRQTEGTA

SEQ ID NO: 3132022 - protein, 10 aa, Giardia lamblia
RAGRRGIDKQ

SEQ ID NO: 3132023 - protein, 10 aa, Giardia lamblia
RAGSNTETER

SEQ ID NO: 3132024 - protein, 39 aa, Giardia lamblia
RAGSPRAPSLASPSQPSSSSEGSSASSAGGSSAEAKRRC

SEQ ID NO: 3132025 - protein, 8 aa, Giardia lamblia
RAGSRPEE

SEQ ID NO: 3132026 - protein, 6 aa, Giardia lamblia
RAGSVE

SEQ ID NO: 3132027 - protein, 8 aa, Giardia lamblia
RAGTGEGG

SEQ ID NO: 3132028 - protein, 11 aa, Giardia lamblia
RAGTSNLEADV

SEQ ID NO: 3132029 - protein, 17 aa, Giardia lamblia
RAGVSSGDIAAHAPGSP

SEQ ID NO: 3132030 - protein, 13 aa, Giardia lamblia
RAHESKPSRSDVH

SEQ ID NO: 3132031 - protein, 7 aa, Giardia lamblia
RAHKNVS

SEQ ID NO: 3132032 - protein, 10 aa, Giardia lamblia
RAHKTRRSQL

SEQ ID NO: 3132033 - protein, 6 aa, Giardia lamblia
RAIERE

SEQ ID NO: 3132034 - protein, 9 aa, Giardia lamblia
RAIGRSPSI

SEQ ID NO: 3132035 - protein, 10 aa, Giardia lamblia
RAIPGPPRSI

SEQ ID NO: 3132036 - protein, 6 aa, Giardia lamblia
RAISGE

SEQ ID NO: 3132037 - protein, 8 aa, Giardia lamblia
RAITAAKG

SEQ ID NO: 3132038 - protein, 7 aa, Giardia lamblia
RAITTEY

SEQ ID NO: 3132039 - protein, 15 aa, Giardia lamblia
RAKAKRDQLSVYARN

SEQ ID NO: 3132040 - protein, 5 aa, Giardia lamblia
RAKDR

SEQ ID NO: 3132041 - protein, 14 aa, Giardia lamblia
RAKEKEITQTLEDS

SEQ ID NO: 3132042 - protein, 6 aa, Giardia lamblia
RAKEPL

SEQ ID NO: 3132043 - protein, 8 aa, Giardia lamblia
RAKIEKDQ

SEQ ID NO: 3132044 - protein, 9 aa, Giardia lamblia
RAKKQRDTI

SEQ ID NO: 3132045 - protein, 4 aa, Giardia lamblia
RAKN

SEQ ID NO: 3132046 - protein, 10 aa, Giardia lamblia
RAKNGTGKTG

SEQ ID NO: 3132047 - protein, 14 aa, Giardia lamblia
RAKNMSRKKIGPYE

SEQ ID NO: 3132048 - protein, 7 aa, Giardia lamblia
RAKPAAW

SEQ ID NO: 3132049 - protein, 6 aa, Giardia lamblia
RAKPAK

SEQ ID NO: 3132050 - protein, 8 aa, Giardia lamblia
RAKQIKNK

SEQ ID NO: 3132051 - protein, 10 aa, Giardia lamblia
RAKREAEKLQ

SEQ ID NO: 3132052 - protein, 7 aa, Giardia lamblia
RAKRQTD

SEQ ID NO: 3132053 - protein, 14 aa, Giardia lamblia
RAKRTLSSSQQASI

SEQ ID NO: 3132054 - protein, 12 aa, Giardia lamblia
RAKSCKGITPSR

SEQ ID NO: 3132055 - protein, 11 aa, Giardia lamblia
RAKSHPPDSPY

SEQ ID NO: 3132056 - protein, 17 aa, Giardia lamblia
RAKSKPFRSPALPTNSK

SEQ ID NO: 3132057 - protein, 10 aa, Giardia lamblia
RAKSRTASRT

SEQ ID NO: 3132058 - protein, 11 aa, Giardia lamblia
RAKSVGGRTRK

SEQ ID NO: 3132059 - protein, 8 aa, Giardia lamblia
RAKSYSKK

SEQ ID NO: 3132060 - protein, 11 aa, Giardia lamblia
RAKTEAGTREA

SEQ ID NO: 3132061 - protein, 4 aa, Giardia lamblia
RALA

SEQ ID NO: 3132062 - protein, 21 aa, Giardia lamblia
RALAEAKQKRESELEQKEALN

SEQ ID NO: 3132063 - protein, 14 aa, Giardia lamblia
RALDSSADPPQPTL

SEQ ID NO: 3132064 - protein, 4 aa, Giardia lamblia
RALE

SEQ ID NO: 3132065 - protein, 8 aa, Giardia lamblia
RALGPEYR

SEQ ID NO: 3132066 - protein, 10 aa, Giardia lamblia
RALKTPTTTR

SEQ ID NO: 3132067 - protein, 10 aa, Giardia lamblia
RALPESASVT

SEQ ID NO: 3132068 - protein, 7 aa, Giardia lamblia
RALPPLS

SEQ ID NO: 3132069 - protein, 30 aa, Giardia lamblia
RALQEGSVHASPGASPQSGDGRSEASGSVL

SEQ ID NO: 3132070 - protein, 5 aa, Giardia lamblia
RALSN

SEQ ID NO: 3132071 - protein, 10 aa, Giardia lamblia
RALSPNCKTN

SEQ ID NO: 3132072 - protein, 13 aa, Giardia lamblia
RALTDSSARTATM

SEQ ID NO: 3132073 - protein, 10 aa, Giardia lamblia
RAMKKRRADM

SEQ ID NO: 3132074 - protein, 13 aa, Giardia lamblia
RAMQARQKQESSI

SEQ ID NO: 3132075 - protein, 14 aa, Giardia lamblia
RANAAATSAKDDLK

SEQ ID NO: 3132076 - protein, 7 aa, Giardia lamblia
RANAHGP

SEQ ID NO: 3132077 - protein, 13 aa, Giardia lamblia
RANDSAEQVIEEQ

SEQ ID NO: 3132078 - protein, 34 aa, Giardia lamblia
RANDTISSLEKANTSTSKQVKDLQSTMESKEKEC

SEQ ID NO: 3132079 - protein, 7 aa, Giardia lamblia
RANGETA

SEQ ID NO: 3132080 - protein, 11 aa, Giardia lamblia
RANGTNKAARM

SEQ ID NO: 3132081 - protein, 6 aa, Giardia lamblia
RANHGE

SEQ ID NO: 3132082 - protein, 10 aa, Giardia lamblia
RANKEGQSNA

SEQ ID NO: 3132083 - protein, 9 aa, Giardia lamblia
RANPKTAKY

SEQ ID NO: 3132084 - protein, 10 aa, Giardia lamblia
RANPPPSPDI

SEQ ID NO: 3132085 - protein, 7 aa, Giardia lamblia
RANPQAV

SEQ ID NO: 3132086 - protein, 10 aa, Giardia lamblia
RANPQTSAQY

SEQ ID NO: 3132087 - protein, 11 aa, Giardia lamblia
RANPSPNGVEK

SEQ ID NO: 3132088 - protein, 7 aa, Giardia lamblia
RANSLTS

SEQ ID NO: 3132089 - protein, 8 aa, Giardia lamblia
RANSNKVV

SEQ ID NO: 3132090 - protein, 9 aa, Giardia lamblia
RANSRNDEL

SEQ ID NO: 3132091 - protein, 9 aa, Giardia lamblia
RANSVAAPR

SEQ ID NO: 3132092 - protein, 5 aa, Giardia lamblia
RANTH

SEQ ID NO: 3132093 - protein, 15 aa, Giardia lamblia
RANVSPDRAHVSDRR

SEQ ID NO: 3132094 - protein, 7 aa, Giardia lamblia
RAPAGLS

SEQ ID NO: 3132095 - protein, 7 aa, Giardia lamblia
RAPAPRL

SEQ ID NO: 3132096 - protein, 7 aa, Giardia lamblia
RAPDGRT

SEQ ID NO: 3132097 - protein, 6 aa, Giardia lamblia
RAPEAT

SEQ ID NO: 3132098 - protein, 7 aa, Giardia lamblia
RAPEGGR

SEQ ID NO: 3132099 - protein, 16 aa, Giardia lamblia
RAPEIKEGEYYGPPSD

SEQ ID NO: 3132100 - protein, 15 aa, Giardia lamblia
RAPEQMSSKTHTTKT

SEQ ID NO: 3132101 - protein, 14 aa, Giardia lamblia
RAPERYKPSSYSDL

SEQ ID NO: 3132102 - protein, 7 aa, Giardia lamblia
RAPESPL

SEQ ID NO: 3132103 - protein, 4 aa, Giardia lamblia
RAPG

SEQ ID NO: 3132104 - protein, 9 aa, Giardia lamblia
RAPGKKTVQ

SEQ ID NO: 3132105 - protein, 15 aa, Giardia lamblia
RAPHTERTAADIEAD

SEQ ID NO: 3132106 - protein, 12 aa, Giardia lamblia
RAPIPANYQPEP

SEQ ID NO: 3132107 - protein, 4 aa, Giardia lamblia
RAPK

SEQ ID NO: 3132108 - protein, 7 aa, Giardia lamblia
RAPLPKH

SEQ ID NO: 3132109 - protein, 5 aa, Giardia lamblia
RAPMS

SEQ ID NO: 3132110 - protein, 4 aa, Giardia lamblia
RAPN

SEQ ID NO: 3132111 - protein, 7 aa, Giardia lamblia
RAPNASI

SEQ ID NO: 3132112 - protein, 18 aa, Giardia lamblia
RAPNEHGSETDSLQDECE

SEQ ID NO: 3132113 - protein, 6 aa, Giardia lamblia
RAPPIE

SEQ ID NO: 3132114 - protein, 13 aa, Giardia lamblia
RAPPLQTSSDPRR

SEQ ID NO: 3132115 - protein, 11 aa, Giardia lamblia
RAPPTSTEGTE

SEQ ID NO: 3132116 - protein, 7 aa, Giardia lamblia
RAPQRGT

SEQ ID NO: 3132117 - protein, 28 aa, Giardia lamblia
RAPRANSAAPALAKERRKSNIPRLEKQN

SEQ ID NO: 3132118 - protein, 5 aa, Giardia lamblia
RAPRD

SEQ ID NO: 3132119 - protein, 14 aa, Giardia lamblia
RAPSIGANSVRPVT

SEQ ID NO: 3132120 - protein, 28 aa, Giardia lamblia
RAPSKRSTVGSLSSSSGGIAPGAGPSLV

SEQ ID NO: 3132121 - protein, 5 aa, Giardia lamblia
RAPSR

SEQ ID NO: 3132122 - protein, 38 aa, Giardia lamblia
RAPSTDTSDDRNDSTTPIRDGIPQNPDCSDSSDGGPIP

SEQ ID NO: 3132123 - protein, 4 aa, Giardia lamblia
RAPV

SEQ ID NO: 3132124 - protein, 11 aa, Giardia lamblia
RAQARKEKCSL

SEQ ID NO: 3132125 - protein, 4 aa, Giardia lamblia
RAQC

SEQ ID NO: 3132126 - protein, 4 aa, Giardia lamblia
RAQE

SEQ ID NO: 3132127 - protein, 6 aa, Giardia lamblia
RAQEAE

SEQ ID NO: 3132128 - protein, 34 aa, Giardia lamblia
RAQEAQQITQESSQTEVLSEKSKEEMYKTNQERL

SEQ ID NO: 3132129 - protein, 12 aa, Giardia lamblia
RAQEEQVGDGTT

SEQ ID NO: 3132130 - protein, 8 aa, Giardia lamblia
RAQEQDHV

SEQ ID NO: 3132131 - protein, 8 aa, Giardia lamblia
RAQEQEQM

SEQ ID NO: 3132132 - protein, 11 aa, Giardia lamblia
RAQGSRQNTDY

SEQ ID NO: 3132133 - protein, 6 aa, Giardia lamblia
RAQGTL

SEQ ID NO: 3132134 - protein, 11 aa, Giardia lamblia
RAQKRADRERV

SEQ ID NO: 3132135 - protein, 4 aa, Giardia lamblia
RAQL

SEQ ID NO: 3132136 - protein, 5 aa, Giardia lamblia
RAQMR

SEQ ID NO: 3132137 - protein, 5 aa, Giardia lamblia
RAQNQ

SEQ ID NO: 3132138 - protein, 11 aa, Giardia lamblia
RAQPAQNGTHY

SEQ ID NO: 3132139 - protein, 9 aa, Giardia lamblia
RAQPEASDE

SEQ ID NO: 3132140 - protein, 7 aa, Giardia lamblia
RAQQESE

SEQ ID NO: 3132141 - protein, 5 aa, Giardia lamblia
RAQQI

SEQ ID NO: 3132142 - protein, 8 aa, Giardia lamblia
RAQQSPAL

SEQ ID NO: 3132143 - protein, 4 aa, Giardia lamblia
RAQR

SEQ ID NO: 3132144 - protein, 10 aa, Giardia lamblia
RAQRARANKF

SEQ ID NO: 3132145 - protein, 5 aa, Giardia lamblia
RAQSE

SEQ ID NO: 3132146 - protein, 7 aa, Giardia lamblia
RAQTATG

SEQ ID NO: 3132147 - protein, 6 aa, Giardia lamblia
RAQTYA

SEQ ID NO: 3132148 - protein, 4 aa, Giardia lamblia
RAQV

SEQ ID NO: 3132149 - protein, 4 aa, Giardia lamblia
RARA

SEQ ID NO: 3132150 - protein, 14 aa, Giardia lamblia
RARAAEEKLAQTEQ

SEQ ID NO: 3132151 - protein, 16 aa, Giardia lamblia
RARAGPVRPPTMLIPT

SEQ ID NO: 3132152 - protein, 10 aa, Giardia lamblia
RARAKKAYTE

SEQ ID NO: 3132153 - protein, 9 aa, Giardia lamblia
RARDSAGMT

SEQ ID NO: 3132154 - protein, 8 aa, Giardia lamblia
RARDSNGM

SEQ ID NO: 3132155 - protein, 7 aa, Giardia lamblia
RAREQKH

SEQ ID NO: 3132156 - protein, 4 aa, Giardia lamblia
RARG

SEQ ID NO: 3132157 - protein, 18 aa, Giardia lamblia
RARGATLTGSLENRPLDP

SEQ ID NO: 3132158 - protein, 6 aa, Giardia lamblia
RARGES

SEQ ID NO: 3132159 - protein, 10 aa, Giardia lamblia
RARKAGGQHF

SEQ ID NO: 3132160 - protein, 9 aa, Giardia lamblia
RARKDDSKR

SEQ ID NO: 3132161 - protein, 9 aa, Giardia lamblia
RARKDGSTA

SEQ ID NO: 3132162 - protein, 8 aa, Giardia lamblia
RARKIQNK

SEQ ID NO: 3132163 - protein, 16 aa, Giardia lamblia
RARQNSAAGARSLSRQ

SEQ ID NO: 3132164 - protein, 8 aa, Giardia lamblia
RARQPVSE

SEQ ID NO: 3132165 - protein, 5 aa, Giardia lamblia
RARRA

SEQ ID NO: 3132166 - protein, 4 aa, Giardia lamblia
RART

SEQ ID NO: 3132167 - protein, 12 aa, Giardia lamblia
RARTENKQPRIA

SEQ ID NO: 3132168 - protein, 13 aa, Giardia lamblia
RARTTGPSADNYI

SEQ ID NO: 3132169 - protein, 9 aa, Giardia lamblia
RASALTPQA

SEQ ID NO: 3132170 - protein, 30 aa, Giardia lamblia
RASASYRNTDPEKQPWSGSSGLKTKAQPQA

SEQ ID NO: 3132171 - protein, 4 aa, Giardia lamblia
RASD

SEQ ID NO: 3132172 - protein, 6 aa, Giardia lamblia
RASDAV

SEQ ID NO: 3132173 - protein, 9 aa, Giardia lamblia
RASDDGTLS

SEQ ID NO: 3132174 - protein, 7 aa, Giardia lamblia
RASDELK

SEQ ID NO: 3132175 - protein, 7 aa, Giardia lamblia
RASDRSL

SEQ ID NO: 3132176 - protein, 27 aa, Giardia lamblia
RASEEDHQSAHAEGAVEENTRHPQYYG

SEQ ID NO: 3132177 - protein, 7 aa, Giardia lamblia
RASENEL

SEQ ID NO: 3132178 - protein, 9 aa, Giardia lamblia
RASERLTKN

SEQ ID NO: 3132179 - protein, 17 aa, Giardia lamblia
RASESLKTLTRSEADAI

SEQ ID NO: 3132180 - protein, 11 aa, Giardia lamblia
RASGAATGSCI

SEQ ID NO: 3132181 - protein, 8 aa, Giardia lamblia
RASGALTG

SEQ ID NO: 3132182 - protein, 14 aa, Giardia lamblia
RASGKKVRDDPARI

SEQ ID NO: 3132183 - protein, 10 aa, Giardia lamblia
RASGNMSKEQ

SEQ ID NO: 3132184 - protein, 5 aa, Giardia lamblia
RASGR

SEQ ID NO: 3132185 - protein, 11 aa, Giardia lamblia
RASGVSEETIS

SEQ ID NO: 3132186 - protein, 12 aa, Giardia lamblia
RASKRSKRQTRV

SEQ ID NO: 3132187 - protein, 13 aa, Giardia lamblia
RASLADDSSLRQT

SEQ ID NO: 3132188 - protein, 7 aa, Giardia lamblia
RASNGDF

SEQ ID NO: 3132189 - protein, 7 aa, Giardia lamblia
RASPEDR

SEQ ID NO: 3132190 - protein, 17 aa, Giardia lamblia
RASQKKRADASTTGQWT

SEQ ID NO: 3132191 - protein, 27 aa, Giardia lamblia
RASQSSSYGASTHSADLTSSRSPQRNF

SEQ ID NO: 3132192 - protein, 14 aa, Giardia lamblia
RASRQTQKDRHGKR

SEQ ID NO: 3132193 - protein, 7 aa, Giardia lamblia
RASRSGD

SEQ ID NO: 3132194 - protein, 34 aa, Giardia lamblia
RASRSKQEQPTDADKHVSDKGENSNDSDSEEGDS

SEQ ID NO: 3132195 - protein, 6 aa, Giardia lamblia
RASRTY

SEQ ID NO: 3132196 - protein, 21 aa, Giardia lamblia
RASSAGTGGKRRESDGSPTFP

SEQ ID NO: 3132197 - protein, 21 aa, Giardia lamblia
RASSEESTSSAQDSSGSVGSR

SEQ ID NO: 3132198 - protein, 21 aa, Giardia lamblia
RASSITAGNISDNLSSDSTFA

SEQ ID NO: 3132199 - protein, 43 aa, Giardia lamblia
RASSSASDTSTYGSESSYNSSYSDESDKYESSDTSTNDSCGRR

SEQ ID NO: 3132200 - protein, 10 aa, Giardia lamblia
RASSTSSVGK

SEQ ID NO: 3132201 - protein, 7 aa, Giardia lamblia
RASTDDY

SEQ ID NO: 3132202 - protein, 9 aa, Giardia lamblia
RASTDSAQL

SEQ ID NO: 3132203 - protein, 6 aa, Giardia lamblia
RASTGA

SEQ ID NO: 3132204 - protein, 7 aa, Giardia lamblia
RASTGLR

SEQ ID NO: 3132205 - protein, 9 aa, Giardia lamblia
RASTKASFP

SEQ ID NO: 3132206 - protein, 12 aa, Giardia lamblia
RASTNRASNYTH

SEQ ID NO: 3132207 - protein, 23 aa, Giardia lamblia
RASVPSNAMGATDELSNTTPPAV

SEQ ID NO: 3132208 - protein, 7 aa, Giardia lamblia
RASYGAG

SEQ ID NO: 3132209 - protein, 14 aa, Giardia lamblia
RATAGESKALDTPA

SEQ ID NO: 3132210 - protein, 5 aa, Giardia lamblia
RATAQ

SEQ ID NO: 3132211 - protein, 8 aa, Giardia lamblia
RATDINGN

SEQ ID NO: 3132212 - protein, 5 aa, Giardia lamblia
RATDK

SEQ ID NO: 3132213 - protein, 17 aa, Giardia lamblia
RATDKRRLRETPNDAEL

SEQ ID NO: 3132214 - protein, 6 aa, Giardia lamblia
RATDPI

SEQ ID NO: 3132215 - protein, 9 aa, Giardia lamblia
RATDTQRSK

SEQ ID NO: 3132216 - protein, 6 aa, Giardia lamblia
RATEEE

SEQ ID NO: 3132217 - protein, 6 aa, Giardia lamblia
RATEES

SEQ ID NO: 3132218 - protein, 6 aa, Giardia lamblia
RATEKQ

SEQ ID NO: 3132219 - protein, 22 aa, Giardia lamblia
RATENKSSDYEKRAKEAAEAAE

SEQ ID NO: 3132220 - protein, 9 aa, Giardia lamblia
RATESDNEH

SEQ ID NO: 3132221 - protein, 5 aa, Giardia lamblia
RATGK

SEQ ID NO: 3132222 - protein, 4 aa, Giardia lamblia
RATK

SEQ ID NO: 3132223 - protein, 9 aa, Giardia lamblia
RATKTNVTA

SEQ ID NO: 3132224 - protein, 5 aa, Giardia lamblia
RATLA

SEQ ID NO: 3132225 - protein, 11 aa, Giardia lamblia
RATNENISTET

SEQ ID NO: 3132226 - protein, 10 aa, Giardia lamblia
RATNLPPKEI

SEQ ID NO: 3132227 - protein, 4 aa, Giardia lamblia
RATP

SEQ ID NO: 3132228 - protein, 8 aa, Giardia lamblia
RATPQTTY

SEQ ID NO: 3132229 - protein, 5 aa, Giardia lamblia
RATPS

SEQ ID NO: 3132230 - protein, 8 aa, Giardia lamblia
RATQSRQE

SEQ ID NO: 3132231 - protein, 16 aa, Giardia lamblia
RATSRPAKSSLEASAN

SEQ ID NO: 3132232 - protein, 9 aa, Giardia lamblia
RATSSPSIV

SEQ ID NO: 3132233 - protein, 6 aa, Giardia lamblia
RATSTL

SEQ ID NO: 3132234 - protein, 6 aa, Giardia lamblia
RATTEH

SEQ ID NO: 3132235 - protein, 11 aa, Giardia lamblia
RAVDPNEYGES

SEQ ID NO: 3132236 - protein, 19 aa, Giardia lamblia
RAVEQEKQQKEREKEDPYQ

SEQ ID NO: 3132237 - protein, 15 aa, Giardia lamblia
RAVGSTDMNARSSRS

SEQ ID NO: 3132238 - protein, 11 aa, Giardia lamblia
RAVPGSKTPTI

SEQ ID NO: 3132239 - protein, 8 aa, Giardia lamblia
RAVPTGRP

SEQ ID NO: 3132240 - protein, 6 aa, Giardia lamblia
RAVSET

SEQ ID NO: 3132241 - protein, 14 aa, Giardia lamblia
RAVSTSAVAQDNGL

SEQ ID NO: 3132242 - protein, 10 aa, Giardia lamblia
RAWEEERTRL

SEQ ID NO: 3132243 - protein, 30 aa, Giardia lamblia
RAWKENPASANSVTRAGTNSSLSDSGTPDY

SEQ ID NO: 3132244 - protein, 6 aa, Giardia lamblia
RAWTDP

SEQ ID NO: 3132245 - protein, 6 aa, Giardia lamblia
RAYDEK

SEQ ID NO: 3132246 - protein, 55 aa, Giardia lamblia
RAYDTRRALQDRSSNRYDSRNDDGYGGRRRDDYHRDEDRYGSDRYAGRHSSGNRR

SEQ ID NO: 3132247 - protein, 6 aa, Giardia lamblia
RAYRDT

SEQ ID NO: 3132248 - protein, 7 aa, Giardia lamblia
RAYRRGP

SEQ ID NO: 3132249 - protein, 19 aa, Giardia lamblia
RCAKTDNGSHRSIKPTALK

SEQ ID NO: 3132250 - protein, 6 aa, Giardia lamblia
RCASPS

SEQ ID NO: 3132251 - protein, 5 aa, Giardia lamblia
RCEDA

SEQ ID NO: 3132252 - protein, 7 aa, Giardia lamblia
RCGETST

SEQ ID NO: 3132253 - protein, 9 aa, Giardia lamblia
RCGTSQYAA

SEQ ID NO: 3132254 - protein, 10 aa, Giardia lamblia
RCKRDREGKT

SEQ ID NO: 3132255 - protein, 17 aa, Giardia lamblia
RCNSHSDHNFGSSTKDN

SEQ ID NO: 3132256 - protein, 9 aa, Giardia lamblia
RCRGRQSED

SEQ ID NO: 3132257 - protein, 4 aa, Giardia lamblia
RCRN

SEQ ID NO: 3132258 - protein, 11 aa, Giardia lamblia
RCSSMDSGSSH

SEQ ID NO: 3132259 - protein, 7 aa, Giardia lamblia
RCSTGST

SEQ ID NO: 3132260 - protein, 11 aa, Giardia lamblia
RCSVTSPTRWG

SEQ ID NO: 3132261 - protein, 9 aa, Giardia lamblia
RCTKPDGTS

SEQ ID NO: 3132262 - protein, 7 aa, Giardia lamblia
RCTRGRG

SEQ ID NO: 3132263 - protein, 29 aa, Giardia lamblia
RCTTPVRSSSLSKSHQAEEPVEEPPRRPA

SEQ ID NO: 3132264 - protein, 11 aa, Giardia lamblia
RDAAQEKAANT

SEQ ID NO: 3132265 - protein, 18 aa, Giardia lamblia
RDAARSSHRSSGASYGTM

SEQ ID NO: 3132266 - protein, 12 aa, Giardia lamblia
RDAATELSPEPQ

SEQ ID NO: 3132267 - protein, 7 aa, Giardia lamblia
RDADGTT

SEQ ID NO: 3132268 - protein, 8 aa, Giardia lamblia
RDADRAKK

SEQ ID NO: 3132269 - protein, 5 aa, Giardia lamblia
RDAEA

SEQ ID NO: 3132270 - protein, 7 aa, Giardia lamblia
RDAEHAS

SEQ ID NO: 3132271 - protein, 9 aa, Giardia lamblia
RDAEKERVK

SEQ ID NO: 3132272 - protein, 19 aa, Giardia lamblia
RDAESIENVEAEESTLKTK

SEQ ID NO: 3132273 - protein, 8 aa, Giardia lamblia
RDAESLQK

SEQ ID NO: 3132274 - protein, 6 aa, Giardia lamblia
RDAEVQ

SEQ ID NO: 3132275 - protein, 8 aa, Giardia lamblia
RDAGCTDE

SEQ ID NO: 3132276 - protein, 6 aa, Giardia lamblia
RDAGGA

SEQ ID NO: 3132277 - protein, 6 aa, Giardia lamblia
RDAGLR

SEQ ID NO: 3132278 - protein, 6 aa, Giardia lamblia
RDAGPV

SEQ ID NO: 3132279 - protein, 7 aa, Giardia lamblia
RDAKGND

SEQ ID NO: 3132280 - protein, 8 aa, Giardia lamblia
RDAKRANL

SEQ ID NO: 3132281 - protein, 5 aa, Giardia lamblia
RDALG

SEQ ID NO: 3132282 - protein, 5 aa, Giardia lamblia
RDALP

SEQ ID NO: 3132283 - protein, 5 aa, Giardia lamblia
RDANG

SEQ ID NO: 3132284 - protein, 7 aa, Giardia lamblia
RDAPISK

SEQ ID NO: 3132285 - protein, 17 aa, Giardia lamblia
RDAPYSMKTQSAQEQSW

SEQ ID NO: 3132286 - protein, 14 aa, Giardia lamblia
RDAREAGKVATGKL

SEQ ID NO: 3132287 - protein, 8 aa, Giardia lamblia
RDARGNTE

SEQ ID NO: 3132288 - protein, 9 aa, Giardia lamblia
RDARNKKTS

SEQ ID NO: 3132289 - protein, 14 aa, Giardia lamblia
RDASDKGVQTDTRL

SEQ ID NO: 3132290 - protein, 16 aa, Giardia lamblia
RDASELKGKSAEQTQH

SEQ ID NO: 3132291 - protein, 10 aa, Giardia lamblia
RDASTGEEKP

SEQ ID NO: 3132292 - protein, 7 aa, Giardia lamblia
RDATDTT

SEQ ID NO: 3132293 - protein, 6 aa, Giardia lamblia
RDATID

SEQ ID NO: 3132294 - protein, 8 aa, Giardia lamblia
RDATLQSA

SEQ ID NO: 3132295 - protein, 5 aa, Giardia lamblia
RDAVG

SEQ ID NO: 3132296 - protein, 5 aa, Giardia lamblia
RDCDG

SEQ ID NO: 3132297 - protein, 9 aa, Giardia lamblia
RDDDSAQVK

SEQ ID NO: 3132298 - protein, 17 aa, Giardia lamblia
RDDDSFDDYGDVTEKRS

SEQ ID NO: 3132299 - protein, 8 aa, Giardia lamblia
RDDDSTVK

SEQ ID NO: 3132300 - protein, 6 aa, Giardia lamblia
RDDDVG

SEQ ID NO: 3132301 - protein, 6 aa, Giardia lamblia
RDDEIQ

SEQ ID NO: 3132302 - protein, 6 aa, Giardia lamblia
RDDEKI

SEQ ID NO: 3132303 - protein, 7 aa, Giardia lamblia
RDDGEPP

SEQ ID NO: 3132304 - protein, 5 aa, Giardia lamblia
RDDGL

SEQ ID NO: 3132305 - protein, 21 aa, Giardia lamblia
RDDGSANVASDGGVAEDPGVS

SEQ ID NO: 3132306 - protein, 6 aa, Giardia lamblia
RDDHST

SEQ ID NO: 3132307 - protein, 10 aa, Giardia lamblia
RDDKNYDRTI

SEQ ID NO: 3132308 - protein, 5 aa, Giardia lamblia
RDDLN

SEQ ID NO: 3132309 - protein, 8 aa, Giardia lamblia
RDDPTADR

SEQ ID NO: 3132310 - protein, 5 aa, Giardia lamblia
RDDQI

SEQ ID NO: 3132311 - protein, 4 aa, Giardia lamblia
RDDT

SEQ ID NO: 3132312 - protein, 8 aa, Giardia lamblia
RDDTDEPL

SEQ ID NO: 3132313 - protein, 7 aa, Giardia lamblia
RDDTVET

SEQ ID NO: 3132314 - protein, 4 aa, Giardia lamblia
RDDY

SEQ ID NO: 3132315 - protein, 6 aa, Giardia lamblia
RDDYEE

SEQ ID NO: 3132316 - protein, 6 aa, Giardia lamblia
RDDYKQ

SEQ ID NO: 3132317 - protein, 6 aa, Giardia lamblia
RDEASA

SEQ ID NO: 3132318 - protein, 4 aa, Giardia lamblia
RDEC

SEQ ID NO: 3132319 - protein, 9 aa, Giardia lamblia
RDEDGRRTR

SEQ ID NO: 3132320 - protein, 12 aa, Giardia lamblia
RDEEDVTEKEGV

SEQ ID NO: 3132321 - protein, 6 aa, Giardia lamblia
RDEENA

SEQ ID NO: 3132322 - protein, 5 aa, Giardia lamblia
RDEGP

SEQ ID NO: 3132323 - protein, 5 aa, Giardia lamblia
RDEHG

SEQ ID NO: 3132324 - protein, 6 aa, Giardia lamblia
RDEIPE

SEQ ID NO: 3132325 - protein, 8 aa, Giardia lamblia
RDEKGTVS

SEQ ID NO: 3132326 - protein, 9 aa, Giardia lamblia
RDEKKSEWA

SEQ ID NO: 3132327 - protein, 7 aa, Giardia lamblia
RDELERR

SEQ ID NO: 3132328 - protein, 7 aa, Giardia lamblia
RDELTKE

SEQ ID NO: 3132329 - protein, 6 aa, Giardia lamblia
RDENDE

SEQ ID NO: 3132330 - protein, 7 aa, Giardia lamblia
RDENDEL

SEQ ID NO: 3132331 - protein, 8 aa, Giardia lamblia
RDENGNTG

SEQ ID NO: 3132332 - protein, 7 aa, Giardia lamblia
RDENGRT

SEQ ID NO: 3132333 - protein, 10 aa, Giardia lamblia
RDEPLEPQER

SEQ ID NO: 3132334 - protein, 4 aa, Giardia lamblia
RDER

SEQ ID NO: 3132335 - protein, 5 aa, Giardia lamblia
RDERE

SEQ ID NO: 3132336 - protein, 6 aa, Giardia lamblia
RDEREE

SEQ ID NO: 3132337 - protein, 10 aa, Giardia lamblia
RDESDSSYIA

SEQ ID NO: 3132338 - protein, 11 aa, Giardia lamblia
RDESGDRTSPM

SEQ ID NO: 3132339 - protein, 35 aa, Giardia lamblia
RDESRSYEEEFPESRSKSRSRSKNKSRMGRASSRS

SEQ ID NO: 3132340 - protein, 5 aa, Giardia lamblia
RDETI

SEQ ID NO: 3132341 - protein, 10 aa, Giardia lamblia
RDEVTAEQEL

SEQ ID NO: 3132342 - protein, 7 aa, Giardia lamblia
RDEVTGA

SEQ ID NO: 3132343 - protein, 4 aa, Giardia lamblia
RDGA

SEQ ID NO: 3132344 - protein, 6 aa, Giardia lamblia
RDGADK

SEQ ID NO: 3132345 - protein, 10 aa, Giardia lamblia
RDGASRNRDN

SEQ ID NO: 3132346 - protein, 10 aa, Giardia lamblia
RDGDMSDDPS

SEQ ID NO: 3132347 - protein, 27 aa, Giardia lamblia
RDGDNTEVQANDRRSTHDSSSSSIDKT

SEQ ID NO: 3132348 - protein, 5 aa, Giardia lamblia
RDGDT

SEQ ID NO: 3132349 - protein, 25 aa, Giardia lamblia
RDGEKVSSTKIREEESMSDSFADRA

SEQ ID NO: 3132350 - protein, 4 aa, Giardia lamblia
RDGF

SEQ ID NO: 3132351 - protein, 11 aa, Giardia lamblia
RDGGAGGVSQK

SEQ ID NO: 3132352 - protein, 28 aa, Giardia lamblia
RDGGNPSRDRQGPRPGSGVTRNRFSHGR

SEQ ID NO: 3132353 - protein, 7 aa, Giardia lamblia
RDGGSPC

SEQ ID NO: 3132354 - protein, 9 aa, Giardia lamblia
RDGKPELRR

SEQ ID NO: 3132355 - protein, 13 aa, Giardia lamblia
RDGKRVPSSTQSL

SEQ ID NO: 3132356 - protein, 4 aa, Giardia lamblia
RDGL

SEQ ID NO: 3132357 - protein, 6 aa, Giardia lamblia
RDGNTN

SEQ ID NO: 3132358 - protein, 14 aa, Giardia lamblia
RDGPDSSPGATNDT

SEQ ID NO: 3132359 - protein, 13 aa, Giardia lamblia
RDGPVNATCPAAS

SEQ ID NO: 3132360 - protein, 13 aa, Giardia lamblia
RDGQDSEKERGER

SEQ ID NO: 3132361 - protein, 11 aa, Giardia lamblia
RDGRNTGDEYP

SEQ ID NO: 3132362 - protein, 7 aa, Giardia lamblia
RDGSARV

SEQ ID NO: 3132363 - protein, 9 aa, Giardia lamblia
RDGSEAPVD

SEQ ID NO: 3132364 - protein, 6 aa, Giardia lamblia
RDGYGR

SEQ ID NO: 3132365 - protein, 7 aa, Giardia lamblia
RDHAPSV

SEQ ID NO: 3132366 - protein, 4 aa, Giardia lamblia
RDHE

SEQ ID NO: 3132367 - protein, 8 aa, Giardia lamblia
RDHEGNTP

SEQ ID NO: 3132368 - protein, 6 aa, Giardia lamblia
RDHEGR

SEQ ID NO: 3132369 - protein, 5 aa, Giardia lamblia
RDHNG

SEQ ID NO: 3132370 - protein, 6 aa, Giardia lamblia
RDHSTG

SEQ ID NO: 3132371 - protein, 4 aa, Giardia lamblia
RDIA

SEQ ID NO: 3132372 - protein, 11 aa, Giardia lamblia
RDIKDKYDKTA

SEQ ID NO: 3132373 - protein, 11 aa, Giardia lamblia
RDIKTRDGRKA

SEQ ID NO: 3132374 - protein, 28 aa, Giardia lamblia
RDIQSLRDSESKEERGLVGKSSNATSAV

SEQ ID NO: 3132375 - protein, 21 aa, Giardia lamblia
RDISKNAKQAEQDRLQAERNA

SEQ ID NO: 3132376 - protein, 12 aa, Giardia lamblia
RDISKTNNEYSK

SEQ ID NO: 3132377 - protein, 18 aa, Giardia lamblia
RDISNDQELDSTFKPGRT

SEQ ID NO: 3132378 - protein, 7 aa, Giardia lamblia
RDISPQT

SEQ ID NO: 3132379 - protein, 20 aa, Giardia lamblia
RDITAEDSAFTEPRPGMKRS

SEQ ID NO: 3132380 - protein, 7 aa, Giardia lamblia
RDITSRK

SEQ ID NO: 3132381 - protein, 8 aa, Giardia lamblia
RDKDGKTA

SEQ ID NO: 3132382 - protein, 10 aa, Giardia lamblia
RDKDGVGAQN

SEQ ID NO: 3132383 - protein, 16 aa, Giardia lamblia
RDKDPSAFRGKGVEQA

SEQ ID NO: 3132384 - protein, 6 aa, Giardia lamblia
RDKEID

SEQ ID NO: 3132385 - protein, 7 aa, Giardia lamblia
RDKHGKT

SEQ ID NO: 3132386 - protein, 7 aa, Giardia lamblia
RDKIDSA

SEQ ID NO: 3132387 - protein, 5 aa, Giardia lamblia
RDKKY

SEQ ID NO: 3132388 - protein, 5 aa, Giardia lamblia
RDKLK

SEQ ID NO: 3132389 - protein, 8 aa, Giardia lamblia
RDKNDEHR

SEQ ID NO: 3132390 - protein, 13 aa, Giardia lamblia
RDKPTRQGATTAL

SEQ ID NO: 3132391 - protein, 8 aa, Giardia lamblia
RDKRGKTA

SEQ ID NO: 3132392 - protein, 10 aa, Giardia lamblia
RDKRYPKGAV

SEQ ID NO: 3132393 - protein, 16 aa, Giardia lamblia
RDKSDNKSNNSSLIIK

SEQ ID NO: 3132394 - protein, 6 aa, Giardia lamblia
RDKSTH

SEQ ID NO: 3132395 - protein, 5 aa, Giardia lamblia
RDKTS

SEQ ID NO: 3132396 - protein, 7 aa, Giardia lamblia
RDKYGNT

SEQ ID NO: 3132397 - protein, 4 aa, Giardia lamblia
RDLA

SEQ ID NO: 3132398 - protein, 7 aa, Giardia lamblia
RDLEDKC

SEQ ID NO: 3132399 - protein, 6 aa, Giardia lamblia
RDLEEE

SEQ ID NO: 3132400 - protein, 7 aa, Giardia lamblia
RDLGTSS

SEQ ID NO: 3132401 - protein, 7 aa, Giardia lamblia
RDLKEGK

SEQ ID NO: 3132402 - protein, 6 aa, Giardia lamblia
RDLPPS

SEQ ID NO: 3132403 - protein, 9 aa, Giardia lamblia
RDLSGRTSL

SEQ ID NO: 3132404 - protein, 27 aa, Giardia lamblia
RDLTDGLPRTGKGPSQASTKAAHPADR

SEQ ID NO: 3132405 - protein, 15 aa, Giardia lamblia
RDNDLSDDLADESIS

SEQ ID NO: 3132406 - protein, 30 aa, Giardia lamblia
RDNDSSDDEGGKGPKNSANGDKKKNNGQLR

SEQ ID NO: 3132407 - protein, 8 aa, Giardia lamblia
RDNEGRSA

SEQ ID NO: 3132408 - protein, 13 aa, Giardia lamblia
RDNIDNSQITTTS

SEQ ID NO: 3132409 - protein, 6 aa, Giardia lamblia
RDNKGA

SEQ ID NO: 3132410 - protein, 18 aa, Giardia lamblia
RDNKKQSALDYARASKDI

SEQ ID NO: 3132411 - protein, 5 aa, Giardia lamblia
RDNNG

SEQ ID NO: 3132412 - protein, 5 aa, Giardia lamblia
RDNNS

SEQ ID NO: 3132413 - protein, 8 aa, Giardia lamblia
RDNRGNTQ

SEQ ID NO: 3132414 - protein, 14 aa, Giardia lamblia
RDNSGALSASELPN

SEQ ID NO: 3132415 - protein, 11 aa, Giardia lamblia
RDNSSQVQTPQ

SEQ ID NO: 3132416 - protein, 6 aa, Giardia lamblia
RDNSYT

SEQ ID NO: 3132417 - protein, 7 aa, Giardia lamblia
RDNTLDE

SEQ ID NO: 3132418 - protein, 19 aa, Giardia lamblia
RDNVDDVRNSRKAAKDELA

SEQ ID NO: 3132419 - protein, 4 aa, Giardia lamblia
RDNY

SEQ ID NO: 3132420 - protein, 12 aa, Giardia lamblia
RDPASPSLVPKG

SEQ ID NO: 3132421 - protein, 4 aa, Giardia lamblia
RDPD

SEQ ID NO: 3132422 - protein, 4 aa, Giardia lamblia
RDPE

SEQ ID NO: 3132423 - protein, 8 aa, Giardia lamblia
RDPEGTRS

SEQ ID NO: 3132424 - protein, 9 aa, Giardia lamblia
RDPENLRPR

SEQ ID NO: 3132425 - protein, 5 aa, Giardia lamblia
RDPET

SEQ ID NO: 3132426 - protein, 25 aa, Giardia lamblia
RDPFSGQASVPSQHQTNPASSVAPI

SEQ ID NO: 3132427 - protein, 10 aa, Giardia lamblia
RDPGPRPKLD

SEQ ID NO: 3132428 - protein, 5 aa, Giardia lamblia
RDPHA

SEQ ID NO: 3132429 - protein, 6 aa, Giardia lamblia
RDPIPG

SEQ ID NO: 3132430 - protein, 9 aa, Giardia lamblia
RDPKGTRCP

SEQ ID NO: 3132431 - protein, 7 aa, Giardia lamblia
RDPKTDL

SEQ ID NO: 3132432 - protein, 21 aa, Giardia lamblia
RDPLSADAEEKVHELLKYVTE

SEQ ID NO: 3132433 - protein, 7 aa, Giardia lamblia
RDPNSKV

SEQ ID NO: 3132434 - protein, 10 aa, Giardia lamblia
RDPPKSRDNL

SEQ ID NO: 3132435 - protein, 9 aa, Giardia lamblia
RDPPPSFPA

SEQ ID NO: 3132436 - protein, 18 aa, Giardia lamblia
RDPPRKVRTIKDEDDKDL

SEQ ID NO: 3132437 - protein, 7 aa, Giardia lamblia
RDPRGNN

SEQ ID NO: 3132438 - protein, 4 aa, Giardia lamblia
RDPS

SEQ ID NO: 3132439 - protein, 5 aa, Giardia lamblia
RDPSL

SEQ ID NO: 3132440 - protein, 10 aa, Giardia lamblia
RDPSLTAEQK

SEQ ID NO: 3132441 - protein, 7 aa, Giardia lamblia
RDPSQPI

SEQ ID NO: 3132442 - protein, 9 aa, Giardia lamblia
RDPSRSLNP

SEQ ID NO: 3132443 - protein, 10 aa, Giardia lamblia
RDPTNYAEEV

SEQ ID NO: 3132444 - protein, 5 aa, Giardia lamblia
RDPTW

SEQ ID NO: 3132445 - protein, 46 aa, Giardia lamblia
RDQDNPTDGAAYGDEKSKSRGRSRSRSRSRSRGKGQTSHSNRRDTF

SEQ ID NO: 3132446 - protein, 4 aa, Giardia lamblia
RDQE

SEQ ID NO: 3132447 - protein, 18 aa, Giardia lamblia
RDQFTSQTGRSAPELEEE

SEQ ID NO: 3132448 - protein, 10 aa, Giardia lamblia
RDQKEAAANY

SEQ ID NO: 3132449 - protein, 5 aa, Giardia lamblia
RDQKN

SEQ ID NO: 3132450 - protein, 13 aa, Giardia lamblia
RDQLSQKNSEIAK

SEQ ID NO: 3132451 - protein, 4 aa, Giardia lamblia
RDQN

SEQ ID NO: 3132452 - protein, 14 aa, Giardia lamblia
RDQPPGSRSTTTLS

SEQ ID NO: 3132453 - protein, 4 aa, Giardia lamblia
RDQR

SEQ ID NO: 3132454 - protein, 6 aa, Giardia lamblia
RDQSPL

SEQ ID NO: 3132455 - protein, 8 aa, Giardia lamblia
RDQSYTLG

SEQ ID NO: 3132456 - protein, 10 aa, Giardia lamblia
RDRDSGRASI

SEQ ID NO: 3132457 - protein, 6 aa, Giardia lamblia
RDREIE

SEQ ID NO: 3132458 - protein, 7 aa, Giardia lamblia
RDRESRR

SEQ ID NO: 3132459 - protein, 10 aa, Giardia lamblia
RDRGPGHDSE

SEQ ID NO: 3132460 - protein, 4 aa, Giardia lamblia
RDRL

SEQ ID NO: 3132461 - protein, 4 aa, Giardia lamblia
RDRM

SEQ ID NO: 3132462 - protein, 8 aa, Giardia lamblia
RDRNGYSA

SEQ ID NO: 3132463 - protein, 7 aa, Giardia lamblia
RDRNGYT

SEQ ID NO: 3132464 - protein, 15 aa, Giardia lamblia
RDRNNKSKRGDPKAA

SEQ ID NO: 3132465 - protein, 7 aa, Giardia lamblia
RDRPSAV

SEQ ID NO: 3132466 - protein, 6 aa, Giardia lamblia
RDRQIK

SEQ ID NO: 3132467 - protein, 9 aa, Giardia lamblia
RDRQQKVAG

SEQ ID NO: 3132468 - protein, 9 aa, Giardia lamblia
RDRSDAVEK

SEQ ID NO: 3132469 - protein, 7 aa, Giardia lamblia
RDRTNSV

SEQ ID NO: 3132470 - protein, 13 aa, Giardia lamblia
RDSATLDSKLESR

SEQ ID NO: 3132471 - protein, 11 aa, Giardia lamblia
RDSDRTTPQDQ

SEQ ID NO: 3132472 - protein, 35 aa, Giardia lamblia
RDSDWDSAGDSDEDGGVVKSESQPRIPRPNTTENQ

SEQ ID NO: 3132473 - protein, 5 aa, Giardia lamblia
RDSDY

SEQ ID NO: 3132474 - protein, 11 aa, Giardia lamblia
RDSEADENAFK

SEQ ID NO: 3132475 - protein, 11 aa, Giardia lamblia
RDSEDETSRKR

SEQ ID NO: 3132476 - protein, 11 aa, Giardia lamblia
RDSETKGSRTA

SEQ ID NO: 3132477 - protein, 4 aa, Giardia lamblia
RDSF

SEQ ID NO: 3132478 - protein, 7 aa, Giardia lamblia
RDSGGRT

SEQ ID NO: 3132479 - protein, 11 aa, Giardia lamblia
RDSGKSDSNGV

SEQ ID NO: 3132480 - protein, 26 aa, Giardia lamblia
RDSGPVVQQKNGTSISKAKANKTIDY

SEQ ID NO: 3132481 - protein, 10 aa, Giardia lamblia
RDSGSNGSIQ

SEQ ID NO: 3132482 - protein, 7 aa, Giardia lamblia
RDSHNRT

SEQ ID NO: 3132483 - protein, 5 aa, Giardia lamblia
RDSID

SEQ ID NO: 3132484 - protein, 10 aa, Giardia lamblia
RDSITGNPVT

SEQ ID NO: 3132485 - protein, 8 aa, Giardia lamblia
RDSKGRTA

SEQ ID NO: 3132486 - protein, 7 aa, Giardia lamblia
RDSLERE

SEQ ID NO: 3132487 - protein, 5 aa, Giardia lamblia
RDSNG

SEQ ID NO: 3132488 - protein, 9 aa, Giardia lamblia
RDSPARGKT

SEQ ID NO: 3132489 - protein, 7 aa, Giardia lamblia
RDSRDRT

SEQ ID NO: 3132490 - protein, 7 aa, Giardia lamblia
RDSRMES

SEQ ID NO: 3132491 - protein, 8 aa, Giardia lamblia
RDSSLSPL

SEQ ID NO: 3132492 - protein, 15 aa, Giardia lamblia
RDSSNRLRQRRGFNT

SEQ ID NO: 3132493 - protein, 21 aa, Giardia lamblia
RDSSTSTKTLSQSPSVEMKPS

SEQ ID NO: 3132494 - protein, 8 aa, Giardia lamblia
RDSTQLDQ

SEQ ID NO: 3132495 - protein, 11 aa, Giardia lamblia
RDSTSGIDAST

SEQ ID NO: 3132496 - protein, 6 aa, Giardia lamblia
RDSTTI

SEQ ID NO: 3132497 - protein, 5 aa, Giardia lamblia
RDSVT

SEQ ID NO: 3132498 - protein, 5 aa, Giardia lamblia
RDSYG

SEQ ID NO: 3132499 - protein, 9 aa, Giardia lamblia
RDTADESNM

SEQ ID NO: 3132500 - protein, 6 aa, Giardia lamblia
RDTETC

SEQ ID NO: 3132501 - protein, 13 aa, Giardia lamblia
RDTGSAKDREIDT

SEQ ID NO: 3132502 - protein, 4 aa, Giardia lamblia
RDTH

SEQ ID NO: 3132503 - protein, 7 aa, Giardia lamblia
RDTHTAM

SEQ ID NO: 3132504 - protein, 4 aa, Giardia lamblia
RDTI

SEQ ID NO: 3132505 - protein, 13 aa, Giardia lamblia
RDTKTVPLPTGAG

SEQ ID NO: 3132506 - protein, 9 aa, Giardia lamblia
RDTLGSQTD

SEQ ID NO: 3132507 - protein, 5 aa, Giardia lamblia
RDTLN

SEQ ID NO: 3132508 - protein, 6 aa, Giardia lamblia
RDTNAT

SEQ ID NO: 3132509 - protein, 6 aa, Giardia lamblia
RDTNRR

SEQ ID NO: 3132510 - protein, 6 aa, Giardia lamblia
RDTPEQ

SEQ ID NO: 3132511 - protein, 7 aa, Giardia lamblia
RDTPGSL

SEQ ID NO: 3132512 - protein, 6 aa, Giardia lamblia
RDTPLV

SEQ ID NO: 3132513 - protein, 4 aa, Giardia lamblia
RDTR

SEQ ID NO: 3132514 - protein, 7 aa, Giardia lamblia
RDTSATE

SEQ ID NO: 3132515 - protein, 11 aa, Giardia lamblia
RDTSGASSLPA

SEQ ID NO: 3132516 - protein, 7 aa, Giardia lamblia
RDTSGRT

SEQ ID NO: 3132517 - protein, 5 aa, Giardia lamblia
RDTSY

SEQ ID NO: 3132518 - protein, 9 aa, Giardia lamblia
RDTTNKSEY

SEQ ID NO: 3132519 - protein, 8 aa, Giardia lamblia
RDTTPHEG

SEQ ID NO: 3132520 - protein, 6 aa, Giardia lamblia
RDTTPT

SEQ ID NO: 3132521 - protein, 7 aa, Giardia lamblia
RDTTRSD

SEQ ID NO: 3132522 - protein, 6 aa, Giardia lamblia
RDTYGT

SEQ ID NO: 3132523 - protein, 5 aa, Giardia lamblia
RDVDE

SEQ ID NO: 3132524 - protein, 13 aa, Giardia lamblia
RDVQQAADIQDRG

SEQ ID NO: 3132525 - protein, 7 aa, Giardia lamblia
RDWRSGR

SEQ ID NO: 3132526 - protein, 6 aa, Giardia lamblia
RDYAKP

SEQ ID NO: 3132527 - protein, 13 aa, Giardia lamblia
RDYASSDGKGGTL

SEQ ID NO: 3132528 - protein, 57 aa, Giardia lamblia
RDYDDGPGYGRRDDRGGRGGYGGGRRRDDRRGYGGGRGGYGGRGSYDDRAGNPGDLH

SEQ ID NO: 3132529 - protein, 4 aa, Giardia lamblia
RDYG

SEQ ID NO: 3132530 - protein, 7 aa, Giardia lamblia
RDYPEPA

SEQ ID NO: 3132531 - protein, 6 aa, Giardia lamblia
RDYQTE

SEQ ID NO: 3132532 - protein, 6 aa, Giardia lamblia
RDYRGT

SEQ ID NO: 3132533 - protein, 7 aa, Giardia lamblia
RDYRSSE

SEQ ID NO: 3132534 - protein, 7 aa, Giardia lamblia
RDYTGDT

SEQ ID NO: 3132535 - protein, 6 aa, Giardia lamblia
READIR

SEQ ID NO: 3132536 - protein, 16 aa, Giardia lamblia
READSNLRKNDSGAYT

SEQ ID NO: 3132537 - protein, 8 aa, Giardia lamblia
READSPHA

SEQ ID NO: 3132538 - protein, 11 aa, Giardia lamblia
REAEAPNMGTP

SEQ ID NO: 3132539 - protein, 9 aa, Giardia lamblia
REAEEESNG

SEQ ID NO: 3132540 - protein, 5 aa, Giardia lamblia
REAEQ

SEQ ID NO: 3132541 - protein, 7 aa, Giardia lamblia
REAESKL

SEQ ID NO: 3132542 - protein, 5 aa, Giardia lamblia
REAGI

SEQ ID NO: 3132543 - protein, 6 aa, Giardia lamblia
REAGLD

SEQ ID NO: 3132544 - protein, 11 aa, Giardia lamblia
REAGMRSKSGE

SEQ ID NO: 3132545 - protein, 5 aa, Giardia lamblia
REAGN

SEQ ID NO: 3132546 - protein, 8 aa, Giardia lamblia
REAGSKEV

SEQ ID NO: 3132547 - protein, 10 aa, Giardia lamblia
REAGSRRRDG

SEQ ID NO: 3132548 - protein, 11 aa, Giardia lamblia
REAGTNGSLTN

SEQ ID NO: 3132549 - protein, 11 aa, Giardia lamblia
REAHGDSIPNY

SEQ ID NO: 3132550 - protein, 5 aa, Giardia lamblia
REAIE

SEQ ID NO: 3132551 - protein, 11 aa, Giardia lamblia
REAKRRKEISE

SEQ ID NO: 3132552 - protein, 11 aa, Giardia lamblia
REALDKDQHTA

SEQ ID NO: 3132553 - protein, 23 aa, Giardia lamblia
REANPDRYVGTNNTVDPSHSQIE

SEQ ID NO: 3132554 - protein, 8 aa, Giardia lamblia
REANPQLL

SEQ ID NO: 3132555 - protein, 9 aa, Giardia lamblia
REAQDENGF

SEQ ID NO: 3132556 - protein, 25 aa, Giardia lamblia
REAREATNPIVSESNQQEVKKDDFP

SEQ ID NO: 3132557 - protein, 18 aa, Giardia lamblia
REARSSVEKANQPESPNI

SEQ ID NO: 3132558 - protein, 4 aa, Giardia lamblia
REAS

SEQ ID NO: 3132559 - protein, 25 aa, Giardia lamblia
REASARSDKRCTHQESTKGQQPNDC

SEQ ID NO: 3132560 - protein, 13 aa, Giardia lamblia
REASQKSISSPLP

SEQ ID NO: 3132561 - protein, 11 aa, Giardia lamblia
REASSISSFTS

SEQ ID NO: 3132562 - protein, 38 aa, Giardia lamblia
REATTAGSYVPRQSALPSVPKQEDLAREYEERKQARIT

SEQ ID NO: 3132563 - protein, 7 aa, Giardia lamblia
REAVPAP

SEQ ID NO: 3132564 - protein, 18 aa, Giardia lamblia
RECTREAREKRTKQQEYA

SEQ ID NO: 3132565 - protein, 4 aa, Giardia lamblia
REDA

SEQ ID NO: 3132566 - protein, 13 aa, Giardia lamblia
REDAEGGSDDSDL

SEQ ID NO: 3132567 - protein, 15 aa, Giardia lamblia
REDEGASDISNTSTN

SEQ ID NO: 3132568 - protein, 6 aa, Giardia lamblia
REDGEY

SEQ ID NO: 3132569 - protein, 5 aa, Giardia lamblia
REDGH

SEQ ID NO: 3132570 - protein, 11 aa, Giardia lamblia
REDHSDRDGDL

SEQ ID NO: 3132571 - protein, 4 aa, Giardia lamblia
REDI

SEQ ID NO: 3132572 - protein, 6 aa, Giardia lamblia
REDKSR

SEQ ID NO: 3132573 - protein, 5 aa, Giardia lamblia
REDNL

SEQ ID NO: 3132574 - protein, 9 aa, Giardia lamblia
REDPGDNLE

SEQ ID NO: 3132575 - protein, 9 aa, Giardia lamblia
REDPGQLRG

SEQ ID NO: 3132576 - protein, 4 aa, Giardia lamblia
REDQ

SEQ ID NO: 3132577 - protein, 17 aa, Giardia lamblia
REDRDKEGSELTTTPNY

SEQ ID NO: 3132578 - protein, 10 aa, Giardia lamblia
REDRGSVEND

SEQ ID NO: 3132579 - protein, 8 aa, Giardia lamblia
REDRRQLA

SEQ ID NO: 3132580 - protein, 12 aa, Giardia lamblia
REDVAKKELTEA

SEQ ID NO: 3132581 - protein, 17 aa, Giardia lamblia
REDVLDPEAGLGSPTGY

SEQ ID NO: 3132582 - protein, 7 aa, Giardia lamblia
REEADRM

SEQ ID NO: 3132583 - protein, 7 aa, Giardia lamblia
REEAGGA

SEQ ID NO: 3132584 - protein, 7 aa, Giardia lamblia
REEARTE

SEQ ID NO: 3132585 - protein, 16 aa, Giardia lamblia
REEASTKDDKDGITRA

SEQ ID NO: 3132586 - protein, 7 aa, Giardia lamblia
REEAYND

SEQ ID NO: 3132587 - protein, 4 aa, Giardia lamblia
REEC

SEQ ID NO: 3132588 - protein, 4 aa, Giardia lamblia
REEE

SEQ ID NO: 3132589 - protein, 9 aa, Giardia lamblia
REEEEETEC

SEQ ID NO: 3132590 - protein, 6 aa, Giardia lamblia
REEEQT

SEQ ID NO: 3132591 - protein, 5 aa, Giardia lamblia
REEEV

SEQ ID NO: 3132592 - protein, 15 aa, Giardia lamblia
REEGTSDIYSSAGTT

SEQ ID NO: 3132593 - protein, 6 aa, Giardia lamblia
REEGVR

SEQ ID NO: 3132594 - protein, 13 aa, Giardia lamblia
REEIPKSHGDVRD

SEQ ID NO: 3132595 - protein, 9 aa, Giardia lamblia
REEKEETAQ

SEQ ID NO: 3132596 - protein, 6 aa, Giardia lamblia
REEKSR

SEQ ID NO: 3132597 - protein, 4 aa, Giardia lamblia
REEL

SEQ ID NO: 3132598 - protein, 7 aa, Giardia lamblia
REELENA

SEQ ID NO: 3132599 - protein, 12 aa, Giardia lamblia
REENGMKDNDGM

SEQ ID NO: 3132600 - protein, 15 aa, Giardia lamblia
REEPPEPSKNQPNLT

SEQ ID NO: 3132601 - protein, 4 aa, Giardia lamblia
REEQ

SEQ ID NO: 3132602 - protein, 10 aa, Giardia lamblia
REEQAAVETA

SEQ ID NO: 3132603 - protein, 8 aa, Giardia lamblia
REEQVRDG

SEQ ID NO: 3132604 - protein, 11 aa, Giardia lamblia
REERDFKDKQR

SEQ ID NO: 3132605 - protein, 16 aa, Giardia lamblia
REERKRREAAEADAAA

SEQ ID NO: 3132606 - protein, 10 aa, Giardia lamblia
REERLAKKQQ

SEQ ID NO: 3132607 - protein, 5 aa, Giardia lamblia
REERR

SEQ ID NO: 3132608 - protein, 7 aa, Giardia lamblia
REESYNK

SEQ ID NO: 3132609 - protein, 8 aa, Giardia lamblia
REETKGAV

SEQ ID NO: 3132610 - protein, 11 aa, Giardia lamblia
REETNTTSLDA

SEQ ID NO: 3132611 - protein, 13 aa, Giardia lamblia
REEVKKHKKSIAS

SEQ ID NO: 3132612 - protein, 4 aa, Giardia lamblia
REFS

SEQ ID NO: 3132613 - protein, 11 aa, Giardia lamblia
REFSSSSRIRG

SEQ ID NO: 3132614 - protein, 5 aa, Giardia lamblia
REFST

SEQ ID NO: 3132615 - protein, 4 aa, Giardia lamblia
REFT

SEQ ID NO: 3132616 - protein, 9 aa, Giardia lamblia
REGAGPRKN

SEQ ID NO: 3132617 - protein, 8 aa, Giardia lamblia
REGEHKKT

SEQ ID NO: 3132618 - protein, 11 aa, Giardia lamblia
REGGISPKETE

SEQ ID NO: 3132619 - protein, 11 aa, Giardia lamblia
REGGKYDNNHK

SEQ ID NO: 3132620 - protein, 10 aa, Giardia lamblia
REGGLKTFTG

SEQ ID NO: 3132621 - protein, 5 aa, Giardia lamblia
REGGM

SEQ ID NO: 3132622 - protein, 11 aa, Giardia lamblia
REGGTQRKDGL

SEQ ID NO: 3132623 - protein, 4 aa, Giardia lamblia
REGK

SEQ ID NO: 3132624 - protein, 4 aa, Giardia lamblia
REGL

SEQ ID NO: 3132625 - protein, 6 aa, Giardia lamblia
REGLQA

SEQ ID NO: 3132626 - protein, 6 aa, Giardia lamblia
REGNEA

SEQ ID NO: 3132627 - protein, 11 aa, Giardia lamblia
REGNGTFEEAN

SEQ ID NO: 3132628 - protein, 6 aa, Giardia lamblia
REGNTD

SEQ ID NO: 3132629 - protein, 5 aa, Giardia lamblia
REGQL

SEQ ID NO: 3132630 - protein, 7 aa, Giardia lamblia
REGQSVS

SEQ ID NO: 3132631 - protein, 4 aa, Giardia lamblia
REGR

SEQ ID NO: 3132632 - protein, 10 aa, Giardia lamblia
REGRARNDKG

SEQ ID NO: 3132633 - protein, 16 aa, Giardia lamblia
REGREKAVEREKYERR

SEQ ID NO: 3132634 - protein, 20 aa, Giardia lamblia
REGRVKPLQGGGWNQRPDRM

SEQ ID NO: 3132635 - protein, 12 aa, Giardia lamblia
REGSIRDRTDKT

SEQ ID NO: 3132636 - protein, 17 aa, Giardia lamblia
REGVSQKGIKSLPPLST

SEQ ID NO: 3132637 - protein, 4 aa, Giardia lamblia
REGY

SEQ ID NO: 3132638 - protein, 10 aa, Giardia lamblia
REHAETTPEA

SEQ ID NO: 3132639 - protein, 14 aa, Giardia lamblia
REHDSGDGRTSVSV

SEQ ID NO: 3132640 - protein, 10 aa, Giardia lamblia
REHEQNTNLQ

SEQ ID NO: 3132641 - protein, 8 aa, Giardia lamblia
REHGDIPE

SEQ ID NO: 3132642 - protein, 8 aa, Giardia lamblia
REHKEELD

SEQ ID NO: 3132643 - protein, 7 aa, Giardia lamblia
REHKPLN

SEQ ID NO: 3132644 - protein, 9 aa, Giardia lamblia
REHNADDDQ

SEQ ID NO: 3132645 - protein, 10 aa, Giardia lamblia
REHSIKTSSM

SEQ ID NO: 3132646 - protein, 5 aa, Giardia lamblia
REHTA

SEQ ID NO: 3132647 - protein, 6 aa, Giardia lamblia
REHVQP

SEQ ID NO: 3132648 - protein, 4 aa, Giardia lamblia
REIA

SEQ ID NO: 3132649 - protein, 4 aa, Giardia lamblia
REID

SEQ ID NO: 3132650 - protein, 6 aa, Giardia lamblia
REIDEK

SEQ ID NO: 3132651 - protein, 4 aa, Giardia lamblia
REIE

SEQ ID NO: 3132652 - protein, 9 aa, Giardia lamblia
REIQKAKQD

SEQ ID NO: 3132653 - protein, 8 aa, Giardia lamblia
REIRPRAT

SEQ ID NO: 3132654 - protein, 4 aa, Giardia lamblia
REIS

SEQ ID NO: 3132655 - protein, 20 aa, Giardia lamblia
REISPLDARGPHTALRGPDN

SEQ ID NO: 3132656 - protein, 5 aa, Giardia lamblia
REITT

SEQ ID NO: 3132657 - protein, 14 aa, Giardia lamblia
REKAAAKVSDEQER

SEQ ID NO: 3132658 - protein, 10 aa, Giardia lamblia
REKAADYERV

SEQ ID NO: 3132659 - protein, 15 aa, Giardia lamblia
REKAALETELKENSY

SEQ ID NO: 3132660 - protein, 5 aa, Giardia lamblia
REKAI

SEQ ID NO: 3132661 - protein, 11 aa, Giardia lamblia
REKALEDTRGL

SEQ ID NO: 3132662 - protein, 38 aa, Giardia lamblia
REKAMADKNSLEKEVERATEVQNEGAATDSIPEQQGNT

SEQ ID NO: 3132663 - protein, 58 aa, Giardia lamblia
REKANMKGLGPKQSPAPAQPKKDLTPQEPRKNNSANDSVEDSKPKKAIKQKTGEDDAL

SEQ ID NO: 3132664 - protein, 8 aa, Giardia lamblia
REKASTVD

SEQ ID NO: 3132665 - protein, 14 aa, Giardia lamblia
REKATSIGDSARGL

SEQ ID NO: 3132666 - protein, 4 aa, Giardia lamblia
REKD

SEQ ID NO: 3132667 - protein, 9 aa, Giardia lamblia
REKDHNGKS

SEQ ID NO: 3132668 - protein, 8 aa, Giardia lamblia
REKDLRST

SEQ ID NO: 3132669 - protein, 11 aa, Giardia lamblia
REKDTSHTNSL

SEQ ID NO: 3132670 - protein, 8 aa, Giardia lamblia
REKEKEFE

SEQ ID NO: 3132671 - protein, 15 aa, Giardia lamblia
REKERRKERHRKRQE

SEQ ID NO: 3132672 - protein, 16 aa, Giardia lamblia
REKFAGQVNDDGDSGL

SEQ ID NO: 3132673 - protein, 7 aa, Giardia lamblia
REKIEES

SEQ ID NO: 3132674 - protein, 13 aa, Giardia lamblia
REKKELKAKYDEA

SEQ ID NO: 3132675 - protein, 10 aa, Giardia lamblia
REKKGDHDPS

SEQ ID NO: 3132676 - protein, 10 aa, Giardia lamblia
REKKGQPNDY

SEQ ID NO: 3132677 - protein, 6 aa, Giardia lamblia
REKLGK

SEQ ID NO: 3132678 - protein, 4 aa, Giardia lamblia
REKN

SEQ ID NO: 3132679 - protein, 7 aa, Giardia lamblia
REKNTLE

SEQ ID NO: 3132680 - protein, 9 aa, Giardia lamblia
REKPRATRV

SEQ ID NO: 3132681 - protein, 7 aa, Giardia lamblia
REKQSYK

SEQ ID NO: 3132682 - protein, 7 aa, Giardia lamblia
REKQTRL

SEQ ID NO: 3132683 - protein, 26 aa, Giardia lamblia
REKRDNLEQTRSLQEKHTTTEEDLAR

SEQ ID NO: 3132684 - protein, 10 aa, Giardia lamblia
REKRKSQQLQ

SEQ ID NO: 3132685 - protein, 8 aa, Giardia lamblia
REKRPIPE

SEQ ID NO: 3132686 - protein, 7 aa, Giardia lamblia
REKRRGG

SEQ ID NO: 3132687 - protein, 8 aa, Giardia lamblia
REKSAGDR

SEQ ID NO: 3132688 - protein, 9 aa, Giardia lamblia
REKSSGSGL

SEQ ID NO: 3132689 - protein, 7 aa, Giardia lamblia
REKSTGA

SEQ ID NO: 3132690 - protein, 7 aa, Giardia lamblia
REKYSSE

SEQ ID NO: 3132691 - protein, 5 aa, Giardia lamblia
RELAA

SEQ ID NO: 3132692 - protein, 6 aa, Giardia lamblia
RELAAS

SEQ ID NO: 3132693 - protein, 7 aa, Giardia lamblia
RELAEKK

SEQ ID NO: 3132694 - protein, 7 aa, Giardia lamblia
RELDSEE

SEQ ID NO: 3132695 - protein, 8 aa, Giardia lamblia
RELEEDNK

SEQ ID NO: 3132696 - protein, 17 aa, Giardia lamblia
RELEETRKALAGKNTTI

SEQ ID NO: 3132697 - protein, 16 aa, Giardia lamblia
RELGQDTDSSATSGST

SEQ ID NO: 3132698 - protein, 6 aa, Giardia lamblia
RELNAQ

SEQ ID NO: 3132699 - protein, 5 aa, Giardia lamblia
RELPT

SEQ ID NO: 3132700 - protein, 5 aa, Giardia lamblia
RELRE

SEQ ID NO: 3132701 - protein, 8 aa, Giardia lamblia
RELRNRAR

SEQ ID NO: 3132702 - protein, 11 aa, Giardia lamblia
RELRQSSTGYT

SEQ ID NO: 3132703 - protein, 5 aa, Giardia lamblia
RELSA

SEQ ID NO: 3132704 - protein, 25 aa, Giardia lamblia
RELSNNTTDSLAELESGKRKLVEQT

SEQ ID NO: 3132705 - protein, 6 aa, Giardia lamblia
RELSSE

SEQ ID NO: 3132706 - protein, 13 aa, Giardia lamblia
REMNTKSKRNFPE

SEQ ID NO: 3132707 - protein, 14 aa, Giardia lamblia
RENDIVDRDNRSAY

SEQ ID NO: 3132708 - protein, 6 aa, Giardia lamblia
RENGET

SEQ ID NO: 3132709 - protein, 9 aa, Giardia lamblia
RENGPSALS

SEQ ID NO: 3132710 - protein, 8 aa, Giardia lamblia
RENGRSSA

SEQ ID NO: 3132711 - protein, 4 aa, Giardia lamblia
RENK

SEQ ID NO: 3132712 - protein, 5 aa, Giardia lamblia
RENPA

SEQ ID NO: 3132713 - protein, 17 aa, Giardia lamblia
RENPSVSENLRKTQAHR

SEQ ID NO: 3132714 - protein, 4 aa, Giardia lamblia
RENR

SEQ ID NO: 3132715 - protein, 6 aa, Giardia lamblia
RENRDG

SEQ ID NO: 3132716 - protein, 7 aa, Giardia lamblia
RENTMKG

SEQ ID NO: 3132717 - protein, 7 aa, Giardia lamblia
RENTTPV

SEQ ID NO: 3132718 - protein, 23 aa, Giardia lamblia
RENYDSKRRCEDAERESRAAKSD

SEQ ID NO: 3132719 - protein, 11 aa, Giardia lamblia
REPAPKLGPEL

SEQ ID NO: 3132720 - protein, 26 aa, Giardia lamblia
REPDPDIKSGQPTEPMAEGPEASESR

SEQ ID NO: 3132721 - protein, 8 aa, Giardia lamblia
REPDQADF

SEQ ID NO: 3132722 - protein, 13 aa, Giardia lamblia
REPDTDQAAALTD

SEQ ID NO: 3132723 - protein, 9 aa, Giardia lamblia
REPEPETSR

SEQ ID NO: 3132724 - protein, 4 aa, Giardia lamblia
REPF

SEQ ID NO: 3132725 - protein, 4 aa, Giardia lamblia
REPG

SEQ ID NO: 3132726 - protein, 32 aa, Giardia lamblia
REPGTLSRGGAKQTHQGQGAHSLSDSEIPSDG

SEQ ID NO: 3132727 - protein, 10 aa, Giardia lamblia
REPKKAIAHT

SEQ ID NO: 3132728 - protein, 14 aa, Giardia lamblia
REPLKEGQEDSEGA

SEQ ID NO: 3132729 - protein, 20 aa, Giardia lamblia
REPRRPEVGDKFSSRHGQKG

SEQ ID NO: 3132730 - protein, 8 aa, Giardia lamblia
REPTAQTK

SEQ ID NO: 3132731 - protein, 12 aa, Giardia lamblia
REPTDGDTAHAK

SEQ ID NO: 3132732 - protein, 4 aa, Giardia lamblia
REQC

SEQ ID NO: 3132733 - protein, 6 aa, Giardia lamblia
REQDAK

SEQ ID NO: 3132734 - protein, 7 aa, Giardia lamblia
REQELKE

SEQ ID NO: 3132735 - protein, 8 aa, Giardia lamblia
REQEQTIQ

SEQ ID NO: 3132736 - protein, 5 aa, Giardia lamblia
REQGE

SEQ ID NO: 3132737 - protein, 4 aa, Giardia lamblia
REQH

SEQ ID NO: 3132738 - protein, 6 aa, Giardia lamblia
REQIGE

SEQ ID NO: 3132739 - protein, 8 aa, Giardia lamblia
REQKDHSL

SEQ ID NO: 3132740 - protein, 6 aa, Giardia lamblia
REQKEA

SEQ ID NO: 3132741 - protein, 6 aa, Giardia lamblia
REQLDS

SEQ ID NO: 3132742 - protein, 5 aa, Giardia lamblia
REQNQ

SEQ ID NO: 3132743 - protein, 10 aa, Giardia lamblia
REQPNPKWTE

SEQ ID NO: 3132744 - protein, 20 aa, Giardia lamblia
REQPQHTDALESKSTQSTSV

SEQ ID NO: 3132745 - protein, 5 aa, Giardia lamblia
REQQI

SEQ ID NO: 3132746 - protein, 7 aa, Giardia lamblia
REQQTQD

SEQ ID NO: 3132747 - protein, 34 aa, Giardia lamblia
REQRRLEREAAEEAARKAAEEAEEAEDGEENGEA

SEQ ID NO: 3132748 - protein, 4 aa, Giardia lamblia
REQS

SEQ ID NO: 3132749 - protein, 9 aa, Giardia lamblia
REQSDHEIE

SEQ ID NO: 3132750 - protein, 5 aa, Giardia lamblia
REQSS

SEQ ID NO: 3132751 - protein, 6 aa, Giardia lamblia
REQYEQ

SEQ ID NO: 3132752 - protein, 18 aa, Giardia lamblia
RERAAKGKTLQRTQDSPL

SEQ ID NO: 3132753 - protein, 31 aa, Giardia lamblia
RERAASQNRSPSLSEKGKSSSHPTGERLSVE

SEQ ID NO: 3132754 - protein, 16 aa, Giardia lamblia
RERATAEAARPTAATV

SEQ ID NO: 3132755 - protein, 20 aa, Giardia lamblia
RERDDDPAAAPGTPTNNTIE

SEQ ID NO: 3132756 - protein, 4 aa, Giardia lamblia
RERE

SEQ ID NO: 3132757 - protein, 6 aa, Giardia lamblia
REREEE

SEQ ID NO: 3132758 - protein, 7 aa, Giardia lamblia
REREEGC

SEQ ID NO: 3132759 - protein, 9 aa, Giardia lamblia
REREGGYNG

SEQ ID NO: 3132760 - protein, 5 aa, Giardia lamblia
RERER

SEQ ID NO: 3132761 - protein, 6 aa, Giardia lamblia
REREYS

SEQ ID NO: 3132762 - protein, 6 aa, Giardia lamblia
RERGGN

SEQ ID NO: 3132763 - protein, 7 aa, Giardia lamblia
RERIASE

SEQ ID NO: 3132764 - protein, 6 aa, Giardia lamblia
RERLSK

SEQ ID NO: 3132765 - protein, 27 aa, Giardia lamblia
RERNKSAAIRSNSTGKPSLKQELESSK

SEQ ID NO: 3132766 - protein, 10 aa, Giardia lamblia
RERNVDPESL

SEQ ID NO: 3132767 - protein, 8 aa, Giardia lamblia
RERPASGK

SEQ ID NO: 3132768 - protein, 9 aa, Giardia lamblia
RERPDLESK

SEQ ID NO: 3132769 - protein, 7 aa, Giardia lamblia
RERPRTV

SEQ ID NO: 3132770 - protein, 14 aa, Giardia lamblia
RERPSNENPPRRLT

SEQ ID NO: 3132771 - protein, 8 aa, Giardia lamblia
RERQDLES

SEQ ID NO: 3132772 - protein, 7 aa, Giardia lamblia
RERQSTS

SEQ ID NO: 3132773 - protein, 21 aa, Giardia lamblia
RERRNAAAAASGVGTNDSRQA

SEQ ID NO: 3132774 - protein, 8 aa, Giardia lamblia
RERSGTTT

SEQ ID NO: 3132775 - protein, 8 aa, Giardia lamblia
RERTSNTE

SEQ ID NO: 3132776 - protein, 4 aa, Giardia lamblia
RERY

SEQ ID NO: 3132777 - protein, 13 aa, Giardia lamblia
RESAGNKPEAYRA

SEQ ID NO: 3132778 - protein, 51 aa, Giardia lamblia
RESAQTPVSSSAASGNTSHSGHGNCNAHNSTFSGAHANSPGAHATSGPVTG

SEQ ID NO: 3132779 - protein, 34 aa, Giardia lamblia
RESCSGGTNAHSTLAQTDANGRARTEHDPGTLNS

SEQ ID NO: 3132780 - protein, 30 aa, Giardia lamblia
RESDGLNEEPSDMSLSDSELEDKRAQIQEV

SEQ ID NO: 3132781 - protein, 9 aa, Giardia lamblia
RESDKASAH

SEQ ID NO: 3132782 - protein, 7 aa, Giardia lamblia
RESEDAR

SEQ ID NO: 3132783 - protein, 11 aa, Giardia lamblia
RESGIQNINGE

SEQ ID NO: 3132784 - protein, 13 aa, Giardia lamblia
RESGYDPTEPGSI

SEQ ID NO: 3132785 - protein, 15 aa, Giardia lamblia
RESKREKALEQRTKE

SEQ ID NO: 3132786 - protein, 6 aa, Giardia lamblia
RESLYT

SEQ ID NO: 3132787 - protein, 5 aa, Giardia lamblia
RESNA

SEQ ID NO: 3132788 - protein, 7 aa, Giardia lamblia
RESPGYR

SEQ ID NO: 3132789 - protein, 4 aa, Giardia lamblia
RESQ

SEQ ID NO: 3132790 - protein, 6 aa, Giardia lamblia
RESQDE

SEQ ID NO: 3132791 - protein, 10 aa, Giardia lamblia
RESRARTTER

SEQ ID NO: 3132792 - protein, 14 aa, Giardia lamblia
RESRDDDPLDDDST

SEQ ID NO: 3132793 - protein, 12 aa, Giardia lamblia
RESRKKKTPIPE

SEQ ID NO: 3132794 - protein, 10 aa, Giardia lamblia
RESRLRSNNG

SEQ ID NO: 3132795 - protein, 12 aa, Giardia lamblia
RESRMQNKDGST

SEQ ID NO: 3132796 - protein, 10 aa, Giardia lamblia
RESRNDSKQD

SEQ ID NO: 3132797 - protein, 14 aa, Giardia lamblia
RESRPGRDKSAELD

SEQ ID NO: 3132798 - protein, 6 aa, Giardia lamblia
RESSEK

SEQ ID NO: 3132799 - protein, 6 aa, Giardia lamblia
RESSGW

SEQ ID NO: 3132800 - protein, 8 aa, Giardia lamblia
RESSSDQM

SEQ ID NO: 3132801 - protein, 9 aa, Giardia lamblia
RESSVSTEL

SEQ ID NO: 3132802 - protein, 4 aa, Giardia lamblia
REST

SEQ ID NO: 3132803 - protein, 8 aa, Giardia lamblia
RESTDQSI

SEQ ID NO: 3132804 - protein, 8 aa, Giardia lamblia
RESTDSGK

SEQ ID NO: 3132805 - protein, 5 aa, Giardia lamblia
RESTE

SEQ ID NO: 3132806 - protein, 8 aa, Giardia lamblia
RESTEVSQ

SEQ ID NO: 3132807 - protein, 26 aa, Giardia lamblia
RESVMSRSQETSVGGRSDLDGGYDAE

SEQ ID NO: 3132808 - protein, 7 aa, Giardia lamblia
RESVRQT

SEQ ID NO: 3132809 - protein, 9 aa, Giardia lamblia
RESVTRPSS

SEQ ID NO: 3132810 - protein, 12 aa, Giardia lamblia
RETAHSNPDPND

SEQ ID NO: 3132811 - protein, 10 aa, Giardia lamblia
RETASQLPSR

SEQ ID NO: 3132812 - protein, 5 aa, Giardia lamblia
RETAT

SEQ ID NO: 3132813 - protein, 4 aa, Giardia lamblia
RETD

SEQ ID NO: 3132814 - protein, 11 aa, Giardia lamblia
RETDKDGRTAL

SEQ ID NO: 3132815 - protein, 7 aa, Giardia lamblia
RETEEQI

SEQ ID NO: 3132816 - protein, 19 aa, Giardia lamblia
RETEHDNGSREPDTEEGDE

SEQ ID NO: 3132817 - protein, 14 aa, Giardia lamblia
RETELQKEKSELQA

SEQ ID NO: 3132818 - protein, 8 aa, Giardia lamblia
RETGEDWT

SEQ ID NO: 3132819 - protein, 6 aa, Giardia lamblia
RETGLS

SEQ ID NO: 3132820 - protein, 11 aa, Giardia lamblia
RETGYTDLAGK

SEQ ID NO: 3132821 - protein, 8 aa, Giardia lamblia
RETHGADA

SEQ ID NO: 3132822 - protein, 16 aa, Giardia lamblia
RETKQGIYTLEPNETF

SEQ ID NO: 3132823 - protein, 9 aa, Giardia lamblia
RETKQQCSE

SEQ ID NO: 3132824 - protein, 15 aa, Giardia lamblia
RETNSYITQTQGSGI

SEQ ID NO: 3132825 - protein, 6 aa, Giardia lamblia
RETNTT

SEQ ID NO: 3132826 - protein, 4 aa, Giardia lamblia
RETP

SEQ ID NO: 3132827 - protein, 5 aa, Giardia lamblia
RETPR

SEQ ID NO: 3132828 - protein, 10 aa, Giardia lamblia
RETPSPYREV

SEQ ID NO: 3132829 - protein, 14 aa, Giardia lamblia
RETQAEIEDKEEEI

SEQ ID NO: 3132830 - protein, 5 aa, Giardia lamblia
RETQE

SEQ ID NO: 3132831 - protein, 13 aa, Giardia lamblia
RETQESPSDSLEH

SEQ ID NO: 3132832 - protein, 8 aa, Giardia lamblia
RETQESVF

SEQ ID NO: 3132833 - protein, 7 aa, Giardia lamblia
RETQGTA

SEQ ID NO: 3132834 - protein, 6 aa, Giardia lamblia
RETRAN

SEQ ID NO: 3132835 - protein, 6 aa, Giardia lamblia
RETRIT

SEQ ID NO: 3132836 - protein, 9 aa, Giardia lamblia
RETSQSDDV

SEQ ID NO: 3132837 - protein, 10 aa, Giardia lamblia
RETSTEESKG

SEQ ID NO: 3132838 - protein, 8 aa, Giardia lamblia
RETTDGYP

SEQ ID NO: 3132839 - protein, 8 aa, Giardia lamblia
RETTGEID

SEQ ID NO: 3132840 - protein, 8 aa, Giardia lamblia
RETTSARA

SEQ ID NO: 3132841 - protein, 6 aa, Giardia lamblia
RETTST

SEQ ID NO: 3132842 - protein, 5 aa, Giardia lamblia
RETVE

SEQ ID NO: 3132843 - protein, 10 aa, Giardia lamblia
REVAESYREN

SEQ ID NO: 3132844 - protein, 8 aa, Giardia lamblia
REVAHSSK

SEQ ID NO: 3132845 - protein, 8 aa, Giardia lamblia
REVDEDGN

SEQ ID NO: 3132846 - protein, 7 aa, Giardia lamblia
REVDGRL

SEQ ID NO: 3132847 - protein, 5 aa, Giardia lamblia
REVQA

SEQ ID NO: 3132848 - protein, 10 aa, Giardia lamblia
REVSRREDEV

SEQ ID NO: 3132849 - protein, 6 aa, Giardia lamblia
REVSSL

SEQ ID NO: 3132850 - protein, 25 aa, Giardia lamblia
REVTGSALSTSASLHPPTASAVPHS

SEQ ID NO: 3132851 - protein, 11 aa, Giardia lamblia
REYDRTGPGIV

SEQ ID NO: 3132852 - protein, 4 aa, Giardia lamblia
REYE

SEQ ID NO: 3132853 - protein, 34 aa, Giardia lamblia
REYEASQNTTPRDLTSEEEDNGSKRSSLGSNTED

SEQ ID NO: 3132854 - protein, 6 aa, Giardia lamblia
REYESY

SEQ ID NO: 3132855 - protein, 11 aa, Giardia lamblia
REYGDSSTSSM

SEQ ID NO: 3132856 - protein, 11 aa, Giardia lamblia
REYPEINDEAD

SEQ ID NO: 3132857 - protein, 4 aa, Giardia lamblia
REYQ

SEQ ID NO: 3132858 - protein, 6 aa, Giardia lamblia
REYQRQ

SEQ ID NO: 3132859 - protein, 18 aa, Giardia lamblia
REYSIGAASNESGAPIKE

SEQ ID NO: 3132860 - protein, 12 aa, Giardia lamblia
REYSSYRQQHES

SEQ ID NO: 3132861 - protein, 9 aa, Giardia lamblia
RFDIDGDEK

SEQ ID NO: 3132862 - protein, 5 aa, Giardia lamblia
RFEGN

SEQ ID NO: 3132863 - protein, 5 aa, Giardia lamblia
RFGPG

SEQ ID NO: 3132864 - protein, 6 aa, Giardia lamblia
RFGPTL

SEQ ID NO: 3132865 - protein, 6 aa, Giardia lamblia
RFNEPI

SEQ ID NO: 3132866 - protein, 17 aa, Giardia lamblia
RFPDGKQFDSSRSRGKP

SEQ ID NO: 3132867 - protein, 36 aa, Giardia lamblia
RFPGGAGPVNPVASESEPSPEESCGVATRPPAIPQQ

SEQ ID NO: 3132868 - protein, 6 aa, Giardia lamblia
RFRPPD

SEQ ID NO: 3132869 - protein, 7 aa, Giardia lamblia
RFRTSTE

SEQ ID NO: 3132870 - protein, 6 aa, Giardia lamblia
RFSEAE

SEQ ID NO: 3132871 - protein, 4 aa, Giardia lamblia
RFSP

SEQ ID NO: 3132872 - protein, 4 aa, Giardia lamblia
RFSQ

SEQ ID NO: 3132873 - protein, 8 aa, Giardia lamblia
RFTNPPRN

SEQ ID NO: 3132874 - protein, 8 aa, Giardia lamblia
RGADGKTA

SEQ ID NO: 3132875 - protein, 7 aa, Giardia lamblia
RGADSSL

SEQ ID NO: 3132876 - protein, 6 aa, Giardia lamblia
RGAELT

SEQ ID NO: 3132877 - protein, 12 aa, Giardia lamblia
RGAGQLTPATRR

SEQ ID NO: 3132878 - protein, 14 aa, Giardia lamblia
RGAMGAGRSAEARK

SEQ ID NO: 3132879 - protein, 5 aa, Giardia lamblia
RGAPC

SEQ ID NO: 3132880 - protein, 5 aa, Giardia lamblia
RGAPG

SEQ ID NO: 3132881 - protein, 9 aa, Giardia lamblia
RGAPNESFE

SEQ ID NO: 3132882 - protein, 9 aa, Giardia lamblia
RGAPNGGEL

SEQ ID NO: 3132883 - protein, 17 aa, Giardia lamblia
RGAQPCNPPIDNGLSSA

SEQ ID NO: 3132884 - protein, 9 aa, Giardia lamblia
RGARLTSDA

SEQ ID NO: 3132885 - protein, 9 aa, Giardia lamblia
RGARPGEAA

SEQ ID NO: 3132886 - protein, 5 aa, Giardia lamblia
RGARV

SEQ ID NO: 3132887 - protein, 26 aa, Giardia lamblia
RGASANASRRLAQPPESLQPKTPLKP

SEQ ID NO: 3132888 - protein, 7 aa, Giardia lamblia
RGASEGD

SEQ ID NO: 3132889 - protein, 9 aa, Giardia lamblia
RGASFPPEQ

SEQ ID NO: 3132890 - protein, 10 aa, Giardia lamblia
RGASRTRTAG

SEQ ID NO: 3132891 - protein, 10 aa, Giardia lamblia
RGCADRQGRT

SEQ ID NO: 3132892 - protein, 6 aa, Giardia lamblia
RGCDPS

SEQ ID NO: 3132893 - protein, 6 aa, Giardia lamblia
RGCTTG

SEQ ID NO: 3132894 - protein, 6 aa, Giardia lamblia
RGDAEC

SEQ ID NO: 3132895 - protein, 12 aa, Giardia lamblia
RGDDSPGFPQDD

SEQ ID NO: 3132896 - protein, 6 aa, Giardia lamblia
RGDDSR

SEQ ID NO: 3132897 - protein, 7 aa, Giardia lamblia
RGDEPIS

SEQ ID NO: 3132898 - protein, 10 aa, Giardia lamblia
RGDETTWDKE

SEQ ID NO: 3132899 - protein, 6 aa, Giardia lamblia
RGDMAT

SEQ ID NO: 3132900 - protein, 9 aa, Giardia lamblia
RGDPRAGPV

SEQ ID NO: 3132901 - protein, 7 aa, Giardia lamblia
RGDSAYD

SEQ ID NO: 3132902 - protein, 4 aa, Giardia lamblia
RGDT

SEQ ID NO: 3132903 - protein, 5 aa, Giardia lamblia
RGDTD

SEQ ID NO: 3132904 - protein, 4 aa, Giardia lamblia
RGDV

SEQ ID NO: 3132905 - protein, 5 aa, Giardia lamblia
RGDVR

SEQ ID NO: 3132906 - protein, 32 aa, Giardia lamblia
RGDYSEVSASTSVAPGPEHPSDAGIVFLASLT

SEQ ID NO: 3132907 - protein, 11 aa, Giardia lamblia
RGEDAIGTDGN

SEQ ID NO: 3132908 - protein, 17 aa, Giardia lamblia
RGEDVEDESSFSTVGSD

SEQ ID NO: 3132909 - protein, 33 aa, Giardia lamblia
RGEDVRNESISERSDISRQSDRPTSARRPQSTM

SEQ ID NO: 3132910 - protein, 5 aa, Giardia lamblia
RGEEG

SEQ ID NO: 3132911 - protein, 6 aa, Giardia lamblia
RGEFTD

SEQ ID NO: 3132912 - protein, 5 aa, Giardia lamblia
RGEGR

SEQ ID NO: 3132913 - protein, 6 aa, Giardia lamblia
RGEGTR

SEQ ID NO: 3132914 - protein, 7 aa, Giardia lamblia
RGEKARE

SEQ ID NO: 3132915 - protein, 7 aa, Giardia lamblia
RGELGRS

SEQ ID NO: 3132916 - protein, 12 aa, Giardia lamblia
RGEPVTEQKSKK

SEQ ID NO: 3132917 - protein, 10 aa, Giardia lamblia
RGESYDISDT

SEQ ID NO: 3132918 - protein, 10 aa, Giardia lamblia
RGETSTAENA

SEQ ID NO: 3132919 - protein, 13 aa, Giardia lamblia
RGEVSTNKEVEDY

SEQ ID NO: 3132920 - protein, 4 aa, Giardia lamblia
RGEY

SEQ ID NO: 3132921 - protein, 4 aa, Giardia lamblia
RGFS

SEQ ID NO: 3132922 - protein, 4 aa, Giardia lamblia
RGGA

SEQ ID NO: 3132923 - protein, 8 aa, Giardia lamblia
RGGASKSF

SEQ ID NO: 3132924 - protein, 7 aa, Giardia lamblia
RGGDPTK

SEQ ID NO: 3132925 - protein, 8 aa, Giardia lamblia
RGGDTDQV

SEQ ID NO: 3132926 - protein, 29 aa, Giardia lamblia
RGGDVAPAAALNPGKKSARFSDDQNRDAL

SEQ ID NO: 3132927 - protein, 7 aa, Giardia lamblia
RGGKQTS

SEQ ID NO: 3132928 - protein, 4 aa, Giardia lamblia
RGGN

SEQ ID NO: 3132929 - protein, 9 aa, Giardia lamblia
RGGNKGGLA

SEQ ID NO: 3132930 - protein, 11 aa, Giardia lamblia
RGGNRARGLPT

SEQ ID NO: 3132931 - protein, 11 aa, Giardia lamblia
RGGPRADAGQT

SEQ ID NO: 3132932 - protein, 7 aa, Giardia lamblia
RGGRFGK

SEQ ID NO: 3132933 - protein, 21 aa, Giardia lamblia
RGGRTGSAGGANGRRSGNSNS

SEQ ID NO: 3132934 - protein, 4 aa, Giardia lamblia
RGGS

SEQ ID NO: 3132935 - protein, 12 aa, Giardia lamblia
RGGSAPARGSFG

SEQ ID NO: 3132936 - protein, 8 aa, Giardia lamblia
RGGSRGAR

SEQ ID NO: 3132937 - protein, 63 aa, Giardia lamblia
RGGTKEDIKEGQGQPGDDGAEAHQAAESNAATAAMSTSGPASSAQPQEGDTAQQAARDIGKQT

SEQ ID NO: 3132938 - protein, 6 aa, Giardia lamblia
RGGTNT

SEQ ID NO: 3132939 - protein, 8 aa, Giardia lamblia
RGGTYTKA

SEQ ID NO: 3132940 - protein, 7 aa, Giardia lamblia
RGGVAGG

SEQ ID NO: 3132941 - protein, 5 aa, Giardia lamblia
RGHAD

SEQ ID NO: 3132942 - protein, 6 aa, Giardia lamblia
RGHAGA

SEQ ID NO: 3132943 - protein, 5 aa, Giardia lamblia
RGHEE

SEQ ID NO: 3132944 - protein, 4 aa, Giardia lamblia
RGHK

SEQ ID NO: 3132945 - protein, 5 aa, Giardia lamblia
RGHRQ

SEQ ID NO: 3132946 - protein, 4 aa, Giardia lamblia
RGHS

SEQ ID NO: 3132947 - protein, 16 aa, Giardia lamblia
RGHSKTSSISSTANQS

SEQ ID NO: 3132948 - protein, 6 aa, Giardia lamblia
RGHSSA

SEQ ID NO: 3132949 - protein, 13 aa, Giardia lamblia
RGHSSSASAANAA

SEQ ID NO: 3132950 - protein, 4 aa, Giardia lamblia
RGHT

SEQ ID NO: 3132951 - protein, 5 aa, Giardia lamblia
RGHTE

SEQ ID NO: 3132952 - protein, 5 aa, Giardia lamblia
RGHTQ

SEQ ID NO: 3132953 - protein, 4 aa, Giardia lamblia
RGIE

SEQ ID NO: 3132954 - protein, 6 aa, Giardia lamblia
RGIPSF

SEQ ID NO: 3132955 - protein, 4 aa, Giardia lamblia
RGIS

SEQ ID NO: 3132956 - protein, 17 aa, Giardia lamblia
RGISNHQTDTLTHEQKR

SEQ ID NO: 3132957 - protein, 9 aa, Giardia lamblia
RGISRSSSF

SEQ ID NO: 3132958 - protein, 4 aa, Giardia lamblia
RGIT

SEQ ID NO: 3132959 - protein, 11 aa, Giardia lamblia
RGKAPEERAAA

SEQ ID NO: 3132960 - protein, 6 aa, Giardia lamblia
RGKEPA

SEQ ID NO: 3132961 - protein, 12 aa, Giardia lamblia
RGKEPKRLKKQG

SEQ ID NO: 3132962 - protein, 9 aa, Giardia lamblia
RGKESKVKN

SEQ ID NO: 3132963 - protein, 9 aa, Giardia lamblia
RGKGATKQR

SEQ ID NO: 3132964 - protein, 7 aa, Giardia lamblia
RGKGGAI

SEQ ID NO: 3132965 - protein, 41 aa, Giardia lamblia
RGKHSDRTKYRRESSNCISDDGSIDLTSHSSGQNQIDDRST

SEQ ID NO: 3132966 - protein, 9 aa, Giardia lamblia
RGKHSQYKS

SEQ ID NO: 3132967 - protein, 7 aa, Giardia lamblia
RGKKHEQ

SEQ ID NO: 3132968 - protein, 16 aa, Giardia lamblia
RGKKPTGFKSKKRYKR

SEQ ID NO: 3132969 - protein, 7 aa, Giardia lamblia
RGKKSRF

SEQ ID NO: 3132970 - protein, 5 aa, Giardia lamblia
RGKLE

SEQ ID NO: 3132971 - protein, 5 aa, Giardia lamblia
RGKLQ

SEQ ID NO: 3132972 - protein, 10 aa, Giardia lamblia
RGKPNPSFTK

SEQ ID NO: 3132973 - protein, 11 aa, Giardia lamblia
RGKQAESAQNN

SEQ ID NO: 3132974 - protein, 6 aa, Giardia lamblia
RGKQSF

SEQ ID NO: 3132975 - protein, 16 aa, Giardia lamblia
RGKSAMPKINDEEQQL

SEQ ID NO: 3132976 - protein, 11 aa, Giardia lamblia
RGKTDDAGKNV

SEQ ID NO: 3132977 - protein, 8 aa, Giardia lamblia
RGKTSGAY

SEQ ID NO: 3132978 - protein, 9 aa, Giardia lamblia
RGLEEKTAR

SEQ ID NO: 3132979 - protein, 10 aa, Giardia lamblia
RGLERTSDLN

SEQ ID NO: 3132980 - protein, 9 aa, Giardia lamblia
RGLKDKQNR

SEQ ID NO: 3132981 - protein, 10 aa, Giardia lamblia
RGLKDNNGCT

SEQ ID NO: 3132982 - protein, 4 aa, Giardia lamblia
RGLP

SEQ ID NO: 3132983 - protein, 7 aa, Giardia lamblia
RGLQPTA

SEQ ID NO: 3132984 - protein, 10 aa, Giardia lamblia
RGLSKKTYGS

SEQ ID NO: 3132985 - protein, 16 aa, Giardia lamblia
RGLSTDQISTGESVSS

SEQ ID NO: 3132986 - protein, 4 aa, Giardia lamblia
RGLY

SEQ ID NO: 3132987 - protein, 9 aa, Giardia lamblia
RGMKEKDGM

SEQ ID NO: 3132988 - protein, 6 aa, Giardia lamblia
RGMRNK

SEQ ID NO: 3132989 - protein, 14 aa, Giardia lamblia
RGNASAYGRSTAGC

SEQ ID NO: 3132990 - protein, 9 aa, Giardia lamblia
RGNASTLTD

SEQ ID NO: 3132991 - protein, 11 aa, Giardia lamblia
RGNGTGDQDTS

SEQ ID NO: 3132992 - protein, 12 aa, Giardia lamblia
RGNGTPGQVGPS

SEQ ID NO: 3132993 - protein, 6 aa, Giardia lamblia
RGNHES

SEQ ID NO: 3132994 - protein, 4 aa, Giardia lamblia
RGNI

SEQ ID NO: 3132995 - protein, 6 aa, Giardia lamblia
RGNIHP

SEQ ID NO: 3132996 - protein, 12 aa, Giardia lamblia
RGNNATKLKDAG

SEQ ID NO: 3132997 - protein, 10 aa, Giardia lamblia
RGNNGEEEQL

SEQ ID NO: 3132998 - protein, 6 aa, Giardia lamblia
RGNPEA

SEQ ID NO: 3132999 - protein, 6 aa, Giardia lamblia
RGNPEL

SEQ ID NO: 3133000 - protein, 33 aa, Giardia lamblia
RGNPKSVREEKLKEHSRPLRGYTKKEPTGAARQ

SEQ ID NO: 3133001 - protein, 6 aa, Giardia lamblia
RGNQAD

SEQ ID NO: 3133002 - protein, 8 aa, Giardia lamblia
RGNRGETA

SEQ ID NO: 3133003 - protein, 9 aa, Giardia lamblia
RGNRTQKYS

SEQ ID NO: 3133004 - protein, 9 aa, Giardia lamblia
RGNSYTDTK

SEQ ID NO: 3133005 - protein, 6 aa, Giardia lamblia
RGNVEE

SEQ ID NO: 3133006 - protein, 12 aa, Giardia lamblia
RGNVGELPGQQG

SEQ ID NO: 3133007 - protein, 5 aa, Giardia lamblia
RGNYE

SEQ ID NO: 3133008 - protein, 10 aa, Giardia lamblia
RGNYNGKRPF

SEQ ID NO: 3133009 - protein, 6 aa, Giardia lamblia
RGPATI

SEQ ID NO: 3133010 - protein, 43 aa, Giardia lamblia
RGPDEMDAEIDRGRRRKTKAIREENHRQHTLEARKKKHERTQQ

SEQ ID NO: 3133011 - protein, 6 aa, Giardia lamblia
RGPDRL

SEQ ID NO: 3133012 - protein, 10 aa, Giardia lamblia
RGPEDVQQEV

SEQ ID NO: 3133013 - protein, 11 aa, Giardia lamblia
RGPEGPSPRYG

SEQ ID NO: 3133014 - protein, 8 aa, Giardia lamblia
RGPGLGAP

SEQ ID NO: 3133015 - protein, 16 aa, Giardia lamblia
RGPGSPAPAGDERPRR

SEQ ID NO: 3133016 - protein, 7 aa, Giardia lamblia
RGPKGTV

SEQ ID NO: 3133017 - protein, 12 aa, Giardia lamblia
RGPKKSSSSSGC

SEQ ID NO: 3133018 - protein, 7 aa, Giardia lamblia
RGPKTHA

SEQ ID NO: 3133019 - protein, 12 aa, Giardia lamblia
RGPSDDKHKEVR

SEQ ID NO: 3133020 - protein, 9 aa, Giardia lamblia
RGPTAHGSS

SEQ ID NO: 3133021 - protein, 6 aa, Giardia lamblia
RGPTLT

SEQ ID NO: 3133022 - protein, 20 aa, Giardia lamblia
RGPWQSSRECTAAGPRLGDP

SEQ ID NO: 3133023 - protein, 14 aa, Giardia lamblia
RGPYDETSYPDVDT

SEQ ID NO: 3133024 - protein, 7 aa, Giardia lamblia
RGQDAGG

SEQ ID NO: 3133025 - protein, 4 aa, Giardia lamblia
RGQF

SEQ ID NO: 3133026 - protein, 21 aa, Giardia lamblia
RGQHTKSTGRRGHVVGVQRKK

SEQ ID NO: 3133027 - protein, 8 aa, Giardia lamblia
RGQPRSDI

SEQ ID NO: 3133028 - protein, 11 aa, Giardia lamblia
RGQPSSTKQPY

SEQ ID NO: 3133029 - protein, 4 aa, Giardia lamblia
RGQR

SEQ ID NO: 3133030 - protein, 14 aa, Giardia lamblia
RGQSKGSAGANEDA

SEQ ID NO: 3133031 - protein, 5 aa, Giardia lamblia
RGQTS

SEQ ID NO: 3133032 - protein, 7 aa, Giardia lamblia
RGRAGSV

SEQ ID NO: 3133033 - protein, 25 aa, Giardia lamblia
RGRAQEMSASQRYSANQAQELQEKA

SEQ ID NO: 3133034 - protein, 7 aa, Giardia lamblia
RGRASQM

SEQ ID NO: 3133035 - protein, 4 aa, Giardia lamblia
RGRD

SEQ ID NO: 3133036 - protein, 12 aa, Giardia lamblia
RGRDDGYTSADD

SEQ ID NO: 3133037 - protein, 6 aa, Giardia lamblia
RGREGI

SEQ ID NO: 3133038 - protein, 7 aa, Giardia lamblia
RGRGAPL

SEQ ID NO: 3133039 - protein, 9 aa, Giardia lamblia
RGRGKSASL

SEQ ID NO: 3133040 - protein, 15 aa, Giardia lamblia
RGRHQPPQSQSGQKT

SEQ ID NO: 3133041 - protein, 7 aa, Giardia lamblia
RGRKTYK

SEQ ID NO: 3133042 - protein, 8 aa, Giardia lamblia
RGRKTYKE

SEQ ID NO: 3133043 - protein, 9 aa, Giardia lamblia
RGRLGPGER

SEQ ID NO: 3133044 - protein, 4 aa, Giardia lamblia
RGRN

SEQ ID NO: 3133045 - protein, 12 aa, Giardia lamblia
RGRPEDYEPITP

SEQ ID NO: 3133046 - protein, 15 aa, Giardia lamblia
RGRPMSEVDSEVDRA

SEQ ID NO: 3133047 - protein, 41 aa, Giardia lamblia
RGRPSDPCSARRAPGRDPQACGTERHTRLPRKDRQKGLSSI

SEQ ID NO: 3133048 - protein, 12 aa, Giardia lamblia
RGRQTESEEQIK

SEQ ID NO: 3133049 - protein, 4 aa, Giardia lamblia
RGRR

SEQ ID NO: 3133050 - protein, 5 aa, Giardia lamblia
RGRRG

SEQ ID NO: 3133051 - protein, 10 aa, Giardia lamblia
RGRRPDRRGV

SEQ ID NO: 3133052 - protein, 6 aa, Giardia lamblia
RGRRSS

SEQ ID NO: 3133053 - protein, 7 aa, Giardia lamblia
RGRTPNP

SEQ ID NO: 3133054 - protein, 9 aa, Giardia lamblia
RGSADSDSK

SEQ ID NO: 3133055 - protein, 5 aa, Giardia lamblia
RGSAG

SEQ ID NO: 3133056 - protein, 7 aa, Giardia lamblia
RGSDDAK

SEQ ID NO: 3133057 - protein, 7 aa, Giardia lamblia
RGSEDLS

SEQ ID NO: 3133058 - protein, 5 aa, Giardia lamblia
RGSEV

SEQ ID NO: 3133059 - protein, 7 aa, Giardia lamblia
RGSGGSM

SEQ ID NO: 3133060 - protein, 7 aa, Giardia lamblia
RGSGKTQ

SEQ ID NO: 3133061 - protein, 25 aa, Giardia lamblia
RGSGQKDSSARRTSNTDRTSRDQSL

SEQ ID NO: 3133062 - protein, 8 aa, Giardia lamblia
RGSKAQVR

SEQ ID NO: 3133063 - protein, 11 aa, Giardia lamblia
RGSKPSYSWNN

SEQ ID NO: 3133064 - protein, 4 aa, Giardia lamblia
RGSL

SEQ ID NO: 3133065 - protein, 13 aa, Giardia lamblia
RGSLAGRGGRAPG

SEQ ID NO: 3133066 - protein, 5 aa, Giardia lamblia
RGSLE

SEQ ID NO: 3133067 - protein, 9 aa, Giardia lamblia
RGSRHGIGS

SEQ ID NO: 3133068 - protein, 5 aa, Giardia lamblia
RGSRI

SEQ ID NO: 3133069 - protein, 13 aa, Giardia lamblia
RGSRNNPISYSSN

SEQ ID NO: 3133070 - protein, 4 aa, Giardia lamblia
RGSS

SEQ ID NO: 3133071 - protein, 14 aa, Giardia lamblia
RGSSPPFQGTEPYT

SEQ ID NO: 3133072 - protein, 7 aa, Giardia lamblia
RGSSSAV

SEQ ID NO: 3133073 - protein, 7 aa, Giardia lamblia
RGSSTGL

SEQ ID NO: 3133074 - protein, 17 aa, Giardia lamblia
RGSSVGSRSESKGKIRP

SEQ ID NO: 3133075 - protein, 28 aa, Giardia lamblia
RGSTGSLMGSAGTVSSRPGSGKAASSNA

SEQ ID NO: 3133076 - protein, 13 aa, Giardia lamblia
RGSTHSSLSGSEN

SEQ ID NO: 3133077 - protein, 8 aa, Giardia lamblia
RGSTSPLR

SEQ ID NO: 3133078 - protein, 5 aa, Giardia lamblia
RGSYS

SEQ ID NO: 3133079 - protein, 6 aa, Giardia lamblia
RGTCPG

SEQ ID NO: 3133080 - protein, 10 aa, Giardia lamblia
RGTDASGNTA

SEQ ID NO: 3133081 - protein, 4 aa, Giardia lamblia
RGTE

SEQ ID NO: 3133082 - protein, 25 aa, Giardia lamblia
RGTEPHNQSRNHSITEAGPAGAAGL

SEQ ID NO: 3133083 - protein, 9 aa, Giardia lamblia
RGTGNGETV

SEQ ID NO: 3133084 - protein, 5 aa, Giardia lamblia
RGTIG

SEQ ID NO: 3133085 - protein, 14 aa, Giardia lamblia
RGTITTKETVRSDQ

SEQ ID NO: 3133086 - protein, 10 aa, Giardia lamblia
RGTKAAETDK

SEQ ID NO: 3133087 - protein, 13 aa, Giardia lamblia
RGTNLRKKKLSKY

SEQ ID NO: 3133088 - protein, 5 aa, Giardia lamblia
RGTNT

SEQ ID NO: 3133089 - protein, 5 aa, Giardia lamblia
RGTNV

SEQ ID NO: 3133090 - protein, 8 aa, Giardia lamblia
RGTPTTEV

SEQ ID NO: 3133091 - protein, 6 aa, Giardia lamblia
RGTRQD

SEQ ID NO: 3133092 - protein, 12 aa, Giardia lamblia
RGTTESITLPDN

SEQ ID NO: 3133093 - protein, 6 aa, Giardia lamblia
RGTTQT

SEQ ID NO: 3133094 - protein, 6 aa, Giardia lamblia
RGTTRA

SEQ ID NO: 3133095 - protein, 14 aa, Giardia lamblia
RGVDQTGGTTTSRL

SEQ ID NO: 3133096 - protein, 24 aa, Giardia lamblia
RGVGLSKSSLAYSQHRSQKGRDEI

SEQ ID NO: 3133097 - protein, 7 aa, Giardia lamblia
RGVPEQD

SEQ ID NO: 3133098 - protein, 17 aa, Giardia lamblia
RGVPSRPASGGSAFDET

SEQ ID NO: 3133099 - protein, 25 aa, Giardia lamblia
RGVQHKQGGWPREIDPTDAEHTTRY

SEQ ID NO: 3133100 - protein, 4 aa, Giardia lamblia
RGVS

SEQ ID NO: 3133101 - protein, 10 aa, Giardia lamblia
RGWQRTSGSD

SEQ ID NO: 3133102 - protein, 4 aa, Giardia lamblia
RGYD

SEQ ID NO: 3133103 - protein, 7 aa, Giardia lamblia
RGYGQQD

SEQ ID NO: 3133104 - protein, 4 aa, Giardia lamblia
RGYI

SEQ ID NO: 3133105 - protein, 4 aa, Giardia lamblia
RGYP

SEQ ID NO: 3133106 - protein, 4 aa, Giardia lamblia
RGYQ

SEQ ID NO: 3133107 - protein, 4 aa, Giardia lamblia
RGYT

SEQ ID NO: 3133108 - protein, 7 aa, Giardia lamblia
RGYTPGQ

SEQ ID NO: 3133109 - protein, 6 aa, Giardia lamblia
RHAADK

SEQ ID NO: 3133110 - protein, 7 aa, Giardia lamblia
RHAEGYE

SEQ ID NO: 3133111 - protein, 5 aa, Giardia lamblia
RHAGK

SEQ ID NO: 3133112 - protein, 5 aa, Giardia lamblia
RHAPG

SEQ ID NO: 3133113 - protein, 18 aa, Giardia lamblia
RHASSNGDKDKSLTTTLG

SEQ ID NO: 3133114 - protein, 10 aa, Giardia lamblia
RHDASSKSFA

SEQ ID NO: 3133115 - protein, 9 aa, Giardia lamblia
RHDRRVPVP

SEQ ID NO: 3133116 - protein, 9 aa, Giardia lamblia
RHDTEADRA

SEQ ID NO: 3133117 - protein, 5 aa, Giardia lamblia
RHEAA

SEQ ID NO: 3133118 - protein, 9 aa, Giardia lamblia
RHEAGNRNK

SEQ ID NO: 3133119 - protein, 22 aa, Giardia lamblia
RHEGIQPIQPPPFKPPPASQQN

SEQ ID NO: 3133120 - protein, 7 aa, Giardia lamblia
RHESGRR

SEQ ID NO: 3133121 - protein, 13 aa, Giardia lamblia
RHFDDPAEAETLS

SEQ ID NO: 3133122 - protein, 6 aa, Giardia lamblia
RHGDPE

SEQ ID NO: 3133123 - protein, 10 aa, Giardia lamblia
RHGKNHAESL

SEQ ID NO: 3133124 - protein, 5 aa, Giardia lamblia
RHGKQ

SEQ ID NO: 3133125 - protein, 7 aa, Giardia lamblia
RHGPGTF

SEQ ID NO: 3133126 - protein, 9 aa, Giardia lamblia
RHGTPSERE

SEQ ID NO: 3133127 - protein, 4 aa, Giardia lamblia
RHGY

SEQ ID NO: 3133128 - protein, 5 aa, Giardia lamblia
RHHNT

SEQ ID NO: 3133129 - protein, 4 aa, Giardia lamblia
RHHS

SEQ ID NO: 3133130 - protein, 9 aa, Giardia lamblia
RHINSRKRE

SEQ ID NO: 3133131 - protein, 18 aa, Giardia lamblia
RHKESSKDAGPGPAQYDV

SEQ ID NO: 3133132 - protein, 13 aa, Giardia lamblia
RHMPPSKTNAMDE

SEQ ID NO: 3133133 - protein, 21 aa, Giardia lamblia
RHNDKPSPSQAHPTARPNLYE

SEQ ID NO: 3133134 - protein, 11 aa, Giardia lamblia
RHNDTDDPSDL

SEQ ID NO: 3133135 - protein, 9 aa, Giardia lamblia
RHNGSSSSY

SEQ ID NO: 3133136 - protein, 6 aa, Giardia lamblia
RHNPDA

SEQ ID NO: 3133137 - protein, 6 aa, Giardia lamblia
RHNQQA

SEQ ID NO: 3133138 - protein, 7 aa, Giardia lamblia
RHNSNRV

SEQ ID NO: 3133139 - protein, 14 aa, Giardia lamblia
RHPGYPDPKPPVPS

SEQ ID NO: 3133140 - protein, 8 aa, Giardia lamblia
RHPIPGAR

SEQ ID NO: 3133141 - protein, 6 aa, Giardia lamblia
RHPNKT

SEQ ID NO: 3133142 - protein, 12 aa, Giardia lamblia
RHQQEPGLNPSI

SEQ ID NO: 3133143 - protein, 7 aa, Giardia lamblia
RHQYNTK

SEQ ID NO: 3133144 - protein, 6 aa, Giardia lamblia
RHRDPV

SEQ ID NO: 3133145 - protein, 7 aa, Giardia lamblia
RHRPPEE

SEQ ID NO: 3133146 - protein, 18 aa, Giardia lamblia
RHRPTAEECSGRAGTTSE

SEQ ID NO: 3133147 - protein, 6 aa, Giardia lamblia
RHRSDG

SEQ ID NO: 3133148 - protein, 10 aa, Giardia lamblia
RHRSTPSRRK

SEQ ID NO: 3133149 - protein, 5 aa, Giardia lamblia
RHRSY

SEQ ID NO: 3133150 - protein, 8 aa, Giardia lamblia
RHSAQGKT

SEQ ID NO: 3133151 - protein, 14 aa, Giardia lamblia
RHSEEVERVNDRRR

SEQ ID NO: 3133152 - protein, 9 aa, Giardia lamblia
RHSGEDRAR

SEQ ID NO: 3133153 - protein, 4 aa, Giardia lamblia
RHSP

SEQ ID NO: 3133154 - protein, 7 aa, Giardia lamblia
RHSPDHA

SEQ ID NO: 3133155 - protein, 6 aa, Giardia lamblia
RHSPSL

SEQ ID NO: 3133156 - protein, 10 aa, Giardia lamblia
RHSQVPSTDY

SEQ ID NO: 3133157 - protein, 23 aa, Giardia lamblia
RHSSGKSAADFAKNDAILNLLKR

SEQ ID NO: 3133158 - protein, 9 aa, Giardia lamblia
RHSSGKTAI

SEQ ID NO: 3133159 - protein, 15 aa, Giardia lamblia
RHSSPSARSKSPQRY

SEQ ID NO: 3133160 - protein, 11 aa, Giardia lamblia
RHSTQKTNHEH

SEQ ID NO: 3133161 - protein, 12 aa, Giardia lamblia
RHSTRGSKKQAL

SEQ ID NO: 3133162 - protein, 5 aa, Giardia lamblia
RHTEA

SEQ ID NO: 3133163 - protein, 9 aa, Giardia lamblia
RHTKNESSL

SEQ ID NO: 3133164 - protein, 11 aa, Giardia lamblia
RHTPPTDPIAE

SEQ ID NO: 3133165 - protein, 13 aa, Giardia lamblia
RHTPQNVASLVYF

SEQ ID NO: 3133166 - protein, 13 aa, Giardia lamblia
RHTSAGSRLPQET

SEQ ID NO: 3133167 - protein, 7 aa, Giardia lamblia
RHTSGLE

SEQ ID NO: 3133168 - protein, 9 aa, Giardia lamblia
RHYRTQSPV

SEQ ID NO: 3133169 - protein, 39 aa, Giardia lamblia
RIANPAASLEKTPAPDDVSHDTSSYLPTEGSKMDPSDPY

SEQ ID NO: 3133170 - protein, 11 aa, Giardia lamblia
RIASPRVKPKQ

SEQ ID NO: 3133171 - protein, 6 aa, Giardia lamblia
RIASSP

SEQ ID NO: 3133172 - protein, 10 aa, Giardia lamblia
RIDDETNRHI

SEQ ID NO: 3133173 - protein, 17 aa, Giardia lamblia
RIDEEEKPKKSKKSKYI

SEQ ID NO: 3133174 - protein, 12 aa, Giardia lamblia
RIDGRGIGETRD

SEQ ID NO: 3133175 - protein, 14 aa, Giardia lamblia
RIDNSTPKEANTTV

SEQ ID NO: 3133176 - protein, 12 aa, Giardia lamblia
RIDQSRASEVPK

SEQ ID NO: 3133177 - protein, 10 aa, Giardia lamblia
RIDSRGRMTS

SEQ ID NO: 3133178 - protein, 5 aa, Giardia lamblia
RIDTA

SEQ ID NO: 3133179 - protein, 4 aa, Giardia lamblia
RIEE

SEQ ID NO: 3133180 - protein, 6 aa, Giardia lamblia
RIEREK

SEQ ID NO: 3133181 - protein, 6 aa, Giardia lamblia
RIERGK

SEQ ID NO: 3133182 - protein, 27 aa, Giardia lamblia
RIGAGPTSSIDNINDGANDASPANAHG

SEQ ID NO: 3133183 - protein, 25 aa, Giardia lamblia
RIGNGEPPIPEEEGQRSDLPIPTTT

SEQ ID NO: 3133184 - protein, 5 aa, Giardia lamblia
RIGPG

SEQ ID NO: 3133185 - protein, 9 aa, Giardia lamblia
RIGSDEKKY

SEQ ID NO: 3133186 - protein, 6 aa, Giardia lamblia
RIKASG

SEQ ID NO: 3133187 - protein, 9 aa, Giardia lamblia
RIKDSQGTT

SEQ ID NO: 3133188 - protein, 10 aa, Giardia lamblia
RIKPSEPATD

SEQ ID NO: 3133189 - protein, 6 aa, Giardia lamblia
RIKPTV

SEQ ID NO: 3133190 - protein, 6 aa, Giardia lamblia
RINDER

SEQ ID NO: 3133191 - protein, 9 aa, Giardia lamblia
RINQHSSRS

SEQ ID NO: 3133192 - protein, 4 aa, Giardia lamblia
RIPD

SEQ ID NO: 3133193 - protein, 7 aa, Giardia lamblia
RIPLSGS

SEQ ID NO: 3133194 - protein, 10 aa, Giardia lamblia
RIPPPQSKGH

SEQ ID NO: 3133195 - protein, 5 aa, Giardia lamblia
RIPPS

SEQ ID NO: 3133196 - protein, 7 aa, Giardia lamblia
RIPQPPC

SEQ ID NO: 3133197 - protein, 5 aa, Giardia lamblia
RIPQT

SEQ ID NO: 3133198 - protein, 4 aa, Giardia lamblia
RIPT

SEQ ID NO: 3133199 - protein, 7 aa, Giardia lamblia
RIPTEER

SEQ ID NO: 3133200 - protein, 12 aa, Giardia lamblia
RIQTPQNDQQKS

SEQ ID NO: 3133201 - protein, 5 aa, Giardia lamblia
RIRAD

SEQ ID NO: 3133202 - protein, 10 aa, Giardia lamblia
RIRDASGRTP

SEQ ID NO: 3133203 - protein, 9 aa, Giardia lamblia
RIRGPSGRS

SEQ ID NO: 3133204 - protein, 13 aa, Giardia lamblia
RIRPKSKAAKKLK

SEQ ID NO: 3133205 - protein, 7 aa, Giardia lamblia
RISAESY

SEQ ID NO: 3133206 - protein, 8 aa, Giardia lamblia
RISASGPL

SEQ ID NO: 3133207 - protein, 17 aa, Giardia lamblia
RISEGYSAGVSSSPRIQ

SEQ ID NO: 3133208 - protein, 53 aa, Giardia lamblia
RISGPSSKPPASGNTPSQTPQPGTAAAKNAASLGRVSGSPERALPASTGQYGS

SEQ ID NO: 3133209 - protein, 15 aa, Giardia lamblia
RISNDPSDLVKETPA

SEQ ID NO: 3133210 - protein, 14 aa, Giardia lamblia
RISPVGKSQQRKTS

SEQ ID NO: 3133211 - protein, 5 aa, Giardia lamblia
RISSE

SEQ ID NO: 3133212 - protein, 10 aa, Giardia lamblia
RISSPEDRKY

SEQ ID NO: 3133213 - protein, 11 aa, Giardia lamblia
RISTESRRPLP

SEQ ID NO: 3133214 - protein, 8 aa, Giardia lamblia
RISTQRET

SEQ ID NO: 3133215 - protein, 9 aa, Giardia lamblia
RISTREQHL

SEQ ID NO: 3133216 - protein, 7 aa, Giardia lamblia
RISTTPP

SEQ ID NO: 3133217 - protein, 10 aa, Giardia lamblia
RITDSKGRTA

SEQ ID NO: 3133218 - protein, 4 aa, Giardia lamblia
RITG

SEQ ID NO: 3133219 - protein, 14 aa, Giardia lamblia
RITGTKPDGTPIRS

SEQ ID NO: 3133220 - protein, 5 aa, Giardia lamblia
RITKD

SEQ ID NO: 3133221 - protein, 7 aa, Giardia lamblia
RITPNTD

SEQ ID NO: 3133222 - protein, 6 aa, Giardia lamblia
RITTEE

SEQ ID NO: 3133223 - protein, 23 aa, Giardia lamblia
RIVPPQTIKPPARPARPIPPPNH

SEQ ID NO: 3133224 - protein, 10 aa, Giardia lamblia
RIVPPRGPQT

SEQ ID NO: 3133225 - protein, 6 aa, Giardia lamblia
RIYASS

SEQ ID NO: 3133226 - protein, 4 aa, Giardia lamblia
RKAA

SEQ ID NO: 3133227 - protein, 15 aa, Giardia lamblia
RKAAASTPEAKDAAM

SEQ ID NO: 3133228 - protein, 18 aa, Giardia lamblia
RKAADDLKRMQSETNTEF

SEQ ID NO: 3133229 - protein, 8 aa, Giardia lamblia
RKAAEEYR

SEQ ID NO: 3133230 - protein, 13 aa, Giardia lamblia
RKAAELATTPYPQ

SEQ ID NO: 3133231 - protein, 8 aa, Giardia lamblia
RKAAGFAG

SEQ ID NO: 3133232 - protein, 7 aa, Giardia lamblia
RKAAQDL

SEQ ID NO: 3133233 - protein, 61 aa, Giardia lamblia
RKADKGAEKPVEETEARTATSTAKQSSPADDAKASGASGTVVPERKDGDVFDSAGTTVRRR

SEQ ID NO: 3133234 - protein, 7 aa, Giardia lamblia
RKAEGLE

SEQ ID NO: 3133235 - protein, 9 aa, Giardia lamblia
RKAKDKIKH

SEQ ID NO: 3133236 - protein, 8 aa, Giardia lamblia
RKAKESEA

SEQ ID NO: 3133237 - protein, 6 aa, Giardia lamblia
RKALPD

SEQ ID NO: 3133238 - protein, 6 aa, Giardia lamblia
RKANPK

SEQ ID NO: 3133239 - protein, 5 aa, Giardia lamblia
RKANS

SEQ ID NO: 3133240 - protein, 8 aa, Giardia lamblia
RKAPDNDQ

SEQ ID NO: 3133241 - protein, 9 aa, Giardia lamblia
RKAPEAQIS

SEQ ID NO: 3133242 - protein, 6 aa, Giardia lamblia
RKAPHI

SEQ ID NO: 3133243 - protein, 6 aa, Giardia lamblia
RKAPKY

SEQ ID NO: 3133244 - protein, 7 aa, Giardia lamblia
RKAPNYL

SEQ ID NO: 3133245 - protein, 8 aa, Giardia lamblia
RKAQVRKE

SEQ ID NO: 3133246 - protein, 4 aa, Giardia lamblia
RKAR

SEQ ID NO: 3133247 - protein, 12 aa, Giardia lamblia
RKASIRTSRELR

SEQ ID NO: 3133248 - protein, 9 aa, Giardia lamblia
RKATDGVGP

SEQ ID NO: 3133249 - protein, 8 aa, Giardia lamblia
RKATGDSH

SEQ ID NO: 3133250 - protein, 5 aa, Giardia lamblia
RKATS

SEQ ID NO: 3133251 - protein, 8 aa, Giardia lamblia
RKAVSGGS

SEQ ID NO: 3133252 - protein, 7 aa, Giardia lamblia
RKAYGTA

SEQ ID NO: 3133253 - protein, 30 aa, Giardia lamblia
RKCGNNLESAASPTHTEPAQAKLAKADKQM

SEQ ID NO: 3133254 - protein, 4 aa, Giardia lamblia
RKDC

SEQ ID NO: 3133255 - protein, 8 aa, Giardia lamblia
RKDDEISR

SEQ ID NO: 3133256 - protein, 11 aa, Giardia lamblia
RKDDSGAGRIN

SEQ ID NO: 3133257 - protein, 6 aa, Giardia lamblia
RKDDTY

SEQ ID NO: 3133258 - protein, 18 aa, Giardia lamblia
RKDDVSGQLNQKIKSANE

SEQ ID NO: 3133259 - protein, 5 aa, Giardia lamblia
RKDEY

SEQ ID NO: 3133260 - protein, 8 aa, Giardia lamblia
RKDGKTAL

SEQ ID NO: 3133261 - protein, 8 aa, Giardia lamblia
RKDGQAAE

SEQ ID NO: 3133262 - protein, 8 aa, Giardia lamblia
RKDGSYDV

SEQ ID NO: 3133263 - protein, 15 aa, Giardia lamblia
RKDINAKIVDLLGSV

SEQ ID NO: 3133264 - protein, 7 aa, Giardia lamblia
RKDIPES

SEQ ID NO: 3133265 - protein, 6 aa, Giardia lamblia
RKDKPL

SEQ ID NO: 3133266 - protein, 10 aa, Giardia lamblia
RKDNAPDVAE

SEQ ID NO: 3133267 - protein, 5 aa, Giardia lamblia
RKDPQ

SEQ ID NO: 3133268 - protein, 5 aa, Giardia lamblia
RKDRE

SEQ ID NO: 3133269 - protein, 7 aa, Giardia lamblia
RKDREID

SEQ ID NO: 3133270 - protein, 7 aa, Giardia lamblia
RKDRGGI

SEQ ID NO: 3133271 - protein, 16 aa, Giardia lamblia
RKDSNSSLQPPDTTVK

SEQ ID NO: 3133272 - protein, 8 aa, Giardia lamblia
RKDSSTGM

SEQ ID NO: 3133273 - protein, 15 aa, Giardia lamblia
RKDSWKPRSNSSSCD

SEQ ID NO: 3133274 - protein, 14 aa, Giardia lamblia
RKDTVERGESLQRP

SEQ ID NO: 3133275 - protein, 7 aa, Giardia lamblia
RKEAEMK

SEQ ID NO: 3133276 - protein, 18 aa, Giardia lamblia
RKEAGDNALRADEKTAEL

SEQ ID NO: 3133277 - protein, 8 aa, Giardia lamblia
RKEAGYKI

SEQ ID NO: 3133278 - protein, 19 aa, Giardia lamblia
RKEARLAEKRAREEERARE

SEQ ID NO: 3133279 - protein, 6 aa, Giardia lamblia
RKEDDL

SEQ ID NO: 3133280 - protein, 8 aa, Giardia lamblia
RKEEAITT

SEQ ID NO: 3133281 - protein, 9 aa, Giardia lamblia
RKEESASMS

SEQ ID NO: 3133282 - protein, 8 aa, Giardia lamblia
RKEGGKKL

SEQ ID NO: 3133283 - protein, 9 aa, Giardia lamblia
RKEGRVSEM

SEQ ID NO: 3133284 - protein, 17 aa, Giardia lamblia
RKEKQAEPVEKEPRPSA

SEQ ID NO: 3133285 - protein, 4 aa, Giardia lamblia
RKEL

SEQ ID NO: 3133286 - protein, 22 aa, Giardia lamblia
RKELENAQSLSAERQRTTKSDM

SEQ ID NO: 3133287 - protein, 8 aa, Giardia lamblia
RKENAAVE

SEQ ID NO: 3133288 - protein, 8 aa, Giardia lamblia
RKENAPTA

SEQ ID NO: 3133289 - protein, 9 aa, Giardia lamblia
RKENGGIKE

SEQ ID NO: 3133290 - protein, 8 aa, Giardia lamblia
RKENSDLQ

SEQ ID NO: 3133291 - protein, 5 aa, Giardia lamblia
RKEPA

SEQ ID NO: 3133292 - protein, 4 aa, Giardia lamblia
RKEQ

SEQ ID NO: 3133293 - protein, 5 aa, Giardia lamblia
RKEQI

SEQ ID NO: 3133294 - protein, 8 aa, Giardia lamblia
RKERELEE

SEQ ID NO: 3133295 - protein, 8 aa, Giardia lamblia
RKEWDKRQ

SEQ ID NO: 3133296 - protein, 7 aa, Giardia lamblia
RKFPGDS

SEQ ID NO: 3133297 - protein, 8 aa, Giardia lamblia
RKGAAPAL

SEQ ID NO: 3133298 - protein, 5 aa, Giardia lamblia
RKGAI

SEQ ID NO: 3133299 - protein, 4 aa, Giardia lamblia
RKGC

SEQ ID NO: 3133300 - protein, 8 aa, Giardia lamblia
RKGERDAL

SEQ ID NO: 3133301 - protein, 7 aa, Giardia lamblia
RKGFERQ

SEQ ID NO: 3133302 - protein, 7 aa, Giardia lamblia
RKGGPDA

SEQ ID NO: 3133303 - protein, 7 aa, Giardia lamblia
RKGGSDA

SEQ ID NO: 3133304 - protein, 4 aa, Giardia lamblia
RKGH

SEQ ID NO: 3133305 - protein, 5 aa, Giardia lamblia
RKGHT

SEQ ID NO: 3133306 - protein, 26 aa, Giardia lamblia
RKGLRSLNSDEAPGAKLSQGNITSST

SEQ ID NO: 3133307 - protein, 5 aa, Giardia lamblia
RKGMK

SEQ ID NO: 3133308 - protein, 18 aa, Giardia lamblia
RKGNKKVKRFDTELDGRI

SEQ ID NO: 3133309 - protein, 5 aa, Giardia lamblia
RKGTP

SEQ ID NO: 3133310 - protein, 8 aa, Giardia lamblia
RKHEEDSI

SEQ ID NO: 3133311 - protein, 7 aa, Giardia lamblia
RKHESEE

SEQ ID NO: 3133312 - protein, 17 aa, Giardia lamblia
RKHESKDETRLSSSPTE

SEQ ID NO: 3133313 - protein, 5 aa, Giardia lamblia
RKHGG

SEQ ID NO: 3133314 - protein, 6 aa, Giardia lamblia
RKHGVA

SEQ ID NO: 3133315 - protein, 9 aa, Giardia lamblia
RKHLSPQRY

SEQ ID NO: 3133316 - protein, 8 aa, Giardia lamblia
RKHNNANA

SEQ ID NO: 3133317 - protein, 4 aa, Giardia lamblia
RKHQ

SEQ ID NO: 3133318 - protein, 6 aa, Giardia lamblia
RKHQET

SEQ ID NO: 3133319 - protein, 12 aa, Giardia lamblia
RKHRGKDGISAE

SEQ ID NO: 3133320 - protein, 6 aa, Giardia lamblia
RKHSGM

SEQ ID NO: 3133321 - protein, 37 aa, Giardia lamblia
RKHSSLQASKAGSSKTDGPRPPDVRQKAPIPSTRAKN

SEQ ID NO: 3133322 - protein, 7 aa, Giardia lamblia
RKHTTRR

SEQ ID NO: 3133323 - protein, 7 aa, Giardia lamblia
RKIEGAT

SEQ ID NO: 3133324 - protein, 7 aa, Giardia lamblia
RKIPSDC

SEQ ID NO: 3133325 - protein, 5 aa, Giardia lamblia
RKKAG

SEQ ID NO: 3133326 - protein, 9 aa, Giardia lamblia
RKKAGKNDD

SEQ ID NO: 3133327 - protein, 16 aa, Giardia lamblia
RKKGIYDNRPSSGNGS

SEQ ID NO: 3133328 - protein, 14 aa, Giardia lamblia
RKKPLLQAPDAQPN

SEQ ID NO: 3133329 - protein, 7 aa, Giardia lamblia
RKKSAKG

SEQ ID NO: 3133330 - protein, 6 aa, Giardia lamblia
RKLESE

SEQ ID NO: 3133331 - protein, 8 aa, Giardia lamblia
RKLRSDYN

SEQ ID NO: 3133332 - protein, 17 aa, Giardia lamblia
RKLSNEEAHDWANDPAN

SEQ ID NO: 3133333 - protein, 7 aa, Giardia lamblia
RKLSRDK

SEQ ID NO: 3133334 - protein, 10 aa, Giardia lamblia
RKLSRNRNTM

SEQ ID NO: 3133335 - protein, 4 aa, Giardia lamblia
RKLT

SEQ ID NO: 3133336 - protein, 20 aa, Giardia lamblia
RKLTQSADEGKSLTTNISAQ

SEQ ID NO: 3133337 - protein, 8 aa, Giardia lamblia
RKLTTKKS

SEQ ID NO: 3133338 - protein, 23 aa, Giardia lamblia
RKMSGSKHKEHTPDSPRATSPLA

SEQ ID NO: 3133339 - protein, 9 aa, Giardia lamblia
RKNATSALH

SEQ ID NO: 3133340 - protein, 7 aa, Giardia lamblia
RKNDGLP

SEQ ID NO: 3133341 - protein, 13 aa, Giardia lamblia
RKNDSITFPTGQQ

SEQ ID NO: 3133342 - protein, 8 aa, Giardia lamblia
RKNGLPDT

SEQ ID NO: 3133343 - protein, 6 aa, Giardia lamblia
RKNHVP

SEQ ID NO: 3133344 - protein, 6 aa, Giardia lamblia
RKNNEQ

SEQ ID NO: 3133345 - protein, 4 aa, Giardia lamblia
RKNP

SEQ ID NO: 3133346 - protein, 40 aa, Giardia lamblia
RKNPANPPQKSESSIGSTPLTQTSGPGDSLSSSVTPYDPA

SEQ ID NO: 3133347 - protein, 9 aa, Giardia lamblia
RKNPNSDSI

SEQ ID NO: 3133348 - protein, 11 aa, Giardia lamblia
RKNRSPRVSRR

SEQ ID NO: 3133349 - protein, 6 aa, Giardia lamblia
RKNSKL

SEQ ID NO: 3133350 - protein, 12 aa, Giardia lamblia
RKNTNDSASEKE

SEQ ID NO: 3133351 - protein, 9 aa, Giardia lamblia
RKNTPAASM

SEQ ID NO: 3133352 - protein, 8 aa, Giardia lamblia
RKNTSKVG

SEQ ID NO: 3133353 - protein, 14 aa, Giardia lamblia
RKPAGTKAKGGESL

SEQ ID NO: 3133354 - protein, 7 aa, Giardia lamblia
RKPDALG

SEQ ID NO: 3133355 - protein, 13 aa, Giardia lamblia
RKPEAEVKPEQAQ

SEQ ID NO: 3133356 - protein, 5 aa, Giardia lamblia
RKPEC

SEQ ID NO: 3133357 - protein, 11 aa, Giardia lamblia
RKPEDDPGRQT

SEQ ID NO: 3133358 - protein, 5 aa, Giardia lamblia
RKPEE

SEQ ID NO: 3133359 - protein, 6 aa, Giardia lamblia
RKPEVS

SEQ ID NO: 3133360 - protein, 7 aa, Giardia lamblia
RKPGPVD

SEQ ID NO: 3133361 - protein, 9 aa, Giardia lamblia
RKPKATQQS

SEQ ID NO: 3133362 - protein, 11 aa, Giardia lamblia
RKPKVPPYGPD

SEQ ID NO: 3133363 - protein, 6 aa, Giardia lamblia
RKPNPI

SEQ ID NO: 3133364 - protein, 6 aa, Giardia lamblia
RKPPNI

SEQ ID NO: 3133365 - protein, 28 aa, Giardia lamblia
RKPPTATPTLQDSVAESSLTERTESQAI

SEQ ID NO: 3133366 - protein, 9 aa, Giardia lamblia
RKPQPPQGA

SEQ ID NO: 3133367 - protein, 6 aa, Giardia lamblia
RKPSDH

SEQ ID NO: 3133368 - protein, 8 aa, Giardia lamblia
RKPSEKPI

SEQ ID NO: 3133369 - protein, 9 aa, Giardia lamblia
RKPSKQAEL

SEQ ID NO: 3133370 - protein, 7 aa, Giardia lamblia
RKPVGDP

SEQ ID NO: 3133371 - protein, 11 aa, Giardia lamblia
RKPVPKSDSDA

SEQ ID NO: 3133372 - protein, 4 aa, Giardia lamblia
RKQA

SEQ ID NO: 3133373 - protein, 5 aa, Giardia lamblia
RKQDP

SEQ ID NO: 3133374 - protein, 9 aa, Giardia lamblia
RKQEEYNRV

SEQ ID NO: 3133375 - protein, 5 aa, Giardia lamblia
RKQGR

SEQ ID NO: 3133376 - protein, 12 aa, Giardia lamblia
RKQIDADSREVN

SEQ ID NO: 3133377 - protein, 4 aa, Giardia lamblia
RKQL

SEQ ID NO: 3133378 - protein, 8 aa, Giardia lamblia
RKQLPAES

SEQ ID NO: 3133379 - protein, 9 aa, Giardia lamblia
RKQMETKDE

SEQ ID NO: 3133380 - protein, 4 aa, Giardia lamblia
RKQQ

SEQ ID NO: 3133381 - protein, 8 aa, Giardia lamblia
RKQRDDNI

SEQ ID NO: 3133382 - protein, 37 aa, Giardia lamblia
RKQRQSQEEKEAVSNSKFRKKRDMDAGPDGPSAQQLR

SEQ ID NO: 3133383 - protein, 25 aa, Giardia lamblia
RKQSQKCKKKSSIQVSPKPVASPSY

SEQ ID NO: 3133384 - protein, 6 aa, Giardia lamblia
RKQTCD

SEQ ID NO: 3133385 - protein, 9 aa, Giardia lamblia
RKQTSIPAP

SEQ ID NO: 3133386 - protein, 9 aa, Giardia lamblia
RKQTSLGET

SEQ ID NO: 3133387 - protein, 7 aa, Giardia lamblia
RKQTTKP

SEQ ID NO: 3133388 - protein, 8 aa, Giardia lamblia
RKQVADNQ

SEQ ID NO: 3133389 - protein, 8 aa, Giardia lamblia
RKRAKKAI

SEQ ID NO: 3133390 - protein, 11 aa, Giardia lamblia
RKREPKPLPEK

SEQ ID NO: 3133391 - protein, 17 aa, Giardia lamblia
RKRGQDRPSVSSYHEPT

SEQ ID NO: 3133392 - protein, 7 aa, Giardia lamblia
RKRPQPL

SEQ ID NO: 3133393 - protein, 11 aa, Giardia lamblia
RKRQRDKRELP

SEQ ID NO: 3133394 - protein, 8 aa, Giardia lamblia
RKRRRERD

SEQ ID NO: 3133395 - protein, 10 aa, Giardia lamblia
RKRSGTPDYG

SEQ ID NO: 3133396 - protein, 9 aa, Giardia lamblia
RKRSKNNHT

SEQ ID NO: 3133397 - protein, 14 aa, Giardia lamblia
RKRTAGEAETDGLR

SEQ ID NO: 3133398 - protein, 10 aa, Giardia lamblia
RKRTLGKTEP

SEQ ID NO: 3133399 - protein, 5 aa, Giardia lamblia
RKRTP

SEQ ID NO: 3133400 - protein, 10 aa, Giardia lamblia
RKRTRSSHNE

SEQ ID NO: 3133401 - protein, 7 aa, Giardia lamblia
RKRTTER

SEQ ID NO: 3133402 - protein, 7 aa, Giardia lamblia
RKSAFER

SEQ ID NO: 3133403 - protein, 9 aa, Giardia lamblia
RKSASTSMT

SEQ ID NO: 3133404 - protein, 10 aa, Giardia lamblia
RKSDAPPTSA

SEQ ID NO: 3133405 - protein, 13 aa, Giardia lamblia
RKSGADEASGLRG

SEQ ID NO: 3133406 - protein, 20 aa, Giardia lamblia
RKSGLSDMAAPSARKHTRSS

SEQ ID NO: 3133407 - protein, 7 aa, Giardia lamblia
RKSIEAG

SEQ ID NO: 3133408 - protein, 9 aa, Giardia lamblia
RKSKGSRKA

SEQ ID NO: 3133409 - protein, 16 aa, Giardia lamblia
RKSKPRPYSGHSSNTV

SEQ ID NO: 3133410 - protein, 5 aa, Giardia lamblia
RKSLK

SEQ ID NO: 3133411 - protein, 10 aa, Giardia lamblia
RKSLTAKKEI

SEQ ID NO: 3133412 - protein, 17 aa, Giardia lamblia
RKSLTQQSAWQKGRAEG

SEQ ID NO: 3133413 - protein, 9 aa, Giardia lamblia
RKSMDDPDA

SEQ ID NO: 3133414 - protein, 4 aa, Giardia lamblia
RKSN

SEQ ID NO: 3133415 - protein, 12 aa, Giardia lamblia
RKSNDFLSNEKK

SEQ ID NO: 3133416 - protein, 18 aa, Giardia lamblia
RKSNPLNQNSESDFESCP

SEQ ID NO: 3133417 - protein, 7 aa, Giardia lamblia
RKSNPQL

SEQ ID NO: 3133418 - protein, 8 aa, Giardia lamblia
RKSNSGIS

SEQ ID NO: 3133419 - protein, 14 aa, Giardia lamblia
RKSPKRDPGSPRSA

SEQ ID NO: 3133420 - protein, 26 aa, Giardia lamblia
RKSPSLSKKQIHSSNSPQVPPPEQTY

SEQ ID NO: 3133421 - protein, 21 aa, Giardia lamblia
RKSRRRIDKRKRDAPSPISTL

SEQ ID NO: 3133422 - protein, 11 aa, Giardia lamblia
RKSSANSLNQE

SEQ ID NO: 3133423 - protein, 6 aa, Giardia lamblia
RKSSHQ

SEQ ID NO: 3133424 - protein, 8 aa, Giardia lamblia
RKSSQQTA

SEQ ID NO: 3133425 - protein, 8 aa, Giardia lamblia
RKSSSTRR

SEQ ID NO: 3133426 - protein, 22 aa, Giardia lamblia
RKSTASTAQAYAEANTRQPNNY

SEQ ID NO: 3133427 - protein, 17 aa, Giardia lamblia
RKSTDPYSDACGKSSYN

SEQ ID NO: 3133428 - protein, 8 aa, Giardia lamblia
RKSTTEAP

SEQ ID NO: 3133429 - protein, 9 aa, Giardia lamblia
RKSVPQETL

SEQ ID NO: 3133430 - protein, 23 aa, Giardia lamblia
RKSYGGSPSRAPISTHTTQVPTV

SEQ ID NO: 3133431 - protein, 18 aa, Giardia lamblia
RKTDSKNNRNLDDQTVAP

SEQ ID NO: 3133432 - protein, 4 aa, Giardia lamblia
RKTE

SEQ ID NO: 3133433 - protein, 6 aa, Giardia lamblia
RKTEQD

SEQ ID NO: 3133434 - protein, 18 aa, Giardia lamblia
RKTNSARPMGQSSGYGQP

SEQ ID NO: 3133435 - protein, 6 aa, Giardia lamblia
RKTNVG

SEQ ID NO: 3133436 - protein, 7 aa, Giardia lamblia
RKTPGAY

SEQ ID NO: 3133437 - protein, 5 aa, Giardia lamblia
RKTPM

SEQ ID NO: 3133438 - protein, 7 aa, Giardia lamblia
RKTTASF

SEQ ID NO: 3133439 - protein, 9 aa, Giardia lamblia
RKTTKDTQS

SEQ ID NO: 3133440 - protein, 20 aa, Giardia lamblia
RKTTKQGDGQDVVDASSTEE

SEQ ID NO: 3133441 - protein, 6 aa, Giardia lamblia
RKTTPG

SEQ ID NO: 3133442 - protein, 7 aa, Giardia lamblia
RKTVNGN

SEQ ID NO: 3133443 - protein, 14 aa, Giardia lamblia
RKVERKEPKSPNPY

SEQ ID NO: 3133444 - protein, 4 aa, Giardia lamblia
RKVP

SEQ ID NO: 3133445 - protein, 6 aa, Giardia lamblia
RKVPRT

SEQ ID NO: 3133446 - protein, 4 aa, Giardia lamblia
RKVR

SEQ ID NO: 3133447 - protein, 20 aa, Giardia lamblia
RKVTPKDIANAKAYAEQHGL

SEQ ID NO: 3133448 - protein, 8 aa, Giardia lamblia
RKYATPEK

SEQ ID NO: 3133449 - protein, 10 aa, Giardia lamblia
RKYDNSPFPE

SEQ ID NO: 3133450 - protein, 6 aa, Giardia lamblia
RKYESH

SEQ ID NO: 3133451 - protein, 4 aa, Giardia lamblia
RKYG

SEQ ID NO: 3133452 - protein, 7 aa, Giardia lamblia
RKYGAPN

SEQ ID NO: 3133453 - protein, 16 aa, Giardia lamblia
RKYPEDRVPLSTGRSE

SEQ ID NO: 3133454 - protein, 6 aa, Giardia lamblia
RKYPGK

SEQ ID NO: 3133455 - protein, 12 aa, Giardia lamblia
RKYRKSIKSDAE

SEQ ID NO: 3133456 - protein, 6 aa, Giardia lamblia
RKYRNR

SEQ ID NO: 3133457 - protein, 11 aa, Giardia lamblia
RLAENQNLSDR

SEQ ID NO: 3133458 - protein, 4 aa, Giardia lamblia
RLAG

SEQ ID NO: 3133459 - protein, 11 aa, Giardia lamblia
RLAKEQAEHSK

SEQ ID NO: 3133460 - protein, 10 aa, Giardia lamblia
RLANTNESMR

SEQ ID NO: 3133461 - protein, 9 aa, Giardia lamblia
RLAPGFSDQ

SEQ ID NO: 3133462 - protein, 17 aa, Giardia lamblia
RLARDNKKPVSGSESVA

SEQ ID NO: 3133463 - protein, 5 aa, Giardia lamblia
RLDDN

SEQ ID NO: 3133464 - protein, 5 aa, Giardia lamblia
RLDEE

SEQ ID NO: 3133465 - protein, 8 aa, Giardia lamblia
RLDEEQAF

SEQ ID NO: 3133466 - protein, 8 aa, Giardia lamblia
RLDERDKQ

SEQ ID NO: 3133467 - protein, 23 aa, Giardia lamblia
RLDGKDAKPVSRYSGRRRRGHSL

SEQ ID NO: 3133468 - protein, 9 aa, Giardia lamblia
RLDGRGKAI

SEQ ID NO: 3133469 - protein, 14 aa, Giardia lamblia
RLDSGASAGYGWFT

SEQ ID NO: 3133470 - protein, 17 aa, Giardia lamblia
RLDSKGEVGYDSIYSKV

SEQ ID NO: 3133471 - protein, 7 aa, Giardia lamblia
RLDSQQD

SEQ ID NO: 3133472 - protein, 7 aa, Giardia lamblia
RLDSTTA

SEQ ID NO: 3133473 - protein, 9 aa, Giardia lamblia
RLDTESELE

SEQ ID NO: 3133474 - protein, 4 aa, Giardia lamblia
RLEA

SEQ ID NO: 3133475 - protein, 7 aa, Giardia lamblia
RLEATNK

SEQ ID NO: 3133476 - protein, 8 aa, Giardia lamblia
RLEEAESY

SEQ ID NO: 3133477 - protein, 11 aa, Giardia lamblia
RLEEEARSMRS

SEQ ID NO: 3133478 - protein, 12 aa, Giardia lamblia
RLEESKKADEAM

SEQ ID NO: 3133479 - protein, 12 aa, Giardia lamblia
RLEQAEAEADAL

SEQ ID NO: 3133480 - protein, 9 aa, Giardia lamblia
RLEQENRAL

SEQ ID NO: 3133481 - protein, 8 aa, Giardia lamblia
RLESKSAE

SEQ ID NO: 3133482 - protein, 11 aa, Giardia lamblia
RLESPSSNQDV

SEQ ID NO: 3133483 - protein, 8 aa, Giardia lamblia
RLETSSAK

SEQ ID NO: 3133484 - protein, 10 aa, Giardia lamblia
RLGRSDGGIA

SEQ ID NO: 3133485 - protein, 20 aa, Giardia lamblia
RLGSEAEVKAAGKVRTEGKN

SEQ ID NO: 3133486 - protein, 16 aa, Giardia lamblia
RLGSSGCTQHTENRVN

SEQ ID NO: 3133487 - protein, 9 aa, Giardia lamblia
RLGTPNPRY

SEQ ID NO: 3133488 - protein, 9 aa, Giardia lamblia
RLGTSGRGS

SEQ ID NO: 3133489 - protein, 4 aa, Giardia lamblia
RLHT

SEQ ID NO: 3133490 - protein, 6 aa, Giardia lamblia
RLIDQP

SEQ ID NO: 3133491 - protein, 17 aa, Giardia lamblia
RLKKRGTEKATVTLGAK

SEQ ID NO: 3133492 - protein, 8 aa, Giardia lamblia
RLKNSNQE

SEQ ID NO: 3133493 - protein, 9 aa, Giardia lamblia
RLNEEKEAS

SEQ ID NO: 3133494 - protein, 9 aa, Giardia lamblia
RLNETNKKL

SEQ ID NO: 3133495 - protein, 8 aa, Giardia lamblia
RLNPAGDL

SEQ ID NO: 3133496 - protein, 8 aa, Giardia lamblia
RLNPAGES

SEQ ID NO: 3133497 - protein, 10 aa, Giardia lamblia
RLNPKDGDIR

SEQ ID NO: 3133498 - protein, 13 aa, Giardia lamblia
RLNPTGATRSVRD

SEQ ID NO: 3133499 - protein, 4 aa, Giardia lamblia
RLNS

SEQ ID NO: 3133500 - protein, 10 aa, Giardia lamblia
RLPAASSVSD

SEQ ID NO: 3133501 - protein, 7 aa, Giardia lamblia
RLPAGQN

SEQ ID NO: 3133502 - protein, 18 aa, Giardia lamblia
RLPATGPTNLTNDSDREA

SEQ ID NO: 3133503 - protein, 6 aa, Giardia lamblia
RLPDGR

SEQ ID NO: 3133504 - protein, 4 aa, Giardia lamblia
RLPE

SEQ ID NO: 3133505 - protein, 37 aa, Giardia lamblia
RLPGGGVRTGEIDPNALTKSTRHVKQSEEARVKRSKR

SEQ ID NO: 3133506 - protein, 28 aa, Giardia lamblia
RLPGPSGDAVASSDSINERGFNEPPMAG

SEQ ID NO: 3133507 - protein, 14 aa, Giardia lamblia
RLPKPGQTNTTGKT

SEQ ID NO: 3133508 - protein, 6 aa, Giardia lamblia
RLPPRV

SEQ ID NO: 3133509 - protein, 27 aa, Giardia lamblia
RLPQTKRTQPPRVDQRHRKPPPPSGFS

SEQ ID NO: 3133510 - protein, 13 aa, Giardia lamblia
RLPSGQKKLISSK

SEQ ID NO: 3133511 - protein, 25 aa, Giardia lamblia
RLPSPPKLSSRSPSSGSPATASSQA

SEQ ID NO: 3133512 - protein, 12 aa, Giardia lamblia
RLPSQSGTEGEA

SEQ ID NO: 3133513 - protein, 6 aa, Giardia lamblia
RLPTEQ

SEQ ID NO: 3133514 - protein, 4 aa, Giardia lamblia
RLPY

SEQ ID NO: 3133515 - protein, 6 aa, Giardia lamblia
RLPYQG

SEQ ID NO: 3133516 - protein, 9 aa, Giardia lamblia
RLQDDGKRT

SEQ ID NO: 3133517 - protein, 6 aa, Giardia lamblia
RLQDTA

SEQ ID NO: 3133518 - protein, 6 aa, Giardia lamblia
RLQEET

SEQ ID NO: 3133519 - protein, 7 aa, Giardia lamblia
RLQEETE

SEQ ID NO: 3133520 - protein, 10 aa, Giardia lamblia
RLQNSNDDLE

SEQ ID NO: 3133521 - protein, 7 aa, Giardia lamblia
RLQNTDG

SEQ ID NO: 3133522 - protein, 8 aa, Giardia lamblia
RLQQSTPL

SEQ ID NO: 3133523 - protein, 13 aa, Giardia lamblia
RLQREASNARRAL

SEQ ID NO: 3133524 - protein, 9 aa, Giardia lamblia
RLQRTGSAV

SEQ ID NO: 3133525 - protein, 5 aa, Giardia lamblia
RLQTP

SEQ ID NO: 3133526 - protein, 9 aa, Giardia lamblia
RLRDRAGRT

SEQ ID NO: 3133527 - protein, 6 aa, Giardia lamblia
RLRDRD

SEQ ID NO: 3133528 - protein, 6 aa, Giardia lamblia
RLRGKK

SEQ ID NO: 3133529 - protein, 6 aa, Giardia lamblia
RLRPGT

SEQ ID NO: 3133530 - protein, 9 aa, Giardia lamblia
RLRSPGNKT

SEQ ID NO: 3133531 - protein, 24 aa, Giardia lamblia
RLRTDQEGAGPPARSLDHAQIAPA

SEQ ID NO: 3133532 - protein, 12 aa, Giardia lamblia
RLRTTEANLAQS

SEQ ID NO: 3133533 - protein, 11 aa, Giardia lamblia
RLSDDDRHSLE

SEQ ID NO: 3133534 - protein, 7 aa, Giardia lamblia
RLSDEKT

SEQ ID NO: 3133535 - protein, 19 aa, Giardia lamblia
RLSESASQREADLAEQAQK

SEQ ID NO: 3133536 - protein, 6 aa, Giardia lamblia
RLSESL

SEQ ID NO: 3133537 - protein, 7 aa, Giardia lamblia
RLSGTSR

SEQ ID NO: 3133538 - protein, 20 aa, Giardia lamblia
RLSKTGKVKGSITDTPGHSQ

SEQ ID NO: 3133539 - protein, 4 aa, Giardia lamblia
RLSN

SEQ ID NO: 3133540 - protein, 11 aa, Giardia lamblia
RLSNRSGNTYT

SEQ ID NO: 3133541 - protein, 11 aa, Giardia lamblia
RLSNTATECRR

SEQ ID NO: 3133542 - protein, 43 aa, Giardia lamblia
RLSPPRASPSSFAQRPPPSGRIANGSSHDLPNPVSYERSAPMT

SEQ ID NO: 3133543 - protein, 6 aa, Giardia lamblia
RLSPSL

SEQ ID NO: 3133544 - protein, 6 aa, Giardia lamblia
RLSPST

SEQ ID NO: 3133545 - protein, 5 aa, Giardia lamblia
RLSQK

SEQ ID NO: 3133546 - protein, 11 aa, Giardia lamblia
RLSQPDPQCTG

SEQ ID NO: 3133547 - protein, 5 aa, Giardia lamblia
RLSQS

SEQ ID NO: 3133548 - protein, 17 aa, Giardia lamblia
RLSQSSDQARSSKAAVA

SEQ ID NO: 3133549 - protein, 11 aa, Giardia lamblia
RLSRPRDGGTA

SEQ ID NO: 3133550 - protein, 8 aa, Giardia lamblia
RLSRSGNS

SEQ ID NO: 3133551 - protein, 12 aa, Giardia lamblia
RLSRSTSNDSKT

SEQ ID NO: 3133552 - protein, 13 aa, Giardia lamblia
RLSSSQENSPRDF

SEQ ID NO: 3133553 - protein, 7 aa, Giardia lamblia
RLSTEAT

SEQ ID NO: 3133554 - protein, 9 aa, Giardia lamblia
RLSTGQIDS

SEQ ID NO: 3133555 - protein, 8 aa, Giardia lamblia
RLSTSSSI

SEQ ID NO: 3133556 - protein, 7 aa, Giardia lamblia
RLSYESS

SEQ ID NO: 3133557 - protein, 13 aa, Giardia lamblia
RLTAKNESLEQKY

SEQ ID NO: 3133558 - protein, 13 aa, Giardia lamblia
RLTEERDGLRQQN

SEQ ID NO: 3133559 - protein, 9 aa, Giardia lamblia
RLTEKAAEV

SEQ ID NO: 3133560 - protein, 8 aa, Giardia lamblia
RLTHRANQ

SEQ ID NO: 3133561 - protein, 15 aa, Giardia lamblia
RLTNTPSLSESSDPV

SEQ ID NO: 3133562 - protein, 7 aa, Giardia lamblia
RLTPIQQ

SEQ ID NO: 3133563 - protein, 8 aa, Giardia lamblia
RLTPTPNT

SEQ ID NO: 3133564 - protein, 11 aa, Giardia lamblia
RLTRSRNPITE

SEQ ID NO: 3133565 - protein, 12 aa, Giardia lamblia
RLTSEHTGATEG

SEQ ID NO: 3133566 - protein, 7 aa, Giardia lamblia
RLTTPEG

SEQ ID NO: 3133567 - protein, 15 aa, Giardia lamblia
RLTTQSSSDPSDPLQ

SEQ ID NO: 3133568 - protein, 11 aa, Giardia lamblia
RLTTTDIPQQN

SEQ ID NO: 3133569 - protein, 13 aa, Giardia lamblia
RMDNGAAPALATE

SEQ ID NO: 3133570 - protein, 4 aa, Giardia lamblia
RMES

SEQ ID NO: 3133571 - protein, 4 aa, Giardia lamblia
RMGA

SEQ ID NO: 3133572 - protein, 27 aa, Giardia lamblia
RMGDQSPALTPQRSASNASLTDQAPPN

SEQ ID NO: 3133573 - protein, 7 aa, Giardia lamblia
RMHRSDG

SEQ ID NO: 3133574 - protein, 5 aa, Giardia lamblia
RMNQS

SEQ ID NO: 3133575 - protein, 12 aa, Giardia lamblia
RMPAESDTDDMD

SEQ ID NO: 3133576 - protein, 9 aa, Giardia lamblia
RMPATDQNR

SEQ ID NO: 3133577 - protein, 30 aa, Giardia lamblia
RMPPKPKQIDASQEKKTADDLPELPAKGTQ

SEQ ID NO: 3133578 - protein, 7 aa, Giardia lamblia
RMPREEP

SEQ ID NO: 3133579 - protein, 7 aa, Giardia lamblia
RMQDNEG

SEQ ID NO: 3133580 - protein, 8 aa, Giardia lamblia
RMQTPEGY

SEQ ID NO: 3133581 - protein, 8 aa, Giardia lamblia
RMRDNSRR

SEQ ID NO: 3133582 - protein, 9 aa, Giardia lamblia
RMSPEERSR

SEQ ID NO: 3133583 - protein, 5 aa, Giardia lamblia
RMSRH

SEQ ID NO: 3133584 - protein, 8 aa, Giardia lamblia
RMTDEERD

SEQ ID NO: 3133585 - protein, 9 aa, Giardia lamblia
RMTDNSGET

SEQ ID NO: 3133586 - protein, 6 aa, Giardia lamblia
RMTENR

SEQ ID NO: 3133587 - protein, 6 aa, Giardia lamblia
RMTGSE

SEQ ID NO: 3133588 - protein, 6 aa, Giardia lamblia
RMTNGK

SEQ ID NO: 3133589 - protein, 21 aa, Giardia lamblia
RMTNPQNYSPLERQYPDKVSP

SEQ ID NO: 3133590 - protein, 5 aa, Giardia lamblia
RMTPQ

SEQ ID NO: 3133591 - protein, 13 aa, Giardia lamblia
RMTTDSMSTPELT

SEQ ID NO: 3133592 - protein, 6 aa, Giardia lamblia
RNAAKQ

SEQ ID NO: 3133593 - protein, 20 aa, Giardia lamblia
RNAANSELESMERETNTASA

SEQ ID NO: 3133594 - protein, 6 aa, Giardia lamblia
RNAASG

SEQ ID NO: 3133595 - protein, 6 aa, Giardia lamblia
RNADGM

SEQ ID NO: 3133596 - protein, 7 aa, Giardia lamblia
RNADGTT

SEQ ID NO: 3133597 - protein, 15 aa, Giardia lamblia
RNAKQHGSSYDVKEV

SEQ ID NO: 3133598 - protein, 7 aa, Giardia lamblia
RNAPITS

SEQ ID NO: 3133599 - protein, 8 aa, Giardia lamblia
RNAPRSRN

SEQ ID NO: 3133600 - protein, 7 aa, Giardia lamblia
RNAQGQT

SEQ ID NO: 3133601 - protein, 6 aa, Giardia lamblia
RNAQLP

SEQ ID NO: 3133602 - protein, 5 aa, Giardia lamblia
RNAQT

SEQ ID NO: 3133603 - protein, 5 aa, Giardia lamblia
RNARG

SEQ ID NO: 3133604 - protein, 8 aa, Giardia lamblia
RNASSTNR

SEQ ID NO: 3133605 - protein, 4 aa, Giardia lamblia
RNAT

SEQ ID NO: 3133606 - protein, 11 aa, Giardia lamblia
RNATSTGAIGS

SEQ ID NO: 3133607 - protein, 8 aa, Giardia lamblia
RNAVPGQK

SEQ ID NO: 3133608 - protein, 12 aa, Giardia lamblia
RNAVPPKISPSS

SEQ ID NO: 3133609 - protein, 9 aa, Giardia lamblia
RNAYEKERQ

SEQ ID NO: 3133610 - protein, 5 aa, Giardia lamblia
RNCGR

SEQ ID NO: 3133611 - protein, 10 aa, Giardia lamblia
RNDDKGKGIN

SEQ ID NO: 3133612 - protein, 11 aa, Giardia lamblia
RNDENPEARGD

SEQ ID NO: 3133613 - protein, 7 aa, Giardia lamblia
RNDGATA

SEQ ID NO: 3133614 - protein, 8 aa, Giardia lamblia
RNDGTNNT

SEQ ID NO: 3133615 - protein, 5 aa, Giardia lamblia
RNDIY

SEQ ID NO: 3133616 - protein, 9 aa, Giardia lamblia
RNDKPKNNY

SEQ ID NO: 3133617 - protein, 6 aa, Giardia lamblia
RNDPNF

SEQ ID NO: 3133618 - protein, 26 aa, Giardia lamblia
RNDQKDVPQKGKPASSAAKDKGSAIQ

SEQ ID NO: 3133619 - protein, 7 aa, Giardia lamblia
RNDRKEQ

SEQ ID NO: 3133620 - protein, 5 aa, Giardia lamblia
RNDRN

SEQ ID NO: 3133621 - protein, 9 aa, Giardia lamblia
RNDSNSATS

SEQ ID NO: 3133622 - protein, 5 aa, Giardia lamblia
RNDSQ

SEQ ID NO: 3133623 - protein, 11 aa, Giardia lamblia
RNDSSQDTAAL

SEQ ID NO: 3133624 - protein, 4 aa, Giardia lamblia
RNDT

SEQ ID NO: 3133625 - protein, 5 aa, Giardia lamblia
RNDVE

SEQ ID NO: 3133626 - protein, 6 aa, Giardia lamblia
RNDVGT

SEQ ID NO: 3133627 - protein, 13 aa, Giardia lamblia
RNEADSSNTMKRE

SEQ ID NO: 3133628 - protein, 6 aa, Giardia lamblia
RNEDEL

SEQ ID NO: 3133629 - protein, 4 aa, Giardia lamblia
RNEI

SEQ ID NO: 3133630 - protein, 12 aa, Giardia lamblia
RNEKARNERGET

SEQ ID NO: 3133631 - protein, 4 aa, Giardia lamblia
RNEL

SEQ ID NO: 3133632 - protein, 6 aa, Giardia lamblia
RNELAS

SEQ ID NO: 3133633 - protein, 5 aa, Giardia lamblia
RNESA

SEQ ID NO: 3133634 - protein, 6 aa, Giardia lamblia
RNESTG

SEQ ID NO: 3133635 - protein, 8 aa, Giardia lamblia
RNETGPKT

SEQ ID NO: 3133636 - protein, 6 aa, Giardia lamblia
RNEVTQ

SEQ ID NO: 3133637 - protein, 4 aa, Giardia lamblia
RNFP

SEQ ID NO: 3133638 - protein, 6 aa, Giardia lamblia
RNGEAL

SEQ ID NO: 3133639 - protein, 14 aa, Giardia lamblia
RNGEGKRDPDSTRL

SEQ ID NO: 3133640 - protein, 10 aa, Giardia lamblia
RNGERKRKSI

SEQ ID NO: 3133641 - protein, 4 aa, Giardia lamblia
RNGH

SEQ ID NO: 3133642 - protein, 5 aa, Giardia lamblia
RNGHK

SEQ ID NO: 3133643 - protein, 5 aa, Giardia lamblia
RNGHQ

SEQ ID NO: 3133644 - protein, 5 aa, Giardia lamblia
RNGHS

SEQ ID NO: 3133645 - protein, 7 aa, Giardia lamblia
RNGHSKS

SEQ ID NO: 3133646 - protein, 6 aa, Giardia lamblia
RNGKAT

SEQ ID NO: 3133647 - protein, 4 aa, Giardia lamblia
RNGN

SEQ ID NO: 3133648 - protein, 5 aa, Giardia lamblia
RNGNI

SEQ ID NO: 3133649 - protein, 15 aa, Giardia lamblia
RNGPAPSEDTGEDLS

SEQ ID NO: 3133650 - protein, 7 aa, Giardia lamblia
RNGQTEA

SEQ ID NO: 3133651 - protein, 4 aa, Giardia lamblia
RNGR

SEQ ID NO: 3133652 - protein, 7 aa, Giardia lamblia
RNGRLGA

SEQ ID NO: 3133653 - protein, 6 aa, Giardia lamblia
RNGRPE

SEQ ID NO: 3133654 - protein, 7 aa, Giardia lamblia
RNGSLES

SEQ ID NO: 3133655 - protein, 34 aa, Giardia lamblia
RNGSNPANESLTTIPSAKGANSKASGEHKDPKAV

SEQ ID NO: 3133656 - protein, 6 aa, Giardia lamblia
RNGSQR

SEQ ID NO: 3133657 - protein, 7 aa, Giardia lamblia
RNHKGNI

SEQ ID NO: 3133658 - protein, 4 aa, Giardia lamblia
RNHQ

SEQ ID NO: 3133659 - protein, 7 aa, Giardia lamblia
RNHTEGA

SEQ ID NO: 3133660 - protein, 10 aa, Giardia lamblia
RNINGPSDDL

SEQ ID NO: 3133661 - protein, 19 aa, Giardia lamblia
RNIPSNKAKPSVPPPPTSA

SEQ ID NO: 3133662 - protein, 4 aa, Giardia lamblia
RNIR

SEQ ID NO: 3133663 - protein, 9 aa, Giardia lamblia
RNISSTERV

SEQ ID NO: 3133664 - protein, 10 aa, Giardia lamblia
RNKASNQSTL

SEQ ID NO: 3133665 - protein, 7 aa, Giardia lamblia
RNKDGAT

SEQ ID NO: 3133666 - protein, 5 aa, Giardia lamblia
RNKEG

SEQ ID NO: 3133667 - protein, 7 aa, Giardia lamblia
RNKENKT

SEQ ID NO: 3133668 - protein, 7 aa, Giardia lamblia
RNKGTNE

SEQ ID NO: 3133669 - protein, 5 aa, Giardia lamblia
RNKHL

SEQ ID NO: 3133670 - protein, 10 aa, Giardia lamblia
RNKKNTQISS

SEQ ID NO: 3133671 - protein, 9 aa, Giardia lamblia
RNKQRDGST

SEQ ID NO: 3133672 - protein, 5 aa, Giardia lamblia
RNKRI

SEQ ID NO: 3133673 - protein, 7 aa, Giardia lamblia
RNKRKGL

SEQ ID NO: 3133674 - protein, 7 aa, Giardia lamblia
RNKRRSE

SEQ ID NO: 3133675 - protein, 8 aa, Giardia lamblia
RNKSTARI

SEQ ID NO: 3133676 - protein, 7 aa, Giardia lamblia
RNKTASV

SEQ ID NO: 3133677 - protein, 8 aa, Giardia lamblia
RNLGRSRG

SEQ ID NO: 3133678 - protein, 7 aa, Giardia lamblia
RNLKSTL

SEQ ID NO: 3133679 - protein, 16 aa, Giardia lamblia
RNLPQLSTSEQSTALT

SEQ ID NO: 3133680 - protein, 5 aa, Giardia lamblia
RNMPE

SEQ ID NO: 3133681 - protein, 7 aa, Giardia lamblia
RNNAQSL

SEQ ID NO: 3133682 - protein, 7 aa, Giardia lamblia
RNNGPAF

SEQ ID NO: 3133683 - protein, 5 aa, Giardia lamblia
RNNID

SEQ ID NO: 3133684 - protein, 16 aa, Giardia lamblia
RNNKENENLRRQAKRA

SEQ ID NO: 3133685 - protein, 5 aa, Giardia lamblia
RNNKV

SEQ ID NO: 3133686 - protein, 8 aa, Giardia lamblia
RNNPHHPP

SEQ ID NO: 3133687 - protein, 9 aa, Giardia lamblia
RNNQTLGST

SEQ ID NO: 3133688 - protein, 5 aa, Giardia lamblia
RNNSG

SEQ ID NO: 3133689 - protein, 5 aa, Giardia lamblia
RNNVK

SEQ ID NO: 3133690 - protein, 18 aa, Giardia lamblia
RNNVPKAAFTSEQSKSPV

SEQ ID NO: 3133691 - protein, 10 aa, Giardia lamblia
RNNVQGDAEA

SEQ ID NO: 3133692 - protein, 7 aa, Giardia lamblia
RNPDLSP

SEQ ID NO: 3133693 - protein, 14 aa, Giardia lamblia
RNPEDAVPNLESEI

SEQ ID NO: 3133694 - protein, 15 aa, Giardia lamblia
RNPGHSNIDSSVSTL

SEQ ID NO: 3133695 - protein, 7 aa, Giardia lamblia
RNPHGKE

SEQ ID NO: 3133696 - protein, 16 aa, Giardia lamblia
RNPNESKRGKKKYSHH

SEQ ID NO: 3133697 - protein, 16 aa, Giardia lamblia
RNPRCARGTLNAQASR

SEQ ID NO: 3133698 - protein, 6 aa, Giardia lamblia
RNPRKV

SEQ ID NO: 3133699 - protein, 12 aa, Giardia lamblia
RNPRSIAKDEVA

SEQ ID NO: 3133700 - protein, 23 aa, Giardia lamblia
RNPSDTRETVRDSASPTPSKEQL

SEQ ID NO: 3133701 - protein, 7 aa, Giardia lamblia
RNPSTGK

SEQ ID NO: 3133702 - protein, 5 aa, Giardia lamblia
RNPTV

SEQ ID NO: 3133703 - protein, 15 aa, Giardia lamblia
RNPYTASDDYQVDPT

SEQ ID NO: 3133704 - protein, 10 aa, Giardia lamblia
RNQAENMTTR

SEQ ID NO: 3133705 - protein, 6 aa, Giardia lamblia
RNQDDY

SEQ ID NO: 3133706 - protein, 10 aa, Giardia lamblia
RNQDEEKSVK

SEQ ID NO: 3133707 - protein, 10 aa, Giardia lamblia
RNQELAKASA

SEQ ID NO: 3133708 - protein, 24 aa, Giardia lamblia
RNQHSLSAEESRMQASTKENKDSM

SEQ ID NO: 3133709 - protein, 7 aa, Giardia lamblia
RNQLEQK

SEQ ID NO: 3133710 - protein, 11 aa, Giardia lamblia
RNQQDGAAKSF

SEQ ID NO: 3133711 - protein, 4 aa, Giardia lamblia
RNQR

SEQ ID NO: 3133712 - protein, 12 aa, Giardia lamblia
RNQTGEQQTRGY

SEQ ID NO: 3133713 - protein, 8 aa, Giardia lamblia
RNRADSAM

SEQ ID NO: 3133714 - protein, 6 aa, Giardia lamblia
RNRDAT

SEQ ID NO: 3133715 - protein, 6 aa, Giardia lamblia
RNRDDL

SEQ ID NO: 3133716 - protein, 7 aa, Giardia lamblia
RNRDGDS

SEQ ID NO: 3133717 - protein, 27 aa, Giardia lamblia
RNRDPESNHLDEHGQQPEEFPAAEDTE

SEQ ID NO: 3133718 - protein, 11 aa, Giardia lamblia
RNRDQEFSQEE

SEQ ID NO: 3133719 - protein, 5 aa, Giardia lamblia
RNRKR

SEQ ID NO: 3133720 - protein, 12 aa, Giardia lamblia
RNRPLQGPGGRL

SEQ ID NO: 3133721 - protein, 4 aa, Giardia lamblia
RNRS

SEQ ID NO: 3133722 - protein, 16 aa, Giardia lamblia
RNRSRLSSATNGIQST

SEQ ID NO: 3133723 - protein, 18 aa, Giardia lamblia
RNRSSASPSHRACAEPKS

SEQ ID NO: 3133724 - protein, 9 aa, Giardia lamblia
RNSAGTTQR

SEQ ID NO: 3133725 - protein, 6 aa, Giardia lamblia
RNSALE

SEQ ID NO: 3133726 - protein, 8 aa, Giardia lamblia
RNSAQDTG

SEQ ID NO: 3133727 - protein, 6 aa, Giardia lamblia
RNSGKK

SEQ ID NO: 3133728 - protein, 4 aa, Giardia lamblia
RNSK

SEQ ID NO: 3133729 - protein, 7 aa, Giardia lamblia
RNSKGET

SEQ ID NO: 3133730 - protein, 6 aa, Giardia lamblia
RNSLES

SEQ ID NO: 3133731 - protein, 10 aa, Giardia lamblia
RNSLKKSKPA

SEQ ID NO: 3133732 - protein, 5 aa, Giardia lamblia
RNSPD

SEQ ID NO: 3133733 - protein, 14 aa, Giardia lamblia
RNSPHGGSVGPMTP

SEQ ID NO: 3133734 - protein, 10 aa, Giardia lamblia
RNSPNGPAAA

SEQ ID NO: 3133735 - protein, 8 aa, Giardia lamblia
RNSQGSIS

SEQ ID NO: 3133736 - protein, 10 aa, Giardia lamblia
RNSSGPSVTY

SEQ ID NO: 3133737 - protein, 6 aa, Giardia lamblia
RNSSGY

SEQ ID NO: 3133738 - protein, 5 aa, Giardia lamblia
RNSSN

SEQ ID NO: 3133739 - protein, 10 aa, Giardia lamblia
RNSSPETLAT

SEQ ID NO: 3133740 - protein, 31 aa, Giardia lamblia
RNSSRTPRARSTSSRHETRGTNPRSFTPPHN

SEQ ID NO: 3133741 - protein, 8 aa, Giardia lamblia
RNSSSTSL

SEQ ID NO: 3133742 - protein, 17 aa, Giardia lamblia
RNSSTGRGSINSAGMSG

SEQ ID NO: 3133743 - protein, 8 aa, Giardia lamblia
RNSTASDG

SEQ ID NO: 3133744 - protein, 6 aa, Giardia lamblia
RNSTLG

SEQ ID NO: 3133745 - protein, 8 aa, Giardia lamblia
RNSTRTPD

SEQ ID NO: 3133746 - protein, 9 aa, Giardia lamblia
RNSTTSVTT

SEQ ID NO: 3133747 - protein, 5 aa, Giardia lamblia
RNSVD

SEQ ID NO: 3133748 - protein, 8 aa, Giardia lamblia
RNSVNPVS

SEQ ID NO: 3133749 - protein, 12 aa, Giardia lamblia
RNSVSVSKPVPF

SEQ ID NO: 3133750 - protein, 4 aa, Giardia lamblia
RNSW

SEQ ID NO: 3133751 - protein, 6 aa, Giardia lamblia
RNTDLE

SEQ ID NO: 3133752 - protein, 4 aa, Giardia lamblia
RNTG

SEQ ID NO: 3133753 - protein, 7 aa, Giardia lamblia
RNTGNTC

SEQ ID NO: 3133754 - protein, 37 aa, Giardia lamblia
RNTGSDVSQYQRDARRAAKLDGKSSLEADATHEQRKV

SEQ ID NO: 3133755 - protein, 24 aa, Giardia lamblia
RNTKKRMDSGKYSTTEGVPEQGSV

SEQ ID NO: 3133756 - protein, 14 aa, Giardia lamblia
RNTLGSLSEGTHAD

SEQ ID NO: 3133757 - protein, 5 aa, Giardia lamblia
RNTNL

SEQ ID NO: 3133758 - protein, 5 aa, Giardia lamblia
RNTNS

SEQ ID NO: 3133759 - protein, 9 aa, Giardia lamblia
RNTRSGHMS

SEQ ID NO: 3133760 - protein, 7 aa, Giardia lamblia
RNTSYGD

SEQ ID NO: 3133761 - protein, 7 aa, Giardia lamblia
RNTTTRS

SEQ ID NO: 3133762 - protein, 65 aa, Giardia lamblia
RNTTTVSESINKKQEASKKRSARKTRSNSASASSGATYNTKRCRSGSPSCSSSRYGPPVSNSTTQ

SEQ ID NO: 3133763 - protein, 4 aa, Giardia lamblia
RNTY

SEQ ID NO: 3133764 - protein, 5 aa, Giardia lamblia
RNVGD

SEQ ID NO: 3133765 - protein, 6 aa, Giardia lamblia
RNVNGE

SEQ ID NO: 3133766 - protein, 4 aa, Giardia lamblia
RNVP

SEQ ID NO: 3133767 - protein, 13 aa, Giardia lamblia
RNVRDGKRRPFPQ

SEQ ID NO: 3133768 - protein, 5 aa, Giardia lamblia
RNYEE

SEQ ID NO: 3133769 - protein, 4 aa, Giardia lamblia
RNYS

SEQ ID NO: 3133770 - protein, 7 aa, Giardia lamblia
RPAASQL

SEQ ID NO: 3133771 - protein, 15 aa, Giardia lamblia
RPADPSSGYATYTGF

SEQ ID NO: 3133772 - protein, 12 aa, Giardia lamblia
RPADTTGYTRED

SEQ ID NO: 3133773 - protein, 6 aa, Giardia lamblia
RPAFED

SEQ ID NO: 3133774 - protein, 13 aa, Giardia lamblia
RPAGTTTMGRSGK

SEQ ID NO: 3133775 - protein, 18 aa, Giardia lamblia
RPAKQGAPPDPALDPARP

SEQ ID NO: 3133776 - protein, 22 aa, Giardia lamblia
RPALSSSSAPASSEAPVAPHQG

SEQ ID NO: 3133777 - protein, 13 aa, Giardia lamblia
RPANEQRSSNTFG

SEQ ID NO: 3133778 - protein, 6 aa, Giardia lamblia
RPANIQ

SEQ ID NO: 3133779 - protein, 5 aa, Giardia lamblia
RPANS

SEQ ID NO: 3133780 - protein, 8 aa, Giardia lamblia
RPAPSPRR

SEQ ID NO: 3133781 - protein, 21 aa, Giardia lamblia
RPARSGSHTHRPRLDGNYTDS

SEQ ID NO: 3133782 - protein, 15 aa, Giardia lamblia
RPASEVEEEDKHESQ

SEQ ID NO: 3133783 - protein, 24 aa, Giardia lamblia
RPASLSAQAPPPPSKQNTSSYQRT

SEQ ID NO: 3133784 - protein, 13 aa, Giardia lamblia
RPASTSSVAKSSC

SEQ ID NO: 3133785 - protein, 13 aa, Giardia lamblia
RPATENGTDGHAR

SEQ ID NO: 3133786 - protein, 27 aa, Giardia lamblia
RPATTSSLGKVSQARLESSPKKNPFQI

SEQ ID NO: 3133787 - protein, 6 aa, Giardia lamblia
RPAYSD

SEQ ID NO: 3133788 - protein, 7 aa, Giardia lamblia
RPDDAKE

SEQ ID NO: 3133789 - protein, 4 aa, Giardia lamblia
RPDE

SEQ ID NO: 3133790 - protein, 5 aa, Giardia lamblia
RPDGH

SEQ ID NO: 3133791 - protein, 6 aa, Giardia lamblia
RPDGTT

SEQ ID NO: 3133792 - protein, 14 aa, Giardia lamblia
RPDHNTQNLSPDPS

SEQ ID NO: 3133793 - protein, 4 aa, Giardia lamblia
RPDI

SEQ ID NO: 3133794 - protein, 6 aa, Giardia lamblia
RPDIAP

SEQ ID NO: 3133795 - protein, 22 aa, Giardia lamblia
RPDIYSSTSSAVNSSTDVRGSR

SEQ ID NO: 3133796 - protein, 8 aa, Giardia lamblia
RPDKRPWD

SEQ ID NO: 3133797 - protein, 14 aa, Giardia lamblia
RPDKSMAPSLLEIF

SEQ ID NO: 3133798 - protein, 6 aa, Giardia lamblia
RPDPSL

SEQ ID NO: 3133799 - protein, 6 aa, Giardia lamblia
RPDQTA

SEQ ID NO: 3133800 - protein, 14 aa, Giardia lamblia
RPDTTALLTVLRNV

SEQ ID NO: 3133801 - protein, 5 aa, Giardia lamblia
RPEAL

SEQ ID NO: 3133802 - protein, 13 aa, Giardia lamblia
RPEDVQKKTPTQR

SEQ ID NO: 3133803 - protein, 4 aa, Giardia lamblia
RPEE

SEQ ID NO: 3133804 - protein, 51 aa, Giardia lamblia
RPEEEEEEEEQEEQEEQEEQGEDQGEEGEETTPIKKEPKPKKEKPIKPTEA

SEQ ID NO: 3133805 - protein, 7 aa, Giardia lamblia
RPEENGL

SEQ ID NO: 3133806 - protein, 4 aa, Giardia lamblia
RPEG

SEQ ID NO: 3133807 - protein, 11 aa, Giardia lamblia
RPEGPARPIED

SEQ ID NO: 3133808 - protein, 7 aa, Giardia lamblia
RPEHSID

SEQ ID NO: 3133809 - protein, 10 aa, Giardia lamblia
RPEKKMGSDE

SEQ ID NO: 3133810 - protein, 12 aa, Giardia lamblia
RPEKSDSQITKV

SEQ ID NO: 3133811 - protein, 5 aa, Giardia lamblia
RPENF

SEQ ID NO: 3133812 - protein, 5 aa, Giardia lamblia
RPEPE

SEQ ID NO: 3133813 - protein, 12 aa, Giardia lamblia
RPERPRSPAAVA

SEQ ID NO: 3133814 - protein, 53 aa, Giardia lamblia
RPESPLRRSPEPGLHAPPYSTASATTGTGVNANTGSIGAPTGLPNDAPESEPF

SEQ ID NO: 3133815 - protein, 7 aa, Giardia lamblia
RPESSSN

SEQ ID NO: 3133816 - protein, 6 aa, Giardia lamblia
RPESTL

SEQ ID NO: 3133817 - protein, 8 aa, Giardia lamblia
RPETTQPC

SEQ ID NO: 3133818 - protein, 4 aa, Giardia lamblia
RPEV

SEQ ID NO: 3133819 - protein, 9 aa, Giardia lamblia
RPFPDPQKQ

SEQ ID NO: 3133820 - protein, 14 aa, Giardia lamblia
RPFQRQDPSYLNSA

SEQ ID NO: 3133821 - protein, 4 aa, Giardia lamblia
RPFS

SEQ ID NO: 3133822 - protein, 11 aa, Giardia lamblia
RPFSGYDRQQI

SEQ ID NO: 3133823 - protein, 5 aa, Giardia lamblia
RPGAI

SEQ ID NO: 3133824 - protein, 6 aa, Giardia lamblia
RPGARG

SEQ ID NO: 3133825 - protein, 4 aa, Giardia lamblia
RPGD

SEQ ID NO: 3133826 - protein, 9 aa, Giardia lamblia
RPGENPLAD

SEQ ID NO: 3133827 - protein, 35 aa, Giardia lamblia
RPGEPGYTPPESAVSKSTAYSRSRSRPSTAENRPL

SEQ ID NO: 3133828 - protein, 17 aa, Giardia lamblia
RPGGAVGGRPGTAGEGA

SEQ ID NO: 3133829 - protein, 20 aa, Giardia lamblia
RPGGAVGGRPGTARKGTYSN

SEQ ID NO: 3133830 - protein, 10 aa, Giardia lamblia
RPGGKKCHEG

SEQ ID NO: 3133831 - protein, 8 aa, Giardia lamblia
RPGHGDPI

SEQ ID NO: 3133832 - protein, 10 aa, Giardia lamblia
RPGKSDYPVS

SEQ ID NO: 3133833 - protein, 6 aa, Giardia lamblia
RPGPAT

SEQ ID NO: 3133834 - protein, 8 aa, Giardia lamblia
RPGPRDPI

SEQ ID NO: 3133835 - protein, 5 aa, Giardia lamblia
RPGQE

SEQ ID NO: 3133836 - protein, 5 aa, Giardia lamblia
RPGRA

SEQ ID NO: 3133837 - protein, 11 aa, Giardia lamblia
RPGVEKSTESG

SEQ ID NO: 3133838 - protein, 9 aa, Giardia lamblia
RPHQAGNPC

SEQ ID NO: 3133839 - protein, 14 aa, Giardia lamblia
RPHSAVSGQQSGSV

SEQ ID NO: 3133840 - protein, 16 aa, Giardia lamblia
RPHSNLARTRAATADQ

SEQ ID NO: 3133841 - protein, 11 aa, Giardia lamblia
RPIKPQSPSFS

SEQ ID NO: 3133842 - protein, 6 aa, Giardia lamblia
RPIPTP

SEQ ID NO: 3133843 - protein, 5 aa, Giardia lamblia
RPIPV

SEQ ID NO: 3133844 - protein, 8 aa, Giardia lamblia
RPISQSEN

SEQ ID NO: 3133845 - protein, 6 aa, Giardia lamblia
RPISSN

SEQ ID NO: 3133846 - protein, 7 aa, Giardia lamblia
RPKAAEL

SEQ ID NO: 3133847 - protein, 43 aa, Giardia lamblia
RPKAGSRGQIDQDGSDDLIDEDNGRGRERRSERTVDQSQSSAN

SEQ ID NO: 3133848 - protein, 12 aa, Giardia lamblia
RPKDMPNALDIF

SEQ ID NO: 3133849 - protein, 50 aa, Giardia lamblia
RPKDPAAGPEAENGPAETAAHAGNKAKQSSKGNKKSDSKADKEGAATPVL

SEQ ID NO: 3133850 - protein, 16 aa, Giardia lamblia
RPKDTYADIGGQDEAI

SEQ ID NO: 3133851 - protein, 18 aa, Giardia lamblia
RPKKPEYTDRDKFSRPER

SEQ ID NO: 3133852 - protein, 30 aa, Giardia lamblia
RPKKRTAKDTHCSHSKRASSTGVAATAKDY

SEQ ID NO: 3133853 - protein, 5 aa, Giardia lamblia
RPKNC

SEQ ID NO: 3133854 - protein, 12 aa, Giardia lamblia
RPKNLRGQEIGY

SEQ ID NO: 3133855 - protein, 6 aa, Giardia lamblia
RPKNRN

SEQ ID NO: 3133856 - protein, 4 aa, Giardia lamblia
RPKP

SEQ ID NO: 3133857 - protein, 10 aa, Giardia lamblia
RPKPQTDPGF

SEQ ID NO: 3133858 - protein, 7 aa, Giardia lamblia
RPKPTEK

SEQ ID NO: 3133859 - protein, 5 aa, Giardia lamblia
RPKRE

SEQ ID NO: 3133860 - protein, 24 aa, Giardia lamblia
RPKRPGSTGSASSIPSTPTKNKAR

SEQ ID NO: 3133861 - protein, 10 aa, Giardia lamblia
RPKRPTSGAA

SEQ ID NO: 3133862 - protein, 9 aa, Giardia lamblia
RPKSNETVT

SEQ ID NO: 3133863 - protein, 21 aa, Giardia lamblia
RPKSSRTSCVTDASGSVDSPT

SEQ ID NO: 3133864 - protein, 36 aa, Giardia lamblia
RPKTATSIPLRRDSSGHSSESSTFKANHDAERRRPR

SEQ ID NO: 3133865 - protein, 11 aa, Giardia lamblia
RPKTTRPKSSR

SEQ ID NO: 3133866 - protein, 21 aa, Giardia lamblia
RPLAADDSATGSSGDKSEPCW

SEQ ID NO: 3133867 - protein, 8 aa, Giardia lamblia
RPLAPEPT

SEQ ID NO: 3133868 - protein, 8 aa, Giardia lamblia
RPLDGEEC

SEQ ID NO: 3133869 - protein, 13 aa, Giardia lamblia
RPLDYSRTKKGPF

SEQ ID NO: 3133870 - protein, 7 aa, Giardia lamblia
RPLGQGS

SEQ ID NO: 3133871 - protein, 9 aa, Giardia lamblia
RPLGSSSDE

SEQ ID NO: 3133872 - protein, 6 aa, Giardia lamblia
RPLLEE

SEQ ID NO: 3133873 - protein, 10 aa, Giardia lamblia
RPLNGGLTTS

SEQ ID NO: 3133874 - protein, 46 aa, Giardia lamblia
RPLPDRPPGPEPSEGSPGYSGEAFDSSGSPRGLTDEAAGSAGLDEE

SEQ ID NO: 3133875 - protein, 11 aa, Giardia lamblia
RPLQPGVGRPV

SEQ ID NO: 3133876 - protein, 8 aa, Giardia lamblia
RPLQTHSG

SEQ ID NO: 3133877 - protein, 6 aa, Giardia lamblia
RPLRTQ

SEQ ID NO: 3133878 - protein, 4 aa, Giardia lamblia
RPLS

SEQ ID NO: 3133879 - protein, 13 aa, Giardia lamblia
RPLSTKGGESHGA

SEQ ID NO: 3133880 - protein, 4 aa, Giardia lamblia
RPLT

SEQ ID NO: 3133881 - protein, 5 aa, Giardia lamblia
RPMPP

SEQ ID NO: 3133882 - protein, 20 aa, Giardia lamblia
RPMSGRASTFSRSNTDLSVS

SEQ ID NO: 3133883 - protein, 9 aa, Giardia lamblia
RPNAEGDKL

SEQ ID NO: 3133884 - protein, 14 aa, Giardia lamblia
RPNFTRTGDPKSTF

SEQ ID NO: 3133885 - protein, 5 aa, Giardia lamblia
RPNPA

SEQ ID NO: 3133886 - protein, 16 aa, Giardia lamblia
RPNQGPGSDTVSREEY

SEQ ID NO: 3133887 - protein, 33 aa, Giardia lamblia
RPNREKESALEARKEQTPCDKDDEQINELEDKQ

SEQ ID NO: 3133888 - protein, 18 aa, Giardia lamblia
RPNSNSTREPIKDTNSAI

SEQ ID NO: 3133889 - protein, 7 aa, Giardia lamblia
RPNSSIS

SEQ ID NO: 3133890 - protein, 6 aa, Giardia lamblia
RPNTTV

SEQ ID NO: 3133891 - protein, 6 aa, Giardia lamblia
RPNVEP

SEQ ID NO: 3133892 - protein, 7 aa, Giardia lamblia
RPPADWS

SEQ ID NO: 3133893 - protein, 15 aa, Giardia lamblia
RPPCYEGGSKMSLPK

SEQ ID NO: 3133894 - protein, 6 aa, Giardia lamblia
RPPDSV

SEQ ID NO: 3133895 - protein, 11 aa, Giardia lamblia
RPPELRRPGEF

SEQ ID NO: 3133896 - protein, 12 aa, Giardia lamblia
RPPFKSAQRGVS

SEQ ID NO: 3133897 - protein, 6 aa, Giardia lamblia
RPPFSS

SEQ ID NO: 3133898 - protein, 9 aa, Giardia lamblia
RPPGSSNTV

SEQ ID NO: 3133899 - protein, 14 aa, Giardia lamblia
RPPISSEKPRAVSS

SEQ ID NO: 3133900 - protein, 8 aa, Giardia lamblia
RPPKMVSG

SEQ ID NO: 3133901 - protein, 9 aa, Giardia lamblia
RPPKMVSGP

SEQ ID NO: 3133902 - protein, 8 aa, Giardia lamblia
RPPKRYND

SEQ ID NO: 3133903 - protein, 4 aa, Giardia lamblia
RPPL

SEQ ID NO: 3133904 - protein, 5 aa, Giardia lamblia
RPPLT

SEQ ID NO: 3133905 - protein, 6 aa, Giardia lamblia
RPPLTD

SEQ ID NO: 3133906 - protein, 48 aa, Giardia lamblia
RPPPPAEAPGEQRPPRTRGSVSSTPVPKPSAECPPKSSGGDGASDSQS

SEQ ID NO: 3133907 - protein, 8 aa, Giardia lamblia
RPPQERTY

SEQ ID NO: 3133908 - protein, 6 aa, Giardia lamblia
RPPQSQ

SEQ ID NO: 3133909 - protein, 5 aa, Giardia lamblia
RPPRC

SEQ ID NO: 3133910 - protein, 9 aa, Giardia lamblia
RPPSPAPEL

SEQ ID NO: 3133911 - protein, 7 aa, Giardia lamblia
RPPSPRS

SEQ ID NO: 3133912 - protein, 6 aa, Giardia lamblia
RPPSQA

SEQ ID NO: 3133913 - protein, 5 aa, Giardia lamblia
RPPSV

SEQ ID NO: 3133914 - protein, 12 aa, Giardia lamblia
RPPTKTELESGV

SEQ ID NO: 3133915 - protein, 4 aa, Giardia lamblia
RPPV

SEQ ID NO: 3133916 - protein, 10 aa, Giardia lamblia
RPQDKLKSVD

SEQ ID NO: 3133917 - protein, 7 aa, Giardia lamblia
RPQIASN

SEQ ID NO: 3133918 - protein, 6 aa, Giardia lamblia
RPQNTS

SEQ ID NO: 3133919 - protein, 27 aa, Giardia lamblia
RPQPQQPNGSGGRAENRQGAPKEKPGL

SEQ ID NO: 3133920 - protein, 13 aa, Giardia lamblia
RPQSKAISKRAGS

SEQ ID NO: 3133921 - protein, 12 aa, Giardia lamblia
RPQSSKAVSSIS

SEQ ID NO: 3133922 - protein, 6 aa, Giardia lamblia
RPQTPP

SEQ ID NO: 3133923 - protein, 8 aa, Giardia lamblia
RPRAKGGY

SEQ ID NO: 3133924 - protein, 6 aa, Giardia lamblia
RPRESR

SEQ ID NO: 3133925 - protein, 5 aa, Giardia lamblia
RPRGF

SEQ ID NO: 3133926 - protein, 16 aa, Giardia lamblia
RPRGPPTRSTARRATR

SEQ ID NO: 3133927 - protein, 34 aa, Giardia lamblia
RPRGRRGRAPPGVRGALPGPGRGPGPPAQPPAPQ

SEQ ID NO: 3133928 - protein, 8 aa, Giardia lamblia
RPRGTKIK

SEQ ID NO: 3133929 - protein, 8 aa, Giardia lamblia
RPRLEQQN

SEQ ID NO: 3133930 - protein, 4 aa, Giardia lamblia
RPRP

SEQ ID NO: 3133931 - protein, 12 aa, Giardia lamblia
RPRQTEGSKTFG

SEQ ID NO: 3133932 - protein, 7 aa, Giardia lamblia
RPRRAGT

SEQ ID NO: 3133933 - protein, 23 aa, Giardia lamblia
RPRRPGTEVKSYSEYTRELEDNA

SEQ ID NO: 3133934 - protein, 25 aa, Giardia lamblia
RPRTKIPSAPSDSETSDGASDDGDA

SEQ ID NO: 3133935 - protein, 4 aa, Giardia lamblia
RPSA

SEQ ID NO: 3133936 - protein, 7 aa, Giardia lamblia
RPSAARK

SEQ ID NO: 3133937 - protein, 9 aa, Giardia lamblia
RPSAGSAVS

SEQ ID NO: 3133938 - protein, 13 aa, Giardia lamblia
RPSANGKSMTTDQ

SEQ ID NO: 3133939 - protein, 5 aa, Giardia lamblia
RPSAQ

SEQ ID NO: 3133940 - protein, 36 aa, Giardia lamblia
RPSECTRGSPVKKEKTPLPRHEQAPIPSSPSTGRKV

SEQ ID NO: 3133941 - protein, 24 aa, Giardia lamblia
RPSEIQRSSGGYNTALRKETSLTC

SEQ ID NO: 3133942 - protein, 6 aa, Giardia lamblia
RPSGAP

SEQ ID NO: 3133943 - protein, 6 aa, Giardia lamblia
RPSGSL

SEQ ID NO: 3133944 - protein, 6 aa, Giardia lamblia
RPSGSR

SEQ ID NO: 3133945 - protein, 20 aa, Giardia lamblia
RPSGSRTTQAQNQKSKPGAR

SEQ ID NO: 3133946 - protein, 21 aa, Giardia lamblia
RPSHYDRDDYGKHSVPSGPEV

SEQ ID NO: 3133947 - protein, 4 aa, Giardia lamblia
RPSI

SEQ ID NO: 3133948 - protein, 29 aa, Giardia lamblia
RPSKDTCSEKPTSVSGNRPYEDTDNGSTI

SEQ ID NO: 3133949 - protein, 19 aa, Giardia lamblia
RPSKRAAWKRNHTRSLRRY

SEQ ID NO: 3133950 - protein, 4 aa, Giardia lamblia
RPSL

SEQ ID NO: 3133951 - protein, 7 aa, Giardia lamblia
RPSNNNT

SEQ ID NO: 3133952 - protein, 5 aa, Giardia lamblia
RPSPL

SEQ ID NO: 3133953 - protein, 5 aa, Giardia lamblia
RPSSA

SEQ ID NO: 3133954 - protein, 11 aa, Giardia lamblia
RPSSANATKCN

SEQ ID NO: 3133955 - protein, 10 aa, Giardia lamblia
RPSSFTPEEV

SEQ ID NO: 3133956 - protein, 7 aa, Giardia lamblia
RPSSPMK

SEQ ID NO: 3133957 - protein, 23 aa, Giardia lamblia
RPSTEQKAQSKSVEKRSSAATTI

SEQ ID NO: 3133958 - protein, 7 aa, Giardia lamblia
RPSTGLS

SEQ ID NO: 3133959 - protein, 8 aa, Giardia lamblia
RPTAAEVD

SEQ ID NO: 3133960 - protein, 7 aa, Giardia lamblia
RPTDELG

SEQ ID NO: 3133961 - protein, 14 aa, Giardia lamblia
RPTDSQKELPSSQY

SEQ ID NO: 3133962 - protein, 5 aa, Giardia lamblia
RPTEP

SEQ ID NO: 3133963 - protein, 30 aa, Giardia lamblia
RPTGGDDIEGLGGLEGGAQAGTAEDGGSTV

SEQ ID NO: 3133964 - protein, 8 aa, Giardia lamblia
RPTGLASA

SEQ ID NO: 3133965 - protein, 30 aa, Giardia lamblia
RPTHNTSTTHTDPASPRSSMEYSASSNSIV

SEQ ID NO: 3133966 - protein, 11 aa, Giardia lamblia
RPTIDTKEQDD

SEQ ID NO: 3133967 - protein, 5 aa, Giardia lamblia
RPTKQ

SEQ ID NO: 3133968 - protein, 27 aa, Giardia lamblia
RPTPQAGTRSNSIASIPQSKPAPPSLK

SEQ ID NO: 3133969 - protein, 6 aa, Giardia lamblia
RPTQPD

SEQ ID NO: 3133970 - protein, 6 aa, Giardia lamblia
RPTQTM

SEQ ID NO: 3133971 - protein, 15 aa, Giardia lamblia
RPTQVYDTSRSTGSV

SEQ ID NO: 3133972 - protein, 12 aa, Giardia lamblia
RPTSADLASLTQ

SEQ ID NO: 3133973 - protein, 24 aa, Giardia lamblia
RPTSAQASHATQSSHASQLRASSL

SEQ ID NO: 3133974 - protein, 6 aa, Giardia lamblia
RPTSET

SEQ ID NO: 3133975 - protein, 19 aa, Giardia lamblia
RPTSGNTGSRVASARQLET

SEQ ID NO: 3133976 - protein, 10 aa, Giardia lamblia
RPTSLSSPVR

SEQ ID NO: 3133977 - protein, 10 aa, Giardia lamblia
RPTSTHVPRN

SEQ ID NO: 3133978 - protein, 11 aa, Giardia lamblia
RPTSTSSSSQL

SEQ ID NO: 3133979 - protein, 6 aa, Giardia lamblia
RPTTSY

SEQ ID NO: 3133980 - protein, 8 aa, Giardia lamblia
RPTTTATA

SEQ ID NO: 3133981 - protein, 19 aa, Giardia lamblia
RPTVREKTAGAQINRPSDR

SEQ ID NO: 3133982 - protein, 22 aa, Giardia lamblia
RPVADDRISAGSLADVGDGPFI

SEQ ID NO: 3133983 - protein, 19 aa, Giardia lamblia
RPVADDSSYSDDYQEANDD

SEQ ID NO: 3133984 - protein, 4 aa, Giardia lamblia
RPVD

SEQ ID NO: 3133985 - protein, 5 aa, Giardia lamblia
RPVES

SEQ ID NO: 3133986 - protein, 5 aa, Giardia lamblia
RPVGD

SEQ ID NO: 3133987 - protein, 10 aa, Giardia lamblia
RPVGEGSYGT

SEQ ID NO: 3133988 - protein, 10 aa, Giardia lamblia
RPVIGNEGTS

SEQ ID NO: 3133989 - protein, 16 aa, Giardia lamblia
RPVLEPKNHTPVYSRG

SEQ ID NO: 3133990 - protein, 8 aa, Giardia lamblia
RPVPTDQA

SEQ ID NO: 3133991 - protein, 8 aa, Giardia lamblia
RPVRDEKG

SEQ ID NO: 3133992 - protein, 6 aa, Giardia lamblia
RPVRPD

SEQ ID NO: 3133993 - protein, 12 aa, Giardia lamblia
RPVSAGTGLDNT

SEQ ID NO: 3133994 - protein, 7 aa, Giardia lamblia
RPVSQEN

SEQ ID NO: 3133995 - protein, 52 aa, Giardia lamblia
RPVSRGIGRSVTRAQPVRNQDQTVSPPEKTDKEEEQYQDDFSDGNDDAPGVS

SEQ ID NO: 3133996 - protein, 6 aa, Giardia lamblia
RPVTEE

SEQ ID NO: 3133997 - protein, 7 aa, Giardia lamblia
RPVTEGN

SEQ ID NO: 3133998 - protein, 5 aa, Giardia lamblia
RPWPG

SEQ ID NO: 3133999 - protein, 41 aa, Giardia lamblia
RPWPGNYNEKFSSGAVGLGNTQTGEPHKVTDETASSKESGF

SEQ ID NO: 3134000 - protein, 20 aa, Giardia lamblia
RPYGLPSPQGDDDGVSATTT

SEQ ID NO: 3134001 - protein, 5 aa, Giardia lamblia
RPYPQ

SEQ ID NO: 3134002 - protein, 8 aa, Giardia lamblia
RPYPRDDA

SEQ ID NO: 3134003 - protein, 8 aa, Giardia lamblia
RPYSGEQL

SEQ ID NO: 3134004 - protein, 7 aa, Giardia lamblia
RPYTAPE

SEQ ID NO: 3134005 - protein, 24 aa, Giardia lamblia
RQAAAQNADNIENSSCDYSSISDD

SEQ ID NO: 3134006 - protein, 10 aa, Giardia lamblia
RQADALASSL

SEQ ID NO: 3134007 - protein, 10 aa, Giardia lamblia
RQADIARPDI

SEQ ID NO: 3134008 - protein, 5 aa, Giardia lamblia
RQAEE

SEQ ID NO: 3134009 - protein, 26 aa, Giardia lamblia
RQAEKNKGQGEDAVKGEGTSIPDEST

SEQ ID NO: 3134010 - protein, 12 aa, Giardia lamblia
RQAEPSNARTEE

SEQ ID NO: 3134011 - protein, 19 aa, Giardia lamblia
RQAERAYNRQCQDETRETG

SEQ ID NO: 3134012 - protein, 5 aa, Giardia lamblia
RQAGD

SEQ ID NO: 3134013 - protein, 15 aa, Giardia lamblia
RQAGRRQRRSTHVNA

SEQ ID NO: 3134014 - protein, 5 aa, Giardia lamblia
RQANS

SEQ ID NO: 3134015 - protein, 8 aa, Giardia lamblia
RQARSDHF

SEQ ID NO: 3134016 - protein, 11 aa, Giardia lamblia
RQARSTRDPTH

SEQ ID NO: 3134017 - protein, 25 aa, Giardia lamblia
RQATKNSLGQSAPVHTSNTKVSPYV

SEQ ID NO: 3134018 - protein, 8 aa, Giardia lamblia
RQATREGY

SEQ ID NO: 3134019 - protein, 5 aa, Giardia lamblia
RQDAT

SEQ ID NO: 3134020 - protein, 6 aa, Giardia lamblia
RQDERL

SEQ ID NO: 3134021 - protein, 7 aa, Giardia lamblia
RQDIGGK

SEQ ID NO: 3134022 - protein, 6 aa, Giardia lamblia
RQDIPK

SEQ ID NO: 3134023 - protein, 6 aa, Giardia lamblia
RQDKAR

SEQ ID NO: 3134024 - protein, 9 aa, Giardia lamblia
RQDNQGRTA

SEQ ID NO: 3134025 - protein, 29 aa, Giardia lamblia
RQDNTSSRYENSTNPHDKARTTVQEQMTK

SEQ ID NO: 3134026 - protein, 6 aa, Giardia lamblia
RQDPDV

SEQ ID NO: 3134027 - protein, 7 aa, Giardia lamblia
RQDPKTG

SEQ ID NO: 3134028 - protein, 8 aa, Giardia lamblia
RQDQPEKR

SEQ ID NO: 3134029 - protein, 25 aa, Giardia lamblia
RQDQPLDGSTTLPDQQSAISGPTVE

SEQ ID NO: 3134030 - protein, 8 aa, Giardia lamblia
RQDSGKSA

SEQ ID NO: 3134031 - protein, 4 aa, Giardia lamblia
RQEA

SEQ ID NO: 3134032 - protein, 6 aa, Giardia lamblia
RQEAAS

SEQ ID NO: 3134033 - protein, 49 aa, Giardia lamblia
RQEAEEAARRNQQGSAEHEDAVDAEASAPPSTDTSSAPTTFKGTDAQPS

SEQ ID NO: 3134034 - protein, 17 aa, Giardia lamblia
RQEALQAPKPPAAPNYA

SEQ ID NO: 3134035 - protein, 22 aa, Giardia lamblia
RQEAPRRGKDPDAPENEEAAKV

SEQ ID NO: 3134036 - protein, 20 aa, Giardia lamblia
RQECTPQRQLAPESSKDPGF

SEQ ID NO: 3134037 - protein, 12 aa, Giardia lamblia
RQEDGSELPNKR

SEQ ID NO: 3134038 - protein, 6 aa, Giardia lamblia
RQEEAL

SEQ ID NO: 3134039 - protein, 5 aa, Giardia lamblia
RQEGD

SEQ ID NO: 3134040 - protein, 9 aa, Giardia lamblia
RQEIQSQSE

SEQ ID NO: 3134041 - protein, 7 aa, Giardia lamblia
RQENERM

SEQ ID NO: 3134042 - protein, 7 aa, Giardia lamblia
RQENQTL

SEQ ID NO: 3134043 - protein, 5 aa, Giardia lamblia
RQENS

SEQ ID NO: 3134044 - protein, 6 aa, Giardia lamblia
RQEPIP

SEQ ID NO: 3134045 - protein, 14 aa, Giardia lamblia
RQEPLDATLSAGDN

SEQ ID NO: 3134046 - protein, 19 aa, Giardia lamblia
RQEQSLRKKYKTAGDLAPD

SEQ ID NO: 3134047 - protein, 17 aa, Giardia lamblia
RQERASRQKALNESQAR

SEQ ID NO: 3134048 - protein, 6 aa, Giardia lamblia
RQEREL

SEQ ID NO: 3134049 - protein, 9 aa, Giardia lamblia
RQESAPSLL

SEQ ID NO: 3134050 - protein, 10 aa, Giardia lamblia
RQESGKEFPY

SEQ ID NO: 3134051 - protein, 27 aa, Giardia lamblia
RQESTSTNAKGTLPRPTFGDGTGPTRV

SEQ ID NO: 3134052 - protein, 10 aa, Giardia lamblia
RQETPRPGDF

SEQ ID NO: 3134053 - protein, 4 aa, Giardia lamblia
RQGD

SEQ ID NO: 3134054 - protein, 10 aa, Giardia lamblia
RQGESSDVPV

SEQ ID NO: 3134055 - protein, 5 aa, Giardia lamblia
RQGFT

SEQ ID NO: 3134056 - protein, 26 aa, Giardia lamblia
RQGHEAVDDSIESDRPMQKTNHETDT

SEQ ID NO: 3134057 - protein, 6 aa, Giardia lamblia
RQGITE

SEQ ID NO: 3134058 - protein, 4 aa, Giardia lamblia
RQGK

SEQ ID NO: 3134059 - protein, 7 aa, Giardia lamblia
RQGLSRE

SEQ ID NO: 3134060 - protein, 8 aa, Giardia lamblia
RQGPQSPR

SEQ ID NO: 3134061 - protein, 7 aa, Giardia lamblia
RQGPTQN

SEQ ID NO: 3134062 - protein, 4 aa, Giardia lamblia
RQGQ

SEQ ID NO: 3134063 - protein, 7 aa, Giardia lamblia
RQGQTPL

SEQ ID NO: 3134064 - protein, 4 aa, Giardia lamblia
RQGS

SEQ ID NO: 3134065 - protein, 6 aa, Giardia lamblia
RQGSSP

SEQ ID NO: 3134066 - protein, 7 aa, Giardia lamblia
RQHASAF

SEQ ID NO: 3134067 - protein, 14 aa, Giardia lamblia
RQINTKTAKTTSIE

SEQ ID NO: 3134068 - protein, 5 aa, Giardia lamblia
RQISD

SEQ ID NO: 3134069 - protein, 9 aa, Giardia lamblia
RQISRTDDS

SEQ ID NO: 3134070 - protein, 10 aa, Giardia lamblia
RQKDPDAFTT

SEQ ID NO: 3134071 - protein, 4 aa, Giardia lamblia
RQKE

SEQ ID NO: 3134072 - protein, 13 aa, Giardia lamblia
RQKHEEKRISAKK

SEQ ID NO: 3134073 - protein, 9 aa, Giardia lamblia
RQKITKDDK

SEQ ID NO: 3134074 - protein, 14 aa, Giardia lamblia
RQKKDSPNPPQDPY

SEQ ID NO: 3134075 - protein, 26 aa, Giardia lamblia
RQKKNDNNSGKRALDQDEIDKHKDAW

SEQ ID NO: 3134076 - protein, 7 aa, Giardia lamblia
RQKMEQE

SEQ ID NO: 3134077 - protein, 6 aa, Giardia lamblia
RQKQES

SEQ ID NO: 3134078 - protein, 8 aa, Giardia lamblia
RQKQKIER

SEQ ID NO: 3134079 - protein, 6 aa, Giardia lamblia
RQKRID

SEQ ID NO: 3134080 - protein, 10 aa, Giardia lamblia
RQKRKYDTKA

SEQ ID NO: 3134081 - protein, 9 aa, Giardia lamblia
RQKTSENIS

SEQ ID NO: 3134082 - protein, 6 aa, Giardia lamblia
RQLDGK

SEQ ID NO: 3134083 - protein, 10 aa, Giardia lamblia
RQLPRESADF

SEQ ID NO: 3134084 - protein, 5 aa, Giardia lamblia
RQLPS

SEQ ID NO: 3134085 - protein, 16 aa, Giardia lamblia
RQLSEAETALQAKNSE

SEQ ID NO: 3134086 - protein, 14 aa, Giardia lamblia
RQMKSTLSKYKNKH

SEQ ID NO: 3134087 - protein, 7 aa, Giardia lamblia
RQNDDGY

SEQ ID NO: 3134088 - protein, 12 aa, Giardia lamblia
RQNGTYYETPKD

SEQ ID NO: 3134089 - protein, 4 aa, Giardia lamblia
RQNK

SEQ ID NO: 3134090 - protein, 6 aa, Giardia lamblia
RQNLSA

SEQ ID NO: 3134091 - protein, 20 aa, Giardia lamblia
RQPCSRSHKETATWSKEEDQ

SEQ ID NO: 3134092 - protein, 8 aa, Giardia lamblia
RQPKRQRD

SEQ ID NO: 3134093 - protein, 12 aa, Giardia lamblia
RQPNEGRSNYGG

SEQ ID NO: 3134094 - protein, 13 aa, Giardia lamblia
RQPPIPEGANPKD

SEQ ID NO: 3134095 - protein, 10 aa, Giardia lamblia
RQPRAAGSKS

SEQ ID NO: 3134096 - protein, 36 aa, Giardia lamblia
RQPRSGKSAKITVQPSRVAGQSSVRPLSAAQSKQFQ

SEQ ID NO: 3134097 - protein, 4 aa, Giardia lamblia
RQPS

SEQ ID NO: 3134098 - protein, 50 aa, Giardia lamblia
RQPSHIPSKKASPIAKNSAPQSFTDPASSTPDKVTTTAEKTSAPTTEFRD

SEQ ID NO: 3134099 - protein, 5 aa, Giardia lamblia
RQPSL

SEQ ID NO: 3134100 - protein, 9 aa, Giardia lamblia
RQPTEGRRV

SEQ ID NO: 3134101 - protein, 8 aa, Giardia lamblia
RQPTSTTA

SEQ ID NO: 3134102 - protein, 4 aa, Giardia lamblia
RQPY

SEQ ID NO: 3134103 - protein, 5 aa, Giardia lamblia
RQPYD

SEQ ID NO: 3134104 - protein, 7 aa, Giardia lamblia
RQPYNEK

SEQ ID NO: 3134105 - protein, 6 aa, Giardia lamblia
RQQAET

SEQ ID NO: 3134106 - protein, 5 aa, Giardia lamblia
RQQAR

SEQ ID NO: 3134107 - protein, 9 aa, Giardia lamblia
RQQAREAGE

SEQ ID NO: 3134108 - protein, 5 aa, Giardia lamblia
RQQDA

SEQ ID NO: 3134109 - protein, 9 aa, Giardia lamblia
RQQDIDGGT

SEQ ID NO: 3134110 - protein, 12 aa, Giardia lamblia
RQQEALRGTERT

SEQ ID NO: 3134111 - protein, 14 aa, Giardia lamblia
RQQEECRKRSYAKT

SEQ ID NO: 3134112 - protein, 8 aa, Giardia lamblia
RQQEPAKV

SEQ ID NO: 3134113 - protein, 30 aa, Giardia lamblia
RQQEQPSKSTSARGSQLSSKASHDKEPDDS

SEQ ID NO: 3134114 - protein, 10 aa, Giardia lamblia
RQQERELEKQ

SEQ ID NO: 3134115 - protein, 7 aa, Giardia lamblia
RQQGSDL

SEQ ID NO: 3134116 - protein, 4 aa, Giardia lamblia
RQQK

SEQ ID NO: 3134117 - protein, 9 aa, Giardia lamblia
RQQNTDQRD

SEQ ID NO: 3134118 - protein, 13 aa, Giardia lamblia
RQQPGSQGALATG

SEQ ID NO: 3134119 - protein, 9 aa, Giardia lamblia
RQQQKNMSK

SEQ ID NO: 3134120 - protein, 8 aa, Giardia lamblia
RQQRDGPA

SEQ ID NO: 3134121 - protein, 10 aa, Giardia lamblia
RQQRKTVPGP

SEQ ID NO: 3134122 - protein, 12 aa, Giardia lamblia
RQQRKVSRPYGG

SEQ ID NO: 3134123 - protein, 9 aa, Giardia lamblia
RQQSPTTLD

SEQ ID NO: 3134124 - protein, 8 aa, Giardia lamblia
RQQSTTLR

SEQ ID NO: 3134125 - protein, 4 aa, Giardia lamblia
RQQV

SEQ ID NO: 3134126 - protein, 11 aa, Giardia lamblia
RQRAEEETSGC

SEQ ID NO: 3134127 - protein, 11 aa, Giardia lamblia
RQRAEKEKLQK

SEQ ID NO: 3134128 - protein, 22 aa, Giardia lamblia
RQRAKKDPSKVPGVKNAEYDEL

SEQ ID NO: 3134129 - protein, 7 aa, Giardia lamblia
RQRDEIS

SEQ ID NO: 3134130 - protein, 7 aa, Giardia lamblia
RQRDELQ

SEQ ID NO: 3134131 - protein, 25 aa, Giardia lamblia
RQRIGDHADKRQRLNRDRRQRLKED

SEQ ID NO: 3134132 - protein, 14 aa, Giardia lamblia
RQRIRSSSPRVSST

SEQ ID NO: 3134133 - protein, 9 aa, Giardia lamblia
RQRKAPKAW

SEQ ID NO: 3134134 - protein, 16 aa, Giardia lamblia
RQRLESADDLLSRTIG

SEQ ID NO: 3134135 - protein, 4 aa, Giardia lamblia
RQRQ

SEQ ID NO: 3134136 - protein, 6 aa, Giardia lamblia
RQRQCS

SEQ ID NO: 3134137 - protein, 8 aa, Giardia lamblia
RQRQTELE

SEQ ID NO: 3134138 - protein, 5 aa, Giardia lamblia
RQRRQ

SEQ ID NO: 3134139 - protein, 11 aa, Giardia lamblia
RQRRTRAEARA

SEQ ID NO: 3134140 - protein, 8 aa, Giardia lamblia
RQRTDAEI

SEQ ID NO: 3134141 - protein, 7 aa, Giardia lamblia
RQRVSGE

SEQ ID NO: 3134142 - protein, 12 aa, Giardia lamblia
RQSAAEAQADAV

SEQ ID NO: 3134143 - protein, 12 aa, Giardia lamblia
RQSAAEASSPAV

SEQ ID NO: 3134144 - protein, 9 aa, Giardia lamblia
RQSAETNSV

SEQ ID NO: 3134145 - protein, 7 aa, Giardia lamblia
RQSALDN

SEQ ID NO: 3134146 - protein, 14 aa, Giardia lamblia
RQSEDGSEPSAPEL

SEQ ID NO: 3134147 - protein, 13 aa, Giardia lamblia
RQSELSHGSLIAT

SEQ ID NO: 3134148 - protein, 8 aa, Giardia lamblia
RQSEQEGF

SEQ ID NO: 3134149 - protein, 7 aa, Giardia lamblia
RQSEQGD

SEQ ID NO: 3134150 - protein, 8 aa, Giardia lamblia
RQSGHSRT

SEQ ID NO: 3134151 - protein, 10 aa, Giardia lamblia
RQSGPSLSTI

SEQ ID NO: 3134152 - protein, 4 aa, Giardia lamblia
RQSH

SEQ ID NO: 3134153 - protein, 14 aa, Giardia lamblia
RQSLAQESEHGAFT

SEQ ID NO: 3134154 - protein, 24 aa, Giardia lamblia
RQSLPRGGDSGNFDPPTKASRPMS

SEQ ID NO: 3134155 - protein, 11 aa, Giardia lamblia
RQSPGSHSESY

SEQ ID NO: 3134156 - protein, 5 aa, Giardia lamblia
RQSRM

SEQ ID NO: 3134157 - protein, 18 aa, Giardia lamblia
RQSSALYQSADPSFSKTV

SEQ ID NO: 3134158 - protein, 7 aa, Giardia lamblia
RQSSEVS

SEQ ID NO: 3134159 - protein, 6 aa, Giardia lamblia
RQSSPY

SEQ ID NO: 3134160 - protein, 6 aa, Giardia lamblia
RQSSRS

SEQ ID NO: 3134161 - protein, 6 aa, Giardia lamblia
RQSTID

SEQ ID NO: 3134162 - protein, 13 aa, Giardia lamblia
RQSTISSPTEHTA

SEQ ID NO: 3134163 - protein, 6 aa, Giardia lamblia
RQSTSR

SEQ ID NO: 3134164 - protein, 20 aa, Giardia lamblia
RQSYRSPETLANEPENETGD

SEQ ID NO: 3134165 - protein, 5 aa, Giardia lamblia
RQTAY

SEQ ID NO: 3134166 - protein, 7 aa, Giardia lamblia
RQTDHSR

SEQ ID NO: 3134167 - protein, 7 aa, Giardia lamblia
RQTEAMR

SEQ ID NO: 3134168 - protein, 8 aa, Giardia lamblia
RQTGDLDR

SEQ ID NO: 3134169 - protein, 9 aa, Giardia lamblia
RQTGSESGI

SEQ ID NO: 3134170 - protein, 7 aa, Giardia lamblia
RQTKAKE

SEQ ID NO: 3134171 - protein, 11 aa, Giardia lamblia
RQTNKDLEAQL

SEQ ID NO: 3134172 - protein, 6 aa, Giardia lamblia
RQTPNS

SEQ ID NO: 3134173 - protein, 5 aa, Giardia lamblia
RQTPW

SEQ ID NO: 3134174 - protein, 5 aa, Giardia lamblia
RQTRG

SEQ ID NO: 3134175 - protein, 6 aa, Giardia lamblia
RQTRRT

SEQ ID NO: 3134176 - protein, 11 aa, Giardia lamblia
RQTRTTGSLSK

SEQ ID NO: 3134177 - protein, 16 aa, Giardia lamblia
RQTSPGTEGPEPDTRL

SEQ ID NO: 3134178 - protein, 8 aa, Giardia lamblia
RQVAEKRK

SEQ ID NO: 3134179 - protein, 4 aa, Giardia lamblia
RQVH

SEQ ID NO: 3134180 - protein, 22 aa, Giardia lamblia
RQVSAQSFQPRAESANTNRRST

SEQ ID NO: 3134181 - protein, 9 aa, Giardia lamblia
RQVSPSLAS

SEQ ID NO: 3134182 - protein, 18 aa, Giardia lamblia
RQYDSEDCAKVSKELADE

SEQ ID NO: 3134183 - protein, 9 aa, Giardia lamblia
RQYPGARGA

SEQ ID NO: 3134184 - protein, 13 aa, Giardia lamblia
RQYTAEDAALRRR

SEQ ID NO: 3134185 - protein, 6 aa, Giardia lamblia
RRAAKQ

SEQ ID NO: 3134186 - protein, 5 aa, Giardia lamblia
RRAAV

SEQ ID NO: 3134187 - protein, 8 aa, Giardia lamblia
RRADGSEI

SEQ ID NO: 3134188 - protein, 10 aa, Giardia lamblia
RRAESDPRQL

SEQ ID NO: 3134189 - protein, 8 aa, Giardia lamblia
RRAGPFSE

SEQ ID NO: 3134190 - protein, 10 aa, Giardia lamblia
RRAGPKATDP

SEQ ID NO: 3134191 - protein, 19 aa, Giardia lamblia
RRAGSRDPQPPQRPEPEAR

SEQ ID NO: 3134192 - protein, 9 aa, Giardia lamblia
RRAHGPSIE

SEQ ID NO: 3134193 - protein, 4 aa, Giardia lamblia
RRAK

SEQ ID NO: 3134194 - protein, 6 aa, Giardia lamblia
RRANAT

SEQ ID NO: 3134195 - protein, 8 aa, Giardia lamblia
RRANEDEL

SEQ ID NO: 3134196 - protein, 7 aa, Giardia lamblia
RRAPCAA

SEQ ID NO: 3134197 - protein, 63 aa, Giardia lamblia
RRAQGDLSRAQSAKKIQQAAEKSPGGDKTRTASPSDEAGKQGKGKKKGKTQEAVAEQEFPDEQ

SEQ ID NO: 3134198 - protein, 9 aa, Giardia lamblia
RRAQQQHVG

SEQ ID NO: 3134199 - protein, 6 aa, Giardia lamblia
RRARGK

SEQ ID NO: 3134200 - protein, 7 aa, Giardia lamblia
RRARSEH

SEQ ID NO: 3134201 - protein, 11 aa, Giardia lamblia
RRATEKVATPE

SEQ ID NO: 3134202 - protein, 10 aa, Giardia lamblia
RRATTATMEP

SEQ ID NO: 3134203 - protein, 5 aa, Giardia lamblia
RRCTP

SEQ ID NO: 3134204 - protein, 5 aa, Giardia lamblia
RRDAE

SEQ ID NO: 3134205 - protein, 5 aa, Giardia lamblia
RRDAG

SEQ ID NO: 3134206 - protein, 6 aa, Giardia lamblia
RRDDGY

SEQ ID NO: 3134207 - protein, 6 aa, Giardia lamblia
RRDDSV

SEQ ID NO: 3134208 - protein, 8 aa, Giardia lamblia
RRDESQRQ

SEQ ID NO: 3134209 - protein, 6 aa, Giardia lamblia
RRDGAT

SEQ ID NO: 3134210 - protein, 6 aa, Giardia lamblia
RRDGEI

SEQ ID NO: 3134211 - protein, 5 aa, Giardia lamblia
RRDGQ

SEQ ID NO: 3134212 - protein, 7 aa, Giardia lamblia
RRDKEKH

SEQ ID NO: 3134213 - protein, 6 aa, Giardia lamblia
RRDNEI

SEQ ID NO: 3134214 - protein, 28 aa, Giardia lamblia
RRDPRVEAYQEKQRRQSVEAQQKREAKI

SEQ ID NO: 3134215 - protein, 5 aa, Giardia lamblia
RRDQY

SEQ ID NO: 3134216 - protein, 10 aa, Giardia lamblia
RRDRDTSNID

SEQ ID NO: 3134217 - protein, 18 aa, Giardia lamblia
RRDRSESGEEGDGEESAS

SEQ ID NO: 3134218 - protein, 9 aa, Giardia lamblia
RRDSDGKTA

SEQ ID NO: 3134219 - protein, 5 aa, Giardia lamblia
RRDTG

SEQ ID NO: 3134220 - protein, 4 aa, Giardia lamblia
RRDY

SEQ ID NO: 3134221 - protein, 21 aa, Giardia lamblia
RREAKKAADKTSDKAPPDALS

SEQ ID NO: 3134222 - protein, 7 aa, Giardia lamblia
RREALKS

SEQ ID NO: 3134223 - protein, 11 aa, Giardia lamblia
RREDSDNARTL

SEQ ID NO: 3134224 - protein, 9 aa, Giardia lamblia
RREEDSTSR

SEQ ID NO: 3134225 - protein, 14 aa, Giardia lamblia
RREEQEAQEKRAAH

SEQ ID NO: 3134226 - protein, 9 aa, Giardia lamblia
RREEREEQQ

SEQ ID NO: 3134227 - protein, 8 aa, Giardia lamblia
RREGEEKI

SEQ ID NO: 3134228 - protein, 10 aa, Giardia lamblia
RREGKTDYQA

SEQ ID NO: 3134229 - protein, 16 aa, Giardia lamblia
RREGTAPSQPPTNVSS

SEQ ID NO: 3134230 - protein, 8 aa, Giardia lamblia
RREGTKSF

SEQ ID NO: 3134231 - protein, 8 aa, Giardia lamblia
RREKGMRM

SEQ ID NO: 3134232 - protein, 17 aa, Giardia lamblia
RREPRNPISDPKQLPEN

SEQ ID NO: 3134233 - protein, 14 aa, Giardia lamblia
RREQDQKTKHSLKQ

SEQ ID NO: 3134234 - protein, 6 aa, Giardia lamblia
RREQDR

SEQ ID NO: 3134235 - protein, 10 aa, Giardia lamblia
RREQGPPERG

SEQ ID NO: 3134236 - protein, 17 aa, Giardia lamblia
RRERMAPADAYGQLVTQ

SEQ ID NO: 3134237 - protein, 20 aa, Giardia lamblia
RRESRRERCRESKIQILNKN

SEQ ID NO: 3134238 - protein, 13 aa, Giardia lamblia
RRFSGSVDSTLSQ

SEQ ID NO: 3134239 - protein, 5 aa, Giardia lamblia
RRFTS

SEQ ID NO: 3134240 - protein, 7 aa, Giardia lamblia
RRGAFES

SEQ ID NO: 3134241 - protein, 7 aa, Giardia lamblia
RRGDAYN

SEQ ID NO: 3134242 - protein, 7 aa, Giardia lamblia
RRGDEET

SEQ ID NO: 3134243 - protein, 20 aa, Giardia lamblia
RRGEYRKLGEKRSSVMPSTS

SEQ ID NO: 3134244 - protein, 4 aa, Giardia lamblia
RRGG

SEQ ID NO: 3134245 - protein, 7 aa, Giardia lamblia
RRGGRKR

SEQ ID NO: 3134246 - protein, 5 aa, Giardia lamblia
RRGGY

SEQ ID NO: 3134247 - protein, 7 aa, Giardia lamblia
RRGLSSQ

SEQ ID NO: 3134248 - protein, 8 aa, Giardia lamblia
RRGNKEGL

SEQ ID NO: 3134249 - protein, 15 aa, Giardia lamblia
RRGRDSGIEYPPQDQ

SEQ ID NO: 3134250 - protein, 10 aa, Giardia lamblia
RRGRVGRTQH

SEQ ID NO: 3134251 - protein, 9 aa, Giardia lamblia
RRGSLPGGS

SEQ ID NO: 3134252 - protein, 12 aa, Giardia lamblia
RRGSNEMMALLS

SEQ ID NO: 3134253 - protein, 5 aa, Giardia lamblia
RRGTG

SEQ ID NO: 3134254 - protein, 5 aa, Giardia lamblia
RRGTN

SEQ ID NO: 3134255 - protein, 4 aa, Giardia lamblia
RRGY

SEQ ID NO: 3134256 - protein, 9 aa, Giardia lamblia
RRGYTPSSI

SEQ ID NO: 3134257 - protein, 15 aa, Giardia lamblia
RRHRQREEEKQTQSL

SEQ ID NO: 3134258 - protein, 6 aa, Giardia lamblia
RRHSPN

SEQ ID NO: 3134259 - protein, 4 aa, Giardia lamblia
RRIP

SEQ ID NO: 3134260 - protein, 9 aa, Giardia lamblia
RRISDSSST

SEQ ID NO: 3134261 - protein, 10 aa, Giardia lamblia
RRKDAEMDNM

SEQ ID NO: 3134262 - protein, 9 aa, Giardia lamblia
RRKDSKKLS

SEQ ID NO: 3134263 - protein, 9 aa, Giardia lamblia
RRKEHDSEL

SEQ ID NO: 3134264 - protein, 7 aa, Giardia lamblia
RRKENEL

SEQ ID NO: 3134265 - protein, 20 aa, Giardia lamblia
RRKETEADPKKPGLPSEAAK

SEQ ID NO: 3134266 - protein, 21 aa, Giardia lamblia
RRKLDQKRAEETVKKVEEQRA

SEQ ID NO: 3134267 - protein, 7 aa, Giardia lamblia
RRKMREQ

SEQ ID NO: 3134268 - protein, 8 aa, Giardia lamblia
RRKNTSYL

SEQ ID NO: 3134269 - protein, 10 aa, Giardia lamblia
RRKPENKQCA

SEQ ID NO: 3134270 - protein, 25 aa, Giardia lamblia
RRKQRRHSPEAEEDSPQDELHPQPL

SEQ ID NO: 3134271 - protein, 73 aa, Giardia lamblia
RRKRAQERRERLDSAGDGSAASDKKKKPSEAAGRAKDKAGTDKADQSGSQSRRGAQGDKQSSTKKRAADGKRL

SEQ ID NO: 3134272 - protein, 24 aa, Giardia lamblia
RRKREERKAAAKEKAAKARMKAKA

SEQ ID NO: 3134273 - protein, 16 aa, Giardia lamblia
RRKRERRAPRRRTGEL

SEQ ID NO: 3134274 - protein, 20 aa, Giardia lamblia
RRKRGFSAKKSSPIEPGNDW

SEQ ID NO: 3134275 - protein, 12 aa, Giardia lamblia
RRKRHGEEREQL

SEQ ID NO: 3134276 - protein, 7 aa, Giardia lamblia
RRKSERL

SEQ ID NO: 3134277 - protein, 12 aa, Giardia lamblia
RRKYQQNYTLNL

SEQ ID NO: 3134278 - protein, 27 aa, Giardia lamblia
RRLAGAKRASTEKLKENAERISETSQR

SEQ ID NO: 3134279 - protein, 10 aa, Giardia lamblia
RRLGDSNSTV

SEQ ID NO: 3134280 - protein, 6 aa, Giardia lamblia
RRLKPG

SEQ ID NO: 3134281 - protein, 7 aa, Giardia lamblia
RRLSSAD

SEQ ID NO: 3134282 - protein, 22 aa, Giardia lamblia
RRLSSTSPDKGSMNTTSPLTNS

SEQ ID NO: 3134283 - protein, 4 aa, Giardia lamblia
RRND

SEQ ID NO: 3134284 - protein, 6 aa, Giardia lamblia
RRNDPN

SEQ ID NO: 3134285 - protein, 66 aa, Giardia lamblia
RRNDPNSHTLSTNTGPERKKGTGVQSLQESKPRSSSRFGTGPVPPRAQPRTLQKAQPHGTKTFSQP

SEQ ID NO: 3134286 - protein, 9 aa, Giardia lamblia
RRNKQRQSS

SEQ ID NO: 3134287 - protein, 20 aa, Giardia lamblia
RRNLEEAKSAYNRVDDTEVT

SEQ ID NO: 3134288 - protein, 5 aa, Giardia lamblia
RRNPA

SEQ ID NO: 3134289 - protein, 10 aa, Giardia lamblia
RRNPNTVDLT

SEQ ID NO: 3134290 - protein, 6 aa, Giardia lamblia
RRNPPQ

SEQ ID NO: 3134291 - protein, 6 aa, Giardia lamblia
RRNRAV

SEQ ID NO: 3134292 - protein, 7 aa, Giardia lamblia
RRNVDGE

SEQ ID NO: 3134293 - protein, 4 aa, Giardia lamblia
RRPE

SEQ ID NO: 3134294 - protein, 5 aa, Giardia lamblia
RRPGR

SEQ ID NO: 3134295 - protein, 8 aa, Giardia lamblia
RRPHSPDS

SEQ ID NO: 3134296 - protein, 5 aa, Giardia lamblia
RRPMS

SEQ ID NO: 3134297 - protein, 5 aa, Giardia lamblia
RRPPG

SEQ ID NO: 3134298 - protein, 5 aa, Giardia lamblia
RRPPN

SEQ ID NO: 3134299 - protein, 14 aa, Giardia lamblia
RRPPSQDNHLDPED

SEQ ID NO: 3134300 - protein, 16 aa, Giardia lamblia
RRPPYSATHVPEDSTD

SEQ ID NO: 3134301 - protein, 41 aa, Giardia lamblia
RRPQSAGGGLTGSNKDNSYNSAYAKSSFQAQNRLDDSDHSD

SEQ ID NO: 3134302 - protein, 12 aa, Giardia lamblia
RRPRSAVKPEWN

SEQ ID NO: 3134303 - protein, 13 aa, Giardia lamblia
RRPRTKRAHSYSS

SEQ ID NO: 3134304 - protein, 16 aa, Giardia lamblia
RRPSAMPTTPQTNDSP

SEQ ID NO: 3134305 - protein, 9 aa, Giardia lamblia
RRPTEGPGF

SEQ ID NO: 3134306 - protein, 64 aa, Giardia lamblia
RRPTKPEMKHEGSKKVPWKKPAGGAPRKPGKPGSGPGKPSANWAAKKGSHPYKRREIPTKNNMT

SEQ ID NO: 3134307 - protein, 11 aa, Giardia lamblia
RRPTKSSLTSR

SEQ ID NO: 3134308 - protein, 10 aa, Giardia lamblia
RRQAADGSVG

SEQ ID NO: 3134309 - protein, 6 aa, Giardia lamblia
RRQAAE

SEQ ID NO: 3134310 - protein, 9 aa, Giardia lamblia
RRQADADQF

SEQ ID NO: 3134311 - protein, 5 aa, Giardia lamblia
RRQDS

SEQ ID NO: 3134312 - protein, 14 aa, Giardia lamblia
RRQERNAERLARIG

SEQ ID NO: 3134313 - protein, 11 aa, Giardia lamblia
RRQGFSSSGTL

SEQ ID NO: 3134314 - protein, 8 aa, Giardia lamblia
RRQNSRGL

SEQ ID NO: 3134315 - protein, 5 aa, Giardia lamblia
RRQPY

SEQ ID NO: 3134316 - protein, 13 aa, Giardia lamblia
RRQQELKKRRRRV

SEQ ID NO: 3134317 - protein, 11 aa, Giardia lamblia
RRQQGPASART

SEQ ID NO: 3134318 - protein, 8 aa, Giardia lamblia
RRQQTSFE

SEQ ID NO: 3134319 - protein, 7 aa, Giardia lamblia
RRQREDI

SEQ ID NO: 3134320 - protein, 6 aa, Giardia lamblia
RRQRRE

SEQ ID NO: 3134321 - protein, 20 aa, Giardia lamblia
RRQTEASKAQRQAMQAKNEQ

SEQ ID NO: 3134322 - protein, 4 aa, Giardia lamblia
RRRA

SEQ ID NO: 3134323 - protein, 20 aa, Giardia lamblia
RRRAEEQAYTQYRPRKSDIF

SEQ ID NO: 3134324 - protein, 20 aa, Giardia lamblia
RRRDEQEAQLRAEGKDITSL

SEQ ID NO: 3134325 - protein, 20 aa, Giardia lamblia
RRREQELKRGEQRAQPPVDE

SEQ ID NO: 3134326 - protein, 8 aa, Giardia lamblia
RRRESLTD

SEQ ID NO: 3134327 - protein, 9 aa, Giardia lamblia
RRRGNTSGV

SEQ ID NO: 3134328 - protein, 12 aa, Giardia lamblia
RRRGSASGFRQQ

SEQ ID NO: 3134329 - protein, 22 aa, Giardia lamblia
RRRGSESSSRLNGRAPSSSYSR

SEQ ID NO: 3134330 - protein, 5 aa, Giardia lamblia
RRRKE

SEQ ID NO: 3134331 - protein, 19 aa, Giardia lamblia
RRRKRKHRRDEENHKSTTI

SEQ ID NO: 3134332 - protein, 6 aa, Giardia lamblia
RRRKTY

SEQ ID NO: 3134333 - protein, 17 aa, Giardia lamblia
RRRPGGGPGGPPVNAFP

SEQ ID NO: 3134334 - protein, 12 aa, Giardia lamblia
RRRPLSSGDISH

SEQ ID NO: 3134335 - protein, 6 aa, Giardia lamblia
RRRPSI

SEQ ID NO: 3134336 - protein, 11 aa, Giardia lamblia
RRRQQTLANAE

SEQ ID NO: 3134337 - protein, 17 aa, Giardia lamblia
RRRQSGGNTSGNRSSLS

SEQ ID NO: 3134338 - protein, 9 aa, Giardia lamblia
RRRREPIPE

SEQ ID NO: 3134339 - protein, 13 aa, Giardia lamblia
RRRRPASAHSIPT

SEQ ID NO: 3134340 - protein, 7 aa, Giardia lamblia
RRRRPKA

SEQ ID NO: 3134341 - protein, 7 aa, Giardia lamblia
RRRSDGA

SEQ ID NO: 3134342 - protein, 27 aa, Giardia lamblia
RRRSKSGARGSSAKSAMSGASARQRSA

SEQ ID NO: 3134343 - protein, 9 aa, Giardia lamblia
RRRSSRPAI

SEQ ID NO: 3134344 - protein, 7 aa, Giardia lamblia
RRRTKYG

SEQ ID NO: 3134345 - protein, 10 aa, Giardia lamblia
RRRTQGTGSM

SEQ ID NO: 3134346 - protein, 9 aa, Giardia lamblia
RRRVSTSGA

SEQ ID NO: 3134347 - protein, 34 aa, Giardia lamblia
RRSAEEYCPPNVPTTERESRGGHTDFSTQSFNGM

SEQ ID NO: 3134348 - protein, 6 aa, Giardia lamblia
RRSDGY

SEQ ID NO: 3134349 - protein, 6 aa, Giardia lamblia
RRSDRE

SEQ ID NO: 3134350 - protein, 6 aa, Giardia lamblia
RRSDSH

SEQ ID NO: 3134351 - protein, 10 aa, Giardia lamblia
RRSETALPSC

SEQ ID NO: 3134352 - protein, 14 aa, Giardia lamblia
RRSGSGVAANKGNI

SEQ ID NO: 3134353 - protein, 4 aa, Giardia lamblia
RRSH

SEQ ID NO: 3134354 - protein, 9 aa, Giardia lamblia
RRSKEKGLG

SEQ ID NO: 3134355 - protein, 23 aa, Giardia lamblia
RRSLTKVSSSQIIPTTSTSDNYT

SEQ ID NO: 3134356 - protein, 5 aa, Giardia lamblia
RRSNV

SEQ ID NO: 3134357 - protein, 11 aa, Giardia lamblia
RRSPDDRDHWG

SEQ ID NO: 3134358 - protein, 7 aa, Giardia lamblia
RRSPEKL

SEQ ID NO: 3134359 - protein, 17 aa, Giardia lamblia
RRSPGKGKDKDKGSAVT

SEQ ID NO: 3134360 - protein, 9 aa, Giardia lamblia
RRSPPASLY

SEQ ID NO: 3134361 - protein, 6 aa, Giardia lamblia
RRSPSQ

SEQ ID NO: 3134362 - protein, 7 aa, Giardia lamblia
RRSQTNE

SEQ ID NO: 3134363 - protein, 7 aa, Giardia lamblia
RRSRGSN

SEQ ID NO: 3134364 - protein, 8 aa, Giardia lamblia
RRSRREIN

SEQ ID NO: 3134365 - protein, 11 aa, Giardia lamblia
RRSRRKSYKGL

SEQ ID NO: 3134366 - protein, 41 aa, Giardia lamblia
RRSSGYGKFGGAPYNECRAESSVSGIGGAQTKSYRRSSVDS

SEQ ID NO: 3134367 - protein, 12 aa, Giardia lamblia
RRSTFSKTKRRC

SEQ ID NO: 3134368 - protein, 10 aa, Giardia lamblia
RRSTVEPPDY

SEQ ID NO: 3134369 - protein, 21 aa, Giardia lamblia
RRSVSAGRRSEAPPLQPQRHC

SEQ ID NO: 3134370 - protein, 4 aa, Giardia lamblia
RRSY

SEQ ID NO: 3134371 - protein, 5 aa, Giardia lamblia
RRSYK

SEQ ID NO: 3134372 - protein, 5 aa, Giardia lamblia
RRTAR

SEQ ID NO: 3134373 - protein, 5 aa, Giardia lamblia
RRTAS

SEQ ID NO: 3134374 - protein, 19 aa, Giardia lamblia
RRTDSSDANASEARVGGPM

SEQ ID NO: 3134375 - protein, 10 aa, Giardia lamblia
RRTDSTGTTG

SEQ ID NO: 3134376 - protein, 8 aa, Giardia lamblia
RRTEKMAS

SEQ ID NO: 3134377 - protein, 10 aa, Giardia lamblia
RRTGPELGRY

SEQ ID NO: 3134378 - protein, 9 aa, Giardia lamblia
RRTGSQSDL

SEQ ID NO: 3134379 - protein, 7 aa, Giardia lamblia
RRTGVGN

SEQ ID NO: 3134380 - protein, 4 aa, Giardia lamblia
RRTI

SEQ ID NO: 3134381 - protein, 7 aa, Giardia lamblia
RRTKGST

SEQ ID NO: 3134382 - protein, 10 aa, Giardia lamblia
RRTPKQKTRL

SEQ ID NO: 3134383 - protein, 29 aa, Giardia lamblia
RRTPTNGSTPRADRPNLSQIQDNSSSPAF

SEQ ID NO: 3134384 - protein, 23 aa, Giardia lamblia
RRTQAQLNAERSLSQDHNRPTVG

SEQ ID NO: 3134385 - protein, 6 aa, Giardia lamblia
RRTSNT

SEQ ID NO: 3134386 - protein, 7 aa, Giardia lamblia
RRTSSPL

SEQ ID NO: 3134387 - protein, 6 aa, Giardia lamblia
RRTTEG

SEQ ID NO: 3134388 - protein, 7 aa, Giardia lamblia
RRTYPEV

SEQ ID NO: 3134389 - protein, 12 aa, Giardia lamblia
RRVEKEQATVAE

SEQ ID NO: 3134390 - protein, 11 aa, Giardia lamblia
RRVKEKTETDM

SEQ ID NO: 3134391 - protein, 5 aa, Giardia lamblia
RRVRK

SEQ ID NO: 3134392 - protein, 14 aa, Giardia lamblia
RRVSSNKAQSRGQR

SEQ ID NO: 3134393 - protein, 4 aa, Giardia lamblia
RRYD

SEQ ID NO: 3134394 - protein, 10 aa, Giardia lamblia
RRYNSDKSSI

SEQ ID NO: 3134395 - protein, 14 aa, Giardia lamblia
RSAANSTSSSLRPD

SEQ ID NO: 3134396 - protein, 27 aa, Giardia lamblia
RSAAQPSPQTKTTGTSPVPGAKDVGEA

SEQ ID NO: 3134397 - protein, 10 aa, Giardia lamblia
RSAATPQPVK

SEQ ID NO: 3134398 - protein, 9 aa, Giardia lamblia
RSADGANFP

SEQ ID NO: 3134399 - protein, 6 aa, Giardia lamblia
RSADGT

SEQ ID NO: 3134400 - protein, 4 aa, Giardia lamblia
RSAE

SEQ ID NO: 3134401 - protein, 15 aa, Giardia lamblia
RSAEAAVKKPPARTL

SEQ ID NO: 3134402 - protein, 7 aa, Giardia lamblia
RSAEGTQ

SEQ ID NO: 3134403 - protein, 8 aa, Giardia lamblia
RSAESGSA

SEQ ID NO: 3134404 - protein, 18 aa, Giardia lamblia
RSAGRKRVKGLAENDTLD

SEQ ID NO: 3134405 - protein, 10 aa, Giardia lamblia
RSAKQSDSCE

SEQ ID NO: 3134406 - protein, 7 aa, Giardia lamblia
RSALSEA

SEQ ID NO: 3134407 - protein, 11 aa, Giardia lamblia
RSANADSGRLA

SEQ ID NO: 3134408 - protein, 26 aa, Giardia lamblia
RSANPSYGKALGSNYENQKVGRQNAA

SEQ ID NO: 3134409 - protein, 8 aa, Giardia lamblia
RSAPNTGL

SEQ ID NO: 3134410 - protein, 9 aa, Giardia lamblia
RSAQLTQES

SEQ ID NO: 3134411 - protein, 9 aa, Giardia lamblia
RSAQPSFEE

SEQ ID NO: 3134412 - protein, 8 aa, Giardia lamblia
RSARAGSY

SEQ ID NO: 3134413 - protein, 26 aa, Giardia lamblia
RSARASSISGRPRSPPQDATPGPGDY

SEQ ID NO: 3134414 - protein, 5 aa, Giardia lamblia
RSARD

SEQ ID NO: 3134415 - protein, 46 aa, Giardia lamblia
RSARPREKQSSAGSSYQGSYQDTHVSSSTTNPDRESGSSKSYVGRR

SEQ ID NO: 3134416 - protein, 5 aa, Giardia lamblia
RSASA

SEQ ID NO: 3134417 - protein, 7 aa, Giardia lamblia
RSASAMS

SEQ ID NO: 3134418 - protein, 9 aa, Giardia lamblia
RSASATPYQ

SEQ ID NO: 3134419 - protein, 10 aa, Giardia lamblia
RSASELERDQ

SEQ ID NO: 3134420 - protein, 7 aa, Giardia lamblia
RSASGKT

SEQ ID NO: 3134421 - protein, 6 aa, Giardia lamblia
RSASHS

SEQ ID NO: 3134422 - protein, 13 aa, Giardia lamblia
RSASQFSLDPATM

SEQ ID NO: 3134423 - protein, 31 aa, Giardia lamblia
RSASSRANAQNNSQVNAQTTIRTNSSYQTPL

SEQ ID NO: 3134424 - protein, 14 aa, Giardia lamblia
RSATDGALEDAQNR

SEQ ID NO: 3134425 - protein, 5 aa, Giardia lamblia
RSATL

SEQ ID NO: 3134426 - protein, 5 aa, Giardia lamblia
RSATV

SEQ ID NO: 3134427 - protein, 7 aa, Giardia lamblia
RSCSTSK

SEQ ID NO: 3134428 - protein, 4 aa, Giardia lamblia
RSDA

SEQ ID NO: 3134429 - protein, 6 aa, Giardia lamblia
RSDAGR

SEQ ID NO: 3134430 - protein, 8 aa, Giardia lamblia
RSDATVAD

SEQ ID NO: 3134431 - protein, 12 aa, Giardia lamblia
RSDDVSAGGPSC

SEQ ID NO: 3134432 - protein, 5 aa, Giardia lamblia
RSDEE

SEQ ID NO: 3134433 - protein, 10 aa, Giardia lamblia
RSDGSKLGGL

SEQ ID NO: 3134434 - protein, 9 aa, Giardia lamblia
RSDGTSFDE

SEQ ID NO: 3134435 - protein, 4 aa, Giardia lamblia
RSDK

SEQ ID NO: 3134436 - protein, 11 aa, Giardia lamblia
RSDKNGPSDTL

SEQ ID NO: 3134437 - protein, 14 aa, Giardia lamblia
RSDKREEKSSFKPN

SEQ ID NO: 3134438 - protein, 9 aa, Giardia lamblia
RSDKSLSPE

SEQ ID NO: 3134439 - protein, 9 aa, Giardia lamblia
RSDPAIETK

SEQ ID NO: 3134440 - protein, 8 aa, Giardia lamblia
RSDPNESG

SEQ ID NO: 3134441 - protein, 11 aa, Giardia lamblia
RSDRNRGTDLT

SEQ ID NO: 3134442 - protein, 10 aa, Giardia lamblia
RSDRRREEDE

SEQ ID NO: 3134443 - protein, 10 aa, Giardia lamblia
RSDSSESDEA

SEQ ID NO: 3134444 - protein, 4 aa, Giardia lamblia
RSDV

SEQ ID NO: 3134445 - protein, 9 aa, Giardia lamblia
RSDYSKEEW

SEQ ID NO: 3134446 - protein, 10 aa, Giardia lamblia
RSEASDAGNT

SEQ ID NO: 3134447 - protein, 5 aa, Giardia lamblia
RSEDT

SEQ ID NO: 3134448 - protein, 9 aa, Giardia lamblia
RSEEDEPTC

SEQ ID NO: 3134449 - protein, 17 aa, Giardia lamblia
RSEEHPSRSDPRGDEHR

SEQ ID NO: 3134450 - protein, 7 aa, Giardia lamblia
RSEHNNS

SEQ ID NO: 3134451 - protein, 10 aa, Giardia lamblia
RSEIGGYAST

SEQ ID NO: 3134452 - protein, 9 aa, Giardia lamblia
RSEKRRKSF

SEQ ID NO: 3134453 - protein, 14 aa, Giardia lamblia
RSEKTHKQASNSAL

SEQ ID NO: 3134454 - protein, 6 aa, Giardia lamblia
RSEMAD

SEQ ID NO: 3134455 - protein, 6 aa, Giardia lamblia
RSEPTA

SEQ ID NO: 3134456 - protein, 12 aa, Giardia lamblia
RSEPYASQPAAV

SEQ ID NO: 3134457 - protein, 4 aa, Giardia lamblia
RSEQ

SEQ ID NO: 3134458 - protein, 8 aa, Giardia lamblia
RSEQKEQQ

SEQ ID NO: 3134459 - protein, 31 aa, Giardia lamblia
RSEQKTSPADLVTSTDRSKKAKEDSRPKSAV

SEQ ID NO: 3134460 - protein, 5 aa, Giardia lamblia
RSEQT

SEQ ID NO: 3134461 - protein, 7 aa, Giardia lamblia
RSERQGI

SEQ ID NO: 3134462 - protein, 10 aa, Giardia lamblia
RSESEGGPFT

SEQ ID NO: 3134463 - protein, 26 aa, Giardia lamblia
RSESKSKRQLRTEAPDKETDKETTLT

SEQ ID NO: 3134464 - protein, 14 aa, Giardia lamblia
RSETPGKSAAAEAA

SEQ ID NO: 3134465 - protein, 7 aa, Giardia lamblia
RSETTRN

SEQ ID NO: 3134466 - protein, 33 aa, Giardia lamblia
RSEVASAVSAQASNSHESTSKTSPNAMKREENP

SEQ ID NO: 3134467 - protein, 5 aa, Giardia lamblia
RSEVS

SEQ ID NO: 3134468 - protein, 16 aa, Giardia lamblia
RSEYTKPIDKSRAVQQ

SEQ ID NO: 3134469 - protein, 11 aa, Giardia lamblia
RSFASEKQSIY

SEQ ID NO: 3134470 - protein, 16 aa, Giardia lamblia
RSFPSRSNQQRPTNVS

SEQ ID NO: 3134471 - protein, 12 aa, Giardia lamblia
RSFRATGESTIR

SEQ ID NO: 3134472 - protein, 4 aa, Giardia lamblia
RSGA

SEQ ID NO: 3134473 - protein, 5 aa, Giardia lamblia
RSGAD

SEQ ID NO: 3134474 - protein, 24 aa, Giardia lamblia
RSGAFTRTGRQGPPPAGPGIEYDD

SEQ ID NO: 3134475 - protein, 20 aa, Giardia lamblia
RSGAFTRTGRQGPPPAGPQT

SEQ ID NO: 3134476 - protein, 10 aa, Giardia lamblia
RSGARNAAKK

SEQ ID NO: 3134477 - protein, 5 aa, Giardia lamblia
RSGDL

SEQ ID NO: 3134478 - protein, 6 aa, Giardia lamblia
RSGDPF

SEQ ID NO: 3134479 - protein, 19 aa, Giardia lamblia
RSGDPQNGQADFKSTANPH

SEQ ID NO: 3134480 - protein, 5 aa, Giardia lamblia
RSGDV

SEQ ID NO: 3134481 - protein, 7 aa, Giardia lamblia
RSGELPA

SEQ ID NO: 3134482 - protein, 9 aa, Giardia lamblia
RSGESAPIK

SEQ ID NO: 3134483 - protein, 6 aa, Giardia lamblia
RSGETE

SEQ ID NO: 3134484 - protein, 7 aa, Giardia lamblia
RSGGQGI

SEQ ID NO: 3134485 - protein, 8 aa, Giardia lamblia
RSGGRTIN

SEQ ID NO: 3134486 - protein, 26 aa, Giardia lamblia
RSGGTSESDGEPPLQKPAQQDPSIRT

SEQ ID NO: 3134487 - protein, 10 aa, Giardia lamblia
RSGHGAASSI

SEQ ID NO: 3134488 - protein, 6 aa, Giardia lamblia
RSGHPP

SEQ ID NO: 3134489 - protein, 13 aa, Giardia lamblia
RSGISSDSPITEF

SEQ ID NO: 3134490 - protein, 8 aa, Giardia lamblia
RSGKEGNY

SEQ ID NO: 3134491 - protein, 39 aa, Giardia lamblia
RSGLGTSASAFEPGAKADLGDGSGLAGRTKQHGSDVQTA

SEQ ID NO: 3134492 - protein, 15 aa, Giardia lamblia
RSGLTNFSESKPRYS

SEQ ID NO: 3134493 - protein, 15 aa, Giardia lamblia
RSGMKDASSSILVLV

SEQ ID NO: 3134494 - protein, 4 aa, Giardia lamblia
RSGN

SEQ ID NO: 3134495 - protein, 7 aa, Giardia lamblia
RSGNADL

SEQ ID NO: 3134496 - protein, 7 aa, Giardia lamblia
RSGNADV

SEQ ID NO: 3134497 - protein, 7 aa, Giardia lamblia
RSGNTEA

SEQ ID NO: 3134498 - protein, 15 aa, Giardia lamblia
RSGPGYSSTTSTTSV

SEQ ID NO: 3134499 - protein, 9 aa, Giardia lamblia
RSGPVPSST

SEQ ID NO: 3134500 - protein, 29 aa, Giardia lamblia
RSGQAGDDIMNEEDAEDDGSGAPRPQPSS

SEQ ID NO: 3134501 - protein, 7 aa, Giardia lamblia
RSGQARA

SEQ ID NO: 3134502 - protein, 9 aa, Giardia lamblia
RSGRAGRFE

SEQ ID NO: 3134503 - protein, 9 aa, Giardia lamblia
RSGRSNDPL

SEQ ID NO: 3134504 - protein, 6 aa, Giardia lamblia
RSGRYG

SEQ ID NO: 3134505 - protein, 4 aa, Giardia lamblia
RSGS

SEQ ID NO: 3134506 - protein, 7 aa, Giardia lamblia
RSGSAAA

SEQ ID NO: 3134507 - protein, 6 aa, Giardia lamblia
RSGSEA

SEQ ID NO: 3134508 - protein, 8 aa, Giardia lamblia
RSGSIRKS

SEQ ID NO: 3134509 - protein, 6 aa, Giardia lamblia
RSGSQS

SEQ ID NO: 3134510 - protein, 11 aa, Giardia lamblia
RSGSTDTPIGD

SEQ ID NO: 3134511 - protein, 8 aa, Giardia lamblia
RSGSTEAF

SEQ ID NO: 3134512 - protein, 16 aa, Giardia lamblia
RSGSYSASGRITATPR

SEQ ID NO: 3134513 - protein, 29 aa, Giardia lamblia
RSGTARRGPAPSTKRGISRKKKSTAKPQG

SEQ ID NO: 3134514 - protein, 18 aa, Giardia lamblia
RSGTGTMKYTDGSVYEGR

SEQ ID NO: 3134515 - protein, 7 aa, Giardia lamblia
RSGTQDN

SEQ ID NO: 3134516 - protein, 5 aa, Giardia lamblia
RSGTS

SEQ ID NO: 3134517 - protein, 4 aa, Giardia lamblia
RSGV

SEQ ID NO: 3134518 - protein, 7 aa, Giardia lamblia
RSGYGTC

SEQ ID NO: 3134519 - protein, 13 aa, Giardia lamblia
RSHAKRETNTANA

SEQ ID NO: 3134520 - protein, 15 aa, Giardia lamblia
RSHDKSDSDSDGETI

SEQ ID NO: 3134521 - protein, 18 aa, Giardia lamblia
RSHPNPTTLAGTASSTAL

SEQ ID NO: 3134522 - protein, 4 aa, Giardia lamblia
RSHQ

SEQ ID NO: 3134523 - protein, 10 aa, Giardia lamblia
RSHSTIPQHS

SEQ ID NO: 3134524 - protein, 5 aa, Giardia lamblia
RSHTE

SEQ ID NO: 3134525 - protein, 4 aa, Giardia lamblia
RSIA

SEQ ID NO: 3134526 - protein, 8 aa, Giardia lamblia
RSIASPEI

SEQ ID NO: 3134527 - protein, 5 aa, Giardia lamblia
RSIDG

SEQ ID NO: 3134528 - protein, 21 aa, Giardia lamblia
RSINDDTDSGQHNAQGAAPAT

SEQ ID NO: 3134529 - protein, 11 aa, Giardia lamblia
RSIPEGTSPRD

SEQ ID NO: 3134530 - protein, 13 aa, Giardia lamblia
RSIPSPPRRPWPA

SEQ ID NO: 3134531 - protein, 33 aa, Giardia lamblia
RSISGRRSSKNVVSERIDTDGVSRNTEVTPCRG

SEQ ID NO: 3134532 - protein, 4 aa, Giardia lamblia
RSIT

SEQ ID NO: 3134533 - protein, 9 aa, Giardia lamblia
RSITDEERQ

SEQ ID NO: 3134534 - protein, 15 aa, Giardia lamblia
RSITPSGVAPAPQQS

SEQ ID NO: 3134535 - protein, 38 aa, Giardia lamblia
RSITRPLQKSPNTDIKSYRKSTKHGHGSPKASVTEQQV

SEQ ID NO: 3134536 - protein, 4 aa, Giardia lamblia
RSKA

SEQ ID NO: 3134537 - protein, 9 aa, Giardia lamblia
RSKADTERL

SEQ ID NO: 3134538 - protein, 10 aa, Giardia lamblia
RSKDKQNKNL

SEQ ID NO: 3134539 - protein, 27 aa, Giardia lamblia
RSKDSESIHGDPDSSANTSVSDKAGNH

SEQ ID NO: 3134540 - protein, 7 aa, Giardia lamblia
RSKELET

SEQ ID NO: 3134541 - protein, 15 aa, Giardia lamblia
RSKEQEHEAAKNEIP

SEQ ID NO: 3134542 - protein, 9 aa, Giardia lamblia
RSKGHGPVY

SEQ ID NO: 3134543 - protein, 8 aa, Giardia lamblia
RSKKGGYY

SEQ ID NO: 3134544 - protein, 9 aa, Giardia lamblia
RSKPSEMTA

SEQ ID NO: 3134545 - protein, 19 aa, Giardia lamblia
RSKQIKEARTYKQRADTYE

SEQ ID NO: 3134546 - protein, 9 aa, Giardia lamblia
RSKQPKAHI

SEQ ID NO: 3134547 - protein, 10 aa, Giardia lamblia
RSKRANSAVE

SEQ ID NO: 3134548 - protein, 6 aa, Giardia lamblia
RSKRDL

SEQ ID NO: 3134549 - protein, 42 aa, Giardia lamblia
RSKRGTTKPLSGPSQDNSRQSSNGSSYAGAAKAQAQMAPTPG

SEQ ID NO: 3134550 - protein, 10 aa, Giardia lamblia
RSKRRAESLA

SEQ ID NO: 3134551 - protein, 7 aa, Giardia lamblia
RSKRSKT

SEQ ID NO: 3134552 - protein, 15 aa, Giardia lamblia
RSKRSSSLTSSPLSE

SEQ ID NO: 3134553 - protein, 9 aa, Giardia lamblia
RSKRTYDQS

SEQ ID NO: 3134554 - protein, 28 aa, Giardia lamblia
RSKSAGRLGQPISEPANTESTEDARRRD

SEQ ID NO: 3134555 - protein, 6 aa, Giardia lamblia
RSKSAY

SEQ ID NO: 3134556 - protein, 25 aa, Giardia lamblia
RSKSIGGKPQNKPHEYTPPVPAPPR

SEQ ID NO: 3134557 - protein, 9 aa, Giardia lamblia
RSKSRNTSL

SEQ ID NO: 3134558 - protein, 9 aa, Giardia lamblia
RSKSSGQFH

SEQ ID NO: 3134559 - protein, 21 aa, Giardia lamblia
RSKSSSPPKTRDGEANAQSSG

SEQ ID NO: 3134560 - protein, 12 aa, Giardia lamblia
RSKSSTSSIGKT

SEQ ID NO: 3134561 - protein, 15 aa, Giardia lamblia
RSKSVSDEPASLSPR

SEQ ID NO: 3134562 - protein, 7 aa, Giardia lamblia
RSKTGRT

SEQ ID NO: 3134563 - protein, 14 aa, Giardia lamblia
RSKTLKGDAHEERQ

SEQ ID NO: 3134564 - protein, 7 aa, Giardia lamblia
RSKTQDT

SEQ ID NO: 3134565 - protein, 21 aa, Giardia lamblia
RSKTQIVDEQPTYTASSHEYS

SEQ ID NO: 3134566 - protein, 19 aa, Giardia lamblia
RSKTSDYSFPSNSSVQDLS

SEQ ID NO: 3134567 - protein, 4 aa, Giardia lamblia
RSLA

SEQ ID NO: 3134568 - protein, 9 aa, Giardia lamblia
RSLAENTSQ

SEQ ID NO: 3134569 - protein, 6 aa, Giardia lamblia
RSLAGP

SEQ ID NO: 3134570 - protein, 8 aa, Giardia lamblia
RSLDDAND

SEQ ID NO: 3134571 - protein, 11 aa, Giardia lamblia
RSLEEDRASQI

SEQ ID NO: 3134572 - protein, 8 aa, Giardia lamblia
RSLEQDSV

SEQ ID NO: 3134573 - protein, 6 aa, Giardia lamblia
RSLGGR

SEQ ID NO: 3134574 - protein, 4 aa, Giardia lamblia
RSLN

SEQ ID NO: 3134575 - protein, 15 aa, Giardia lamblia
RSLPDEEHSSPTKDW

SEQ ID NO: 3134576 - protein, 6 aa, Giardia lamblia
RSLQRH

SEQ ID NO: 3134577 - protein, 11 aa, Giardia lamblia
RSLRDEMGDCE

SEQ ID NO: 3134578 - protein, 54 aa, Giardia lamblia
RSLSEPPRRASAHPRLGPGPGLASRRPPALREKSPVLPPRRPRSSAEPGAGDAG

SEQ ID NO: 3134579 - protein, 5 aa, Giardia lamblia
RSLSK

SEQ ID NO: 3134580 - protein, 18 aa, Giardia lamblia
RSLSPGSNLRERTQPGEL

SEQ ID NO: 3134581 - protein, 15 aa, Giardia lamblia
RSLSSKGSEGRVSDK

SEQ ID NO: 3134582 - protein, 4 aa, Giardia lamblia
RSLT

SEQ ID NO: 3134583 - protein, 7 aa, Giardia lamblia
RSLTASS

SEQ ID NO: 3134584 - protein, 6 aa, Giardia lamblia
RSLTQS

SEQ ID NO: 3134585 - protein, 4 aa, Giardia lamblia
RSMK

SEQ ID NO: 3134586 - protein, 4 aa, Giardia lamblia
RSMN

SEQ ID NO: 3134587 - protein, 11 aa, Giardia lamblia
RSMNPASQLTG

SEQ ID NO: 3134588 - protein, 13 aa, Giardia lamblia
RSMQGNKHPIKYT

SEQ ID NO: 3134589 - protein, 18 aa, Giardia lamblia
RSNAMSEPEVSKPKKARL

SEQ ID NO: 3134590 - protein, 11 aa, Giardia lamblia
RSNANPPNRNV

SEQ ID NO: 3134591 - protein, 5 aa, Giardia lamblia
RSNDP

SEQ ID NO: 3134592 - protein, 12 aa, Giardia lamblia
RSNDSTADQAAL

SEQ ID NO: 3134593 - protein, 7 aa, Giardia lamblia
RSNEVDE

SEQ ID NO: 3134594 - protein, 6 aa, Giardia lamblia
RSNGPL

SEQ ID NO: 3134595 - protein, 17 aa, Giardia lamblia
RSNGQDALSAQKSPAEL

SEQ ID NO: 3134596 - protein, 10 aa, Giardia lamblia
RSNKHRDSGR

SEQ ID NO: 3134597 - protein, 6 aa, Giardia lamblia
RSNKPE

SEQ ID NO: 3134598 - protein, 8 aa, Giardia lamblia
RSNKSNPK

SEQ ID NO: 3134599 - protein, 5 aa, Giardia lamblia
RSNNV

SEQ ID NO: 3134600 - protein, 6 aa, Giardia lamblia
RSNPHN

SEQ ID NO: 3134601 - protein, 6 aa, Giardia lamblia
RSNPQG

SEQ ID NO: 3134602 - protein, 10 aa, Giardia lamblia
RSNPQKPLER

SEQ ID NO: 3134603 - protein, 5 aa, Giardia lamblia
RSNQA

SEQ ID NO: 3134604 - protein, 18 aa, Giardia lamblia
RSNSPVNSHGRTSSAQSV

SEQ ID NO: 3134605 - protein, 6 aa, Giardia lamblia
RSNTDG

SEQ ID NO: 3134606 - protein, 13 aa, Giardia lamblia
RSNVATIDDTLAK

SEQ ID NO: 3134607 - protein, 5 aa, Giardia lamblia
RSPAF

SEQ ID NO: 3134608 - protein, 5 aa, Giardia lamblia
RSPAG

SEQ ID NO: 3134609 - protein, 5 aa, Giardia lamblia
RSPAY

SEQ ID NO: 3134610 - protein, 18 aa, Giardia lamblia
RSPDDNMNEPLDTETALG

SEQ ID NO: 3134611 - protein, 19 aa, Giardia lamblia
RSPDEAKTISDAVPPPEIA

SEQ ID NO: 3134612 - protein, 10 aa, Giardia lamblia
RSPDNRQQGS

SEQ ID NO: 3134613 - protein, 5 aa, Giardia lamblia
RSPEC

SEQ ID NO: 3134614 - protein, 5 aa, Giardia lamblia
RSPEE

SEQ ID NO: 3134615 - protein, 6 aa, Giardia lamblia
RSPEKA

SEQ ID NO: 3134616 - protein, 9 aa, Giardia lamblia
RSPETTEGL

SEQ ID NO: 3134617 - protein, 8 aa, Giardia lamblia
RSPFTNEA

SEQ ID NO: 3134618 - protein, 18 aa, Giardia lamblia
RSPGPGYTNTLPKSAQAR

SEQ ID NO: 3134619 - protein, 5 aa, Giardia lamblia
RSPGR

SEQ ID NO: 3134620 - protein, 5 aa, Giardia lamblia
RSPGW

SEQ ID NO: 3134621 - protein, 6 aa, Giardia lamblia
RSPHRI

SEQ ID NO: 3134622 - protein, 7 aa, Giardia lamblia
RSPITPE

SEQ ID NO: 3134623 - protein, 14 aa, Giardia lamblia
RSPITQSPSLGANN

SEQ ID NO: 3134624 - protein, 5 aa, Giardia lamblia
RSPKL

SEQ ID NO: 3134625 - protein, 5 aa, Giardia lamblia
RSPLG

SEQ ID NO: 3134626 - protein, 8 aa, Giardia lamblia
RSPLSPRE

SEQ ID NO: 3134627 - protein, 7 aa, Giardia lamblia
RSPPKMC

SEQ ID NO: 3134628 - protein, 37 aa, Giardia lamblia
RSPPPPQDEPACEGDGRYDEKGDNDCHGDHCRPIQAP

SEQ ID NO: 3134629 - protein, 15 aa, Giardia lamblia
RSPPPSQDIDAGDTI

SEQ ID NO: 3134630 - protein, 7 aa, Giardia lamblia
RSPQECR

SEQ ID NO: 3134631 - protein, 7 aa, Giardia lamblia
RSPQICS

SEQ ID NO: 3134632 - protein, 14 aa, Giardia lamblia
RSPQLSSNASPPGK

SEQ ID NO: 3134633 - protein, 27 aa, Giardia lamblia
RSPRNERQASRTRSTRQQSNSSPGSFD

SEQ ID NO: 3134634 - protein, 5 aa, Giardia lamblia
RSPRQ

SEQ ID NO: 3134635 - protein, 6 aa, Giardia lamblia
RSPSAF

SEQ ID NO: 3134636 - protein, 6 aa, Giardia lamblia
RSPSAL

SEQ ID NO: 3134637 - protein, 11 aa, Giardia lamblia
RSPSARKSPLR

SEQ ID NO: 3134638 - protein, 6 aa, Giardia lamblia
RSPSHE

SEQ ID NO: 3134639 - protein, 9 aa, Giardia lamblia
RSPSNSRVA

SEQ ID NO: 3134640 - protein, 13 aa, Giardia lamblia
RSPSNSSTTANQP

SEQ ID NO: 3134641 - protein, 13 aa, Giardia lamblia
RSPSSLAQETARF

SEQ ID NO: 3134642 - protein, 6 aa, Giardia lamblia
RSPTGW

SEQ ID NO: 3134643 - protein, 10 aa, Giardia lamblia
RSPTREQEVT

SEQ ID NO: 3134644 - protein, 8 aa, Giardia lamblia
RSPVISGR

SEQ ID NO: 3134645 - protein, 5 aa, Giardia lamblia
RSPYC

SEQ ID NO: 3134646 - protein, 9 aa, Giardia lamblia
RSQAKKYKD

SEQ ID NO: 3134647 - protein, 22 aa, Giardia lamblia
RSQAPPSASVGQSQSSLDPEQV

SEQ ID NO: 3134648 - protein, 14 aa, Giardia lamblia
RSQAPRGNHDKSGM

SEQ ID NO: 3134649 - protein, 17 aa, Giardia lamblia
RSQDADEPTEEQRADSL

SEQ ID NO: 3134650 - protein, 17 aa, Giardia lamblia
RSQENQRLQREQREKSV

SEQ ID NO: 3134651 - protein, 12 aa, Giardia lamblia
RSQGAPRATEGR

SEQ ID NO: 3134652 - protein, 9 aa, Giardia lamblia
RSQHNDSTF

SEQ ID NO: 3134653 - protein, 6 aa, Giardia lamblia
RSQLES

SEQ ID NO: 3134654 - protein, 11 aa, Giardia lamblia
RSQLPEDSKRF

SEQ ID NO: 3134655 - protein, 8 aa, Giardia lamblia
RSQMSTDT

SEQ ID NO: 3134656 - protein, 24 aa, Giardia lamblia
RSQPDENPKDQKSEPQPAADSVKP

SEQ ID NO: 3134657 - protein, 8 aa, Giardia lamblia
RSQPGYDP

SEQ ID NO: 3134658 - protein, 7 aa, Giardia lamblia
RSQPIDG

SEQ ID NO: 3134659 - protein, 26 aa, Giardia lamblia
RSQPVPSDHGSCKEENGNSTGENGAT

SEQ ID NO: 3134660 - protein, 19 aa, Giardia lamblia
RSQQETSRKLAKYFAEQVY

SEQ ID NO: 3134661 - protein, 9 aa, Giardia lamblia
RSQQSDSVS

SEQ ID NO: 3134662 - protein, 7 aa, Giardia lamblia
RSQQSPV

SEQ ID NO: 3134663 - protein, 7 aa, Giardia lamblia
RSQTRDI

SEQ ID NO: 3134664 - protein, 20 aa, Giardia lamblia
RSQTTTHCRRTSASRPSIFQ

SEQ ID NO: 3134665 - protein, 7 aa, Giardia lamblia
RSQVEQN

SEQ ID NO: 3134666 - protein, 10 aa, Giardia lamblia
RSRAEDDDTG

SEQ ID NO: 3134667 - protein, 9 aa, Giardia lamblia
RSRAKQREN

SEQ ID NO: 3134668 - protein, 17 aa, Giardia lamblia
RSRANDPRQSLRPNLNK

SEQ ID NO: 3134669 - protein, 5 aa, Giardia lamblia
RSRAS

SEQ ID NO: 3134670 - protein, 4 aa, Giardia lamblia
RSRD

SEQ ID NO: 3134671 - protein, 17 aa, Giardia lamblia
RSRENRGVPAPSREAVQ

SEQ ID NO: 3134672 - protein, 26 aa, Giardia lamblia
RSRGPVPPDRGHVDTSVSMRSKPVVC

SEQ ID NO: 3134673 - protein, 12 aa, Giardia lamblia
RSRGSLSRKDLD

SEQ ID NO: 3134674 - protein, 7 aa, Giardia lamblia
RSRGSSL

SEQ ID NO: 3134675 - protein, 12 aa, Giardia lamblia
RSRHLSPQAGEQ

SEQ ID NO: 3134676 - protein, 10 aa, Giardia lamblia
RSRKSANRVN

SEQ ID NO: 3134677 - protein, 6 aa, Giardia lamblia
RSRPGF

SEQ ID NO: 3134678 - protein, 5 aa, Giardia lamblia
RSRPL

SEQ ID NO: 3134679 - protein, 14 aa, Giardia lamblia
RSRPSSASKTLSTK

SEQ ID NO: 3134680 - protein, 9 aa, Giardia lamblia
RSRPYPAGR

SEQ ID NO: 3134681 - protein, 9 aa, Giardia lamblia
RSRSDVSHT

SEQ ID NO: 3134682 - protein, 39 aa, Giardia lamblia
RSRSKGKATSQPSLPGDSLGSLEPQPQTQTQDGTPRRER

SEQ ID NO: 3134683 - protein, 9 aa, Giardia lamblia
RSRSPSPMR

SEQ ID NO: 3134684 - protein, 9 aa, Giardia lamblia
RSRSRVPDA

SEQ ID NO: 3134685 - protein, 11 aa, Giardia lamblia
RSRSSSSTRSL

SEQ ID NO: 3134686 - protein, 7 aa, Giardia lamblia
RSRSVKP

SEQ ID NO: 3134687 - protein, 4 aa, Giardia lamblia
RSRT

SEQ ID NO: 3134688 - protein, 9 aa, Giardia lamblia
RSRTAEGET

SEQ ID NO: 3134689 - protein, 7 aa, Giardia lamblia
RSRTKEG

SEQ ID NO: 3134690 - protein, 8 aa, Giardia lamblia
RSRTSTYV

SEQ ID NO: 3134691 - protein, 7 aa, Giardia lamblia
RSRVPNE

SEQ ID NO: 3134692 - protein, 9 aa, Giardia lamblia
RSSADPGKY

SEQ ID NO: 3134693 - protein, 12 aa, Giardia lamblia
RSSAGDNSQYLI

SEQ ID NO: 3134694 - protein, 20 aa, Giardia lamblia
RSSARSGALGPDTSTQNLEE

SEQ ID NO: 3134695 - protein, 13 aa, Giardia lamblia
RSSDAQEETDRRN

SEQ ID NO: 3134696 - protein, 7 aa, Giardia lamblia
RSSDDAV

SEQ ID NO: 3134697 - protein, 8 aa, Giardia lamblia
RSSDKEKA

SEQ ID NO: 3134698 - protein, 10 aa, Giardia lamblia
RSSDQYGTSS

SEQ ID NO: 3134699 - protein, 12 aa, Giardia lamblia
RSSEEASGYSPH

SEQ ID NO: 3134700 - protein, 18 aa, Giardia lamblia
RSSEESYPQFGPSDASEA

SEQ ID NO: 3134701 - protein, 5 aa, Giardia lamblia
RSSEL

SEQ ID NO: 3134702 - protein, 6 aa, Giardia lamblia
RSSEPY

SEQ ID NO: 3134703 - protein, 10 aa, Giardia lamblia
RSSETETRAS

SEQ ID NO: 3134704 - protein, 12 aa, Giardia lamblia
RSSFDRAAKDQY

SEQ ID NO: 3134705 - protein, 4 aa, Giardia lamblia
RSSG

SEQ ID NO: 3134706 - protein, 5 aa, Giardia lamblia
RSSGF

SEQ ID NO: 3134707 - protein, 8 aa, Giardia lamblia
RSSGRPRE

SEQ ID NO: 3134708 - protein, 7 aa, Giardia lamblia
RSSGSPA

SEQ ID NO: 3134709 - protein, 10 aa, Giardia lamblia
RSSHPDPSDA

SEQ ID NO: 3134710 - protein, 4 aa, Giardia lamblia
RSSI

SEQ ID NO: 3134711 - protein, 9 aa, Giardia lamblia
RSSIRSRTR

SEQ ID NO: 3134712 - protein, 14 aa, Giardia lamblia
RSSKAIKGSRHCDP

SEQ ID NO: 3134713 - protein, 24 aa, Giardia lamblia
RSSKEGSSEGSFNLPSTAESSALT

SEQ ID NO: 3134714 - protein, 4 aa, Giardia lamblia
RSSL

SEQ ID NO: 3134715 - protein, 7 aa, Giardia lamblia
RSSLGET

SEQ ID NO: 3134716 - protein, 6 aa, Giardia lamblia
RSSLPE

SEQ ID NO: 3134717 - protein, 9 aa, Giardia lamblia
RSSNAHPGT

SEQ ID NO: 3134718 - protein, 4 aa, Giardia lamblia
RSSP

SEQ ID NO: 3134719 - protein, 9 aa, Giardia lamblia
RSSPAESPV

SEQ ID NO: 3134720 - protein, 6 aa, Giardia lamblia
RSSPNY

SEQ ID NO: 3134721 - protein, 9 aa, Giardia lamblia
RSSPSGGLD

SEQ ID NO: 3134722 - protein, 6 aa, Giardia lamblia
RSSPST

SEQ ID NO: 3134723 - protein, 4 aa, Giardia lamblia
RSSR

SEQ ID NO: 3134724 - protein, 9 aa, Giardia lamblia
RSSREKPEI

SEQ ID NO: 3134725 - protein, 13 aa, Giardia lamblia
RSSRESKQYSASQ

SEQ ID NO: 3134726 - protein, 4 aa, Giardia lamblia
RSSS

SEQ ID NO: 3134727 - protein, 5 aa, Giardia lamblia
RSSSA

SEQ ID NO: 3134728 - protein, 11 aa, Giardia lamblia
RSSSAAKRAYA

SEQ ID NO: 3134729 - protein, 17 aa, Giardia lamblia
RSSSAQPSSPQPALAAG

SEQ ID NO: 3134730 - protein, 6 aa, Giardia lamblia
RSSSAV

SEQ ID NO: 3134731 - protein, 9 aa, Giardia lamblia
RSSSDPILT

SEQ ID NO: 3134732 - protein, 12 aa, Giardia lamblia
RSSSKTSSSLKQ

SEQ ID NO: 3134733 - protein, 13 aa, Giardia lamblia
RSSSLGSKLTEER

SEQ ID NO: 3134734 - protein, 15 aa, Giardia lamblia
RSSSNFTRGGMSTSA

SEQ ID NO: 3134735 - protein, 21 aa, Giardia lamblia
RSSSQLNRPSTGSGSRVPSIR

SEQ ID NO: 3134736 - protein, 10 aa, Giardia lamblia
RSSSRAQPKV

SEQ ID NO: 3134737 - protein, 17 aa, Giardia lamblia
RSSSRDINSQEKRKHDA

SEQ ID NO: 3134738 - protein, 6 aa, Giardia lamblia
RSSSRH

SEQ ID NO: 3134739 - protein, 7 aa, Giardia lamblia
RSSSRPD

SEQ ID NO: 3134740 - protein, 6 aa, Giardia lamblia
RSSSSI

SEQ ID NO: 3134741 - protein, 16 aa, Giardia lamblia
RSSSVSRSYTHNSDYP

SEQ ID NO: 3134742 - protein, 10 aa, Giardia lamblia
RSSTDPVGPY

SEQ ID NO: 3134743 - protein, 21 aa, Giardia lamblia
RSSTGSAGSSRIQPKAAPYVT

SEQ ID NO: 3134744 - protein, 9 aa, Giardia lamblia
RSSTNGPQL

SEQ ID NO: 3134745 - protein, 7 aa, Giardia lamblia
RSSTNKT

SEQ ID NO: 3134746 - protein, 8 aa, Giardia lamblia
RSSTTPFS

SEQ ID NO: 3134747 - protein, 4 aa, Giardia lamblia
RSSV

SEQ ID NO: 3134748 - protein, 5 aa, Giardia lamblia
RSSVD

SEQ ID NO: 3134749 - protein, 5 aa, Giardia lamblia
RSSYL

SEQ ID NO: 3134750 - protein, 7 aa, Giardia lamblia
RSSYTDA

SEQ ID NO: 3134751 - protein, 4 aa, Giardia lamblia
RSTA

SEQ ID NO: 3134752 - protein, 10 aa, Giardia lamblia
RSTANMSKAD

SEQ ID NO: 3134753 - protein, 12 aa, Giardia lamblia
RSTASKTASRPV

SEQ ID NO: 3134754 - protein, 9 aa, Giardia lamblia
RSTDPKREA

SEQ ID NO: 3134755 - protein, 23 aa, Giardia lamblia
RSTDRSEKEQEVSAADKDHSQPR

SEQ ID NO: 3134756 - protein, 4 aa, Giardia lamblia
RSTE

SEQ ID NO: 3134757 - protein, 7 aa, Giardia lamblia
RSTEAPE

SEQ ID NO: 3134758 - protein, 11 aa, Giardia lamblia
RSTEPEKCTDY

SEQ ID NO: 3134759 - protein, 7 aa, Giardia lamblia
RSTFDPT

SEQ ID NO: 3134760 - protein, 5 aa, Giardia lamblia
RSTGC

SEQ ID NO: 3134761 - protein, 5 aa, Giardia lamblia
RSTGT

SEQ ID NO: 3134762 - protein, 7 aa, Giardia lamblia
RSTKPPF

SEQ ID NO: 3134763 - protein, 5 aa, Giardia lamblia
RSTLQ

SEQ ID NO: 3134764 - protein, 5 aa, Giardia lamblia
RSTNA

SEQ ID NO: 3134765 - protein, 11 aa, Giardia lamblia
RSTNVQELTDS

SEQ ID NO: 3134766 - protein, 15 aa, Giardia lamblia
RSTPPSANTDSSQKG

SEQ ID NO: 3134767 - protein, 7 aa, Giardia lamblia
RSTPYDT

SEQ ID NO: 3134768 - protein, 6 aa, Giardia lamblia
RSTQKS

SEQ ID NO: 3134769 - protein, 7 aa, Giardia lamblia
RSTRENR

SEQ ID NO: 3134770 - protein, 4 aa, Giardia lamblia
RSTS

SEQ ID NO: 3134771 - protein, 14 aa, Giardia lamblia
RSTSIAARRVCAET

SEQ ID NO: 3134772 - protein, 14 aa, Giardia lamblia
RSTSQTTTVKKSDL

SEQ ID NO: 3134773 - protein, 10 aa, Giardia lamblia
RSTSRRPSCI

SEQ ID NO: 3134774 - protein, 7 aa, Giardia lamblia
RSTSRTK

SEQ ID NO: 3134775 - protein, 10 aa, Giardia lamblia
RSTSTGNTHR

SEQ ID NO: 3134776 - protein, 18 aa, Giardia lamblia
RSTTGISPKTAAPASTLP

SEQ ID NO: 3134777 - protein, 12 aa, Giardia lamblia
RSTTSDTEETQE

SEQ ID NO: 3134778 - protein, 7 aa, Giardia lamblia
RSTTYSS

SEQ ID NO: 3134779 - protein, 9 aa, Giardia lamblia
RSTYYQKGN

SEQ ID NO: 3134780 - protein, 9 aa, Giardia lamblia
RSVDEDGNT

SEQ ID NO: 3134781 - protein, 4 aa, Giardia lamblia
RSVE

SEQ ID NO: 3134782 - protein, 19 aa, Giardia lamblia
RSVESRSIAQPDTYQESPK

SEQ ID NO: 3134783 - protein, 4 aa, Giardia lamblia
RSVG

SEQ ID NO: 3134784 - protein, 10 aa, Giardia lamblia
RSVGQNRDQI

SEQ ID NO: 3134785 - protein, 16 aa, Giardia lamblia
RSVPHSNDSNPRPLKN

SEQ ID NO: 3134786 - protein, 18 aa, Giardia lamblia
RSVQGNSVDPGAASANLR

SEQ ID NO: 3134787 - protein, 5 aa, Giardia lamblia
RSVSA

SEQ ID NO: 3134788 - protein, 6 aa, Giardia lamblia
RSVSEP

SEQ ID NO: 3134789 - protein, 14 aa, Giardia lamblia
RSVSMETEKVATND

SEQ ID NO: 3134790 - protein, 5 aa, Giardia lamblia
RSVSP

SEQ ID NO: 3134791 - protein, 36 aa, Giardia lamblia
RSVSQANRQPHPKTSSDYKKTSKPGSRSHSKERDTL

SEQ ID NO: 3134792 - protein, 18 aa, Giardia lamblia
RSVSQSQYRSPSKRGKNS

SEQ ID NO: 3134793 - protein, 7 aa, Giardia lamblia
RSVTNDG

SEQ ID NO: 3134794 - protein, 10 aa, Giardia lamblia
RSVTPQDKED

SEQ ID NO: 3134795 - protein, 9 aa, Giardia lamblia
RSVTSGSDL

SEQ ID NO: 3134796 - protein, 5 aa, Giardia lamblia
RSVYQ

SEQ ID NO: 3134797 - protein, 14 aa, Giardia lamblia
RSWSPSPPPDYRYT

SEQ ID NO: 3134798 - protein, 10 aa, Giardia lamblia
RSYGDDDADF

SEQ ID NO: 3134799 - protein, 5 aa, Giardia lamblia
RSYPA

SEQ ID NO: 3134800 - protein, 9 aa, Giardia lamblia
RSYQPVGRN

SEQ ID NO: 3134801 - protein, 5 aa, Giardia lamblia
RSYRA

SEQ ID NO: 3134802 - protein, 5 aa, Giardia lamblia
RSYSP

SEQ ID NO: 3134803 - protein, 5 aa, Giardia lamblia
RSYSS

SEQ ID NO: 3134804 - protein, 11 aa, Giardia lamblia
RSYTATSPCLT

SEQ ID NO: 3134805 - protein, 12 aa, Giardia lamblia
RTAAPNDPETQA

SEQ ID NO: 3134806 - protein, 13 aa, Giardia lamblia
RTAASKRRSHASY

SEQ ID NO: 3134807 - protein, 8 aa, Giardia lamblia
RTAATEQK

SEQ ID NO: 3134808 - protein, 7 aa, Giardia lamblia
RTAAVGR

SEQ ID NO: 3134809 - protein, 6 aa, Giardia lamblia
RTADEY

SEQ ID NO: 3134810 - protein, 10 aa, Giardia lamblia
RTADNKLRSS

SEQ ID NO: 3134811 - protein, 13 aa, Giardia lamblia
RTAEGSSAVAGHT

SEQ ID NO: 3134812 - protein, 24 aa, Giardia lamblia
RTAELGAASSHQQLHESRSSKLSM

SEQ ID NO: 3134813 - protein, 7 aa, Giardia lamblia
RTAKASE

SEQ ID NO: 3134814 - protein, 15 aa, Giardia lamblia
RTANGSEIQSTEAPA

SEQ ID NO: 3134815 - protein, 11 aa, Giardia lamblia
RTAPRPQESRE

SEQ ID NO: 3134816 - protein, 6 aa, Giardia lamblia
RTAQGR

SEQ ID NO: 3134817 - protein, 6 aa, Giardia lamblia
RTAREN

SEQ ID NO: 3134818 - protein, 9 aa, Giardia lamblia
RTARGANPC

SEQ ID NO: 3134819 - protein, 26 aa, Giardia lamblia
RTARNRARLAKRDAEREAAAKTKGGK

SEQ ID NO: 3134820 - protein, 10 aa, Giardia lamblia
RTASDSSVNC

SEQ ID NO: 3134821 - protein, 5 aa, Giardia lamblia
RTASG

SEQ ID NO: 3134822 - protein, 21 aa, Giardia lamblia
RTATDDHKRDLPDADQSLQHH

SEQ ID NO: 3134823 - protein, 9 aa, Giardia lamblia
RTDDGDDGH

SEQ ID NO: 3134824 - protein, 4 aa, Giardia lamblia
RTDE

SEQ ID NO: 3134825 - protein, 9 aa, Giardia lamblia
RTDENATTK

SEQ ID NO: 3134826 - protein, 6 aa, Giardia lamblia
RTDGTT

SEQ ID NO: 3134827 - protein, 13 aa, Giardia lamblia
RTDHSSERNSTQN

SEQ ID NO: 3134828 - protein, 6 aa, Giardia lamblia
RTDPTV

SEQ ID NO: 3134829 - protein, 5 aa, Giardia lamblia
RTDTT

SEQ ID NO: 3134830 - protein, 6 aa, Giardia lamblia
RTDTTA

SEQ ID NO: 3134831 - protein, 7 aa, Giardia lamblia
RTEAEAT

SEQ ID NO: 3134832 - protein, 9 aa, Giardia lamblia
RTEAKLSAG

SEQ ID NO: 3134833 - protein, 7 aa, Giardia lamblia
RTEARDL

SEQ ID NO: 3134834 - protein, 9 aa, Giardia lamblia
RTEDDDQYR

SEQ ID NO: 3134835 - protein, 9 aa, Giardia lamblia
RTEEDKREW

SEQ ID NO: 3134836 - protein, 9 aa, Giardia lamblia
RTEGDDQPI

SEQ ID NO: 3134837 - protein, 21 aa, Giardia lamblia
RTEKAESESSDGDHVTPRTVN

SEQ ID NO: 3134838 - protein, 17 aa, Giardia lamblia
RTEMEAKNTNPGPGAYD

SEQ ID NO: 3134839 - protein, 6 aa, Giardia lamblia
RTEPAH

SEQ ID NO: 3134840 - protein, 6 aa, Giardia lamblia
RTEPLY

SEQ ID NO: 3134841 - protein, 9 aa, Giardia lamblia
RTEQEVQED

SEQ ID NO: 3134842 - protein, 5 aa, Giardia lamblia
RTEQT

SEQ ID NO: 3134843 - protein, 4 aa, Giardia lamblia
RTER

SEQ ID NO: 3134844 - protein, 5 aa, Giardia lamblia
RTERD

SEQ ID NO: 3134845 - protein, 6 aa, Giardia lamblia
RTERSM

SEQ ID NO: 3134846 - protein, 13 aa, Giardia lamblia
RTESAEKSSRLDD

SEQ ID NO: 3134847 - protein, 16 aa, Giardia lamblia
RTESSSRISAATPPVP

SEQ ID NO: 3134848 - protein, 10 aa, Giardia lamblia
RTETDEKSLS

SEQ ID NO: 3134849 - protein, 52 aa, Giardia lamblia
RTETMQPGTKDEEPDEDKPPSDYSDDEEVHRQRKDDDENDGRKRGWGNRYRR

SEQ ID NO: 3134850 - protein, 5 aa, Giardia lamblia
RTETR

SEQ ID NO: 3134851 - protein, 8 aa, Giardia lamblia
RTFEQDGE

SEQ ID NO: 3134852 - protein, 12 aa, Giardia lamblia
RTFGQKKPYASQ

SEQ ID NO: 3134853 - protein, 31 aa, Giardia lamblia
RTFSGGKIGSNKQRRRPPTEEQSLLFLATPA

SEQ ID NO: 3134854 - protein, 7 aa, Giardia lamblia
RTFSSSK

SEQ ID NO: 3134855 - protein, 4 aa, Giardia lamblia
RTGA

SEQ ID NO: 3134856 - protein, 9 aa, Giardia lamblia
RTGANQTQD

SEQ ID NO: 3134857 - protein, 4 aa, Giardia lamblia
RTGD

SEQ ID NO: 3134858 - protein, 6 aa, Giardia lamblia
RTGDEQ

SEQ ID NO: 3134859 - protein, 7 aa, Giardia lamblia
RTGDPDL

SEQ ID NO: 3134860 - protein, 6 aa, Giardia lamblia
RTGEMD

SEQ ID NO: 3134861 - protein, 7 aa, Giardia lamblia
RTGETEE

SEQ ID NO: 3134862 - protein, 6 aa, Giardia lamblia
RTGETR

SEQ ID NO: 3134863 - protein, 10 aa, Giardia lamblia
RTGGKDRPSI

SEQ ID NO: 3134864 - protein, 4 aa, Giardia lamblia
RTGH

SEQ ID NO: 3134865 - protein, 9 aa, Giardia lamblia
RTGKDNQRY

SEQ ID NO: 3134866 - protein, 6 aa, Giardia lamblia
RTGKND

SEQ ID NO: 3134867 - protein, 8 aa, Giardia lamblia
RTGLTTED

SEQ ID NO: 3134868 - protein, 5 aa, Giardia lamblia
RTGPI

SEQ ID NO: 3134869 - protein, 9 aa, Giardia lamblia
RTGPSTAMT

SEQ ID NO: 3134870 - protein, 30 aa, Giardia lamblia
RTGQATSVTDQPSAPQADSAPANVSAESEI

SEQ ID NO: 3134871 - protein, 11 aa, Giardia lamblia
RTGRADAPGTS

SEQ ID NO: 3134872 - protein, 10 aa, Giardia lamblia
RTGRAGAEGL

SEQ ID NO: 3134873 - protein, 9 aa, Giardia lamblia
RTGRRNRQG

SEQ ID NO: 3134874 - protein, 6 aa, Giardia lamblia
RTGSGK

SEQ ID NO: 3134875 - protein, 7 aa, Giardia lamblia
RTGSGKT

SEQ ID NO: 3134876 - protein, 7 aa, Giardia lamblia
RTGSSAA

SEQ ID NO: 3134877 - protein, 6 aa, Giardia lamblia
RTGSYG

SEQ ID NO: 3134878 - protein, 9 aa, Giardia lamblia
RTGTSESQT

SEQ ID NO: 3134879 - protein, 4 aa, Giardia lamblia
RTGV

SEQ ID NO: 3134880 - protein, 9 aa, Giardia lamblia
RTGVNQPQM

SEQ ID NO: 3134881 - protein, 30 aa, Giardia lamblia
RTGVPGASDDTLQRGGPGPTPRQTEASPPS

SEQ ID NO: 3134882 - protein, 8 aa, Giardia lamblia
RTHEEERQ

SEQ ID NO: 3134883 - protein, 8 aa, Giardia lamblia
RTHKTSEV

SEQ ID NO: 3134884 - protein, 5 aa, Giardia lamblia
RTHNK

SEQ ID NO: 3134885 - protein, 7 aa, Giardia lamblia
RTHPRYN

SEQ ID NO: 3134886 - protein, 23 aa, Giardia lamblia
RTHSKAKAVADELKSESLKAYES

SEQ ID NO: 3134887 - protein, 9 aa, Giardia lamblia
RTIEANETR

SEQ ID NO: 3134888 - protein, 6 aa, Giardia lamblia
RTIEGR

SEQ ID NO: 3134889 - protein, 5 aa, Giardia lamblia
RTIPD

SEQ ID NO: 3134890 - protein, 8 aa, Giardia lamblia
RTIPSSSI

SEQ ID NO: 3134891 - protein, 11 aa, Giardia lamblia
RTIRDPRIADK

SEQ ID NO: 3134892 - protein, 5 aa, Giardia lamblia
RTITD

SEQ ID NO: 3134893 - protein, 5 aa, Giardia lamblia
RTKAD

SEQ ID NO: 3134894 - protein, 8 aa, Giardia lamblia
RTKAGEHE

SEQ ID NO: 3134895 - protein, 8 aa, Giardia lamblia
RTKDGRGA

SEQ ID NO: 3134896 - protein, 6 aa, Giardia lamblia
RTKEEA

SEQ ID NO: 3134897 - protein, 21 aa, Giardia lamblia
RTKEEDAADDPDDGDGEGYGE

SEQ ID NO: 3134898 - protein, 5 aa, Giardia lamblia
RTKEI

SEQ ID NO: 3134899 - protein, 6 aa, Giardia lamblia
RTKELD

SEQ ID NO: 3134900 - protein, 5 aa, Giardia lamblia
RTKEQ

SEQ ID NO: 3134901 - protein, 10 aa, Giardia lamblia
RTKEYTDARE

SEQ ID NO: 3134902 - protein, 9 aa, Giardia lamblia
RTKGATGRF

SEQ ID NO: 3134903 - protein, 24 aa, Giardia lamblia
RTKKTPLRKGGKKAKGSDQADGEN

SEQ ID NO: 3134904 - protein, 18 aa, Giardia lamblia
RTKNKNSIYQHDTTSQYE

SEQ ID NO: 3134905 - protein, 16 aa, Giardia lamblia
RTKNNPVLTGPAGVGK

SEQ ID NO: 3134906 - protein, 8 aa, Giardia lamblia
RTKNSVCT

SEQ ID NO: 3134907 - protein, 7 aa, Giardia lamblia
RTKPPLT

SEQ ID NO: 3134908 - protein, 6 aa, Giardia lamblia
RTKPSR

SEQ ID NO: 3134909 - protein, 4 aa, Giardia lamblia
RTKQ

SEQ ID NO: 3134910 - protein, 42 aa, Giardia lamblia
RTKQRSTSATPNLGGQSTMRSTSRGGAVGAPQTPGRSRYDDS

SEQ ID NO: 3134911 - protein, 5 aa, Giardia lamblia
RTKRG

SEQ ID NO: 3134912 - protein, 21 aa, Giardia lamblia
RTKRTQDGTGSGAKTPTTPVS

SEQ ID NO: 3134913 - protein, 14 aa, Giardia lamblia
RTKSAPAHLSREDL

SEQ ID NO: 3134914 - protein, 8 aa, Giardia lamblia
RTKTPSDS

SEQ ID NO: 3134915 - protein, 5 aa, Giardia lamblia
RTLGA

SEQ ID NO: 3134916 - protein, 6 aa, Giardia lamblia
RTLKPD

SEQ ID NO: 3134917 - protein, 4 aa, Giardia lamblia
RTLP

SEQ ID NO: 3134918 - protein, 12 aa, Giardia lamblia
RTLPTSPPRSLQ

SEQ ID NO: 3134919 - protein, 10 aa, Giardia lamblia
RTLSGGQRSR

SEQ ID NO: 3134920 - protein, 5 aa, Giardia lamblia
RTLSS

SEQ ID NO: 3134921 - protein, 9 aa, Giardia lamblia
RTLSSASEI

SEQ ID NO: 3134922 - protein, 42 aa, Giardia lamblia
RTLTGNSTGAGGSEELGASTRMRQGVTKSQVTKSQLAKTGTM

SEQ ID NO: 3134923 - protein, 5 aa, Giardia lamblia
RTMAG

SEQ ID NO: 3134924 - protein, 9 aa, Giardia lamblia
RTMKPRTSR

SEQ ID NO: 3134925 - protein, 10 aa, Giardia lamblia
RTMQSQASSQ

SEQ ID NO: 3134926 - protein, 5 aa, Giardia lamblia
RTMSD

SEQ ID NO: 3134927 - protein, 5 aa, Giardia lamblia
RTNDA

SEQ ID NO: 3134928 - protein, 5 aa, Giardia lamblia
RTNDC

SEQ ID NO: 3134929 - protein, 11 aa, Giardia lamblia
RTNDSQSSADP

SEQ ID NO: 3134930 - protein, 7 aa, Giardia lamblia
RTNETET

SEQ ID NO: 3134931 - protein, 16 aa, Giardia lamblia
RTNGPASSASQDEISA

SEQ ID NO: 3134932 - protein, 9 aa, Giardia lamblia
RTNKDTENV

SEQ ID NO: 3134933 - protein, 5 aa, Giardia lamblia
RTNLG

SEQ ID NO: 3134934 - protein, 14 aa, Giardia lamblia
RTNNENISSVARTT

SEQ ID NO: 3134935 - protein, 6 aa, Giardia lamblia
RTNPGS

SEQ ID NO: 3134936 - protein, 10 aa, Giardia lamblia
RTNPRFSESG

SEQ ID NO: 3134937 - protein, 9 aa, Giardia lamblia
RTNPSDIDP

SEQ ID NO: 3134938 - protein, 11 aa, Giardia lamblia
RTNQIGEPRHS

SEQ ID NO: 3134939 - protein, 6 aa, Giardia lamblia
RTNSDR

SEQ ID NO: 3134940 - protein, 7 aa, Giardia lamblia
RTNSGRT

SEQ ID NO: 3134941 - protein, 6 aa, Giardia lamblia
RTNSTK

SEQ ID NO: 3134942 - protein, 5 aa, Giardia lamblia
RTNTG

SEQ ID NO: 3134943 - protein, 5 aa, Giardia lamblia
RTNTP

SEQ ID NO: 3134944 - protein, 6 aa, Giardia lamblia
RTNTRV

SEQ ID NO: 3134945 - protein, 6 aa, Giardia lamblia
RTNTVS

SEQ ID NO: 3134946 - protein, 5 aa, Giardia lamblia
RTNVQ

SEQ ID NO: 3134947 - protein, 5 aa, Giardia lamblia
RTNYG

SEQ ID NO: 3134948 - protein, 65 aa, Giardia lamblia
RTPARAGSTASRATSQSTQGISSSNRVASSAAQDRRTVSNTSRASSSTSRSASNAVRNRSLPSTN

SEQ ID NO: 3134949 - protein, 18 aa, Giardia lamblia
RTPASRGIESDRDSDDQV

SEQ ID NO: 3134950 - protein, 10 aa, Giardia lamblia
RTPDDGRPAE

SEQ ID NO: 3134951 - protein, 9 aa, Giardia lamblia
RTPDEPFSS

SEQ ID NO: 3134952 - protein, 5 aa, Giardia lamblia
RTPEK

SEQ ID NO: 3134953 - protein, 8 aa, Giardia lamblia
RTPETQSE

SEQ ID NO: 3134954 - protein, 8 aa, Giardia lamblia
RTPISRPN

SEQ ID NO: 3134955 - protein, 7 aa, Giardia lamblia
RTPNFSG

SEQ ID NO: 3134956 - protein, 9 aa, Giardia lamblia
RTPNRNGET

SEQ ID NO: 3134957 - protein, 5 aa, Giardia lamblia
RTPRD

SEQ ID NO: 3134958 - protein, 5 aa, Giardia lamblia
RTPRH

SEQ ID NO: 3134959 - protein, 11 aa, Giardia lamblia
RTPRNSPTEDI

SEQ ID NO: 3134960 - protein, 19 aa, Giardia lamblia
RTPSDSDIAGSGGPATAVP

SEQ ID NO: 3134961 - protein, 8 aa, Giardia lamblia
RTPSLKQE

SEQ ID NO: 3134962 - protein, 9 aa, Giardia lamblia
RTPSSARKR

SEQ ID NO: 3134963 - protein, 9 aa, Giardia lamblia
RTPSYRSGQ

SEQ ID NO: 3134964 - protein, 17 aa, Giardia lamblia
RTPTGESAQPPSLTETE

SEQ ID NO: 3134965 - protein, 8 aa, Giardia lamblia
RTPTGRSL

SEQ ID NO: 3134966 - protein, 7 aa, Giardia lamblia
RTPTSSV

SEQ ID NO: 3134967 - protein, 7 aa, Giardia lamblia
RTPTTKM

SEQ ID NO: 3134968 - protein, 23 aa, Giardia lamblia
RTQASKSARPNVNETASKRRIQS

SEQ ID NO: 3134969 - protein, 4 aa, Giardia lamblia
RTQE

SEQ ID NO: 3134970 - protein, 26 aa, Giardia lamblia
RTQHTAKNHGTSNQYKAAPERSHSAL

SEQ ID NO: 3134971 - protein, 5 aa, Giardia lamblia
RTQNT

SEQ ID NO: 3134972 - protein, 12 aa, Giardia lamblia
RTQSDKDSKTLS

SEQ ID NO: 3134973 - protein, 5 aa, Giardia lamblia
RTQSL

SEQ ID NO: 3134974 - protein, 5 aa, Giardia lamblia
RTQTE

SEQ ID NO: 3134975 - protein, 13 aa, Giardia lamblia
RTQTKEDGFKEIN

SEQ ID NO: 3134976 - protein, 6 aa, Giardia lamblia
RTRADK

SEQ ID NO: 3134977 - protein, 44 aa, Giardia lamblia
RTREARARKMEERERAELEGHAPERRYAEKDGPKERAPRARTRK

SEQ ID NO: 3134978 - protein, 8 aa, Giardia lamblia
RTREVSKE

SEQ ID NO: 3134979 - protein, 6 aa, Giardia lamblia
RTRKAS

SEQ ID NO: 3134980 - protein, 13 aa, Giardia lamblia
RTRKSSSTQDPTL

SEQ ID NO: 3134981 - protein, 5 aa, Giardia lamblia
RTRLT

SEQ ID NO: 3134982 - protein, 10 aa, Giardia lamblia
RTRQDNHDQG

SEQ ID NO: 3134983 - protein, 14 aa, Giardia lamblia
RTRQTTTPTTKQRV

SEQ ID NO: 3134984 - protein, 4 aa, Giardia lamblia
RTRR

SEQ ID NO: 3134985 - protein, 10 aa, Giardia lamblia
RTRSGGLEPD

SEQ ID NO: 3134986 - protein, 13 aa, Giardia lamblia
RTRSRRDKEAEAI

SEQ ID NO: 3134987 - protein, 10 aa, Giardia lamblia
RTRSSITPGE

SEQ ID NO: 3134988 - protein, 8 aa, Giardia lamblia
RTRTDSYE

SEQ ID NO: 3134989 - protein, 9 aa, Giardia lamblia
RTRTEAGET

SEQ ID NO: 3134990 - protein, 11 aa, Giardia lamblia
RTSAPDGERVP

SEQ ID NO: 3134991 - protein, 14 aa, Giardia lamblia
RTSATRPHANGRFS

SEQ ID NO: 3134992 - protein, 7 aa, Giardia lamblia
RTSDPSI

SEQ ID NO: 3134993 - protein, 8 aa, Giardia lamblia
RTSDPTYA

SEQ ID NO: 3134994 - protein, 5 aa, Giardia lamblia
RTSEG

SEQ ID NO: 3134995 - protein, 6 aa, Giardia lamblia
RTSERT

SEQ ID NO: 3134996 - protein, 19 aa, Giardia lamblia
RTSFKTAKTKRDYMGPRKS

SEQ ID NO: 3134997 - protein, 5 aa, Giardia lamblia
RTSFR

SEQ ID NO: 3134998 - protein, 5 aa, Giardia lamblia
RTSFT

SEQ ID NO: 3134999 - protein, 4 aa, Giardia lamblia
RTSG

SEQ ID NO: 3135000 - protein, 8 aa, Giardia lamblia
RTSGATSC

SEQ ID NO: 3135001 - protein, 5 aa, Giardia lamblia
RTSGE

SEQ ID NO: 3135002 - protein, 9 aa, Giardia lamblia
RTSGEISNE

SEQ ID NO: 3135003 - protein, 7 aa, Giardia lamblia
RTSGQKR

SEQ ID NO: 3135004 - protein, 15 aa, Giardia lamblia
RTSGSAGKHLYYRLC

SEQ ID NO: 3135005 - protein, 5 aa, Giardia lamblia
RTSKG

SEQ ID NO: 3135006 - protein, 12 aa, Giardia lamblia
RTSKSQSEGTKL

SEQ ID NO: 3135007 - protein, 17 aa, Giardia lamblia
RTSLEKSTKNTSTATAS

SEQ ID NO: 3135008 - protein, 16 aa, Giardia lamblia
RTSLQGTSKPNVPRPQ

SEQ ID NO: 3135009 - protein, 18 aa, Giardia lamblia
RTSNNDYTAPTDDDDTFD

SEQ ID NO: 3135010 - protein, 13 aa, Giardia lamblia
RTSPGEKASAGSW

SEQ ID NO: 3135011 - protein, 9 aa, Giardia lamblia
RTSPMQSES

SEQ ID NO: 3135012 - protein, 21 aa, Giardia lamblia
RTSPQSARLSEVPESDTDGVP

SEQ ID NO: 3135013 - protein, 5 aa, Giardia lamblia
RTSPS

SEQ ID NO: 3135014 - protein, 6 aa, Giardia lamblia
RTSPYR

SEQ ID NO: 3135015 - protein, 7 aa, Giardia lamblia
RTSQPQV

SEQ ID NO: 3135016 - protein, 53 aa, Giardia lamblia
RTSRISRNADDSVEEDSSASPPSQNQPAPTSQLTQQIKKQDQKPGTHHKDQGQ

SEQ ID NO: 3135017 - protein, 4 aa, Giardia lamblia
RTSS

SEQ ID NO: 3135018 - protein, 20 aa, Giardia lamblia
RTSSDGPAPPRAPETRDAKK

SEQ ID NO: 3135019 - protein, 6 aa, Giardia lamblia
RTSSLG

SEQ ID NO: 3135020 - protein, 9 aa, Giardia lamblia
RTSSRGGIT

SEQ ID NO: 3135021 - protein, 8 aa, Giardia lamblia
RTSSTATN

SEQ ID NO: 3135022 - protein, 6 aa, Giardia lamblia
RTSSVS

SEQ ID NO: 3135023 - protein, 8 aa, Giardia lamblia
RTSTTGTT

SEQ ID NO: 3135024 - protein, 32 aa, Giardia lamblia
RTSVSDPPQMESHTPNTAISPSTGNSALTRSR

SEQ ID NO: 3135025 - protein, 8 aa, Giardia lamblia
RTTAYAAT

SEQ ID NO: 3135026 - protein, 15 aa, Giardia lamblia
RTTDDNSRASANAEF

SEQ ID NO: 3135027 - protein, 6 aa, Giardia lamblia
RTTDPD

SEQ ID NO: 3135028 - protein, 6 aa, Giardia lamblia
RTTDPL

SEQ ID NO: 3135029 - protein, 11 aa, Giardia lamblia
RTTDTSRKDTI

SEQ ID NO: 3135030 - protein, 9 aa, Giardia lamblia
RTTETAHRP

SEQ ID NO: 3135031 - protein, 11 aa, Giardia lamblia
RTTETNSNNLT

SEQ ID NO: 3135032 - protein, 15 aa, Giardia lamblia
RTTEVQKDELQVDQR

SEQ ID NO: 3135033 - protein, 4 aa, Giardia lamblia
RTTG

SEQ ID NO: 3135034 - protein, 5 aa, Giardia lamblia
RTTGA

SEQ ID NO: 3135035 - protein, 6 aa, Giardia lamblia
RTTGIQ

SEQ ID NO: 3135036 - protein, 12 aa, Giardia lamblia
RTTGRPKSARLQ

SEQ ID NO: 3135037 - protein, 35 aa, Giardia lamblia
RTTIRGGNENPGPGAYEQNVDPIKERAPASSLRSR

SEQ ID NO: 3135038 - protein, 7 aa, Giardia lamblia
RTTMSAD

SEQ ID NO: 3135039 - protein, 5 aa, Giardia lamblia
RTTPG

SEQ ID NO: 3135040 - protein, 7 aa, Giardia lamblia
RTTQIPE

SEQ ID NO: 3135041 - protein, 7 aa, Giardia lamblia
RTTSALG

SEQ ID NO: 3135042 - protein, 7 aa, Giardia lamblia
RTTSESI

SEQ ID NO: 3135043 - protein, 10 aa, Giardia lamblia
RTTSSGKDAD

SEQ ID NO: 3135044 - protein, 4 aa, Giardia lamblia
RTVD

SEQ ID NO: 3135045 - protein, 6 aa, Giardia lamblia
RTVDSL

SEQ ID NO: 3135046 - protein, 6 aa, Giardia lamblia
RTVEER

SEQ ID NO: 3135047 - protein, 17 aa, Giardia lamblia
RTVEESGDSQQATQLPP

SEQ ID NO: 3135048 - protein, 8 aa, Giardia lamblia
RTVEQERK

SEQ ID NO: 3135049 - protein, 14 aa, Giardia lamblia
RTVRGSRENSTEAK

SEQ ID NO: 3135050 - protein, 4 aa, Giardia lamblia
RTVS

SEQ ID NO: 3135051 - protein, 9 aa, Giardia lamblia
RTVSSSLTD

SEQ ID NO: 3135052 - protein, 4 aa, Giardia lamblia
RTVT

SEQ ID NO: 3135053 - protein, 5 aa, Giardia lamblia
RTYGD

SEQ ID NO: 3135054 - protein, 24 aa, Giardia lamblia
RTYGPRAAKQEEEASPVAASPPPP

SEQ ID NO: 3135055 - protein, 24 aa, Giardia lamblia
RTYGPRAAKQEEEASPVTASPPPP

SEQ ID NO: 3135056 - protein, 24 aa, Giardia lamblia
RTYGPRAAKQEEEVSPVTASPPPP

SEQ ID NO: 3135057 - protein, 4 aa, Giardia lamblia
RTYP

SEQ ID NO: 3135058 - protein, 11 aa, Giardia lamblia
RTYQSSSETHM

SEQ ID NO: 3135059 - protein, 4 aa, Giardia lamblia
RTYS

SEQ ID NO: 3135060 - protein, 7 aa, Giardia lamblia
RTYSDGP

SEQ ID NO: 3135061 - protein, 14 aa, Giardia lamblia
RTYSQQKGQLQNSD

SEQ ID NO: 3135062 - protein, 7 aa, Giardia lamblia
RVADARQ

SEQ ID NO: 3135063 - protein, 7 aa, Giardia lamblia
RVADPPS

SEQ ID NO: 3135064 - protein, 10 aa, Giardia lamblia
RVAEKDAEID

SEQ ID NO: 3135065 - protein, 10 aa, Giardia lamblia
RVANNKDLSQ

SEQ ID NO: 3135066 - protein, 15 aa, Giardia lamblia
RVAPRLGSAGLTAGG

SEQ ID NO: 3135067 - protein, 11 aa, Giardia lamblia
RVDGSGSSPMP

SEQ ID NO: 3135068 - protein, 8 aa, Giardia lamblia
RVDTTTPK

SEQ ID NO: 3135069 - protein, 7 aa, Giardia lamblia
RVEEENR

SEQ ID NO: 3135070 - protein, 14 aa, Giardia lamblia
RVEQDGGKPNNDTL

SEQ ID NO: 3135071 - protein, 14 aa, Giardia lamblia
RVESARRPSSAKAS

SEQ ID NO: 3135072 - protein, 5 aa, Giardia lamblia
RVESE

SEQ ID NO: 3135073 - protein, 6 aa, Giardia lamblia
RVESTT

SEQ ID NO: 3135074 - protein, 5 aa, Giardia lamblia
RVGAT

SEQ ID NO: 3135075 - protein, 5 aa, Giardia lamblia
RVGDN

SEQ ID NO: 3135076 - protein, 18 aa, Giardia lamblia
RVGGPRSTQSMNGTSSMR

SEQ ID NO: 3135077 - protein, 4 aa, Giardia lamblia
RVGK

SEQ ID NO: 3135078 - protein, 6 aa, Giardia lamblia
RVGKPH

SEQ ID NO: 3135079 - protein, 6 aa, Giardia lamblia
RVGNAT

SEQ ID NO: 3135080 - protein, 37 aa, Giardia lamblia
RVGSAGDGTLGTKNKQRRHQEAKGGVKKPGAKKATGI

SEQ ID NO: 3135081 - protein, 24 aa, Giardia lamblia
RVGTGAGNNFGAGYAGYGEEHGQR

SEQ ID NO: 3135082 - protein, 5 aa, Giardia lamblia
RVGYT

SEQ ID NO: 3135083 - protein, 8 aa, Giardia lamblia
RVKEEDEL

SEQ ID NO: 3135084 - protein, 7 aa, Giardia lamblia
RVKPRET

SEQ ID NO: 3135085 - protein, 7 aa, Giardia lamblia
RVNPSSV

SEQ ID NO: 3135086 - protein, 9 aa, Giardia lamblia
RVPDPSPFE

SEQ ID NO: 3135087 - protein, 5 aa, Giardia lamblia
RVPEE

SEQ ID NO: 3135088 - protein, 4 aa, Giardia lamblia
RVPG

SEQ ID NO: 3135089 - protein, 6 aa, Giardia lamblia
RVPGSE

SEQ ID NO: 3135090 - protein, 6 aa, Giardia lamblia
RVPPDD

SEQ ID NO: 3135091 - protein, 10 aa, Giardia lamblia
RVPRPRDPQD

SEQ ID NO: 3135092 - protein, 20 aa, Giardia lamblia
RVPRTGNMPRTPGVGERKEE

SEQ ID NO: 3135093 - protein, 5 aa, Giardia lamblia
RVPVG

SEQ ID NO: 3135094 - protein, 6 aa, Giardia lamblia
RVQADT

SEQ ID NO: 3135095 - protein, 7 aa, Giardia lamblia
RVQEDNS

SEQ ID NO: 3135096 - protein, 5 aa, Giardia lamblia
RVQTV

SEQ ID NO: 3135097 - protein, 13 aa, Giardia lamblia
RVRELEKSRPGHV

SEQ ID NO: 3135098 - protein, 10 aa, Giardia lamblia
RVRKQRDDLR

SEQ ID NO: 3135099 - protein, 57 aa, Giardia lamblia
RVRSSSQNRVDAKARSAQRSASRYSDTRSASESYTEVSSTSDSESDGGYSHTMSGST

SEQ ID NO: 3135100 - protein, 5 aa, Giardia lamblia
RVSDS

SEQ ID NO: 3135101 - protein, 23 aa, Giardia lamblia
RVSDSLEKDPVRAHSGLPPRKAS

SEQ ID NO: 3135102 - protein, 5 aa, Giardia lamblia
RVSEK

SEQ ID NO: 3135103 - protein, 10 aa, Giardia lamblia
RVSKGTADIE

SEQ ID NO: 3135104 - protein, 4 aa, Giardia lamblia
RVSP

SEQ ID NO: 3135105 - protein, 17 aa, Giardia lamblia
RVSRSPSPVRSPSPSRL

SEQ ID NO: 3135106 - protein, 23 aa, Giardia lamblia
RVSSGKRRELEKKARAAEDATEN

SEQ ID NO: 3135107 - protein, 18 aa, Giardia lamblia
RVSSGSTSHGISENARNT

SEQ ID NO: 3135108 - protein, 36 aa, Giardia lamblia
RVSSRMSQNRLKNPVKQRPTSANNASANRSTQSAVS

SEQ ID NO: 3135109 - protein, 29 aa, Giardia lamblia
RVSSTSHVSPEQLQADTPLRDTSELENVT

SEQ ID NO: 3135110 - protein, 17 aa, Giardia lamblia
RVSTPVPRGASSSSRGG

SEQ ID NO: 3135111 - protein, 5 aa, Giardia lamblia
RVSTS

SEQ ID NO: 3135112 - protein, 4 aa, Giardia lamblia
RVTE

SEQ ID NO: 3135113 - protein, 12 aa, Giardia lamblia
RVTEERQSLSAT

SEQ ID NO: 3135114 - protein, 10 aa, Giardia lamblia
RVTKASVSEQ

SEQ ID NO: 3135115 - protein, 12 aa, Giardia lamblia
RVTKEKTPPTKL

SEQ ID NO: 3135116 - protein, 13 aa, Giardia lamblia
RVTPTKSNSIEIP

SEQ ID NO: 3135117 - protein, 5 aa, Giardia lamblia
RVTQQ

SEQ ID NO: 3135118 - protein, 11 aa, Giardia lamblia
RVTSKTETPLH

SEQ ID NO: 3135119 - protein, 6 aa, Giardia lamblia
RVTSTS

SEQ ID NO: 3135120 - protein, 13 aa, Giardia lamblia
RVVTSDRSTSPVA

SEQ ID NO: 3135121 - protein, 12 aa, Giardia lamblia
RVYTTQGTDTAR

SEQ ID NO: 3135122 - protein, 17 aa, Giardia lamblia
RYADYDPPGNSSRSGST

SEQ ID NO: 3135123 - protein, 5 aa, Giardia lamblia
RYAGQ

SEQ ID NO: 3135124 - protein, 11 aa, Giardia lamblia
RYAKGSEDYLE

SEQ ID NO: 3135125 - protein, 6 aa, Giardia lamblia
RYAPED

SEQ ID NO: 3135126 - protein, 16 aa, Giardia lamblia
RYDEQTRQLEEQEHQR

SEQ ID NO: 3135127 - protein, 5 aa, Giardia lamblia
RYDGT

SEQ ID NO: 3135128 - protein, 17 aa, Giardia lamblia
RYDKGSVNQRGHSSASM

SEQ ID NO: 3135129 - protein, 8 aa, Giardia lamblia
RYDRAPST

SEQ ID NO: 3135130 - protein, 12 aa, Giardia lamblia
RYDSLSAAERDA

SEQ ID NO: 3135131 - protein, 11 aa, Giardia lamblia
RYEDSTTGDNF

SEQ ID NO: 3135132 - protein, 12 aa, Giardia lamblia
RYEDSTTTCEAG

SEQ ID NO: 3135133 - protein, 7 aa, Giardia lamblia
RYEKATQ

SEQ ID NO: 3135134 - protein, 11 aa, Giardia lamblia
RYEQQSTRVRP

SEQ ID NO: 3135135 - protein, 5 aa, Giardia lamblia
RYERR

SEQ ID NO: 3135136 - protein, 6 aa, Giardia lamblia
RYETEE

SEQ ID NO: 3135137 - protein, 9 aa, Giardia lamblia
RYGASQDEL

SEQ ID NO: 3135138 - protein, 6 aa, Giardia lamblia
RYGATG

SEQ ID NO: 3135139 - protein, 76 aa, Giardia lamblia
RYGDSPSRSTSRTRTALSSSQTRAGSNTLRRSGSVTGTATGATKAHGSTSTSRAQSRTQSRNQSRTGRSGSTVDRQ

SEQ ID NO: 3135140 - protein, 5 aa, Giardia lamblia
RYGET

SEQ ID NO: 3135141 - protein, 5 aa, Giardia lamblia
RYGHP

SEQ ID NO: 3135142 - protein, 9 aa, Giardia lamblia
RYGNGEPNT

SEQ ID NO: 3135143 - protein, 6 aa, Giardia lamblia
RYGNPS

SEQ ID NO: 3135144 - protein, 17 aa, Giardia lamblia
RYHGSGRSGIANTETNK

SEQ ID NO: 3135145 - protein, 27 aa, Giardia lamblia
RYKDATKKRGEADAQQQLEDEKRSLEA

SEQ ID NO: 3135146 - protein, 9 aa, Giardia lamblia
RYKEESGRL

SEQ ID NO: 3135147 - protein, 4 aa, Giardia lamblia
RYKN

SEQ ID NO: 3135148 - protein, 13 aa, Giardia lamblia
RYKQDEGVPELIF

SEQ ID NO: 3135149 - protein, 4 aa, Giardia lamblia
RYKT

SEQ ID NO: 3135150 - protein, 12 aa, Giardia lamblia
RYKTYDPKQQYE

SEQ ID NO: 3135151 - protein, 9 aa, Giardia lamblia
RYNGDTKDE

SEQ ID NO: 3135152 - protein, 6 aa, Giardia lamblia
RYNPSA

SEQ ID NO: 3135153 - protein, 13 aa, Giardia lamblia
RYNPSEGSVTFTG

SEQ ID NO: 3135154 - protein, 18 aa, Giardia lamblia
RYNRDKDKESQKIAYKNG

SEQ ID NO: 3135155 - protein, 5 aa, Giardia lamblia
RYNTD

SEQ ID NO: 3135156 - protein, 6 aa, Giardia lamblia
RYPALS

SEQ ID NO: 3135157 - protein, 9 aa, Giardia lamblia
RYPDTVDSS

SEQ ID NO: 3135158 - protein, 4 aa, Giardia lamblia
RYPE

SEQ ID NO: 3135159 - protein, 6 aa, Giardia lamblia
RYPGTL

SEQ ID NO: 3135160 - protein, 15 aa, Giardia lamblia
RYPKPQVPYSPANKD

SEQ ID NO: 3135161 - protein, 7 aa, Giardia lamblia
RYPLPDP

SEQ ID NO: 3135162 - protein, 4 aa, Giardia lamblia
RYPP

SEQ ID NO: 3135163 - protein, 9 aa, Giardia lamblia
RYPRTNIPE

SEQ ID NO: 3135164 - protein, 9 aa, Giardia lamblia
RYPTPRGYH

SEQ ID NO: 3135165 - protein, 8 aa, Giardia lamblia
RYPTQQER

SEQ ID NO: 3135166 - protein, 10 aa, Giardia lamblia
RYPTSTTVET

SEQ ID NO: 3135167 - protein, 9 aa, Giardia lamblia
RYQDDQGRT

SEQ ID NO: 3135168 - protein, 9 aa, Giardia lamblia
RYQPTSPQP

SEQ ID NO: 3135169 - protein, 7 aa, Giardia lamblia
RYQRGRP

SEQ ID NO: 3135170 - protein, 18 aa, Giardia lamblia
RYQSGEKRTLDSAEAEIE

SEQ ID NO: 3135171 - protein, 5 aa, Giardia lamblia
RYRSL

SEQ ID NO: 3135172 - protein, 29 aa, Giardia lamblia
RYSDSLQKSPIKQQALADDSFKSSSPIRK

SEQ ID NO: 3135173 - protein, 15 aa, Giardia lamblia
RYSFQEKPYPSGLQD

SEQ ID NO: 3135174 - protein, 18 aa, Giardia lamblia
RYSGSTNPQLRDAFIRLL

SEQ ID NO: 3135175 - protein, 8 aa, Giardia lamblia
RYSPDGME

SEQ ID NO: 3135176 - protein, 17 aa, Giardia lamblia
RYSPHGRGTEGAPSGSY

SEQ ID NO: 3135177 - protein, 5 aa, Giardia lamblia
RYSSV

SEQ ID NO: 3135178 - protein, 8 aa, Giardia lamblia
RYSTTTKR

SEQ ID NO: 3135179 - protein, 5 aa, Giardia lamblia
RYTAT

SEQ ID NO: 3135180 - protein, 6 aa, Giardia lamblia
RYTEES

SEQ ID NO: 3135181 - protein, 13 aa, Giardia lamblia
RYTKGIDEAEQRT

SEQ ID NO: 3135182 - protein, 11 aa, Giardia lamblia
RYTKQKDQESK

SEQ ID NO: 3135183 - protein, 8 aa, Giardia lamblia
RYTPKDTP

SEQ ID NO: 3135184 - protein, 16 aa, Giardia lamblia
RYTPSARSQPQSDHTS

SEQ ID NO: 3135185 - protein, 6 aa, Giardia lamblia
SAAAER

SEQ ID NO: 3135186 - protein, 12 aa, Giardia lamblia
SAAAQQRKEQET

SEQ ID NO: 3135187 - protein, 9 aa, Giardia lamblia
SAAASRSIT

SEQ ID NO: 3135188 - protein, 8 aa, Giardia lamblia
SAADHNNV

SEQ ID NO: 3135189 - protein, 7 aa, Giardia lamblia
SAADHSE

SEQ ID NO: 3135190 - protein, 7 aa, Giardia lamblia
SAADQGT

SEQ ID NO: 3135191 - protein, 9 aa, Giardia lamblia
SAAEASERF

SEQ ID NO: 3135192 - protein, 7 aa, Giardia lamblia
SAAEDNS

SEQ ID NO: 3135193 - protein, 23 aa, Giardia lamblia
SAAEEEDPLVNKPGDKGDSSQPF

SEQ ID NO: 3135194 - protein, 33 aa, Giardia lamblia
SAAFTSAATSAVSSAKTAAVAAAASDKESAMGN

SEQ ID NO: 3135195 - protein, 5 aa, Giardia lamblia
SAAGE

SEQ ID NO: 3135196 - protein, 16 aa, Giardia lamblia
SAAGPIDTSEELREAK

SEQ ID NO: 3135197 - protein, 9 aa, Giardia lamblia
SAAGSNRIN

SEQ ID NO: 3135198 - protein, 13 aa, Giardia lamblia
SAAGSSAKALETQ

SEQ ID NO: 3135199 - protein, 6 aa, Giardia lamblia
SAAGVD

SEQ ID NO: 3135200 - protein, 7 aa, Giardia lamblia
SAAHEQL

SEQ ID NO: 3135201 - protein, 8 aa, Giardia lamblia
SAAHKQRL

SEQ ID NO: 3135202 - protein, 22 aa, Giardia lamblia
SAAIKEQEQRRQQRKDYRQQGL

SEQ ID NO: 3135203 - protein, 9 aa, Giardia lamblia
SAAISKDER

SEQ ID NO: 3135204 - protein, 13 aa, Giardia lamblia
SAAKERPPPPPYS

SEQ ID NO: 3135205 - protein, 9 aa, Giardia lamblia
SAAKGNTHG

SEQ ID NO: 3135206 - protein, 12 aa, Giardia lamblia
SAAKPNPPPRRK

SEQ ID NO: 3135207 - protein, 24 aa, Giardia lamblia
SAAKTTTQTELESVGKKRQQNAED

SEQ ID NO: 3135208 - protein, 4 aa, Giardia lamblia
SAAL

SEQ ID NO: 3135209 - protein, 8 aa, Giardia lamblia
SAALSSSV

SEQ ID NO: 3135210 - protein, 16 aa, Giardia lamblia
SAANEKTTSKAPEVSG

SEQ ID NO: 3135211 - protein, 7 aa, Giardia lamblia
SAANGNS

SEQ ID NO: 3135212 - protein, 8 aa, Giardia lamblia
SAANKPDA

SEQ ID NO: 3135213 - protein, 9 aa, Giardia lamblia
SAANSVRAS

SEQ ID NO: 3135214 - protein, 4 aa, Giardia lamblia
SAAP

SEQ ID NO: 3135215 - protein, 8 aa, Giardia lamblia
SAAPPRQL

SEQ ID NO: 3135216 - protein, 8 aa, Giardia lamblia
SAAPSGEL

SEQ ID NO: 3135217 - protein, 7 aa, Giardia lamblia
SAAPTLD

SEQ ID NO: 3135218 - protein, 16 aa, Giardia lamblia
SAAPTVTGTEPTRLDS

SEQ ID NO: 3135219 - protein, 5 aa, Giardia lamblia
SAAQE

SEQ ID NO: 3135220 - protein, 10 aa, Giardia lamblia
SAAQSPGSVR

SEQ ID NO: 3135221 - protein, 7 aa, Giardia lamblia
SAAQTRA

SEQ ID NO: 3135222 - protein, 4 aa, Giardia lamblia
SAAR

SEQ ID NO: 3135223 - protein, 6 aa, Giardia lamblia
SAARGK

SEQ ID NO: 3135224 - protein, 24 aa, Giardia lamblia
SAARGSEGGSTSPYTNSDNTQKPS

SEQ ID NO: 3135225 - protein, 9 aa, Giardia lamblia
SAARGSIPS

SEQ ID NO: 3135226 - protein, 5 aa, Giardia lamblia
SAASD

SEQ ID NO: 3135227 - protein, 19 aa, Giardia lamblia
SAASDCNYSTLQQNKNYHD

SEQ ID NO: 3135228 - protein, 11 aa, Giardia lamblia
SAASINKGSYN

SEQ ID NO: 3135229 - protein, 10 aa, Giardia lamblia
SAATDQPQQP

SEQ ID NO: 3135230 - protein, 19 aa, Giardia lamblia
SAATDSYLSAKKDSDVTDY

SEQ ID NO: 3135231 - protein, 16 aa, Giardia lamblia
SAATLGGVASANASMA

SEQ ID NO: 3135232 - protein, 6 aa, Giardia lamblia
SAATNN

SEQ ID NO: 3135233 - protein, 10 aa, Giardia lamblia
SAATRDNPTS

SEQ ID NO: 3135234 - protein, 15 aa, Giardia lamblia
SAATTNQDHGHNSSN

SEQ ID NO: 3135235 - protein, 13 aa, Giardia lamblia
SAAVASPNSSALL

SEQ ID NO: 3135236 - protein, 12 aa, Giardia lamblia
SACDSNADPRSV

SEQ ID NO: 3135237 - protein, 16 aa, Giardia lamblia
SACGKTSTSMAPGSSI

SEQ ID NO: 3135238 - protein, 8 aa, Giardia lamblia
SACNSAES

SEQ ID NO: 3135239 - protein, 13 aa, Giardia lamblia
SADAGKKTSKGET

SEQ ID NO: 3135240 - protein, 8 aa, Giardia lamblia
SADAKQRL

SEQ ID NO: 3135241 - protein, 17 aa, Giardia lamblia
SADASNAVKREKEAREE

SEQ ID NO: 3135242 - protein, 7 aa, Giardia lamblia
SADDERL

SEQ ID NO: 3135243 - protein, 16 aa, Giardia lamblia
SADDPVKQVTNTKQNV

SEQ ID NO: 3135244 - protein, 6 aa, Giardia lamblia
SADEGQ

SEQ ID NO: 3135245 - protein, 5 aa, Giardia lamblia
SADEI

SEQ ID NO: 3135246 - protein, 7 aa, Giardia lamblia
SADERGN

SEQ ID NO: 3135247 - protein, 12 aa, Giardia lamblia
SADESGGTIAAT

SEQ ID NO: 3135248 - protein, 8 aa, Giardia lamblia
SADGGKVG

SEQ ID NO: 3135249 - protein, 5 aa, Giardia lamblia
SADGY

SEQ ID NO: 3135250 - protein, 11 aa, Giardia lamblia
SADISSGSHGG

SEQ ID NO: 3135251 - protein, 13 aa, Giardia lamblia
SADKSSRVREVLN

SEQ ID NO: 3135252 - protein, 18 aa, Giardia lamblia
SADLRQVEQDNKKLREEN

SEQ ID NO: 3135253 - protein, 12 aa, Giardia lamblia
SADLSNNNIQRG

SEQ ID NO: 3135254 - protein, 4 aa, Giardia lamblia
SADN

SEQ ID NO: 3135255 - protein, 6 aa, Giardia lamblia
SADNLA

SEQ ID NO: 3135256 - protein, 40 aa, Giardia lamblia
SADNPNRNAGYQDESLETPPVSTVPKTDASTPKDTGEALD

SEQ ID NO: 3135257 - protein, 8 aa, Giardia lamblia
SADNQTPV

SEQ ID NO: 3135258 - protein, 9 aa, Giardia lamblia
SADNSSSKK

SEQ ID NO: 3135259 - protein, 7 aa, Giardia lamblia
SADPELQ

SEQ ID NO: 3135260 - protein, 5 aa, Giardia lamblia
SADPQ

SEQ ID NO: 3135261 - protein, 11 aa, Giardia lamblia
SADPSAKDTDS

SEQ ID NO: 3135262 - protein, 4 aa, Giardia lamblia
SADQ

SEQ ID NO: 3135263 - protein, 10 aa, Giardia lamblia
SADQEKQKKT

SEQ ID NO: 3135264 - protein, 5 aa, Giardia lamblia
SADRS

SEQ ID NO: 3135265 - protein, 6 aa, Giardia lamblia
SADSIN

SEQ ID NO: 3135266 - protein, 7 aa, Giardia lamblia
SADSLEK

SEQ ID NO: 3135267 - protein, 11 aa, Giardia lamblia
SADSLQPPDVK

SEQ ID NO: 3135268 - protein, 10 aa, Giardia lamblia
SADSPNYDPK

SEQ ID NO: 3135269 - protein, 6 aa, Giardia lamblia
SADSSL

SEQ ID NO: 3135270 - protein, 13 aa, Giardia lamblia
SADSTNGALGSPS

SEQ ID NO: 3135271 - protein, 13 aa, Giardia lamblia
SADSVAAGAPRLP

SEQ ID NO: 3135272 - protein, 5 aa, Giardia lamblia
SADTD

SEQ ID NO: 3135273 - protein, 10 aa, Giardia lamblia
SADTDQDGLL

SEQ ID NO: 3135274 - protein, 6 aa, Giardia lamblia
SADTSA

SEQ ID NO: 3135275 - protein, 6 aa, Giardia lamblia
SADTTV

SEQ ID NO: 3135276 - protein, 13 aa, Giardia lamblia
SADYDSPEAKRKM

SEQ ID NO: 3135277 - protein, 8 aa, Giardia lamblia
SADYETPC

SEQ ID NO: 3135278 - protein, 4 aa, Giardia lamblia
SAEA

SEQ ID NO: 3135279 - protein, 8 aa, Giardia lamblia
SAEAGRDR

SEQ ID NO: 3135280 - protein, 5 aa, Giardia lamblia
SAEAL

SEQ ID NO: 3135281 - protein, 7 aa, Giardia lamblia
SAEARDA

SEQ ID NO: 3135282 - protein, 12 aa, Giardia lamblia
SAEAREAKQTSW

SEQ ID NO: 3135283 - protein, 8 aa, Giardia lamblia
SAECRDTA

SEQ ID NO: 3135284 - protein, 4 aa, Giardia lamblia
SAED

SEQ ID NO: 3135285 - protein, 45 aa, Giardia lamblia
SAEDGTDDDVSTYSAEEGNGNTDTNKCSHEGRIDNLSDDDEQINL

SEQ ID NO: 3135286 - protein, 5 aa, Giardia lamblia
SAEDK

SEQ ID NO: 3135287 - protein, 5 aa, Giardia lamblia
SAEDT

SEQ ID NO: 3135288 - protein, 8 aa, Giardia lamblia
SAEDTPGI

SEQ ID NO: 3135289 - protein, 12 aa, Giardia lamblia
SAEEATGRNIRQ

SEQ ID NO: 3135290 - protein, 40 aa, Giardia lamblia
SAEEETGNPCDSDSEDQAQPASLTSPAPKKKQKDGKKRKY

SEQ ID NO: 3135291 - protein, 8 aa, Giardia lamblia
SAEEPLSE

SEQ ID NO: 3135292 - protein, 8 aa, Giardia lamblia
SAEEQSCR

SEQ ID NO: 3135293 - protein, 9 aa, Giardia lamblia
SAEERKELR

SEQ ID NO: 3135294 - protein, 8 aa, Giardia lamblia
SAEHEKKQ

SEQ ID NO: 3135295 - protein, 28 aa, Giardia lamblia
SAEISGAKEPTTSGGQNADSDTPSQSNI

SEQ ID NO: 3135296 - protein, 6 aa, Giardia lamblia
SAEKEA

SEQ ID NO: 3135297 - protein, 9 aa, Giardia lamblia
SAEKGSIDV

SEQ ID NO: 3135298 - protein, 20 aa, Giardia lamblia
SAEKQARNREDEAYMLAFLA

SEQ ID NO: 3135299 - protein, 12 aa, Giardia lamblia
SAEKSSGKAHIT

SEQ ID NO: 3135300 - protein, 7 aa, Giardia lamblia
SAELDTQ

SEQ ID NO: 3135301 - protein, 8 aa, Giardia lamblia
SAELEDST

SEQ ID NO: 3135302 - protein, 10 aa, Giardia lamblia
SAENRADQMP

SEQ ID NO: 3135303 - protein, 7 aa, Giardia lamblia
SAENSIN

SEQ ID NO: 3135304 - protein, 7 aa, Giardia lamblia
SAEPKRL

SEQ ID NO: 3135305 - protein, 5 aa, Giardia lamblia
SAEPV

SEQ ID NO: 3135306 - protein, 8 aa, Giardia lamblia
SAEQQRKI

SEQ ID NO: 3135307 - protein, 6 aa, Giardia lamblia
SAEQVA

SEQ ID NO: 3135308 - protein, 7 aa, Giardia lamblia
SAESDVV

SEQ ID NO: 3135309 - protein, 9 aa, Giardia lamblia
SAESERSAL

SEQ ID NO: 3135310 - protein, 6 aa, Giardia lamblia
SAESQQ

SEQ ID NO: 3135311 - protein, 9 aa, Giardia lamblia
SAESSFAEG

SEQ ID NO: 3135312 - protein, 14 aa, Giardia lamblia
SAESSQDPSNPVPR

SEQ ID NO: 3135313 - protein, 9 aa, Giardia lamblia
SAESTKDIT

SEQ ID NO: 3135314 - protein, 8 aa, Giardia lamblia
SAESYRNS

SEQ ID NO: 3135315 - protein, 13 aa, Giardia lamblia
SAETAKKQFSEKV

SEQ ID NO: 3135316 - protein, 5 aa, Giardia lamblia
SAETG

SEQ ID NO: 3135317 - protein, 7 aa, Giardia lamblia
SAETITR

SEQ ID NO: 3135318 - protein, 13 aa, Giardia lamblia
SAETSEAASNQAA

SEQ ID NO: 3135319 - protein, 7 aa, Giardia lamblia
SAETTAD

SEQ ID NO: 3135320 - protein, 13 aa, Giardia lamblia
SAETVSSKKKAFS

SEQ ID NO: 3135321 - protein, 6 aa, Giardia lamblia
SAFDDK

SEQ ID NO: 3135322 - protein, 9 aa, Giardia lamblia
SAFDEDGPS

SEQ ID NO: 3135323 - protein, 5 aa, Giardia lamblia
SAFGS

SEQ ID NO: 3135324 - protein, 11 aa, Giardia lamblia
SAFKDNQSDQF

SEQ ID NO: 3135325 - protein, 17 aa, Giardia lamblia
SAFSEPSMTPNAPQGQE

SEQ ID NO: 3135326 - protein, 4 aa, Giardia lamblia
SAGA

SEQ ID NO: 3135327 - protein, 12 aa, Giardia lamblia
SAGAAEKEPAPK

SEQ ID NO: 3135328 - protein, 8 aa, Giardia lamblia
SAGAGIPR

SEQ ID NO: 3135329 - protein, 11 aa, Giardia lamblia
SAGAIPPHGAR

SEQ ID NO: 3135330 - protein, 5 aa, Giardia lamblia
SAGAL

SEQ ID NO: 3135331 - protein, 7 aa, Giardia lamblia
SAGASPL

SEQ ID NO: 3135332 - protein, 5 aa, Giardia lamblia
SAGDP

SEQ ID NO: 3135333 - protein, 11 aa, Giardia lamblia
SAGDRVTPEYT

SEQ ID NO: 3135334 - protein, 10 aa, Giardia lamblia
SAGDSSPYAG

SEQ ID NO: 3135335 - protein, 8 aa, Giardia lamblia
SAGEIPEE

SEQ ID NO: 3135336 - protein, 7 aa, Giardia lamblia
SAGERSI

SEQ ID NO: 3135337 - protein, 13 aa, Giardia lamblia
SAGGDSEEWNGPY

SEQ ID NO: 3135338 - protein, 6 aa, Giardia lamblia
SAGGFN

SEQ ID NO: 3135339 - protein, 7 aa, Giardia lamblia
SAGGRVD

SEQ ID NO: 3135340 - protein, 12 aa, Giardia lamblia
SAGGSGEDVDGL

SEQ ID NO: 3135341 - protein, 9 aa, Giardia lamblia
SAGKAPIFS

SEQ ID NO: 3135342 - protein, 5 aa, Giardia lamblia
SAGKD

SEQ ID NO: 3135343 - protein, 5 aa, Giardia lamblia
SAGLT

SEQ ID NO: 3135344 - protein, 8 aa, Giardia lamblia
SAGNAEAT

SEQ ID NO: 3135345 - protein, 8 aa, Giardia lamblia
SAGNKPEE

SEQ ID NO: 3135346 - protein, 10 aa, Giardia lamblia
SAGNSAGYPR

SEQ ID NO: 3135347 - protein, 8 aa, Giardia lamblia
SAGNTEPH

SEQ ID NO: 3135348 - protein, 14 aa, Giardia lamblia
SAGPAKSSERPLGL

SEQ ID NO: 3135349 - protein, 14 aa, Giardia lamblia
SAGQSANGKMSQPG

SEQ ID NO: 3135350 - protein, 4 aa, Giardia lamblia
SAGS

SEQ ID NO: 3135351 - protein, 7 aa, Giardia lamblia
SAGSDAL

SEQ ID NO: 3135352 - protein, 6 aa, Giardia lamblia
SAGSEE

SEQ ID NO: 3135353 - protein, 9 aa, Giardia lamblia
SAGSFSQAG

SEQ ID NO: 3135354 - protein, 8 aa, Giardia lamblia
SAGSRESV

SEQ ID NO: 3135355 - protein, 8 aa, Giardia lamblia
SAGSRTKI

SEQ ID NO: 3135356 - protein, 10 aa, Giardia lamblia
SAGSTGVTKV

SEQ ID NO: 3135357 - protein, 8 aa, Giardia lamblia
SAGTDLTQ

SEQ ID NO: 3135358 - protein, 10 aa, Giardia lamblia
SAGTGPNEAI

SEQ ID NO: 3135359 - protein, 18 aa, Giardia lamblia
SAGTKNNDMDRSKATMED

SEQ ID NO: 3135360 - protein, 22 aa, Giardia lamblia
SAGTRKGDRRLQKARRRQRLLT

SEQ ID NO: 3135361 - protein, 6 aa, Giardia lamblia
SAGVDG

SEQ ID NO: 3135362 - protein, 7 aa, Giardia lamblia
SAGYSTQ

SEQ ID NO: 3135363 - protein, 20 aa, Giardia lamblia
SAHGANVKRPSSTRSNYNSL

SEQ ID NO: 3135364 - protein, 17 aa, Giardia lamblia
SAHLPSTAEQHNGTSID

SEQ ID NO: 3135365 - protein, 14 aa, Giardia lamblia
SAHMEQRSRTPSLA

SEQ ID NO: 3135366 - protein, 12 aa, Giardia lamblia
SAHNTQDEEVSE

SEQ ID NO: 3135367 - protein, 8 aa, Giardia lamblia
SAHSIGSE

SEQ ID NO: 3135368 - protein, 8 aa, Giardia lamblia
SAHSRNSS

SEQ ID NO: 3135369 - protein, 7 aa, Giardia lamblia
SAHSTDD

SEQ ID NO: 3135370 - protein, 28 aa, Giardia lamblia
SAHTSRSGTAASTRSARGSEALADPPIV

SEQ ID NO: 3135371 - protein, 4 aa, Giardia lamblia
SAIA

SEQ ID NO: 3135372 - protein, 9 aa, Giardia lamblia
SAIAATEKF

SEQ ID NO: 3135373 - protein, 18 aa, Giardia lamblia
SAIGNNATQNESNEAELS

SEQ ID NO: 3135374 - protein, 7 aa, Giardia lamblia
SAIGSTG

SEQ ID NO: 3135375 - protein, 19 aa, Giardia lamblia
SAIGTTATVASTVTSAGTW

SEQ ID NO: 3135376 - protein, 31 aa, Giardia lamblia
SAINRERVQSASRNTASSGAPELATGQAADT

SEQ ID NO: 3135377 - protein, 7 aa, Giardia lamblia
SAIPGDG

SEQ ID NO: 3135378 - protein, 7 aa, Giardia lamblia
SAIPGTP

SEQ ID NO: 3135379 - protein, 7 aa, Giardia lamblia
SAIQQDE

SEQ ID NO: 3135380 - protein, 6 aa, Giardia lamblia
SAIQSS

SEQ ID NO: 3135381 - protein, 5 aa, Giardia lamblia
SAIQT

SEQ ID NO: 3135382 - protein, 7 aa, Giardia lamblia
SAISTEK

SEQ ID NO: 3135383 - protein, 14 aa, Giardia lamblia
SAITESTGGPTRQA

SEQ ID NO: 3135384 - protein, 4 aa, Giardia lamblia
SAKD

SEQ ID NO: 3135385 - protein, 8 aa, Giardia lamblia
SAKDDLNV

SEQ ID NO: 3135386 - protein, 5 aa, Giardia lamblia
SAKDI

SEQ ID NO: 3135387 - protein, 15 aa, Giardia lamblia
SAKEELRSEAEQKLR

SEQ ID NO: 3135388 - protein, 5 aa, Giardia lamblia
SAKGT

SEQ ID NO: 3135389 - protein, 22 aa, Giardia lamblia
SAKHSLPPPSQTSSAAERETRT

SEQ ID NO: 3135390 - protein, 10 aa, Giardia lamblia
SAKKEKLEKM

SEQ ID NO: 3135391 - protein, 6 aa, Giardia lamblia
SAKKKS

SEQ ID NO: 3135392 - protein, 11 aa, Giardia lamblia
SAKKNKLSSLS

SEQ ID NO: 3135393 - protein, 4 aa, Giardia lamblia
SAKL

SEQ ID NO: 3135394 - protein, 7 aa, Giardia lamblia
SAKNEAS

SEQ ID NO: 3135395 - protein, 10 aa, Giardia lamblia
SAKPAVPERV

SEQ ID NO: 3135396 - protein, 15 aa, Giardia lamblia
SAKPSELQGQPDHQE

SEQ ID NO: 3135397 - protein, 9 aa, Giardia lamblia
SAKPSGAWA

SEQ ID NO: 3135398 - protein, 8 aa, Giardia lamblia
SAKPSKGS

SEQ ID NO: 3135399 - protein, 6 aa, Giardia lamblia
SAKQGY

SEQ ID NO: 3135400 - protein, 9 aa, Giardia lamblia
SAKQKKPEL

SEQ ID NO: 3135401 - protein, 17 aa, Giardia lamblia
SAKQLTTIPPPTPPYSN

SEQ ID NO: 3135402 - protein, 9 aa, Giardia lamblia
SAKQPNSAV

SEQ ID NO: 3135403 - protein, 9 aa, Giardia lamblia
SAKQTKDNM

SEQ ID NO: 3135404 - protein, 35 aa, Giardia lamblia
SAKRRGSLGMSTDGSFTDRSKSATPEGRRPRRNSL

SEQ ID NO: 3135405 - protein, 16 aa, Giardia lamblia
SAKRRKQEADSNMKSE

SEQ ID NO: 3135406 - protein, 4 aa, Giardia lamblia
SAKS

SEQ ID NO: 3135407 - protein, 9 aa, Giardia lamblia
SAKSENEFT

SEQ ID NO: 3135408 - protein, 7 aa, Giardia lamblia
SAKSGEG

SEQ ID NO: 3135409 - protein, 27 aa, Giardia lamblia
SAKSIKDKREKDLKAAYKKQKEAYEQM

SEQ ID NO: 3135410 - protein, 7 aa, Giardia lamblia
SAKSNTD

SEQ ID NO: 3135411 - protein, 14 aa, Giardia lamblia
SAKSQTKPKQRGSV

SEQ ID NO: 3135412 - protein, 8 aa, Giardia lamblia
SAKSSANE

SEQ ID NO: 3135413 - protein, 9 aa, Giardia lamblia
SAKTNSNVE

SEQ ID NO: 3135414 - protein, 11 aa, Giardia lamblia
SAKVPNPSAEL

SEQ ID NO: 3135415 - protein, 12 aa, Giardia lamblia
SALAAKPRSSLN

SEQ ID NO: 3135416 - protein, 14 aa, Giardia lamblia
SALATSNTGLSEDQ

SEQ ID NO: 3135417 - protein, 10 aa, Giardia lamblia
SALDKSSESV

SEQ ID NO: 3135418 - protein, 7 aa, Giardia lamblia
SALDPKQ

SEQ ID NO: 3135419 - protein, 19 aa, Giardia lamblia
SALDQSTLSTTRPSSSERV

SEQ ID NO: 3135420 - protein, 11 aa, Giardia lamblia
SALDSSAFEPE

SEQ ID NO: 3135421 - protein, 4 aa, Giardia lamblia
SALG

SEQ ID NO: 3135422 - protein, 19 aa, Giardia lamblia
SALGDSSINSLGSTSPDQD

SEQ ID NO: 3135423 - protein, 13 aa, Giardia lamblia
SALGGKDRRQTGI

SEQ ID NO: 3135424 - protein, 18 aa, Giardia lamblia
SALGGTSMTGYGTAGALQ

SEQ ID NO: 3135425 - protein, 12 aa, Giardia lamblia
SALGSACGSCDA

SEQ ID NO: 3135426 - protein, 10 aa, Giardia lamblia
SALGSSITPR

SEQ ID NO: 3135427 - protein, 9 aa, Giardia lamblia
SALNGTPSQ

SEQ ID NO: 3135428 - protein, 11 aa, Giardia lamblia
SALNTASRHAA

SEQ ID NO: 3135429 - protein, 4 aa, Giardia lamblia
SALP

SEQ ID NO: 3135430 - protein, 10 aa, Giardia lamblia
SALPDPSKKK

SEQ ID NO: 3135431 - protein, 11 aa, Giardia lamblia
SALPPAEQREL

SEQ ID NO: 3135432 - protein, 7 aa, Giardia lamblia
SALPPPI

SEQ ID NO: 3135433 - protein, 57 aa, Giardia lamblia
SALPPSAPSNSSSVYSTLPPSHLNTTTSPAPTTTNAPVSNGTEGKKRTSSSGISDEK

SEQ ID NO: 3135434 - protein, 6 aa, Giardia lamblia
SALQPT

SEQ ID NO: 3135435 - protein, 7 aa, Giardia lamblia
SALQQRS

SEQ ID NO: 3135436 - protein, 7 aa, Giardia lamblia
SALRKPV

SEQ ID NO: 3135437 - protein, 14 aa, Giardia lamblia
SALSATADSADDHM

SEQ ID NO: 3135438 - protein, 7 aa, Giardia lamblia
SALSPSN

SEQ ID NO: 3135439 - protein, 9 aa, Giardia lamblia
SALSTGTWK

SEQ ID NO: 3135440 - protein, 5 aa, Giardia lamblia
SALTD

SEQ ID NO: 3135441 - protein, 6 aa, Giardia lamblia
SALTGA

SEQ ID NO: 3135442 - protein, 13 aa, Giardia lamblia
SAMGLSPSIQTSL

SEQ ID NO: 3135443 - protein, 10 aa, Giardia lamblia
SAMPASSKEQ

SEQ ID NO: 3135444 - protein, 14 aa, Giardia lamblia
SAMPSLSNPFASGN

SEQ ID NO: 3135445 - protein, 14 aa, Giardia lamblia
SAMQASESKPSGRI

SEQ ID NO: 3135446 - protein, 16 aa, Giardia lamblia
SAMQGQGQSHQRFSGS

SEQ ID NO: 3135447 - protein, 10 aa, Giardia lamblia
SANDPGQQAY

SEQ ID NO: 3135448 - protein, 5 aa, Giardia lamblia
SANEE

SEQ ID NO: 3135449 - protein, 9 aa, Giardia lamblia
SANEPSGDV

SEQ ID NO: 3135450 - protein, 7 aa, Giardia lamblia
SANGPCG

SEQ ID NO: 3135451 - protein, 6 aa, Giardia lamblia
SANKHN

SEQ ID NO: 3135452 - protein, 12 aa, Giardia lamblia
SANKKKAFEKTY

SEQ ID NO: 3135453 - protein, 10 aa, Giardia lamblia
SANKTTEETL

SEQ ID NO: 3135454 - protein, 14 aa, Giardia lamblia
SANLNSTSGQLTGN

SEQ ID NO: 3135455 - protein, 5 aa, Giardia lamblia
SANND

SEQ ID NO: 3135456 - protein, 8 aa, Giardia lamblia
SANNDKIT

SEQ ID NO: 3135457 - protein, 23 aa, Giardia lamblia
SANPMQQARAPETHSNGEKHRGL

SEQ ID NO: 3135458 - protein, 9 aa, Giardia lamblia
SANPQPLTD

SEQ ID NO: 3135459 - protein, 5 aa, Giardia lamblia
SANQP

SEQ ID NO: 3135460 - protein, 10 aa, Giardia lamblia
SANQTGEPRK

SEQ ID NO: 3135461 - protein, 6 aa, Giardia lamblia
SANSDP

SEQ ID NO: 3135462 - protein, 9 aa, Giardia lamblia
SANSNEPNL

SEQ ID NO: 3135463 - protein, 10 aa, Giardia lamblia
SANSSGRSNL

SEQ ID NO: 3135464 - protein, 15 aa, Giardia lamblia
SANTDAFTESAREED

SEQ ID NO: 3135465 - protein, 9 aa, Giardia lamblia
SANTKVESE

SEQ ID NO: 3135466 - protein, 29 aa, Giardia lamblia
SANTPASLPSSDSAPAASVQQPSAARRRS

SEQ ID NO: 3135467 - protein, 12 aa, Giardia lamblia
SANVDDEELQSD

SEQ ID NO: 3135468 - protein, 7 aa, Giardia lamblia
SANYSAD

SEQ ID NO: 3135469 - protein, 9 aa, Giardia lamblia
SAPAACSDP

SEQ ID NO: 3135470 - protein, 9 aa, Giardia lamblia
SAPAAPGFT

SEQ ID NO: 3135471 - protein, 7 aa, Giardia lamblia
SAPAFSN

SEQ ID NO: 3135472 - protein, 8 aa, Giardia lamblia
SAPAGPEN

SEQ ID NO: 3135473 - protein, 21 aa, Giardia lamblia
SAPAGSAAFAKSEQQQPQPQV

SEQ ID NO: 3135474 - protein, 8 aa, Giardia lamblia
SAPAHEQQ

SEQ ID NO: 3135475 - protein, 11 aa, Giardia lamblia
SAPAPVPTPAP

SEQ ID NO: 3135476 - protein, 8 aa, Giardia lamblia
SAPAVSTN

SEQ ID NO: 3135477 - protein, 13 aa, Giardia lamblia
SAPDGQGASDKSV

SEQ ID NO: 3135478 - protein, 10 aa, Giardia lamblia
SAPDHDRNSA

SEQ ID NO: 3135479 - protein, 7 aa, Giardia lamblia
SAPDPLR

SEQ ID NO: 3135480 - protein, 9 aa, Giardia lamblia
SAPDSTSSH

SEQ ID NO: 3135481 - protein, 8 aa, Giardia lamblia
SAPEASYT

SEQ ID NO: 3135482 - protein, 18 aa, Giardia lamblia
SAPHADSKVSSNLAKSLN

SEQ ID NO: 3135483 - protein, 6 aa, Giardia lamblia
SAPIAA

SEQ ID NO: 3135484 - protein, 20 aa, Giardia lamblia
SAPISSKPPPVRSSRPMPHR

SEQ ID NO: 3135485 - protein, 9 aa, Giardia lamblia
SAPLGAQPQ

SEQ ID NO: 3135486 - protein, 6 aa, Giardia lamblia
SAPLST

SEQ ID NO: 3135487 - protein, 18 aa, Giardia lamblia
SAPLTTGENDQENDQDRE

SEQ ID NO: 3135488 - protein, 8 aa, Giardia lamblia
SAPNGNAG

SEQ ID NO: 3135489 - protein, 34 aa, Giardia lamblia
SAPNPFSHPSEEAQEHPCDHPRDPCGTKQCPKRT

SEQ ID NO: 3135490 - protein, 11 aa, Giardia lamblia
SAPNTDSPLNC

SEQ ID NO: 3135491 - protein, 6 aa, Giardia lamblia
SAPPIH

SEQ ID NO: 3135492 - protein, 6 aa, Giardia lamblia
SAPPNF

SEQ ID NO: 3135493 - protein, 12 aa, Giardia lamblia
SAPPPAKNSLVI

SEQ ID NO: 3135494 - protein, 15 aa, Giardia lamblia
SAPPSFKSDPLLTGK

SEQ ID NO: 3135495 - protein, 10 aa, Giardia lamblia
SAPQDNLSFP

SEQ ID NO: 3135496 - protein, 11 aa, Giardia lamblia
SAPQPLPPAAN

SEQ ID NO: 3135497 - protein, 17 aa, Giardia lamblia
SAPSAPKNSSALASGAT

SEQ ID NO: 3135498 - protein, 9 aa, Giardia lamblia
SAPSKEKTC

SEQ ID NO: 3135499 - protein, 8 aa, Giardia lamblia
SAPSLVSG

SEQ ID NO: 3135500 - protein, 8 aa, Giardia lamblia
SAPSPAMT

SEQ ID NO: 3135501 - protein, 10 aa, Giardia lamblia
SAPSPSTSPA

SEQ ID NO: 3135502 - protein, 21 aa, Giardia lamblia
SAPSRPSRQPAPEVSGPAPVS

SEQ ID NO: 3135503 - protein, 28 aa, Giardia lamblia
SAPSRSAPSVATASAANQQHTPAPAPTL

SEQ ID NO: 3135504 - protein, 39 aa, Giardia lamblia
SAPSSRAPSELQSPKKTRHAARSVPPRDSPVKSSQALSN

SEQ ID NO: 3135505 - protein, 12 aa, Giardia lamblia
SAPSSVSLETTS

SEQ ID NO: 3135506 - protein, 16 aa, Giardia lamblia
SAPSTEPNLPGEPSSV

SEQ ID NO: 3135507 - protein, 12 aa, Giardia lamblia
SAPTDPSSLLPP

SEQ ID NO: 3135508 - protein, 9 aa, Giardia lamblia
SAPTPYRSK

SEQ ID NO: 3135509 - protein, 24 aa, Giardia lamblia
SAPTSRKDEEKAPLGDQPSGHGPL

SEQ ID NO: 3135510 - protein, 25 aa, Giardia lamblia
SAPTSVPSDPNYTPAYEGLPSNAND

SEQ ID NO: 3135511 - protein, 7 aa, Giardia lamblia
SAPTTPR

SEQ ID NO: 3135512 - protein, 4 aa, Giardia lamblia
SAPV

SEQ ID NO: 3135513 - protein, 9 aa, Giardia lamblia
SAPVDGSGL

SEQ ID NO: 3135514 - protein, 6 aa, Giardia lamblia
SAPVTS

SEQ ID NO: 3135515 - protein, 7 aa, Giardia lamblia
SAQAEAS

SEQ ID NO: 3135516 - protein, 40 aa, Giardia lamblia
SAQAKTLKSKAGMAGRSRQRGKMEKDNEISSQANDLPQLD

SEQ ID NO: 3135517 - protein, 6 aa, Giardia lamblia
SAQAPG

SEQ ID NO: 3135518 - protein, 6 aa, Giardia lamblia
SAQASS

SEQ ID NO: 3135519 - protein, 8 aa, Giardia lamblia
SAQATARL

SEQ ID NO: 3135520 - protein, 5 aa, Giardia lamblia
SAQCN

SEQ ID NO: 3135521 - protein, 9 aa, Giardia lamblia
SAQDGSVEK

SEQ ID NO: 3135522 - protein, 5 aa, Giardia lamblia
SAQEA

SEQ ID NO: 3135523 - protein, 16 aa, Giardia lamblia
SAQEEPQSSTSSQEQI

SEQ ID NO: 3135524 - protein, 7 aa, Giardia lamblia
SAQEGWK

SEQ ID NO: 3135525 - protein, 5 aa, Giardia lamblia
SAQEK

SEQ ID NO: 3135526 - protein, 7 aa, Giardia lamblia
SAQELRD

SEQ ID NO: 3135527 - protein, 8 aa, Giardia lamblia
SAQEPPIR

SEQ ID NO: 3135528 - protein, 11 aa, Giardia lamblia
SAQKDGDQAQL

SEQ ID NO: 3135529 - protein, 23 aa, Giardia lamblia
SAQKEDPPTVNEPLRKTAAVTSP

SEQ ID NO: 3135530 - protein, 8 aa, Giardia lamblia
SAQKPTIL

SEQ ID NO: 3135531 - protein, 15 aa, Giardia lamblia
SAQKREEAEMEEKKN

SEQ ID NO: 3135532 - protein, 48 aa, Giardia lamblia
SAQLGSTQSKLSLNKATKVSKRATTTITTTATAVPPPVLPEEEEHGDV

SEQ ID NO: 3135533 - protein, 7 aa, Giardia lamblia
SAQNATL

SEQ ID NO: 3135534 - protein, 8 aa, Giardia lamblia
SAQPDLQD

SEQ ID NO: 3135535 - protein, 11 aa, Giardia lamblia
SAQPGQLPPAL

SEQ ID NO: 3135536 - protein, 7 aa, Giardia lamblia
SAQPITA

SEQ ID NO: 3135537 - protein, 25 aa, Giardia lamblia
SAQPPPPPKPAKSTIEAAAEHGSVK

SEQ ID NO: 3135538 - protein, 10 aa, Giardia lamblia
SAQQAETSRL

SEQ ID NO: 3135539 - protein, 12 aa, Giardia lamblia
SAQQYGQVGAPD

SEQ ID NO: 3135540 - protein, 7 aa, Giardia lamblia
SAQRPLN

SEQ ID NO: 3135541 - protein, 4 aa, Giardia lamblia
SAQT

SEQ ID NO: 3135542 - protein, 10 aa, Giardia lamblia
SAQTHQTLPK

SEQ ID NO: 3135543 - protein, 7 aa, Giardia lamblia
SAQTIGE

SEQ ID NO: 3135544 - protein, 8 aa, Giardia lamblia
SAQTSPQR

SEQ ID NO: 3135545 - protein, 4 aa, Giardia lamblia
SARA

SEQ ID NO: 3135546 - protein, 11 aa, Giardia lamblia
SARAAYGTRPL

SEQ ID NO: 3135547 - protein, 7 aa, Giardia lamblia
SARADLE

SEQ ID NO: 3135548 - protein, 11 aa, Giardia lamblia
SARARDSDSEW

SEQ ID NO: 3135549 - protein, 9 aa, Giardia lamblia
SARASDTSN

SEQ ID NO: 3135550 - protein, 5 aa, Giardia lamblia
SARDE

SEQ ID NO: 3135551 - protein, 8 aa, Giardia lamblia
SARDPKEV

SEQ ID NO: 3135552 - protein, 5 aa, Giardia lamblia
SAREA

SEQ ID NO: 3135553 - protein, 10 aa, Giardia lamblia
SAREINDSSN

SEQ ID NO: 3135554 - protein, 36 aa, Giardia lamblia
SARESLSGSGLGSSYKARSPAFGSKGPRSPSSKTTS

SEQ ID NO: 3135555 - protein, 19 aa, Giardia lamblia
SARETQQHESRLTKRTQVP

SEQ ID NO: 3135556 - protein, 6 aa, Giardia lamblia
SAREYS

SEQ ID NO: 3135557 - protein, 6 aa, Giardia lamblia
SARGAG

SEQ ID NO: 3135558 - protein, 10 aa, Giardia lamblia
SARGQRSHQA

SEQ ID NO: 3135559 - protein, 12 aa, Giardia lamblia
SARGRSHNTGIL

SEQ ID NO: 3135560 - protein, 22 aa, Giardia lamblia
SARHRTDKYSLTSPGPSSRSEL

SEQ ID NO: 3135561 - protein, 5 aa, Giardia lamblia
SARIR

SEQ ID NO: 3135562 - protein, 9 aa, Giardia lamblia
SARKQESLA

SEQ ID NO: 3135563 - protein, 5 aa, Giardia lamblia
SARPG

SEQ ID NO: 3135564 - protein, 16 aa, Giardia lamblia
SARQKREEANDRCSDR

SEQ ID NO: 3135565 - protein, 11 aa, Giardia lamblia
SARQLGPGARI

SEQ ID NO: 3135566 - protein, 10 aa, Giardia lamblia
SARQTAPHSI

SEQ ID NO: 3135567 - protein, 4 aa, Giardia lamblia
SARR

SEQ ID NO: 3135568 - protein, 6 aa, Giardia lamblia
SARRLG

SEQ ID NO: 3135569 - protein, 10 aa, Giardia lamblia
SARRPRPMST

SEQ ID NO: 3135570 - protein, 6 aa, Giardia lamblia
SARSAD

SEQ ID NO: 3135571 - protein, 10 aa, Giardia lamblia
SARSGEQSAI

SEQ ID NO: 3135572 - protein, 9 aa, Giardia lamblia
SARSSGVTT

SEQ ID NO: 3135573 - protein, 25 aa, Giardia lamblia
SARSSKKQKTYHRRTQSDGDVTLAS

SEQ ID NO: 3135574 - protein, 18 aa, Giardia lamblia
SARSSSTFARSSGELQGT

SEQ ID NO: 3135575 - protein, 9 aa, Giardia lamblia
SARSSVGGT

SEQ ID NO: 3135576 - protein, 11 aa, Giardia lamblia
SARSTRDPSSN

SEQ ID NO: 3135577 - protein, 14 aa, Giardia lamblia
SARSTTKSNRDNER

SEQ ID NO: 3135578 - protein, 17 aa, Giardia lamblia
SARTRLDKEAGTAEAEK

SEQ ID NO: 3135579 - protein, 6 aa, Giardia lamblia
SARYRK

SEQ ID NO: 3135580 - protein, 8 aa, Giardia lamblia
SASAASPA

SEQ ID NO: 3135581 - protein, 9 aa, Giardia lamblia
SASAEPSQK

SEQ ID NO: 3135582 - protein, 16 aa, Giardia lamblia
SASAESSKAAQSAAKK

SEQ ID NO: 3135583 - protein, 9 aa, Giardia lamblia
SASAGEYSE

SEQ ID NO: 3135584 - protein, 8 aa, Giardia lamblia
SASANSVA

SEQ ID NO: 3135585 - protein, 10 aa, Giardia lamblia
SASARNQLRT

SEQ ID NO: 3135586 - protein, 15 aa, Giardia lamblia
SASASPTEATSQHQR

SEQ ID NO: 3135587 - protein, 10 aa, Giardia lamblia
SASDAKSTPA

SEQ ID NO: 3135588 - protein, 8 aa, Giardia lamblia
SASDETGY

SEQ ID NO: 3135589 - protein, 41 aa, Giardia lamblia
SASDKRSSKAALASSDALSTAPPAVVSSGEVSPINNSNAKR

SEQ ID NO: 3135590 - protein, 6 aa, Giardia lamblia
SASDTI

SEQ ID NO: 3135591 - protein, 14 aa, Giardia lamblia
SASEEARGKGVSPQ

SEQ ID NO: 3135592 - protein, 8 aa, Giardia lamblia
SASEECRN

SEQ ID NO: 3135593 - protein, 10 aa, Giardia lamblia
SASEHPAAST

SEQ ID NO: 3135594 - protein, 9 aa, Giardia lamblia
SASEQDGSY

SEQ ID NO: 3135595 - protein, 7 aa, Giardia lamblia
SASESDQ

SEQ ID NO: 3135596 - protein, 10 aa, Giardia lamblia
SASESKGSSA

SEQ ID NO: 3135597 - protein, 7 aa, Giardia lamblia
SASGDTT

SEQ ID NO: 3135598 - protein, 9 aa, Giardia lamblia
SASGGTVAE

SEQ ID NO: 3135599 - protein, 8 aa, Giardia lamblia
SASGMTAG

SEQ ID NO: 3135600 - protein, 17 aa, Giardia lamblia
SASGQASEVSKGRPSIE

SEQ ID NO: 3135601 - protein, 23 aa, Giardia lamblia
SASGSTSTSLRSGSHLSEPANLS

SEQ ID NO: 3135602 - protein, 16 aa, Giardia lamblia
SASGTELKASGSDPDW

SEQ ID NO: 3135603 - protein, 18 aa, Giardia lamblia
SASHSRPDAEAKHTGAQL

SEQ ID NO: 3135604 - protein, 10 aa, Giardia lamblia
SASHVSPEDR

SEQ ID NO: 3135605 - protein, 6 aa, Giardia lamblia
SASIKY

SEQ ID NO: 3135606 - protein, 21 aa, Giardia lamblia
SASKSYLDQPQNSQPPADAVR

SEQ ID NO: 3135607 - protein, 14 aa, Giardia lamblia
SASLLSSNSRDSHR

SEQ ID NO: 3135608 - protein, 23 aa, Giardia lamblia
SASMRTSSRASSRGSTASGNAVQ

SEQ ID NO: 3135609 - protein, 4 aa, Giardia lamblia
SASN

SEQ ID NO: 3135610 - protein, 10 aa, Giardia lamblia
SASNKQYDNI

SEQ ID NO: 3135611 - protein, 7 aa, Giardia lamblia
SASNNMT

SEQ ID NO: 3135612 - protein, 6 aa, Giardia lamblia
SASNRQ

SEQ ID NO: 3135613 - protein, 8 aa, Giardia lamblia
SASNVEEV

SEQ ID NO: 3135614 - protein, 32 aa, Giardia lamblia
SASPAPSIDGSFSSKDTPVEISDSSGKIRPTI

SEQ ID NO: 3135615 - protein, 7 aa, Giardia lamblia
SASPGGI

SEQ ID NO: 3135616 - protein, 10 aa, Giardia lamblia
SASPSPTRAL

SEQ ID NO: 3135617 - protein, 21 aa, Giardia lamblia
SASPSRGTAAHPGLGSSNMTG

SEQ ID NO: 3135618 - protein, 8 aa, Giardia lamblia
SASQDKGI

SEQ ID NO: 3135619 - protein, 7 aa, Giardia lamblia
SASQPGL

SEQ ID NO: 3135620 - protein, 7 aa, Giardia lamblia
SASRAQE

SEQ ID NO: 3135621 - protein, 9 aa, Giardia lamblia
SASRSHRDV

SEQ ID NO: 3135622 - protein, 14 aa, Giardia lamblia
SASRTVPAISKFSD

SEQ ID NO: 3135623 - protein, 7 aa, Giardia lamblia
SASSAGQ

SEQ ID NO: 3135624 - protein, 12 aa, Giardia lamblia
SASSGYKDGQNM

SEQ ID NO: 3135625 - protein, 10 aa, Giardia lamblia
SASSNASSEL

SEQ ID NO: 3135626 - protein, 8 aa, Giardia lamblia
SASSPHSL

SEQ ID NO: 3135627 - protein, 11 aa, Giardia lamblia
SASSQTCVTTS

SEQ ID NO: 3135628 - protein, 8 aa, Giardia lamblia
SASSRPDG

SEQ ID NO: 3135629 - protein, 9 aa, Giardia lamblia
SASSSIASA

SEQ ID NO: 3135630 - protein, 9 aa, Giardia lamblia
SASSSNSSL

SEQ ID NO: 3135631 - protein, 16 aa, Giardia lamblia
SASSTNSSLEQDASSI

SEQ ID NO: 3135632 - protein, 15 aa, Giardia lamblia
SASSVNGPAASTVQE

SEQ ID NO: 3135633 - protein, 6 aa, Giardia lamblia
SASTGI

SEQ ID NO: 3135634 - protein, 8 aa, Giardia lamblia
SASTGQYR

SEQ ID NO: 3135635 - protein, 9 aa, Giardia lamblia
SASTSLSSS

SEQ ID NO: 3135636 - protein, 8 aa, Giardia lamblia
SASTTQGF

SEQ ID NO: 3135637 - protein, 4 aa, Giardia lamblia
SASW

SEQ ID NO: 3135638 - protein, 8 aa, Giardia lamblia
SASYISDN

SEQ ID NO: 3135639 - protein, 17 aa, Giardia lamblia
SASYRSAVTGAKDSTSI

SEQ ID NO: 3135640 - protein, 10 aa, Giardia lamblia
SATARPGSSH

SEQ ID NO: 3135641 - protein, 10 aa, Giardia lamblia
SATASGERNI

SEQ ID NO: 3135642 - protein, 25 aa, Giardia lamblia
SATATPSRQATTSKLGTSRGNSSMQ

SEQ ID NO: 3135643 - protein, 16 aa, Giardia lamblia
SATDQKPSSPRRSTRI

SEQ ID NO: 3135644 - protein, 9 aa, Giardia lamblia
SATDQQYSP

SEQ ID NO: 3135645 - protein, 8 aa, Giardia lamblia
SATEDGSI

SEQ ID NO: 3135646 - protein, 6 aa, Giardia lamblia
SATENC

SEQ ID NO: 3135647 - protein, 4 aa, Giardia lamblia
SATG

SEQ ID NO: 3135648 - protein, 6 aa, Giardia lamblia
SATGAT

SEQ ID NO: 3135649 - protein, 6 aa, Giardia lamblia
SATGGI

SEQ ID NO: 3135650 - protein, 7 aa, Giardia lamblia
SATGHAQ

SEQ ID NO: 3135651 - protein, 6 aa, Giardia lamblia
SATGRT

SEQ ID NO: 3135652 - protein, 13 aa, Giardia lamblia
SATGSAHNSHDPE

SEQ ID NO: 3135653 - protein, 10 aa, Giardia lamblia
SATGSSVTHS

SEQ ID NO: 3135654 - protein, 4 aa, Giardia lamblia
SATH

SEQ ID NO: 3135655 - protein, 7 aa, Giardia lamblia
SATIAEA

SEQ ID NO: 3135656 - protein, 7 aa, Giardia lamblia
SATKERD

SEQ ID NO: 3135657 - protein, 9 aa, Giardia lamblia
SATKSPFTK

SEQ ID NO: 3135658 - protein, 5 aa, Giardia lamblia
SATLH

SEQ ID NO: 3135659 - protein, 12 aa, Giardia lamblia
SATNASTARPLS

SEQ ID NO: 3135660 - protein, 14 aa, Giardia lamblia
SATNQAKKETPGTT

SEQ ID NO: 3135661 - protein, 6 aa, Giardia lamblia
SATPEI

SEQ ID NO: 3135662 - protein, 89 aa, Giardia lamblia
SATPLRKSSTHQSPKSLVSKKEETSAVQSPKSALDAKEHDKSRTEHSHVKQQTPKKTRTPNASSNVSPKSKPSNVPVQEGNELSNESID

SEQ ID NO: 3135663 - protein, 6 aa, Giardia lamblia
SATPVA

SEQ ID NO: 3135664 - protein, 7 aa, Giardia lamblia
SATPVQN

SEQ ID NO: 3135665 - protein, 9 aa, Giardia lamblia
SATPVSGKT

SEQ ID NO: 3135666 - protein, 4 aa, Giardia lamblia
SATQ

SEQ ID NO: 3135667 - protein, 22 aa, Giardia lamblia
SATQAAPEGGEENKNRYPYTEE

SEQ ID NO: 3135668 - protein, 6 aa, Giardia lamblia
SATQGN

SEQ ID NO: 3135669 - protein, 5 aa, Giardia lamblia
SATQK

SEQ ID NO: 3135670 - protein, 12 aa, Giardia lamblia
SATQKSQGIGGM

SEQ ID NO: 3135671 - protein, 9 aa, Giardia lamblia
SATQTLDPT

SEQ ID NO: 3135672 - protein, 4 aa, Giardia lamblia
SATR

SEQ ID NO: 3135673 - protein, 7 aa, Giardia lamblia
SATREPN

SEQ ID NO: 3135674 - protein, 6 aa, Giardia lamblia
SATRGH

SEQ ID NO: 3135675 - protein, 14 aa, Giardia lamblia
SATRSPSCSTGGEL

SEQ ID NO: 3135676 - protein, 13 aa, Giardia lamblia
SATSDSGSAAFQS

SEQ ID NO: 3135677 - protein, 12 aa, Giardia lamblia
SATSEEAEKVSY

SEQ ID NO: 3135678 - protein, 13 aa, Giardia lamblia
SATSKDQAQTLGE

SEQ ID NO: 3135679 - protein, 6 aa, Giardia lamblia
SATSPI

SEQ ID NO: 3135680 - protein, 10 aa, Giardia lamblia
SATSPPSSST

SEQ ID NO: 3135681 - protein, 22 aa, Giardia lamblia
SATSRQPNLYKSSSTGDTTSSV

SEQ ID NO: 3135682 - protein, 10 aa, Giardia lamblia
SATSRSFGEG

SEQ ID NO: 3135683 - protein, 8 aa, Giardia lamblia
SATSSSQE

SEQ ID NO: 3135684 - protein, 16 aa, Giardia lamblia
SATTPATLSETQTAAL

SEQ ID NO: 3135685 - protein, 8 aa, Giardia lamblia
SATTSWDS

SEQ ID NO: 3135686 - protein, 16 aa, Giardia lamblia
SATTTVAPTQQPTSQE

SEQ ID NO: 3135687 - protein, 8 aa, Giardia lamblia
SATVYPNT

SEQ ID NO: 3135688 - protein, 4 aa, Giardia lamblia
SAVD

SEQ ID NO: 3135689 - protein, 4 aa, Giardia lamblia
SAVG

SEQ ID NO: 3135690 - protein, 8 aa, Giardia lamblia
SAVGNEDS

SEQ ID NO: 3135691 - protein, 25 aa, Giardia lamblia
SAVNNTPASNDSRLRSLSNASKVLT

SEQ ID NO: 3135692 - protein, 8 aa, Giardia lamblia
SAVPGRQE

SEQ ID NO: 3135693 - protein, 10 aa, Giardia lamblia
SAVPSTSRSL

SEQ ID NO: 3135694 - protein, 7 aa, Giardia lamblia
SAVRPSR

SEQ ID NO: 3135695 - protein, 13 aa, Giardia lamblia
SAVSSNNLANTCG

SEQ ID NO: 3135696 - protein, 16 aa, Giardia lamblia
SAVSTHSTRTNTPSQG

SEQ ID NO: 3135697 - protein, 9 aa, Giardia lamblia
SAVTETNDI

SEQ ID NO: 3135698 - protein, 21 aa, Giardia lamblia
SAVTTSLSTRETPSAESRSKV

SEQ ID NO: 3135699 - protein, 13 aa, Giardia lamblia
SAYAEKHSASAMG

SEQ ID NO: 3135700 - protein, 25 aa, Giardia lamblia
SAYAKDAAGMAKIGGNKTWKKYNPD

SEQ ID NO: 3135701 - protein, 7 aa, Giardia lamblia
SAYSDNK

SEQ ID NO: 3135702 - protein, 10 aa, Giardia lamblia
SAYSGKEREK

SEQ ID NO: 3135703 - protein, 11 aa, Giardia lamblia
SAYSPGTMSDE

SEQ ID NO: 3135704 - protein, 18 aa, Giardia lamblia
SAYVGSPASRTKGPDRSI

SEQ ID NO: 3135705 - protein, 11 aa, Giardia lamblia
SAYVSRTEPLR

SEQ ID NO: 3135706 - protein, 4 aa, Giardia lamblia
SAYY

SEQ ID NO: 3135707 - protein, 9 aa, Giardia lamblia
SCAPPPSST

SEQ ID NO: 3135708 - protein, 6 aa, Giardia lamblia
SCASPG

SEQ ID NO: 3135709 - protein, 8 aa, Giardia lamblia
SCASSKGY

SEQ ID NO: 3135710 - protein, 8 aa, Giardia lamblia
SCATTRTG

SEQ ID NO: 3135711 - protein, 13 aa, Giardia lamblia
SCATTTTTSPSQC

SEQ ID NO: 3135712 - protein, 15 aa, Giardia lamblia
SCCPADPEHGLPHEQ

SEQ ID NO: 3135713 - protein, 12 aa, Giardia lamblia
SCCTGGQTTNDV

SEQ ID NO: 3135714 - protein, 17 aa, Giardia lamblia
SCDNSQRSIAGDSEDNL

SEQ ID NO: 3135715 - protein, 6 aa, Giardia lamblia
SCDSPQ

SEQ ID NO: 3135716 - protein, 14 aa, Giardia lamblia
SCEDKNGNQDESDL

SEQ ID NO: 3135717 - protein, 4 aa, Giardia lamblia
SCEG

SEQ ID NO: 3135718 - protein, 6 aa, Giardia lamblia
SCEPVS

SEQ ID NO: 3135719 - protein, 6 aa, Giardia lamblia
SCETSE

SEQ ID NO: 3135720 - protein, 11 aa, Giardia lamblia
SCGAEDLDSRV

SEQ ID NO: 3135721 - protein, 4 aa, Giardia lamblia
SCGG

SEQ ID NO: 3135722 - protein, 8 aa, Giardia lamblia
SCGGDDGV

SEQ ID NO: 3135723 - protein, 16 aa, Giardia lamblia
SCGPASVPSNLSYSEE

SEQ ID NO: 3135724 - protein, 8 aa, Giardia lamblia
SCGSDDDL

SEQ ID NO: 3135725 - protein, 11 aa, Giardia lamblia
SCGSPNYASPE

SEQ ID NO: 3135726 - protein, 9 aa, Giardia lamblia
SCGTASDSF

SEQ ID NO: 3135727 - protein, 7 aa, Giardia lamblia
SCGTEGS

SEQ ID NO: 3135728 - protein, 13 aa, Giardia lamblia
SCHSENDDEDSEV

SEQ ID NO: 3135729 - protein, 8 aa, Giardia lamblia
SCHSNNTS

SEQ ID NO: 3135730 - protein, 5 aa, Giardia lamblia
SCIDP

SEQ ID NO: 3135731 - protein, 10 aa, Giardia lamblia
SCISDDSEDQ

SEQ ID NO: 3135732 - protein, 6 aa, Giardia lamblia
SCKASV

SEQ ID NO: 3135733 - protein, 8 aa, Giardia lamblia
SCKNREEV

SEQ ID NO: 3135734 - protein, 4 aa, Giardia lamblia
SCKP

SEQ ID NO: 3135735 - protein, 6 aa, Giardia lamblia
SCNGKT

SEQ ID NO: 3135736 - protein, 13 aa, Giardia lamblia
SCNPNNPNYPTKL

SEQ ID NO: 3135737 - protein, 7 aa, Giardia lamblia
SCNSEGH

SEQ ID NO: 3135738 - protein, 7 aa, Giardia lamblia
SCPDGKT

SEQ ID NO: 3135739 - protein, 8 aa, Giardia lamblia
SCPDRQGL

SEQ ID NO: 3135740 - protein, 7 aa, Giardia lamblia
SCPDTGG

SEQ ID NO: 3135741 - protein, 6 aa, Giardia lamblia
SCPEDQ

SEQ ID NO: 3135742 - protein, 13 aa, Giardia lamblia
SCPEPGAESGNPI

SEQ ID NO: 3135743 - protein, 21 aa, Giardia lamblia
SCPITSTSSAFQSSRSQSVSL

SEQ ID NO: 3135744 - protein, 8 aa, Giardia lamblia
SCPPPQDT

SEQ ID NO: 3135745 - protein, 5 aa, Giardia lamblia
SCPTT

SEQ ID NO: 3135746 - protein, 9 aa, Giardia lamblia
SCPYGAQSK

SEQ ID NO: 3135747 - protein, 8 aa, Giardia lamblia
SCQESSDW

SEQ ID NO: 3135748 - protein, 4 aa, Giardia lamblia
SCQG

SEQ ID NO: 3135749 - protein, 13 aa, Giardia lamblia
SCQSGAEKYARPD

SEQ ID NO: 3135750 - protein, 4 aa, Giardia lamblia
SCRS

SEQ ID NO: 3135751 - protein, 5 aa, Giardia lamblia
SCSGK

SEQ ID NO: 3135752 - protein, 8 aa, Giardia lamblia
SCSNSDNI

SEQ ID NO: 3135753 - protein, 12 aa, Giardia lamblia
SCSPPSHLYMQG

SEQ ID NO: 3135754 - protein, 9 aa, Giardia lamblia
SCSPYDDDA

SEQ ID NO: 3135755 - protein, 8 aa, Giardia lamblia
SCSRPPSV

SEQ ID NO: 3135756 - protein, 9 aa, Giardia lamblia
SCTGGSEAT

SEQ ID NO: 3135757 - protein, 7 aa, Giardia lamblia
SCTGTTS

SEQ ID NO: 3135758 - protein, 22 aa, Giardia lamblia
SCTQSDTETPVVAGDEAKETWA

SEQ ID NO: 3135759 - protein, 12 aa, Giardia lamblia
SCTTSTSDFNGS

SEQ ID NO: 3135760 - protein, 8 aa, Giardia lamblia
SCVPSGNG

SEQ ID NO: 3135761 - protein, 13 aa, Giardia lamblia
SDAAPDGETGLAD

SEQ ID NO: 3135762 - protein, 4 aa, Giardia lamblia
SDAC

SEQ ID NO: 3135763 - protein, 8 aa, Giardia lamblia
SDAEASIG

SEQ ID NO: 3135764 - protein, 6 aa, Giardia lamblia
SDAEQF

SEQ ID NO: 3135765 - protein, 8 aa, Giardia lamblia
SDAEVRKT

SEQ ID NO: 3135766 - protein, 18 aa, Giardia lamblia
SDAGDYDKLDAPAEFSSK

SEQ ID NO: 3135767 - protein, 14 aa, Giardia lamblia
SDAGTTGVSPEDAV

SEQ ID NO: 3135768 - protein, 31 aa, Giardia lamblia
SDAHDATVQPPVEDAGPALPDKEAPSTEAED

SEQ ID NO: 3135769 - protein, 6 aa, Giardia lamblia
SDAKEA

SEQ ID NO: 3135770 - protein, 6 aa, Giardia lamblia
SDALPT

SEQ ID NO: 3135771 - protein, 11 aa, Giardia lamblia
SDAMSESFREG

SEQ ID NO: 3135772 - protein, 7 aa, Giardia lamblia
SDANAKI

SEQ ID NO: 3135773 - protein, 8 aa, Giardia lamblia
SDAPDATL

SEQ ID NO: 3135774 - protein, 9 aa, Giardia lamblia
SDAPGVEKA

SEQ ID NO: 3135775 - protein, 12 aa, Giardia lamblia
SDAPKDQAPSRD

SEQ ID NO: 3135776 - protein, 14 aa, Giardia lamblia
SDAQFTADTSGSRR

SEQ ID NO: 3135777 - protein, 7 aa, Giardia lamblia
SDAQRLR

SEQ ID NO: 3135778 - protein, 18 aa, Giardia lamblia
SDAQSTTLNPGPKFTPSA

SEQ ID NO: 3135779 - protein, 15 aa, Giardia lamblia
SDARAEEDLPVASPC

SEQ ID NO: 3135780 - protein, 25 aa, Giardia lamblia
SDARASEYPEPAGCTGPQDPPGTTV

SEQ ID NO: 3135781 - protein, 5 aa, Giardia lamblia
SDARI

SEQ ID NO: 3135782 - protein, 7 aa, Giardia lamblia
SDARKDL

SEQ ID NO: 3135783 - protein, 14 aa, Giardia lamblia
SDARREAHAEEAQP

SEQ ID NO: 3135784 - protein, 4 aa, Giardia lamblia
SDAS

SEQ ID NO: 3135785 - protein, 9 aa, Giardia lamblia
SDASATKRN

SEQ ID NO: 3135786 - protein, 35 aa, Giardia lamblia
SDASSNPDTVSASGTTGSTHTGRASKEPGAVRQRN

SEQ ID NO: 3135787 - protein, 7 aa, Giardia lamblia
SDASSSD

SEQ ID NO: 3135788 - protein, 9 aa, Giardia lamblia
SDATDELTK

SEQ ID NO: 3135789 - protein, 11 aa, Giardia lamblia
SDATIDDQSTG

SEQ ID NO: 3135790 - protein, 8 aa, Giardia lamblia
SDATQDRI

SEQ ID NO: 3135791 - protein, 23 aa, Giardia lamblia
SDCASACRSSDAFQQREPADNEN

SEQ ID NO: 3135792 - protein, 7 aa, Giardia lamblia
SDCSERV

SEQ ID NO: 3135793 - protein, 5 aa, Giardia lamblia
SDCVG

SEQ ID NO: 3135794 - protein, 4 aa, Giardia lamblia
SDCY

SEQ ID NO: 3135795 - protein, 4 aa, Giardia lamblia
SDDA

SEQ ID NO: 3135796 - protein, 12 aa, Giardia lamblia
SDDADSGPLPTM

SEQ ID NO: 3135797 - protein, 5 aa, Giardia lamblia
SDDDM

SEQ ID NO: 3135798 - protein, 19 aa, Giardia lamblia
SDDDPTGNSIHSKTHTAPS

SEQ ID NO: 3135799 - protein, 8 aa, Giardia lamblia
SDDDTGIR

SEQ ID NO: 3135800 - protein, 4 aa, Giardia lamblia
SDDE

SEQ ID NO: 3135801 - protein, 6 aa, Giardia lamblia
SDDEDN

SEQ ID NO: 3135802 - protein, 17 aa, Giardia lamblia
SDDEKNAYSKRHKDAME

SEQ ID NO: 3135803 - protein, 7 aa, Giardia lamblia
SDDELKQ

SEQ ID NO: 3135804 - protein, 11 aa, Giardia lamblia
SDDEQKSFDGI

SEQ ID NO: 3135805 - protein, 6 aa, Giardia lamblia
SDDERE

SEQ ID NO: 3135806 - protein, 42 aa, Giardia lamblia
SDDESQEQPKACVPSNGASGGNTNEAVKGAQNGNPPDERQRR

SEQ ID NO: 3135807 - protein, 7 aa, Giardia lamblia
SDDGTSK

SEQ ID NO: 3135808 - protein, 10 aa, Giardia lamblia
SDDHPQNEEA

SEQ ID NO: 3135809 - protein, 6 aa, Giardia lamblia
SDDKAI

SEQ ID NO: 3135810 - protein, 8 aa, Giardia lamblia
SDDKGLPH

SEQ ID NO: 3135811 - protein, 16 aa, Giardia lamblia
SDDLSPDQIRQCKDLL

SEQ ID NO: 3135812 - protein, 4 aa, Giardia lamblia
SDDN

SEQ ID NO: 3135813 - protein, 6 aa, Giardia lamblia
SDDNTA

SEQ ID NO: 3135814 - protein, 9 aa, Giardia lamblia
SDDPSSPDY

SEQ ID NO: 3135815 - protein, 11 aa, Giardia lamblia
SDDPTRTNDDI

SEQ ID NO: 3135816 - protein, 5 aa, Giardia lamblia
SDDPW

SEQ ID NO: 3135817 - protein, 6 aa, Giardia lamblia
SDDQDR

SEQ ID NO: 3135818 - protein, 8 aa, Giardia lamblia
SDDRAQRY

SEQ ID NO: 3135819 - protein, 5 aa, Giardia lamblia
SDDSD

SEQ ID NO: 3135820 - protein, 8 aa, Giardia lamblia
SDDSLSKT

SEQ ID NO: 3135821 - protein, 9 aa, Giardia lamblia
SDDSSQHGV

SEQ ID NO: 3135822 - protein, 13 aa, Giardia lamblia
SDDTDLDANPYPL

SEQ ID NO: 3135823 - protein, 5 aa, Giardia lamblia
SDDTL

SEQ ID NO: 3135824 - protein, 5 aa, Giardia lamblia
SDDTQ

SEQ ID NO: 3135825 - protein, 15 aa, Giardia lamblia
SDDYNAKYSVTRDYG

SEQ ID NO: 3135826 - protein, 12 aa, Giardia lamblia
SDEADQSSSVSF

SEQ ID NO: 3135827 - protein, 13 aa, Giardia lamblia
SDEDHSSSDPEVT

SEQ ID NO: 3135828 - protein, 7 aa, Giardia lamblia
SDEDMAR

SEQ ID NO: 3135829 - protein, 6 aa, Giardia lamblia
SDEEEI

SEQ ID NO: 3135830 - protein, 9 aa, Giardia lamblia
SDEEKEEAL

SEQ ID NO: 3135831 - protein, 6 aa, Giardia lamblia
SDEEPE

SEQ ID NO: 3135832 - protein, 8 aa, Giardia lamblia
SDEESIEQ

SEQ ID NO: 3135833 - protein, 9 aa, Giardia lamblia
SDEETPVYS

SEQ ID NO: 3135834 - protein, 7 aa, Giardia lamblia
SDEGTTP

SEQ ID NO: 3135835 - protein, 7 aa, Giardia lamblia
SDEGYKT

SEQ ID NO: 3135836 - protein, 11 aa, Giardia lamblia
SDEIKKKDDEI

SEQ ID NO: 3135837 - protein, 6 aa, Giardia lamblia
SDEIKT

SEQ ID NO: 3135838 - protein, 5 aa, Giardia lamblia
SDEIS

SEQ ID NO: 3135839 - protein, 25 aa, Giardia lamblia
SDEKPASTQKDTQQTASFGAGKEDD

SEQ ID NO: 3135840 - protein, 8 aa, Giardia lamblia
SDENQPTQ

SEQ ID NO: 3135841 - protein, 6 aa, Giardia lamblia
SDENRP

SEQ ID NO: 3135842 - protein, 10 aa, Giardia lamblia
SDEPRTARDH

SEQ ID NO: 3135843 - protein, 6 aa, Giardia lamblia
SDEQAT

SEQ ID NO: 3135844 - protein, 14 aa, Giardia lamblia
SDEQKRNIIDSLAS

SEQ ID NO: 3135845 - protein, 7 aa, Giardia lamblia
SDEQLST

SEQ ID NO: 3135846 - protein, 16 aa, Giardia lamblia
SDERPRDSNPQTVKVS

SEQ ID NO: 3135847 - protein, 13 aa, Giardia lamblia
SDESPNDGTSDSY

SEQ ID NO: 3135848 - protein, 4 aa, Giardia lamblia
SDET

SEQ ID NO: 3135849 - protein, 8 aa, Giardia lamblia
SDETGSIT

SEQ ID NO: 3135850 - protein, 7 aa, Giardia lamblia
SDEVTRT

SEQ ID NO: 3135851 - protein, 6 aa, Giardia lamblia
SDEYRE

SEQ ID NO: 3135852 - protein, 12 aa, Giardia lamblia
SDEYTQVSSREK

SEQ ID NO: 3135853 - protein, 12 aa, Giardia lamblia
SDFSDSERDAMR

SEQ ID NO: 3135854 - protein, 4 aa, Giardia lamblia
SDGA

SEQ ID NO: 3135855 - protein, 16 aa, Giardia lamblia
SDGAALGGSMKQPTSQ

SEQ ID NO: 3135856 - protein, 9 aa, Giardia lamblia
SDGAAPSAI

SEQ ID NO: 3135857 - protein, 5 aa, Giardia lamblia
SDGAQ

SEQ ID NO: 3135858 - protein, 6 aa, Giardia lamblia
SDGDDD

SEQ ID NO: 3135859 - protein, 4 aa, Giardia lamblia
SDGE

SEQ ID NO: 3135860 - protein, 15 aa, Giardia lamblia
SDGEGCPGNPRTAAN

SEQ ID NO: 3135861 - protein, 9 aa, Giardia lamblia
SDGEHPPET

SEQ ID NO: 3135862 - protein, 4 aa, Giardia lamblia
SDGH

SEQ ID NO: 3135863 - protein, 8 aa, Giardia lamblia
SDGIGTGF

SEQ ID NO: 3135864 - protein, 4 aa, Giardia lamblia
SDGK

SEQ ID NO: 3135865 - protein, 14 aa, Giardia lamblia
SDGKRLKTRAGETV

SEQ ID NO: 3135866 - protein, 5 aa, Giardia lamblia
SDGKV

SEQ ID NO: 3135867 - protein, 10 aa, Giardia lamblia
SDGLPSDDLS

SEQ ID NO: 3135868 - protein, 8 aa, Giardia lamblia
SDGLTPRA

SEQ ID NO: 3135869 - protein, 4 aa, Giardia lamblia
SDGN

SEQ ID NO: 3135870 - protein, 5 aa, Giardia lamblia
SDGNL

SEQ ID NO: 3135871 - protein, 6 aa, Giardia lamblia
SDGNQA

SEQ ID NO: 3135872 - protein, 11 aa, Giardia lamblia
SDGPEETTKTY

SEQ ID NO: 3135873 - protein, 5 aa, Giardia lamblia
SDGPM

SEQ ID NO: 3135874 - protein, 6 aa, Giardia lamblia
SDGPMS

SEQ ID NO: 3135875 - protein, 8 aa, Giardia lamblia
SDGQTRAV

SEQ ID NO: 3135876 - protein, 6 aa, Giardia lamblia
SDGRRA

SEQ ID NO: 3135877 - protein, 4 aa, Giardia lamblia
SDGS

SEQ ID NO: 3135878 - protein, 8 aa, Giardia lamblia
SDGSGRID

SEQ ID NO: 3135879 - protein, 5 aa, Giardia lamblia
SDGSI

SEQ ID NO: 3135880 - protein, 6 aa, Giardia lamblia
SDGSIY

SEQ ID NO: 3135881 - protein, 12 aa, Giardia lamblia
SDGSRPEYSPAS

SEQ ID NO: 3135882 - protein, 4 aa, Giardia lamblia
SDGT

SEQ ID NO: 3135883 - protein, 11 aa, Giardia lamblia
SDGTAQRRGSE

SEQ ID NO: 3135884 - protein, 9 aa, Giardia lamblia
SDGTEASDC

SEQ ID NO: 3135885 - protein, 7 aa, Giardia lamblia
SDGTETV

SEQ ID NO: 3135886 - protein, 7 aa, Giardia lamblia
SDGTGHT

SEQ ID NO: 3135887 - protein, 7 aa, Giardia lamblia
SDGTIGA

SEQ ID NO: 3135888 - protein, 6 aa, Giardia lamblia
SDGVTY

SEQ ID NO: 3135889 - protein, 4 aa, Giardia lamblia
SDHA

SEQ ID NO: 3135890 - protein, 9 aa, Giardia lamblia
SDHANPAAS

SEQ ID NO: 3135891 - protein, 6 aa, Giardia lamblia
SDHDLA

SEQ ID NO: 3135892 - protein, 34 aa, Giardia lamblia
SDHDVAKDRPQDCLGPSNKVRSSTPTSRTAKNNM

SEQ ID NO: 3135893 - protein, 7 aa, Giardia lamblia
SDHEGMP

SEQ ID NO: 3135894 - protein, 12 aa, Giardia lamblia
SDHGSKNLPTGQ

SEQ ID NO: 3135895 - protein, 5 aa, Giardia lamblia
SDHPR

SEQ ID NO: 3135896 - protein, 7 aa, Giardia lamblia
SDHRPRM

SEQ ID NO: 3135897 - protein, 7 aa, Giardia lamblia
SDHSRRK

SEQ ID NO: 3135898 - protein, 14 aa, Giardia lamblia
SDHSTPSLDNNDTG

SEQ ID NO: 3135899 - protein, 7 aa, Giardia lamblia
SDHTELE

SEQ ID NO: 3135900 - protein, 10 aa, Giardia lamblia
SDIDKAKETI

SEQ ID NO: 3135901 - protein, 12 aa, Giardia lamblia
SDIKEKSTLDAF

SEQ ID NO: 3135902 - protein, 4 aa, Giardia lamblia
SDIP

SEQ ID NO: 3135903 - protein, 6 aa, Giardia lamblia
SDIRTR

SEQ ID NO: 3135904 - protein, 7 aa, Giardia lamblia
SDISDTA

SEQ ID NO: 3135905 - protein, 5 aa, Giardia lamblia
SDITK

SEQ ID NO: 3135906 - protein, 9 aa, Giardia lamblia
SDKADYEEL

SEQ ID NO: 3135907 - protein, 6 aa, Giardia lamblia
SDKAED

SEQ ID NO: 3135908 - protein, 8 aa, Giardia lamblia
SDKAEING

SEQ ID NO: 3135909 - protein, 10 aa, Giardia lamblia
SDKANSETEI

SEQ ID NO: 3135910 - protein, 4 aa, Giardia lamblia
SDKD

SEQ ID NO: 3135911 - protein, 9 aa, Giardia lamblia
SDKDGYERR

SEQ ID NO: 3135912 - protein, 6 aa, Giardia lamblia
SDKEDE

SEQ ID NO: 3135913 - protein, 13 aa, Giardia lamblia
SDKELTPKSIRTN

SEQ ID NO: 3135914 - protein, 6 aa, Giardia lamblia
SDKEPD

SEQ ID NO: 3135915 - protein, 8 aa, Giardia lamblia
SDKEQAEA

SEQ ID NO: 3135916 - protein, 4 aa, Giardia lamblia
SDKL

SEQ ID NO: 3135917 - protein, 7 aa, Giardia lamblia
SDKLGSM

SEQ ID NO: 3135918 - protein, 8 aa, Giardia lamblia
SDKLKPPR

SEQ ID NO: 3135919 - protein, 5 aa, Giardia lamblia
SDKNE

SEQ ID NO: 3135920 - protein, 6 aa, Giardia lamblia
SDKNNT

SEQ ID NO: 3135921 - protein, 9 aa, Giardia lamblia
SDKPEIASN

SEQ ID NO: 3135922 - protein, 9 aa, Giardia lamblia
SDKPKPCGC

SEQ ID NO: 3135923 - protein, 6 aa, Giardia lamblia
SDKRNA

SEQ ID NO: 3135924 - protein, 9 aa, Giardia lamblia
SDKRYRDPI

SEQ ID NO: 3135925 - protein, 5 aa, Giardia lamblia
SDKSI

SEQ ID NO: 3135926 - protein, 6 aa, Giardia lamblia
SDKTDV

SEQ ID NO: 3135927 - protein, 7 aa, Giardia lamblia
SDKTKEA

SEQ ID NO: 3135928 - protein, 4 aa, Giardia lamblia
SDLA

SEQ ID NO: 3135929 - protein, 6 aa, Giardia lamblia
SDLAAS

SEQ ID NO: 3135930 - protein, 10 aa, Giardia lamblia
SDLDPSAGRG

SEQ ID NO: 3135931 - protein, 7 aa, Giardia lamblia
SDLEGDG

SEQ ID NO: 3135932 - protein, 11 aa, Giardia lamblia
SDLESASQSYV

SEQ ID NO: 3135933 - protein, 11 aa, Giardia lamblia
SDLGKRAHGGY

SEQ ID NO: 3135934 - protein, 19 aa, Giardia lamblia
SDLKGALTENTEPTGTSNY

SEQ ID NO: 3135935 - protein, 12 aa, Giardia lamblia
SDLPETTTQAQH

SEQ ID NO: 3135936 - protein, 12 aa, Giardia lamblia
SDLQKDQLAEQT

SEQ ID NO: 3135937 - protein, 17 aa, Giardia lamblia
SDLQRKPVKKAAPPANS

SEQ ID NO: 3135938 - protein, 6 aa, Giardia lamblia
SDLRAT

SEQ ID NO: 3135939 - protein, 6 aa, Giardia lamblia
SDLSPQ

SEQ ID NO: 3135940 - protein, 10 aa, Giardia lamblia
SDLSSDSAGH

SEQ ID NO: 3135941 - protein, 16 aa, Giardia lamblia
SDLSSIQEKGSPQPLS

SEQ ID NO: 3135942 - protein, 6 aa, Giardia lamblia
SDLTAK

SEQ ID NO: 3135943 - protein, 31 aa, Giardia lamblia
SDLTSSVGSSSSGTIRSTSKTADMSRQNKDI

SEQ ID NO: 3135944 - protein, 7 aa, Giardia lamblia
SDLTTSS

SEQ ID NO: 3135945 - protein, 8 aa, Giardia lamblia
SDMPGAEK

SEQ ID NO: 3135946 - protein, 8 aa, Giardia lamblia
SDMQEQNK

SEQ ID NO: 3135947 - protein, 9 aa, Giardia lamblia
SDMSKEAKM

SEQ ID NO: 3135948 - protein, 10 aa, Giardia lamblia
SDMTDKPRQR

SEQ ID NO: 3135949 - protein, 11 aa, Giardia lamblia
SDNAREKDSHG

SEQ ID NO: 3135950 - protein, 13 aa, Giardia lamblia
SDNDATVDFRDMP

SEQ ID NO: 3135951 - protein, 14 aa, Giardia lamblia
SDNEAADEHALQSS

SEQ ID NO: 3135952 - protein, 6 aa, Giardia lamblia
SDNEMN

SEQ ID NO: 3135953 - protein, 4 aa, Giardia lamblia
SDNG

SEQ ID NO: 3135954 - protein, 7 aa, Giardia lamblia
SDNGDIS

SEQ ID NO: 3135955 - protein, 7 aa, Giardia lamblia
SDNKQEL

SEQ ID NO: 3135956 - protein, 14 aa, Giardia lamblia
SDNKQRDSDRSAEH

SEQ ID NO: 3135957 - protein, 11 aa, Giardia lamblia
SDNLTDAQHEN

SEQ ID NO: 3135958 - protein, 8 aa, Giardia lamblia
SDNPDEAV

SEQ ID NO: 3135959 - protein, 6 aa, Giardia lamblia
SDNPGI

SEQ ID NO: 3135960 - protein, 20 aa, Giardia lamblia
SDNRDAVSTITRKSTTIKAP

SEQ ID NO: 3135961 - protein, 8 aa, Giardia lamblia
SDNSNCKK

SEQ ID NO: 3135962 - protein, 5 aa, Giardia lamblia
SDNTE

SEQ ID NO: 3135963 - protein, 15 aa, Giardia lamblia
SDPAAGVPDESRYES

SEQ ID NO: 3135964 - protein, 9 aa, Giardia lamblia
SDPDFPKDK

SEQ ID NO: 3135965 - protein, 6 aa, Giardia lamblia
SDPFNG

SEQ ID NO: 3135966 - protein, 7 aa, Giardia lamblia
SDPGTPR

SEQ ID NO: 3135967 - protein, 7 aa, Giardia lamblia
SDPIPDR

SEQ ID NO: 3135968 - protein, 7 aa, Giardia lamblia
SDPKDVK

SEQ ID NO: 3135969 - protein, 6 aa, Giardia lamblia
SDPLDT

SEQ ID NO: 3135970 - protein, 7 aa, Giardia lamblia
SDPLNPD

SEQ ID NO: 3135971 - protein, 4 aa, Giardia lamblia
SDPM

SEQ ID NO: 3135972 - protein, 8 aa, Giardia lamblia
SDPNISSR

SEQ ID NO: 3135973 - protein, 10 aa, Giardia lamblia
SDPPGSRKHN

SEQ ID NO: 3135974 - protein, 5 aa, Giardia lamblia
SDPPI

SEQ ID NO: 3135975 - protein, 8 aa, Giardia lamblia
SDPPQATA

SEQ ID NO: 3135976 - protein, 8 aa, Giardia lamblia
SDPQGGVA

SEQ ID NO: 3135977 - protein, 7 aa, Giardia lamblia
SDPQKAI

SEQ ID NO: 3135978 - protein, 20 aa, Giardia lamblia
SDPRSDATPLKDSQQPNTQA

SEQ ID NO: 3135979 - protein, 8 aa, Giardia lamblia
SDPRVAAQ

SEQ ID NO: 3135980 - protein, 18 aa, Giardia lamblia
SDPSDREEELRTTDQGQR

SEQ ID NO: 3135981 - protein, 12 aa, Giardia lamblia
SDPSDSYKQEGS

SEQ ID NO: 3135982 - protein, 9 aa, Giardia lamblia
SDPSHKAIE

SEQ ID NO: 3135983 - protein, 8 aa, Giardia lamblia
SDPSKTPL

SEQ ID NO: 3135984 - protein, 24 aa, Giardia lamblia
SDPSQTPIDSSSGDGPAHTRPSHR

SEQ ID NO: 3135985 - protein, 18 aa, Giardia lamblia
SDPSSISVQKSAPSIGSD

SEQ ID NO: 3135986 - protein, 7 aa, Giardia lamblia
SDPSTAL

SEQ ID NO: 3135987 - protein, 4 aa, Giardia lamblia
SDPT

SEQ ID NO: 3135988 - protein, 26 aa, Giardia lamblia
SDPTKRENYDNYGEKGIEGQPMSGSP

SEQ ID NO: 3135989 - protein, 24 aa, Giardia lamblia
SDQAKSGGDGATASCDIDDSDNRK

SEQ ID NO: 3135990 - protein, 13 aa, Giardia lamblia
SDQCANSSNHAHD

SEQ ID NO: 3135991 - protein, 13 aa, Giardia lamblia
SDQDASSGSFAAK

SEQ ID NO: 3135992 - protein, 12 aa, Giardia lamblia
SDQDDYNSQESH

SEQ ID NO: 3135993 - protein, 22 aa, Giardia lamblia
SDQDTSESRQHADASNPRAAIA

SEQ ID NO: 3135994 - protein, 10 aa, Giardia lamblia
SDQGEGSKEP

SEQ ID NO: 3135995 - protein, 8 aa, Giardia lamblia
SDQGFTSS

SEQ ID NO: 3135996 - protein, 8 aa, Giardia lamblia
SDQGTPAN

SEQ ID NO: 3135997 - protein, 7 aa, Giardia lamblia
SDQISSL

SEQ ID NO: 3135998 - protein, 18 aa, Giardia lamblia
SDQKGKHTSSVESLSSDQ

SEQ ID NO: 3135999 - protein, 5 aa, Giardia lamblia
SDQKQ

SEQ ID NO: 3136000 - protein, 8 aa, Giardia lamblia
SDQLASDL

SEQ ID NO: 3136001 - protein, 10 aa, Giardia lamblia
SDQLVSTDTQ

SEQ ID NO: 3136002 - protein, 6 aa, Giardia lamblia
SDQNER

SEQ ID NO: 3136003 - protein, 24 aa, Giardia lamblia
SDQNSESATINTPSTPAVDSTTGH

SEQ ID NO: 3136004 - protein, 6 aa, Giardia lamblia
SDQNYK

SEQ ID NO: 3136005 - protein, 10 aa, Giardia lamblia
SDQQAESLSA

SEQ ID NO: 3136006 - protein, 13 aa, Giardia lamblia
SDQQESAESRVSQ

SEQ ID NO: 3136007 - protein, 8 aa, Giardia lamblia
SDQSSITD

SEQ ID NO: 3136008 - protein, 28 aa, Giardia lamblia
SDRFSTDSNDSNQSPSISARRPLRSSTL

SEQ ID NO: 3136009 - protein, 58 aa, Giardia lamblia
SDRGDTQDQTGYASTYEASDIHKSGKSKPRERRQRKSKSHSNSTKDYQGNEEASYSQS

SEQ ID NO: 3136010 - protein, 5 aa, Giardia lamblia
SDRGE

SEQ ID NO: 3136011 - protein, 6 aa, Giardia lamblia
SDRGEV

SEQ ID NO: 3136012 - protein, 8 aa, Giardia lamblia
SDRIQDDY

SEQ ID NO: 3136013 - protein, 22 aa, Giardia lamblia
SDRKPNEAMTGSAGGDKTGGRS

SEQ ID NO: 3136014 - protein, 4 aa, Giardia lamblia
SDRL

SEQ ID NO: 3136015 - protein, 5 aa, Giardia lamblia
SDRNA

SEQ ID NO: 3136016 - protein, 5 aa, Giardia lamblia
SDRNL

SEQ ID NO: 3136017 - protein, 5 aa, Giardia lamblia
SDRPE

SEQ ID NO: 3136018 - protein, 5 aa, Giardia lamblia
SDRPH

SEQ ID NO: 3136019 - protein, 14 aa, Giardia lamblia
SDRPPERDNAQKLR

SEQ ID NO: 3136020 - protein, 8 aa, Giardia lamblia
SDRQEDYE

SEQ ID NO: 3136021 - protein, 5 aa, Giardia lamblia
SDRQI

SEQ ID NO: 3136022 - protein, 17 aa, Giardia lamblia
SDRRLPEPRPAGEKDVR

SEQ ID NO: 3136023 - protein, 8 aa, Giardia lamblia
SDRSIPAI

SEQ ID NO: 3136024 - protein, 5 aa, Giardia lamblia
SDRTI

SEQ ID NO: 3136025 - protein, 5 aa, Giardia lamblia
SDRVA

SEQ ID NO: 3136026 - protein, 9 aa, Giardia lamblia
SDRYETSEK

SEQ ID NO: 3136027 - protein, 11 aa, Giardia lamblia
SDSASSGPSSM

SEQ ID NO: 3136028 - protein, 7 aa, Giardia lamblia
SDSDMEA

SEQ ID NO: 3136029 - protein, 7 aa, Giardia lamblia
SDSDNVD

SEQ ID NO: 3136030 - protein, 11 aa, Giardia lamblia
SDSDPDVPEET

SEQ ID NO: 3136031 - protein, 13 aa, Giardia lamblia
SDSDRSNSHEEPL

SEQ ID NO: 3136032 - protein, 11 aa, Giardia lamblia
SDSDSDLSTAP

SEQ ID NO: 3136033 - protein, 18 aa, Giardia lamblia
SDSEDNLGRRPAKALPDQ

SEQ ID NO: 3136034 - protein, 6 aa, Giardia lamblia
SDSEGN

SEQ ID NO: 3136035 - protein, 8 aa, Giardia lamblia
SDSELRAY

SEQ ID NO: 3136036 - protein, 50 aa, Giardia lamblia
SDSESSSEEQDDDSDAFQENSYDEDDEDDEITGSCATSEPDNLQGDDEFS

SEQ ID NO: 3136037 - protein, 6 aa, Giardia lamblia
SDSFHG

SEQ ID NO: 3136038 - protein, 21 aa, Giardia lamblia
SDSGASQELMGPSSPARSTSV

SEQ ID NO: 3136039 - protein, 5 aa, Giardia lamblia
SDSGE

SEQ ID NO: 3136040 - protein, 28 aa, Giardia lamblia
SDSGEEENSLQDNVGRVTDAADPTAKDD

SEQ ID NO: 3136041 - protein, 10 aa, Giardia lamblia
SDSGSGEATV

SEQ ID NO: 3136042 - protein, 31 aa, Giardia lamblia
SDSGTVCAESASSDQAASEPALSKDECTPAE

SEQ ID NO: 3136043 - protein, 7 aa, Giardia lamblia
SDSGYRA

SEQ ID NO: 3136044 - protein, 4 aa, Giardia lamblia
SDSI

SEQ ID NO: 3136045 - protein, 10 aa, Giardia lamblia
SDSLGSSQKT

SEQ ID NO: 3136046 - protein, 9 aa, Giardia lamblia
SDSLKDQPF

SEQ ID NO: 3136047 - protein, 22 aa, Giardia lamblia
SDSLPAPEAKVDPLGDNQNVDE

SEQ ID NO: 3136048 - protein, 4 aa, Giardia lamblia
SDSN

SEQ ID NO: 3136049 - protein, 10 aa, Giardia lamblia
SDSNKGAATC

SEQ ID NO: 3136050 - protein, 6 aa, Giardia lamblia
SDSNTN

SEQ ID NO: 3136051 - protein, 8 aa, Giardia lamblia
SDSPAPAP

SEQ ID NO: 3136052 - protein, 6 aa, Giardia lamblia
SDSPDY

SEQ ID NO: 3136053 - protein, 7 aa, Giardia lamblia
SDSPGRH

SEQ ID NO: 3136054 - protein, 35 aa, Giardia lamblia
SDSPLPDDKQDKRPVEEPVSAPLAAPDHSASSDFM

SEQ ID NO: 3136055 - protein, 8 aa, Giardia lamblia
SDSPQEQD

SEQ ID NO: 3136056 - protein, 5 aa, Giardia lamblia
SDSPR

SEQ ID NO: 3136057 - protein, 6 aa, Giardia lamblia
SDSPSR

SEQ ID NO: 3136058 - protein, 5 aa, Giardia lamblia
SDSQT

SEQ ID NO: 3136059 - protein, 10 aa, Giardia lamblia
SDSRAADGDL

SEQ ID NO: 3136060 - protein, 26 aa, Giardia lamblia
SDSREKAERGKKQESSAPAQTRPIDP

SEQ ID NO: 3136061 - protein, 6 aa, Giardia lamblia
SDSRGI

SEQ ID NO: 3136062 - protein, 8 aa, Giardia lamblia
SDSRLTSK

SEQ ID NO: 3136063 - protein, 24 aa, Giardia lamblia
SDSRSGRSQRSMTPSSVGRSQGNT

SEQ ID NO: 3136064 - protein, 8 aa, Giardia lamblia
SDSRSTSD

SEQ ID NO: 3136065 - protein, 8 aa, Giardia lamblia
SDSSAEAL

SEQ ID NO: 3136066 - protein, 10 aa, Giardia lamblia
SDSSGPSHPR

SEQ ID NO: 3136067 - protein, 10 aa, Giardia lamblia
SDSSTITDTP

SEQ ID NO: 3136068 - protein, 8 aa, Giardia lamblia
SDSSYKQS

SEQ ID NO: 3136069 - protein, 14 aa, Giardia lamblia
SDSTDEQEAQDTRL

SEQ ID NO: 3136070 - protein, 8 aa, Giardia lamblia
SDSTDSGK

SEQ ID NO: 3136071 - protein, 12 aa, Giardia lamblia
SDSTEDNNEDQK

SEQ ID NO: 3136072 - protein, 9 aa, Giardia lamblia
SDSTGDEKL

SEQ ID NO: 3136073 - protein, 8 aa, Giardia lamblia
SDSTGPEK

SEQ ID NO: 3136074 - protein, 16 aa, Giardia lamblia
SDSTHDPSSTANSLRE

SEQ ID NO: 3136075 - protein, 7 aa, Giardia lamblia
SDSTSMA

SEQ ID NO: 3136076 - protein, 5 aa, Giardia lamblia
SDSTT

SEQ ID NO: 3136077 - protein, 14 aa, Giardia lamblia
SDSTVHDTDKDADW

SEQ ID NO: 3136078 - protein, 4 aa, Giardia lamblia
SDSY

SEQ ID NO: 3136079 - protein, 4 aa, Giardia lamblia
SDTA

SEQ ID NO: 3136080 - protein, 6 aa, Giardia lamblia
SDTAES

SEQ ID NO: 3136081 - protein, 8 aa, Giardia lamblia
SDTAPYRA

SEQ ID NO: 3136082 - protein, 14 aa, Giardia lamblia
SDTAQTHNEPFTSA

SEQ ID NO: 3136083 - protein, 18 aa, Giardia lamblia
SDTDSESLEDLSDSQTRV

SEQ ID NO: 3136084 - protein, 7 aa, Giardia lamblia
SDTEPKR

SEQ ID NO: 3136085 - protein, 10 aa, Giardia lamblia
SDTEQENDSM

SEQ ID NO: 3136086 - protein, 8 aa, Giardia lamblia
SDTFLDGK

SEQ ID NO: 3136087 - protein, 4 aa, Giardia lamblia
SDTG

SEQ ID NO: 3136088 - protein, 8 aa, Giardia lamblia
SDTGFKED

SEQ ID NO: 3136089 - protein, 12 aa, Giardia lamblia
SDTGSSPSGRYG

SEQ ID NO: 3136090 - protein, 7 aa, Giardia lamblia
SDTGTDR

SEQ ID NO: 3136091 - protein, 9 aa, Giardia lamblia
SDTKAELDF

SEQ ID NO: 3136092 - protein, 5 aa, Giardia lamblia
SDTKF

SEQ ID NO: 3136093 - protein, 10 aa, Giardia lamblia
SDTKRIHETR

SEQ ID NO: 3136094 - protein, 9 aa, Giardia lamblia
SDTLSTEET

SEQ ID NO: 3136095 - protein, 4 aa, Giardia lamblia
SDTN

SEQ ID NO: 3136096 - protein, 18 aa, Giardia lamblia
SDTNNDEASNEKPATSTE

SEQ ID NO: 3136097 - protein, 7 aa, Giardia lamblia
SDTNSTK

SEQ ID NO: 3136098 - protein, 9 aa, Giardia lamblia
SDTPEGESV

SEQ ID NO: 3136099 - protein, 6 aa, Giardia lamblia
SDTPKN

SEQ ID NO: 3136100 - protein, 6 aa, Giardia lamblia
SDTSLD

SEQ ID NO: 3136101 - protein, 9 aa, Giardia lamblia
SDTSPMRTT

SEQ ID NO: 3136102 - protein, 4 aa, Giardia lamblia
SDTT

SEQ ID NO: 3136103 - protein, 20 aa, Giardia lamblia
SDTTYTPDLGSKADPSTADP

SEQ ID NO: 3136104 - protein, 7 aa, Giardia lamblia
SDTVDEK

SEQ ID NO: 3136105 - protein, 16 aa, Giardia lamblia
SDTVSDPSMNINDTDS

SEQ ID NO: 3136106 - protein, 6 aa, Giardia lamblia
SDTYST

SEQ ID NO: 3136107 - protein, 9 aa, Giardia lamblia
SDVAGKDPL

SEQ ID NO: 3136108 - protein, 8 aa, Giardia lamblia
SDVCQEEP

SEQ ID NO: 3136109 - protein, 7 aa, Giardia lamblia
SDVDKEE

SEQ ID NO: 3136110 - protein, 9 aa, Giardia lamblia
SDVHSSSVG

SEQ ID NO: 3136111 - protein, 4 aa, Giardia lamblia
SDVN

SEQ ID NO: 3136112 - protein, 6 aa, Giardia lamblia
SDVQPT

SEQ ID NO: 3136113 - protein, 15 aa, Giardia lamblia
SDVSASGSSSSRGIK

SEQ ID NO: 3136114 - protein, 8 aa, Giardia lamblia
SDVSEPQA

SEQ ID NO: 3136115 - protein, 12 aa, Giardia lamblia
SDVTEGTEATDV

SEQ ID NO: 3136116 - protein, 6 aa, Giardia lamblia
SDYDGL

SEQ ID NO: 3136117 - protein, 11 aa, Giardia lamblia
SDYEKECERYE

SEQ ID NO: 3136118 - protein, 9 aa, Giardia lamblia
SDYGATATL

SEQ ID NO: 3136119 - protein, 7 aa, Giardia lamblia
SDYNNNQ

SEQ ID NO: 3136120 - protein, 6 aa, Giardia lamblia
SDYPPV

SEQ ID NO: 3136121 - protein, 4 aa, Giardia lamblia
SDYS

SEQ ID NO: 3136122 - protein, 10 aa, Giardia lamblia
SDYSYTDQRS

SEQ ID NO: 3136123 - protein, 6 aa, Giardia lamblia
SEAAGP

SEQ ID NO: 3136124 - protein, 12 aa, Giardia lamblia
SEAAQGDGDTIT

SEQ ID NO: 3136125 - protein, 11 aa, Giardia lamblia
SEADIPASYRP

SEQ ID NO: 3136126 - protein, 5 aa, Giardia lamblia
SEADR

SEQ ID NO: 3136127 - protein, 5 aa, Giardia lamblia
SEAEA

SEQ ID NO: 3136128 - protein, 6 aa, Giardia lamblia
SEAEGP

SEQ ID NO: 3136129 - protein, 8 aa, Giardia lamblia
SEAEKSIE

SEQ ID NO: 3136130 - protein, 6 aa, Giardia lamblia
SEAEVQ

SEQ ID NO: 3136131 - protein, 4 aa, Giardia lamblia
SEAG

SEQ ID NO: 3136132 - protein, 6 aa, Giardia lamblia
SEAGGT

SEQ ID NO: 3136133 - protein, 7 aa, Giardia lamblia
SEAGKNA

SEQ ID NO: 3136134 - protein, 10 aa, Giardia lamblia
SEAGKTDWQG

SEQ ID NO: 3136135 - protein, 11 aa, Giardia lamblia
SEAGMKDANGY

SEQ ID NO: 3136136 - protein, 8 aa, Giardia lamblia
SEAGMQDV

SEQ ID NO: 3136137 - protein, 8 aa, Giardia lamblia
SEAGNADA

SEQ ID NO: 3136138 - protein, 14 aa, Giardia lamblia
SEAGRQEASSKKSF

SEQ ID NO: 3136139 - protein, 11 aa, Giardia lamblia
SEAGRQQKTGI

SEQ ID NO: 3136140 - protein, 10 aa, Giardia lamblia
SEAGRQSGVG

SEQ ID NO: 3136141 - protein, 10 aa, Giardia lamblia
SEAGVATSAG

SEQ ID NO: 3136142 - protein, 4 aa, Giardia lamblia
SEAH

SEQ ID NO: 3136143 - protein, 20 aa, Giardia lamblia
SEAHRQRSGQLEEPPATAED

SEQ ID NO: 3136144 - protein, 7 aa, Giardia lamblia
SEALENN

SEQ ID NO: 3136145 - protein, 5 aa, Giardia lamblia
SEALG

SEQ ID NO: 3136146 - protein, 12 aa, Giardia lamblia
SEANGGTSQESS

SEQ ID NO: 3136147 - protein, 16 aa, Giardia lamblia
SEAPAIAGDTSFEEQE

SEQ ID NO: 3136148 - protein, 16 aa, Giardia lamblia
SEAPELDSEGTKMPEK

SEQ ID NO: 3136149 - protein, 8 aa, Giardia lamblia
SEAPENID

SEQ ID NO: 3136150 - protein, 8 aa, Giardia lamblia
SEAPPFPD

SEQ ID NO: 3136151 - protein, 14 aa, Giardia lamblia
SEAQENAAKSHAGM

SEQ ID NO: 3136152 - protein, 10 aa, Giardia lamblia
SEARKQNLYG

SEQ ID NO: 3136153 - protein, 5 aa, Giardia lamblia
SEARM

SEQ ID NO: 3136154 - protein, 12 aa, Giardia lamblia
SEARSGKRPSTD

SEQ ID NO: 3136155 - protein, 5 aa, Giardia lamblia
SEASI

SEQ ID NO: 3136156 - protein, 10 aa, Giardia lamblia
SEASLKDGRR

SEQ ID NO: 3136157 - protein, 5 aa, Giardia lamblia
SEASP

SEQ ID NO: 3136158 - protein, 6 aa, Giardia lamblia
SEASSQ

SEQ ID NO: 3136159 - protein, 6 aa, Giardia lamblia
SEATES

SEQ ID NO: 3136160 - protein, 7 aa, Giardia lamblia
SEATSEL

SEQ ID NO: 3136161 - protein, 17 aa, Giardia lamblia
SEAVPENGPSKKQENVN

SEQ ID NO: 3136162 - protein, 9 aa, Giardia lamblia
SEAVSRSKE

SEQ ID NO: 3136163 - protein, 48 aa, Giardia lamblia
SEAVSTMEESSESSEASPVFDDTEDTQNQAVSDELSDVPDHDTDVEEE

SEQ ID NO: 3136164 - protein, 29 aa, Giardia lamblia
SECPHDNTLNTDVPEPLPKRVDESKPLST

SEQ ID NO: 3136165 - protein, 17 aa, Giardia lamblia
SECSAQAQKALAESTRL

SEQ ID NO: 3136166 - protein, 16 aa, Giardia lamblia
SECSGTPLPDYGQREY

SEQ ID NO: 3136167 - protein, 12 aa, Giardia lamblia
SEDEAAEKKERL

SEQ ID NO: 3136168 - protein, 7 aa, Giardia lamblia
SEDEIDT

SEQ ID NO: 3136169 - protein, 7 aa, Giardia lamblia
SEDESGV

SEQ ID NO: 3136170 - protein, 5 aa, Giardia lamblia
SEDEV

SEQ ID NO: 3136171 - protein, 4 aa, Giardia lamblia
SEDI

SEQ ID NO: 3136172 - protein, 6 aa, Giardia lamblia
SEDLTQ

SEQ ID NO: 3136173 - protein, 7 aa, Giardia lamblia
SEDNSTR

SEQ ID NO: 3136174 - protein, 12 aa, Giardia lamblia
SEDPPPSAPQRG

SEQ ID NO: 3136175 - protein, 10 aa, Giardia lamblia
SEDPSERPSA

SEQ ID NO: 3136176 - protein, 10 aa, Giardia lamblia
SEDPTDGNGV

SEQ ID NO: 3136177 - protein, 5 aa, Giardia lamblia
SEDQG

SEQ ID NO: 3136178 - protein, 8 aa, Giardia lamblia
SEDQTDDM

SEQ ID NO: 3136179 - protein, 8 aa, Giardia lamblia
SEDRDLSK

SEQ ID NO: 3136180 - protein, 8 aa, Giardia lamblia
SEDRGTFD

SEQ ID NO: 3136181 - protein, 15 aa, Giardia lamblia
SEDRQDAKDDAARDI

SEQ ID NO: 3136182 - protein, 4 aa, Giardia lamblia
SEDS

SEQ ID NO: 3136183 - protein, 6 aa, Giardia lamblia
SEDSEL

SEQ ID NO: 3136184 - protein, 13 aa, Giardia lamblia
SEDSFPDAVPGLS

SEQ ID NO: 3136185 - protein, 6 aa, Giardia lamblia
SEDSGL

SEQ ID NO: 3136186 - protein, 17 aa, Giardia lamblia
SEDSQAASEYDSRHPKH

SEQ ID NO: 3136187 - protein, 12 aa, Giardia lamblia
SEDSVSEEQTPA

SEQ ID NO: 3136188 - protein, 11 aa, Giardia lamblia
SEDTPEEKREA

SEQ ID NO: 3136189 - protein, 6 aa, Giardia lamblia
SEDTQT

SEQ ID NO: 3136190 - protein, 18 aa, Giardia lamblia
SEDTSSAKHATRAGRGTT

SEQ ID NO: 3136191 - protein, 4 aa, Giardia lamblia
SEEA

SEQ ID NO: 3136192 - protein, 8 aa, Giardia lamblia
SEEAAEKA

SEQ ID NO: 3136193 - protein, 18 aa, Giardia lamblia
SEEADPSDGAGRSREDGS

SEQ ID NO: 3136194 - protein, 9 aa, Giardia lamblia
SEEAGLANP

SEQ ID NO: 3136195 - protein, 5 aa, Giardia lamblia
SEEAL

SEQ ID NO: 3136196 - protein, 7 aa, Giardia lamblia
SEECSTK

SEQ ID NO: 3136197 - protein, 19 aa, Giardia lamblia
SEEDEAARGLSGSSAAASA

SEQ ID NO: 3136198 - protein, 6 aa, Giardia lamblia
SEEDPS

SEQ ID NO: 3136199 - protein, 12 aa, Giardia lamblia
SEEDYVDEEEFG

SEQ ID NO: 3136200 - protein, 6 aa, Giardia lamblia
SEEEAR

SEQ ID NO: 3136201 - protein, 7 aa, Giardia lamblia
SEEEEKL

SEQ ID NO: 3136202 - protein, 11 aa, Giardia lamblia
SEEEHRPSATN

SEQ ID NO: 3136203 - protein, 5 aa, Giardia lamblia
SEEER

SEQ ID NO: 3136204 - protein, 6 aa, Giardia lamblia
SEEERK

SEQ ID NO: 3136205 - protein, 8 aa, Giardia lamblia
SEEESVER

SEQ ID NO: 3136206 - protein, 6 aa, Giardia lamblia
SEEGGL

SEQ ID NO: 3136207 - protein, 14 aa, Giardia lamblia
SEEGGVVAEDGSTA

SEQ ID NO: 3136208 - protein, 7 aa, Giardia lamblia
SEEGMKT

SEQ ID NO: 3136209 - protein, 4 aa, Giardia lamblia
SEEI

SEQ ID NO: 3136210 - protein, 4 aa, Giardia lamblia
SEEK

SEQ ID NO: 3136211 - protein, 9 aa, Giardia lamblia
SEEKELTEQ

SEQ ID NO: 3136212 - protein, 9 aa, Giardia lamblia
SEEKLTDEQ

SEQ ID NO: 3136213 - protein, 8 aa, Giardia lamblia
SEELQASQ

SEQ ID NO: 3136214 - protein, 5 aa, Giardia lamblia
SEELT

SEQ ID NO: 3136215 - protein, 4 aa, Giardia lamblia
SEEN

SEQ ID NO: 3136216 - protein, 12 aa, Giardia lamblia
SEENGSASGNVV

SEQ ID NO: 3136217 - protein, 8 aa, Giardia lamblia
SEEPGYKA

SEQ ID NO: 3136218 - protein, 6 aa, Giardia lamblia
SEEPQE

SEQ ID NO: 3136219 - protein, 7 aa, Giardia lamblia
SEEPRFA

SEQ ID NO: 3136220 - protein, 29 aa, Giardia lamblia
SEERHDVSTAQEEGAGLGGSQLSGPSEEN

SEQ ID NO: 3136221 - protein, 6 aa, Giardia lamblia
SEERQR

SEQ ID NO: 3136222 - protein, 32 aa, Giardia lamblia
SEESASIPGPSPEDPQDDPVSSSPAASKINNP

SEQ ID NO: 3136223 - protein, 13 aa, Giardia lamblia
SEESGDKDMPQTI

SEQ ID NO: 3136224 - protein, 5 aa, Giardia lamblia
SEESN

SEQ ID NO: 3136225 - protein, 6 aa, Giardia lamblia
SEETDN

SEQ ID NO: 3136226 - protein, 4 aa, Giardia lamblia
SEEV

SEQ ID NO: 3136227 - protein, 5 aa, Giardia lamblia
SEEVG

SEQ ID NO: 3136228 - protein, 6 aa, Giardia lamblia
SEFDQE

SEQ ID NO: 3136229 - protein, 5 aa, Giardia lamblia
SEFNK

SEQ ID NO: 3136230 - protein, 4 aa, Giardia lamblia
SEFP

SEQ ID NO: 3136231 - protein, 4 aa, Giardia lamblia
SEFS

SEQ ID NO: 3136232 - protein, 9 aa, Giardia lamblia
SEFSTDTKL

SEQ ID NO: 3136233 - protein, 7 aa, Giardia lamblia
SEFYSKN

SEQ ID NO: 3136234 - protein, 9 aa, Giardia lamblia
SEGAAQSLV

SEQ ID NO: 3136235 - protein, 7 aa, Giardia lamblia
SEGARTE

SEQ ID NO: 3136236 - protein, 11 aa, Giardia lamblia
SEGASSTKDHN

SEQ ID NO: 3136237 - protein, 16 aa, Giardia lamblia
SEGATLGPADTGSGSI

SEQ ID NO: 3136238 - protein, 9 aa, Giardia lamblia
SEGDLSKIG

SEQ ID NO: 3136239 - protein, 11 aa, Giardia lamblia
SEGGMYDRNRQ

SEQ ID NO: 3136240 - protein, 12 aa, Giardia lamblia
SEGGSRRPDGKT

SEQ ID NO: 3136241 - protein, 5 aa, Giardia lamblia
SEGGV

SEQ ID NO: 3136242 - protein, 4 aa, Giardia lamblia
SEGI

SEQ ID NO: 3136243 - protein, 6 aa, Giardia lamblia
SEGKAK

SEQ ID NO: 3136244 - protein, 9 aa, Giardia lamblia
SEGKRAISP

SEQ ID NO: 3136245 - protein, 8 aa, Giardia lamblia
SEGKSVKN

SEQ ID NO: 3136246 - protein, 5 aa, Giardia lamblia
SEGLA

SEQ ID NO: 3136247 - protein, 6 aa, Giardia lamblia
SEGLQA

SEQ ID NO: 3136248 - protein, 4 aa, Giardia lamblia
SEGN

SEQ ID NO: 3136249 - protein, 6 aa, Giardia lamblia
SEGNDA

SEQ ID NO: 3136250 - protein, 7 aa, Giardia lamblia
SEGNTSL

SEQ ID NO: 3136251 - protein, 5 aa, Giardia lamblia
SEGPI

SEQ ID NO: 3136252 - protein, 26 aa, Giardia lamblia
SEGPRHATSKGHKGHKGQKRGEGDGD

SEQ ID NO: 3136253 - protein, 5 aa, Giardia lamblia
SEGRP

SEQ ID NO: 3136254 - protein, 4 aa, Giardia lamblia
SEGT

SEQ ID NO: 3136255 - protein, 9 aa, Giardia lamblia
SEGTGRPNR

SEQ ID NO: 3136256 - protein, 8 aa, Giardia lamblia
SEGTPLDA

SEQ ID NO: 3136257 - protein, 5 aa, Giardia lamblia
SEGTV

SEQ ID NO: 3136258 - protein, 13 aa, Giardia lamblia
SEGVDTHAGPDIS

SEQ ID NO: 3136259 - protein, 7 aa, Giardia lamblia
SEGVQVP

SEQ ID NO: 3136260 - protein, 14 aa, Giardia lamblia
SEGVTTPASTPSAS

SEQ ID NO: 3136261 - protein, 4 aa, Giardia lamblia
SEGY

SEQ ID NO: 3136262 - protein, 10 aa, Giardia lamblia
SEGYARYNKG

SEQ ID NO: 3136263 - protein, 7 aa, Giardia lamblia
SEGYTLE

SEQ ID NO: 3136264 - protein, 6 aa, Giardia lamblia
SEHAPQ

SEQ ID NO: 3136265 - protein, 9 aa, Giardia lamblia
SEHDSEPLR

SEQ ID NO: 3136266 - protein, 8 aa, Giardia lamblia
SEHEDGAI

SEQ ID NO: 3136267 - protein, 13 aa, Giardia lamblia
SEHESLSQHQAEQ

SEQ ID NO: 3136268 - protein, 6 aa, Giardia lamblia
SEHKAY

SEQ ID NO: 3136269 - protein, 23 aa, Giardia lamblia
SEHQESNTGNPGAPKQERDGRAM

SEQ ID NO: 3136270 - protein, 16 aa, Giardia lamblia
SEHRTGSSTKLSAHSP

SEQ ID NO: 3136271 - protein, 7 aa, Giardia lamblia
SEHTERK

SEQ ID NO: 3136272 - protein, 5 aa, Giardia lamblia
SEHTN

SEQ ID NO: 3136273 - protein, 22 aa, Giardia lamblia
SEHTSPKEANGKDDLEEGDETS

SEQ ID NO: 3136274 - protein, 9 aa, Giardia lamblia
SEIDPSVTN

SEQ ID NO: 3136275 - protein, 4 aa, Giardia lamblia
SEIE

SEQ ID NO: 3136276 - protein, 16 aa, Giardia lamblia
SEIEDQQQASPTELPE

SEQ ID NO: 3136277 - protein, 13 aa, Giardia lamblia
SEIEKKKAEKRAE

SEQ ID NO: 3136278 - protein, 15 aa, Giardia lamblia
SEINTREQAERPSVG

SEQ ID NO: 3136279 - protein, 5 aa, Giardia lamblia
SEIPR

SEQ ID NO: 3136280 - protein, 9 aa, Giardia lamblia
SEIQTKDES

SEQ ID NO: 3136281 - protein, 8 aa, Giardia lamblia
SEIRSEAT

SEQ ID NO: 3136282 - protein, 17 aa, Giardia lamblia
SEISSTAAKEALRRRSG

SEQ ID NO: 3136283 - protein, 4 aa, Giardia lamblia
SEIT

SEQ ID NO: 3136284 - protein, 16 aa, Giardia lamblia
SEKAAAKKHDKAEKYR

SEQ ID NO: 3136285 - protein, 8 aa, Giardia lamblia
SEKAPYEV

SEQ ID NO: 3136286 - protein, 8 aa, Giardia lamblia
SEKDDKLE

SEQ ID NO: 3136287 - protein, 17 aa, Giardia lamblia
SEKESGGEDPAASSASL

SEQ ID NO: 3136288 - protein, 5 aa, Giardia lamblia
SEKGD

SEQ ID NO: 3136289 - protein, 6 aa, Giardia lamblia
SEKGEL

SEQ ID NO: 3136290 - protein, 13 aa, Giardia lamblia
SEKGLQNKKGQTA

SEQ ID NO: 3136291 - protein, 12 aa, Giardia lamblia
SEKHKGSGDEQA

SEQ ID NO: 3136292 - protein, 13 aa, Giardia lamblia
SEKIENRTDELNL

SEQ ID NO: 3136293 - protein, 4 aa, Giardia lamblia
SEKK

SEQ ID NO: 3136294 - protein, 11 aa, Giardia lamblia
SEKKARENALK

SEQ ID NO: 3136295 - protein, 7 aa, Giardia lamblia
SEKKLTE

SEQ ID NO: 3136296 - protein, 27 aa, Giardia lamblia
SEKLEGTQSDLTRDSAPDNASRGCFIY

SEQ ID NO: 3136297 - protein, 6 aa, Giardia lamblia
SEKLPE

SEQ ID NO: 3136298 - protein, 9 aa, Giardia lamblia
SEKLSSPVS

SEQ ID NO: 3136299 - protein, 5 aa, Giardia lamblia
SEKME

SEQ ID NO: 3136300 - protein, 9 aa, Giardia lamblia
SEKPTTEQL

SEQ ID NO: 3136301 - protein, 11 aa, Giardia lamblia
SEKQCNKDNGF

SEQ ID NO: 3136302 - protein, 9 aa, Giardia lamblia
SEKQELQDK

SEQ ID NO: 3136303 - protein, 10 aa, Giardia lamblia
SEKRTGRSRG

SEQ ID NO: 3136304 - protein, 12 aa, Giardia lamblia
SEKSCTDQTSSN

SEQ ID NO: 3136305 - protein, 5 aa, Giardia lamblia
SEKSD

SEQ ID NO: 3136306 - protein, 8 aa, Giardia lamblia
SEKSNPII

SEQ ID NO: 3136307 - protein, 6 aa, Giardia lamblia
SEKSTF

SEQ ID NO: 3136308 - protein, 6 aa, Giardia lamblia
SEKTIT

SEQ ID NO: 3136309 - protein, 7 aa, Giardia lamblia
SEKTKVP

SEQ ID NO: 3136310 - protein, 10 aa, Giardia lamblia
SEKTRISEKY

SEQ ID NO: 3136311 - protein, 8 aa, Giardia lamblia
SEKVTGNA

SEQ ID NO: 3136312 - protein, 8 aa, Giardia lamblia
SEKYNQKS

SEQ ID NO: 3136313 - protein, 8 aa, Giardia lamblia
SELDQGGI

SEQ ID NO: 3136314 - protein, 15 aa, Giardia lamblia
SELDSAANKLGQDGK

SEQ ID NO: 3136315 - protein, 4 aa, Giardia lamblia
SELE

SEQ ID NO: 3136316 - protein, 12 aa, Giardia lamblia
SELEESKRTVSK

SEQ ID NO: 3136317 - protein, 5 aa, Giardia lamblia
SELER

SEQ ID NO: 3136318 - protein, 16 aa, Giardia lamblia
SELERPEGVRSTAPSH

SEQ ID NO: 3136319 - protein, 22 aa, Giardia lamblia
SELESKYQADSKELKSKYEAAQ

SEQ ID NO: 3136320 - protein, 11 aa, Giardia lamblia
SELESSKRLQD

SEQ ID NO: 3136321 - protein, 7 aa, Giardia lamblia
SELETEY

SEQ ID NO: 3136322 - protein, 13 aa, Giardia lamblia
SELGRQDKEGKTA

SEQ ID NO: 3136323 - protein, 6 aa, Giardia lamblia
SELGSG

SEQ ID NO: 3136324 - protein, 4 aa, Giardia lamblia
SELK

SEQ ID NO: 3136325 - protein, 9 aa, Giardia lamblia
SELKKRGVG

SEQ ID NO: 3136326 - protein, 17 aa, Giardia lamblia
SELKSAQEKYLSRDREY

SEQ ID NO: 3136327 - protein, 6 aa, Giardia lamblia
SELKST

SEQ ID NO: 3136328 - protein, 10 aa, Giardia lamblia
SELNGSTSSI

SEQ ID NO: 3136329 - protein, 24 aa, Giardia lamblia
SELNSPSKQKSSNYLRGTADESYV

SEQ ID NO: 3136330 - protein, 17 aa, Giardia lamblia
SELPGTSVSRSRTTSQL

SEQ ID NO: 3136331 - protein, 18 aa, Giardia lamblia
SELPSQNSQITGGQSSTI

SEQ ID NO: 3136332 - protein, 9 aa, Giardia lamblia
SELQGTLTE

SEQ ID NO: 3136333 - protein, 7 aa, Giardia lamblia
SELQSRD

SEQ ID NO: 3136334 - protein, 12 aa, Giardia lamblia
SELRKKEANLRE

SEQ ID NO: 3136335 - protein, 5 aa, Giardia lamblia
SELSD

SEQ ID NO: 3136336 - protein, 17 aa, Giardia lamblia
SELSRSSVSRAPYQSTH

SEQ ID NO: 3136337 - protein, 18 aa, Giardia lamblia
SELSSTSYLSDKNATDLK

SEQ ID NO: 3136338 - protein, 6 aa, Giardia lamblia
SEMGGG

SEQ ID NO: 3136339 - protein, 13 aa, Giardia lamblia
SEMNRADSQTNLS

SEQ ID NO: 3136340 - protein, 12 aa, Giardia lamblia
SENAMDTDRPIA

SEQ ID NO: 3136341 - protein, 10 aa, Giardia lamblia
SENCDESRVP

SEQ ID NO: 3136342 - protein, 17 aa, Giardia lamblia
SENDKLRTVGEQREAQL

SEQ ID NO: 3136343 - protein, 8 aa, Giardia lamblia
SENDPNAK

SEQ ID NO: 3136344 - protein, 49 aa, Giardia lamblia
SENEADGAVAETTTETSHAADSKALSSTAKPRSSAGGDRQGGATGKKGQ

SEQ ID NO: 3136345 - protein, 6 aa, Giardia lamblia
SENEAR

SEQ ID NO: 3136346 - protein, 4 aa, Giardia lamblia
SENG

SEQ ID NO: 3136347 - protein, 5 aa, Giardia lamblia
SENGR

SEQ ID NO: 3136348 - protein, 20 aa, Giardia lamblia
SENISQESVSTQQPNNQLPP

SEQ ID NO: 3136349 - protein, 9 aa, Giardia lamblia
SENLNGSDV

SEQ ID NO: 3136350 - protein, 9 aa, Giardia lamblia
SENNTFTAD

SEQ ID NO: 3136351 - protein, 6 aa, Giardia lamblia
SENPSA

SEQ ID NO: 3136352 - protein, 8 aa, Giardia lamblia
SENRAQKE

SEQ ID NO: 3136353 - protein, 39 aa, Giardia lamblia
SENRGFRGKKVNQQRTQANPESSATGPLTSDDLSSITTS

SEQ ID NO: 3136354 - protein, 8 aa, Giardia lamblia
SENRKAVA

SEQ ID NO: 3136355 - protein, 13 aa, Giardia lamblia
SENRTTTDDQVSR

SEQ ID NO: 3136356 - protein, 12 aa, Giardia lamblia
SENSLHPDELEP

SEQ ID NO: 3136357 - protein, 8 aa, Giardia lamblia
SENSSTIR

SEQ ID NO: 3136358 - protein, 11 aa, Giardia lamblia
SENSTGLSQQD

SEQ ID NO: 3136359 - protein, 7 aa, Giardia lamblia
SENTAQL

SEQ ID NO: 3136360 - protein, 5 aa, Giardia lamblia
SENTD

SEQ ID NO: 3136361 - protein, 12 aa, Giardia lamblia
SENYPKLRGGSA

SEQ ID NO: 3136362 - protein, 26 aa, Giardia lamblia
SEPASSGQIGSKEEAFNGADCEQRAL

SEQ ID NO: 3136363 - protein, 6 aa, Giardia lamblia
SEPATG

SEQ ID NO: 3136364 - protein, 9 aa, Giardia lamblia
SEPEQGAAL

SEQ ID NO: 3136365 - protein, 20 aa, Giardia lamblia
SEPGAAQSDNSEQSREQERS

SEQ ID NO: 3136366 - protein, 7 aa, Giardia lamblia
SEPGQEA

SEQ ID NO: 3136367 - protein, 12 aa, Giardia lamblia
SEPNSQKSRNGR

SEQ ID NO: 3136368 - protein, 6 aa, Giardia lamblia
SEPPLK

SEQ ID NO: 3136369 - protein, 14 aa, Giardia lamblia
SEPPPIKSADTKDL

SEQ ID NO: 3136370 - protein, 10 aa, Giardia lamblia
SEPPSHLGPE

SEQ ID NO: 3136371 - protein, 10 aa, Giardia lamblia
SEPREATPLA

SEQ ID NO: 3136372 - protein, 8 aa, Giardia lamblia
SEPSLTNR

SEQ ID NO: 3136373 - protein, 14 aa, Giardia lamblia
SEPTGPLTLSPQTS

SEQ ID NO: 3136374 - protein, 14 aa, Giardia lamblia
SEPTRGSERPGNDI

SEQ ID NO: 3136375 - protein, 7 aa, Giardia lamblia
SEPTVPD

SEQ ID NO: 3136376 - protein, 4 aa, Giardia lamblia
SEPV

SEQ ID NO: 3136377 - protein, 8 aa, Giardia lamblia
SEQDRDIG

SEQ ID NO: 3136378 - protein, 4 aa, Giardia lamblia
SEQE

SEQ ID NO: 3136379 - protein, 13 aa, Giardia lamblia
SEQEKAKKALQTL

SEQ ID NO: 3136380 - protein, 8 aa, Giardia lamblia
SEQEPGVE

SEQ ID NO: 3136381 - protein, 5 aa, Giardia lamblia
SEQEQ

SEQ ID NO: 3136382 - protein, 9 aa, Giardia lamblia
SEQGIDPDE

SEQ ID NO: 3136383 - protein, 9 aa, Giardia lamblia
SEQGRSNLQ

SEQ ID NO: 3136384 - protein, 6 aa, Giardia lamblia
SEQGYN

SEQ ID NO: 3136385 - protein, 4 aa, Giardia lamblia
SEQI

SEQ ID NO: 3136386 - protein, 17 aa, Giardia lamblia
SEQISTAGAEASGTGNM

SEQ ID NO: 3136387 - protein, 14 aa, Giardia lamblia
SEQKERRLSEAEEK

SEQ ID NO: 3136388 - protein, 9 aa, Giardia lamblia
SEQKSDDAF

SEQ ID NO: 3136389 - protein, 6 aa, Giardia lamblia
SEQKVH

SEQ ID NO: 3136390 - protein, 30 aa, Giardia lamblia
SEQLPGSLHQSPGSLNAPSTTLTASEISNV

SEQ ID NO: 3136391 - protein, 8 aa, Giardia lamblia
SEQLRRAK

SEQ ID NO: 3136392 - protein, 6 aa, Giardia lamblia
SEQLSH

SEQ ID NO: 3136393 - protein, 9 aa, Giardia lamblia
SEQLSSQDH

SEQ ID NO: 3136394 - protein, 11 aa, Giardia lamblia
SEQNHRDINGK

SEQ ID NO: 3136395 - protein, 6 aa, Giardia lamblia
SEQNKE

SEQ ID NO: 3136396 - protein, 12 aa, Giardia lamblia
SEQNSTTEDVDH

SEQ ID NO: 3136397 - protein, 4 aa, Giardia lamblia
SEQP

SEQ ID NO: 3136398 - protein, 7 aa, Giardia lamblia
SEQPSVF

SEQ ID NO: 3136399 - protein, 10 aa, Giardia lamblia
SEQQGPAAVG

SEQ ID NO: 3136400 - protein, 11 aa, Giardia lamblia
SEQQSRYPGWP

SEQ ID NO: 3136401 - protein, 7 aa, Giardia lamblia
SEQRQTE

SEQ ID NO: 3136402 - protein, 5 aa, Giardia lamblia
SEQSD

SEQ ID NO: 3136403 - protein, 15 aa, Giardia lamblia
SERAQSDQREQAQAQ

SEQ ID NO: 3136404 - protein, 9 aa, Giardia lamblia
SERDERSDS

SEQ ID NO: 3136405 - protein, 5 aa, Giardia lamblia
SERDF

SEQ ID NO: 3136406 - protein, 7 aa, Giardia lamblia
SERDKLN

SEQ ID NO: 3136407 - protein, 11 aa, Giardia lamblia
SERDPNADTGV

SEQ ID NO: 3136408 - protein, 5 aa, Giardia lamblia
SEREA

SEQ ID NO: 3136409 - protein, 7 aa, Giardia lamblia
SERELST

SEQ ID NO: 3136410 - protein, 7 aa, Giardia lamblia
SERGEYR

SEQ ID NO: 3136411 - protein, 9 aa, Giardia lamblia
SERKKTDLT

SEQ ID NO: 3136412 - protein, 10 aa, Giardia lamblia
SERLSTTQKI

SEQ ID NO: 3136413 - protein, 6 aa, Giardia lamblia
SERLTA

SEQ ID NO: 3136414 - protein, 7 aa, Giardia lamblia
SERMRGT

SEQ ID NO: 3136415 - protein, 12 aa, Giardia lamblia
SERNALKEENEA

SEQ ID NO: 3136416 - protein, 5 aa, Giardia lamblia
SERPF

SEQ ID NO: 3136417 - protein, 15 aa, Giardia lamblia
SERPSDGGGCMQDGP

SEQ ID NO: 3136418 - protein, 10 aa, Giardia lamblia
SERPSGVAER

SEQ ID NO: 3136419 - protein, 6 aa, Giardia lamblia
SERQQP

SEQ ID NO: 3136420 - protein, 4 aa, Giardia lamblia
SERR

SEQ ID NO: 3136421 - protein, 5 aa, Giardia lamblia
SERRR

SEQ ID NO: 3136422 - protein, 4 aa, Giardia lamblia
SERT

SEQ ID NO: 3136423 - protein, 7 aa, Giardia lamblia
SERTTIT

SEQ ID NO: 3136424 - protein, 8 aa, Giardia lamblia
SERVEGQV

SEQ ID NO: 3136425 - protein, 8 aa, Giardia lamblia
SESAAGTV

SEQ ID NO: 3136426 - protein, 11 aa, Giardia lamblia
SESAMTDSSSM

SEQ ID NO: 3136427 - protein, 5 aa, Giardia lamblia
SESAR

SEQ ID NO: 3136428 - protein, 6 aa, Giardia lamblia
SESARK

SEQ ID NO: 3136429 - protein, 7 aa, Giardia lamblia
SESARSR

SEQ ID NO: 3136430 - protein, 4 aa, Giardia lamblia
SESD

SEQ ID NO: 3136431 - protein, 12 aa, Giardia lamblia
SESDGPTEDAAD

SEQ ID NO: 3136432 - protein, 5 aa, Giardia lamblia
SESEQ

SEQ ID NO: 3136433 - protein, 9 aa, Giardia lamblia
SESERSKRA

SEQ ID NO: 3136434 - protein, 8 aa, Giardia lamblia
SESGDRST

SEQ ID NO: 3136435 - protein, 6 aa, Giardia lamblia
SESGIE

SEQ ID NO: 3136436 - protein, 9 aa, Giardia lamblia
SESGMFDSN

SEQ ID NO: 3136437 - protein, 6 aa, Giardia lamblia
SESGSH

SEQ ID NO: 3136438 - protein, 34 aa, Giardia lamblia
SESHDQPPTHIKQSTDARAAKGRQVAKPSGTGSI

SEQ ID NO: 3136439 - protein, 19 aa, Giardia lamblia
SESIAKEKQTCLDRNSRDE

SEQ ID NO: 3136440 - protein, 13 aa, Giardia lamblia
SESISAEPAPLTK

SEQ ID NO: 3136441 - protein, 9 aa, Giardia lamblia
SESKASLVT

SEQ ID NO: 3136442 - protein, 4 aa, Giardia lamblia
SESL

SEQ ID NO: 3136443 - protein, 5 aa, Giardia lamblia
SESLA

SEQ ID NO: 3136444 - protein, 7 aa, Giardia lamblia
SESLSSQ

SEQ ID NO: 3136445 - protein, 15 aa, Giardia lamblia
SESNGNDPQSEESYE

SEQ ID NO: 3136446 - protein, 14 aa, Giardia lamblia
SESNQNRYSTSRFT

SEQ ID NO: 3136447 - protein, 5 aa, Giardia lamblia
SESNS

SEQ ID NO: 3136448 - protein, 27 aa, Giardia lamblia
SESPDRIPSAVQSGESAFDTTKPNNNL

SEQ ID NO: 3136449 - protein, 10 aa, Giardia lamblia
SESRNPYFQP

SEQ ID NO: 3136450 - protein, 7 aa, Giardia lamblia
SESRRIK

SEQ ID NO: 3136451 - protein, 6 aa, Giardia lamblia
SESRSY

SEQ ID NO: 3136452 - protein, 15 aa, Giardia lamblia
SESSTATPSSEPSVL

SEQ ID NO: 3136453 - protein, 8 aa, Giardia lamblia
SESSTIEQ

SEQ ID NO: 3136454 - protein, 8 aa, Giardia lamblia
SESSVSPH

SEQ ID NO: 3136455 - protein, 11 aa, Giardia lamblia
SESTETGDEND

SEQ ID NO: 3136456 - protein, 14 aa, Giardia lamblia
SESTLCGGDDETPL

SEQ ID NO: 3136457 - protein, 13 aa, Giardia lamblia
SESVQKQQLASSA

SEQ ID NO: 3136458 - protein, 14 aa, Giardia lamblia
SESYQGKDTEFSRQ

SEQ ID NO: 3136459 - protein, 4 aa, Giardia lamblia
SETA

SEQ ID NO: 3136460 - protein, 25 aa, Giardia lamblia
SETAVTRSDTHRKKETGDSASYVSS

SEQ ID NO: 3136461 - protein, 9 aa, Giardia lamblia
SETDASFTQ

SEQ ID NO: 3136462 - protein, 6 aa, Giardia lamblia
SETDTV

SEQ ID NO: 3136463 - protein, 7 aa, Giardia lamblia
SETEEVN

SEQ ID NO: 3136464 - protein, 5 aa, Giardia lamblia
SETEI

SEQ ID NO: 3136465 - protein, 17 aa, Giardia lamblia
SETEPSQDERSASPPAG

SEQ ID NO: 3136466 - protein, 6 aa, Giardia lamblia
SETEQD

SEQ ID NO: 3136467 - protein, 7 aa, Giardia lamblia
SETESST

SEQ ID NO: 3136468 - protein, 7 aa, Giardia lamblia
SETETQA

SEQ ID NO: 3136469 - protein, 10 aa, Giardia lamblia
SETGDANGDI

SEQ ID NO: 3136470 - protein, 19 aa, Giardia lamblia
SETGEKTELAGSLKNQQET

SEQ ID NO: 3136471 - protein, 5 aa, Giardia lamblia
SETGK

SEQ ID NO: 3136472 - protein, 14 aa, Giardia lamblia
SETGSALSSSPQVQ

SEQ ID NO: 3136473 - protein, 5 aa, Giardia lamblia
SETHM

SEQ ID NO: 3136474 - protein, 11 aa, Giardia lamblia
SETIDSATAGK

SEQ ID NO: 3136475 - protein, 13 aa, Giardia lamblia
SETIKGRKENLES

SEQ ID NO: 3136476 - protein, 9 aa, Giardia lamblia
SETIPEEEA

SEQ ID NO: 3136477 - protein, 8 aa, Giardia lamblia
SETKLPES

SEQ ID NO: 3136478 - protein, 13 aa, Giardia lamblia
SETLGGDTTPKTP

SEQ ID NO: 3136479 - protein, 9 aa, Giardia lamblia
SETNQKLSE

SEQ ID NO: 3136480 - protein, 7 aa, Giardia lamblia
SETNRSD

SEQ ID NO: 3136481 - protein, 8 aa, Giardia lamblia
SETNRSRD

SEQ ID NO: 3136482 - protein, 12 aa, Giardia lamblia
SETNSDETVPEH

SEQ ID NO: 3136483 - protein, 13 aa, Giardia lamblia
SETNTEASSATQF

SEQ ID NO: 3136484 - protein, 7 aa, Giardia lamblia
SETPADM

SEQ ID NO: 3136485 - protein, 5 aa, Giardia lamblia
SETPE

SEQ ID NO: 3136486 - protein, 6 aa, Giardia lamblia
SETPIH

SEQ ID NO: 3136487 - protein, 10 aa, Giardia lamblia
SETPTEYSSR

SEQ ID NO: 3136488 - protein, 10 aa, Giardia lamblia
SETQGQTPSY

SEQ ID NO: 3136489 - protein, 14 aa, Giardia lamblia
SETSDGALQESITT

SEQ ID NO: 3136490 - protein, 5 aa, Giardia lamblia
SETSP

SEQ ID NO: 3136491 - protein, 18 aa, Giardia lamblia
SETSSAARVPEPQGKERE

SEQ ID NO: 3136492 - protein, 6 aa, Giardia lamblia
SETSSR

SEQ ID NO: 3136493 - protein, 4 aa, Giardia lamblia
SETY

SEQ ID NO: 3136494 - protein, 5 aa, Giardia lamblia
SETYE

SEQ ID NO: 3136495 - protein, 11 aa, Giardia lamblia
SEVAANDGKSV

SEQ ID NO: 3136496 - protein, 10 aa, Giardia lamblia
SEVDRDNAGL

SEQ ID NO: 3136497 - protein, 6 aa, Giardia lamblia
SEVEQQ

SEQ ID NO: 3136498 - protein, 7 aa, Giardia lamblia
SEVGTAP

SEQ ID NO: 3136499 - protein, 15 aa, Giardia lamblia
SEVPSGATSTRASRR

SEQ ID NO: 3136500 - protein, 5 aa, Giardia lamblia
SEVRR

SEQ ID NO: 3136501 - protein, 11 aa, Giardia lamblia
SEVSPSVPGEQ

SEQ ID NO: 3136502 - protein, 6 aa, Giardia lamblia
SEVSQR

SEQ ID NO: 3136503 - protein, 27 aa, Giardia lamblia
SEWADSRAPPPLKRDTPQCQVDPSTSL

SEQ ID NO: 3136504 - protein, 4 aa, Giardia lamblia
SEYA

SEQ ID NO: 3136505 - protein, 6 aa, Giardia lamblia
SEYDEK

SEQ ID NO: 3136506 - protein, 10 aa, Giardia lamblia
SEYPTGRTTL

SEQ ID NO: 3136507 - protein, 10 aa, Giardia lamblia
SEYPTKPPAV

SEQ ID NO: 3136508 - protein, 7 aa, Giardia lamblia
SEYQRAE

SEQ ID NO: 3136509 - protein, 10 aa, Giardia lamblia
SEYRSKDSPL

SEQ ID NO: 3136510 - protein, 10 aa, Giardia lamblia
SEYRTGTVDP

SEQ ID NO: 3136511 - protein, 8 aa, Giardia lamblia
SFADSKDV

SEQ ID NO: 3136512 - protein, 13 aa, Giardia lamblia
SFAESGSAEAQEA

SEQ ID NO: 3136513 - protein, 35 aa, Giardia lamblia
SFATRTTSKPSSFDISSGSAPLGPLTSETSKSTDI

SEQ ID NO: 3136514 - protein, 10 aa, Giardia lamblia
SFDDNDSSYV

SEQ ID NO: 3136515 - protein, 9 aa, Giardia lamblia
SFDNGSQTV

SEQ ID NO: 3136516 - protein, 23 aa, Giardia lamblia
SFDNYSTARKLKSAKTKEEQQKI

SEQ ID NO: 3136517 - protein, 5 aa, Giardia lamblia
SFDPT

SEQ ID NO: 3136518 - protein, 6 aa, Giardia lamblia
SFDSDS

SEQ ID NO: 3136519 - protein, 9 aa, Giardia lamblia
SFEKPTPPL

SEQ ID NO: 3136520 - protein, 5 aa, Giardia lamblia
SFEQA

SEQ ID NO: 3136521 - protein, 9 aa, Giardia lamblia
SFESGENRS

SEQ ID NO: 3136522 - protein, 13 aa, Giardia lamblia
SFGASGDSPGCGS

SEQ ID NO: 3136523 - protein, 4 aa, Giardia lamblia
SFGE

SEQ ID NO: 3136524 - protein, 6 aa, Giardia lamblia
SFGGGH

SEQ ID NO: 3136525 - protein, 12 aa, Giardia lamblia
SFGGSRAPDDFY

SEQ ID NO: 3136526 - protein, 5 aa, Giardia lamblia
SFGNA

SEQ ID NO: 3136527 - protein, 4 aa, Giardia lamblia
SFGP

SEQ ID NO: 3136528 - protein, 6 aa, Giardia lamblia
SFGRER

SEQ ID NO: 3136529 - protein, 5 aa, Giardia lamblia
SFGTS

SEQ ID NO: 3136530 - protein, 6 aa, Giardia lamblia
SFHPPD

SEQ ID NO: 3136531 - protein, 8 aa, Giardia lamblia
SFHTGSIS

SEQ ID NO: 3136532 - protein, 4 aa, Giardia lamblia
SFKE

SEQ ID NO: 3136533 - protein, 8 aa, Giardia lamblia
SFKEEQPV

SEQ ID NO: 3136534 - protein, 7 aa, Giardia lamblia
SFKGTPR

SEQ ID NO: 3136535 - protein, 17 aa, Giardia lamblia
SFKGTSSPLYKQRHDPS

SEQ ID NO: 3136536 - protein, 8 aa, Giardia lamblia
SFKKTGTT

SEQ ID NO: 3136537 - protein, 9 aa, Giardia lamblia
SFKPPPNVD

SEQ ID NO: 3136538 - protein, 5 aa, Giardia lamblia
SFKQE

SEQ ID NO: 3136539 - protein, 13 aa, Giardia lamblia
SFKSSKDRREGSL

SEQ ID NO: 3136540 - protein, 8 aa, Giardia lamblia
SFNDREQE

SEQ ID NO: 3136541 - protein, 4 aa, Giardia lamblia
SFNG

SEQ ID NO: 3136542 - protein, 7 aa, Giardia lamblia
SFNPGDP

SEQ ID NO: 3136543 - protein, 11 aa, Giardia lamblia
SFPASSPKNAF

SEQ ID NO: 3136544 - protein, 9 aa, Giardia lamblia
SFPDSFPEN

SEQ ID NO: 3136545 - protein, 5 aa, Giardia lamblia
SFPED

SEQ ID NO: 3136546 - protein, 4 aa, Giardia lamblia
SFPG

SEQ ID NO: 3136547 - protein, 7 aa, Giardia lamblia
SFPQPQS

SEQ ID NO: 3136548 - protein, 8 aa, Giardia lamblia
SFPSGSTA

SEQ ID NO: 3136549 - protein, 5 aa, Giardia lamblia
SFPST

SEQ ID NO: 3136550 - protein, 4 aa, Giardia lamblia
SFPV

SEQ ID NO: 3136551 - protein, 21 aa, Giardia lamblia
SFQGTPRKNQLAKEAASDSTI

SEQ ID NO: 3136552 - protein, 5 aa, Giardia lamblia
SFQPY

SEQ ID NO: 3136553 - protein, 8 aa, Giardia lamblia
SFQSPRLA

SEQ ID NO: 3136554 - protein, 11 aa, Giardia lamblia
SFRDRETGHTL

SEQ ID NO: 3136555 - protein, 7 aa, Giardia lamblia
SFRPASN

SEQ ID NO: 3136556 - protein, 14 aa, Giardia lamblia
SFRPATPRESSRNM

SEQ ID NO: 3136557 - protein, 8 aa, Giardia lamblia
SFRSESSL

SEQ ID NO: 3136558 - protein, 29 aa, Giardia lamblia
SFRTARANAPTGRSSLSGEKEQQEASTHS

SEQ ID NO: 3136559 - protein, 19 aa, Giardia lamblia
SFSAPSEQDPSSAQLPHSR

SEQ ID NO: 3136560 - protein, 4 aa, Giardia lamblia
SFSE

SEQ ID NO: 3136561 - protein, 27 aa, Giardia lamblia
SFSKPGFGAPPAPQPPSADPNVPPYND

SEQ ID NO: 3136562 - protein, 8 aa, Giardia lamblia
SFSNDSVD

SEQ ID NO: 3136563 - protein, 23 aa, Giardia lamblia
SFSPGKEEEATQPLKTRRTVSEK

SEQ ID NO: 3136564 - protein, 9 aa, Giardia lamblia
SFSRPNKTI

SEQ ID NO: 3136565 - protein, 103 aa, Giardia lamblia
SFSSSSSHQPTPRPQSPSSSSSSSSSSSSSSSSSSSSSSSSSSSSSSSSSSSSSSSSSSRSSSHSSSSHSTTDSEESSGSLSVPSPETSSSSSSSKSSPNEVI

SEQ ID NO: 3136566 - protein, 4 aa, Giardia lamblia
SFST

SEQ ID NO: 3136567 - protein, 7 aa, Giardia lamblia
SFSTNQQ

SEQ ID NO: 3136568 - protein, 14 aa, Giardia lamblia
SFSTTTNVSMSEGG

SEQ ID NO: 3136569 - protein, 4 aa, Giardia lamblia
SFTA

SEQ ID NO: 3136570 - protein, 14 aa, Giardia lamblia
SFTDPRLSTPVSSF

SEQ ID NO: 3136571 - protein, 15 aa, Giardia lamblia
SFTDQQSSESARETM

SEQ ID NO: 3136572 - protein, 11 aa, Giardia lamblia
SFTSTTEHGLQ

SEQ ID NO: 3136573 - protein, 14 aa, Giardia lamblia
SFTTASAADLADEV

SEQ ID NO: 3136574 - protein, 11 aa, Giardia lamblia
SFTTPTTPDAD

SEQ ID NO: 3136575 - protein, 15 aa, Giardia lamblia
SFYGSESSTSLDISP

SEQ ID NO: 3136576 - protein, 8 aa, Giardia lamblia
SGAATGVN

SEQ ID NO: 3136577 - protein, 4 aa, Giardia lamblia
SGAC

SEQ ID NO: 3136578 - protein, 10 aa, Giardia lamblia
SGADGTYEIN

SEQ ID NO: 3136579 - protein, 5 aa, Giardia lamblia
SGADM

SEQ ID NO: 3136580 - protein, 6 aa, Giardia lamblia
SGAFNS

SEQ ID NO: 3136581 - protein, 10 aa, Giardia lamblia
SGAGPPSKQI

SEQ ID NO: 3136582 - protein, 9 aa, Giardia lamblia
SGAGTASGF

SEQ ID NO: 3136583 - protein, 21 aa, Giardia lamblia
SGAIPRSISSGSAPAAGAGTC

SEQ ID NO: 3136584 - protein, 7 aa, Giardia lamblia
SGAKGLS

SEQ ID NO: 3136585 - protein, 10 aa, Giardia lamblia
SGAKKTLGPK

SEQ ID NO: 3136586 - protein, 6 aa, Giardia lamblia
SGAKTS

SEQ ID NO: 3136587 - protein, 5 aa, Giardia lamblia
SGALS

SEQ ID NO: 3136588 - protein, 4 aa, Giardia lamblia
SGAN

SEQ ID NO: 3136589 - protein, 7 aa, Giardia lamblia
SGANSDD

SEQ ID NO: 3136590 - protein, 10 aa, Giardia lamblia
SGANSSQNEG

SEQ ID NO: 3136591 - protein, 7 aa, Giardia lamblia
SGANTDF

SEQ ID NO: 3136592 - protein, 6 aa, Giardia lamblia
SGAPAT

SEQ ID NO: 3136593 - protein, 5 aa, Giardia lamblia
SGAPG

SEQ ID NO: 3136594 - protein, 8 aa, Giardia lamblia
SGAPTGNA

SEQ ID NO: 3136595 - protein, 6 aa, Giardia lamblia
SGAPTL

SEQ ID NO: 3136596 - protein, 4 aa, Giardia lamblia
SGAQ

SEQ ID NO: 3136597 - protein, 6 aa, Giardia lamblia
SGAQEE

SEQ ID NO: 3136598 - protein, 17 aa, Giardia lamblia
SGAQGSRPASAAAGTLG

SEQ ID NO: 3136599 - protein, 7 aa, Giardia lamblia
SGAQLSS

SEQ ID NO: 3136600 - protein, 5 aa, Giardia lamblia
SGAQS

SEQ ID NO: 3136601 - protein, 15 aa, Giardia lamblia
SGARHSFGAGENHQS

SEQ ID NO: 3136602 - protein, 5 aa, Giardia lamblia
SGASM

SEQ ID NO: 3136603 - protein, 8 aa, Giardia lamblia
SGASVTSA

SEQ ID NO: 3136604 - protein, 8 aa, Giardia lamblia
SGATDAAE

SEQ ID NO: 3136605 - protein, 9 aa, Giardia lamblia
SGATDGEGR

SEQ ID NO: 3136606 - protein, 7 aa, Giardia lamblia
SGATEVP

SEQ ID NO: 3136607 - protein, 7 aa, Giardia lamblia
SGATPQK

SEQ ID NO: 3136608 - protein, 7 aa, Giardia lamblia
SGAVTTH

SEQ ID NO: 3136609 - protein, 8 aa, Giardia lamblia
SGCANREE

SEQ ID NO: 3136610 - protein, 18 aa, Giardia lamblia
SGCDDNSVSSPSGWSFGG

SEQ ID NO: 3136611 - protein, 7 aa, Giardia lamblia
SGCEDAD

SEQ ID NO: 3136612 - protein, 7 aa, Giardia lamblia
SGCPDTI

SEQ ID NO: 3136613 - protein, 32 aa, Giardia lamblia
SGCRSTSSAEKTESVQKQVEKEEVSAKDRTDT

SEQ ID NO: 3136614 - protein, 6 aa, Giardia lamblia
SGCTES

SEQ ID NO: 3136615 - protein, 5 aa, Giardia lamblia
SGCYD

SEQ ID NO: 3136616 - protein, 4 aa, Giardia lamblia
SGDA

SEQ ID NO: 3136617 - protein, 11 aa, Giardia lamblia
SGDAAERSIPE

SEQ ID NO: 3136618 - protein, 8 aa, Giardia lamblia
SGDAAGAA

SEQ ID NO: 3136619 - protein, 5 aa, Giardia lamblia
SGDCD

SEQ ID NO: 3136620 - protein, 4 aa, Giardia lamblia
SGDD

SEQ ID NO: 3136621 - protein, 4 aa, Giardia lamblia
SGDG

SEQ ID NO: 3136622 - protein, 8 aa, Giardia lamblia
SGDGLPED

SEQ ID NO: 3136623 - protein, 9 aa, Giardia lamblia
SGDHTSNLG

SEQ ID NO: 3136624 - protein, 4 aa, Giardia lamblia
SGDI

SEQ ID NO: 3136625 - protein, 5 aa, Giardia lamblia
SGDIK

SEQ ID NO: 3136626 - protein, 4 aa, Giardia lamblia
SGDK

SEQ ID NO: 3136627 - protein, 7 aa, Giardia lamblia
SGDKRLA

SEQ ID NO: 3136628 - protein, 9 aa, Giardia lamblia
SGDKTVPYS

SEQ ID NO: 3136629 - protein, 6 aa, Giardia lamblia
SGDNLS

SEQ ID NO: 3136630 - protein, 6 aa, Giardia lamblia
SGDPAY

SEQ ID NO: 3136631 - protein, 10 aa, Giardia lamblia
SGDPKDISAH

SEQ ID NO: 3136632 - protein, 6 aa, Giardia lamblia
SGDQPL

SEQ ID NO: 3136633 - protein, 9 aa, Giardia lamblia
SGDQTDYEA

SEQ ID NO: 3136634 - protein, 8 aa, Giardia lamblia
SGDREAAG

SEQ ID NO: 3136635 - protein, 12 aa, Giardia lamblia
SGDRQVNTAGRT

SEQ ID NO: 3136636 - protein, 7 aa, Giardia lamblia
SGDRRGE

SEQ ID NO: 3136637 - protein, 12 aa, Giardia lamblia
SGDSAFPPNQPV

SEQ ID NO: 3136638 - protein, 11 aa, Giardia lamblia
SGDSTKAAEIE

SEQ ID NO: 3136639 - protein, 4 aa, Giardia lamblia
SGDT

SEQ ID NO: 3136640 - protein, 15 aa, Giardia lamblia
SGDTSSQEQTGVPEQ

SEQ ID NO: 3136641 - protein, 7 aa, Giardia lamblia
SGDTTDA

SEQ ID NO: 3136642 - protein, 7 aa, Giardia lamblia
SGDVAET

SEQ ID NO: 3136643 - protein, 13 aa, Giardia lamblia
SGDVDSFLTKLDE

SEQ ID NO: 3136644 - protein, 7 aa, Giardia lamblia
SGDVDSV

SEQ ID NO: 3136645 - protein, 6 aa, Giardia lamblia
SGDVET

SEQ ID NO: 3136646 - protein, 9 aa, Giardia lamblia
SGEATRKIK

SEQ ID NO: 3136647 - protein, 4 aa, Giardia lamblia
SGED

SEQ ID NO: 3136648 - protein, 9 aa, Giardia lamblia
SGEDLQKNA

SEQ ID NO: 3136649 - protein, 7 aa, Giardia lamblia
SGEDPDV

SEQ ID NO: 3136650 - protein, 8 aa, Giardia lamblia
SGEEGSDQ

SEQ ID NO: 3136651 - protein, 10 aa, Giardia lamblia
SGEENYQKEL

SEQ ID NO: 3136652 - protein, 7 aa, Giardia lamblia
SGEERTC

SEQ ID NO: 3136653 - protein, 9 aa, Giardia lamblia
SGEGVQPQE

SEQ ID NO: 3136654 - protein, 63 aa, Giardia lamblia
SGEHREKSGSLRATSNSTRFGTAPRSQTISSRSGTARISSARSPVKTSKSPRATRSSDANSSM

SEQ ID NO: 3136655 - protein, 14 aa, Giardia lamblia
SGEINEKTLSDDIS

SEQ ID NO: 3136656 - protein, 7 aa, Giardia lamblia
SGEKTAS

SEQ ID NO: 3136657 - protein, 4 aa, Giardia lamblia
SGEL

SEQ ID NO: 3136658 - protein, 6 aa, Giardia lamblia
SGELER

SEQ ID NO: 3136659 - protein, 5 aa, Giardia lamblia
SGELP

SEQ ID NO: 3136660 - protein, 8 aa, Giardia lamblia
SGELTEKT

SEQ ID NO: 3136661 - protein, 6 aa, Giardia lamblia
SGEPSF

SEQ ID NO: 3136662 - protein, 6 aa, Giardia lamblia
SGEQAS

SEQ ID NO: 3136663 - protein, 5 aa, Giardia lamblia
SGETA

SEQ ID NO: 3136664 - protein, 28 aa, Giardia lamblia
SGETKAGGLATSLTQPSESSESDESSDV

SEQ ID NO: 3136665 - protein, 7 aa, Giardia lamblia
SGETSDR

SEQ ID NO: 3136666 - protein, 9 aa, Giardia lamblia
SGETVDPHD

SEQ ID NO: 3136667 - protein, 4 aa, Giardia lamblia
SGEV

SEQ ID NO: 3136668 - protein, 9 aa, Giardia lamblia
SGEYRDSDG

SEQ ID NO: 3136669 - protein, 4 aa, Giardia lamblia
SGFE

SEQ ID NO: 3136670 - protein, 6 aa, Giardia lamblia
SGFESP

SEQ ID NO: 3136671 - protein, 7 aa, Giardia lamblia
SGFGPGS

SEQ ID NO: 3136672 - protein, 14 aa, Giardia lamblia
SGFGQSPNSTAPMS

SEQ ID NO: 3136673 - protein, 18 aa, Giardia lamblia
SGFSPASNTGSATTSAVP

SEQ ID NO: 3136674 - protein, 14 aa, Giardia lamblia
SGFSTVPPGPYPVG

SEQ ID NO: 3136675 - protein, 5 aa, Giardia lamblia
SGFTA

SEQ ID NO: 3136676 - protein, 8 aa, Giardia lamblia
SGFTPTPQ

SEQ ID NO: 3136677 - protein, 11 aa, Giardia lamblia
SGGAAQQTSRV

SEQ ID NO: 3136678 - protein, 12 aa, Giardia lamblia
SGGATVKNPWGL

SEQ ID NO: 3136679 - protein, 6 aa, Giardia lamblia
SGGDGI

SEQ ID NO: 3136680 - protein, 6 aa, Giardia lamblia
SGGDSG

SEQ ID NO: 3136681 - protein, 7 aa, Giardia lamblia
SGGEEGA

SEQ ID NO: 3136682 - protein, 7 aa, Giardia lamblia
SGGEGTI

SEQ ID NO: 3136683 - protein, 4 aa, Giardia lamblia
SGGF

SEQ ID NO: 3136684 - protein, 12 aa, Giardia lamblia
SGGGQEGGIRSG

SEQ ID NO: 3136685 - protein, 6 aa, Giardia lamblia
SGGGRM

SEQ ID NO: 3136686 - protein, 14 aa, Giardia lamblia
SGGIINPPQQPEEL

SEQ ID NO: 3136687 - protein, 10 aa, Giardia lamblia
SGGIRYDENT

SEQ ID NO: 3136688 - protein, 7 aa, Giardia lamblia
SGGKASA

SEQ ID NO: 3136689 - protein, 5 aa, Giardia lamblia
SGGKD

SEQ ID NO: 3136690 - protein, 16 aa, Giardia lamblia
SGGKMSKNPAKIRKWR

SEQ ID NO: 3136691 - protein, 4 aa, Giardia lamblia
SGGM

SEQ ID NO: 3136692 - protein, 9 aa, Giardia lamblia
SGGNASNCG

SEQ ID NO: 3136693 - protein, 6 aa, Giardia lamblia
SGGNDY

SEQ ID NO: 3136694 - protein, 6 aa, Giardia lamblia
SGGNTQ

SEQ ID NO: 3136695 - protein, 11 aa, Giardia lamblia
SGGPAQAMKQN

SEQ ID NO: 3136696 - protein, 7 aa, Giardia lamblia
SGGPHGA

SEQ ID NO: 3136697 - protein, 10 aa, Giardia lamblia
SGGQLGDVGS

SEQ ID NO: 3136698 - protein, 11 aa, Giardia lamblia
SGGRDTEEEHR

SEQ ID NO: 3136699 - protein, 12 aa, Giardia lamblia
SGGSAHNAIPGS

SEQ ID NO: 3136700 - protein, 13 aa, Giardia lamblia
SGGSEYAEGLLTC

SEQ ID NO: 3136701 - protein, 9 aa, Giardia lamblia
SGGSGRSSM

SEQ ID NO: 3136702 - protein, 30 aa, Giardia lamblia
SGGSSIKAQSTTDMQAGKMDTKQASAGATL

SEQ ID NO: 3136703 - protein, 6 aa, Giardia lamblia
SGGVRM

SEQ ID NO: 3136704 - protein, 4 aa, Giardia lamblia
SGGY

SEQ ID NO: 3136705 - protein, 5 aa, Giardia lamblia
SGHAD

SEQ ID NO: 3136706 - protein, 17 aa, Giardia lamblia
SGHDDGPLGNDKPSPLM

SEQ ID NO: 3136707 - protein, 6 aa, Giardia lamblia
SGHDPR

SEQ ID NO: 3136708 - protein, 4 aa, Giardia lamblia
SGHE

SEQ ID NO: 3136709 - protein, 8 aa, Giardia lamblia
SGHHESGA

SEQ ID NO: 3136710 - protein, 7 aa, Giardia lamblia
SGHHITE

SEQ ID NO: 3136711 - protein, 7 aa, Giardia lamblia
SGHIQSY

SEQ ID NO: 3136712 - protein, 6 aa, Giardia lamblia
SGHPTE

SEQ ID NO: 3136713 - protein, 7 aa, Giardia lamblia
SGHQSGA

SEQ ID NO: 3136714 - protein, 4 aa, Giardia lamblia
SGHR

SEQ ID NO: 3136715 - protein, 13 aa, Giardia lamblia
SGHRANVGNSPTL

SEQ ID NO: 3136716 - protein, 9 aa, Giardia lamblia
SGHRDNNHN

SEQ ID NO: 3136717 - protein, 10 aa, Giardia lamblia
SGHSASNNSK

SEQ ID NO: 3136718 - protein, 5 aa, Giardia lamblia
SGHTD

SEQ ID NO: 3136719 - protein, 6 aa, Giardia lamblia
SGHTDF

SEQ ID NO: 3136720 - protein, 5 aa, Giardia lamblia
SGHTG

SEQ ID NO: 3136721 - protein, 6 aa, Giardia lamblia
SGHTVG

SEQ ID NO: 3136722 - protein, 13 aa, Giardia lamblia
SGIARAPSMNTHP

SEQ ID NO: 3136723 - protein, 11 aa, Giardia lamblia
SGIGKVAAAST

SEQ ID NO: 3136724 - protein, 6 aa, Giardia lamblia
SGINPR

SEQ ID NO: 3136725 - protein, 23 aa, Giardia lamblia
SGINSNPGPGAYDPNLSKTAPAF

SEQ ID NO: 3136726 - protein, 9 aa, Giardia lamblia
SGIPPGSAI

SEQ ID NO: 3136727 - protein, 4 aa, Giardia lamblia
SGIQ

SEQ ID NO: 3136728 - protein, 12 aa, Giardia lamblia
SGIRSPRKMESE

SEQ ID NO: 3136729 - protein, 4 aa, Giardia lamblia
SGIS

SEQ ID NO: 3136730 - protein, 17 aa, Giardia lamblia
SGISPPKVSEESGENKD

SEQ ID NO: 3136731 - protein, 4 aa, Giardia lamblia
SGIT

SEQ ID NO: 3136732 - protein, 10 aa, Giardia lamblia
SGITDTQGRT

SEQ ID NO: 3136733 - protein, 44 aa, Giardia lamblia
SGITSTDRQLTASSTTKRKTPVSVPTSSETQRQIEQPSDASDID

SEQ ID NO: 3136734 - protein, 8 aa, Giardia lamblia
SGITTDTG

SEQ ID NO: 3136735 - protein, 8 aa, Giardia lamblia
SGKAATSI

SEQ ID NO: 3136736 - protein, 9 aa, Giardia lamblia
SGKAQELGI

SEQ ID NO: 3136737 - protein, 25 aa, Giardia lamblia
SGKDEEEEDDAGKKRDTGKGGSERQ

SEQ ID NO: 3136738 - protein, 8 aa, Giardia lamblia
SGKEEADK

SEQ ID NO: 3136739 - protein, 20 aa, Giardia lamblia
SGKFDAQNAPSAAADPHSSR

SEQ ID NO: 3136740 - protein, 5 aa, Giardia lamblia
SGKGT

SEQ ID NO: 3136741 - protein, 7 aa, Giardia lamblia
SGKHISD

SEQ ID NO: 3136742 - protein, 18 aa, Giardia lamblia
SGKIPGGYSKYEKLGSAA

SEQ ID NO: 3136743 - protein, 6 aa, Giardia lamblia
SGKIPI

SEQ ID NO: 3136744 - protein, 9 aa, Giardia lamblia
SGKKADEDA

SEQ ID NO: 3136745 - protein, 10 aa, Giardia lamblia
SGKKDPDPGY

SEQ ID NO: 3136746 - protein, 8 aa, Giardia lamblia
SGKKEEEP

SEQ ID NO: 3136747 - protein, 10 aa, Giardia lamblia
SGKKNAEHPC

SEQ ID NO: 3136748 - protein, 8 aa, Giardia lamblia
SGKNGSVT

SEQ ID NO: 3136749 - protein, 11 aa, Giardia lamblia
SGKNKEIVSDE

SEQ ID NO: 3136750 - protein, 7 aa, Giardia lamblia
SGKPDDL

SEQ ID NO: 3136751 - protein, 5 aa, Giardia lamblia
SGKPV

SEQ ID NO: 3136752 - protein, 9 aa, Giardia lamblia
SGKQDRDGM

SEQ ID NO: 3136753 - protein, 6 aa, Giardia lamblia
SGKQET

SEQ ID NO: 3136754 - protein, 9 aa, Giardia lamblia
SGKQNRDGW

SEQ ID NO: 3136755 - protein, 7 aa, Giardia lamblia
SGKQTDR

SEQ ID NO: 3136756 - protein, 8 aa, Giardia lamblia
SGKRRRKQ

SEQ ID NO: 3136757 - protein, 4 aa, Giardia lamblia
SGKS

SEQ ID NO: 3136758 - protein, 12 aa, Giardia lamblia
SGKSNGGAYKYK

SEQ ID NO: 3136759 - protein, 6 aa, Giardia lamblia
SGKSTI

SEQ ID NO: 3136760 - protein, 11 aa, Giardia lamblia
SGKSTTNASSC

SEQ ID NO: 3136761 - protein, 16 aa, Giardia lamblia
SGKSYTVEGSQSDSAL

SEQ ID NO: 3136762 - protein, 4 aa, Giardia lamblia
SGKT

SEQ ID NO: 3136763 - protein, 5 aa, Giardia lamblia
SGKTA

SEQ ID NO: 3136764 - protein, 6 aa, Giardia lamblia
SGKTEC

SEQ ID NO: 3136765 - protein, 5 aa, Giardia lamblia
SGKVG

SEQ ID NO: 3136766 - protein, 15 aa, Giardia lamblia
SGKYKKAAAKYDKGT

SEQ ID NO: 3136767 - protein, 6 aa, Giardia lamblia
SGKYSS

SEQ ID NO: 3136768 - protein, 9 aa, Giardia lamblia
SGLADESDA

SEQ ID NO: 3136769 - protein, 10 aa, Giardia lamblia
SGLDAPATLY

SEQ ID NO: 3136770 - protein, 14 aa, Giardia lamblia
SGLESSKLKNDRVS

SEQ ID NO: 3136771 - protein, 9 aa, Giardia lamblia
SGLETKEGD

SEQ ID NO: 3136772 - protein, 16 aa, Giardia lamblia
SGLGDSLRASAAGNSF

SEQ ID NO: 3136773 - protein, 23 aa, Giardia lamblia
SGLMSDPSLADTESTIYAGPHGN

SEQ ID NO: 3136774 - protein, 4 aa, Giardia lamblia
SGLN

SEQ ID NO: 3136775 - protein, 10 aa, Giardia lamblia
SGLNTSNTSL

SEQ ID NO: 3136776 - protein, 26 aa, Giardia lamblia
SGLPTRKEESQYKSFSSPSKTEETKD

SEQ ID NO: 3136777 - protein, 10 aa, Giardia lamblia
SGLQDATGRS

SEQ ID NO: 3136778 - protein, 7 aa, Giardia lamblia
SGLQGTG

SEQ ID NO: 3136779 - protein, 19 aa, Giardia lamblia
SGLREHEGTINPHSEEGVE

SEQ ID NO: 3136780 - protein, 14 aa, Giardia lamblia
SGLRERSVSRQLNR

SEQ ID NO: 3136781 - protein, 9 aa, Giardia lamblia
SGLSDNTGV

SEQ ID NO: 3136782 - protein, 9 aa, Giardia lamblia
SGLSGPGGV

SEQ ID NO: 3136783 - protein, 8 aa, Giardia lamblia
SGLTGPPS

SEQ ID NO: 3136784 - protein, 6 aa, Giardia lamblia
SGLTNG

SEQ ID NO: 3136785 - protein, 7 aa, Giardia lamblia
SGLTNSQ

SEQ ID NO: 3136786 - protein, 10 aa, Giardia lamblia
SGMDPETYRP

SEQ ID NO: 3136787 - protein, 8 aa, Giardia lamblia
SGMKTGPT

SEQ ID NO: 3136788 - protein, 4 aa, Giardia lamblia
SGMQ

SEQ ID NO: 3136789 - protein, 12 aa, Giardia lamblia
SGMQSQEGDTAL

SEQ ID NO: 3136790 - protein, 15 aa, Giardia lamblia
SGMSGSHSRFTTEKY

SEQ ID NO: 3136791 - protein, 12 aa, Giardia lamblia
SGMTEKDAKARW

SEQ ID NO: 3136792 - protein, 5 aa, Giardia lamblia
SGNAK

SEQ ID NO: 3136793 - protein, 8 aa, Giardia lamblia
SGNAKTTI

SEQ ID NO: 3136794 - protein, 14 aa, Giardia lamblia
SGNAREDDNLETAI

SEQ ID NO: 3136795 - protein, 7 aa, Giardia lamblia
SGNEDAA

SEQ ID NO: 3136796 - protein, 7 aa, Giardia lamblia
SGNEDDV

SEQ ID NO: 3136797 - protein, 5 aa, Giardia lamblia
SGNES

SEQ ID NO: 3136798 - protein, 6 aa, Giardia lamblia
SGNESA

SEQ ID NO: 3136799 - protein, 5 aa, Giardia lamblia
SGNET

SEQ ID NO: 3136800 - protein, 8 aa, Giardia lamblia
SGNGPQVG

SEQ ID NO: 3136801 - protein, 28 aa, Giardia lamblia
SGNHTPQASSASRSGATGIHASSEYPPE

SEQ ID NO: 3136802 - protein, 5 aa, Giardia lamblia
SGNIE

SEQ ID NO: 3136803 - protein, 5 aa, Giardia lamblia
SGNIP

SEQ ID NO: 3136804 - protein, 8 aa, Giardia lamblia
SGNKDEVD

SEQ ID NO: 3136805 - protein, 9 aa, Giardia lamblia
SGNKQPPIY

SEQ ID NO: 3136806 - protein, 7 aa, Giardia lamblia
SGNKQSY

SEQ ID NO: 3136807 - protein, 5 aa, Giardia lamblia
SGNLQ

SEQ ID NO: 3136808 - protein, 7 aa, Giardia lamblia
SGNLSKA

SEQ ID NO: 3136809 - protein, 6 aa, Giardia lamblia
SGNPDG

SEQ ID NO: 3136810 - protein, 5 aa, Giardia lamblia
SGNRE

SEQ ID NO: 3136811 - protein, 10 aa, Giardia lamblia
SGNSGNPLPY

SEQ ID NO: 3136812 - protein, 13 aa, Giardia lamblia
SGNSLKKKPVSGL

SEQ ID NO: 3136813 - protein, 7 aa, Giardia lamblia
SGNSNID

SEQ ID NO: 3136814 - protein, 26 aa, Giardia lamblia
SGNSRETVTEERPESSHRETQTAPGH

SEQ ID NO: 3136815 - protein, 6 aa, Giardia lamblia
SGNSTA

SEQ ID NO: 3136816 - protein, 7 aa, Giardia lamblia
SGNSTGR

SEQ ID NO: 3136817 - protein, 7 aa, Giardia lamblia
SGNTEGV

SEQ ID NO: 3136818 - protein, 7 aa, Giardia lamblia
SGNTSKE

SEQ ID NO: 3136819 - protein, 4 aa, Giardia lamblia
SGNV

SEQ ID NO: 3136820 - protein, 5 aa, Giardia lamblia
SGNVN

SEQ ID NO: 3136821 - protein, 6 aa, Giardia lamblia
SGNYGT

SEQ ID NO: 3136822 - protein, 10 aa, Giardia lamblia
SGPAPPAPIT

SEQ ID NO: 3136823 - protein, 28 aa, Giardia lamblia
SGPASTLKGRTSTHTPDNYPGPGAYEQD

SEQ ID NO: 3136824 - protein, 10 aa, Giardia lamblia
SGPDAWEAKG

SEQ ID NO: 3136825 - protein, 17 aa, Giardia lamblia
SGPDVDLGKTESDNSLG

SEQ ID NO: 3136826 - protein, 6 aa, Giardia lamblia
SGPELS

SEQ ID NO: 3136827 - protein, 6 aa, Giardia lamblia
SGPESV

SEQ ID NO: 3136828 - protein, 5 aa, Giardia lamblia
SGPHS

SEQ ID NO: 3136829 - protein, 4 aa, Giardia lamblia
SGPI

SEQ ID NO: 3136830 - protein, 11 aa, Giardia lamblia
SGPNDPTPEQI

SEQ ID NO: 3136831 - protein, 6 aa, Giardia lamblia
SGPNEY

SEQ ID NO: 3136832 - protein, 7 aa, Giardia lamblia
SGPNNRG

SEQ ID NO: 3136833 - protein, 9 aa, Giardia lamblia
SGPRELPGT

SEQ ID NO: 3136834 - protein, 8 aa, Giardia lamblia
SGPSGIGK

SEQ ID NO: 3136835 - protein, 5 aa, Giardia lamblia
SGPSM

SEQ ID NO: 3136836 - protein, 10 aa, Giardia lamblia
SGPTGTNKPI

SEQ ID NO: 3136837 - protein, 7 aa, Giardia lamblia
SGPTSLS

SEQ ID NO: 3136838 - protein, 12 aa, Giardia lamblia
SGPTSTIDPGLN

SEQ ID NO: 3136839 - protein, 4 aa, Giardia lamblia
SGPV

SEQ ID NO: 3136840 - protein, 5 aa, Giardia lamblia
SGPVA

SEQ ID NO: 3136841 - protein, 7 aa, Giardia lamblia
SGPYAPT

SEQ ID NO: 3136842 - protein, 9 aa, Giardia lamblia
SGQAAISSK

SEQ ID NO: 3136843 - protein, 24 aa, Giardia lamblia
SGQAEHSGHLSSKNTAAATPDAWD

SEQ ID NO: 3136844 - protein, 10 aa, Giardia lamblia
SGQEQQKRTT

SEQ ID NO: 3136845 - protein, 22 aa, Giardia lamblia
SGQIDETAPAEGGSVPKPVAFE

SEQ ID NO: 3136846 - protein, 5 aa, Giardia lamblia
SGQIP

SEQ ID NO: 3136847 - protein, 8 aa, Giardia lamblia
SGQKERKT

SEQ ID NO: 3136848 - protein, 10 aa, Giardia lamblia
SGQKQAIQRQ

SEQ ID NO: 3136849 - protein, 9 aa, Giardia lamblia
SGQLNDEEI

SEQ ID NO: 3136850 - protein, 8 aa, Giardia lamblia
SGQLNKHG

SEQ ID NO: 3136851 - protein, 5 aa, Giardia lamblia
SGQNK

SEQ ID NO: 3136852 - protein, 5 aa, Giardia lamblia
SGQPD

SEQ ID NO: 3136853 - protein, 10 aa, Giardia lamblia
SGQPTSPEPD

SEQ ID NO: 3136854 - protein, 9 aa, Giardia lamblia
SGQQGIPRG

SEQ ID NO: 3136855 - protein, 8 aa, Giardia lamblia
SGQQTDKH

SEQ ID NO: 3136856 - protein, 7 aa, Giardia lamblia
SGQRDCG

SEQ ID NO: 3136857 - protein, 6 aa, Giardia lamblia
SGQRDL

SEQ ID NO: 3136858 - protein, 10 aa, Giardia lamblia
SGQRTKEGKS

SEQ ID NO: 3136859 - protein, 4 aa, Giardia lamblia
SGQS

SEQ ID NO: 3136860 - protein, 9 aa, Giardia lamblia
SGQSNAGYE

SEQ ID NO: 3136861 - protein, 7 aa, Giardia lamblia
SGQSPSI

SEQ ID NO: 3136862 - protein, 4 aa, Giardia lamblia
SGRA

SEQ ID NO: 3136863 - protein, 7 aa, Giardia lamblia
SGRAITD

SEQ ID NO: 3136864 - protein, 8 aa, Giardia lamblia
SGRATLGG

SEQ ID NO: 3136865 - protein, 7 aa, Giardia lamblia
SGRCGPG

SEQ ID NO: 3136866 - protein, 9 aa, Giardia lamblia
SGRDAGSRA

SEQ ID NO: 3136867 - protein, 6 aa, Giardia lamblia
SGREGV

SEQ ID NO: 3136868 - protein, 11 aa, Giardia lamblia
SGRETIGRVSG

SEQ ID NO: 3136869 - protein, 7 aa, Giardia lamblia
SGRFGRK

SEQ ID NO: 3136870 - protein, 22 aa, Giardia lamblia
SGRGWTPTRSAPRRANSRPYAQ

SEQ ID NO: 3136871 - protein, 7 aa, Giardia lamblia
SGRHRQE

SEQ ID NO: 3136872 - protein, 8 aa, Giardia lamblia
SGRHTPTA

SEQ ID NO: 3136873 - protein, 7 aa, Giardia lamblia
SGRIGSP

SEQ ID NO: 3136874 - protein, 15 aa, Giardia lamblia
SGRKECDSPYLGGGP

SEQ ID NO: 3136875 - protein, 6 aa, Giardia lamblia
SGRLNP

SEQ ID NO: 3136876 - protein, 8 aa, Giardia lamblia
SGRLPSAT

SEQ ID NO: 3136877 - protein, 6 aa, Giardia lamblia
SGRNHE

SEQ ID NO: 3136878 - protein, 8 aa, Giardia lamblia
SGRPFSDL

SEQ ID NO: 3136879 - protein, 7 aa, Giardia lamblia
SGRPKTL

SEQ ID NO: 3136880 - protein, 10 aa, Giardia lamblia
SGRPSGSTKD

SEQ ID NO: 3136881 - protein, 9 aa, Giardia lamblia
SGRPVAKGN

SEQ ID NO: 3136882 - protein, 4 aa, Giardia lamblia
SGRQ

SEQ ID NO: 3136883 - protein, 13 aa, Giardia lamblia
SGRQEKAYGKAEA

SEQ ID NO: 3136884 - protein, 4 aa, Giardia lamblia
SGRR

SEQ ID NO: 3136885 - protein, 8 aa, Giardia lamblia
SGRRAHRS

SEQ ID NO: 3136886 - protein, 19 aa, Giardia lamblia
SGRRASSRGVHQAPEPLSA

SEQ ID NO: 3136887 - protein, 4 aa, Giardia lamblia
SGRS

SEQ ID NO: 3136888 - protein, 5 aa, Giardia lamblia
SGRSC

SEQ ID NO: 3136889 - protein, 8 aa, Giardia lamblia
SGRSRTVK

SEQ ID NO: 3136890 - protein, 9 aa, Giardia lamblia
SGRSSIESE

SEQ ID NO: 3136891 - protein, 5 aa, Giardia lamblia
SGRSW

SEQ ID NO: 3136892 - protein, 16 aa, Giardia lamblia
SGRTEQASFKEADAEA

SEQ ID NO: 3136893 - protein, 34 aa, Giardia lamblia
SGRTGIDAKNTNPGPGAYDQGEDAVRRKAPAYTL

SEQ ID NO: 3136894 - protein, 8 aa, Giardia lamblia
SGRTQTTE

SEQ ID NO: 3136895 - protein, 4 aa, Giardia lamblia
SGRY

SEQ ID NO: 3136896 - protein, 14 aa, Giardia lamblia
SGSAAGSADQAELS

SEQ ID NO: 3136897 - protein, 7 aa, Giardia lamblia
SGSADET

SEQ ID NO: 3136898 - protein, 8 aa, Giardia lamblia
SGSALEEK

SEQ ID NO: 3136899 - protein, 8 aa, Giardia lamblia
SGSAPIPD

SEQ ID NO: 3136900 - protein, 10 aa, Giardia lamblia
SGSAVRGAAQ

SEQ ID NO: 3136901 - protein, 4 aa, Giardia lamblia
SGSD

SEQ ID NO: 3136902 - protein, 5 aa, Giardia lamblia
SGSDD

SEQ ID NO: 3136903 - protein, 7 aa, Giardia lamblia
SGSDDTK

SEQ ID NO: 3136904 - protein, 4 aa, Giardia lamblia
SGSE

SEQ ID NO: 3136905 - protein, 6 aa, Giardia lamblia
SGSEDS

SEQ ID NO: 3136906 - protein, 8 aa, Giardia lamblia
SGSEPHSN

SEQ ID NO: 3136907 - protein, 28 aa, Giardia lamblia
SGSEPSPSPQQPPVQQPQVPTQNPGNPT

SEQ ID NO: 3136908 - protein, 10 aa, Giardia lamblia
SGSERASKKA

SEQ ID NO: 3136909 - protein, 8 aa, Giardia lamblia
SGSEVSAN

SEQ ID NO: 3136910 - protein, 15 aa, Giardia lamblia
SGSFSDSASCTEPAY

SEQ ID NO: 3136911 - protein, 10 aa, Giardia lamblia
SGSGARSVYP

SEQ ID NO: 3136912 - protein, 8 aa, Giardia lamblia
SGSGGPRV

SEQ ID NO: 3136913 - protein, 6 aa, Giardia lamblia
SGSGNV

SEQ ID NO: 3136914 - protein, 12 aa, Giardia lamblia
SGSGSLSAGAWP

SEQ ID NO: 3136915 - protein, 7 aa, Giardia lamblia
SGSGTDL

SEQ ID NO: 3136916 - protein, 5 aa, Giardia lamblia
SGSIP

SEQ ID NO: 3136917 - protein, 20 aa, Giardia lamblia
SGSISTGKPRRKTRAEVSEE

SEQ ID NO: 3136918 - protein, 15 aa, Giardia lamblia
SGSKQREPAAEPDGK

SEQ ID NO: 3136919 - protein, 15 aa, Giardia lamblia
SGSKSLSSTEEGQHK

SEQ ID NO: 3136920 - protein, 12 aa, Giardia lamblia
SGSMSPSGSTRL

SEQ ID NO: 3136921 - protein, 8 aa, Giardia lamblia
SGSNPSEL

SEQ ID NO: 3136922 - protein, 6 aa, Giardia lamblia
SGSPLT

SEQ ID NO: 3136923 - protein, 10 aa, Giardia lamblia
SGSPSNQDVS

SEQ ID NO: 3136924 - protein, 8 aa, Giardia lamblia
SGSRENER

SEQ ID NO: 3136925 - protein, 17 aa, Giardia lamblia
SGSRVSNAELTAQTPQT

SEQ ID NO: 3136926 - protein, 5 aa, Giardia lamblia
SGSRY

SEQ ID NO: 3136927 - protein, 6 aa, Giardia lamblia
SGSSAL

SEQ ID NO: 3136928 - protein, 9 aa, Giardia lamblia
SGSSAVTQS

SEQ ID NO: 3136929 - protein, 14 aa, Giardia lamblia
SGSSMTDSLSSTTM

SEQ ID NO: 3136930 - protein, 7 aa, Giardia lamblia
SGSSSGE

SEQ ID NO: 3136931 - protein, 21 aa, Giardia lamblia
SGSSSGSSGGMGAATDGYTRL

SEQ ID NO: 3136932 - protein, 13 aa, Giardia lamblia
SGSSWDAEAPVPD

SEQ ID NO: 3136933 - protein, 6 aa, Giardia lamblia
SGSTEA

SEQ ID NO: 3136934 - protein, 6 aa, Giardia lamblia
SGSTFQ

SEQ ID NO: 3136935 - protein, 5 aa, Giardia lamblia
SGSTL

SEQ ID NO: 3136936 - protein, 7 aa, Giardia lamblia
SGSVGED

SEQ ID NO: 3136937 - protein, 8 aa, Giardia lamblia
SGSVPVPG

SEQ ID NO: 3136938 - protein, 6 aa, Giardia lamblia
SGSVST

SEQ ID NO: 3136939 - protein, 10 aa, Giardia lamblia
SGSVVGSSQL

SEQ ID NO: 3136940 - protein, 5 aa, Giardia lamblia
SGSYG

SEQ ID NO: 3136941 - protein, 9 aa, Giardia lamblia
SGSYSIPSG

SEQ ID NO: 3136942 - protein, 19 aa, Giardia lamblia
SGSYTSHRDRASASPSTVM

SEQ ID NO: 3136943 - protein, 7 aa, Giardia lamblia
SGTAASA

SEQ ID NO: 3136944 - protein, 5 aa, Giardia lamblia
SGTAK

SEQ ID NO: 3136945 - protein, 6 aa, Giardia lamblia
SGTDAT

SEQ ID NO: 3136946 - protein, 6 aa, Giardia lamblia
SGTDDQ

SEQ ID NO: 3136947 - protein, 7 aa, Giardia lamblia
SGTDPHR

SEQ ID NO: 3136948 - protein, 36 aa, Giardia lamblia
SGTEAPLPETVAQSPHVDQETTSEVTTTNSTKERTS

SEQ ID NO: 3136949 - protein, 6 aa, Giardia lamblia
SGTEPF

SEQ ID NO: 3136950 - protein, 9 aa, Giardia lamblia
SGTETEETD

SEQ ID NO: 3136951 - protein, 17 aa, Giardia lamblia
SGTETEKAISDVPDNDS

SEQ ID NO: 3136952 - protein, 4 aa, Giardia lamblia
SGTF

SEQ ID NO: 3136953 - protein, 20 aa, Giardia lamblia
SGTFGADNSFADSGSAGSFQ

SEQ ID NO: 3136954 - protein, 23 aa, Giardia lamblia
SGTGEGPAVQDSAAKSVSGGESV

SEQ ID NO: 3136955 - protein, 7 aa, Giardia lamblia
SGTGKTS

SEQ ID NO: 3136956 - protein, 5 aa, Giardia lamblia
SGTGL

SEQ ID NO: 3136957 - protein, 6 aa, Giardia lamblia
SGTGRL

SEQ ID NO: 3136958 - protein, 5 aa, Giardia lamblia
SGTHP

SEQ ID NO: 3136959 - protein, 11 aa, Giardia lamblia
SGTINSQAFPD

SEQ ID NO: 3136960 - protein, 35 aa, Giardia lamblia
SGTITTTDTSAARIRSSSSGSTSPLPGGQISQGGV

SEQ ID NO: 3136961 - protein, 5 aa, Giardia lamblia
SGTLA

SEQ ID NO: 3136962 - protein, 8 aa, Giardia lamblia
SGTLGQKA

SEQ ID NO: 3136963 - protein, 22 aa, Giardia lamblia
SGTLPLKGSKLQQKPDPSLSNL

SEQ ID NO: 3136964 - protein, 8 aa, Giardia lamblia
SGTLTDEG

SEQ ID NO: 3136965 - protein, 10 aa, Giardia lamblia
SGTNSGLPED

SEQ ID NO: 3136966 - protein, 7 aa, Giardia lamblia
SGTPGRI

SEQ ID NO: 3136967 - protein, 8 aa, Giardia lamblia
SGTPSRAD

SEQ ID NO: 3136968 - protein, 4 aa, Giardia lamblia
SGTQ

SEQ ID NO: 3136969 - protein, 8 aa, Giardia lamblia
SGTQASCT

SEQ ID NO: 3136970 - protein, 7 aa, Giardia lamblia
SGTRDNG

SEQ ID NO: 3136971 - protein, 5 aa, Giardia lamblia
SGTRV

SEQ ID NO: 3136972 - protein, 20 aa, Giardia lamblia
SGTSKAGKKKDGSGKGKCVI

SEQ ID NO: 3136973 - protein, 9 aa, Giardia lamblia
SGTSKEQVR

SEQ ID NO: 3136974 - protein, 8 aa, Giardia lamblia
SGTSLTAP

SEQ ID NO: 3136975 - protein, 14 aa, Giardia lamblia
SGTSSFGAAAARAA

SEQ ID NO: 3136976 - protein, 9 aa, Giardia lamblia
SGTSSTPKG

SEQ ID NO: 3136977 - protein, 7 aa, Giardia lamblia
SGTSTIK

SEQ ID NO: 3136978 - protein, 5 aa, Giardia lamblia
SGTTE

SEQ ID NO: 3136979 - protein, 11 aa, Giardia lamblia
SGTTGNPKGVK

SEQ ID NO: 3136980 - protein, 13 aa, Giardia lamblia
SGTTGNPKGVKLT

SEQ ID NO: 3136981 - protein, 4 aa, Giardia lamblia
SGTV

SEQ ID NO: 3136982 - protein, 14 aa, Giardia lamblia
SGTVGPSTSIVDSG

SEQ ID NO: 3136983 - protein, 5 aa, Giardia lamblia
SGTVT

SEQ ID NO: 3136984 - protein, 5 aa, Giardia lamblia
SGTYF

SEQ ID NO: 3136985 - protein, 13 aa, Giardia lamblia
SGVADRPENYPDE

SEQ ID NO: 3136986 - protein, 9 aa, Giardia lamblia
SGVANRRGE

SEQ ID NO: 3136987 - protein, 5 aa, Giardia lamblia
SGVAS

SEQ ID NO: 3136988 - protein, 6 aa, Giardia lamblia
SGVDTN

SEQ ID NO: 3136989 - protein, 7 aa, Giardia lamblia
SGVEDKD

SEQ ID NO: 3136990 - protein, 9 aa, Giardia lamblia
SGVEQDRAA

SEQ ID NO: 3136991 - protein, 6 aa, Giardia lamblia
SGVGKT

SEQ ID NO: 3136992 - protein, 8 aa, Giardia lamblia
SGVGRKDH

SEQ ID NO: 3136993 - protein, 24 aa, Giardia lamblia
SGVKPKTDREEVEHERAAAQNMRK

SEQ ID NO: 3136994 - protein, 9 aa, Giardia lamblia
SGVLSDDEI

SEQ ID NO: 3136995 - protein, 4 aa, Giardia lamblia
SGVP

SEQ ID NO: 3136996 - protein, 5 aa, Giardia lamblia
SGVPD

SEQ ID NO: 3136997 - protein, 12 aa, Giardia lamblia
SGVPKKGPSMRE

SEQ ID NO: 3136998 - protein, 7 aa, Giardia lamblia
SGVPQKD

SEQ ID NO: 3136999 - protein, 21 aa, Giardia lamblia
SGVSAYTSPVDEKKARRSPRL

SEQ ID NO: 3137000 - protein, 5 aa, Giardia lamblia
SGVSG

SEQ ID NO: 3137001 - protein, 9 aa, Giardia lamblia
SGVSGAHEE

SEQ ID NO: 3137002 - protein, 21 aa, Giardia lamblia
SGVSGASQTPESTRRSRSNSI

SEQ ID NO: 3137003 - protein, 17 aa, Giardia lamblia
SGVSHSTPATSSPKEYI

SEQ ID NO: 3137004 - protein, 7 aa, Giardia lamblia
SGVSSER

SEQ ID NO: 3137005 - protein, 4 aa, Giardia lamblia
SGVT

SEQ ID NO: 3137006 - protein, 11 aa, Giardia lamblia
SGVTSGNPELA

SEQ ID NO: 3137007 - protein, 4 aa, Giardia lamblia
SGYA

SEQ ID NO: 3137008 - protein, 22 aa, Giardia lamblia
SGYANPSSQTEPSKKLDGITEK

SEQ ID NO: 3137009 - protein, 4 aa, Giardia lamblia
SGYD

SEQ ID NO: 3137010 - protein, 13 aa, Giardia lamblia
SGYDSAKSNNSKA

SEQ ID NO: 3137011 - protein, 5 aa, Giardia lamblia
SGYNG

SEQ ID NO: 3137012 - protein, 6 aa, Giardia lamblia
SGYNRQ

SEQ ID NO: 3137013 - protein, 8 aa, Giardia lamblia
SGYQDKRG

SEQ ID NO: 3137014 - protein, 10 aa, Giardia lamblia
SGYQDSDGNT

SEQ ID NO: 3137015 - protein, 8 aa, Giardia lamblia
SGYQRPGI

SEQ ID NO: 3137016 - protein, 5 aa, Giardia lamblia
SGYSA

SEQ ID NO: 3137017 - protein, 5 aa, Giardia lamblia
SGYSD

SEQ ID NO: 3137018 - protein, 10 aa, Giardia lamblia
SGYSKENNRI

SEQ ID NO: 3137019 - protein, 6 aa, Giardia lamblia
SGYTAQ

SEQ ID NO: 3137020 - protein, 24 aa, Giardia lamblia
SGYTDKDPRPLAPAPATDPKKNFS

SEQ ID NO: 3137021 - protein, 5 aa, Giardia lamblia
SGYTE

SEQ ID NO: 3137022 - protein, 6 aa, Giardia lamblia
SGYVPQ

SEQ ID NO: 3137023 - protein, 6 aa, Giardia lamblia
SHAAPL

SEQ ID NO: 3137024 - protein, 7 aa, Giardia lamblia
SHAEAAR

SEQ ID NO: 3137025 - protein, 11 aa, Giardia lamblia
SHAKDNSTLKP

SEQ ID NO: 3137026 - protein, 4 aa, Giardia lamblia
SHAN

SEQ ID NO: 3137027 - protein, 15 aa, Giardia lamblia
SHAQQLTGMSAGSAI

SEQ ID NO: 3137028 - protein, 19 aa, Giardia lamblia
SHARTQAATAENATSSRSH

SEQ ID NO: 3137029 - protein, 4 aa, Giardia lamblia
SHAS

SEQ ID NO: 3137030 - protein, 9 aa, Giardia lamblia
SHASEFQQE

SEQ ID NO: 3137031 - protein, 6 aa, Giardia lamblia
SHASSE

SEQ ID NO: 3137032 - protein, 25 aa, Giardia lamblia
SHATPPDSSNTSDSELRDYSESSGF

SEQ ID NO: 3137033 - protein, 22 aa, Giardia lamblia
SHAVDERPGNVLTSSSSSESLR

SEQ ID NO: 3137034 - protein, 9 aa, Giardia lamblia
SHDEDDYDL

SEQ ID NO: 3137035 - protein, 6 aa, Giardia lamblia
SHDGTT

SEQ ID NO: 3137036 - protein, 4 aa, Giardia lamblia
SHDP

SEQ ID NO: 3137037 - protein, 30 aa, Giardia lamblia
SHDQEGEGKQVDCDRESKENQTTDISDTAI

SEQ ID NO: 3137038 - protein, 9 aa, Giardia lamblia
SHDSALSPY

SEQ ID NO: 3137039 - protein, 9 aa, Giardia lamblia
SHDSRAEKT

SEQ ID NO: 3137040 - protein, 9 aa, Giardia lamblia
SHEARPRSA

SEQ ID NO: 3137041 - protein, 13 aa, Giardia lamblia
SHEDMGPGSPLKY

SEQ ID NO: 3137042 - protein, 8 aa, Giardia lamblia
SHEEDEQL

SEQ ID NO: 3137043 - protein, 8 aa, Giardia lamblia
SHELKDGH

SEQ ID NO: 3137044 - protein, 8 aa, Giardia lamblia
SHELSNTS

SEQ ID NO: 3137045 - protein, 33 aa, Giardia lamblia
SHENTDPGVKISGESSSHNAPVSKPSNAPVGGQ

SEQ ID NO: 3137046 - protein, 6 aa, Giardia lamblia
SHEPDF

SEQ ID NO: 3137047 - protein, 23 aa, Giardia lamblia
SHEPPPQSEKDTYQASHNRTTLS

SEQ ID NO: 3137048 - protein, 8 aa, Giardia lamblia
SHEPPRGL

SEQ ID NO: 3137049 - protein, 4 aa, Giardia lamblia
SHET

SEQ ID NO: 3137050 - protein, 6 aa, Giardia lamblia
SHFTPE

SEQ ID NO: 3137051 - protein, 8 aa, Giardia lamblia
SHGADGAN

SEQ ID NO: 3137052 - protein, 6 aa, Giardia lamblia
SHGANV

SEQ ID NO: 3137053 - protein, 7 aa, Giardia lamblia
SHGDRRD

SEQ ID NO: 3137054 - protein, 5 aa, Giardia lamblia
SHGDV

SEQ ID NO: 3137055 - protein, 10 aa, Giardia lamblia
SHGEGGVGDN

SEQ ID NO: 3137056 - protein, 5 aa, Giardia lamblia
SHGPI

SEQ ID NO: 3137057 - protein, 47 aa, Giardia lamblia
SHGPPSPQPGPGNSRSATDNSPNESSPVHGLQGSGASVARDASPPCL

SEQ ID NO: 3137058 - protein, 36 aa, Giardia lamblia
SHGPSFSIGPSRSLSQSGMRQTSRSNSRSASRSTAL

SEQ ID NO: 3137059 - protein, 6 aa, Giardia lamblia
SHGQRE

SEQ ID NO: 3137060 - protein, 32 aa, Giardia lamblia
SHGSASKPSTSMRQPAPSASSSSAAKETRDRI

SEQ ID NO: 3137061 - protein, 8 aa, Giardia lamblia
SHGSGHAS

SEQ ID NO: 3137062 - protein, 33 aa, Giardia lamblia
SHGSSSNDARVVPRASSELPRPHTDAGALDQST

SEQ ID NO: 3137063 - protein, 6 aa, Giardia lamblia
SHGSTR

SEQ ID NO: 3137064 - protein, 4 aa, Giardia lamblia
SHGY

SEQ ID NO: 3137065 - protein, 51 aa, Giardia lamblia
SHHEDAEQLRSSSRPGSARSRQSIRSTSSRASSGRRSVARGASSGSRGISP

SEQ ID NO: 3137066 - protein, 4 aa, Giardia lamblia
SHKA

SEQ ID NO: 3137067 - protein, 6 aa, Giardia lamblia
SHKEEH

SEQ ID NO: 3137068 - protein, 10 aa, Giardia lamblia
SHKSDLTPFE

SEQ ID NO: 3137069 - protein, 15 aa, Giardia lamblia
SHKSNENADNEEYSY

SEQ ID NO: 3137070 - protein, 18 aa, Giardia lamblia
SHKTERMRRADARAARAM

SEQ ID NO: 3137071 - protein, 20 aa, Giardia lamblia
SHLPSDDDIKAAASQKNGIK

SEQ ID NO: 3137072 - protein, 6 aa, Giardia lamblia
SHNDSH

SEQ ID NO: 3137073 - protein, 7 aa, Giardia lamblia
SHNGFYE

SEQ ID NO: 3137074 - protein, 5 aa, Giardia lamblia
SHNKR

SEQ ID NO: 3137075 - protein, 9 aa, Giardia lamblia
SHNLRNDER

SEQ ID NO: 3137076 - protein, 11 aa, Giardia lamblia
SHNPSKDNGYK

SEQ ID NO: 3137077 - protein, 5 aa, Giardia lamblia
SHNRT

SEQ ID NO: 3137078 - protein, 23 aa, Giardia lamblia
SHPATAALPKQEASQQPVIPTSV

SEQ ID NO: 3137079 - protein, 13 aa, Giardia lamblia
SHPDQQAQALEGL

SEQ ID NO: 3137080 - protein, 6 aa, Giardia lamblia
SHPEYP

SEQ ID NO: 3137081 - protein, 4 aa, Giardia lamblia
SHPG

SEQ ID NO: 3137082 - protein, 5 aa, Giardia lamblia
SHPGM

SEQ ID NO: 3137083 - protein, 9 aa, Giardia lamblia
SHPKKGNMA

SEQ ID NO: 3137084 - protein, 5 aa, Giardia lamblia
SHPNR

SEQ ID NO: 3137085 - protein, 8 aa, Giardia lamblia
SHPPGPDH

SEQ ID NO: 3137086 - protein, 13 aa, Giardia lamblia
SHPQPRIPPTNSW

SEQ ID NO: 3137087 - protein, 4 aa, Giardia lamblia
SHPT

SEQ ID NO: 3137088 - protein, 5 aa, Giardia lamblia
SHPTH

SEQ ID NO: 3137089 - protein, 13 aa, Giardia lamblia
SHPTRPEKARRLG

SEQ ID NO: 3137090 - protein, 26 aa, Giardia lamblia
SHPTRSSPEKTTDKPADSKPSIPPLK

SEQ ID NO: 3137091 - protein, 19 aa, Giardia lamblia
SHQDSTAPGSTHGSAYDGN

SEQ ID NO: 3137092 - protein, 11 aa, Giardia lamblia
SHQEDKSKIER

SEQ ID NO: 3137093 - protein, 16 aa, Giardia lamblia
SHQGEPPALGTYRSGR

SEQ ID NO: 3137094 - protein, 19 aa, Giardia lamblia
SHQGSSINGDGRSSKTTFQ

SEQ ID NO: 3137095 - protein, 16 aa, Giardia lamblia
SHQPLSTTLADSSPLK

SEQ ID NO: 3137096 - protein, 11 aa, Giardia lamblia
SHQQPSQGAHT

SEQ ID NO: 3137097 - protein, 7 aa, Giardia lamblia
SHQQRRQ

SEQ ID NO: 3137098 - protein, 4 aa, Giardia lamblia
SHQS

SEQ ID NO: 3137099 - protein, 8 aa, Giardia lamblia
SHQSADNE

SEQ ID NO: 3137100 - protein, 26 aa, Giardia lamblia
SHQSAGDSIKSPARHSAPTHQEPLPD

SEQ ID NO: 3137101 - protein, 27 aa, Giardia lamblia
SHQSPNPKKVSATRQPPAINAGPSGLY

SEQ ID NO: 3137102 - protein, 5 aa, Giardia lamblia
SHQSV

SEQ ID NO: 3137103 - protein, 4 aa, Giardia lamblia
SHRA

SEQ ID NO: 3137104 - protein, 5 aa, Giardia lamblia
SHRGA

SEQ ID NO: 3137105 - protein, 25 aa, Giardia lamblia
SHRGAHYSKGKDNTHHNGRYTYQQN

SEQ ID NO: 3137106 - protein, 10 aa, Giardia lamblia
SHRPMSPAAR

SEQ ID NO: 3137107 - protein, 4 aa, Giardia lamblia
SHRS

SEQ ID NO: 3137108 - protein, 113 aa, Giardia lamblia
SHRTASCSTINSKSSNVKSNSKASTPTSKSPRRSLGKSQQKTASRSSSKSKEPDASQKQERSVSPTSSPRESKGEMASQASVPQSPQRQEGLTPPASKQPSRQGSPKPHISGS

SEQ ID NO: 3137109 - protein, 8 aa, Giardia lamblia
SHRYQQQQ

SEQ ID NO: 3137110 - protein, 8 aa, Giardia lamblia
SHSANTPA

SEQ ID NO: 3137111 - protein, 26 aa, Giardia lamblia
SHSDREEESTDAIPPVPPNEREPSPQ

SEQ ID NO: 3137112 - protein, 6 aa, Giardia lamblia
SHSENI

SEQ ID NO: 3137113 - protein, 31 aa, Giardia lamblia
SHSEPQVSMSNEAGPLADCSESKRSLQTSMT

SEQ ID NO: 3137114 - protein, 14 aa, Giardia lamblia
SHSHINKSELSKTR

SEQ ID NO: 3137115 - protein, 47 aa, Giardia lamblia
SHSIPKSPEEAKALPPPGSCHDAGKKAKSEEDAQEAPAAPKKEDPYA

SEQ ID NO: 3137116 - protein, 16 aa, Giardia lamblia
SHSKDEPSTSRDISTR

SEQ ID NO: 3137117 - protein, 9 aa, Giardia lamblia
SHSLESSPL

SEQ ID NO: 3137118 - protein, 8 aa, Giardia lamblia
SHSNETDV

SEQ ID NO: 3137119 - protein, 38 aa, Giardia lamblia
SHSNTNLRDPSKTGSRAGSSLQGDVDAASVGTQTVHTG

SEQ ID NO: 3137120 - protein, 15 aa, Giardia lamblia
SHSPSFSSATRVESG

SEQ ID NO: 3137121 - protein, 5 aa, Giardia lamblia
SHSQG

SEQ ID NO: 3137122 - protein, 7 aa, Giardia lamblia
SHSQTGV

SEQ ID NO: 3137123 - protein, 8 aa, Giardia lamblia
SHSRKGSR

SEQ ID NO: 3137124 - protein, 5 aa, Giardia lamblia
SHTDR

SEQ ID NO: 3137125 - protein, 14 aa, Giardia lamblia
SHTDSVKDATSKYE

SEQ ID NO: 3137126 - protein, 10 aa, Giardia lamblia
SHTEEASKVE

SEQ ID NO: 3137127 - protein, 5 aa, Giardia lamblia
SHTNE

SEQ ID NO: 3137128 - protein, 11 aa, Giardia lamblia
SHTPGHPERDI

SEQ ID NO: 3137129 - protein, 13 aa, Giardia lamblia
SHTPMSASPAQTV

SEQ ID NO: 3137130 - protein, 19 aa, Giardia lamblia
SHTRKPDRAEPEDNNGNTQ

SEQ ID NO: 3137131 - protein, 10 aa, Giardia lamblia
SHTSSGKCLS

SEQ ID NO: 3137132 - protein, 7 aa, Giardia lamblia
SHTTENH

SEQ ID NO: 3137133 - protein, 10 aa, Giardia lamblia
SHTVTDPPGF

SEQ ID NO: 3137134 - protein, 36 aa, Giardia lamblia
SHVRPASSSSLSGSATTRQANRCRSSSAVRSASSAR

SEQ ID NO: 3137135 - protein, 7 aa, Giardia lamblia
SHVTPEF

SEQ ID NO: 3137136 - protein, 20 aa, Giardia lamblia
SHYGTKGESAGSNQMASEGR

SEQ ID NO: 3137137 - protein, 6 aa, Giardia lamblia
SHYPST

SEQ ID NO: 3137138 - protein, 17 aa, Giardia lamblia
SHYQSAPDFGETYTHNR

SEQ ID NO: 3137139 - protein, 8 aa, Giardia lamblia
SIADGGAF

SEQ ID NO: 3137140 - protein, 7 aa, Giardia lamblia
SIADRPS

SEQ ID NO: 3137141 - protein, 7 aa, Giardia lamblia
SIAEEKE

SEQ ID NO: 3137142 - protein, 10 aa, Giardia lamblia
SIAEGSPSPY

SEQ ID NO: 3137143 - protein, 5 aa, Giardia lamblia
SIAGR

SEQ ID NO: 3137144 - protein, 21 aa, Giardia lamblia
SIANEDGKKPAELAAESGAHE

SEQ ID NO: 3137145 - protein, 10 aa, Giardia lamblia
SIAPSALPTI

SEQ ID NO: 3137146 - protein, 11 aa, Giardia lamblia
SIAPTSDGTRP

SEQ ID NO: 3137147 - protein, 5 aa, Giardia lamblia
SIASA

SEQ ID NO: 3137148 - protein, 17 aa, Giardia lamblia
SIASPSASRAGSPGYRA

SEQ ID NO: 3137149 - protein, 7 aa, Giardia lamblia
SIASQAE

SEQ ID NO: 3137150 - protein, 7 aa, Giardia lamblia
SIASQET

SEQ ID NO: 3137151 - protein, 6 aa, Giardia lamblia
SICPSP

SEQ ID NO: 3137152 - protein, 4 aa, Giardia lamblia
SIDA

SEQ ID NO: 3137153 - protein, 12 aa, Giardia lamblia
SIDAERQAAERK

SEQ ID NO: 3137154 - protein, 5 aa, Giardia lamblia
SIDAS

SEQ ID NO: 3137155 - protein, 4 aa, Giardia lamblia
SIDE

SEQ ID NO: 3137156 - protein, 9 aa, Giardia lamblia
SIDGSDCPN

SEQ ID NO: 3137157 - protein, 6 aa, Giardia lamblia
SIDGSF

SEQ ID NO: 3137158 - protein, 5 aa, Giardia lamblia
SIDKA

SEQ ID NO: 3137159 - protein, 6 aa, Giardia lamblia
SIDNAE

SEQ ID NO: 3137160 - protein, 14 aa, Giardia lamblia
SIDNGDSPNSEPTL

SEQ ID NO: 3137161 - protein, 6 aa, Giardia lamblia
SIDNKT

SEQ ID NO: 3137162 - protein, 10 aa, Giardia lamblia
SIDPCDERSR

SEQ ID NO: 3137163 - protein, 5 aa, Giardia lamblia
SIDPS

SEQ ID NO: 3137164 - protein, 7 aa, Giardia lamblia
SIDPSTR

SEQ ID NO: 3137165 - protein, 12 aa, Giardia lamblia
SIDPTKQQLPNI

SEQ ID NO: 3137166 - protein, 6 aa, Giardia lamblia
SIDQSS

SEQ ID NO: 3137167 - protein, 6 aa, Giardia lamblia
SIDSDK

SEQ ID NO: 3137168 - protein, 8 aa, Giardia lamblia
SIDTDSLN

SEQ ID NO: 3137169 - protein, 13 aa, Giardia lamblia
SIDTSPDVANLLT

SEQ ID NO: 3137170 - protein, 8 aa, Giardia lamblia
SIDTTEPQ

SEQ ID NO: 3137171 - protein, 11 aa, Giardia lamblia
SIEDKTGQEIG

SEQ ID NO: 3137172 - protein, 13 aa, Giardia lamblia
SIEDSQPSTPTGS

SEQ ID NO: 3137173 - protein, 4 aa, Giardia lamblia
SIEE

SEQ ID NO: 3137174 - protein, 7 aa, Giardia lamblia
SIEEKDQ

SEQ ID NO: 3137175 - protein, 9 aa, Giardia lamblia
SIENPSANV

SEQ ID NO: 3137176 - protein, 6 aa, Giardia lamblia
SIEPRT

SEQ ID NO: 3137177 - protein, 9 aa, Giardia lamblia
SIEPSSTLN

SEQ ID NO: 3137178 - protein, 9 aa, Giardia lamblia
SIEPVSPDK

SEQ ID NO: 3137179 - protein, 5 aa, Giardia lamblia
SIEQE

SEQ ID NO: 3137180 - protein, 6 aa, Giardia lamblia
SIERSD

SEQ ID NO: 3137181 - protein, 12 aa, Giardia lamblia
SIERSNQHQKAL

SEQ ID NO: 3137182 - protein, 14 aa, Giardia lamblia
SIESETTAATLGTQ

SEQ ID NO: 3137183 - protein, 4 aa, Giardia lamblia
SIET

SEQ ID NO: 3137184 - protein, 5 aa, Giardia lamblia
SIGGK

SEQ ID NO: 3137185 - protein, 13 aa, Giardia lamblia
SIGNTGKPYVTKS

SEQ ID NO: 3137186 - protein, 32 aa, Giardia lamblia
SIGQNSRPVLSQPSTSVGTGSVPLSASVSSSV

SEQ ID NO: 3137187 - protein, 9 aa, Giardia lamblia
SIGRRDEHG

SEQ ID NO: 3137188 - protein, 36 aa, Giardia lamblia
SIGSASSSDHESNRQPQHQKRERSGGEGNGDHTSHD

SEQ ID NO: 3137189 - protein, 8 aa, Giardia lamblia
SIGSPPQD

SEQ ID NO: 3137190 - protein, 6 aa, Giardia lamblia
SIGTDE

SEQ ID NO: 3137191 - protein, 20 aa, Giardia lamblia
SIGTKRSEDSHGGESEVNRT

SEQ ID NO: 3137192 - protein, 11 aa, Giardia lamblia
SIGTSKQDVSA

SEQ ID NO: 3137193 - protein, 7 aa, Giardia lamblia
SIHPGSK

SEQ ID NO: 3137194 - protein, 13 aa, Giardia lamblia
SIHPTAQDADEDA

SEQ ID NO: 3137195 - protein, 5 aa, Giardia lamblia
SIITG

SEQ ID NO: 3137196 - protein, 4 aa, Giardia lamblia
SIKG

SEQ ID NO: 3137197 - protein, 23 aa, Giardia lamblia
SIKPAKPSKKDKAKGSNTSSMNN

SEQ ID NO: 3137198 - protein, 10 aa, Giardia lamblia
SIKPKTPASV

SEQ ID NO: 3137199 - protein, 5 aa, Giardia lamblia
SIKPP

SEQ ID NO: 3137200 - protein, 10 aa, Giardia lamblia
SIKSPAGGAT

SEQ ID NO: 3137201 - protein, 15 aa, Giardia lamblia
SIKSPSEPNDEVEGF

SEQ ID NO: 3137202 - protein, 16 aa, Giardia lamblia
SIKSRPSLQSEQCNGS

SEQ ID NO: 3137203 - protein, 6 aa, Giardia lamblia
SIKSSD

SEQ ID NO: 3137204 - protein, 13 aa, Giardia lamblia
SILSPDSSTTSNR

SEQ ID NO: 3137205 - protein, 10 aa, Giardia lamblia
SILTPDGKSA

SEQ ID NO: 3137206 - protein, 9 aa, Giardia lamblia
SINDPKPYE

SEQ ID NO: 3137207 - protein, 18 aa, Giardia lamblia
SINEGNLSKSTRAPFASN

SEQ ID NO: 3137208 - protein, 12 aa, Giardia lamblia
SINENADPTVRE

SEQ ID NO: 3137209 - protein, 10 aa, Giardia lamblia
SINESDPEKR

SEQ ID NO: 3137210 - protein, 6 aa, Giardia lamblia
SINPEG

SEQ ID NO: 3137211 - protein, 6 aa, Giardia lamblia
SINPKT

SEQ ID NO: 3137212 - protein, 7 aa, Giardia lamblia
SINQGAV

SEQ ID NO: 3137213 - protein, 13 aa, Giardia lamblia
SINRQQHDKARTQ

SEQ ID NO: 3137214 - protein, 29 aa, Giardia lamblia
SIPAAAPSATIASDRAVGPAAVPSLPPLS

SEQ ID NO: 3137215 - protein, 10 aa, Giardia lamblia
SIPAEFGKDN

SEQ ID NO: 3137216 - protein, 32 aa, Giardia lamblia
SIPAPSGVSPLPARNPMTSSMPPLPPRPKSAA

SEQ ID NO: 3137217 - protein, 6 aa, Giardia lamblia
SIPATS

SEQ ID NO: 3137218 - protein, 37 aa, Giardia lamblia
SIPEDGDRKNTGTGQAHYKGSAYHRNAGNKRRKAHHT

SEQ ID NO: 3137219 - protein, 6 aa, Giardia lamblia
SIPEKS

SEQ ID NO: 3137220 - protein, 5 aa, Giardia lamblia
SIPGP

SEQ ID NO: 3137221 - protein, 18 aa, Giardia lamblia
SIPGPGELDRYDTAHSGY

SEQ ID NO: 3137222 - protein, 18 aa, Giardia lamblia
SIPGPSNHSSNAPSANAS

SEQ ID NO: 3137223 - protein, 24 aa, Giardia lamblia
SIPGSRPNSTARVPPDDLKSVESN

SEQ ID NO: 3137224 - protein, 13 aa, Giardia lamblia
SIPKTDLSDAADG

SEQ ID NO: 3137225 - protein, 9 aa, Giardia lamblia
SIPNKEGTY

SEQ ID NO: 3137226 - protein, 8 aa, Giardia lamblia
SIPPGTAD

SEQ ID NO: 3137227 - protein, 7 aa, Giardia lamblia
SIPPQSD

SEQ ID NO: 3137228 - protein, 13 aa, Giardia lamblia
SIPQASTTQQPAA

SEQ ID NO: 3137229 - protein, 20 aa, Giardia lamblia
SIPQPTRAAASDDPVSTPTV

SEQ ID NO: 3137230 - protein, 5 aa, Giardia lamblia
SIPQV

SEQ ID NO: 3137231 - protein, 8 aa, Giardia lamblia
SIPRPRRE

SEQ ID NO: 3137232 - protein, 11 aa, Giardia lamblia
SIPSDAEGIAG

SEQ ID NO: 3137233 - protein, 7 aa, Giardia lamblia
SIPSDDI

SEQ ID NO: 3137234 - protein, 6 aa, Giardia lamblia
SIPSID

SEQ ID NO: 3137235 - protein, 10 aa, Giardia lamblia
SIPSSNGSDL

SEQ ID NO: 3137236 - protein, 6 aa, Giardia lamblia
SIPSSR

SEQ ID NO: 3137237 - protein, 6 aa, Giardia lamblia
SIPSTD

SEQ ID NO: 3137238 - protein, 4 aa, Giardia lamblia
SIPT

SEQ ID NO: 3137239 - protein, 6 aa, Giardia lamblia
SIPTGG

SEQ ID NO: 3137240 - protein, 8 aa, Giardia lamblia
SIPTGGAG

SEQ ID NO: 3137241 - protein, 7 aa, Giardia lamblia
SIPTPEM

SEQ ID NO: 3137242 - protein, 5 aa, Giardia lamblia
SIPTS

SEQ ID NO: 3137243 - protein, 17 aa, Giardia lamblia
SIPTSEQPPADNTDTQV

SEQ ID NO: 3137244 - protein, 22 aa, Giardia lamblia
SIPTSNAEIRTGKSSPSPLTST

SEQ ID NO: 3137245 - protein, 4 aa, Giardia lamblia
SIQA

SEQ ID NO: 3137246 - protein, 7 aa, Giardia lamblia
SIQAEDL

SEQ ID NO: 3137247 - protein, 12 aa, Giardia lamblia
SIQESADGADSL

SEQ ID NO: 3137248 - protein, 15 aa, Giardia lamblia
SIQETTASNTQDIDQ

SEQ ID NO: 3137249 - protein, 17 aa, Giardia lamblia
SIQKDNKSHPMAKAGTE

SEQ ID NO: 3137250 - protein, 6 aa, Giardia lamblia
SIQNSA

SEQ ID NO: 3137251 - protein, 6 aa, Giardia lamblia
SIQQAS

SEQ ID NO: 3137252 - protein, 6 aa, Giardia lamblia
SIQSSI

SEQ ID NO: 3137253 - protein, 8 aa, Giardia lamblia
SIQTPSHR

SEQ ID NO: 3137254 - protein, 6 aa, Giardia lamblia
SIRANK

SEQ ID NO: 3137255 - protein, 64 aa, Giardia lamblia
SIRDSAKDDTKSDTKDGTKASDNKETEGVQEADSSSMATKAAEHDPSTPAEKQASAPSASKEAG

SEQ ID NO: 3137256 - protein, 9 aa, Giardia lamblia
SIREGKEDV

SEQ ID NO: 3137257 - protein, 7 aa, Giardia lamblia
SIREPTT

SEQ ID NO: 3137258 - protein, 13 aa, Giardia lamblia
SIRQAQQKKTSER

SEQ ID NO: 3137259 - protein, 5 aa, Giardia lamblia
SIRQE

SEQ ID NO: 3137260 - protein, 34 aa, Giardia lamblia
SIRQGGASPTYSTGRRMTGDIPESASSAFKYNSD

SEQ ID NO: 3137261 - protein, 10 aa, Giardia lamblia
SIRRPRSRTM

SEQ ID NO: 3137262 - protein, 17 aa, Giardia lamblia
SIRSENSTESESSPTHY

SEQ ID NO: 3137263 - protein, 10 aa, Giardia lamblia
SISASLATSN

SEQ ID NO: 3137264 - protein, 16 aa, Giardia lamblia
SISDGDVSYDSNIKEK

SEQ ID NO: 3137265 - protein, 35 aa, Giardia lamblia
SISDPNGTVKPSHHSDDDSSDDEDFVPSSSEDTSD

SEQ ID NO: 3137266 - protein, 9 aa, Giardia lamblia
SISDPTGPI

SEQ ID NO: 3137267 - protein, 16 aa, Giardia lamblia
SISDSASTLCPSGETT

SEQ ID NO: 3137268 - protein, 8 aa, Giardia lamblia
SISDTPSG

SEQ ID NO: 3137269 - protein, 5 aa, Giardia lamblia
SISEG

SEQ ID NO: 3137270 - protein, 9 aa, Giardia lamblia
SISGAPRDM

SEQ ID NO: 3137271 - protein, 14 aa, Giardia lamblia
SISHNSDNSPMSLQ

SEQ ID NO: 3137272 - protein, 11 aa, Giardia lamblia
SISKPPPGSPP

SEQ ID NO: 3137273 - protein, 14 aa, Giardia lamblia
SISKPPSSETYPLT

SEQ ID NO: 3137274 - protein, 5 aa, Giardia lamblia
SISPD

SEQ ID NO: 3137275 - protein, 6 aa, Giardia lamblia
SISPKR

SEQ ID NO: 3137276 - protein, 11 aa, Giardia lamblia
SISPKRNPAHL

SEQ ID NO: 3137277 - protein, 19 aa, Giardia lamblia
SISPKTAQKPQTTVVPTTS

SEQ ID NO: 3137278 - protein, 5 aa, Giardia lamblia
SISPQ

SEQ ID NO: 3137279 - protein, 8 aa, Giardia lamblia
SISPSSKH

SEQ ID NO: 3137280 - protein, 6 aa, Giardia lamblia
SISQDK

SEQ ID NO: 3137281 - protein, 8 aa, Giardia lamblia
SISRTEEW

SEQ ID NO: 3137282 - protein, 5 aa, Giardia lamblia
SISSD

SEQ ID NO: 3137283 - protein, 17 aa, Giardia lamblia
SISSDSPFGAASTHQPT

SEQ ID NO: 3137284 - protein, 48 aa, Giardia lamblia
SISSFSPTASFSSSGSVSMNEQPVQQSSFPSRHSQEITVDDKPETMHQ

SEQ ID NO: 3137285 - protein, 25 aa, Giardia lamblia
SISSPSEIQRTTQQTSEKVKVNDND

SEQ ID NO: 3137286 - protein, 5 aa, Giardia lamblia
SISTD

SEQ ID NO: 3137287 - protein, 8 aa, Giardia lamblia
SISTDAPF

SEQ ID NO: 3137288 - protein, 16 aa, Giardia lamblia
SISTKRALSPNDPHSR

SEQ ID NO: 3137289 - protein, 24 aa, Giardia lamblia
SISTKRTQPSPQPSKVTPPSSKSF

SEQ ID NO: 3137290 - protein, 8 aa, Giardia lamblia
SISTREEI

SEQ ID NO: 3137291 - protein, 8 aa, Giardia lamblia
SISVTRDG

SEQ ID NO: 3137292 - protein, 25 aa, Giardia lamblia
SITASTKSHSHSKTGTTNQQSTSNE

SEQ ID NO: 3137293 - protein, 10 aa, Giardia lamblia
SITATKAEQL

SEQ ID NO: 3137294 - protein, 6 aa, Giardia lamblia
SITATP

SEQ ID NO: 3137295 - protein, 8 aa, Giardia lamblia
SITEPGRN

SEQ ID NO: 3137296 - protein, 5 aa, Giardia lamblia
SITER

SEQ ID NO: 3137297 - protein, 5 aa, Giardia lamblia
SITES

SEQ ID NO: 3137298 - protein, 4 aa, Giardia lamblia
SITG

SEQ ID NO: 3137299 - protein, 5 aa, Giardia lamblia
SITKE

SEQ ID NO: 3137300 - protein, 5 aa, Giardia lamblia
SITPE

SEQ ID NO: 3137301 - protein, 12 aa, Giardia lamblia
SITQEDVQRSLS

SEQ ID NO: 3137302 - protein, 5 aa, Giardia lamblia
SITQG

SEQ ID NO: 3137303 - protein, 13 aa, Giardia lamblia
SITREEADRKYES

SEQ ID NO: 3137304 - protein, 16 aa, Giardia lamblia
SITRNSTKVSTEPPLG

SEQ ID NO: 3137305 - protein, 14 aa, Giardia lamblia
SITSKLTGGHSGPI

SEQ ID NO: 3137306 - protein, 6 aa, Giardia lamblia
SITSPQ

SEQ ID NO: 3137307 - protein, 5 aa, Giardia lamblia
SITSS

SEQ ID NO: 3137308 - protein, 6 aa, Giardia lamblia
SITTAK

SEQ ID NO: 3137309 - protein, 5 aa, Giardia lamblia
SITTD

SEQ ID NO: 3137310 - protein, 26 aa, Giardia lamblia
SITTDDHDRGSPVKQQLGRGSVTGSR

SEQ ID NO: 3137311 - protein, 12 aa, Giardia lamblia
SITTPDGSTPLE

SEQ ID NO: 3137312 - protein, 25 aa, Giardia lamblia
SIYQEQEVQRASSGVSTNGDSNPIT

SEQ ID NO: 3137313 - protein, 16 aa, Giardia lamblia
SKAAEAEASSAANVPN

SEQ ID NO: 3137314 - protein, 9 aa, Giardia lamblia
SKAAEKQKK

SEQ ID NO: 3137315 - protein, 9 aa, Giardia lamblia
SKAAEKSPI

SEQ ID NO: 3137316 - protein, 9 aa, Giardia lamblia
SKAAFRDTT

SEQ ID NO: 3137317 - protein, 9 aa, Giardia lamblia
SKAATCTNE

SEQ ID NO: 3137318 - protein, 5 aa, Giardia lamblia
SKAEA

SEQ ID NO: 3137319 - protein, 8 aa, Giardia lamblia
SKAEERER

SEQ ID NO: 3137320 - protein, 6 aa, Giardia lamblia
SKAEKI

SEQ ID NO: 3137321 - protein, 7 aa, Giardia lamblia
SKAESRP

SEQ ID NO: 3137322 - protein, 19 aa, Giardia lamblia
SKAIEDKRHTSRSATAPTI

SEQ ID NO: 3137323 - protein, 8 aa, Giardia lamblia
SKAKKQLT

SEQ ID NO: 3137324 - protein, 7 aa, Giardia lamblia
SKAKLSN

SEQ ID NO: 3137325 - protein, 8 aa, Giardia lamblia
SKANLSQS

SEQ ID NO: 3137326 - protein, 8 aa, Giardia lamblia
SKAPKKSV

SEQ ID NO: 3137327 - protein, 9 aa, Giardia lamblia
SKAPVELDA

SEQ ID NO: 3137328 - protein, 17 aa, Giardia lamblia
SKAQAVQRKGRAGRVQK

SEQ ID NO: 3137329 - protein, 12 aa, Giardia lamblia
SKAQGPDAPGLE

SEQ ID NO: 3137330 - protein, 8 aa, Giardia lamblia
SKAQSRLG

SEQ ID NO: 3137331 - protein, 15 aa, Giardia lamblia
SKAQVDSVKRASNQL

SEQ ID NO: 3137332 - protein, 27 aa, Giardia lamblia
SKASDQDLPQQDPPRLARSSSANDTDI

SEQ ID NO: 3137333 - protein, 6 aa, Giardia lamblia
SKASGV

SEQ ID NO: 3137334 - protein, 6 aa, Giardia lamblia
SKASLQ

SEQ ID NO: 3137335 - protein, 20 aa, Giardia lamblia
SKASPGAASRTNLGSRTGRM

SEQ ID NO: 3137336 - protein, 35 aa, Giardia lamblia
SKASTAPEGGFTEPLRGTSVPPRNIGTQRRPSSPF

SEQ ID NO: 3137337 - protein, 8 aa, Giardia lamblia
SKASVSNT

SEQ ID NO: 3137338 - protein, 11 aa, Giardia lamblia
SKATQAGEEDM

SEQ ID NO: 3137339 - protein, 12 aa, Giardia lamblia
SKATRDDIDEYR

SEQ ID NO: 3137340 - protein, 18 aa, Giardia lamblia
SKAYKRDSQVTDKRRSYD

SEQ ID NO: 3137341 - protein, 5 aa, Giardia lamblia
SKCEN

SEQ ID NO: 3137342 - protein, 14 aa, Giardia lamblia
SKCKEGDKDARVSY

SEQ ID NO: 3137343 - protein, 7 aa, Giardia lamblia
SKCQQQA

SEQ ID NO: 3137344 - protein, 9 aa, Giardia lamblia
SKCRDAQGR

SEQ ID NO: 3137345 - protein, 10 aa, Giardia lamblia
SKCRDNNGQT

SEQ ID NO: 3137346 - protein, 6 aa, Giardia lamblia
SKCTNS

SEQ ID NO: 3137347 - protein, 17 aa, Giardia lamblia
SKDAESKKHEATNATRD

SEQ ID NO: 3137348 - protein, 5 aa, Giardia lamblia
SKDAH

SEQ ID NO: 3137349 - protein, 10 aa, Giardia lamblia
SKDAHTKYAG

SEQ ID NO: 3137350 - protein, 7 aa, Giardia lamblia
SKDARVR

SEQ ID NO: 3137351 - protein, 5 aa, Giardia lamblia
SKDAV

SEQ ID NO: 3137352 - protein, 12 aa, Giardia lamblia
SKDAVGPKEDGG

SEQ ID NO: 3137353 - protein, 7 aa, Giardia lamblia
SKDDEIQ

SEQ ID NO: 3137354 - protein, 8 aa, Giardia lamblia
SKDDTGDE

SEQ ID NO: 3137355 - protein, 6 aa, Giardia lamblia
SKDDTK

SEQ ID NO: 3137356 - protein, 8 aa, Giardia lamblia
SKDDYEER

SEQ ID NO: 3137357 - protein, 6 aa, Giardia lamblia
SKDEAQ

SEQ ID NO: 3137358 - protein, 6 aa, Giardia lamblia
SKDEEI

SEQ ID NO: 3137359 - protein, 7 aa, Giardia lamblia
SKDEEIE

SEQ ID NO: 3137360 - protein, 8 aa, Giardia lamblia
SKDEQIET

SEQ ID NO: 3137361 - protein, 9 aa, Giardia lamblia
SKDESTDSI

SEQ ID NO: 3137362 - protein, 6 aa, Giardia lamblia
SKDGLQ

SEQ ID NO: 3137363 - protein, 17 aa, Giardia lamblia
SKDKDTRSDGDDSHSTT

SEQ ID NO: 3137364 - protein, 5 aa, Giardia lamblia
SKDLS

SEQ ID NO: 3137365 - protein, 10 aa, Giardia lamblia
SKDNKGTSRA

SEQ ID NO: 3137366 - protein, 7 aa, Giardia lamblia
SKDNSSA

SEQ ID NO: 3137367 - protein, 8 aa, Giardia lamblia
SKDPARLA

SEQ ID NO: 3137368 - protein, 6 aa, Giardia lamblia
SKDPEL

SEQ ID NO: 3137369 - protein, 7 aa, Giardia lamblia
SKDPSIT

SEQ ID NO: 3137370 - protein, 6 aa, Giardia lamblia
SKDPVS

SEQ ID NO: 3137371 - protein, 8 aa, Giardia lamblia
SKDQKDKL

SEQ ID NO: 3137372 - protein, 12 aa, Giardia lamblia
SKDRDENTGSGE

SEQ ID NO: 3137373 - protein, 11 aa, Giardia lamblia
SKDRGSGTETG

SEQ ID NO: 3137374 - protein, 14 aa, Giardia lamblia
SKDRPGIAHPSGAV

SEQ ID NO: 3137375 - protein, 23 aa, Giardia lamblia
SKDSFSPTNDTAGAADALGSHSD

SEQ ID NO: 3137376 - protein, 9 aa, Giardia lamblia
SKDSGVKAG

SEQ ID NO: 3137377 - protein, 6 aa, Giardia lamblia
SKDSIE

SEQ ID NO: 3137378 - protein, 8 aa, Giardia lamblia
SKDTATDT

SEQ ID NO: 3137379 - protein, 8 aa, Giardia lamblia
SKDTDLGK

SEQ ID NO: 3137380 - protein, 8 aa, Giardia lamblia
SKDTEETV

SEQ ID NO: 3137381 - protein, 7 aa, Giardia lamblia
SKDTQEA

SEQ ID NO: 3137382 - protein, 4 aa, Giardia lamblia
SKEA

SEQ ID NO: 3137383 - protein, 7 aa, Giardia lamblia
SKEASQY

SEQ ID NO: 3137384 - protein, 5 aa, Giardia lamblia
SKEAV

SEQ ID NO: 3137385 - protein, 6 aa, Giardia lamblia
SKECYG

SEQ ID NO: 3137386 - protein, 8 aa, Giardia lamblia
SKEDNSIA

SEQ ID NO: 3137387 - protein, 10 aa, Giardia lamblia
SKEDQSTISS

SEQ ID NO: 3137388 - protein, 13 aa, Giardia lamblia
SKEDRKRSRHAEA

SEQ ID NO: 3137389 - protein, 4 aa, Giardia lamblia
SKEE

SEQ ID NO: 3137390 - protein, 6 aa, Giardia lamblia
SKEEGL

SEQ ID NO: 3137391 - protein, 13 aa, Giardia lamblia
SKEEQSSTSAGSY

SEQ ID NO: 3137392 - protein, 12 aa, Giardia lamblia
SKEERAAGQRSR

SEQ ID NO: 3137393 - protein, 8 aa, Giardia lamblia
SKEGLQDD

SEQ ID NO: 3137394 - protein, 9 aa, Giardia lamblia
SKEGRAAFR

SEQ ID NO: 3137395 - protein, 34 aa, Giardia lamblia
SKEGRIEASDQGRTGAKRRGRRRRGRSNKDLLTK

SEQ ID NO: 3137396 - protein, 21 aa, Giardia lamblia
SKEIPKAESQTTKLSFRRNVK

SEQ ID NO: 3137397 - protein, 9 aa, Giardia lamblia
SKEIPTDDV

SEQ ID NO: 3137398 - protein, 6 aa, Giardia lamblia
SKEIRK

SEQ ID NO: 3137399 - protein, 5 aa, Giardia lamblia
SKEKF

SEQ ID NO: 3137400 - protein, 21 aa, Giardia lamblia
SKEKPQQSVYEDTDGCTDLNP

SEQ ID NO: 3137401 - protein, 11 aa, Giardia lamblia
SKELANKKEKI

SEQ ID NO: 3137402 - protein, 5 aa, Giardia lamblia
SKELT

SEQ ID NO: 3137403 - protein, 8 aa, Giardia lamblia
SKELTSQT

SEQ ID NO: 3137404 - protein, 4 aa, Giardia lamblia
SKEM

SEQ ID NO: 3137405 - protein, 10 aa, Giardia lamblia
SKENAQSPIN

SEQ ID NO: 3137406 - protein, 9 aa, Giardia lamblia
SKENDSEHN

SEQ ID NO: 3137407 - protein, 10 aa, Giardia lamblia
SKENSELTQQ

SEQ ID NO: 3137408 - protein, 16 aa, Giardia lamblia
SKEPDPNELSDDPSVE

SEQ ID NO: 3137409 - protein, 14 aa, Giardia lamblia
SKEPHKKHSKYPQL

SEQ ID NO: 3137410 - protein, 48 aa, Giardia lamblia
SKEPKEASLSPRQKIPALSDSDLGPAATTVTDAVANGDEQGPGASAAT

SEQ ID NO: 3137411 - protein, 13 aa, Giardia lamblia
SKEPSSSSKRSLQ

SEQ ID NO: 3137412 - protein, 7 aa, Giardia lamblia
SKEPTDI

SEQ ID NO: 3137413 - protein, 18 aa, Giardia lamblia
SKEQIDAASDAGDALPAS

SEQ ID NO: 3137414 - protein, 7 aa, Giardia lamblia
SKEQSTI

SEQ ID NO: 3137415 - protein, 5 aa, Giardia lamblia
SKERE

SEQ ID NO: 3137416 - protein, 7 aa, Giardia lamblia
SKERGLD

SEQ ID NO: 3137417 - protein, 9 aa, Giardia lamblia
SKERQQKEM

SEQ ID NO: 3137418 - protein, 5 aa, Giardia lamblia
SKERY

SEQ ID NO: 3137419 - protein, 7 aa, Giardia lamblia
SKESNGQ

SEQ ID NO: 3137420 - protein, 5 aa, Giardia lamblia
SKEST

SEQ ID NO: 3137421 - protein, 6 aa, Giardia lamblia
SKETEA

SEQ ID NO: 3137422 - protein, 10 aa, Giardia lamblia
SKETKALKKE

SEQ ID NO: 3137423 - protein, 8 aa, Giardia lamblia
SKETQETR

SEQ ID NO: 3137424 - protein, 12 aa, Giardia lamblia
SKETQPSAGPTD

SEQ ID NO: 3137425 - protein, 35 aa, Giardia lamblia
SKETTMQTATSTATMQREEYEKRYTELKKSNAEVE

SEQ ID NO: 3137426 - protein, 6 aa, Giardia lamblia
SKEVPN

SEQ ID NO: 3137427 - protein, 4 aa, Giardia lamblia
SKFD

SEQ ID NO: 3137428 - protein, 13 aa, Giardia lamblia
SKFKGSRTQSGDT

SEQ ID NO: 3137429 - protein, 13 aa, Giardia lamblia
SKFPGTHSTQQAW

SEQ ID NO: 3137430 - protein, 16 aa, Giardia lamblia
SKFSERSNASDPAVDV

SEQ ID NO: 3137431 - protein, 8 aa, Giardia lamblia
SKFSGDGK

SEQ ID NO: 3137432 - protein, 22 aa, Giardia lamblia
SKGAPSSDIAKTQAQDLDSTES

SEQ ID NO: 3137433 - protein, 10 aa, Giardia lamblia
SKGEKPGNQV

SEQ ID NO: 3137434 - protein, 18 aa, Giardia lamblia
SKGETSVLTTQKEADSRK

SEQ ID NO: 3137435 - protein, 7 aa, Giardia lamblia
SKGGAIK

SEQ ID NO: 3137436 - protein, 11 aa, Giardia lamblia
SKGGGAPSYKT

SEQ ID NO: 3137437 - protein, 13 aa, Giardia lamblia
SKGGQFSTGLAQT

SEQ ID NO: 3137438 - protein, 7 aa, Giardia lamblia
SKGHTDS

SEQ ID NO: 3137439 - protein, 5 aa, Giardia lamblia
SKGHV

SEQ ID NO: 3137440 - protein, 9 aa, Giardia lamblia
SKGISGSRS

SEQ ID NO: 3137441 - protein, 8 aa, Giardia lamblia
SKGKNRGC

SEQ ID NO: 3137442 - protein, 13 aa, Giardia lamblia
SKGKRSSLPGLRR

SEQ ID NO: 3137443 - protein, 10 aa, Giardia lamblia
SKGLADAAAH

SEQ ID NO: 3137444 - protein, 6 aa, Giardia lamblia
SKGLEE

SEQ ID NO: 3137445 - protein, 7 aa, Giardia lamblia
SKGLTPV

SEQ ID NO: 3137446 - protein, 4 aa, Giardia lamblia
SKGN

SEQ ID NO: 3137447 - protein, 6 aa, Giardia lamblia
SKGNEA

SEQ ID NO: 3137448 - protein, 6 aa, Giardia lamblia
SKGNLQ

SEQ ID NO: 3137449 - protein, 6 aa, Giardia lamblia
SKGNPA

SEQ ID NO: 3137450 - protein, 6 aa, Giardia lamblia
SKGNSE

SEQ ID NO: 3137451 - protein, 9 aa, Giardia lamblia
SKGRDEVKS

SEQ ID NO: 3137452 - protein, 6 aa, Giardia lamblia
SKGRFY

SEQ ID NO: 3137453 - protein, 7 aa, Giardia lamblia
SKGRLQG

SEQ ID NO: 3137454 - protein, 9 aa, Giardia lamblia
SKGRPPPRK

SEQ ID NO: 3137455 - protein, 7 aa, Giardia lamblia
SKGSPIN

SEQ ID NO: 3137456 - protein, 16 aa, Giardia lamblia
SKGSYRSYRRRSKSEY

SEQ ID NO: 3137457 - protein, 8 aa, Giardia lamblia
SKGSYSKK

SEQ ID NO: 3137458 - protein, 6 aa, Giardia lamblia
SKGVIQ

SEQ ID NO: 3137459 - protein, 13 aa, Giardia lamblia
SKHAGRRNKAQKT

SEQ ID NO: 3137460 - protein, 4 aa, Giardia lamblia
SKHD

SEQ ID NO: 3137461 - protein, 9 aa, Giardia lamblia
SKHERQDSF

SEQ ID NO: 3137462 - protein, 14 aa, Giardia lamblia
SKHGSSKITASNTH

SEQ ID NO: 3137463 - protein, 8 aa, Giardia lamblia
SKHHPSAD

SEQ ID NO: 3137464 - protein, 18 aa, Giardia lamblia
SKHISGSARVSLPPLARV

SEQ ID NO: 3137465 - protein, 21 aa, Giardia lamblia
SKHNADEDSALSGKDKGMSPI

SEQ ID NO: 3137466 - protein, 6 aa, Giardia lamblia
SKHNES

SEQ ID NO: 3137467 - protein, 8 aa, Giardia lamblia
SKHNSPGV

SEQ ID NO: 3137468 - protein, 7 aa, Giardia lamblia
SKHPATL

SEQ ID NO: 3137469 - protein, 9 aa, Giardia lamblia
SKHRHKGTT

SEQ ID NO: 3137470 - protein, 8 aa, Giardia lamblia
SKHRHRHR

SEQ ID NO: 3137471 - protein, 11 aa, Giardia lamblia
SKHRNREKDDL

SEQ ID NO: 3137472 - protein, 12 aa, Giardia lamblia
SKHSGDTSSRGV

SEQ ID NO: 3137473 - protein, 7 aa, Giardia lamblia
SKHSPDF

SEQ ID NO: 3137474 - protein, 7 aa, Giardia lamblia
SKHSSKC

SEQ ID NO: 3137475 - protein, 7 aa, Giardia lamblia
SKHTPEL

SEQ ID NO: 3137476 - protein, 13 aa, Giardia lamblia
SKHTPYERDGVPS

SEQ ID NO: 3137477 - protein, 6 aa, Giardia lamblia
SKIAAP

SEQ ID NO: 3137478 - protein, 10 aa, Giardia lamblia
SKIAKQTQEI

SEQ ID NO: 3137479 - protein, 15 aa, Giardia lamblia
SKIDEERSSNKRSIS

SEQ ID NO: 3137480 - protein, 19 aa, Giardia lamblia
SKIDNSRGRVSTLSRPRTS

SEQ ID NO: 3137481 - protein, 8 aa, Giardia lamblia
SKIDSAAL

SEQ ID NO: 3137482 - protein, 5 aa, Giardia lamblia
SKIDT

SEQ ID NO: 3137483 - protein, 26 aa, Giardia lamblia
SKINQTDNNNQQNEMKQATELPVPKR

SEQ ID NO: 3137484 - protein, 5 aa, Giardia lamblia
SKINS

SEQ ID NO: 3137485 - protein, 9 aa, Giardia lamblia
SKIPEDSNS

SEQ ID NO: 3137486 - protein, 6 aa, Giardia lamblia
SKIPKM

SEQ ID NO: 3137487 - protein, 5 aa, Giardia lamblia
SKIQS

SEQ ID NO: 3137488 - protein, 10 aa, Giardia lamblia
SKKDEEATHA

SEQ ID NO: 3137489 - protein, 8 aa, Giardia lamblia
SKKDNKKC

SEQ ID NO: 3137490 - protein, 12 aa, Giardia lamblia
SKKDPPPAPLTT

SEQ ID NO: 3137491 - protein, 9 aa, Giardia lamblia
SKKEATSSI

SEQ ID NO: 3137492 - protein, 7 aa, Giardia lamblia
SKKETEA

SEQ ID NO: 3137493 - protein, 16 aa, Giardia lamblia
SKKEVGTKEQSKALEQ

SEQ ID NO: 3137494 - protein, 10 aa, Giardia lamblia
SKKFSASRET

SEQ ID NO: 3137495 - protein, 8 aa, Giardia lamblia
SKKGSTDA

SEQ ID NO: 3137496 - protein, 21 aa, Giardia lamblia
SKKHASNARTSRGAAGAGANA

SEQ ID NO: 3137497 - protein, 8 aa, Giardia lamblia
SKKHDTDF

SEQ ID NO: 3137498 - protein, 22 aa, Giardia lamblia
SKKHTDPSLTAEPLRKQAAANS

SEQ ID NO: 3137499 - protein, 10 aa, Giardia lamblia
SKKKSAMGSV

SEQ ID NO: 3137500 - protein, 6 aa, Giardia lamblia
SKKMGS

SEQ ID NO: 3137501 - protein, 9 aa, Giardia lamblia
SKKNEGQKI

SEQ ID NO: 3137502 - protein, 7 aa, Giardia lamblia
SKKNNTI

SEQ ID NO: 3137503 - protein, 32 aa, Giardia lamblia
SKKPDAQPLGTDRSDKQSSTRALGSTKDKQKS

SEQ ID NO: 3137504 - protein, 15 aa, Giardia lamblia
SKKPEYKKNEIRPMN

SEQ ID NO: 3137505 - protein, 8 aa, Giardia lamblia
SKKPFPGA

SEQ ID NO: 3137506 - protein, 17 aa, Giardia lamblia
SKKQEVETARSEKNAMG

SEQ ID NO: 3137507 - protein, 8 aa, Giardia lamblia
SKKRDYDA

SEQ ID NO: 3137508 - protein, 9 aa, Giardia lamblia
SKKSNKFEE

SEQ ID NO: 3137509 - protein, 8 aa, Giardia lamblia
SKKSSQLK

SEQ ID NO: 3137510 - protein, 9 aa, Giardia lamblia
SKKVTQKGS

SEQ ID NO: 3137511 - protein, 8 aa, Giardia lamblia
SKKYPTKT

SEQ ID NO: 3137512 - protein, 17 aa, Giardia lamblia
SKLDREQGHTVKSMTNG

SEQ ID NO: 3137513 - protein, 11 aa, Giardia lamblia
SKLDSDRAQLR

SEQ ID NO: 3137514 - protein, 6 aa, Giardia lamblia
SKLEIE

SEQ ID NO: 3137515 - protein, 14 aa, Giardia lamblia
SKLETAAKSTCFPK

SEQ ID NO: 3137516 - protein, 7 aa, Giardia lamblia
SKLGKND

SEQ ID NO: 3137517 - protein, 21 aa, Giardia lamblia
SKLGLTQDPSRVTEDGVGRAQ

SEQ ID NO: 3137518 - protein, 5 aa, Giardia lamblia
SKLKA

SEQ ID NO: 3137519 - protein, 6 aa, Giardia lamblia
SKLNER

SEQ ID NO: 3137520 - protein, 17 aa, Giardia lamblia
SKLPAHKDTADPSSEHA

SEQ ID NO: 3137521 - protein, 9 aa, Giardia lamblia
SKLPASEDL

SEQ ID NO: 3137522 - protein, 5 aa, Giardia lamblia
SKLPR

SEQ ID NO: 3137523 - protein, 21 aa, Giardia lamblia
SKLPRNSAPRGAADDDARDMR

SEQ ID NO: 3137524 - protein, 7 aa, Giardia lamblia
SKLPRTS

SEQ ID NO: 3137525 - protein, 6 aa, Giardia lamblia
SKLPSS

SEQ ID NO: 3137526 - protein, 6 aa, Giardia lamblia
SKLRPS

SEQ ID NO: 3137527 - protein, 12 aa, Giardia lamblia
SKLSPRGPSQHQ

SEQ ID NO: 3137528 - protein, 8 aa, Giardia lamblia
SKLSTRRL

SEQ ID NO: 3137529 - protein, 16 aa, Giardia lamblia
SKLTSPVSKRPSLAEV

SEQ ID NO: 3137530 - protein, 23 aa, Giardia lamblia
SKMGRGSSMGSRSLSVSTAPGTM

SEQ ID NO: 3137531 - protein, 17 aa, Giardia lamblia
SKMKGKRDTRATNTDGS

SEQ ID NO: 3137532 - protein, 9 aa, Giardia lamblia
SKMNANTEQ

SEQ ID NO: 3137533 - protein, 6 aa, Giardia lamblia
SKMNQA

SEQ ID NO: 3137534 - protein, 8 aa, Giardia lamblia
SKMPGQHV

SEQ ID NO: 3137535 - protein, 8 aa, Giardia lamblia
SKNAATIA

SEQ ID NO: 3137536 - protein, 8 aa, Giardia lamblia
SKNADKSI

SEQ ID NO: 3137537 - protein, 6 aa, Giardia lamblia
SKNAEI

SEQ ID NO: 3137538 - protein, 7 aa, Giardia lamblia
SKNASLA

SEQ ID NO: 3137539 - protein, 8 aa, Giardia lamblia
SKNATDKL

SEQ ID NO: 3137540 - protein, 6 aa, Giardia lamblia
SKNDKL

SEQ ID NO: 3137541 - protein, 5 aa, Giardia lamblia
SKNET

SEQ ID NO: 3137542 - protein, 5 aa, Giardia lamblia
SKNGG

SEQ ID NO: 3137543 - protein, 7 aa, Giardia lamblia
SKNGLSR

SEQ ID NO: 3137544 - protein, 13 aa, Giardia lamblia
SKNGRAVTDKGET

SEQ ID NO: 3137545 - protein, 5 aa, Giardia lamblia
SKNKA

SEQ ID NO: 3137546 - protein, 6 aa, Giardia lamblia
SKNPAI

SEQ ID NO: 3137547 - protein, 22 aa, Giardia lamblia
SKNPEKRARSTKLTSNPTRKVP

SEQ ID NO: 3137548 - protein, 28 aa, Giardia lamblia
SKNPGTSQSAKSYPAGTTESAETSENSF

SEQ ID NO: 3137549 - protein, 6 aa, Giardia lamblia
SKNPLA

SEQ ID NO: 3137550 - protein, 6 aa, Giardia lamblia
SKNRQI

SEQ ID NO: 3137551 - protein, 12 aa, Giardia lamblia
SKNSEPQGPVTT

SEQ ID NO: 3137552 - protein, 6 aa, Giardia lamblia
SKNSKL

SEQ ID NO: 3137553 - protein, 5 aa, Giardia lamblia
SKNST

SEQ ID NO: 3137554 - protein, 6 aa, Giardia lamblia
SKNTIQ

SEQ ID NO: 3137555 - protein, 5 aa, Giardia lamblia
SKNTV

SEQ ID NO: 3137556 - protein, 10 aa, Giardia lamblia
SKNVNPDEAV

SEQ ID NO: 3137557 - protein, 10 aa, Giardia lamblia
SKPATDEQGH

SEQ ID NO: 3137558 - protein, 9 aa, Giardia lamblia
SKPCDPDAD

SEQ ID NO: 3137559 - protein, 28 aa, Giardia lamblia
SKPCTADSSMQRSVGAAKTKKDRERESL

SEQ ID NO: 3137560 - protein, 10 aa, Giardia lamblia
SKPDASRASS

SEQ ID NO: 3137561 - protein, 8 aa, Giardia lamblia
SKPEQDAP

SEQ ID NO: 3137562 - protein, 8 aa, Giardia lamblia
SKPEVSAT

SEQ ID NO: 3137563 - protein, 8 aa, Giardia lamblia
SKPFESYG

SEQ ID NO: 3137564 - protein, 5 aa, Giardia lamblia
SKPFT

SEQ ID NO: 3137565 - protein, 5 aa, Giardia lamblia
SKPGG

SEQ ID NO: 3137566 - protein, 7 aa, Giardia lamblia
SKPGPVY

SEQ ID NO: 3137567 - protein, 7 aa, Giardia lamblia
SKPINSI

SEQ ID NO: 3137568 - protein, 16 aa, Giardia lamblia
SKPKITSGGKPKVHTR

SEQ ID NO: 3137569 - protein, 9 aa, Giardia lamblia
SKPKKSTRE

SEQ ID NO: 3137570 - protein, 6 aa, Giardia lamblia
SKPPDL

SEQ ID NO: 3137571 - protein, 6 aa, Giardia lamblia
SKPPSR

SEQ ID NO: 3137572 - protein, 37 aa, Giardia lamblia
SKPPSTTNSRTTTPKRGASTSTRSERTASTSVSPRAV

SEQ ID NO: 3137573 - protein, 6 aa, Giardia lamblia
SKPQHV

SEQ ID NO: 3137574 - protein, 32 aa, Giardia lamblia
SKPQKDIGKDVSNASKHANTSMPGSSGYYGED

SEQ ID NO: 3137575 - protein, 9 aa, Giardia lamblia
SKPRQWTKG

SEQ ID NO: 3137576 - protein, 13 aa, Giardia lamblia
SKPSAPAGSNYDA

SEQ ID NO: 3137577 - protein, 40 aa, Giardia lamblia
SKPSLSGSPRPASEKTPLSRNDGSLRQVSARSRPSAFRTS

SEQ ID NO: 3137578 - protein, 5 aa, Giardia lamblia
SKPSM

SEQ ID NO: 3137579 - protein, 9 aa, Giardia lamblia
SKPSSESAV

SEQ ID NO: 3137580 - protein, 6 aa, Giardia lamblia
SKPSVQ

SEQ ID NO: 3137581 - protein, 8 aa, Giardia lamblia
SKPSYASN

SEQ ID NO: 3137582 - protein, 5 aa, Giardia lamblia
SKPTA

SEQ ID NO: 3137583 - protein, 7 aa, Giardia lamblia
SKPTDCD

SEQ ID NO: 3137584 - protein, 5 aa, Giardia lamblia
SKPTR

SEQ ID NO: 3137585 - protein, 5 aa, Giardia lamblia
SKPTV

SEQ ID NO: 3137586 - protein, 5 aa, Giardia lamblia
SKPVS

SEQ ID NO: 3137587 - protein, 7 aa, Giardia lamblia
SKQADNA

SEQ ID NO: 3137588 - protein, 7 aa, Giardia lamblia
SKQALGK

SEQ ID NO: 3137589 - protein, 10 aa, Giardia lamblia
SKQASQQSDV

SEQ ID NO: 3137590 - protein, 8 aa, Giardia lamblia
SKQDLSPD

SEQ ID NO: 3137591 - protein, 9 aa, Giardia lamblia
SKQDPERER

SEQ ID NO: 3137592 - protein, 5 aa, Giardia lamblia
SKQED

SEQ ID NO: 3137593 - protein, 19 aa, Giardia lamblia
SKQEVSAADGQSDAITDAA

SEQ ID NO: 3137594 - protein, 9 aa, Giardia lamblia
SKQGEHANV

SEQ ID NO: 3137595 - protein, 5 aa, Giardia lamblia
SKQGH

SEQ ID NO: 3137596 - protein, 20 aa, Giardia lamblia
SKQIAEGAEIPARARKPTTF

SEQ ID NO: 3137597 - protein, 7 aa, Giardia lamblia
SKQIDAG

SEQ ID NO: 3137598 - protein, 12 aa, Giardia lamblia
SKQKEKQHATGR

SEQ ID NO: 3137599 - protein, 10 aa, Giardia lamblia
SKQLGKRDTY

SEQ ID NO: 3137600 - protein, 5 aa, Giardia lamblia
SKQLQ

SEQ ID NO: 3137601 - protein, 5 aa, Giardia lamblia
SKQLS

SEQ ID NO: 3137602 - protein, 13 aa, Giardia lamblia
SKQNSHSLQPGAV

SEQ ID NO: 3137603 - protein, 9 aa, Giardia lamblia
SKQNTTRKG

SEQ ID NO: 3137604 - protein, 22 aa, Giardia lamblia
SKQNVDATVGAGDPAEAAKAKQ

SEQ ID NO: 3137605 - protein, 18 aa, Giardia lamblia
SKQNVDNVDEPRKGTEVG

SEQ ID NO: 3137606 - protein, 10 aa, Giardia lamblia
SKQPKARAAG

SEQ ID NO: 3137607 - protein, 11 aa, Giardia lamblia
SKQPRSRSIRP

SEQ ID NO: 3137608 - protein, 11 aa, Giardia lamblia
SKQQKYSTAEY

SEQ ID NO: 3137609 - protein, 13 aa, Giardia lamblia
SKQQQPPPQPVKQ

SEQ ID NO: 3137610 - protein, 8 aa, Giardia lamblia
SKQQQQEA

SEQ ID NO: 3137611 - protein, 19 aa, Giardia lamblia
SKQQQQQQQSVSQIPPATL

SEQ ID NO: 3137612 - protein, 19 aa, Giardia lamblia
SKQQSAQRGRDTQTTSRTP

SEQ ID NO: 3137613 - protein, 4 aa, Giardia lamblia
SKQR

SEQ ID NO: 3137614 - protein, 5 aa, Giardia lamblia
SKQSI

SEQ ID NO: 3137615 - protein, 6 aa, Giardia lamblia
SKQSNT

SEQ ID NO: 3137616 - protein, 10 aa, Giardia lamblia
SKQSQTAQSI

SEQ ID NO: 3137617 - protein, 7 aa, Giardia lamblia
SKQSTQV

SEQ ID NO: 3137618 - protein, 6 aa, Giardia lamblia
SKQTGA

SEQ ID NO: 3137619 - protein, 8 aa, Giardia lamblia
SKQTHKAG

SEQ ID NO: 3137620 - protein, 12 aa, Giardia lamblia
SKQTKHSRRFKS

SEQ ID NO: 3137621 - protein, 13 aa, Giardia lamblia
SKQTVAESSPPQI

SEQ ID NO: 3137622 - protein, 6 aa, Giardia lamblia
SKQYRD

SEQ ID NO: 3137623 - protein, 7 aa, Giardia lamblia
SKRASNA

SEQ ID NO: 3137624 - protein, 6 aa, Giardia lamblia
SKRDQA

SEQ ID NO: 3137625 - protein, 10 aa, Giardia lamblia
SKREGNGKIT

SEQ ID NO: 3137626 - protein, 8 aa, Giardia lamblia
SKRFDSSG

SEQ ID NO: 3137627 - protein, 7 aa, Giardia lamblia
SKRGKLQ

SEQ ID NO: 3137628 - protein, 4 aa, Giardia lamblia
SKRI

SEQ ID NO: 3137629 - protein, 9 aa, Giardia lamblia
SKRKSVPLN

SEQ ID NO: 3137630 - protein, 20 aa, Giardia lamblia
SKRKTTLKPEAPETQSTPQL

SEQ ID NO: 3137631 - protein, 12 aa, Giardia lamblia
SKRLPNNSHPKS

SEQ ID NO: 3137632 - protein, 14 aa, Giardia lamblia
SKRLQDKTSSLRSS

SEQ ID NO: 3137633 - protein, 5 aa, Giardia lamblia
SKRLS

SEQ ID NO: 3137634 - protein, 7 aa, Giardia lamblia
SKRPAAA

SEQ ID NO: 3137635 - protein, 5 aa, Giardia lamblia
SKRPL

SEQ ID NO: 3137636 - protein, 6 aa, Giardia lamblia
SKRPRT

SEQ ID NO: 3137637 - protein, 10 aa, Giardia lamblia
SKRPTDKSGE

SEQ ID NO: 3137638 - protein, 13 aa, Giardia lamblia
SKRQAKISEKAAE

SEQ ID NO: 3137639 - protein, 9 aa, Giardia lamblia
SKRQDVTRA

SEQ ID NO: 3137640 - protein, 8 aa, Giardia lamblia
SKRQKDDE

SEQ ID NO: 3137641 - protein, 5 aa, Giardia lamblia
SKRRG

SEQ ID NO: 3137642 - protein, 6 aa, Giardia lamblia
SKRRGT

SEQ ID NO: 3137643 - protein, 6 aa, Giardia lamblia
SKRRHA

SEQ ID NO: 3137644 - protein, 7 aa, Giardia lamblia
SKRSDEI

SEQ ID NO: 3137645 - protein, 12 aa, Giardia lamblia
SKRSEDEEPENC

SEQ ID NO: 3137646 - protein, 8 aa, Giardia lamblia
SKRSHPPV

SEQ ID NO: 3137647 - protein, 7 aa, Giardia lamblia
SKRSPTE

SEQ ID NO: 3137648 - protein, 14 aa, Giardia lamblia
SKRSRPDKQGSEAA

SEQ ID NO: 3137649 - protein, 18 aa, Giardia lamblia
SKRSRTPSCEQPRPEQTL

SEQ ID NO: 3137650 - protein, 7 aa, Giardia lamblia
SKRTPMS

SEQ ID NO: 3137651 - protein, 7 aa, Giardia lamblia
SKRVTNT

SEQ ID NO: 3137652 - protein, 17 aa, Giardia lamblia
SKSAKRPRVKTPSPKVD

SEQ ID NO: 3137653 - protein, 10 aa, Giardia lamblia
SKSATSASSM

SEQ ID NO: 3137654 - protein, 9 aa, Giardia lamblia
SKSDSFKPK

SEQ ID NO: 3137655 - protein, 14 aa, Giardia lamblia
SKSEAITSKFSTTR

SEQ ID NO: 3137656 - protein, 8 aa, Giardia lamblia
SKSEDHSK

SEQ ID NO: 3137657 - protein, 5 aa, Giardia lamblia
SKSES

SEQ ID NO: 3137658 - protein, 22 aa, Giardia lamblia
SKSESKDNYRAQRYPDGINPRT

SEQ ID NO: 3137659 - protein, 11 aa, Giardia lamblia
SKSESNLKSAS

SEQ ID NO: 3137660 - protein, 15 aa, Giardia lamblia
SKSETFQPHKASARL

SEQ ID NO: 3137661 - protein, 11 aa, Giardia lamblia
SKSFDKPLQDH

SEQ ID NO: 3137662 - protein, 7 aa, Giardia lamblia
SKSGLDT

SEQ ID NO: 3137663 - protein, 5 aa, Giardia lamblia
SKSGR

SEQ ID NO: 3137664 - protein, 10 aa, Giardia lamblia
SKSIDNPVEV

SEQ ID NO: 3137665 - protein, 10 aa, Giardia lamblia
SKSISDQAIS

SEQ ID NO: 3137666 - protein, 7 aa, Giardia lamblia
SKSISGH

SEQ ID NO: 3137667 - protein, 17 aa, Giardia lamblia
SKSKAINGVSEKSHSKL

SEQ ID NO: 3137668 - protein, 12 aa, Giardia lamblia
SKSKASVSLEDE

SEQ ID NO: 3137669 - protein, 5 aa, Giardia lamblia
SKSKL

SEQ ID NO: 3137670 - protein, 12 aa, Giardia lamblia
SKSKSKSNSTIN

SEQ ID NO: 3137671 - protein, 13 aa, Giardia lamblia
SKSLSGLSSAQEL

SEQ ID NO: 3137672 - protein, 32 aa, Giardia lamblia
SKSLTRPRTASRSGPAALDSSRTDSTPGSSYL

SEQ ID NO: 3137673 - protein, 16 aa, Giardia lamblia
SKSNAQQKKKFQAQQK

SEQ ID NO: 3137674 - protein, 10 aa, Giardia lamblia
SKSNKGQIPE

SEQ ID NO: 3137675 - protein, 6 aa, Giardia lamblia
SKSNSK

SEQ ID NO: 3137676 - protein, 56 aa, Giardia lamblia
SKSPALKENAGPSDAGPTNNSKESATSSKPKTHTSKKEKHDAAPDKSEPATPPGAP

SEQ ID NO: 3137677 - protein, 7 aa, Giardia lamblia
SKSPEVA

SEQ ID NO: 3137678 - protein, 6 aa, Giardia lamblia
SKSPHA

SEQ ID NO: 3137679 - protein, 6 aa, Giardia lamblia
SKSPLT

SEQ ID NO: 3137680 - protein, 8 aa, Giardia lamblia
SKSQEIDT

SEQ ID NO: 3137681 - protein, 14 aa, Giardia lamblia
SKSRADKEQPIAGE

SEQ ID NO: 3137682 - protein, 6 aa, Giardia lamblia
SKSRLS

SEQ ID NO: 3137683 - protein, 6 aa, Giardia lamblia
SKSRNH

SEQ ID NO: 3137684 - protein, 8 aa, Giardia lamblia
SKSRPTDA

SEQ ID NO: 3137685 - protein, 25 aa, Giardia lamblia
SKSRSNSPEYQSASSAEPSNTYITP

SEQ ID NO: 3137686 - protein, 9 aa, Giardia lamblia
SKSSDGSEE

SEQ ID NO: 3137687 - protein, 20 aa, Giardia lamblia
SKSSGTPGVSASAIRKQPPE

SEQ ID NO: 3137688 - protein, 6 aa, Giardia lamblia
SKSSIS

SEQ ID NO: 3137689 - protein, 6 aa, Giardia lamblia
SKSSKF

SEQ ID NO: 3137690 - protein, 8 aa, Giardia lamblia
SKSSTEFA

SEQ ID NO: 3137691 - protein, 21 aa, Giardia lamblia
SKSSTSAPTAVPQEPSGAHEE

SEQ ID NO: 3137692 - protein, 9 aa, Giardia lamblia
SKSSTSDDV

SEQ ID NO: 3137693 - protein, 14 aa, Giardia lamblia
SKSTGNRDPETGQK

SEQ ID NO: 3137694 - protein, 6 aa, Giardia lamblia
SKSTIQ

SEQ ID NO: 3137695 - protein, 12 aa, Giardia lamblia
SKSTKGSSPRAD

SEQ ID NO: 3137696 - protein, 12 aa, Giardia lamblia
SKSTPTVSRLDS

SEQ ID NO: 3137697 - protein, 7 aa, Giardia lamblia
SKSVSPT

SEQ ID NO: 3137698 - protein, 12 aa, Giardia lamblia
SKSWSARGSIQQ

SEQ ID NO: 3137699 - protein, 13 aa, Giardia lamblia
SKTAESTVTKTSR

SEQ ID NO: 3137700 - protein, 7 aa, Giardia lamblia
SKTASEC

SEQ ID NO: 3137701 - protein, 9 aa, Giardia lamblia
SKTAWTDNS

SEQ ID NO: 3137702 - protein, 6 aa, Giardia lamblia
SKTCGK

SEQ ID NO: 3137703 - protein, 5 aa, Giardia lamblia
SKTDI

SEQ ID NO: 3137704 - protein, 6 aa, Giardia lamblia
SKTERD

SEQ ID NO: 3137705 - protein, 5 aa, Giardia lamblia
SKTGA

SEQ ID NO: 3137706 - protein, 8 aa, Giardia lamblia
SKTGAVQG

SEQ ID NO: 3137707 - protein, 5 aa, Giardia lamblia
SKTGM

SEQ ID NO: 3137708 - protein, 11 aa, Giardia lamblia
SKTGRKYTPAM

SEQ ID NO: 3137709 - protein, 11 aa, Giardia lamblia
SKTGSGKTAAY

SEQ ID NO: 3137710 - protein, 4 aa, Giardia lamblia
SKTI

SEQ ID NO: 3137711 - protein, 6 aa, Giardia lamblia
SKTLEK

SEQ ID NO: 3137712 - protein, 9 aa, Giardia lamblia
SKTLENDHA

SEQ ID NO: 3137713 - protein, 14 aa, Giardia lamblia
SKTLRTRNAETKKI

SEQ ID NO: 3137714 - protein, 8 aa, Giardia lamblia
SKTLSPGE

SEQ ID NO: 3137715 - protein, 6 aa, Giardia lamblia
SKTLTR

SEQ ID NO: 3137716 - protein, 5 aa, Giardia lamblia
SKTNQ

SEQ ID NO: 3137717 - protein, 21 aa, Giardia lamblia
SKTNSLEDAGGTKNTSSHETP

SEQ ID NO: 3137718 - protein, 6 aa, Giardia lamblia
SKTNVD

SEQ ID NO: 3137719 - protein, 27 aa, Giardia lamblia
SKTPATDVTHTRSNPPFTEPAKPTVKK

SEQ ID NO: 3137720 - protein, 17 aa, Giardia lamblia
SKTPGSAIQSTKISNDC

SEQ ID NO: 3137721 - protein, 70 aa, Giardia lamblia
SKTPKQGPVTPGPGAYNPRPQSSGPSFSLSGRSPVRKPRTESPGPGAYNPQLKNTGPSFSMGGTRSPVRI

SEQ ID NO: 3137722 - protein, 7 aa, Giardia lamblia
SKTPVRK

SEQ ID NO: 3137723 - protein, 8 aa, Giardia lamblia
SKTPYSKG

SEQ ID NO: 3137724 - protein, 14 aa, Giardia lamblia
SKTQRDHECTGNPF

SEQ ID NO: 3137725 - protein, 7 aa, Giardia lamblia
SKTSEGR

SEQ ID NO: 3137726 - protein, 5 aa, Giardia lamblia
SKTSF

SEQ ID NO: 3137727 - protein, 6 aa, Giardia lamblia
SKTSKY

SEQ ID NO: 3137728 - protein, 9 aa, Giardia lamblia
SKTSLPPVK

SEQ ID NO: 3137729 - protein, 12 aa, Giardia lamblia
SKTSPQVGPPTV

SEQ ID NO: 3137730 - protein, 5 aa, Giardia lamblia
SKTTD

SEQ ID NO: 3137731 - protein, 7 aa, Giardia lamblia
SKTTIKQ

SEQ ID NO: 3137732 - protein, 8 aa, Giardia lamblia
SKTTQRQH

SEQ ID NO: 3137733 - protein, 5 aa, Giardia lamblia
SKTVT

SEQ ID NO: 3137734 - protein, 4 aa, Giardia lamblia
SKTW

SEQ ID NO: 3137735 - protein, 8 aa, Giardia lamblia
SKVDCTNK

SEQ ID NO: 3137736 - protein, 7 aa, Giardia lamblia
SKVDSKN

SEQ ID NO: 3137737 - protein, 10 aa, Giardia lamblia
SKVEPTPITE

SEQ ID NO: 3137738 - protein, 17 aa, Giardia lamblia
SKVESVQSGASTKLGSV

SEQ ID NO: 3137739 - protein, 6 aa, Giardia lamblia
SKVNAM

SEQ ID NO: 3137740 - protein, 10 aa, Giardia lamblia
SKVNTSMPPD

SEQ ID NO: 3137741 - protein, 8 aa, Giardia lamblia
SKVPDQLS

SEQ ID NO: 3137742 - protein, 22 aa, Giardia lamblia
SKVPRPPQKKGAEEAQKKVSTF

SEQ ID NO: 3137743 - protein, 4 aa, Giardia lamblia
SKVS

SEQ ID NO: 3137744 - protein, 5 aa, Giardia lamblia
SKVSG

SEQ ID NO: 3137745 - protein, 7 aa, Giardia lamblia
SKVSSKA

SEQ ID NO: 3137746 - protein, 4 aa, Giardia lamblia
SKVT

SEQ ID NO: 3137747 - protein, 4 aa, Giardia lamblia
SKYD

SEQ ID NO: 3137748 - protein, 7 aa, Giardia lamblia
SKYDSSD

SEQ ID NO: 3137749 - protein, 7 aa, Giardia lamblia
SKYESQP

SEQ ID NO: 3137750 - protein, 10 aa, Giardia lamblia
SKYKLPDGSV

SEQ ID NO: 3137751 - protein, 10 aa, Giardia lamblia
SKYNKEYPPV

SEQ ID NO: 3137752 - protein, 7 aa, Giardia lamblia
SKYPETH

SEQ ID NO: 3137753 - protein, 9 aa, Giardia lamblia
SKYRGEAEK

SEQ ID NO: 3137754 - protein, 26 aa, Giardia lamblia
SKYRQPKTLSSTISDSPSARASAASA

SEQ ID NO: 3137755 - protein, 6 aa, Giardia lamblia
SKYTQE

SEQ ID NO: 3137756 - protein, 10 aa, Giardia lamblia
SKYYDSNIGR

SEQ ID NO: 3137757 - protein, 7 aa, Giardia lamblia
SLAAETG

SEQ ID NO: 3137758 - protein, 35 aa, Giardia lamblia
SLADETSGVSHAAESSRRSDNRSYIGTNEPSASAG

SEQ ID NO: 3137759 - protein, 7 aa, Giardia lamblia
SLAEAGR

SEQ ID NO: 3137760 - protein, 14 aa, Giardia lamblia
SLAEDGKVVENAAS

SEQ ID NO: 3137761 - protein, 14 aa, Giardia lamblia
SLAEDSKAVPPPVK

SEQ ID NO: 3137762 - protein, 9 aa, Giardia lamblia
SLAEGKGVS

SEQ ID NO: 3137763 - protein, 17 aa, Giardia lamblia
SLAGNRDSGDTSGDSVA

SEQ ID NO: 3137764 - protein, 9 aa, Giardia lamblia
SLAGPSDEH

SEQ ID NO: 3137765 - protein, 16 aa, Giardia lamblia
SLAGRNNQKLSPYGRV

SEQ ID NO: 3137766 - protein, 20 aa, Giardia lamblia
SLAHSKSQESALKKQKKQLD

SEQ ID NO: 3137767 - protein, 13 aa, Giardia lamblia
SLANARDQEVKAE

SEQ ID NO: 3137768 - protein, 13 aa, Giardia lamblia
SLANQKRLEAEKK

SEQ ID NO: 3137769 - protein, 19 aa, Giardia lamblia
SLANTSRRNRNVRSHYGPS

SEQ ID NO: 3137770 - protein, 13 aa, Giardia lamblia
SLAPKGSLAGTTA

SEQ ID NO: 3137771 - protein, 7 aa, Giardia lamblia
SLAPKTS

SEQ ID NO: 3137772 - protein, 12 aa, Giardia lamblia
SLAQGRSVTHAE

SEQ ID NO: 3137773 - protein, 18 aa, Giardia lamblia
SLAQSQLSIDSDSRDSEV

SEQ ID NO: 3137774 - protein, 12 aa, Giardia lamblia
SLARGNDGEIAQ

SEQ ID NO: 3137775 - protein, 7 aa, Giardia lamblia
SLARNGG

SEQ ID NO: 3137776 - protein, 11 aa, Giardia lamblia
SLARPQGPLSK

SEQ ID NO: 3137777 - protein, 6 aa, Giardia lamblia
SLARPT

SEQ ID NO: 3137778 - protein, 14 aa, Giardia lamblia
SLARSTSRSTQNLG

SEQ ID NO: 3137779 - protein, 11 aa, Giardia lamblia
SLASAQPSLSK

SEQ ID NO: 3137780 - protein, 8 aa, Giardia lamblia
SLASLSKS

SEQ ID NO: 3137781 - protein, 7 aa, Giardia lamblia
SLASNNP

SEQ ID NO: 3137782 - protein, 21 aa, Giardia lamblia
SLASNSHQSGVYPPSDSPKQL

SEQ ID NO: 3137783 - protein, 6 aa, Giardia lamblia
SLASSL

SEQ ID NO: 3137784 - protein, 4 aa, Giardia lamblia
SLAT

SEQ ID NO: 3137785 - protein, 14 aa, Giardia lamblia
SLDARTKLAEEYND

SEQ ID NO: 3137786 - protein, 8 aa, Giardia lamblia
SLDASGNT

SEQ ID NO: 3137787 - protein, 6 aa, Giardia lamblia
SLDDSE

SEQ ID NO: 3137788 - protein, 5 aa, Giardia lamblia
SLDDT

SEQ ID NO: 3137789 - protein, 4 aa, Giardia lamblia
SLDE

SEQ ID NO: 3137790 - protein, 8 aa, Giardia lamblia
SLDEPPEK

SEQ ID NO: 3137791 - protein, 6 aa, Giardia lamblia
SLDESA

SEQ ID NO: 3137792 - protein, 8 aa, Giardia lamblia
SLDGSGKH

SEQ ID NO: 3137793 - protein, 5 aa, Giardia lamblia
SLDGT

SEQ ID NO: 3137794 - protein, 4 aa, Giardia lamblia
SLDK

SEQ ID NO: 3137795 - protein, 9 aa, Giardia lamblia
SLDKEDSVE

SEQ ID NO: 3137796 - protein, 6 aa, Giardia lamblia
SLDKQA

SEQ ID NO: 3137797 - protein, 20 aa, Giardia lamblia
SLDNDAAKNSLDQRPHPSED

SEQ ID NO: 3137798 - protein, 17 aa, Giardia lamblia
SLDNQEPGSMPSTANQS

SEQ ID NO: 3137799 - protein, 6 aa, Giardia lamblia
SLDNQQ

SEQ ID NO: 3137800 - protein, 6 aa, Giardia lamblia
SLDNSA

SEQ ID NO: 3137801 - protein, 5 aa, Giardia lamblia
SLDPE

SEQ ID NO: 3137802 - protein, 9 aa, Giardia lamblia
SLDPNTSYA

SEQ ID NO: 3137803 - protein, 5 aa, Giardia lamblia
SLDRD

SEQ ID NO: 3137804 - protein, 8 aa, Giardia lamblia
SLDSDGRQ

SEQ ID NO: 3137805 - protein, 10 aa, Giardia lamblia
SLDSGQEPIP

SEQ ID NO: 3137806 - protein, 10 aa, Giardia lamblia
SLDSKSTARF

SEQ ID NO: 3137807 - protein, 11 aa, Giardia lamblia
SLEAGGRSSVE

SEQ ID NO: 3137808 - protein, 20 aa, Giardia lamblia
SLEASAGGFGGAPGAGDPGA

SEQ ID NO: 3137809 - protein, 26 aa, Giardia lamblia
SLEDNKSCSYSQSQSTSNNSGQSPHI

SEQ ID NO: 3137810 - protein, 17 aa, Giardia lamblia
SLEEAAPALNPIPSSPV

SEQ ID NO: 3137811 - protein, 19 aa, Giardia lamblia
SLEESLAGGSADAKAVQSL

SEQ ID NO: 3137812 - protein, 5 aa, Giardia lamblia
SLEET

SEQ ID NO: 3137813 - protein, 6 aa, Giardia lamblia
SLEEVT

SEQ ID NO: 3137814 - protein, 17 aa, Giardia lamblia
SLEGDKNAAENTPTGIA

SEQ ID NO: 3137815 - protein, 19 aa, Giardia lamblia
SLEGVSESVTHPDEPHDDH

SEQ ID NO: 3137816 - protein, 12 aa, Giardia lamblia
SLEKPDKQVEHP

SEQ ID NO: 3137817 - protein, 5 aa, Giardia lamblia
SLEPE

SEQ ID NO: 3137818 - protein, 10 aa, Giardia lamblia
SLEPNATAIQ

SEQ ID NO: 3137819 - protein, 4 aa, Giardia lamblia
SLEQ

SEQ ID NO: 3137820 - protein, 6 aa, Giardia lamblia
SLEQAT

SEQ ID NO: 3137821 - protein, 5 aa, Giardia lamblia
SLEQD

SEQ ID NO: 3137822 - protein, 13 aa, Giardia lamblia
SLEQKIRQTEDAS

SEQ ID NO: 3137823 - protein, 6 aa, Giardia lamblia
SLEQRR

SEQ ID NO: 3137824 - protein, 5 aa, Giardia lamblia
SLERP

SEQ ID NO: 3137825 - protein, 9 aa, Giardia lamblia
SLERSKERE

SEQ ID NO: 3137826 - protein, 7 aa, Giardia lamblia
SLERSSA

SEQ ID NO: 3137827 - protein, 16 aa, Giardia lamblia
SLESAREEADNERNTR

SEQ ID NO: 3137828 - protein, 5 aa, Giardia lamblia
SLETA

SEQ ID NO: 3137829 - protein, 11 aa, Giardia lamblia
SLETKNKKWKD

SEQ ID NO: 3137830 - protein, 7 aa, Giardia lamblia
SLGAGLG

SEQ ID NO: 3137831 - protein, 6 aa, Giardia lamblia
SLGAPM

SEQ ID NO: 3137832 - protein, 4 aa, Giardia lamblia
SLGD

SEQ ID NO: 3137833 - protein, 8 aa, Giardia lamblia
SLGDDPYE

SEQ ID NO: 3137834 - protein, 21 aa, Giardia lamblia
SLGDSGTSTSDNGGSASATDL

SEQ ID NO: 3137835 - protein, 9 aa, Giardia lamblia
SLGEASQCS

SEQ ID NO: 3137836 - protein, 4 aa, Giardia lamblia
SLGG

SEQ ID NO: 3137837 - protein, 7 aa, Giardia lamblia
SLGGASK

SEQ ID NO: 3137838 - protein, 5 aa, Giardia lamblia
SLGGN

SEQ ID NO: 3137839 - protein, 7 aa, Giardia lamblia
SLGGRTK

SEQ ID NO: 3137840 - protein, 6 aa, Giardia lamblia
SLGGRY

SEQ ID NO: 3137841 - protein, 7 aa, Giardia lamblia
SLGGSST

SEQ ID NO: 3137842 - protein, 8 aa, Giardia lamblia
SLGGTSST

SEQ ID NO: 3137843 - protein, 6 aa, Giardia lamblia
SLGIPS

SEQ ID NO: 3137844 - protein, 11 aa, Giardia lamblia
SLGKTVNDTYG

SEQ ID NO: 3137845 - protein, 10 aa, Giardia lamblia
SLGNDQAELS

SEQ ID NO: 3137846 - protein, 4 aa, Giardia lamblia
SLGP

SEQ ID NO: 3137847 - protein, 6 aa, Giardia lamblia
SLGPRG

SEQ ID NO: 3137848 - protein, 10 aa, Giardia lamblia
SLGPVSSPTE

SEQ ID NO: 3137849 - protein, 25 aa, Giardia lamblia
SLGQLSSDTQAALSTQAAKQETLPN

SEQ ID NO: 3137850 - protein, 8 aa, Giardia lamblia
SLGQNKSA

SEQ ID NO: 3137851 - protein, 5 aa, Giardia lamblia
SLGQT

SEQ ID NO: 3137852 - protein, 19 aa, Giardia lamblia
SLGRKAEARAEEVRDRERQ

SEQ ID NO: 3137853 - protein, 5 aa, Giardia lamblia
SLGRS

SEQ ID NO: 3137854 - protein, 8 aa, Giardia lamblia
SLGRTTTA

SEQ ID NO: 3137855 - protein, 10 aa, Giardia lamblia
SLGSETPAAV

SEQ ID NO: 3137856 - protein, 7 aa, Giardia lamblia
SLGSGLP

SEQ ID NO: 3137857 - protein, 6 aa, Giardia lamblia
SLGSPH

SEQ ID NO: 3137858 - protein, 6 aa, Giardia lamblia
SLGSRS

SEQ ID NO: 3137859 - protein, 11 aa, Giardia lamblia
SLGTHNPEPVM

SEQ ID NO: 3137860 - protein, 16 aa, Giardia lamblia
SLGTSSRNKSCNRTSQ

SEQ ID NO: 3137861 - protein, 4 aa, Giardia lamblia
SLHS

SEQ ID NO: 3137862 - protein, 10 aa, Giardia lamblia
SLHSAPGQPN

SEQ ID NO: 3137863 - protein, 16 aa, Giardia lamblia
SLHSPAKPSSRGRHMP

SEQ ID NO: 3137864 - protein, 10 aa, Giardia lamblia
SLHSQPPVHS

SEQ ID NO: 3137865 - protein, 19 aa, Giardia lamblia
SLHSRSQGKLEQMDAGTPL

SEQ ID NO: 3137866 - protein, 8 aa, Giardia lamblia
SLHTPSTI

SEQ ID NO: 3137867 - protein, 6 aa, Giardia lamblia
SLIGSD

SEQ ID NO: 3137868 - protein, 8 aa, Giardia lamblia
SLKDHNTD

SEQ ID NO: 3137869 - protein, 8 aa, Giardia lamblia
SLKDSEQT

SEQ ID NO: 3137870 - protein, 4 aa, Giardia lamblia
SLKG

SEQ ID NO: 3137871 - protein, 10 aa, Giardia lamblia
SLKGDSKDPH

SEQ ID NO: 3137872 - protein, 8 aa, Giardia lamblia
SLKGGTAE

SEQ ID NO: 3137873 - protein, 4 aa, Giardia lamblia
SLKH

SEQ ID NO: 3137874 - protein, 4 aa, Giardia lamblia
SLKK

SEQ ID NO: 3137875 - protein, 10 aa, Giardia lamblia
SLKKPDQPKM

SEQ ID NO: 3137876 - protein, 15 aa, Giardia lamblia
SLKPSDAGPYPTNPY

SEQ ID NO: 3137877 - protein, 16 aa, Giardia lamblia
SLKQESSLKQANNACE

SEQ ID NO: 3137878 - protein, 12 aa, Giardia lamblia
SLKSAQDQGHQE

SEQ ID NO: 3137879 - protein, 10 aa, Giardia lamblia
SLKSEVDAKT

SEQ ID NO: 3137880 - protein, 6 aa, Giardia lamblia
SLKTDN

SEQ ID NO: 3137881 - protein, 4 aa, Giardia lamblia
SLLG

SEQ ID NO: 3137882 - protein, 5 aa, Giardia lamblia
SLLSD

SEQ ID NO: 3137883 - protein, 10 aa, Giardia lamblia
SLLSPAKPSH

SEQ ID NO: 3137884 - protein, 5 aa, Giardia lamblia
SLNDE

SEQ ID NO: 3137885 - protein, 9 aa, Giardia lamblia
SLNDKTSAL

SEQ ID NO: 3137886 - protein, 8 aa, Giardia lamblia
SLNGPTSA

SEQ ID NO: 3137887 - protein, 9 aa, Giardia lamblia
SLNKNDISE

SEQ ID NO: 3137888 - protein, 26 aa, Giardia lamblia
SLNNSRAESPKEASDEDLIGITFKKN

SEQ ID NO: 3137889 - protein, 4 aa, Giardia lamblia
SLNP

SEQ ID NO: 3137890 - protein, 9 aa, Giardia lamblia
SLNPESKSE

SEQ ID NO: 3137891 - protein, 13 aa, Giardia lamblia
SLNPGAATYAYPA

SEQ ID NO: 3137892 - protein, 12 aa, Giardia lamblia
SLNQEGPLTTEN

SEQ ID NO: 3137893 - protein, 12 aa, Giardia lamblia
SLNSGDNDAATD

SEQ ID NO: 3137894 - protein, 5 aa, Giardia lamblia
SLNSR

SEQ ID NO: 3137895 - protein, 10 aa, Giardia lamblia
SLNSTSLDKQ

SEQ ID NO: 3137896 - protein, 5 aa, Giardia lamblia
SLNYP

SEQ ID NO: 3137897 - protein, 16 aa, Giardia lamblia
SLPAPTYHPPGYSGVP

SEQ ID NO: 3137898 - protein, 5 aa, Giardia lamblia
SLPDA

SEQ ID NO: 3137899 - protein, 12 aa, Giardia lamblia
SLPDAPEQYAAE

SEQ ID NO: 3137900 - protein, 14 aa, Giardia lamblia
SLPDRSRPKSFATD

SEQ ID NO: 3137901 - protein, 18 aa, Giardia lamblia
SLPEDHEATADCKDPTLS

SEQ ID NO: 3137902 - protein, 19 aa, Giardia lamblia
SLPENRDTEPSSTQNNPEV

SEQ ID NO: 3137903 - protein, 19 aa, Giardia lamblia
SLPEPAPNEARATPPTPLT

SEQ ID NO: 3137904 - protein, 5 aa, Giardia lamblia
SLPET

SEQ ID NO: 3137905 - protein, 4 aa, Giardia lamblia
SLPG

SEQ ID NO: 3137906 - protein, 6 aa, Giardia lamblia
SLPGSS

SEQ ID NO: 3137907 - protein, 10 aa, Giardia lamblia
SLPGTEQQPV

SEQ ID NO: 3137908 - protein, 12 aa, Giardia lamblia
SLPKAGSPSKSI

SEQ ID NO: 3137909 - protein, 12 aa, Giardia lamblia
SLPKESAGIKTP

SEQ ID NO: 3137910 - protein, 22 aa, Giardia lamblia
SLPKQEASSPSAVNETANELPS

SEQ ID NO: 3137911 - protein, 13 aa, Giardia lamblia
SLPKTDPIKALEM

SEQ ID NO: 3137912 - protein, 17 aa, Giardia lamblia
SLPLNKQSSRPKTTDNS

SEQ ID NO: 3137913 - protein, 6 aa, Giardia lamblia
SLPNNA

SEQ ID NO: 3137914 - protein, 5 aa, Giardia lamblia
SLPPI

SEQ ID NO: 3137915 - protein, 10 aa, Giardia lamblia
SLPPPEIPAS

SEQ ID NO: 3137916 - protein, 6 aa, Giardia lamblia
SLPPPS

SEQ ID NO: 3137917 - protein, 22 aa, Giardia lamblia
SLPPPYSRREEQEVSTLPTKEE

SEQ ID NO: 3137918 - protein, 8 aa, Giardia lamblia
SLPPSTVS

SEQ ID NO: 3137919 - protein, 5 aa, Giardia lamblia
SLPPT

SEQ ID NO: 3137920 - protein, 6 aa, Giardia lamblia
SLPPTE

SEQ ID NO: 3137921 - protein, 8 aa, Giardia lamblia
SLPQKPDI

SEQ ID NO: 3137922 - protein, 11 aa, Giardia lamblia
SLPQSQLTGKG

SEQ ID NO: 3137923 - protein, 6 aa, Giardia lamblia
SLPQSR

SEQ ID NO: 3137924 - protein, 6 aa, Giardia lamblia
SLPQTE

SEQ ID NO: 3137925 - protein, 4 aa, Giardia lamblia
SLPR

SEQ ID NO: 3137926 - protein, 10 aa, Giardia lamblia
SLPRDEQGNT

SEQ ID NO: 3137927 - protein, 16 aa, Giardia lamblia
SLPRSTTVATSRSAGG

SEQ ID NO: 3137928 - protein, 4 aa, Giardia lamblia
SLPS

SEQ ID NO: 3137929 - protein, 15 aa, Giardia lamblia
SLPSGGAAEAISSDQ

SEQ ID NO: 3137930 - protein, 9 aa, Giardia lamblia
SLPSLPDTT

SEQ ID NO: 3137931 - protein, 12 aa, Giardia lamblia
SLPSPSTAKGLP

SEQ ID NO: 3137932 - protein, 6 aa, Giardia lamblia
SLPSVR

SEQ ID NO: 3137933 - protein, 6 aa, Giardia lamblia
SLPSYK

SEQ ID NO: 3137934 - protein, 36 aa, Giardia lamblia
SLPTPRSSTRRRRPLRSPSSTRDGPAAASEKDPRVF

SEQ ID NO: 3137935 - protein, 9 aa, Giardia lamblia
SLPTPTSDF

SEQ ID NO: 3137936 - protein, 5 aa, Giardia lamblia
SLQAE

SEQ ID NO: 3137937 - protein, 4 aa, Giardia lamblia
SLQD

SEQ ID NO: 3137938 - protein, 8 aa, Giardia lamblia
SLQDAKKE

SEQ ID NO: 3137939 - protein, 9 aa, Giardia lamblia
SLQDENGTT

SEQ ID NO: 3137940 - protein, 6 aa, Giardia lamblia
SLQGAL

SEQ ID NO: 3137941 - protein, 7 aa, Giardia lamblia
SLQKAES

SEQ ID NO: 3137942 - protein, 7 aa, Giardia lamblia
SLQNKRT

SEQ ID NO: 3137943 - protein, 7 aa, Giardia lamblia
SLQNPQD

SEQ ID NO: 3137944 - protein, 6 aa, Giardia lamblia
SLQNQY

SEQ ID NO: 3137945 - protein, 24 aa, Giardia lamblia
SLQNSSNTNLNSQQSPRQDTPTNL

SEQ ID NO: 3137946 - protein, 6 aa, Giardia lamblia
SLQPAN

SEQ ID NO: 3137947 - protein, 7 aa, Giardia lamblia
SLQPGQS

SEQ ID NO: 3137948 - protein, 7 aa, Giardia lamblia
SLQQEQQ

SEQ ID NO: 3137949 - protein, 11 aa, Giardia lamblia
SLQQTGERVDE

SEQ ID NO: 3137950 - protein, 9 aa, Giardia lamblia
SLQSQSNSQ

SEQ ID NO: 3137951 - protein, 8 aa, Giardia lamblia
SLQTDAKS

SEQ ID NO: 3137952 - protein, 8 aa, Giardia lamblia
SLRDDPAF

SEQ ID NO: 3137953 - protein, 9 aa, Giardia lamblia
SLRDSTGGD

SEQ ID NO: 3137954 - protein, 19 aa, Giardia lamblia
SLRDTPTRSLDSDLSRSLS

SEQ ID NO: 3137955 - protein, 8 aa, Giardia lamblia
SLREDGAK

SEQ ID NO: 3137956 - protein, 7 aa, Giardia lamblia
SLREQAE

SEQ ID NO: 3137957 - protein, 8 aa, Giardia lamblia
SLRETSSV

SEQ ID NO: 3137958 - protein, 7 aa, Giardia lamblia
SLRGGRR

SEQ ID NO: 3137959 - protein, 4 aa, Giardia lamblia
SLRH

SEQ ID NO: 3137960 - protein, 11 aa, Giardia lamblia
SLRPPEKPSLT

SEQ ID NO: 3137961 - protein, 10 aa, Giardia lamblia
SLRQTDGSAL

SEQ ID NO: 3137962 - protein, 6 aa, Giardia lamblia
SLRRAD

SEQ ID NO: 3137963 - protein, 15 aa, Giardia lamblia
SLRTNTMAGDGTTTS

SEQ ID NO: 3137964 - protein, 9 aa, Giardia lamblia
SLRTPGVSR

SEQ ID NO: 3137965 - protein, 7 aa, Giardia lamblia
SLRTQKS

SEQ ID NO: 3137966 - protein, 8 aa, Giardia lamblia
SLSAAGEQ

SEQ ID NO: 3137967 - protein, 7 aa, Giardia lamblia
SLSARQS

SEQ ID NO: 3137968 - protein, 25 aa, Giardia lamblia
SLSASTALSRSTTCQLGSSRTITSG

SEQ ID NO: 3137969 - protein, 9 aa, Giardia lamblia
SLSASVKPK

SEQ ID NO: 3137970 - protein, 17 aa, Giardia lamblia
SLSDENNPSNDPDQTYH

SEQ ID NO: 3137971 - protein, 7 aa, Giardia lamblia
SLSDKAH

SEQ ID NO: 3137972 - protein, 6 aa, Giardia lamblia
SLSDPG

SEQ ID NO: 3137973 - protein, 5 aa, Giardia lamblia
SLSDS

SEQ ID NO: 3137974 - protein, 11 aa, Giardia lamblia
SLSDTESSGRE

SEQ ID NO: 3137975 - protein, 5 aa, Giardia lamblia
SLSDV

SEQ ID NO: 3137976 - protein, 10 aa, Giardia lamblia
SLSGKKTRLD

SEQ ID NO: 3137977 - protein, 7 aa, Giardia lamblia
SLSGNSK

SEQ ID NO: 3137978 - protein, 52 aa, Giardia lamblia
SLSGSSQSITAPAISDKQANEKIKSIPESESTKPSKKNSSGSRNEQSIGASK

SEQ ID NO: 3137979 - protein, 7 aa, Giardia lamblia
SLSGTGS

SEQ ID NO: 3137980 - protein, 9 aa, Giardia lamblia
SLSKRTAET

SEQ ID NO: 3137981 - protein, 14 aa, Giardia lamblia
SLSNSGRVRSMPSD

SEQ ID NO: 3137982 - protein, 20 aa, Giardia lamblia
SLSPAAAQARAISNATRQSH

SEQ ID NO: 3137983 - protein, 8 aa, Giardia lamblia
SLSPDDPI

SEQ ID NO: 3137984 - protein, 20 aa, Giardia lamblia
SLSPPKKNKTSINDSHDSKI

SEQ ID NO: 3137985 - protein, 9 aa, Giardia lamblia
SLSPQHPEM

SEQ ID NO: 3137986 - protein, 5 aa, Giardia lamblia
SLSPS

SEQ ID NO: 3137987 - protein, 4 aa, Giardia lamblia
SLSQ

SEQ ID NO: 3137988 - protein, 8 aa, Giardia lamblia
SLSQAGSE

SEQ ID NO: 3137989 - protein, 4 aa, Giardia lamblia
SLSR

SEQ ID NO: 3137990 - protein, 8 aa, Giardia lamblia
SLSRDNRE

SEQ ID NO: 3137991 - protein, 33 aa, Giardia lamblia
SLSRRSLDDTGSQPNRAKDSVPDVDTSSQEEAK

SEQ ID NO: 3137992 - protein, 8 aa, Giardia lamblia
SLSRSRAS

SEQ ID NO: 3137993 - protein, 8 aa, Giardia lamblia
SLSRTKSI

SEQ ID NO: 3137994 - protein, 9 aa, Giardia lamblia
SLSRYDDKS

SEQ ID NO: 3137995 - protein, 24 aa, Giardia lamblia
SLSSRPSSPDYKRDTAAGHEGYSA

SEQ ID NO: 3137996 - protein, 10 aa, Giardia lamblia
SLSSSARDRP

SEQ ID NO: 3137997 - protein, 12 aa, Giardia lamblia
SLSSSGVQTSDI

SEQ ID NO: 3137998 - protein, 11 aa, Giardia lamblia
SLSSSSAGKAV

SEQ ID NO: 3137999 - protein, 7 aa, Giardia lamblia
SLSSYSQ

SEQ ID NO: 3138000 - protein, 20 aa, Giardia lamblia
SLSTAQGDLTSPSDPQSPYI

SEQ ID NO: 3138001 - protein, 14 aa, Giardia lamblia
SLSTEAVADADSGV

SEQ ID NO: 3138002 - protein, 7 aa, Giardia lamblia
SLSTHSQ

SEQ ID NO: 3138003 - protein, 7 aa, Giardia lamblia
SLSTPSL

SEQ ID NO: 3138004 - protein, 13 aa, Giardia lamblia
SLSTRQPTEEGTM

SEQ ID NO: 3138005 - protein, 6 aa, Giardia lamblia
SLSTSL

SEQ ID NO: 3138006 - protein, 44 aa, Giardia lamblia
SLSTTKKSLAESNTSATKSALAPLRSSRTTGGSRLGSVAGTRTI

SEQ ID NO: 3138007 - protein, 13 aa, Giardia lamblia
SLSTTSQVPSTFN

SEQ ID NO: 3138008 - protein, 13 aa, Giardia lamblia
SLSVESKAAGSME

SEQ ID NO: 3138009 - protein, 9 aa, Giardia lamblia
SLTAEETGR

SEQ ID NO: 3138010 - protein, 9 aa, Giardia lamblia
SLTDENDTI

SEQ ID NO: 3138011 - protein, 12 aa, Giardia lamblia
SLTDPPQYATPH

SEQ ID NO: 3138012 - protein, 32 aa, Giardia lamblia
SLTDVGEVDSDLGPGAGVDVKSPESEYEKPNT

SEQ ID NO: 3138013 - protein, 24 aa, Giardia lamblia
SLTEDEYNAVKGSAIGSGAPDMEK

SEQ ID NO: 3138014 - protein, 21 aa, Giardia lamblia
SLTEDQSSLSSKLTTSKLGTS

SEQ ID NO: 3138015 - protein, 7 aa, Giardia lamblia
SLTEDSM

SEQ ID NO: 3138016 - protein, 22 aa, Giardia lamblia
SLTESGLARPQISVPDDSSDTF

SEQ ID NO: 3138017 - protein, 4 aa, Giardia lamblia
SLTG

SEQ ID NO: 3138018 - protein, 7 aa, Giardia lamblia
SLTGKGI

SEQ ID NO: 3138019 - protein, 7 aa, Giardia lamblia
SLTGTEE

SEQ ID NO: 3138020 - protein, 10 aa, Giardia lamblia
SLTHGKSGSV

SEQ ID NO: 3138021 - protein, 4 aa, Giardia lamblia
SLTK

SEQ ID NO: 3138022 - protein, 13 aa, Giardia lamblia
SLTKSPRPKETPV

SEQ ID NO: 3138023 - protein, 8 aa, Giardia lamblia
SLTPQSSF

SEQ ID NO: 3138024 - protein, 4 aa, Giardia lamblia
SLTR

SEQ ID NO: 3138025 - protein, 8 aa, Giardia lamblia
SLTRSAAE

SEQ ID NO: 3138026 - protein, 15 aa, Giardia lamblia
SLTSAKEDLAEKQAA

SEQ ID NO: 3138027 - protein, 10 aa, Giardia lamblia
SLTSARNDAL

SEQ ID NO: 3138028 - protein, 5 aa, Giardia lamblia
SLTSE

SEQ ID NO: 3138029 - protein, 6 aa, Giardia lamblia
SLTSET

SEQ ID NO: 3138030 - protein, 6 aa, Giardia lamblia
SLTSKG

SEQ ID NO: 3138031 - protein, 33 aa, Giardia lamblia
SLTSSPVYRSTNSLVDSSKSYLRDSSSTYENRR

SEQ ID NO: 3138032 - protein, 8 aa, Giardia lamblia
SLTTSGRE

SEQ ID NO: 3138033 - protein, 6 aa, Giardia lamblia
SLTTTS

SEQ ID NO: 3138034 - protein, 5 aa, Giardia lamblia
SLTYS

SEQ ID NO: 3138035 - protein, 5 aa, Giardia lamblia
SLVET

SEQ ID NO: 3138036 - protein, 10 aa, Giardia lamblia
SLVTDTQTTL

SEQ ID NO: 3138037 - protein, 14 aa, Giardia lamblia
SLYSGAGESAADTV

SEQ ID NO: 3138038 - protein, 4 aa, Giardia lamblia
SMAG

SEQ ID NO: 3138039 - protein, 23 aa, Giardia lamblia
SMAPGVSLGPDETSSSRQSPSRM

SEQ ID NO: 3138040 - protein, 14 aa, Giardia lamblia
SMAPPSTSSTTERL

SEQ ID NO: 3138041 - protein, 11 aa, Giardia lamblia
SMASNEGRNLK

SEQ ID NO: 3138042 - protein, 29 aa, Giardia lamblia
SMASSEKTTQEFATEGETDEAPKSDNLHN

SEQ ID NO: 3138043 - protein, 6 aa, Giardia lamblia
SMASTT

SEQ ID NO: 3138044 - protein, 15 aa, Giardia lamblia
SMATEHETEANGSRI

SEQ ID NO: 3138045 - protein, 12 aa, Giardia lamblia
SMATGDSAPHST

SEQ ID NO: 3138046 - protein, 7 aa, Giardia lamblia
SMDAGGA

SEQ ID NO: 3138047 - protein, 6 aa, Giardia lamblia
SMDKRP

SEQ ID NO: 3138048 - protein, 4 aa, Giardia lamblia
SMDS

SEQ ID NO: 3138049 - protein, 8 aa, Giardia lamblia
SMDTASYK

SEQ ID NO: 3138050 - protein, 9 aa, Giardia lamblia
SMDTPSRAL

SEQ ID NO: 3138051 - protein, 10 aa, Giardia lamblia
SMEAAPNAQE

SEQ ID NO: 3138052 - protein, 5 aa, Giardia lamblia
SMESS

SEQ ID NO: 3138053 - protein, 5 aa, Giardia lamblia
SMETG

SEQ ID NO: 3138054 - protein, 8 aa, Giardia lamblia
SMGCTGPK

SEQ ID NO: 3138055 - protein, 4 aa, Giardia lamblia
SMGE

SEQ ID NO: 3138056 - protein, 10 aa, Giardia lamblia
SMGKQDNKGM

SEQ ID NO: 3138057 - protein, 8 aa, Giardia lamblia
SMGQDKRL

SEQ ID NO: 3138058 - protein, 4 aa, Giardia lamblia
SMGT

SEQ ID NO: 3138059 - protein, 13 aa, Giardia lamblia
SMGTSQKLTRELD

SEQ ID NO: 3138060 - protein, 5 aa, Giardia lamblia
SMKAK

SEQ ID NO: 3138061 - protein, 8 aa, Giardia lamblia
SMNKDTSF

SEQ ID NO: 3138062 - protein, 10 aa, Giardia lamblia
SMNPSSSSFA

SEQ ID NO: 3138063 - protein, 6 aa, Giardia lamblia
SMPDGR

SEQ ID NO: 3138064 - protein, 39 aa, Giardia lamblia
SMPGTQANEDVSQRETPKEKGKEKEAPKAKDVGAVSENS

SEQ ID NO: 3138065 - protein, 9 aa, Giardia lamblia
SMPKSGAQR

SEQ ID NO: 3138066 - protein, 4 aa, Giardia lamblia
SMPP

SEQ ID NO: 3138067 - protein, 12 aa, Giardia lamblia
SMPPSVSVTPSL

SEQ ID NO: 3138068 - protein, 42 aa, Giardia lamblia
SMPSKYGQVSGRVRSREYESVKKGARIDSDEDLSDSSDCAEQ

SEQ ID NO: 3138069 - protein, 5 aa, Giardia lamblia
SMPSR

SEQ ID NO: 3138070 - protein, 23 aa, Giardia lamblia
SMPTKAEQHQVGDNLGERPSSSL

SEQ ID NO: 3138071 - protein, 9 aa, Giardia lamblia
SMPTPEPAI

SEQ ID NO: 3138072 - protein, 6 aa, Giardia lamblia
SMQRGE

SEQ ID NO: 3138073 - protein, 6 aa, Giardia lamblia
SMQSSQ

SEQ ID NO: 3138074 - protein, 6 aa, Giardia lamblia
SMQTPI

SEQ ID NO: 3138075 - protein, 9 aa, Giardia lamblia
SMRESQRLS

SEQ ID NO: 3138076 - protein, 12 aa, Giardia lamblia
SMRETNPAKRQE

SEQ ID NO: 3138077 - protein, 14 aa, Giardia lamblia
SMRKSASPLSTERA

SEQ ID NO: 3138078 - protein, 21 aa, Giardia lamblia
SMRSASNKHSASQSPTHSVSP

SEQ ID NO: 3138079 - protein, 13 aa, Giardia lamblia
SMRTTKNEKGETG

SEQ ID NO: 3138080 - protein, 7 aa, Giardia lamblia
SMSDADE

SEQ ID NO: 3138081 - protein, 4 aa, Giardia lamblia
SMSE

SEQ ID NO: 3138082 - protein, 18 aa, Giardia lamblia
SMSETKTEASQTAPWSPQ

SEQ ID NO: 3138083 - protein, 25 aa, Giardia lamblia
SMSGRSQEEKAIENNSREGKGSEVK

SEQ ID NO: 3138084 - protein, 6 aa, Giardia lamblia
SMSPAE

SEQ ID NO: 3138085 - protein, 6 aa, Giardia lamblia
SMSPED

SEQ ID NO: 3138086 - protein, 80 aa, Giardia lamblia
SMSPQPSVQRSSQAHTSITHTSNTHPTTTTGSGDTSKVSTSRDSRSDVRSSASQQYSSSVEPPPYASLSAKKPKSGSSLG

SEQ ID NO: 3138087 - protein, 13 aa, Giardia lamblia
SMSPRNAPSLDPK

SEQ ID NO: 3138088 - protein, 5 aa, Giardia lamblia
SMSRQ

SEQ ID NO: 3138089 - protein, 25 aa, Giardia lamblia
SMSSEQSKAALSASATQRDLAGKEV

SEQ ID NO: 3138090 - protein, 19 aa, Giardia lamblia
SMSSSTGLDVSSGTSTGPI

SEQ ID NO: 3138091 - protein, 6 aa, Giardia lamblia
SMTAQK

SEQ ID NO: 3138092 - protein, 9 aa, Giardia lamblia
SMTERRDNI

SEQ ID NO: 3138093 - protein, 8 aa, Giardia lamblia
SMTESAAL

SEQ ID NO: 3138094 - protein, 4 aa, Giardia lamblia
SMTG

SEQ ID NO: 3138095 - protein, 12 aa, Giardia lamblia
SMTGYGKPAGYS

SEQ ID NO: 3138096 - protein, 8 aa, Giardia lamblia
SMTNNRGY

SEQ ID NO: 3138097 - protein, 10 aa, Giardia lamblia
SMTSATTSAA

SEQ ID NO: 3138098 - protein, 9 aa, Giardia lamblia
SMTSEQRRR

SEQ ID NO: 3138099 - protein, 8 aa, Giardia lamblia
SMTSSQAK

SEQ ID NO: 3138100 - protein, 17 aa, Giardia lamblia
SMTSTQGGRTRARPDDF

SEQ ID NO: 3138101 - protein, 5 aa, Giardia lamblia
SNADH

SEQ ID NO: 3138102 - protein, 7 aa, Giardia lamblia
SNAEVTE

SEQ ID NO: 3138103 - protein, 7 aa, Giardia lamblia
SNAGAQH

SEQ ID NO: 3138104 - protein, 5 aa, Giardia lamblia
SNAKA

SEQ ID NO: 3138105 - protein, 13 aa, Giardia lamblia
SNAKHAHKKEEDE

SEQ ID NO: 3138106 - protein, 23 aa, Giardia lamblia
SNAKSELETRKKEIVSTKRNAEK

SEQ ID NO: 3138107 - protein, 13 aa, Giardia lamblia
SNAKTTRESDALP

SEQ ID NO: 3138108 - protein, 4 aa, Giardia lamblia
SNAL

SEQ ID NO: 3138109 - protein, 5 aa, Giardia lamblia
SNALP

SEQ ID NO: 3138110 - protein, 12 aa, Giardia lamblia
SNANNRSVSNSA

SEQ ID NO: 3138111 - protein, 9 aa, Giardia lamblia
SNANQGSNA

SEQ ID NO: 3138112 - protein, 6 aa, Giardia lamblia
SNAPDV

SEQ ID NO: 3138113 - protein, 8 aa, Giardia lamblia
SNAPNVAP

SEQ ID NO: 3138114 - protein, 5 aa, Giardia lamblia
SNAPV

SEQ ID NO: 3138115 - protein, 9 aa, Giardia lamblia
SNAQASDPR

SEQ ID NO: 3138116 - protein, 10 aa, Giardia lamblia
SNAQSSQMNT

SEQ ID NO: 3138117 - protein, 8 aa, Giardia lamblia
SNAQSTID

SEQ ID NO: 3138118 - protein, 8 aa, Giardia lamblia
SNARPTAE

SEQ ID NO: 3138119 - protein, 30 aa, Giardia lamblia
SNARTTKCAKSRKGQFPANDDEKGATSQEV

SEQ ID NO: 3138120 - protein, 8 aa, Giardia lamblia
SNASANNS

SEQ ID NO: 3138121 - protein, 9 aa, Giardia lamblia
SNASPEQHR

SEQ ID NO: 3138122 - protein, 12 aa, Giardia lamblia
SNATPAKQQDSK

SEQ ID NO: 3138123 - protein, 16 aa, Giardia lamblia
SNATPLKDTVNRPTTA

SEQ ID NO: 3138124 - protein, 15 aa, Giardia lamblia
SNATSVARKTLPTDD

SEQ ID NO: 3138125 - protein, 16 aa, Giardia lamblia
SNATTKSQHRPDVPPL

SEQ ID NO: 3138126 - protein, 7 aa, Giardia lamblia
SNAVPPE

SEQ ID NO: 3138127 - protein, 32 aa, Giardia lamblia
SNAYNEGSEDDDAAESARFNEERHQRGHEGQI

SEQ ID NO: 3138128 - protein, 4 aa, Giardia lamblia
SNCE

SEQ ID NO: 3138129 - protein, 7 aa, Giardia lamblia
SNCNDGT

SEQ ID NO: 3138130 - protein, 5 aa, Giardia lamblia
SNCTS

SEQ ID NO: 3138131 - protein, 7 aa, Giardia lamblia
SNDADGC

SEQ ID NO: 3138132 - protein, 8 aa, Giardia lamblia
SNDAEDLN

SEQ ID NO: 3138133 - protein, 13 aa, Giardia lamblia
SNDAEHTSSVPEL

SEQ ID NO: 3138134 - protein, 10 aa, Giardia lamblia
SNDAKTKSGY

SEQ ID NO: 3138135 - protein, 11 aa, Giardia lamblia
SNDAPTATYQG

SEQ ID NO: 3138136 - protein, 8 aa, Giardia lamblia
SNDATATL

SEQ ID NO: 3138137 - protein, 10 aa, Giardia lamblia
SNDDALTETL

SEQ ID NO: 3138138 - protein, 6 aa, Giardia lamblia
SNDDTV

SEQ ID NO: 3138139 - protein, 7 aa, Giardia lamblia
SNDDYNE

SEQ ID NO: 3138140 - protein, 7 aa, Giardia lamblia
SNDEGDV

SEQ ID NO: 3138141 - protein, 5 aa, Giardia lamblia
SNDGA

SEQ ID NO: 3138142 - protein, 8 aa, Giardia lamblia
SNDGDRRI

SEQ ID NO: 3138143 - protein, 14 aa, Giardia lamblia
SNDHRTYEGSSGEC

SEQ ID NO: 3138144 - protein, 4 aa, Giardia lamblia
SNDI

SEQ ID NO: 3138145 - protein, 6 aa, Giardia lamblia
SNDIGE

SEQ ID NO: 3138146 - protein, 6 aa, Giardia lamblia
SNDPHR

SEQ ID NO: 3138147 - protein, 15 aa, Giardia lamblia
SNDPSSSSWTATTGI

SEQ ID NO: 3138148 - protein, 4 aa, Giardia lamblia
SNDQ

SEQ ID NO: 3138149 - protein, 10 aa, Giardia lamblia
SNDSAGNARV

SEQ ID NO: 3138150 - protein, 8 aa, Giardia lamblia
SNDTPAEI

SEQ ID NO: 3138151 - protein, 5 aa, Giardia lamblia
SNDTQ

SEQ ID NO: 3138152 - protein, 8 aa, Giardia lamblia
SNDTQPIA

SEQ ID NO: 3138153 - protein, 4 aa, Giardia lamblia
SNDV

SEQ ID NO: 3138154 - protein, 6 aa, Giardia lamblia
SNDVES

SEQ ID NO: 3138155 - protein, 5 aa, Giardia lamblia
SNDYS

SEQ ID NO: 3138156 - protein, 4 aa, Giardia lamblia
SNEA

SEQ ID NO: 3138157 - protein, 5 aa, Giardia lamblia
SNEAE

SEQ ID NO: 3138158 - protein, 6 aa, Giardia lamblia
SNEDDK

SEQ ID NO: 3138159 - protein, 5 aa, Giardia lamblia
SNEDR

SEQ ID NO: 3138160 - protein, 8 aa, Giardia lamblia
SNEHNSPY

SEQ ID NO: 3138161 - protein, 6 aa, Giardia lamblia
SNEKCA

SEQ ID NO: 3138162 - protein, 9 aa, Giardia lamblia
SNEKNVQSN

SEQ ID NO: 3138163 - protein, 4 aa, Giardia lamblia
SNEQ

SEQ ID NO: 3138164 - protein, 5 aa, Giardia lamblia
SNEQQ

SEQ ID NO: 3138165 - protein, 7 aa, Giardia lamblia
SNERPKF

SEQ ID NO: 3138166 - protein, 23 aa, Giardia lamblia
SNESIGDTLDDATTKMAHTNPPA

SEQ ID NO: 3138167 - protein, 6 aa, Giardia lamblia
SNESVY

SEQ ID NO: 3138168 - protein, 13 aa, Giardia lamblia
SNETTAAAGANLE

SEQ ID NO: 3138169 - protein, 4 aa, Giardia lamblia
SNEV

SEQ ID NO: 3138170 - protein, 26 aa, Giardia lamblia
SNEVPKQNSQDQYSSIAQENAGEHPQ

SEQ ID NO: 3138171 - protein, 10 aa, Giardia lamblia
SNFGDSDGFN

SEQ ID NO: 3138172 - protein, 6 aa, Giardia lamblia
SNFPKG

SEQ ID NO: 3138173 - protein, 4 aa, Giardia lamblia
SNFS

SEQ ID NO: 3138174 - protein, 6 aa, Giardia lamblia
SNFSQD

SEQ ID NO: 3138175 - protein, 8 aa, Giardia lamblia
SNGAWSPE

SEQ ID NO: 3138176 - protein, 7 aa, Giardia lamblia
SNGDASS

SEQ ID NO: 3138177 - protein, 9 aa, Giardia lamblia
SNGDISGDK

SEQ ID NO: 3138178 - protein, 6 aa, Giardia lamblia
SNGDPL

SEQ ID NO: 3138179 - protein, 7 aa, Giardia lamblia
SNGEGTC

SEQ ID NO: 3138180 - protein, 14 aa, Giardia lamblia
SNGEMSKAQKVKSN

SEQ ID NO: 3138181 - protein, 9 aa, Giardia lamblia
SNGKQKTRR

SEQ ID NO: 3138182 - protein, 5 aa, Giardia lamblia
SNGKV

SEQ ID NO: 3138183 - protein, 9 aa, Giardia lamblia
SNGNSNAKV

SEQ ID NO: 3138184 - protein, 9 aa, Giardia lamblia
SNGPIPPSL

SEQ ID NO: 3138185 - protein, 5 aa, Giardia lamblia
SNGPT

SEQ ID NO: 3138186 - protein, 6 aa, Giardia lamblia
SNGQHS

SEQ ID NO: 3138187 - protein, 4 aa, Giardia lamblia
SNGS

SEQ ID NO: 3138188 - protein, 8 aa, Giardia lamblia
SNGSESDI

SEQ ID NO: 3138189 - protein, 6 aa, Giardia lamblia
SNGSIS

SEQ ID NO: 3138190 - protein, 5 aa, Giardia lamblia
SNGSS

SEQ ID NO: 3138191 - protein, 5 aa, Giardia lamblia
SNGTV

SEQ ID NO: 3138192 - protein, 15 aa, Giardia lamblia
SNGTVQDHAPTDKPN

SEQ ID NO: 3138193 - protein, 4 aa, Giardia lamblia
SNGV

SEQ ID NO: 3138194 - protein, 5 aa, Giardia lamblia
SNGYR

SEQ ID NO: 3138195 - protein, 4 aa, Giardia lamblia
SNHA

SEQ ID NO: 3138196 - protein, 6 aa, Giardia lamblia
SNHAQY

SEQ ID NO: 3138197 - protein, 9 aa, Giardia lamblia
SNHETSSVR

SEQ ID NO: 3138198 - protein, 11 aa, Giardia lamblia
SNHKQDRPRAG

SEQ ID NO: 3138199 - protein, 16 aa, Giardia lamblia
SNHNNSSHPDGNNSKL

SEQ ID NO: 3138200 - protein, 8 aa, Giardia lamblia
SNHPSTGV

SEQ ID NO: 3138201 - protein, 10 aa, Giardia lamblia
SNHQTPLNTS

SEQ ID NO: 3138202 - protein, 6 aa, Giardia lamblia
SNHSRN

SEQ ID NO: 3138203 - protein, 4 aa, Giardia lamblia
SNHY

SEQ ID NO: 3138204 - protein, 5 aa, Giardia lamblia
SNIAG

SEQ ID NO: 3138205 - protein, 8 aa, Giardia lamblia
SNIAKQQG

SEQ ID NO: 3138206 - protein, 10 aa, Giardia lamblia
SNIEDTQSKL

SEQ ID NO: 3138207 - protein, 4 aa, Giardia lamblia
SNIP

SEQ ID NO: 3138208 - protein, 6 aa, Giardia lamblia
SNIPEE

SEQ ID NO: 3138209 - protein, 5 aa, Giardia lamblia
SNIPR

SEQ ID NO: 3138210 - protein, 6 aa, Giardia lamblia
SNIQGK

SEQ ID NO: 3138211 - protein, 10 aa, Giardia lamblia
SNISPEEKKY

SEQ ID NO: 3138212 - protein, 21 aa, Giardia lamblia
SNISRGQKDPKRGASLHSSKD

SEQ ID NO: 3138213 - protein, 5 aa, Giardia lamblia
SNISS

SEQ ID NO: 3138214 - protein, 9 aa, Giardia lamblia
SNITAERRA

SEQ ID NO: 3138215 - protein, 22 aa, Giardia lamblia
SNITDGYGNIGNSQNLNSSVQG

SEQ ID NO: 3138216 - protein, 10 aa, Giardia lamblia
SNITEQDTNR

SEQ ID NO: 3138217 - protein, 13 aa, Giardia lamblia
SNITSSPGRNLSQ

SEQ ID NO: 3138218 - protein, 8 aa, Giardia lamblia
SNKADHLG

SEQ ID NO: 3138219 - protein, 14 aa, Giardia lamblia
SNKALSNRYLLNGH

SEQ ID NO: 3138220 - protein, 6 aa, Giardia lamblia
SNKATH

SEQ ID NO: 3138221 - protein, 13 aa, Giardia lamblia
SNKDPIADQIVRE

SEQ ID NO: 3138222 - protein, 8 aa, Giardia lamblia
SNKDTEMS

SEQ ID NO: 3138223 - protein, 8 aa, Giardia lamblia
SNKNDTEW

SEQ ID NO: 3138224 - protein, 4 aa, Giardia lamblia
SNKP

SEQ ID NO: 3138225 - protein, 6 aa, Giardia lamblia
SNKPET

SEQ ID NO: 3138226 - protein, 6 aa, Giardia lamblia
SNKPLT

SEQ ID NO: 3138227 - protein, 9 aa, Giardia lamblia
SNKRNTQIS

SEQ ID NO: 3138228 - protein, 5 aa, Giardia lamblia
SNKRR

SEQ ID NO: 3138229 - protein, 11 aa, Giardia lamblia
SNKTESDSFER

SEQ ID NO: 3138230 - protein, 9 aa, Giardia lamblia
SNLDRSDKS

SEQ ID NO: 3138231 - protein, 13 aa, Giardia lamblia
SNLGSSNSDASMK

SEQ ID NO: 3138232 - protein, 4 aa, Giardia lamblia
SNLH

SEQ ID NO: 3138233 - protein, 9 aa, Giardia lamblia
SNLNDDKRL

SEQ ID NO: 3138234 - protein, 5 aa, Giardia lamblia
SNLNN

SEQ ID NO: 3138235 - protein, 6 aa, Giardia lamblia
SNLNQP

SEQ ID NO: 3138236 - protein, 8 aa, Giardia lamblia
SNLNQSIP

SEQ ID NO: 3138237 - protein, 6 aa, Giardia lamblia
SNLPDA

SEQ ID NO: 3138238 - protein, 25 aa, Giardia lamblia
SNLPRSSGLTSSQDPTFTHRSSEDG

SEQ ID NO: 3138239 - protein, 8 aa, Giardia lamblia
SNLPSDSY

SEQ ID NO: 3138240 - protein, 8 aa, Giardia lamblia
SNLPSTGL

SEQ ID NO: 3138241 - protein, 19 aa, Giardia lamblia
SNLQGSEYPEGRRKGDNVT

SEQ ID NO: 3138242 - protein, 11 aa, Giardia lamblia
SNLQPPQPSIE

SEQ ID NO: 3138243 - protein, 13 aa, Giardia lamblia
SNLQQECDSPTKG

SEQ ID NO: 3138244 - protein, 6 aa, Giardia lamblia
SNLQSS

SEQ ID NO: 3138245 - protein, 5 aa, Giardia lamblia
SNLRQ

SEQ ID NO: 3138246 - protein, 7 aa, Giardia lamblia
SNLSSGK

SEQ ID NO: 3138247 - protein, 6 aa, Giardia lamblia
SNLSTS

SEQ ID NO: 3138248 - protein, 5 aa, Giardia lamblia
SNLTA

SEQ ID NO: 3138249 - protein, 7 aa, Giardia lamblia
SNLTPNS

SEQ ID NO: 3138250 - protein, 7 aa, Giardia lamblia
SNMANAG

SEQ ID NO: 3138251 - protein, 5 aa, Giardia lamblia
SNMED

SEQ ID NO: 3138252 - protein, 10 aa, Giardia lamblia
SNMETRPNGQ

SEQ ID NO: 3138253 - protein, 9 aa, Giardia lamblia
SNMKGPRAL

SEQ ID NO: 3138254 - protein, 5 aa, Giardia lamblia
SNMPV

SEQ ID NO: 3138255 - protein, 5 aa, Giardia lamblia
SNMSI

SEQ ID NO: 3138256 - protein, 6 aa, Giardia lamblia
SNNDAE

SEQ ID NO: 3138257 - protein, 7 aa, Giardia lamblia
SNNEDAC

SEQ ID NO: 3138258 - protein, 5 aa, Giardia lamblia
SNNEG

SEQ ID NO: 3138259 - protein, 10 aa, Giardia lamblia
SNNGEKTRRA

SEQ ID NO: 3138260 - protein, 4 aa, Giardia lamblia
SNNI

SEQ ID NO: 3138261 - protein, 6 aa, Giardia lamblia
SNNLDD

SEQ ID NO: 3138262 - protein, 5 aa, Giardia lamblia
SNNLQ

SEQ ID NO: 3138263 - protein, 10 aa, Giardia lamblia
SNNNKDQPSS

SEQ ID NO: 3138264 - protein, 5 aa, Giardia lamblia
SNNPG

SEQ ID NO: 3138265 - protein, 10 aa, Giardia lamblia
SNNPSFPSSS

SEQ ID NO: 3138266 - protein, 4 aa, Giardia lamblia
SNNQ

SEQ ID NO: 3138267 - protein, 7 aa, Giardia lamblia
SNNQMDQ

SEQ ID NO: 3138268 - protein, 6 aa, Giardia lamblia
SNNQPQ

SEQ ID NO: 3138269 - protein, 30 aa, Giardia lamblia
SNNRALSGTSLATNVPDQALKTPPPPPISL

SEQ ID NO: 3138270 - protein, 8 aa, Giardia lamblia
SNNRHTDE

SEQ ID NO: 3138271 - protein, 5 aa, Giardia lamblia
SNNSH

SEQ ID NO: 3138272 - protein, 6 aa, Giardia lamblia
SNNSVM

SEQ ID NO: 3138273 - protein, 14 aa, Giardia lamblia
SNNTTAQAMEDPEF

SEQ ID NO: 3138274 - protein, 13 aa, Giardia lamblia
SNNVAQTDEYESD

SEQ ID NO: 3138275 - protein, 8 aa, Giardia lamblia
SNNVNEAD

SEQ ID NO: 3138276 - protein, 6 aa, Giardia lamblia
SNPANL

SEQ ID NO: 3138277 - protein, 13 aa, Giardia lamblia
SNPARQNTPQSNI

SEQ ID NO: 3138278 - protein, 9 aa, Giardia lamblia
SNPATIKKP

SEQ ID NO: 3138279 - protein, 4 aa, Giardia lamblia
SNPE

SEQ ID NO: 3138280 - protein, 19 aa, Giardia lamblia
SNPEGTPSKMSILLSNPCN

SEQ ID NO: 3138281 - protein, 6 aa, Giardia lamblia
SNPELE

SEQ ID NO: 3138282 - protein, 6 aa, Giardia lamblia
SNPEQE

SEQ ID NO: 3138283 - protein, 21 aa, Giardia lamblia
SNPESRSVSTNAREDKRDPNV

SEQ ID NO: 3138284 - protein, 6 aa, Giardia lamblia
SNPETS

SEQ ID NO: 3138285 - protein, 20 aa, Giardia lamblia
SNPFRKEKPLGMKPARPIDE

SEQ ID NO: 3138286 - protein, 22 aa, Giardia lamblia
SNPFSETTARPSITSKPEEAYS

SEQ ID NO: 3138287 - protein, 5 aa, Giardia lamblia
SNPGL

SEQ ID NO: 3138288 - protein, 6 aa, Giardia lamblia
SNPGMT

SEQ ID NO: 3138289 - protein, 8 aa, Giardia lamblia
SNPGSLKA

SEQ ID NO: 3138290 - protein, 5 aa, Giardia lamblia
SNPIP

SEQ ID NO: 3138291 - protein, 7 aa, Giardia lamblia
SNPKNKA

SEQ ID NO: 3138292 - protein, 10 aa, Giardia lamblia
SNPKREESRQ

SEQ ID NO: 3138293 - protein, 7 aa, Giardia lamblia
SNPLGTD

SEQ ID NO: 3138294 - protein, 9 aa, Giardia lamblia
SNPNGSIQS

SEQ ID NO: 3138295 - protein, 7 aa, Giardia lamblia
SNPNNFS

SEQ ID NO: 3138296 - protein, 7 aa, Giardia lamblia
SNPNYYT

SEQ ID NO: 3138297 - protein, 13 aa, Giardia lamblia
SNPQEVGHGSSGH

SEQ ID NO: 3138298 - protein, 11 aa, Giardia lamblia
SNPRCRKSSRE

SEQ ID NO: 3138299 - protein, 8 aa, Giardia lamblia
SNPRGGLT

SEQ ID NO: 3138300 - protein, 44 aa, Giardia lamblia
SNPRNNGSVPIGSELPQQGIHSTPPTAHQQQGRNGDAENERSSQ

SEQ ID NO: 3138301 - protein, 6 aa, Giardia lamblia
SNPRSL

SEQ ID NO: 3138302 - protein, 6 aa, Giardia lamblia
SNPRTR

SEQ ID NO: 3138303 - protein, 7 aa, Giardia lamblia
SNPSESD

SEQ ID NO: 3138304 - protein, 14 aa, Giardia lamblia
SNPSWTEENSATYS

SEQ ID NO: 3138305 - protein, 5 aa, Giardia lamblia
SNPVV

SEQ ID NO: 3138306 - protein, 10 aa, Giardia lamblia
SNPYAASEAP

SEQ ID NO: 3138307 - protein, 4 aa, Giardia lamblia
SNQA

SEQ ID NO: 3138308 - protein, 5 aa, Giardia lamblia
SNQDL

SEQ ID NO: 3138309 - protein, 8 aa, Giardia lamblia
SNQEARRA

SEQ ID NO: 3138310 - protein, 13 aa, Giardia lamblia
SNQEPQDDEQKRI

SEQ ID NO: 3138311 - protein, 6 aa, Giardia lamblia
SNQFES

SEQ ID NO: 3138312 - protein, 102 aa, Giardia lamblia
SNQGFGESNFGGPGGPGMGGFPPGGPGGPGGPGGPGGPPGGPGMNRGPGGPPGAPGGPGGPMNRGPGGPGGPGGPGGPGPQQFNESVPEKIKAQGPLSEAEK

SEQ ID NO: 3138313 - protein, 6 aa, Giardia lamblia
SNQKYQ

SEQ ID NO: 3138314 - protein, 28 aa, Giardia lamblia
SNQNDLPPPARSMSAPGAHTDSKLEHKD

SEQ ID NO: 3138315 - protein, 9 aa, Giardia lamblia
SNQNKKEIL

SEQ ID NO: 3138316 - protein, 16 aa, Giardia lamblia
SNQNQPLGNSVSDATE

SEQ ID NO: 3138317 - protein, 7 aa, Giardia lamblia
SNQPIGA

SEQ ID NO: 3138318 - protein, 6 aa, Giardia lamblia
SNQQPA

SEQ ID NO: 3138319 - protein, 6 aa, Giardia lamblia
SNQRAI

SEQ ID NO: 3138320 - protein, 8 aa, Giardia lamblia
SNQSPTIN

SEQ ID NO: 3138321 - protein, 5 aa, Giardia lamblia
SNRDA

SEQ ID NO: 3138322 - protein, 8 aa, Giardia lamblia
SNRDPTEE

SEQ ID NO: 3138323 - protein, 20 aa, Giardia lamblia
SNRDTRVKGAEDKTQAPIGS

SEQ ID NO: 3138324 - protein, 13 aa, Giardia lamblia
SNRESSTLYKNGE

SEQ ID NO: 3138325 - protein, 32 aa, Giardia lamblia
SNRGTQASIPLPKDQSVATNPPPSETTKGEFN

SEQ ID NO: 3138326 - protein, 5 aa, Giardia lamblia
SNRIR

SEQ ID NO: 3138327 - protein, 8 aa, Giardia lamblia
SNRKALRG

SEQ ID NO: 3138328 - protein, 28 aa, Giardia lamblia
SNRKRTKPSNSPKKAHASPEYSRTQRQN

SEQ ID NO: 3138329 - protein, 40 aa, Giardia lamblia
SNRMDTTARRSRSTRTRQTDPSTPSPRSTSRSPLSMALRH

SEQ ID NO: 3138330 - protein, 6 aa, Giardia lamblia
SNRNTK

SEQ ID NO: 3138331 - protein, 10 aa, Giardia lamblia
SNRNTTQENK

SEQ ID NO: 3138332 - protein, 4 aa, Giardia lamblia
SNRP

SEQ ID NO: 3138333 - protein, 7 aa, Giardia lamblia
SNRPEDI

SEQ ID NO: 3138334 - protein, 14 aa, Giardia lamblia
SNRPPQSESSLAAP

SEQ ID NO: 3138335 - protein, 5 aa, Giardia lamblia
SNRPR

SEQ ID NO: 3138336 - protein, 9 aa, Giardia lamblia
SNRRSASTS

SEQ ID NO: 3138337 - protein, 7 aa, Giardia lamblia
SNRSPSP

SEQ ID NO: 3138338 - protein, 4 aa, Giardia lamblia
SNRT

SEQ ID NO: 3138339 - protein, 29 aa, Giardia lamblia
SNRTADQEDPSVNESTPLNPDNSQLTADY

SEQ ID NO: 3138340 - protein, 4 aa, Giardia lamblia
SNSA

SEQ ID NO: 3138341 - protein, 13 aa, Giardia lamblia
SNSAGETPKPHST

SEQ ID NO: 3138342 - protein, 18 aa, Giardia lamblia
SNSALSRQSGYSSNKHSM

SEQ ID NO: 3138343 - protein, 10 aa, Giardia lamblia
SNSAQSAVSQ

SEQ ID NO: 3138344 - protein, 5 aa, Giardia lamblia
SNSAR

SEQ ID NO: 3138345 - protein, 8 aa, Giardia lamblia
SNSEHAQE

SEQ ID NO: 3138346 - protein, 5 aa, Giardia lamblia
SNSEM

SEQ ID NO: 3138347 - protein, 10 aa, Giardia lamblia
SNSEPSPQMG

SEQ ID NO: 3138348 - protein, 8 aa, Giardia lamblia
SNSEYGDF

SEQ ID NO: 3138349 - protein, 7 aa, Giardia lamblia
SNSFTNM

SEQ ID NO: 3138350 - protein, 10 aa, Giardia lamblia
SNSGAGREYE

SEQ ID NO: 3138351 - protein, 5 aa, Giardia lamblia
SNSGD

SEQ ID NO: 3138352 - protein, 9 aa, Giardia lamblia
SNSGGKSLA

SEQ ID NO: 3138353 - protein, 16 aa, Giardia lamblia
SNSGVYAEASTSSQLT

SEQ ID NO: 3138354 - protein, 5 aa, Giardia lamblia
SNSGY

SEQ ID NO: 3138355 - protein, 19 aa, Giardia lamblia
SNSHTEARESTSKPSGISV

SEQ ID NO: 3138356 - protein, 8 aa, Giardia lamblia
SNSIDESK

SEQ ID NO: 3138357 - protein, 41 aa, Giardia lamblia
SNSIDNGSMVSNSELKGSNQQDSNDNHGNVSLTNSEEHKHD

SEQ ID NO: 3138358 - protein, 6 aa, Giardia lamblia
SNSKEI

SEQ ID NO: 3138359 - protein, 6 aa, Giardia lamblia
SNSLDE

SEQ ID NO: 3138360 - protein, 6 aa, Giardia lamblia
SNSLTQ

SEQ ID NO: 3138361 - protein, 5 aa, Giardia lamblia
SNSMS

SEQ ID NO: 3138362 - protein, 5 aa, Giardia lamblia
SNSNA

SEQ ID NO: 3138363 - protein, 6 aa, Giardia lamblia
SNSNEE

SEQ ID NO: 3138364 - protein, 54 aa, Giardia lamblia
SNSNRESNSKTDQSISTTQTSAKPKVSTKSKRRSSKKPCSKRSSSTESSSSSYY

SEQ ID NO: 3138365 - protein, 24 aa, Giardia lamblia
SNSPATASRVSDKADESGEAEEPV

SEQ ID NO: 3138366 - protein, 13 aa, Giardia lamblia
SNSPEEKTRQELE

SEQ ID NO: 3138367 - protein, 26 aa, Giardia lamblia
SNSPRRTGESSPRIRRSTTGEPGEDC

SEQ ID NO: 3138368 - protein, 7 aa, Giardia lamblia
SNSPTFT

SEQ ID NO: 3138369 - protein, 10 aa, Giardia lamblia
SNSQEAHSPP

SEQ ID NO: 3138370 - protein, 6 aa, Giardia lamblia
SNSQNQ

SEQ ID NO: 3138371 - protein, 14 aa, Giardia lamblia
SNSQSKIEEQEAQI

SEQ ID NO: 3138372 - protein, 6 aa, Giardia lamblia
SNSSEA

SEQ ID NO: 3138373 - protein, 25 aa, Giardia lamblia
SNSSESRARDRYKQSREKESYEPHL

SEQ ID NO: 3138374 - protein, 5 aa, Giardia lamblia
SNSSF

SEQ ID NO: 3138375 - protein, 6 aa, Giardia lamblia
SNSSKM

SEQ ID NO: 3138376 - protein, 16 aa, Giardia lamblia
SNSSKNMITKEKSRSV

SEQ ID NO: 3138377 - protein, 24 aa, Giardia lamblia
SNSSQPPPQQAPRETVASPPQEDL

SEQ ID NO: 3138378 - protein, 7 aa, Giardia lamblia
SNSSQVI

SEQ ID NO: 3138379 - protein, 9 aa, Giardia lamblia
SNSTAEQVD

SEQ ID NO: 3138380 - protein, 9 aa, Giardia lamblia
SNSTDSTGL

SEQ ID NO: 3138381 - protein, 16 aa, Giardia lamblia
SNSTFTKPDETNSANN

SEQ ID NO: 3138382 - protein, 6 aa, Giardia lamblia
SNSTGI

SEQ ID NO: 3138383 - protein, 4 aa, Giardia lamblia
SNSV

SEQ ID NO: 3138384 - protein, 8 aa, Giardia lamblia
SNSVETTS

SEQ ID NO: 3138385 - protein, 17 aa, Giardia lamblia
SNSVSRRESRQGSPQRS

SEQ ID NO: 3138386 - protein, 9 aa, Giardia lamblia
SNSYSEADI

SEQ ID NO: 3138387 - protein, 4 aa, Giardia lamblia
SNTA

SEQ ID NO: 3138388 - protein, 8 aa, Giardia lamblia
SNTAADAL

SEQ ID NO: 3138389 - protein, 7 aa, Giardia lamblia
SNTCPST

SEQ ID NO: 3138390 - protein, 5 aa, Giardia lamblia
SNTDQ

SEQ ID NO: 3138391 - protein, 5 aa, Giardia lamblia
SNTEA

SEQ ID NO: 3138392 - protein, 8 aa, Giardia lamblia
SNTEEKKA

SEQ ID NO: 3138393 - protein, 6 aa, Giardia lamblia
SNTEKA

SEQ ID NO: 3138394 - protein, 7 aa, Giardia lamblia
SNTEKLS

SEQ ID NO: 3138395 - protein, 8 aa, Giardia lamblia
SNTGMTDE

SEQ ID NO: 3138396 - protein, 23 aa, Giardia lamblia
SNTGNFRSNDNNDKHQFGSAPFT

SEQ ID NO: 3138397 - protein, 28 aa, Giardia lamblia
SNTKQSLDRIQKSTSSLLASSSAKPQDV

SEQ ID NO: 3138398 - protein, 4 aa, Giardia lamblia
SNTL

SEQ ID NO: 3138399 - protein, 7 aa, Giardia lamblia
SNTLERE

SEQ ID NO: 3138400 - protein, 7 aa, Giardia lamblia
SNTNGAN

SEQ ID NO: 3138401 - protein, 6 aa, Giardia lamblia
SNTNPF

SEQ ID NO: 3138402 - protein, 6 aa, Giardia lamblia
SNTNTY

SEQ ID NO: 3138403 - protein, 14 aa, Giardia lamblia
SNTPAEVNPPAAKS

SEQ ID NO: 3138404 - protein, 11 aa, Giardia lamblia
SNTPEKRTTVA

SEQ ID NO: 3138405 - protein, 6 aa, Giardia lamblia
SNTPES

SEQ ID NO: 3138406 - protein, 45 aa, Giardia lamblia
SNTQHGSGSTRSTSCSDARPESCKQPRSKSASFYQPSRSSSLTSA

SEQ ID NO: 3138407 - protein, 5 aa, Giardia lamblia
SNTSL

SEQ ID NO: 3138408 - protein, 7 aa, Giardia lamblia
SNTSMQA

SEQ ID NO: 3138409 - protein, 8 aa, Giardia lamblia
SNTSSIPA

SEQ ID NO: 3138410 - protein, 9 aa, Giardia lamblia
SNTSTYEER

SEQ ID NO: 3138411 - protein, 4 aa, Giardia lamblia
SNTT

SEQ ID NO: 3138412 - protein, 17 aa, Giardia lamblia
SNTTDFSAAKSDTSQPT

SEQ ID NO: 3138413 - protein, 9 aa, Giardia lamblia
SNTTPVSAP

SEQ ID NO: 3138414 - protein, 6 aa, Giardia lamblia
SNTTYS

SEQ ID NO: 3138415 - protein, 33 aa, Giardia lamblia
SNVAANSNRKRSKSSGKTKQPRGRAKSRQKSAA

SEQ ID NO: 3138416 - protein, 24 aa, Giardia lamblia
SNVADTSNHSSQTLSDSDTPGDAF

SEQ ID NO: 3138417 - protein, 7 aa, Giardia lamblia
SNVDGGE

SEQ ID NO: 3138418 - protein, 16 aa, Giardia lamblia
SNVNDAAKDCPQIPPT

SEQ ID NO: 3138419 - protein, 6 aa, Giardia lamblia
SNVNGS

SEQ ID NO: 3138420 - protein, 10 aa, Giardia lamblia
SNVNSYGTDT

SEQ ID NO: 3138421 - protein, 8 aa, Giardia lamblia
SNVPGVSP

SEQ ID NO: 3138422 - protein, 13 aa, Giardia lamblia
SNVPKPKASGSSV

SEQ ID NO: 3138423 - protein, 10 aa, Giardia lamblia
SNVQDPEGRT

SEQ ID NO: 3138424 - protein, 7 aa, Giardia lamblia
SNVRGRI

SEQ ID NO: 3138425 - protein, 27 aa, Giardia lamblia
SNVSGGASAKPVGTPEEATSGTTVADS

SEQ ID NO: 3138426 - protein, 10 aa, Giardia lamblia
SNVSPARRQP

SEQ ID NO: 3138427 - protein, 11 aa, Giardia lamblia
SNVTGDTRKQT

SEQ ID NO: 3138428 - protein, 10 aa, Giardia lamblia
SNYAGRTDAI

SEQ ID NO: 3138429 - protein, 19 aa, Giardia lamblia
SNYDDTEQRVTGGRNGYGA

SEQ ID NO: 3138430 - protein, 6 aa, Giardia lamblia
SNYDEL

SEQ ID NO: 3138431 - protein, 7 aa, Giardia lamblia
SNYDETL

SEQ ID NO: 3138432 - protein, 8 aa, Giardia lamblia
SNYKQKPY

SEQ ID NO: 3138433 - protein, 6 aa, Giardia lamblia
SNYSSM

SEQ ID NO: 3138434 - protein, 13 aa, Giardia lamblia
SNYTAISSRSSQA

SEQ ID NO: 3138435 - protein, 9 aa, Giardia lamblia
SNYTAKPYE

SEQ ID NO: 3138436 - protein, 7 aa, Giardia lamblia
SNYTESY

SEQ ID NO: 3138437 - protein, 6 aa, Giardia lamblia
SPAAEW

SEQ ID NO: 3138438 - protein, 8 aa, Giardia lamblia
SPAAGDLS

SEQ ID NO: 3138439 - protein, 5 aa, Giardia lamblia
SPAAT

SEQ ID NO: 3138440 - protein, 6 aa, Giardia lamblia
SPAATA

SEQ ID NO: 3138441 - protein, 6 aa, Giardia lamblia
SPADNS

SEQ ID NO: 3138442 - protein, 10 aa, Giardia lamblia
SPADRPSASD

SEQ ID NO: 3138443 - protein, 17 aa, Giardia lamblia
SPADSPLGAPTSNEGDD

SEQ ID NO: 3138444 - protein, 4 aa, Giardia lamblia
SPAE

SEQ ID NO: 3138445 - protein, 5 aa, Giardia lamblia
SPAEA

SEQ ID NO: 3138446 - protein, 11 aa, Giardia lamblia
SPAEAVAGGAP

SEQ ID NO: 3138447 - protein, 14 aa, Giardia lamblia
SPAEHYANTSMRGQ

SEQ ID NO: 3138448 - protein, 30 aa, Giardia lamblia
SPAFPSSLSPRSFGQKSSAAKSGKSGTSDI

SEQ ID NO: 3138449 - protein, 8 aa, Giardia lamblia
SPAGANNL

SEQ ID NO: 3138450 - protein, 8 aa, Giardia lamblia
SPAGCGRG

SEQ ID NO: 3138451 - protein, 4 aa, Giardia lamblia
SPAH

SEQ ID NO: 3138452 - protein, 6 aa, Giardia lamblia
SPAHQS

SEQ ID NO: 3138453 - protein, 8 aa, Giardia lamblia
SPAHSAPT

SEQ ID NO: 3138454 - protein, 4 aa, Giardia lamblia
SPAI

SEQ ID NO: 3138455 - protein, 8 aa, Giardia lamblia
SPAINGDN

SEQ ID NO: 3138456 - protein, 8 aa, Giardia lamblia
SPAKPGFA

SEQ ID NO: 3138457 - protein, 6 aa, Giardia lamblia
SPALPT

SEQ ID NO: 3138458 - protein, 4 aa, Giardia lamblia
SPAM

SEQ ID NO: 3138459 - protein, 19 aa, Giardia lamblia
SPAMTPSIESQDITKDTHK

SEQ ID NO: 3138460 - protein, 14 aa, Giardia lamblia
SPANRSPEGSSPPI

SEQ ID NO: 3138461 - protein, 8 aa, Giardia lamblia
SPANSKSL

SEQ ID NO: 3138462 - protein, 15 aa, Giardia lamblia
SPAPSFKKPSQWTPE

SEQ ID NO: 3138463 - protein, 9 aa, Giardia lamblia
SPAPWNAPT

SEQ ID NO: 3138464 - protein, 5 aa, Giardia lamblia
SPAQP

SEQ ID NO: 3138465 - protein, 4 aa, Giardia lamblia
SPAR

SEQ ID NO: 3138466 - protein, 8 aa, Giardia lamblia
SPARATTE

SEQ ID NO: 3138467 - protein, 5 aa, Giardia lamblia
SPASF

SEQ ID NO: 3138468 - protein, 5 aa, Giardia lamblia
SPASS

SEQ ID NO: 3138469 - protein, 10 aa, Giardia lamblia
SPASTNYDET

SEQ ID NO: 3138470 - protein, 7 aa, Giardia lamblia
SPASVTK

SEQ ID NO: 3138471 - protein, 10 aa, Giardia lamblia
SPATSPGRKY

SEQ ID NO: 3138472 - protein, 7 aa, Giardia lamblia
SPATTCS

SEQ ID NO: 3138473 - protein, 8 aa, Giardia lamblia
SPAYAPPE

SEQ ID NO: 3138474 - protein, 6 aa, Giardia lamblia
SPCGQG

SEQ ID NO: 3138475 - protein, 19 aa, Giardia lamblia
SPCGSVKARSDASDGAHSP

SEQ ID NO: 3138476 - protein, 14 aa, Giardia lamblia
SPCKDKDAKEELPS

SEQ ID NO: 3138477 - protein, 19 aa, Giardia lamblia
SPCNPGASATEQANRYPSN

SEQ ID NO: 3138478 - protein, 5 aa, Giardia lamblia
SPCRT

SEQ ID NO: 3138479 - protein, 7 aa, Giardia lamblia
SPCSGQS

SEQ ID NO: 3138480 - protein, 17 aa, Giardia lamblia
SPCSTKTTEEQATRQQH

SEQ ID NO: 3138481 - protein, 5 aa, Giardia lamblia
SPDAA

SEQ ID NO: 3138482 - protein, 6 aa, Giardia lamblia
SPDAIN

SEQ ID NO: 3138483 - protein, 8 aa, Giardia lamblia
SPDDRISS

SEQ ID NO: 3138484 - protein, 6 aa, Giardia lamblia
SPDDVV

SEQ ID NO: 3138485 - protein, 4 aa, Giardia lamblia
SPDE

SEQ ID NO: 3138486 - protein, 5 aa, Giardia lamblia
SPDEA

SEQ ID NO: 3138487 - protein, 4 aa, Giardia lamblia
SPDG

SEQ ID NO: 3138488 - protein, 5 aa, Giardia lamblia
SPDGS

SEQ ID NO: 3138489 - protein, 10 aa, Giardia lamblia
SPDGSAYKGT

SEQ ID NO: 3138490 - protein, 8 aa, Giardia lamblia
SPDGTGEY

SEQ ID NO: 3138491 - protein, 7 aa, Giardia lamblia
SPDGTSF

SEQ ID NO: 3138492 - protein, 5 aa, Giardia lamblia
SPDGV

SEQ ID NO: 3138493 - protein, 4 aa, Giardia lamblia
SPDH

SEQ ID NO: 3138494 - protein, 15 aa, Giardia lamblia
SPDISRQLPAESKNF

SEQ ID NO: 3138495 - protein, 4 aa, Giardia lamblia
SPDK

SEQ ID NO: 3138496 - protein, 8 aa, Giardia lamblia
SPDKASEE

SEQ ID NO: 3138497 - protein, 12 aa, Giardia lamblia
SPDKTDSTGKPL

SEQ ID NO: 3138498 - protein, 11 aa, Giardia lamblia
SPDKTSPKDGS

SEQ ID NO: 3138499 - protein, 4 aa, Giardia lamblia
SPDL

SEQ ID NO: 3138500 - protein, 18 aa, Giardia lamblia
SPDPKKADTQLAQPASVA

SEQ ID NO: 3138501 - protein, 10 aa, Giardia lamblia
SPDPQDRPLA

SEQ ID NO: 3138502 - protein, 26 aa, Giardia lamblia
SPDPSVDLPRKPRTNIPPRSQSPYKA

SEQ ID NO: 3138503 - protein, 6 aa, Giardia lamblia
SPDQPL

SEQ ID NO: 3138504 - protein, 4 aa, Giardia lamblia
SPDR

SEQ ID NO: 3138505 - protein, 6 aa, Giardia lamblia
SPDRHI

SEQ ID NO: 3138506 - protein, 5 aa, Giardia lamblia
SPDRK

SEQ ID NO: 3138507 - protein, 11 aa, Giardia lamblia
SPDRKYPPNPD

SEQ ID NO: 3138508 - protein, 8 aa, Giardia lamblia
SPDRRPSA

SEQ ID NO: 3138509 - protein, 4 aa, Giardia lamblia
SPDS

SEQ ID NO: 3138510 - protein, 9 aa, Giardia lamblia
SPDSNGLTP

SEQ ID NO: 3138511 - protein, 6 aa, Giardia lamblia
SPDSPS

SEQ ID NO: 3138512 - protein, 5 aa, Giardia lamblia
SPDTS

SEQ ID NO: 3138513 - protein, 7 aa, Giardia lamblia
SPDTVRD

SEQ ID NO: 3138514 - protein, 11 aa, Giardia lamblia
SPDVDNDEERQ

SEQ ID NO: 3138515 - protein, 9 aa, Giardia lamblia
SPDVSGPLT

SEQ ID NO: 3138516 - protein, 8 aa, Giardia lamblia
SPDYPQRV

SEQ ID NO: 3138517 - protein, 4 aa, Giardia lamblia
SPEA

SEQ ID NO: 3138518 - protein, 6 aa, Giardia lamblia
SPEADS

SEQ ID NO: 3138519 - protein, 6 aa, Giardia lamblia
SPEDPY

SEQ ID NO: 3138520 - protein, 6 aa, Giardia lamblia
SPEDVP

SEQ ID NO: 3138521 - protein, 21 aa, Giardia lamblia
SPEEENIKRSVDSSSRMSKGV

SEQ ID NO: 3138522 - protein, 5 aa, Giardia lamblia
SPEEH

SEQ ID NO: 3138523 - protein, 5 aa, Giardia lamblia
SPEEL

SEQ ID NO: 3138524 - protein, 11 aa, Giardia lamblia
SPEEYGDEGRK

SEQ ID NO: 3138525 - protein, 4 aa, Giardia lamblia
SPEG

SEQ ID NO: 3138526 - protein, 6 aa, Giardia lamblia
SPEGAA

SEQ ID NO: 3138527 - protein, 5 aa, Giardia lamblia
SPEGE

SEQ ID NO: 3138528 - protein, 13 aa, Giardia lamblia
SPEGGSREATNVD

SEQ ID NO: 3138529 - protein, 6 aa, Giardia lamblia
SPEGVN

SEQ ID NO: 3138530 - protein, 20 aa, Giardia lamblia
SPEHSKTVGSACPDAVTKAS

SEQ ID NO: 3138531 - protein, 5 aa, Giardia lamblia
SPEIK

SEQ ID NO: 3138532 - protein, 6 aa, Giardia lamblia
SPELNY

SEQ ID NO: 3138533 - protein, 5 aa, Giardia lamblia
SPEPF

SEQ ID NO: 3138534 - protein, 4 aa, Giardia lamblia
SPEQ

SEQ ID NO: 3138535 - protein, 6 aa, Giardia lamblia
SPEQEQ

SEQ ID NO: 3138536 - protein, 13 aa, Giardia lamblia
SPEQRDRDPDTLS

SEQ ID NO: 3138537 - protein, 7 aa, Giardia lamblia
SPEQTAK

SEQ ID NO: 3138538 - protein, 7 aa, Giardia lamblia
SPERDGQ

SEQ ID NO: 3138539 - protein, 5 aa, Giardia lamblia
SPERY

SEQ ID NO: 3138540 - protein, 5 aa, Giardia lamblia
SPESL

SEQ ID NO: 3138541 - protein, 8 aa, Giardia lamblia
SPESTPDI

SEQ ID NO: 3138542 - protein, 8 aa, Giardia lamblia
SPETDSSS

SEQ ID NO: 3138543 - protein, 7 aa, Giardia lamblia
SPETGTL

SEQ ID NO: 3138544 - protein, 8 aa, Giardia lamblia
SPFGRVGG

SEQ ID NO: 3138545 - protein, 21 aa, Giardia lamblia
SPFGTQPSTTDGASGPQAGSF

SEQ ID NO: 3138546 - protein, 17 aa, Giardia lamblia
SPFSDHAKKATNSELDA

SEQ ID NO: 3138547 - protein, 6 aa, Giardia lamblia
SPFSKN

SEQ ID NO: 3138548 - protein, 12 aa, Giardia lamblia
SPFSPADEALGD

SEQ ID NO: 3138549 - protein, 4 aa, Giardia lamblia
SPGE

SEQ ID NO: 3138550 - protein, 7 aa, Giardia lamblia
SPGGDGR

SEQ ID NO: 3138551 - protein, 10 aa, Giardia lamblia
SPGGDLDANG

SEQ ID NO: 3138552 - protein, 6 aa, Giardia lamblia
SPGGFR

SEQ ID NO: 3138553 - protein, 5 aa, Giardia lamblia
SPGGI

SEQ ID NO: 3138554 - protein, 20 aa, Giardia lamblia
SPGHVAASESTHNNLKSDEL

SEQ ID NO: 3138555 - protein, 13 aa, Giardia lamblia
SPGISAPHLGPTR

SEQ ID NO: 3138556 - protein, 6 aa, Giardia lamblia
SPGKPA

SEQ ID NO: 3138557 - protein, 6 aa, Giardia lamblia
SPGPAY

SEQ ID NO: 3138558 - protein, 5 aa, Giardia lamblia
SPGPE

SEQ ID NO: 3138559 - protein, 7 aa, Giardia lamblia
SPGQQTP

SEQ ID NO: 3138560 - protein, 13 aa, Giardia lamblia
SPGQSQTPESPNF

SEQ ID NO: 3138561 - protein, 34 aa, Giardia lamblia
SPGRHSQPRKRAPHNFRDSTSSTAMQDESFASTA

SEQ ID NO: 3138562 - protein, 7 aa, Giardia lamblia
SPGSGER

SEQ ID NO: 3138563 - protein, 8 aa, Giardia lamblia
SPGSGPLH

SEQ ID NO: 3138564 - protein, 9 aa, Giardia lamblia
SPGSRHGSS

SEQ ID NO: 3138565 - protein, 9 aa, Giardia lamblia
SPGSSQARG

SEQ ID NO: 3138566 - protein, 5 aa, Giardia lamblia
SPGST

SEQ ID NO: 3138567 - protein, 7 aa, Giardia lamblia
SPGSTLH

SEQ ID NO: 3138568 - protein, 6 aa, Giardia lamblia
SPGSVS

SEQ ID NO: 3138569 - protein, 12 aa, Giardia lamblia
SPGTHSPGHSDI

SEQ ID NO: 3138570 - protein, 8 aa, Giardia lamblia
SPGTSPSV

SEQ ID NO: 3138571 - protein, 7 aa, Giardia lamblia
SPGTTSD

SEQ ID NO: 3138572 - protein, 5 aa, Giardia lamblia
SPGVS

SEQ ID NO: 3138573 - protein, 11 aa, Giardia lamblia
SPHDPDLPADP

SEQ ID NO: 3138574 - protein, 11 aa, Giardia lamblia
SPHGINSSSTV

SEQ ID NO: 3138575 - protein, 10 aa, Giardia lamblia
SPHGLTPPTA

SEQ ID NO: 3138576 - protein, 8 aa, Giardia lamblia
SPHKGGIS

SEQ ID NO: 3138577 - protein, 10 aa, Giardia lamblia
SPHQRLSDEE

SEQ ID NO: 3138578 - protein, 9 aa, Giardia lamblia
SPHRQSRKG

SEQ ID NO: 3138579 - protein, 20 aa, Giardia lamblia
SPHRQSRKRSLPDLYLLSLP

SEQ ID NO: 3138580 - protein, 23 aa, Giardia lamblia
SPHSPLQAATNVTSSPSRNQQAL

SEQ ID NO: 3138581 - protein, 4 aa, Giardia lamblia
SPHY

SEQ ID NO: 3138582 - protein, 6 aa, Giardia lamblia
SPIENV

SEQ ID NO: 3138583 - protein, 12 aa, Giardia lamblia
SPIESEPQQLYP

SEQ ID NO: 3138584 - protein, 5 aa, Giardia lamblia
SPIEV

SEQ ID NO: 3138585 - protein, 8 aa, Giardia lamblia
SPILEASS

SEQ ID NO: 3138586 - protein, 8 aa, Giardia lamblia
SPIPADRT

SEQ ID NO: 3138587 - protein, 6 aa, Giardia lamblia
SPIPDA

SEQ ID NO: 3138588 - protein, 10 aa, Giardia lamblia
SPIPQHTDKP

SEQ ID NO: 3138589 - protein, 12 aa, Giardia lamblia
SPIRASSPSGLR

SEQ ID NO: 3138590 - protein, 12 aa, Giardia lamblia
SPISDSSAGSVT

SEQ ID NO: 3138591 - protein, 5 aa, Giardia lamblia
SPITK

SEQ ID NO: 3138592 - protein, 7 aa, Giardia lamblia
SPKAAES

SEQ ID NO: 3138593 - protein, 10 aa, Giardia lamblia
SPKADSYDRR

SEQ ID NO: 3138594 - protein, 6 aa, Giardia lamblia
SPKDID

SEQ ID NO: 3138595 - protein, 5 aa, Giardia lamblia
SPKDL

SEQ ID NO: 3138596 - protein, 6 aa, Giardia lamblia
SPKESF

SEQ ID NO: 3138597 - protein, 11 aa, Giardia lamblia
SPKESGMSDYE

SEQ ID NO: 3138598 - protein, 12 aa, Giardia lamblia
SPKHGNPDSDDL

SEQ ID NO: 3138599 - protein, 9 aa, Giardia lamblia
SPKKAQQYR

SEQ ID NO: 3138600 - protein, 9 aa, Giardia lamblia
SPKKGDSSL

SEQ ID NO: 3138601 - protein, 8 aa, Giardia lamblia
SPKKGGNV

SEQ ID NO: 3138602 - protein, 7 aa, Giardia lamblia
SPKPGER

SEQ ID NO: 3138603 - protein, 9 aa, Giardia lamblia
SPKPQFGTK

SEQ ID NO: 3138604 - protein, 22 aa, Giardia lamblia
SPKQPQAKSYYSTPTSTTPTSV

SEQ ID NO: 3138605 - protein, 14 aa, Giardia lamblia
SPKQQNSPPTEKEI

SEQ ID NO: 3138606 - protein, 10 aa, Giardia lamblia
SPKQSFEDTL

SEQ ID NO: 3138607 - protein, 19 aa, Giardia lamblia
SPKRKSFQTTQLKNNASGF

SEQ ID NO: 3138608 - protein, 9 aa, Giardia lamblia
SPKSIRTPE

SEQ ID NO: 3138609 - protein, 8 aa, Giardia lamblia
SPKSLREK

SEQ ID NO: 3138610 - protein, 8 aa, Giardia lamblia
SPKVTSRP

SEQ ID NO: 3138611 - protein, 45 aa, Giardia lamblia
SPKYAETEEGADGAQGDESDNDLEDSDDSVDKAKKRSMGKNGISA

SEQ ID NO: 3138612 - protein, 8 aa, Giardia lamblia
SPLAQQDD

SEQ ID NO: 3138613 - protein, 45 aa, Giardia lamblia
SPLASPSTSPTVPLGPSLAGSERDPNIPRLGTPTACSEDSPQITN

SEQ ID NO: 3138614 - protein, 4 aa, Giardia lamblia
SPLD

SEQ ID NO: 3138615 - protein, 9 aa, Giardia lamblia
SPLDPNQEE

SEQ ID NO: 3138616 - protein, 6 aa, Giardia lamblia
SPLEPS

SEQ ID NO: 3138617 - protein, 37 aa, Giardia lamblia
SPLERSLSSDVPRSDLSEADHVSPDASLAQDDSSLQQ

SEQ ID NO: 3138618 - protein, 7 aa, Giardia lamblia
SPLGPQT

SEQ ID NO: 3138619 - protein, 8 aa, Giardia lamblia
SPLGRCPD

SEQ ID NO: 3138620 - protein, 6 aa, Giardia lamblia
SPLISS

SEQ ID NO: 3138621 - protein, 6 aa, Giardia lamblia
SPLNAK

SEQ ID NO: 3138622 - protein, 8 aa, Giardia lamblia
SPLPAKRA

SEQ ID NO: 3138623 - protein, 6 aa, Giardia lamblia
SPLPAL

SEQ ID NO: 3138624 - protein, 7 aa, Giardia lamblia
SPLPSAP

SEQ ID NO: 3138625 - protein, 5 aa, Giardia lamblia
SPLRA

SEQ ID NO: 3138626 - protein, 5 aa, Giardia lamblia
SPLRE

SEQ ID NO: 3138627 - protein, 21 aa, Giardia lamblia
SPLRKTTSNESSLSIDQGPGA

SEQ ID NO: 3138628 - protein, 6 aa, Giardia lamblia
SPLSEN

SEQ ID NO: 3138629 - protein, 6 aa, Giardia lamblia
SPLSHT

SEQ ID NO: 3138630 - protein, 9 aa, Giardia lamblia
SPLSPNSSH

SEQ ID NO: 3138631 - protein, 5 aa, Giardia lamblia
SPLST

SEQ ID NO: 3138632 - protein, 14 aa, Giardia lamblia
SPLTEAPKPLSRPT

SEQ ID NO: 3138633 - protein, 13 aa, Giardia lamblia
SPLVTSESSAETR

SEQ ID NO: 3138634 - protein, 6 aa, Giardia lamblia
SPMDDG

SEQ ID NO: 3138635 - protein, 12 aa, Giardia lamblia
SPMFTNTSDDFE

SEQ ID NO: 3138636 - protein, 18 aa, Giardia lamblia
SPMGGSYADPRDPSGTQK

SEQ ID NO: 3138637 - protein, 4 aa, Giardia lamblia
SPMQ

SEQ ID NO: 3138638 - protein, 18 aa, Giardia lamblia
SPMQNKPNLEPRPSSSPC

SEQ ID NO: 3138639 - protein, 11 aa, Giardia lamblia
SPMRSSQQEYT

SEQ ID NO: 3138640 - protein, 20 aa, Giardia lamblia
SPMTPSSNNSQPFTLDKGSS

SEQ ID NO: 3138641 - protein, 5 aa, Giardia lamblia
SPNAK

SEQ ID NO: 3138642 - protein, 11 aa, Giardia lamblia
SPNDKSCDNTL

SEQ ID NO: 3138643 - protein, 14 aa, Giardia lamblia
SPNDSVSETNSVAS

SEQ ID NO: 3138644 - protein, 11 aa, Giardia lamblia
SPNEDNRPSLA

SEQ ID NO: 3138645 - protein, 6 aa, Giardia lamblia
SPNERI

SEQ ID NO: 3138646 - protein, 6 aa, Giardia lamblia
SPNERY

SEQ ID NO: 3138647 - protein, 4 aa, Giardia lamblia
SPNF

SEQ ID NO: 3138648 - protein, 10 aa, Giardia lamblia
SPNFDVSSDA

SEQ ID NO: 3138649 - protein, 8 aa, Giardia lamblia
SPNIPDSN

SEQ ID NO: 3138650 - protein, 15 aa, Giardia lamblia
SPNISTGKDLTDNLE

SEQ ID NO: 3138651 - protein, 4 aa, Giardia lamblia
SPNK

SEQ ID NO: 3138652 - protein, 11 aa, Giardia lamblia
SPNKPDSSGVG

SEQ ID NO: 3138653 - protein, 9 aa, Giardia lamblia
SPNKPGFKP

SEQ ID NO: 3138654 - protein, 7 aa, Giardia lamblia
SPNNAAA

SEQ ID NO: 3138655 - protein, 4 aa, Giardia lamblia
SPNP

SEQ ID NO: 3138656 - protein, 5 aa, Giardia lamblia
SPNPS

SEQ ID NO: 3138657 - protein, 4 aa, Giardia lamblia
SPNQ

SEQ ID NO: 3138658 - protein, 7 aa, Giardia lamblia
SPNQRQL

SEQ ID NO: 3138659 - protein, 11 aa, Giardia lamblia
SPNRAKNATSE

SEQ ID NO: 3138660 - protein, 5 aa, Giardia lamblia
SPNSA

SEQ ID NO: 3138661 - protein, 5 aa, Giardia lamblia
SPNSF

SEQ ID NO: 3138662 - protein, 6 aa, Giardia lamblia
SPNSQK

SEQ ID NO: 3138663 - protein, 10 aa, Giardia lamblia
SPNTSQKYAN

SEQ ID NO: 3138664 - protein, 8 aa, Giardia lamblia
SPNTTADA

SEQ ID NO: 3138665 - protein, 5 aa, Giardia lamblia
SPNVA

SEQ ID NO: 3138666 - protein, 19 aa, Giardia lamblia
SPPAPADNTTTVPVDDSAD

SEQ ID NO: 3138667 - protein, 6 aa, Giardia lamblia
SPPAVV

SEQ ID NO: 3138668 - protein, 9 aa, Giardia lamblia
SPPEAASPR

SEQ ID NO: 3138669 - protein, 7 aa, Giardia lamblia
SPPEIDD

SEQ ID NO: 3138670 - protein, 5 aa, Giardia lamblia
SPPFF

SEQ ID NO: 3138671 - protein, 7 aa, Giardia lamblia
SPPFYSD

SEQ ID NO: 3138672 - protein, 7 aa, Giardia lamblia
SPPGTYA

SEQ ID NO: 3138673 - protein, 6 aa, Giardia lamblia
SPPIPL

SEQ ID NO: 3138674 - protein, 5 aa, Giardia lamblia
SPPLS

SEQ ID NO: 3138675 - protein, 8 aa, Giardia lamblia
SPPNDATV

SEQ ID NO: 3138676 - protein, 8 aa, Giardia lamblia
SPPNISDT

SEQ ID NO: 3138677 - protein, 7 aa, Giardia lamblia
SPPNISS

SEQ ID NO: 3138678 - protein, 13 aa, Giardia lamblia
SPPNTEEELTPEK

SEQ ID NO: 3138679 - protein, 13 aa, Giardia lamblia
SPPPTDDDTGGPY

SEQ ID NO: 3138680 - protein, 8 aa, Giardia lamblia
SPPRPESV

SEQ ID NO: 3138681 - protein, 7 aa, Giardia lamblia
SPPSETD

SEQ ID NO: 3138682 - protein, 9 aa, Giardia lamblia
SPPSEVEAS

SEQ ID NO: 3138683 - protein, 11 aa, Giardia lamblia
SPPSIRSSANT

SEQ ID NO: 3138684 - protein, 8 aa, Giardia lamblia
SPPTGVST

SEQ ID NO: 3138685 - protein, 6 aa, Giardia lamblia
SPPTSI

SEQ ID NO: 3138686 - protein, 22 aa, Giardia lamblia
SPPTSLTNSSIAHSPADSYPLG

SEQ ID NO: 3138687 - protein, 6 aa, Giardia lamblia
SPPTYN

SEQ ID NO: 3138688 - protein, 4 aa, Giardia lamblia
SPQA

SEQ ID NO: 3138689 - protein, 7 aa, Giardia lamblia
SPQATIE

SEQ ID NO: 3138690 - protein, 6 aa, Giardia lamblia
SPQDLD

SEQ ID NO: 3138691 - protein, 5 aa, Giardia lamblia
SPQEA

SEQ ID NO: 3138692 - protein, 6 aa, Giardia lamblia
SPQEEA

SEQ ID NO: 3138693 - protein, 11 aa, Giardia lamblia
SPQEKHASPVD

SEQ ID NO: 3138694 - protein, 9 aa, Giardia lamblia
SPQEREEYE

SEQ ID NO: 3138695 - protein, 29 aa, Giardia lamblia
SPQGPKRIDSATSPGHATSLSNALDSDSA

SEQ ID NO: 3138696 - protein, 16 aa, Giardia lamblia
SPQGRSRFTATQGDKL

SEQ ID NO: 3138697 - protein, 16 aa, Giardia lamblia
SPQISQESSGITPVPT

SEQ ID NO: 3138698 - protein, 5 aa, Giardia lamblia
SPQKV

SEQ ID NO: 3138699 - protein, 6 aa, Giardia lamblia
SPQLDE

SEQ ID NO: 3138700 - protein, 6 aa, Giardia lamblia
SPQNAK

SEQ ID NO: 3138701 - protein, 7 aa, Giardia lamblia
SPQPCQS

SEQ ID NO: 3138702 - protein, 7 aa, Giardia lamblia
SPQPLSI

SEQ ID NO: 3138703 - protein, 7 aa, Giardia lamblia
SPQPTHR

SEQ ID NO: 3138704 - protein, 9 aa, Giardia lamblia
SPQQVPTRM

SEQ ID NO: 3138705 - protein, 4 aa, Giardia lamblia
SPQR

SEQ ID NO: 3138706 - protein, 29 aa, Giardia lamblia
SPQRGGKPSHFGAPQPRQQRAKSSGVPEC

SEQ ID NO: 3138707 - protein, 8 aa, Giardia lamblia
SPQTATEL

SEQ ID NO: 3138708 - protein, 40 aa, Giardia lamblia
SPQTHQEDGADLGKVPEARRGAEDHASKDDLRTEGEKNVH

SEQ ID NO: 3138709 - protein, 5 aa, Giardia lamblia
SPQTS

SEQ ID NO: 3138710 - protein, 6 aa, Giardia lamblia
SPRAIR

SEQ ID NO: 3138711 - protein, 8 aa, Giardia lamblia
SPRATTET

SEQ ID NO: 3138712 - protein, 7 aa, Giardia lamblia
SPRDPIS

SEQ ID NO: 3138713 - protein, 25 aa, Giardia lamblia
SPREASAEPRRQDEHAKTAAKSIDN

SEQ ID NO: 3138714 - protein, 5 aa, Giardia lamblia
SPRFK

SEQ ID NO: 3138715 - protein, 11 aa, Giardia lamblia
SPRGPACTAPQ

SEQ ID NO: 3138716 - protein, 8 aa, Giardia lamblia
SPRGSLQN

SEQ ID NO: 3138717 - protein, 10 aa, Giardia lamblia
SPRHTGYTSQ

SEQ ID NO: 3138718 - protein, 5 aa, Giardia lamblia
SPRKN

SEQ ID NO: 3138719 - protein, 12 aa, Giardia lamblia
SPRLGNSAIRDR

SEQ ID NO: 3138720 - protein, 4 aa, Giardia lamblia
SPRP

SEQ ID NO: 3138721 - protein, 6 aa, Giardia lamblia
SPRSEL

SEQ ID NO: 3138722 - protein, 15 aa, Giardia lamblia
SPRSSNPEVTKTKVK

SEQ ID NO: 3138723 - protein, 19 aa, Giardia lamblia
SPRSVYTSGKGSSQAGLTA

SEQ ID NO: 3138724 - protein, 12 aa, Giardia lamblia
SPRTNTRKNTPR

SEQ ID NO: 3138725 - protein, 15 aa, Giardia lamblia
SPRTTSGDDSSIKQQ

SEQ ID NO: 3138726 - protein, 8 aa, Giardia lamblia
SPRVPPQV

SEQ ID NO: 3138727 - protein, 7 aa, Giardia lamblia
SPRVSQH

SEQ ID NO: 3138728 - protein, 9 aa, Giardia lamblia
SPSADPQTI

SEQ ID NO: 3138729 - protein, 9 aa, Giardia lamblia
SPSAEKAGS

SEQ ID NO: 3138730 - protein, 6 aa, Giardia lamblia
SPSAHN

SEQ ID NO: 3138731 - protein, 12 aa, Giardia lamblia
SPSAPDSSQSQV

SEQ ID NO: 3138732 - protein, 8 aa, Giardia lamblia
SPSASDRT

SEQ ID NO: 3138733 - protein, 6 aa, Giardia lamblia
SPSAYK

SEQ ID NO: 3138734 - protein, 5 aa, Giardia lamblia
SPSEG

SEQ ID NO: 3138735 - protein, 6 aa, Giardia lamblia
SPSENV

SEQ ID NO: 3138736 - protein, 5 aa, Giardia lamblia
SPSEY

SEQ ID NO: 3138737 - protein, 13 aa, Giardia lamblia
SPSFSSGPTITSQ

SEQ ID NO: 3138738 - protein, 6 aa, Giardia lamblia
SPSFST

SEQ ID NO: 3138739 - protein, 4 aa, Giardia lamblia
SPSG

SEQ ID NO: 3138740 - protein, 8 aa, Giardia lamblia
SPSGKPSY

SEQ ID NO: 3138741 - protein, 6 aa, Giardia lamblia
SPSGLS

SEQ ID NO: 3138742 - protein, 9 aa, Giardia lamblia
SPSGSVYGS

SEQ ID NO: 3138743 - protein, 7 aa, Giardia lamblia
SPSHTTE

SEQ ID NO: 3138744 - protein, 9 aa, Giardia lamblia
SPSIAEQES

SEQ ID NO: 3138745 - protein, 13 aa, Giardia lamblia
SPSIPSLQKTSTY

SEQ ID NO: 3138746 - protein, 4 aa, Giardia lamblia
SPSK

SEQ ID NO: 3138747 - protein, 11 aa, Giardia lamblia
SPSKIRTSRGI

SEQ ID NO: 3138748 - protein, 10 aa, Giardia lamblia
SPSKRNAPDI

SEQ ID NO: 3138749 - protein, 8 aa, Giardia lamblia
SPSKSLSE

SEQ ID NO: 3138750 - protein, 13 aa, Giardia lamblia
SPSKSPTTQPRSP

SEQ ID NO: 3138751 - protein, 7 aa, Giardia lamblia
SPSLEET

SEQ ID NO: 3138752 - protein, 6 aa, Giardia lamblia
SPSLPQ

SEQ ID NO: 3138753 - protein, 6 aa, Giardia lamblia
SPSLPT

SEQ ID NO: 3138754 - protein, 13 aa, Giardia lamblia
SPSLSADTREDSI

SEQ ID NO: 3138755 - protein, 12 aa, Giardia lamblia
SPSNAVEPPAAY

SEQ ID NO: 3138756 - protein, 17 aa, Giardia lamblia
SPSNENEQQVLPEDRLK

SEQ ID NO: 3138757 - protein, 5 aa, Giardia lamblia
SPSNG

SEQ ID NO: 3138758 - protein, 25 aa, Giardia lamblia
SPSPPDVDSSSPETPQASELHPGDT

SEQ ID NO: 3138759 - protein, 11 aa, Giardia lamblia
SPSQASFGTGT

SEQ ID NO: 3138760 - protein, 6 aa, Giardia lamblia
SPSQLE

SEQ ID NO: 3138761 - protein, 6 aa, Giardia lamblia
SPSQNF

SEQ ID NO: 3138762 - protein, 8 aa, Giardia lamblia
SPSQRQQV

SEQ ID NO: 3138763 - protein, 5 aa, Giardia lamblia
SPSRA

SEQ ID NO: 3138764 - protein, 32 aa, Giardia lamblia
SPSRASTLQTTVRPGSAPPCGELPDRPSYKST

SEQ ID NO: 3138765 - protein, 25 aa, Giardia lamblia
SPSRSSAKSPIRGVSPSRQTTNRPV

SEQ ID NO: 3138766 - protein, 9 aa, Giardia lamblia
SPSSAAPGS

SEQ ID NO: 3138767 - protein, 12 aa, Giardia lamblia
SPSSASQQPASH

SEQ ID NO: 3138768 - protein, 20 aa, Giardia lamblia
SPSSCPDEATDQQAKGINTN

SEQ ID NO: 3138769 - protein, 7 aa, Giardia lamblia
SPSSGAY

SEQ ID NO: 3138770 - protein, 22 aa, Giardia lamblia
SPSSGTSSPAKGQRLSDSSKVY

SEQ ID NO: 3138771 - protein, 8 aa, Giardia lamblia
SPSSKAPL

SEQ ID NO: 3138772 - protein, 9 aa, Giardia lamblia
SPSSNEEIK

SEQ ID NO: 3138773 - protein, 5 aa, Giardia lamblia
SPSSQ

SEQ ID NO: 3138774 - protein, 9 aa, Giardia lamblia
SPSSSSINQ

SEQ ID NO: 3138775 - protein, 7 aa, Giardia lamblia
SPSSSTS

SEQ ID NO: 3138776 - protein, 5 aa, Giardia lamblia
SPSST

SEQ ID NO: 3138777 - protein, 7 aa, Giardia lamblia
SPSSTFD

SEQ ID NO: 3138778 - protein, 7 aa, Giardia lamblia
SPSTFGG

SEQ ID NO: 3138779 - protein, 9 aa, Giardia lamblia
SPSTNKDQV

SEQ ID NO: 3138780 - protein, 6 aa, Giardia lamblia
SPSTRG

SEQ ID NO: 3138781 - protein, 5 aa, Giardia lamblia
SPSTS

SEQ ID NO: 3138782 - protein, 19 aa, Giardia lamblia
SPSTSGPVDKQYRSYVSPV

SEQ ID NO: 3138783 - protein, 4 aa, Giardia lamblia
SPSY

SEQ ID NO: 3138784 - protein, 16 aa, Giardia lamblia
SPSYRNKAKHKRAQSY

SEQ ID NO: 3138785 - protein, 6 aa, Giardia lamblia
SPSYSA

SEQ ID NO: 3138786 - protein, 5 aa, Giardia lamblia
SPTAE

SEQ ID NO: 3138787 - protein, 12 aa, Giardia lamblia
SPTANIDTASTL

SEQ ID NO: 3138788 - protein, 6 aa, Giardia lamblia
SPTATT

SEQ ID NO: 3138789 - protein, 6 aa, Giardia lamblia
SPTAYQ

SEQ ID NO: 3138790 - protein, 10 aa, Giardia lamblia
SPTDGRGTTA

SEQ ID NO: 3138791 - protein, 15 aa, Giardia lamblia
SPTEASSLQTESDFS

SEQ ID NO: 3138792 - protein, 8 aa, Giardia lamblia
SPTKPGFD

SEQ ID NO: 3138793 - protein, 10 aa, Giardia lamblia
SPTKRDSDGR

SEQ ID NO: 3138794 - protein, 4 aa, Giardia lamblia
SPTL

SEQ ID NO: 3138795 - protein, 7 aa, Giardia lamblia
SPTLEHS

SEQ ID NO: 3138796 - protein, 5 aa, Giardia lamblia
SPTNA

SEQ ID NO: 3138797 - protein, 7 aa, Giardia lamblia
SPTNNGT

SEQ ID NO: 3138798 - protein, 20 aa, Giardia lamblia
SPTNSTSASAMDQKSAYENV

SEQ ID NO: 3138799 - protein, 8 aa, Giardia lamblia
SPTNTYPC

SEQ ID NO: 3138800 - protein, 18 aa, Giardia lamblia
SPTPASLAPKAIAGAETA

SEQ ID NO: 3138801 - protein, 6 aa, Giardia lamblia
SPTPFP

SEQ ID NO: 3138802 - protein, 6 aa, Giardia lamblia
SPTPGC

SEQ ID NO: 3138803 - protein, 6 aa, Giardia lamblia
SPTPHR

SEQ ID NO: 3138804 - protein, 5 aa, Giardia lamblia
SPTPS

SEQ ID NO: 3138805 - protein, 26 aa, Giardia lamblia
SPTRNTKSTPNQSPQQQQQQQQQQQQ

SEQ ID NO: 3138806 - protein, 19 aa, Giardia lamblia
SPTRRNVASDSALNCESAE

SEQ ID NO: 3138807 - protein, 4 aa, Giardia lamblia
SPTS

SEQ ID NO: 3138808 - protein, 14 aa, Giardia lamblia
SPTSGQRSSTRVRS

SEQ ID NO: 3138809 - protein, 11 aa, Giardia lamblia
SPTSPHPNKTV

SEQ ID NO: 3138810 - protein, 16 aa, Giardia lamblia
SPTSQSGSGGPSTTKL

SEQ ID NO: 3138811 - protein, 13 aa, Giardia lamblia
SPTSTPNSHGPAV

SEQ ID NO: 3138812 - protein, 4 aa, Giardia lamblia
SPTT

SEQ ID NO: 3138813 - protein, 12 aa, Giardia lamblia
SPTTESASSTTL

SEQ ID NO: 3138814 - protein, 5 aa, Giardia lamblia
SPTTR

SEQ ID NO: 3138815 - protein, 6 aa, Giardia lamblia
SPTTTR

SEQ ID NO: 3138816 - protein, 15 aa, Giardia lamblia
SPTVPTREATLPPKD

SEQ ID NO: 3138817 - protein, 8 aa, Giardia lamblia
SPVASIPT

SEQ ID NO: 3138818 - protein, 9 aa, Giardia lamblia
SPVDPDECP

SEQ ID NO: 3138819 - protein, 14 aa, Giardia lamblia
SPVDRKKLSPTDPI

SEQ ID NO: 3138820 - protein, 11 aa, Giardia lamblia
SPVDSKTRSPF

SEQ ID NO: 3138821 - protein, 26 aa, Giardia lamblia
SPVETKQGSAPATTEPQNSNTMQSPQ

SEQ ID NO: 3138822 - protein, 8 aa, Giardia lamblia
SPVGSLSE

SEQ ID NO: 3138823 - protein, 18 aa, Giardia lamblia
SPVKPEGQHQKLTGSPFP

SEQ ID NO: 3138824 - protein, 6 aa, Giardia lamblia
SPVPAQ

SEQ ID NO: 3138825 - protein, 17 aa, Giardia lamblia
SPVPRSYSNNGEYSSAH

SEQ ID NO: 3138826 - protein, 11 aa, Giardia lamblia
SPVPSSRGAFE

SEQ ID NO: 3138827 - protein, 5 aa, Giardia lamblia
SPVPT

SEQ ID NO: 3138828 - protein, 11 aa, Giardia lamblia
SPVSAPSELAD

SEQ ID NO: 3138829 - protein, 7 aa, Giardia lamblia
SPVSSTT

SEQ ID NO: 3138830 - protein, 24 aa, Giardia lamblia
SPVSTQEPADHNSSQTPPTTDTVV

SEQ ID NO: 3138831 - protein, 6 aa, Giardia lamblia
SPVSTT

SEQ ID NO: 3138832 - protein, 4 aa, Giardia lamblia
SPVT

SEQ ID NO: 3138833 - protein, 11 aa, Giardia lamblia
SPVYNDKGADV

SEQ ID NO: 3138834 - protein, 12 aa, Giardia lamblia
SPWASDTERGKE

SEQ ID NO: 3138835 - protein, 12 aa, Giardia lamblia
SPWQTSTGGTWP

SEQ ID NO: 3138836 - protein, 5 aa, Giardia lamblia
SPWSD

SEQ ID NO: 3138837 - protein, 9 aa, Giardia lamblia
SPWTSQGPL

SEQ ID NO: 3138838 - protein, 6 aa, Giardia lamblia
SPYAES

SEQ ID NO: 3138839 - protein, 14 aa, Giardia lamblia
SPYASSSRSLSNRA

SEQ ID NO: 3138840 - protein, 4 aa, Giardia lamblia
SPYE

SEQ ID NO: 3138841 - protein, 7 aa, Giardia lamblia
SPYETQT

SEQ ID NO: 3138842 - protein, 6 aa, Giardia lamblia
SPYGEK

SEQ ID NO: 3138843 - protein, 12 aa, Giardia lamblia
SPYHQDQTPARA

SEQ ID NO: 3138844 - protein, 8 aa, Giardia lamblia
SPYKPNTT

SEQ ID NO: 3138845 - protein, 7 aa, Giardia lamblia
SPYPQNA

SEQ ID NO: 3138846 - protein, 5 aa, Giardia lamblia
SPYRN

SEQ ID NO: 3138847 - protein, 5 aa, Giardia lamblia
SPYTE

SEQ ID NO: 3138848 - protein, 7 aa, Giardia lamblia
SQACNKR

SEQ ID NO: 3138849 - protein, 9 aa, Giardia lamblia
SQADASGFY

SEQ ID NO: 3138850 - protein, 8 aa, Giardia lamblia
SQADKDLE

SEQ ID NO: 3138851 - protein, 9 aa, Giardia lamblia
SQADKYRTE

SEQ ID NO: 3138852 - protein, 11 aa, Giardia lamblia
SQADTNTREEI

SEQ ID NO: 3138853 - protein, 13 aa, Giardia lamblia
SQAEASSESLERE

SEQ ID NO: 3138854 - protein, 11 aa, Giardia lamblia
SQAERAALPAK

SEQ ID NO: 3138855 - protein, 5 aa, Giardia lamblia
SQAGA

SEQ ID NO: 3138856 - protein, 13 aa, Giardia lamblia
SQAGAKDADGRTA

SEQ ID NO: 3138857 - protein, 6 aa, Giardia lamblia
SQAGLQ

SEQ ID NO: 3138858 - protein, 10 aa, Giardia lamblia
SQAGQGDVQG

SEQ ID NO: 3138859 - protein, 12 aa, Giardia lamblia
SQAGTTNKSGRT

SEQ ID NO: 3138860 - protein, 31 aa, Giardia lamblia
SQAHNAKSSDSIDTQGDTAAMQKASQMSTDA

SEQ ID NO: 3138861 - protein, 11 aa, Giardia lamblia
SQAIKDANPGL

SEQ ID NO: 3138862 - protein, 17 aa, Giardia lamblia
SQAKAKTSAPVVPPEDE

SEQ ID NO: 3138863 - protein, 13 aa, Giardia lamblia
SQAKDDYASMNSS

SEQ ID NO: 3138864 - protein, 10 aa, Giardia lamblia
SQAKGEKAEY

SEQ ID NO: 3138865 - protein, 6 aa, Giardia lamblia
SQAKKL

SEQ ID NO: 3138866 - protein, 5 aa, Giardia lamblia
SQANG

SEQ ID NO: 3138867 - protein, 8 aa, Giardia lamblia
SQANGALE

SEQ ID NO: 3138868 - protein, 7 aa, Giardia lamblia
SQANGNW

SEQ ID NO: 3138869 - protein, 7 aa, Giardia lamblia
SQANSRT

SEQ ID NO: 3138870 - protein, 6 aa, Giardia lamblia
SQAPAE

SEQ ID NO: 3138871 - protein, 15 aa, Giardia lamblia
SQAPLEYDTQEYDRK

SEQ ID NO: 3138872 - protein, 10 aa, Giardia lamblia
SQAPQDADTT

SEQ ID NO: 3138873 - protein, 6 aa, Giardia lamblia
SQAQHN

SEQ ID NO: 3138874 - protein, 19 aa, Giardia lamblia
SQARKTIAAESEEDSWHNG

SEQ ID NO: 3138875 - protein, 13 aa, Giardia lamblia
SQASALRSSNQVR

SEQ ID NO: 3138876 - protein, 9 aa, Giardia lamblia
SQASPATVS

SEQ ID NO: 3138877 - protein, 38 aa, Giardia lamblia
SQASQVDSRSEVQGSGQARSHQPTSVRASSVQQQDPGI

SEQ ID NO: 3138878 - protein, 8 aa, Giardia lamblia
SQASTDNL

SEQ ID NO: 3138879 - protein, 12 aa, Giardia lamblia
SQASVPPGDDSL

SEQ ID NO: 3138880 - protein, 6 aa, Giardia lamblia
SQATGF

SEQ ID NO: 3138881 - protein, 12 aa, Giardia lamblia
SQATLADEEGKT

SEQ ID NO: 3138882 - protein, 13 aa, Giardia lamblia
SQATYQPQNPVKP

SEQ ID NO: 3138883 - protein, 7 aa, Giardia lamblia
SQCGPDE

SEQ ID NO: 3138884 - protein, 6 aa, Giardia lamblia
SQCTGA

SEQ ID NO: 3138885 - protein, 7 aa, Giardia lamblia
SQDAEEI

SEQ ID NO: 3138886 - protein, 11 aa, Giardia lamblia
SQDAGLKPVQG

SEQ ID NO: 3138887 - protein, 5 aa, Giardia lamblia
SQDDF

SEQ ID NO: 3138888 - protein, 10 aa, Giardia lamblia
SQDEASLASL

SEQ ID NO: 3138889 - protein, 8 aa, Giardia lamblia
SQDENGNP

SEQ ID NO: 3138890 - protein, 4 aa, Giardia lamblia
SQDF

SEQ ID NO: 3138891 - protein, 15 aa, Giardia lamblia
SQDGCSERSQQDPEN

SEQ ID NO: 3138892 - protein, 8 aa, Giardia lamblia
SQDGSTPP

SEQ ID NO: 3138893 - protein, 6 aa, Giardia lamblia
SQDGTV

SEQ ID NO: 3138894 - protein, 12 aa, Giardia lamblia
SQDIEAGDGTTT

SEQ ID NO: 3138895 - protein, 9 aa, Giardia lamblia
SQDPSQKTQ

SEQ ID NO: 3138896 - protein, 19 aa, Giardia lamblia
SQDPTKDIKVRENSKNETF

SEQ ID NO: 3138897 - protein, 6 aa, Giardia lamblia
SQDQQM

SEQ ID NO: 3138898 - protein, 6 aa, Giardia lamblia
SQDQRR

SEQ ID NO: 3138899 - protein, 18 aa, Giardia lamblia
SQDRLSQHDQLPERTAPS

SEQ ID NO: 3138900 - protein, 5 aa, Giardia lamblia
SQDTK

SEQ ID NO: 3138901 - protein, 11 aa, Giardia lamblia
SQDTPRSIPTV

SEQ ID NO: 3138902 - protein, 5 aa, Giardia lamblia
SQDYA

SEQ ID NO: 3138903 - protein, 4 aa, Giardia lamblia
SQEA

SEQ ID NO: 3138904 - protein, 5 aa, Giardia lamblia
SQEAL

SEQ ID NO: 3138905 - protein, 7 aa, Giardia lamblia
SQEALTP

SEQ ID NO: 3138906 - protein, 15 aa, Giardia lamblia
SQEARAKSSCLAKES

SEQ ID NO: 3138907 - protein, 6 aa, Giardia lamblia
SQEARK

SEQ ID NO: 3138908 - protein, 9 aa, Giardia lamblia
SQEDRTKRF

SEQ ID NO: 3138909 - protein, 4 aa, Giardia lamblia
SQEE

SEQ ID NO: 3138910 - protein, 13 aa, Giardia lamblia
SQEELASIKESSA

SEQ ID NO: 3138911 - protein, 4 aa, Giardia lamblia
SQEG

SEQ ID NO: 3138912 - protein, 6 aa, Giardia lamblia
SQEGSE

SEQ ID NO: 3138913 - protein, 8 aa, Giardia lamblia
SQEGTPSV

SEQ ID NO: 3138914 - protein, 8 aa, Giardia lamblia
SQEHEAEV

SEQ ID NO: 3138915 - protein, 21 aa, Giardia lamblia
SQEIETEEAVARAKSLSELEP

SEQ ID NO: 3138916 - protein, 8 aa, Giardia lamblia
SQEISDSA

SEQ ID NO: 3138917 - protein, 25 aa, Giardia lamblia
SQEKENKLPPLAVPSSTTPTPSITP

SEQ ID NO: 3138918 - protein, 16 aa, Giardia lamblia
SQEKEQVKEQSSANER

SEQ ID NO: 3138919 - protein, 10 aa, Giardia lamblia
SQEKSDSAKI

SEQ ID NO: 3138920 - protein, 7 aa, Giardia lamblia
SQENAAA

SEQ ID NO: 3138921 - protein, 7 aa, Giardia lamblia
SQENASA

SEQ ID NO: 3138922 - protein, 5 aa, Giardia lamblia
SQENK

SEQ ID NO: 3138923 - protein, 11 aa, Giardia lamblia
SQEQSNPYNTA

SEQ ID NO: 3138924 - protein, 18 aa, Giardia lamblia
SQERAAGAAVDDASRERI

SEQ ID NO: 3138925 - protein, 5 aa, Giardia lamblia
SQERK

SEQ ID NO: 3138926 - protein, 15 aa, Giardia lamblia
SQERQLKANDESISN

SEQ ID NO: 3138927 - protein, 10 aa, Giardia lamblia
SQERSIEDTT

SEQ ID NO: 3138928 - protein, 11 aa, Giardia lamblia
SQESIGQENPL

SEQ ID NO: 3138929 - protein, 8 aa, Giardia lamblia
SQESSTPV

SEQ ID NO: 3138930 - protein, 6 aa, Giardia lamblia
SQETKA

SEQ ID NO: 3138931 - protein, 16 aa, Giardia lamblia
SQETLASPLDSPQEQR

SEQ ID NO: 3138932 - protein, 4 aa, Giardia lamblia
SQEV

SEQ ID NO: 3138933 - protein, 5 aa, Giardia lamblia
SQEYS

SEQ ID NO: 3138934 - protein, 4 aa, Giardia lamblia
SQFE

SEQ ID NO: 3138935 - protein, 14 aa, Giardia lamblia
SQFSHKQNENSITD

SEQ ID NO: 3138936 - protein, 8 aa, Giardia lamblia
SQGENNDT

SEQ ID NO: 3138937 - protein, 7 aa, Giardia lamblia
SQGETMP

SEQ ID NO: 3138938 - protein, 12 aa, Giardia lamblia
SQGFGAKNASGM

SEQ ID NO: 3138939 - protein, 6 aa, Giardia lamblia
SQGGMS

SEQ ID NO: 3138940 - protein, 4 aa, Giardia lamblia
SQGH

SEQ ID NO: 3138941 - protein, 6 aa, Giardia lamblia
SQGHRP

SEQ ID NO: 3138942 - protein, 5 aa, Giardia lamblia
SQGIR

SEQ ID NO: 3138943 - protein, 8 aa, Giardia lamblia
SQGITDKG

SEQ ID NO: 3138944 - protein, 9 aa, Giardia lamblia
SQGKEDEVE

SEQ ID NO: 3138945 - protein, 28 aa, Giardia lamblia
SQGKGGAHQVSSTNSNSLSGSVGPAPGS

SEQ ID NO: 3138946 - protein, 7 aa, Giardia lamblia
SQGLSTR

SEQ ID NO: 3138947 - protein, 7 aa, Giardia lamblia
SQGMSRS

SEQ ID NO: 3138948 - protein, 4 aa, Giardia lamblia
SQGN

SEQ ID NO: 3138949 - protein, 6 aa, Giardia lamblia
SQGNTD

SEQ ID NO: 3138950 - protein, 6 aa, Giardia lamblia
SQGPIG

SEQ ID NO: 3138951 - protein, 16 aa, Giardia lamblia
SQGPQQDAASGGRPIN

SEQ ID NO: 3138952 - protein, 6 aa, Giardia lamblia
SQGPTR

SEQ ID NO: 3138953 - protein, 6 aa, Giardia lamblia
SQGRED

SEQ ID NO: 3138954 - protein, 8 aa, Giardia lamblia
SQGRGNGA

SEQ ID NO: 3138955 - protein, 6 aa, Giardia lamblia
SQGRLT

SEQ ID NO: 3138956 - protein, 15 aa, Giardia lamblia
SQGSFSASDDAELSI

SEQ ID NO: 3138957 - protein, 6 aa, Giardia lamblia
SQGSLL

SEQ ID NO: 3138958 - protein, 8 aa, Giardia lamblia
SQGSSDGL

SEQ ID NO: 3138959 - protein, 12 aa, Giardia lamblia
SQGYGKNASAIA

SEQ ID NO: 3138960 - protein, 8 aa, Giardia lamblia
SQHGPKTY

SEQ ID NO: 3138961 - protein, 9 aa, Giardia lamblia
SQHKADSPK

SEQ ID NO: 3138962 - protein, 6 aa, Giardia lamblia
SQHNRQ

SEQ ID NO: 3138963 - protein, 8 aa, Giardia lamblia
SQHPNSGR

SEQ ID NO: 3138964 - protein, 6 aa, Giardia lamblia
SQHQDT

SEQ ID NO: 3138965 - protein, 20 aa, Giardia lamblia
SQIESTPAPTLDAKSSSAVA

SEQ ID NO: 3138966 - protein, 13 aa, Giardia lamblia
SQIGAGAVSTDGS

SEQ ID NO: 3138967 - protein, 6 aa, Giardia lamblia
SQIGEL

SEQ ID NO: 3138968 - protein, 8 aa, Giardia lamblia
SQIGKPTQ

SEQ ID NO: 3138969 - protein, 10 aa, Giardia lamblia
SQIGQESRLQ

SEQ ID NO: 3138970 - protein, 11 aa, Giardia lamblia
SQIGSTGLKGA

SEQ ID NO: 3138971 - protein, 9 aa, Giardia lamblia
SQIKTSSQV

SEQ ID NO: 3138972 - protein, 25 aa, Giardia lamblia
SQINMTPSTSSSSHQTQDTFDQTDL

SEQ ID NO: 3138973 - protein, 14 aa, Giardia lamblia
SQIPDKGHAATNIQ

SEQ ID NO: 3138974 - protein, 37 aa, Giardia lamblia
SQIPEQTPTRKKATKDKGLTKALKADKKQKQKHAHDS

SEQ ID NO: 3138975 - protein, 4 aa, Giardia lamblia
SQIQ

SEQ ID NO: 3138976 - protein, 15 aa, Giardia lamblia
SQIREATLSKESATV

SEQ ID NO: 3138977 - protein, 6 aa, Giardia lamblia
SQISDK

SEQ ID NO: 3138978 - protein, 19 aa, Giardia lamblia
SQITDGPAPGRQRPKRHSG

SEQ ID NO: 3138979 - protein, 10 aa, Giardia lamblia
SQKDIDAQKT

SEQ ID NO: 3138980 - protein, 12 aa, Giardia lamblia
SQKDITSDTYGE

SEQ ID NO: 3138981 - protein, 12 aa, Giardia lamblia
SQKDSGDGLGPL

SEQ ID NO: 3138982 - protein, 11 aa, Giardia lamblia
SQKESTSRMTT

SEQ ID NO: 3138983 - protein, 11 aa, Giardia lamblia
SQKLATAQAAE

SEQ ID NO: 3138984 - protein, 17 aa, Giardia lamblia
SQKNDSGEDMCIWDLLD

SEQ ID NO: 3138985 - protein, 15 aa, Giardia lamblia
SQKPAKSDVVESGSA

SEQ ID NO: 3138986 - protein, 12 aa, Giardia lamblia
SQKQEPLPTSRV

SEQ ID NO: 3138987 - protein, 8 aa, Giardia lamblia
SQKRTYDA

SEQ ID NO: 3138988 - protein, 6 aa, Giardia lamblia
SQKSAK

SEQ ID NO: 3138989 - protein, 27 aa, Giardia lamblia
SQKSVSFSTKEGDATESSWEKKEGEQS

SEQ ID NO: 3138990 - protein, 36 aa, Giardia lamblia
SQKVQSDATQAHGSNHKQQSRMERTTTRGKSPIARP

SEQ ID NO: 3138991 - protein, 4 aa, Giardia lamblia
SQLE

SEQ ID NO: 3138992 - protein, 7 aa, Giardia lamblia
SQLEQSH

SEQ ID NO: 3138993 - protein, 8 aa, Giardia lamblia
SQLGGKQL

SEQ ID NO: 3138994 - protein, 8 aa, Giardia lamblia
SQLGSESL

SEQ ID NO: 3138995 - protein, 6 aa, Giardia lamblia
SQLKEQ

SEQ ID NO: 3138996 - protein, 5 aa, Giardia lamblia
SQLKQ

SEQ ID NO: 3138997 - protein, 14 aa, Giardia lamblia
SQLLGSKAPKIEAS

SEQ ID NO: 3138998 - protein, 6 aa, Giardia lamblia
SQLPKG

SEQ ID NO: 3138999 - protein, 28 aa, Giardia lamblia
SQLPTLPASQAQTTNSTSVQGNDSNPEN

SEQ ID NO: 3139000 - protein, 6 aa, Giardia lamblia
SQLQEQ

SEQ ID NO: 3139001 - protein, 8 aa, Giardia lamblia
SQLQPSLA

SEQ ID NO: 3139002 - protein, 6 aa, Giardia lamblia
SQLREE

SEQ ID NO: 3139003 - protein, 9 aa, Giardia lamblia
SQLRTGDSV

SEQ ID NO: 3139004 - protein, 13 aa, Giardia lamblia
SQLSKEKDDNKRC

SEQ ID NO: 3139005 - protein, 8 aa, Giardia lamblia
SQLSSKEE

SEQ ID NO: 3139006 - protein, 4 aa, Giardia lamblia
SQMP

SEQ ID NO: 3139007 - protein, 35 aa, Giardia lamblia
SQMTSASTYGTPDGRQTPSTRRSVTPSNNSSLSIS

SEQ ID NO: 3139008 - protein, 4 aa, Giardia lamblia
SQNC

SEQ ID NO: 3139009 - protein, 8 aa, Giardia lamblia
SQNEAKTT

SEQ ID NO: 3139010 - protein, 5 aa, Giardia lamblia
SQNEG

SEQ ID NO: 3139011 - protein, 17 aa, Giardia lamblia
SQNEGEITDEPSDSHQQ

SEQ ID NO: 3139012 - protein, 8 aa, Giardia lamblia
SQNKFTAG

SEQ ID NO: 3139013 - protein, 8 aa, Giardia lamblia
SQNKPPLY

SEQ ID NO: 3139014 - protein, 5 aa, Giardia lamblia
SQNLT

SEQ ID NO: 3139015 - protein, 8 aa, Giardia lamblia
SQNNEESV

SEQ ID NO: 3139016 - protein, 6 aa, Giardia lamblia
SQNNMS

SEQ ID NO: 3139017 - protein, 10 aa, Giardia lamblia
SQNNQNDGNL

SEQ ID NO: 3139018 - protein, 10 aa, Giardia lamblia
SQNPEKSKHL

SEQ ID NO: 3139019 - protein, 6 aa, Giardia lamblia
SQNPLF

SEQ ID NO: 3139020 - protein, 7 aa, Giardia lamblia
SQNQSPY

SEQ ID NO: 3139021 - protein, 6 aa, Giardia lamblia
SQNREL

SEQ ID NO: 3139022 - protein, 10 aa, Giardia lamblia
SQNSDFPAQG

SEQ ID NO: 3139023 - protein, 6 aa, Giardia lamblia
SQNSES

SEQ ID NO: 3139024 - protein, 16 aa, Giardia lamblia
SQNSHAGDADDEDNAA

SEQ ID NO: 3139025 - protein, 17 aa, Giardia lamblia
SQNSSGHDGSSKKSISA

SEQ ID NO: 3139026 - protein, 12 aa, Giardia lamblia
SQNTQTHDPTVV

SEQ ID NO: 3139027 - protein, 5 aa, Giardia lamblia
SQNVA

SEQ ID NO: 3139028 - protein, 6 aa, Giardia lamblia
SQNVTQ

SEQ ID NO: 3139029 - protein, 4 aa, Giardia lamblia
SQNY

SEQ ID NO: 3139030 - protein, 4 aa, Giardia lamblia
SQPA

SEQ ID NO: 3139031 - protein, 10 aa, Giardia lamblia
SQPAANNASL

SEQ ID NO: 3139032 - protein, 6 aa, Giardia lamblia
SQPEDR

SEQ ID NO: 3139033 - protein, 6 aa, Giardia lamblia
SQPESV

SEQ ID NO: 3139034 - protein, 4 aa, Giardia lamblia
SQPG

SEQ ID NO: 3139035 - protein, 17 aa, Giardia lamblia
SQPGGGFGLSRSSDDEA

SEQ ID NO: 3139036 - protein, 5 aa, Giardia lamblia
SQPKD

SEQ ID NO: 3139037 - protein, 8 aa, Giardia lamblia
SQPKPKDL

SEQ ID NO: 3139038 - protein, 12 aa, Giardia lamblia
SQPNTPNTTHEY

SEQ ID NO: 3139039 - protein, 7 aa, Giardia lamblia
SQPPAYR

SEQ ID NO: 3139040 - protein, 14 aa, Giardia lamblia
SQPPGGGRNEVTRR

SEQ ID NO: 3139041 - protein, 11 aa, Giardia lamblia
SQPPGTEFTES

SEQ ID NO: 3139042 - protein, 10 aa, Giardia lamblia
SQPQKATTLS

SEQ ID NO: 3139043 - protein, 8 aa, Giardia lamblia
SQPQNINS

SEQ ID NO: 3139044 - protein, 6 aa, Giardia lamblia
SQPSLG

SEQ ID NO: 3139045 - protein, 25 aa, Giardia lamblia
SQPSMKGDDSQGGVVDQAERKEETD

SEQ ID NO: 3139046 - protein, 33 aa, Giardia lamblia
SQPSQYSTRSMRSTTERDNTGQAKNRRHSSSRD

SEQ ID NO: 3139047 - protein, 6 aa, Giardia lamblia
SQPTGD

SEQ ID NO: 3139048 - protein, 7 aa, Giardia lamblia
SQPTGDV

SEQ ID NO: 3139049 - protein, 5 aa, Giardia lamblia
SQPTL

SEQ ID NO: 3139050 - protein, 4 aa, Giardia lamblia
SQPV

SEQ ID NO: 3139051 - protein, 14 aa, Giardia lamblia
SQPYQQLPPAPQHP

SEQ ID NO: 3139052 - protein, 7 aa, Giardia lamblia
SQQATKA

SEQ ID NO: 3139053 - protein, 25 aa, Giardia lamblia
SQQAYKHNESLSKKYAELKESHDSL

SEQ ID NO: 3139054 - protein, 11 aa, Giardia lamblia
SQQDRAGHGVS

SEQ ID NO: 3139055 - protein, 7 aa, Giardia lamblia
SQQELAD

SEQ ID NO: 3139056 - protein, 9 aa, Giardia lamblia
SQQERERNV

SEQ ID NO: 3139057 - protein, 8 aa, Giardia lamblia
SQQGCVNP

SEQ ID NO: 3139058 - protein, 19 aa, Giardia lamblia
SQQHEARKPISPEQTEKKV

SEQ ID NO: 3139059 - protein, 4 aa, Giardia lamblia
SQQI

SEQ ID NO: 3139060 - protein, 8 aa, Giardia lamblia
SQQIDTNG

SEQ ID NO: 3139061 - protein, 6 aa, Giardia lamblia
SQQKLG

SEQ ID NO: 3139062 - protein, 9 aa, Giardia lamblia
SQQKTISED

SEQ ID NO: 3139063 - protein, 4 aa, Giardia lamblia
SQQL

SEQ ID NO: 3139064 - protein, 31 aa, Giardia lamblia
SQQLKEAEKNDERTQASLSPRGRSAVASANA

SEQ ID NO: 3139065 - protein, 6 aa, Giardia lamblia
SQQLYQ

SEQ ID NO: 3139066 - protein, 5 aa, Giardia lamblia
SQQNN

SEQ ID NO: 3139067 - protein, 9 aa, Giardia lamblia
SQQPDFASS

SEQ ID NO: 3139068 - protein, 50 aa, Giardia lamblia
SQQQLQPPSQPTPAQPPREDYERPTLPSRGHVSTQKGDPPRRHYLDSQRL

SEQ ID NO: 3139069 - protein, 6 aa, Giardia lamblia
SQQQPF

SEQ ID NO: 3139070 - protein, 8 aa, Giardia lamblia
SQQRYTNE

SEQ ID NO: 3139071 - protein, 5 aa, Giardia lamblia
SQQSK

SEQ ID NO: 3139072 - protein, 25 aa, Giardia lamblia
SQQTRPRSAPTNSAPWTAKYSVYEL

SEQ ID NO: 3139073 - protein, 11 aa, Giardia lamblia
SQQVDRSRPGI

SEQ ID NO: 3139074 - protein, 61 aa, Giardia lamblia
SQRAVTPNKKSTQAGPVSKTTPRRPTSSRPQVSSARTPVAKTPSRDQHYSQTTHSKGATKM

SEQ ID NO: 3139075 - protein, 33 aa, Giardia lamblia
SQRDQARSSHQDHRTENRDHRGSPQRRDRHEYS

SEQ ID NO: 3139076 - protein, 4 aa, Giardia lamblia
SQRE

SEQ ID NO: 3139077 - protein, 7 aa, Giardia lamblia
SQRKDMG

SEQ ID NO: 3139078 - protein, 14 aa, Giardia lamblia
SQRKEVHSSANSAL

SEQ ID NO: 3139079 - protein, 5 aa, Giardia lamblia
SQRKN

SEQ ID NO: 3139080 - protein, 4 aa, Giardia lamblia
SQRL

SEQ ID NO: 3139081 - protein, 5 aa, Giardia lamblia
SQRNA

SEQ ID NO: 3139082 - protein, 8 aa, Giardia lamblia
SQRNPVTE

SEQ ID NO: 3139083 - protein, 7 aa, Giardia lamblia
SQRPAAT

SEQ ID NO: 3139084 - protein, 6 aa, Giardia lamblia
SQRPHK

SEQ ID NO: 3139085 - protein, 19 aa, Giardia lamblia
SQRPSRPHSHYTPRSSNTM

SEQ ID NO: 3139086 - protein, 4 aa, Giardia lamblia
SQRQ

SEQ ID NO: 3139087 - protein, 7 aa, Giardia lamblia
SQRQDTT

SEQ ID NO: 3139088 - protein, 22 aa, Giardia lamblia
SQRQSLDKESVTAKEQNKDTIY

SEQ ID NO: 3139089 - protein, 5 aa, Giardia lamblia
SQRRK

SEQ ID NO: 3139090 - protein, 13 aa, Giardia lamblia
SQRSGDDSDGIRR

SEQ ID NO: 3139091 - protein, 7 aa, Giardia lamblia
SQRSGRD

SEQ ID NO: 3139092 - protein, 27 aa, Giardia lamblia
SQRSISTSGRPSVGLPPPSTTYAGGYT

SEQ ID NO: 3139093 - protein, 9 aa, Giardia lamblia
SQRSNSSDQ

SEQ ID NO: 3139094 - protein, 9 aa, Giardia lamblia
SQRSPPPAL

SEQ ID NO: 3139095 - protein, 9 aa, Giardia lamblia
SQRSPQVST

SEQ ID NO: 3139096 - protein, 10 aa, Giardia lamblia
SQRSQSQTQY

SEQ ID NO: 3139097 - protein, 4 aa, Giardia lamblia
SQRT

SEQ ID NO: 3139098 - protein, 6 aa, Giardia lamblia
SQSALR

SEQ ID NO: 3139099 - protein, 6 aa, Giardia lamblia
SQSASD

SEQ ID NO: 3139100 - protein, 5 aa, Giardia lamblia
SQSAV

SEQ ID NO: 3139101 - protein, 5 aa, Giardia lamblia
SQSDD

SEQ ID NO: 3139102 - protein, 11 aa, Giardia lamblia
SQSDDGTLTNR

SEQ ID NO: 3139103 - protein, 24 aa, Giardia lamblia
SQSERRPRRQQHTSSSLPPRSLES

SEQ ID NO: 3139104 - protein, 4 aa, Giardia lamblia
SQSG

SEQ ID NO: 3139105 - protein, 7 aa, Giardia lamblia
SQSGADM

SEQ ID NO: 3139106 - protein, 12 aa, Giardia lamblia
SQSGAEPESGEV

SEQ ID NO: 3139107 - protein, 6 aa, Giardia lamblia
SQSGEV

SEQ ID NO: 3139108 - protein, 6 aa, Giardia lamblia
SQSGFS

SEQ ID NO: 3139109 - protein, 12 aa, Giardia lamblia
SQSGHREGAIRS

SEQ ID NO: 3139110 - protein, 6 aa, Giardia lamblia
SQSGLH

SEQ ID NO: 3139111 - protein, 15 aa, Giardia lamblia
SQSGQTTAAPPATDI

SEQ ID NO: 3139112 - protein, 17 aa, Giardia lamblia
SQSGRAVGARDSSTSNM

SEQ ID NO: 3139113 - protein, 12 aa, Giardia lamblia
SQSGVRGGATHT

SEQ ID NO: 3139114 - protein, 5 aa, Giardia lamblia
SQSID

SEQ ID NO: 3139115 - protein, 9 aa, Giardia lamblia
SQSKAGRQD

SEQ ID NO: 3139116 - protein, 8 aa, Giardia lamblia
SQSKRARL

SEQ ID NO: 3139117 - protein, 4 aa, Giardia lamblia
SQSL

SEQ ID NO: 3139118 - protein, 5 aa, Giardia lamblia
SQSLA

SEQ ID NO: 3139119 - protein, 6 aa, Giardia lamblia
SQSLDQ

SEQ ID NO: 3139120 - protein, 14 aa, Giardia lamblia
SQSLEDNKSGHSPY

SEQ ID NO: 3139121 - protein, 20 aa, Giardia lamblia
SQSLKQKSVDENARKDSSFA

SEQ ID NO: 3139122 - protein, 12 aa, Giardia lamblia
SQSMEGASGSDC

SEQ ID NO: 3139123 - protein, 9 aa, Giardia lamblia
SQSNLGSHM

SEQ ID NO: 3139124 - protein, 21 aa, Giardia lamblia
SQSNRVHSDADISTLSPEEMR

SEQ ID NO: 3139125 - protein, 20 aa, Giardia lamblia
SQSPKENKSSSNSPNNDTID

SEQ ID NO: 3139126 - protein, 8 aa, Giardia lamblia
SQSPKYGV

SEQ ID NO: 3139127 - protein, 7 aa, Giardia lamblia
SQSPVSV

SEQ ID NO: 3139128 - protein, 8 aa, Giardia lamblia
SQSQEKLS

SEQ ID NO: 3139129 - protein, 11 aa, Giardia lamblia
SQSQKTSQEIA

SEQ ID NO: 3139130 - protein, 13 aa, Giardia lamblia
SQSQLQEGGTSPF

SEQ ID NO: 3139131 - protein, 11 aa, Giardia lamblia
SQSQRDQQPSY

SEQ ID NO: 3139132 - protein, 7 aa, Giardia lamblia
SQSQRYE

SEQ ID NO: 3139133 - protein, 19 aa, Giardia lamblia
SQSQTGTLVPNQAAQNYAS

SEQ ID NO: 3139134 - protein, 21 aa, Giardia lamblia
SQSRTARPGPIATGGIASPAD

SEQ ID NO: 3139135 - protein, 4 aa, Giardia lamblia
SQSS

SEQ ID NO: 3139136 - protein, 9 aa, Giardia lamblia
SQSSEYKDS

SEQ ID NO: 3139137 - protein, 14 aa, Giardia lamblia
SQSSHTVSRLSGKS

SEQ ID NO: 3139138 - protein, 7 aa, Giardia lamblia
SQSSNAN

SEQ ID NO: 3139139 - protein, 9 aa, Giardia lamblia
SQSSPQKAQ

SEQ ID NO: 3139140 - protein, 9 aa, Giardia lamblia
SQSSRSSSF

SEQ ID NO: 3139141 - protein, 19 aa, Giardia lamblia
SQSSVDERTKGSQTKQRKL

SEQ ID NO: 3139142 - protein, 10 aa, Giardia lamblia
SQSTDGTRAS

SEQ ID NO: 3139143 - protein, 5 aa, Giardia lamblia
SQSTP

SEQ ID NO: 3139144 - protein, 15 aa, Giardia lamblia
SQSTQTPGRLRPSQP

SEQ ID NO: 3139145 - protein, 7 aa, Giardia lamblia
SQSTTVQ

SEQ ID NO: 3139146 - protein, 11 aa, Giardia lamblia
SQSVDGIKSDG

SEQ ID NO: 3139147 - protein, 9 aa, Giardia lamblia
SQTAAEIAT

SEQ ID NO: 3139148 - protein, 5 aa, Giardia lamblia
SQTCH

SEQ ID NO: 3139149 - protein, 6 aa, Giardia lamblia
SQTDAC

SEQ ID NO: 3139150 - protein, 13 aa, Giardia lamblia
SQTDNVPKPPSKG

SEQ ID NO: 3139151 - protein, 4 aa, Giardia lamblia
SQTG

SEQ ID NO: 3139152 - protein, 13 aa, Giardia lamblia
SQTGEVHAEDKTD

SEQ ID NO: 3139153 - protein, 15 aa, Giardia lamblia
SQTGNQEVIKCLRAY

SEQ ID NO: 3139154 - protein, 7 aa, Giardia lamblia
SQTGNQY

SEQ ID NO: 3139155 - protein, 14 aa, Giardia lamblia
SQTGREGLPPSQAS

SEQ ID NO: 3139156 - protein, 8 aa, Giardia lamblia
SQTGSGKT

SEQ ID NO: 3139157 - protein, 4 aa, Giardia lamblia
SQTI

SEQ ID NO: 3139158 - protein, 7 aa, Giardia lamblia
SQTIRDD

SEQ ID NO: 3139159 - protein, 6 aa, Giardia lamblia
SQTKSV

SEQ ID NO: 3139160 - protein, 24 aa, Giardia lamblia
SQTQLSTGAPTQTASKNGSSDAPA

SEQ ID NO: 3139161 - protein, 5 aa, Giardia lamblia
SQTSP

SEQ ID NO: 3139162 - protein, 6 aa, Giardia lamblia
SQTSRI

SEQ ID NO: 3139163 - protein, 17 aa, Giardia lamblia
SQTSSPGASQYTASEAS

SEQ ID NO: 3139164 - protein, 24 aa, Giardia lamblia
SQTSTCSKQPRTPLKAVLKKSKSK

SEQ ID NO: 3139165 - protein, 7 aa, Giardia lamblia
SQTTAKM

SEQ ID NO: 3139166 - protein, 8 aa, Giardia lamblia
SQTTPQRI

SEQ ID NO: 3139167 - protein, 8 aa, Giardia lamblia
SQTTTISD

SEQ ID NO: 3139168 - protein, 20 aa, Giardia lamblia
SQTYADSAAIKTTESLQKPN

SEQ ID NO: 3139169 - protein, 5 aa, Giardia lamblia
SQVDR

SEQ ID NO: 3139170 - protein, 10 aa, Giardia lamblia
SQVEESPLAR

SEQ ID NO: 3139171 - protein, 9 aa, Giardia lamblia
SQVGPTERK

SEQ ID NO: 3139172 - protein, 21 aa, Giardia lamblia
SQVGQYSAKLGDANRTHAGVT

SEQ ID NO: 3139173 - protein, 13 aa, Giardia lamblia
SQVKGKGARIPPD

SEQ ID NO: 3139174 - protein, 19 aa, Giardia lamblia
SQVPSSKQAKGVAAQSQAS

SEQ ID NO: 3139175 - protein, 13 aa, Giardia lamblia
SQVSRSAASLSDL

SEQ ID NO: 3139176 - protein, 6 aa, Giardia lamblia
SQVTDA

SEQ ID NO: 3139177 - protein, 11 aa, Giardia lamblia
SQVTSPNPQLQ

SEQ ID NO: 3139178 - protein, 5 aa, Giardia lamblia
SQYGS

SEQ ID NO: 3139179 - protein, 9 aa, Giardia lamblia
SQYSQKTSS

SEQ ID NO: 3139180 - protein, 9 aa, Giardia lamblia
SQYTAGAKN

SEQ ID NO: 3139181 - protein, 6 aa, Giardia lamblia
SQYTPA

SEQ ID NO: 3139182 - protein, 4 aa, Giardia lamblia
SRAA

SEQ ID NO: 3139183 - protein, 10 aa, Giardia lamblia
SRAATGASKV

SEQ ID NO: 3139184 - protein, 5 aa, Giardia lamblia
SRADE

SEQ ID NO: 3139185 - protein, 8 aa, Giardia lamblia
SRADEGAL

SEQ ID NO: 3139186 - protein, 9 aa, Giardia lamblia
SRADTTRQI

SEQ ID NO: 3139187 - protein, 9 aa, Giardia lamblia
SRAEADRVP

SEQ ID NO: 3139188 - protein, 6 aa, Giardia lamblia
SRAEKR

SEQ ID NO: 3139189 - protein, 8 aa, Giardia lamblia
SRAGPINR

SEQ ID NO: 3139190 - protein, 20 aa, Giardia lamblia
SRAGRPKSEDDDEDDEDDIN

SEQ ID NO: 3139191 - protein, 6 aa, Giardia lamblia
SRAGRT

SEQ ID NO: 3139192 - protein, 5 aa, Giardia lamblia
SRAGV

SEQ ID NO: 3139193 - protein, 17 aa, Giardia lamblia
SRAKDAISDDDKNMEQS

SEQ ID NO: 3139194 - protein, 10 aa, Giardia lamblia
SRAKDTISAL

SEQ ID NO: 3139195 - protein, 6 aa, Giardia lamblia
SRAKKE

SEQ ID NO: 3139196 - protein, 5 aa, Giardia lamblia
SRALE

SEQ ID NO: 3139197 - protein, 12 aa, Giardia lamblia
SRANLSAASTFA

SEQ ID NO: 3139198 - protein, 8 aa, Giardia lamblia
SRAPGTLK

SEQ ID NO: 3139199 - protein, 12 aa, Giardia lamblia
SRAPLKPPSSDC

SEQ ID NO: 3139200 - protein, 13 aa, Giardia lamblia
SRAPNTRPTIESV

SEQ ID NO: 3139201 - protein, 7 aa, Giardia lamblia
SRAPWDK

SEQ ID NO: 3139202 - protein, 23 aa, Giardia lamblia
SRAQETEGDSKTISSGFNKQDQE

SEQ ID NO: 3139203 - protein, 13 aa, Giardia lamblia
SRAQSRNVHHSTT

SEQ ID NO: 3139204 - protein, 4 aa, Giardia lamblia
SRAR

SEQ ID NO: 3139205 - protein, 14 aa, Giardia lamblia
SRARGGKDSSAPRY

SEQ ID NO: 3139206 - protein, 4 aa, Giardia lamblia
SRAS

SEQ ID NO: 3139207 - protein, 10 aa, Giardia lamblia
SRASEHKESN

SEQ ID NO: 3139208 - protein, 19 aa, Giardia lamblia
SRASKKAARIEARRNAEEQ

SEQ ID NO: 3139209 - protein, 10 aa, Giardia lamblia
SRASQEENLS

SEQ ID NO: 3139210 - protein, 9 aa, Giardia lamblia
SRASSRSRL

SEQ ID NO: 3139211 - protein, 25 aa, Giardia lamblia
SRASSTLDDSIDASLSSSVSVQEDL

SEQ ID NO: 3139212 - protein, 47 aa, Giardia lamblia
SRASTIGSSGAGTRQSGNMGRSMGPQRGSGAPTRAPPARSATGGQSK

SEQ ID NO: 3139213 - protein, 14 aa, Giardia lamblia
SRASYSKEKAIPSS

SEQ ID NO: 3139214 - protein, 29 aa, Giardia lamblia
SRATQSVKKPQEASAPSHHKQSVANAYKA

SEQ ID NO: 3139215 - protein, 9 aa, Giardia lamblia
SRATRAGTR

SEQ ID NO: 3139216 - protein, 6 aa, Giardia lamblia
SRATTD

SEQ ID NO: 3139217 - protein, 19 aa, Giardia lamblia
SRAVRPSIRTDGTTAEDQL

SEQ ID NO: 3139218 - protein, 6 aa, Giardia lamblia
SRAYTE

SEQ ID NO: 3139219 - protein, 4 aa, Giardia lamblia
SRDA

SEQ ID NO: 3139220 - protein, 7 aa, Giardia lamblia
SRDAGNT

SEQ ID NO: 3139221 - protein, 19 aa, Giardia lamblia
SRDAQKQCSGMDPNKNTDL

SEQ ID NO: 3139222 - protein, 7 aa, Giardia lamblia
SRDDAGK

SEQ ID NO: 3139223 - protein, 7 aa, Giardia lamblia
SRDDARL

SEQ ID NO: 3139224 - protein, 23 aa, Giardia lamblia
SRDEARPSLRESMGASGSHEPMT

SEQ ID NO: 3139225 - protein, 9 aa, Giardia lamblia
SRDEHSSEC

SEQ ID NO: 3139226 - protein, 5 aa, Giardia lamblia
SRDEM

SEQ ID NO: 3139227 - protein, 8 aa, Giardia lamblia
SRDENGET

SEQ ID NO: 3139228 - protein, 7 aa, Giardia lamblia
SRDFPSS

SEQ ID NO: 3139229 - protein, 6 aa, Giardia lamblia
SRDGTN

SEQ ID NO: 3139230 - protein, 9 aa, Giardia lamblia
SRDIASSSG

SEQ ID NO: 3139231 - protein, 7 aa, Giardia lamblia
SRDKELQ

SEQ ID NO: 3139232 - protein, 6 aa, Giardia lamblia
SRDLHD

SEQ ID NO: 3139233 - protein, 9 aa, Giardia lamblia
SRDNRSASG

SEQ ID NO: 3139234 - protein, 9 aa, Giardia lamblia
SRDPASPRR

SEQ ID NO: 3139235 - protein, 9 aa, Giardia lamblia
SRDPKADKK

SEQ ID NO: 3139236 - protein, 6 aa, Giardia lamblia
SRDPSF

SEQ ID NO: 3139237 - protein, 10 aa, Giardia lamblia
SRDPSSHPRT

SEQ ID NO: 3139238 - protein, 11 aa, Giardia lamblia
SRDPVGKNPRP

SEQ ID NO: 3139239 - protein, 16 aa, Giardia lamblia
SRDQAKELAENLRGEK

SEQ ID NO: 3139240 - protein, 8 aa, Giardia lamblia
SRDRKESR

SEQ ID NO: 3139241 - protein, 25 aa, Giardia lamblia
SRDSDAYSAERIPPATLATDSTPSK

SEQ ID NO: 3139242 - protein, 5 aa, Giardia lamblia
SRDSN

SEQ ID NO: 3139243 - protein, 17 aa, Giardia lamblia
SRDSNPQPAQSTQPAQA

SEQ ID NO: 3139244 - protein, 8 aa, Giardia lamblia
SRDSNQNS

SEQ ID NO: 3139245 - protein, 6 aa, Giardia lamblia
SRDSSL

SEQ ID NO: 3139246 - protein, 12 aa, Giardia lamblia
SRDVSKGTIGPT

SEQ ID NO: 3139247 - protein, 6 aa, Giardia lamblia
SREAKS

SEQ ID NO: 3139248 - protein, 15 aa, Giardia lamblia
SREAQNQKETIPPTP

SEQ ID NO: 3139249 - protein, 18 aa, Giardia lamblia
SREDAQNCANKYKNAKVN

SEQ ID NO: 3139250 - protein, 11 aa, Giardia lamblia
SREDPTARGSY

SEQ ID NO: 3139251 - protein, 21 aa, Giardia lamblia
SREDRKIRTPPKRFPRNSSQK

SEQ ID NO: 3139252 - protein, 6 aa, Giardia lamblia
SREDRQ

SEQ ID NO: 3139253 - protein, 5 aa, Giardia lamblia
SREDV

SEQ ID NO: 3139254 - protein, 7 aa, Giardia lamblia
SREEEAE

SEQ ID NO: 3139255 - protein, 9 aa, Giardia lamblia
SREEELRGA

SEQ ID NO: 3139256 - protein, 8 aa, Giardia lamblia
SREGAAAH

SEQ ID NO: 3139257 - protein, 11 aa, Giardia lamblia
SREGGLQDSMS

SEQ ID NO: 3139258 - protein, 11 aa, Giardia lamblia
SREHTSDPSRF

SEQ ID NO: 3139259 - protein, 8 aa, Giardia lamblia
SREIPKDN

SEQ ID NO: 3139260 - protein, 11 aa, Giardia lamblia
SREKDEDGNTS

SEQ ID NO: 3139261 - protein, 23 aa, Giardia lamblia
SREKRRNYPERDMTGRTDVPEGW

SEQ ID NO: 3139262 - protein, 9 aa, Giardia lamblia
SREPGSDVV

SEQ ID NO: 3139263 - protein, 4 aa, Giardia lamblia
SRER

SEQ ID NO: 3139264 - protein, 14 aa, Giardia lamblia
SRERPQSSHNNPSD

SEQ ID NO: 3139265 - protein, 6 aa, Giardia lamblia
SRESFD

SEQ ID NO: 3139266 - protein, 7 aa, Giardia lamblia
SRESNGQ

SEQ ID NO: 3139267 - protein, 5 aa, Giardia lamblia
SRETA

SEQ ID NO: 3139268 - protein, 7 aa, Giardia lamblia
SREVPRE

SEQ ID NO: 3139269 - protein, 4 aa, Giardia lamblia
SREY

SEQ ID NO: 3139270 - protein, 5 aa, Giardia lamblia
SRFAN

SEQ ID NO: 3139271 - protein, 5 aa, Giardia lamblia
SRFGQ

SEQ ID NO: 3139272 - protein, 7 aa, Giardia lamblia
SRFGTPD

SEQ ID NO: 3139273 - protein, 6 aa, Giardia lamblia
SRFPSG

SEQ ID NO: 3139274 - protein, 9 aa, Giardia lamblia
SRFSNPTDD

SEQ ID NO: 3139275 - protein, 6 aa, Giardia lamblia
SRFSPY

SEQ ID NO: 3139276 - protein, 7 aa, Giardia lamblia
SRFTTEA

SEQ ID NO: 3139277 - protein, 4 aa, Giardia lamblia
SRGA

SEQ ID NO: 3139278 - protein, 6 aa, Giardia lamblia
SRGAME

SEQ ID NO: 3139279 - protein, 26 aa, Giardia lamblia
SRGASRGVSATTPSRRYHDQADPRPI

SEQ ID NO: 3139280 - protein, 9 aa, Giardia lamblia
SRGDPNGHS

SEQ ID NO: 3139281 - protein, 10 aa, Giardia lamblia
SRGERGAAPA

SEQ ID NO: 3139282 - protein, 17 aa, Giardia lamblia
SRGESVRPLSPSVTQST

SEQ ID NO: 3139283 - protein, 6 aa, Giardia lamblia
SRGGVD

SEQ ID NO: 3139284 - protein, 10 aa, Giardia lamblia
SRGISRTSEL

SEQ ID NO: 3139285 - protein, 4 aa, Giardia lamblia
SRGL

SEQ ID NO: 3139286 - protein, 11 aa, Giardia lamblia
SRGLSSSDTEM

SEQ ID NO: 3139287 - protein, 5 aa, Giardia lamblia
SRGNM

SEQ ID NO: 3139288 - protein, 20 aa, Giardia lamblia
SRGNSRSTKGLQSSSGSSSF

SEQ ID NO: 3139289 - protein, 11 aa, Giardia lamblia
SRGRSQTSLGG

SEQ ID NO: 3139290 - protein, 8 aa, Giardia lamblia
SRGRSRLG

SEQ ID NO: 3139291 - protein, 9 aa, Giardia lamblia
SRGSCDPAP

SEQ ID NO: 3139292 - protein, 7 aa, Giardia lamblia
SRGSDEV

SEQ ID NO: 3139293 - protein, 14 aa, Giardia lamblia
SRGSKRRQSQQKNT

SEQ ID NO: 3139294 - protein, 8 aa, Giardia lamblia
SRGSQERY

SEQ ID NO: 3139295 - protein, 28 aa, Giardia lamblia
SRGSRSSSSHADTERSASPNKQRPQVAH

SEQ ID NO: 3139296 - protein, 19 aa, Giardia lamblia
SRGTEARPAASEKQRQTVQ

SEQ ID NO: 3139297 - protein, 7 aa, Giardia lamblia
SRGTGQT

SEQ ID NO: 3139298 - protein, 6 aa, Giardia lamblia
SRGTLT

SEQ ID NO: 3139299 - protein, 4 aa, Giardia lamblia
SRGV

SEQ ID NO: 3139300 - protein, 6 aa, Giardia lamblia
SRGVMT

SEQ ID NO: 3139301 - protein, 5 aa, Giardia lamblia
SRGYP

SEQ ID NO: 3139302 - protein, 7 aa, Giardia lamblia
SRHDGST

SEQ ID NO: 3139303 - protein, 4 aa, Giardia lamblia
SRHG

SEQ ID NO: 3139304 - protein, 21 aa, Giardia lamblia
SRHGPESTNINPGPGTYEQDV

SEQ ID NO: 3139305 - protein, 6 aa, Giardia lamblia
SRHKDQ

SEQ ID NO: 3139306 - protein, 21 aa, Giardia lamblia
SRHNPNEVNTNPGPGAYDHGN

SEQ ID NO: 3139307 - protein, 6 aa, Giardia lamblia
SRHPET

SEQ ID NO: 3139308 - protein, 7 aa, Giardia lamblia
SRHSDAL

SEQ ID NO: 3139309 - protein, 6 aa, Giardia lamblia
SRHSNR

SEQ ID NO: 3139310 - protein, 18 aa, Giardia lamblia
SRHSQQDHGASRSKADDM

SEQ ID NO: 3139311 - protein, 32 aa, Giardia lamblia
SRHSSRGHSRIESRSSEPGQDHEYDTTDGAKQ

SEQ ID NO: 3139312 - protein, 17 aa, Giardia lamblia
SRHTAAAQCRYDEDLWG

SEQ ID NO: 3139313 - protein, 7 aa, Giardia lamblia
SRIAQPT

SEQ ID NO: 3139314 - protein, 15 aa, Giardia lamblia
SRIGANRTGSIGGTR

SEQ ID NO: 3139315 - protein, 18 aa, Giardia lamblia
SRIGGASPFDKTAKNVSQ

SEQ ID NO: 3139316 - protein, 30 aa, Giardia lamblia
SRIGGHGDLSKEYSGKMGGKTTADLSDSNL

SEQ ID NO: 3139317 - protein, 8 aa, Giardia lamblia
SRIGNRRT

SEQ ID NO: 3139318 - protein, 7 aa, Giardia lamblia
SRIKKDE

SEQ ID NO: 3139319 - protein, 6 aa, Giardia lamblia
SRIKTG

SEQ ID NO: 3139320 - protein, 6 aa, Giardia lamblia
SRINGQ

SEQ ID NO: 3139321 - protein, 25 aa, Giardia lamblia
SRIPQPDFSPTGGYKSSNRESDSGA

SEQ ID NO: 3139322 - protein, 10 aa, Giardia lamblia
SRIQDRTGKT

SEQ ID NO: 3139323 - protein, 6 aa, Giardia lamblia
SRIQGR

SEQ ID NO: 3139324 - protein, 8 aa, Giardia lamblia
SRIQRAER

SEQ ID NO: 3139325 - protein, 7 aa, Giardia lamblia
SRIRDNG

SEQ ID NO: 3139326 - protein, 10 aa, Giardia lamblia
SRIRKQASRY

SEQ ID NO: 3139327 - protein, 5 aa, Giardia lamblia
SRITG

SEQ ID NO: 3139328 - protein, 5 aa, Giardia lamblia
SRITN

SEQ ID NO: 3139329 - protein, 8 aa, Giardia lamblia
SRITPEDE

SEQ ID NO: 3139330 - protein, 18 aa, Giardia lamblia
SRKCDSKTSPSELTSDPP

SEQ ID NO: 3139331 - protein, 9 aa, Giardia lamblia
SRKDANGDT

SEQ ID NO: 3139332 - protein, 6 aa, Giardia lamblia
SRKGEK

SEQ ID NO: 3139333 - protein, 5 aa, Giardia lamblia
SRKGI

SEQ ID NO: 3139334 - protein, 24 aa, Giardia lamblia
SRKKTLTYSTEERHKDEAKEDEAD

SEQ ID NO: 3139335 - protein, 5 aa, Giardia lamblia
SRKLT

SEQ ID NO: 3139336 - protein, 4 aa, Giardia lamblia
SRKN

SEQ ID NO: 3139337 - protein, 33 aa, Giardia lamblia
SRKNNTASSLYKATQDADRPNIKEELSKPASEK

SEQ ID NO: 3139338 - protein, 6 aa, Giardia lamblia
SRKRDE

SEQ ID NO: 3139339 - protein, 8 aa, Giardia lamblia
SRKSDGQV

SEQ ID NO: 3139340 - protein, 18 aa, Giardia lamblia
SRKSLKSLTDTSSLDDEQ

SEQ ID NO: 3139341 - protein, 7 aa, Giardia lamblia
SRLASRK

SEQ ID NO: 3139342 - protein, 9 aa, Giardia lamblia
SRLDNRETE

SEQ ID NO: 3139343 - protein, 4 aa, Giardia lamblia
SRLG

SEQ ID NO: 3139344 - protein, 5 aa, Giardia lamblia
SRLGD

SEQ ID NO: 3139345 - protein, 17 aa, Giardia lamblia
SRLGESMTRTRPSSSKM

SEQ ID NO: 3139346 - protein, 8 aa, Giardia lamblia
SRLPSGES

SEQ ID NO: 3139347 - protein, 6 aa, Giardia lamblia
SRLPTS

SEQ ID NO: 3139348 - protein, 13 aa, Giardia lamblia
SRLRRPKQPNPSE

SEQ ID NO: 3139349 - protein, 12 aa, Giardia lamblia
SRLSEKEQEEKR

SEQ ID NO: 3139350 - protein, 9 aa, Giardia lamblia
SRLSENATL

SEQ ID NO: 3139351 - protein, 5 aa, Giardia lamblia
SRLSH

SEQ ID NO: 3139352 - protein, 11 aa, Giardia lamblia
SRLSPSTLNNR

SEQ ID NO: 3139353 - protein, 8 aa, Giardia lamblia
SRMKDQQG

SEQ ID NO: 3139354 - protein, 9 aa, Giardia lamblia
SRMRSSNEY

SEQ ID NO: 3139355 - protein, 10 aa, Giardia lamblia
SRMSEANDRK

SEQ ID NO: 3139356 - protein, 10 aa, Giardia lamblia
SRMTSPEGQT

SEQ ID NO: 3139357 - protein, 8 aa, Giardia lamblia
SRMTTNKG

SEQ ID NO: 3139358 - protein, 5 aa, Giardia lamblia
SRMVN

SEQ ID NO: 3139359 - protein, 8 aa, Giardia lamblia
SRNADNKT

SEQ ID NO: 3139360 - protein, 6 aa, Giardia lamblia
SRNALS

SEQ ID NO: 3139361 - protein, 17 aa, Giardia lamblia
SRNATVPALTQRDNNPT

SEQ ID NO: 3139362 - protein, 6 aa, Giardia lamblia
SRNDNY

SEQ ID NO: 3139363 - protein, 6 aa, Giardia lamblia
SRNGTT

SEQ ID NO: 3139364 - protein, 6 aa, Giardia lamblia
SRNGTY

SEQ ID NO: 3139365 - protein, 11 aa, Giardia lamblia
SRNKEQKSRGY

SEQ ID NO: 3139366 - protein, 4 aa, Giardia lamblia
SRNL

SEQ ID NO: 3139367 - protein, 9 aa, Giardia lamblia
SRNPDSWRS

SEQ ID NO: 3139368 - protein, 8 aa, Giardia lamblia
SRNPPSPD

SEQ ID NO: 3139369 - protein, 10 aa, Giardia lamblia
SRNSDIRNKP

SEQ ID NO: 3139370 - protein, 8 aa, Giardia lamblia
SRNSKDDM

SEQ ID NO: 3139371 - protein, 8 aa, Giardia lamblia
SRNSYTSA

SEQ ID NO: 3139372 - protein, 10 aa, Giardia lamblia
SRNTDSEEEL

SEQ ID NO: 3139373 - protein, 4 aa, Giardia lamblia
SRNY

SEQ ID NO: 3139374 - protein, 11 aa, Giardia lamblia
SRNYDSSPENC

SEQ ID NO: 3139375 - protein, 6 aa, Giardia lamblia
SRPAFR

SEQ ID NO: 3139376 - protein, 11 aa, Giardia lamblia
SRPGDRQREAA

SEQ ID NO: 3139377 - protein, 17 aa, Giardia lamblia
SRPGSHSHSRSRTSPGV

SEQ ID NO: 3139378 - protein, 21 aa, Giardia lamblia
SRPGVAGIGPGVPGGVPYGVG

SEQ ID NO: 3139379 - protein, 4 aa, Giardia lamblia
SRPI

SEQ ID NO: 3139380 - protein, 18 aa, Giardia lamblia
SRPITDAPALPAKDAAKS

SEQ ID NO: 3139381 - protein, 14 aa, Giardia lamblia
SRPKKTVGRPAEVP

SEQ ID NO: 3139382 - protein, 11 aa, Giardia lamblia
SRPKVVTKGPG

SEQ ID NO: 3139383 - protein, 4 aa, Giardia lamblia
SRPL

SEQ ID NO: 3139384 - protein, 5 aa, Giardia lamblia
SRPLD

SEQ ID NO: 3139385 - protein, 8 aa, Giardia lamblia
SRPLDKDE

SEQ ID NO: 3139386 - protein, 14 aa, Giardia lamblia
SRPLPPTNQANPKQ

SEQ ID NO: 3139387 - protein, 6 aa, Giardia lamblia
SRPLRQ

SEQ ID NO: 3139388 - protein, 6 aa, Giardia lamblia
SRPNSA

SEQ ID NO: 3139389 - protein, 8 aa, Giardia lamblia
SRPPLSGR

SEQ ID NO: 3139390 - protein, 7 aa, Giardia lamblia
SRPQIEE

SEQ ID NO: 3139391 - protein, 5 aa, Giardia lamblia
SRPQV

SEQ ID NO: 3139392 - protein, 10 aa, Giardia lamblia
SRPRSATMAK

SEQ ID NO: 3139393 - protein, 8 aa, Giardia lamblia
SRPRTSES

SEQ ID NO: 3139394 - protein, 6 aa, Giardia lamblia
SRPRYD

SEQ ID NO: 3139395 - protein, 16 aa, Giardia lamblia
SRPSETVGIYTTFRIC

SEQ ID NO: 3139396 - protein, 16 aa, Giardia lamblia
SRPSFANSDDSQSAFT

SEQ ID NO: 3139397 - protein, 9 aa, Giardia lamblia
SRPSISSLS

SEQ ID NO: 3139398 - protein, 9 aa, Giardia lamblia
SRPSKVPAD

SEQ ID NO: 3139399 - protein, 17 aa, Giardia lamblia
SRPTPTNHSKEEPQDND

SEQ ID NO: 3139400 - protein, 9 aa, Giardia lamblia
SRPTTPQKE

SEQ ID NO: 3139401 - protein, 5 aa, Giardia lamblia
SRQAQ

SEQ ID NO: 3139402 - protein, 10 aa, Giardia lamblia
SRQAQPKTSI

SEQ ID NO: 3139403 - protein, 4 aa, Giardia lamblia
SRQD

SEQ ID NO: 3139404 - protein, 12 aa, Giardia lamblia
SRQDTNSRLPQE

SEQ ID NO: 3139405 - protein, 8 aa, Giardia lamblia
SRQEQDEL

SEQ ID NO: 3139406 - protein, 5 aa, Giardia lamblia
SRQGL

SEQ ID NO: 3139407 - protein, 14 aa, Giardia lamblia
SRQISEKDATAKDL

SEQ ID NO: 3139408 - protein, 8 aa, Giardia lamblia
SRQPGSEV

SEQ ID NO: 3139409 - protein, 6 aa, Giardia lamblia
SRQQEA

SEQ ID NO: 3139410 - protein, 9 aa, Giardia lamblia
SRQSKSRDE

SEQ ID NO: 3139411 - protein, 9 aa, Giardia lamblia
SRQSYDSAT

SEQ ID NO: 3139412 - protein, 8 aa, Giardia lamblia
SRQTKLNE

SEQ ID NO: 3139413 - protein, 8 aa, Giardia lamblia
SRQTKSSL

SEQ ID NO: 3139414 - protein, 8 aa, Giardia lamblia
SRQVEPRD

SEQ ID NO: 3139415 - protein, 10 aa, Giardia lamblia
SRQVSSEAMA

SEQ ID NO: 3139416 - protein, 9 aa, Giardia lamblia
SRRAPSRTV

SEQ ID NO: 3139417 - protein, 52 aa, Giardia lamblia
SRRASGSRSRSHSPSSVRVQSNGKKTSRPSSNRSRGSRASSTTKDAGREPSI

SEQ ID NO: 3139418 - protein, 8 aa, Giardia lamblia
SRRDDDKN

SEQ ID NO: 3139419 - protein, 8 aa, Giardia lamblia
SRRDEQGM

SEQ ID NO: 3139420 - protein, 12 aa, Giardia lamblia
SRRDPKRKSTTD

SEQ ID NO: 3139421 - protein, 4 aa, Giardia lamblia
SRRG

SEQ ID NO: 3139422 - protein, 6 aa, Giardia lamblia
SRRGRE

SEQ ID NO: 3139423 - protein, 6 aa, Giardia lamblia
SRRGSF

SEQ ID NO: 3139424 - protein, 6 aa, Giardia lamblia
SRRHPD

SEQ ID NO: 3139425 - protein, 6 aa, Giardia lamblia
SRRHVP

SEQ ID NO: 3139426 - protein, 19 aa, Giardia lamblia
SRRIDTAKSRRGAGDNYDE

SEQ ID NO: 3139427 - protein, 11 aa, Giardia lamblia
SRRKRAPDSLF

SEQ ID NO: 3139428 - protein, 6 aa, Giardia lamblia
SRRNTL

SEQ ID NO: 3139429 - protein, 7 aa, Giardia lamblia
SRRPAPE

SEQ ID NO: 3139430 - protein, 11 aa, Giardia lamblia
SRRPGATSNHP

SEQ ID NO: 3139431 - protein, 27 aa, Giardia lamblia
SRRPYRPRAQRKKADKPKAPEANTPVE

SEQ ID NO: 3139432 - protein, 4 aa, Giardia lamblia
SRRQ

SEQ ID NO: 3139433 - protein, 17 aa, Giardia lamblia
SRRQPKEARDKNLDDPP

SEQ ID NO: 3139434 - protein, 65 aa, Giardia lamblia
SRRRAYDTTSQYDSSDTYEYSEYTDQEFSPRPQRALTRNTEECQSKYKEKLTSSKGVIPAGGYST

SEQ ID NO: 3139435 - protein, 11 aa, Giardia lamblia
SRRRSNPDLSE

SEQ ID NO: 3139436 - protein, 7 aa, Giardia lamblia
SRRRSPS

SEQ ID NO: 3139437 - protein, 16 aa, Giardia lamblia
SRRSGDGSGNEDSALN

SEQ ID NO: 3139438 - protein, 10 aa, Giardia lamblia
SRRSSSVGSS

SEQ ID NO: 3139439 - protein, 5 aa, Giardia lamblia
SRRTE

SEQ ID NO: 3139440 - protein, 10 aa, Giardia lamblia
SRRTGRQTGV

SEQ ID NO: 3139441 - protein, 6 aa, Giardia lamblia
SRRTKS

SEQ ID NO: 3139442 - protein, 5 aa, Giardia lamblia
SRRTR

SEQ ID NO: 3139443 - protein, 25 aa, Giardia lamblia
SRRTRPLSASAVTSRPRTNTRGRMD

SEQ ID NO: 3139444 - protein, 5 aa, Giardia lamblia
SRRTV

SEQ ID NO: 3139445 - protein, 22 aa, Giardia lamblia
SRSAIEAEQKLREEDRERRHQE

SEQ ID NO: 3139446 - protein, 21 aa, Giardia lamblia
SRSAPVGQATANSVAGEENSH

SEQ ID NO: 3139447 - protein, 9 aa, Giardia lamblia
SRSASTTYS

SEQ ID NO: 3139448 - protein, 9 aa, Giardia lamblia
SRSDRPEPF

SEQ ID NO: 3139449 - protein, 8 aa, Giardia lamblia
SRSDTQKP

SEQ ID NO: 3139450 - protein, 8 aa, Giardia lamblia
SRSEGGLA

SEQ ID NO: 3139451 - protein, 6 aa, Giardia lamblia
SRSEPT

SEQ ID NO: 3139452 - protein, 13 aa, Giardia lamblia
SRSESKRNAPSKP

SEQ ID NO: 3139453 - protein, 5 aa, Giardia lamblia
SRSFQ

SEQ ID NO: 3139454 - protein, 7 aa, Giardia lamblia
SRSGETA

SEQ ID NO: 3139455 - protein, 14 aa, Giardia lamblia
SRSGVTNLRSSGLT

SEQ ID NO: 3139456 - protein, 7 aa, Giardia lamblia
SRSKQKK

SEQ ID NO: 3139457 - protein, 25 aa, Giardia lamblia
SRSKSNFTSNAARGQISQSEPVTSS

SEQ ID NO: 3139458 - protein, 10 aa, Giardia lamblia
SRSKSQARRL

SEQ ID NO: 3139459 - protein, 24 aa, Giardia lamblia
SRSNEADEKANTGPPKTLQSNRSS

SEQ ID NO: 3139460 - protein, 8 aa, Giardia lamblia
SRSNPEDW

SEQ ID NO: 3139461 - protein, 6 aa, Giardia lamblia
SRSNQV

SEQ ID NO: 3139462 - protein, 14 aa, Giardia lamblia
SRSNSALPPTERTR

SEQ ID NO: 3139463 - protein, 10 aa, Giardia lamblia
SRSNSHDSDR

SEQ ID NO: 3139464 - protein, 4 aa, Giardia lamblia
SRSP

SEQ ID NO: 3139465 - protein, 7 aa, Giardia lamblia
SRSPEPI

SEQ ID NO: 3139466 - protein, 5 aa, Giardia lamblia
SRSPF

SEQ ID NO: 3139467 - protein, 5 aa, Giardia lamblia
SRSPI

SEQ ID NO: 3139468 - protein, 7 aa, Giardia lamblia
SRSPSIF

SEQ ID NO: 3139469 - protein, 4 aa, Giardia lamblia
SRSQ

SEQ ID NO: 3139470 - protein, 5 aa, Giardia lamblia
SRSQD

SEQ ID NO: 3139471 - protein, 25 aa, Giardia lamblia
SRSQTSSRRSSRAPSEERSRTHKRS

SEQ ID NO: 3139472 - protein, 10 aa, Giardia lamblia
SRSRAGSRAL

SEQ ID NO: 3139473 - protein, 14 aa, Giardia lamblia
SRSREQRASKSKEI

SEQ ID NO: 3139474 - protein, 6 aa, Giardia lamblia
SRSRGL

SEQ ID NO: 3139475 - protein, 4 aa, Giardia lamblia
SRSS

SEQ ID NO: 3139476 - protein, 7 aa, Giardia lamblia
SRSSEAA

SEQ ID NO: 3139477 - protein, 5 aa, Giardia lamblia
SRSSG

SEQ ID NO: 3139478 - protein, 5 aa, Giardia lamblia
SRSSI

SEQ ID NO: 3139479 - protein, 11 aa, Giardia lamblia
SRSSLDRSGRL

SEQ ID NO: 3139480 - protein, 16 aa, Giardia lamblia
SRSSRCTQSKSRIHKP

SEQ ID NO: 3139481 - protein, 45 aa, Giardia lamblia
SRSSSPKISVTSTNTNVATPRKSPGDSSSVRSAGSKRTPLRQERS

SEQ ID NO: 3139482 - protein, 43 aa, Giardia lamblia
SRSSSPPGRSNTTARTHGKPHKQKKKRRATSGTKLRASPSLPG

SEQ ID NO: 3139483 - protein, 11 aa, Giardia lamblia
SRSSTQNHSSL

SEQ ID NO: 3139484 - protein, 4 aa, Giardia lamblia
SRST

SEQ ID NO: 3139485 - protein, 17 aa, Giardia lamblia
SRSTEDKAKDPLPQSAP

SEQ ID NO: 3139486 - protein, 8 aa, Giardia lamblia
SRSTQGQF

SEQ ID NO: 3139487 - protein, 4 aa, Giardia lamblia
SRTA

SEQ ID NO: 3139488 - protein, 9 aa, Giardia lamblia
SRTEDGDTG

SEQ ID NO: 3139489 - protein, 4 aa, Giardia lamblia
SRTG

SEQ ID NO: 3139490 - protein, 7 aa, Giardia lamblia
SRTHPSE

SEQ ID NO: 3139491 - protein, 27 aa, Giardia lamblia
SRTIEDADGITATLSTNPGTVISSGND

SEQ ID NO: 3139492 - protein, 38 aa, Giardia lamblia
SRTIKSRASSRRGSVASVDHSDAELSTSDPGEGDAVTK

SEQ ID NO: 3139493 - protein, 12 aa, Giardia lamblia
SRTISGRTQGSG

SEQ ID NO: 3139494 - protein, 24 aa, Giardia lamblia
SRTKRCPDEQPGAVQANRSSIDQR

SEQ ID NO: 3139495 - protein, 5 aa, Giardia lamblia
SRTLD

SEQ ID NO: 3139496 - protein, 25 aa, Giardia lamblia
SRTLSRSKSGSRNPRARSNALPQED

SEQ ID NO: 3139497 - protein, 4 aa, Giardia lamblia
SRTN

SEQ ID NO: 3139498 - protein, 7 aa, Giardia lamblia
SRTPADY

SEQ ID NO: 3139499 - protein, 7 aa, Giardia lamblia
SRTPARE

SEQ ID NO: 3139500 - protein, 6 aa, Giardia lamblia
SRTPLS

SEQ ID NO: 3139501 - protein, 6 aa, Giardia lamblia
SRTPQF

SEQ ID NO: 3139502 - protein, 13 aa, Giardia lamblia
SRTPTSAGSGSLR

SEQ ID NO: 3139503 - protein, 7 aa, Giardia lamblia
SRTREGF

SEQ ID NO: 3139504 - protein, 12 aa, Giardia lamblia
SRTRIDTSTAEM

SEQ ID NO: 3139505 - protein, 6 aa, Giardia lamblia
SRTRNE

SEQ ID NO: 3139506 - protein, 6 aa, Giardia lamblia
SRTRSA

SEQ ID NO: 3139507 - protein, 5 aa, Giardia lamblia
SRTRY

SEQ ID NO: 3139508 - protein, 9 aa, Giardia lamblia
SRTSAAPVK

SEQ ID NO: 3139509 - protein, 8 aa, Giardia lamblia
SRTSPASV

SEQ ID NO: 3139510 - protein, 19 aa, Giardia lamblia
SRTSQSSIQSTPGPSDYHG

SEQ ID NO: 3139511 - protein, 9 aa, Giardia lamblia
SRTSQYKNL

SEQ ID NO: 3139512 - protein, 14 aa, Giardia lamblia
SRTSRKENVDGDAR

SEQ ID NO: 3139513 - protein, 15 aa, Giardia lamblia
SRTSVSTRSQNSIDH

SEQ ID NO: 3139514 - protein, 6 aa, Giardia lamblia
SRTTED

SEQ ID NO: 3139515 - protein, 5 aa, Giardia lamblia
SRTTG

SEQ ID NO: 3139516 - protein, 5 aa, Giardia lamblia
SRTVK

SEQ ID NO: 3139517 - protein, 5 aa, Giardia lamblia
SRTVP

SEQ ID NO: 3139518 - protein, 11 aa, Giardia lamblia
SRVAAEGDAEA

SEQ ID NO: 3139519 - protein, 10 aa, Giardia lamblia
SRVDETAPTM

SEQ ID NO: 3139520 - protein, 10 aa, Giardia lamblia
SRVEDAPTAV

SEQ ID NO: 3139521 - protein, 12 aa, Giardia lamblia
SRVESTDISQRY

SEQ ID NO: 3139522 - protein, 8 aa, Giardia lamblia
SRVKNARG

SEQ ID NO: 3139523 - protein, 14 aa, Giardia lamblia
SRVQPSSKTGKNIA

SEQ ID NO: 3139524 - protein, 8 aa, Giardia lamblia
SRVSEDID

SEQ ID NO: 3139525 - protein, 6 aa, Giardia lamblia
SRVSRE

SEQ ID NO: 3139526 - protein, 15 aa, Giardia lamblia
SRYEKQYGERSPRTA

SEQ ID NO: 3139527 - protein, 9 aa, Giardia lamblia
SRYPADQRD

SEQ ID NO: 3139528 - protein, 7 aa, Giardia lamblia
SRYPSLP

SEQ ID NO: 3139529 - protein, 7 aa, Giardia lamblia
SRYRNQF

SEQ ID NO: 3139530 - protein, 13 aa, Giardia lamblia
SRYRTGGSVSGWP

SEQ ID NO: 3139531 - protein, 9 aa, Giardia lamblia
SRYSAESVK

SEQ ID NO: 3139532 - protein, 6 aa, Giardia lamblia
SRYSDT

SEQ ID NO: 3139533 - protein, 6 aa, Giardia lamblia
SRYTES

SEQ ID NO: 3139534 - protein, 12 aa, Giardia lamblia
SRYTQDAEGAGR

SEQ ID NO: 3139535 - protein, 6 aa, Giardia lamblia
SSAAGE

SEQ ID NO: 3139536 - protein, 7 aa, Giardia lamblia
SSAAIKR

SEQ ID NO: 3139537 - protein, 8 aa, Giardia lamblia
SSAANIAA

SEQ ID NO: 3139538 - protein, 44 aa, Giardia lamblia
SSAANVRDSCSDAKEPATPEPKDPVDLPATSLPESIAPSVDLAT

SEQ ID NO: 3139539 - protein, 9 aa, Giardia lamblia
SSAARNRGY

SEQ ID NO: 3139540 - protein, 18 aa, Giardia lamblia
SSAATPRKPKSTCRQSKQ

SEQ ID NO: 3139541 - protein, 8 aa, Giardia lamblia
SSAATQSR

SEQ ID NO: 3139542 - protein, 12 aa, Giardia lamblia
SSADADISSAPP

SEQ ID NO: 3139543 - protein, 13 aa, Giardia lamblia
SSADDSDHCSQEH

SEQ ID NO: 3139544 - protein, 7 aa, Giardia lamblia
SSADEGL

SEQ ID NO: 3139545 - protein, 8 aa, Giardia lamblia
SSADEHPE

SEQ ID NO: 3139546 - protein, 13 aa, Giardia lamblia
SSADLDPNNGNVS

SEQ ID NO: 3139547 - protein, 7 aa, Giardia lamblia
SSADMPY

SEQ ID NO: 3139548 - protein, 14 aa, Giardia lamblia
SSADNLPPGTNPLD

SEQ ID NO: 3139549 - protein, 4 aa, Giardia lamblia
SSAE

SEQ ID NO: 3139550 - protein, 9 aa, Giardia lamblia
SSAEAEDFS

SEQ ID NO: 3139551 - protein, 6 aa, Giardia lamblia
SSAEAF

SEQ ID NO: 3139552 - protein, 9 aa, Giardia lamblia
SSAEKRLSE

SEQ ID NO: 3139553 - protein, 5 aa, Giardia lamblia
SSAEL

SEQ ID NO: 3139554 - protein, 7 aa, Giardia lamblia
SSAERTG

SEQ ID NO: 3139555 - protein, 8 aa, Giardia lamblia
SSAGQTTI

SEQ ID NO: 3139556 - protein, 8 aa, Giardia lamblia
SSAGRRLS

SEQ ID NO: 3139557 - protein, 9 aa, Giardia lamblia
SSAIDSGDI

SEQ ID NO: 3139558 - protein, 9 aa, Giardia lamblia
SSAKSAAAK

SEQ ID NO: 3139559 - protein, 9 aa, Giardia lamblia
SSAKTQADI

SEQ ID NO: 3139560 - protein, 4 aa, Giardia lamblia
SSAL

SEQ ID NO: 3139561 - protein, 13 aa, Giardia lamblia
SSALGNDPNNKTY

SEQ ID NO: 3139562 - protein, 7 aa, Giardia lamblia
SSALKGN

SEQ ID NO: 3139563 - protein, 8 aa, Giardia lamblia
SSALPVPG

SEQ ID NO: 3139564 - protein, 10 aa, Giardia lamblia
SSALRQSDRV

SEQ ID NO: 3139565 - protein, 11 aa, Giardia lamblia
SSALTETYSRD

SEQ ID NO: 3139566 - protein, 24 aa, Giardia lamblia
SSANASSVATQQRDGSQATDRELR

SEQ ID NO: 3139567 - protein, 6 aa, Giardia lamblia
SSANGG

SEQ ID NO: 3139568 - protein, 6 aa, Giardia lamblia
SSANIT

SEQ ID NO: 3139569 - protein, 13 aa, Giardia lamblia
SSANSPLTTCSPA

SEQ ID NO: 3139570 - protein, 10 aa, Giardia lamblia
SSANTSRRPS

SEQ ID NO: 3139571 - protein, 10 aa, Giardia lamblia
SSAPAGASTL

SEQ ID NO: 3139572 - protein, 8 aa, Giardia lamblia
SSAPGLTS

SEQ ID NO: 3139573 - protein, 32 aa, Giardia lamblia
SSAPNTSDPLDGSLGEVPEDISDQTDGRPIDK

SEQ ID NO: 3139574 - protein, 5 aa, Giardia lamblia
SSAPS

SEQ ID NO: 3139575 - protein, 22 aa, Giardia lamblia
SSAPSLSSQLSHPSNSNTTAIP

SEQ ID NO: 3139576 - protein, 14 aa, Giardia lamblia
SSAPSTAKKGNSHL

SEQ ID NO: 3139577 - protein, 8 aa, Giardia lamblia
SSAPTLPL

SEQ ID NO: 3139578 - protein, 7 aa, Giardia lamblia
SSAQAPL

SEQ ID NO: 3139579 - protein, 15 aa, Giardia lamblia
SSARPGTANRGRVPP

SEQ ID NO: 3139580 - protein, 9 aa, Giardia lamblia
SSARPKAEQ

SEQ ID NO: 3139581 - protein, 24 aa, Giardia lamblia
SSARSHIGSGIDPQDLNTNTISSP

SEQ ID NO: 3139582 - protein, 8 aa, Giardia lamblia
SSASDKEY

SEQ ID NO: 3139583 - protein, 7 aa, Giardia lamblia
SSASGLT

SEQ ID NO: 3139584 - protein, 7 aa, Giardia lamblia
SSASHNS

SEQ ID NO: 3139585 - protein, 6 aa, Giardia lamblia
SSASLD

SEQ ID NO: 3139586 - protein, 21 aa, Giardia lamblia
SSASSALIRGSKGSLVDDSEA

SEQ ID NO: 3139587 - protein, 16 aa, Giardia lamblia
SSASSGLQSARSERPY

SEQ ID NO: 3139588 - protein, 8 aa, Giardia lamblia
SSASTAAT

SEQ ID NO: 3139589 - protein, 8 aa, Giardia lamblia
SSASTLDK

SEQ ID NO: 3139590 - protein, 10 aa, Giardia lamblia
SSASVGTPSM

SEQ ID NO: 3139591 - protein, 5 aa, Giardia lamblia
SSATD

SEQ ID NO: 3139592 - protein, 13 aa, Giardia lamblia
SSATGAESGGSQL

SEQ ID NO: 3139593 - protein, 6 aa, Giardia lamblia
SSATLT

SEQ ID NO: 3139594 - protein, 26 aa, Giardia lamblia
SSATMTPSRAGSTSRARIPTSTSTVE

SEQ ID NO: 3139595 - protein, 8 aa, Giardia lamblia
SSATQTEH

SEQ ID NO: 3139596 - protein, 7 aa, Giardia lamblia
SSATSSS

SEQ ID NO: 3139597 - protein, 9 aa, Giardia lamblia
SSATTAMTS

SEQ ID NO: 3139598 - protein, 8 aa, Giardia lamblia
SSATVAGR

SEQ ID NO: 3139599 - protein, 5 aa, Giardia lamblia
SSAYA

SEQ ID NO: 3139600 - protein, 34 aa, Giardia lamblia
SSAYQDQGRNKSVPHTKNSSPRSPVTTSPTHPYP

SEQ ID NO: 3139601 - protein, 19 aa, Giardia lamblia
SSAYSQAYKPVNPAFDTGT

SEQ ID NO: 3139602 - protein, 5 aa, Giardia lamblia
SSCED

SEQ ID NO: 3139603 - protein, 10 aa, Giardia lamblia
SSCSGDPGPL

SEQ ID NO: 3139604 - protein, 4 aa, Giardia lamblia
SSCT

SEQ ID NO: 3139605 - protein, 8 aa, Giardia lamblia
SSDADKDD

SEQ ID NO: 3139606 - protein, 18 aa, Giardia lamblia
SSDAEKKLREVGGVPLLV

SEQ ID NO: 3139607 - protein, 12 aa, Giardia lamblia
SSDANSNSTETS

SEQ ID NO: 3139608 - protein, 7 aa, Giardia lamblia
SSDASQR

SEQ ID NO: 3139609 - protein, 20 aa, Giardia lamblia
SSDDEDYEGPEAAPKEGDLT

SEQ ID NO: 3139610 - protein, 6 aa, Giardia lamblia
SSDDGR

SEQ ID NO: 3139611 - protein, 13 aa, Giardia lamblia
SSDEEGQHSDVPQ

SEQ ID NO: 3139612 - protein, 12 aa, Giardia lamblia
SSDEMNKELGSR

SEQ ID NO: 3139613 - protein, 15 aa, Giardia lamblia
SSDFPDATRVQSPGM

SEQ ID NO: 3139614 - protein, 4 aa, Giardia lamblia
SSDG

SEQ ID NO: 3139615 - protein, 8 aa, Giardia lamblia
SSDGPQTA

SEQ ID NO: 3139616 - protein, 35 aa, Giardia lamblia
SSDGYNVRRPEEVTRPGERPQRRYDDARDERDPPG

SEQ ID NO: 3139617 - protein, 16 aa, Giardia lamblia
SSDINSDATSTSSEDY

SEQ ID NO: 3139618 - protein, 5 aa, Giardia lamblia
SSDKL

SEQ ID NO: 3139619 - protein, 11 aa, Giardia lamblia
SSDKPQGALRG

SEQ ID NO: 3139620 - protein, 5 aa, Giardia lamblia
SSDKS

SEQ ID NO: 3139621 - protein, 8 aa, Giardia lamblia
SSDLGTDG

SEQ ID NO: 3139622 - protein, 16 aa, Giardia lamblia
SSDLPAVPAGVPQGDP

SEQ ID NO: 3139623 - protein, 12 aa, Giardia lamblia
SSDMADKEQEIQ

SEQ ID NO: 3139624 - protein, 11 aa, Giardia lamblia
SSDNATSSKRI

SEQ ID NO: 3139625 - protein, 7 aa, Giardia lamblia
SSDNKDI

SEQ ID NO: 3139626 - protein, 5 aa, Giardia lamblia
SSDPA

SEQ ID NO: 3139627 - protein, 8 aa, Giardia lamblia
SSDPAQVQ

SEQ ID NO: 3139628 - protein, 7 aa, Giardia lamblia
SSDPMST

SEQ ID NO: 3139629 - protein, 14 aa, Giardia lamblia
SSDPSRRPKAAELS

SEQ ID NO: 3139630 - protein, 8 aa, Giardia lamblia
SSDPTTCH

SEQ ID NO: 3139631 - protein, 8 aa, Giardia lamblia
SSDQEMST

SEQ ID NO: 3139632 - protein, 7 aa, Giardia lamblia
SSDQSAH

SEQ ID NO: 3139633 - protein, 4 aa, Giardia lamblia
SSDS

SEQ ID NO: 3139634 - protein, 8 aa, Giardia lamblia
SSDSGALT

SEQ ID NO: 3139635 - protein, 5 aa, Giardia lamblia
SSDSM

SEQ ID NO: 3139636 - protein, 7 aa, Giardia lamblia
SSDSSTA

SEQ ID NO: 3139637 - protein, 4 aa, Giardia lamblia
SSDT

SEQ ID NO: 3139638 - protein, 8 aa, Giardia lamblia
SSDTQTQL

SEQ ID NO: 3139639 - protein, 8 aa, Giardia lamblia
SSDYPTDN

SEQ ID NO: 3139640 - protein, 4 aa, Giardia lamblia
SSEA

SEQ ID NO: 3139641 - protein, 9 aa, Giardia lamblia
SSEAAFSKR

SEQ ID NO: 3139642 - protein, 10 aa, Giardia lamblia
SSEADSIGHC

SEQ ID NO: 3139643 - protein, 9 aa, Giardia lamblia
SSEAEAADQ

SEQ ID NO: 3139644 - protein, 5 aa, Giardia lamblia
SSEAP

SEQ ID NO: 3139645 - protein, 7 aa, Giardia lamblia
SSEATDL

SEQ ID NO: 3139646 - protein, 7 aa, Giardia lamblia
SSEATQD

SEQ ID NO: 3139647 - protein, 4 aa, Giardia lamblia
SSEC

SEQ ID NO: 3139648 - protein, 7 aa, Giardia lamblia
SSECTAL

SEQ ID NO: 3139649 - protein, 5 aa, Giardia lamblia
SSEDH

SEQ ID NO: 3139650 - protein, 9 aa, Giardia lamblia
SSEDYQEDN

SEQ ID NO: 3139651 - protein, 4 aa, Giardia lamblia
SSEE

SEQ ID NO: 3139652 - protein, 8 aa, Giardia lamblia
SSEEAKDV

SEQ ID NO: 3139653 - protein, 6 aa, Giardia lamblia
SSEEFR

SEQ ID NO: 3139654 - protein, 8 aa, Giardia lamblia
SSEEGIQD

SEQ ID NO: 3139655 - protein, 8 aa, Giardia lamblia
SSEESGAV

SEQ ID NO: 3139656 - protein, 9 aa, Giardia lamblia
SSEETRKKE

SEQ ID NO: 3139657 - protein, 4 aa, Giardia lamblia
SSEG

SEQ ID NO: 3139658 - protein, 6 aa, Giardia lamblia
SSEGEH

SEQ ID NO: 3139659 - protein, 9 aa, Giardia lamblia
SSEGNRRTE

SEQ ID NO: 3139660 - protein, 5 aa, Giardia lamblia
SSEGT

SEQ ID NO: 3139661 - protein, 8 aa, Giardia lamblia
SSEGYLTK

SEQ ID NO: 3139662 - protein, 7 aa, Giardia lamblia
SSEIDKS

SEQ ID NO: 3139663 - protein, 10 aa, Giardia lamblia
SSEIPSEGPF

SEQ ID NO: 3139664 - protein, 4 aa, Giardia lamblia
SSEK

SEQ ID NO: 3139665 - protein, 13 aa, Giardia lamblia
SSEKARALAEKRR

SEQ ID NO: 3139666 - protein, 13 aa, Giardia lamblia
SSEKDRGPAMPGL

SEQ ID NO: 3139667 - protein, 9 aa, Giardia lamblia
SSEKEDELA

SEQ ID NO: 3139668 - protein, 12 aa, Giardia lamblia
SSEKSADAQEQM

SEQ ID NO: 3139669 - protein, 4 aa, Giardia lamblia
SSEL

SEQ ID NO: 3139670 - protein, 5 aa, Giardia lamblia
SSELG

SEQ ID NO: 3139671 - protein, 6 aa, Giardia lamblia
SSELQS

SEQ ID NO: 3139672 - protein, 6 aa, Giardia lamblia
SSEMRP

SEQ ID NO: 3139673 - protein, 9 aa, Giardia lamblia
SSENADLQR

SEQ ID NO: 3139674 - protein, 6 aa, Giardia lamblia
SSEPAT

SEQ ID NO: 3139675 - protein, 6 aa, Giardia lamblia
SSEPFD

SEQ ID NO: 3139676 - protein, 19 aa, Giardia lamblia
SSEPQDDGVDDSNNSGFTS

SEQ ID NO: 3139677 - protein, 7 aa, Giardia lamblia
SSEPRSN

SEQ ID NO: 3139678 - protein, 8 aa, Giardia lamblia
SSEPSRES

SEQ ID NO: 3139679 - protein, 5 aa, Giardia lamblia
SSEQA

SEQ ID NO: 3139680 - protein, 7 aa, Giardia lamblia
SSEQKPA

SEQ ID NO: 3139681 - protein, 5 aa, Giardia lamblia
SSEQR

SEQ ID NO: 3139682 - protein, 14 aa, Giardia lamblia
SSEQSAHEPLKNPT

SEQ ID NO: 3139683 - protein, 9 aa, Giardia lamblia
SSEQTSTIS

SEQ ID NO: 3139684 - protein, 4 aa, Giardia lamblia
SSER

SEQ ID NO: 3139685 - protein, 8 aa, Giardia lamblia
SSERKEQS

SEQ ID NO: 3139686 - protein, 7 aa, Giardia lamblia
SSERPER

SEQ ID NO: 3139687 - protein, 11 aa, Giardia lamblia
SSERRAQAAAQ

SEQ ID NO: 3139688 - protein, 7 aa, Giardia lamblia
SSESAGI

SEQ ID NO: 3139689 - protein, 7 aa, Giardia lamblia
SSESAQL

SEQ ID NO: 3139690 - protein, 11 aa, Giardia lamblia
SSESKEEAGLT

SEQ ID NO: 3139691 - protein, 17 aa, Giardia lamblia
SSESKRKSKSKDRKSGT

SEQ ID NO: 3139692 - protein, 4 aa, Giardia lamblia
SSET

SEQ ID NO: 3139693 - protein, 7 aa, Giardia lamblia
SSETDGI

SEQ ID NO: 3139694 - protein, 8 aa, Giardia lamblia
SSETENPI

SEQ ID NO: 3139695 - protein, 7 aa, Giardia lamblia
SSETISP

SEQ ID NO: 3139696 - protein, 49 aa, Giardia lamblia
SSETMTSLADPSPSTDKTSITANTSSISTTSIGSHDRPYYREAKQNAAE

SEQ ID NO: 3139697 - protein, 4 aa, Giardia lamblia
SSEV

SEQ ID NO: 3139698 - protein, 4 aa, Giardia lamblia
SSEY

SEQ ID NO: 3139699 - protein, 6 aa, Giardia lamblia
SSFGRQ

SEQ ID NO: 3139700 - protein, 10 aa, Giardia lamblia
SSFKGRTPHK

SEQ ID NO: 3139701 - protein, 4 aa, Giardia lamblia
SSFR

SEQ ID NO: 3139702 - protein, 10 aa, Giardia lamblia
SSFSTENSAP

SEQ ID NO: 3139703 - protein, 7 aa, Giardia lamblia
SSFSTPV

SEQ ID NO: 3139704 - protein, 30 aa, Giardia lamblia
SSFTSARSSSRSQSAGARSKRVSESSATIS

SEQ ID NO: 3139705 - protein, 4 aa, Giardia lamblia
SSGA

SEQ ID NO: 3139706 - protein, 13 aa, Giardia lamblia
SSGAPAEQPAPST

SEQ ID NO: 3139707 - protein, 14 aa, Giardia lamblia
SSGATGTTTTTQAP

SEQ ID NO: 3139708 - protein, 26 aa, Giardia lamblia
SSGDDHASNLNEEQLDASEEQPLGPE

SEQ ID NO: 3139709 - protein, 7 aa, Giardia lamblia
SSGDQST

SEQ ID NO: 3139710 - protein, 7 aa, Giardia lamblia
SSGDSRT

SEQ ID NO: 3139711 - protein, 5 aa, Giardia lamblia
SSGED

SEQ ID NO: 3139712 - protein, 6 aa, Giardia lamblia
SSGEDE

SEQ ID NO: 3139713 - protein, 6 aa, Giardia lamblia
SSGEFT

SEQ ID NO: 3139714 - protein, 7 aa, Giardia lamblia
SSGEGTT

SEQ ID NO: 3139715 - protein, 5 aa, Giardia lamblia
SSGEI

SEQ ID NO: 3139716 - protein, 5 aa, Giardia lamblia
SSGEM

SEQ ID NO: 3139717 - protein, 13 aa, Giardia lamblia
SSGEPELKRGLAD

SEQ ID NO: 3139718 - protein, 4 aa, Giardia lamblia
SSGG

SEQ ID NO: 3139719 - protein, 14 aa, Giardia lamblia
SSGGADDSSASQEV

SEQ ID NO: 3139720 - protein, 8 aa, Giardia lamblia
SSGGATVP

SEQ ID NO: 3139721 - protein, 11 aa, Giardia lamblia
SSGGVNDESLP

SEQ ID NO: 3139722 - protein, 12 aa, Giardia lamblia
SSGHSSDEMTSQ

SEQ ID NO: 3139723 - protein, 4 aa, Giardia lamblia
SSGI

SEQ ID NO: 3139724 - protein, 5 aa, Giardia lamblia
SSGIV

SEQ ID NO: 3139725 - protein, 6 aa, Giardia lamblia
SSGKNV

SEQ ID NO: 3139726 - protein, 7 aa, Giardia lamblia
SSGKPQM

SEQ ID NO: 3139727 - protein, 6 aa, Giardia lamblia
SSGKVQ

SEQ ID NO: 3139728 - protein, 5 aa, Giardia lamblia
SSGLP

SEQ ID NO: 3139729 - protein, 36 aa, Giardia lamblia
SSGNNSDYNEAPSIPGAPDESLENPPLGSKTTDTVN

SEQ ID NO: 3139730 - protein, 7 aa, Giardia lamblia
SSGNVQA

SEQ ID NO: 3139731 - protein, 7 aa, Giardia lamblia
SSGPDDQ

SEQ ID NO: 3139732 - protein, 14 aa, Giardia lamblia
SSGPEAPLYQPDSS

SEQ ID NO: 3139733 - protein, 4 aa, Giardia lamblia
SSGR

SEQ ID NO: 3139734 - protein, 6 aa, Giardia lamblia
SSGRAD

SEQ ID NO: 3139735 - protein, 7 aa, Giardia lamblia
SSGREDL

SEQ ID NO: 3139736 - protein, 19 aa, Giardia lamblia
SSGRQSKPSSISTTDTSYT

SEQ ID NO: 3139737 - protein, 23 aa, Giardia lamblia
SSGRTKISVSTAPPTIGAQPKPV

SEQ ID NO: 3139738 - protein, 7 aa, Giardia lamblia
SSGRTTG

SEQ ID NO: 3139739 - protein, 21 aa, Giardia lamblia
SSGSEKSNSMASSLPSSRTSY

SEQ ID NO: 3139740 - protein, 9 aa, Giardia lamblia
SSGSGENAL

SEQ ID NO: 3139741 - protein, 6 aa, Giardia lamblia
SSGSLL

SEQ ID NO: 3139742 - protein, 8 aa, Giardia lamblia
SSGSMSSA

SEQ ID NO: 3139743 - protein, 6 aa, Giardia lamblia
SSGSPA

SEQ ID NO: 3139744 - protein, 32 aa, Giardia lamblia
SSGSTNPESVKPCENGLPPPLQSDDNSSCGPR

SEQ ID NO: 3139745 - protein, 6 aa, Giardia lamblia
SSGSYY

SEQ ID NO: 3139746 - protein, 4 aa, Giardia lamblia
SSGT

SEQ ID NO: 3139747 - protein, 6 aa, Giardia lamblia
SSGTAR

SEQ ID NO: 3139748 - protein, 8 aa, Giardia lamblia
SSGTESTA

SEQ ID NO: 3139749 - protein, 8 aa, Giardia lamblia
SSGTLEDN

SEQ ID NO: 3139750 - protein, 7 aa, Giardia lamblia
SSGTLPD

SEQ ID NO: 3139751 - protein, 8 aa, Giardia lamblia
SSGTQISN

SEQ ID NO: 3139752 - protein, 7 aa, Giardia lamblia
SSGTVGA

SEQ ID NO: 3139753 - protein, 6 aa, Giardia lamblia
SSGVPG

SEQ ID NO: 3139754 - protein, 6 aa, Giardia lamblia
SSGVSE

SEQ ID NO: 3139755 - protein, 12 aa, Giardia lamblia
SSHATPQRLRAH

SEQ ID NO: 3139756 - protein, 12 aa, Giardia lamblia
SSHATSAPVTPQ

SEQ ID NO: 3139757 - protein, 4 aa, Giardia lamblia
SSHD

SEQ ID NO: 3139758 - protein, 4 aa, Giardia lamblia
SSHE

SEQ ID NO: 3139759 - protein, 7 aa, Giardia lamblia
SSHEKLD

SEQ ID NO: 3139760 - protein, 5 aa, Giardia lamblia
SSHGT

SEQ ID NO: 3139761 - protein, 6 aa, Giardia lamblia
SSHGTK

SEQ ID NO: 3139762 - protein, 6 aa, Giardia lamblia
SSHIDE

SEQ ID NO: 3139763 - protein, 8 aa, Giardia lamblia
SSHKADAD

SEQ ID NO: 3139764 - protein, 20 aa, Giardia lamblia
SSHKGKKLTESAASLAGDKS

SEQ ID NO: 3139765 - protein, 7 aa, Giardia lamblia
SSHKPSM

SEQ ID NO: 3139766 - protein, 15 aa, Giardia lamblia
SSHPGAPPAPPDASQ

SEQ ID NO: 3139767 - protein, 7 aa, Giardia lamblia
SSHPKED

SEQ ID NO: 3139768 - protein, 13 aa, Giardia lamblia
SSHPKGRSSSHLA

SEQ ID NO: 3139769 - protein, 13 aa, Giardia lamblia
SSHSSPRSKDDCQ

SEQ ID NO: 3139770 - protein, 8 aa, Giardia lamblia
SSHTGDIE

SEQ ID NO: 3139771 - protein, 7 aa, Giardia lamblia
SSHTQKQ

SEQ ID NO: 3139772 - protein, 7 aa, Giardia lamblia
SSHTRQP

SEQ ID NO: 3139773 - protein, 7 aa, Giardia lamblia
SSHTTPQ

SEQ ID NO: 3139774 - protein, 5 aa, Giardia lamblia
SSHTV

SEQ ID NO: 3139775 - protein, 8 aa, Giardia lamblia
SSIAEAGG

SEQ ID NO: 3139776 - protein, 10 aa, Giardia lamblia
SSIATSEAAA

SEQ ID NO: 3139777 - protein, 4 aa, Giardia lamblia
SSID

SEQ ID NO: 3139778 - protein, 5 aa, Giardia lamblia
SSIDG

SEQ ID NO: 3139779 - protein, 6 aa, Giardia lamblia
SSIDQT

SEQ ID NO: 3139780 - protein, 8 aa, Giardia lamblia
SSIEDGKK

SEQ ID NO: 3139781 - protein, 6 aa, Giardia lamblia
SSIEPT

SEQ ID NO: 3139782 - protein, 7 aa, Giardia lamblia
SSIGDPS

SEQ ID NO: 3139783 - protein, 9 aa, Giardia lamblia
SSIIPSKTE

SEQ ID NO: 3139784 - protein, 4 aa, Giardia lamblia
SSIK

SEQ ID NO: 3139785 - protein, 11 aa, Giardia lamblia
SSIKEANDFKR

SEQ ID NO: 3139786 - protein, 20 aa, Giardia lamblia
SSILSDSDVSVENDPTTTDL

SEQ ID NO: 3139787 - protein, 4 aa, Giardia lamblia
SSIM

SEQ ID NO: 3139788 - protein, 4 aa, Giardia lamblia
SSIP

SEQ ID NO: 3139789 - protein, 17 aa, Giardia lamblia
SSIPPIEASEPPKPPSV

SEQ ID NO: 3139790 - protein, 14 aa, Giardia lamblia
SSIPPPSPSQRNSA

SEQ ID NO: 3139791 - protein, 9 aa, Giardia lamblia
SSIQDVNGT

SEQ ID NO: 3139792 - protein, 5 aa, Giardia lamblia
SSIQP

SEQ ID NO: 3139793 - protein, 44 aa, Giardia lamblia
SSIRGTPRSSMTGSSYRNLNNTPRESISGSQDAYVTGTPGAPKN

SEQ ID NO: 3139794 - protein, 16 aa, Giardia lamblia
SSISTKKQDSNRKRPL

SEQ ID NO: 3139795 - protein, 12 aa, Giardia lamblia
SSITLSNKADRA

SEQ ID NO: 3139796 - protein, 9 aa, Giardia lamblia
SSITNPGIE

SEQ ID NO: 3139797 - protein, 11 aa, Giardia lamblia
SSITPEHTQKP

SEQ ID NO: 3139798 - protein, 13 aa, Giardia lamblia
SSITQMSTTPGGA

SEQ ID NO: 3139799 - protein, 13 aa, Giardia lamblia
SSITSSQFAPQER

SEQ ID NO: 3139800 - protein, 16 aa, Giardia lamblia
SSIVSSDSPKQGSGTP

SEQ ID NO: 3139801 - protein, 6 aa, Giardia lamblia
SSKAPD

SEQ ID NO: 3139802 - protein, 12 aa, Giardia lamblia
SSKDEKNNDGNT

SEQ ID NO: 3139803 - protein, 18 aa, Giardia lamblia
SSKDFKNRCPPGFQFQTA

SEQ ID NO: 3139804 - protein, 9 aa, Giardia lamblia
SSKDKTIAL

SEQ ID NO: 3139805 - protein, 5 aa, Giardia lamblia
SSKDL

SEQ ID NO: 3139806 - protein, 9 aa, Giardia lamblia
SSKDNPELS

SEQ ID NO: 3139807 - protein, 14 aa, Giardia lamblia
SSKEAEQKRNEIVE

SEQ ID NO: 3139808 - protein, 20 aa, Giardia lamblia
SSKEANEKYTDLTQTETEEL

SEQ ID NO: 3139809 - protein, 8 aa, Giardia lamblia
SSKEARRS

SEQ ID NO: 3139810 - protein, 10 aa, Giardia lamblia
SSKEDEAHSQ

SEQ ID NO: 3139811 - protein, 10 aa, Giardia lamblia
SSKEENGGVT

SEQ ID NO: 3139812 - protein, 17 aa, Giardia lamblia
SSKEKEELQQEREKQIE

SEQ ID NO: 3139813 - protein, 17 aa, Giardia lamblia
SSKGKPDRAPQPKPDEA

SEQ ID NO: 3139814 - protein, 8 aa, Giardia lamblia
SSKGNGMS

SEQ ID NO: 3139815 - protein, 14 aa, Giardia lamblia
SSKGNREAGHNDGH

SEQ ID NO: 3139816 - protein, 8 aa, Giardia lamblia
SSKGQEEK

SEQ ID NO: 3139817 - protein, 24 aa, Giardia lamblia
SSKGQPSPLESGLKRSRPMSMSED

SEQ ID NO: 3139818 - protein, 6 aa, Giardia lamblia
SSKGRR

SEQ ID NO: 3139819 - protein, 8 aa, Giardia lamblia
SSKGRTAL

SEQ ID NO: 3139820 - protein, 10 aa, Giardia lamblia
SSKGTAEHTL

SEQ ID NO: 3139821 - protein, 37 aa, Giardia lamblia
SSKGTAEMKSADSVQGSQTPKQRSVSSASQTPSITKD

SEQ ID NO: 3139822 - protein, 12 aa, Giardia lamblia
SSKGTSENATND

SEQ ID NO: 3139823 - protein, 5 aa, Giardia lamblia
SSKHY

SEQ ID NO: 3139824 - protein, 4 aa, Giardia lamblia
SSKI

SEQ ID NO: 3139825 - protein, 13 aa, Giardia lamblia
SSKIMTDSKPNTV

SEQ ID NO: 3139826 - protein, 8 aa, Giardia lamblia
SSKKCTRS

SEQ ID NO: 3139827 - protein, 4 aa, Giardia lamblia
SSKM

SEQ ID NO: 3139828 - protein, 6 aa, Giardia lamblia
SSKNLQ

SEQ ID NO: 3139829 - protein, 7 aa, Giardia lamblia
SSKPVQT

SEQ ID NO: 3139830 - protein, 8 aa, Giardia lamblia
SSKRALTA

SEQ ID NO: 3139831 - protein, 11 aa, Giardia lamblia
SSKRDTGEYTV

SEQ ID NO: 3139832 - protein, 12 aa, Giardia lamblia
SSKRNERTCKAS

SEQ ID NO: 3139833 - protein, 7 aa, Giardia lamblia
SSKRQKA

SEQ ID NO: 3139834 - protein, 9 aa, Giardia lamblia
SSKRTNDNL

SEQ ID NO: 3139835 - protein, 30 aa, Giardia lamblia
SSKSDPSTSGSISAVTTYKKQSAGEQEVGH

SEQ ID NO: 3139836 - protein, 6 aa, Giardia lamblia
SSKSEI

SEQ ID NO: 3139837 - protein, 7 aa, Giardia lamblia
SSKSMTE

SEQ ID NO: 3139838 - protein, 9 aa, Giardia lamblia
SSKSPDQRQ

SEQ ID NO: 3139839 - protein, 11 aa, Giardia lamblia
SSKSRHRAERD

SEQ ID NO: 3139840 - protein, 26 aa, Giardia lamblia
SSKSTISSTSSSVADAHTDGNLEPQL

SEQ ID NO: 3139841 - protein, 10 aa, Giardia lamblia
SSKSTLPRPL

SEQ ID NO: 3139842 - protein, 6 aa, Giardia lamblia
SSKSYA

SEQ ID NO: 3139843 - protein, 6 aa, Giardia lamblia
SSKTEG

SEQ ID NO: 3139844 - protein, 4 aa, Giardia lamblia
SSKV

SEQ ID NO: 3139845 - protein, 41 aa, Giardia lamblia
SSKYDVQSLKDDSDEESSGDILPGQPSLSSVQKRPSSVSAG

SEQ ID NO: 3139846 - protein, 7 aa, Giardia lamblia
SSLAAAQ

SEQ ID NO: 3139847 - protein, 12 aa, Giardia lamblia
SSLAESAPPFDN

SEQ ID NO: 3139848 - protein, 12 aa, Giardia lamblia
SSLAGSTSQPSL

SEQ ID NO: 3139849 - protein, 46 aa, Giardia lamblia
SSLARTSTQRPSSTTFATRTSTLSTRVPPSQTAHSSVSKKKARDDL

SEQ ID NO: 3139850 - protein, 8 aa, Giardia lamblia
SSLASANA

SEQ ID NO: 3139851 - protein, 6 aa, Giardia lamblia
SSLASS

SEQ ID NO: 3139852 - protein, 6 aa, Giardia lamblia
SSLDSI

SEQ ID NO: 3139853 - protein, 6 aa, Giardia lamblia
SSLDSQ

SEQ ID NO: 3139854 - protein, 4 aa, Giardia lamblia
SSLE

SEQ ID NO: 3139855 - protein, 28 aa, Giardia lamblia
SSLEDSPKSKSFAEPSSTIEDPQERRAP

SEQ ID NO: 3139856 - protein, 21 aa, Giardia lamblia
SSLEEENKALEATAKDSLNQV

SEQ ID NO: 3139857 - protein, 10 aa, Giardia lamblia
SSLEKDKATL

SEQ ID NO: 3139858 - protein, 4 aa, Giardia lamblia
SSLG

SEQ ID NO: 3139859 - protein, 7 aa, Giardia lamblia
SSLGASS

SEQ ID NO: 3139860 - protein, 12 aa, Giardia lamblia
SSLHDRAHEPTL

SEQ ID NO: 3139861 - protein, 10 aa, Giardia lamblia
SSLKTPVESA

SEQ ID NO: 3139862 - protein, 8 aa, Giardia lamblia
SSLKTSGD

SEQ ID NO: 3139863 - protein, 4 aa, Giardia lamblia
SSLL

SEQ ID NO: 3139864 - protein, 9 aa, Giardia lamblia
SSLNQDTGV

SEQ ID NO: 3139865 - protein, 18 aa, Giardia lamblia
SSLNTSSLAKSLASPDVS

SEQ ID NO: 3139866 - protein, 16 aa, Giardia lamblia
SSLPEKPKGASKALED

SEQ ID NO: 3139867 - protein, 5 aa, Giardia lamblia
SSLPN

SEQ ID NO: 3139868 - protein, 5 aa, Giardia lamblia
SSLPP

SEQ ID NO: 3139869 - protein, 15 aa, Giardia lamblia
SSLPTNEDAPDGPAT

SEQ ID NO: 3139870 - protein, 4 aa, Giardia lamblia
SSLQ

SEQ ID NO: 3139871 - protein, 5 aa, Giardia lamblia
SSLQD

SEQ ID NO: 3139872 - protein, 23 aa, Giardia lamblia
SSLQEDQASHNTPPVHKDSRLAR

SEQ ID NO: 3139873 - protein, 7 aa, Giardia lamblia
SSLQTQE

SEQ ID NO: 3139874 - protein, 7 aa, Giardia lamblia
SSLRESF

SEQ ID NO: 3139875 - protein, 6 aa, Giardia lamblia
SSLRTQ

SEQ ID NO: 3139876 - protein, 9 aa, Giardia lamblia
SSLSAEARS

SEQ ID NO: 3139877 - protein, 9 aa, Giardia lamblia
SSLSAKQAT

SEQ ID NO: 3139878 - protein, 10 aa, Giardia lamblia
SSLSFSTGTL

SEQ ID NO: 3139879 - protein, 6 aa, Giardia lamblia
SSLSGE

SEQ ID NO: 3139880 - protein, 16 aa, Giardia lamblia
SSLSNLRSGKDDAERY

SEQ ID NO: 3139881 - protein, 27 aa, Giardia lamblia
SSLSNPGPSDASDSIKVESQSCDPESK

SEQ ID NO: 3139882 - protein, 5 aa, Giardia lamblia
SSLSR

SEQ ID NO: 3139883 - protein, 8 aa, Giardia lamblia
SSLSSGDQ

SEQ ID NO: 3139884 - protein, 8 aa, Giardia lamblia
SSLTADPE

SEQ ID NO: 3139885 - protein, 11 aa, Giardia lamblia
SSLTDAESMKA

SEQ ID NO: 3139886 - protein, 6 aa, Giardia lamblia
SSLTES

SEQ ID NO: 3139887 - protein, 6 aa, Giardia lamblia
SSLTKS

SEQ ID NO: 3139888 - protein, 6 aa, Giardia lamblia
SSMATD

SEQ ID NO: 3139889 - protein, 12 aa, Giardia lamblia
SSMHSPPKETLK

SEQ ID NO: 3139890 - protein, 9 aa, Giardia lamblia
SSMNTRGSG

SEQ ID NO: 3139891 - protein, 5 aa, Giardia lamblia
SSMPK

SEQ ID NO: 3139892 - protein, 5 aa, Giardia lamblia
SSMPP

SEQ ID NO: 3139893 - protein, 7 aa, Giardia lamblia
SSMRAAN

SEQ ID NO: 3139894 - protein, 4 aa, Giardia lamblia
SSMT

SEQ ID NO: 3139895 - protein, 10 aa, Giardia lamblia
SSMTDEQRKT

SEQ ID NO: 3139896 - protein, 11 aa, Giardia lamblia
SSMTGSLGESL

SEQ ID NO: 3139897 - protein, 4 aa, Giardia lamblia
SSNA

SEQ ID NO: 3139898 - protein, 29 aa, Giardia lamblia
SSNAMADGSNRASHSQHNTHNPHSSHNAH

SEQ ID NO: 3139899 - protein, 17 aa, Giardia lamblia
SSNANLQDLQTGTGSSG

SEQ ID NO: 3139900 - protein, 4 aa, Giardia lamblia
SSND

SEQ ID NO: 3139901 - protein, 7 aa, Giardia lamblia
SSNDARI

SEQ ID NO: 3139902 - protein, 7 aa, Giardia lamblia
SSNDPNL

SEQ ID NO: 3139903 - protein, 8 aa, Giardia lamblia
SSNDPSGL

SEQ ID NO: 3139904 - protein, 33 aa, Giardia lamblia
SSNDRTEGQTTNTRQTMAPRQANKTTKQGKSSF

SEQ ID NO: 3139905 - protein, 5 aa, Giardia lamblia
SSNDT

SEQ ID NO: 3139906 - protein, 7 aa, Giardia lamblia
SSNERTR

SEQ ID NO: 3139907 - protein, 4 aa, Giardia lamblia
SSNG

SEQ ID NO: 3139908 - protein, 8 aa, Giardia lamblia
SSNGIREQ

SEQ ID NO: 3139909 - protein, 6 aa, Giardia lamblia
SSNGPA

SEQ ID NO: 3139910 - protein, 6 aa, Giardia lamblia
SSNGRV

SEQ ID NO: 3139911 - protein, 15 aa, Giardia lamblia
SSNHVKDESSKQTPL

SEQ ID NO: 3139912 - protein, 7 aa, Giardia lamblia
SSNKGNV

SEQ ID NO: 3139913 - protein, 7 aa, Giardia lamblia
SSNLSQD

SEQ ID NO: 3139914 - protein, 4 aa, Giardia lamblia
SSNM

SEQ ID NO: 3139915 - protein, 12 aa, Giardia lamblia
SSNMKEDNNVTS

SEQ ID NO: 3139916 - protein, 19 aa, Giardia lamblia
SSNNTRVNVTSAQKQKDPW

SEQ ID NO: 3139917 - protein, 9 aa, Giardia lamblia
SSNNTTQNV

SEQ ID NO: 3139918 - protein, 8 aa, Giardia lamblia
SSNPDRSF

SEQ ID NO: 3139919 - protein, 5 aa, Giardia lamblia
SSNPQ

SEQ ID NO: 3139920 - protein, 10 aa, Giardia lamblia
SSNQPSVPAH

SEQ ID NO: 3139921 - protein, 10 aa, Giardia lamblia
SSNQTGLSNS

SEQ ID NO: 3139922 - protein, 10 aa, Giardia lamblia
SSNRASDRTA

SEQ ID NO: 3139923 - protein, 6 aa, Giardia lamblia
SSNRGA

SEQ ID NO: 3139924 - protein, 8 aa, Giardia lamblia
SSNRKTMS

SEQ ID NO: 3139925 - protein, 11 aa, Giardia lamblia
SSNRQDDESEF

SEQ ID NO: 3139926 - protein, 9 aa, Giardia lamblia
SSNSGQPQT

SEQ ID NO: 3139927 - protein, 7 aa, Giardia lamblia
SSNSSMI

SEQ ID NO: 3139928 - protein, 19 aa, Giardia lamblia
SSNTAINDQPQEIDPASQL

SEQ ID NO: 3139929 - protein, 14 aa, Giardia lamblia
SSNTQSTSLTENQL

SEQ ID NO: 3139930 - protein, 7 aa, Giardia lamblia
SSNVKPQ

SEQ ID NO: 3139931 - protein, 26 aa, Giardia lamblia
SSNYAGAEMNETDLKRQATGPYGVPS

SEQ ID NO: 3139932 - protein, 5 aa, Giardia lamblia
SSNYN

SEQ ID NO: 3139933 - protein, 6 aa, Giardia lamblia
SSNYSP

SEQ ID NO: 3139934 - protein, 15 aa, Giardia lamblia
SSNYTPHRTSGDNLH

SEQ ID NO: 3139935 - protein, 6 aa, Giardia lamblia
SSPASV

SEQ ID NO: 3139936 - protein, 11 aa, Giardia lamblia
SSPATATSTQL

SEQ ID NO: 3139937 - protein, 7 aa, Giardia lamblia
SSPATRE

SEQ ID NO: 3139938 - protein, 5 aa, Giardia lamblia
SSPAV

SEQ ID NO: 3139939 - protein, 4 aa, Giardia lamblia
SSPC

SEQ ID NO: 3139940 - protein, 4 aa, Giardia lamblia
SSPD

SEQ ID NO: 3139941 - protein, 5 aa, Giardia lamblia
SSPDE

SEQ ID NO: 3139942 - protein, 5 aa, Giardia lamblia
SSPDI

SEQ ID NO: 3139943 - protein, 7 aa, Giardia lamblia
SSPDSAL

SEQ ID NO: 3139944 - protein, 7 aa, Giardia lamblia
SSPDTST

SEQ ID NO: 3139945 - protein, 6 aa, Giardia lamblia
SSPEAS

SEQ ID NO: 3139946 - protein, 9 aa, Giardia lamblia
SSPELPGSV

SEQ ID NO: 3139947 - protein, 12 aa, Giardia lamblia
SSPELQQANEQA

SEQ ID NO: 3139948 - protein, 17 aa, Giardia lamblia
SSPEMYKEDRAGSQTDF

SEQ ID NO: 3139949 - protein, 12 aa, Giardia lamblia
SSPEPPSLPTDT

SEQ ID NO: 3139950 - protein, 7 aa, Giardia lamblia
SSPEQVK

SEQ ID NO: 3139951 - protein, 9 aa, Giardia lamblia
SSPESARQW

SEQ ID NO: 3139952 - protein, 14 aa, Giardia lamblia
SSPGPVVGQEERER

SEQ ID NO: 3139953 - protein, 7 aa, Giardia lamblia
SSPGPYQ

SEQ ID NO: 3139954 - protein, 14 aa, Giardia lamblia
SSPGYGTNPPSMTS

SEQ ID NO: 3139955 - protein, 6 aa, Giardia lamblia
SSPKEA

SEQ ID NO: 3139956 - protein, 7 aa, Giardia lamblia
SSPKFSM

SEQ ID NO: 3139957 - protein, 5 aa, Giardia lamblia
SSPKI

SEQ ID NO: 3139958 - protein, 25 aa, Giardia lamblia
SSPKRRRSASHTDPAKANKALQNSL

SEQ ID NO: 3139959 - protein, 9 aa, Giardia lamblia
SSPKVGTPQ

SEQ ID NO: 3139960 - protein, 4 aa, Giardia lamblia
SSPL

SEQ ID NO: 3139961 - protein, 8 aa, Giardia lamblia
SSPLKSAS

SEQ ID NO: 3139962 - protein, 12 aa, Giardia lamblia
SSPLKTQANTND

SEQ ID NO: 3139963 - protein, 5 aa, Giardia lamblia
SSPLM

SEQ ID NO: 3139964 - protein, 7 aa, Giardia lamblia
SSPLNKY

SEQ ID NO: 3139965 - protein, 11 aa, Giardia lamblia
SSPLQTGSQAQ

SEQ ID NO: 3139966 - protein, 17 aa, Giardia lamblia
SSPLTQTEHANNSPLRE

SEQ ID NO: 3139967 - protein, 6 aa, Giardia lamblia
SSPLTS

SEQ ID NO: 3139968 - protein, 20 aa, Giardia lamblia
SSPNDRGVSGRSPGAYPPPV

SEQ ID NO: 3139969 - protein, 5 aa, Giardia lamblia
SSPNG

SEQ ID NO: 3139970 - protein, 7 aa, Giardia lamblia
SSPPALC

SEQ ID NO: 3139971 - protein, 8 aa, Giardia lamblia
SSPPELDE

SEQ ID NO: 3139972 - protein, 7 aa, Giardia lamblia
SSPPETV

SEQ ID NO: 3139973 - protein, 7 aa, Giardia lamblia
SSPPHGA

SEQ ID NO: 3139974 - protein, 6 aa, Giardia lamblia
SSPPLA

SEQ ID NO: 3139975 - protein, 18 aa, Giardia lamblia
SSPPMSNKSLSSKISSLT

SEQ ID NO: 3139976 - protein, 5 aa, Giardia lamblia
SSPPS

SEQ ID NO: 3139977 - protein, 6 aa, Giardia lamblia
SSPQAH

SEQ ID NO: 3139978 - protein, 13 aa, Giardia lamblia
SSPRRPFAPHRRR

SEQ ID NO: 3139979 - protein, 5 aa, Giardia lamblia
SSPSE

SEQ ID NO: 3139980 - protein, 7 aa, Giardia lamblia
SSPSFSE

SEQ ID NO: 3139981 - protein, 6 aa, Giardia lamblia
SSPSGH

SEQ ID NO: 3139982 - protein, 15 aa, Giardia lamblia
SSPSISTGTQPEGPD

SEQ ID NO: 3139983 - protein, 6 aa, Giardia lamblia
SSPSKA

SEQ ID NO: 3139984 - protein, 5 aa, Giardia lamblia
SSPSL

SEQ ID NO: 3139985 - protein, 6 aa, Giardia lamblia
SSPSRD

SEQ ID NO: 3139986 - protein, 8 aa, Giardia lamblia
SSPSSVPS

SEQ ID NO: 3139987 - protein, 5 aa, Giardia lamblia
SSPTG

SEQ ID NO: 3139988 - protein, 22 aa, Giardia lamblia
SSPTSPAFSSVSKSHPRAPALK

SEQ ID NO: 3139989 - protein, 7 aa, Giardia lamblia
SSPTTTL

SEQ ID NO: 3139990 - protein, 7 aa, Giardia lamblia
SSPTVSG

SEQ ID NO: 3139991 - protein, 13 aa, Giardia lamblia
SSPVPVSKQQSKT

SEQ ID NO: 3139992 - protein, 4 aa, Giardia lamblia
SSQA

SEQ ID NO: 3139993 - protein, 5 aa, Giardia lamblia
SSQAI

SEQ ID NO: 3139994 - protein, 8 aa, Giardia lamblia
SSQAKRRG

SEQ ID NO: 3139995 - protein, 10 aa, Giardia lamblia
SSQARSDTEC

SEQ ID NO: 3139996 - protein, 4 aa, Giardia lamblia
SSQE

SEQ ID NO: 3139997 - protein, 6 aa, Giardia lamblia
SSQEDK

SEQ ID NO: 3139998 - protein, 6 aa, Giardia lamblia
SSQEHD

SEQ ID NO: 3139999 - protein, 11 aa, Giardia lamblia
SSQEQQSQEPV

SEQ ID NO: 3140000 - protein, 5 aa, Giardia lamblia
SSQEV

SEQ ID NO: 3140001 - protein, 11 aa, Giardia lamblia
SSQGDRGPSSY

SEQ ID NO: 3140002 - protein, 7 aa, Giardia lamblia
SSQGPRH

SEQ ID NO: 3140003 - protein, 13 aa, Giardia lamblia
SSQGRQDQNFQDQ

SEQ ID NO: 3140004 - protein, 6 aa, Giardia lamblia
SSQHPI

SEQ ID NO: 3140005 - protein, 16 aa, Giardia lamblia
SSQHPNHNADTINSID

SEQ ID NO: 3140006 - protein, 12 aa, Giardia lamblia
SSQIDKSAKQIS

SEQ ID NO: 3140007 - protein, 12 aa, Giardia lamblia
SSQIREEQKKEL

SEQ ID NO: 3140008 - protein, 8 aa, Giardia lamblia
SSQKATTD

SEQ ID NO: 3140009 - protein, 7 aa, Giardia lamblia
SSQKKEL

SEQ ID NO: 3140010 - protein, 5 aa, Giardia lamblia
SSQLE

SEQ ID NO: 3140011 - protein, 12 aa, Giardia lamblia
SSQLSRSSAHID

SEQ ID NO: 3140012 - protein, 4 aa, Giardia lamblia
SSQN

SEQ ID NO: 3140013 - protein, 5 aa, Giardia lamblia
SSQNA

SEQ ID NO: 3140014 - protein, 16 aa, Giardia lamblia
SSQNAYKQHEQSTKHR

SEQ ID NO: 3140015 - protein, 8 aa, Giardia lamblia
SSQNQWEK

SEQ ID NO: 3140016 - protein, 8 aa, Giardia lamblia
SSQPDYHP

SEQ ID NO: 3140017 - protein, 14 aa, Giardia lamblia
SSQPETLPIPQPYQ

SEQ ID NO: 3140018 - protein, 7 aa, Giardia lamblia
SSQPISE

SEQ ID NO: 3140019 - protein, 9 aa, Giardia lamblia
SSQQEETIP

SEQ ID NO: 3140020 - protein, 6 aa, Giardia lamblia
SSQQRG

SEQ ID NO: 3140021 - protein, 14 aa, Giardia lamblia
SSQQTSNQTHGGPD

SEQ ID NO: 3140022 - protein, 4 aa, Giardia lamblia
SSQR

SEQ ID NO: 3140023 - protein, 6 aa, Giardia lamblia
SSQRPL

SEQ ID NO: 3140024 - protein, 4 aa, Giardia lamblia
SSQS

SEQ ID NO: 3140025 - protein, 14 aa, Giardia lamblia
SSQSNVRAPATPAI

SEQ ID NO: 3140026 - protein, 7 aa, Giardia lamblia
SSQSPDI

SEQ ID NO: 3140027 - protein, 49 aa, Giardia lamblia
SSQSPQSPQQQTTAAVGNEKQTKIEQKKPITQKAQKGRRLEGAQKKKGM

SEQ ID NO: 3140028 - protein, 7 aa, Giardia lamblia
SSQSPQV

SEQ ID NO: 3140029 - protein, 8 aa, Giardia lamblia
SSQSQRDH

SEQ ID NO: 3140030 - protein, 5 aa, Giardia lamblia
SSQSR

SEQ ID NO: 3140031 - protein, 8 aa, Giardia lamblia
SSQTATKD

SEQ ID NO: 3140032 - protein, 8 aa, Giardia lamblia
SSQTFPSA

SEQ ID NO: 3140033 - protein, 8 aa, Giardia lamblia
SSQTGNIY

SEQ ID NO: 3140034 - protein, 29 aa, Giardia lamblia
SSQTQTSTPNGTDYASSEYEVGASSSTIQ

SEQ ID NO: 3140035 - protein, 7 aa, Giardia lamblia
SSQTRAD

SEQ ID NO: 3140036 - protein, 12 aa, Giardia lamblia
SSQTSQGPTTAV

SEQ ID NO: 3140037 - protein, 12 aa, Giardia lamblia
SSQVDTVSPALS

SEQ ID NO: 3140038 - protein, 8 aa, Giardia lamblia
SSQVGNPA

SEQ ID NO: 3140039 - protein, 7 aa, Giardia lamblia
SSQVQTS

SEQ ID NO: 3140040 - protein, 4 aa, Giardia lamblia
SSQW

SEQ ID NO: 3140041 - protein, 7 aa, Giardia lamblia
SSQYSSM

SEQ ID NO: 3140042 - protein, 55 aa, Giardia lamblia
SSRAGSKQASSGQSNAKGASKGKGGARAPSKLQKTKKSGSVKNISDKDQLPPSEA

SEQ ID NO: 3140043 - protein, 14 aa, Giardia lamblia
SSRASEAQQNRQGI

SEQ ID NO: 3140044 - protein, 10 aa, Giardia lamblia
SSRCDEDGNS

SEQ ID NO: 3140045 - protein, 6 aa, Giardia lamblia
SSRCKS

SEQ ID NO: 3140046 - protein, 17 aa, Giardia lamblia
SSRDDFPVNPGSLEHPD

SEQ ID NO: 3140047 - protein, 11 aa, Giardia lamblia
SSRDDTISNRE

SEQ ID NO: 3140048 - protein, 5 aa, Giardia lamblia
SSRDK

SEQ ID NO: 3140049 - protein, 11 aa, Giardia lamblia
SSRDSPGPPQG

SEQ ID NO: 3140050 - protein, 4 aa, Giardia lamblia
SSRE

SEQ ID NO: 3140051 - protein, 8 aa, Giardia lamblia
SSREAQNT

SEQ ID NO: 3140052 - protein, 16 aa, Giardia lamblia
SSREGPSVNEYDNENY

SEQ ID NO: 3140053 - protein, 4 aa, Giardia lamblia
SSRG

SEQ ID NO: 3140054 - protein, 9 aa, Giardia lamblia
SSRGDHERA

SEQ ID NO: 3140055 - protein, 16 aa, Giardia lamblia
SSRGSGPNSSHTSDEH

SEQ ID NO: 3140056 - protein, 26 aa, Giardia lamblia
SSRGSSKNSSRVTSRAGSAKQQTDTH

SEQ ID NO: 3140057 - protein, 6 aa, Giardia lamblia
SSRITA

SEQ ID NO: 3140058 - protein, 17 aa, Giardia lamblia
SSRITKHDATAAPVSLS

SEQ ID NO: 3140059 - protein, 15 aa, Giardia lamblia
SSRKGDKRIDEKEEK

SEQ ID NO: 3140060 - protein, 5 aa, Giardia lamblia
SSRKS

SEQ ID NO: 3140061 - protein, 19 aa, Giardia lamblia
SSRKSTQASRTLSRPGSAL

SEQ ID NO: 3140062 - protein, 5 aa, Giardia lamblia
SSRKT

SEQ ID NO: 3140063 - protein, 6 aa, Giardia lamblia
SSRLPA

SEQ ID NO: 3140064 - protein, 8 aa, Giardia lamblia
SSRLQKGD

SEQ ID NO: 3140065 - protein, 4 aa, Giardia lamblia
SSRM

SEQ ID NO: 3140066 - protein, 6 aa, Giardia lamblia
SSRNAV

SEQ ID NO: 3140067 - protein, 7 aa, Giardia lamblia
SSRNTGP

SEQ ID NO: 3140068 - protein, 5 aa, Giardia lamblia
SSRNV

SEQ ID NO: 3140069 - protein, 18 aa, Giardia lamblia
SSRPAQPAISGPSSSIPV

SEQ ID NO: 3140070 - protein, 8 aa, Giardia lamblia
SSRPESAQ

SEQ ID NO: 3140071 - protein, 15 aa, Giardia lamblia
SSRPGQTATGKCRTS

SEQ ID NO: 3140072 - protein, 10 aa, Giardia lamblia
SSRPGQVGTA

SEQ ID NO: 3140073 - protein, 8 aa, Giardia lamblia
SSRPQNNK

SEQ ID NO: 3140074 - protein, 9 aa, Giardia lamblia
SSRPVPVPG

SEQ ID NO: 3140075 - protein, 4 aa, Giardia lamblia
SSRQ

SEQ ID NO: 3140076 - protein, 24 aa, Giardia lamblia
SSRQQSSYDQQQCHRTSPASPIRS

SEQ ID NO: 3140077 - protein, 6 aa, Giardia lamblia
SSRRHD

SEQ ID NO: 3140078 - protein, 9 aa, Giardia lamblia
SSRRTSGYY

SEQ ID NO: 3140079 - protein, 9 aa, Giardia lamblia
SSRSATKAM

SEQ ID NO: 3140080 - protein, 7 aa, Giardia lamblia
SSRSDYE

SEQ ID NO: 3140081 - protein, 6 aa, Giardia lamblia
SSRSED

SEQ ID NO: 3140082 - protein, 5 aa, Giardia lamblia
SSRSG

SEQ ID NO: 3140083 - protein, 10 aa, Giardia lamblia
SSRSKEVESG

SEQ ID NO: 3140084 - protein, 9 aa, Giardia lamblia
SSRSPEEPN

SEQ ID NO: 3140085 - protein, 11 aa, Giardia lamblia
SSRSSAPGSTA

SEQ ID NO: 3140086 - protein, 9 aa, Giardia lamblia
SSRSSKSRL

SEQ ID NO: 3140087 - protein, 10 aa, Giardia lamblia
SSRSTDHDAV

SEQ ID NO: 3140088 - protein, 15 aa, Giardia lamblia
SSRTADGEHEASRRM

SEQ ID NO: 3140089 - protein, 7 aa, Giardia lamblia
SSRTASL

SEQ ID NO: 3140090 - protein, 11 aa, Giardia lamblia
SSRTDETPDAA

SEQ ID NO: 3140091 - protein, 8 aa, Giardia lamblia
SSRTGGEI

SEQ ID NO: 3140092 - protein, 8 aa, Giardia lamblia
SSRTPVAQ

SEQ ID NO: 3140093 - protein, 18 aa, Giardia lamblia
SSRTQTLDKKNVPGPGAY

SEQ ID NO: 3140094 - protein, 7 aa, Giardia lamblia
SSRTRWD

SEQ ID NO: 3140095 - protein, 8 aa, Giardia lamblia
SSRVGEDR

SEQ ID NO: 3140096 - protein, 6 aa, Giardia lamblia
SSRVGS

SEQ ID NO: 3140097 - protein, 7 aa, Giardia lamblia
SSRVGTD

SEQ ID NO: 3140098 - protein, 8 aa, Giardia lamblia
SSRVPQLG

SEQ ID NO: 3140099 - protein, 6 aa, Giardia lamblia
SSRVSD

SEQ ID NO: 3140100 - protein, 13 aa, Giardia lamblia
SSRYTEALATVWK

SEQ ID NO: 3140101 - protein, 16 aa, Giardia lamblia
SSSAAKPSAKLSSYND

SEQ ID NO: 3140102 - protein, 11 aa, Giardia lamblia
SSSAAQGTGSS

SEQ ID NO: 3140103 - protein, 5 aa, Giardia lamblia
SSSAF

SEQ ID NO: 3140104 - protein, 6 aa, Giardia lamblia
SSSAKD

SEQ ID NO: 3140105 - protein, 8 aa, Giardia lamblia
SSSAKSSN

SEQ ID NO: 3140106 - protein, 8 aa, Giardia lamblia
SSSAPIDK

SEQ ID NO: 3140107 - protein, 5 aa, Giardia lamblia
SSSAV

SEQ ID NO: 3140108 - protein, 4 aa, Giardia lamblia
SSSD

SEQ ID NO: 3140109 - protein, 5 aa, Giardia lamblia
SSSDG

SEQ ID NO: 3140110 - protein, 10 aa, Giardia lamblia
SSSDHDDRAV

SEQ ID NO: 3140111 - protein, 5 aa, Giardia lamblia
SSSDS

SEQ ID NO: 3140112 - protein, 9 aa, Giardia lamblia
SSSDYKETL

SEQ ID NO: 3140113 - protein, 10 aa, Giardia lamblia
SSSEEDLGEQ

SEQ ID NO: 3140114 - protein, 15 aa, Giardia lamblia
SSSEEESSDYYSSDE

SEQ ID NO: 3140115 - protein, 8 aa, Giardia lamblia
SSSEEVRS

SEQ ID NO: 3140116 - protein, 12 aa, Giardia lamblia
SSSEPDVKNPKR

SEQ ID NO: 3140117 - protein, 9 aa, Giardia lamblia
SSSFETAGG

SEQ ID NO: 3140118 - protein, 4 aa, Giardia lamblia
SSSG

SEQ ID NO: 3140119 - protein, 24 aa, Giardia lamblia
SSSGDNNSINNSVGERSEANRAPA

SEQ ID NO: 3140120 - protein, 12 aa, Giardia lamblia
SSSGGDSTGTFN

SEQ ID NO: 3140121 - protein, 11 aa, Giardia lamblia
SSSGMATENGE

SEQ ID NO: 3140122 - protein, 28 aa, Giardia lamblia
SSSGRDSSFSRPRSTSTKIQPPRISSQP

SEQ ID NO: 3140123 - protein, 14 aa, Giardia lamblia
SSSGRQDTFQETSK

SEQ ID NO: 3140124 - protein, 7 aa, Giardia lamblia
SSSGSAL

SEQ ID NO: 3140125 - protein, 19 aa, Giardia lamblia
SSSGTVKKIRPKTAPKPEK

SEQ ID NO: 3140126 - protein, 10 aa, Giardia lamblia
SSSIGEASTE

SEQ ID NO: 3140127 - protein, 16 aa, Giardia lamblia
SSSIHGSRISGPLPPE

SEQ ID NO: 3140128 - protein, 5 aa, Giardia lamblia
SSSIK

SEQ ID NO: 3140129 - protein, 6 aa, Giardia lamblia
SSSINY

SEQ ID NO: 3140130 - protein, 14 aa, Giardia lamblia
SSSIPGDSSLQTQP

SEQ ID NO: 3140131 - protein, 7 aa, Giardia lamblia
SSSIQNK

SEQ ID NO: 3140132 - protein, 18 aa, Giardia lamblia
SSSISSSMRHSSTDGIDP

SEQ ID NO: 3140133 - protein, 13 aa, Giardia lamblia
SSSITESTAPHLS

SEQ ID NO: 3140134 - protein, 19 aa, Giardia lamblia
SSSKGSEFHEASAESSDLR

SEQ ID NO: 3140135 - protein, 16 aa, Giardia lamblia
SSSKLGSKKDRDRSIT

SEQ ID NO: 3140136 - protein, 16 aa, Giardia lamblia
SSSKPECTPTRPLSTS

SEQ ID NO: 3140137 - protein, 37 aa, Giardia lamblia
SSSKRTDGLTKERVKASRRSRSNSANMKSHSPLATGK

SEQ ID NO: 3140138 - protein, 9 aa, Giardia lamblia
SSSKSQQIA

SEQ ID NO: 3140139 - protein, 14 aa, Giardia lamblia
SSSLEEARQANPEV

SEQ ID NO: 3140140 - protein, 9 aa, Giardia lamblia
SSSLRSEAT

SEQ ID NO: 3140141 - protein, 8 aa, Giardia lamblia
SSSLTSEE

SEQ ID NO: 3140142 - protein, 7 aa, Giardia lamblia
SSSMSVG

SEQ ID NO: 3140143 - protein, 8 aa, Giardia lamblia
SSSNADYN

SEQ ID NO: 3140144 - protein, 7 aa, Giardia lamblia
SSSNAEI

SEQ ID NO: 3140145 - protein, 13 aa, Giardia lamblia
SSSNDNTESTPTI

SEQ ID NO: 3140146 - protein, 15 aa, Giardia lamblia
SSSNGSMAPTNTSMA

SEQ ID NO: 3140147 - protein, 8 aa, Giardia lamblia
SSSNGTYP

SEQ ID NO: 3140148 - protein, 9 aa, Giardia lamblia
SSSNLLSSS

SEQ ID NO: 3140149 - protein, 6 aa, Giardia lamblia
SSSNSF

SEQ ID NO: 3140150 - protein, 15 aa, Giardia lamblia
SSSNSLVPPKTALET

SEQ ID NO: 3140151 - protein, 5 aa, Giardia lamblia
SSSPA

SEQ ID NO: 3140152 - protein, 8 aa, Giardia lamblia
SSSPDDIL

SEQ ID NO: 3140153 - protein, 8 aa, Giardia lamblia
SSSPDLKT

SEQ ID NO: 3140154 - protein, 5 aa, Giardia lamblia
SSSPE

SEQ ID NO: 3140155 - protein, 8 aa, Giardia lamblia
SSSPIAPA

SEQ ID NO: 3140156 - protein, 6 aa, Giardia lamblia
SSSPMT

SEQ ID NO: 3140157 - protein, 19 aa, Giardia lamblia
SSSPPPSSLGENDYYPSGA

SEQ ID NO: 3140158 - protein, 18 aa, Giardia lamblia
SSSPSLPPTPSERPQTSK

SEQ ID NO: 3140159 - protein, 8 aa, Giardia lamblia
SSSPSPVS

SEQ ID NO: 3140160 - protein, 15 aa, Giardia lamblia
SSSQDRQSGNQSPDH

SEQ ID NO: 3140161 - protein, 14 aa, Giardia lamblia
SSSQLQSKERELER

SEQ ID NO: 3140162 - protein, 9 aa, Giardia lamblia
SSSQRGDVG

SEQ ID NO: 3140163 - protein, 22 aa, Giardia lamblia
SSSQYTTGPMSTSRSSRSASRQ

SEQ ID NO: 3140164 - protein, 9 aa, Giardia lamblia
SSSRDDPEG

SEQ ID NO: 3140165 - protein, 41 aa, Giardia lamblia
SSSRESPKTSVQSRRSSPTATGIPSSSHLRKTSPSGTPQLT

SEQ ID NO: 3140166 - protein, 6 aa, Giardia lamblia
SSSRLG

SEQ ID NO: 3140167 - protein, 5 aa, Giardia lamblia
SSSRS

SEQ ID NO: 3140168 - protein, 13 aa, Giardia lamblia
SSSRSSIVRRLLL

SEQ ID NO: 3140169 - protein, 7 aa, Giardia lamblia
SSSRTYD

SEQ ID NO: 3140170 - protein, 7 aa, Giardia lamblia
SSSSDKG

SEQ ID NO: 3140171 - protein, 25 aa, Giardia lamblia
SSSSGPPKTTSARRMSSTSTNSTLA

SEQ ID NO: 3140172 - protein, 9 aa, Giardia lamblia
SSSSPATSI

SEQ ID NO: 3140173 - protein, 9 aa, Giardia lamblia
SSSSPWNTS

SEQ ID NO: 3140174 - protein, 20 aa, Giardia lamblia
SSSSQSKLSDHSSASDPHAN

SEQ ID NO: 3140175 - protein, 12 aa, Giardia lamblia
SSSSRAKTTEPT

SEQ ID NO: 3140176 - protein, 9 aa, Giardia lamblia
SSSSRGAGA

SEQ ID NO: 3140177 - protein, 7 aa, Giardia lamblia
SSSSRNA

SEQ ID NO: 3140178 - protein, 10 aa, Giardia lamblia
SSSSRSRVPT

SEQ ID NO: 3140179 - protein, 13 aa, Giardia lamblia
SSSSSSDAETEFG

SEQ ID NO: 3140180 - protein, 10 aa, Giardia lamblia
SSSSTGDLEP

SEQ ID NO: 3140181 - protein, 7 aa, Giardia lamblia
SSSSTRI

SEQ ID NO: 3140182 - protein, 11 aa, Giardia lamblia
SSSSYTPTYAN

SEQ ID NO: 3140183 - protein, 4 aa, Giardia lamblia
SSST

SEQ ID NO: 3140184 - protein, 6 aa, Giardia lamblia
SSSTAD

SEQ ID NO: 3140185 - protein, 6 aa, Giardia lamblia
SSSTDQ

SEQ ID NO: 3140186 - protein, 49 aa, Giardia lamblia
SSSTFGDSSLYPSGGGVDLSSGRGSRMGSRSSSTAMGRRNVKSTKITRS

SEQ ID NO: 3140187 - protein, 8 aa, Giardia lamblia
SSSTGKSA

SEQ ID NO: 3140188 - protein, 9 aa, Giardia lamblia
SSSTGNSKM

SEQ ID NO: 3140189 - protein, 8 aa, Giardia lamblia
SSSTHKGS

SEQ ID NO: 3140190 - protein, 8 aa, Giardia lamblia
SSSTKSNV

SEQ ID NO: 3140191 - protein, 8 aa, Giardia lamblia
SSSTNGLI

SEQ ID NO: 3140192 - protein, 8 aa, Giardia lamblia
SSSTSLEP

SEQ ID NO: 3140193 - protein, 8 aa, Giardia lamblia
SSSTSMQE

SEQ ID NO: 3140194 - protein, 9 aa, Giardia lamblia
SSSTSPSPE

SEQ ID NO: 3140195 - protein, 8 aa, Giardia lamblia
SSSTTSVI

SEQ ID NO: 3140196 - protein, 8 aa, Giardia lamblia
SSSVPKDV

SEQ ID NO: 3140197 - protein, 5 aa, Giardia lamblia
SSSVR

SEQ ID NO: 3140198 - protein, 42 aa, Giardia lamblia
SSSVSTGANRAASALSSVGTATAAGASGLGTTSMHTSPRSIN

SEQ ID NO: 3140199 - protein, 5 aa, Giardia lamblia
SSSWT

SEQ ID NO: 3140200 - protein, 11 aa, Giardia lamblia
SSSYANYEGPT

SEQ ID NO: 3140201 - protein, 11 aa, Giardia lamblia
SSSYSDSTDCE

SEQ ID NO: 3140202 - protein, 23 aa, Giardia lamblia
SSTAASQGSAAAAASQALPDNLS

SEQ ID NO: 3140203 - protein, 5 aa, Giardia lamblia
SSTAE

SEQ ID NO: 3140204 - protein, 15 aa, Giardia lamblia
SSTAETNERTELTPS

SEQ ID NO: 3140205 - protein, 5 aa, Giardia lamblia
SSTAL

SEQ ID NO: 3140206 - protein, 9 aa, Giardia lamblia
SSTASSIGP

SEQ ID NO: 3140207 - protein, 16 aa, Giardia lamblia
SSTCTARARDARSPET

SEQ ID NO: 3140208 - protein, 6 aa, Giardia lamblia
SSTDAL

SEQ ID NO: 3140209 - protein, 10 aa, Giardia lamblia
SSTDDDISKT

SEQ ID NO: 3140210 - protein, 46 aa, Giardia lamblia
SSTDEGQNSTESNEKRETSTPGEDAEHVSESKQIKQGKEQEPTRVT

SEQ ID NO: 3140211 - protein, 7 aa, Giardia lamblia
SSTDPTL

SEQ ID NO: 3140212 - protein, 7 aa, Giardia lamblia
SSTDYSG

SEQ ID NO: 3140213 - protein, 12 aa, Giardia lamblia
SSTENAASQALG

SEQ ID NO: 3140214 - protein, 9 aa, Giardia lamblia
SSTEPKINT

SEQ ID NO: 3140215 - protein, 8 aa, Giardia lamblia
SSTESLPE

SEQ ID NO: 3140216 - protein, 11 aa, Giardia lamblia
SSTGAGAGAGS

SEQ ID NO: 3140217 - protein, 19 aa, Giardia lamblia
SSTGALIGGTHDGKLYAFF

SEQ ID NO: 3140218 - protein, 9 aa, Giardia lamblia
SSTGEHETA

SEQ ID NO: 3140219 - protein, 7 aa, Giardia lamblia
SSTGKNL

SEQ ID NO: 3140220 - protein, 13 aa, Giardia lamblia
SSTGRTASELEKE

SEQ ID NO: 3140221 - protein, 13 aa, Giardia lamblia
SSTGTPTILSPES

SEQ ID NO: 3140222 - protein, 9 aa, Giardia lamblia
SSTGTVYSG

SEQ ID NO: 3140223 - protein, 14 aa, Giardia lamblia
SSTGWRSTAQRPTH

SEQ ID NO: 3140224 - protein, 4 aa, Giardia lamblia
SSTI

SEQ ID NO: 3140225 - protein, 19 aa, Giardia lamblia
SSTIAKPGIAKRSRNRGNL

SEQ ID NO: 3140226 - protein, 14 aa, Giardia lamblia
SSTISNSLRGTTGA

SEQ ID NO: 3140227 - protein, 4 aa, Giardia lamblia
SSTK

SEQ ID NO: 3140228 - protein, 10 aa, Giardia lamblia
SSTKASQAPR

SEQ ID NO: 3140229 - protein, 24 aa, Giardia lamblia
SSTKCSSTMEQPCRETDGRRSSYV

SEQ ID NO: 3140230 - protein, 45 aa, Giardia lamblia
SSTKRKGPASRVASNRQAPSWPTQRLSGSRTQYSAKRKRQKPQRH

SEQ ID NO: 3140231 - protein, 12 aa, Giardia lamblia
SSTKSGKGKKRT

SEQ ID NO: 3140232 - protein, 8 aa, Giardia lamblia
SSTLQESQ

SEQ ID NO: 3140233 - protein, 24 aa, Giardia lamblia
SSTLQPPISVSPAKPNLGASSSQF

SEQ ID NO: 3140234 - protein, 6 aa, Giardia lamblia
SSTLRS

SEQ ID NO: 3140235 - protein, 8 aa, Giardia lamblia
SSTLTSSN

SEQ ID NO: 3140236 - protein, 7 aa, Giardia lamblia
SSTLTTD

SEQ ID NO: 3140237 - protein, 10 aa, Giardia lamblia
SSTNADINSA

SEQ ID NO: 3140238 - protein, 7 aa, Giardia lamblia
SSTPGYK

SEQ ID NO: 3140239 - protein, 14 aa, Giardia lamblia
SSTPKAAGASGSAL

SEQ ID NO: 3140240 - protein, 5 aa, Giardia lamblia
SSTPM

SEQ ID NO: 3140241 - protein, 8 aa, Giardia lamblia
SSTPTTDQ

SEQ ID NO: 3140242 - protein, 7 aa, Giardia lamblia
SSTPYQT

SEQ ID NO: 3140243 - protein, 4 aa, Giardia lamblia
SSTQ

SEQ ID NO: 3140244 - protein, 40 aa, Giardia lamblia
SSTQAERGTRPELSPAGVTNTKGSDTPSGADSDEQQEADL

SEQ ID NO: 3140245 - protein, 14 aa, Giardia lamblia
SSTQARMTTPTGQT

SEQ ID NO: 3140246 - protein, 34 aa, Giardia lamblia
SSTQATEHSTALSSSSTVLPSQQHQTRSPSISME

SEQ ID NO: 3140247 - protein, 9 aa, Giardia lamblia
SSTQELKDS

SEQ ID NO: 3140248 - protein, 8 aa, Giardia lamblia
SSTQPNDA

SEQ ID NO: 3140249 - protein, 5 aa, Giardia lamblia
SSTQT

SEQ ID NO: 3140250 - protein, 10 aa, Giardia lamblia
SSTRLSTTTL

SEQ ID NO: 3140251 - protein, 31 aa, Giardia lamblia
SSTRSFPPPADNTLRSTTALSTSALSTSTDL

SEQ ID NO: 3140252 - protein, 8 aa, Giardia lamblia
SSTRTTTM

SEQ ID NO: 3140253 - protein, 13 aa, Giardia lamblia
SSTRVSTAAHSQV

SEQ ID NO: 3140254 - protein, 5 aa, Giardia lamblia
SSTSD

SEQ ID NO: 3140255 - protein, 7 aa, Giardia lamblia
SSTSDRM

SEQ ID NO: 3140256 - protein, 9 aa, Giardia lamblia
SSTSGGDKY

SEQ ID NO: 3140257 - protein, 20 aa, Giardia lamblia
SSTSHLSQGNSARVCPGGNL

SEQ ID NO: 3140258 - protein, 6 aa, Giardia lamblia
SSTSNM

SEQ ID NO: 3140259 - protein, 8 aa, Giardia lamblia
SSTSPESQ

SEQ ID NO: 3140260 - protein, 10 aa, Giardia lamblia
SSTSSLRDDS

SEQ ID NO: 3140261 - protein, 6 aa, Giardia lamblia
SSTTAQ

SEQ ID NO: 3140262 - protein, 7 aa, Giardia lamblia
SSTTCTY

SEQ ID NO: 3140263 - protein, 22 aa, Giardia lamblia
SSTTPEEKNRASAHNTNSPHRS

SEQ ID NO: 3140264 - protein, 8 aa, Giardia lamblia
SSTTPQLG

SEQ ID NO: 3140265 - protein, 16 aa, Giardia lamblia
SSTTQHSGETETETEY

SEQ ID NO: 3140266 - protein, 6 aa, Giardia lamblia
SSTTTG

SEQ ID NO: 3140267 - protein, 7 aa, Giardia lamblia
SSTTVSR

SEQ ID NO: 3140268 - protein, 5 aa, Giardia lamblia
SSTVG

SEQ ID NO: 3140269 - protein, 6 aa, Giardia lamblia
SSTVSP

SEQ ID NO: 3140270 - protein, 7 aa, Giardia lamblia
SSTVTRP

SEQ ID NO: 3140271 - protein, 13 aa, Giardia lamblia
SSTVVAQQEQPYA

SEQ ID NO: 3140272 - protein, 16 aa, Giardia lamblia
SSTYSQPPPPAPNPRS

SEQ ID NO: 3140273 - protein, 6 aa, Giardia lamblia
SSVADT

SEQ ID NO: 3140274 - protein, 12 aa, Giardia lamblia
SSVATTRPMPTP

SEQ ID NO: 3140275 - protein, 27 aa, Giardia lamblia
SSVDATSDAVGSTSEALSQSVQDSDRP

SEQ ID NO: 3140276 - protein, 7 aa, Giardia lamblia
SSVDDKQ

SEQ ID NO: 3140277 - protein, 9 aa, Giardia lamblia
SSVDSTLKP

SEQ ID NO: 3140278 - protein, 14 aa, Giardia lamblia
SSVENKEKEQGVPQ

SEQ ID NO: 3140279 - protein, 22 aa, Giardia lamblia
SSVGSGSATKQQLRESIPSQPA

SEQ ID NO: 3140280 - protein, 8 aa, Giardia lamblia
SSVGTDVE

SEQ ID NO: 3140281 - protein, 16 aa, Giardia lamblia
SSVKSREGFTSSTKTQ

SEQ ID NO: 3140282 - protein, 6 aa, Giardia lamblia
SSVNSY

SEQ ID NO: 3140283 - protein, 4 aa, Giardia lamblia
SSVP

SEQ ID NO: 3140284 - protein, 8 aa, Giardia lamblia
SSVPKERV

SEQ ID NO: 3140285 - protein, 13 aa, Giardia lamblia
SSVPNGDSMSESE

SEQ ID NO: 3140286 - protein, 25 aa, Giardia lamblia
SSVPSDDQKVSKQPDPRTNQGSMPR

SEQ ID NO: 3140287 - protein, 15 aa, Giardia lamblia
SSVQEGSSKMGPLKG

SEQ ID NO: 3140288 - protein, 45 aa, Giardia lamblia
SSVQPGGTVSSSLTADSTVRSSSAKSSLHHRDPHEGLQSTYTPNR

SEQ ID NO: 3140289 - protein, 4 aa, Giardia lamblia
SSVR

SEQ ID NO: 3140290 - protein, 19 aa, Giardia lamblia
SSVRSTSGSVDPAKLATNL

SEQ ID NO: 3140291 - protein, 11 aa, Giardia lamblia
SSVRTTNKAGV

SEQ ID NO: 3140292 - protein, 5 aa, Giardia lamblia
SSVSG

SEQ ID NO: 3140293 - protein, 12 aa, Giardia lamblia
SSVSQSSNHDGN

SEQ ID NO: 3140294 - protein, 6 aa, Giardia lamblia
SSVSRD

SEQ ID NO: 3140295 - protein, 9 aa, Giardia lamblia
SSVSSKEEV

SEQ ID NO: 3140296 - protein, 21 aa, Giardia lamblia
SSVTNPPYNKRCDEASESFAK

SEQ ID NO: 3140297 - protein, 9 aa, Giardia lamblia
SSVTSDNNE

SEQ ID NO: 3140298 - protein, 4 aa, Giardia lamblia
SSVV

SEQ ID NO: 3140299 - protein, 7 aa, Giardia lamblia
SSYASER

SEQ ID NO: 3140300 - protein, 15 aa, Giardia lamblia
SSYEPPRSYSSYVPQ

SEQ ID NO: 3140301 - protein, 27 aa, Giardia lamblia
SSYGVTPKGHRADEAKESKDSTALPST

SEQ ID NO: 3140302 - protein, 21 aa, Giardia lamblia
SSYKAYDPKVPVSPTPNPLSA

SEQ ID NO: 3140303 - protein, 12 aa, Giardia lamblia
SSYNEGPASNDF

SEQ ID NO: 3140304 - protein, 19 aa, Giardia lamblia
SSYNRRPNASVTTDDDARV

SEQ ID NO: 3140305 - protein, 14 aa, Giardia lamblia
SSYPANSVPNPTKH

SEQ ID NO: 3140306 - protein, 6 aa, Giardia lamblia
SSYPSI

SEQ ID NO: 3140307 - protein, 7 aa, Giardia lamblia
SSYQKTS

SEQ ID NO: 3140308 - protein, 7 aa, Giardia lamblia
SSYSAKN

SEQ ID NO: 3140309 - protein, 5 aa, Giardia lamblia
SSYSP

SEQ ID NO: 3140310 - protein, 22 aa, Giardia lamblia
SSYSSAPSSSSSTSVSSRTISS

SEQ ID NO: 3140311 - protein, 23 aa, Giardia lamblia
SSYSSPCPPASRSVKSPHPNQNM

SEQ ID NO: 3140312 - protein, 9 aa, Giardia lamblia
SSYSSYSSY

SEQ ID NO: 3140313 - protein, 4 aa, Giardia lamblia
SSYT

SEQ ID NO: 3140314 - protein, 5 aa, Giardia lamblia
SSYTD

SEQ ID NO: 3140315 - protein, 5 aa, Giardia lamblia
SSYVE

SEQ ID NO: 3140316 - protein, 6 aa, Giardia lamblia
SSYYSS

SEQ ID NO: 3140317 - protein, 4 aa, Giardia lamblia
STAA

SEQ ID NO: 3140318 - protein, 8 aa, Giardia lamblia
STAAEERC

SEQ ID NO: 3140319 - protein, 7 aa, Giardia lamblia
STAAPGE

SEQ ID NO: 3140320 - protein, 23 aa, Giardia lamblia
STAASGRSCNNIGHSSKLDKRSS

SEQ ID NO: 3140321 - protein, 18 aa, Giardia lamblia
STADALQAGISDPSLTNS

SEQ ID NO: 3140322 - protein, 8 aa, Giardia lamblia
STADAPHA

SEQ ID NO: 3140323 - protein, 22 aa, Giardia lamblia
STADAVKDSLDEVSASSKEQPY

SEQ ID NO: 3140324 - protein, 6 aa, Giardia lamblia
STADGD

SEQ ID NO: 3140325 - protein, 12 aa, Giardia lamblia
STADIDSNKYED

SEQ ID NO: 3140326 - protein, 10 aa, Giardia lamblia
STAEASETVI

SEQ ID NO: 3140327 - protein, 5 aa, Giardia lamblia
STAEI

SEQ ID NO: 3140328 - protein, 6 aa, Giardia lamblia
STAGDH

SEQ ID NO: 3140329 - protein, 6 aa, Giardia lamblia
STAGGN

SEQ ID NO: 3140330 - protein, 7 aa, Giardia lamblia
STAGGSI

SEQ ID NO: 3140331 - protein, 9 aa, Giardia lamblia
STAGSDPRF

SEQ ID NO: 3140332 - protein, 12 aa, Giardia lamblia
STAHDQFELANI

SEQ ID NO: 3140333 - protein, 9 aa, Giardia lamblia
STAKSIGPA

SEQ ID NO: 3140334 - protein, 52 aa, Giardia lamblia
STAKSKGKVPAKVRGASVKKTDGKSIRRKLSKEEARLRQQSQNKAKNLTKSM

SEQ ID NO: 3140335 - protein, 4 aa, Giardia lamblia
STAL

SEQ ID NO: 3140336 - protein, 10 aa, Giardia lamblia
STANNRKTDL

SEQ ID NO: 3140337 - protein, 13 aa, Giardia lamblia
STAPASVRRPNNP

SEQ ID NO: 3140338 - protein, 80 aa, Giardia lamblia
STAPPAPASISAPTSAQVPSIPSVPSVPQTKSSYLASSSSTFKTTTNPQVESPPAVPAPVPAPAPPVQSTQPKLPREPTY

SEQ ID NO: 3140339 - protein, 23 aa, Giardia lamblia
STAQPEASHVGTPSSLPITGASG

SEQ ID NO: 3140340 - protein, 10 aa, Giardia lamblia
STAQSKGASS

SEQ ID NO: 3140341 - protein, 8 aa, Giardia lamblia
STAQSRTI

SEQ ID NO: 3140342 - protein, 6 aa, Giardia lamblia
STAREE

SEQ ID NO: 3140343 - protein, 8 aa, Giardia lamblia
STARPSIE

SEQ ID NO: 3140344 - protein, 4 aa, Giardia lamblia
STAS

SEQ ID NO: 3140345 - protein, 8 aa, Giardia lamblia
STASARRI

SEQ ID NO: 3140346 - protein, 8 aa, Giardia lamblia
STASGPVE

SEQ ID NO: 3140347 - protein, 21 aa, Giardia lamblia
STATDDKANTNSVTSSAVDDT

SEQ ID NO: 3140348 - protein, 11 aa, Giardia lamblia
STATKDTLDDS

SEQ ID NO: 3140349 - protein, 6 aa, Giardia lamblia
STATPF

SEQ ID NO: 3140350 - protein, 6 aa, Giardia lamblia
STATPV

SEQ ID NO: 3140351 - protein, 17 aa, Giardia lamblia
STATRAKVNMEKSDSSD

SEQ ID NO: 3140352 - protein, 6 aa, Giardia lamblia
STATRL

SEQ ID NO: 3140353 - protein, 9 aa, Giardia lamblia
STAYNKDEV

SEQ ID NO: 3140354 - protein, 8 aa, Giardia lamblia
STCPENSQ

SEQ ID NO: 3140355 - protein, 6 aa, Giardia lamblia
STCQQP

SEQ ID NO: 3140356 - protein, 9 aa, Giardia lamblia
STDAGNPKY

SEQ ID NO: 3140357 - protein, 4 aa, Giardia lamblia
STDD

SEQ ID NO: 3140358 - protein, 5 aa, Giardia lamblia
STDDI

SEQ ID NO: 3140359 - protein, 19 aa, Giardia lamblia
STDDNTEEATSEHSFPGSV

SEQ ID NO: 3140360 - protein, 6 aa, Giardia lamblia
STDDPD

SEQ ID NO: 3140361 - protein, 5 aa, Giardia lamblia
STDDV

SEQ ID NO: 3140362 - protein, 4 aa, Giardia lamblia
STDE

SEQ ID NO: 3140363 - protein, 10 aa, Giardia lamblia
STDENATSIR

SEQ ID NO: 3140364 - protein, 7 aa, Giardia lamblia
STDEREI

SEQ ID NO: 3140365 - protein, 7 aa, Giardia lamblia
STDESAK

SEQ ID NO: 3140366 - protein, 10 aa, Giardia lamblia
STDEVETRHR

SEQ ID NO: 3140367 - protein, 4 aa, Giardia lamblia
STDG

SEQ ID NO: 3140368 - protein, 8 aa, Giardia lamblia
STDGFNGA

SEQ ID NO: 3140369 - protein, 7 aa, Giardia lamblia
STDIDGN

SEQ ID NO: 3140370 - protein, 16 aa, Giardia lamblia
STDIPPKPGSSEGPIE

SEQ ID NO: 3140371 - protein, 11 aa, Giardia lamblia
STDKAHGSPIQ

SEQ ID NO: 3140372 - protein, 18 aa, Giardia lamblia
STDKESGTNTKTTKTNYA

SEQ ID NO: 3140373 - protein, 8 aa, Giardia lamblia
STDKLGRT

SEQ ID NO: 3140374 - protein, 10 aa, Giardia lamblia
STDKYTADRT

SEQ ID NO: 3140375 - protein, 7 aa, Giardia lamblia
STDLETR

SEQ ID NO: 3140376 - protein, 9 aa, Giardia lamblia
STDLKGSPI

SEQ ID NO: 3140377 - protein, 8 aa, Giardia lamblia
STDNNADR

SEQ ID NO: 3140378 - protein, 8 aa, Giardia lamblia
STDNPRAA

SEQ ID NO: 3140379 - protein, 4 aa, Giardia lamblia
STDP

SEQ ID NO: 3140380 - protein, 13 aa, Giardia lamblia
STDPKKSSIIPPG

SEQ ID NO: 3140381 - protein, 9 aa, Giardia lamblia
STDPNGKTT

SEQ ID NO: 3140382 - protein, 6 aa, Giardia lamblia
STDPQD

SEQ ID NO: 3140383 - protein, 5 aa, Giardia lamblia
STDPR

SEQ ID NO: 3140384 - protein, 9 aa, Giardia lamblia
STDPSNENQ

SEQ ID NO: 3140385 - protein, 7 aa, Giardia lamblia
STDQDTR

SEQ ID NO: 3140386 - protein, 11 aa, Giardia lamblia
STDQHESQSSP

SEQ ID NO: 3140387 - protein, 37 aa, Giardia lamblia
STDQRPANLDDPIAESNTSSPSTPSHVDSRKKTSTIK

SEQ ID NO: 3140388 - protein, 9 aa, Giardia lamblia
STDSGGGIS

SEQ ID NO: 3140389 - protein, 7 aa, Giardia lamblia
STDSQAM

SEQ ID NO: 3140390 - protein, 10 aa, Giardia lamblia
STDSQTQEAA

SEQ ID NO: 3140391 - protein, 8 aa, Giardia lamblia
STDSSNTG

SEQ ID NO: 3140392 - protein, 7 aa, Giardia lamblia
STDSTSF

SEQ ID NO: 3140393 - protein, 10 aa, Giardia lamblia
STDTSQGKGQ

SEQ ID NO: 3140394 - protein, 20 aa, Giardia lamblia
STDVSEPRAITPNPEPEQLS

SEQ ID NO: 3140395 - protein, 7 aa, Giardia lamblia
STDYNPD

SEQ ID NO: 3140396 - protein, 9 aa, Giardia lamblia
STDYRSSMD

SEQ ID NO: 3140397 - protein, 7 aa, Giardia lamblia
STEAANE

SEQ ID NO: 3140398 - protein, 7 aa, Giardia lamblia
STEAEQR

SEQ ID NO: 3140399 - protein, 9 aa, Giardia lamblia
STEASSEQY

SEQ ID NO: 3140400 - protein, 7 aa, Giardia lamblia
STEASSK

SEQ ID NO: 3140401 - protein, 6 aa, Giardia lamblia
STEAVD

SEQ ID NO: 3140402 - protein, 22 aa, Giardia lamblia
STEDTSPGRHRSTSSMPDSKDE

SEQ ID NO: 3140403 - protein, 22 aa, Giardia lamblia
STEEGAAAMATAAKSKKAMKTT

SEQ ID NO: 3140404 - protein, 6 aa, Giardia lamblia
STEEPS

SEQ ID NO: 3140405 - protein, 7 aa, Giardia lamblia
STEERKQ

SEQ ID NO: 3140406 - protein, 5 aa, Giardia lamblia
STEGL

SEQ ID NO: 3140407 - protein, 6 aa, Giardia lamblia
STEGRA

SEQ ID NO: 3140408 - protein, 5 aa, Giardia lamblia
STEGT

SEQ ID NO: 3140409 - protein, 7 aa, Giardia lamblia
STEGVSH

SEQ ID NO: 3140410 - protein, 12 aa, Giardia lamblia
STEHHREDTNTA

SEQ ID NO: 3140411 - protein, 6 aa, Giardia lamblia
STEIEK

SEQ ID NO: 3140412 - protein, 5 aa, Giardia lamblia
STEKA

SEQ ID NO: 3140413 - protein, 9 aa, Giardia lamblia
STEKEARGL

SEQ ID NO: 3140414 - protein, 23 aa, Giardia lamblia
STEKNNESKERSVCESSADPRRA

SEQ ID NO: 3140415 - protein, 36 aa, Giardia lamblia
STEKRSAELDDLSSEESDTEGQGPDDVKSTAKKRDV

SEQ ID NO: 3140416 - protein, 8 aa, Giardia lamblia
STEKYTEA

SEQ ID NO: 3140417 - protein, 4 aa, Giardia lamblia
STEL

SEQ ID NO: 3140418 - protein, 5 aa, Giardia lamblia
STENA

SEQ ID NO: 3140419 - protein, 5 aa, Giardia lamblia
STENN

SEQ ID NO: 3140420 - protein, 7 aa, Giardia lamblia
STENPAT

SEQ ID NO: 3140421 - protein, 20 aa, Giardia lamblia
STENQSTTEEVDKDNTFPVT

SEQ ID NO: 3140422 - protein, 10 aa, Giardia lamblia
STENYESPEQ

SEQ ID NO: 3140423 - protein, 15 aa, Giardia lamblia
STEPATERTTPDPQA

SEQ ID NO: 3140424 - protein, 15 aa, Giardia lamblia
STEPGTFARFLEEIS

SEQ ID NO: 3140425 - protein, 6 aa, Giardia lamblia
STEPQG

SEQ ID NO: 3140426 - protein, 7 aa, Giardia lamblia
STERDCD

SEQ ID NO: 3140427 - protein, 19 aa, Giardia lamblia
STESGTSDDGLCKQPVETQ

SEQ ID NO: 3140428 - protein, 25 aa, Giardia lamblia
STESLNANQVTAPEPSSAYTQGNTI

SEQ ID NO: 3140429 - protein, 5 aa, Giardia lamblia
STESS

SEQ ID NO: 3140430 - protein, 8 aa, Giardia lamblia
STESSLKQ

SEQ ID NO: 3140431 - protein, 11 aa, Giardia lamblia
STESVDISDAQ

SEQ ID NO: 3140432 - protein, 5 aa, Giardia lamblia
STETE

SEQ ID NO: 3140433 - protein, 6 aa, Giardia lamblia
STETRE

SEQ ID NO: 3140434 - protein, 9 aa, Giardia lamblia
STETSAPGQ

SEQ ID NO: 3140435 - protein, 7 aa, Giardia lamblia
STETTGP

SEQ ID NO: 3140436 - protein, 14 aa, Giardia lamblia
STETTPPTSWGDSP

SEQ ID NO: 3140437 - protein, 4 aa, Giardia lamblia
STEY

SEQ ID NO: 3140438 - protein, 6 aa, Giardia lamblia
STEYNS

SEQ ID NO: 3140439 - protein, 18 aa, Giardia lamblia
STFRPLPPSAHSGTHGYR

SEQ ID NO: 3140440 - protein, 11 aa, Giardia lamblia
STFRPTPTYPA

SEQ ID NO: 3140441 - protein, 6 aa, Giardia lamblia
STFTEK

SEQ ID NO: 3140442 - protein, 31 aa, Giardia lamblia
STFYQSDGKRAEDYATESNANDAQAALEGKT

SEQ ID NO: 3140443 - protein, 4 aa, Giardia lamblia
STGA

SEQ ID NO: 3140444 - protein, 9 aa, Giardia lamblia
STGAAVSNR

SEQ ID NO: 3140445 - protein, 6 aa, Giardia lamblia
STGAEP

SEQ ID NO: 3140446 - protein, 5 aa, Giardia lamblia
STGAK

SEQ ID NO: 3140447 - protein, 10 aa, Giardia lamblia
STGASLAGAG

SEQ ID NO: 3140448 - protein, 12 aa, Giardia lamblia
STGATKPGQATL

SEQ ID NO: 3140449 - protein, 6 aa, Giardia lamblia
STGATL

SEQ ID NO: 3140450 - protein, 56 aa, Giardia lamblia
STGATSPHSAQLNSSDTLLGSQSSVAESIEKQRRSRGPSGSVRSRSSHITSRSGAR

SEQ ID NO: 3140451 - protein, 5 aa, Giardia lamblia
STGAV

SEQ ID NO: 3140452 - protein, 17 aa, Giardia lamblia
STGDCPPTSKDSDCTEA

SEQ ID NO: 3140453 - protein, 6 aa, Giardia lamblia
STGEPL

SEQ ID NO: 3140454 - protein, 13 aa, Giardia lamblia
STGESSKTFSPEV

SEQ ID NO: 3140455 - protein, 6 aa, Giardia lamblia
STGESV

SEQ ID NO: 3140456 - protein, 8 aa, Giardia lamblia
STGETSAT

SEQ ID NO: 3140457 - protein, 10 aa, Giardia lamblia
STGGSSTEVQ

SEQ ID NO: 3140458 - protein, 50 aa, Giardia lamblia
STGHRPESKYSATNESTYSRSNYATSALDGNEWAPARGPRKIEKSDDHKY

SEQ ID NO: 3140459 - protein, 6 aa, Giardia lamblia
STGIER

SEQ ID NO: 3140460 - protein, 10 aa, Giardia lamblia
STGKSTRDYD

SEQ ID NO: 3140461 - protein, 8 aa, Giardia lamblia
STGKTLHE

SEQ ID NO: 3140462 - protein, 15 aa, Giardia lamblia
STGLGKGKSSVGGCG

SEQ ID NO: 3140463 - protein, 12 aa, Giardia lamblia
STGLSDTYRSSD

SEQ ID NO: 3140464 - protein, 9 aa, Giardia lamblia
STGMSSYSS

SEQ ID NO: 3140465 - protein, 4 aa, Giardia lamblia
STGN

SEQ ID NO: 3140466 - protein, 19 aa, Giardia lamblia
STGPFATNHSNVNKVSTTT

SEQ ID NO: 3140467 - protein, 6 aa, Giardia lamblia
STGPGL

SEQ ID NO: 3140468 - protein, 10 aa, Giardia lamblia
STGPSTAGAL

SEQ ID NO: 3140469 - protein, 13 aa, Giardia lamblia
STGQLSATPENIG

SEQ ID NO: 3140470 - protein, 9 aa, Giardia lamblia
STGQSPAPF

SEQ ID NO: 3140471 - protein, 6 aa, Giardia lamblia
STGRES

SEQ ID NO: 3140472 - protein, 9 aa, Giardia lamblia
STGSDGTAR

SEQ ID NO: 3140473 - protein, 6 aa, Giardia lamblia
STGSFG

SEQ ID NO: 3140474 - protein, 6 aa, Giardia lamblia
STGSGH

SEQ ID NO: 3140475 - protein, 11 aa, Giardia lamblia
STGSGKSTQLP

SEQ ID NO: 3140476 - protein, 51 aa, Giardia lamblia
STGSSLNKGSGSASNSTGSDDSDSSMSSYEYSNPEDEDDSCQGNTAFPSKW

SEQ ID NO: 3140477 - protein, 21 aa, Giardia lamblia
STGSYSSCEDGEYRVGDGRKV

SEQ ID NO: 3140478 - protein, 4 aa, Giardia lamblia
STGT

SEQ ID NO: 3140479 - protein, 5 aa, Giardia lamblia
STGTY

SEQ ID NO: 3140480 - protein, 7 aa, Giardia lamblia
STGVEEN

SEQ ID NO: 3140481 - protein, 24 aa, Giardia lamblia
STGWGSSTDADGRLGGETTNDPLP

SEQ ID NO: 3140482 - protein, 9 aa, Giardia lamblia
STHDLTEPE

SEQ ID NO: 3140483 - protein, 5 aa, Giardia lamblia
STHDN

SEQ ID NO: 3140484 - protein, 12 aa, Giardia lamblia
STHDPGPTYCTD

SEQ ID NO: 3140485 - protein, 7 aa, Giardia lamblia
STHEAKM

SEQ ID NO: 3140486 - protein, 6 aa, Giardia lamblia
STHGEE

SEQ ID NO: 3140487 - protein, 13 aa, Giardia lamblia
STHHSAGRKQQTG

SEQ ID NO: 3140488 - protein, 6 aa, Giardia lamblia
STHPGV

SEQ ID NO: 3140489 - protein, 8 aa, Giardia lamblia
STHPYDDS

SEQ ID NO: 3140490 - protein, 16 aa, Giardia lamblia
STHQGSAASNNKTTEC

SEQ ID NO: 3140491 - protein, 4 aa, Giardia lamblia
STHR

SEQ ID NO: 3140492 - protein, 4 aa, Giardia lamblia
STHT

SEQ ID NO: 3140493 - protein, 15 aa, Giardia lamblia
STHVNDSVSNRAGKG

SEQ ID NO: 3140494 - protein, 15 aa, Giardia lamblia
STIDRGYSNSFNPNE

SEQ ID NO: 3140495 - protein, 8 aa, Giardia lamblia
STIGDAPA

SEQ ID NO: 3140496 - protein, 5 aa, Giardia lamblia
STIGG

SEQ ID NO: 3140497 - protein, 11 aa, Giardia lamblia
STIGSKRRAKA

SEQ ID NO: 3140498 - protein, 5 aa, Giardia lamblia
STIKT

SEQ ID NO: 3140499 - protein, 10 aa, Giardia lamblia
STIPAKDEKA

SEQ ID NO: 3140500 - protein, 6 aa, Giardia lamblia
STIQPP

SEQ ID NO: 3140501 - protein, 6 aa, Giardia lamblia
STIQRS

SEQ ID NO: 3140502 - protein, 5 aa, Giardia lamblia
STIQS

SEQ ID NO: 3140503 - protein, 22 aa, Giardia lamblia
STIRSESRKEIDSLQSGQGEIQ

SEQ ID NO: 3140504 - protein, 5 aa, Giardia lamblia
STISS

SEQ ID NO: 3140505 - protein, 10 aa, Giardia lamblia
STITGSDDTN

SEQ ID NO: 3140506 - protein, 6 aa, Giardia lamblia
STITNG

SEQ ID NO: 3140507 - protein, 9 aa, Giardia lamblia
STITPADST

SEQ ID NO: 3140508 - protein, 5 aa, Giardia lamblia
STITS

SEQ ID NO: 3140509 - protein, 4 aa, Giardia lamblia
STIV

SEQ ID NO: 3140510 - protein, 5 aa, Giardia lamblia
STKAL

SEQ ID NO: 3140511 - protein, 5 aa, Giardia lamblia
STKAR

SEQ ID NO: 3140512 - protein, 8 aa, Giardia lamblia
STKAVRSA

SEQ ID NO: 3140513 - protein, 11 aa, Giardia lamblia
STKDMTSYTET

SEQ ID NO: 3140514 - protein, 9 aa, Giardia lamblia
STKDVDSTM

SEQ ID NO: 3140515 - protein, 7 aa, Giardia lamblia
STKEHRE

SEQ ID NO: 3140516 - protein, 7 aa, Giardia lamblia
STKEPTY

SEQ ID NO: 3140517 - protein, 11 aa, Giardia lamblia
STKERNTRLQT

SEQ ID NO: 3140518 - protein, 7 aa, Giardia lamblia
STKEVSD

SEQ ID NO: 3140519 - protein, 16 aa, Giardia lamblia
STKEYEDEQKQAREGA

SEQ ID NO: 3140520 - protein, 7 aa, Giardia lamblia
STKIGGT

SEQ ID NO: 3140521 - protein, 8 aa, Giardia lamblia
STKKARTF

SEQ ID NO: 3140522 - protein, 11 aa, Giardia lamblia
STKKEERGDEL

SEQ ID NO: 3140523 - protein, 4 aa, Giardia lamblia
STKL

SEQ ID NO: 3140524 - protein, 11 aa, Giardia lamblia
STKMDRRTGRD

SEQ ID NO: 3140525 - protein, 7 aa, Giardia lamblia
STKNPMN

SEQ ID NO: 3140526 - protein, 5 aa, Giardia lamblia
STKPG

SEQ ID NO: 3140527 - protein, 8 aa, Giardia lamblia
STKPSEIK

SEQ ID NO: 3140528 - protein, 75 aa, Giardia lamblia
STKQKASAAAVTAKAPLSGSRGPPSRSLGGVSGAGTRQKTVTSTAGVSSAKPKPVSAAGHGAVRAGSQQTAETIP

SEQ ID NO: 3140529 - protein, 10 aa, Giardia lamblia
STKRADYDAA

SEQ ID NO: 3140530 - protein, 12 aa, Giardia lamblia
STKSKDKRTSLD

SEQ ID NO: 3140531 - protein, 7 aa, Giardia lamblia
STKSPDM

SEQ ID NO: 3140532 - protein, 7 aa, Giardia lamblia
STKTSSH

SEQ ID NO: 3140533 - protein, 7 aa, Giardia lamblia
STKVTGM

SEQ ID NO: 3140534 - protein, 12 aa, Giardia lamblia
STLAPNQALAEQ

SEQ ID NO: 3140535 - protein, 4 aa, Giardia lamblia
STLD

SEQ ID NO: 3140536 - protein, 18 aa, Giardia lamblia
STLDAQGEPAQDAQPDIQ

SEQ ID NO: 3140537 - protein, 13 aa, Giardia lamblia
STLEGEPPKPVVA

SEQ ID NO: 3140538 - protein, 14 aa, Giardia lamblia
STLEQAKRATQDKI

SEQ ID NO: 3140539 - protein, 6 aa, Giardia lamblia
STLEQQ

SEQ ID NO: 3140540 - protein, 14 aa, Giardia lamblia
STLGEAPTPSGGAT

SEQ ID NO: 3140541 - protein, 7 aa, Giardia lamblia
STLGEGK

SEQ ID NO: 3140542 - protein, 7 aa, Giardia lamblia
STLGGPA

SEQ ID NO: 3140543 - protein, 43 aa, Giardia lamblia
STLGGPASSLAGRTPLHKPEDTPGPAAYATDSYALTKGSAPAF

SEQ ID NO: 3140544 - protein, 13 aa, Giardia lamblia
STLGSQQGAFENE

SEQ ID NO: 3140545 - protein, 9 aa, Giardia lamblia
STLGSSTDH

SEQ ID NO: 3140546 - protein, 11 aa, Giardia lamblia
STLGTRSSNSI

SEQ ID NO: 3140547 - protein, 20 aa, Giardia lamblia
STLKNSLNSTPKNRKSTSIT

SEQ ID NO: 3140548 - protein, 28 aa, Giardia lamblia
STLNSKEEHFRSEGGTAGTEATDTTRRA

SEQ ID NO: 3140549 - protein, 7 aa, Giardia lamblia
STLNTQK

SEQ ID NO: 3140550 - protein, 13 aa, Giardia lamblia
STLPGSFPAAQSV

SEQ ID NO: 3140551 - protein, 11 aa, Giardia lamblia
STLPKESPDIS

SEQ ID NO: 3140552 - protein, 7 aa, Giardia lamblia
STLPQPH

SEQ ID NO: 3140553 - protein, 20 aa, Giardia lamblia
STLQSTHSARLSPSAARPNI

SEQ ID NO: 3140554 - protein, 4 aa, Giardia lamblia
STLR

SEQ ID NO: 3140555 - protein, 4 aa, Giardia lamblia
STLS

SEQ ID NO: 3140556 - protein, 14 aa, Giardia lamblia
STLSEANKKTSKLD

SEQ ID NO: 3140557 - protein, 14 aa, Giardia lamblia
STLSEERTMKTANA

SEQ ID NO: 3140558 - protein, 12 aa, Giardia lamblia
STLSERNQLESK

SEQ ID NO: 3140559 - protein, 5 aa, Giardia lamblia
STLSH

SEQ ID NO: 3140560 - protein, 26 aa, Giardia lamblia
STLSSEPNTVPDDARTDTTSSHSDTP

SEQ ID NO: 3140561 - protein, 11 aa, Giardia lamblia
STLTDRSHGTA

SEQ ID NO: 3140562 - protein, 28 aa, Giardia lamblia
STLTSSSLSPHSTENIHRSTSPLRSSTV

SEQ ID NO: 3140563 - protein, 7 aa, Giardia lamblia
STMADQS

SEQ ID NO: 3140564 - protein, 6 aa, Giardia lamblia
STMAGE

SEQ ID NO: 3140565 - protein, 11 aa, Giardia lamblia
STMAPRPASSG

SEQ ID NO: 3140566 - protein, 6 aa, Giardia lamblia
STMATA

SEQ ID NO: 3140567 - protein, 10 aa, Giardia lamblia
STMEGANRQL

SEQ ID NO: 3140568 - protein, 6 aa, Giardia lamblia
STMETA

SEQ ID NO: 3140569 - protein, 13 aa, Giardia lamblia
STMETRDNSIAEV

SEQ ID NO: 3140570 - protein, 19 aa, Giardia lamblia
STMKSTTDSLEKKANGHET

SEQ ID NO: 3140571 - protein, 7 aa, Giardia lamblia
STNASKQ

SEQ ID NO: 3140572 - protein, 9 aa, Giardia lamblia
STNDPDARE

SEQ ID NO: 3140573 - protein, 7 aa, Giardia lamblia
STNDSGS

SEQ ID NO: 3140574 - protein, 11 aa, Giardia lamblia
STNESNQLKKK

SEQ ID NO: 3140575 - protein, 5 aa, Giardia lamblia
STNFG

SEQ ID NO: 3140576 - protein, 6 aa, Giardia lamblia
STNGKL

SEQ ID NO: 3140577 - protein, 6 aa, Giardia lamblia
STNGRV

SEQ ID NO: 3140578 - protein, 14 aa, Giardia lamblia
STNIQGKEVGGITQ

SEQ ID NO: 3140579 - protein, 7 aa, Giardia lamblia
STNIRTD

SEQ ID NO: 3140580 - protein, 7 aa, Giardia lamblia
STNPLKD

SEQ ID NO: 3140581 - protein, 9 aa, Giardia lamblia
STNPNLTGG

SEQ ID NO: 3140582 - protein, 10 aa, Giardia lamblia
STNPQAAQQY

SEQ ID NO: 3140583 - protein, 8 aa, Giardia lamblia
STNPTVEQ

SEQ ID NO: 3140584 - protein, 4 aa, Giardia lamblia
STNQ

SEQ ID NO: 3140585 - protein, 6 aa, Giardia lamblia
STNQKE

SEQ ID NO: 3140586 - protein, 6 aa, Giardia lamblia
STNQNG

SEQ ID NO: 3140587 - protein, 5 aa, Giardia lamblia
STNRD

SEQ ID NO: 3140588 - protein, 12 aa, Giardia lamblia
STNSDATALTPK

SEQ ID NO: 3140589 - protein, 8 aa, Giardia lamblia
STNSGERQ

SEQ ID NO: 3140590 - protein, 7 aa, Giardia lamblia
STNSKQA

SEQ ID NO: 3140591 - protein, 7 aa, Giardia lamblia
STNSKSW

SEQ ID NO: 3140592 - protein, 26 aa, Giardia lamblia
STNSSMNDETPQLTQKQHRNTTSTQD

SEQ ID NO: 3140593 - protein, 20 aa, Giardia lamblia
STNSSPNADYAELDQSNSNI

SEQ ID NO: 3140594 - protein, 9 aa, Giardia lamblia
STNSTKNLH

SEQ ID NO: 3140595 - protein, 4 aa, Giardia lamblia
STNV

SEQ ID NO: 3140596 - protein, 5 aa, Giardia lamblia
STPAA

SEQ ID NO: 3140597 - protein, 6 aa, Giardia lamblia
STPAGL

SEQ ID NO: 3140598 - protein, 5 aa, Giardia lamblia
STPAM

SEQ ID NO: 3140599 - protein, 11 aa, Giardia lamblia
STPANSGDSNI

SEQ ID NO: 3140600 - protein, 9 aa, Giardia lamblia
STPAQEEQL

SEQ ID NO: 3140601 - protein, 6 aa, Giardia lamblia
STPATR

SEQ ID NO: 3140602 - protein, 42 aa, Giardia lamblia
STPDTYSSSTTSCSSSQEEEDINNHGGRSHRRARRHQSRKHK

SEQ ID NO: 3140603 - protein, 6 aa, Giardia lamblia
STPEDF

SEQ ID NO: 3140604 - protein, 7 aa, Giardia lamblia
STPETHR

SEQ ID NO: 3140605 - protein, 8 aa, Giardia lamblia
STPFTNAS

SEQ ID NO: 3140606 - protein, 8 aa, Giardia lamblia
STPGDAAQ

SEQ ID NO: 3140607 - protein, 16 aa, Giardia lamblia
STPGHTFGETSESLQQ

SEQ ID NO: 3140608 - protein, 8 aa, Giardia lamblia
STPGKISN

SEQ ID NO: 3140609 - protein, 5 aa, Giardia lamblia
STPGP

SEQ ID NO: 3140610 - protein, 10 aa, Giardia lamblia
STPGPGEYSV

SEQ ID NO: 3140611 - protein, 6 aa, Giardia lamblia
STPHDR

SEQ ID NO: 3140612 - protein, 14 aa, Giardia lamblia
STPHSARSAGPLEA

SEQ ID NO: 3140613 - protein, 8 aa, Giardia lamblia
STPIDGDE

SEQ ID NO: 3140614 - protein, 14 aa, Giardia lamblia
STPIEENKRGQWKD

SEQ ID NO: 3140615 - protein, 8 aa, Giardia lamblia
STPIMSNG

SEQ ID NO: 3140616 - protein, 6 aa, Giardia lamblia
STPIST

SEQ ID NO: 3140617 - protein, 5 aa, Giardia lamblia
STPIT

SEQ ID NO: 3140618 - protein, 5 aa, Giardia lamblia
STPLD

SEQ ID NO: 3140619 - protein, 14 aa, Giardia lamblia
STPLPTDRSELERQ

SEQ ID NO: 3140620 - protein, 9 aa, Giardia lamblia
STPMETSPS

SEQ ID NO: 3140621 - protein, 8 aa, Giardia lamblia
STPMNTND

SEQ ID NO: 3140622 - protein, 17 aa, Giardia lamblia
STPMSGSLTAEPRAPEN

SEQ ID NO: 3140623 - protein, 7 aa, Giardia lamblia
STPNASD

SEQ ID NO: 3140624 - protein, 19 aa, Giardia lamblia
STPPFAKKSQPVVKTPGDA

SEQ ID NO: 3140625 - protein, 7 aa, Giardia lamblia
STPPGKV

SEQ ID NO: 3140626 - protein, 6 aa, Giardia lamblia
STPQLS

SEQ ID NO: 3140627 - protein, 9 aa, Giardia lamblia
STPRQHNSQ

SEQ ID NO: 3140628 - protein, 7 aa, Giardia lamblia
STPSKVS

SEQ ID NO: 3140629 - protein, 5 aa, Giardia lamblia
STPSL

SEQ ID NO: 3140630 - protein, 48 aa, Giardia lamblia
STPSLTEKPPHKPADKPTPARAASNLASSTRSVPTLPNSSSRPAQESA

SEQ ID NO: 3140631 - protein, 4 aa, Giardia lamblia
STPT

SEQ ID NO: 3140632 - protein, 7 aa, Giardia lamblia
STPTDSN

SEQ ID NO: 3140633 - protein, 7 aa, Giardia lamblia
STPTERT

SEQ ID NO: 3140634 - protein, 5 aa, Giardia lamblia
STPTG

SEQ ID NO: 3140635 - protein, 20 aa, Giardia lamblia
STPTIPGPVKPAPAAAKVTP

SEQ ID NO: 3140636 - protein, 6 aa, Giardia lamblia
STPTPV

SEQ ID NO: 3140637 - protein, 6 aa, Giardia lamblia
STPTQK

SEQ ID NO: 3140638 - protein, 21 aa, Giardia lamblia
STPTQSKRNAITRPRAPARRN

SEQ ID NO: 3140639 - protein, 4 aa, Giardia lamblia
STPV

SEQ ID NO: 3140640 - protein, 15 aa, Giardia lamblia
STPYNEVAQSPKNTT

SEQ ID NO: 3140641 - protein, 4 aa, Giardia lamblia
STQA

SEQ ID NO: 3140642 - protein, 7 aa, Giardia lamblia
STQAIEP

SEQ ID NO: 3140643 - protein, 9 aa, Giardia lamblia
STQDQQKIS

SEQ ID NO: 3140644 - protein, 9 aa, Giardia lamblia
STQEERADN

SEQ ID NO: 3140645 - protein, 10 aa, Giardia lamblia
STQEGQSSGI

SEQ ID NO: 3140646 - protein, 11 aa, Giardia lamblia
STQIAKKGNKF

SEQ ID NO: 3140647 - protein, 9 aa, Giardia lamblia
STQKDLERR

SEQ ID NO: 3140648 - protein, 6 aa, Giardia lamblia
STQLQE

SEQ ID NO: 3140649 - protein, 21 aa, Giardia lamblia
STQMSQRYRSDGTDPYDPAAK

SEQ ID NO: 3140650 - protein, 11 aa, Giardia lamblia
STQPEFPAKTT

SEQ ID NO: 3140651 - protein, 15 aa, Giardia lamblia
STQPIKSKSLHTRKR

SEQ ID NO: 3140652 - protein, 24 aa, Giardia lamblia
STQPLAQKTNPETARSLTAHPQRT

SEQ ID NO: 3140653 - protein, 7 aa, Giardia lamblia
STQPLHS

SEQ ID NO: 3140654 - protein, 8 aa, Giardia lamblia
STQPLKEP

SEQ ID NO: 3140655 - protein, 9 aa, Giardia lamblia
STQPRRAQS

SEQ ID NO: 3140656 - protein, 9 aa, Giardia lamblia
STQQAEEPV

SEQ ID NO: 3140657 - protein, 11 aa, Giardia lamblia
STQQVASETTL

SEQ ID NO: 3140658 - protein, 8 aa, Giardia lamblia
STQRPKDQ

SEQ ID NO: 3140659 - protein, 4 aa, Giardia lamblia
STQS

SEQ ID NO: 3140660 - protein, 31 aa, Giardia lamblia
STQSTTRAVGPNKPEKLKKQKKSKEPTQPPV

SEQ ID NO: 3140661 - protein, 10 aa, Giardia lamblia
STQTDPIRNE

SEQ ID NO: 3140662 - protein, 5 aa, Giardia lamblia
STQTI

SEQ ID NO: 3140663 - protein, 29 aa, Giardia lamblia
STQTRRVARTGKAKRSVSSSPKTNPASYK

SEQ ID NO: 3140664 - protein, 5 aa, Giardia lamblia
STQTS

SEQ ID NO: 3140665 - protein, 5 aa, Giardia lamblia
STRDR

SEQ ID NO: 3140666 - protein, 13 aa, Giardia lamblia
STRFEEDSSLDPT

SEQ ID NO: 3140667 - protein, 19 aa, Giardia lamblia
STRGSSEPLRQKTQQAEPV

SEQ ID NO: 3140668 - protein, 4 aa, Giardia lamblia
STRH

SEQ ID NO: 3140669 - protein, 12 aa, Giardia lamblia
STRIEQAPTLPL

SEQ ID NO: 3140670 - protein, 5 aa, Giardia lamblia
STRIP

SEQ ID NO: 3140671 - protein, 14 aa, Giardia lamblia
STRISADTGPEPEQ

SEQ ID NO: 3140672 - protein, 4 aa, Giardia lamblia
STRK

SEQ ID NO: 3140673 - protein, 6 aa, Giardia lamblia
STRKDV

SEQ ID NO: 3140674 - protein, 29 aa, Giardia lamblia
STRKKEAREQMRQERELSRHKEGSNEITE

SEQ ID NO: 3140675 - protein, 12 aa, Giardia lamblia
STRKSSGWRDGP

SEQ ID NO: 3140676 - protein, 29 aa, Giardia lamblia
STRLKSSNIRPPATQSPKVQPSPGPRGTR

SEQ ID NO: 3140677 - protein, 6 aa, Giardia lamblia
STRLRE

SEQ ID NO: 3140678 - protein, 6 aa, Giardia lamblia
STRMEE

SEQ ID NO: 3140679 - protein, 9 aa, Giardia lamblia
STRNTAEVG

SEQ ID NO: 3140680 - protein, 10 aa, Giardia lamblia
STRPDNYRTL

SEQ ID NO: 3140681 - protein, 43 aa, Giardia lamblia
STRPKSNHAQRSGSKASSSAGATTATANQPPDAPAVTEAGHSD

SEQ ID NO: 3140682 - protein, 5 aa, Giardia lamblia
STRPQ

SEQ ID NO: 3140683 - protein, 28 aa, Giardia lamblia
STRPQAIPTTTSEKTDRVAHTLGISSLR

SEQ ID NO: 3140684 - protein, 5 aa, Giardia lamblia
STRPS

SEQ ID NO: 3140685 - protein, 7 aa, Giardia lamblia
STRPTSQ

SEQ ID NO: 3140686 - protein, 6 aa, Giardia lamblia
STRQQS

SEQ ID NO: 3140687 - protein, 7 aa, Giardia lamblia
STRQSVP

SEQ ID NO: 3140688 - protein, 11 aa, Giardia lamblia
STRQTFNQETQ

SEQ ID NO: 3140689 - protein, 5 aa, Giardia lamblia
STRRR

SEQ ID NO: 3140690 - protein, 11 aa, Giardia lamblia
STRRSMSMDSR

SEQ ID NO: 3140691 - protein, 5 aa, Giardia lamblia
STRRV

SEQ ID NO: 3140692 - protein, 6 aa, Giardia lamblia
STRSKL

SEQ ID NO: 3140693 - protein, 17 aa, Giardia lamblia
STRSNETSTERAERKAL

SEQ ID NO: 3140694 - protein, 13 aa, Giardia lamblia
STRSPQEKPPTRV

SEQ ID NO: 3140695 - protein, 9 aa, Giardia lamblia
STRTGGDID

SEQ ID NO: 3140696 - protein, 4 aa, Giardia lamblia
STSA

SEQ ID NO: 3140697 - protein, 16 aa, Giardia lamblia
STSAHNSKTITETRQA

SEQ ID NO: 3140698 - protein, 10 aa, Giardia lamblia
STSANGKHTS

SEQ ID NO: 3140699 - protein, 11 aa, Giardia lamblia
STSATGNTPAF

SEQ ID NO: 3140700 - protein, 5 aa, Giardia lamblia
STSCT

SEQ ID NO: 3140701 - protein, 8 aa, Giardia lamblia
STSDAPLE

SEQ ID NO: 3140702 - protein, 10 aa, Giardia lamblia
STSDAQKYTS

SEQ ID NO: 3140703 - protein, 10 aa, Giardia lamblia
STSDQQTLAA

SEQ ID NO: 3140704 - protein, 7 aa, Giardia lamblia
STSDRQQ

SEQ ID NO: 3140705 - protein, 9 aa, Giardia lamblia
STSEHSSDP

SEQ ID NO: 3140706 - protein, 6 aa, Giardia lamblia
STSETL

SEQ ID NO: 3140707 - protein, 8 aa, Giardia lamblia
STSETSIE

SEQ ID NO: 3140708 - protein, 7 aa, Giardia lamblia
STSFSPS

SEQ ID NO: 3140709 - protein, 8 aa, Giardia lamblia
STSGHSVE

SEQ ID NO: 3140710 - protein, 8 aa, Giardia lamblia
STSGKGLS

SEQ ID NO: 3140711 - protein, 11 aa, Giardia lamblia
STSGLGLTGGT

SEQ ID NO: 3140712 - protein, 16 aa, Giardia lamblia
STSGMPAGNERGHTGI

SEQ ID NO: 3140713 - protein, 8 aa, Giardia lamblia
STSGPMGP

SEQ ID NO: 3140714 - protein, 7 aa, Giardia lamblia
STSGPTV

SEQ ID NO: 3140715 - protein, 10 aa, Giardia lamblia
STSGSNDRVH

SEQ ID NO: 3140716 - protein, 8 aa, Giardia lamblia
STSGTTYE

SEQ ID NO: 3140717 - protein, 5 aa, Giardia lamblia
STSGY

SEQ ID NO: 3140718 - protein, 8 aa, Giardia lamblia
STSHDIRS

SEQ ID NO: 3140719 - protein, 6 aa, Giardia lamblia
STSIDG

SEQ ID NO: 3140720 - protein, 6 aa, Giardia lamblia
STSIPH

SEQ ID NO: 3140721 - protein, 8 aa, Giardia lamblia
STSLDDQR

SEQ ID NO: 3140722 - protein, 7 aa, Giardia lamblia
STSLGGL

SEQ ID NO: 3140723 - protein, 9 aa, Giardia lamblia
STSLQNSQF

SEQ ID NO: 3140724 - protein, 9 aa, Giardia lamblia
STSLSSPPI

SEQ ID NO: 3140725 - protein, 6 aa, Giardia lamblia
STSNEL

SEQ ID NO: 3140726 - protein, 6 aa, Giardia lamblia
STSNGR

SEQ ID NO: 3140727 - protein, 7 aa, Giardia lamblia
STSNKQF

SEQ ID NO: 3140728 - protein, 7 aa, Giardia lamblia
STSNTAE

SEQ ID NO: 3140729 - protein, 10 aa, Giardia lamblia
STSNYSPDMR

SEQ ID NO: 3140730 - protein, 4 aa, Giardia lamblia
STSP

SEQ ID NO: 3140731 - protein, 9 aa, Giardia lamblia
STSPPPQNT

SEQ ID NO: 3140732 - protein, 5 aa, Giardia lamblia
STSPQ

SEQ ID NO: 3140733 - protein, 11 aa, Giardia lamblia
STSPRSTASGV

SEQ ID NO: 3140734 - protein, 16 aa, Giardia lamblia
STSPTGTRAPSTEGQR

SEQ ID NO: 3140735 - protein, 19 aa, Giardia lamblia
STSQTSAHSPNVPAPPAMA

SEQ ID NO: 3140736 - protein, 6 aa, Giardia lamblia
STSRGG

SEQ ID NO: 3140737 - protein, 8 aa, Giardia lamblia
STSRIRDP

SEQ ID NO: 3140738 - protein, 10 aa, Giardia lamblia
STSRPRKQST

SEQ ID NO: 3140739 - protein, 5 aa, Giardia lamblia
STSRW

SEQ ID NO: 3140740 - protein, 4 aa, Giardia lamblia
STSS

SEQ ID NO: 3140741 - protein, 16 aa, Giardia lamblia
STSSASTQYEPQSAPF

SEQ ID NO: 3140742 - protein, 8 aa, Giardia lamblia
STSSEYRA

SEQ ID NO: 3140743 - protein, 35 aa, Giardia lamblia
STSSHSSTSSLGATNTAESPSLPISSTASHQDEQD

SEQ ID NO: 3140744 - protein, 7 aa, Giardia lamblia
STSSLEN

SEQ ID NO: 3140745 - protein, 17 aa, Giardia lamblia
STSSLSQSRLQHNPDAN

SEQ ID NO: 3140746 - protein, 22 aa, Giardia lamblia
STSSRHAPFTNTGGYLESTPHG

SEQ ID NO: 3140747 - protein, 18 aa, Giardia lamblia
STSSSGALSSASKASTVS

SEQ ID NO: 3140748 - protein, 13 aa, Giardia lamblia
STSSTTDAEVPPE

SEQ ID NO: 3140749 - protein, 8 aa, Giardia lamblia
STSSVSKA

SEQ ID NO: 3140750 - protein, 21 aa, Giardia lamblia
STSTIEQPTGKFSKRTGQQRM

SEQ ID NO: 3140751 - protein, 6 aa, Giardia lamblia
STSTKE

SEQ ID NO: 3140752 - protein, 7 aa, Giardia lamblia
STSTSDL

SEQ ID NO: 3140753 - protein, 7 aa, Giardia lamblia
STSTTLS

SEQ ID NO: 3140754 - protein, 9 aa, Giardia lamblia
STSTTRSFQ

SEQ ID NO: 3140755 - protein, 10 aa, Giardia lamblia
STSTTSSLRP

SEQ ID NO: 3140756 - protein, 6 aa, Giardia lamblia
STSVGN

SEQ ID NO: 3140757 - protein, 5 aa, Giardia lamblia
STSVS

SEQ ID NO: 3140758 - protein, 13 aa, Giardia lamblia
STSVSSASTLTDT

SEQ ID NO: 3140759 - protein, 16 aa, Giardia lamblia
STSYGPDTMQNGGGYY

SEQ ID NO: 3140760 - protein, 13 aa, Giardia lamblia
STSYGPGDQHTNQ

SEQ ID NO: 3140761 - protein, 8 aa, Giardia lamblia
STSYNHSK

SEQ ID NO: 3140762 - protein, 9 aa, Giardia lamblia
STTAGGTTL

SEQ ID NO: 3140763 - protein, 13 aa, Giardia lamblia
STTAKESSKEFSS

SEQ ID NO: 3140764 - protein, 9 aa, Giardia lamblia
STTAPAGAF

SEQ ID NO: 3140765 - protein, 29 aa, Giardia lamblia
STTASMRYGGSGTSQSSHSTLATTPSGTG

SEQ ID NO: 3140766 - protein, 12 aa, Giardia lamblia
STTDEEIEQGYP

SEQ ID NO: 3140767 - protein, 24 aa, Giardia lamblia
STTDGSNVSQYSGSSYRTTDTNDR

SEQ ID NO: 3140768 - protein, 15 aa, Giardia lamblia
STTDNTTDNTTNKGF

SEQ ID NO: 3140769 - protein, 8 aa, Giardia lamblia
STTDTTGQ

SEQ ID NO: 3140770 - protein, 6 aa, Giardia lamblia
STTEAL

SEQ ID NO: 3140771 - protein, 12 aa, Giardia lamblia
STTELDNMGDEY

SEQ ID NO: 3140772 - protein, 9 aa, Giardia lamblia
STTEPSNTH

SEQ ID NO: 3140773 - protein, 10 aa, Giardia lamblia
STTEYKPGES

SEQ ID NO: 3140774 - protein, 9 aa, Giardia lamblia
STTGAPAPF

SEQ ID NO: 3140775 - protein, 6 aa, Giardia lamblia
STTGGW

SEQ ID NO: 3140776 - protein, 6 aa, Giardia lamblia
STTGHS

SEQ ID NO: 3140777 - protein, 33 aa, Giardia lamblia
STTGPHLGHGSATDEDSGAKDGALEPAPKKTSV

SEQ ID NO: 3140778 - protein, 13 aa, Giardia lamblia
STTGSAAAGYSTA

SEQ ID NO: 3140779 - protein, 8 aa, Giardia lamblia
STTGTSTN

SEQ ID NO: 3140780 - protein, 5 aa, Giardia lamblia
STTGV

SEQ ID NO: 3140781 - protein, 11 aa, Giardia lamblia
STTIEEDALPR

SEQ ID NO: 3140782 - protein, 9 aa, Giardia lamblia
STTIPNNDI

SEQ ID NO: 3140783 - protein, 8 aa, Giardia lamblia
STTIPTSK

SEQ ID NO: 3140784 - protein, 5 aa, Giardia lamblia
STTIQ

SEQ ID NO: 3140785 - protein, 8 aa, Giardia lamblia
STTKKYDS

SEQ ID NO: 3140786 - protein, 13 aa, Giardia lamblia
STTKLGRTTVNDD

SEQ ID NO: 3140787 - protein, 14 aa, Giardia lamblia
STTLASDGDVDTHA

SEQ ID NO: 3140788 - protein, 25 aa, Giardia lamblia
STTLGSKESSSVQSRSSTESTLDED

SEQ ID NO: 3140789 - protein, 5 aa, Giardia lamblia
STTLT

SEQ ID NO: 3140790 - protein, 5 aa, Giardia lamblia
STTNM

SEQ ID NO: 3140791 - protein, 7 aa, Giardia lamblia
STTPAKT

SEQ ID NO: 3140792 - protein, 10 aa, Giardia lamblia
STTPDEVTSL

SEQ ID NO: 3140793 - protein, 9 aa, Giardia lamblia
STTPDEYTQ

SEQ ID NO: 3140794 - protein, 7 aa, Giardia lamblia
STTPDNQ

SEQ ID NO: 3140795 - protein, 6 aa, Giardia lamblia
STTPIG

SEQ ID NO: 3140796 - protein, 7 aa, Giardia lamblia
STTPKPD

SEQ ID NO: 3140797 - protein, 7 aa, Giardia lamblia
STTPNKR

SEQ ID NO: 3140798 - protein, 11 aa, Giardia lamblia
STTPPELPTES

SEQ ID NO: 3140799 - protein, 5 aa, Giardia lamblia
STTPS

SEQ ID NO: 3140800 - protein, 6 aa, Giardia lamblia
STTPSH

SEQ ID NO: 3140801 - protein, 11 aa, Giardia lamblia
STTPSREVEEQ

SEQ ID NO: 3140802 - protein, 6 aa, Giardia lamblia
STTPSV

SEQ ID NO: 3140803 - protein, 30 aa, Giardia lamblia
STTQCEQQRSDSAGSSSSFDSSGSKDCVEK

SEQ ID NO: 3140804 - protein, 12 aa, Giardia lamblia
STTQIQEPNDPS

SEQ ID NO: 3140805 - protein, 7 aa, Giardia lamblia
STTRKTL

SEQ ID NO: 3140806 - protein, 10 aa, Giardia lamblia
STTSMATPTE

SEQ ID NO: 3140807 - protein, 6 aa, Giardia lamblia
STTSTD

SEQ ID NO: 3140808 - protein, 29 aa, Giardia lamblia
STTSTDEQVEQTSPERETVERAAKPTKKR

SEQ ID NO: 3140809 - protein, 7 aa, Giardia lamblia
STTSVGP

SEQ ID NO: 3140810 - protein, 6 aa, Giardia lamblia
STTTRY

SEQ ID NO: 3140811 - protein, 38 aa, Giardia lamblia
STTTSGMTSSGRSKSASTPLSRNTHQPISGMSSSTTDG

SEQ ID NO: 3140812 - protein, 19 aa, Giardia lamblia
STTTTTQPQNSSSTQFPAS

SEQ ID NO: 3140813 - protein, 4 aa, Giardia lamblia
STTV

SEQ ID NO: 3140814 - protein, 7 aa, Giardia lamblia
STTVPGG

SEQ ID NO: 3140815 - protein, 13 aa, Giardia lamblia
STTYEATEHSAER

SEQ ID NO: 3140816 - protein, 9 aa, Giardia lamblia
STTYKTQLP

SEQ ID NO: 3140817 - protein, 16 aa, Giardia lamblia
STTYTARRKSDGKTVA

SEQ ID NO: 3140818 - protein, 4 aa, Giardia lamblia
STVA

SEQ ID NO: 3140819 - protein, 9 aa, Giardia lamblia
STVASVGED

SEQ ID NO: 3140820 - protein, 12 aa, Giardia lamblia
STVPRRSVSPAT

SEQ ID NO: 3140821 - protein, 6 aa, Giardia lamblia
STVPRT

SEQ ID NO: 3140822 - protein, 6 aa, Giardia lamblia
STVQKG

SEQ ID NO: 3140823 - protein, 14 aa, Giardia lamblia
STVRPVNKQQKPFS

SEQ ID NO: 3140824 - protein, 5 aa, Giardia lamblia
STVSA

SEQ ID NO: 3140825 - protein, 18 aa, Giardia lamblia
STVSGRGTVEQPPSTPAV

SEQ ID NO: 3140826 - protein, 13 aa, Giardia lamblia
STVSRCPDCSTNR

SEQ ID NO: 3140827 - protein, 7 aa, Giardia lamblia
STVSSKA

SEQ ID NO: 3140828 - protein, 5 aa, Giardia lamblia
STVST

SEQ ID NO: 3140829 - protein, 4 aa, Giardia lamblia
STVT

SEQ ID NO: 3140830 - protein, 6 aa, Giardia lamblia
STVTGD

SEQ ID NO: 3140831 - protein, 7 aa, Giardia lamblia
STVYGGV

SEQ ID NO: 3140832 - protein, 5 aa, Giardia lamblia
STWKV

SEQ ID NO: 3140833 - protein, 9 aa, Giardia lamblia
STWSGPNQS

SEQ ID NO: 3140834 - protein, 9 aa, Giardia lamblia
STYADGATN

SEQ ID NO: 3140835 - protein, 5 aa, Giardia lamblia
STYDK

SEQ ID NO: 3140836 - protein, 15 aa, Giardia lamblia
STYDPTDLDPDNRFE

SEQ ID NO: 3140837 - protein, 33 aa, Giardia lamblia
STYGSNQESHTARDKNNQHNKNDIPVSNGRRTP

SEQ ID NO: 3140838 - protein, 12 aa, Giardia lamblia
STYHSEENEQRI

SEQ ID NO: 3140839 - protein, 9 aa, Giardia lamblia
STYHSSRKL

SEQ ID NO: 3140840 - protein, 15 aa, Giardia lamblia
STYNAPPGQGFQPND

SEQ ID NO: 3140841 - protein, 4 aa, Giardia lamblia
STYP

SEQ ID NO: 3140842 - protein, 5 aa, Giardia lamblia
STYQN

SEQ ID NO: 3140843 - protein, 25 aa, Giardia lamblia
STYSGDALSANPRRSYSTDRSMQSA

SEQ ID NO: 3140844 - protein, 4 aa, Giardia lamblia
STYY

SEQ ID NO: 3140845 - protein, 4 aa, Giardia lamblia
SVAA

SEQ ID NO: 3140846 - protein, 11 aa, Giardia lamblia
SVADESKSPNM

SEQ ID NO: 3140847 - protein, 6 aa, Giardia lamblia
SVADNK

SEQ ID NO: 3140848 - protein, 7 aa, Giardia lamblia
SVAGHAD

SEQ ID NO: 3140849 - protein, 9 aa, Giardia lamblia
SVAGSSSNK

SEQ ID NO: 3140850 - protein, 13 aa, Giardia lamblia
SVAMRGKGQSESF

SEQ ID NO: 3140851 - protein, 12 aa, Giardia lamblia
SVANGRKAPQTA

SEQ ID NO: 3140852 - protein, 10 aa, Giardia lamblia
SVANTQSRAR

SEQ ID NO: 3140853 - protein, 4 aa, Giardia lamblia
SVAP

SEQ ID NO: 3140854 - protein, 16 aa, Giardia lamblia
SVAPASTPTLKTPDRR

SEQ ID NO: 3140855 - protein, 5 aa, Giardia lamblia
SVAPG

SEQ ID NO: 3140856 - protein, 6 aa, Giardia lamblia
SVASGI

SEQ ID NO: 3140857 - protein, 8 aa, Giardia lamblia
SVASSSLP

SEQ ID NO: 3140858 - protein, 5 aa, Giardia lamblia
SVATT

SEQ ID NO: 3140859 - protein, 7 aa, Giardia lamblia
SVDAGPS

SEQ ID NO: 3140860 - protein, 8 aa, Giardia lamblia
SVDDSGQL

SEQ ID NO: 3140861 - protein, 4 aa, Giardia lamblia
SVDE

SEQ ID NO: 3140862 - protein, 7 aa, Giardia lamblia
SVDEARE

SEQ ID NO: 3140863 - protein, 10 aa, Giardia lamblia
SVDEEGVSTG

SEQ ID NO: 3140864 - protein, 9 aa, Giardia lamblia
SVDGGTPAL

SEQ ID NO: 3140865 - protein, 15 aa, Giardia lamblia
SVDGMPDLSAANTKT

SEQ ID NO: 3140866 - protein, 9 aa, Giardia lamblia
SVDGNGETA

SEQ ID NO: 3140867 - protein, 5 aa, Giardia lamblia
SVDGS

SEQ ID NO: 3140868 - protein, 38 aa, Giardia lamblia
SVDHAGDPGQTEGPPTAEPATVPAGADSPAVPDEPMDE

SEQ ID NO: 3140869 - protein, 6 aa, Giardia lamblia
SVDNDS

SEQ ID NO: 3140870 - protein, 8 aa, Giardia lamblia
SVDPDSGL

SEQ ID NO: 3140871 - protein, 7 aa, Giardia lamblia
SVDPTFN

SEQ ID NO: 3140872 - protein, 9 aa, Giardia lamblia
SVDRDGETG

SEQ ID NO: 3140873 - protein, 10 aa, Giardia lamblia
SVDRTQTLRT

SEQ ID NO: 3140874 - protein, 11 aa, Giardia lamblia
SVDSGHKVTPF

SEQ ID NO: 3140875 - protein, 11 aa, Giardia lamblia
SVDSNANDSLI

SEQ ID NO: 3140876 - protein, 8 aa, Giardia lamblia
SVDSQGRT

SEQ ID NO: 3140877 - protein, 6 aa, Giardia lamblia
SVDTGK

SEQ ID NO: 3140878 - protein, 9 aa, Giardia lamblia
SVEASSGLS

SEQ ID NO: 3140879 - protein, 5 aa, Giardia lamblia
SVEDY

SEQ ID NO: 3140880 - protein, 13 aa, Giardia lamblia
SVEEAHQAKLTDG

SEQ ID NO: 3140881 - protein, 20 aa, Giardia lamblia
SVEEEEQRDAKGSEKSRIQT

SEQ ID NO: 3140882 - protein, 7 aa, Giardia lamblia
SVEGGTP

SEQ ID NO: 3140883 - protein, 18 aa, Giardia lamblia
SVEGPDVSLGNAGAQEDM

SEQ ID NO: 3140884 - protein, 9 aa, Giardia lamblia
SVEGTESKI

SEQ ID NO: 3140885 - protein, 9 aa, Giardia lamblia
SVEKNRTDV

SEQ ID NO: 3140886 - protein, 15 aa, Giardia lamblia
SVENSSNEQKVKDLS

SEQ ID NO: 3140887 - protein, 7 aa, Giardia lamblia
SVEPEKV

SEQ ID NO: 3140888 - protein, 6 aa, Giardia lamblia
SVEPGR

SEQ ID NO: 3140889 - protein, 16 aa, Giardia lamblia
SVEPQTMSSMNSATSI

SEQ ID NO: 3140890 - protein, 26 aa, Giardia lamblia
SVESSAASSLFSSEGTHEELAEEPET

SEQ ID NO: 3140891 - protein, 6 aa, Giardia lamblia
SVETDR

SEQ ID NO: 3140892 - protein, 7 aa, Giardia lamblia
SVETPSL

SEQ ID NO: 3140893 - protein, 52 aa, Giardia lamblia
SVETSKEMLQGKDRDYYGGRPLAEDEDGLGQHEKEGVSEGTRERARQNRDEP

SEQ ID NO: 3140894 - protein, 11 aa, Giardia lamblia
SVETVSSAERQ

SEQ ID NO: 3140895 - protein, 5 aa, Giardia lamblia
SVGDP

SEQ ID NO: 3140896 - protein, 4 aa, Giardia lamblia
SVGG

SEQ ID NO: 3140897 - protein, 31 aa, Giardia lamblia
SVGGGSLRLGDGSAPIWPANSDGCNATPGVA

SEQ ID NO: 3140898 - protein, 10 aa, Giardia lamblia
SVGGGSTQFD

SEQ ID NO: 3140899 - protein, 7 aa, Giardia lamblia
SVGGYTD

SEQ ID NO: 3140900 - protein, 10 aa, Giardia lamblia
SVGHRQTSSD

SEQ ID NO: 3140901 - protein, 7 aa, Giardia lamblia
SVGHTSA

SEQ ID NO: 3140902 - protein, 12 aa, Giardia lamblia
SVGKYDGEYQGT

SEQ ID NO: 3140903 - protein, 22 aa, Giardia lamblia
SVGPSDKNEDVESVGASVTQDP

SEQ ID NO: 3140904 - protein, 8 aa, Giardia lamblia
SVGPTAER

SEQ ID NO: 3140905 - protein, 4 aa, Giardia lamblia
SVGR

SEQ ID NO: 3140906 - protein, 10 aa, Giardia lamblia
SVGRSSSGMR

SEQ ID NO: 3140907 - protein, 7 aa, Giardia lamblia
SVGSKGL

SEQ ID NO: 3140908 - protein, 18 aa, Giardia lamblia
SVGSSGSCYKPVKDRDSW

SEQ ID NO: 3140909 - protein, 8 aa, Giardia lamblia
SVGSSTSI

SEQ ID NO: 3140910 - protein, 7 aa, Giardia lamblia
SVGTPER

SEQ ID NO: 3140911 - protein, 17 aa, Giardia lamblia
SVGTQTPPVLTEENETL

SEQ ID NO: 3140912 - protein, 5 aa, Giardia lamblia
SVGTS

SEQ ID NO: 3140913 - protein, 15 aa, Giardia lamblia
SVGTTPFDHPPDPSL

SEQ ID NO: 3140914 - protein, 4 aa, Giardia lamblia
SVHD

SEQ ID NO: 3140915 - protein, 7 aa, Giardia lamblia
SVHGDPG

SEQ ID NO: 3140916 - protein, 19 aa, Giardia lamblia
SVHGRSRSGKVVSAGTETS

SEQ ID NO: 3140917 - protein, 35 aa, Giardia lamblia
SVHGSKYDEEYKSNCASTSLKNSSVSKPVEISSNP

SEQ ID NO: 3140918 - protein, 16 aa, Giardia lamblia
SVHNEGQRPVHPNGAF

SEQ ID NO: 3140919 - protein, 6 aa, Giardia lamblia
SVIPKG

SEQ ID NO: 3140920 - protein, 8 aa, Giardia lamblia
SVIPPPPP

SEQ ID NO: 3140921 - protein, 12 aa, Giardia lamblia
SVITPSKSLLLD

SEQ ID NO: 3140922 - protein, 22 aa, Giardia lamblia
SVKDASAKPVGLGEQKDANARP

SEQ ID NO: 3140923 - protein, 12 aa, Giardia lamblia
SVKERGPAYSLS

SEQ ID NO: 3140924 - protein, 20 aa, Giardia lamblia
SVKGRRKKPNIFGHKVAATK

SEQ ID NO: 3140925 - protein, 15 aa, Giardia lamblia
SVKKSRPTAHADTDL

SEQ ID NO: 3140926 - protein, 43 aa, Giardia lamblia
SVKNPSPEYDTGLPTNNVNEGAFNRTATPSSITTTTRPNSIPG

SEQ ID NO: 3140927 - protein, 19 aa, Giardia lamblia
SVKQESAEALKKKSAKIEE

SEQ ID NO: 3140928 - protein, 4 aa, Giardia lamblia
SVKT

SEQ ID NO: 3140929 - protein, 5 aa, Giardia lamblia
SVKTD

SEQ ID NO: 3140930 - protein, 11 aa, Giardia lamblia
SVLPPSPATLG

SEQ ID NO: 3140931 - protein, 4 aa, Giardia lamblia
SVLT

SEQ ID NO: 3140932 - protein, 13 aa, Giardia lamblia
SVLTKSGPTHFTG

SEQ ID NO: 3140933 - protein, 8 aa, Giardia lamblia
SVNAESSE

SEQ ID NO: 3140934 - protein, 6 aa, Giardia lamblia
SVNAQG

SEQ ID NO: 3140935 - protein, 6 aa, Giardia lamblia
SVNDYR

SEQ ID NO: 3140936 - protein, 10 aa, Giardia lamblia
SVNPGSYSGY

SEQ ID NO: 3140937 - protein, 8 aa, Giardia lamblia
SVNQAGKT

SEQ ID NO: 3140938 - protein, 9 aa, Giardia lamblia
SVNSEEAKA

SEQ ID NO: 3140939 - protein, 8 aa, Giardia lamblia
SVNSHGET

SEQ ID NO: 3140940 - protein, 9 aa, Giardia lamblia
SVNSTTAEN

SEQ ID NO: 3140941 - protein, 20 aa, Giardia lamblia
SVNSVSTALNTSTHNCSPDK

SEQ ID NO: 3140942 - protein, 7 aa, Giardia lamblia
SVNTDTY

SEQ ID NO: 3140943 - protein, 6 aa, Giardia lamblia
SVPADT

SEQ ID NO: 3140944 - protein, 31 aa, Giardia lamblia
SVPAKRSRKRTKRQSLSRPVSTRSCPPPQEN

SEQ ID NO: 3140945 - protein, 11 aa, Giardia lamblia
SVPASGSDAYI

SEQ ID NO: 3140946 - protein, 6 aa, Giardia lamblia
SVPAST

SEQ ID NO: 3140947 - protein, 11 aa, Giardia lamblia
SVPDEDISNTL

SEQ ID NO: 3140948 - protein, 6 aa, Giardia lamblia
SVPEKN

SEQ ID NO: 3140949 - protein, 11 aa, Giardia lamblia
SVPETATELDD

SEQ ID NO: 3140950 - protein, 7 aa, Giardia lamblia
SVPGHPD

SEQ ID NO: 3140951 - protein, 12 aa, Giardia lamblia
SVPGNTRIGKNN

SEQ ID NO: 3140952 - protein, 7 aa, Giardia lamblia
SVPGQPL

SEQ ID NO: 3140953 - protein, 4 aa, Giardia lamblia
SVPH

SEQ ID NO: 3140954 - protein, 32 aa, Giardia lamblia
SVPHHTDRAPLESSPLPPSSAAAQVSTKRQSL

SEQ ID NO: 3140955 - protein, 23 aa, Giardia lamblia
SVPNGDCPPKRTHGLQQTPDTCP

SEQ ID NO: 3140956 - protein, 4 aa, Giardia lamblia
SVPQ

SEQ ID NO: 3140957 - protein, 8 aa, Giardia lamblia
SVPQDNHS

SEQ ID NO: 3140958 - protein, 18 aa, Giardia lamblia
SVPQGKPPTDLTIPASSP

SEQ ID NO: 3140959 - protein, 20 aa, Giardia lamblia
SVPQISDTPGARPDPASGEQ

SEQ ID NO: 3140960 - protein, 7 aa, Giardia lamblia
SVPRDSS

SEQ ID NO: 3140961 - protein, 24 aa, Giardia lamblia
SVPRPGAQSRLEARSTGKKPSAFR

SEQ ID NO: 3140962 - protein, 10 aa, Giardia lamblia
SVPSKRKDNY

SEQ ID NO: 3140963 - protein, 10 aa, Giardia lamblia
SVPSPKPDPI

SEQ ID NO: 3140964 - protein, 13 aa, Giardia lamblia
SVPSPLRPPSSSN

SEQ ID NO: 3140965 - protein, 17 aa, Giardia lamblia
SVPSSSPIVRRTDSKPI

SEQ ID NO: 3140966 - protein, 7 aa, Giardia lamblia
SVPTDDG

SEQ ID NO: 3140967 - protein, 8 aa, Giardia lamblia
SVPTDQDH

SEQ ID NO: 3140968 - protein, 7 aa, Giardia lamblia
SVPTMST

SEQ ID NO: 3140969 - protein, 5 aa, Giardia lamblia
SVPWR

SEQ ID NO: 3140970 - protein, 10 aa, Giardia lamblia
SVQEKSNTWE

SEQ ID NO: 3140971 - protein, 8 aa, Giardia lamblia
SVQGTLGE

SEQ ID NO: 3140972 - protein, 15 aa, Giardia lamblia
SVQKCSEQFGKDDEF

SEQ ID NO: 3140973 - protein, 21 aa, Giardia lamblia
SVQPTTSTIVEEGGSDMEDAA

SEQ ID NO: 3140974 - protein, 63 aa, Giardia lamblia
SVQQPERSLSKEKGASRKETSSTGTQSSKKTSKEPPRVATDTNTSAEQQSQDVASDALAKPPC

SEQ ID NO: 3140975 - protein, 8 aa, Giardia lamblia
SVQSDKCG

SEQ ID NO: 3140976 - protein, 8 aa, Giardia lamblia
SVQSRTRF

SEQ ID NO: 3140977 - protein, 9 aa, Giardia lamblia
SVQSSDSNF

SEQ ID NO: 3140978 - protein, 10 aa, Giardia lamblia
SVQSSSNLYT

SEQ ID NO: 3140979 - protein, 16 aa, Giardia lamblia
SVQSTSRSKVRNQDGH

SEQ ID NO: 3140980 - protein, 17 aa, Giardia lamblia
SVQTEQNADRRPPSSNH

SEQ ID NO: 3140981 - protein, 4 aa, Giardia lamblia
SVRA

SEQ ID NO: 3140982 - protein, 9 aa, Giardia lamblia
SVRASTDPQ

SEQ ID NO: 3140983 - protein, 7 aa, Giardia lamblia
SVRNDSN

SEQ ID NO: 3140984 - protein, 5 aa, Giardia lamblia
SVRPP

SEQ ID NO: 3140985 - protein, 8 aa, Giardia lamblia
SVRPSVRD

SEQ ID NO: 3140986 - protein, 14 aa, Giardia lamblia
SVRRQPEDRSESPL

SEQ ID NO: 3140987 - protein, 16 aa, Giardia lamblia
SVRSGRNSPYIDPDED

SEQ ID NO: 3140988 - protein, 10 aa, Giardia lamblia
SVRTGQLPDK

SEQ ID NO: 3140989 - protein, 11 aa, Giardia lamblia
SVSAQAEAQEE

SEQ ID NO: 3140990 - protein, 25 aa, Giardia lamblia
SVSATIDETNDSDDSDDSDDSPRHL

SEQ ID NO: 3140991 - protein, 8 aa, Giardia lamblia
SVSDAKVD

SEQ ID NO: 3140992 - protein, 8 aa, Giardia lamblia
SVSDEGDT

SEQ ID NO: 3140993 - protein, 9 aa, Giardia lamblia
SVSDKKLKE

SEQ ID NO: 3140994 - protein, 13 aa, Giardia lamblia
SVSEANRLKRPKG

SEQ ID NO: 3140995 - protein, 14 aa, Giardia lamblia
SVSESKKQMKDGTT

SEQ ID NO: 3140996 - protein, 12 aa, Giardia lamblia
SVSGAPRRHSGG

SEQ ID NO: 3140997 - protein, 5 aa, Giardia lamblia
SVSGE

SEQ ID NO: 3140998 - protein, 7 aa, Giardia lamblia
SVSGHSG

SEQ ID NO: 3140999 - protein, 12 aa, Giardia lamblia
SVSGRRPSNEDA

SEQ ID NO: 3141000 - protein, 13 aa, Giardia lamblia
SVSGSAHSDYSDE

SEQ ID NO: 3141001 - protein, 7 aa, Giardia lamblia
SVSGSDR

SEQ ID NO: 3141002 - protein, 8 aa, Giardia lamblia
SVSGSSAI

SEQ ID NO: 3141003 - protein, 8 aa, Giardia lamblia
SVSKPSDF

SEQ ID NO: 3141004 - protein, 11 aa, Giardia lamblia
SVSNADRADRS

SEQ ID NO: 3141005 - protein, 8 aa, Giardia lamblia
SVSPDFEG

SEQ ID NO: 3141006 - protein, 9 aa, Giardia lamblia
SVSPDKTNV

SEQ ID NO: 3141007 - protein, 13 aa, Giardia lamblia
SVSPKVGMSYRAS

SEQ ID NO: 3141008 - protein, 5 aa, Giardia lamblia
SVSPT

SEQ ID NO: 3141009 - protein, 13 aa, Giardia lamblia
SVSPTAKSIQSAS

SEQ ID NO: 3141010 - protein, 8 aa, Giardia lamblia
SVSPTARS

SEQ ID NO: 3141011 - protein, 6 aa, Giardia lamblia
SVSQTA

SEQ ID NO: 3141012 - protein, 4 aa, Giardia lamblia
SVSS

SEQ ID NO: 3141013 - protein, 7 aa, Giardia lamblia
SVSSRRP

SEQ ID NO: 3141014 - protein, 6 aa, Giardia lamblia
SVSSTA

SEQ ID NO: 3141015 - protein, 12 aa, Giardia lamblia
SVSTENIDGGKT

SEQ ID NO: 3141016 - protein, 14 aa, Giardia lamblia
SVSTERVSPEAQRD

SEQ ID NO: 3141017 - protein, 7 aa, Giardia lamblia
SVSTHLA

SEQ ID NO: 3141018 - protein, 6 aa, Giardia lamblia
SVSTPE

SEQ ID NO: 3141019 - protein, 10 aa, Giardia lamblia
SVSTPRPAVE

SEQ ID NO: 3141020 - protein, 23 aa, Giardia lamblia
SVSTRRGEPPEVSSKDAAEAKKA

SEQ ID NO: 3141021 - protein, 20 aa, Giardia lamblia
SVSTSTIATYSTDLGQQDRC

SEQ ID NO: 3141022 - protein, 4 aa, Giardia lamblia
SVTA

SEQ ID NO: 3141023 - protein, 4 aa, Giardia lamblia
SVTD

SEQ ID NO: 3141024 - protein, 4 aa, Giardia lamblia
SVTE

SEQ ID NO: 3141025 - protein, 15 aa, Giardia lamblia
SVTESSGKDDGAGDA

SEQ ID NO: 3141026 - protein, 8 aa, Giardia lamblia
SVTEVTTE

SEQ ID NO: 3141027 - protein, 5 aa, Giardia lamblia
SVTGA

SEQ ID NO: 3141028 - protein, 5 aa, Giardia lamblia
SVTGN

SEQ ID NO: 3141029 - protein, 15 aa, Giardia lamblia
SVTGVSTGSLLPTSS

SEQ ID NO: 3141030 - protein, 18 aa, Giardia lamblia
SVTINKGKDTEYVSGSIG

SEQ ID NO: 3141031 - protein, 21 aa, Giardia lamblia
SVTISEGSTCKHRSSQDESFR

SEQ ID NO: 3141032 - protein, 8 aa, Giardia lamblia
SVTKDDGN

SEQ ID NO: 3141033 - protein, 6 aa, Giardia lamblia
SVTKRL

SEQ ID NO: 3141034 - protein, 5 aa, Giardia lamblia
SVTMD

SEQ ID NO: 3141035 - protein, 5 aa, Giardia lamblia
SVTPP

SEQ ID NO: 3141036 - protein, 8 aa, Giardia lamblia
SVTPPSPG

SEQ ID NO: 3141037 - protein, 31 aa, Giardia lamblia
SVTPQSPSERKANRRAKSSVDTRSRYNSEAL

SEQ ID NO: 3141038 - protein, 15 aa, Giardia lamblia
SVTPRRRTSASFTNA

SEQ ID NO: 3141039 - protein, 11 aa, Giardia lamblia
SVTQSEAGPEL

SEQ ID NO: 3141040 - protein, 10 aa, Giardia lamblia
SVTRDTANQI

SEQ ID NO: 3141041 - protein, 7 aa, Giardia lamblia
SVTRGQP

SEQ ID NO: 3141042 - protein, 5 aa, Giardia lamblia
SVTRR

SEQ ID NO: 3141043 - protein, 4 aa, Giardia lamblia
SVTS

SEQ ID NO: 3141044 - protein, 20 aa, Giardia lamblia
SVTSASQTVTGIDTGQSLSH

SEQ ID NO: 3141045 - protein, 10 aa, Giardia lamblia
SVTSENGRTP

SEQ ID NO: 3141046 - protein, 6 aa, Giardia lamblia
SVTSND

SEQ ID NO: 3141047 - protein, 30 aa, Giardia lamblia
SVTSSASTAKDGQPPLADSASTSNTQNKAV

SEQ ID NO: 3141048 - protein, 6 aa, Giardia lamblia
SVTSTV

SEQ ID NO: 3141049 - protein, 6 aa, Giardia lamblia
SVTTGS

SEQ ID NO: 3141050 - protein, 7 aa, Giardia lamblia
SVTTTKT

SEQ ID NO: 3141051 - protein, 14 aa, Giardia lamblia
SVTWESEDNSNGAV

SEQ ID NO: 3141052 - protein, 12 aa, Giardia lamblia
SVYASDANETMN

SEQ ID NO: 3141053 - protein, 6 aa, Giardia lamblia
SVYEGT

SEQ ID NO: 3141054 - protein, 5 aa, Giardia lamblia
SVYTG

SEQ ID NO: 3141055 - protein, 15 aa, Giardia lamblia
SVYTNSSYHEGPGIS

SEQ ID NO: 3141056 - protein, 14 aa, Giardia lamblia
SWAGQAGATNEAKL

SEQ ID NO: 3141057 - protein, 5 aa, Giardia lamblia
SWEGQ

SEQ ID NO: 3141058 - protein, 6 aa, Giardia lamblia
SWGPGR

SEQ ID NO: 3141059 - protein, 11 aa, Giardia lamblia
SWKDPKVDEGM

SEQ ID NO: 3141060 - protein, 5 aa, Giardia lamblia
SWPRG

SEQ ID NO: 3141061 - protein, 5 aa, Giardia lamblia
SWQPA

SEQ ID NO: 3141062 - protein, 23 aa, Giardia lamblia
SWRGEASGDIGVNGPTKIDRTDT

SEQ ID NO: 3141063 - protein, 8 aa, Giardia lamblia
SWSEQDNN

SEQ ID NO: 3141064 - protein, 4 aa, Giardia lamblia
SWTN

SEQ ID NO: 3141065 - protein, 10 aa, Giardia lamblia
SYAAVKTPQQ

SEQ ID NO: 3141066 - protein, 6 aa, Giardia lamblia
SYAENT

SEQ ID NO: 3141067 - protein, 6 aa, Giardia lamblia
SYAGDA

SEQ ID NO: 3141068 - protein, 6 aa, Giardia lamblia
SYAGNA

SEQ ID NO: 3141069 - protein, 15 aa, Giardia lamblia
SYAPSTACSHEASTT

SEQ ID NO: 3141070 - protein, 4 aa, Giardia lamblia
SYAQ

SEQ ID NO: 3141071 - protein, 12 aa, Giardia lamblia
SYAQKKAKTTKE

SEQ ID NO: 3141072 - protein, 8 aa, Giardia lamblia
SYARESGN

SEQ ID NO: 3141073 - protein, 9 aa, Giardia lamblia
SYDAEQSVV

SEQ ID NO: 3141074 - protein, 6 aa, Giardia lamblia
SYDDPQ

SEQ ID NO: 3141075 - protein, 8 aa, Giardia lamblia
SYDGDHLP

SEQ ID NO: 3141076 - protein, 5 aa, Giardia lamblia
SYDKS

SEQ ID NO: 3141077 - protein, 4 aa, Giardia lamblia
SYDN

SEQ ID NO: 3141078 - protein, 7 aa, Giardia lamblia
SYDNKGK

SEQ ID NO: 3141079 - protein, 4 aa, Giardia lamblia
SYDQ

SEQ ID NO: 3141080 - protein, 10 aa, Giardia lamblia
SYDQETKKQT

SEQ ID NO: 3141081 - protein, 5 aa, Giardia lamblia
SYDQI

SEQ ID NO: 3141082 - protein, 38 aa, Giardia lamblia
SYDSSNSEVGTADLNTSPNASSNSKDKSTRPLPQPEHS

SEQ ID NO: 3141083 - protein, 12 aa, Giardia lamblia
SYEATYKTPITE

SEQ ID NO: 3141084 - protein, 6 aa, Giardia lamblia
SYEGDT

SEQ ID NO: 3141085 - protein, 5 aa, Giardia lamblia
SYEPQ

SEQ ID NO: 3141086 - protein, 5 aa, Giardia lamblia
SYERD

SEQ ID NO: 3141087 - protein, 18 aa, Giardia lamblia
SYESSHEAKTQKSSGKQS

SEQ ID NO: 3141088 - protein, 13 aa, Giardia lamblia
SYEVSSQTSSGSF

SEQ ID NO: 3141089 - protein, 22 aa, Giardia lamblia
SYGAAKKTIDKSTREQDEDRGQ

SEQ ID NO: 3141090 - protein, 54 aa, Giardia lamblia
SYGAPLNKSQNASNLTSSRMDKGMGKSTLGRSMSAGASSSGYANSKGPARPRNT

SEQ ID NO: 3141091 - protein, 24 aa, Giardia lamblia
SYGDEDDEDDFEGSLASEGSDEEA

SEQ ID NO: 3141092 - protein, 8 aa, Giardia lamblia
SYGENEFK

SEQ ID NO: 3141093 - protein, 7 aa, Giardia lamblia
SYGGEQA

SEQ ID NO: 3141094 - protein, 20 aa, Giardia lamblia
SYGGGEGATNLNSRAQSEIQ

SEQ ID NO: 3141095 - protein, 6 aa, Giardia lamblia
SYGGNV

SEQ ID NO: 3141096 - protein, 14 aa, Giardia lamblia
SYGGQEKRLTRAQR

SEQ ID NO: 3141097 - protein, 8 aa, Giardia lamblia
SYGGTDRA

SEQ ID NO: 3141098 - protein, 5 aa, Giardia lamblia
SYGKA

SEQ ID NO: 3141099 - protein, 13 aa, Giardia lamblia
SYGKNSVSENVGP

SEQ ID NO: 3141100 - protein, 4 aa, Giardia lamblia
SYGS

SEQ ID NO: 3141101 - protein, 26 aa, Giardia lamblia
SYGSFGSHGGGAFSGKDASKVDRSGA

SEQ ID NO: 3141102 - protein, 15 aa, Giardia lamblia
SYGTPRKSKSCTREH

SEQ ID NO: 3141103 - protein, 5 aa, Giardia lamblia
SYGVG

SEQ ID NO: 3141104 - protein, 18 aa, Giardia lamblia
SYGYNNYKQEAKKEELQR

SEQ ID NO: 3141105 - protein, 6 aa, Giardia lamblia
SYIDSS

SEQ ID NO: 3141106 - protein, 6 aa, Giardia lamblia
SYISED

SEQ ID NO: 3141107 - protein, 20 aa, Giardia lamblia
SYKAGASHGGDSTFTGASRK

SEQ ID NO: 3141108 - protein, 5 aa, Giardia lamblia
SYKDL

SEQ ID NO: 3141109 - protein, 8 aa, Giardia lamblia
SYKGTRQE

SEQ ID NO: 3141110 - protein, 21 aa, Giardia lamblia
SYKRRDEKNFNSSSDESDGDF

SEQ ID NO: 3141111 - protein, 13 aa, Giardia lamblia
SYKSTTKGNEHID

SEQ ID NO: 3141112 - protein, 19 aa, Giardia lamblia
SYKTTGDRVTTSGNIPTEL

SEQ ID NO: 3141113 - protein, 7 aa, Giardia lamblia
SYLSPNQ

SEQ ID NO: 3141114 - protein, 41 aa, Giardia lamblia
SYNGPSEPKPGAKNEVIKPKGKAYGKDTPAPPRYEFDDESE

SEQ ID NO: 3141115 - protein, 15 aa, Giardia lamblia
SYNGSRVDTSESIKE

SEQ ID NO: 3141116 - protein, 7 aa, Giardia lamblia
SYNNETD

SEQ ID NO: 3141117 - protein, 11 aa, Giardia lamblia
SYNPLSRSEPL

SEQ ID NO: 3141118 - protein, 7 aa, Giardia lamblia
SYNPPSV

SEQ ID NO: 3141119 - protein, 5 aa, Giardia lamblia
SYNSE

SEQ ID NO: 3141120 - protein, 5 aa, Giardia lamblia
SYNSV

SEQ ID NO: 3141121 - protein, 6 aa, Giardia lamblia
SYNTSR

SEQ ID NO: 3141122 - protein, 17 aa, Giardia lamblia
SYPAKVKKEAVKGAVPE

SEQ ID NO: 3141123 - protein, 5 aa, Giardia lamblia
SYPEF

SEQ ID NO: 3141124 - protein, 8 aa, Giardia lamblia
SYPGTTSL

SEQ ID NO: 3141125 - protein, 9 aa, Giardia lamblia
SYPNPDGSS

SEQ ID NO: 3141126 - protein, 5 aa, Giardia lamblia
SYPPI

SEQ ID NO: 3141127 - protein, 7 aa, Giardia lamblia
SYPPNQL

SEQ ID NO: 3141128 - protein, 6 aa, Giardia lamblia
SYPPPT

SEQ ID NO: 3141129 - protein, 6 aa, Giardia lamblia
SYPSRE

SEQ ID NO: 3141130 - protein, 17 aa, Giardia lamblia
SYQNRKELEELTTGRTG

SEQ ID NO: 3141131 - protein, 17 aa, Giardia lamblia
SYQNSKCKTTSKTRRGV

SEQ ID NO: 3141132 - protein, 16 aa, Giardia lamblia
SYQPAQQKRTYQPPQL

SEQ ID NO: 3141133 - protein, 6 aa, Giardia lamblia
SYQPPV

SEQ ID NO: 3141134 - protein, 5 aa, Giardia lamblia
SYQTP

SEQ ID NO: 3141135 - protein, 22 aa, Giardia lamblia
SYRGGHKPCNSISGTHTPSNNF

SEQ ID NO: 3141136 - protein, 6 aa, Giardia lamblia
SYRGKM

SEQ ID NO: 3141137 - protein, 25 aa, Giardia lamblia
SYRPYATADDLRDDIGESIREGGSF

SEQ ID NO: 3141138 - protein, 7 aa, Giardia lamblia
SYRSDVT

SEQ ID NO: 3141139 - protein, 35 aa, Giardia lamblia
SYSDEDSDGRDGDEEEYEETEANELDVNQGSMTKR

SEQ ID NO: 3141140 - protein, 8 aa, Giardia lamblia
SYSDTDDF

SEQ ID NO: 3141141 - protein, 9 aa, Giardia lamblia
SYSEDSNEK

SEQ ID NO: 3141142 - protein, 6 aa, Giardia lamblia
SYSEGG

SEQ ID NO: 3141143 - protein, 4 aa, Giardia lamblia
SYSG

SEQ ID NO: 3141144 - protein, 25 aa, Giardia lamblia
SYSGGIGDGLGSMGNAGRRNANPAI

SEQ ID NO: 3141145 - protein, 12 aa, Giardia lamblia
SYSGKELSSSFR

SEQ ID NO: 3141146 - protein, 13 aa, Giardia lamblia
SYSGSSASQKSRK

SEQ ID NO: 3141147 - protein, 5 aa, Giardia lamblia
SYSKE

SEQ ID NO: 3141148 - protein, 10 aa, Giardia lamblia
SYSKSTSISP

SEQ ID NO: 3141149 - protein, 4 aa, Giardia lamblia
SYSL

SEQ ID NO: 3141150 - protein, 13 aa, Giardia lamblia
SYSNKNPVSKQSL

SEQ ID NO: 3141151 - protein, 4 aa, Giardia lamblia
SYSP

SEQ ID NO: 3141152 - protein, 9 aa, Giardia lamblia
SYSPEDKEP

SEQ ID NO: 3141153 - protein, 17 aa, Giardia lamblia
SYSPYQSAFNSTSDSLS

SEQ ID NO: 3141154 - protein, 7 aa, Giardia lamblia
SYSQAGK

SEQ ID NO: 3141155 - protein, 11 aa, Giardia lamblia
SYSQARPSLNS

SEQ ID NO: 3141156 - protein, 17 aa, Giardia lamblia
SYSRGSSTAAPTRPQAQ

SEQ ID NO: 3141157 - protein, 7 aa, Giardia lamblia
SYSSAAN

SEQ ID NO: 3141158 - protein, 7 aa, Giardia lamblia
SYSSAER

SEQ ID NO: 3141159 - protein, 11 aa, Giardia lamblia
SYSSDASEGTV

SEQ ID NO: 3141160 - protein, 18 aa, Giardia lamblia
SYSSNAALPSHANPLESG

SEQ ID NO: 3141161 - protein, 17 aa, Giardia lamblia
SYSSPSEPSGQGSSHPK

SEQ ID NO: 3141162 - protein, 7 aa, Giardia lamblia
SYSSSED

SEQ ID NO: 3141163 - protein, 8 aa, Giardia lamblia
SYSTGRVN

SEQ ID NO: 3141164 - protein, 27 aa, Giardia lamblia
SYSVQGQGLGEPHPSSQQRSLQPSGRK

SEQ ID NO: 3141165 - protein, 15 aa, Giardia lamblia
SYTASPLSNYSSTSL

SEQ ID NO: 3141166 - protein, 10 aa, Giardia lamblia
SYTGPTNESM

SEQ ID NO: 3141167 - protein, 8 aa, Giardia lamblia
SYTNSRGI

SEQ ID NO: 3141168 - protein, 10 aa, Giardia lamblia
SYTNVGSENP

SEQ ID NO: 3141169 - protein, 5 aa, Giardia lamblia
SYTPG

SEQ ID NO: 3141170 - protein, 4 aa, Giardia lamblia
SYTQ

SEQ ID NO: 3141171 - protein, 9 aa, Giardia lamblia
SYTQRPCTT

SEQ ID NO: 3141172 - protein, 6 aa, Giardia lamblia
SYTREN

SEQ ID NO: 3141173 - protein, 8 aa, Giardia lamblia
SYTRTSGI

SEQ ID NO: 3141174 - protein, 5 aa, Giardia lamblia
SYTSQ

SEQ ID NO: 3141175 - protein, 8 aa, Giardia lamblia
SYTTELDT

SEQ ID NO: 3141176 - protein, 6 aa, Giardia lamblia
SYVEGP

SEQ ID NO: 3141177 - protein, 8 aa, Giardia lamblia
SYVSQEEY

SEQ ID NO: 3141178 - protein, 12 aa, Giardia lamblia
SYVTPAESETDR

SEQ ID NO: 3141179 - protein, 11 aa, Giardia lamblia
SYYSQPPMSDN

SEQ ID NO: 3141180 - protein, 5 aa, Giardia lamblia
SYYSS

SEQ ID NO: 3141181 - protein, 26 aa, Giardia lamblia
TAAAKDSDEEEDDQGVTKDEKKEALK

SEQ ID NO: 3141182 - protein, 9 aa, Giardia lamblia
TAADGTSTR

SEQ ID NO: 3141183 - protein, 9 aa, Giardia lamblia
TAADRLNQD

SEQ ID NO: 3141184 - protein, 15 aa, Giardia lamblia
TAADTPSANKSGSLK

SEQ ID NO: 3141185 - protein, 4 aa, Giardia lamblia
TAAE

SEQ ID NO: 3141186 - protein, 14 aa, Giardia lamblia
TAAEEGDDNASVEE

SEQ ID NO: 3141187 - protein, 8 aa, Giardia lamblia
TAAEQRAL

SEQ ID NO: 3141188 - protein, 21 aa, Giardia lamblia
TAAESDTKQTDPTHPQDVQEP

SEQ ID NO: 3141189 - protein, 9 aa, Giardia lamblia
TAAGKAEEA

SEQ ID NO: 3141190 - protein, 22 aa, Giardia lamblia
TAAGKSTLMEQSKQARGDSVHH

SEQ ID NO: 3141191 - protein, 5 aa, Giardia lamblia
TAAGP

SEQ ID NO: 3141192 - protein, 14 aa, Giardia lamblia
TAAGTSAEPRSVAT

SEQ ID NO: 3141193 - protein, 8 aa, Giardia lamblia
TAAHGTVQ

SEQ ID NO: 3141194 - protein, 66 aa, Giardia lamblia
TAAHRPEDTPGPGAYNAEQYGTTGSDAPAASLAGRHADNTKNTNPGPGAYEQGEDAIRQKAPAYSM

SEQ ID NO: 3141195 - protein, 7 aa, Giardia lamblia
TAAKGHD

SEQ ID NO: 3141196 - protein, 8 aa, Giardia lamblia
TAALTGTV

SEQ ID NO: 3141197 - protein, 5 aa, Giardia lamblia
TAANE

SEQ ID NO: 3141198 - protein, 10 aa, Giardia lamblia
TAAPATDMTR

SEQ ID NO: 3141199 - protein, 10 aa, Giardia lamblia
TAAPSKTRDR

SEQ ID NO: 3141200 - protein, 6 aa, Giardia lamblia
TAAQKV

SEQ ID NO: 3141201 - protein, 8 aa, Giardia lamblia
TAAQNTEL

SEQ ID NO: 3141202 - protein, 16 aa, Giardia lamblia
TAAQQAPEKQDNTIST

SEQ ID NO: 3141203 - protein, 8 aa, Giardia lamblia
TAARDDDN

SEQ ID NO: 3141204 - protein, 6 aa, Giardia lamblia
TAARDS

SEQ ID NO: 3141205 - protein, 17 aa, Giardia lamblia
TAARVPAPIPTTLQDGD

SEQ ID NO: 3141206 - protein, 11 aa, Giardia lamblia
TAASCKREECQ

SEQ ID NO: 3141207 - protein, 10 aa, Giardia lamblia
TAASDTVARL

SEQ ID NO: 3141208 - protein, 7 aa, Giardia lamblia
TAASENE

SEQ ID NO: 3141209 - protein, 23 aa, Giardia lamblia
TAASMAGSMGKSLSRSSRARPTD

SEQ ID NO: 3141210 - protein, 9 aa, Giardia lamblia
TAASSKSIA

SEQ ID NO: 3141211 - protein, 10 aa, Giardia lamblia
TAASTEIEDT

SEQ ID NO: 3141212 - protein, 7 aa, Giardia lamblia
TAATAAT

SEQ ID NO: 3141213 - protein, 5 aa, Giardia lamblia
TAATL

SEQ ID NO: 3141214 - protein, 17 aa, Giardia lamblia
TAATPESPSCRAPRRPL

SEQ ID NO: 3141215 - protein, 9 aa, Giardia lamblia
TAATQASGQ

SEQ ID NO: 3141216 - protein, 17 aa, Giardia lamblia
TADAGSASTSEETQEPA

SEQ ID NO: 3141217 - protein, 14 aa, Giardia lamblia
TADASSESNLVTQG

SEQ ID NO: 3141218 - protein, 7 aa, Giardia lamblia
TADESAV

SEQ ID NO: 3141219 - protein, 7 aa, Giardia lamblia
TADEYKE

SEQ ID NO: 3141220 - protein, 9 aa, Giardia lamblia
TADGASEGT

SEQ ID NO: 3141221 - protein, 7 aa, Giardia lamblia
TADGDTI

SEQ ID NO: 3141222 - protein, 6 aa, Giardia lamblia
TADGRN

SEQ ID NO: 3141223 - protein, 6 aa, Giardia lamblia
TADGRT

SEQ ID NO: 3141224 - protein, 10 aa, Giardia lamblia
TADHTTLPRN

SEQ ID NO: 3141225 - protein, 9 aa, Giardia lamblia
TADIDSAPY

SEQ ID NO: 3141226 - protein, 7 aa, Giardia lamblia
TADKADL

SEQ ID NO: 3141227 - protein, 4 aa, Giardia lamblia
TADL

SEQ ID NO: 3141228 - protein, 4 aa, Giardia lamblia
TADN

SEQ ID NO: 3141229 - protein, 10 aa, Giardia lamblia
TADNAAGKKE

SEQ ID NO: 3141230 - protein, 7 aa, Giardia lamblia
TADNGRV

SEQ ID NO: 3141231 - protein, 10 aa, Giardia lamblia
TADNPEGIER

SEQ ID NO: 3141232 - protein, 9 aa, Giardia lamblia
TADNTRISD

SEQ ID NO: 3141233 - protein, 6 aa, Giardia lamblia
TADPGI

SEQ ID NO: 3141234 - protein, 24 aa, Giardia lamblia
TADPRPRHELPEDGVDQDHEARHD

SEQ ID NO: 3141235 - protein, 26 aa, Giardia lamblia
TADPRPRHELPENGVDQDHEAQHDRR

SEQ ID NO: 3141236 - protein, 24 aa, Giardia lamblia
TADPRPRHELPESGVDQDHEARHD

SEQ ID NO: 3141237 - protein, 7 aa, Giardia lamblia
TADQADK

SEQ ID NO: 3141238 - protein, 12 aa, Giardia lamblia
TADQQKSPSPQF

SEQ ID NO: 3141239 - protein, 13 aa, Giardia lamblia
TADQQTPKTEQVE

SEQ ID NO: 3141240 - protein, 20 aa, Giardia lamblia
TADSSTAYGRTFSKEDTPTL

SEQ ID NO: 3141241 - protein, 14 aa, Giardia lamblia
TAEAEKTKKEVQTV

SEQ ID NO: 3141242 - protein, 10 aa, Giardia lamblia
TAEASDAPTY

SEQ ID NO: 3141243 - protein, 9 aa, Giardia lamblia
TAEEGTVSS

SEQ ID NO: 3141244 - protein, 6 aa, Giardia lamblia
TAEGAT

SEQ ID NO: 3141245 - protein, 6 aa, Giardia lamblia
TAEGPV

SEQ ID NO: 3141246 - protein, 12 aa, Giardia lamblia
TAEHHGAETSHG

SEQ ID NO: 3141247 - protein, 8 aa, Giardia lamblia
TAEIADQR

SEQ ID NO: 3141248 - protein, 4 aa, Giardia lamblia
TAEK

SEQ ID NO: 3141249 - protein, 9 aa, Giardia lamblia
TAEKDPDRT

SEQ ID NO: 3141250 - protein, 10 aa, Giardia lamblia
TAEKEAEASL

SEQ ID NO: 3141251 - protein, 13 aa, Giardia lamblia
TAEKIDQLSDKAN

SEQ ID NO: 3141252 - protein, 8 aa, Giardia lamblia
TAEKTPCG

SEQ ID NO: 3141253 - protein, 17 aa, Giardia lamblia
TAELETAADNLSKEKAT

SEQ ID NO: 3141254 - protein, 8 aa, Giardia lamblia
TAENGLST

SEQ ID NO: 3141255 - protein, 5 aa, Giardia lamblia
TAENS

SEQ ID NO: 3141256 - protein, 8 aa, Giardia lamblia
TAENTIST

SEQ ID NO: 3141257 - protein, 4 aa, Giardia lamblia
TAEQ

SEQ ID NO: 3141258 - protein, 13 aa, Giardia lamblia
TAEQASQEQQANQ

SEQ ID NO: 3141259 - protein, 5 aa, Giardia lamblia
TAEQD

SEQ ID NO: 3141260 - protein, 7 aa, Giardia lamblia
TAEQEDQ

SEQ ID NO: 3141261 - protein, 14 aa, Giardia lamblia
TAERAAVASEQERN

SEQ ID NO: 3141262 - protein, 11 aa, Giardia lamblia
TAERDSLRDEV

SEQ ID NO: 3141263 - protein, 9 aa, Giardia lamblia
TAERRAREA

SEQ ID NO: 3141264 - protein, 8 aa, Giardia lamblia
TAERTTSA

SEQ ID NO: 3141265 - protein, 6 aa, Giardia lamblia
TAETEA

SEQ ID NO: 3141266 - protein, 5 aa, Giardia lamblia
TAETN

SEQ ID NO: 3141267 - protein, 7 aa, Giardia lamblia
TAFNSTP

SEQ ID NO: 3141268 - protein, 9 aa, Giardia lamblia
TAFQETESD

SEQ ID NO: 3141269 - protein, 6 aa, Giardia lamblia
TAFSSH

SEQ ID NO: 3141270 - protein, 16 aa, Giardia lamblia
TAFTPTPTPKPSGTKH

SEQ ID NO: 3141271 - protein, 21 aa, Giardia lamblia
TAGCSTRATNNNTQNLGGTAE

SEQ ID NO: 3141272 - protein, 12 aa, Giardia lamblia
TAGDRVDDRPEV

SEQ ID NO: 3141273 - protein, 20 aa, Giardia lamblia
TAGGKESISDSFRSTTASDA

SEQ ID NO: 3141274 - protein, 10 aa, Giardia lamblia
TAGKNNGSLG

SEQ ID NO: 3141275 - protein, 19 aa, Giardia lamblia
TAGLSVTESSPRDSEFDFP

SEQ ID NO: 3141276 - protein, 4 aa, Giardia lamblia
TAGM

SEQ ID NO: 3141277 - protein, 9 aa, Giardia lamblia
TAGMGSGAN

SEQ ID NO: 3141278 - protein, 5 aa, Giardia lamblia
TAGNI

SEQ ID NO: 3141279 - protein, 6 aa, Giardia lamblia
TAGNLP

SEQ ID NO: 3141280 - protein, 5 aa, Giardia lamblia
TAGNV

SEQ ID NO: 3141281 - protein, 7 aa, Giardia lamblia
TAGPEDL

SEQ ID NO: 3141282 - protein, 8 aa, Giardia lamblia
TAGQTPGG

SEQ ID NO: 3141283 - protein, 13 aa, Giardia lamblia
TAGSKDSSYSAKA

SEQ ID NO: 3141284 - protein, 13 aa, Giardia lamblia
TAGSNTPIRPGSS

SEQ ID NO: 3141285 - protein, 10 aa, Giardia lamblia
TAGSQNEQQA

SEQ ID NO: 3141286 - protein, 18 aa, Giardia lamblia
TAGSSSCANELPESSTKE

SEQ ID NO: 3141287 - protein, 5 aa, Giardia lamblia
TAGTL

SEQ ID NO: 3141288 - protein, 10 aa, Giardia lamblia
TAGVEHSKEH

SEQ ID NO: 3141289 - protein, 5 aa, Giardia lamblia
TAGVR

SEQ ID NO: 3141290 - protein, 8 aa, Giardia lamblia
TAGVRGDK

SEQ ID NO: 3141291 - protein, 12 aa, Giardia lamblia
TAGVSRSKQGIG

SEQ ID NO: 3141292 - protein, 11 aa, Giardia lamblia
TAGVSSGASKA

SEQ ID NO: 3141293 - protein, 9 aa, Giardia lamblia
TAGVSVSQG

SEQ ID NO: 3141294 - protein, 4 aa, Giardia lamblia
TAGY

SEQ ID NO: 3141295 - protein, 9 aa, Giardia lamblia
TAGYGQADR

SEQ ID NO: 3141296 - protein, 17 aa, Giardia lamblia
TAGYGRTGPWQSAAGNL

SEQ ID NO: 3141297 - protein, 5 aa, Giardia lamblia
TAGYK

SEQ ID NO: 3141298 - protein, 6 aa, Giardia lamblia
TAHENA

SEQ ID NO: 3141299 - protein, 7 aa, Giardia lamblia
TAHGDDS

SEQ ID NO: 3141300 - protein, 8 aa, Giardia lamblia
TAHNGTRQ

SEQ ID NO: 3141301 - protein, 17 aa, Giardia lamblia
TAHPAKFSPDDKYSEQR

SEQ ID NO: 3141302 - protein, 7 aa, Giardia lamblia
TAHRGKK

SEQ ID NO: 3141303 - protein, 8 aa, Giardia lamblia
TAHRPHSS

SEQ ID NO: 3141304 - protein, 31 aa, Giardia lamblia
TAHTSSKTQQTHTETETPSSELDAPLPPTLP

SEQ ID NO: 3141305 - protein, 14 aa, Giardia lamblia
TAIENAESRARAEK

SEQ ID NO: 3141306 - protein, 9 aa, Giardia lamblia
TAIESRPSK

SEQ ID NO: 3141307 - protein, 17 aa, Giardia lamblia
TAIKGDKLNSTKCGTPL

SEQ ID NO: 3141308 - protein, 6 aa, Giardia lamblia
TAIPGS

SEQ ID NO: 3141309 - protein, 4 aa, Giardia lamblia
TAIS

SEQ ID NO: 3141310 - protein, 14 aa, Giardia lamblia
TAISADAGKSLPGG

SEQ ID NO: 3141311 - protein, 15 aa, Giardia lamblia
TAKAAAEGPDRKPNV

SEQ ID NO: 3141312 - protein, 8 aa, Giardia lamblia
TAKAGAST

SEQ ID NO: 3141313 - protein, 8 aa, Giardia lamblia
TAKAGGGA

SEQ ID NO: 3141314 - protein, 9 aa, Giardia lamblia
TAKDTKPNV

SEQ ID NO: 3141315 - protein, 6 aa, Giardia lamblia
TAKEAL

SEQ ID NO: 3141316 - protein, 8 aa, Giardia lamblia
TAKGASVG

SEQ ID NO: 3141317 - protein, 7 aa, Giardia lamblia
TAKGSSM

SEQ ID NO: 3141318 - protein, 4 aa, Giardia lamblia
TAKH

SEQ ID NO: 3141319 - protein, 6 aa, Giardia lamblia
TAKHAT

SEQ ID NO: 3141320 - protein, 9 aa, Giardia lamblia
TAKHSNADR

SEQ ID NO: 3141321 - protein, 4 aa, Giardia lamblia
TAKK

SEQ ID NO: 3141322 - protein, 10 aa, Giardia lamblia
TAKKYGHPKN

SEQ ID NO: 3141323 - protein, 12 aa, Giardia lamblia
TAKLNKNRPAMS

SEQ ID NO: 3141324 - protein, 7 aa, Giardia lamblia
TAKLTSQ

SEQ ID NO: 3141325 - protein, 25 aa, Giardia lamblia
TAKPPAWQQEQSSELTSDDRKGWEE

SEQ ID NO: 3141326 - protein, 11 aa, Giardia lamblia
TAKPPSTGSYQ

SEQ ID NO: 3141327 - protein, 14 aa, Giardia lamblia
TAKPSARAAAKASY

SEQ ID NO: 3141328 - protein, 10 aa, Giardia lamblia
TAKPSNNAEI

SEQ ID NO: 3141329 - protein, 7 aa, Giardia lamblia
TAKPTSV

SEQ ID NO: 3141330 - protein, 6 aa, Giardia lamblia
TAKRDV

SEQ ID NO: 3141331 - protein, 7 aa, Giardia lamblia
TAKRELE

SEQ ID NO: 3141332 - protein, 11 aa, Giardia lamblia
TAKRKAEESRR

SEQ ID NO: 3141333 - protein, 8 aa, Giardia lamblia
TAKSLASD

SEQ ID NO: 3141334 - protein, 8 aa, Giardia lamblia
TAKTAKTQ

SEQ ID NO: 3141335 - protein, 15 aa, Giardia lamblia
TAKTGDDLKRAAKCR

SEQ ID NO: 3141336 - protein, 5 aa, Giardia lamblia
TALDT

SEQ ID NO: 3141337 - protein, 6 aa, Giardia lamblia
TALENK

SEQ ID NO: 3141338 - protein, 10 aa, Giardia lamblia
TALGQGHSYQ

SEQ ID NO: 3141339 - protein, 5 aa, Giardia lamblia
TALPH

SEQ ID NO: 3141340 - protein, 43 aa, Giardia lamblia
TALQTKPATKRTTQETVSKPVRTRPGSASASQGVRSTTLAPSS

SEQ ID NO: 3141341 - protein, 9 aa, Giardia lamblia
TALRGKPRS

SEQ ID NO: 3141342 - protein, 4 aa, Giardia lamblia
TALS

SEQ ID NO: 3141343 - protein, 16 aa, Giardia lamblia
TALSTAASSARGSPGQ

SEQ ID NO: 3141344 - protein, 6 aa, Giardia lamblia
TAMTGE

SEQ ID NO: 3141345 - protein, 6 aa, Giardia lamblia
TAMTSP

SEQ ID NO: 3141346 - protein, 11 aa, Giardia lamblia
TAMTSTNPEHA

SEQ ID NO: 3141347 - protein, 8 aa, Giardia lamblia
TANADTRD

SEQ ID NO: 3141348 - protein, 6 aa, Giardia lamblia
TANDDS

SEQ ID NO: 3141349 - protein, 7 aa, Giardia lamblia
TANDIDP

SEQ ID NO: 3141350 - protein, 6 aa, Giardia lamblia
TANETT

SEQ ID NO: 3141351 - protein, 7 aa, Giardia lamblia
TANGGSL

SEQ ID NO: 3141352 - protein, 7 aa, Giardia lamblia
TANGRRT

SEQ ID NO: 3141353 - protein, 19 aa, Giardia lamblia
TANKHTSTDPSPEHNEATT

SEQ ID NO: 3141354 - protein, 13 aa, Giardia lamblia
TANLTDPRSSRLN

SEQ ID NO: 3141355 - protein, 9 aa, Giardia lamblia
TANNSQHGN

SEQ ID NO: 3141356 - protein, 15 aa, Giardia lamblia
TANPGDIVSSTEAEY

SEQ ID NO: 3141357 - protein, 18 aa, Giardia lamblia
TANPHKQETSQLDTELDT

SEQ ID NO: 3141358 - protein, 9 aa, Giardia lamblia
TANRTPESL

SEQ ID NO: 3141359 - protein, 27 aa, Giardia lamblia
TANSNDPSTGHPSGRSSRSCAHRQTSE

SEQ ID NO: 3141360 - protein, 24 aa, Giardia lamblia
TANSQINTSKGKTKTSAKKDKSNI

SEQ ID NO: 3141361 - protein, 7 aa, Giardia lamblia
TANYPTY

SEQ ID NO: 3141362 - protein, 14 aa, Giardia lamblia
TAPAEDDPLTAKKH

SEQ ID NO: 3141363 - protein, 6 aa, Giardia lamblia
TAPARA

SEQ ID NO: 3141364 - protein, 5 aa, Giardia lamblia
TAPDD

SEQ ID NO: 3141365 - protein, 8 aa, Giardia lamblia
TAPDNIPE

SEQ ID NO: 3141366 - protein, 9 aa, Giardia lamblia
TAPFDDSEL

SEQ ID NO: 3141367 - protein, 13 aa, Giardia lamblia
TAPFPPNQATIRP

SEQ ID NO: 3141368 - protein, 12 aa, Giardia lamblia
TAPFRKTGRLRG

SEQ ID NO: 3141369 - protein, 4 aa, Giardia lamblia
TAPG

SEQ ID NO: 3141370 - protein, 9 aa, Giardia lamblia
TAPGIGNAP

SEQ ID NO: 3141371 - protein, 13 aa, Giardia lamblia
TAPGPDSKSAQIR

SEQ ID NO: 3141372 - protein, 12 aa, Giardia lamblia
TAPGPGRCTRCP

SEQ ID NO: 3141373 - protein, 10 aa, Giardia lamblia
TAPGSGKTKA

SEQ ID NO: 3141374 - protein, 13 aa, Giardia lamblia
TAPGVNDSAVTNA

SEQ ID NO: 3141375 - protein, 7 aa, Giardia lamblia
TAPHGAG

SEQ ID NO: 3141376 - protein, 26 aa, Giardia lamblia
TAPHPSHRDYTTEREAKGWPKASDKY

SEQ ID NO: 3141377 - protein, 12 aa, Giardia lamblia
TAPISPESPQEI

SEQ ID NO: 3141378 - protein, 5 aa, Giardia lamblia
TAPKF

SEQ ID NO: 3141379 - protein, 19 aa, Giardia lamblia
TAPKSSSVKRSRSATFHSR

SEQ ID NO: 3141380 - protein, 9 aa, Giardia lamblia
TAPLQTAAS

SEQ ID NO: 3141381 - protein, 10 aa, Giardia lamblia
TAPPAITTPL

SEQ ID NO: 3141382 - protein, 5 aa, Giardia lamblia
TAPPK

SEQ ID NO: 3141383 - protein, 12 aa, Giardia lamblia
TAPQTGAKQTGA

SEQ ID NO: 3141384 - protein, 7 aa, Giardia lamblia
TAPRHPR

SEQ ID NO: 3141385 - protein, 7 aa, Giardia lamblia
TAPRPSI

SEQ ID NO: 3141386 - protein, 13 aa, Giardia lamblia
TAPSAFAKPDTGV

SEQ ID NO: 3141387 - protein, 10 aa, Giardia lamblia
TAPSDDGNEK

SEQ ID NO: 3141388 - protein, 7 aa, Giardia lamblia
TAPSEQK

SEQ ID NO: 3141389 - protein, 13 aa, Giardia lamblia
TAPSINPDPSGTN

SEQ ID NO: 3141390 - protein, 22 aa, Giardia lamblia
TAPSNQRSASVSIKGDALSPSF

SEQ ID NO: 3141391 - protein, 10 aa, Giardia lamblia
TAPSSNNNTD

SEQ ID NO: 3141392 - protein, 11 aa, Giardia lamblia
TAPSSVKLDTS

SEQ ID NO: 3141393 - protein, 35 aa, Giardia lamblia
TAPSTPVQGAPRGAPRGPLSGLPSPSPTWLQRRTS

SEQ ID NO: 3141394 - protein, 4 aa, Giardia lamblia
TAPT

SEQ ID NO: 3141395 - protein, 6 aa, Giardia lamblia
TAPTGR

SEQ ID NO: 3141396 - protein, 8 aa, Giardia lamblia
TAPTGTAA

SEQ ID NO: 3141397 - protein, 5 aa, Giardia lamblia
TAQAA

SEQ ID NO: 3141398 - protein, 15 aa, Giardia lamblia
TAQANKYKAIRSAYK

SEQ ID NO: 3141399 - protein, 10 aa, Giardia lamblia
TAQAQSPTEE

SEQ ID NO: 3141400 - protein, 22 aa, Giardia lamblia
TAQARAATPASGSTSLQSEQQI

SEQ ID NO: 3141401 - protein, 10 aa, Giardia lamblia
TAQDGASALN

SEQ ID NO: 3141402 - protein, 7 aa, Giardia lamblia
TAQDLSG

SEQ ID NO: 3141403 - protein, 4 aa, Giardia lamblia
TAQG

SEQ ID NO: 3141404 - protein, 8 aa, Giardia lamblia
TAQGEETY

SEQ ID NO: 3141405 - protein, 6 aa, Giardia lamblia
TAQHDR

SEQ ID NO: 3141406 - protein, 6 aa, Giardia lamblia
TAQHTS

SEQ ID NO: 3141407 - protein, 8 aa, Giardia lamblia
TAQKEASD

SEQ ID NO: 3141408 - protein, 11 aa, Giardia lamblia
TAQKEEVDARE

SEQ ID NO: 3141409 - protein, 10 aa, Giardia lamblia
TAQKSELEAT

SEQ ID NO: 3141410 - protein, 7 aa, Giardia lamblia
TAQNKNL

SEQ ID NO: 3141411 - protein, 7 aa, Giardia lamblia
TAQPNTL

SEQ ID NO: 3141412 - protein, 5 aa, Giardia lamblia
TAQSE

SEQ ID NO: 3141413 - protein, 9 aa, Giardia lamblia
TARATKELS

SEQ ID NO: 3141414 - protein, 8 aa, Giardia lamblia
TARDPTNS

SEQ ID NO: 3141415 - protein, 11 aa, Giardia lamblia
TARDSNTSLSA

SEQ ID NO: 3141416 - protein, 12 aa, Giardia lamblia
TAREKDGIDVRE

SEQ ID NO: 3141417 - protein, 9 aa, Giardia lamblia
TARERRDAE

SEQ ID NO: 3141418 - protein, 9 aa, Giardia lamblia
TARGMATGT

SEQ ID NO: 3141419 - protein, 15 aa, Giardia lamblia
TARHRTGYSDERGGG

SEQ ID NO: 3141420 - protein, 4 aa, Giardia lamblia
TARI

SEQ ID NO: 3141421 - protein, 9 aa, Giardia lamblia
TARLADGRQ

SEQ ID NO: 3141422 - protein, 5 aa, Giardia lamblia
TARNG

SEQ ID NO: 3141423 - protein, 7 aa, Giardia lamblia
TARPMTS

SEQ ID NO: 3141424 - protein, 7 aa, Giardia lamblia
TARRQKW

SEQ ID NO: 3141425 - protein, 19 aa, Giardia lamblia
TARSLTKAAQALKEKGAEQ

SEQ ID NO: 3141426 - protein, 6 aa, Giardia lamblia
TARTEE

SEQ ID NO: 3141427 - protein, 28 aa, Giardia lamblia
TARTVDQSDWSEQSVEHSDTSTETSADL

SEQ ID NO: 3141428 - protein, 10 aa, Giardia lamblia
TASAITASQL

SEQ ID NO: 3141429 - protein, 11 aa, Giardia lamblia
TASAKSEDVPE

SEQ ID NO: 3141430 - protein, 14 aa, Giardia lamblia
TASATNKKNDDLTT

SEQ ID NO: 3141431 - protein, 6 aa, Giardia lamblia
TASDSA

SEQ ID NO: 3141432 - protein, 9 aa, Giardia lamblia
TASDSASTL

SEQ ID NO: 3141433 - protein, 5 aa, Giardia lamblia
TASEA

SEQ ID NO: 3141434 - protein, 7 aa, Giardia lamblia
TASEHSS

SEQ ID NO: 3141435 - protein, 6 aa, Giardia lamblia
TASEPL

SEQ ID NO: 3141436 - protein, 12 aa, Giardia lamblia
TASGDTIKTSKV

SEQ ID NO: 3141437 - protein, 5 aa, Giardia lamblia
TASGF

SEQ ID NO: 3141438 - protein, 9 aa, Giardia lamblia
TASGLVPSG

SEQ ID NO: 3141439 - protein, 7 aa, Giardia lamblia
TASGMGY

SEQ ID NO: 3141440 - protein, 14 aa, Giardia lamblia
TASGPYLPPTTNLE

SEQ ID NO: 3141441 - protein, 14 aa, Giardia lamblia
TASGRSLKDQEDAL

SEQ ID NO: 3141442 - protein, 26 aa, Giardia lamblia
TASIQQKKQQIQPGPLPNNGSCKHAS

SEQ ID NO: 3141443 - protein, 6 aa, Giardia lamblia
TASKKD

SEQ ID NO: 3141444 - protein, 11 aa, Giardia lamblia
TASKQEGKQST

SEQ ID NO: 3141445 - protein, 24 aa, Giardia lamblia
TASKSDSARPGSAFSGRSKRASSA

SEQ ID NO: 3141446 - protein, 4 aa, Giardia lamblia
TASL

SEQ ID NO: 3141447 - protein, 4 aa, Giardia lamblia
TASM

SEQ ID NO: 3141448 - protein, 11 aa, Giardia lamblia
TASNAQHCTSE

SEQ ID NO: 3141449 - protein, 7 aa, Giardia lamblia
TASNTNA

SEQ ID NO: 3141450 - protein, 10 aa, Giardia lamblia
TASPADSLTS

SEQ ID NO: 3141451 - protein, 18 aa, Giardia lamblia
TASPIDAVGESTRERAPH

SEQ ID NO: 3141452 - protein, 6 aa, Giardia lamblia
TASPLE

SEQ ID NO: 3141453 - protein, 10 aa, Giardia lamblia
TASPSSATAS

SEQ ID NO: 3141454 - protein, 8 aa, Giardia lamblia
TASPVTPE

SEQ ID NO: 3141455 - protein, 4 aa, Giardia lamblia
TASQ

SEQ ID NO: 3141456 - protein, 4 aa, Giardia lamblia
TASR

SEQ ID NO: 3141457 - protein, 7 aa, Giardia lamblia
TASRHDA

SEQ ID NO: 3141458 - protein, 14 aa, Giardia lamblia
TASRTQSPGQTISS

SEQ ID NO: 3141459 - protein, 4 aa, Giardia lamblia
TASS

SEQ ID NO: 3141460 - protein, 5 aa, Giardia lamblia
TASSA

SEQ ID NO: 3141461 - protein, 14 aa, Giardia lamblia
TASSADTTLNEQQY

SEQ ID NO: 3141462 - protein, 8 aa, Giardia lamblia
TASSDGTI

SEQ ID NO: 3141463 - protein, 8 aa, Giardia lamblia
TASSDTST

SEQ ID NO: 3141464 - protein, 7 aa, Giardia lamblia
TASSKGT

SEQ ID NO: 3141465 - protein, 4 aa, Giardia lamblia
TAST

SEQ ID NO: 3141466 - protein, 18 aa, Giardia lamblia
TASTGELPEILSDALRSL

SEQ ID NO: 3141467 - protein, 16 aa, Giardia lamblia
TASTSISLDNPQYSTD

SEQ ID NO: 3141468 - protein, 9 aa, Giardia lamblia
TASTTENMD

SEQ ID NO: 3141469 - protein, 8 aa, Giardia lamblia
TASVATGD

SEQ ID NO: 3141470 - protein, 19 aa, Giardia lamblia
TASVSSHRSSSASFIDCLD

SEQ ID NO: 3141471 - protein, 8 aa, Giardia lamblia
TASWPEGL

SEQ ID NO: 3141472 - protein, 13 aa, Giardia lamblia
TASYKTFTQKQYS

SEQ ID NO: 3141473 - protein, 33 aa, Giardia lamblia
TATASMSQYPSQFSTQRPSLPYSSRPTSRTSDN

SEQ ID NO: 3141474 - protein, 13 aa, Giardia lamblia
TATCPQSTDGPEI

SEQ ID NO: 3141475 - protein, 18 aa, Giardia lamblia
TATDAQREAVQATLNRNK

SEQ ID NO: 3141476 - protein, 10 aa, Giardia lamblia
TATDDFRSDP

SEQ ID NO: 3141477 - protein, 8 aa, Giardia lamblia
TATDETVR

SEQ ID NO: 3141478 - protein, 9 aa, Giardia lamblia
TATDNHGNT

SEQ ID NO: 3141479 - protein, 6 aa, Giardia lamblia
TATEES

SEQ ID NO: 3141480 - protein, 23 aa, Giardia lamblia
TATEGAEKTGSGRHSPASSESWD

SEQ ID NO: 3141481 - protein, 9 aa, Giardia lamblia
TATEPGPYA

SEQ ID NO: 3141482 - protein, 9 aa, Giardia lamblia
TATERRQNA

SEQ ID NO: 3141483 - protein, 8 aa, Giardia lamblia
TATGDAPS

SEQ ID NO: 3141484 - protein, 5 aa, Giardia lamblia
TATGP

SEQ ID NO: 3141485 - protein, 5 aa, Giardia lamblia
TATHA

SEQ ID NO: 3141486 - protein, 16 aa, Giardia lamblia
TATHPEALTESRTRHS

SEQ ID NO: 3141487 - protein, 7 aa, Giardia lamblia
TATISKA

SEQ ID NO: 3141488 - protein, 15 aa, Giardia lamblia
TATKNGKSLTPLPDG

SEQ ID NO: 3141489 - protein, 18 aa, Giardia lamblia
TATKQEERSADQQRQTEA

SEQ ID NO: 3141490 - protein, 6 aa, Giardia lamblia
TATKVG

SEQ ID NO: 3141491 - protein, 5 aa, Giardia lamblia
TATKY

SEQ ID NO: 3141492 - protein, 13 aa, Giardia lamblia
TATNDRDDLTITP

SEQ ID NO: 3141493 - protein, 18 aa, Giardia lamblia
TATNPPENISEDTFSHAE

SEQ ID NO: 3141494 - protein, 9 aa, Giardia lamblia
TATNTQLEK

SEQ ID NO: 3141495 - protein, 8 aa, Giardia lamblia
TATPKQGY

SEQ ID NO: 3141496 - protein, 41 aa, Giardia lamblia
TATPVSSALRPSQLGPARENDATTLHDTPRTVGYEAKQEGS

SEQ ID NO: 3141497 - protein, 12 aa, Giardia lamblia
TATRLAGARANS

SEQ ID NO: 3141498 - protein, 4 aa, Giardia lamblia
TATS

SEQ ID NO: 3141499 - protein, 9 aa, Giardia lamblia
TATSEPDYR

SEQ ID NO: 3141500 - protein, 8 aa, Giardia lamblia
TATSGVGD

SEQ ID NO: 3141501 - protein, 6 aa, Giardia lamblia
TATSIS

SEQ ID NO: 3141502 - protein, 4 aa, Giardia lamblia
TATT

SEQ ID NO: 3141503 - protein, 15 aa, Giardia lamblia
TATTATDFRGRDDPI

SEQ ID NO: 3141504 - protein, 11 aa, Giardia lamblia
TATTKKTYERQ

SEQ ID NO: 3141505 - protein, 4 aa, Giardia lamblia
TATV

SEQ ID NO: 3141506 - protein, 6 aa, Giardia lamblia
TATVSD

SEQ ID NO: 3141507 - protein, 29 aa, Giardia lamblia
TAVELTGKKGKTGDDNHSNKSGRKDDDLD

SEQ ID NO: 3141508 - protein, 9 aa, Giardia lamblia
TAVETSPPH

SEQ ID NO: 3141509 - protein, 37 aa, Giardia lamblia
TAVKDSSTDQSAAQPAPDDQGKKKQAKKKKDTKEVLE

SEQ ID NO: 3141510 - protein, 7 aa, Giardia lamblia
TAVKNQR

SEQ ID NO: 3141511 - protein, 11 aa, Giardia lamblia
TAVNTQKEAAT

SEQ ID NO: 3141512 - protein, 16 aa, Giardia lamblia
TAVPANSKDKVRRSTI

SEQ ID NO: 3141513 - protein, 6 aa, Giardia lamblia
TAVPGD

SEQ ID NO: 3141514 - protein, 17 aa, Giardia lamblia
TAVRKDALSRNPNAQQA

SEQ ID NO: 3141515 - protein, 7 aa, Giardia lamblia
TAVSEGD

SEQ ID NO: 3141516 - protein, 12 aa, Giardia lamblia
TAWDNPEADQID

SEQ ID NO: 3141517 - protein, 7 aa, Giardia lamblia
TAWSASN

SEQ ID NO: 3141518 - protein, 12 aa, Giardia lamblia
TAYATEDKVYPI

SEQ ID NO: 3141519 - protein, 5 aa, Giardia lamblia
TAYPQ

SEQ ID NO: 3141520 - protein, 4 aa, Giardia lamblia
TAYQ

SEQ ID NO: 3141521 - protein, 10 aa, Giardia lamblia
TAYRNSETGR

SEQ ID NO: 3141522 - protein, 10 aa, Giardia lamblia
TAYSKESTAL

SEQ ID NO: 3141523 - protein, 7 aa, Giardia lamblia
TCASDSG

SEQ ID NO: 3141524 - protein, 8 aa, Giardia lamblia
TCDSEARR

SEQ ID NO: 3141525 - protein, 25 aa, Giardia lamblia
TCEGADRASSSTPAPKAQSAEPAKF

SEQ ID NO: 3141526 - protein, 5 aa, Giardia lamblia
TCEGR

SEQ ID NO: 3141527 - protein, 21 aa, Giardia lamblia
TCKEEPQGSLSPRRSARGTPN

SEQ ID NO: 3141528 - protein, 6 aa, Giardia lamblia
TCKENS

SEQ ID NO: 3141529 - protein, 8 aa, Giardia lamblia
TCKGTAPE

SEQ ID NO: 3141530 - protein, 23 aa, Giardia lamblia
TCNVSNAQRRSSDLTTQTPPLPG

SEQ ID NO: 3141531 - protein, 12 aa, Giardia lamblia
TCPLETNEQSCL

SEQ ID NO: 3141532 - protein, 5 aa, Giardia lamblia
TCPPA

SEQ ID NO: 3141533 - protein, 11 aa, Giardia lamblia
TCPPGTKPMTV

SEQ ID NO: 3141534 - protein, 8 aa, Giardia lamblia
TCQRSSSM

SEQ ID NO: 3141535 - protein, 7 aa, Giardia lamblia
TCRSPGS

SEQ ID NO: 3141536 - protein, 7 aa, Giardia lamblia
TCSEERL

SEQ ID NO: 3141537 - protein, 7 aa, Giardia lamblia
TCSGKSS

SEQ ID NO: 3141538 - protein, 16 aa, Giardia lamblia
TCSSGSNELGCRDSTH

SEQ ID NO: 3141539 - protein, 31 aa, Giardia lamblia
TCSSSGIYSNKDASLAEAAGVAKTHADPAEL

SEQ ID NO: 3141540 - protein, 10 aa, Giardia lamblia
TCSSTGEDSC

SEQ ID NO: 3141541 - protein, 6 aa, Giardia lamblia
TCTAPV

SEQ ID NO: 3141542 - protein, 4 aa, Giardia lamblia
TCVS

SEQ ID NO: 3141543 - protein, 8 aa, Giardia lamblia
TDAAGNDL

SEQ ID NO: 3141544 - protein, 18 aa, Giardia lamblia
TDAALSASEEYSEAGSIT

SEQ ID NO: 3141545 - protein, 9 aa, Giardia lamblia
TDADLTPRD

SEQ ID NO: 3141546 - protein, 8 aa, Giardia lamblia
TDADTAAA

SEQ ID NO: 3141547 - protein, 15 aa, Giardia lamblia
TDAEAAERDACNKKA

SEQ ID NO: 3141548 - protein, 8 aa, Giardia lamblia
TDAEGCQN

SEQ ID NO: 3141549 - protein, 10 aa, Giardia lamblia
TDAEKASLAE

SEQ ID NO: 3141550 - protein, 7 aa, Giardia lamblia
TDAENGV

SEQ ID NO: 3141551 - protein, 18 aa, Giardia lamblia
TDAGQAEGPDFEVRGIPI

SEQ ID NO: 3141552 - protein, 8 aa, Giardia lamblia
TDAKNTLQ

SEQ ID NO: 3141553 - protein, 4 aa, Giardia lamblia
TDAN

SEQ ID NO: 3141554 - protein, 21 aa, Giardia lamblia
TDANDTLDESSINGTSRIESA

SEQ ID NO: 3141555 - protein, 10 aa, Giardia lamblia
TDANSTREDH

SEQ ID NO: 3141556 - protein, 9 aa, Giardia lamblia
TDANTKKKM

SEQ ID NO: 3141557 - protein, 5 aa, Giardia lamblia
TDAPI

SEQ ID NO: 3141558 - protein, 12 aa, Giardia lamblia
TDAPIDQASGSL

SEQ ID NO: 3141559 - protein, 6 aa, Giardia lamblia
TDAPRN

SEQ ID NO: 3141560 - protein, 6 aa, Giardia lamblia
TDAQKQ

SEQ ID NO: 3141561 - protein, 13 aa, Giardia lamblia
TDAQLGDAVDDGN

SEQ ID NO: 3141562 - protein, 20 aa, Giardia lamblia
TDAQNQQSRATPTDGATHGP

SEQ ID NO: 3141563 - protein, 7 aa, Giardia lamblia
TDARNSA

SEQ ID NO: 3141564 - protein, 56 aa, Giardia lamblia
TDASAKSSIRGRGSAQASVKMNSDSEVKPQCKKPKARSENTPAPQAHSISSRAQEP

SEQ ID NO: 3141565 - protein, 6 aa, Giardia lamblia
TDASGR

SEQ ID NO: 3141566 - protein, 6 aa, Giardia lamblia
TDASIA

SEQ ID NO: 3141567 - protein, 16 aa, Giardia lamblia
TDASTQKIRQREVPKQ

SEQ ID NO: 3141568 - protein, 5 aa, Giardia lamblia
TDATE

SEQ ID NO: 3141569 - protein, 14 aa, Giardia lamblia
TDATGDRANIGPKH

SEQ ID NO: 3141570 - protein, 9 aa, Giardia lamblia
TDATPIAST

SEQ ID NO: 3141571 - protein, 18 aa, Giardia lamblia
TDCKSNLQDAGKADGDRC

SEQ ID NO: 3141572 - protein, 11 aa, Giardia lamblia
TDDADGVEAAS

SEQ ID NO: 3141573 - protein, 7 aa, Giardia lamblia
TDDADPS

SEQ ID NO: 3141574 - protein, 5 aa, Giardia lamblia
TDDDD

SEQ ID NO: 3141575 - protein, 12 aa, Giardia lamblia
TDDDNGTKKQPY

SEQ ID NO: 3141576 - protein, 6 aa, Giardia lamblia
TDDDYN

SEQ ID NO: 3141577 - protein, 14 aa, Giardia lamblia
TDDESGPSAITNDQ

SEQ ID NO: 3141578 - protein, 4 aa, Giardia lamblia
TDDG

SEQ ID NO: 3141579 - protein, 12 aa, Giardia lamblia
TDDGDRLTTEPV

SEQ ID NO: 3141580 - protein, 18 aa, Giardia lamblia
TDDGTTRTKVRAGAPFGD

SEQ ID NO: 3141581 - protein, 4 aa, Giardia lamblia
TDDI

SEQ ID NO: 3141582 - protein, 26 aa, Giardia lamblia
TDDIEGAQPHSKDFRTNRSVDPLEPD

SEQ ID NO: 3141583 - protein, 7 aa, Giardia lamblia
TDDLGRT

SEQ ID NO: 3141584 - protein, 9 aa, Giardia lamblia
TDDLQTDEG

SEQ ID NO: 3141585 - protein, 9 aa, Giardia lamblia
TDDMDSLTS

SEQ ID NO: 3141586 - protein, 7 aa, Giardia lamblia
TDDNART

SEQ ID NO: 3141587 - protein, 5 aa, Giardia lamblia
TDDNY

SEQ ID NO: 3141588 - protein, 7 aa, Giardia lamblia
TDDREDV

SEQ ID NO: 3141589 - protein, 7 aa, Giardia lamblia
TDDRTIT

SEQ ID NO: 3141590 - protein, 8 aa, Giardia lamblia
TDDSSKTQ

SEQ ID NO: 3141591 - protein, 10 aa, Giardia lamblia
TDDSSPPVRT

SEQ ID NO: 3141592 - protein, 7 aa, Giardia lamblia
TDDTITD

SEQ ID NO: 3141593 - protein, 7 aa, Giardia lamblia
TDDTKPD

SEQ ID NO: 3141594 - protein, 14 aa, Giardia lamblia
TDDYTDDEAGHRRT

SEQ ID NO: 3141595 - protein, 10 aa, Giardia lamblia
TDEADRKGVD

SEQ ID NO: 3141596 - protein, 11 aa, Giardia lamblia
TDEASTSTQAA

SEQ ID NO: 3141597 - protein, 6 aa, Giardia lamblia
TDEATT

SEQ ID NO: 3141598 - protein, 15 aa, Giardia lamblia
TDEATTALDHDGTLR

SEQ ID NO: 3141599 - protein, 8 aa, Giardia lamblia
TDEDGTTA

SEQ ID NO: 3141600 - protein, 8 aa, Giardia lamblia
TDEEPVSS

SEQ ID NO: 3141601 - protein, 9 aa, Giardia lamblia
TDEGEKEAE

SEQ ID NO: 3141602 - protein, 8 aa, Giardia lamblia
TDEGSSYN

SEQ ID NO: 3141603 - protein, 18 aa, Giardia lamblia
TDEHGQKVQQSAEKMGLQ

SEQ ID NO: 3141604 - protein, 13 aa, Giardia lamblia
TDEIGQKPVSTDS

SEQ ID NO: 3141605 - protein, 8 aa, Giardia lamblia
TDEKAQAY

SEQ ID NO: 3141606 - protein, 9 aa, Giardia lamblia
TDEKNNALE

SEQ ID NO: 3141607 - protein, 5 aa, Giardia lamblia
TDEKR

SEQ ID NO: 3141608 - protein, 10 aa, Giardia lamblia
TDEKTADDRG

SEQ ID NO: 3141609 - protein, 5 aa, Giardia lamblia
TDEQK

SEQ ID NO: 3141610 - protein, 8 aa, Giardia lamblia
TDEQLEER

SEQ ID NO: 3141611 - protein, 4 aa, Giardia lamblia
TDER

SEQ ID NO: 3141612 - protein, 4 aa, Giardia lamblia
TDES

SEQ ID NO: 3141613 - protein, 11 aa, Giardia lamblia
TDESALTAETD

SEQ ID NO: 3141614 - protein, 9 aa, Giardia lamblia
TDESRFPPG

SEQ ID NO: 3141615 - protein, 6 aa, Giardia lamblia
TDETQL

SEQ ID NO: 3141616 - protein, 24 aa, Giardia lamblia
TDEVGYPMSTGNSNEGVGHGRSAP

SEQ ID NO: 3141617 - protein, 8 aa, Giardia lamblia
TDFATNST

SEQ ID NO: 3141618 - protein, 7 aa, Giardia lamblia
TDFENKH

SEQ ID NO: 3141619 - protein, 17 aa, Giardia lamblia
TDFPADDIERASKRYDL

SEQ ID NO: 3141620 - protein, 5 aa, Giardia lamblia
TDFSP

SEQ ID NO: 3141621 - protein, 10 aa, Giardia lamblia
TDGATSNTSF

SEQ ID NO: 3141622 - protein, 17 aa, Giardia lamblia
TDGATVKSSAGPSNLLT

SEQ ID NO: 3141623 - protein, 5 aa, Giardia lamblia
TDGDT

SEQ ID NO: 3141624 - protein, 21 aa, Giardia lamblia
TDGDTSTRSRSSSSKHRISQG

SEQ ID NO: 3141625 - protein, 16 aa, Giardia lamblia
TDGGSDSRSRSSSRRR

SEQ ID NO: 3141626 - protein, 6 aa, Giardia lamblia
TDGHYG

SEQ ID NO: 3141627 - protein, 6 aa, Giardia lamblia
TDGIKP

SEQ ID NO: 3141628 - protein, 6 aa, Giardia lamblia
TDGKSA

SEQ ID NO: 3141629 - protein, 17 aa, Giardia lamblia
TDGLTASSSSNTIGESD

SEQ ID NO: 3141630 - protein, 6 aa, Giardia lamblia
TDGNLE

SEQ ID NO: 3141631 - protein, 17 aa, Giardia lamblia
TDGPSGSATQAHTNTSM

SEQ ID NO: 3141632 - protein, 20 aa, Giardia lamblia
TDGQSESVHDSVSSQTEPNS

SEQ ID NO: 3141633 - protein, 7 aa, Giardia lamblia
TDGRDAF

SEQ ID NO: 3141634 - protein, 5 aa, Giardia lamblia
TDGRT

SEQ ID NO: 3141635 - protein, 16 aa, Giardia lamblia
TDGSAFHRPQDSPVES

SEQ ID NO: 3141636 - protein, 5 aa, Giardia lamblia
TDGSD

SEQ ID NO: 3141637 - protein, 11 aa, Giardia lamblia
TDGSEEHVNSN

SEQ ID NO: 3141638 - protein, 5 aa, Giardia lamblia
TDGST

SEQ ID NO: 3141639 - protein, 9 aa, Giardia lamblia
TDGTQKASR

SEQ ID NO: 3141640 - protein, 5 aa, Giardia lamblia
TDGTS

SEQ ID NO: 3141641 - protein, 8 aa, Giardia lamblia
TDGYSGAD

SEQ ID NO: 3141642 - protein, 5 aa, Giardia lamblia
TDHAP

SEQ ID NO: 3141643 - protein, 7 aa, Giardia lamblia
TDHATQE

SEQ ID NO: 3141644 - protein, 14 aa, Giardia lamblia
TDHPAQPDANERPD

SEQ ID NO: 3141645 - protein, 6 aa, Giardia lamblia
TDHPLD

SEQ ID NO: 3141646 - protein, 4 aa, Giardia lamblia
TDHQ

SEQ ID NO: 3141647 - protein, 10 aa, Giardia lamblia
TDHQAQMEKA

SEQ ID NO: 3141648 - protein, 8 aa, Giardia lamblia
TDHQTPKD

SEQ ID NO: 3141649 - protein, 9 aa, Giardia lamblia
TDHSNAGGL

SEQ ID NO: 3141650 - protein, 6 aa, Giardia lamblia
TDHTQA

SEQ ID NO: 3141651 - protein, 12 aa, Giardia lamblia
TDIKSRRDTMPE

SEQ ID NO: 3141652 - protein, 14 aa, Giardia lamblia
TDITGSTTDNNNRG

SEQ ID NO: 3141653 - protein, 8 aa, Giardia lamblia
TDITPEEV

SEQ ID NO: 3141654 - protein, 8 aa, Giardia lamblia
TDKDADEL

SEQ ID NO: 3141655 - protein, 9 aa, Giardia lamblia
TDKDGIATA

SEQ ID NO: 3141656 - protein, 14 aa, Giardia lamblia
TDKDTLVDNYLKLF

SEQ ID NO: 3141657 - protein, 14 aa, Giardia lamblia
TDKDTLVDSYLKLF

SEQ ID NO: 3141658 - protein, 7 aa, Giardia lamblia
TDKENYI

SEQ ID NO: 3141659 - protein, 5 aa, Giardia lamblia
TDKEQ

SEQ ID NO: 3141660 - protein, 21 aa, Giardia lamblia
TDKEQDPSLSTVSSTAGISEE

SEQ ID NO: 3141661 - protein, 7 aa, Giardia lamblia
TDKESHK

SEQ ID NO: 3141662 - protein, 7 aa, Giardia lamblia
TDKHGNT

SEQ ID NO: 3141663 - protein, 7 aa, Giardia lamblia
TDKIGAS

SEQ ID NO: 3141664 - protein, 15 aa, Giardia lamblia
TDKIKENSRAKRALE

SEQ ID NO: 3141665 - protein, 11 aa, Giardia lamblia
TDKIQNTSQYK

SEQ ID NO: 3141666 - protein, 8 aa, Giardia lamblia
TDKIREDP

SEQ ID NO: 3141667 - protein, 9 aa, Giardia lamblia
TDKKGQSAL

SEQ ID NO: 3141668 - protein, 7 aa, Giardia lamblia
TDKPISE

SEQ ID NO: 3141669 - protein, 8 aa, Giardia lamblia
TDKSQKLN

SEQ ID NO: 3141670 - protein, 4 aa, Giardia lamblia
TDKT

SEQ ID NO: 3141671 - protein, 13 aa, Giardia lamblia
TDKTDDRAATPTM

SEQ ID NO: 3141672 - protein, 6 aa, Giardia lamblia
TDKTHT

SEQ ID NO: 3141673 - protein, 8 aa, Giardia lamblia
TDKTPAYK

SEQ ID NO: 3141674 - protein, 6 aa, Giardia lamblia
TDKYSR

SEQ ID NO: 3141675 - protein, 18 aa, Giardia lamblia
TDLEHKRKVSKEEGEQFA

SEQ ID NO: 3141676 - protein, 5 aa, Giardia lamblia
TDLGP

SEQ ID NO: 3141677 - protein, 11 aa, Giardia lamblia
TDLGSPEDVEA

SEQ ID NO: 3141678 - protein, 9 aa, Giardia lamblia
TDLKGRSAL

SEQ ID NO: 3141679 - protein, 12 aa, Giardia lamblia
TDLPASEGSGNG

SEQ ID NO: 3141680 - protein, 7 aa, Giardia lamblia
TDLPESN

SEQ ID NO: 3141681 - protein, 16 aa, Giardia lamblia
TDLPRRDWRESEDEVR

SEQ ID NO: 3141682 - protein, 11 aa, Giardia lamblia
TDLPTDREPVA

SEQ ID NO: 3141683 - protein, 6 aa, Giardia lamblia
TDLPTV

SEQ ID NO: 3141684 - protein, 4 aa, Giardia lamblia
TDLR

SEQ ID NO: 3141685 - protein, 8 aa, Giardia lamblia
TDLRTQES

SEQ ID NO: 3141686 - protein, 10 aa, Giardia lamblia
TDLSGNYASR

SEQ ID NO: 3141687 - protein, 15 aa, Giardia lamblia
TDNAPHPSVKPTAPK

SEQ ID NO: 3141688 - protein, 5 aa, Giardia lamblia
TDNDD

SEQ ID NO: 3141689 - protein, 14 aa, Giardia lamblia
TDNDDDDDLVGTPN

SEQ ID NO: 3141690 - protein, 10 aa, Giardia lamblia
TDNEREKKRQ

SEQ ID NO: 3141691 - protein, 11 aa, Giardia lamblia
TDNERKIERGL

SEQ ID NO: 3141692 - protein, 26 aa, Giardia lamblia
TDNGLTKYRPANFKPNPEPNWGPKKA

SEQ ID NO: 3141693 - protein, 8 aa, Giardia lamblia
TDNKKNLD

SEQ ID NO: 3141694 - protein, 10 aa, Giardia lamblia
TDNKRDDPEV

SEQ ID NO: 3141695 - protein, 11 aa, Giardia lamblia
TDNLGTETATH

SEQ ID NO: 3141696 - protein, 5 aa, Giardia lamblia
TDNNE

SEQ ID NO: 3141697 - protein, 8 aa, Giardia lamblia
TDNNPGKA

SEQ ID NO: 3141698 - protein, 8 aa, Giardia lamblia
TDNSGKTG

SEQ ID NO: 3141699 - protein, 6 aa, Giardia lamblia
TDNSGY

SEQ ID NO: 3141700 - protein, 8 aa, Giardia lamblia
TDPAGADR

SEQ ID NO: 3141701 - protein, 9 aa, Giardia lamblia
TDPAGTNTG

SEQ ID NO: 3141702 - protein, 8 aa, Giardia lamblia
TDPCPACP

SEQ ID NO: 3141703 - protein, 30 aa, Giardia lamblia
TDPCPREITKKEKKGKKSKKGKKGTKGSNK

SEQ ID NO: 3141704 - protein, 4 aa, Giardia lamblia
TDPD

SEQ ID NO: 3141705 - protein, 7 aa, Giardia lamblia
TDPDADR

SEQ ID NO: 3141706 - protein, 8 aa, Giardia lamblia
TDPDGTTP

SEQ ID NO: 3141707 - protein, 10 aa, Giardia lamblia
TDPDSVINQE

SEQ ID NO: 3141708 - protein, 7 aa, Giardia lamblia
TDPDTAE

SEQ ID NO: 3141709 - protein, 10 aa, Giardia lamblia
TDPDTGEYTV

SEQ ID NO: 3141710 - protein, 11 aa, Giardia lamblia
TDPEATKTGTE

SEQ ID NO: 3141711 - protein, 5 aa, Giardia lamblia
TDPEK

SEQ ID NO: 3141712 - protein, 6 aa, Giardia lamblia
TDPEMT

SEQ ID NO: 3141713 - protein, 7 aa, Giardia lamblia
TDPENQT

SEQ ID NO: 3141714 - protein, 4 aa, Giardia lamblia
TDPI

SEQ ID NO: 3141715 - protein, 14 aa, Giardia lamblia
TDPKVTLDTSRYSD

SEQ ID NO: 3141716 - protein, 5 aa, Giardia lamblia
TDPNL

SEQ ID NO: 3141717 - protein, 15 aa, Giardia lamblia
TDPNPSSPANSDAAH

SEQ ID NO: 3141718 - protein, 4 aa, Giardia lamblia
TDPQ

SEQ ID NO: 3141719 - protein, 9 aa, Giardia lamblia
TDPQGNEIK

SEQ ID NO: 3141720 - protein, 6 aa, Giardia lamblia
TDPQRL

SEQ ID NO: 3141721 - protein, 7 aa, Giardia lamblia
TDPRAAP

SEQ ID NO: 3141722 - protein, 8 aa, Giardia lamblia
TDPSGNYS

SEQ ID NO: 3141723 - protein, 9 aa, Giardia lamblia
TDPSTYQAS

SEQ ID NO: 3141724 - protein, 5 aa, Giardia lamblia
TDPTI

SEQ ID NO: 3141725 - protein, 9 aa, Giardia lamblia
TDPTKFKPL

SEQ ID NO: 3141726 - protein, 5 aa, Giardia lamblia
TDPVK

SEQ ID NO: 3141727 - protein, 6 aa, Giardia lamblia
TDPYSL

SEQ ID NO: 3141728 - protein, 5 aa, Giardia lamblia
TDQAG

SEQ ID NO: 3141729 - protein, 21 aa, Giardia lamblia
TDQATAADRNAAAKFRQSHPG

SEQ ID NO: 3141730 - protein, 5 aa, Giardia lamblia
TDQCQ

SEQ ID NO: 3141731 - protein, 4 aa, Giardia lamblia
TDQD

SEQ ID NO: 3141732 - protein, 9 aa, Giardia lamblia
TDQEPTFSK

SEQ ID NO: 3141733 - protein, 6 aa, Giardia lamblia
TDQEPY

SEQ ID NO: 3141734 - protein, 25 aa, Giardia lamblia
TDQGVQAQTTSTNSNGYDPSTNSVE

SEQ ID NO: 3141735 - protein, 13 aa, Giardia lamblia
TDQHADHLSAEKD

SEQ ID NO: 3141736 - protein, 8 aa, Giardia lamblia
TDQIDTSE

SEQ ID NO: 3141737 - protein, 6 aa, Giardia lamblia
TDQKQE

SEQ ID NO: 3141738 - protein, 6 aa, Giardia lamblia
TDQPTL

SEQ ID NO: 3141739 - protein, 17 aa, Giardia lamblia
TDQQSEGRSMVQEVEGG

SEQ ID NO: 3141740 - protein, 4 aa, Giardia lamblia
TDQR

SEQ ID NO: 3141741 - protein, 6 aa, Giardia lamblia
TDRATK

SEQ ID NO: 3141742 - protein, 8 aa, Giardia lamblia
TDRDATAS

SEQ ID NO: 3141743 - protein, 8 aa, Giardia lamblia
TDRDEAEA

SEQ ID NO: 3141744 - protein, 28 aa, Giardia lamblia
TDRFNEEKKRIDGKHRAELQSAETQTAR

SEQ ID NO: 3141745 - protein, 17 aa, Giardia lamblia
TDRGSPSCPGPADESDS

SEQ ID NO: 3141746 - protein, 9 aa, Giardia lamblia
TDRKRRTFD

SEQ ID NO: 3141747 - protein, 6 aa, Giardia lamblia
TDRNDV

SEQ ID NO: 3141748 - protein, 13 aa, Giardia lamblia
TDRNNSSLDRPNP

SEQ ID NO: 3141749 - protein, 14 aa, Giardia lamblia
TDRPDGAGDSDSDL

SEQ ID NO: 3141750 - protein, 7 aa, Giardia lamblia
TDRPGFM

SEQ ID NO: 3141751 - protein, 4 aa, Giardia lamblia
TDRR

SEQ ID NO: 3141752 - protein, 8 aa, Giardia lamblia
TDRRASRT

SEQ ID NO: 3141753 - protein, 6 aa, Giardia lamblia
TDRRRM

SEQ ID NO: 3141754 - protein, 6 aa, Giardia lamblia
TDRSDY

SEQ ID NO: 3141755 - protein, 19 aa, Giardia lamblia
TDRSPAADANCDGPGADLN

SEQ ID NO: 3141756 - protein, 7 aa, Giardia lamblia
TDRSVQD

SEQ ID NO: 3141757 - protein, 5 aa, Giardia lamblia
TDRTI

SEQ ID NO: 3141758 - protein, 7 aa, Giardia lamblia
TDRTNQQ

SEQ ID NO: 3141759 - protein, 10 aa, Giardia lamblia
TDRTPNFKDP

SEQ ID NO: 3141760 - protein, 8 aa, Giardia lamblia
TDRVTGGT

SEQ ID NO: 3141761 - protein, 17 aa, Giardia lamblia
TDSAAAAEATLHTPAGL

SEQ ID NO: 3141762 - protein, 7 aa, Giardia lamblia
TDSAAAS

SEQ ID NO: 3141763 - protein, 13 aa, Giardia lamblia
TDSASQEKAPVNT

SEQ ID NO: 3141764 - protein, 10 aa, Giardia lamblia
TDSDLSKRTA

SEQ ID NO: 3141765 - protein, 7 aa, Giardia lamblia
TDSEDKT

SEQ ID NO: 3141766 - protein, 10 aa, Giardia lamblia
TDSEKAAPKV

SEQ ID NO: 3141767 - protein, 31 aa, Giardia lamblia
TDSGEAVGGTNQPRKLTEPFAADDSKRLSIP

SEQ ID NO: 3141768 - protein, 6 aa, Giardia lamblia
TDSGGY

SEQ ID NO: 3141769 - protein, 8 aa, Giardia lamblia
TDSGSTVA

SEQ ID NO: 3141770 - protein, 8 aa, Giardia lamblia
TDSHEPVR

SEQ ID NO: 3141771 - protein, 8 aa, Giardia lamblia
TDSHSQQR

SEQ ID NO: 3141772 - protein, 5 aa, Giardia lamblia
TDSIY

SEQ ID NO: 3141773 - protein, 4 aa, Giardia lamblia
TDSL

SEQ ID NO: 3141774 - protein, 6 aa, Giardia lamblia
TDSPAS

SEQ ID NO: 3141775 - protein, 4 aa, Giardia lamblia
TDSQ

SEQ ID NO: 3141776 - protein, 9 aa, Giardia lamblia
TDSQQKTLA

SEQ ID NO: 3141777 - protein, 7 aa, Giardia lamblia
TDSQSDN

SEQ ID NO: 3141778 - protein, 20 aa, Giardia lamblia
TDSQSGGQLTSSPGAPSHNS

SEQ ID NO: 3141779 - protein, 4 aa, Giardia lamblia
TDSR

SEQ ID NO: 3141780 - protein, 11 aa, Giardia lamblia
TDSRKGFTGYN

SEQ ID NO: 3141781 - protein, 9 aa, Giardia lamblia
TDSSDGRCS

SEQ ID NO: 3141782 - protein, 6 aa, Giardia lamblia
TDSSNL

SEQ ID NO: 3141783 - protein, 6 aa, Giardia lamblia
TDSSPQ

SEQ ID NO: 3141784 - protein, 10 aa, Giardia lamblia
TDSSRKTNKT

SEQ ID NO: 3141785 - protein, 8 aa, Giardia lamblia
TDSSRNAG

SEQ ID NO: 3141786 - protein, 11 aa, Giardia lamblia
TDTAEKRDKEL

SEQ ID NO: 3141787 - protein, 13 aa, Giardia lamblia
TDTAKQAAQLRTE

SEQ ID NO: 3141788 - protein, 9 aa, Giardia lamblia
TDTASTSST

SEQ ID NO: 3141789 - protein, 4 aa, Giardia lamblia
TDTD

SEQ ID NO: 3141790 - protein, 20 aa, Giardia lamblia
TDTDEKSGIPTAEKSSPYQD

SEQ ID NO: 3141791 - protein, 7 aa, Giardia lamblia
TDTESNY

SEQ ID NO: 3141792 - protein, 5 aa, Giardia lamblia
TDTFA

SEQ ID NO: 3141793 - protein, 6 aa, Giardia lamblia
TDTFGD

SEQ ID NO: 3141794 - protein, 5 aa, Giardia lamblia
TDTGD

SEQ ID NO: 3141795 - protein, 5 aa, Giardia lamblia
TDTGE

SEQ ID NO: 3141796 - protein, 5 aa, Giardia lamblia
TDTGK

SEQ ID NO: 3141797 - protein, 5 aa, Giardia lamblia
TDTIA

SEQ ID NO: 3141798 - protein, 4 aa, Giardia lamblia
TDTN

SEQ ID NO: 3141799 - protein, 10 aa, Giardia lamblia
TDTNEDDSAA

SEQ ID NO: 3141800 - protein, 5 aa, Giardia lamblia
TDTPK

SEQ ID NO: 3141801 - protein, 5 aa, Giardia lamblia
TDTPL

SEQ ID NO: 3141802 - protein, 8 aa, Giardia lamblia
TDTPSDVP

SEQ ID NO: 3141803 - protein, 7 aa, Giardia lamblia
TDTPSKD

SEQ ID NO: 3141804 - protein, 6 aa, Giardia lamblia
TDTPVQ

SEQ ID NO: 3141805 - protein, 4 aa, Giardia lamblia
TDTQ

SEQ ID NO: 3141806 - protein, 9 aa, Giardia lamblia
TDTQATTLG

SEQ ID NO: 3141807 - protein, 7 aa, Giardia lamblia
TDTQLSG

SEQ ID NO: 3141808 - protein, 14 aa, Giardia lamblia
TDTRSYDGNTNGHV

SEQ ID NO: 3141809 - protein, 35 aa, Giardia lamblia
TDTSGKHRPPVDEELSGDSIHTTEPDTDHSQDDEV

SEQ ID NO: 3141810 - protein, 17 aa, Giardia lamblia
TDTSINSSGVAEATKPS

SEQ ID NO: 3141811 - protein, 8 aa, Giardia lamblia
TDTSKKRN

SEQ ID NO: 3141812 - protein, 5 aa, Giardia lamblia
TDTST

SEQ ID NO: 3141813 - protein, 7 aa, Giardia lamblia
TDTTGKG

SEQ ID NO: 3141814 - protein, 7 aa, Giardia lamblia
TDTTVET

SEQ ID NO: 3141815 - protein, 7 aa, Giardia lamblia
TDTYRQT

SEQ ID NO: 3141816 - protein, 11 aa, Giardia lamblia
TDVEDPEGHFS

SEQ ID NO: 3141817 - protein, 13 aa, Giardia lamblia
TDVGESATGCASS

SEQ ID NO: 3141818 - protein, 5 aa, Giardia lamblia
TDVGR

SEQ ID NO: 3141819 - protein, 14 aa, Giardia lamblia
TDVQESSAATNKRM

SEQ ID NO: 3141820 - protein, 29 aa, Giardia lamblia
TDVSDATSSQNTHHTNPLRDSEDNVNTET

SEQ ID NO: 3141821 - protein, 5 aa, Giardia lamblia
TDVST

SEQ ID NO: 3141822 - protein, 4 aa, Giardia lamblia
TDYE

SEQ ID NO: 3141823 - protein, 25 aa, Giardia lamblia
TDYIDQTESYRQSGSFSSKVPANES

SEQ ID NO: 3141824 - protein, 6 aa, Giardia lamblia
TDYTTE

SEQ ID NO: 3141825 - protein, 9 aa, Giardia lamblia
TEAAPVATT

SEQ ID NO: 3141826 - protein, 12 aa, Giardia lamblia
TEAARRNKTGHT

SEQ ID NO: 3141827 - protein, 8 aa, Giardia lamblia
TEAASHDP

SEQ ID NO: 3141828 - protein, 10 aa, Giardia lamblia
TEACEQRDRS

SEQ ID NO: 3141829 - protein, 5 aa, Giardia lamblia
TEADL

SEQ ID NO: 3141830 - protein, 8 aa, Giardia lamblia
TEAEEKAM

SEQ ID NO: 3141831 - protein, 6 aa, Giardia lamblia
TEAERV

SEQ ID NO: 3141832 - protein, 11 aa, Giardia lamblia
TEAGCATTTGR

SEQ ID NO: 3141833 - protein, 11 aa, Giardia lamblia
TEAGDLTDAEY

SEQ ID NO: 3141834 - protein, 18 aa, Giardia lamblia
TEAGHQISDPHYATAPST

SEQ ID NO: 3141835 - protein, 12 aa, Giardia lamblia
TEAGQQDENGNT

SEQ ID NO: 3141836 - protein, 11 aa, Giardia lamblia
TEAGRKSNKGW

SEQ ID NO: 3141837 - protein, 10 aa, Giardia lamblia
TEAGRSSTEL

SEQ ID NO: 3141838 - protein, 20 aa, Giardia lamblia
TEAGSRGAPVSQTNSASVSL

SEQ ID NO: 3141839 - protein, 11 aa, Giardia lamblia
TEAIAQKDAQI

SEQ ID NO: 3141840 - protein, 9 aa, Giardia lamblia
TEAKGEAFK

SEQ ID NO: 3141841 - protein, 9 aa, Giardia lamblia
TEAKQRHMQ

SEQ ID NO: 3141842 - protein, 16 aa, Giardia lamblia
TEANTRMRSSLEDPNS

SEQ ID NO: 3141843 - protein, 5 aa, Giardia lamblia
TEAPE

SEQ ID NO: 3141844 - protein, 6 aa, Giardia lamblia
TEAPFS

SEQ ID NO: 3141845 - protein, 6 aa, Giardia lamblia
TEAQAR

SEQ ID NO: 3141846 - protein, 13 aa, Giardia lamblia
TEAQSLSSQNKST

SEQ ID NO: 3141847 - protein, 11 aa, Giardia lamblia
TEARARKPTKI

SEQ ID NO: 3141848 - protein, 7 aa, Giardia lamblia
TEARNGV

SEQ ID NO: 3141849 - protein, 10 aa, Giardia lamblia
TEARSSSSTI

SEQ ID NO: 3141850 - protein, 11 aa, Giardia lamblia
TEASNARGTLS

SEQ ID NO: 3141851 - protein, 5 aa, Giardia lamblia
TEASR

SEQ ID NO: 3141852 - protein, 6 aa, Giardia lamblia
TEASRD

SEQ ID NO: 3141853 - protein, 18 aa, Giardia lamblia
TEASSKASEAIRTGSLSG

SEQ ID NO: 3141854 - protein, 13 aa, Giardia lamblia
TEASYSKLRQEHK

SEQ ID NO: 3141855 - protein, 23 aa, Giardia lamblia
TEAVDHEADVDSEVKEPGPSNMS

SEQ ID NO: 3141856 - protein, 7 aa, Giardia lamblia
TEAYANK

SEQ ID NO: 3141857 - protein, 8 aa, Giardia lamblia
TECGGSAS

SEQ ID NO: 3141858 - protein, 6 aa, Giardia lamblia
TECNDS

SEQ ID NO: 3141859 - protein, 4 aa, Giardia lamblia
TECR

SEQ ID NO: 3141860 - protein, 6 aa, Giardia lamblia
TECSNS

SEQ ID NO: 3141861 - protein, 24 aa, Giardia lamblia
TEDAEDDDGQGGGEQKAPGTRGSK

SEQ ID NO: 3141862 - protein, 12 aa, Giardia lamblia
TEDAVTTNSKAK

SEQ ID NO: 3141863 - protein, 5 aa, Giardia lamblia
TEDDM

SEQ ID NO: 3141864 - protein, 4 aa, Giardia lamblia
TEDE

SEQ ID NO: 3141865 - protein, 6 aa, Giardia lamblia
TEDEIA

SEQ ID NO: 3141866 - protein, 14 aa, Giardia lamblia
TEDEKKEQEEKKER

SEQ ID NO: 3141867 - protein, 11 aa, Giardia lamblia
TEDEVGQRDEY

SEQ ID NO: 3141868 - protein, 6 aa, Giardia lamblia
TEDGGV

SEQ ID NO: 3141869 - protein, 5 aa, Giardia lamblia
TEDGS

SEQ ID NO: 3141870 - protein, 6 aa, Giardia lamblia
TEDISA

SEQ ID NO: 3141871 - protein, 7 aa, Giardia lamblia
TEDRDNL

SEQ ID NO: 3141872 - protein, 18 aa, Giardia lamblia
TEDSEPLNTQYSAQMNKE

SEQ ID NO: 3141873 - protein, 6 aa, Giardia lamblia
TEDSKW

SEQ ID NO: 3141874 - protein, 4 aa, Giardia lamblia
TEDT

SEQ ID NO: 3141875 - protein, 15 aa, Giardia lamblia
TEDTPPAAQEPDTVP

SEQ ID NO: 3141876 - protein, 9 aa, Giardia lamblia
TEEAHEQEI

SEQ ID NO: 3141877 - protein, 5 aa, Giardia lamblia
TEEAK

SEQ ID NO: 3141878 - protein, 24 aa, Giardia lamblia
TEEAPRSSSAITEASSNRKAADRY

SEQ ID NO: 3141879 - protein, 4 aa, Giardia lamblia
TEEE

SEQ ID NO: 3141880 - protein, 8 aa, Giardia lamblia
TEEEPLNN

SEQ ID NO: 3141881 - protein, 9 aa, Giardia lamblia
TEEERDKAD

SEQ ID NO: 3141882 - protein, 18 aa, Giardia lamblia
TEEERNAEIDKLNSEQNV

SEQ ID NO: 3141883 - protein, 5 aa, Giardia lamblia
TEEGP

SEQ ID NO: 3141884 - protein, 16 aa, Giardia lamblia
TEEIASSSPSLAESPT

SEQ ID NO: 3141885 - protein, 11 aa, Giardia lamblia
TEELASRRAEL

SEQ ID NO: 3141886 - protein, 7 aa, Giardia lamblia
TEELSSL

SEQ ID NO: 3141887 - protein, 5 aa, Giardia lamblia
TEENI

SEQ ID NO: 3141888 - protein, 7 aa, Giardia lamblia
TEENSGE

SEQ ID NO: 3141889 - protein, 11 aa, Giardia lamblia
TEEPSQQASLT

SEQ ID NO: 3141890 - protein, 14 aa, Giardia lamblia
TEEQDTSELGSKQQ

SEQ ID NO: 3141891 - protein, 12 aa, Giardia lamblia
TEERGREGPDRS

SEQ ID NO: 3141892 - protein, 15 aa, Giardia lamblia
TEERGVQSMAPSSPC

SEQ ID NO: 3141893 - protein, 7 aa, Giardia lamblia
TEERNAL

SEQ ID NO: 3141894 - protein, 7 aa, Giardia lamblia
TEESRPR

SEQ ID NO: 3141895 - protein, 6 aa, Giardia lamblia
TEETLT

SEQ ID NO: 3141896 - protein, 18 aa, Giardia lamblia
TEETPKQRLSDAATRTKR

SEQ ID NO: 3141897 - protein, 27 aa, Giardia lamblia
TEETRSRQVAKRPQKTPPGAKRIGPSG

SEQ ID NO: 3141898 - protein, 12 aa, Giardia lamblia
TEEVRQKEKEAE

SEQ ID NO: 3141899 - protein, 6 aa, Giardia lamblia
TEEVTT

SEQ ID NO: 3141900 - protein, 7 aa, Giardia lamblia
TEEYPDS

SEQ ID NO: 3141901 - protein, 15 aa, Giardia lamblia
TEGAGQGGLSQRSTL

SEQ ID NO: 3141902 - protein, 10 aa, Giardia lamblia
TEGATGSFTK

SEQ ID NO: 3141903 - protein, 10 aa, Giardia lamblia
TEGCKGGWRQ

SEQ ID NO: 3141904 - protein, 21 aa, Giardia lamblia
TEGDGFKKAEKGKHKGRQDKD

SEQ ID NO: 3141905 - protein, 9 aa, Giardia lamblia
TEGENGKDR

SEQ ID NO: 3141906 - protein, 6 aa, Giardia lamblia
TEGETE

SEQ ID NO: 3141907 - protein, 4 aa, Giardia lamblia
TEGG

SEQ ID NO: 3141908 - protein, 7 aa, Giardia lamblia
TEGGSVE

SEQ ID NO: 3141909 - protein, 10 aa, Giardia lamblia
TEGKPPHSEL

SEQ ID NO: 3141910 - protein, 9 aa, Giardia lamblia
TEGKTRHDL

SEQ ID NO: 3141911 - protein, 5 aa, Giardia lamblia
TEGLQ

SEQ ID NO: 3141912 - protein, 11 aa, Giardia lamblia
TEGMNVGGPSI

SEQ ID NO: 3141913 - protein, 7 aa, Giardia lamblia
TEGNGEA

SEQ ID NO: 3141914 - protein, 6 aa, Giardia lamblia
TEGPGG

SEQ ID NO: 3141915 - protein, 6 aa, Giardia lamblia
TEGPRL

SEQ ID NO: 3141916 - protein, 4 aa, Giardia lamblia
TEGR

SEQ ID NO: 3141917 - protein, 5 aa, Giardia lamblia
TEGRQ

SEQ ID NO: 3141918 - protein, 15 aa, Giardia lamblia
TEGSKLDKQANEQQF

SEQ ID NO: 3141919 - protein, 7 aa, Giardia lamblia
TEGSPDV

SEQ ID NO: 3141920 - protein, 8 aa, Giardia lamblia
TEGSTASL

SEQ ID NO: 3141921 - protein, 8 aa, Giardia lamblia
TEGSYKAI

SEQ ID NO: 3141922 - protein, 6 aa, Giardia lamblia
TEGTSG

SEQ ID NO: 3141923 - protein, 7 aa, Giardia lamblia
TEGVRTN

SEQ ID NO: 3141924 - protein, 6 aa, Giardia lamblia
TEGYSS

SEQ ID NO: 3141925 - protein, 5 aa, Giardia lamblia
TEHET

SEQ ID NO: 3141926 - protein, 4 aa, Giardia lamblia
TEHK

SEQ ID NO: 3141927 - protein, 6 aa, Giardia lamblia
TEHPVN

SEQ ID NO: 3141928 - protein, 6 aa, Giardia lamblia
TEHQDM

SEQ ID NO: 3141929 - protein, 11 aa, Giardia lamblia
TEIASSSDARE

SEQ ID NO: 3141930 - protein, 51 aa, Giardia lamblia
TEIGASSGPEPPNHAPTDSHRPLPRGTPDPMTLGDGNDASTTAMARPSSCE

SEQ ID NO: 3141931 - protein, 4 aa, Giardia lamblia
TEIN

SEQ ID NO: 3141932 - protein, 11 aa, Giardia lamblia
TEIPGASSISR

SEQ ID NO: 3141933 - protein, 20 aa, Giardia lamblia
TEISTNDHENKYSTPLTSSD

SEQ ID NO: 3141934 - protein, 32 aa, Giardia lamblia
TEKDERGGAAGSVPLSSPTSATGVVERARALG

SEQ ID NO: 3141935 - protein, 9 aa, Giardia lamblia
TEKDNASWK

SEQ ID NO: 3141936 - protein, 8 aa, Giardia lamblia
TEKDTSYA

SEQ ID NO: 3141937 - protein, 4 aa, Giardia lamblia
TEKE

SEQ ID NO: 3141938 - protein, 6 aa, Giardia lamblia
TEKEAE

SEQ ID NO: 3141939 - protein, 13 aa, Giardia lamblia
TEKEAEIATKDAR

SEQ ID NO: 3141940 - protein, 5 aa, Giardia lamblia
TEKEL

SEQ ID NO: 3141941 - protein, 11 aa, Giardia lamblia
TEKFSGSSPSL

SEQ ID NO: 3141942 - protein, 22 aa, Giardia lamblia
TEKGKERTLDDTLENTAPSGSL

SEQ ID NO: 3141943 - protein, 5 aa, Giardia lamblia
TEKGS

SEQ ID NO: 3141944 - protein, 9 aa, Giardia lamblia
TEKKNYSET

SEQ ID NO: 3141945 - protein, 66 aa, Giardia lamblia
TEKKPEPVDIRPESVKNAQANSGKKSKTDAAQEDVGSHPTLKNQKQPADKTPEKKLSHNSKQTRTV

SEQ ID NO: 3141946 - protein, 12 aa, Giardia lamblia
TEKKQRSTVSER

SEQ ID NO: 3141947 - protein, 5 aa, Giardia lamblia
TEKNI

SEQ ID NO: 3141948 - protein, 7 aa, Giardia lamblia
TEKNPAR

SEQ ID NO: 3141949 - protein, 4 aa, Giardia lamblia
TEKP

SEQ ID NO: 3141950 - protein, 5 aa, Giardia lamblia
TEKPL

SEQ ID NO: 3141951 - protein, 27 aa, Giardia lamblia
TEKPRSKGSDHSVGGDVGGGHKDIAKD

SEQ ID NO: 3141952 - protein, 12 aa, Giardia lamblia
TEKRSEKPDNSH

SEQ ID NO: 3141953 - protein, 8 aa, Giardia lamblia
TEKSEVSL

SEQ ID NO: 3141954 - protein, 7 aa, Giardia lamblia
TEKTQFN

SEQ ID NO: 3141955 - protein, 8 aa, Giardia lamblia
TEKYGFSG

SEQ ID NO: 3141956 - protein, 5 aa, Giardia lamblia
TELAA

SEQ ID NO: 3141957 - protein, 9 aa, Giardia lamblia
TELDPEASF

SEQ ID NO: 3141958 - protein, 5 aa, Giardia lamblia
TELDS

SEQ ID NO: 3141959 - protein, 13 aa, Giardia lamblia
TELEAEEKKDRYI

SEQ ID NO: 3141960 - protein, 5 aa, Giardia lamblia
TELES

SEQ ID NO: 3141961 - protein, 8 aa, Giardia lamblia
TELGPGST

SEQ ID NO: 3141962 - protein, 11 aa, Giardia lamblia
TELKDQQDEIK

SEQ ID NO: 3141963 - protein, 9 aa, Giardia lamblia
TELKETAAK

SEQ ID NO: 3141964 - protein, 11 aa, Giardia lamblia
TELPASERDQL

SEQ ID NO: 3141965 - protein, 11 aa, Giardia lamblia
TELPGQHEQNA

SEQ ID NO: 3141966 - protein, 5 aa, Giardia lamblia
TELPS

SEQ ID NO: 3141967 - protein, 10 aa, Giardia lamblia
TELQQDSERY

SEQ ID NO: 3141968 - protein, 6 aa, Giardia lamblia
TELREK

SEQ ID NO: 3141969 - protein, 15 aa, Giardia lamblia
TELSESTDDIGTGDS

SEQ ID NO: 3141970 - protein, 10 aa, Giardia lamblia
TELTETQTQL

SEQ ID NO: 3141971 - protein, 7 aa, Giardia lamblia
TEMDEST

SEQ ID NO: 3141972 - protein, 7 aa, Giardia lamblia
TEMSTPR

SEQ ID NO: 3141973 - protein, 13 aa, Giardia lamblia
TEMTHKEATAELQ

SEQ ID NO: 3141974 - protein, 9 aa, Giardia lamblia
TENAGTQYE

SEQ ID NO: 3141975 - protein, 5 aa, Giardia lamblia
TENAR

SEQ ID NO: 3141976 - protein, 12 aa, Giardia lamblia
TENATSKPSPEE

SEQ ID NO: 3141977 - protein, 15 aa, Giardia lamblia
TENDAFKKSGVTQDE

SEQ ID NO: 3141978 - protein, 5 aa, Giardia lamblia
TENDK

SEQ ID NO: 3141979 - protein, 5 aa, Giardia lamblia
TENEA

SEQ ID NO: 3141980 - protein, 6 aa, Giardia lamblia
TENEAL

SEQ ID NO: 3141981 - protein, 8 aa, Giardia lamblia
TENEQDAA

SEQ ID NO: 3141982 - protein, 4 aa, Giardia lamblia
TENG

SEQ ID NO: 3141983 - protein, 14 aa, Giardia lamblia
TENHGRQYGGKTYN

SEQ ID NO: 3141984 - protein, 21 aa, Giardia lamblia
TENISSPAAISQEKDAVQSPW

SEQ ID NO: 3141985 - protein, 11 aa, Giardia lamblia
TENKPRYKVSS

SEQ ID NO: 3141986 - protein, 9 aa, Giardia lamblia
TENKSLKTE

SEQ ID NO: 3141987 - protein, 5 aa, Giardia lamblia
TENNP

SEQ ID NO: 3141988 - protein, 7 aa, Giardia lamblia
TENNTLT

SEQ ID NO: 3141989 - protein, 4 aa, Giardia lamblia
TENR

SEQ ID NO: 3141990 - protein, 6 aa, Giardia lamblia
TENRLA

SEQ ID NO: 3141991 - protein, 19 aa, Giardia lamblia
TENRRVAETKMNSSSSRSH

SEQ ID NO: 3141992 - protein, 6 aa, Giardia lamblia
TENSRS

SEQ ID NO: 3141993 - protein, 20 aa, Giardia lamblia
TENTTLSKAAEEQEADASTM

SEQ ID NO: 3141994 - protein, 13 aa, Giardia lamblia
TENVENSEYKNSG

SEQ ID NO: 3141995 - protein, 4 aa, Giardia lamblia
TEPA

SEQ ID NO: 3141996 - protein, 5 aa, Giardia lamblia
TEPAP

SEQ ID NO: 3141997 - protein, 4 aa, Giardia lamblia
TEPC

SEQ ID NO: 3141998 - protein, 13 aa, Giardia lamblia
TEPDNGKNVATIP

SEQ ID NO: 3141999 - protein, 5 aa, Giardia lamblia
TEPED

SEQ ID NO: 3142000 - protein, 9 aa, Giardia lamblia
TEPHTKTHS

SEQ ID NO: 3142001 - protein, 5 aa, Giardia lamblia
TEPKK

SEQ ID NO: 3142002 - protein, 4 aa, Giardia lamblia
TEPL

SEQ ID NO: 3142003 - protein, 5 aa, Giardia lamblia
TEPLT

SEQ ID NO: 3142004 - protein, 6 aa, Giardia lamblia
TEPLTS

SEQ ID NO: 3142005 - protein, 4 aa, Giardia lamblia
TEPN

SEQ ID NO: 3142006 - protein, 5 aa, Giardia lamblia
TEPNS

SEQ ID NO: 3142007 - protein, 5 aa, Giardia lamblia
TEPNY

SEQ ID NO: 3142008 - protein, 16 aa, Giardia lamblia
TEPPGLPETMSDEGRD

SEQ ID NO: 3142009 - protein, 34 aa, Giardia lamblia
TEPQEKESPKSDKIASEKPLVESNPGRSRTPSSM

SEQ ID NO: 3142010 - protein, 7 aa, Giardia lamblia
TEPQYKT

SEQ ID NO: 3142011 - protein, 5 aa, Giardia lamblia
TEPSE

SEQ ID NO: 3142012 - protein, 6 aa, Giardia lamblia
TEPTLT

SEQ ID NO: 3142013 - protein, 5 aa, Giardia lamblia
TEPVD

SEQ ID NO: 3142014 - protein, 5 aa, Giardia lamblia
TEQAE

SEQ ID NO: 3142015 - protein, 5 aa, Giardia lamblia
TEQAF

SEQ ID NO: 3142016 - protein, 9 aa, Giardia lamblia
TEQANLTGT

SEQ ID NO: 3142017 - protein, 10 aa, Giardia lamblia
TEQANNMSEP

SEQ ID NO: 3142018 - protein, 9 aa, Giardia lamblia
TEQAPNNDI

SEQ ID NO: 3142019 - protein, 9 aa, Giardia lamblia
TEQAPSIQN

SEQ ID NO: 3142020 - protein, 18 aa, Giardia lamblia
TEQASDLENYAPLGNDVE

SEQ ID NO: 3142021 - protein, 21 aa, Giardia lamblia
TEQELGNQKKSLETEREANKK

SEQ ID NO: 3142022 - protein, 11 aa, Giardia lamblia
TEQEPGDAGSV

SEQ ID NO: 3142023 - protein, 12 aa, Giardia lamblia
TEQGQRTPDGRT

SEQ ID NO: 3142024 - protein, 5 aa, Giardia lamblia
TEQGS

SEQ ID NO: 3142025 - protein, 5 aa, Giardia lamblia
TEQGT

SEQ ID NO: 3142026 - protein, 13 aa, Giardia lamblia
TEQHRRGTERSSV

SEQ ID NO: 3142027 - protein, 4 aa, Giardia lamblia
TEQK

SEQ ID NO: 3142028 - protein, 7 aa, Giardia lamblia
TEQKDSF

SEQ ID NO: 3142029 - protein, 7 aa, Giardia lamblia
TEQKQYP

SEQ ID NO: 3142030 - protein, 13 aa, Giardia lamblia
TEQLRKNRSNNRE

SEQ ID NO: 3142031 - protein, 7 aa, Giardia lamblia
TEQPGYT

SEQ ID NO: 3142032 - protein, 6 aa, Giardia lamblia
TEQQNH

SEQ ID NO: 3142033 - protein, 4 aa, Giardia lamblia
TEQR

SEQ ID NO: 3142034 - protein, 14 aa, Giardia lamblia
TEQSTAHSGSQKSL

SEQ ID NO: 3142035 - protein, 15 aa, Giardia lamblia
TEQTLQSETRKQSAV

SEQ ID NO: 3142036 - protein, 7 aa, Giardia lamblia
TEQTYSR

SEQ ID NO: 3142037 - protein, 11 aa, Giardia lamblia
TEQVQNLPTGW

SEQ ID NO: 3142038 - protein, 6 aa, Giardia lamblia
TEQYTP

SEQ ID NO: 3142039 - protein, 11 aa, Giardia lamblia
TERAESPDVRQ

SEQ ID NO: 3142040 - protein, 13 aa, Giardia lamblia
TERENAKSSVDSE

SEQ ID NO: 3142041 - protein, 5 aa, Giardia lamblia
TERGC

SEQ ID NO: 3142042 - protein, 4 aa, Giardia lamblia
TERI

SEQ ID NO: 3142043 - protein, 8 aa, Giardia lamblia
TERKDHLE

SEQ ID NO: 3142044 - protein, 12 aa, Giardia lamblia
TERKNDPDEQAI

SEQ ID NO: 3142045 - protein, 6 aa, Giardia lamblia
TERKSY

SEQ ID NO: 3142046 - protein, 4 aa, Giardia lamblia
TERN

SEQ ID NO: 3142047 - protein, 4 aa, Giardia lamblia
TERP

SEQ ID NO: 3142048 - protein, 9 aa, Giardia lamblia
TERPEIPQD

SEQ ID NO: 3142049 - protein, 8 aa, Giardia lamblia
TERQQHVA

SEQ ID NO: 3142050 - protein, 5 aa, Giardia lamblia
TERSN

SEQ ID NO: 3142051 - protein, 9 aa, Giardia lamblia
TERSTTAQL

SEQ ID NO: 3142052 - protein, 4 aa, Giardia lamblia
TERT

SEQ ID NO: 3142053 - protein, 20 aa, Giardia lamblia
TERTDSVNNSAARSSSNSSR

SEQ ID NO: 3142054 - protein, 7 aa, Giardia lamblia
TERTHTI

SEQ ID NO: 3142055 - protein, 5 aa, Giardia lamblia
TERTT

SEQ ID NO: 3142056 - protein, 10 aa, Giardia lamblia
TERTTQLASA

SEQ ID NO: 3142057 - protein, 5 aa, Giardia lamblia
TERYE

SEQ ID NO: 3142058 - protein, 4 aa, Giardia lamblia
TESA

SEQ ID NO: 3142059 - protein, 9 aa, Giardia lamblia
TESAKQLKN

SEQ ID NO: 3142060 - protein, 8 aa, Giardia lamblia
TESAPDFG

SEQ ID NO: 3142061 - protein, 6 aa, Giardia lamblia
TESAPH

SEQ ID NO: 3142062 - protein, 12 aa, Giardia lamblia
TESCTEKVGAEN

SEQ ID NO: 3142063 - protein, 4 aa, Giardia lamblia
TESD

SEQ ID NO: 3142064 - protein, 12 aa, Giardia lamblia
TESDAKSVSLDN

SEQ ID NO: 3142065 - protein, 7 aa, Giardia lamblia
TESDATE

SEQ ID NO: 3142066 - protein, 6 aa, Giardia lamblia
TESDNI

SEQ ID NO: 3142067 - protein, 10 aa, Giardia lamblia
TESDPSYQAG

SEQ ID NO: 3142068 - protein, 7 aa, Giardia lamblia
TESERRE

SEQ ID NO: 3142069 - protein, 6 aa, Giardia lamblia
TESGAR

SEQ ID NO: 3142070 - protein, 12 aa, Giardia lamblia
TESGCAPPFAPD

SEQ ID NO: 3142071 - protein, 7 aa, Giardia lamblia
TESGRNN

SEQ ID NO: 3142072 - protein, 8 aa, Giardia lamblia
TESKQQLE

SEQ ID NO: 3142073 - protein, 10 aa, Giardia lamblia
TESNESETLT

SEQ ID NO: 3142074 - protein, 17 aa, Giardia lamblia
TESNSGFSERRQKQRDI

SEQ ID NO: 3142075 - protein, 15 aa, Giardia lamblia
TESQKNTEDAEEAHN

SEQ ID NO: 3142076 - protein, 12 aa, Giardia lamblia
TESQQQQAESLP

SEQ ID NO: 3142077 - protein, 10 aa, Giardia lamblia
TESRKRQASF

SEQ ID NO: 3142078 - protein, 9 aa, Giardia lamblia
TESRRQNEE

SEQ ID NO: 3142079 - protein, 4 aa, Giardia lamblia
TESS

SEQ ID NO: 3142080 - protein, 8 aa, Giardia lamblia
TESSAPAQ

SEQ ID NO: 3142081 - protein, 9 aa, Giardia lamblia
TESSDTTMY

SEQ ID NO: 3142082 - protein, 4 aa, Giardia lamblia
TEST

SEQ ID NO: 3142083 - protein, 10 aa, Giardia lamblia
TESTAESSAT

SEQ ID NO: 3142084 - protein, 5 aa, Giardia lamblia
TESTD

SEQ ID NO: 3142085 - protein, 5 aa, Giardia lamblia
TESVP

SEQ ID NO: 3142086 - protein, 5 aa, Giardia lamblia
TESVT

SEQ ID NO: 3142087 - protein, 13 aa, Giardia lamblia
TESVYARSSADLE

SEQ ID NO: 3142088 - protein, 9 aa, Giardia lamblia
TESYSCGKG

SEQ ID NO: 3142089 - protein, 9 aa, Giardia lamblia
TETADDGRV

SEQ ID NO: 3142090 - protein, 10 aa, Giardia lamblia
TETAGKKPVK

SEQ ID NO: 3142091 - protein, 11 aa, Giardia lamblia
TETAVQQRTNV

SEQ ID NO: 3142092 - protein, 4 aa, Giardia lamblia
TETD

SEQ ID NO: 3142093 - protein, 15 aa, Giardia lamblia
TETDEDQNFEGKQDQ

SEQ ID NO: 3142094 - protein, 6 aa, Giardia lamblia
TETDSS

SEQ ID NO: 3142095 - protein, 4 aa, Giardia lamblia
TETE

SEQ ID NO: 3142096 - protein, 18 aa, Giardia lamblia
TETEGLNTSHISRTGGTI

SEQ ID NO: 3142097 - protein, 4 aa, Giardia lamblia
TETF

SEQ ID NO: 3142098 - protein, 21 aa, Giardia lamblia
TETNSSDFEEEKGFIVDSISE

SEQ ID NO: 3142099 - protein, 8 aa, Giardia lamblia
TETPEDYA

SEQ ID NO: 3142100 - protein, 5 aa, Giardia lamblia
TETPT

SEQ ID NO: 3142101 - protein, 9 aa, Giardia lamblia
TETPTGPVA

SEQ ID NO: 3142102 - protein, 18 aa, Giardia lamblia
TETQQQIAGSAPCPACNG

SEQ ID NO: 3142103 - protein, 21 aa, Giardia lamblia
TETQVHTDHRQQQHITQRSSA

SEQ ID NO: 3142104 - protein, 6 aa, Giardia lamblia
TETQYS

SEQ ID NO: 3142105 - protein, 27 aa, Giardia lamblia
TETRRPSSASKQDRKASSASGGSGTQV

SEQ ID NO: 3142106 - protein, 6 aa, Giardia lamblia
TETSAS

SEQ ID NO: 3142107 - protein, 4 aa, Giardia lamblia
TETT

SEQ ID NO: 3142108 - protein, 5 aa, Giardia lamblia
TETTM

SEQ ID NO: 3142109 - protein, 6 aa, Giardia lamblia
TETWEE

SEQ ID NO: 3142110 - protein, 6 aa, Giardia lamblia
TEVEDP

SEQ ID NO: 3142111 - protein, 8 aa, Giardia lamblia
TEVPSDVS

SEQ ID NO: 3142112 - protein, 5 aa, Giardia lamblia
TEVSD

SEQ ID NO: 3142113 - protein, 4 aa, Giardia lamblia
TEYD

SEQ ID NO: 3142114 - protein, 12 aa, Giardia lamblia
TEYDTLSSTTKR

SEQ ID NO: 3142115 - protein, 11 aa, Giardia lamblia
TEYENYRASTA

SEQ ID NO: 3142116 - protein, 19 aa, Giardia lamblia
TEYESKLASERKQADSNID

SEQ ID NO: 3142117 - protein, 38 aa, Giardia lamblia
TEYKTHEQSAKSHDEFRPKDDTAADATEEARHGAGYEG

SEQ ID NO: 3142118 - protein, 6 aa, Giardia lamblia
TEYNGR

SEQ ID NO: 3142119 - protein, 44 aa, Giardia lamblia
TEYQRNSDQSKAPSGQFSDSHDRARYRGKSDRDSADTARSPRSL

SEQ ID NO: 3142120 - protein, 24 aa, Giardia lamblia
TEYSQSQSTATASPGQKAFDPQPN

SEQ ID NO: 3142121 - protein, 43 aa, Giardia lamblia
TEYTPAKPAELDSPEPVPDPHPHPEPEPDLDPDGDTPNKNTNN

SEQ ID NO: 3142122 - protein, 39 aa, Giardia lamblia
TFAAEASKENSPMKSASPNNPNSNPSIVSPENRSDDDIK

SEQ ID NO: 3142123 - protein, 4 aa, Giardia lamblia
TFDD

SEQ ID NO: 3142124 - protein, 8 aa, Giardia lamblia
TFDGQGDN

SEQ ID NO: 3142125 - protein, 13 aa, Giardia lamblia
TFDPDDPRSKPRT

SEQ ID NO: 3142126 - protein, 6 aa, Giardia lamblia
TFDPST

SEQ ID NO: 3142127 - protein, 10 aa, Giardia lamblia
TFDRRRPRPA

SEQ ID NO: 3142128 - protein, 9 aa, Giardia lamblia
TFDSGVEEN

SEQ ID NO: 3142129 - protein, 6 aa, Giardia lamblia
TFGQQN

SEQ ID NO: 3142130 - protein, 9 aa, Giardia lamblia
TFGSDPTTI

SEQ ID NO: 3142131 - protein, 13 aa, Giardia lamblia
TFGSESSKPPGRI

SEQ ID NO: 3142132 - protein, 4 aa, Giardia lamblia
TFHE

SEQ ID NO: 3142133 - protein, 10 aa, Giardia lamblia
TFKRQSEEEY

SEQ ID NO: 3142134 - protein, 26 aa, Giardia lamblia
TFKTTAATVGELDPTAAYTTNDPNDI

SEQ ID NO: 3142135 - protein, 8 aa, Giardia lamblia
TFNEQSET

SEQ ID NO: 3142136 - protein, 12 aa, Giardia lamblia
TFNKPSDPPIGG

SEQ ID NO: 3142137 - protein, 13 aa, Giardia lamblia
TFNRRENNKKPLD

SEQ ID NO: 3142138 - protein, 4 aa, Giardia lamblia
TFPE

SEQ ID NO: 3142139 - protein, 9 aa, Giardia lamblia
TFPETSDED

SEQ ID NO: 3142140 - protein, 8 aa, Giardia lamblia
TFPSASPT

SEQ ID NO: 3142141 - protein, 5 aa, Giardia lamblia
TFPTP

SEQ ID NO: 3142142 - protein, 25 aa, Giardia lamblia
TFQGTAGAKLSEARDGDSEGESTEE

SEQ ID NO: 3142143 - protein, 22 aa, Giardia lamblia
TFQPTGCAADDDSQRGAPLPPP

SEQ ID NO: 3142144 - protein, 8 aa, Giardia lamblia
TFQSGNSQ

SEQ ID NO: 3142145 - protein, 20 aa, Giardia lamblia
TFQSPANRLSTSPPSPAKAL

SEQ ID NO: 3142146 - protein, 9 aa, Giardia lamblia
TFQTEQTPL

SEQ ID NO: 3142147 - protein, 6 aa, Giardia lamblia
TFRKSG

SEQ ID NO: 3142148 - protein, 5 aa, Giardia lamblia
TFSAP

SEQ ID NO: 3142149 - protein, 6 aa, Giardia lamblia
TFSDNT

SEQ ID NO: 3142150 - protein, 7 aa, Giardia lamblia
TFSGGKQ

SEQ ID NO: 3142151 - protein, 4 aa, Giardia lamblia
TFSS

SEQ ID NO: 3142152 - protein, 8 aa, Giardia lamblia
TFSSPSKQ

SEQ ID NO: 3142153 - protein, 11 aa, Giardia lamblia
TFSSSSTSLDD

SEQ ID NO: 3142154 - protein, 13 aa, Giardia lamblia
TFSSTDVGVGTRR

SEQ ID NO: 3142155 - protein, 7 aa, Giardia lamblia
TFSTETP

SEQ ID NO: 3142156 - protein, 12 aa, Giardia lamblia
TFTGEETTLSGD

SEQ ID NO: 3142157 - protein, 5 aa, Giardia lamblia
TFTGP

SEQ ID NO: 3142158 - protein, 40 aa, Giardia lamblia
TFTNQADDYNEYTSRGTNFNPAHANPEVHNDSQAHFDPPS

SEQ ID NO: 3142159 - protein, 11 aa, Giardia lamblia
TFYKPGDTYTP

SEQ ID NO: 3142160 - protein, 4 aa, Giardia lamblia
TGAA

SEQ ID NO: 3142161 - protein, 27 aa, Giardia lamblia
TGAANSSKEASTTVAPQRTSSANSNLR

SEQ ID NO: 3142162 - protein, 5 aa, Giardia lamblia
TGADN

SEQ ID NO: 3142163 - protein, 4 aa, Giardia lamblia
TGAE

SEQ ID NO: 3142164 - protein, 6 aa, Giardia lamblia
TGAEAK

SEQ ID NO: 3142165 - protein, 11 aa, Giardia lamblia
TGAEGDPETCK

SEQ ID NO: 3142166 - protein, 22 aa, Giardia lamblia
TGAEVASGALRQARAGSPRSGA

SEQ ID NO: 3142167 - protein, 5 aa, Giardia lamblia
TGAGL

SEQ ID NO: 3142168 - protein, 8 aa, Giardia lamblia
TGAGLADP

SEQ ID NO: 3142169 - protein, 6 aa, Giardia lamblia
TGAGLH

SEQ ID NO: 3142170 - protein, 9 aa, Giardia lamblia
TGAIDNDDY

SEQ ID NO: 3142171 - protein, 9 aa, Giardia lamblia
TGAIGSDDV

SEQ ID NO: 3142172 - protein, 10 aa, Giardia lamblia
TGAKDGEVTG

SEQ ID NO: 3142173 - protein, 9 aa, Giardia lamblia
TGAKRQLGA

SEQ ID NO: 3142174 - protein, 6 aa, Giardia lamblia
TGAKSM

SEQ ID NO: 3142175 - protein, 4 aa, Giardia lamblia
TGAN

SEQ ID NO: 3142176 - protein, 9 aa, Giardia lamblia
TGANPPRKN

SEQ ID NO: 3142177 - protein, 10 aa, Giardia lamblia
TGAPMEQRSP

SEQ ID NO: 3142178 - protein, 11 aa, Giardia lamblia
TGAPPTSLTAG

SEQ ID NO: 3142179 - protein, 12 aa, Giardia lamblia
TGAQKKEQAAEQ

SEQ ID NO: 3142180 - protein, 17 aa, Giardia lamblia
TGAQPDESSAPLSYDSK

SEQ ID NO: 3142181 - protein, 8 aa, Giardia lamblia
TGAQPGAR

SEQ ID NO: 3142182 - protein, 8 aa, Giardia lamblia
TGAQRQRA

SEQ ID NO: 3142183 - protein, 6 aa, Giardia lamblia
TGARKA

SEQ ID NO: 3142184 - protein, 29 aa, Giardia lamblia
TGASARSASANATNSTFSTTSTTSTNSTM

SEQ ID NO: 3142185 - protein, 22 aa, Giardia lamblia
TGASKRLSDCDASAADHPGVAK

SEQ ID NO: 3142186 - protein, 9 aa, Giardia lamblia
TGASPTGFA

SEQ ID NO: 3142187 - protein, 95 aa, Giardia lamblia
TGASTEDDQDHQQGLDSQRSYEHPAEETPVDQPGTEQGQPDAEQHQEEGTYETEGNTGLPEVDNPPEDAPENEGLEEKEEPARNIESAGTNGTTD

SEQ ID NO: 3142188 - protein, 6 aa, Giardia lamblia
TGATET

SEQ ID NO: 3142189 - protein, 18 aa, Giardia lamblia
TGATNPGLSSNPGVAPAS

SEQ ID NO: 3142190 - protein, 5 aa, Giardia lamblia
TGATP

SEQ ID NO: 3142191 - protein, 17 aa, Giardia lamblia
TGATQEPDYDTENRTQQ

SEQ ID NO: 3142192 - protein, 7 aa, Giardia lamblia
TGATTGA

SEQ ID NO: 3142193 - protein, 9 aa, Giardia lamblia
TGAVTSSLN

SEQ ID NO: 3142194 - protein, 4 aa, Giardia lamblia
TGAY

SEQ ID NO: 3142195 - protein, 7 aa, Giardia lamblia
TGCRDGG

SEQ ID NO: 3142196 - protein, 7 aa, Giardia lamblia
TGDAART

SEQ ID NO: 3142197 - protein, 19 aa, Giardia lamblia
TGDALSEQVTSSQKLSKRG

SEQ ID NO: 3142198 - protein, 6 aa, Giardia lamblia
TGDAPG

SEQ ID NO: 3142199 - protein, 23 aa, Giardia lamblia
TGDATAEQPLPGRRMKPGANTSS

SEQ ID NO: 3142200 - protein, 4 aa, Giardia lamblia
TGDC

SEQ ID NO: 3142201 - protein, 10 aa, Giardia lamblia
TGDDQRYTTT

SEQ ID NO: 3142202 - protein, 4 aa, Giardia lamblia
TGDE

SEQ ID NO: 3142203 - protein, 5 aa, Giardia lamblia
TGDED

SEQ ID NO: 3142204 - protein, 16 aa, Giardia lamblia
TGDEVTREAKDDEATL

SEQ ID NO: 3142205 - protein, 4 aa, Giardia lamblia
TGDI

SEQ ID NO: 3142206 - protein, 10 aa, Giardia lamblia
TGDIAAQEGL

SEQ ID NO: 3142207 - protein, 5 aa, Giardia lamblia
TGDKG

SEQ ID NO: 3142208 - protein, 6 aa, Giardia lamblia
TGDNPF

SEQ ID NO: 3142209 - protein, 4 aa, Giardia lamblia
TGDP

SEQ ID NO: 3142210 - protein, 11 aa, Giardia lamblia
TGDPDKEPDVS

SEQ ID NO: 3142211 - protein, 9 aa, Giardia lamblia
TGDPSAYTG

SEQ ID NO: 3142212 - protein, 8 aa, Giardia lamblia
TGDPSNLN

SEQ ID NO: 3142213 - protein, 6 aa, Giardia lamblia
TGDPTI

SEQ ID NO: 3142214 - protein, 7 aa, Giardia lamblia
TGDQKSA

SEQ ID NO: 3142215 - protein, 8 aa, Giardia lamblia
TGDQRDDD

SEQ ID NO: 3142216 - protein, 12 aa, Giardia lamblia
TGDRIPRDTHEL

SEQ ID NO: 3142217 - protein, 6 aa, Giardia lamblia
TGDRPR

SEQ ID NO: 3142218 - protein, 4 aa, Giardia lamblia
TGDT

SEQ ID NO: 3142219 - protein, 6 aa, Giardia lamblia
TGDTEL

SEQ ID NO: 3142220 - protein, 14 aa, Giardia lamblia
TGDTFKPSPTDLEK

SEQ ID NO: 3142221 - protein, 6 aa, Giardia lamblia
TGDTKT

SEQ ID NO: 3142222 - protein, 15 aa, Giardia lamblia
TGDVGNAVLAATTDA

SEQ ID NO: 3142223 - protein, 26 aa, Giardia lamblia
TGDVITSRSPSPKTRSRSPSPGRVKS

SEQ ID NO: 3142224 - protein, 5 aa, Giardia lamblia
TGDVT

SEQ ID NO: 3142225 - protein, 12 aa, Giardia lamblia
TGEAECTQGYQP

SEQ ID NO: 3142226 - protein, 22 aa, Giardia lamblia
TGEAHTVPQPARKRFTEPPGDS

SEQ ID NO: 3142227 - protein, 7 aa, Giardia lamblia
TGEARAN

SEQ ID NO: 3142228 - protein, 9 aa, Giardia lamblia
TGEDGVLSA

SEQ ID NO: 3142229 - protein, 18 aa, Giardia lamblia
TGEDLSEHQKESLKAYSA

SEQ ID NO: 3142230 - protein, 4 aa, Giardia lamblia
TGEE

SEQ ID NO: 3142231 - protein, 8 aa, Giardia lamblia
TGEGDLDD

SEQ ID NO: 3142232 - protein, 10 aa, Giardia lamblia
TGEGGDSEHL

SEQ ID NO: 3142233 - protein, 12 aa, Giardia lamblia
TGEGVRAQDAAG

SEQ ID NO: 3142234 - protein, 4 aa, Giardia lamblia
TGEL

SEQ ID NO: 3142235 - protein, 6 aa, Giardia lamblia
TGELPR

SEQ ID NO: 3142236 - protein, 17 aa, Giardia lamblia
TGELRESDLDATKRKIR

SEQ ID NO: 3142237 - protein, 27 aa, Giardia lamblia
TGELTANNADSLHTNSQGGGISRSPSM

SEQ ID NO: 3142238 - protein, 10 aa, Giardia lamblia
TGENDHYKGE

SEQ ID NO: 3142239 - protein, 8 aa, Giardia lamblia
TGEPGGQI

SEQ ID NO: 3142240 - protein, 15 aa, Giardia lamblia
TGEPLGDWTDFKSEF

SEQ ID NO: 3142241 - protein, 13 aa, Giardia lamblia
TGEPPDESPIKRA

SEQ ID NO: 3142242 - protein, 12 aa, Giardia lamblia
TGEPRSASPDLP

SEQ ID NO: 3142243 - protein, 7 aa, Giardia lamblia
TGEQGKN

SEQ ID NO: 3142244 - protein, 6 aa, Giardia lamblia
TGEQTR

SEQ ID NO: 3142245 - protein, 4 aa, Giardia lamblia
TGER

SEQ ID NO: 3142246 - protein, 7 aa, Giardia lamblia
TGERPNL

SEQ ID NO: 3142247 - protein, 4 aa, Giardia lamblia
TGES

SEQ ID NO: 3142248 - protein, 9 aa, Giardia lamblia
TGEYKPTHY

SEQ ID NO: 3142249 - protein, 14 aa, Giardia lamblia
TGEYTIGPNGEIID

SEQ ID NO: 3142250 - protein, 17 aa, Giardia lamblia
TGFGNNKEKHDAPRDAV

SEQ ID NO: 3142251 - protein, 6 aa, Giardia lamblia
TGFQDI

SEQ ID NO: 3142252 - protein, 5 aa, Giardia lamblia
TGFTR

SEQ ID NO: 3142253 - protein, 7 aa, Giardia lamblia
TGGAPVD

SEQ ID NO: 3142254 - protein, 9 aa, Giardia lamblia
TGGCNEDQL

SEQ ID NO: 3142255 - protein, 4 aa, Giardia lamblia
TGGD

SEQ ID NO: 3142256 - protein, 4 aa, Giardia lamblia
TGGE

SEQ ID NO: 3142257 - protein, 6 aa, Giardia lamblia
TGGEPE

SEQ ID NO: 3142258 - protein, 6 aa, Giardia lamblia
TGGGDG

SEQ ID NO: 3142259 - protein, 19 aa, Giardia lamblia
TGGGYTGGFSGDSESLEGA

SEQ ID NO: 3142260 - protein, 5 aa, Giardia lamblia
TGGHE

SEQ ID NO: 3142261 - protein, 5 aa, Giardia lamblia
TGGHQ

SEQ ID NO: 3142262 - protein, 7 aa, Giardia lamblia
TGGKSKF

SEQ ID NO: 3142263 - protein, 12 aa, Giardia lamblia
TGGKSSQKGMRS

SEQ ID NO: 3142264 - protein, 9 aa, Giardia lamblia
TGGLDTGMT

SEQ ID NO: 3142265 - protein, 9 aa, Giardia lamblia
TGGNDAQGF

SEQ ID NO: 3142266 - protein, 7 aa, Giardia lamblia
TGGPGMV

SEQ ID NO: 3142267 - protein, 6 aa, Giardia lamblia
TGGSDG

SEQ ID NO: 3142268 - protein, 16 aa, Giardia lamblia
TGGSSLQTPALATPNV

SEQ ID NO: 3142269 - protein, 17 aa, Giardia lamblia
TGGSSPQSKLPDLGSGA

SEQ ID NO: 3142270 - protein, 9 aa, Giardia lamblia
TGGTDQSLE

SEQ ID NO: 3142271 - protein, 4 aa, Giardia lamblia
TGGV

SEQ ID NO: 3142272 - protein, 5 aa, Giardia lamblia
TGGVA

SEQ ID NO: 3142273 - protein, 15 aa, Giardia lamblia
TGHAPDETGKKTLTD

SEQ ID NO: 3142274 - protein, 5 aa, Giardia lamblia
TGHDA

SEQ ID NO: 3142275 - protein, 5 aa, Giardia lamblia
TGHDM

SEQ ID NO: 3142276 - protein, 6 aa, Giardia lamblia
TGHEDA

SEQ ID NO: 3142277 - protein, 5 aa, Giardia lamblia
TGHGK

SEQ ID NO: 3142278 - protein, 11 aa, Giardia lamblia
TGHLPGSGLQS

SEQ ID NO: 3142279 - protein, 9 aa, Giardia lamblia
TGHNHADEG

SEQ ID NO: 3142280 - protein, 13 aa, Giardia lamblia
TGIATENAERKKM

SEQ ID NO: 3142281 - protein, 19 aa, Giardia lamblia
TGIDSDGGLGSNLVSILNK

SEQ ID NO: 3142282 - protein, 18 aa, Giardia lamblia
TGIDTKNTGVSRGTSADA

SEQ ID NO: 3142283 - protein, 4 aa, Giardia lamblia
TGIP

SEQ ID NO: 3142284 - protein, 10 aa, Giardia lamblia
TGIPSDQLQT

SEQ ID NO: 3142285 - protein, 9 aa, Giardia lamblia
TGIPSEQSI

SEQ ID NO: 3142286 - protein, 10 aa, Giardia lamblia
TGKAGASSVG

SEQ ID NO: 3142287 - protein, 6 aa, Giardia lamblia
TGKDVT

SEQ ID NO: 3142288 - protein, 7 aa, Giardia lamblia
TGKESNW

SEQ ID NO: 3142289 - protein, 16 aa, Giardia lamblia
TGKGAQHSHRGTSLNG

SEQ ID NO: 3142290 - protein, 23 aa, Giardia lamblia
TGKGERGKSNDENWHGNDGLGDA

SEQ ID NO: 3142291 - protein, 10 aa, Giardia lamblia
TGKGFESTRA

SEQ ID NO: 3142292 - protein, 8 aa, Giardia lamblia
TGKHSETH

SEQ ID NO: 3142293 - protein, 9 aa, Giardia lamblia
TGKKKRMHG

SEQ ID NO: 3142294 - protein, 16 aa, Giardia lamblia
TGKPGTSSAPHRTSKH

SEQ ID NO: 3142295 - protein, 6 aa, Giardia lamblia
TGKRPD

SEQ ID NO: 3142296 - protein, 7 aa, Giardia lamblia
TGKRTGV

SEQ ID NO: 3142297 - protein, 10 aa, Giardia lamblia
TGKRTSVSVK

SEQ ID NO: 3142298 - protein, 10 aa, Giardia lamblia
TGKSSSTEVS

SEQ ID NO: 3142299 - protein, 4 aa, Giardia lamblia
TGKT

SEQ ID NO: 3142300 - protein, 5 aa, Giardia lamblia
TGKTA

SEQ ID NO: 3142301 - protein, 6 aa, Giardia lamblia
TGKTEA

SEQ ID NO: 3142302 - protein, 5 aa, Giardia lamblia
TGKTP

SEQ ID NO: 3142303 - protein, 4 aa, Giardia lamblia
TGKY

SEQ ID NO: 3142304 - protein, 17 aa, Giardia lamblia
TGKYPTPPELLAIIESK

SEQ ID NO: 3142305 - protein, 4 aa, Giardia lamblia
TGLE

SEQ ID NO: 3142306 - protein, 13 aa, Giardia lamblia
TGLETASRVPGNV

SEQ ID NO: 3142307 - protein, 17 aa, Giardia lamblia
TGLNPPETPDSTPKNRN

SEQ ID NO: 3142308 - protein, 8 aa, Giardia lamblia
TGLPPQQQ

SEQ ID NO: 3142309 - protein, 4 aa, Giardia lamblia
TGLR

SEQ ID NO: 3142310 - protein, 6 aa, Giardia lamblia
TGLRDI

SEQ ID NO: 3142311 - protein, 16 aa, Giardia lamblia
TGLSEISKTGVSAADI

SEQ ID NO: 3142312 - protein, 8 aa, Giardia lamblia
TGLSTGGR

SEQ ID NO: 3142313 - protein, 7 aa, Giardia lamblia
TGLTEEG

SEQ ID NO: 3142314 - protein, 30 aa, Giardia lamblia
TGLTESSLNPPSASFSSIGGVPNGTSDPSG

SEQ ID NO: 3142315 - protein, 16 aa, Giardia lamblia
TGLTGSASQSTPSDAR

SEQ ID NO: 3142316 - protein, 22 aa, Giardia lamblia
TGMTASGSASLGPRSVGPTTGN

SEQ ID NO: 3142317 - protein, 5 aa, Giardia lamblia
TGNAA

SEQ ID NO: 3142318 - protein, 16 aa, Giardia lamblia
TGNARSKSCTAVNNTS

SEQ ID NO: 3142319 - protein, 7 aa, Giardia lamblia
TGNDGSP

SEQ ID NO: 3142320 - protein, 12 aa, Giardia lamblia
TGNDSGEVNVWG

SEQ ID NO: 3142321 - protein, 5 aa, Giardia lamblia
TGNDW

SEQ ID NO: 3142322 - protein, 6 aa, Giardia lamblia
TGNHTV

SEQ ID NO: 3142323 - protein, 6 aa, Giardia lamblia
TGNKEY

SEQ ID NO: 3142324 - protein, 25 aa, Giardia lamblia
TGNKNAQQLSTSKPPATALNDPIST

SEQ ID NO: 3142325 - protein, 8 aa, Giardia lamblia
TGNKQEVQ

SEQ ID NO: 3142326 - protein, 4 aa, Giardia lamblia
TGNL

SEQ ID NO: 3142327 - protein, 5 aa, Giardia lamblia
TGNND

SEQ ID NO: 3142328 - protein, 9 aa, Giardia lamblia
TGNPDEVTS

SEQ ID NO: 3142329 - protein, 6 aa, Giardia lamblia
TGNPVV

SEQ ID NO: 3142330 - protein, 10 aa, Giardia lamblia
TGNSTARITT

SEQ ID NO: 3142331 - protein, 8 aa, Giardia lamblia
TGNTGSLT

SEQ ID NO: 3142332 - protein, 5 aa, Giardia lamblia
TGNVD

SEQ ID NO: 3142333 - protein, 6 aa, Giardia lamblia
TGNYDE

SEQ ID NO: 3142334 - protein, 7 aa, Giardia lamblia
TGPAGLG

SEQ ID NO: 3142335 - protein, 7 aa, Giardia lamblia
TGPAPRY

SEQ ID NO: 3142336 - protein, 4 aa, Giardia lamblia
TGPD

SEQ ID NO: 3142337 - protein, 8 aa, Giardia lamblia
TGPEFEGE

SEQ ID NO: 3142338 - protein, 8 aa, Giardia lamblia
TGPGDCSA

SEQ ID NO: 3142339 - protein, 21 aa, Giardia lamblia
TGPGPGAYATPEGTLKGPAFS

SEQ ID NO: 3142340 - protein, 9 aa, Giardia lamblia
TGPGRTTGL

SEQ ID NO: 3142341 - protein, 4 aa, Giardia lamblia
TGPL

SEQ ID NO: 3142342 - protein, 11 aa, Giardia lamblia
TGPLDDPAAEA

SEQ ID NO: 3142343 - protein, 8 aa, Giardia lamblia
TGPNGTTC

SEQ ID NO: 3142344 - protein, 5 aa, Giardia lamblia
TGPNT

SEQ ID NO: 3142345 - protein, 5 aa, Giardia lamblia
TGPQK

SEQ ID NO: 3142346 - protein, 6 aa, Giardia lamblia
TGPRQG

SEQ ID NO: 3142347 - protein, 7 aa, Giardia lamblia
TGPTGSI

SEQ ID NO: 3142348 - protein, 8 aa, Giardia lamblia
TGPTTQSL

SEQ ID NO: 3142349 - protein, 9 aa, Giardia lamblia
TGQESDVPD

SEQ ID NO: 3142350 - protein, 5 aa, Giardia lamblia
TGQGL

SEQ ID NO: 3142351 - protein, 7 aa, Giardia lamblia
TGQGRSI

SEQ ID NO: 3142352 - protein, 17 aa, Giardia lamblia
TGQHNISDGDGVGPASG

SEQ ID NO: 3142353 - protein, 14 aa, Giardia lamblia
TGQIASGATPMNQT

SEQ ID NO: 3142354 - protein, 5 aa, Giardia lamblia
TGQKA

SEQ ID NO: 3142355 - protein, 8 aa, Giardia lamblia
TGQKFNSS

SEQ ID NO: 3142356 - protein, 20 aa, Giardia lamblia
TGQKHLSDEPYIQEENQKNT

SEQ ID NO: 3142357 - protein, 10 aa, Giardia lamblia
TGQPAVSDKK

SEQ ID NO: 3142358 - protein, 14 aa, Giardia lamblia
TGQQITTKSEIPVG

SEQ ID NO: 3142359 - protein, 9 aa, Giardia lamblia
TGQRDKQGM

SEQ ID NO: 3142360 - protein, 9 aa, Giardia lamblia
TGQRDKQKM

SEQ ID NO: 3142361 - protein, 4 aa, Giardia lamblia
TGQS

SEQ ID NO: 3142362 - protein, 9 aa, Giardia lamblia
TGQSSSKMD

SEQ ID NO: 3142363 - protein, 6 aa, Giardia lamblia
TGQTAV

SEQ ID NO: 3142364 - protein, 9 aa, Giardia lamblia
TGQTSTGEA

SEQ ID NO: 3142365 - protein, 5 aa, Giardia lamblia
TGRAD

SEQ ID NO: 3142366 - protein, 11 aa, Giardia lamblia
TGREASGRSVK

SEQ ID NO: 3142367 - protein, 4 aa, Giardia lamblia
TGRF

SEQ ID NO: 3142368 - protein, 9 aa, Giardia lamblia
TGRIETKGG

SEQ ID NO: 3142369 - protein, 7 aa, Giardia lamblia
TGRKPLV

SEQ ID NO: 3142370 - protein, 14 aa, Giardia lamblia
TGRNATNKTRNSTH

SEQ ID NO: 3142371 - protein, 5 aa, Giardia lamblia
TGRNE

SEQ ID NO: 3142372 - protein, 6 aa, Giardia lamblia
TGRNTG

SEQ ID NO: 3142373 - protein, 5 aa, Giardia lamblia
TGRPI

SEQ ID NO: 3142374 - protein, 15 aa, Giardia lamblia
TGRPTPEDIEATESP

SEQ ID NO: 3142375 - protein, 9 aa, Giardia lamblia
TGRQYNNGP

SEQ ID NO: 3142376 - protein, 6 aa, Giardia lamblia
TGRRAS

SEQ ID NO: 3142377 - protein, 14 aa, Giardia lamblia
TGRRSTTLTSESPA

SEQ ID NO: 3142378 - protein, 6 aa, Giardia lamblia
TGRSFG

SEQ ID NO: 3142379 - protein, 28 aa, Giardia lamblia
TGRSPPRSTHGIDPHQGYDHSSSANNAL

SEQ ID NO: 3142380 - protein, 6 aa, Giardia lamblia
TGRTEG

SEQ ID NO: 3142381 - protein, 4 aa, Giardia lamblia
TGRV

SEQ ID NO: 3142382 - protein, 6 aa, Giardia lamblia
TGRYPN

SEQ ID NO: 3142383 - protein, 7 aa, Giardia lamblia
TGSADSQ

SEQ ID NO: 3142384 - protein, 11 aa, Giardia lamblia
TGSAKPEETLR

SEQ ID NO: 3142385 - protein, 5 aa, Giardia lamblia
TGSAS

SEQ ID NO: 3142386 - protein, 5 aa, Giardia lamblia
TGSAT

SEQ ID NO: 3142387 - protein, 7 aa, Giardia lamblia
TGSATGE

SEQ ID NO: 3142388 - protein, 14 aa, Giardia lamblia
TGSDNQEKEDDVSP

SEQ ID NO: 3142389 - protein, 7 aa, Giardia lamblia
TGSEIGS

SEQ ID NO: 3142390 - protein, 17 aa, Giardia lamblia
TGSFGTTKTVKTGKRTE

SEQ ID NO: 3142391 - protein, 10 aa, Giardia lamblia
TGSGGTHPDS

SEQ ID NO: 3142392 - protein, 6 aa, Giardia lamblia
TGSGKT

SEQ ID NO: 3142393 - protein, 7 aa, Giardia lamblia
TGSGVAA

SEQ ID NO: 3142394 - protein, 12 aa, Giardia lamblia
TGSGVPETEPTQ

SEQ ID NO: 3142395 - protein, 10 aa, Giardia lamblia
TGSHGDGRSL

SEQ ID NO: 3142396 - protein, 24 aa, Giardia lamblia
TGSINGRAVGGQTRGDQGGAGALG

SEQ ID NO: 3142397 - protein, 16 aa, Giardia lamblia
TGSKPAAHFHRTWKGN

SEQ ID NO: 3142398 - protein, 12 aa, Giardia lamblia
TGSKPVAPDGRR

SEQ ID NO: 3142399 - protein, 24 aa, Giardia lamblia
TGSKPVAPDGRRTDELLEKGVTSD

SEQ ID NO: 3142400 - protein, 7 aa, Giardia lamblia
TGSLASD

SEQ ID NO: 3142401 - protein, 5 aa, Giardia lamblia
TGSLD

SEQ ID NO: 3142402 - protein, 5 aa, Giardia lamblia
TGSLG

SEQ ID NO: 3142403 - protein, 15 aa, Giardia lamblia
TGSLPRNTFTAPDSL

SEQ ID NO: 3142404 - protein, 17 aa, Giardia lamblia
TGSLSTNWAQAASPTTY

SEQ ID NO: 3142405 - protein, 14 aa, Giardia lamblia
TGSMPQLQQTTGTF

SEQ ID NO: 3142406 - protein, 16 aa, Giardia lamblia
TGSNGPHTTPADTTSH

SEQ ID NO: 3142407 - protein, 8 aa, Giardia lamblia
TGSREQPS

SEQ ID NO: 3142408 - protein, 10 aa, Giardia lamblia
TGSRPYTPED

SEQ ID NO: 3142409 - protein, 6 aa, Giardia lamblia
TGSRTM

SEQ ID NO: 3142410 - protein, 5 aa, Giardia lamblia
TGSRV

SEQ ID NO: 3142411 - protein, 6 aa, Giardia lamblia
TGSSAY

SEQ ID NO: 3142412 - protein, 6 aa, Giardia lamblia
TGSSEL

SEQ ID NO: 3142413 - protein, 8 aa, Giardia lamblia
TGSSKITF

SEQ ID NO: 3142414 - protein, 7 aa, Giardia lamblia
TGSSNMS

SEQ ID NO: 3142415 - protein, 9 aa, Giardia lamblia
TGSSPLCNP

SEQ ID NO: 3142416 - protein, 11 aa, Giardia lamblia
TGSSSDTADTH

SEQ ID NO: 3142417 - protein, 12 aa, Giardia lamblia
TGSSSKKEITAK

SEQ ID NO: 3142418 - protein, 4 aa, Giardia lamblia
TGST

SEQ ID NO: 3142419 - protein, 5 aa, Giardia lamblia
TGSTE

SEQ ID NO: 3142420 - protein, 10 aa, Giardia lamblia
TGSTENVDRV

SEQ ID NO: 3142421 - protein, 7 aa, Giardia lamblia
TGSTNSS

SEQ ID NO: 3142422 - protein, 9 aa, Giardia lamblia
TGSTSNRIR

SEQ ID NO: 3142423 - protein, 12 aa, Giardia lamblia
TGSTSSQANHSL

SEQ ID NO: 3142424 - protein, 4 aa, Giardia lamblia
TGSV

SEQ ID NO: 3142425 - protein, 7 aa, Giardia lamblia
TGSVDTL

SEQ ID NO: 3142426 - protein, 8 aa, Giardia lamblia
TGSVNERR

SEQ ID NO: 3142427 - protein, 4 aa, Giardia lamblia
TGSY

SEQ ID NO: 3142428 - protein, 5 aa, Giardia lamblia
TGSYA

SEQ ID NO: 3142429 - protein, 7 aa, Giardia lamblia
TGSYNSS

SEQ ID NO: 3142430 - protein, 6 aa, Giardia lamblia
TGSYSG

SEQ ID NO: 3142431 - protein, 4 aa, Giardia lamblia
TGTA

SEQ ID NO: 3142432 - protein, 7 aa, Giardia lamblia
TGTAPTA

SEQ ID NO: 3142433 - protein, 17 aa, Giardia lamblia
TGTASDSKEAQTARTGR

SEQ ID NO: 3142434 - protein, 7 aa, Giardia lamblia
TGTDDKR

SEQ ID NO: 3142435 - protein, 5 aa, Giardia lamblia
TGTDV

SEQ ID NO: 3142436 - protein, 6 aa, Giardia lamblia
TGTEQI

SEQ ID NO: 3142437 - protein, 14 aa, Giardia lamblia
TGTERVTKESQAVL

SEQ ID NO: 3142438 - protein, 14 aa, Giardia lamblia
TGTFKTDDLPSSVI

SEQ ID NO: 3142439 - protein, 4 aa, Giardia lamblia
TGTG

SEQ ID NO: 3142440 - protein, 7 aa, Giardia lamblia
TGTGSFG

SEQ ID NO: 3142441 - protein, 14 aa, Giardia lamblia
TGTKNNPQALFDDF

SEQ ID NO: 3142442 - protein, 4 aa, Giardia lamblia
TGTL

SEQ ID NO: 3142443 - protein, 5 aa, Giardia lamblia
TGTNF

SEQ ID NO: 3142444 - protein, 7 aa, Giardia lamblia
TGTPADK

SEQ ID NO: 3142445 - protein, 7 aa, Giardia lamblia
TGTPDNI

SEQ ID NO: 3142446 - protein, 4 aa, Giardia lamblia
TGTR

SEQ ID NO: 3142447 - protein, 8 aa, Giardia lamblia
TGTRKQST

SEQ ID NO: 3142448 - protein, 8 aa, Giardia lamblia
TGTRPGLP

SEQ ID NO: 3142449 - protein, 5 aa, Giardia lamblia
TGTRR

SEQ ID NO: 3142450 - protein, 7 aa, Giardia lamblia
TGTRTGF

SEQ ID NO: 3142451 - protein, 8 aa, Giardia lamblia
TGTSIPKK

SEQ ID NO: 3142452 - protein, 17 aa, Giardia lamblia
TGTTSTSLRSSIDEPGV

SEQ ID NO: 3142453 - protein, 4 aa, Giardia lamblia
TGTV

SEQ ID NO: 3142454 - protein, 4 aa, Giardia lamblia
TGTY

SEQ ID NO: 3142455 - protein, 5 aa, Giardia lamblia
TGVAA

SEQ ID NO: 3142456 - protein, 7 aa, Giardia lamblia
TGVAGDK

SEQ ID NO: 3142457 - protein, 9 aa, Giardia lamblia
TGVDAGSVT

SEQ ID NO: 3142458 - protein, 18 aa, Giardia lamblia
TGVDHGDGGRKQHASSDL

SEQ ID NO: 3142459 - protein, 5 aa, Giardia lamblia
TGVDS

SEQ ID NO: 3142460 - protein, 4 aa, Giardia lamblia
TGVE

SEQ ID NO: 3142461 - protein, 7 aa, Giardia lamblia
TGVEQEG

SEQ ID NO: 3142462 - protein, 4 aa, Giardia lamblia
TGVG

SEQ ID NO: 3142463 - protein, 6 aa, Giardia lamblia
TGVGKS

SEQ ID NO: 3142464 - protein, 8 aa, Giardia lamblia
TGVGNEEI

SEQ ID NO: 3142465 - protein, 5 aa, Giardia lamblia
TGVGP

SEQ ID NO: 3142466 - protein, 12 aa, Giardia lamblia
TGVGRNYESITE

SEQ ID NO: 3142467 - protein, 21 aa, Giardia lamblia
TGVGTEADDTGDIKQTEDETY

SEQ ID NO: 3142468 - protein, 35 aa, Giardia lamblia
TGVRRGPTRPGKAQGAGLSETQRRQEKSQQRTHGT

SEQ ID NO: 3142469 - protein, 6 aa, Giardia lamblia
TGVRVG

SEQ ID NO: 3142470 - protein, 5 aa, Giardia lamblia
TGWDK

SEQ ID NO: 3142471 - protein, 8 aa, Giardia lamblia
TGWSASTT

SEQ ID NO: 3142472 - protein, 5 aa, Giardia lamblia
TGWSG

SEQ ID NO: 3142473 - protein, 5 aa, Giardia lamblia
TGYEN

SEQ ID NO: 3142474 - protein, 5 aa, Giardia lamblia
TGYES

SEQ ID NO: 3142475 - protein, 5 aa, Giardia lamblia
TGYNL

SEQ ID NO: 3142476 - protein, 14 aa, Giardia lamblia
TGYPCSDDDSVDKS

SEQ ID NO: 3142477 - protein, 6 aa, Giardia lamblia
TGYPGF

SEQ ID NO: 3142478 - protein, 4 aa, Giardia lamblia
THAA

SEQ ID NO: 3142479 - protein, 5 aa, Giardia lamblia
THAPS

SEQ ID NO: 3142480 - protein, 4 aa, Giardia lamblia
THAQ

SEQ ID NO: 3142481 - protein, 4 aa, Giardia lamblia
THAR

SEQ ID NO: 3142482 - protein, 12 aa, Giardia lamblia
THDAATKISGYS

SEQ ID NO: 3142483 - protein, 6 aa, Giardia lamblia
THDEDA

SEQ ID NO: 3142484 - protein, 14 aa, Giardia lamblia
THDGRSGAAPGEQE

SEQ ID NO: 3142485 - protein, 16 aa, Giardia lamblia
THDKTIRKQHTSSESS

SEQ ID NO: 3142486 - protein, 5 aa, Giardia lamblia
THDNG

SEQ ID NO: 3142487 - protein, 4 aa, Giardia lamblia
THEE

SEQ ID NO: 3142488 - protein, 12 aa, Giardia lamblia
THEERHDEKPDT

SEQ ID NO: 3142489 - protein, 6 aa, Giardia lamblia
THENTV

SEQ ID NO: 3142490 - protein, 8 aa, Giardia lamblia
THEPPMRP

SEQ ID NO: 3142491 - protein, 8 aa, Giardia lamblia
THERHEAA

SEQ ID NO: 3142492 - protein, 4 aa, Giardia lamblia
THES

SEQ ID NO: 3142493 - protein, 8 aa, Giardia lamblia
THEYDKSG

SEQ ID NO: 3142494 - protein, 9 aa, Giardia lamblia
THGDEEPDG

SEQ ID NO: 3142495 - protein, 5 aa, Giardia lamblia
THGMT

SEQ ID NO: 3142496 - protein, 16 aa, Giardia lamblia
THGPTDALTQPGGWGH

SEQ ID NO: 3142497 - protein, 5 aa, Giardia lamblia
THGSG

SEQ ID NO: 3142498 - protein, 14 aa, Giardia lamblia
THHGAAAEAQIGEP

SEQ ID NO: 3142499 - protein, 7 aa, Giardia lamblia
THHPSTA

SEQ ID NO: 3142500 - protein, 4 aa, Giardia lamblia
THHQ

SEQ ID NO: 3142501 - protein, 6 aa, Giardia lamblia
THIDGR

SEQ ID NO: 3142502 - protein, 7 aa, Giardia lamblia
THKEEYI

SEQ ID NO: 3142503 - protein, 13 aa, Giardia lamblia
THKQKEANSDNAV

SEQ ID NO: 3142504 - protein, 14 aa, Giardia lamblia
THKTNIPKKRPVSN

SEQ ID NO: 3142505 - protein, 8 aa, Giardia lamblia
THKYTSSD

SEQ ID NO: 3142506 - protein, 4 aa, Giardia lamblia
THLP

SEQ ID NO: 3142507 - protein, 6 aa, Giardia lamblia
THNPQW

SEQ ID NO: 3142508 - protein, 7 aa, Giardia lamblia
THNRRSS

SEQ ID NO: 3142509 - protein, 4 aa, Giardia lamblia
THNS

SEQ ID NO: 3142510 - protein, 4 aa, Giardia lamblia
THNT

SEQ ID NO: 3142511 - protein, 4 aa, Giardia lamblia
THPA

SEQ ID NO: 3142512 - protein, 19 aa, Giardia lamblia
THPANTADAAGSTEGEADI

SEQ ID NO: 3142513 - protein, 8 aa, Giardia lamblia
THPDGGTE

SEQ ID NO: 3142514 - protein, 6 aa, Giardia lamblia
THPEAR

SEQ ID NO: 3142515 - protein, 15 aa, Giardia lamblia
THPEDTCSSLSPASV

SEQ ID NO: 3142516 - protein, 5 aa, Giardia lamblia
THPEV

SEQ ID NO: 3142517 - protein, 5 aa, Giardia lamblia
THPNF

SEQ ID NO: 3142518 - protein, 8 aa, Giardia lamblia
THPQAGDP

SEQ ID NO: 3142519 - protein, 26 aa, Giardia lamblia
THPQGRQQKVSNKQHAADQPNNQSAR

SEQ ID NO: 3142520 - protein, 4 aa, Giardia lamblia
THPR

SEQ ID NO: 3142521 - protein, 16 aa, Giardia lamblia
THPSASEESASIRAKS

SEQ ID NO: 3142522 - protein, 11 aa, Giardia lamblia
THPTGQKETAQ

SEQ ID NO: 3142523 - protein, 11 aa, Giardia lamblia
THPTTTETDHA

SEQ ID NO: 3142524 - protein, 4 aa, Giardia lamblia
THQD

SEQ ID NO: 3142525 - protein, 7 aa, Giardia lamblia
THQERQQ

SEQ ID NO: 3142526 - protein, 14 aa, Giardia lamblia
THQGQIDNHASHNA

SEQ ID NO: 3142527 - protein, 12 aa, Giardia lamblia
THQPGQQKEAGL

SEQ ID NO: 3142528 - protein, 19 aa, Giardia lamblia
THQPGQQKEAGQRLSRSYS

SEQ ID NO: 3142529 - protein, 4 aa, Giardia lamblia
THQR

SEQ ID NO: 3142530 - protein, 11 aa, Giardia lamblia
THRDDSRRQHA

SEQ ID NO: 3142531 - protein, 9 aa, Giardia lamblia
THRGGTRPF

SEQ ID NO: 3142532 - protein, 9 aa, Giardia lamblia
THRKTAKST

SEQ ID NO: 3142533 - protein, 7 aa, Giardia lamblia
THRPPEE

SEQ ID NO: 3142534 - protein, 7 aa, Giardia lamblia
THRPPTA

SEQ ID NO: 3142535 - protein, 15 aa, Giardia lamblia
THRRRQQREGQNEHS

SEQ ID NO: 3142536 - protein, 6 aa, Giardia lamblia
THSHEP

SEQ ID NO: 3142537 - protein, 4 aa, Giardia lamblia
THSQ

SEQ ID NO: 3142538 - protein, 21 aa, Giardia lamblia
THSSGQPEEKDTIEDADEEVD

SEQ ID NO: 3142539 - protein, 10 aa, Giardia lamblia
THSSSHLDDM

SEQ ID NO: 3142540 - protein, 6 aa, Giardia lamblia
THSSSL

SEQ ID NO: 3142541 - protein, 17 aa, Giardia lamblia
THSSSPKRSSQMQSDTA

SEQ ID NO: 3142542 - protein, 8 aa, Giardia lamblia
THTDDRPV

SEQ ID NO: 3142543 - protein, 5 aa, Giardia lamblia
THTNS

SEQ ID NO: 3142544 - protein, 8 aa, Giardia lamblia
THTSTVPR

SEQ ID NO: 3142545 - protein, 4 aa, Giardia lamblia
THVQ

SEQ ID NO: 3142546 - protein, 12 aa, Giardia lamblia
THVRKKDQGQTS

SEQ ID NO: 3142547 - protein, 8 aa, Giardia lamblia
TIAADAPA

SEQ ID NO: 3142548 - protein, 8 aa, Giardia lamblia
TIAAPSNI

SEQ ID NO: 3142549 - protein, 17 aa, Giardia lamblia
TIAEPQQEGLPDNDDYF

SEQ ID NO: 3142550 - protein, 5 aa, Giardia lamblia
TIAER

SEQ ID NO: 3142551 - protein, 8 aa, Giardia lamblia
TIAGTPKY

SEQ ID NO: 3142552 - protein, 8 aa, Giardia lamblia
TIAKNKNE

SEQ ID NO: 3142553 - protein, 6 aa, Giardia lamblia
TIAPED

SEQ ID NO: 3142554 - protein, 10 aa, Giardia lamblia
TIASNDAEVQ

SEQ ID NO: 3142555 - protein, 13 aa, Giardia lamblia
TIATNTSKIDQQT

SEQ ID NO: 3142556 - protein, 12 aa, Giardia lamblia
TIDEQSQDGQQP

SEQ ID NO: 3142557 - protein, 7 aa, Giardia lamblia
TIDETNQ

SEQ ID NO: 3142558 - protein, 12 aa, Giardia lamblia
TIDNTTKNISKA

SEQ ID NO: 3142559 - protein, 6 aa, Giardia lamblia
TIDPHD

SEQ ID NO: 3142560 - protein, 9 aa, Giardia lamblia
TIDYESRAM

SEQ ID NO: 3142561 - protein, 7 aa, Giardia lamblia
TIEASSG

SEQ ID NO: 3142562 - protein, 13 aa, Giardia lamblia
TIEDDDDEAGTDD

SEQ ID NO: 3142563 - protein, 12 aa, Giardia lamblia
TIEGKSRKISET

SEQ ID NO: 3142564 - protein, 4 aa, Giardia lamblia
TIEP

SEQ ID NO: 3142565 - protein, 6 aa, Giardia lamblia
TIEPQS

SEQ ID NO: 3142566 - protein, 6 aa, Giardia lamblia
TIEPSS

SEQ ID NO: 3142567 - protein, 13 aa, Giardia lamblia
TIEPSTDASVAPA

SEQ ID NO: 3142568 - protein, 7 aa, Giardia lamblia
TIEQKKQ

SEQ ID NO: 3142569 - protein, 11 aa, Giardia lamblia
TIEQTKSGFPS

SEQ ID NO: 3142570 - protein, 8 aa, Giardia lamblia
TIGDSKGV

SEQ ID NO: 3142571 - protein, 5 aa, Giardia lamblia
TIGEQ

SEQ ID NO: 3142572 - protein, 7 aa, Giardia lamblia
TIGGQGN

SEQ ID NO: 3142573 - protein, 8 aa, Giardia lamblia
TIGPPKVS

SEQ ID NO: 3142574 - protein, 9 aa, Giardia lamblia
TIGPSGTTM

SEQ ID NO: 3142575 - protein, 8 aa, Giardia lamblia
TIGQSRKK

SEQ ID NO: 3142576 - protein, 12 aa, Giardia lamblia
TIHSSDKLNNDD

SEQ ID NO: 3142577 - protein, 4 aa, Giardia lamblia
TIKG

SEQ ID NO: 3142578 - protein, 4 aa, Giardia lamblia
TIKR

SEQ ID NO: 3142579 - protein, 8 aa, Giardia lamblia
TINDPNQV

SEQ ID NO: 3142580 - protein, 9 aa, Giardia lamblia
TINSGTQES

SEQ ID NO: 3142581 - protein, 17 aa, Giardia lamblia
TIPDAKPVAPSRQGARV

SEQ ID NO: 3142582 - protein, 10 aa, Giardia lamblia
TIPDDEGRRL

SEQ ID NO: 3142583 - protein, 10 aa, Giardia lamblia
TIPDNKKLAT

SEQ ID NO: 3142584 - protein, 14 aa, Giardia lamblia
TIPDSKLGVSSGQV

SEQ ID NO: 3142585 - protein, 6 aa, Giardia lamblia
TIPDTE

SEQ ID NO: 3142586 - protein, 4 aa, Giardia lamblia
TIPG

SEQ ID NO: 3142587 - protein, 8 aa, Giardia lamblia
TIPGPGAY

SEQ ID NO: 3142588 - protein, 11 aa, Giardia lamblia
TIPGVPGPQPV

SEQ ID NO: 3142589 - protein, 5 aa, Giardia lamblia
TIPKE

SEQ ID NO: 3142590 - protein, 6 aa, Giardia lamblia
TIPKSY

SEQ ID NO: 3142591 - protein, 5 aa, Giardia lamblia
TIPRP

SEQ ID NO: 3142592 - protein, 6 aa, Giardia lamblia
TIPRSE

SEQ ID NO: 3142593 - protein, 25 aa, Giardia lamblia
TIPSDDTSNMGKTEAQCNSESQEHD

SEQ ID NO: 3142594 - protein, 5 aa, Giardia lamblia
TIPSE

SEQ ID NO: 3142595 - protein, 12 aa, Giardia lamblia
TIPSPDRSRPFQ

SEQ ID NO: 3142596 - protein, 5 aa, Giardia lamblia
TIPST

SEQ ID NO: 3142597 - protein, 5 aa, Giardia lamblia
TIPSV

SEQ ID NO: 3142598 - protein, 4 aa, Giardia lamblia
TIPT

SEQ ID NO: 3142599 - protein, 10 aa, Giardia lamblia
TIPTQSPSLS

SEQ ID NO: 3142600 - protein, 14 aa, Giardia lamblia
TIPTSVDEPQPTPL

SEQ ID NO: 3142601 - protein, 20 aa, Giardia lamblia
TIQPALRSSDGTQGDPSNNS

SEQ ID NO: 3142602 - protein, 9 aa, Giardia lamblia
TIQSGDPTK

SEQ ID NO: 3142603 - protein, 8 aa, Giardia lamblia
TIRDSAPA

SEQ ID NO: 3142604 - protein, 10 aa, Giardia lamblia
TIRNPHSDSE

SEQ ID NO: 3142605 - protein, 4 aa, Giardia lamblia
TIRP

SEQ ID NO: 3142606 - protein, 8 aa, Giardia lamblia
TIRPNKKT

SEQ ID NO: 3142607 - protein, 12 aa, Giardia lamblia
TIRPTDENRVIF

SEQ ID NO: 3142608 - protein, 14 aa, Giardia lamblia
TIRQSSGDRKSALG

SEQ ID NO: 3142609 - protein, 13 aa, Giardia lamblia
TIRQTDNGEYTDI

SEQ ID NO: 3142610 - protein, 9 aa, Giardia lamblia
TIRRGKPSW

SEQ ID NO: 3142611 - protein, 8 aa, Giardia lamblia
TISETNLG

SEQ ID NO: 3142612 - protein, 5 aa, Giardia lamblia
TISGK

SEQ ID NO: 3142613 - protein, 6 aa, Giardia lamblia
TISNNE

SEQ ID NO: 3142614 - protein, 8 aa, Giardia lamblia
TISPGPGH

SEQ ID NO: 3142615 - protein, 14 aa, Giardia lamblia
TISPLETSKHQGAS

SEQ ID NO: 3142616 - protein, 13 aa, Giardia lamblia
TISPQEQPAAEVT

SEQ ID NO: 3142617 - protein, 14 aa, Giardia lamblia
TISSNTAYTSPITT

SEQ ID NO: 3142618 - protein, 14 aa, Giardia lamblia
TISSPISGTKNSRK

SEQ ID NO: 3142619 - protein, 12 aa, Giardia lamblia
TISSTLNSDSVS

SEQ ID NO: 3142620 - protein, 6 aa, Giardia lamblia
TISSTM

SEQ ID NO: 3142621 - protein, 10 aa, Giardia lamblia
TISTASGKSP

SEQ ID NO: 3142622 - protein, 5 aa, Giardia lamblia
TISTN

SEQ ID NO: 3142623 - protein, 6 aa, Giardia lamblia
TISTST

SEQ ID NO: 3142624 - protein, 5 aa, Giardia lamblia
TISTT

SEQ ID NO: 3142625 - protein, 7 aa, Giardia lamblia
TITDEGQ

SEQ ID NO: 3142626 - protein, 13 aa, Giardia lamblia
TITEENSKSTQSL

SEQ ID NO: 3142627 - protein, 24 aa, Giardia lamblia
TITGDTTMEEPSPGDHAGSYYSNT

SEQ ID NO: 3142628 - protein, 10 aa, Giardia lamblia
TITGKRNRES

SEQ ID NO: 3142629 - protein, 8 aa, Giardia lamblia
TITKEQKD

SEQ ID NO: 3142630 - protein, 9 aa, Giardia lamblia
TITNSKGQF

SEQ ID NO: 3142631 - protein, 5 aa, Giardia lamblia
TITRE

SEQ ID NO: 3142632 - protein, 14 aa, Giardia lamblia
TITSDADSVTSSYD

SEQ ID NO: 3142633 - protein, 29 aa, Giardia lamblia
TITSGDVGDTGDVHTSGSDTDLSEETSDD

SEQ ID NO: 3142634 - protein, 9 aa, Giardia lamblia
TITTQQLEE

SEQ ID NO: 3142635 - protein, 7 aa, Giardia lamblia
TITTSTR

SEQ ID NO: 3142636 - protein, 10 aa, Giardia lamblia
TIYDNNRSEA

SEQ ID NO: 3142637 - protein, 7 aa, Giardia lamblia
TKAAAAE

SEQ ID NO: 3142638 - protein, 9 aa, Giardia lamblia
TKAAPSRTV

SEQ ID NO: 3142639 - protein, 15 aa, Giardia lamblia
TKAARDALKQVNLSK

SEQ ID NO: 3142640 - protein, 6 aa, Giardia lamblia
TKAATL

SEQ ID NO: 3142641 - protein, 5 aa, Giardia lamblia
TKACN

SEQ ID NO: 3142642 - protein, 12 aa, Giardia lamblia
TKADAAGDQEEL

SEQ ID NO: 3142643 - protein, 22 aa, Giardia lamblia
TKAEQSYRETPRRGSSSLVKGS

SEQ ID NO: 3142644 - protein, 4 aa, Giardia lamblia
TKAG

SEQ ID NO: 3142645 - protein, 10 aa, Giardia lamblia
TKAGKRYPDA

SEQ ID NO: 3142646 - protein, 11 aa, Giardia lamblia
TKAKQKKTDSI

SEQ ID NO: 3142647 - protein, 4 aa, Giardia lamblia
TKAL

SEQ ID NO: 3142648 - protein, 8 aa, Giardia lamblia
TKAPDAGA

SEQ ID NO: 3142649 - protein, 20 aa, Giardia lamblia
TKARARTPPNIGRQSDTGSS

SEQ ID NO: 3142650 - protein, 4 aa, Giardia lamblia
TKAS

SEQ ID NO: 3142651 - protein, 9 aa, Giardia lamblia
TKATASMPL

SEQ ID NO: 3142652 - protein, 7 aa, Giardia lamblia
TKATRDI

SEQ ID NO: 3142653 - protein, 10 aa, Giardia lamblia
TKAVTSNPTL

SEQ ID NO: 3142654 - protein, 4 aa, Giardia lamblia
TKDA

SEQ ID NO: 3142655 - protein, 15 aa, Giardia lamblia
TKDARSKGDEAELGA

SEQ ID NO: 3142656 - protein, 7 aa, Giardia lamblia
TKDDGTT

SEQ ID NO: 3142657 - protein, 9 aa, Giardia lamblia
TKDEPSPVI

SEQ ID NO: 3142658 - protein, 7 aa, Giardia lamblia
TKDEVND

SEQ ID NO: 3142659 - protein, 7 aa, Giardia lamblia
TKDGEKK

SEQ ID NO: 3142660 - protein, 9 aa, Giardia lamblia
TKDGLGPTI

SEQ ID NO: 3142661 - protein, 7 aa, Giardia lamblia
TKDLKGR

SEQ ID NO: 3142662 - protein, 20 aa, Giardia lamblia
TKDPSDLQEGFDDDGEHAAG

SEQ ID NO: 3142663 - protein, 4 aa, Giardia lamblia
TKDQ

SEQ ID NO: 3142664 - protein, 15 aa, Giardia lamblia
TKDRGSTSLVSRSGN

SEQ ID NO: 3142665 - protein, 9 aa, Giardia lamblia
TKDSSPVVR

SEQ ID NO: 3142666 - protein, 10 aa, Giardia lamblia
TKDTDVTQST

SEQ ID NO: 3142667 - protein, 12 aa, Giardia lamblia
TKDTRPKPTANT

SEQ ID NO: 3142668 - protein, 17 aa, Giardia lamblia
TKDTYERRRSALDRGNS

SEQ ID NO: 3142669 - protein, 6 aa, Giardia lamblia
TKDYPK

SEQ ID NO: 3142670 - protein, 5 aa, Giardia lamblia
TKEAE

SEQ ID NO: 3142671 - protein, 14 aa, Giardia lamblia
TKEAGCKTVSVDGK

SEQ ID NO: 3142672 - protein, 5 aa, Giardia lamblia
TKEAI

SEQ ID NO: 3142673 - protein, 5 aa, Giardia lamblia
TKEAL

SEQ ID NO: 3142674 - protein, 9 aa, Giardia lamblia
TKEAQQSFK

SEQ ID NO: 3142675 - protein, 7 aa, Giardia lamblia
TKEARDA

SEQ ID NO: 3142676 - protein, 9 aa, Giardia lamblia
TKEATASSI

SEQ ID NO: 3142677 - protein, 6 aa, Giardia lamblia
TKEDRE

SEQ ID NO: 3142678 - protein, 9 aa, Giardia lamblia
TKEEASSLS

SEQ ID NO: 3142679 - protein, 8 aa, Giardia lamblia
TKEEPREI

SEQ ID NO: 3142680 - protein, 12 aa, Giardia lamblia
TKEEYNRKTQER

SEQ ID NO: 3142681 - protein, 10 aa, Giardia lamblia
TKEGARKGLP

SEQ ID NO: 3142682 - protein, 8 aa, Giardia lamblia
TKEGDSDV

SEQ ID NO: 3142683 - protein, 16 aa, Giardia lamblia
TKEGGLSTNELHEEGA

SEQ ID NO: 3142684 - protein, 6 aa, Giardia lamblia
TKEGLT

SEQ ID NO: 3142685 - protein, 7 aa, Giardia lamblia
TKEKEEE

SEQ ID NO: 3142686 - protein, 25 aa, Giardia lamblia
TKELKPAPPSINEETDAHPAGPQRN

SEQ ID NO: 3142687 - protein, 11 aa, Giardia lamblia
TKENDLDTEAF

SEQ ID NO: 3142688 - protein, 9 aa, Giardia lamblia
TKENGEDAV

SEQ ID NO: 3142689 - protein, 9 aa, Giardia lamblia
TKENKALTA

SEQ ID NO: 3142690 - protein, 8 aa, Giardia lamblia
TKENRAGG

SEQ ID NO: 3142691 - protein, 8 aa, Giardia lamblia
TKENSIEG

SEQ ID NO: 3142692 - protein, 7 aa, Giardia lamblia
TKEQEQE

SEQ ID NO: 3142693 - protein, 12 aa, Giardia lamblia
TKERADEPPLNA

SEQ ID NO: 3142694 - protein, 7 aa, Giardia lamblia
TKERGDF

SEQ ID NO: 3142695 - protein, 32 aa, Giardia lamblia
TKESARADLEKAEELRKKAEKKVDELSRASVE

SEQ ID NO: 3142696 - protein, 8 aa, Giardia lamblia
TKESATAI

SEQ ID NO: 3142697 - protein, 9 aa, Giardia lamblia
TKESSANTV

SEQ ID NO: 3142698 - protein, 17 aa, Giardia lamblia
TKESSHKDNSNSGTNRI

SEQ ID NO: 3142699 - protein, 26 aa, Giardia lamblia
TKESSSTTLPLPSTNTTNPEKTLTSN

SEQ ID NO: 3142700 - protein, 5 aa, Giardia lamblia
TKESY

SEQ ID NO: 3142701 - protein, 25 aa, Giardia lamblia
TKEVPIDQENPAATSSISESPLPRN

SEQ ID NO: 3142702 - protein, 21 aa, Giardia lamblia
TKFDGESTYHADYQPKPLEGN

SEQ ID NO: 3142703 - protein, 9 aa, Giardia lamblia
TKGCGTEPL

SEQ ID NO: 3142704 - protein, 6 aa, Giardia lamblia
TKGCND

SEQ ID NO: 3142705 - protein, 10 aa, Giardia lamblia
TKGEAAAKHV

SEQ ID NO: 3142706 - protein, 9 aa, Giardia lamblia
TKGESVLTD

SEQ ID NO: 3142707 - protein, 5 aa, Giardia lamblia
TKGFT

SEQ ID NO: 3142708 - protein, 8 aa, Giardia lamblia
TKGGNRPA

SEQ ID NO: 3142709 - protein, 4 aa, Giardia lamblia
TKGI

SEQ ID NO: 3142710 - protein, 14 aa, Giardia lamblia
TKGLSPAMTHTTRS

SEQ ID NO: 3142711 - protein, 11 aa, Giardia lamblia
TKGPGGNGSGY

SEQ ID NO: 3142712 - protein, 8 aa, Giardia lamblia
TKGRPISA

SEQ ID NO: 3142713 - protein, 9 aa, Giardia lamblia
TKGRVSTEI

SEQ ID NO: 3142714 - protein, 8 aa, Giardia lamblia
TKGSYAVR

SEQ ID NO: 3142715 - protein, 10 aa, Giardia lamblia
TKGTDSGPFS

SEQ ID NO: 3142716 - protein, 11 aa, Giardia lamblia
TKGVTADEAET

SEQ ID NO: 3142717 - protein, 6 aa, Giardia lamblia
TKGYYT

SEQ ID NO: 3142718 - protein, 7 aa, Giardia lamblia
TKHNRAG

SEQ ID NO: 3142719 - protein, 7 aa, Giardia lamblia
TKHPSRE

SEQ ID NO: 3142720 - protein, 13 aa, Giardia lamblia
TKHPTESEDRPVD

SEQ ID NO: 3142721 - protein, 5 aa, Giardia lamblia
TKHQA

SEQ ID NO: 3142722 - protein, 6 aa, Giardia lamblia
TKHQKR

SEQ ID NO: 3142723 - protein, 14 aa, Giardia lamblia
TKHSDEVANEDVEQ

SEQ ID NO: 3142724 - protein, 5 aa, Giardia lamblia
TKHSE

SEQ ID NO: 3142725 - protein, 10 aa, Giardia lamblia
TKHTKPKKDE

SEQ ID NO: 3142726 - protein, 4 aa, Giardia lamblia
TKIA

SEQ ID NO: 3142727 - protein, 8 aa, Giardia lamblia
TKIASTQC

SEQ ID NO: 3142728 - protein, 5 aa, Giardia lamblia
TKIGG

SEQ ID NO: 3142729 - protein, 4 aa, Giardia lamblia
TKIK

SEQ ID NO: 3142730 - protein, 7 aa, Giardia lamblia
TKIRTRK

SEQ ID NO: 3142731 - protein, 11 aa, Giardia lamblia
TKITSGPHDDL

SEQ ID NO: 3142732 - protein, 7 aa, Giardia lamblia
TKITTKF

SEQ ID NO: 3142733 - protein, 10 aa, Giardia lamblia
TKKDQNTTPL

SEQ ID NO: 3142734 - protein, 8 aa, Giardia lamblia
TKKEAYEK

SEQ ID NO: 3142735 - protein, 11 aa, Giardia lamblia
TKKGSASLQGE

SEQ ID NO: 3142736 - protein, 4 aa, Giardia lamblia
TKKK

SEQ ID NO: 3142737 - protein, 5 aa, Giardia lamblia
TKKND

SEQ ID NO: 3142738 - protein, 9 aa, Giardia lamblia
TKKPAFTDD

SEQ ID NO: 3142739 - protein, 15 aa, Giardia lamblia
TKKPQKSKRAKGRST

SEQ ID NO: 3142740 - protein, 9 aa, Giardia lamblia
TKKRITSPR

SEQ ID NO: 3142741 - protein, 8 aa, Giardia lamblia
TKKRTLSE

SEQ ID NO: 3142742 - protein, 6 aa, Giardia lamblia
TKKSDL

SEQ ID NO: 3142743 - protein, 8 aa, Giardia lamblia
TKKSDLKD

SEQ ID NO: 3142744 - protein, 11 aa, Giardia lamblia
TKKSGGKGSGF

SEQ ID NO: 3142745 - protein, 21 aa, Giardia lamblia
TKKSKALHEAHRSPQKSGTQG

SEQ ID NO: 3142746 - protein, 9 aa, Giardia lamblia
TKKTTEDLQ

SEQ ID NO: 3142747 - protein, 6 aa, Giardia lamblia
TKKVGS

SEQ ID NO: 3142748 - protein, 6 aa, Giardia lamblia
TKKYNK

SEQ ID NO: 3142749 - protein, 8 aa, Giardia lamblia
TKLADDDD

SEQ ID NO: 3142750 - protein, 9 aa, Giardia lamblia
TKLAETNET

SEQ ID NO: 3142751 - protein, 12 aa, Giardia lamblia
TKLERRKNRVTA

SEQ ID NO: 3142752 - protein, 13 aa, Giardia lamblia
TKLPLKEDKTRGI

SEQ ID NO: 3142753 - protein, 10 aa, Giardia lamblia
TKLRATSEEL

SEQ ID NO: 3142754 - protein, 4 aa, Giardia lamblia
TKLS

SEQ ID NO: 3142755 - protein, 8 aa, Giardia lamblia
TKLSAEKA

SEQ ID NO: 3142756 - protein, 9 aa, Giardia lamblia
TKLSNTEIE

SEQ ID NO: 3142757 - protein, 10 aa, Giardia lamblia
TKLSQAKAAE

SEQ ID NO: 3142758 - protein, 9 aa, Giardia lamblia
TKLSQRFRS

SEQ ID NO: 3142759 - protein, 7 aa, Giardia lamblia
TKLSSLT

SEQ ID NO: 3142760 - protein, 8 aa, Giardia lamblia
TKLTDRNR

SEQ ID NO: 3142761 - protein, 9 aa, Giardia lamblia
TKLTDSNGL

SEQ ID NO: 3142762 - protein, 13 aa, Giardia lamblia
TKMEKDNDELQAE

SEQ ID NO: 3142763 - protein, 4 aa, Giardia lamblia
TKNA

SEQ ID NO: 3142764 - protein, 6 aa, Giardia lamblia
TKNDSK

SEQ ID NO: 3142765 - protein, 8 aa, Giardia lamblia
TKNDTERI

SEQ ID NO: 3142766 - protein, 5 aa, Giardia lamblia
TKNDY

SEQ ID NO: 3142767 - protein, 6 aa, Giardia lamblia
TKNEEI

SEQ ID NO: 3142768 - protein, 6 aa, Giardia lamblia
TKNENK

SEQ ID NO: 3142769 - protein, 9 aa, Giardia lamblia
TKNGHASYS

SEQ ID NO: 3142770 - protein, 8 aa, Giardia lamblia
TKNNASAT

SEQ ID NO: 3142771 - protein, 9 aa, Giardia lamblia
TKNNEKQSL

SEQ ID NO: 3142772 - protein, 17 aa, Giardia lamblia
TKNPQTSYWTPCGDIFE

SEQ ID NO: 3142773 - protein, 6 aa, Giardia lamblia
TKNQPA

SEQ ID NO: 3142774 - protein, 6 aa, Giardia lamblia
TKNQRH

SEQ ID NO: 3142775 - protein, 9 aa, Giardia lamblia
TKNQRPTTL

SEQ ID NO: 3142776 - protein, 7 aa, Giardia lamblia
TKNSKKI

SEQ ID NO: 3142777 - protein, 20 aa, Giardia lamblia
TKNSKNDSTDGSQQKRGGVR

SEQ ID NO: 3142778 - protein, 7 aa, Giardia lamblia
TKNTKPL

SEQ ID NO: 3142779 - protein, 5 aa, Giardia lamblia
TKNTQ

SEQ ID NO: 3142780 - protein, 10 aa, Giardia lamblia
TKNTSNVPAG

SEQ ID NO: 3142781 - protein, 5 aa, Giardia lamblia
TKPAD

SEQ ID NO: 3142782 - protein, 17 aa, Giardia lamblia
TKPADVPARASSPQKMA

SEQ ID NO: 3142783 - protein, 15 aa, Giardia lamblia
TKPAQQAQPSQGDYT

SEQ ID NO: 3142784 - protein, 9 aa, Giardia lamblia
TKPARDSYS

SEQ ID NO: 3142785 - protein, 17 aa, Giardia lamblia
TKPCPVPKGAPLPMETT

SEQ ID NO: 3142786 - protein, 46 aa, Giardia lamblia
TKPDKRTAEWYSEDKRRHAEAKKKLDDKKQEEAAREAAASIERKQA

SEQ ID NO: 3142787 - protein, 8 aa, Giardia lamblia
TKPDLDSA

SEQ ID NO: 3142788 - protein, 13 aa, Giardia lamblia
TKPDRARNSNADM

SEQ ID NO: 3142789 - protein, 5 aa, Giardia lamblia
TKPDV

SEQ ID NO: 3142790 - protein, 7 aa, Giardia lamblia
TKPEQLA

SEQ ID NO: 3142791 - protein, 7 aa, Giardia lamblia
TKPEREY

SEQ ID NO: 3142792 - protein, 5 aa, Giardia lamblia
TKPGA

SEQ ID NO: 3142793 - protein, 9 aa, Giardia lamblia
TKPGKNTSV

SEQ ID NO: 3142794 - protein, 7 aa, Giardia lamblia
TKPGQFV

SEQ ID NO: 3142795 - protein, 4 aa, Giardia lamblia
TKPI

SEQ ID NO: 3142796 - protein, 49 aa, Giardia lamblia
TKPIPGKSQSSQTSHTPRRSTRQSDDKSSTRETGPAPVTASSPDAQQAE

SEQ ID NO: 3142797 - protein, 6 aa, Giardia lamblia
TKPITR

SEQ ID NO: 3142798 - protein, 6 aa, Giardia lamblia
TKPQEW

SEQ ID NO: 3142799 - protein, 34 aa, Giardia lamblia
TKPQHYSQPIDTKHPVEAPVSSTSIESERQKAGD

SEQ ID NO: 3142800 - protein, 6 aa, Giardia lamblia
TKPQNG

SEQ ID NO: 3142801 - protein, 12 aa, Giardia lamblia
TKPRASRDNSSE

SEQ ID NO: 3142802 - protein, 15 aa, Giardia lamblia
TKPSGLKSDHDPGYV

SEQ ID NO: 3142803 - protein, 8 aa, Giardia lamblia
TKPSITIS

SEQ ID NO: 3142804 - protein, 4 aa, Giardia lamblia
TKQA

SEQ ID NO: 3142805 - protein, 7 aa, Giardia lamblia
TKQARKV

SEQ ID NO: 3142806 - protein, 11 aa, Giardia lamblia
TKQARQKSLHE

SEQ ID NO: 3142807 - protein, 5 aa, Giardia lamblia
TKQDD

SEQ ID NO: 3142808 - protein, 9 aa, Giardia lamblia
TKQDPPTMA

SEQ ID NO: 3142809 - protein, 9 aa, Giardia lamblia
TKQEIRATP

SEQ ID NO: 3142810 - protein, 11 aa, Giardia lamblia
TKQEQKKPATD

SEQ ID NO: 3142811 - protein, 5 aa, Giardia lamblia
TKQGE

SEQ ID NO: 3142812 - protein, 8 aa, Giardia lamblia
TKQGSKNL

SEQ ID NO: 3142813 - protein, 16 aa, Giardia lamblia
TKQKTRSQSTTSNSPL

SEQ ID NO: 3142814 - protein, 4 aa, Giardia lamblia
TKQP

SEQ ID NO: 3142815 - protein, 8 aa, Giardia lamblia
TKQPDTYP

SEQ ID NO: 3142816 - protein, 10 aa, Giardia lamblia
TKQPESDLQS

SEQ ID NO: 3142817 - protein, 5 aa, Giardia lamblia
TKQPI

SEQ ID NO: 3142818 - protein, 9 aa, Giardia lamblia
TKQPTRKSV

SEQ ID NO: 3142819 - protein, 7 aa, Giardia lamblia
TKQRAAL

SEQ ID NO: 3142820 - protein, 11 aa, Giardia lamblia
TKQSDATRNRR

SEQ ID NO: 3142821 - protein, 6 aa, Giardia lamblia
TKQSRS

SEQ ID NO: 3142822 - protein, 6 aa, Giardia lamblia
TKQTLP

SEQ ID NO: 3142823 - protein, 8 aa, Giardia lamblia
TKRAPSEA

SEQ ID NO: 3142824 - protein, 11 aa, Giardia lamblia
TKRDDKGNLPQ

SEQ ID NO: 3142825 - protein, 7 aa, Giardia lamblia
TKRDKEK

SEQ ID NO: 3142826 - protein, 10 aa, Giardia lamblia
TKRDRSPHGI

SEQ ID NO: 3142827 - protein, 12 aa, Giardia lamblia
TKRFSSRSNHSR

SEQ ID NO: 3142828 - protein, 15 aa, Giardia lamblia
TKRHTASASQHAHGG

SEQ ID NO: 3142829 - protein, 9 aa, Giardia lamblia
TKRPAEGEL

SEQ ID NO: 3142830 - protein, 5 aa, Giardia lamblia
TKRPD

SEQ ID NO: 3142831 - protein, 39 aa, Giardia lamblia
TKRPTEQFPGQSDRKTLHAAAPDSNQEKTLPSEPSLKQS

SEQ ID NO: 3142832 - protein, 8 aa, Giardia lamblia
TKRQEEIE

SEQ ID NO: 3142833 - protein, 26 aa, Giardia lamblia
TKRQLNKQSAARNFSEDVGNAEGTTI

SEQ ID NO: 3142834 - protein, 7 aa, Giardia lamblia
TKRRGPT

SEQ ID NO: 3142835 - protein, 14 aa, Giardia lamblia
TKRSRPARYSTPQT

SEQ ID NO: 3142836 - protein, 18 aa, Giardia lamblia
TKRTSSVLPPEQPKNDID

SEQ ID NO: 3142837 - protein, 15 aa, Giardia lamblia
TKRTVSESLDAANDS

SEQ ID NO: 3142838 - protein, 4 aa, Giardia lamblia
TKRY

SEQ ID NO: 3142839 - protein, 9 aa, Giardia lamblia
TKRYTLPAG

SEQ ID NO: 3142840 - protein, 9 aa, Giardia lamblia
TKSAQKHGF

SEQ ID NO: 3142841 - protein, 10 aa, Giardia lamblia
TKSDSRGNGN

SEQ ID NO: 3142842 - protein, 14 aa, Giardia lamblia
TKSEIDENLGDSIR

SEQ ID NO: 3142843 - protein, 10 aa, Giardia lamblia
TKSESDYQER

SEQ ID NO: 3142844 - protein, 6 aa, Giardia lamblia
TKSGET

SEQ ID NO: 3142845 - protein, 5 aa, Giardia lamblia
TKSGI

SEQ ID NO: 3142846 - protein, 8 aa, Giardia lamblia
TKSGKEYS

SEQ ID NO: 3142847 - protein, 11 aa, Giardia lamblia
TKSIEKKEEAY

SEQ ID NO: 3142848 - protein, 6 aa, Giardia lamblia
TKSISQ

SEQ ID NO: 3142849 - protein, 10 aa, Giardia lamblia
TKSKKDPVGS

SEQ ID NO: 3142850 - protein, 21 aa, Giardia lamblia
TKSKPMAKSKPEVSQREPSIN

SEQ ID NO: 3142851 - protein, 5 aa, Giardia lamblia
TKSLT

SEQ ID NO: 3142852 - protein, 9 aa, Giardia lamblia
TKSLTNPST

SEQ ID NO: 3142853 - protein, 7 aa, Giardia lamblia
TKSNEVQ

SEQ ID NO: 3142854 - protein, 7 aa, Giardia lamblia
TKSNYEL

SEQ ID NO: 3142855 - protein, 10 aa, Giardia lamblia
TKSPSTGPLT

SEQ ID NO: 3142856 - protein, 11 aa, Giardia lamblia
TKSQIAAKNMS

SEQ ID NO: 3142857 - protein, 8 aa, Giardia lamblia
TKSQLSKA

SEQ ID NO: 3142858 - protein, 8 aa, Giardia lamblia
TKSQQNSS

SEQ ID NO: 3142859 - protein, 8 aa, Giardia lamblia
TKSRLSST

SEQ ID NO: 3142860 - protein, 21 aa, Giardia lamblia
TKSRSGAYKSSLPEQQDPDLK

SEQ ID NO: 3142861 - protein, 13 aa, Giardia lamblia
TKSSAGQITARSK

SEQ ID NO: 3142862 - protein, 8 aa, Giardia lamblia
TKSSRRAA

SEQ ID NO: 3142863 - protein, 5 aa, Giardia lamblia
TKSSS

SEQ ID NO: 3142864 - protein, 16 aa, Giardia lamblia
TKSTPSRADTTDERTC

SEQ ID NO: 3142865 - protein, 8 aa, Giardia lamblia
TKSTRLPR

SEQ ID NO: 3142866 - protein, 21 aa, Giardia lamblia
TKTAARGTACSTDESFPDTAH

SEQ ID NO: 3142867 - protein, 10 aa, Giardia lamblia
TKTADEGHRH

SEQ ID NO: 3142868 - protein, 15 aa, Giardia lamblia
TKTAGDGKKLKLPSG

SEQ ID NO: 3142869 - protein, 10 aa, Giardia lamblia
TKTASANPTC

SEQ ID NO: 3142870 - protein, 5 aa, Giardia lamblia
TKTDE

SEQ ID NO: 3142871 - protein, 10 aa, Giardia lamblia
TKTDGSKTSQ

SEQ ID NO: 3142872 - protein, 9 aa, Giardia lamblia
TKTDKGGLQ

SEQ ID NO: 3142873 - protein, 9 aa, Giardia lamblia
TKTDKRTDT

SEQ ID NO: 3142874 - protein, 10 aa, Giardia lamblia
TKTEKPKETP

SEQ ID NO: 3142875 - protein, 18 aa, Giardia lamblia
TKTGAASSSGSDNDPALK

SEQ ID NO: 3142876 - protein, 8 aa, Giardia lamblia
TKTGGEKE

SEQ ID NO: 3142877 - protein, 11 aa, Giardia lamblia
TKTGNYSGDTE

SEQ ID NO: 3142878 - protein, 10 aa, Giardia lamblia
TKTKEDIPSE

SEQ ID NO: 3142879 - protein, 8 aa, Giardia lamblia
TKTKSGLS

SEQ ID NO: 3142880 - protein, 8 aa, Giardia lamblia
TKTNETVT

SEQ ID NO: 3142881 - protein, 5 aa, Giardia lamblia
TKTPI

SEQ ID NO: 3142882 - protein, 11 aa, Giardia lamblia
TKTPNKPGNIE

SEQ ID NO: 3142883 - protein, 6 aa, Giardia lamblia
TKTPSI

SEQ ID NO: 3142884 - protein, 7 aa, Giardia lamblia
TKTRFTE

SEQ ID NO: 3142885 - protein, 12 aa, Giardia lamblia
TKTSSNSSAELS

SEQ ID NO: 3142886 - protein, 5 aa, Giardia lamblia
TKTSW

SEQ ID NO: 3142887 - protein, 7 aa, Giardia lamblia
TKTTENY

SEQ ID NO: 3142888 - protein, 11 aa, Giardia lamblia
TKTTISPEKRA

SEQ ID NO: 3142889 - protein, 4 aa, Giardia lamblia
TKVA

SEQ ID NO: 3142890 - protein, 7 aa, Giardia lamblia
TKVDPKD

SEQ ID NO: 3142891 - protein, 6 aa, Giardia lamblia
TKVKED

SEQ ID NO: 3142892 - protein, 16 aa, Giardia lamblia
TKVKQGARPAIPSHYS

SEQ ID NO: 3142893 - protein, 6 aa, Giardia lamblia
TKVSKK

SEQ ID NO: 3142894 - protein, 6 aa, Giardia lamblia
TKVTPV

SEQ ID NO: 3142895 - protein, 7 aa, Giardia lamblia
TKYGTSV

SEQ ID NO: 3142896 - protein, 6 aa, Giardia lamblia
TKYSGN

SEQ ID NO: 3142897 - protein, 10 aa, Giardia lamblia
TLADASGKTA

SEQ ID NO: 3142898 - protein, 9 aa, Giardia lamblia
TLADSSGRT

SEQ ID NO: 3142899 - protein, 20 aa, Giardia lamblia
TLAEDVRDKANSLQDTTRKL

SEQ ID NO: 3142900 - protein, 5 aa, Giardia lamblia
TLAES

SEQ ID NO: 3142901 - protein, 8 aa, Giardia lamblia
TLAGTPGV

SEQ ID NO: 3142902 - protein, 5 aa, Giardia lamblia
TLAPE

SEQ ID NO: 3142903 - protein, 5 aa, Giardia lamblia
TLAQQ

SEQ ID NO: 3142904 - protein, 8 aa, Giardia lamblia
TLAQQSQA

SEQ ID NO: 3142905 - protein, 10 aa, Giardia lamblia
TLARGGEAAD

SEQ ID NO: 3142906 - protein, 12 aa, Giardia lamblia
TLARKTDSSGRS

SEQ ID NO: 3142907 - protein, 11 aa, Giardia lamblia
TLASKAGRTAV

SEQ ID NO: 3142908 - protein, 8 aa, Giardia lamblia
TLASNSPS

SEQ ID NO: 3142909 - protein, 23 aa, Giardia lamblia
TLASQGVAGQSNVANSDASSTCG

SEQ ID NO: 3142910 - protein, 11 aa, Giardia lamblia
TLASSTRSQPL

SEQ ID NO: 3142911 - protein, 9 aa, Giardia lamblia
TLDAASSES

SEQ ID NO: 3142912 - protein, 12 aa, Giardia lamblia
TLDAPSKSTMSE

SEQ ID NO: 3142913 - protein, 11 aa, Giardia lamblia
TLDDDDEHVGS

SEQ ID NO: 3142914 - protein, 8 aa, Giardia lamblia
TLDDGRDS

SEQ ID NO: 3142915 - protein, 10 aa, Giardia lamblia
TLDERATDVP

SEQ ID NO: 3142916 - protein, 10 aa, Giardia lamblia
TLDESEKAYQ

SEQ ID NO: 3142917 - protein, 5 aa, Giardia lamblia
TLDQS

SEQ ID NO: 3142918 - protein, 15 aa, Giardia lamblia
TLDSNGCADVSGSHQ

SEQ ID NO: 3142919 - protein, 12 aa, Giardia lamblia
TLEDSKAEVRNQ

SEQ ID NO: 3142920 - protein, 9 aa, Giardia lamblia
TLEEEGELS

SEQ ID NO: 3142921 - protein, 24 aa, Giardia lamblia
TLEEEQKKLEEQIKESERKAKERQ

SEQ ID NO: 3142922 - protein, 5 aa, Giardia lamblia
TLEEM

SEQ ID NO: 3142923 - protein, 13 aa, Giardia lamblia
TLEESSKKSSDGF

SEQ ID NO: 3142924 - protein, 13 aa, Giardia lamblia
TLEHGEKSAELDA

SEQ ID NO: 3142925 - protein, 8 aa, Giardia lamblia
TLEKTSAE

SEQ ID NO: 3142926 - protein, 6 aa, Giardia lamblia
TLEPDS

SEQ ID NO: 3142927 - protein, 10 aa, Giardia lamblia
TLEQASSGVS

SEQ ID NO: 3142928 - protein, 5 aa, Giardia lamblia
TLERQ

SEQ ID NO: 3142929 - protein, 5 aa, Giardia lamblia
TLESD

SEQ ID NO: 3142930 - protein, 8 aa, Giardia lamblia
TLGADGAR

SEQ ID NO: 3142931 - protein, 11 aa, Giardia lamblia
TLGDTSTQSVS

SEQ ID NO: 3142932 - protein, 15 aa, Giardia lamblia
TLGESKNDVLEALSW

SEQ ID NO: 3142933 - protein, 4 aa, Giardia lamblia
TLGG

SEQ ID NO: 3142934 - protein, 9 aa, Giardia lamblia
TLGKKGSAV

SEQ ID NO: 3142935 - protein, 10 aa, Giardia lamblia
TLGNTSDRAR

SEQ ID NO: 3142936 - protein, 11 aa, Giardia lamblia
TLGSPTREDWP

SEQ ID NO: 3142937 - protein, 10 aa, Giardia lamblia
TLGSTAGSFR

SEQ ID NO: 3142938 - protein, 11 aa, Giardia lamblia
TLGSTEVKSET

SEQ ID NO: 3142939 - protein, 5 aa, Giardia lamblia
TLGTG

SEQ ID NO: 3142940 - protein, 9 aa, Giardia lamblia
TLKDEKQEL

SEQ ID NO: 3142941 - protein, 13 aa, Giardia lamblia
TLKEQAGELQSSL

SEQ ID NO: 3142942 - protein, 17 aa, Giardia lamblia
TLKEQSETDNASEITNP

SEQ ID NO: 3142943 - protein, 7 aa, Giardia lamblia
TLKGGDT

SEQ ID NO: 3142944 - protein, 13 aa, Giardia lamblia
TLKPRKQHSKSKT

SEQ ID NO: 3142945 - protein, 14 aa, Giardia lamblia
TLKQKDARLEEVSS

SEQ ID NO: 3142946 - protein, 24 aa, Giardia lamblia
TLKSPGSSLGSNSRTSQTASPIST

SEQ ID NO: 3142947 - protein, 8 aa, Giardia lamblia
TLLPNGER

SEQ ID NO: 3142948 - protein, 5 aa, Giardia lamblia
TLNAG

SEQ ID NO: 3142949 - protein, 8 aa, Giardia lamblia
TLNAQSNK

SEQ ID NO: 3142950 - protein, 4 aa, Giardia lamblia
TLNQ

SEQ ID NO: 3142951 - protein, 5 aa, Giardia lamblia
TLNSA

SEQ ID NO: 3142952 - protein, 23 aa, Giardia lamblia
TLNTRDTSLRSTQRVNSAKPLND

SEQ ID NO: 3142953 - protein, 10 aa, Giardia lamblia
TLNTSEKESL

SEQ ID NO: 3142954 - protein, 6 aa, Giardia lamblia
TLPADS

SEQ ID NO: 3142955 - protein, 6 aa, Giardia lamblia
TLPDGR

SEQ ID NO: 3142956 - protein, 7 aa, Giardia lamblia
TLPDGTT

SEQ ID NO: 3142957 - protein, 5 aa, Giardia lamblia
TLPEE

SEQ ID NO: 3142958 - protein, 9 aa, Giardia lamblia
TLPGDQPST

SEQ ID NO: 3142959 - protein, 8 aa, Giardia lamblia
TLPGPSRA

SEQ ID NO: 3142960 - protein, 14 aa, Giardia lamblia
TLPGRYAKSALSEH

SEQ ID NO: 3142961 - protein, 5 aa, Giardia lamblia
TLPGS

SEQ ID NO: 3142962 - protein, 8 aa, Giardia lamblia
TLPKTRSA

SEQ ID NO: 3142963 - protein, 27 aa, Giardia lamblia
TLPLTNDETPAKEDSAGDRGGFSSYEA

SEQ ID NO: 3142964 - protein, 4 aa, Giardia lamblia
TLPN

SEQ ID NO: 3142965 - protein, 7 aa, Giardia lamblia
TLPPGED

SEQ ID NO: 3142966 - protein, 4 aa, Giardia lamblia
TLPQ

SEQ ID NO: 3142967 - protein, 6 aa, Giardia lamblia
TLPRSK

SEQ ID NO: 3142968 - protein, 10 aa, Giardia lamblia
TLPSDNGSVE

SEQ ID NO: 3142969 - protein, 22 aa, Giardia lamblia
TLPSEDNITQNSPPPSSPSECT

SEQ ID NO: 3142970 - protein, 9 aa, Giardia lamblia
TLPSPTQRP

SEQ ID NO: 3142971 - protein, 20 aa, Giardia lamblia
TLPSRSDSKQDQLPQDEPEI

SEQ ID NO: 3142972 - protein, 10 aa, Giardia lamblia
TLPSSKAPFK

SEQ ID NO: 3142973 - protein, 5 aa, Giardia lamblia
TLPTK

SEQ ID NO: 3142974 - protein, 7 aa, Giardia lamblia
TLPTPTR

SEQ ID NO: 3142975 - protein, 4 aa, Giardia lamblia
TLPV

SEQ ID NO: 3142976 - protein, 4 aa, Giardia lamblia
TLQD

SEQ ID NO: 3142977 - protein, 7 aa, Giardia lamblia
TLQDPVA

SEQ ID NO: 3142978 - protein, 23 aa, Giardia lamblia
TLQESQGGCVSQGKVATASSVLG

SEQ ID NO: 3142979 - protein, 5 aa, Giardia lamblia
TLQGS

SEQ ID NO: 3142980 - protein, 4 aa, Giardia lamblia
TLQK

SEQ ID NO: 3142981 - protein, 13 aa, Giardia lamblia
TLQQKKRDLAPRV

SEQ ID NO: 3142982 - protein, 6 aa, Giardia lamblia
TLQQNT

SEQ ID NO: 3142983 - protein, 7 aa, Giardia lamblia
TLQTEKM

SEQ ID NO: 3142984 - protein, 10 aa, Giardia lamblia
TLRDASSQKM

SEQ ID NO: 3142985 - protein, 8 aa, Giardia lamblia
TLRDCEGQ

SEQ ID NO: 3142986 - protein, 38 aa, Giardia lamblia
TLRDGGSSPLQSSKAFSPASTGLTNTFSGGASIKNTQL

SEQ ID NO: 3142987 - protein, 4 aa, Giardia lamblia
TLRE

SEQ ID NO: 3142988 - protein, 8 aa, Giardia lamblia
TLREKENE

SEQ ID NO: 3142989 - protein, 12 aa, Giardia lamblia
TLRKRKPSAETK

SEQ ID NO: 3142990 - protein, 12 aa, Giardia lamblia
TLRNPPKEAQKS

SEQ ID NO: 3142991 - protein, 4 aa, Giardia lamblia
TLRP

SEQ ID NO: 3142992 - protein, 5 aa, Giardia lamblia
TLRPK

SEQ ID NO: 3142993 - protein, 19 aa, Giardia lamblia
TLRPKGSSKEENPTTREIE

SEQ ID NO: 3142994 - protein, 4 aa, Giardia lamblia
TLRQ

SEQ ID NO: 3142995 - protein, 5 aa, Giardia lamblia
TLRQP

SEQ ID NO: 3142996 - protein, 12 aa, Giardia lamblia
TLRSPHSEKPEI

SEQ ID NO: 3142997 - protein, 19 aa, Giardia lamblia
TLRSQKQQHSQQIEEKDHE

SEQ ID NO: 3142998 - protein, 4 aa, Giardia lamblia
TLRT

SEQ ID NO: 3142999 - protein, 4 aa, Giardia lamblia
TLSA

SEQ ID NO: 3143000 - protein, 6 aa, Giardia lamblia
TLSAGS

SEQ ID NO: 3143001 - protein, 10 aa, Giardia lamblia
TLSARNSVEE

SEQ ID NO: 3143002 - protein, 4 aa, Giardia lamblia
TLSD

SEQ ID NO: 3143003 - protein, 9 aa, Giardia lamblia
TLSDTLESI

SEQ ID NO: 3143004 - protein, 4 aa, Giardia lamblia
TLSE

SEQ ID NO: 3143005 - protein, 5 aa, Giardia lamblia
TLSED

SEQ ID NO: 3143006 - protein, 15 aa, Giardia lamblia
TLSEELEAKDSTIQQ

SEQ ID NO: 3143007 - protein, 6 aa, Giardia lamblia
TLSEGL

SEQ ID NO: 3143008 - protein, 13 aa, Giardia lamblia
TLSEKDDATKKSI

SEQ ID NO: 3143009 - protein, 6 aa, Giardia lamblia
TLSEQE

SEQ ID NO: 3143010 - protein, 20 aa, Giardia lamblia
TLSEVSTQITGASGLSEMSR

SEQ ID NO: 3143011 - protein, 6 aa, Giardia lamblia
TLSGDE

SEQ ID NO: 3143012 - protein, 6 aa, Giardia lamblia
TLSGGR

SEQ ID NO: 3143013 - protein, 12 aa, Giardia lamblia
TLSGSGEIIDGG

SEQ ID NO: 3143014 - protein, 7 aa, Giardia lamblia
TLSGSLS

SEQ ID NO: 3143015 - protein, 4 aa, Giardia lamblia
TLSH

SEQ ID NO: 3143016 - protein, 5 aa, Giardia lamblia
TLSKF

SEQ ID NO: 3143017 - protein, 32 aa, Giardia lamblia
TLSKTPKDSTYKTAGTYQAIKSSKEKDKEIAQ

SEQ ID NO: 3143018 - protein, 7 aa, Giardia lamblia
TLSPDSV

SEQ ID NO: 3143019 - protein, 5 aa, Giardia lamblia
TLSPT

SEQ ID NO: 3143020 - protein, 12 aa, Giardia lamblia
TLSPTGETPAES

SEQ ID NO: 3143021 - protein, 9 aa, Giardia lamblia
TLSRSQKNS

SEQ ID NO: 3143022 - protein, 6 aa, Giardia lamblia
TLSRTY

SEQ ID NO: 3143023 - protein, 8 aa, Giardia lamblia
TLSSDKSN

SEQ ID NO: 3143024 - protein, 6 aa, Giardia lamblia
TLSSPA

SEQ ID NO: 3143025 - protein, 27 aa, Giardia lamblia
TLSTEREEHKTELRNTTRAVKNAEYKA

SEQ ID NO: 3143026 - protein, 9 aa, Giardia lamblia
TLSTSGKDA

SEQ ID NO: 3143027 - protein, 10 aa, Giardia lamblia
TLSTTSTHKH

SEQ ID NO: 3143028 - protein, 12 aa, Giardia lamblia
TLTADEQRTLNK

SEQ ID NO: 3143029 - protein, 24 aa, Giardia lamblia
TLTAGDKSFHKTSRQDYPDPYSVP

SEQ ID NO: 3143030 - protein, 7 aa, Giardia lamblia
TLTARED

SEQ ID NO: 3143031 - protein, 7 aa, Giardia lamblia
TLTGKTV

SEQ ID NO: 3143032 - protein, 14 aa, Giardia lamblia
TLTHDSKCSSIQPN

SEQ ID NO: 3143033 - protein, 4 aa, Giardia lamblia
TLTL

SEQ ID NO: 3143034 - protein, 4 aa, Giardia lamblia
TLTN

SEQ ID NO: 3143035 - protein, 10 aa, Giardia lamblia
TLTNDNKALR

SEQ ID NO: 3143036 - protein, 15 aa, Giardia lamblia
TLTNTQKMRKSRYGY

SEQ ID NO: 3143037 - protein, 8 aa, Giardia lamblia
TLTQDPPV

SEQ ID NO: 3143038 - protein, 16 aa, Giardia lamblia
TLTQGMTAQQASASKT

SEQ ID NO: 3143039 - protein, 7 aa, Giardia lamblia
TLTSASS

SEQ ID NO: 3143040 - protein, 8 aa, Giardia lamblia
TLTSKQEE

SEQ ID NO: 3143041 - protein, 11 aa, Giardia lamblia
TLTSKYHGESE

SEQ ID NO: 3143042 - protein, 9 aa, Giardia lamblia
TLTSSNTVN

SEQ ID NO: 3143043 - protein, 11 aa, Giardia lamblia
TLTTEPEVAEK

SEQ ID NO: 3143044 - protein, 12 aa, Giardia lamblia
TLTTTTASPPSA

SEQ ID NO: 3143045 - protein, 12 aa, Giardia lamblia
TMAGTSEYFSPE

SEQ ID NO: 3143046 - protein, 9 aa, Giardia lamblia
TMAKTNVGT

SEQ ID NO: 3143047 - protein, 5 aa, Giardia lamblia
TMANP

SEQ ID NO: 3143048 - protein, 9 aa, Giardia lamblia
TMATKSASV

SEQ ID NO: 3143049 - protein, 5 aa, Giardia lamblia
TMDEQ

SEQ ID NO: 3143050 - protein, 7 aa, Giardia lamblia
TMDKDAS

SEQ ID NO: 3143051 - protein, 12 aa, Giardia lamblia
TMDKTNKKTNTT

SEQ ID NO: 3143052 - protein, 6 aa, Giardia lamblia
TMDSAR

SEQ ID NO: 3143053 - protein, 8 aa, Giardia lamblia
TMEDKDRE

SEQ ID NO: 3143054 - protein, 5 aa, Giardia lamblia
TMEDQ

SEQ ID NO: 3143055 - protein, 8 aa, Giardia lamblia
TMEGKTQG

SEQ ID NO: 3143056 - protein, 6 aa, Giardia lamblia
TMEQDR

SEQ ID NO: 3143057 - protein, 5 aa, Giardia lamblia
TMETQ

SEQ ID NO: 3143058 - protein, 6 aa, Giardia lamblia
TMGGAS

SEQ ID NO: 3143059 - protein, 4 aa, Giardia lamblia
TMGK

SEQ ID NO: 3143060 - protein, 6 aa, Giardia lamblia
TMGPKG

SEQ ID NO: 3143061 - protein, 13 aa, Giardia lamblia
TMHPERSELKPRK

SEQ ID NO: 3143062 - protein, 12 aa, Giardia lamblia
TMKGQRNENGAT

SEQ ID NO: 3143063 - protein, 16 aa, Giardia lamblia
TMKKADNQQKLEERRE

SEQ ID NO: 3143064 - protein, 10 aa, Giardia lamblia
TMNDSPSAVL

SEQ ID NO: 3143065 - protein, 9 aa, Giardia lamblia
TMNKSQPPY

SEQ ID NO: 3143066 - protein, 4 aa, Giardia lamblia
TMNN

SEQ ID NO: 3143067 - protein, 5 aa, Giardia lamblia
TMPAP

SEQ ID NO: 3143068 - protein, 7 aa, Giardia lamblia
TMPDGTT

SEQ ID NO: 3143069 - protein, 5 aa, Giardia lamblia
TMPDR

SEQ ID NO: 3143070 - protein, 4 aa, Giardia lamblia
TMPP

SEQ ID NO: 3143071 - protein, 14 aa, Giardia lamblia
TMPTPDTYGSQPPI

SEQ ID NO: 3143072 - protein, 7 aa, Giardia lamblia
TMSETEK

SEQ ID NO: 3143073 - protein, 8 aa, Giardia lamblia
TMSKHEEE

SEQ ID NO: 3143074 - protein, 11 aa, Giardia lamblia
TMSNKKVSSVQ

SEQ ID NO: 3143075 - protein, 11 aa, Giardia lamblia
TMSPGTTGAEN

SEQ ID NO: 3143076 - protein, 13 aa, Giardia lamblia
TMSPSRGANSNIS

SEQ ID NO: 3143077 - protein, 17 aa, Giardia lamblia
TMSPTKAQENAESAAHS

SEQ ID NO: 3143078 - protein, 5 aa, Giardia lamblia
TMSSN

SEQ ID NO: 3143079 - protein, 4 aa, Giardia lamblia
TMST

SEQ ID NO: 3143080 - protein, 6 aa, Giardia lamblia
TMTPRA

SEQ ID NO: 3143081 - protein, 11 aa, Giardia lamblia
TMTQDNSGISD

SEQ ID NO: 3143082 - protein, 5 aa, Giardia lamblia
TMTRE

SEQ ID NO: 3143083 - protein, 7 aa, Giardia lamblia
TNAAKSI

SEQ ID NO: 3143084 - protein, 20 aa, Giardia lamblia
TNAARGKSANADSSRGTSMK

SEQ ID NO: 3143085 - protein, 6 aa, Giardia lamblia
TNADSE

SEQ ID NO: 3143086 - protein, 9 aa, Giardia lamblia
TNADTPHDA

SEQ ID NO: 3143087 - protein, 10 aa, Giardia lamblia
TNAESASAAY

SEQ ID NO: 3143088 - protein, 17 aa, Giardia lamblia
TNANNRTNVKDLFKPPG

SEQ ID NO: 3143089 - protein, 7 aa, Giardia lamblia
TNAQGKT

SEQ ID NO: 3143090 - protein, 7 aa, Giardia lamblia
TNAQNTI

SEQ ID NO: 3143091 - protein, 15 aa, Giardia lamblia
TNARQGTRHANEERI

SEQ ID NO: 3143092 - protein, 12 aa, Giardia lamblia
TNARRESAEVDA

SEQ ID NO: 3143093 - protein, 4 aa, Giardia lamblia
TNAS

SEQ ID NO: 3143094 - protein, 8 aa, Giardia lamblia
TNASSQHL

SEQ ID NO: 3143095 - protein, 11 aa, Giardia lamblia
TNATLKDDNQR

SEQ ID NO: 3143096 - protein, 9 aa, Giardia lamblia
TNCNPYRTS

SEQ ID NO: 3143097 - protein, 4 aa, Giardia lamblia
TNCQ

SEQ ID NO: 3143098 - protein, 6 aa, Giardia lamblia
TNDDET

SEQ ID NO: 3143099 - protein, 18 aa, Giardia lamblia
TNDGVKDPTNQGTQNLGD

SEQ ID NO: 3143100 - protein, 11 aa, Giardia lamblia
TNDKDSLSSEY

SEQ ID NO: 3143101 - protein, 4 aa, Giardia lamblia
TNDM

SEQ ID NO: 3143102 - protein, 7 aa, Giardia lamblia
TNDNGLS

SEQ ID NO: 3143103 - protein, 7 aa, Giardia lamblia
TNDPRAK

SEQ ID NO: 3143104 - protein, 8 aa, Giardia lamblia
TNDPSCPE

SEQ ID NO: 3143105 - protein, 23 aa, Giardia lamblia
TNDPVRTSSTQELTAYGTQRPSN

SEQ ID NO: 3143106 - protein, 11 aa, Giardia lamblia
TNDRAVPPQES

SEQ ID NO: 3143107 - protein, 7 aa, Giardia lamblia
TNDRRPI

SEQ ID NO: 3143108 - protein, 8 aa, Giardia lamblia
TNDSGSLS

SEQ ID NO: 3143109 - protein, 4 aa, Giardia lamblia
TNDV

SEQ ID NO: 3143110 - protein, 4 aa, Giardia lamblia
TNDY

SEQ ID NO: 3143111 - protein, 10 aa, Giardia lamblia
TNEAGRSQQL

SEQ ID NO: 3143112 - protein, 7 aa, Giardia lamblia
TNEDREA

SEQ ID NO: 3143113 - protein, 7 aa, Giardia lamblia
TNEDWRR

SEQ ID NO: 3143114 - protein, 5 aa, Giardia lamblia
TNEEA

SEQ ID NO: 3143115 - protein, 7 aa, Giardia lamblia
TNEHSEH

SEQ ID NO: 3143116 - protein, 6 aa, Giardia lamblia
TNEPDM

SEQ ID NO: 3143117 - protein, 4 aa, Giardia lamblia
TNEQ

SEQ ID NO: 3143118 - protein, 5 aa, Giardia lamblia
TNERS

SEQ ID NO: 3143119 - protein, 7 aa, Giardia lamblia
TNFPSNI

SEQ ID NO: 3143120 - protein, 6 aa, Giardia lamblia
TNGDGY

SEQ ID NO: 3143121 - protein, 6 aa, Giardia lamblia
TNGDRK

SEQ ID NO: 3143122 - protein, 9 aa, Giardia lamblia
TNGGGGAGM

SEQ ID NO: 3143123 - protein, 7 aa, Giardia lamblia
TNGGGTA

SEQ ID NO: 3143124 - protein, 6 aa, Giardia lamblia
TNGLNE

SEQ ID NO: 3143125 - protein, 6 aa, Giardia lamblia
TNGPSL

SEQ ID NO: 3143126 - protein, 6 aa, Giardia lamblia
TNGQTD

SEQ ID NO: 3143127 - protein, 9 aa, Giardia lamblia
TNGSANAER

SEQ ID NO: 3143128 - protein, 9 aa, Giardia lamblia
TNGTKRTFE

SEQ ID NO: 3143129 - protein, 14 aa, Giardia lamblia
TNHAHTDLATSNTR

SEQ ID NO: 3143130 - protein, 12 aa, Giardia lamblia
TNHNGTGGKSIY

SEQ ID NO: 3143131 - protein, 4 aa, Giardia lamblia
TNIE

SEQ ID NO: 3143132 - protein, 4 aa, Giardia lamblia
TNIP

SEQ ID NO: 3143133 - protein, 5 aa, Giardia lamblia
TNITD

SEQ ID NO: 3143134 - protein, 5 aa, Giardia lamblia
TNKAR

SEQ ID NO: 3143135 - protein, 8 aa, Giardia lamblia
TNKDSLDA

SEQ ID NO: 3143136 - protein, 12 aa, Giardia lamblia
TNKGENGSGESF

SEQ ID NO: 3143137 - protein, 6 aa, Giardia lamblia
TNKGPN

SEQ ID NO: 3143138 - protein, 6 aa, Giardia lamblia
TNKMPP

SEQ ID NO: 3143139 - protein, 13 aa, Giardia lamblia
TNKNDGKSVKEKT

SEQ ID NO: 3143140 - protein, 5 aa, Giardia lamblia
TNKNG

SEQ ID NO: 3143141 - protein, 10 aa, Giardia lamblia
TNKQGSQKAS

SEQ ID NO: 3143142 - protein, 4 aa, Giardia lamblia
TNKS

SEQ ID NO: 3143143 - protein, 5 aa, Giardia lamblia
TNKSP

SEQ ID NO: 3143144 - protein, 8 aa, Giardia lamblia
TNKSPMKT

SEQ ID NO: 3143145 - protein, 8 aa, Giardia lamblia
TNKTENKI

SEQ ID NO: 3143146 - protein, 7 aa, Giardia lamblia
TNKTGAG

SEQ ID NO: 3143147 - protein, 7 aa, Giardia lamblia
TNKYDPY

SEQ ID NO: 3143148 - protein, 6 aa, Giardia lamblia
TNKYTQ

SEQ ID NO: 3143149 - protein, 9 aa, Giardia lamblia
TNLDDELNS

SEQ ID NO: 3143150 - protein, 11 aa, Giardia lamblia
TNLERGEEIDG

SEQ ID NO: 3143151 - protein, 5 aa, Giardia lamblia
TNLND

SEQ ID NO: 3143152 - protein, 7 aa, Giardia lamblia
TNLTDES

SEQ ID NO: 3143153 - protein, 30 aa, Giardia lamblia
TNMRNDQRYQELEQSRREEIKRRDETITNL

SEQ ID NO: 3143154 - protein, 12 aa, Giardia lamblia
TNNGSPASLTNT

SEQ ID NO: 3143155 - protein, 6 aa, Giardia lamblia
TNNGST

SEQ ID NO: 3143156 - protein, 27 aa, Giardia lamblia
TNNKKANNQQLSAAQKASDEQEQRAHC

SEQ ID NO: 3143157 - protein, 4 aa, Giardia lamblia
TNNM

SEQ ID NO: 3143158 - protein, 6 aa, Giardia lamblia
TNNNGE

SEQ ID NO: 3143159 - protein, 11 aa, Giardia lamblia
TNNPDYEGVEE

SEQ ID NO: 3143160 - protein, 14 aa, Giardia lamblia
TNNPEAQAVSQELS

SEQ ID NO: 3143161 - protein, 7 aa, Giardia lamblia
TNNPTLR

SEQ ID NO: 3143162 - protein, 4 aa, Giardia lamblia
TNNQ

SEQ ID NO: 3143163 - protein, 6 aa, Giardia lamblia
TNNSAV

SEQ ID NO: 3143164 - protein, 14 aa, Giardia lamblia
TNNSKLQTTPPGNS

SEQ ID NO: 3143165 - protein, 8 aa, Giardia lamblia
TNNSPEYI

SEQ ID NO: 3143166 - protein, 13 aa, Giardia lamblia
TNNSSLMQDSQAD

SEQ ID NO: 3143167 - protein, 5 aa, Giardia lamblia
TNNTE

SEQ ID NO: 3143168 - protein, 5 aa, Giardia lamblia
TNNTS

SEQ ID NO: 3143169 - protein, 7 aa, Giardia lamblia
TNNTVDN

SEQ ID NO: 3143170 - protein, 6 aa, Giardia lamblia
TNNYDS

SEQ ID NO: 3143171 - protein, 5 aa, Giardia lamblia
TNPAK

SEQ ID NO: 3143172 - protein, 8 aa, Giardia lamblia
TNPATERM

SEQ ID NO: 3143173 - protein, 10 aa, Giardia lamblia
TNPATGAAYP

SEQ ID NO: 3143174 - protein, 5 aa, Giardia lamblia
TNPDE

SEQ ID NO: 3143175 - protein, 8 aa, Giardia lamblia
TNPDTDKT

SEQ ID NO: 3143176 - protein, 6 aa, Giardia lamblia
TNPEDA

SEQ ID NO: 3143177 - protein, 8 aa, Giardia lamblia
TNPEERQQ

SEQ ID NO: 3143178 - protein, 7 aa, Giardia lamblia
TNPEPSL

SEQ ID NO: 3143179 - protein, 7 aa, Giardia lamblia
TNPEPTP

SEQ ID NO: 3143180 - protein, 4 aa, Giardia lamblia
TNPF

SEQ ID NO: 3143181 - protein, 6 aa, Giardia lamblia
TNPGKV

SEQ ID NO: 3143182 - protein, 10 aa, Giardia lamblia
TNPISGASSI

SEQ ID NO: 3143183 - protein, 12 aa, Giardia lamblia
TNPLQVPSQVQP

SEQ ID NO: 3143184 - protein, 5 aa, Giardia lamblia
TNPLS

SEQ ID NO: 3143185 - protein, 5 aa, Giardia lamblia
TNPLT

SEQ ID NO: 3143186 - protein, 7 aa, Giardia lamblia
TNPNGLT

SEQ ID NO: 3143187 - protein, 7 aa, Giardia lamblia
TNPPNAV

SEQ ID NO: 3143188 - protein, 45 aa, Giardia lamblia
TNPPPPPQRQAKQGGAQKRPQGKPAGKPGKPNDRRRDSKGPNPFS

SEQ ID NO: 3143189 - protein, 10 aa, Giardia lamblia
TNPPYGGPET

SEQ ID NO: 3143190 - protein, 8 aa, Giardia lamblia
TNPRAQAY

SEQ ID NO: 3143191 - protein, 9 aa, Giardia lamblia
TNPRGNESF

SEQ ID NO: 3143192 - protein, 11 aa, Giardia lamblia
TNPRQTSIETG

SEQ ID NO: 3143193 - protein, 16 aa, Giardia lamblia
TNPRTTVPNPEPNGGR

SEQ ID NO: 3143194 - protein, 4 aa, Giardia lamblia
TNPS

SEQ ID NO: 3143195 - protein, 6 aa, Giardia lamblia
TNPSGF

SEQ ID NO: 3143196 - protein, 6 aa, Giardia lamblia
TNPTAL

SEQ ID NO: 3143197 - protein, 12 aa, Giardia lamblia
TNPYSKSLKNQI

SEQ ID NO: 3143198 - protein, 11 aa, Giardia lamblia
TNQANANEKLS

SEQ ID NO: 3143199 - protein, 20 aa, Giardia lamblia
TNQRSATTQGNSGTAAGSSM

SEQ ID NO: 3143200 - protein, 11 aa, Giardia lamblia
TNQRSKSGMCG

SEQ ID NO: 3143201 - protein, 12 aa, Giardia lamblia
TNQSSSLQTELN

SEQ ID NO: 3143202 - protein, 10 aa, Giardia lamblia
TNQTKNNITT

SEQ ID NO: 3143203 - protein, 7 aa, Giardia lamblia
TNQTNGD

SEQ ID NO: 3143204 - protein, 6 aa, Giardia lamblia
TNQYIS

SEQ ID NO: 3143205 - protein, 14 aa, Giardia lamblia
TNRAKSASVHPDDV

SEQ ID NO: 3143206 - protein, 4 aa, Giardia lamblia
TNRC

SEQ ID NO: 3143207 - protein, 7 aa, Giardia lamblia
TNRCGTK

SEQ ID NO: 3143208 - protein, 7 aa, Giardia lamblia
TNRDQPL

SEQ ID NO: 3143209 - protein, 11 aa, Giardia lamblia
TNRKYKDGAGV

SEQ ID NO: 3143210 - protein, 8 aa, Giardia lamblia
TNRNMETS

SEQ ID NO: 3143211 - protein, 5 aa, Giardia lamblia
TNRPV

SEQ ID NO: 3143212 - protein, 15 aa, Giardia lamblia
TNRRAGRPTQSSCAS

SEQ ID NO: 3143213 - protein, 14 aa, Giardia lamblia
TNRRQSELAPTEES

SEQ ID NO: 3143214 - protein, 6 aa, Giardia lamblia
TNRSDI

SEQ ID NO: 3143215 - protein, 5 aa, Giardia lamblia
TNRTH

SEQ ID NO: 3143216 - protein, 29 aa, Giardia lamblia
TNRTTDSQSRQPGQFSGLPQQKEQQNEET

SEQ ID NO: 3143217 - protein, 16 aa, Giardia lamblia
TNSAPSTAQPVSDEGF

SEQ ID NO: 3143218 - protein, 6 aa, Giardia lamblia
TNSDRF

SEQ ID NO: 3143219 - protein, 5 aa, Giardia lamblia
TNSEL

SEQ ID NO: 3143220 - protein, 4 aa, Giardia lamblia
TNSL

SEQ ID NO: 3143221 - protein, 17 aa, Giardia lamblia
TNSNAGAEQNGKQHIKE

SEQ ID NO: 3143222 - protein, 7 aa, Giardia lamblia
TNSNGST

SEQ ID NO: 3143223 - protein, 6 aa, Giardia lamblia
TNSNVE

SEQ ID NO: 3143224 - protein, 9 aa, Giardia lamblia
TNSPHGNPF

SEQ ID NO: 3143225 - protein, 10 aa, Giardia lamblia
TNSPPQYQSH

SEQ ID NO: 3143226 - protein, 9 aa, Giardia lamblia
TNSPTSRHL

SEQ ID NO: 3143227 - protein, 4 aa, Giardia lamblia
TNSS

SEQ ID NO: 3143228 - protein, 11 aa, Giardia lamblia
TNSSSSPTTLF

SEQ ID NO: 3143229 - protein, 6 aa, Giardia lamblia
TNSTAI

SEQ ID NO: 3143230 - protein, 18 aa, Giardia lamblia
TNSTRSKRLSEYPQSSHE

SEQ ID NO: 3143231 - protein, 11 aa, Giardia lamblia
TNSVSLGPDVP

SEQ ID NO: 3143232 - protein, 11 aa, Giardia lamblia
TNTAAPSTRST

SEQ ID NO: 3143233 - protein, 7 aa, Giardia lamblia
TNTALQT

SEQ ID NO: 3143234 - protein, 6 aa, Giardia lamblia
TNTAND

SEQ ID NO: 3143235 - protein, 4 aa, Giardia lamblia
TNTD

SEQ ID NO: 3143236 - protein, 7 aa, Giardia lamblia
TNTDLSG

SEQ ID NO: 3143237 - protein, 4 aa, Giardia lamblia
TNTE

SEQ ID NO: 3143238 - protein, 19 aa, Giardia lamblia
TNTEESGFAGAPGYRAPEA

SEQ ID NO: 3143239 - protein, 12 aa, Giardia lamblia
TNTEQGGEDDLN

SEQ ID NO: 3143240 - protein, 8 aa, Giardia lamblia
TNTEQPTQ

SEQ ID NO: 3143241 - protein, 4 aa, Giardia lamblia
TNTG

SEQ ID NO: 3143242 - protein, 31 aa, Giardia lamblia
TNTKTGANTRSASVSSTQLEGPVVRERLPVR

SEQ ID NO: 3143243 - protein, 8 aa, Giardia lamblia
TNTLNSGK

SEQ ID NO: 3143244 - protein, 7 aa, Giardia lamblia
TNTNGIE

SEQ ID NO: 3143245 - protein, 7 aa, Giardia lamblia
TNTNPQH

SEQ ID NO: 3143246 - protein, 4 aa, Giardia lamblia
TNTP

SEQ ID NO: 3143247 - protein, 5 aa, Giardia lamblia
TNTPE

SEQ ID NO: 3143248 - protein, 20 aa, Giardia lamblia
TNTPLQTTRSPVKDTSQVPS

SEQ ID NO: 3143249 - protein, 8 aa, Giardia lamblia
TNTQTATR

SEQ ID NO: 3143250 - protein, 7 aa, Giardia lamblia
TNTRSDV

SEQ ID NO: 3143251 - protein, 6 aa, Giardia lamblia
TNTRTS

SEQ ID NO: 3143252 - protein, 10 aa, Giardia lamblia
TNTSAPDNSV

SEQ ID NO: 3143253 - protein, 9 aa, Giardia lamblia
TNTSGTRKH

SEQ ID NO: 3143254 - protein, 6 aa, Giardia lamblia
TNTSLD

SEQ ID NO: 3143255 - protein, 15 aa, Giardia lamblia
TNTSNEEKSKASSEL

SEQ ID NO: 3143256 - protein, 10 aa, Giardia lamblia
TNTSSASASV

SEQ ID NO: 3143257 - protein, 14 aa, Giardia lamblia
TNTSSKLNQISPGV

SEQ ID NO: 3143258 - protein, 24 aa, Giardia lamblia
TNTTAPSEGASSSPQQIVSPTEHA

SEQ ID NO: 3143259 - protein, 21 aa, Giardia lamblia
TNTTETKLRQEAPVNVSQSGS

SEQ ID NO: 3143260 - protein, 9 aa, Giardia lamblia
TNTTNEVTK

SEQ ID NO: 3143261 - protein, 7 aa, Giardia lamblia
TNTTTSP

SEQ ID NO: 3143262 - protein, 7 aa, Giardia lamblia
TNTVAET

SEQ ID NO: 3143263 - protein, 13 aa, Giardia lamblia
TNTVQRESTANTI

SEQ ID NO: 3143264 - protein, 6 aa, Giardia lamblia
TNTVTE

SEQ ID NO: 3143265 - protein, 5 aa, Giardia lamblia
TNVEG

SEQ ID NO: 3143266 - protein, 5 aa, Giardia lamblia
TNVGE

SEQ ID NO: 3143267 - protein, 7 aa, Giardia lamblia
TNVPDTG

SEQ ID NO: 3143268 - protein, 16 aa, Giardia lamblia
TNWTPSSAKSPRSGNK

SEQ ID NO: 3143269 - protein, 12 aa, Giardia lamblia
TNYEKSAGSMLQ

SEQ ID NO: 3143270 - protein, 4 aa, Giardia lamblia
TNYP

SEQ ID NO: 3143271 - protein, 4 aa, Giardia lamblia
TNYQ

SEQ ID NO: 3143272 - protein, 4 aa, Giardia lamblia
TPAA

SEQ ID NO: 3143273 - protein, 10 aa, Giardia lamblia
TPADIETKSI

SEQ ID NO: 3143274 - protein, 8 aa, Giardia lamblia
TPADNTKN

SEQ ID NO: 3143275 - protein, 14 aa, Giardia lamblia
TPAEKAHKAGTKIR

SEQ ID NO: 3143276 - protein, 4 aa, Giardia lamblia
TPAG

SEQ ID NO: 3143277 - protein, 16 aa, Giardia lamblia
TPAHDPNDFESGRRNK

SEQ ID NO: 3143278 - protein, 17 aa, Giardia lamblia
TPAKEPIRRESSPTPQG

SEQ ID NO: 3143279 - protein, 7 aa, Giardia lamblia
TPAKQAM

SEQ ID NO: 3143280 - protein, 10 aa, Giardia lamblia
TPAKYTDNIP

SEQ ID NO: 3143281 - protein, 34 aa, Giardia lamblia
TPAMVAPSGTAIPARPGRSSPNTAAEAKDKERRL

SEQ ID NO: 3143282 - protein, 21 aa, Giardia lamblia
TPANARAEAEDQTPGDTDPLS

SEQ ID NO: 3143283 - protein, 7 aa, Giardia lamblia
TPAPLSS

SEQ ID NO: 3143284 - protein, 8 aa, Giardia lamblia
TPAPVAPS

SEQ ID NO: 3143285 - protein, 4 aa, Giardia lamblia
TPAQ

SEQ ID NO: 3143286 - protein, 12 aa, Giardia lamblia
TPARDQKDTTVG

SEQ ID NO: 3143287 - protein, 6 aa, Giardia lamblia
TPARTG

SEQ ID NO: 3143288 - protein, 35 aa, Giardia lamblia
TPASGQSGGVLTEEERALKQRDGSIMGQTRGTCPG

SEQ ID NO: 3143289 - protein, 5 aa, Giardia lamblia
TPASN

SEQ ID NO: 3143290 - protein, 6 aa, Giardia lamblia
TPATFT

SEQ ID NO: 3143291 - protein, 7 aa, Giardia lamblia
TPATRQS

SEQ ID NO: 3143292 - protein, 8 aa, Giardia lamblia
TPATSTAK

SEQ ID NO: 3143293 - protein, 19 aa, Giardia lamblia
TPCDSTPDDFAPPDSHGPE

SEQ ID NO: 3143294 - protein, 4 aa, Giardia lamblia
TPCS

SEQ ID NO: 3143295 - protein, 8 aa, Giardia lamblia
TPCYSSPE

SEQ ID NO: 3143296 - protein, 6 aa, Giardia lamblia
TPDAPR

SEQ ID NO: 3143297 - protein, 7 aa, Giardia lamblia
TPDATDA

SEQ ID NO: 3143298 - protein, 10 aa, Giardia lamblia
TPDDLSTEEI

SEQ ID NO: 3143299 - protein, 5 aa, Giardia lamblia
TPDEE

SEQ ID NO: 3143300 - protein, 9 aa, Giardia lamblia
TPDEKDDAY

SEQ ID NO: 3143301 - protein, 7 aa, Giardia lamblia
TPDESGI

SEQ ID NO: 3143302 - protein, 14 aa, Giardia lamblia
TPDFSEAAGLRSQV

SEQ ID NO: 3143303 - protein, 4 aa, Giardia lamblia
TPDG

SEQ ID NO: 3143304 - protein, 6 aa, Giardia lamblia
TPDGAP

SEQ ID NO: 3143305 - protein, 5 aa, Giardia lamblia
TPDGR

SEQ ID NO: 3143306 - protein, 7 aa, Giardia lamblia
TPDGTKM

SEQ ID NO: 3143307 - protein, 4 aa, Giardia lamblia
TPDI

SEQ ID NO: 3143308 - protein, 5 aa, Giardia lamblia
TPDKA

SEQ ID NO: 3143309 - protein, 7 aa, Giardia lamblia
TPDKSLP

SEQ ID NO: 3143310 - protein, 4 aa, Giardia lamblia
TPDN

SEQ ID NO: 3143311 - protein, 6 aa, Giardia lamblia
TPDPLA

SEQ ID NO: 3143312 - protein, 7 aa, Giardia lamblia
TPDPRKR

SEQ ID NO: 3143313 - protein, 6 aa, Giardia lamblia
TPDQKN

SEQ ID NO: 3143314 - protein, 5 aa, Giardia lamblia
TPDSV

SEQ ID NO: 3143315 - protein, 8 aa, Giardia lamblia
TPDTKQTL

SEQ ID NO: 3143316 - protein, 4 aa, Giardia lamblia
TPDV

SEQ ID NO: 3143317 - protein, 8 aa, Giardia lamblia
TPDYSKSD

SEQ ID NO: 3143318 - protein, 7 aa, Giardia lamblia
TPEARMS

SEQ ID NO: 3143319 - protein, 4 aa, Giardia lamblia
TPED

SEQ ID NO: 3143320 - protein, 6 aa, Giardia lamblia
TPEDAE

SEQ ID NO: 3143321 - protein, 8 aa, Giardia lamblia
TPEEDRQC

SEQ ID NO: 3143322 - protein, 7 aa, Giardia lamblia
TPEEEAR

SEQ ID NO: 3143323 - protein, 6 aa, Giardia lamblia
TPEEIE

SEQ ID NO: 3143324 - protein, 8 aa, Giardia lamblia
TPEEPNYE

SEQ ID NO: 3143325 - protein, 6 aa, Giardia lamblia
TPEESL

SEQ ID NO: 3143326 - protein, 39 aa, Giardia lamblia
TPEETERPANESSGNPSRTQSRSGARGSVKTVDANPVAS

SEQ ID NO: 3143327 - protein, 11 aa, Giardia lamblia
TPEFKSKGGID

SEQ ID NO: 3143328 - protein, 7 aa, Giardia lamblia
TPEFNPG

SEQ ID NO: 3143329 - protein, 5 aa, Giardia lamblia
TPEGA

SEQ ID NO: 3143330 - protein, 5 aa, Giardia lamblia
TPEGQ

SEQ ID NO: 3143331 - protein, 4 aa, Giardia lamblia
TPEK

SEQ ID NO: 3143332 - protein, 5 aa, Giardia lamblia
TPEKE

SEQ ID NO: 3143333 - protein, 10 aa, Giardia lamblia
TPENQPANSE

SEQ ID NO: 3143334 - protein, 7 aa, Giardia lamblia
TPENVDG

SEQ ID NO: 3143335 - protein, 33 aa, Giardia lamblia
TPEPAPKRLPSASTPASSKPCSFGAQSTEGAGH

SEQ ID NO: 3143336 - protein, 13 aa, Giardia lamblia
TPEPSVDIPITIQ

SEQ ID NO: 3143337 - protein, 7 aa, Giardia lamblia
TPEQCSE

SEQ ID NO: 3143338 - protein, 5 aa, Giardia lamblia
TPEQE

SEQ ID NO: 3143339 - protein, 9 aa, Giardia lamblia
TPEQRKTLQ

SEQ ID NO: 3143340 - protein, 5 aa, Giardia lamblia
TPEQT

SEQ ID NO: 3143341 - protein, 8 aa, Giardia lamblia
TPESDPDP

SEQ ID NO: 3143342 - protein, 16 aa, Giardia lamblia
TPESEENAIKTDPPAV

SEQ ID NO: 3143343 - protein, 8 aa, Giardia lamblia
TPESYTPS

SEQ ID NO: 3143344 - protein, 5 aa, Giardia lamblia
TPETL

SEQ ID NO: 3143345 - protein, 7 aa, Giardia lamblia
TPETRNN

SEQ ID NO: 3143346 - protein, 6 aa, Giardia lamblia
TPEVEE

SEQ ID NO: 3143347 - protein, 6 aa, Giardia lamblia
TPEYRP

SEQ ID NO: 3143348 - protein, 7 aa, Giardia lamblia
TPFGDEE

SEQ ID NO: 3143349 - protein, 21 aa, Giardia lamblia
TPFLSTSSSSLMDATNNSRSV

SEQ ID NO: 3143350 - protein, 4 aa, Giardia lamblia
TPFN

SEQ ID NO: 3143351 - protein, 9 aa, Giardia lamblia
TPFSPTPEV

SEQ ID NO: 3143352 - protein, 15 aa, Giardia lamblia
TPFTSPSSLTHNPRD

SEQ ID NO: 3143353 - protein, 4 aa, Giardia lamblia
TPGA

SEQ ID NO: 3143354 - protein, 9 aa, Giardia lamblia
TPGAPTPRY

SEQ ID NO: 3143355 - protein, 22 aa, Giardia lamblia
TPGATGQSGQSNVHSDSSLNKT

SEQ ID NO: 3143356 - protein, 11 aa, Giardia lamblia
TPGDDTLEETK

SEQ ID NO: 3143357 - protein, 10 aa, Giardia lamblia
TPGDNKPRVG

SEQ ID NO: 3143358 - protein, 6 aa, Giardia lamblia
TPGHTK

SEQ ID NO: 3143359 - protein, 6 aa, Giardia lamblia
TPGKGI

SEQ ID NO: 3143360 - protein, 10 aa, Giardia lamblia
TPGPSATVNS

SEQ ID NO: 3143361 - protein, 8 aa, Giardia lamblia
TPGQISET

SEQ ID NO: 3143362 - protein, 6 aa, Giardia lamblia
TPGRPS

SEQ ID NO: 3143363 - protein, 4 aa, Giardia lamblia
TPHD

SEQ ID NO: 3143364 - protein, 7 aa, Giardia lamblia
TPHEDIN

SEQ ID NO: 3143365 - protein, 12 aa, Giardia lamblia
TPHLPSSPAGLR

SEQ ID NO: 3143366 - protein, 5 aa, Giardia lamblia
TPHNS

SEQ ID NO: 3143367 - protein, 5 aa, Giardia lamblia
TPHPL

SEQ ID NO: 3143368 - protein, 13 aa, Giardia lamblia
TPHPSGETPWESH

SEQ ID NO: 3143369 - protein, 14 aa, Giardia lamblia
TPHSSNHPSAPNLN

SEQ ID NO: 3143370 - protein, 8 aa, Giardia lamblia
TPIDDPGK

SEQ ID NO: 3143371 - protein, 4 aa, Giardia lamblia
TPIE

SEQ ID NO: 3143372 - protein, 32 aa, Giardia lamblia
TPIGSSATSIPSENSSISSLSDLSTASVSAEL

SEQ ID NO: 3143373 - protein, 4 aa, Giardia lamblia
TPIN

SEQ ID NO: 3143374 - protein, 18 aa, Giardia lamblia
TPIPEHSNRVQENDEQTF

SEQ ID NO: 3143375 - protein, 5 aa, Giardia lamblia
TPIQN

SEQ ID NO: 3143376 - protein, 5 aa, Giardia lamblia
TPIRG

SEQ ID NO: 3143377 - protein, 7 aa, Giardia lamblia
TPITEEN

SEQ ID NO: 3143378 - protein, 13 aa, Giardia lamblia
TPITKSQTRQEKV

SEQ ID NO: 3143379 - protein, 5 aa, Giardia lamblia
TPITN

SEQ ID NO: 3143380 - protein, 7 aa, Giardia lamblia
TPITSSS

SEQ ID NO: 3143381 - protein, 6 aa, Giardia lamblia
TPKDLR

SEQ ID NO: 3143382 - protein, 9 aa, Giardia lamblia
TPKGAAEQL

SEQ ID NO: 3143383 - protein, 6 aa, Giardia lamblia
TPKKDL

SEQ ID NO: 3143384 - protein, 91 aa, Giardia lamblia
TPKLSAQPSVRTAPAEKRRPNTTACRNHPAQSSTAPTSRPAAQTPLSKGGPKVRTLGKSQSQSSLRKTKPNESDLRPTTAPSETPASSGAA

SEQ ID NO: 3143385 - protein, 7 aa, Giardia lamblia
TPKPEFP

SEQ ID NO: 3143386 - protein, 6 aa, Giardia lamblia
TPKPPV

SEQ ID NO: 3143387 - protein, 7 aa, Giardia lamblia
TPKRSVT

SEQ ID NO: 3143388 - protein, 8 aa, Giardia lamblia
TPKSGLPF

SEQ ID NO: 3143389 - protein, 8 aa, Giardia lamblia
TPKSPSIL

SEQ ID NO: 3143390 - protein, 9 aa, Giardia lamblia
TPKTEDAAA

SEQ ID NO: 3143391 - protein, 8 aa, Giardia lamblia
TPKTPTYC

SEQ ID NO: 3143392 - protein, 18 aa, Giardia lamblia
TPKTTYSRINNNSKSGTF

SEQ ID NO: 3143393 - protein, 28 aa, Giardia lamblia
TPLASTTKSSVSVTGESDKGSSQSRKPV

SEQ ID NO: 3143394 - protein, 8 aa, Giardia lamblia
TPLDGSQE

SEQ ID NO: 3143395 - protein, 4 aa, Giardia lamblia
TPLE

SEQ ID NO: 3143396 - protein, 5 aa, Giardia lamblia
TPLEP

SEQ ID NO: 3143397 - protein, 10 aa, Giardia lamblia
TPLEQQRNRL

SEQ ID NO: 3143398 - protein, 9 aa, Giardia lamblia
TPLESSLTQ

SEQ ID NO: 3143399 - protein, 6 aa, Giardia lamblia
TPLPEG

SEQ ID NO: 3143400 - protein, 5 aa, Giardia lamblia
TPLPH

SEQ ID NO: 3143401 - protein, 7 aa, Giardia lamblia
TPLPPPD

SEQ ID NO: 3143402 - protein, 8 aa, Giardia lamblia
TPLPREKT

SEQ ID NO: 3143403 - protein, 8 aa, Giardia lamblia
TPLPSSPT

SEQ ID NO: 3143404 - protein, 14 aa, Giardia lamblia
TPLPSTEMTSKDSI

SEQ ID NO: 3143405 - protein, 28 aa, Giardia lamblia
TPLPTKCSAPKVTAGIRPSTASVSHRGE

SEQ ID NO: 3143406 - protein, 8 aa, Giardia lamblia
TPLQPSPD

SEQ ID NO: 3143407 - protein, 8 aa, Giardia lamblia
TPLREDDE

SEQ ID NO: 3143408 - protein, 4 aa, Giardia lamblia
TPLS

SEQ ID NO: 3143409 - protein, 19 aa, Giardia lamblia
TPLSDEAPYSLNANMTTAW

SEQ ID NO: 3143410 - protein, 11 aa, Giardia lamblia
TPLSPGNTESA

SEQ ID NO: 3143411 - protein, 13 aa, Giardia lamblia
TPLSRSAPKALPT

SEQ ID NO: 3143412 - protein, 7 aa, Giardia lamblia
TPLTDPV

SEQ ID NO: 3143413 - protein, 5 aa, Giardia lamblia
TPLTG

SEQ ID NO: 3143414 - protein, 25 aa, Giardia lamblia
TPLTSLPAATEASNSLSALDPPYAR

SEQ ID NO: 3143415 - protein, 6 aa, Giardia lamblia
TPMDSD

SEQ ID NO: 3143416 - protein, 4 aa, Giardia lamblia
TPMP

SEQ ID NO: 3143417 - protein, 5 aa, Giardia lamblia
TPMPT

SEQ ID NO: 3143418 - protein, 5 aa, Giardia lamblia
TPMQN

SEQ ID NO: 3143419 - protein, 4 aa, Giardia lamblia
TPNA

SEQ ID NO: 3143420 - protein, 10 aa, Giardia lamblia
TPNADDTKDL

SEQ ID NO: 3143421 - protein, 11 aa, Giardia lamblia
TPNFPQDSNAY

SEQ ID NO: 3143422 - protein, 4 aa, Giardia lamblia
TPNG

SEQ ID NO: 3143423 - protein, 4 aa, Giardia lamblia
TPNP

SEQ ID NO: 3143424 - protein, 9 aa, Giardia lamblia
TPNPKSQAF

SEQ ID NO: 3143425 - protein, 8 aa, Giardia lamblia
TPNPSLKS

SEQ ID NO: 3143426 - protein, 8 aa, Giardia lamblia
TPNRATAR

SEQ ID NO: 3143427 - protein, 16 aa, Giardia lamblia
TPNRENVKRDADGNTN

SEQ ID NO: 3143428 - protein, 6 aa, Giardia lamblia
TPNRHR

SEQ ID NO: 3143429 - protein, 11 aa, Giardia lamblia
TPNSCEGASNS

SEQ ID NO: 3143430 - protein, 13 aa, Giardia lamblia
TPNTEFNQQREET

SEQ ID NO: 3143431 - protein, 15 aa, Giardia lamblia
TPPDEANPDSTGEVE

SEQ ID NO: 3143432 - protein, 7 aa, Giardia lamblia
TPPEELH

SEQ ID NO: 3143433 - protein, 5 aa, Giardia lamblia
TPPET

SEQ ID NO: 3143434 - protein, 5 aa, Giardia lamblia
TPPGP

SEQ ID NO: 3143435 - protein, 4 aa, Giardia lamblia
TPPH

SEQ ID NO: 3143436 - protein, 7 aa, Giardia lamblia
TPPHGVS

SEQ ID NO: 3143437 - protein, 5 aa, Giardia lamblia
TPPKE

SEQ ID NO: 3143438 - protein, 136 aa, Giardia lamblia
TPPKHLPKSHTKHKAEHQRDEHAKEKHHAAKQKKEKKLEKPEKEPKHEADKKKTSAIKKKPDLIKETKDAPAEKPQKINGDTSSSKPHSTIKSTTETRRADKKIAKKQQKDKKEPMERETSTTVSSLTESSHSEDI

SEQ ID NO: 3143439 - protein, 19 aa, Giardia lamblia
TPPKQVSYSQSNGLETCGG

SEQ ID NO: 3143440 - protein, 5 aa, Giardia lamblia
TPPLS

SEQ ID NO: 3143441 - protein, 13 aa, Giardia lamblia
TPPNIKSTKRYTN

SEQ ID NO: 3143442 - protein, 6 aa, Giardia lamblia
TPPNVQ

SEQ ID NO: 3143443 - protein, 14 aa, Giardia lamblia
TPPPASAASSGQTS

SEQ ID NO: 3143444 - protein, 17 aa, Giardia lamblia
TPPPFDSGTLTETPTLP

SEQ ID NO: 3143445 - protein, 7 aa, Giardia lamblia
TPPPPLQ

SEQ ID NO: 3143446 - protein, 8 aa, Giardia lamblia
TPPPTYLS

SEQ ID NO: 3143447 - protein, 6 aa, Giardia lamblia
TPPQTS

SEQ ID NO: 3143448 - protein, 4 aa, Giardia lamblia
TPPS

SEQ ID NO: 3143449 - protein, 6 aa, Giardia lamblia
TPPTDI

SEQ ID NO: 3143450 - protein, 9 aa, Giardia lamblia
TPPTSDTGL

SEQ ID NO: 3143451 - protein, 6 aa, Giardia lamblia
TPPVQF

SEQ ID NO: 3143452 - protein, 4 aa, Giardia lamblia
TPPY

SEQ ID NO: 3143453 - protein, 23 aa, Giardia lamblia
TPQEAREIREKGTANYKRNDKLR

SEQ ID NO: 3143454 - protein, 32 aa, Giardia lamblia
TPQENGAPRSQQSDDLQNKSYGNTTDGPGGIT

SEQ ID NO: 3143455 - protein, 6 aa, Giardia lamblia
TPQKAE

SEQ ID NO: 3143456 - protein, 6 aa, Giardia lamblia
TPQKPL

SEQ ID NO: 3143457 - protein, 4 aa, Giardia lamblia
TPQL

SEQ ID NO: 3143458 - protein, 6 aa, Giardia lamblia
TPQLSN

SEQ ID NO: 3143459 - protein, 9 aa, Giardia lamblia
TPQPTIEEP

SEQ ID NO: 3143460 - protein, 27 aa, Giardia lamblia
TPQQPYQNAPQPTLQYPAPGSVSGGLQ

SEQ ID NO: 3143461 - protein, 55 aa, Giardia lamblia
TPQQREGGETWTSERKRNYPTARNKQEREDARRRLRESGAYTSPPETNRFKQGYT

SEQ ID NO: 3143462 - protein, 11 aa, Giardia lamblia
TPQQSVEQLTE

SEQ ID NO: 3143463 - protein, 19 aa, Giardia lamblia
TPQQYTHQSSGYERSSEKH

SEQ ID NO: 3143464 - protein, 8 aa, Giardia lamblia
TPQSSKDK

SEQ ID NO: 3143465 - protein, 6 aa, Giardia lamblia
TPQSSL

SEQ ID NO: 3143466 - protein, 4 aa, Giardia lamblia
TPQT

SEQ ID NO: 3143467 - protein, 5 aa, Giardia lamblia
TPQTA

SEQ ID NO: 3143468 - protein, 8 aa, Giardia lamblia
TPQTDPNL

SEQ ID NO: 3143469 - protein, 21 aa, Giardia lamblia
TPQTKKGQKLKTVSSPLRRTI

SEQ ID NO: 3143470 - protein, 7 aa, Giardia lamblia
TPQTPDD

SEQ ID NO: 3143471 - protein, 5 aa, Giardia lamblia
TPQYG

SEQ ID NO: 3143472 - protein, 5 aa, Giardia lamblia
TPRAK

SEQ ID NO: 3143473 - protein, 6 aa, Giardia lamblia
TPRDAT

SEQ ID NO: 3143474 - protein, 8 aa, Giardia lamblia
TPREDLSG

SEQ ID NO: 3143475 - protein, 4 aa, Giardia lamblia
TPRG

SEQ ID NO: 3143476 - protein, 13 aa, Giardia lamblia
TPRGNQEFDTNYK

SEQ ID NO: 3143477 - protein, 12 aa, Giardia lamblia
TPRGRKAKRKIR

SEQ ID NO: 3143478 - protein, 5 aa, Giardia lamblia
TPRKT

SEQ ID NO: 3143479 - protein, 5 aa, Giardia lamblia
TPRLN

SEQ ID NO: 3143480 - protein, 12 aa, Giardia lamblia
TPRPMQNPSIRT

SEQ ID NO: 3143481 - protein, 13 aa, Giardia lamblia
TPRSEPLATDADA

SEQ ID NO: 3143482 - protein, 12 aa, Giardia lamblia
TPRTGLRTTEQT

SEQ ID NO: 3143483 - protein, 8 aa, Giardia lamblia
TPSAATPN

SEQ ID NO: 3143484 - protein, 5 aa, Giardia lamblia
TPSAI

SEQ ID NO: 3143485 - protein, 4 aa, Giardia lamblia
TPSE

SEQ ID NO: 3143486 - protein, 13 aa, Giardia lamblia
TPSELADNVASGK

SEQ ID NO: 3143487 - protein, 23 aa, Giardia lamblia
TPSEQGRGSPSNLTARQRRGRRA

SEQ ID NO: 3143488 - protein, 9 aa, Giardia lamblia
TPSEQPQDV

SEQ ID NO: 3143489 - protein, 11 aa, Giardia lamblia
TPSESIAGEVG

SEQ ID NO: 3143490 - protein, 13 aa, Giardia lamblia
TPSEVGATDREGK

SEQ ID NO: 3143491 - protein, 7 aa, Giardia lamblia
TPSEYRD

SEQ ID NO: 3143492 - protein, 6 aa, Giardia lamblia
TPSGNS

SEQ ID NO: 3143493 - protein, 5 aa, Giardia lamblia
TPSGV

SEQ ID NO: 3143494 - protein, 5 aa, Giardia lamblia
TPSIG

SEQ ID NO: 3143495 - protein, 6 aa, Giardia lamblia
TPSIGY

SEQ ID NO: 3143496 - protein, 8 aa, Giardia lamblia
TPSLQSPT

SEQ ID NO: 3143497 - protein, 6 aa, Giardia lamblia
TPSLSM

SEQ ID NO: 3143498 - protein, 4 aa, Giardia lamblia
TPSM

SEQ ID NO: 3143499 - protein, 5 aa, Giardia lamblia
TPSMN

SEQ ID NO: 3143500 - protein, 7 aa, Giardia lamblia
TPSNQTI

SEQ ID NO: 3143501 - protein, 6 aa, Giardia lamblia
TPSPAL

SEQ ID NO: 3143502 - protein, 10 aa, Giardia lamblia
TPSPDASGAP

SEQ ID NO: 3143503 - protein, 6 aa, Giardia lamblia
TPSPIR

SEQ ID NO: 3143504 - protein, 17 aa, Giardia lamblia
TPSPPEPSVTRRSIGSQ

SEQ ID NO: 3143505 - protein, 19 aa, Giardia lamblia
TPSPPEQSQTGRSIRRGNT

SEQ ID NO: 3143506 - protein, 8 aa, Giardia lamblia
TPSPTSDS

SEQ ID NO: 3143507 - protein, 6 aa, Giardia lamblia
TPSQEL

SEQ ID NO: 3143508 - protein, 7 aa, Giardia lamblia
TPSQGEC

SEQ ID NO: 3143509 - protein, 13 aa, Giardia lamblia
TPSQQNPQDPGDF

SEQ ID NO: 3143510 - protein, 6 aa, Giardia lamblia
TPSRGV

SEQ ID NO: 3143511 - protein, 6 aa, Giardia lamblia
TPSRHA

SEQ ID NO: 3143512 - protein, 6 aa, Giardia lamblia
TPSRRE

SEQ ID NO: 3143513 - protein, 7 aa, Giardia lamblia
TPSRSTA

SEQ ID NO: 3143514 - protein, 4 aa, Giardia lamblia
TPSS

SEQ ID NO: 3143515 - protein, 6 aa, Giardia lamblia
TPSSAT

SEQ ID NO: 3143516 - protein, 11 aa, Giardia lamblia
TPSSQLSDSPL

SEQ ID NO: 3143517 - protein, 10 aa, Giardia lamblia
TPSSSSYQET

SEQ ID NO: 3143518 - protein, 16 aa, Giardia lamblia
TPSSTQPAGLTTQPNL

SEQ ID NO: 3143519 - protein, 8 aa, Giardia lamblia
TPSSYMGE

SEQ ID NO: 3143520 - protein, 15 aa, Giardia lamblia
TPSTPSTEAAPGNNL

SEQ ID NO: 3143521 - protein, 5 aa, Giardia lamblia
TPSTS

SEQ ID NO: 3143522 - protein, 4 aa, Giardia lamblia
TPSV

SEQ ID NO: 3143523 - protein, 7 aa, Giardia lamblia
TPSVPEL

SEQ ID NO: 3143524 - protein, 18 aa, Giardia lamblia
TPSYRGSSASETVKGARA

SEQ ID NO: 3143525 - protein, 6 aa, Giardia lamblia
TPTADE

SEQ ID NO: 3143526 - protein, 4 aa, Giardia lamblia
TPTC

SEQ ID NO: 3143527 - protein, 5 aa, Giardia lamblia
TPTEM

SEQ ID NO: 3143528 - protein, 14 aa, Giardia lamblia
TPTFSNADGFSDPG

SEQ ID NO: 3143529 - protein, 18 aa, Giardia lamblia
TPTGRGDAITAKASYTSS

SEQ ID NO: 3143530 - protein, 42 aa, Giardia lamblia
TPTGVAPQQGGPASSHDPGAALQEAASKIPRPPDSDTSASAD

SEQ ID NO: 3143531 - protein, 5 aa, Giardia lamblia
TPTHN

SEQ ID NO: 3143532 - protein, 9 aa, Giardia lamblia
TPTKASDLE

SEQ ID NO: 3143533 - protein, 4 aa, Giardia lamblia
TPTL

SEQ ID NO: 3143534 - protein, 8 aa, Giardia lamblia
TPTLSPPA

SEQ ID NO: 3143535 - protein, 5 aa, Giardia lamblia
TPTNL

SEQ ID NO: 3143536 - protein, 5 aa, Giardia lamblia
TPTNP

SEQ ID NO: 3143537 - protein, 5 aa, Giardia lamblia
TPTNQ

SEQ ID NO: 3143538 - protein, 8 aa, Giardia lamblia
TPTPADTQ

SEQ ID NO: 3143539 - protein, 7 aa, Giardia lamblia
TPTPGLA

SEQ ID NO: 3143540 - protein, 22 aa, Giardia lamblia
TPTQARPRQELSTRSTVDTKTR

SEQ ID NO: 3143541 - protein, 11 aa, Giardia lamblia
TPTQMKDPSVP

SEQ ID NO: 3143542 - protein, 4 aa, Giardia lamblia
TPTR

SEQ ID NO: 3143543 - protein, 11 aa, Giardia lamblia
TPTRESTRAGV

SEQ ID NO: 3143544 - protein, 15 aa, Giardia lamblia
TPTSSDKNDRSNNNL

SEQ ID NO: 3143545 - protein, 12 aa, Giardia lamblia
TPTSSDKSDVHQ

SEQ ID NO: 3143546 - protein, 11 aa, Giardia lamblia
TPTSTYTSHSS

SEQ ID NO: 3143547 - protein, 5 aa, Giardia lamblia
TPTSV

SEQ ID NO: 3143548 - protein, 7 aa, Giardia lamblia
TPTSYEA

SEQ ID NO: 3143549 - protein, 24 aa, Giardia lamblia
TPTTAGAAETSSKPRLPADAADSF

SEQ ID NO: 3143550 - protein, 5 aa, Giardia lamblia
TPTTE

SEQ ID NO: 3143551 - protein, 25 aa, Giardia lamblia
TPTTTTASLSSGQSSMYSGLSSNTD

SEQ ID NO: 3143552 - protein, 4 aa, Giardia lamblia
TPTY

SEQ ID NO: 3143553 - protein, 6 aa, Giardia lamblia
TPVAGP

SEQ ID NO: 3143554 - protein, 4 aa, Giardia lamblia
TPVE

SEQ ID NO: 3143555 - protein, 9 aa, Giardia lamblia
TPVGQNEVR

SEQ ID NO: 3143556 - protein, 6 aa, Giardia lamblia
TPVIGD

SEQ ID NO: 3143557 - protein, 5 aa, Giardia lamblia
TPVKL

SEQ ID NO: 3143558 - protein, 5 aa, Giardia lamblia
TPVPP

SEQ ID NO: 3143559 - protein, 9 aa, Giardia lamblia
TPVPTSRSD

SEQ ID NO: 3143560 - protein, 6 aa, Giardia lamblia
TPVRGQ

SEQ ID NO: 3143561 - protein, 5 aa, Giardia lamblia
TPVSE

SEQ ID NO: 3143562 - protein, 5 aa, Giardia lamblia
TPVSS

SEQ ID NO: 3143563 - protein, 24 aa, Giardia lamblia
TPVTNGQEHASSRGIQNSTHSISS

SEQ ID NO: 3143564 - protein, 5 aa, Giardia lamblia
TPVTS

SEQ ID NO: 3143565 - protein, 5 aa, Giardia lamblia
TPVVG

SEQ ID NO: 3143566 - protein, 5 aa, Giardia lamblia
TPVYS

SEQ ID NO: 3143567 - protein, 5 aa, Giardia lamblia
TPYDL

SEQ ID NO: 3143568 - protein, 7 aa, Giardia lamblia
TPYPQAS

SEQ ID NO: 3143569 - protein, 4 aa, Giardia lamblia
TPYT

SEQ ID NO: 3143570 - protein, 6 aa, Giardia lamblia
TPYYEN

SEQ ID NO: 3143571 - protein, 5 aa, Giardia lamblia
TQAEQ

SEQ ID NO: 3143572 - protein, 15 aa, Giardia lamblia
TQAEYEARSAQLAAR

SEQ ID NO: 3143573 - protein, 4 aa, Giardia lamblia
TQAG

SEQ ID NO: 3143574 - protein, 15 aa, Giardia lamblia
TQAMDDDRRKNEREI

SEQ ID NO: 3143575 - protein, 6 aa, Giardia lamblia
TQANEM

SEQ ID NO: 3143576 - protein, 11 aa, Giardia lamblia
TQANGDGATIE

SEQ ID NO: 3143577 - protein, 10 aa, Giardia lamblia
TQANQATRLQ

SEQ ID NO: 3143578 - protein, 15 aa, Giardia lamblia
TQAPAQGHAPPNPYA

SEQ ID NO: 3143579 - protein, 4 aa, Giardia lamblia
TQAR

SEQ ID NO: 3143580 - protein, 15 aa, Giardia lamblia
TQARAEYEKTIRESE

SEQ ID NO: 3143581 - protein, 10 aa, Giardia lamblia
TQARSYNNEG

SEQ ID NO: 3143582 - protein, 4 aa, Giardia lamblia
TQAS

SEQ ID NO: 3143583 - protein, 8 aa, Giardia lamblia
TQASGDKE

SEQ ID NO: 3143584 - protein, 6 aa, Giardia lamblia
TQASID

SEQ ID NO: 3143585 - protein, 5 aa, Giardia lamblia
TQASL

SEQ ID NO: 3143586 - protein, 6 aa, Giardia lamblia
TQASTR

SEQ ID NO: 3143587 - protein, 8 aa, Giardia lamblia
TQASYTQK

SEQ ID NO: 3143588 - protein, 9 aa, Giardia lamblia
TQDDPFQPT

SEQ ID NO: 3143589 - protein, 6 aa, Giardia lamblia
TQDEQE

SEQ ID NO: 3143590 - protein, 5 aa, Giardia lamblia
TQDNY

SEQ ID NO: 3143591 - protein, 4 aa, Giardia lamblia
TQDP

SEQ ID NO: 3143592 - protein, 14 aa, Giardia lamblia
TQDPAVSVSSPPTL

SEQ ID NO: 3143593 - protein, 5 aa, Giardia lamblia
TQDSD

SEQ ID NO: 3143594 - protein, 6 aa, Giardia lamblia
TQEAVP

SEQ ID NO: 3143595 - protein, 9 aa, Giardia lamblia
TQEAVQASS

SEQ ID NO: 3143596 - protein, 4 aa, Giardia lamblia
TQED

SEQ ID NO: 3143597 - protein, 6 aa, Giardia lamblia
TQEDTY

SEQ ID NO: 3143598 - protein, 4 aa, Giardia lamblia
TQEE

SEQ ID NO: 3143599 - protein, 13 aa, Giardia lamblia
TQEEPDSNASMSI

SEQ ID NO: 3143600 - protein, 5 aa, Giardia lamblia
TQEGK

SEQ ID NO: 3143601 - protein, 6 aa, Giardia lamblia
TQEIKD

SEQ ID NO: 3143602 - protein, 21 aa, Giardia lamblia
TQEKPGKGVKGQTAAPTTTAS

SEQ ID NO: 3143603 - protein, 11 aa, Giardia lamblia
TQEKRNSRELR

SEQ ID NO: 3143604 - protein, 9 aa, Giardia lamblia
TQELGAQDT

SEQ ID NO: 3143605 - protein, 4 aa, Giardia lamblia
TQEM

SEQ ID NO: 3143606 - protein, 6 aa, Giardia lamblia
TQENEY

SEQ ID NO: 3143607 - protein, 6 aa, Giardia lamblia
TQENRA

SEQ ID NO: 3143608 - protein, 5 aa, Giardia lamblia
TQESA

SEQ ID NO: 3143609 - protein, 13 aa, Giardia lamblia
TQESEATKKATAN

SEQ ID NO: 3143610 - protein, 7 aa, Giardia lamblia
TQESLTN

SEQ ID NO: 3143611 - protein, 12 aa, Giardia lamblia
TQETGKSAQDWA

SEQ ID NO: 3143612 - protein, 6 aa, Giardia lamblia
TQETPY

SEQ ID NO: 3143613 - protein, 5 aa, Giardia lamblia
TQEYA

SEQ ID NO: 3143614 - protein, 5 aa, Giardia lamblia
TQFDG

SEQ ID NO: 3143615 - protein, 12 aa, Giardia lamblia
TQFGSRDTAGKT

SEQ ID NO: 3143616 - protein, 15 aa, Giardia lamblia
TQFSPSDWREEQRVG

SEQ ID NO: 3143617 - protein, 9 aa, Giardia lamblia
TQGATLNEG

SEQ ID NO: 3143618 - protein, 24 aa, Giardia lamblia
TQGDSTYSPLGTQTAPEAKETNTA

SEQ ID NO: 3143619 - protein, 13 aa, Giardia lamblia
TQGITPQACQVES

SEQ ID NO: 3143620 - protein, 11 aa, Giardia lamblia
TQGKKGRGNPG

SEQ ID NO: 3143621 - protein, 12 aa, Giardia lamblia
TQGKKGRGNPGH

SEQ ID NO: 3143622 - protein, 13 aa, Giardia lamblia
TQGKKSRGDPGRT

SEQ ID NO: 3143623 - protein, 5 aa, Giardia lamblia
TQGKT

SEQ ID NO: 3143624 - protein, 11 aa, Giardia lamblia
TQGKYDGRDRT

SEQ ID NO: 3143625 - protein, 6 aa, Giardia lamblia
TQGNHK

SEQ ID NO: 3143626 - protein, 7 aa, Giardia lamblia
TQGQHTK

SEQ ID NO: 3143627 - protein, 4 aa, Giardia lamblia
TQGR

SEQ ID NO: 3143628 - protein, 11 aa, Giardia lamblia
TQGSAPTDDKL

SEQ ID NO: 3143629 - protein, 4 aa, Giardia lamblia
TQGT

SEQ ID NO: 3143630 - protein, 12 aa, Giardia lamblia
TQGTGKTRLSSY

SEQ ID NO: 3143631 - protein, 12 aa, Giardia lamblia
TQGTTAQGGGRV

SEQ ID NO: 3143632 - protein, 11 aa, Giardia lamblia
TQGTTNIDTES

SEQ ID NO: 3143633 - protein, 5 aa, Giardia lamblia
TQGVS

SEQ ID NO: 3143634 - protein, 11 aa, Giardia lamblia
TQHGKKDATIN

SEQ ID NO: 3143635 - protein, 9 aa, Giardia lamblia
TQHHPNSSS

SEQ ID NO: 3143636 - protein, 35 aa, Giardia lamblia
TQHPTFNSKAPQAIRPEVPNTSIRGQSTTTRRAPD

SEQ ID NO: 3143637 - protein, 5 aa, Giardia lamblia
TQHQH

SEQ ID NO: 3143638 - protein, 9 aa, Giardia lamblia
TQHQYPSSF

SEQ ID NO: 3143639 - protein, 15 aa, Giardia lamblia
TQHRGTSASGGGEVT

SEQ ID NO: 3143640 - protein, 9 aa, Giardia lamblia
TQIDRDEAA

SEQ ID NO: 3143641 - protein, 5 aa, Giardia lamblia
TQIEE

SEQ ID NO: 3143642 - protein, 9 aa, Giardia lamblia
TQINSQNEI

SEQ ID NO: 3143643 - protein, 16 aa, Giardia lamblia
TQIPHRASTSGAQPGQ

SEQ ID NO: 3143644 - protein, 8 aa, Giardia lamblia
TQKAELEE

SEQ ID NO: 3143645 - protein, 8 aa, Giardia lamblia
TQKERENN

SEQ ID NO: 3143646 - protein, 12 aa, Giardia lamblia
TQKGMSDRSGNT

SEQ ID NO: 3143647 - protein, 5 aa, Giardia lamblia
TQKNR

SEQ ID NO: 3143648 - protein, 13 aa, Giardia lamblia
TQKPRRRGGRVGG

SEQ ID NO: 3143649 - protein, 8 aa, Giardia lamblia
TQKQERRI

SEQ ID NO: 3143650 - protein, 6 aa, Giardia lamblia
TQKRVD

SEQ ID NO: 3143651 - protein, 10 aa, Giardia lamblia
TQKSDSIEFS

SEQ ID NO: 3143652 - protein, 8 aa, Giardia lamblia
TQKSKLES

SEQ ID NO: 3143653 - protein, 6 aa, Giardia lamblia
TQKSRF

SEQ ID NO: 3143654 - protein, 30 aa, Giardia lamblia
TQKTAEKAAIAQGADSVSKPELTATSASQK

SEQ ID NO: 3143655 - protein, 12 aa, Giardia lamblia
TQKYTKSGLPLP

SEQ ID NO: 3143656 - protein, 8 aa, Giardia lamblia
TQLEEAKD

SEQ ID NO: 3143657 - protein, 7 aa, Giardia lamblia
TQLGVTP

SEQ ID NO: 3143658 - protein, 15 aa, Giardia lamblia
TQLNTMGNGDSLRHD

SEQ ID NO: 3143659 - protein, 4 aa, Giardia lamblia
TQLP

SEQ ID NO: 3143660 - protein, 12 aa, Giardia lamblia
TQLPRPHSGEPQ

SEQ ID NO: 3143661 - protein, 6 aa, Giardia lamblia
TQLQEH

SEQ ID NO: 3143662 - protein, 11 aa, Giardia lamblia
TQMNDTSSRSH

SEQ ID NO: 3143663 - protein, 20 aa, Giardia lamblia
TQNAPRSKGSPQKKVAEEDV

SEQ ID NO: 3143664 - protein, 13 aa, Giardia lamblia
TQNDQEPSLKQKN

SEQ ID NO: 3143665 - protein, 5 aa, Giardia lamblia
TQNLR

SEQ ID NO: 3143666 - protein, 10 aa, Giardia lamblia
TQNMNESVST

SEQ ID NO: 3143667 - protein, 9 aa, Giardia lamblia
TQNNKKGVT

SEQ ID NO: 3143668 - protein, 17 aa, Giardia lamblia
TQNQPYPEVESSPLRNE

SEQ ID NO: 3143669 - protein, 10 aa, Giardia lamblia
TQNSHRPNSV

SEQ ID NO: 3143670 - protein, 9 aa, Giardia lamblia
TQNTTEPDA

SEQ ID NO: 3143671 - protein, 4 aa, Giardia lamblia
TQPE

SEQ ID NO: 3143672 - protein, 6 aa, Giardia lamblia
TQPERL

SEQ ID NO: 3143673 - protein, 12 aa, Giardia lamblia
TQPFSRRSTKSV

SEQ ID NO: 3143674 - protein, 20 aa, Giardia lamblia
TQPISTKSVATRSIDSSCSY

SEQ ID NO: 3143675 - protein, 7 aa, Giardia lamblia
TQPKDVV

SEQ ID NO: 3143676 - protein, 5 aa, Giardia lamblia
TQPPE

SEQ ID NO: 3143677 - protein, 10 aa, Giardia lamblia
TQPPTENDES

SEQ ID NO: 3143678 - protein, 5 aa, Giardia lamblia
TQPRR

SEQ ID NO: 3143679 - protein, 6 aa, Giardia lamblia
TQPRRS

SEQ ID NO: 3143680 - protein, 11 aa, Giardia lamblia
TQPSDKAGVPA

SEQ ID NO: 3143681 - protein, 13 aa, Giardia lamblia
TQPSSTMYGPPGS

SEQ ID NO: 3143682 - protein, 5 aa, Giardia lamblia
TQPTL

SEQ ID NO: 3143683 - protein, 4 aa, Giardia lamblia
TQPV

SEQ ID NO: 3143684 - protein, 19 aa, Giardia lamblia
TQPVPKTKGTYQDLSNPGH

SEQ ID NO: 3143685 - protein, 29 aa, Giardia lamblia
TQPVTGVSKESLKPDTATTSASSQVTGAT

SEQ ID NO: 3143686 - protein, 6 aa, Giardia lamblia
TQQENR

SEQ ID NO: 3143687 - protein, 8 aa, Giardia lamblia
TQQEVPDV

SEQ ID NO: 3143688 - protein, 7 aa, Giardia lamblia
TQQGHEE

SEQ ID NO: 3143689 - protein, 4 aa, Giardia lamblia
TQQL

SEQ ID NO: 3143690 - protein, 18 aa, Giardia lamblia
TQQLNDGISSAGDCQNGS

SEQ ID NO: 3143691 - protein, 4 aa, Giardia lamblia
TQQM

SEQ ID NO: 3143692 - protein, 11 aa, Giardia lamblia
TQQMAQRSQQV

SEQ ID NO: 3143693 - protein, 16 aa, Giardia lamblia
TQQMPDKEEEAEDGSK

SEQ ID NO: 3143694 - protein, 5 aa, Giardia lamblia
TQQNH

SEQ ID NO: 3143695 - protein, 9 aa, Giardia lamblia
TQQNTENSK

SEQ ID NO: 3143696 - protein, 12 aa, Giardia lamblia
TQQPGISPESAK

SEQ ID NO: 3143697 - protein, 6 aa, Giardia lamblia
TQQPHP

SEQ ID NO: 3143698 - protein, 31 aa, Giardia lamblia
TQQRSNLEEESTELDSDNSAVGDADPNAART

SEQ ID NO: 3143699 - protein, 16 aa, Giardia lamblia
TQQSASSASPAARQMN

SEQ ID NO: 3143700 - protein, 20 aa, Giardia lamblia
TQQSGSSSSLHEQQSFTTEE

SEQ ID NO: 3143701 - protein, 17 aa, Giardia lamblia
TQQTKEADVDGDVQPQR

SEQ ID NO: 3143702 - protein, 12 aa, Giardia lamblia
TQREHRQPKDVA

SEQ ID NO: 3143703 - protein, 11 aa, Giardia lamblia
TQRGANTGQHD

SEQ ID NO: 3143704 - protein, 10 aa, Giardia lamblia
TQRGEVDGCG

SEQ ID NO: 3143705 - protein, 6 aa, Giardia lamblia
TQRGHS

SEQ ID NO: 3143706 - protein, 8 aa, Giardia lamblia
TQRKTPTV

SEQ ID NO: 3143707 - protein, 10 aa, Giardia lamblia
TQRNSTARES

SEQ ID NO: 3143708 - protein, 11 aa, Giardia lamblia
TQRPGSLAGNA

SEQ ID NO: 3143709 - protein, 21 aa, Giardia lamblia
TQRPRSARDTSNLSASKKETL

SEQ ID NO: 3143710 - protein, 5 aa, Giardia lamblia
TQRQP

SEQ ID NO: 3143711 - protein, 5 aa, Giardia lamblia
TQRRM

SEQ ID NO: 3143712 - protein, 7 aa, Giardia lamblia
TQRRTAG

SEQ ID NO: 3143713 - protein, 5 aa, Giardia lamblia
TQRSE

SEQ ID NO: 3143714 - protein, 7 aa, Giardia lamblia
TQSDPGC

SEQ ID NO: 3143715 - protein, 12 aa, Giardia lamblia
TQSDRASSSDDF

SEQ ID NO: 3143716 - protein, 13 aa, Giardia lamblia
TQSDTPDSSSSLP

SEQ ID NO: 3143717 - protein, 7 aa, Giardia lamblia
TQSGMRN

SEQ ID NO: 3143718 - protein, 5 aa, Giardia lamblia
TQSHR

SEQ ID NO: 3143719 - protein, 4 aa, Giardia lamblia
TQSI

SEQ ID NO: 3143720 - protein, 5 aa, Giardia lamblia
TQSIP

SEQ ID NO: 3143721 - protein, 11 aa, Giardia lamblia
TQSKQKNDMGK

SEQ ID NO: 3143722 - protein, 14 aa, Giardia lamblia
TQSPHGKDSGAHEA

SEQ ID NO: 3143723 - protein, 7 aa, Giardia lamblia
TQSQSHY

SEQ ID NO: 3143724 - protein, 29 aa, Giardia lamblia
TQSQSSTEEQATITSSDLKKPSSAFTKNS

SEQ ID NO: 3143725 - protein, 5 aa, Giardia lamblia
TQSRR

SEQ ID NO: 3143726 - protein, 10 aa, Giardia lamblia
TQSSEKAQSI

SEQ ID NO: 3143727 - protein, 7 aa, Giardia lamblia
TQSSIDK

SEQ ID NO: 3143728 - protein, 15 aa, Giardia lamblia
TQSSVGSLDNESDQQ

SEQ ID NO: 3143729 - protein, 5 aa, Giardia lamblia
TQSTE

SEQ ID NO: 3143730 - protein, 16 aa, Giardia lamblia
TQSTLDESGELRSRPV

SEQ ID NO: 3143731 - protein, 9 aa, Giardia lamblia
TQSTSKTSP

SEQ ID NO: 3143732 - protein, 8 aa, Giardia lamblia
TQSVDDLT

SEQ ID NO: 3143733 - protein, 14 aa, Giardia lamblia
TQSVSSYTNKQQTH

SEQ ID NO: 3143734 - protein, 5 aa, Giardia lamblia
TQSYR

SEQ ID NO: 3143735 - protein, 9 aa, Giardia lamblia
TQTADLKKA

SEQ ID NO: 3143736 - protein, 13 aa, Giardia lamblia
TQTAPLPDRNEQH

SEQ ID NO: 3143737 - protein, 15 aa, Giardia lamblia
TQTASDGSSKEVSDL

SEQ ID NO: 3143738 - protein, 14 aa, Giardia lamblia
TQTEPGKQLAKYGN

SEQ ID NO: 3143739 - protein, 4 aa, Giardia lamblia
TQTF

SEQ ID NO: 3143740 - protein, 4 aa, Giardia lamblia
TQTG

SEQ ID NO: 3143741 - protein, 6 aa, Giardia lamblia
TQTLKQ

SEQ ID NO: 3143742 - protein, 18 aa, Giardia lamblia
TQTNHPPKLSDSKSTDNV

SEQ ID NO: 3143743 - protein, 4 aa, Giardia lamblia
TQTP

SEQ ID NO: 3143744 - protein, 5 aa, Giardia lamblia
TQTPL

SEQ ID NO: 3143745 - protein, 21 aa, Giardia lamblia
TQTPRATSRTPKTQVKSTGVP

SEQ ID NO: 3143746 - protein, 8 aa, Giardia lamblia
TQTQNTNK

SEQ ID NO: 3143747 - protein, 9 aa, Giardia lamblia
TQTSNEHQA

SEQ ID NO: 3143748 - protein, 13 aa, Giardia lamblia
TQTTRKPVSADEV

SEQ ID NO: 3143749 - protein, 14 aa, Giardia lamblia
TQTVIDDGKRASSG

SEQ ID NO: 3143750 - protein, 5 aa, Giardia lamblia
TQTYK

SEQ ID NO: 3143751 - protein, 10 aa, Giardia lamblia
TQVDQETAAR

SEQ ID NO: 3143752 - protein, 5 aa, Giardia lamblia
TQYAK

SEQ ID NO: 3143753 - protein, 4 aa, Giardia lamblia
TQYK

SEQ ID NO: 3143754 - protein, 5 aa, Giardia lamblia
TQYSG

SEQ ID NO: 3143755 - protein, 8 aa, Giardia lamblia
TRADSNDT

SEQ ID NO: 3143756 - protein, 4 aa, Giardia lamblia
TRAE

SEQ ID NO: 3143757 - protein, 12 aa, Giardia lamblia
TRAEGERLTESK

SEQ ID NO: 3143758 - protein, 7 aa, Giardia lamblia
TRAETDK

SEQ ID NO: 3143759 - protein, 10 aa, Giardia lamblia
TRAGNTKRNR

SEQ ID NO: 3143760 - protein, 7 aa, Giardia lamblia
TRAGVST

SEQ ID NO: 3143761 - protein, 16 aa, Giardia lamblia
TRAKQQDIKGQRQGIK

SEQ ID NO: 3143762 - protein, 8 aa, Giardia lamblia
TRANNSEA

SEQ ID NO: 3143763 - protein, 9 aa, Giardia lamblia
TRAQERETE

SEQ ID NO: 3143764 - protein, 7 aa, Giardia lamblia
TRAQGGY

SEQ ID NO: 3143765 - protein, 20 aa, Giardia lamblia
TRAQSTSQHAASRAARPLNS

SEQ ID NO: 3143766 - protein, 13 aa, Giardia lamblia
TRARASLNQRAQE

SEQ ID NO: 3143767 - protein, 38 aa, Giardia lamblia
TRARPSMTGHAGNNYQPAPDNPYISASSPNPPSGTRAF

SEQ ID NO: 3143768 - protein, 9 aa, Giardia lamblia
TRASAPSLS

SEQ ID NO: 3143769 - protein, 13 aa, Giardia lamblia
TRASEAEVSAGTD

SEQ ID NO: 3143770 - protein, 9 aa, Giardia lamblia
TRASEQGSI

SEQ ID NO: 3143771 - protein, 7 aa, Giardia lamblia
TRASGRQ

SEQ ID NO: 3143772 - protein, 11 aa, Giardia lamblia
TRASNKSPALA

SEQ ID NO: 3143773 - protein, 23 aa, Giardia lamblia
TRASSIGAVSGSRLSVDSSKTLD

SEQ ID NO: 3143774 - protein, 10 aa, Giardia lamblia
TRASTAPDIP

SEQ ID NO: 3143775 - protein, 10 aa, Giardia lamblia
TRASVKPTMR

SEQ ID NO: 3143776 - protein, 9 aa, Giardia lamblia
TRATAGRCQ

SEQ ID NO: 3143777 - protein, 23 aa, Giardia lamblia
TRATNRSGIAQDTATAGEVPGPG

SEQ ID NO: 3143778 - protein, 12 aa, Giardia lamblia
TRATSEGISSRH

SEQ ID NO: 3143779 - protein, 15 aa, Giardia lamblia
TRCEEDVDKQKAYYD

SEQ ID NO: 3143780 - protein, 5 aa, Giardia lamblia
TRCER

SEQ ID NO: 3143781 - protein, 7 aa, Giardia lamblia
TRDDNEE

SEQ ID NO: 3143782 - protein, 7 aa, Giardia lamblia
TRDESLN

SEQ ID NO: 3143783 - protein, 4 aa, Giardia lamblia
TRDG

SEQ ID NO: 3143784 - protein, 5 aa, Giardia lamblia
TRDGS

SEQ ID NO: 3143785 - protein, 13 aa, Giardia lamblia
TRDHASQKQPHLT

SEQ ID NO: 3143786 - protein, 8 aa, Giardia lamblia
TRDHKGRT

SEQ ID NO: 3143787 - protein, 4 aa, Giardia lamblia
TRDK

SEQ ID NO: 3143788 - protein, 5 aa, Giardia lamblia
TRDKR

SEQ ID NO: 3143789 - protein, 5 aa, Giardia lamblia
TRDLG

SEQ ID NO: 3143790 - protein, 5 aa, Giardia lamblia
TRDNR

SEQ ID NO: 3143791 - protein, 6 aa, Giardia lamblia
TRDPEE

SEQ ID NO: 3143792 - protein, 7 aa, Giardia lamblia
TRDPSQY

SEQ ID NO: 3143793 - protein, 16 aa, Giardia lamblia
TRDPTAVAEKSSITTP

SEQ ID NO: 3143794 - protein, 10 aa, Giardia lamblia
TRDRKEGTAH

SEQ ID NO: 3143795 - protein, 24 aa, Giardia lamblia
TRDRLDESTRGSVSGRPRSRGDMS

SEQ ID NO: 3143796 - protein, 8 aa, Giardia lamblia
TRDSDPVT

SEQ ID NO: 3143797 - protein, 5 aa, Giardia lamblia
TRDSG

SEQ ID NO: 3143798 - protein, 4 aa, Giardia lamblia
TRDT

SEQ ID NO: 3143799 - protein, 8 aa, Giardia lamblia
TRDTQTYS

SEQ ID NO: 3143800 - protein, 6 aa, Giardia lamblia
TREAAS

SEQ ID NO: 3143801 - protein, 7 aa, Giardia lamblia
TREAGET

SEQ ID NO: 3143802 - protein, 6 aa, Giardia lamblia
TREAVE

SEQ ID NO: 3143803 - protein, 9 aa, Giardia lamblia
TREEDGQTL

SEQ ID NO: 3143804 - protein, 5 aa, Giardia lamblia
TREER

SEQ ID NO: 3143805 - protein, 6 aa, Giardia lamblia
TREGNT

SEQ ID NO: 3143806 - protein, 5 aa, Giardia lamblia
TREGQ

SEQ ID NO: 3143807 - protein, 14 aa, Giardia lamblia
TREISNRKDQDSTV

SEQ ID NO: 3143808 - protein, 8 aa, Giardia lamblia
TREKTEQA

SEQ ID NO: 3143809 - protein, 4 aa, Giardia lamblia
TREL

SEQ ID NO: 3143810 - protein, 6 aa, Giardia lamblia
TRENQK

SEQ ID NO: 3143811 - protein, 5 aa, Giardia lamblia
TREPA

SEQ ID NO: 3143812 - protein, 6 aa, Giardia lamblia
TREPPA

SEQ ID NO: 3143813 - protein, 4 aa, Giardia lamblia
TREQ

SEQ ID NO: 3143814 - protein, 11 aa, Giardia lamblia
TREQDQSNRTA

SEQ ID NO: 3143815 - protein, 13 aa, Giardia lamblia
TREQLAEKTGFQR

SEQ ID NO: 3143816 - protein, 6 aa, Giardia lamblia
TREQRP

SEQ ID NO: 3143817 - protein, 8 aa, Giardia lamblia
TREQVSEM

SEQ ID NO: 3143818 - protein, 8 aa, Giardia lamblia
TRERQRTM

SEQ ID NO: 3143819 - protein, 17 aa, Giardia lamblia
TRETPTPASASSSISAS

SEQ ID NO: 3143820 - protein, 7 aa, Giardia lamblia
TRETTKY

SEQ ID NO: 3143821 - protein, 4 aa, Giardia lamblia
TREV

SEQ ID NO: 3143822 - protein, 20 aa, Giardia lamblia
TRFPARKRTRENSRSQRPEF

SEQ ID NO: 3143823 - protein, 11 aa, Giardia lamblia
TRGAPTSPAAA

SEQ ID NO: 3143824 - protein, 13 aa, Giardia lamblia
TRGCPVQNKKRVE

SEQ ID NO: 3143825 - protein, 9 aa, Giardia lamblia
TRGENVSRE

SEQ ID NO: 3143826 - protein, 4 aa, Giardia lamblia
TRGH

SEQ ID NO: 3143827 - protein, 12 aa, Giardia lamblia
TRGKERQDSQST

SEQ ID NO: 3143828 - protein, 11 aa, Giardia lamblia
TRGKSSSYRTR

SEQ ID NO: 3143829 - protein, 5 aa, Giardia lamblia
TRGMP

SEQ ID NO: 3143830 - protein, 7 aa, Giardia lamblia
TRGNPDG

SEQ ID NO: 3143831 - protein, 4 aa, Giardia lamblia
TRGP

SEQ ID NO: 3143832 - protein, 27 aa, Giardia lamblia
TRGPRESNLAGNREESAEHEDCQSTPV

SEQ ID NO: 3143833 - protein, 5 aa, Giardia lamblia
TRGQT

SEQ ID NO: 3143834 - protein, 5 aa, Giardia lamblia
TRGRA

SEQ ID NO: 3143835 - protein, 14 aa, Giardia lamblia
TRGRGWGGGSLPER

SEQ ID NO: 3143836 - protein, 5 aa, Giardia lamblia
TRGRQ

SEQ ID NO: 3143837 - protein, 5 aa, Giardia lamblia
TRGSA

SEQ ID NO: 3143838 - protein, 21 aa, Giardia lamblia
TRGSAEQRLSKNESSKELNET

SEQ ID NO: 3143839 - protein, 6 aa, Giardia lamblia
TRGSAT

SEQ ID NO: 3143840 - protein, 9 aa, Giardia lamblia
TRGSKSYIA

SEQ ID NO: 3143841 - protein, 9 aa, Giardia lamblia
TRGTDDPSA

SEQ ID NO: 3143842 - protein, 7 aa, Giardia lamblia
TRGTSRL

SEQ ID NO: 3143843 - protein, 4 aa, Giardia lamblia
TRGY

SEQ ID NO: 3143844 - protein, 5 aa, Giardia lamblia
TRGYE

SEQ ID NO: 3143845 - protein, 5 aa, Giardia lamblia
TRGYT

SEQ ID NO: 3143846 - protein, 8 aa, Giardia lamblia
TRHKPEPK

SEQ ID NO: 3143847 - protein, 13 aa, Giardia lamblia
TRHNSEHKRKDEG

SEQ ID NO: 3143848 - protein, 6 aa, Giardia lamblia
TRHQTV

SEQ ID NO: 3143849 - protein, 22 aa, Giardia lamblia
TRHSLQGKQKNSHIAPPPSSTV

SEQ ID NO: 3143850 - protein, 4 aa, Giardia lamblia
TRHT

SEQ ID NO: 3143851 - protein, 5 aa, Giardia lamblia
TRIQE

SEQ ID NO: 3143852 - protein, 17 aa, Giardia lamblia
TRIRAGDKVTFLSMVHG

SEQ ID NO: 3143853 - protein, 5 aa, Giardia lamblia
TRISD

SEQ ID NO: 3143854 - protein, 13 aa, Giardia lamblia
TRKASLSSSSESV

SEQ ID NO: 3143855 - protein, 15 aa, Giardia lamblia
TRKDDSESDRETETL

SEQ ID NO: 3143856 - protein, 7 aa, Giardia lamblia
TRKDNDY

SEQ ID NO: 3143857 - protein, 9 aa, Giardia lamblia
TRKDTGKKY

SEQ ID NO: 3143858 - protein, 8 aa, Giardia lamblia
TRKNTSGF

SEQ ID NO: 3143859 - protein, 7 aa, Giardia lamblia
TRKPRLQ

SEQ ID NO: 3143860 - protein, 9 aa, Giardia lamblia
TRKPTWDET

SEQ ID NO: 3143861 - protein, 4 aa, Giardia lamblia
TRKR

SEQ ID NO: 3143862 - protein, 8 aa, Giardia lamblia
TRKRKAQE

SEQ ID NO: 3143863 - protein, 9 aa, Giardia lamblia
TRKSDGAAL

SEQ ID NO: 3143864 - protein, 11 aa, Giardia lamblia
TRKSNARGPMA

SEQ ID NO: 3143865 - protein, 11 aa, Giardia lamblia
TRKSPCGEGTN

SEQ ID NO: 3143866 - protein, 10 aa, Giardia lamblia
TRKSQPESRV

SEQ ID NO: 3143867 - protein, 8 aa, Giardia lamblia
TRKSSREL

SEQ ID NO: 3143868 - protein, 10 aa, Giardia lamblia
TRKSTGHDEI

SEQ ID NO: 3143869 - protein, 8 aa, Giardia lamblia
TRKTPSKA

SEQ ID NO: 3143870 - protein, 8 aa, Giardia lamblia
TRLESNEK

SEQ ID NO: 3143871 - protein, 6 aa, Giardia lamblia
TRLGTR

SEQ ID NO: 3143872 - protein, 8 aa, Giardia lamblia
TRLPNKEK

SEQ ID NO: 3143873 - protein, 10 aa, Giardia lamblia
TRLPSPSVND

SEQ ID NO: 3143874 - protein, 8 aa, Giardia lamblia
TRLPTSSF

SEQ ID NO: 3143875 - protein, 13 aa, Giardia lamblia
TRLRDANEQMSTK

SEQ ID NO: 3143876 - protein, 6 aa, Giardia lamblia
TRLSEG

SEQ ID NO: 3143877 - protein, 6 aa, Giardia lamblia
TRLSKD

SEQ ID NO: 3143878 - protein, 9 aa, Giardia lamblia
TRLSSASEM

SEQ ID NO: 3143879 - protein, 12 aa, Giardia lamblia
TRLTSKSREAAR

SEQ ID NO: 3143880 - protein, 8 aa, Giardia lamblia
TRLTTNEA

SEQ ID NO: 3143881 - protein, 13 aa, Giardia lamblia
TRMEDTNEQALKE

SEQ ID NO: 3143882 - protein, 6 aa, Giardia lamblia
TRNDEL

SEQ ID NO: 3143883 - protein, 7 aa, Giardia lamblia
TRNDPWN

SEQ ID NO: 3143884 - protein, 13 aa, Giardia lamblia
TRNDRLEQKSPQI

SEQ ID NO: 3143885 - protein, 8 aa, Giardia lamblia
TRNETTGE

SEQ ID NO: 3143886 - protein, 6 aa, Giardia lamblia
TRNGSP

SEQ ID NO: 3143887 - protein, 4 aa, Giardia lamblia
TRNK

SEQ ID NO: 3143888 - protein, 4 aa, Giardia lamblia
TRNN

SEQ ID NO: 3143889 - protein, 4 aa, Giardia lamblia
TRNP

SEQ ID NO: 3143890 - protein, 16 aa, Giardia lamblia
TRNQETSCSTLEKNGP

SEQ ID NO: 3143891 - protein, 8 aa, Giardia lamblia
TRNSESAL

SEQ ID NO: 3143892 - protein, 5 aa, Giardia lamblia
TRNSH

SEQ ID NO: 3143893 - protein, 7 aa, Giardia lamblia
TRNSNIK

SEQ ID NO: 3143894 - protein, 5 aa, Giardia lamblia
TRNSS

SEQ ID NO: 3143895 - protein, 19 aa, Giardia lamblia
TRNTGEGHEKLGASGVSTE

SEQ ID NO: 3143896 - protein, 11 aa, Giardia lamblia
TRNVPEGSAAL

SEQ ID NO: 3143897 - protein, 4 aa, Giardia lamblia
TRNY

SEQ ID NO: 3143898 - protein, 4 aa, Giardia lamblia
TRPA

SEQ ID NO: 3143899 - protein, 13 aa, Giardia lamblia
TRPAFSRSDPSGA

SEQ ID NO: 3143900 - protein, 6 aa, Giardia lamblia
TRPAPR

SEQ ID NO: 3143901 - protein, 8 aa, Giardia lamblia
TRPATRDQ

SEQ ID NO: 3143902 - protein, 4 aa, Giardia lamblia
TRPD

SEQ ID NO: 3143903 - protein, 5 aa, Giardia lamblia
TRPEL

SEQ ID NO: 3143904 - protein, 6 aa, Giardia lamblia
TRPETI

SEQ ID NO: 3143905 - protein, 6 aa, Giardia lamblia
TRPGRI

SEQ ID NO: 3143906 - protein, 4 aa, Giardia lamblia
TRPH

SEQ ID NO: 3143907 - protein, 6 aa, Giardia lamblia
TRPHSS

SEQ ID NO: 3143908 - protein, 18 aa, Giardia lamblia
TRPLQGSTVTEKTSVGEG

SEQ ID NO: 3143909 - protein, 12 aa, Giardia lamblia
TRPPASGTITVT

SEQ ID NO: 3143910 - protein, 50 aa, Giardia lamblia
TRPPERPASASDKCPSSANTSINGCTSPDTIEKTGTRGASGGPKRRSTVE

SEQ ID NO: 3143911 - protein, 7 aa, Giardia lamblia
TRPPQVE

SEQ ID NO: 3143912 - protein, 26 aa, Giardia lamblia
TRPPVTNAPAVTNTDAVDKSSQPVVT

SEQ ID NO: 3143913 - protein, 4 aa, Giardia lamblia
TRPQ

SEQ ID NO: 3143914 - protein, 10 aa, Giardia lamblia
TRPQDDQKEF

SEQ ID NO: 3143915 - protein, 6 aa, Giardia lamblia
TRPQER

SEQ ID NO: 3143916 - protein, 6 aa, Giardia lamblia
TRPQGA

SEQ ID NO: 3143917 - protein, 13 aa, Giardia lamblia
TRPRGSDVPQKGR

SEQ ID NO: 3143918 - protein, 7 aa, Giardia lamblia
TRPSEPH

SEQ ID NO: 3143919 - protein, 10 aa, Giardia lamblia
TRPSYFPPAT

SEQ ID NO: 3143920 - protein, 23 aa, Giardia lamblia
TRPVTGCDGTGPRWGYGNPCMTS

SEQ ID NO: 3143921 - protein, 18 aa, Giardia lamblia
TRQAAANLKAREYVETSC

SEQ ID NO: 3143922 - protein, 14 aa, Giardia lamblia
TRQAKEAKSKIAEL

SEQ ID NO: 3143923 - protein, 7 aa, Giardia lamblia
TRQATEI

SEQ ID NO: 3143924 - protein, 14 aa, Giardia lamblia
TRQDPVQSDSYPGV

SEQ ID NO: 3143925 - protein, 7 aa, Giardia lamblia
TRQERNR

SEQ ID NO: 3143926 - protein, 6 aa, Giardia lamblia
TRQGIT

SEQ ID NO: 3143927 - protein, 12 aa, Giardia lamblia
TRQGKHAQAVRP

SEQ ID NO: 3143928 - protein, 15 aa, Giardia lamblia
TRQGSHRGDRPGEAT

SEQ ID NO: 3143929 - protein, 12 aa, Giardia lamblia
TRQHPADQKPTL

SEQ ID NO: 3143930 - protein, 8 aa, Giardia lamblia
TRQNEELK

SEQ ID NO: 3143931 - protein, 9 aa, Giardia lamblia
TRQNNELSA

SEQ ID NO: 3143932 - protein, 6 aa, Giardia lamblia
TRQPYY

SEQ ID NO: 3143933 - protein, 7 aa, Giardia lamblia
TRQRAQQ

SEQ ID NO: 3143934 - protein, 7 aa, Giardia lamblia
TRQRQGD

SEQ ID NO: 3143935 - protein, 18 aa, Giardia lamblia
TRQSQAPWRPDTSLPRDR

SEQ ID NO: 3143936 - protein, 7 aa, Giardia lamblia
TRQTSTK

SEQ ID NO: 3143937 - protein, 16 aa, Giardia lamblia
TRQYSTSLSSNKPSVV

SEQ ID NO: 3143938 - protein, 5 aa, Giardia lamblia
TRRAE

SEQ ID NO: 3143939 - protein, 5 aa, Giardia lamblia
TRREP

SEQ ID NO: 3143940 - protein, 12 aa, Giardia lamblia
TRRKDIGPDGSS

SEQ ID NO: 3143941 - protein, 9 aa, Giardia lamblia
TRRKSNAGI

SEQ ID NO: 3143942 - protein, 9 aa, Giardia lamblia
TRRNEELQA

SEQ ID NO: 3143943 - protein, 13 aa, Giardia lamblia
TRRPSPSRGCSTS

SEQ ID NO: 3143944 - protein, 7 aa, Giardia lamblia
TRRPVQE

SEQ ID NO: 3143945 - protein, 4 aa, Giardia lamblia
TRRQ

SEQ ID NO: 3143946 - protein, 6 aa, Giardia lamblia
TRRQER

SEQ ID NO: 3143947 - protein, 4 aa, Giardia lamblia
TRRT

SEQ ID NO: 3143948 - protein, 7 aa, Giardia lamblia
TRRTPIP

SEQ ID NO: 3143949 - protein, 6 aa, Giardia lamblia
TRRTSL

SEQ ID NO: 3143950 - protein, 19 aa, Giardia lamblia
TRRTSRTASRARKGEKVGG

SEQ ID NO: 3143951 - protein, 5 aa, Giardia lamblia
TRRVK

SEQ ID NO: 3143952 - protein, 19 aa, Giardia lamblia
TRSAQNRGAKPQKQLPNRP

SEQ ID NO: 3143953 - protein, 7 aa, Giardia lamblia
TRSARDA

SEQ ID NO: 3143954 - protein, 7 aa, Giardia lamblia
TRSDGAT

SEQ ID NO: 3143955 - protein, 4 aa, Giardia lamblia
TRSE

SEQ ID NO: 3143956 - protein, 12 aa, Giardia lamblia
TRSERYNPANES

SEQ ID NO: 3143957 - protein, 4 aa, Giardia lamblia
TRSF

SEQ ID NO: 3143958 - protein, 9 aa, Giardia lamblia
TRSGALSEA

SEQ ID NO: 3143959 - protein, 6 aa, Giardia lamblia
TRSGRF

SEQ ID NO: 3143960 - protein, 8 aa, Giardia lamblia
TRSGSALG

SEQ ID NO: 3143961 - protein, 8 aa, Giardia lamblia
TRSGSPGN

SEQ ID NO: 3143962 - protein, 10 aa, Giardia lamblia
TRSHRENPMH

SEQ ID NO: 3143963 - protein, 11 aa, Giardia lamblia
TRSKCTSYTER

SEQ ID NO: 3143964 - protein, 7 aa, Giardia lamblia
TRSKHLR

SEQ ID NO: 3143965 - protein, 9 aa, Giardia lamblia
TRSPSRPNQ

SEQ ID NO: 3143966 - protein, 10 aa, Giardia lamblia
TRSQKSNSRR

SEQ ID NO: 3143967 - protein, 8 aa, Giardia lamblia
TRSQSRTM

SEQ ID NO: 3143968 - protein, 11 aa, Giardia lamblia
TRSQSTTEKSL

SEQ ID NO: 3143969 - protein, 6 aa, Giardia lamblia
TRSRRR

SEQ ID NO: 3143970 - protein, 16 aa, Giardia lamblia
TRSRSELKASAAAQAS

SEQ ID NO: 3143971 - protein, 4 aa, Giardia lamblia
TRSS

SEQ ID NO: 3143972 - protein, 18 aa, Giardia lamblia
TRSSNNPRTQRSSGTHSL

SEQ ID NO: 3143973 - protein, 9 aa, Giardia lamblia
TRSSPGDRV

SEQ ID NO: 3143974 - protein, 11 aa, Giardia lamblia
TRSSPTGSTLR

SEQ ID NO: 3143975 - protein, 12 aa, Giardia lamblia
TRSSSKGKTSSI

SEQ ID NO: 3143976 - protein, 7 aa, Giardia lamblia
TRSTASL

SEQ ID NO: 3143977 - protein, 5 aa, Giardia lamblia
TRSTG

SEQ ID NO: 3143978 - protein, 15 aa, Giardia lamblia
TRSTPDISASNDRRS

SEQ ID NO: 3143979 - protein, 23 aa, Giardia lamblia
TRSVDNEGDDPGDPNEDATQSQM

SEQ ID NO: 3143980 - protein, 9 aa, Giardia lamblia
TRSVSEDSF

SEQ ID NO: 3143981 - protein, 6 aa, Giardia lamblia
TRTDRE

SEQ ID NO: 3143982 - protein, 4 aa, Giardia lamblia
TRTE

SEQ ID NO: 3143983 - protein, 7 aa, Giardia lamblia
TRTHQQR

SEQ ID NO: 3143984 - protein, 8 aa, Giardia lamblia
TRTQDTTK

SEQ ID NO: 3143985 - protein, 7 aa, Giardia lamblia
TRTQETA

SEQ ID NO: 3143986 - protein, 19 aa, Giardia lamblia
TRTQSAARARSQSAPGPIS

SEQ ID NO: 3143987 - protein, 7 aa, Giardia lamblia
TRTRPEI

SEQ ID NO: 3143988 - protein, 7 aa, Giardia lamblia
TRTSDVQ

SEQ ID NO: 3143989 - protein, 10 aa, Giardia lamblia
TRTSTNNSYQ

SEQ ID NO: 3143990 - protein, 14 aa, Giardia lamblia
TRTSTTGPLQSNTE

SEQ ID NO: 3143991 - protein, 17 aa, Giardia lamblia
TRTTSAGLRSSSSSFSS

SEQ ID NO: 3143992 - protein, 6 aa, Giardia lamblia
TRTTTG

SEQ ID NO: 3143993 - protein, 7 aa, Giardia lamblia
TRTTTPV

SEQ ID NO: 3143994 - protein, 6 aa, Giardia lamblia
TRTYTD

SEQ ID NO: 3143995 - protein, 20 aa, Giardia lamblia
TRVDPSDPRRGYEGSIEPKE

SEQ ID NO: 3143996 - protein, 5 aa, Giardia lamblia
TRVKT

SEQ ID NO: 3143997 - protein, 9 aa, Giardia lamblia
TRVNHTPDT

SEQ ID NO: 3143998 - protein, 26 aa, Giardia lamblia
TRVQDSSTCEDSTDSTATSLRSRYSY

SEQ ID NO: 3143999 - protein, 26 aa, Giardia lamblia
TRVRAASGPKNQLAEEPAVRAPSKSK

SEQ ID NO: 3144000 - protein, 13 aa, Giardia lamblia
TRVSEAEADAMPQ

SEQ ID NO: 3144001 - protein, 6 aa, Giardia lamblia
TRVTKS

SEQ ID NO: 3144002 - protein, 10 aa, Giardia lamblia
TRYADKENAR

SEQ ID NO: 3144003 - protein, 12 aa, Giardia lamblia
TRYANSVEKRER

SEQ ID NO: 3144004 - protein, 10 aa, Giardia lamblia
TRYGSAGTGN

SEQ ID NO: 3144005 - protein, 5 aa, Giardia lamblia
TRYSR

SEQ ID NO: 3144006 - protein, 11 aa, Giardia lamblia
TSAALNASATE

SEQ ID NO: 3144007 - protein, 12 aa, Giardia lamblia
TSADSALSETEQ

SEQ ID NO: 3144008 - protein, 8 aa, Giardia lamblia
TSAENHPG

SEQ ID NO: 3144009 - protein, 8 aa, Giardia lamblia
TSAEPKVE

SEQ ID NO: 3144010 - protein, 5 aa, Giardia lamblia
TSAES

SEQ ID NO: 3144011 - protein, 9 aa, Giardia lamblia
TSAETAYDD

SEQ ID NO: 3144012 - protein, 6 aa, Giardia lamblia
TSAEYN

SEQ ID NO: 3144013 - protein, 12 aa, Giardia lamblia
TSAGDLAPQDLE

SEQ ID NO: 3144014 - protein, 9 aa, Giardia lamblia
TSAGETGKD

SEQ ID NO: 3144015 - protein, 33 aa, Giardia lamblia
TSAGGPRPRPKTPLSDTSGLGGDSKPSKNPNSF

SEQ ID NO: 3144016 - protein, 6 aa, Giardia lamblia
TSAGKT

SEQ ID NO: 3144017 - protein, 8 aa, Giardia lamblia
TSAGKTTV

SEQ ID NO: 3144018 - protein, 20 aa, Giardia lamblia
TSAGSACTGQPLRDKILEPQ

SEQ ID NO: 3144019 - protein, 12 aa, Giardia lamblia
TSAHGDVSQESE

SEQ ID NO: 3144020 - protein, 13 aa, Giardia lamblia
TSAIRPPDDIDSY

SEQ ID NO: 3144021 - protein, 14 aa, Giardia lamblia
TSAKQSLSEPKPLP

SEQ ID NO: 3144022 - protein, 8 aa, Giardia lamblia
TSAKSEVA

SEQ ID NO: 3144023 - protein, 5 aa, Giardia lamblia
TSALP

SEQ ID NO: 3144024 - protein, 10 aa, Giardia lamblia
TSAPSTPRGG

SEQ ID NO: 3144025 - protein, 9 aa, Giardia lamblia
TSAQPQARV

SEQ ID NO: 3144026 - protein, 18 aa, Giardia lamblia
TSARAADTGAVETTRQAE

SEQ ID NO: 3144027 - protein, 43 aa, Giardia lamblia
TSASAGASCDGASETSTHCSSPHRAGSQGCTRATSCCPRMSDR

SEQ ID NO: 3144028 - protein, 5 aa, Giardia lamblia
TSASD

SEQ ID NO: 3144029 - protein, 19 aa, Giardia lamblia
TSASHKADSSHATARNTVT

SEQ ID NO: 3144030 - protein, 8 aa, Giardia lamblia
TSASPQHK

SEQ ID NO: 3144031 - protein, 9 aa, Giardia lamblia
TSASQLANE

SEQ ID NO: 3144032 - protein, 8 aa, Giardia lamblia
TSASSVAH

SEQ ID NO: 3144033 - protein, 35 aa, Giardia lamblia
TSATKAPRKTIARKAARKTASSTSGIKKTGRKKQG

SEQ ID NO: 3144034 - protein, 32 aa, Giardia lamblia
TSATRPAAHAQASIAEGKASTLTRSQDPDTLP

SEQ ID NO: 3144035 - protein, 6 aa, Giardia lamblia
TSATVA

SEQ ID NO: 3144036 - protein, 7 aa, Giardia lamblia
TSAVPAD

SEQ ID NO: 3144037 - protein, 5 aa, Giardia lamblia
TSAVQ

SEQ ID NO: 3144038 - protein, 9 aa, Giardia lamblia
TSCDPQGET

SEQ ID NO: 3144039 - protein, 14 aa, Giardia lamblia
TSCSSPQLRGVSPQ

SEQ ID NO: 3144040 - protein, 6 aa, Giardia lamblia
TSCTSP

SEQ ID NO: 3144041 - protein, 17 aa, Giardia lamblia
TSDAQTEARLSVGSRSQ

SEQ ID NO: 3144042 - protein, 7 aa, Giardia lamblia
TSDARRH

SEQ ID NO: 3144043 - protein, 5 aa, Giardia lamblia
TSDAV

SEQ ID NO: 3144044 - protein, 43 aa, Giardia lamblia
TSDCSYDSEEETDSEGGDDLQEDDTCKAQPGVPSDGSANVTNT

SEQ ID NO: 3144045 - protein, 4 aa, Giardia lamblia
TSDD

SEQ ID NO: 3144046 - protein, 9 aa, Giardia lamblia
TSDDDVTDK

SEQ ID NO: 3144047 - protein, 9 aa, Giardia lamblia
TSDDIDDVD

SEQ ID NO: 3144048 - protein, 5 aa, Giardia lamblia
TSDDW

SEQ ID NO: 3144049 - protein, 7 aa, Giardia lamblia
TSDEEED

SEQ ID NO: 3144050 - protein, 7 aa, Giardia lamblia
TSDEKRI

SEQ ID NO: 3144051 - protein, 4 aa, Giardia lamblia
TSDG

SEQ ID NO: 3144052 - protein, 6 aa, Giardia lamblia
TSDISG

SEQ ID NO: 3144053 - protein, 7 aa, Giardia lamblia
TSDKDLK

SEQ ID NO: 3144054 - protein, 28 aa, Giardia lamblia
TSDLERSNASLKNKQDIVEQQQKTYDKC

SEQ ID NO: 3144055 - protein, 5 aa, Giardia lamblia
TSDLQ

SEQ ID NO: 3144056 - protein, 16 aa, Giardia lamblia
TSDMQTALKSAEDAFT

SEQ ID NO: 3144057 - protein, 8 aa, Giardia lamblia
TSDNAEAF

SEQ ID NO: 3144058 - protein, 6 aa, Giardia lamblia
TSDNVD

SEQ ID NO: 3144059 - protein, 6 aa, Giardia lamblia
TSDPKI

SEQ ID NO: 3144060 - protein, 8 aa, Giardia lamblia
TSDPRERD

SEQ ID NO: 3144061 - protein, 6 aa, Giardia lamblia
TSDPYR

SEQ ID NO: 3144062 - protein, 4 aa, Giardia lamblia
TSDR

SEQ ID NO: 3144063 - protein, 7 aa, Giardia lamblia
TSDREEL

SEQ ID NO: 3144064 - protein, 25 aa, Giardia lamblia
TSDRGRDERERDASTPISASTTQFK

SEQ ID NO: 3144065 - protein, 16 aa, Giardia lamblia
TSDRSKISVTPSVGQI

SEQ ID NO: 3144066 - protein, 9 aa, Giardia lamblia
TSDSASYQE

SEQ ID NO: 3144067 - protein, 11 aa, Giardia lamblia
TSDSKSGVPSS

SEQ ID NO: 3144068 - protein, 5 aa, Giardia lamblia
TSDTS

SEQ ID NO: 3144069 - protein, 10 aa, Giardia lamblia
TSDTSKNDYS

SEQ ID NO: 3144070 - protein, 12 aa, Giardia lamblia
TSDVTGANRRKM

SEQ ID NO: 3144071 - protein, 5 aa, Giardia lamblia
TSDYS

SEQ ID NO: 3144072 - protein, 9 aa, Giardia lamblia
TSEARAHDP

SEQ ID NO: 3144073 - protein, 13 aa, Giardia lamblia
TSEARDQANNQGF

SEQ ID NO: 3144074 - protein, 13 aa, Giardia lamblia
TSEAVSDKIKVLK

SEQ ID NO: 3144075 - protein, 6 aa, Giardia lamblia
TSEDIE

SEQ ID NO: 3144076 - protein, 6 aa, Giardia lamblia
TSEDIR

SEQ ID NO: 3144077 - protein, 10 aa, Giardia lamblia
TSEDKVQGNY

SEQ ID NO: 3144078 - protein, 16 aa, Giardia lamblia
TSEDTASQSRENSESV

SEQ ID NO: 3144079 - protein, 14 aa, Giardia lamblia
TSEEEREKGKTVEC

SEQ ID NO: 3144080 - protein, 25 aa, Giardia lamblia
TSEEHKQKLEELSRANDALARENAR

SEQ ID NO: 3144081 - protein, 5 aa, Giardia lamblia
TSEFT

SEQ ID NO: 3144082 - protein, 4 aa, Giardia lamblia
TSEG

SEQ ID NO: 3144083 - protein, 7 aa, Giardia lamblia
TSEGAPV

SEQ ID NO: 3144084 - protein, 14 aa, Giardia lamblia
TSEGCASSSARNQR

SEQ ID NO: 3144085 - protein, 9 aa, Giardia lamblia
TSEGRDGDK

SEQ ID NO: 3144086 - protein, 6 aa, Giardia lamblia
TSEHDV

SEQ ID NO: 3144087 - protein, 6 aa, Giardia lamblia
TSEIKT

SEQ ID NO: 3144088 - protein, 10 aa, Giardia lamblia
TSEKISDATY

SEQ ID NO: 3144089 - protein, 11 aa, Giardia lamblia
TSELTSQRDSS

SEQ ID NO: 3144090 - protein, 7 aa, Giardia lamblia
TSEPLPP

SEQ ID NO: 3144091 - protein, 9 aa, Giardia lamblia
TSEPPYETA

SEQ ID NO: 3144092 - protein, 7 aa, Giardia lamblia
TSEPQPL

SEQ ID NO: 3144093 - protein, 6 aa, Giardia lamblia
TSEQDA

SEQ ID NO: 3144094 - protein, 4 aa, Giardia lamblia
TSER

SEQ ID NO: 3144095 - protein, 7 aa, Giardia lamblia
TSEREAG

SEQ ID NO: 3144096 - protein, 21 aa, Giardia lamblia
TSERETRNCPTISSKASTEIL

SEQ ID NO: 3144097 - protein, 18 aa, Giardia lamblia
TSERKETTTWSSDTTPYK

SEQ ID NO: 3144098 - protein, 6 aa, Giardia lamblia
TSERTV

SEQ ID NO: 3144099 - protein, 6 aa, Giardia lamblia
TSETAA

SEQ ID NO: 3144100 - protein, 5 aa, Giardia lamblia
TSETI

SEQ ID NO: 3144101 - protein, 17 aa, Giardia lamblia
TSETPGDATSTTAASNI

SEQ ID NO: 3144102 - protein, 40 aa, Giardia lamblia
TSEVERSAYGSMNNTRRDRKYERARSNQTRCKTPYTTETD

SEQ ID NO: 3144103 - protein, 5 aa, Giardia lamblia
TSEVN

SEQ ID NO: 3144104 - protein, 10 aa, Giardia lamblia
TSEYSGAKSE

SEQ ID NO: 3144105 - protein, 7 aa, Giardia lamblia
TSFGESI

SEQ ID NO: 3144106 - protein, 11 aa, Giardia lamblia
TSFNSSTSSSM

SEQ ID NO: 3144107 - protein, 7 aa, Giardia lamblia
TSFPQDA

SEQ ID NO: 3144108 - protein, 10 aa, Giardia lamblia
TSFRTTGEGA

SEQ ID NO: 3144109 - protein, 8 aa, Giardia lamblia
TSFSPASD

SEQ ID NO: 3144110 - protein, 18 aa, Giardia lamblia
TSFSSASHCPTDEATDNT

SEQ ID NO: 3144111 - protein, 9 aa, Giardia lamblia
TSFSSSCSQ

SEQ ID NO: 3144112 - protein, 14 aa, Giardia lamblia
TSFTDRAHTAQPSH

SEQ ID NO: 3144113 - protein, 9 aa, Giardia lamblia
TSFTPRGGS

SEQ ID NO: 3144114 - protein, 8 aa, Giardia lamblia
TSGADNNS

SEQ ID NO: 3144115 - protein, 14 aa, Giardia lamblia
TSGAGGAGTSLTSS

SEQ ID NO: 3144116 - protein, 11 aa, Giardia lamblia
TSGASSAASIQ

SEQ ID NO: 3144117 - protein, 16 aa, Giardia lamblia
TSGDGTALANSSGEVT

SEQ ID NO: 3144118 - protein, 9 aa, Giardia lamblia
TSGDSMDTE

SEQ ID NO: 3144119 - protein, 9 aa, Giardia lamblia
TSGEAAYED

SEQ ID NO: 3144120 - protein, 10 aa, Giardia lamblia
TSGERLNADE

SEQ ID NO: 3144121 - protein, 4 aa, Giardia lamblia
TSGG

SEQ ID NO: 3144122 - protein, 8 aa, Giardia lamblia
TSGGGRGL

SEQ ID NO: 3144123 - protein, 5 aa, Giardia lamblia
TSGGI

SEQ ID NO: 3144124 - protein, 11 aa, Giardia lamblia
TSGGTSAERYG

SEQ ID NO: 3144125 - protein, 5 aa, Giardia lamblia
TSGHD

SEQ ID NO: 3144126 - protein, 5 aa, Giardia lamblia
TSGIA

SEQ ID NO: 3144127 - protein, 28 aa, Giardia lamblia
TSGIPESYAKPPTTLAPNKQQTSESPDL

SEQ ID NO: 3144128 - protein, 11 aa, Giardia lamblia
TSGKGSSAAGL

SEQ ID NO: 3144129 - protein, 10 aa, Giardia lamblia
TSGKPLASND

SEQ ID NO: 3144130 - protein, 10 aa, Giardia lamblia
TSGKSTSAVG

SEQ ID NO: 3144131 - protein, 4 aa, Giardia lamblia
TSGL

SEQ ID NO: 3144132 - protein, 9 aa, Giardia lamblia
TSGLGTQRD

SEQ ID NO: 3144133 - protein, 6 aa, Giardia lamblia
TSGNTT

SEQ ID NO: 3144134 - protein, 12 aa, Giardia lamblia
TSGPHSARPVQT

SEQ ID NO: 3144135 - protein, 19 aa, Giardia lamblia
TSGPTETLYPEASANESVD

SEQ ID NO: 3144136 - protein, 6 aa, Giardia lamblia
TSGRPC

SEQ ID NO: 3144137 - protein, 11 aa, Giardia lamblia
TSGSANPEPHV

SEQ ID NO: 3144138 - protein, 8 aa, Giardia lamblia
TSGSEGCP

SEQ ID NO: 3144139 - protein, 8 aa, Giardia lamblia
TSGSGDAL

SEQ ID NO: 3144140 - protein, 16 aa, Giardia lamblia
TSGSMEKLSSSTGNAD

SEQ ID NO: 3144141 - protein, 8 aa, Giardia lamblia
TSGSQYGD

SEQ ID NO: 3144142 - protein, 9 aa, Giardia lamblia
TSGTEAPWK

SEQ ID NO: 3144143 - protein, 6 aa, Giardia lamblia
TSGTIG

SEQ ID NO: 3144144 - protein, 20 aa, Giardia lamblia
TSGTLPVEDPGRSATTLPGS

SEQ ID NO: 3144145 - protein, 33 aa, Giardia lamblia
TSGTQPGPDESSAAAEVSQTPNFNDSDQKGEPV

SEQ ID NO: 3144146 - protein, 11 aa, Giardia lamblia
TSGTTSAMSDG

SEQ ID NO: 3144147 - protein, 21 aa, Giardia lamblia
TSGVQQQTEALQQEDKPGNDS

SEQ ID NO: 3144148 - protein, 4 aa, Giardia lamblia
TSHA

SEQ ID NO: 3144149 - protein, 4 aa, Giardia lamblia
TSHD

SEQ ID NO: 3144150 - protein, 5 aa, Giardia lamblia
TSHDI

SEQ ID NO: 3144151 - protein, 13 aa, Giardia lamblia
TSHEQLKRASQRE

SEQ ID NO: 3144152 - protein, 4 aa, Giardia lamblia
TSHG

SEQ ID NO: 3144153 - protein, 11 aa, Giardia lamblia
TSHGPSPLTES

SEQ ID NO: 3144154 - protein, 10 aa, Giardia lamblia
TSHKSEEISK

SEQ ID NO: 3144155 - protein, 27 aa, Giardia lamblia
TSHRSRTNQHLSSDSMHASANSSGLYD

SEQ ID NO: 3144156 - protein, 4 aa, Giardia lamblia
TSIA

SEQ ID NO: 3144157 - protein, 4 aa, Giardia lamblia
TSID

SEQ ID NO: 3144158 - protein, 5 aa, Giardia lamblia
TSIDD

SEQ ID NO: 3144159 - protein, 7 aa, Giardia lamblia
TSIEQER

SEQ ID NO: 3144160 - protein, 7 aa, Giardia lamblia
TSIESGL

SEQ ID NO: 3144161 - protein, 16 aa, Giardia lamblia
TSIHNEQDALQAEEDG

SEQ ID NO: 3144162 - protein, 6 aa, Giardia lamblia
TSINSS

SEQ ID NO: 3144163 - protein, 6 aa, Giardia lamblia
TSIPPE

SEQ ID NO: 3144164 - protein, 9 aa, Giardia lamblia
TSISKTTQA

SEQ ID NO: 3144165 - protein, 6 aa, Giardia lamblia
TSISSR

SEQ ID NO: 3144166 - protein, 6 aa, Giardia lamblia
TSISST

SEQ ID NO: 3144167 - protein, 10 aa, Giardia lamblia
TSISTAREPQ

SEQ ID NO: 3144168 - protein, 4 aa, Giardia lamblia
TSIT

SEQ ID NO: 3144169 - protein, 6 aa, Giardia lamblia
TSITGK

SEQ ID NO: 3144170 - protein, 6 aa, Giardia lamblia
TSITRE

SEQ ID NO: 3144171 - protein, 4 aa, Giardia lamblia
TSKA

SEQ ID NO: 3144172 - protein, 10 aa, Giardia lamblia
TSKANDMDQT

SEQ ID NO: 3144173 - protein, 9 aa, Giardia lamblia
TSKDNVNSK

SEQ ID NO: 3144174 - protein, 5 aa, Giardia lamblia
TSKDP

SEQ ID NO: 3144175 - protein, 12 aa, Giardia lamblia
TSKDPAKPLPSA

SEQ ID NO: 3144176 - protein, 7 aa, Giardia lamblia
TSKFPQS

SEQ ID NO: 3144177 - protein, 39 aa, Giardia lamblia
TSKGDTAQVNTNDSDSDLDIKSAAKAKPKTKRTKKTIET

SEQ ID NO: 3144178 - protein, 19 aa, Giardia lamblia
TSKGIQKSPSVSMSTTSAL

SEQ ID NO: 3144179 - protein, 64 aa, Giardia lamblia
TSKKHRNAQKESAATDAPTKATINSENVERTEPRKRRRAIQEGTPDESIEKGEACEGGSKNSHQ

SEQ ID NO: 3144180 - protein, 8 aa, Giardia lamblia
TSKKSHQV

SEQ ID NO: 3144181 - protein, 15 aa, Giardia lamblia
TSKPGIKLERPRSHG

SEQ ID NO: 3144182 - protein, 29 aa, Giardia lamblia
TSKPRLNKPSQGLQPTRKGREDSVTSPFS

SEQ ID NO: 3144183 - protein, 9 aa, Giardia lamblia
TSKPTTATA

SEQ ID NO: 3144184 - protein, 10 aa, Giardia lamblia
TSKRDDRSYH

SEQ ID NO: 3144185 - protein, 7 aa, Giardia lamblia
TSKRQSE

SEQ ID NO: 3144186 - protein, 4 aa, Giardia lamblia
TSKS

SEQ ID NO: 3144187 - protein, 7 aa, Giardia lamblia
TSKSANI

SEQ ID NO: 3144188 - protein, 9 aa, Giardia lamblia
TSKSKQREL

SEQ ID NO: 3144189 - protein, 39 aa, Giardia lamblia
TSKSNDKSSKASSARNSTSGASSRHNSGHATTRGSANNY

SEQ ID NO: 3144190 - protein, 12 aa, Giardia lamblia
TSKSPKAWHYSG

SEQ ID NO: 3144191 - protein, 14 aa, Giardia lamblia
TSKTETQQGQAKTH

SEQ ID NO: 3144192 - protein, 15 aa, Giardia lamblia
TSKYEPQEQKEYGMG

SEQ ID NO: 3144193 - protein, 8 aa, Giardia lamblia
TSLAENGE

SEQ ID NO: 3144194 - protein, 9 aa, Giardia lamblia
TSLAKSRAA

SEQ ID NO: 3144195 - protein, 13 aa, Giardia lamblia
TSLEKQNRELEGQ

SEQ ID NO: 3144196 - protein, 4 aa, Giardia lamblia
TSLG

SEQ ID NO: 3144197 - protein, 11 aa, Giardia lamblia
TSLKDEKAEAA

SEQ ID NO: 3144198 - protein, 14 aa, Giardia lamblia
TSLNHSKDSVSQED

SEQ ID NO: 3144199 - protein, 20 aa, Giardia lamblia
TSLNKGKAESSSREELDREA

SEQ ID NO: 3144200 - protein, 26 aa, Giardia lamblia
TSLNSDDPHAFGDTSEKTTSSPNVAG

SEQ ID NO: 3144201 - protein, 4 aa, Giardia lamblia
TSLP

SEQ ID NO: 3144202 - protein, 8 aa, Giardia lamblia
TSLQEAEA

SEQ ID NO: 3144203 - protein, 7 aa, Giardia lamblia
TSLQPGK

SEQ ID NO: 3144204 - protein, 7 aa, Giardia lamblia
TSLREEA

SEQ ID NO: 3144205 - protein, 15 aa, Giardia lamblia
TSLRGSEKAGGSQFQ

SEQ ID NO: 3144206 - protein, 7 aa, Giardia lamblia
TSLSGEV

SEQ ID NO: 3144207 - protein, 8 aa, Giardia lamblia
TSLSGKTL

SEQ ID NO: 3144208 - protein, 5 aa, Giardia lamblia
TSLSK

SEQ ID NO: 3144209 - protein, 14 aa, Giardia lamblia
TSLSKQQRDKVAGQ

SEQ ID NO: 3144210 - protein, 9 aa, Giardia lamblia
TSLSQTESI

SEQ ID NO: 3144211 - protein, 6 aa, Giardia lamblia
TSLTAP

SEQ ID NO: 3144212 - protein, 9 aa, Giardia lamblia
TSLTDDETS

SEQ ID NO: 3144213 - protein, 6 aa, Giardia lamblia
TSLTNA

SEQ ID NO: 3144214 - protein, 6 aa, Giardia lamblia
TSLVES

SEQ ID NO: 3144215 - protein, 7 aa, Giardia lamblia
TSMEEQS

SEQ ID NO: 3144216 - protein, 11 aa, Giardia lamblia
TSMERQTRQQM

SEQ ID NO: 3144217 - protein, 8 aa, Giardia lamblia
TSMGNTTH

SEQ ID NO: 3144218 - protein, 7 aa, Giardia lamblia
TSMGPNG

SEQ ID NO: 3144219 - protein, 6 aa, Giardia lamblia
TSMKQK

SEQ ID NO: 3144220 - protein, 4 aa, Giardia lamblia
TSMS

SEQ ID NO: 3144221 - protein, 10 aa, Giardia lamblia
TSMSDPSNCN

SEQ ID NO: 3144222 - protein, 6 aa, Giardia lamblia
TSMTAQ

SEQ ID NO: 3144223 - protein, 19 aa, Giardia lamblia
TSMTSECSGENKQQTDGGT

SEQ ID NO: 3144224 - protein, 5 aa, Giardia lamblia
TSNAK

SEQ ID NO: 3144225 - protein, 4 aa, Giardia lamblia
TSND

SEQ ID NO: 3144226 - protein, 7 aa, Giardia lamblia
TSNDGST

SEQ ID NO: 3144227 - protein, 15 aa, Giardia lamblia
TSNDSARIYEDGTAN

SEQ ID NO: 3144228 - protein, 13 aa, Giardia lamblia
TSNEGSSVNPSSV

SEQ ID NO: 3144229 - protein, 5 aa, Giardia lamblia
TSNEY

SEQ ID NO: 3144230 - protein, 9 aa, Giardia lamblia
TSNGKLTVT

SEQ ID NO: 3144231 - protein, 6 aa, Giardia lamblia
TSNGTL

SEQ ID NO: 3144232 - protein, 6 aa, Giardia lamblia
TSNIGA

SEQ ID NO: 3144233 - protein, 5 aa, Giardia lamblia
TSNLN

SEQ ID NO: 3144234 - protein, 4 aa, Giardia lamblia
TSNR

SEQ ID NO: 3144235 - protein, 15 aa, Giardia lamblia
TSNRSLQKAETEIKS

SEQ ID NO: 3144236 - protein, 36 aa, Giardia lamblia
TSNRSPMGEQGSCRKSHTVEARSPRQTGSHKSAQSC

SEQ ID NO: 3144237 - protein, 9 aa, Giardia lamblia
TSNSAALNR

SEQ ID NO: 3144238 - protein, 7 aa, Giardia lamblia
TSNSPHA

SEQ ID NO: 3144239 - protein, 38 aa, Giardia lamblia
TSNSQQEQRRLPQSRPMSPPPVEDVRPRKVPPQNNPSI

SEQ ID NO: 3144240 - protein, 13 aa, Giardia lamblia
TSNSSEFYTSQSQ

SEQ ID NO: 3144241 - protein, 5 aa, Giardia lamblia
TSNTD

SEQ ID NO: 3144242 - protein, 5 aa, Giardia lamblia
TSNTN

SEQ ID NO: 3144243 - protein, 6 aa, Giardia lamblia
TSNTPY

SEQ ID NO: 3144244 - protein, 5 aa, Giardia lamblia
TSNTQ

SEQ ID NO: 3144245 - protein, 6 aa, Giardia lamblia
TSNVKS

SEQ ID NO: 3144246 - protein, 8 aa, Giardia lamblia
TSPASNTM

SEQ ID NO: 3144247 - protein, 17 aa, Giardia lamblia
TSPDDMSSSETDLTDSE

SEQ ID NO: 3144248 - protein, 6 aa, Giardia lamblia
TSPDSP

SEQ ID NO: 3144249 - protein, 11 aa, Giardia lamblia
TSPEAGDTVDN

SEQ ID NO: 3144250 - protein, 7 aa, Giardia lamblia
TSPEAMA

SEQ ID NO: 3144251 - protein, 5 aa, Giardia lamblia
TSPED

SEQ ID NO: 3144252 - protein, 18 aa, Giardia lamblia
TSPEHRTFNQNSTHTQQD

SEQ ID NO: 3144253 - protein, 32 aa, Giardia lamblia
TSPEKGSSVPAAEIHSSSSRELPREVFFASRL

SEQ ID NO: 3144254 - protein, 21 aa, Giardia lamblia
TSPELTEEHDSVTRYRQQASK

SEQ ID NO: 3144255 - protein, 13 aa, Giardia lamblia
TSPGSVHASNPGM

SEQ ID NO: 3144256 - protein, 10 aa, Giardia lamblia
TSPIRPRSPV

SEQ ID NO: 3144257 - protein, 7 aa, Giardia lamblia
TSPISPP

SEQ ID NO: 3144258 - protein, 7 aa, Giardia lamblia
TSPLDQA

SEQ ID NO: 3144259 - protein, 15 aa, Giardia lamblia
TSPMETNRYAQGNNN

SEQ ID NO: 3144260 - protein, 10 aa, Giardia lamblia
TSPNNKVDDV

SEQ ID NO: 3144261 - protein, 14 aa, Giardia lamblia
TSPPASPDRSALTA

SEQ ID NO: 3144262 - protein, 9 aa, Giardia lamblia
TSPPDKCGR

SEQ ID NO: 3144263 - protein, 6 aa, Giardia lamblia
TSPPPY

SEQ ID NO: 3144264 - protein, 5 aa, Giardia lamblia
TSPPY

SEQ ID NO: 3144265 - protein, 22 aa, Giardia lamblia
TSPQETIASPPAGSTAPAAEPV

SEQ ID NO: 3144266 - protein, 4 aa, Giardia lamblia
TSPR

SEQ ID NO: 3144267 - protein, 5 aa, Giardia lamblia
TSPRK

SEQ ID NO: 3144268 - protein, 9 aa, Giardia lamblia
TSPSGAAQT

SEQ ID NO: 3144269 - protein, 15 aa, Giardia lamblia
TSPSHDQQPVGDVSG

SEQ ID NO: 3144270 - protein, 7 aa, Giardia lamblia
TSPSKLE

SEQ ID NO: 3144271 - protein, 10 aa, Giardia lamblia
TSPSLPQSAQ

SEQ ID NO: 3144272 - protein, 6 aa, Giardia lamblia
TSPTCT

SEQ ID NO: 3144273 - protein, 9 aa, Giardia lamblia
TSPTHNGEI

SEQ ID NO: 3144274 - protein, 14 aa, Giardia lamblia
TSPTKSTRVGSQLP

SEQ ID NO: 3144275 - protein, 5 aa, Giardia lamblia
TSPTN

SEQ ID NO: 3144276 - protein, 31 aa, Giardia lamblia
TSPTQSRNPDLTKTSSTRKGTSTVKSPSKTL

SEQ ID NO: 3144277 - protein, 10 aa, Giardia lamblia
TSPTRKSGGP

SEQ ID NO: 3144278 - protein, 5 aa, Giardia lamblia
TSPYR

SEQ ID NO: 3144279 - protein, 24 aa, Giardia lamblia
TSQAWPSASRGESTFNSDASRQPG

SEQ ID NO: 3144280 - protein, 15 aa, Giardia lamblia
TSQEVTSANELEKRA

SEQ ID NO: 3144281 - protein, 8 aa, Giardia lamblia
TSQGAIKP

SEQ ID NO: 3144282 - protein, 7 aa, Giardia lamblia
TSQGETV

SEQ ID NO: 3144283 - protein, 7 aa, Giardia lamblia
TSQGPAT

SEQ ID NO: 3144284 - protein, 21 aa, Giardia lamblia
TSQGQNALQRAGRGGAQKQQL

SEQ ID NO: 3144285 - protein, 6 aa, Giardia lamblia
TSQHTQ

SEQ ID NO: 3144286 - protein, 35 aa, Giardia lamblia
TSQLEGTDYCGRSTRESSHSSSSHHQSTRSRKGVA

SEQ ID NO: 3144287 - protein, 12 aa, Giardia lamblia
TSQLESSAQVDE

SEQ ID NO: 3144288 - protein, 8 aa, Giardia lamblia
TSQNKNAS

SEQ ID NO: 3144289 - protein, 9 aa, Giardia lamblia
TSQNQASSR

SEQ ID NO: 3144290 - protein, 7 aa, Giardia lamblia
TSQNSNL

SEQ ID NO: 3144291 - protein, 12 aa, Giardia lamblia
TSQNYEKEKHME

SEQ ID NO: 3144292 - protein, 8 aa, Giardia lamblia
TSQPESPY

SEQ ID NO: 3144293 - protein, 24 aa, Giardia lamblia
TSQQPAPMQQPQNGTDDDKELAGS

SEQ ID NO: 3144294 - protein, 10 aa, Giardia lamblia
TSQRSTDARE

SEQ ID NO: 3144295 - protein, 12 aa, Giardia lamblia
TSQRSVHTAQGL

SEQ ID NO: 3144296 - protein, 13 aa, Giardia lamblia
TSQRVRESALGTP

SEQ ID NO: 3144297 - protein, 11 aa, Giardia lamblia
TSQSAPCDSEF

SEQ ID NO: 3144298 - protein, 10 aa, Giardia lamblia
TSQSDPNYAT

SEQ ID NO: 3144299 - protein, 7 aa, Giardia lamblia
TSRAVQT

SEQ ID NO: 3144300 - protein, 9 aa, Giardia lamblia
TSRDGRRDY

SEQ ID NO: 3144301 - protein, 9 aa, Giardia lamblia
TSRGASVPS

SEQ ID NO: 3144302 - protein, 8 aa, Giardia lamblia
TSRGPIPV

SEQ ID NO: 3144303 - protein, 8 aa, Giardia lamblia
TSRGTGPV

SEQ ID NO: 3144304 - protein, 7 aa, Giardia lamblia
TSRHTQS

SEQ ID NO: 3144305 - protein, 64 aa, Giardia lamblia
TSRKSPSPPPVPAKSPSGVGGSTPSRSPRGSQVSQFGGKSPTSHRSPAASHRDASVRNQSFRDQ

SEQ ID NO: 3144306 - protein, 5 aa, Giardia lamblia
TSRLT

SEQ ID NO: 3144307 - protein, 9 aa, Giardia lamblia
TSRNPSSRL

SEQ ID NO: 3144308 - protein, 10 aa, Giardia lamblia
TSRPEGLEKK

SEQ ID NO: 3144309 - protein, 5 aa, Giardia lamblia
TSRPI

SEQ ID NO: 3144310 - protein, 8 aa, Giardia lamblia
TSRQNRRA

SEQ ID NO: 3144311 - protein, 4 aa, Giardia lamblia
TSRR

SEQ ID NO: 3144312 - protein, 5 aa, Giardia lamblia
TSRRE

SEQ ID NO: 3144313 - protein, 13 aa, Giardia lamblia
TSRRKCDGSGPVC

SEQ ID NO: 3144314 - protein, 7 aa, Giardia lamblia
TSRRTPG

SEQ ID NO: 3144315 - protein, 5 aa, Giardia lamblia
TSRSC

SEQ ID NO: 3144316 - protein, 12 aa, Giardia lamblia
TSRSGNSSEDLS

SEQ ID NO: 3144317 - protein, 8 aa, Giardia lamblia
TSRTSTQM

SEQ ID NO: 3144318 - protein, 5 aa, Giardia lamblia
TSRVG

SEQ ID NO: 3144319 - protein, 4 aa, Giardia lamblia
TSRY

SEQ ID NO: 3144320 - protein, 20 aa, Giardia lamblia
TSSAAHSTLRSPTEGSASGF

SEQ ID NO: 3144321 - protein, 8 aa, Giardia lamblia
TSSADGYT

SEQ ID NO: 3144322 - protein, 7 aa, Giardia lamblia
TSSADQT

SEQ ID NO: 3144323 - protein, 12 aa, Giardia lamblia
TSSANTDTRPKR

SEQ ID NO: 3144324 - protein, 15 aa, Giardia lamblia
TSSARKSMNQNKRPI

SEQ ID NO: 3144325 - protein, 7 aa, Giardia lamblia
TSSASLK

SEQ ID NO: 3144326 - protein, 8 aa, Giardia lamblia
TSSDHSAW

SEQ ID NO: 3144327 - protein, 5 aa, Giardia lamblia
TSSDV

SEQ ID NO: 3144328 - protein, 18 aa, Giardia lamblia
TSSEGSIDDSHGEPTYSV

SEQ ID NO: 3144329 - protein, 28 aa, Giardia lamblia
TSSEKNKVRGTDMSDKSEGDGAPEAEAK

SEQ ID NO: 3144330 - protein, 12 aa, Giardia lamblia
TSSESSESSYKR

SEQ ID NO: 3144331 - protein, 8 aa, Giardia lamblia
TSSEYDTH

SEQ ID NO: 3144332 - protein, 7 aa, Giardia lamblia
TSSFSQP

SEQ ID NO: 3144333 - protein, 8 aa, Giardia lamblia
TSSGEQVV

SEQ ID NO: 3144334 - protein, 10 aa, Giardia lamblia
TSSGGKEDTR

SEQ ID NO: 3144335 - protein, 10 aa, Giardia lamblia
TSSGRKDADL

SEQ ID NO: 3144336 - protein, 33 aa, Giardia lamblia
TSSGSPITSSNVSTNSTHRTGHKVNSDVPLRST

SEQ ID NO: 3144337 - protein, 7 aa, Giardia lamblia
TSSGTTA

SEQ ID NO: 3144338 - protein, 15 aa, Giardia lamblia
TSSHDSSREGGTSAE

SEQ ID NO: 3144339 - protein, 10 aa, Giardia lamblia
TSSHVSSSQR

SEQ ID NO: 3144340 - protein, 4 aa, Giardia lamblia
TSSK

SEQ ID NO: 3144341 - protein, 10 aa, Giardia lamblia
TSSKEEIDYA

SEQ ID NO: 3144342 - protein, 10 aa, Giardia lamblia
TSSKKGNTDN

SEQ ID NO: 3144343 - protein, 36 aa, Giardia lamblia
TSSKPSDCPPSTGSAEAQSNIRSGGPSSRESRSVNQ

SEQ ID NO: 3144344 - protein, 10 aa, Giardia lamblia
TSSKSGENVE

SEQ ID NO: 3144345 - protein, 5 aa, Giardia lamblia
TSSLE

SEQ ID NO: 3144346 - protein, 20 aa, Giardia lamblia
TSSLKKNAPRTSVSSATQSI

SEQ ID NO: 3144347 - protein, 6 aa, Giardia lamblia
TSSLPG

SEQ ID NO: 3144348 - protein, 6 aa, Giardia lamblia
TSSNER

SEQ ID NO: 3144349 - protein, 9 aa, Giardia lamblia
TSSNGEIDD

SEQ ID NO: 3144350 - protein, 13 aa, Giardia lamblia
TSSNLTKASLGPY

SEQ ID NO: 3144351 - protein, 5 aa, Giardia lamblia
TSSNN

SEQ ID NO: 3144352 - protein, 4 aa, Giardia lamblia
TSSP

SEQ ID NO: 3144353 - protein, 6 aa, Giardia lamblia
TSSPDV

SEQ ID NO: 3144354 - protein, 6 aa, Giardia lamblia
TSSPLA

SEQ ID NO: 3144355 - protein, 15 aa, Giardia lamblia
TSSPPRIKRAGGDVT

SEQ ID NO: 3144356 - protein, 8 aa, Giardia lamblia
TSSPPTHA

SEQ ID NO: 3144357 - protein, 9 aa, Giardia lamblia
TSSPQITST

SEQ ID NO: 3144358 - protein, 10 aa, Giardia lamblia
TSSPRSGSYK

SEQ ID NO: 3144359 - protein, 13 aa, Giardia lamblia
TSSPVPESLQSSS

SEQ ID NO: 3144360 - protein, 6 aa, Giardia lamblia
TSSPYT

SEQ ID NO: 3144361 - protein, 29 aa, Giardia lamblia
TSSQGEEPVSEPDPNNEDSASIPKQPERK

SEQ ID NO: 3144362 - protein, 6 aa, Giardia lamblia
TSSQPM

SEQ ID NO: 3144363 - protein, 17 aa, Giardia lamblia
TSSQTEEPEYLPEERNG

SEQ ID NO: 3144364 - protein, 10 aa, Giardia lamblia
TSSRSPAAVQ

SEQ ID NO: 3144365 - protein, 5 aa, Giardia lamblia
TSSRY

SEQ ID NO: 3144366 - protein, 31 aa, Giardia lamblia
TSSSASQSLRSRVAQTPASIHTGKNTRYGRK

SEQ ID NO: 3144367 - protein, 6 aa, Giardia lamblia
TSSSAV

SEQ ID NO: 3144368 - protein, 5 aa, Giardia lamblia
TSSSE

SEQ ID NO: 3144369 - protein, 17 aa, Giardia lamblia
TSSSFTADAASKTSATM

SEQ ID NO: 3144370 - protein, 8 aa, Giardia lamblia
TSSSPSYS

SEQ ID NO: 3144371 - protein, 9 aa, Giardia lamblia
TSSSQYSLK

SEQ ID NO: 3144372 - protein, 7 aa, Giardia lamblia
TSSSSTA

SEQ ID NO: 3144373 - protein, 8 aa, Giardia lamblia
TSSSYEDR

SEQ ID NO: 3144374 - protein, 17 aa, Giardia lamblia
TSSTADPSSATIAGGHE

SEQ ID NO: 3144375 - protein, 5 aa, Giardia lamblia
TSSTE

SEQ ID NO: 3144376 - protein, 7 aa, Giardia lamblia
TSSTHVN

SEQ ID NO: 3144377 - protein, 8 aa, Giardia lamblia
TSSTQDSD

SEQ ID NO: 3144378 - protein, 43 aa, Giardia lamblia
TSSTRTDASLNNSDTASVRSVQSGTHLDASSDEKASSLPPANL

SEQ ID NO: 3144379 - protein, 20 aa, Giardia lamblia
TSSTSQGAGPTSELSSTGDT

SEQ ID NO: 3144380 - protein, 16 aa, Giardia lamblia
TSSTTSPDKASSNQCV

SEQ ID NO: 3144381 - protein, 5 aa, Giardia lamblia
TSSVR

SEQ ID NO: 3144382 - protein, 6 aa, Giardia lamblia
TSSVSS

SEQ ID NO: 3144383 - protein, 23 aa, Giardia lamblia
TSSWGDPKVEEGLTTTTTKVEGS

SEQ ID NO: 3144384 - protein, 7 aa, Giardia lamblia
TSSYSGL

SEQ ID NO: 3144385 - protein, 10 aa, Giardia lamblia
TSTALRPPGI

SEQ ID NO: 3144386 - protein, 10 aa, Giardia lamblia
TSTAPSLDDA

SEQ ID NO: 3144387 - protein, 6 aa, Giardia lamblia
TSTAVS

SEQ ID NO: 3144388 - protein, 9 aa, Giardia lamblia
TSTDDENDF

SEQ ID NO: 3144389 - protein, 5 aa, Giardia lamblia
TSTDE

SEQ ID NO: 3144390 - protein, 29 aa, Giardia lamblia
TSTDEVTKTEKSLKTKASKKSNADSQPVL

SEQ ID NO: 3144391 - protein, 9 aa, Giardia lamblia
TSTDGSRRL

SEQ ID NO: 3144392 - protein, 6 aa, Giardia lamblia
TSTDKY

SEQ ID NO: 3144393 - protein, 5 aa, Giardia lamblia
TSTDL

SEQ ID NO: 3144394 - protein, 8 aa, Giardia lamblia
TSTDRPTV

SEQ ID NO: 3144395 - protein, 8 aa, Giardia lamblia
TSTEESRT

SEQ ID NO: 3144396 - protein, 4 aa, Giardia lamblia
TSTG

SEQ ID NO: 3144397 - protein, 5 aa, Giardia lamblia
TSTGE

SEQ ID NO: 3144398 - protein, 7 aa, Giardia lamblia
TSTGHHS

SEQ ID NO: 3144399 - protein, 14 aa, Giardia lamblia
TSTGMHKAGGAKAE

SEQ ID NO: 3144400 - protein, 4 aa, Giardia lamblia
TSTH

SEQ ID NO: 3144401 - protein, 9 aa, Giardia lamblia
TSTHNPDEL

SEQ ID NO: 3144402 - protein, 4 aa, Giardia lamblia
TSTI

SEQ ID NO: 3144403 - protein, 11 aa, Giardia lamblia
TSTKKNGISGA

SEQ ID NO: 3144404 - protein, 7 aa, Giardia lamblia
TSTKSSS

SEQ ID NO: 3144405 - protein, 16 aa, Giardia lamblia
TSTKTTKDSTPPSSVV

SEQ ID NO: 3144406 - protein, 8 aa, Giardia lamblia
TSTLDSQK

SEQ ID NO: 3144407 - protein, 6 aa, Giardia lamblia
TSTNLN

SEQ ID NO: 3144408 - protein, 23 aa, Giardia lamblia
TSTNPSASKVSREACSNRDGDVS

SEQ ID NO: 3144409 - protein, 33 aa, Giardia lamblia
TSTNRRIEPSEDYAGTYKSRATTRDFDDDLSDI

SEQ ID NO: 3144410 - protein, 9 aa, Giardia lamblia
TSTNVQTTQ

SEQ ID NO: 3144411 - protein, 7 aa, Giardia lamblia
TSTPITN

SEQ ID NO: 3144412 - protein, 6 aa, Giardia lamblia
TSTPQE

SEQ ID NO: 3144413 - protein, 10 aa, Giardia lamblia
TSTPTGSQQL

SEQ ID NO: 3144414 - protein, 6 aa, Giardia lamblia
TSTRVQ

SEQ ID NO: 3144415 - protein, 18 aa, Giardia lamblia
TSTSCHSSVTDKHTHSYG

SEQ ID NO: 3144416 - protein, 14 aa, Giardia lamblia
TSTSNDSVLPETQG

SEQ ID NO: 3144417 - protein, 8 aa, Giardia lamblia
TSTSNRQE

SEQ ID NO: 3144418 - protein, 18 aa, Giardia lamblia
TSTSSSASVPCSSSTTPS

SEQ ID NO: 3144419 - protein, 11 aa, Giardia lamblia
TSTSSTSTQDH

SEQ ID NO: 3144420 - protein, 9 aa, Giardia lamblia
TSTTGDLRG

SEQ ID NO: 3144421 - protein, 57 aa, Giardia lamblia
TSTTRRPSLTRASSSVQSRSRQKLSSTSSQPRSLSRNTGTGRTAPRPAGQNTDQPLA

SEQ ID NO: 3144422 - protein, 6 aa, Giardia lamblia
TSVAPN

SEQ ID NO: 3144423 - protein, 10 aa, Giardia lamblia
TSVATTRANS

SEQ ID NO: 3144424 - protein, 10 aa, Giardia lamblia
TSVDPNQERV

SEQ ID NO: 3144425 - protein, 10 aa, Giardia lamblia
TSVERTEGAN

SEQ ID NO: 3144426 - protein, 12 aa, Giardia lamblia
TSVESDFSTSDI

SEQ ID NO: 3144427 - protein, 9 aa, Giardia lamblia
TSVGKRATS

SEQ ID NO: 3144428 - protein, 30 aa, Giardia lamblia
TSVGSAKSRMESGTSPNYAASGTGDPSNKT

SEQ ID NO: 3144429 - protein, 5 aa, Giardia lamblia
TSVKS

SEQ ID NO: 3144430 - protein, 8 aa, Giardia lamblia
TSVPDDPI

SEQ ID NO: 3144431 - protein, 5 aa, Giardia lamblia
TSVPR

SEQ ID NO: 3144432 - protein, 6 aa, Giardia lamblia
TSVPTT

SEQ ID NO: 3144433 - protein, 8 aa, Giardia lamblia
TSVQPPKW

SEQ ID NO: 3144434 - protein, 17 aa, Giardia lamblia
TSVQRTSSAESRPNNQT

SEQ ID NO: 3144435 - protein, 12 aa, Giardia lamblia
TSVRTGDSEKDK

SEQ ID NO: 3144436 - protein, 5 aa, Giardia lamblia
TSVSE

SEQ ID NO: 3144437 - protein, 26 aa, Giardia lamblia
TSVSKRNTTTSPTTGYSADEISDTTG

SEQ ID NO: 3144438 - protein, 11 aa, Giardia lamblia
TSVSSSSRSGV

SEQ ID NO: 3144439 - protein, 12 aa, Giardia lamblia
TSVSTDCASTQL

SEQ ID NO: 3144440 - protein, 8 aa, Giardia lamblia
TSVTGTRE

SEQ ID NO: 3144441 - protein, 9 aa, Giardia lamblia
TSVVPSQMN

SEQ ID NO: 3144442 - protein, 17 aa, Giardia lamblia
TSWGGGTEKATRKTSQA

SEQ ID NO: 3144443 - protein, 4 aa, Giardia lamblia
TSYA

SEQ ID NO: 3144444 - protein, 4 aa, Giardia lamblia
TSYD

SEQ ID NO: 3144445 - protein, 21 aa, Giardia lamblia
TSYDTGDVSLPSANGSSTLSS

SEQ ID NO: 3144446 - protein, 9 aa, Giardia lamblia
TSYNGSTTY

SEQ ID NO: 3144447 - protein, 5 aa, Giardia lamblia
TSYPR

SEQ ID NO: 3144448 - protein, 8 aa, Giardia lamblia
TSYSNNSD

SEQ ID NO: 3144449 - protein, 14 aa, Giardia lamblia
TSYTNSPLPRTDLE

SEQ ID NO: 3144450 - protein, 5 aa, Giardia lamblia
TSYTQ

SEQ ID NO: 3144451 - protein, 10 aa, Giardia lamblia
TSYTSEDFTE

SEQ ID NO: 3144452 - protein, 6 aa, Giardia lamblia
TTAAGR

SEQ ID NO: 3144453 - protein, 22 aa, Giardia lamblia
TTAAPPAQGTNQSTAKGPPSYA

SEQ ID NO: 3144454 - protein, 5 aa, Giardia lamblia
TTAAR

SEQ ID NO: 3144455 - protein, 11 aa, Giardia lamblia
TTAASEKGYTM

SEQ ID NO: 3144456 - protein, 12 aa, Giardia lamblia
TTAEEQTEVEGA

SEQ ID NO: 3144457 - protein, 9 aa, Giardia lamblia
TTAEKNTLA

SEQ ID NO: 3144458 - protein, 6 aa, Giardia lamblia
TTAKAS

SEQ ID NO: 3144459 - protein, 22 aa, Giardia lamblia
TTAKEADIDGPSKEDDATDASA

SEQ ID NO: 3144460 - protein, 8 aa, Giardia lamblia
TTAKPRFD

SEQ ID NO: 3144461 - protein, 4 aa, Giardia lamblia
TTAL

SEQ ID NO: 3144462 - protein, 5 aa, Giardia lamblia
TTANE

SEQ ID NO: 3144463 - protein, 22 aa, Giardia lamblia
TTANGVGNGANGDFAEQEPKPV

SEQ ID NO: 3144464 - protein, 9 aa, Giardia lamblia
TTANPSAHK

SEQ ID NO: 3144465 - protein, 9 aa, Giardia lamblia
TTAPAKTLQ

SEQ ID NO: 3144466 - protein, 12 aa, Giardia lamblia
TTAPLGDTDSTI

SEQ ID NO: 3144467 - protein, 59 aa, Giardia lamblia
TTAPPHVRGKTPTSTAQPPRPEKTYPSDKRKAAPPGSQSSDCVRSNSTSGSATSPGSFT

SEQ ID NO: 3144468 - protein, 12 aa, Giardia lamblia
TTAPRAAGPRQF

SEQ ID NO: 3144469 - protein, 8 aa, Giardia lamblia
TTAPRGAY

SEQ ID NO: 3144470 - protein, 14 aa, Giardia lamblia
TTAPTTSATSSQKI

SEQ ID NO: 3144471 - protein, 16 aa, Giardia lamblia
TTAPTVSEVESKPFGD

SEQ ID NO: 3144472 - protein, 12 aa, Giardia lamblia
TTASNRIDPTST

SEQ ID NO: 3144473 - protein, 6 aa, Giardia lamblia
TTASTT

SEQ ID NO: 3144474 - protein, 6 aa, Giardia lamblia
TTATNV

SEQ ID NO: 3144475 - protein, 15 aa, Giardia lamblia
TTATSQPGSLNRKGE

SEQ ID NO: 3144476 - protein, 15 aa, Giardia lamblia
TTATVQQGLPQQASL

SEQ ID NO: 3144477 - protein, 10 aa, Giardia lamblia
TTAVQETENE

SEQ ID NO: 3144478 - protein, 5 aa, Giardia lamblia
TTAVT

SEQ ID NO: 3144479 - protein, 13 aa, Giardia lamblia
TTCGESELGADGV

SEQ ID NO: 3144480 - protein, 6 aa, Giardia lamblia
TTCHQP

SEQ ID NO: 3144481 - protein, 4 aa, Giardia lamblia
TTDA

SEQ ID NO: 3144482 - protein, 9 aa, Giardia lamblia
TTDDVKGSG

SEQ ID NO: 3144483 - protein, 15 aa, Giardia lamblia
TTDEDAMDAGPSAHS

SEQ ID NO: 3144484 - protein, 9 aa, Giardia lamblia
TTDEDDEYY

SEQ ID NO: 3144485 - protein, 8 aa, Giardia lamblia
TTDESTDQ

SEQ ID NO: 3144486 - protein, 6 aa, Giardia lamblia
TTDESV

SEQ ID NO: 3144487 - protein, 14 aa, Giardia lamblia
TTDESVRTETPQQL

SEQ ID NO: 3144488 - protein, 10 aa, Giardia lamblia
TTDGDSSGAT

SEQ ID NO: 3144489 - protein, 11 aa, Giardia lamblia
TTDGPGPAGYT

SEQ ID NO: 3144490 - protein, 11 aa, Giardia lamblia
TTDGPSVSSAD

SEQ ID NO: 3144491 - protein, 6 aa, Giardia lamblia
TTDKEI

SEQ ID NO: 3144492 - protein, 32 aa, Giardia lamblia
TTDKKQEEEEERERSKCPAALPADKNRSKPKL

SEQ ID NO: 3144493 - protein, 12 aa, Giardia lamblia
TTDMTATRAGTP

SEQ ID NO: 3144494 - protein, 5 aa, Giardia lamblia
TTDNG

SEQ ID NO: 3144495 - protein, 7 aa, Giardia lamblia
TTDNGTV

SEQ ID NO: 3144496 - protein, 5 aa, Giardia lamblia
TTDNN

SEQ ID NO: 3144497 - protein, 7 aa, Giardia lamblia
TTDPLNE

SEQ ID NO: 3144498 - protein, 7 aa, Giardia lamblia
TTDPTGR

SEQ ID NO: 3144499 - protein, 5 aa, Giardia lamblia
TTDRT

SEQ ID NO: 3144500 - protein, 14 aa, Giardia lamblia
TTDSRQSQKSSYTL

SEQ ID NO: 3144501 - protein, 8 aa, Giardia lamblia
TTDSSAGL

SEQ ID NO: 3144502 - protein, 12 aa, Giardia lamblia
TTDTMKKQSAER

SEQ ID NO: 3144503 - protein, 7 aa, Giardia lamblia
TTDTPEA

SEQ ID NO: 3144504 - protein, 13 aa, Giardia lamblia
TTDYGSEPPSIDQ

SEQ ID NO: 3144505 - protein, 4 aa, Giardia lamblia
TTEA

SEQ ID NO: 3144506 - protein, 13 aa, Giardia lamblia
TTEAKQQDALNSQ

SEQ ID NO: 3144507 - protein, 17 aa, Giardia lamblia
TTEANHTPTFTSAPPSI

SEQ ID NO: 3144508 - protein, 10 aa, Giardia lamblia
TTEAPSGVRA

SEQ ID NO: 3144509 - protein, 28 aa, Giardia lamblia
TTEASADETVETASKRPSRPYTHNSSST

SEQ ID NO: 3144510 - protein, 22 aa, Giardia lamblia
TTEDQGLDADDAYAHAEKRKLK

SEQ ID NO: 3144511 - protein, 4 aa, Giardia lamblia
TTEE

SEQ ID NO: 3144512 - protein, 11 aa, Giardia lamblia
TTEEATAFAQQ

SEQ ID NO: 3144513 - protein, 10 aa, Giardia lamblia
TTEEEPPRKG

SEQ ID NO: 3144514 - protein, 6 aa, Giardia lamblia
TTEEQE

SEQ ID NO: 3144515 - protein, 6 aa, Giardia lamblia
TTEGEW

SEQ ID NO: 3144516 - protein, 16 aa, Giardia lamblia
TTEGQQSAENNKPQTN

SEQ ID NO: 3144517 - protein, 8 aa, Giardia lamblia
TTEGSTAM

SEQ ID NO: 3144518 - protein, 5 aa, Giardia lamblia
TTEGV

SEQ ID NO: 3144519 - protein, 8 aa, Giardia lamblia
TTEIDQPD

SEQ ID NO: 3144520 - protein, 9 aa, Giardia lamblia
TTEKTDVSR

SEQ ID NO: 3144521 - protein, 8 aa, Giardia lamblia
TTELDEQA

SEQ ID NO: 3144522 - protein, 16 aa, Giardia lamblia
TTELPSPNAARKRAPF

SEQ ID NO: 3144523 - protein, 5 aa, Giardia lamblia
TTENA

SEQ ID NO: 3144524 - protein, 12 aa, Giardia lamblia
TTENLPEDLSSL

SEQ ID NO: 3144525 - protein, 12 aa, Giardia lamblia
TTENNKRATSNE

SEQ ID NO: 3144526 - protein, 23 aa, Giardia lamblia
TTEPAATATATSPIGFGTSPAIG

SEQ ID NO: 3144527 - protein, 7 aa, Giardia lamblia
TTEPSTV

SEQ ID NO: 3144528 - protein, 4 aa, Giardia lamblia
TTER

SEQ ID NO: 3144529 - protein, 5 aa, Giardia lamblia
TTERA

SEQ ID NO: 3144530 - protein, 5 aa, Giardia lamblia
TTERI

SEQ ID NO: 3144531 - protein, 9 aa, Giardia lamblia
TTETNQLSS

SEQ ID NO: 3144532 - protein, 7 aa, Giardia lamblia
TTFDPFD

SEQ ID NO: 3144533 - protein, 12 aa, Giardia lamblia
TTFEKNNTKDFT

SEQ ID NO: 3144534 - protein, 5 aa, Giardia lamblia
TTFPD

SEQ ID NO: 3144535 - protein, 16 aa, Giardia lamblia
TTFPDPATTQQSQGEA

SEQ ID NO: 3144536 - protein, 8 aa, Giardia lamblia
TTGATPVA

SEQ ID NO: 3144537 - protein, 6 aa, Giardia lamblia
TTGATT

SEQ ID NO: 3144538 - protein, 6 aa, Giardia lamblia
TTGAVT

SEQ ID NO: 3144539 - protein, 9 aa, Giardia lamblia
TTGDPKNLN

SEQ ID NO: 3144540 - protein, 8 aa, Giardia lamblia
TTGDSKYC

SEQ ID NO: 3144541 - protein, 4 aa, Giardia lamblia
TTGE

SEQ ID NO: 3144542 - protein, 7 aa, Giardia lamblia
TTGGGGI

SEQ ID NO: 3144543 - protein, 7 aa, Giardia lamblia
TTGGPVK

SEQ ID NO: 3144544 - protein, 11 aa, Giardia lamblia
TTGKHEDEEQL

SEQ ID NO: 3144545 - protein, 6 aa, Giardia lamblia
TTGLET

SEQ ID NO: 3144546 - protein, 8 aa, Giardia lamblia
TTGLSDEN

SEQ ID NO: 3144547 - protein, 5 aa, Giardia lamblia
TTGNL

SEQ ID NO: 3144548 - protein, 5 aa, Giardia lamblia
TTGPG

SEQ ID NO: 3144549 - protein, 22 aa, Giardia lamblia
TTGQEESVSTLSSSVSETPVQD

SEQ ID NO: 3144550 - protein, 6 aa, Giardia lamblia
TTGRPV

SEQ ID NO: 3144551 - protein, 5 aa, Giardia lamblia
TTGRT

SEQ ID NO: 3144552 - protein, 17 aa, Giardia lamblia
TTGSHSHKDRKDLTSMP

SEQ ID NO: 3144553 - protein, 4 aa, Giardia lamblia
TTGT

SEQ ID NO: 3144554 - protein, 5 aa, Giardia lamblia
TTGTR

SEQ ID NO: 3144555 - protein, 24 aa, Giardia lamblia
TTHDSNEDSISDSKVEQSADSTLG

SEQ ID NO: 3144556 - protein, 4 aa, Giardia lamblia
TTHE

SEQ ID NO: 3144557 - protein, 7 aa, Giardia lamblia
TTHETQK

SEQ ID NO: 3144558 - protein, 13 aa, Giardia lamblia
TTHHNSRAYREED

SEQ ID NO: 3144559 - protein, 5 aa, Giardia lamblia
TTHPD

SEQ ID NO: 3144560 - protein, 7 aa, Giardia lamblia
TTHPEAM

SEQ ID NO: 3144561 - protein, 7 aa, Giardia lamblia
TTHPGAA

SEQ ID NO: 3144562 - protein, 27 aa, Giardia lamblia
TTHRDTSDLGLSAASGKRSEKGLEENQ

SEQ ID NO: 3144563 - protein, 10 aa, Giardia lamblia
TTIDSDGDGT

SEQ ID NO: 3144564 - protein, 5 aa, Giardia lamblia
TTIGS

SEQ ID NO: 3144565 - protein, 14 aa, Giardia lamblia
TTIRPTVDASPENP

SEQ ID NO: 3144566 - protein, 7 aa, Giardia lamblia
TTISKTT

SEQ ID NO: 3144567 - protein, 9 aa, Giardia lamblia
TTKAAAHER

SEQ ID NO: 3144568 - protein, 6 aa, Giardia lamblia
TTKAGL

SEQ ID NO: 3144569 - protein, 20 aa, Giardia lamblia
TTKAKSKTSVSTAGSEPEIP

SEQ ID NO: 3144570 - protein, 29 aa, Giardia lamblia
TTKAPTYSSKIPSAVSQQGPQSPGISPDT

SEQ ID NO: 3144571 - protein, 9 aa, Giardia lamblia
TTKATGQQK

SEQ ID NO: 3144572 - protein, 7 aa, Giardia lamblia
TTKDGRA

SEQ ID NO: 3144573 - protein, 25 aa, Giardia lamblia
TTKDGSDILSRPGYAKGRVLDDLIY

SEQ ID NO: 3144574 - protein, 9 aa, Giardia lamblia
TTKEIEENV

SEQ ID NO: 3144575 - protein, 7 aa, Giardia lamblia
TTKEKIT

SEQ ID NO: 3144576 - protein, 5 aa, Giardia lamblia
TTKER

SEQ ID NO: 3144577 - protein, 4 aa, Giardia lamblia
TTKG

SEQ ID NO: 3144578 - protein, 8 aa, Giardia lamblia
TTKGKVET

SEQ ID NO: 3144579 - protein, 8 aa, Giardia lamblia
TTKKGKEA

SEQ ID NO: 3144580 - protein, 10 aa, Giardia lamblia
TTKNSDTVVG

SEQ ID NO: 3144581 - protein, 6 aa, Giardia lamblia
TTKPAN

SEQ ID NO: 3144582 - protein, 6 aa, Giardia lamblia
TTKQEL

SEQ ID NO: 3144583 - protein, 8 aa, Giardia lamblia
TTKQLADA

SEQ ID NO: 3144584 - protein, 6 aa, Giardia lamblia
TTKREN

SEQ ID NO: 3144585 - protein, 4 aa, Giardia lamblia
TTKS

SEQ ID NO: 3144586 - protein, 14 aa, Giardia lamblia
TTKSGLTKTLSPNN

SEQ ID NO: 3144587 - protein, 15 aa, Giardia lamblia
TTKSGNEALNSDPAS

SEQ ID NO: 3144588 - protein, 21 aa, Giardia lamblia
TTKSKPKSVVSTSYHSPDCTG

SEQ ID NO: 3144589 - protein, 5 aa, Giardia lamblia
TTKSQ

SEQ ID NO: 3144590 - protein, 9 aa, Giardia lamblia
TTKSSSDQA

SEQ ID NO: 3144591 - protein, 10 aa, Giardia lamblia
TTKSSVSKAD

SEQ ID NO: 3144592 - protein, 28 aa, Giardia lamblia
TTKSWTQSDNVDNEESKSSSTKKDEESV

SEQ ID NO: 3144593 - protein, 9 aa, Giardia lamblia
TTKVRSKSM

SEQ ID NO: 3144594 - protein, 5 aa, Giardia lamblia
TTLDD

SEQ ID NO: 3144595 - protein, 12 aa, Giardia lamblia
TTLEQSQSQPII

SEQ ID NO: 3144596 - protein, 10 aa, Giardia lamblia
TTLGADNGIG

SEQ ID NO: 3144597 - protein, 8 aa, Giardia lamblia
TTLGADNS

SEQ ID NO: 3144598 - protein, 4 aa, Giardia lamblia
TTLN

SEQ ID NO: 3144599 - protein, 6 aa, Giardia lamblia
TTLNRT

SEQ ID NO: 3144600 - protein, 9 aa, Giardia lamblia
TTLPPTPLS

SEQ ID NO: 3144601 - protein, 6 aa, Giardia lamblia
TTLPQE

SEQ ID NO: 3144602 - protein, 5 aa, Giardia lamblia
TTLPT

SEQ ID NO: 3144603 - protein, 4 aa, Giardia lamblia
TTLR

SEQ ID NO: 3144604 - protein, 4 aa, Giardia lamblia
TTLS

SEQ ID NO: 3144605 - protein, 17 aa, Giardia lamblia
TTLSPTLSSPKADYENS

SEQ ID NO: 3144606 - protein, 25 aa, Giardia lamblia
TTLTGSGCDAGVGDSDGDGDEEKDA

SEQ ID NO: 3144607 - protein, 5 aa, Giardia lamblia
TTMGQ

SEQ ID NO: 3144608 - protein, 4 aa, Giardia lamblia
TTMP

SEQ ID NO: 3144609 - protein, 24 aa, Giardia lamblia
TTNADEPESEEVSAAGAQQSSNKY

SEQ ID NO: 3144610 - protein, 13 aa, Giardia lamblia
TTNATAVRPTTGF

SEQ ID NO: 3144611 - protein, 8 aa, Giardia lamblia
TTNDLGRS

SEQ ID NO: 3144612 - protein, 8 aa, Giardia lamblia
TTNETLEK

SEQ ID NO: 3144613 - protein, 6 aa, Giardia lamblia
TTNFAR

SEQ ID NO: 3144614 - protein, 7 aa, Giardia lamblia
TTNGDGN

SEQ ID NO: 3144615 - protein, 5 aa, Giardia lamblia
TTNKA

SEQ ID NO: 3144616 - protein, 6 aa, Giardia lamblia
TTNKKQ

SEQ ID NO: 3144617 - protein, 27 aa, Giardia lamblia
TTNNDYGDFTQSNKPVYGKPQVAPTSV

SEQ ID NO: 3144618 - protein, 10 aa, Giardia lamblia
TTNPANTKFK

SEQ ID NO: 3144619 - protein, 21 aa, Giardia lamblia
TTNPDQKMPSDTTNKEYGDFR

SEQ ID NO: 3144620 - protein, 4 aa, Giardia lamblia
TTNR

SEQ ID NO: 3144621 - protein, 4 aa, Giardia lamblia
TTNS

SEQ ID NO: 3144622 - protein, 12 aa, Giardia lamblia
TTNSVASSITPA

SEQ ID NO: 3144623 - protein, 11 aa, Giardia lamblia
TTNTAETDTKT

SEQ ID NO: 3144624 - protein, 6 aa, Giardia lamblia
TTNTGY

SEQ ID NO: 3144625 - protein, 6 aa, Giardia lamblia
TTPAPV

SEQ ID NO: 3144626 - protein, 8 aa, Giardia lamblia
TTPASPDA

SEQ ID NO: 3144627 - protein, 4 aa, Giardia lamblia
TTPE

SEQ ID NO: 3144628 - protein, 9 aa, Giardia lamblia
TTPEDCNSK

SEQ ID NO: 3144629 - protein, 18 aa, Giardia lamblia
TTPEDGKKFNATNPYVNR

SEQ ID NO: 3144630 - protein, 6 aa, Giardia lamblia
TTPGEY

SEQ ID NO: 3144631 - protein, 20 aa, Giardia lamblia
TTPGSTNSQSASQANTPGPA

SEQ ID NO: 3144632 - protein, 17 aa, Giardia lamblia
TTPGSTPVASTPSGSGL

SEQ ID NO: 3144633 - protein, 17 aa, Giardia lamblia
TTPHIRTSGGEKSEPHG

SEQ ID NO: 3144634 - protein, 4 aa, Giardia lamblia
TTPI

SEQ ID NO: 3144635 - protein, 17 aa, Giardia lamblia
TTPKSAASARGKPAPPV

SEQ ID NO: 3144636 - protein, 9 aa, Giardia lamblia
TTPKSYRQA

SEQ ID NO: 3144637 - protein, 9 aa, Giardia lamblia
TTPLSTSNS

SEQ ID NO: 3144638 - protein, 4 aa, Giardia lamblia
TTPN

SEQ ID NO: 3144639 - protein, 14 aa, Giardia lamblia
TTPNHEREDARSPL

SEQ ID NO: 3144640 - protein, 12 aa, Giardia lamblia
TTPNYGTQTSKA

SEQ ID NO: 3144641 - protein, 7 aa, Giardia lamblia
TTPPSEV

SEQ ID NO: 3144642 - protein, 22 aa, Giardia lamblia
TTPQGPGDLSASSSNSVRPSHR

SEQ ID NO: 3144643 - protein, 11 aa, Giardia lamblia
TTPSGRQTSVS

SEQ ID NO: 3144644 - protein, 6 aa, Giardia lamblia
TTPSSL

SEQ ID NO: 3144645 - protein, 4 aa, Giardia lamblia
TTPT

SEQ ID NO: 3144646 - protein, 9 aa, Giardia lamblia
TTPTIPDRA

SEQ ID NO: 3144647 - protein, 5 aa, Giardia lamblia
TTPVE

SEQ ID NO: 3144648 - protein, 19 aa, Giardia lamblia
TTQAAKTVNPADKKVPDTV

SEQ ID NO: 3144649 - protein, 16 aa, Giardia lamblia
TTQESMTISGTGSKAY

SEQ ID NO: 3144650 - protein, 5 aa, Giardia lamblia
TTQET

SEQ ID NO: 3144651 - protein, 5 aa, Giardia lamblia
TTQGD

SEQ ID NO: 3144652 - protein, 13 aa, Giardia lamblia
TTQGKKGRGDPGR

SEQ ID NO: 3144653 - protein, 6 aa, Giardia lamblia
TTQGTL

SEQ ID NO: 3144654 - protein, 7 aa, Giardia lamblia
TTQHNPP

SEQ ID NO: 3144655 - protein, 19 aa, Giardia lamblia
TTQIGEETRRLRSRERALE

SEQ ID NO: 3144656 - protein, 9 aa, Giardia lamblia
TTQKPTSLQ

SEQ ID NO: 3144657 - protein, 24 aa, Giardia lamblia
TTQPDTKETNECTPIKQRKRPTSC

SEQ ID NO: 3144658 - protein, 16 aa, Giardia lamblia
TTQPPQPINQDDVPAS

SEQ ID NO: 3144659 - protein, 15 aa, Giardia lamblia
TTQRSVNDEKQRKRE

SEQ ID NO: 3144660 - protein, 15 aa, Giardia lamblia
TTQSELADAAGALQR

SEQ ID NO: 3144661 - protein, 22 aa, Giardia lamblia
TTQTKGAGNTSDLGSKSEHNPG

SEQ ID NO: 3144662 - protein, 8 aa, Giardia lamblia
TTQTMSQS

SEQ ID NO: 3144663 - protein, 13 aa, Giardia lamblia
TTQTPIQSTKADH

SEQ ID NO: 3144664 - protein, 7 aa, Giardia lamblia
TTQTTRT

SEQ ID NO: 3144665 - protein, 12 aa, Giardia lamblia
TTRAPRPGERDG

SEQ ID NO: 3144666 - protein, 18 aa, Giardia lamblia
TTRCKEELSKANDELKEL

SEQ ID NO: 3144667 - protein, 12 aa, Giardia lamblia
TTRGEVSKAADL

SEQ ID NO: 3144668 - protein, 12 aa, Giardia lamblia
TTRGSTKLYGGS

SEQ ID NO: 3144669 - protein, 4 aa, Giardia lamblia
TTRH

SEQ ID NO: 3144670 - protein, 5 aa, Giardia lamblia
TTRIG

SEQ ID NO: 3144671 - protein, 6 aa, Giardia lamblia
TTRLKP

SEQ ID NO: 3144672 - protein, 15 aa, Giardia lamblia
TTRPNLQQSDQTEAL

SEQ ID NO: 3144673 - protein, 18 aa, Giardia lamblia
TTRPYDATAKAAAQGPFS

SEQ ID NO: 3144674 - protein, 4 aa, Giardia lamblia
TTRR

SEQ ID NO: 3144675 - protein, 7 aa, Giardia lamblia
TTRRQAD

SEQ ID NO: 3144676 - protein, 8 aa, Giardia lamblia
TTRTGSSM

SEQ ID NO: 3144677 - protein, 7 aa, Giardia lamblia
TTRTQEI

SEQ ID NO: 3144678 - protein, 6 aa, Giardia lamblia
TTRTTV

SEQ ID NO: 3144679 - protein, 5 aa, Giardia lamblia
TTSAG

SEQ ID NO: 3144680 - protein, 7 aa, Giardia lamblia
TTSDGRT

SEQ ID NO: 3144681 - protein, 4 aa, Giardia lamblia
TTSE

SEQ ID NO: 3144682 - protein, 6 aa, Giardia lamblia
TTSFPE

SEQ ID NO: 3144683 - protein, 4 aa, Giardia lamblia
TTSG

SEQ ID NO: 3144684 - protein, 9 aa, Giardia lamblia
TTSKQARIN

SEQ ID NO: 3144685 - protein, 5 aa, Giardia lamblia
TTSND

SEQ ID NO: 3144686 - protein, 21 aa, Giardia lamblia
TTSNQPEVDTITTTERSAIKR

SEQ ID NO: 3144687 - protein, 15 aa, Giardia lamblia
TTSPATPGSATGTPR

SEQ ID NO: 3144688 - protein, 6 aa, Giardia lamblia
TTSPHG

SEQ ID NO: 3144689 - protein, 6 aa, Giardia lamblia
TTSPSF

SEQ ID NO: 3144690 - protein, 7 aa, Giardia lamblia
TTSQQYG

SEQ ID NO: 3144691 - protein, 40 aa, Giardia lamblia
TTSRAAAPRPPGRDCTGPGGHEGERGSPRPARALLQSEKP

SEQ ID NO: 3144692 - protein, 7 aa, Giardia lamblia
TTSRISQ

SEQ ID NO: 3144693 - protein, 7 aa, Giardia lamblia
TTSSSRF

SEQ ID NO: 3144694 - protein, 7 aa, Giardia lamblia
TTSSTEW

SEQ ID NO: 3144695 - protein, 10 aa, Giardia lamblia
TTSSYTMGPD

SEQ ID NO: 3144696 - protein, 8 aa, Giardia lamblia
TTSTCNFD

SEQ ID NO: 3144697 - protein, 9 aa, Giardia lamblia
TTSTEERYR

SEQ ID NO: 3144698 - protein, 15 aa, Giardia lamblia
TTSTGTISSAHGSEI

SEQ ID NO: 3144699 - protein, 6 aa, Giardia lamblia
TTSTST

SEQ ID NO: 3144700 - protein, 21 aa, Giardia lamblia
TTSTSTISSTSESSFTGTESR

SEQ ID NO: 3144701 - protein, 18 aa, Giardia lamblia
TTSTTPVQPISKCSANIN

SEQ ID NO: 3144702 - protein, 10 aa, Giardia lamblia
TTSVERPPKE

SEQ ID NO: 3144703 - protein, 16 aa, Giardia lamblia
TTSYGRSTLTSEDTGN

SEQ ID NO: 3144704 - protein, 60 aa, Giardia lamblia
TTSYGTPDSTMHSTRSYDGLPISRTDSPYPESGSFTSRAPQSSGSLTRGYTDRSTDRFDQ

SEQ ID NO: 3144705 - protein, 6 aa, Giardia lamblia
TTSYKT

SEQ ID NO: 3144706 - protein, 9 aa, Giardia lamblia
TTTADGEHS

SEQ ID NO: 3144707 - protein, 6 aa, Giardia lamblia
TTTAHR

SEQ ID NO: 3144708 - protein, 24 aa, Giardia lamblia
TTTAPQARAPRRQPTQSLSAGQPY

SEQ ID NO: 3144709 - protein, 11 aa, Giardia lamblia
TTTDKDARDKV

SEQ ID NO: 3144710 - protein, 9 aa, Giardia lamblia
TTTDSNGET

SEQ ID NO: 3144711 - protein, 6 aa, Giardia lamblia
TTTEEY

SEQ ID NO: 3144712 - protein, 7 aa, Giardia lamblia
TTTEQSE

SEQ ID NO: 3144713 - protein, 8 aa, Giardia lamblia
TTTGHSSN

SEQ ID NO: 3144714 - protein, 14 aa, Giardia lamblia
TTTGKQGSSGVNKY

SEQ ID NO: 3144715 - protein, 5 aa, Giardia lamblia
TTTKD

SEQ ID NO: 3144716 - protein, 8 aa, Giardia lamblia
TTTKLEEQ

SEQ ID NO: 3144717 - protein, 6 aa, Giardia lamblia
TTTKLG

SEQ ID NO: 3144718 - protein, 4 aa, Giardia lamblia
TTTN

SEQ ID NO: 3144719 - protein, 5 aa, Giardia lamblia
TTTND

SEQ ID NO: 3144720 - protein, 7 aa, Giardia lamblia
TTTNELY

SEQ ID NO: 3144721 - protein, 30 aa, Giardia lamblia
TTTNGTRSGAEGLRNTLSTDRGVGSSSQVT

SEQ ID NO: 3144722 - protein, 8 aa, Giardia lamblia
TTTNLDSP

SEQ ID NO: 3144723 - protein, 7 aa, Giardia lamblia
TTTPDEW

SEQ ID NO: 3144724 - protein, 7 aa, Giardia lamblia
TTTPDTK

SEQ ID NO: 3144725 - protein, 6 aa, Giardia lamblia
TTTPGV

SEQ ID NO: 3144726 - protein, 16 aa, Giardia lamblia
TTTPNTSGLQSSSTMS

SEQ ID NO: 3144727 - protein, 8 aa, Giardia lamblia
TTTPTPLS

SEQ ID NO: 3144728 - protein, 4 aa, Giardia lamblia
TTTQ

SEQ ID NO: 3144729 - protein, 8 aa, Giardia lamblia
TTTSADTT

SEQ ID NO: 3144730 - protein, 6 aa, Giardia lamblia
TTTSAV

SEQ ID NO: 3144731 - protein, 7 aa, Giardia lamblia
TTTSGRT

SEQ ID NO: 3144732 - protein, 6 aa, Giardia lamblia
TTTTGE

SEQ ID NO: 3144733 - protein, 7 aa, Giardia lamblia
TTTTNDI

SEQ ID NO: 3144734 - protein, 13 aa, Giardia lamblia
TTTTTPSGKKDPK

SEQ ID NO: 3144735 - protein, 6 aa, Giardia lamblia
TTTTVG

SEQ ID NO: 3144736 - protein, 33 aa, Giardia lamblia
TTVEGSTGYIPNKKHGPPVGASGSSAAGGASYR

SEQ ID NO: 3144737 - protein, 6 aa, Giardia lamblia
TTVGNR

SEQ ID NO: 3144738 - protein, 13 aa, Giardia lamblia
TTVGTLSSGESST

SEQ ID NO: 3144739 - protein, 11 aa, Giardia lamblia
TTVPSQNKTES

SEQ ID NO: 3144740 - protein, 6 aa, Giardia lamblia
TTVPVS

SEQ ID NO: 3144741 - protein, 6 aa, Giardia lamblia
TTVRDP

SEQ ID NO: 3144742 - protein, 14 aa, Giardia lamblia
TTVSATRSASVGSF

SEQ ID NO: 3144743 - protein, 15 aa, Giardia lamblia
TTVTPTSPQAHGDNT

SEQ ID NO: 3144744 - protein, 5 aa, Giardia lamblia
TTWDR

SEQ ID NO: 3144745 - protein, 5 aa, Giardia lamblia
TTWTT

SEQ ID NO: 3144746 - protein, 6 aa, Giardia lamblia
TTYEST

SEQ ID NO: 3144747 - protein, 4 aa, Giardia lamblia
TTYN

SEQ ID NO: 3144748 - protein, 5 aa, Giardia lamblia
TTYNP

SEQ ID NO: 3144749 - protein, 9 aa, Giardia lamblia
TTYNSMRSQ

SEQ ID NO: 3144750 - protein, 26 aa, Giardia lamblia
TTYPNSDPFDPDARPTSHQAPSTTIT

SEQ ID NO: 3144751 - protein, 6 aa, Giardia lamblia
TTYRDD

SEQ ID NO: 3144752 - protein, 5 aa, Giardia lamblia
TTYRE

SEQ ID NO: 3144753 - protein, 4 aa, Giardia lamblia
TTYS

SEQ ID NO: 3144754 - protein, 17 aa, Giardia lamblia
TTYSKPQHQASRPPPMA

SEQ ID NO: 3144755 - protein, 5 aa, Giardia lamblia
TTYST

SEQ ID NO: 3144756 - protein, 9 aa, Giardia lamblia
TVAARDDAI

SEQ ID NO: 3144757 - protein, 14 aa, Giardia lamblia
TVADDDDPQYGDFP

SEQ ID NO: 3144758 - protein, 15 aa, Giardia lamblia
TVADTEIKKATGTLS

SEQ ID NO: 3144759 - protein, 10 aa, Giardia lamblia
TVAEKNNSKL

SEQ ID NO: 3144760 - protein, 6 aa, Giardia lamblia
TVAENK

SEQ ID NO: 3144761 - protein, 8 aa, Giardia lamblia
TVAGPSRN

SEQ ID NO: 3144762 - protein, 6 aa, Giardia lamblia
TVAGRL

SEQ ID NO: 3144763 - protein, 20 aa, Giardia lamblia
TVANENKDTTENQGKVRRRS

SEQ ID NO: 3144764 - protein, 8 aa, Giardia lamblia
TVAQKGQR

SEQ ID NO: 3144765 - protein, 6 aa, Giardia lamblia
TVASLS

SEQ ID NO: 3144766 - protein, 9 aa, Giardia lamblia
TVASPGSFY

SEQ ID NO: 3144767 - protein, 20 aa, Giardia lamblia
TVASTTTSLQRSRSHDPRHS

SEQ ID NO: 3144768 - protein, 4 aa, Giardia lamblia
TVDA

SEQ ID NO: 3144769 - protein, 9 aa, Giardia lamblia
TVDAQDAAD

SEQ ID NO: 3144770 - protein, 9 aa, Giardia lamblia
TVDARDASI

SEQ ID NO: 3144771 - protein, 10 aa, Giardia lamblia
TVDDKDQALR

SEQ ID NO: 3144772 - protein, 10 aa, Giardia lamblia
TVDEDKEKAL

SEQ ID NO: 3144773 - protein, 7 aa, Giardia lamblia
TVDGKGY

SEQ ID NO: 3144774 - protein, 11 aa, Giardia lamblia
TVDKATSTGEL

SEQ ID NO: 3144775 - protein, 9 aa, Giardia lamblia
TVDPDSQKS

SEQ ID NO: 3144776 - protein, 9 aa, Giardia lamblia
TVDPTNATR

SEQ ID NO: 3144777 - protein, 6 aa, Giardia lamblia
TVDRDY

SEQ ID NO: 3144778 - protein, 17 aa, Giardia lamblia
TVDSQQSSQRGTSKFGD

SEQ ID NO: 3144779 - protein, 12 aa, Giardia lamblia
TVEASRKGNPDV

SEQ ID NO: 3144780 - protein, 8 aa, Giardia lamblia
TVEDGREQ

SEQ ID NO: 3144781 - protein, 11 aa, Giardia lamblia
TVEDTNGRTPL

SEQ ID NO: 3144782 - protein, 8 aa, Giardia lamblia
TVEGTTAD

SEQ ID NO: 3144783 - protein, 6 aa, Giardia lamblia
TVEKEE

SEQ ID NO: 3144784 - protein, 19 aa, Giardia lamblia
TVEQQPCRGTAHPDPTSTC

SEQ ID NO: 3144785 - protein, 10 aa, Giardia lamblia
TVESSKERKY

SEQ ID NO: 3144786 - protein, 12 aa, Giardia lamblia
TVETTASAEVTR

SEQ ID NO: 3144787 - protein, 18 aa, Giardia lamblia
TVGAGAECTELTSTSTGH

SEQ ID NO: 3144788 - protein, 13 aa, Giardia lamblia
TVGATAAAGFGTS

SEQ ID NO: 3144789 - protein, 23 aa, Giardia lamblia
TVGDDSNDAKPRINSSSHSSARN

SEQ ID NO: 3144790 - protein, 5 aa, Giardia lamblia
TVGDV

SEQ ID NO: 3144791 - protein, 15 aa, Giardia lamblia
TVGEPELKRAQSSTQ

SEQ ID NO: 3144792 - protein, 7 aa, Giardia lamblia
TVGETAS

SEQ ID NO: 3144793 - protein, 8 aa, Giardia lamblia
TVGKTDGI

SEQ ID NO: 3144794 - protein, 4 aa, Giardia lamblia
TVGR

SEQ ID NO: 3144795 - protein, 13 aa, Giardia lamblia
TVGSAGKEKQEAA

SEQ ID NO: 3144796 - protein, 19 aa, Giardia lamblia
TVGSEKRPEPEEKQPEVVR

SEQ ID NO: 3144797 - protein, 11 aa, Giardia lamblia
TVGSKNGSSRS

SEQ ID NO: 3144798 - protein, 7 aa, Giardia lamblia
TVGTGDH

SEQ ID NO: 3144799 - protein, 10 aa, Giardia lamblia
TVGTTGKGLD

SEQ ID NO: 3144800 - protein, 125 aa, Giardia lamblia
TVHEETYDSSLHEDEADQAHGAQSPQNGTSSENQSPTKPHTKQRNAPRNVRDKAPPYGNDASTNTQHRRPKEEHPTKERKHKKDQQEDCRQQGQNHAKQSARRDGEQTVSRATTTREASKAGGKY

SEQ ID NO: 3144801 - protein, 4 aa, Giardia lamblia
TVHR

SEQ ID NO: 3144802 - protein, 8 aa, Giardia lamblia
TVKAQEAE

SEQ ID NO: 3144803 - protein, 20 aa, Giardia lamblia
TVKDAKKRSLARQDSQASSV

SEQ ID NO: 3144804 - protein, 20 aa, Giardia lamblia
TVKGTSVDQSQTDAADEEPL

SEQ ID NO: 3144805 - protein, 15 aa, Giardia lamblia
TVKPDEKDSNTPTFS

SEQ ID NO: 3144806 - protein, 6 aa, Giardia lamblia
TVKPYG

SEQ ID NO: 3144807 - protein, 10 aa, Giardia lamblia
TVNATNRELT

SEQ ID NO: 3144808 - protein, 10 aa, Giardia lamblia
TVNDDLSRNT

SEQ ID NO: 3144809 - protein, 4 aa, Giardia lamblia
TVNN

SEQ ID NO: 3144810 - protein, 10 aa, Giardia lamblia
TVNPDTALAE

SEQ ID NO: 3144811 - protein, 9 aa, Giardia lamblia
TVNPSSADD

SEQ ID NO: 3144812 - protein, 11 aa, Giardia lamblia
TVNRGSPTIGS

SEQ ID NO: 3144813 - protein, 8 aa, Giardia lamblia
TVPAESNS

SEQ ID NO: 3144814 - protein, 5 aa, Giardia lamblia
TVPAR

SEQ ID NO: 3144815 - protein, 11 aa, Giardia lamblia
TVPEGDDPDAL

SEQ ID NO: 3144816 - protein, 27 aa, Giardia lamblia
TVPEGVEEDRPSLSSSPTRDLASSDTS

SEQ ID NO: 3144817 - protein, 7 aa, Giardia lamblia
TVPGAST

SEQ ID NO: 3144818 - protein, 4 aa, Giardia lamblia
TVPP

SEQ ID NO: 3144819 - protein, 7 aa, Giardia lamblia
TVPPALS

SEQ ID NO: 3144820 - protein, 15 aa, Giardia lamblia
TVPPKAPSLSREKKH

SEQ ID NO: 3144821 - protein, 4 aa, Giardia lamblia
TVPS

SEQ ID NO: 3144822 - protein, 14 aa, Giardia lamblia
TVPSDKLQQEAGTV

SEQ ID NO: 3144823 - protein, 5 aa, Giardia lamblia
TVPSE

SEQ ID NO: 3144824 - protein, 7 aa, Giardia lamblia
TVPSGPE

SEQ ID NO: 3144825 - protein, 8 aa, Giardia lamblia
TVPSITGS

SEQ ID NO: 3144826 - protein, 23 aa, Giardia lamblia
TVPSPLERPTPQTPQAAQPPQVP

SEQ ID NO: 3144827 - protein, 13 aa, Giardia lamblia
TVPSSLSSRGVDK

SEQ ID NO: 3144828 - protein, 20 aa, Giardia lamblia
TVPTNSSVNSELSAGSTTFR

SEQ ID NO: 3144829 - protein, 8 aa, Giardia lamblia
TVPTRAEV

SEQ ID NO: 3144830 - protein, 11 aa, Giardia lamblia
TVQEKGRRPVT

SEQ ID NO: 3144831 - protein, 7 aa, Giardia lamblia
TVQGPSG

SEQ ID NO: 3144832 - protein, 29 aa, Giardia lamblia
TVQKQQNPYGASKSARYSISSDASPSEVY

SEQ ID NO: 3144833 - protein, 6 aa, Giardia lamblia
TVQPTT

SEQ ID NO: 3144834 - protein, 9 aa, Giardia lamblia
TVQQPASTA

SEQ ID NO: 3144835 - protein, 22 aa, Giardia lamblia
TVQQQQQELENQTAITREKERQ

SEQ ID NO: 3144836 - protein, 8 aa, Giardia lamblia
TVQQREER

SEQ ID NO: 3144837 - protein, 10 aa, Giardia lamblia
TVQSATVARG

SEQ ID NO: 3144838 - protein, 11 aa, Giardia lamblia
TVQSSNPTQAK

SEQ ID NO: 3144839 - protein, 8 aa, Giardia lamblia
TVQTDREE

SEQ ID NO: 3144840 - protein, 21 aa, Giardia lamblia
TVQTEPTCDSVPGPDLSPDNV

SEQ ID NO: 3144841 - protein, 25 aa, Giardia lamblia
TVRDKNEDRPDSVEIEEDREVEVCV

SEQ ID NO: 3144842 - protein, 6 aa, Giardia lamblia
TVRGDN

SEQ ID NO: 3144843 - protein, 17 aa, Giardia lamblia
TVRPTKQGNRATNKLSN

SEQ ID NO: 3144844 - protein, 6 aa, Giardia lamblia
TVRRGS

SEQ ID NO: 3144845 - protein, 9 aa, Giardia lamblia
TVRRTPTDK

SEQ ID NO: 3144846 - protein, 4 aa, Giardia lamblia
TVRS

SEQ ID NO: 3144847 - protein, 11 aa, Giardia lamblia
TVRSPQLAGSL

SEQ ID NO: 3144848 - protein, 5 aa, Giardia lamblia
TVRSR

SEQ ID NO: 3144849 - protein, 7 aa, Giardia lamblia
TVRTSPL

SEQ ID NO: 3144850 - protein, 4 aa, Giardia lamblia
TVSA

SEQ ID NO: 3144851 - protein, 18 aa, Giardia lamblia
TVSAPSPGVTKRTNGITP

SEQ ID NO: 3144852 - protein, 8 aa, Giardia lamblia
TVSDQDAQ

SEQ ID NO: 3144853 - protein, 10 aa, Giardia lamblia
TVSDSAGNNE

SEQ ID NO: 3144854 - protein, 6 aa, Giardia lamblia
TVSEAS

SEQ ID NO: 3144855 - protein, 11 aa, Giardia lamblia
TVSEEQATNMS

SEQ ID NO: 3144856 - protein, 15 aa, Giardia lamblia
TVSEPRSLRKATTRR

SEQ ID NO: 3144857 - protein, 6 aa, Giardia lamblia
TVSESS

SEQ ID NO: 3144858 - protein, 5 aa, Giardia lamblia
TVSGA

SEQ ID NO: 3144859 - protein, 14 aa, Giardia lamblia
TVSGDKKYKGVLHC

SEQ ID NO: 3144860 - protein, 5 aa, Giardia lamblia
TVSGF

SEQ ID NO: 3144861 - protein, 12 aa, Giardia lamblia
TVSHESVTQTSQ

SEQ ID NO: 3144862 - protein, 7 aa, Giardia lamblia
TVSIPDT

SEQ ID NO: 3144863 - protein, 10 aa, Giardia lamblia
TVSKASPTFH

SEQ ID NO: 3144864 - protein, 10 aa, Giardia lamblia
TVSKEGPNFE

SEQ ID NO: 3144865 - protein, 17 aa, Giardia lamblia
TVSNESTDSSLASNGTF

SEQ ID NO: 3144866 - protein, 7 aa, Giardia lamblia
TVSPDAA

SEQ ID NO: 3144867 - protein, 12 aa, Giardia lamblia
TVSPEEYARNNE

SEQ ID NO: 3144868 - protein, 14 aa, Giardia lamblia
TVSPTFSDSSPSVT

SEQ ID NO: 3144869 - protein, 5 aa, Giardia lamblia
TVSQE

SEQ ID NO: 3144870 - protein, 15 aa, Giardia lamblia
TVSQLQKDNSVPPEG

SEQ ID NO: 3144871 - protein, 13 aa, Giardia lamblia
TVSQTTRSDERAV

SEQ ID NO: 3144872 - protein, 11 aa, Giardia lamblia
TVSRDSYADSV

SEQ ID NO: 3144873 - protein, 10 aa, Giardia lamblia
TVSSSEKAIE

SEQ ID NO: 3144874 - protein, 8 aa, Giardia lamblia
TVSSSGAR

SEQ ID NO: 3144875 - protein, 19 aa, Giardia lamblia
TVSSTGQQSGPITGPTATD

SEQ ID NO: 3144876 - protein, 10 aa, Giardia lamblia
TVSTHSQRER

SEQ ID NO: 3144877 - protein, 16 aa, Giardia lamblia
TVSVGRSTTTDTTPLN

SEQ ID NO: 3144878 - protein, 6 aa, Giardia lamblia
TVTDDP

SEQ ID NO: 3144879 - protein, 19 aa, Giardia lamblia
TVTDTRKLRSNRLSSPSLH

SEQ ID NO: 3144880 - protein, 7 aa, Giardia lamblia
TVTEKST

SEQ ID NO: 3144881 - protein, 6 aa, Giardia lamblia
TVTGEK

SEQ ID NO: 3144882 - protein, 8 aa, Giardia lamblia
TVTGTKAH

SEQ ID NO: 3144883 - protein, 19 aa, Giardia lamblia
TVTHSGCSAGISPSCSPSV

SEQ ID NO: 3144884 - protein, 4 aa, Giardia lamblia
TVTK

SEQ ID NO: 3144885 - protein, 8 aa, Giardia lamblia
TVTKPTYE

SEQ ID NO: 3144886 - protein, 6 aa, Giardia lamblia
TVTNDE

SEQ ID NO: 3144887 - protein, 8 aa, Giardia lamblia
TVTNDGAT

SEQ ID NO: 3144888 - protein, 5 aa, Giardia lamblia
TVTNE

SEQ ID NO: 3144889 - protein, 11 aa, Giardia lamblia
TVTNQNGQQIS

SEQ ID NO: 3144890 - protein, 6 aa, Giardia lamblia
TVTPET

SEQ ID NO: 3144891 - protein, 7 aa, Giardia lamblia
TVTPGVQ

SEQ ID NO: 3144892 - protein, 19 aa, Giardia lamblia
TVTPSASASGRSGSGKRHK

SEQ ID NO: 3144893 - protein, 11 aa, Giardia lamblia
TVTPSSISNYR

SEQ ID NO: 3144894 - protein, 14 aa, Giardia lamblia
TVTPTSLPKTMAKD

SEQ ID NO: 3144895 - protein, 9 aa, Giardia lamblia
TVTQNSANL

SEQ ID NO: 3144896 - protein, 16 aa, Giardia lamblia
TVTRGSVQQAVGGTAA

SEQ ID NO: 3144897 - protein, 8 aa, Giardia lamblia
TVTSNNQT

SEQ ID NO: 3144898 - protein, 7 aa, Giardia lamblia
TVTSPSI

SEQ ID NO: 3144899 - protein, 6 aa, Giardia lamblia
TVTSSP

SEQ ID NO: 3144900 - protein, 58 aa, Giardia lamblia
TVTTTTKTYSPNGRTGTLRDRSTSRSQSHTTRSRTELERTQDKDRDGDRSGDRSLTNS

SEQ ID NO: 3144901 - protein, 7 aa, Giardia lamblia
TVVDKSG

SEQ ID NO: 3144902 - protein, 10 aa, Giardia lamblia
TVYQGANGRT

SEQ ID NO: 3144903 - protein, 6 aa, Giardia lamblia
TVYSPA

SEQ ID NO: 3144904 - protein, 5 aa, Giardia lamblia
TWGSP

SEQ ID NO: 3144905 - protein, 4 aa, Giardia lamblia
TWPG

SEQ ID NO: 3144906 - protein, 5 aa, Giardia lamblia
TWSDM

SEQ ID NO: 3144907 - protein, 19 aa, Giardia lamblia
TWSETSRPKTESSASEVLA

SEQ ID NO: 3144908 - protein, 6 aa, Giardia lamblia
TWSPDA

SEQ ID NO: 3144909 - protein, 10 aa, Giardia lamblia
TWTGEDLPPE

SEQ ID NO: 3144910 - protein, 12 aa, Giardia lamblia
TYAKKKNSRGDT

SEQ ID NO: 3144911 - protein, 11 aa, Giardia lamblia
TYAQPIAPSPI

SEQ ID NO: 3144912 - protein, 24 aa, Giardia lamblia
TYATRRKPRRASTSSGDAQSSQTP

SEQ ID NO: 3144913 - protein, 8 aa, Giardia lamblia
TYDEREMT

SEQ ID NO: 3144914 - protein, 6 aa, Giardia lamblia
TYDPST

SEQ ID NO: 3144915 - protein, 7 aa, Giardia lamblia
TYDRDNP

SEQ ID NO: 3144916 - protein, 4 aa, Giardia lamblia
TYEG

SEQ ID NO: 3144917 - protein, 6 aa, Giardia lamblia
TYENDE

SEQ ID NO: 3144918 - protein, 6 aa, Giardia lamblia
TYEPRE

SEQ ID NO: 3144919 - protein, 4 aa, Giardia lamblia
TYET

SEQ ID NO: 3144920 - protein, 6 aa, Giardia lamblia
TYGGDK

SEQ ID NO: 3144921 - protein, 27 aa, Giardia lamblia
TYGHQNQESVTGSFEETNPIDNKSCSS

SEQ ID NO: 3144922 - protein, 15 aa, Giardia lamblia
TYGSQRDPETSDDPA

SEQ ID NO: 3144923 - protein, 7 aa, Giardia lamblia
TYHSDPP

SEQ ID NO: 3144924 - protein, 20 aa, Giardia lamblia
TYKDNPSRLEARQRSLETEV

SEQ ID NO: 3144925 - protein, 6 aa, Giardia lamblia
TYKNDN

SEQ ID NO: 3144926 - protein, 6 aa, Giardia lamblia
TYKPEL

SEQ ID NO: 3144927 - protein, 5 aa, Giardia lamblia
TYKTP

SEQ ID NO: 3144928 - protein, 18 aa, Giardia lamblia
TYLDPNARDFEKHKPSVD

SEQ ID NO: 3144929 - protein, 12 aa, Giardia lamblia
TYLPSPSPSLSS

SEQ ID NO: 3144930 - protein, 11 aa, Giardia lamblia
TYLSSGVSSTL

SEQ ID NO: 3144931 - protein, 5 aa, Giardia lamblia
TYNGN

SEQ ID NO: 3144932 - protein, 12 aa, Giardia lamblia
TYNNSEVTKPGT

SEQ ID NO: 3144933 - protein, 14 aa, Giardia lamblia
TYNPPHSPQGYEDN

SEQ ID NO: 3144934 - protein, 8 aa, Giardia lamblia
TYNPYTAP

SEQ ID NO: 3144935 - protein, 8 aa, Giardia lamblia
TYNSNDKT

SEQ ID NO: 3144936 - protein, 23 aa, Giardia lamblia
TYNTSQGGGWRPPEDKKPRKQKS

SEQ ID NO: 3144937 - protein, 5 aa, Giardia lamblia
TYPDD

SEQ ID NO: 3144938 - protein, 5 aa, Giardia lamblia
TYPNP

SEQ ID NO: 3144939 - protein, 17 aa, Giardia lamblia
TYPPLDGKVNTNEAGGY

SEQ ID NO: 3144940 - protein, 14 aa, Giardia lamblia
TYPPSHSIQTDSPK

SEQ ID NO: 3144941 - protein, 9 aa, Giardia lamblia
TYPSNNEHR

SEQ ID NO: 3144942 - protein, 31 aa, Giardia lamblia
TYPTEEPGDAKGSNSTSLRSPSSSDAEDAAS

SEQ ID NO: 3144943 - protein, 5 aa, Giardia lamblia
TYQDD

SEQ ID NO: 3144944 - protein, 8 aa, Giardia lamblia
TYQDGSPV

SEQ ID NO: 3144945 - protein, 6 aa, Giardia lamblia
TYQDNT

SEQ ID NO: 3144946 - protein, 12 aa, Giardia lamblia
TYQKSVDRQGET

SEQ ID NO: 3144947 - protein, 26 aa, Giardia lamblia
TYQPDPASEEVSDSKSDTSSLRGSKK

SEQ ID NO: 3144948 - protein, 9 aa, Giardia lamblia
TYQPTAEEC

SEQ ID NO: 3144949 - protein, 5 aa, Giardia lamblia
TYRER

SEQ ID NO: 3144950 - protein, 13 aa, Giardia lamblia
TYRGTKDKRGATV

SEQ ID NO: 3144951 - protein, 5 aa, Giardia lamblia
TYRPQ

SEQ ID NO: 3144952 - protein, 5 aa, Giardia lamblia
TYSET

SEQ ID NO: 3144953 - protein, 10 aa, Giardia lamblia
TYSGQSDIAA

SEQ ID NO: 3144954 - protein, 8 aa, Giardia lamblia
TYSIEPDD

SEQ ID NO: 3144955 - protein, 17 aa, Giardia lamblia
TYSKSQYKLKQKTEEMR

SEQ ID NO: 3144956 - protein, 4 aa, Giardia lamblia
TYSL

SEQ ID NO: 3144957 - protein, 5 aa, Giardia lamblia
TYTAS

SEQ ID NO: 3144958 - protein, 19 aa, Giardia lamblia
TYTEEGNLKQQYDATTEQN

SEQ ID NO: 3144959 - protein, 8 aa, Giardia lamblia
TYTEETGL

SEQ ID NO: 3144960 - protein, 5 aa, Giardia lamblia
TYTKT

SEQ ID NO: 3144961 - protein, 10 aa, Giardia lamblia
TYTNDEEDRG

SEQ ID NO: 3144962 - protein, 6 aa, Giardia lamblia
TYTPDA

SEQ ID NO: 3144963 - protein, 7 aa, Giardia lamblia
TYTTESD

SEQ ID NO: 3144964 - protein, 6 aa, Giardia lamblia
TYTTET

SEQ ID NO: 3144965 - protein, 32 aa, Giardia lamblia
TYTTNAGDKTDGTAGATVTGGGARKKTKMSTQ

SEQ ID NO: 3144966 - protein, 8 aa, Giardia lamblia
TYTTPEPH

SEQ ID NO: 3144967 - protein, 13 aa, Giardia lamblia
TYVSSQDSYSQQS

SEQ ID NO: 3144968 - protein, 5 aa, Giardia lamblia
TYVST

SEQ ID NO: 3144969 - protein, 4 aa, Giardia lamblia
VAAD

SEQ ID NO: 3144970 - protein, 19 aa, Giardia lamblia
VAADRGSASRISADQRCGT

SEQ ID NO: 3144971 - protein, 37 aa, Giardia lamblia
VAAPGSTELQPATKYSGSLAPEISGSSPGTARPGERP

SEQ ID NO: 3144972 - protein, 12 aa, Giardia lamblia
VAAPNAQEATTL

SEQ ID NO: 3144973 - protein, 13 aa, Giardia lamblia
VAAQDVASKLSNT

SEQ ID NO: 3144974 - protein, 8 aa, Giardia lamblia
VAAQPSRP

SEQ ID NO: 3144975 - protein, 9 aa, Giardia lamblia
VAAREEQAA

SEQ ID NO: 3144976 - protein, 10 aa, Giardia lamblia
VAASARNLNY

SEQ ID NO: 3144977 - protein, 14 aa, Giardia lamblia
VAASNDNPGPGAYE

SEQ ID NO: 3144978 - protein, 98 aa, Giardia lamblia
VAASPDPVPAPAPRAPAADPKSHHKQSAAVPEKGSSSRPGHANPATHQKPAAPAHVRPAQPSAPIDKHKSTKPSAPAPPPPPSKPTVSASGAKQGTKF

SEQ ID NO: 3144979 - protein, 12 aa, Giardia lamblia
VAASRAQSLKTS

SEQ ID NO: 3144980 - protein, 8 aa, Giardia lamblia
VAASYGQP

SEQ ID NO: 3144981 - protein, 9 aa, Giardia lamblia
VAATPGKTK

SEQ ID NO: 3144982 - protein, 9 aa, Giardia lamblia
VADDDQHDA

SEQ ID NO: 3144983 - protein, 6 aa, Giardia lamblia
VADDGT

SEQ ID NO: 3144984 - protein, 8 aa, Giardia lamblia
VADDRRVG

SEQ ID NO: 3144985 - protein, 6 aa, Giardia lamblia
VADEGL

SEQ ID NO: 3144986 - protein, 8 aa, Giardia lamblia
VADNTGRT

SEQ ID NO: 3144987 - protein, 7 aa, Giardia lamblia
VADPREI

SEQ ID NO: 3144988 - protein, 7 aa, Giardia lamblia
VADPSDD

SEQ ID NO: 3144989 - protein, 8 aa, Giardia lamblia
VADRTHNA

SEQ ID NO: 3144990 - protein, 9 aa, Giardia lamblia
VADSDLSTQ

SEQ ID NO: 3144991 - protein, 9 aa, Giardia lamblia
VADSRTPWS

SEQ ID NO: 3144992 - protein, 52 aa, Giardia lamblia
VADTEKAPESKRKRRGNDITKDTAESMERPHKQRTSRQQQHPNKTPEGSASE

SEQ ID NO: 3144993 - protein, 27 aa, Giardia lamblia
VADTPEPQAAQPSVASVATEASALETS

SEQ ID NO: 3144994 - protein, 6 aa, Giardia lamblia
VADTTE

SEQ ID NO: 3144995 - protein, 4 aa, Giardia lamblia
VAEA

SEQ ID NO: 3144996 - protein, 8 aa, Giardia lamblia
VAEASKAG

SEQ ID NO: 3144997 - protein, 8 aa, Giardia lamblia
VAEASSTE

SEQ ID NO: 3144998 - protein, 9 aa, Giardia lamblia
VAEEDQHAE

SEQ ID NO: 3144999 - protein, 18 aa, Giardia lamblia
VAEETTTALRNALSAQLI

SEQ ID NO: 3145000 - protein, 17 aa, Giardia lamblia
VAEKEASCADSAGSDAI

SEQ ID NO: 3145001 - protein, 10 aa, Giardia lamblia
VAEKSYTAQL

SEQ ID NO: 3145002 - protein, 5 aa, Giardia lamblia
VAEPI

SEQ ID NO: 3145003 - protein, 10 aa, Giardia lamblia
VAEQYPNQVD

SEQ ID NO: 3145004 - protein, 11 aa, Giardia lamblia
VAERTGDLNSM

SEQ ID NO: 3145005 - protein, 8 aa, Giardia lamblia
VAESEERN

SEQ ID NO: 3145006 - protein, 12 aa, Giardia lamblia
VAESEKTEKEID

SEQ ID NO: 3145007 - protein, 10 aa, Giardia lamblia
VAESTPPSNT

SEQ ID NO: 3145008 - protein, 9 aa, Giardia lamblia
VAETQTDPG

SEQ ID NO: 3145009 - protein, 13 aa, Giardia lamblia
VAGAQEASELPRD

SEQ ID NO: 3145010 - protein, 18 aa, Giardia lamblia
VAGASVSAGTKKKGLSIK

SEQ ID NO: 3145011 - protein, 32 aa, Giardia lamblia
VAGATASSAVTVGAEPSLKKEPPNSSVRAPPF

SEQ ID NO: 3145012 - protein, 19 aa, Giardia lamblia
VAGDDDDDWGETAKKPTRK

SEQ ID NO: 3145013 - protein, 10 aa, Giardia lamblia
VAGDGSNPYA

SEQ ID NO: 3145014 - protein, 18 aa, Giardia lamblia
VAGEDPAAEQQSTQPGSL

SEQ ID NO: 3145015 - protein, 7 aa, Giardia lamblia
VAGGKEL

SEQ ID NO: 3145016 - protein, 9 aa, Giardia lamblia
VAGKTNGEI

SEQ ID NO: 3145017 - protein, 8 aa, Giardia lamblia
VAGNTFDS

SEQ ID NO: 3145018 - protein, 6 aa, Giardia lamblia
VAGPDA

SEQ ID NO: 3145019 - protein, 6 aa, Giardia lamblia
VAGPDR

SEQ ID NO: 3145020 - protein, 4 aa, Giardia lamblia
VAGR

SEQ ID NO: 3145021 - protein, 7 aa, Giardia lamblia
VAGTDTR

SEQ ID NO: 3145022 - protein, 5 aa, Giardia lamblia
VAGTE

SEQ ID NO: 3145023 - protein, 9 aa, Giardia lamblia
VAHGSYSST

SEQ ID NO: 3145024 - protein, 13 aa, Giardia lamblia
VAHPPKPSHLQRQ

SEQ ID NO: 3145025 - protein, 7 aa, Giardia lamblia
VAKADAN

SEQ ID NO: 3145026 - protein, 8 aa, Giardia lamblia
VAKDPAAA

SEQ ID NO: 3145027 - protein, 4 aa, Giardia lamblia
VAKP

SEQ ID NO: 3145028 - protein, 6 aa, Giardia lamblia
VAKRDV

SEQ ID NO: 3145029 - protein, 4 aa, Giardia lamblia
VAKT

SEQ ID NO: 3145030 - protein, 5 aa, Giardia lamblia
VANDP

SEQ ID NO: 3145031 - protein, 6 aa, Giardia lamblia
VANGTA

SEQ ID NO: 3145032 - protein, 4 aa, Giardia lamblia
VANK

SEQ ID NO: 3145033 - protein, 16 aa, Giardia lamblia
VANPNNQSIPRSSQPL

SEQ ID NO: 3145034 - protein, 10 aa, Giardia lamblia
VANPPPATPG

SEQ ID NO: 3145035 - protein, 8 aa, Giardia lamblia
VANPSEIS

SEQ ID NO: 3145036 - protein, 7 aa, Giardia lamblia
VANPSKW

SEQ ID NO: 3145037 - protein, 8 aa, Giardia lamblia
VANPSLSE

SEQ ID NO: 3145038 - protein, 4 aa, Giardia lamblia
VANS

SEQ ID NO: 3145039 - protein, 9 aa, Giardia lamblia
VANSSGNTY

SEQ ID NO: 3145040 - protein, 7 aa, Giardia lamblia
VANSTHK

SEQ ID NO: 3145041 - protein, 5 aa, Giardia lamblia
VAPAE

SEQ ID NO: 3145042 - protein, 5 aa, Giardia lamblia
VAPAR

SEQ ID NO: 3145043 - protein, 9 aa, Giardia lamblia
VAPDQPSYA

SEQ ID NO: 3145044 - protein, 10 aa, Giardia lamblia
VAPENPQYQH

SEQ ID NO: 3145045 - protein, 14 aa, Giardia lamblia
VAPGASGDSQVDSN

SEQ ID NO: 3145046 - protein, 8 aa, Giardia lamblia
VAPGEETS

SEQ ID NO: 3145047 - protein, 6 aa, Giardia lamblia
VAPGHV

SEQ ID NO: 3145048 - protein, 12 aa, Giardia lamblia
VAPGSKTHTYAD

SEQ ID NO: 3145049 - protein, 8 aa, Giardia lamblia
VAPHPKTL

SEQ ID NO: 3145050 - protein, 6 aa, Giardia lamblia
VAPPKE

SEQ ID NO: 3145051 - protein, 7 aa, Giardia lamblia
VAPPPQM

SEQ ID NO: 3145052 - protein, 20 aa, Giardia lamblia
VAPPSAQQDNNGTENEPAPT

SEQ ID NO: 3145053 - protein, 29 aa, Giardia lamblia
VAPPSRGAIATTPTVPTNASKGAPKDSGQ

SEQ ID NO: 3145054 - protein, 9 aa, Giardia lamblia
VAPRPNSYN

SEQ ID NO: 3145055 - protein, 7 aa, Giardia lamblia
VAPSDEL

SEQ ID NO: 3145056 - protein, 12 aa, Giardia lamblia
VAPSINSAAPTT

SEQ ID NO: 3145057 - protein, 6 aa, Giardia lamblia
VAPSTD

SEQ ID NO: 3145058 - protein, 23 aa, Giardia lamblia
VAPTPPTRTPQRPPLPPTDTTAL

SEQ ID NO: 3145059 - protein, 19 aa, Giardia lamblia
VAPTTETDLGRDSHKDSSF

SEQ ID NO: 3145060 - protein, 8 aa, Giardia lamblia
VAPVPQSS

SEQ ID NO: 3145061 - protein, 4 aa, Giardia lamblia
VAQA

SEQ ID NO: 3145062 - protein, 9 aa, Giardia lamblia
VAQAAEDEV

SEQ ID NO: 3145063 - protein, 12 aa, Giardia lamblia
VAQAATTLRCRQ

SEQ ID NO: 3145064 - protein, 11 aa, Giardia lamblia
VAQEDDTYQSY

SEQ ID NO: 3145065 - protein, 8 aa, Giardia lamblia
VAQGDTDF

SEQ ID NO: 3145066 - protein, 16 aa, Giardia lamblia
VAQGDYSSGSSYDHMH

SEQ ID NO: 3145067 - protein, 7 aa, Giardia lamblia
VAQGTSS

SEQ ID NO: 3145068 - protein, 14 aa, Giardia lamblia
VAQHRSEAARELQR

SEQ ID NO: 3145069 - protein, 22 aa, Giardia lamblia
VAQKTNNLTAIPNASEIAPEIQ

SEQ ID NO: 3145070 - protein, 6 aa, Giardia lamblia
VAQTGK

SEQ ID NO: 3145071 - protein, 4 aa, Giardia lamblia
VARA

SEQ ID NO: 3145072 - protein, 7 aa, Giardia lamblia
VARETEA

SEQ ID NO: 3145073 - protein, 5 aa, Giardia lamblia
VARPT

SEQ ID NO: 3145074 - protein, 27 aa, Giardia lamblia
VARRSSNTTPTTIRPRQSDGPPRPPSA

SEQ ID NO: 3145075 - protein, 7 aa, Giardia lamblia
VARTRPL

SEQ ID NO: 3145076 - protein, 4 aa, Giardia lamblia
VASA

SEQ ID NO: 3145077 - protein, 10 aa, Giardia lamblia
VASADPSTYA

SEQ ID NO: 3145078 - protein, 9 aa, Giardia lamblia
VASAGDDVD

SEQ ID NO: 3145079 - protein, 11 aa, Giardia lamblia
VASDKSALRTS

SEQ ID NO: 3145080 - protein, 14 aa, Giardia lamblia
VASDSSSSTSIDSI

SEQ ID NO: 3145081 - protein, 10 aa, Giardia lamblia
VASETNSRAA

SEQ ID NO: 3145082 - protein, 36 aa, Giardia lamblia
VASGRRSSTDKSMTTGPDAPMEQSTESNPVDAEQTN

SEQ ID NO: 3145083 - protein, 10 aa, Giardia lamblia
VASGRTAGAY

SEQ ID NO: 3145084 - protein, 7 aa, Giardia lamblia
VASNAEN

SEQ ID NO: 3145085 - protein, 9 aa, Giardia lamblia
VASNCSGEV

SEQ ID NO: 3145086 - protein, 10 aa, Giardia lamblia
VASNKEVSQM

SEQ ID NO: 3145087 - protein, 6 aa, Giardia lamblia
VASPEE

SEQ ID NO: 3145088 - protein, 7 aa, Giardia lamblia
VASPQQL

SEQ ID NO: 3145089 - protein, 5 aa, Giardia lamblia
VASPR

SEQ ID NO: 3145090 - protein, 9 aa, Giardia lamblia
VASPTSRLT

SEQ ID NO: 3145091 - protein, 4 aa, Giardia lamblia
VASQ

SEQ ID NO: 3145092 - protein, 6 aa, Giardia lamblia
VASRGR

SEQ ID NO: 3145093 - protein, 8 aa, Giardia lamblia
VASRHGQK

SEQ ID NO: 3145094 - protein, 8 aa, Giardia lamblia
VASSGSVH

SEQ ID NO: 3145095 - protein, 5 aa, Giardia lamblia
VASSP

SEQ ID NO: 3145096 - protein, 9 aa, Giardia lamblia
VASSTLATE

SEQ ID NO: 3145097 - protein, 4 aa, Giardia lamblia
VAST

SEQ ID NO: 3145098 - protein, 32 aa, Giardia lamblia
VASTAPLGSHGDNKQYRDRYGQQNQRTRVGEV

SEQ ID NO: 3145099 - protein, 15 aa, Giardia lamblia
VASTDAETGEETTEF

SEQ ID NO: 3145100 - protein, 9 aa, Giardia lamblia
VASTPLSSA

SEQ ID NO: 3145101 - protein, 13 aa, Giardia lamblia
VATAEIETATEEI

SEQ ID NO: 3145102 - protein, 7 aa, Giardia lamblia
VATARKM

SEQ ID NO: 3145103 - protein, 16 aa, Giardia lamblia
VATDTAKDIRGNQEGL

SEQ ID NO: 3145104 - protein, 5 aa, Giardia lamblia
VATGE

SEQ ID NO: 3145105 - protein, 9 aa, Giardia lamblia
VATLQGGSY

SEQ ID NO: 3145106 - protein, 6 aa, Giardia lamblia
VATQAG

SEQ ID NO: 3145107 - protein, 9 aa, Giardia lamblia
VATSKSGNI

SEQ ID NO: 3145108 - protein, 8 aa, Giardia lamblia
VATSPIQS

SEQ ID NO: 3145109 - protein, 10 aa, Giardia lamblia
VATSSSWDST

SEQ ID NO: 3145110 - protein, 8 aa, Giardia lamblia
VATSTASR

SEQ ID NO: 3145111 - protein, 6 aa, Giardia lamblia
VATSTG

SEQ ID NO: 3145112 - protein, 15 aa, Giardia lamblia
VATTDSNAPKHMQPN

SEQ ID NO: 3145113 - protein, 7 aa, Giardia lamblia
VATTKSD

SEQ ID NO: 3145114 - protein, 7 aa, Giardia lamblia
VATTRNK

SEQ ID NO: 3145115 - protein, 11 aa, Giardia lamblia
VCPSGSASSRA

SEQ ID NO: 3145116 - protein, 5 aa, Giardia lamblia
VCTQA

SEQ ID NO: 3145117 - protein, 7 aa, Giardia lamblia
VDAAGPQ

SEQ ID NO: 3145118 - protein, 9 aa, Giardia lamblia
VDAATENTK

SEQ ID NO: 3145119 - protein, 6 aa, Giardia lamblia
VDADDR

SEQ ID NO: 3145120 - protein, 5 aa, Giardia lamblia
VDADR

SEQ ID NO: 3145121 - protein, 14 aa, Giardia lamblia
VDAEERLRKNEASA

SEQ ID NO: 3145122 - protein, 11 aa, Giardia lamblia
VDAGEEPVDPS

SEQ ID NO: 3145123 - protein, 10 aa, Giardia lamblia
VDAGEQGRAE

SEQ ID NO: 3145124 - protein, 12 aa, Giardia lamblia
VDAGQRDADGKT

SEQ ID NO: 3145125 - protein, 18 aa, Giardia lamblia
VDANAEKALAQRTARERV

SEQ ID NO: 3145126 - protein, 14 aa, Giardia lamblia
VDAPIKTASAEHRD

SEQ ID NO: 3145127 - protein, 15 aa, Giardia lamblia
VDAQPPPSDSPSLEP

SEQ ID NO: 3145128 - protein, 7 aa, Giardia lamblia
VDARGRT

SEQ ID NO: 3145129 - protein, 25 aa, Giardia lamblia
VDARPDSRRVASASQRPLLPALSPK

SEQ ID NO: 3145130 - protein, 10 aa, Giardia lamblia
VDARSSTSHL

SEQ ID NO: 3145131 - protein, 18 aa, Giardia lamblia
VDAYAKEQAQLTNSTTIA

SEQ ID NO: 3145132 - protein, 4 aa, Giardia lamblia
VDDD

SEQ ID NO: 3145133 - protein, 16 aa, Giardia lamblia
VDDDADPVDKSKEPRM

SEQ ID NO: 3145134 - protein, 6 aa, Giardia lamblia
VDDDTR

SEQ ID NO: 3145135 - protein, 12 aa, Giardia lamblia
VDDGTASHLEED

SEQ ID NO: 3145136 - protein, 7 aa, Giardia lamblia
VDDNGKT

SEQ ID NO: 3145137 - protein, 9 aa, Giardia lamblia
VDDNPGIQD

SEQ ID NO: 3145138 - protein, 7 aa, Giardia lamblia
VDDPFPT

SEQ ID NO: 3145139 - protein, 13 aa, Giardia lamblia
VDDPGSGCSASKK

SEQ ID NO: 3145140 - protein, 21 aa, Giardia lamblia
VDDPSFSTVTSGTDKSSTRPF

SEQ ID NO: 3145141 - protein, 14 aa, Giardia lamblia
VDDPSHAPQMPSDY

SEQ ID NO: 3145142 - protein, 8 aa, Giardia lamblia
VDDPSKVA

SEQ ID NO: 3145143 - protein, 6 aa, Giardia lamblia
VDDQGH

SEQ ID NO: 3145144 - protein, 7 aa, Giardia lamblia
VDDQQSY

SEQ ID NO: 3145145 - protein, 34 aa, Giardia lamblia
VDDQSTAQNRSTSQASMGEKSGKSQTSMGPSDPL

SEQ ID NO: 3145146 - protein, 13 aa, Giardia lamblia
VDDRPSSARTAKK

SEQ ID NO: 3145147 - protein, 14 aa, Giardia lamblia
VDDRTATVTATLAS

SEQ ID NO: 3145148 - protein, 16 aa, Giardia lamblia
VDDSDDERAAAEYKDA

SEQ ID NO: 3145149 - protein, 12 aa, Giardia lamblia
VDDSITGATGLD

SEQ ID NO: 3145150 - protein, 7 aa, Giardia lamblia
VDDTRPA

SEQ ID NO: 3145151 - protein, 7 aa, Giardia lamblia
VDEAEDE

SEQ ID NO: 3145152 - protein, 8 aa, Giardia lamblia
VDEEEGDA

SEQ ID NO: 3145153 - protein, 11 aa, Giardia lamblia
VDEEGDGADCR

SEQ ID NO: 3145154 - protein, 10 aa, Giardia lamblia
VDEGYGTESG

SEQ ID NO: 3145155 - protein, 6 aa, Giardia lamblia
VDEHGK

SEQ ID NO: 3145156 - protein, 13 aa, Giardia lamblia
VDEPERESSKEVV

SEQ ID NO: 3145157 - protein, 12 aa, Giardia lamblia
VDEQPEKPLDSA

SEQ ID NO: 3145158 - protein, 7 aa, Giardia lamblia
VDERDST

SEQ ID NO: 3145159 - protein, 6 aa, Giardia lamblia
VDERET

SEQ ID NO: 3145160 - protein, 8 aa, Giardia lamblia
VDESEDNK

SEQ ID NO: 3145161 - protein, 14 aa, Giardia lamblia
VDESSPAEAREKYP

SEQ ID NO: 3145162 - protein, 14 aa, Giardia lamblia
VDESTVSGRSTRPM

SEQ ID NO: 3145163 - protein, 41 aa, Giardia lamblia
VDETSDDANQQPITTIASSKGSIDIRSTTRGATSLSGGEST

SEQ ID NO: 3145164 - protein, 8 aa, Giardia lamblia
VDEYNNSN

SEQ ID NO: 3145165 - protein, 8 aa, Giardia lamblia
VDGASPEV

SEQ ID NO: 3145166 - protein, 7 aa, Giardia lamblia
VDGEGRT

SEQ ID NO: 3145167 - protein, 16 aa, Giardia lamblia
VDGGSGFEAGTAAAAR

SEQ ID NO: 3145168 - protein, 8 aa, Giardia lamblia
VDGKPKKK

SEQ ID NO: 3145169 - protein, 9 aa, Giardia lamblia
VDGQQTKSI

SEQ ID NO: 3145170 - protein, 4 aa, Giardia lamblia
VDGR

SEQ ID NO: 3145171 - protein, 6 aa, Giardia lamblia
VDGSGK

SEQ ID NO: 3145172 - protein, 10 aa, Giardia lamblia
VDGSSVPVSA

SEQ ID NO: 3145173 - protein, 8 aa, Giardia lamblia
VDGTDKNI

SEQ ID NO: 3145174 - protein, 7 aa, Giardia lamblia
VDGTKRS

SEQ ID NO: 3145175 - protein, 17 aa, Giardia lamblia
VDGTNGSITSDSSDDGE

SEQ ID NO: 3145176 - protein, 9 aa, Giardia lamblia
VDGTSLANN

SEQ ID NO: 3145177 - protein, 6 aa, Giardia lamblia
VDGTTA

SEQ ID NO: 3145178 - protein, 13 aa, Giardia lamblia
VDHPEEPAKPKKP

SEQ ID NO: 3145179 - protein, 4 aa, Giardia lamblia
VDIT

SEQ ID NO: 3145180 - protein, 27 aa, Giardia lamblia
VDKDSGSMQTQQREKSISSAEPVTSSL

SEQ ID NO: 3145181 - protein, 15 aa, Giardia lamblia
VDKKAPAKNLSSGER

SEQ ID NO: 3145182 - protein, 8 aa, Giardia lamblia
VDKNGRDA

SEQ ID NO: 3145183 - protein, 7 aa, Giardia lamblia
VDKNTRE

SEQ ID NO: 3145184 - protein, 20 aa, Giardia lamblia
VDKPTKSARPRKHMNTKKPV

SEQ ID NO: 3145185 - protein, 6 aa, Giardia lamblia
VDLPSD

SEQ ID NO: 3145186 - protein, 12 aa, Giardia lamblia
VDLSSQNLQSVG

SEQ ID NO: 3145187 - protein, 8 aa, Giardia lamblia
VDNAGRTA

SEQ ID NO: 3145188 - protein, 7 aa, Giardia lamblia
VDNDGNS

SEQ ID NO: 3145189 - protein, 10 aa, Giardia lamblia
VDNKTAKDYY

SEQ ID NO: 3145190 - protein, 10 aa, Giardia lamblia
VDNKTPPRQP

SEQ ID NO: 3145191 - protein, 7 aa, Giardia lamblia
VDNNSRP

SEQ ID NO: 3145192 - protein, 6 aa, Giardia lamblia
VDNPEE

SEQ ID NO: 3145193 - protein, 21 aa, Giardia lamblia
VDNPEERASLGSTHHEQDLST

SEQ ID NO: 3145194 - protein, 6 aa, Giardia lamblia
VDNPEL

SEQ ID NO: 3145195 - protein, 13 aa, Giardia lamblia
VDNPKDNSTGHGL

SEQ ID NO: 3145196 - protein, 11 aa, Giardia lamblia
VDNQSSSKVSE

SEQ ID NO: 3145197 - protein, 9 aa, Giardia lamblia
VDNYEKAGN

SEQ ID NO: 3145198 - protein, 4 aa, Giardia lamblia
VDPE

SEQ ID NO: 3145199 - protein, 11 aa, Giardia lamblia
VDPEASKPRVP

SEQ ID NO: 3145200 - protein, 13 aa, Giardia lamblia
VDPERKRLKPPEY

SEQ ID NO: 3145201 - protein, 9 aa, Giardia lamblia
VDPETRKAA

SEQ ID NO: 3145202 - protein, 4 aa, Giardia lamblia
VDPG

SEQ ID NO: 3145203 - protein, 10 aa, Giardia lamblia
VDPGCTPEDH

SEQ ID NO: 3145204 - protein, 9 aa, Giardia lamblia
VDPGTSITA

SEQ ID NO: 3145205 - protein, 4 aa, Giardia lamblia
VDPL

SEQ ID NO: 3145206 - protein, 8 aa, Giardia lamblia
VDPPSCKD

SEQ ID NO: 3145207 - protein, 21 aa, Giardia lamblia
VDPPTSAEGNVHSSKDTAQFT

SEQ ID NO: 3145208 - protein, 7 aa, Giardia lamblia
VDPRTAA

SEQ ID NO: 3145209 - protein, 9 aa, Giardia lamblia
VDPSSDKVK

SEQ ID NO: 3145210 - protein, 8 aa, Giardia lamblia
VDPSTEQY

SEQ ID NO: 3145211 - protein, 5 aa, Giardia lamblia
VDPTC

SEQ ID NO: 3145212 - protein, 6 aa, Giardia lamblia
VDPWPG

SEQ ID NO: 3145213 - protein, 13 aa, Giardia lamblia
VDPYADAPSANKS

SEQ ID NO: 3145214 - protein, 8 aa, Giardia lamblia
VDPYSLTT

SEQ ID NO: 3145215 - protein, 10 aa, Giardia lamblia
VDQASASMAT

SEQ ID NO: 3145216 - protein, 19 aa, Giardia lamblia
VDQEASTEDLVAPDGPSLL

SEQ ID NO: 3145217 - protein, 17 aa, Giardia lamblia
VDQGPLVPNSGDTTNSL

SEQ ID NO: 3145218 - protein, 7 aa, Giardia lamblia
VDQPDHD

SEQ ID NO: 3145219 - protein, 15 aa, Giardia lamblia
VDQPIDSQRKSSRNF

SEQ ID NO: 3145220 - protein, 14 aa, Giardia lamblia
VDQRQKQDLGVQEA

SEQ ID NO: 3145221 - protein, 5 aa, Giardia lamblia
VDQSG

SEQ ID NO: 3145222 - protein, 6 aa, Giardia lamblia
VDQSQT

SEQ ID NO: 3145223 - protein, 10 aa, Giardia lamblia
VDQTETRNDA

SEQ ID NO: 3145224 - protein, 30 aa, Giardia lamblia
VDRAGSDTDYSDQPEGDSSIVEEENESDEV

SEQ ID NO: 3145225 - protein, 5 aa, Giardia lamblia
VDRTF

SEQ ID NO: 3145226 - protein, 10 aa, Giardia lamblia
VDSANERAHQ

SEQ ID NO: 3145227 - protein, 5 aa, Giardia lamblia
VDSDG

SEQ ID NO: 3145228 - protein, 6 aa, Giardia lamblia
VDSEGF

SEQ ID NO: 3145229 - protein, 7 aa, Giardia lamblia
VDSEGTS

SEQ ID NO: 3145230 - protein, 9 aa, Giardia lamblia
VDSEQQALA

SEQ ID NO: 3145231 - protein, 6 aa, Giardia lamblia
VDSGKT

SEQ ID NO: 3145232 - protein, 12 aa, Giardia lamblia
VDSGPEQPLPNG

SEQ ID NO: 3145233 - protein, 8 aa, Giardia lamblia
VDSKTMSQ

SEQ ID NO: 3145234 - protein, 4 aa, Giardia lamblia
VDSN

SEQ ID NO: 3145235 - protein, 7 aa, Giardia lamblia
VDSNADA

SEQ ID NO: 3145236 - protein, 8 aa, Giardia lamblia
VDSPEPRR

SEQ ID NO: 3145237 - protein, 16 aa, Giardia lamblia
VDSRHSREGQRPIHCL

SEQ ID NO: 3145238 - protein, 5 aa, Giardia lamblia
VDSRR

SEQ ID NO: 3145239 - protein, 4 aa, Giardia lamblia
VDSS

SEQ ID NO: 3145240 - protein, 9 aa, Giardia lamblia
VDSSGDVKA

SEQ ID NO: 3145241 - protein, 10 aa, Giardia lamblia
VDSSKTSSFH

SEQ ID NO: 3145242 - protein, 22 aa, Giardia lamblia
VDSSKVNHDDHDEKYSDRCSTD

SEQ ID NO: 3145243 - protein, 9 aa, Giardia lamblia
VDSSSAARI

SEQ ID NO: 3145244 - protein, 7 aa, Giardia lamblia
VDSTANP

SEQ ID NO: 3145245 - protein, 7 aa, Giardia lamblia
VDSTGQT

SEQ ID NO: 3145246 - protein, 4 aa, Giardia lamblia
VDSV

SEQ ID NO: 3145247 - protein, 7 aa, Giardia lamblia
VDSVPPS

SEQ ID NO: 3145248 - protein, 5 aa, Giardia lamblia
VDTAA

SEQ ID NO: 3145249 - protein, 15 aa, Giardia lamblia
VDTALTSGDHKEDLR

SEQ ID NO: 3145250 - protein, 5 aa, Giardia lamblia
VDTHL

SEQ ID NO: 3145251 - protein, 10 aa, Giardia lamblia
VDTHTEPDVE

SEQ ID NO: 3145252 - protein, 9 aa, Giardia lamblia
VDTKPLQQL

SEQ ID NO: 3145253 - protein, 7 aa, Giardia lamblia
VDTLRTD

SEQ ID NO: 3145254 - protein, 23 aa, Giardia lamblia
VDTPERAGLNEEDSSDNEQDAQE

SEQ ID NO: 3145255 - protein, 7 aa, Giardia lamblia
VDTPPEL

SEQ ID NO: 3145256 - protein, 8 aa, Giardia lamblia
VDTPPELS

SEQ ID NO: 3145257 - protein, 15 aa, Giardia lamblia
VDTPTVKTSSEAPEM

SEQ ID NO: 3145258 - protein, 5 aa, Giardia lamblia
VDTQI

SEQ ID NO: 3145259 - protein, 8 aa, Giardia lamblia
VDTQTQVE

SEQ ID NO: 3145260 - protein, 7 aa, Giardia lamblia
VDTRQRG

SEQ ID NO: 3145261 - protein, 8 aa, Giardia lamblia
VDTRTNTT

SEQ ID NO: 3145262 - protein, 11 aa, Giardia lamblia
VDTSDETREAV

SEQ ID NO: 3145263 - protein, 7 aa, Giardia lamblia
VDTSDNH

SEQ ID NO: 3145264 - protein, 9 aa, Giardia lamblia
VDTSPIPEV

SEQ ID NO: 3145265 - protein, 36 aa, Giardia lamblia
VDTSTKPCTADSKVSQQPFRGSPKRNLPPDHGVGEA

SEQ ID NO: 3145266 - protein, 8 aa, Giardia lamblia
VDTTGAGL

SEQ ID NO: 3145267 - protein, 8 aa, Giardia lamblia
VDVDPQTK

SEQ ID NO: 3145268 - protein, 4 aa, Giardia lamblia
VDVT

SEQ ID NO: 3145269 - protein, 8 aa, Giardia lamblia
VDYDPEFN

SEQ ID NO: 3145270 - protein, 15 aa, Giardia lamblia
VEADALKDGSGASVK

SEQ ID NO: 3145271 - protein, 7 aa, Giardia lamblia
VEADSHG

SEQ ID NO: 3145272 - protein, 7 aa, Giardia lamblia
VEAENNA

SEQ ID NO: 3145273 - protein, 6 aa, Giardia lamblia
VEAENQ

SEQ ID NO: 3145274 - protein, 7 aa, Giardia lamblia
VEAGDKN

SEQ ID NO: 3145275 - protein, 29 aa, Giardia lamblia
VEAPQPPPVSKPQEAEYKEDYDDYNDDDF

SEQ ID NO: 3145276 - protein, 16 aa, Giardia lamblia
VEAQTDTDASSQTTEF

SEQ ID NO: 3145277 - protein, 5 aa, Giardia lamblia
VEATE

SEQ ID NO: 3145278 - protein, 25 aa, Giardia lamblia
VEATPQIGSTPSGPYGAPPPQSSMY

SEQ ID NO: 3145279 - protein, 6 aa, Giardia lamblia
VECTQD

SEQ ID NO: 3145280 - protein, 34 aa, Giardia lamblia
VEDDDPESSRGAEKAKPKRSDEDQRSSGKTREED

SEQ ID NO: 3145281 - protein, 11 aa, Giardia lamblia
VEDDNNGIAGS

SEQ ID NO: 3145282 - protein, 9 aa, Giardia lamblia
VEDELSGPM

SEQ ID NO: 3145283 - protein, 28 aa, Giardia lamblia
VEDGGLTTSVEATSYRRPHSAAPSSRDI

SEQ ID NO: 3145284 - protein, 8 aa, Giardia lamblia
VEDGPSTG

SEQ ID NO: 3145285 - protein, 8 aa, Giardia lamblia
VEDHSTDP

SEQ ID NO: 3145286 - protein, 4 aa, Giardia lamblia
VEDL

SEQ ID NO: 3145287 - protein, 18 aa, Giardia lamblia
VEDNADPPPCLDTGPTSI

SEQ ID NO: 3145288 - protein, 5 aa, Giardia lamblia
VEDPG

SEQ ID NO: 3145289 - protein, 8 aa, Giardia lamblia
VEDPPNAV

SEQ ID NO: 3145290 - protein, 15 aa, Giardia lamblia
VEDQDDDDKDSVTIE

SEQ ID NO: 3145291 - protein, 78 aa, Giardia lamblia
VEEADEERRTTSRKRSHSQGRMSTRTNHKVSSSQRRSKRESTSHSKRSRGQSARHRRRPSSATRSRSAKSKPADKVHS

SEQ ID NO: 3145292 - protein, 19 aa, Giardia lamblia
VEEAGDPGATYRAHTSSSL

SEQ ID NO: 3145293 - protein, 25 aa, Giardia lamblia
VEEESVSRAPTKPIPGLETRTGAHA

SEQ ID NO: 3145294 - protein, 48 aa, Giardia lamblia
VEEEYDDEDDEAVPEDDNEDHQEESGEEDEDNGDNEDNEVVEDTTKRR

SEQ ID NO: 3145295 - protein, 10 aa, Giardia lamblia
VEEGKKDGLD

SEQ ID NO: 3145296 - protein, 8 aa, Giardia lamblia
VEEGTVSK

SEQ ID NO: 3145297 - protein, 4 aa, Giardia lamblia
VEEH

SEQ ID NO: 3145298 - protein, 10 aa, Giardia lamblia
VEEKDKETAN

SEQ ID NO: 3145299 - protein, 5 aa, Giardia lamblia
VEEKE

SEQ ID NO: 3145300 - protein, 10 aa, Giardia lamblia
VEEKERTSGL

SEQ ID NO: 3145301 - protein, 4 aa, Giardia lamblia
VEEN

SEQ ID NO: 3145302 - protein, 7 aa, Giardia lamblia
VEENGNT

SEQ ID NO: 3145303 - protein, 5 aa, Giardia lamblia
VEENN

SEQ ID NO: 3145304 - protein, 4 aa, Giardia lamblia
VEEP

SEQ ID NO: 3145305 - protein, 8 aa, Giardia lamblia
VEEPESSI

SEQ ID NO: 3145306 - protein, 8 aa, Giardia lamblia
VEEPSGYD

SEQ ID NO: 3145307 - protein, 6 aa, Giardia lamblia
VEERTP

SEQ ID NO: 3145308 - protein, 10 aa, Giardia lamblia
VEESHDEHPS

SEQ ID NO: 3145309 - protein, 17 aa, Giardia lamblia
VEESTTLTSEIARQEEK

SEQ ID NO: 3145310 - protein, 4 aa, Giardia lamblia
VEEY

SEQ ID NO: 3145311 - protein, 6 aa, Giardia lamblia
VEGASE

SEQ ID NO: 3145312 - protein, 17 aa, Giardia lamblia
VEGDPNDPKLGAMGDDS

SEQ ID NO: 3145313 - protein, 7 aa, Giardia lamblia
VEGETDR

SEQ ID NO: 3145314 - protein, 6 aa, Giardia lamblia
VEGGKL

SEQ ID NO: 3145315 - protein, 9 aa, Giardia lamblia
VEGLTESSM

SEQ ID NO: 3145316 - protein, 6 aa, Giardia lamblia
VEGNAA

SEQ ID NO: 3145317 - protein, 11 aa, Giardia lamblia
VEGNAQSYGAR

SEQ ID NO: 3145318 - protein, 17 aa, Giardia lamblia
VEGNNPVDTPPRRSSKM

SEQ ID NO: 3145319 - protein, 9 aa, Giardia lamblia
VEGNRKGSF

SEQ ID NO: 3145320 - protein, 9 aa, Giardia lamblia
VEGSDSDER

SEQ ID NO: 3145321 - protein, 11 aa, Giardia lamblia
VEGSVEKNKAL

SEQ ID NO: 3145322 - protein, 4 aa, Giardia lamblia
VEGV

SEQ ID NO: 3145323 - protein, 4 aa, Giardia lamblia
VEGY

SEQ ID NO: 3145324 - protein, 9 aa, Giardia lamblia
VEHGGDTDS

SEQ ID NO: 3145325 - protein, 8 aa, Giardia lamblia
VEIQTEAD

SEQ ID NO: 3145326 - protein, 8 aa, Giardia lamblia
VEKATQSV

SEQ ID NO: 3145327 - protein, 10 aa, Giardia lamblia
VEKGEAEEQL

SEQ ID NO: 3145328 - protein, 14 aa, Giardia lamblia
VEKKEDLTRQVEET

SEQ ID NO: 3145329 - protein, 21 aa, Giardia lamblia
VEKKTPSKSKTTSSTSSQEEF

SEQ ID NO: 3145330 - protein, 7 aa, Giardia lamblia
VEKPGKD

SEQ ID NO: 3145331 - protein, 20 aa, Giardia lamblia
VEKPKRTVESMNEASTRLSR

SEQ ID NO: 3145332 - protein, 12 aa, Giardia lamblia
VEKRPKNCPNDG

SEQ ID NO: 3145333 - protein, 6 aa, Giardia lamblia
VEKVEQ

SEQ ID NO: 3145334 - protein, 4 aa, Giardia lamblia
VELP

SEQ ID NO: 3145335 - protein, 10 aa, Giardia lamblia
VENANTGSSW

SEQ ID NO: 3145336 - protein, 6 aa, Giardia lamblia
VENEEQ

SEQ ID NO: 3145337 - protein, 5 aa, Giardia lamblia
VENIT

SEQ ID NO: 3145338 - protein, 4 aa, Giardia lamblia
VENR

SEQ ID NO: 3145339 - protein, 6 aa, Giardia lamblia
VENSNT

SEQ ID NO: 3145340 - protein, 8 aa, Giardia lamblia
VENSSGEC

SEQ ID NO: 3145341 - protein, 8 aa, Giardia lamblia
VENSSSVP

SEQ ID NO: 3145342 - protein, 15 aa, Giardia lamblia
VENTNEDSSAIPADS

SEQ ID NO: 3145343 - protein, 15 aa, Giardia lamblia
VEPDASSAGAEPSIV

SEQ ID NO: 3145344 - protein, 5 aa, Giardia lamblia
VEPDT

SEQ ID NO: 3145345 - protein, 9 aa, Giardia lamblia
VEPEGATEA

SEQ ID NO: 3145346 - protein, 47 aa, Giardia lamblia
VEPGDELKDPEDVESTLTASTSKSRKSMKSAKKAPKSKTKSGKNPTI

SEQ ID NO: 3145347 - protein, 12 aa, Giardia lamblia
VEPGQKSNGGEP

SEQ ID NO: 3145348 - protein, 14 aa, Giardia lamblia
VEPKRQKLAEAEGE

SEQ ID NO: 3145349 - protein, 8 aa, Giardia lamblia
VEPPSRSH

SEQ ID NO: 3145350 - protein, 8 aa, Giardia lamblia
VEPRTRQG

SEQ ID NO: 3145351 - protein, 14 aa, Giardia lamblia
VEPRYANDPTTSAS

SEQ ID NO: 3145352 - protein, 5 aa, Giardia lamblia
VEPSG

SEQ ID NO: 3145353 - protein, 5 aa, Giardia lamblia
VEPSQ

SEQ ID NO: 3145354 - protein, 5 aa, Giardia lamblia
VEPST

SEQ ID NO: 3145355 - protein, 8 aa, Giardia lamblia
VEPTDTIN

SEQ ID NO: 3145356 - protein, 4 aa, Giardia lamblia
VEPV

SEQ ID NO: 3145357 - protein, 11 aa, Giardia lamblia
VEQANAQKTDV

SEQ ID NO: 3145358 - protein, 5 aa, Giardia lamblia
VEQDF

SEQ ID NO: 3145359 - protein, 6 aa, Giardia lamblia
VEQGQE

SEQ ID NO: 3145360 - protein, 9 aa, Giardia lamblia
VEQLPEDER

SEQ ID NO: 3145361 - protein, 20 aa, Giardia lamblia
VEQNKRGANPYNSRTNASVN

SEQ ID NO: 3145362 - protein, 9 aa, Giardia lamblia
VEQPPESRT

SEQ ID NO: 3145363 - protein, 18 aa, Giardia lamblia
VEQQIRKAAQDGDRSSAE

SEQ ID NO: 3145364 - protein, 33 aa, Giardia lamblia
VEQQTSLTSTQSSELSGDAHSVHDEPKDMTGTP

SEQ ID NO: 3145365 - protein, 4 aa, Giardia lamblia
VEQY

SEQ ID NO: 3145366 - protein, 9 aa, Giardia lamblia
VERDSLRPE

SEQ ID NO: 3145367 - protein, 9 aa, Giardia lamblia
VERDSSDWT

SEQ ID NO: 3145368 - protein, 7 aa, Giardia lamblia
VERDSVS

SEQ ID NO: 3145369 - protein, 5 aa, Giardia lamblia
VERGL

SEQ ID NO: 3145370 - protein, 12 aa, Giardia lamblia
VERGSADSNESA

SEQ ID NO: 3145371 - protein, 16 aa, Giardia lamblia
VERHKSRLKPAAEVEG

SEQ ID NO: 3145372 - protein, 5 aa, Giardia lamblia
VERRY

SEQ ID NO: 3145373 - protein, 9 aa, Giardia lamblia
VERTQTPGR

SEQ ID NO: 3145374 - protein, 5 aa, Giardia lamblia
VERYE

SEQ ID NO: 3145375 - protein, 11 aa, Giardia lamblia
VESASAEGELP

SEQ ID NO: 3145376 - protein, 4 aa, Giardia lamblia
VESE

SEQ ID NO: 3145377 - protein, 8 aa, Giardia lamblia
VESEDAKM

SEQ ID NO: 3145378 - protein, 8 aa, Giardia lamblia
VESGEADF

SEQ ID NO: 3145379 - protein, 8 aa, Giardia lamblia
VESGGVDG

SEQ ID NO: 3145380 - protein, 9 aa, Giardia lamblia
VESGPQTQK

SEQ ID NO: 3145381 - protein, 10 aa, Giardia lamblia
VESGSAAYSN

SEQ ID NO: 3145382 - protein, 9 aa, Giardia lamblia
VESHEPTSL

SEQ ID NO: 3145383 - protein, 16 aa, Giardia lamblia
VESKSPIGSPSRPTAV

SEQ ID NO: 3145384 - protein, 13 aa, Giardia lamblia
VESKYGSEPTSGS

SEQ ID NO: 3145385 - protein, 5 aa, Giardia lamblia
VESNS

SEQ ID NO: 3145386 - protein, 8 aa, Giardia lamblia
VESPPLLA

SEQ ID NO: 3145387 - protein, 6 aa, Giardia lamblia
VESPPQ

SEQ ID NO: 3145388 - protein, 6 aa, Giardia lamblia
VESPRP

SEQ ID NO: 3145389 - protein, 8 aa, Giardia lamblia
VESPTRPM

SEQ ID NO: 3145390 - protein, 5 aa, Giardia lamblia
VESQT

SEQ ID NO: 3145391 - protein, 11 aa, Giardia lamblia
VESRDRERSAE

SEQ ID NO: 3145392 - protein, 10 aa, Giardia lamblia
VESRDSYEVR

SEQ ID NO: 3145393 - protein, 17 aa, Giardia lamblia
VESRPSATTSTSSLENA

SEQ ID NO: 3145394 - protein, 5 aa, Giardia lamblia
VESSA

SEQ ID NO: 3145395 - protein, 27 aa, Giardia lamblia
VESSCTADDEKVTVNATGQNRYPVDRD

SEQ ID NO: 3145396 - protein, 16 aa, Giardia lamblia
VESSSSQNPAPQEPER

SEQ ID NO: 3145397 - protein, 8 aa, Giardia lamblia
VESTERAY

SEQ ID NO: 3145398 - protein, 16 aa, Giardia lamblia
VESTKEKLSESQLSPT

SEQ ID NO: 3145399 - protein, 10 aa, Giardia lamblia
VETDDTNCQG

SEQ ID NO: 3145400 - protein, 18 aa, Giardia lamblia
VETDGTITPKTLETNKEE

SEQ ID NO: 3145401 - protein, 38 aa, Giardia lamblia
VETDNKASSVDTNLEEPCPNDAREQDSIKTTIQSTRVR

SEQ ID NO: 3145402 - protein, 6 aa, Giardia lamblia
VETGKT

SEQ ID NO: 3145403 - protein, 5 aa, Giardia lamblia
VETNH

SEQ ID NO: 3145404 - protein, 10 aa, Giardia lamblia
VETNKSIRNQ

SEQ ID NO: 3145405 - protein, 13 aa, Giardia lamblia
VETPAVPAPEHKP

SEQ ID NO: 3145406 - protein, 6 aa, Giardia lamblia
VETPEL

SEQ ID NO: 3145407 - protein, 39 aa, Giardia lamblia
VETQDDDEFGAQSGVQPLETSVPAPSSDTKEKGREERKI

SEQ ID NO: 3145408 - protein, 9 aa, Giardia lamblia
VETQNDDMA

SEQ ID NO: 3145409 - protein, 11 aa, Giardia lamblia
VETQNRETRPL

SEQ ID NO: 3145410 - protein, 14 aa, Giardia lamblia
VETSKCNAEREALT

SEQ ID NO: 3145411 - protein, 6 aa, Giardia lamblia
VETSQE

SEQ ID NO: 3145412 - protein, 10 aa, Giardia lamblia
VETTKSSAAN

SEQ ID NO: 3145413 - protein, 9 aa, Giardia lamblia
VEVGEGGSD

SEQ ID NO: 3145414 - protein, 32 aa, Giardia lamblia
VEVPRKEDDSSSVSSSSSNSDFSSEGAPGPMA

SEQ ID NO: 3145415 - protein, 10 aa, Giardia lamblia
VEVQRSETVK

SEQ ID NO: 3145416 - protein, 24 aa, Giardia lamblia
VEVSGNRRERPTGDHQRSEPRTSL

SEQ ID NO: 3145417 - protein, 20 aa, Giardia lamblia
VFAPSKKCTAAPPKSPQFTA

SEQ ID NO: 3145418 - protein, 6 aa, Giardia lamblia
VFPPAS

SEQ ID NO: 3145419 - protein, 8 aa, Giardia lamblia
VFSQDSNE

SEQ ID NO: 3145420 - protein, 10 aa, Giardia lamblia
VGAADTEISD

SEQ ID NO: 3145421 - protein, 14 aa, Giardia lamblia
VGAARSVDQQDEDL

SEQ ID NO: 3145422 - protein, 9 aa, Giardia lamblia
VGADGRPYK

SEQ ID NO: 3145423 - protein, 10 aa, Giardia lamblia
VGAEANTGTL

SEQ ID NO: 3145424 - protein, 7 aa, Giardia lamblia
VGAERSK

SEQ ID NO: 3145425 - protein, 15 aa, Giardia lamblia
VGAGEDKKTLTTDST

SEQ ID NO: 3145426 - protein, 9 aa, Giardia lamblia
VGAGQGDEN

SEQ ID NO: 3145427 - protein, 4 aa, Giardia lamblia
VGAP

SEQ ID NO: 3145428 - protein, 10 aa, Giardia lamblia
VGAPPDAFTP

SEQ ID NO: 3145429 - protein, 18 aa, Giardia lamblia
VGAPPTKPRRPPSFYNPP

SEQ ID NO: 3145430 - protein, 6 aa, Giardia lamblia
VGAPQG

SEQ ID NO: 3145431 - protein, 4 aa, Giardia lamblia
VGAQ

SEQ ID NO: 3145432 - protein, 7 aa, Giardia lamblia
VGAQPVA

SEQ ID NO: 3145433 - protein, 6 aa, Giardia lamblia
VGARSH

SEQ ID NO: 3145434 - protein, 14 aa, Giardia lamblia
VGASRALDADAAST

SEQ ID NO: 3145435 - protein, 7 aa, Giardia lamblia
VGASSGH

SEQ ID NO: 3145436 - protein, 6 aa, Giardia lamblia
VGCESD

SEQ ID NO: 3145437 - protein, 9 aa, Giardia lamblia
VGDDTGVEK

SEQ ID NO: 3145438 - protein, 8 aa, Giardia lamblia
VGDEGNRV

SEQ ID NO: 3145439 - protein, 8 aa, Giardia lamblia
VGDGAPSV

SEQ ID NO: 3145440 - protein, 7 aa, Giardia lamblia
VGDLTDE

SEQ ID NO: 3145441 - protein, 5 aa, Giardia lamblia
VGDME

SEQ ID NO: 3145442 - protein, 8 aa, Giardia lamblia
VGDPASYG

SEQ ID NO: 3145443 - protein, 5 aa, Giardia lamblia
VGDPE

SEQ ID NO: 3145444 - protein, 6 aa, Giardia lamblia
VGDPYV

SEQ ID NO: 3145445 - protein, 7 aa, Giardia lamblia
VGDRDVE

SEQ ID NO: 3145446 - protein, 8 aa, Giardia lamblia
VGDSGGNV

SEQ ID NO: 3145447 - protein, 13 aa, Giardia lamblia
VGDTARSYNPPSV

SEQ ID NO: 3145448 - protein, 7 aa, Giardia lamblia
VGEDDGD

SEQ ID NO: 3145449 - protein, 4 aa, Giardia lamblia
VGEE

SEQ ID NO: 3145450 - protein, 6 aa, Giardia lamblia
VGEEEG

SEQ ID NO: 3145451 - protein, 9 aa, Giardia lamblia
VGEGGPITP

SEQ ID NO: 3145452 - protein, 5 aa, Giardia lamblia
VGEGN

SEQ ID NO: 3145453 - protein, 20 aa, Giardia lamblia
VGEHGDKGGRWRGKGAPVGV

SEQ ID NO: 3145454 - protein, 12 aa, Giardia lamblia
VGEIDSNGSYVT

SEQ ID NO: 3145455 - protein, 14 aa, Giardia lamblia
VGEMERRKAEEDIR

SEQ ID NO: 3145456 - protein, 5 aa, Giardia lamblia
VGENI

SEQ ID NO: 3145457 - protein, 17 aa, Giardia lamblia
VGEPETDTERGDGHNHM

SEQ ID NO: 3145458 - protein, 9 aa, Giardia lamblia
VGEPTNAVP

SEQ ID NO: 3145459 - protein, 13 aa, Giardia lamblia
VGEQAAAKESALK

SEQ ID NO: 3145460 - protein, 5 aa, Giardia lamblia
VGESD

SEQ ID NO: 3145461 - protein, 44 aa, Giardia lamblia
VGGDQNAVSPSVSPSLSGRQPALESKPFSNAPRPNTKTETVSYD

SEQ ID NO: 3145462 - protein, 5 aa, Giardia lamblia
VGGDT

SEQ ID NO: 3145463 - protein, 53 aa, Giardia lamblia
VGGGATKKALGSTNPDDYMDESDESSELSNLSEGGVEDDDEPVDETVAPEGVS

SEQ ID NO: 3145464 - protein, 7 aa, Giardia lamblia
VGGGDAL

SEQ ID NO: 3145465 - protein, 7 aa, Giardia lamblia
VGGGIQE

SEQ ID NO: 3145466 - protein, 4 aa, Giardia lamblia
VGGK

SEQ ID NO: 3145467 - protein, 8 aa, Giardia lamblia
VGGPNYAP

SEQ ID NO: 3145468 - protein, 4 aa, Giardia lamblia
VGGT

SEQ ID NO: 3145469 - protein, 5 aa, Giardia lamblia
VGGTR

SEQ ID NO: 3145470 - protein, 4 aa, Giardia lamblia
VGGV

SEQ ID NO: 3145471 - protein, 7 aa, Giardia lamblia
VGIARRD

SEQ ID NO: 3145472 - protein, 49 aa, Giardia lamblia
VGIPGKPVSGVPPKDDASSEASSAGRQPASRHGPPSAHPPPPPSQQNKP

SEQ ID NO: 3145473 - protein, 10 aa, Giardia lamblia
VGKATYSGKT

SEQ ID NO: 3145474 - protein, 7 aa, Giardia lamblia
VGKDQKR

SEQ ID NO: 3145475 - protein, 9 aa, Giardia lamblia
VGKESGSSA

SEQ ID NO: 3145476 - protein, 8 aa, Giardia lamblia
VGKGSHQT

SEQ ID NO: 3145477 - protein, 4 aa, Giardia lamblia
VGKK

SEQ ID NO: 3145478 - protein, 8 aa, Giardia lamblia
VGKKSPNA

SEQ ID NO: 3145479 - protein, 10 aa, Giardia lamblia
VGKNPSLHSS

SEQ ID NO: 3145480 - protein, 8 aa, Giardia lamblia
VGKSAVNG

SEQ ID NO: 3145481 - protein, 26 aa, Giardia lamblia
VGKTISKSRGASGRSDKPDPAHRTSS

SEQ ID NO: 3145482 - protein, 4 aa, Giardia lamblia
VGLK

SEQ ID NO: 3145483 - protein, 10 aa, Giardia lamblia
VGMPGAPAPM

SEQ ID NO: 3145484 - protein, 5 aa, Giardia lamblia
VGMPN

SEQ ID NO: 3145485 - protein, 12 aa, Giardia lamblia
VGMTEKSTIEKG

SEQ ID NO: 3145486 - protein, 7 aa, Giardia lamblia
VGNASAD

SEQ ID NO: 3145487 - protein, 4 aa, Giardia lamblia
VGNE

SEQ ID NO: 3145488 - protein, 9 aa, Giardia lamblia
VGNGDPTKR

SEQ ID NO: 3145489 - protein, 23 aa, Giardia lamblia
VGNNPYRHDDSAQVRPAPGPGHT

SEQ ID NO: 3145490 - protein, 8 aa, Giardia lamblia
VGNPRGST

SEQ ID NO: 3145491 - protein, 6 aa, Giardia lamblia
VGNSAA

SEQ ID NO: 3145492 - protein, 10 aa, Giardia lamblia
VGPANSYTTS

SEQ ID NO: 3145493 - protein, 6 aa, Giardia lamblia
VGPAVP

SEQ ID NO: 3145494 - protein, 4 aa, Giardia lamblia
VGPD

SEQ ID NO: 3145495 - protein, 10 aa, Giardia lamblia
VGPDKAAEMT

SEQ ID NO: 3145496 - protein, 4 aa, Giardia lamblia
VGPE

SEQ ID NO: 3145497 - protein, 8 aa, Giardia lamblia
VGPEEKEQ

SEQ ID NO: 3145498 - protein, 6 aa, Giardia lamblia
VGPELQ

SEQ ID NO: 3145499 - protein, 12 aa, Giardia lamblia
VGPESDPYKPKY

SEQ ID NO: 3145500 - protein, 7 aa, Giardia lamblia
VGPLPKR

SEQ ID NO: 3145501 - protein, 4 aa, Giardia lamblia
VGPQ

SEQ ID NO: 3145502 - protein, 8 aa, Giardia lamblia
VGPRESAK

SEQ ID NO: 3145503 - protein, 15 aa, Giardia lamblia
VGPRGRRSKKVVSPE

SEQ ID NO: 3145504 - protein, 9 aa, Giardia lamblia
VGPSDDKDF

SEQ ID NO: 3145505 - protein, 6 aa, Giardia lamblia
VGPSKG

SEQ ID NO: 3145506 - protein, 9 aa, Giardia lamblia
VGPSTSDGD

SEQ ID NO: 3145507 - protein, 5 aa, Giardia lamblia
VGPTG

SEQ ID NO: 3145508 - protein, 18 aa, Giardia lamblia
VGPVEKAEHENNDRLNGD

SEQ ID NO: 3145509 - protein, 8 aa, Giardia lamblia
VGQANELR

SEQ ID NO: 3145510 - protein, 4 aa, Giardia lamblia
VGQD

SEQ ID NO: 3145511 - protein, 28 aa, Giardia lamblia
VGQENTSPRGVKSRPGPGHTASIAPPRF

SEQ ID NO: 3145512 - protein, 9 aa, Giardia lamblia
VGQGNQANK

SEQ ID NO: 3145513 - protein, 9 aa, Giardia lamblia
VGQPKSPQT

SEQ ID NO: 3145514 - protein, 5 aa, Giardia lamblia
VGQPM

SEQ ID NO: 3145515 - protein, 9 aa, Giardia lamblia
VGQQTKCAS

SEQ ID NO: 3145516 - protein, 11 aa, Giardia lamblia
VGQRDEQGRIS

SEQ ID NO: 3145517 - protein, 6 aa, Giardia lamblia
VGQRRD

SEQ ID NO: 3145518 - protein, 10 aa, Giardia lamblia
VGQRYKDSCK

SEQ ID NO: 3145519 - protein, 13 aa, Giardia lamblia
VGQSNRENNTADL

SEQ ID NO: 3145520 - protein, 12 aa, Giardia lamblia
VGQSPAGEQGTV

SEQ ID NO: 3145521 - protein, 7 aa, Giardia lamblia
VGQSQKE

SEQ ID NO: 3145522 - protein, 13 aa, Giardia lamblia
VGQTSSSTGAKYK

SEQ ID NO: 3145523 - protein, 14 aa, Giardia lamblia
VGRDLPKIGNTELG

SEQ ID NO: 3145524 - protein, 16 aa, Giardia lamblia
VGRKRYDADSGGAREI

SEQ ID NO: 3145525 - protein, 13 aa, Giardia lamblia
VGRNVPGRDSDRQ

SEQ ID NO: 3145526 - protein, 11 aa, Giardia lamblia
VGRQEETEAER

SEQ ID NO: 3145527 - protein, 24 aa, Giardia lamblia
VGRQGDKGASSEVPGSNGAATNPF

SEQ ID NO: 3145528 - protein, 9 aa, Giardia lamblia
VGRRSGRPL

SEQ ID NO: 3145529 - protein, 5 aa, Giardia lamblia
VGRSS

SEQ ID NO: 3145530 - protein, 7 aa, Giardia lamblia
VGRTETD

SEQ ID NO: 3145531 - protein, 13 aa, Giardia lamblia
VGRYETSLMNRGA

SEQ ID NO: 3145532 - protein, 24 aa, Giardia lamblia
VGSDDDQDPYDTYDPTAQEQDEEE

SEQ ID NO: 3145533 - protein, 7 aa, Giardia lamblia
VGSDGKI

SEQ ID NO: 3145534 - protein, 7 aa, Giardia lamblia
VGSEDSL

SEQ ID NO: 3145535 - protein, 10 aa, Giardia lamblia
VGSEGSQPSQ

SEQ ID NO: 3145536 - protein, 14 aa, Giardia lamblia
VGSISQRQNELRQQ

SEQ ID NO: 3145537 - protein, 20 aa, Giardia lamblia
VGSKEGIDNGDSGEDGEWRN

SEQ ID NO: 3145538 - protein, 14 aa, Giardia lamblia
VGSKPVEKQKVSHA

SEQ ID NO: 3145539 - protein, 13 aa, Giardia lamblia
VGSNPTGAAWPRN

SEQ ID NO: 3145540 - protein, 13 aa, Giardia lamblia
VGSPDEEDNEQEK

SEQ ID NO: 3145541 - protein, 26 aa, Giardia lamblia
VGSPQADEVEPEAESPVHEQPAAPDP

SEQ ID NO: 3145542 - protein, 10 aa, Giardia lamblia
VGSPSSLPPN

SEQ ID NO: 3145543 - protein, 13 aa, Giardia lamblia
VGSRSVSRAASVA

SEQ ID NO: 3145544 - protein, 10 aa, Giardia lamblia
VGSRTEAEAI

SEQ ID NO: 3145545 - protein, 4 aa, Giardia lamblia
VGSS

SEQ ID NO: 3145546 - protein, 7 aa, Giardia lamblia
VGSSNAG

SEQ ID NO: 3145547 - protein, 8 aa, Giardia lamblia
VGSSNSTA

SEQ ID NO: 3145548 - protein, 13 aa, Giardia lamblia
VGSSQGGGQGFTN

SEQ ID NO: 3145549 - protein, 9 aa, Giardia lamblia
VGSSRPSDA

SEQ ID NO: 3145550 - protein, 9 aa, Giardia lamblia
VGSSRRRGS

SEQ ID NO: 3145551 - protein, 8 aa, Giardia lamblia
VGSTPEYR

SEQ ID NO: 3145552 - protein, 12 aa, Giardia lamblia
VGSTPLSTKPRS

SEQ ID NO: 3145553 - protein, 5 aa, Giardia lamblia
VGTAC

SEQ ID NO: 3145554 - protein, 11 aa, Giardia lamblia
VGTASLGSDTY

SEQ ID NO: 3145555 - protein, 15 aa, Giardia lamblia
VGTGGKKKPSAAAQL

SEQ ID NO: 3145556 - protein, 8 aa, Giardia lamblia
VGTGHGRG

SEQ ID NO: 3145557 - protein, 26 aa, Giardia lamblia
VGTGNEDAADAVSTKKASKKTPKKDA

SEQ ID NO: 3145558 - protein, 5 aa, Giardia lamblia
VGTGR

SEQ ID NO: 3145559 - protein, 7 aa, Giardia lamblia
VGTHSAE

SEQ ID NO: 3145560 - protein, 11 aa, Giardia lamblia
VGTNTASQNSI

SEQ ID NO: 3145561 - protein, 9 aa, Giardia lamblia
VGTPDISCN

SEQ ID NO: 3145562 - protein, 12 aa, Giardia lamblia
VGTPSSEPLYSS

SEQ ID NO: 3145563 - protein, 30 aa, Giardia lamblia
VGTPTRSVSEPRLPTKSLRRSDSTKSSLAS

SEQ ID NO: 3145564 - protein, 19 aa, Giardia lamblia
VGTQQSKKPPKQSSNPDEN

SEQ ID NO: 3145565 - protein, 4 aa, Giardia lamblia
VGTS

SEQ ID NO: 3145566 - protein, 8 aa, Giardia lamblia
VGTSEGTL

SEQ ID NO: 3145567 - protein, 8 aa, Giardia lamblia
VGTTQDEQ

SEQ ID NO: 3145568 - protein, 8 aa, Giardia lamblia
VGTTQENL

SEQ ID NO: 3145569 - protein, 16 aa, Giardia lamblia
VGTTRTKARAGASFGD

SEQ ID NO: 3145570 - protein, 6 aa, Giardia lamblia
VGTTSD

SEQ ID NO: 3145571 - protein, 36 aa, Giardia lamblia
VGVESKSVRPVPAGISSSSNPPRMHPSQRRDEAQGS

SEQ ID NO: 3145572 - protein, 10 aa, Giardia lamblia
VGVGGGGNQM

SEQ ID NO: 3145573 - protein, 6 aa, Giardia lamblia
VGVSPE

SEQ ID NO: 3145574 - protein, 8 aa, Giardia lamblia
VGYTSKYS

SEQ ID NO: 3145575 - protein, 11 aa, Giardia lamblia
VHDGDPDTAEA

SEQ ID NO: 3145576 - protein, 13 aa, Giardia lamblia
VHEQDESTYTNRS

SEQ ID NO: 3145577 - protein, 12 aa, Giardia lamblia
VHGDPDPDLETH

SEQ ID NO: 3145578 - protein, 9 aa, Giardia lamblia
VHGDSSGCR

SEQ ID NO: 3145579 - protein, 28 aa, Giardia lamblia
VHGNEQETPNSSESNPLTNHRKKNRSDA

SEQ ID NO: 3145580 - protein, 12 aa, Giardia lamblia
VHGPKGFGTAGA

SEQ ID NO: 3145581 - protein, 6 aa, Giardia lamblia
VHGPPH

SEQ ID NO: 3145582 - protein, 12 aa, Giardia lamblia
VHGSDDSSNLTD

SEQ ID NO: 3145583 - protein, 6 aa, Giardia lamblia
VHNKNE

SEQ ID NO: 3145584 - protein, 10 aa, Giardia lamblia
VHNNSPGKVF

SEQ ID NO: 3145585 - protein, 5 aa, Giardia lamblia
VHNTS

SEQ ID NO: 3145586 - protein, 4 aa, Giardia lamblia
VHPG

SEQ ID NO: 3145587 - protein, 9 aa, Giardia lamblia
VHPGADKQC

SEQ ID NO: 3145588 - protein, 14 aa, Giardia lamblia
VHPSPKKLSPPNSF

SEQ ID NO: 3145589 - protein, 5 aa, Giardia lamblia
VHPTP

SEQ ID NO: 3145590 - protein, 18 aa, Giardia lamblia
VHPWGSDQYSSQDLPRNI

SEQ ID NO: 3145591 - protein, 10 aa, Giardia lamblia
VHQKTPTTRK

SEQ ID NO: 3145592 - protein, 27 aa, Giardia lamblia
VHQPSYQDGYSPTLNPTLHGNGGSIPP

SEQ ID NO: 3145593 - protein, 21 aa, Giardia lamblia
VHRESEIHGENNDQERQDTQK

SEQ ID NO: 3145594 - protein, 9 aa, Giardia lamblia
VHSDQHDNR

SEQ ID NO: 3145595 - protein, 5 aa, Giardia lamblia
VHSPS

SEQ ID NO: 3145596 - protein, 13 aa, Giardia lamblia
VHSYDSNTSGKLS

SEQ ID NO: 3145597 - protein, 8 aa, Giardia lamblia
VHTENYPP

SEQ ID NO: 3145598 - protein, 16 aa, Giardia lamblia
VHTPESMAGSIIRALY

SEQ ID NO: 3145599 - protein, 5 aa, Giardia lamblia
VHTPK

SEQ ID NO: 3145600 - protein, 5 aa, Giardia lamblia
VIAPA

SEQ ID NO: 3145601 - protein, 18 aa, Giardia lamblia
VIESGKDTPKSGAASPSR

SEQ ID NO: 3145602 - protein, 10 aa, Giardia lamblia
VIGPSGQQEI

SEQ ID NO: 3145603 - protein, 17 aa, Giardia lamblia
VIPKQATTTPPSSAKST

SEQ ID NO: 3145604 - protein, 17 aa, Giardia lamblia
VIPPGNSSHARMGTRQT

SEQ ID NO: 3145605 - protein, 18 aa, Giardia lamblia
VIPQTKTTQSEDAPARAL

SEQ ID NO: 3145606 - protein, 11 aa, Giardia lamblia
VIQESSQDSIP

SEQ ID NO: 3145607 - protein, 11 aa, Giardia lamblia
VISGGTAKSIT

SEQ ID NO: 3145608 - protein, 12 aa, Giardia lamblia
VISNSNTFTTSG

SEQ ID NO: 3145609 - protein, 20 aa, Giardia lamblia
VITPSQPSKAPQTKADKKEI

SEQ ID NO: 3145610 - protein, 26 aa, Giardia lamblia
VKAASTSKNTVNMKTEAPSKESGGCG

SEQ ID NO: 3145611 - protein, 8 aa, Giardia lamblia
VKAGAPPN

SEQ ID NO: 3145612 - protein, 15 aa, Giardia lamblia
VKAKKSSKNAKTKSK

SEQ ID NO: 3145613 - protein, 10 aa, Giardia lamblia
VKAKPAPYDA

SEQ ID NO: 3145614 - protein, 10 aa, Giardia lamblia
VKAKQNIKAE

SEQ ID NO: 3145615 - protein, 6 aa, Giardia lamblia
VKANAE

SEQ ID NO: 3145616 - protein, 5 aa, Giardia lamblia
VKANP

SEQ ID NO: 3145617 - protein, 6 aa, Giardia lamblia
VKAQKA

SEQ ID NO: 3145618 - protein, 5 aa, Giardia lamblia
VKASD

SEQ ID NO: 3145619 - protein, 7 aa, Giardia lamblia
VKASEAK

SEQ ID NO: 3145620 - protein, 8 aa, Giardia lamblia
VKASELDE

SEQ ID NO: 3145621 - protein, 13 aa, Giardia lamblia
VKDAAKAKDSEVT

SEQ ID NO: 3145622 - protein, 7 aa, Giardia lamblia
VKDASAI

SEQ ID NO: 3145623 - protein, 4 aa, Giardia lamblia
VKDD

SEQ ID NO: 3145624 - protein, 10 aa, Giardia lamblia
VKDGKEVREG

SEQ ID NO: 3145625 - protein, 7 aa, Giardia lamblia
VKDKSDY

SEQ ID NO: 3145626 - protein, 10 aa, Giardia lamblia
VKDLDAQKAD

SEQ ID NO: 3145627 - protein, 18 aa, Giardia lamblia
VKDPHSSHDNCEESEDLE

SEQ ID NO: 3145628 - protein, 8 aa, Giardia lamblia
VKDREIRT

SEQ ID NO: 3145629 - protein, 11 aa, Giardia lamblia
VKDSDDASLPT

SEQ ID NO: 3145630 - protein, 11 aa, Giardia lamblia
VKDSQQITSSA

SEQ ID NO: 3145631 - protein, 31 aa, Giardia lamblia
VKDSSEKSVERESAPTVSELSEGEKTASTAY

SEQ ID NO: 3145632 - protein, 5 aa, Giardia lamblia
VKDTD

SEQ ID NO: 3145633 - protein, 7 aa, Giardia lamblia
VKDVDRN

SEQ ID NO: 3145634 - protein, 9 aa, Giardia lamblia
VKEAKTKGK

SEQ ID NO: 3145635 - protein, 10 aa, Giardia lamblia
VKEGAKSQME

SEQ ID NO: 3145636 - protein, 13 aa, Giardia lamblia
VKEGGSTTLDTEA

SEQ ID NO: 3145637 - protein, 28 aa, Giardia lamblia
VKEHTKDQEAGSGAVAGAAAGATRRQVH

SEQ ID NO: 3145638 - protein, 17 aa, Giardia lamblia
VKEKEELEQEADAKTRL

SEQ ID NO: 3145639 - protein, 7 aa, Giardia lamblia
VKEKSST

SEQ ID NO: 3145640 - protein, 12 aa, Giardia lamblia
VKENEGDSSNYK

SEQ ID NO: 3145641 - protein, 9 aa, Giardia lamblia
VKENPDRVI

SEQ ID NO: 3145642 - protein, 7 aa, Giardia lamblia
VKEQNAS

SEQ ID NO: 3145643 - protein, 9 aa, Giardia lamblia
VKESTLKTA

SEQ ID NO: 3145644 - protein, 7 aa, Giardia lamblia
VKGAPLS

SEQ ID NO: 3145645 - protein, 6 aa, Giardia lamblia
VKGDDS

SEQ ID NO: 3145646 - protein, 29 aa, Giardia lamblia
VKGESSTSTGTPAGSDAKPQLRPTSPRSP

SEQ ID NO: 3145647 - protein, 11 aa, Giardia lamblia
VKGGADVTTLS

SEQ ID NO: 3145648 - protein, 6 aa, Giardia lamblia
VKGNGA

SEQ ID NO: 3145649 - protein, 6 aa, Giardia lamblia
VKGQKQ

SEQ ID NO: 3145650 - protein, 7 aa, Giardia lamblia
VKGSGSY

SEQ ID NO: 3145651 - protein, 7 aa, Giardia lamblia
VKGTIQA

SEQ ID NO: 3145652 - protein, 21 aa, Giardia lamblia
VKHASRSLNNKSQYKFPGTPE

SEQ ID NO: 3145653 - protein, 4 aa, Giardia lamblia
VKHN

SEQ ID NO: 3145654 - protein, 9 aa, Giardia lamblia
VKHRKGPDF

SEQ ID NO: 3145655 - protein, 7 aa, Giardia lamblia
VKKAQEQ

SEQ ID NO: 3145656 - protein, 19 aa, Giardia lamblia
VKKEDGHRNREAGDQKSQQ

SEQ ID NO: 3145657 - protein, 5 aa, Giardia lamblia
VKKGD

SEQ ID NO: 3145658 - protein, 24 aa, Giardia lamblia
VKKKTEEYESEKSTLITKKQNDAV

SEQ ID NO: 3145659 - protein, 17 aa, Giardia lamblia
VKKNLSDKDKKNDDGET

SEQ ID NO: 3145660 - protein, 11 aa, Giardia lamblia
VKKPPGAQKPI

SEQ ID NO: 3145661 - protein, 4 aa, Giardia lamblia
VKKR

SEQ ID NO: 3145662 - protein, 48 aa, Giardia lamblia
VKLTSQGKKETGRRRRSGKPATDTIEQPVPATGNSDAHSTIDESEDEV

SEQ ID NO: 3145663 - protein, 12 aa, Giardia lamblia
VKMSTGGSNWKT

SEQ ID NO: 3145664 - protein, 10 aa, Giardia lamblia
VKNEQQQSQS

SEQ ID NO: 3145665 - protein, 6 aa, Giardia lamblia
VKNGDV

SEQ ID NO: 3145666 - protein, 5 aa, Giardia lamblia
VKNNA

SEQ ID NO: 3145667 - protein, 11 aa, Giardia lamblia
VKNNDESNNQA

SEQ ID NO: 3145668 - protein, 8 aa, Giardia lamblia
VKNPSEDK

SEQ ID NO: 3145669 - protein, 8 aa, Giardia lamblia
VKNSDGET

SEQ ID NO: 3145670 - protein, 10 aa, Giardia lamblia
VKNSDGETAL

SEQ ID NO: 3145671 - protein, 4 aa, Giardia lamblia
VKNT

SEQ ID NO: 3145672 - protein, 13 aa, Giardia lamblia
VKNTSDRTSEPTE

SEQ ID NO: 3145673 - protein, 10 aa, Giardia lamblia
VKNYSKTASR

SEQ ID NO: 3145674 - protein, 11 aa, Giardia lamblia
VKPAGKGAPQI

SEQ ID NO: 3145675 - protein, 19 aa, Giardia lamblia
VKPAGRASGKEKAAKRQKK

SEQ ID NO: 3145676 - protein, 7 aa, Giardia lamblia
VKPDSDV

SEQ ID NO: 3145677 - protein, 4 aa, Giardia lamblia
VKPG

SEQ ID NO: 3145678 - protein, 18 aa, Giardia lamblia
VKPGDIEKHHNREKPDHY

SEQ ID NO: 3145679 - protein, 8 aa, Giardia lamblia
VKPGRSRI

SEQ ID NO: 3145680 - protein, 10 aa, Giardia lamblia
VKPHSQATQL

SEQ ID NO: 3145681 - protein, 8 aa, Giardia lamblia
VKPRPGEP

SEQ ID NO: 3145682 - protein, 10 aa, Giardia lamblia
VKPSKKEAAP

SEQ ID NO: 3145683 - protein, 8 aa, Giardia lamblia
VKPSTQHN

SEQ ID NO: 3145684 - protein, 7 aa, Giardia lamblia
VKPTHSV

SEQ ID NO: 3145685 - protein, 20 aa, Giardia lamblia
VKPTVSSAHRSRPSSSSLNT

SEQ ID NO: 3145686 - protein, 22 aa, Giardia lamblia
VKQEPQSSNVSPGRPKSSTRGP

SEQ ID NO: 3145687 - protein, 31 aa, Giardia lamblia
VKQEQVRREAQRSACKTGPVYGNKDEIGLDS

SEQ ID NO: 3145688 - protein, 18 aa, Giardia lamblia
VKQGEDGKPAPAPFPGPT

SEQ ID NO: 3145689 - protein, 5 aa, Giardia lamblia
VKQGG

SEQ ID NO: 3145690 - protein, 24 aa, Giardia lamblia
VKQGGTSENATGMEAHSPATESHG

SEQ ID NO: 3145691 - protein, 10 aa, Giardia lamblia
VKQRKPSSEA

SEQ ID NO: 3145692 - protein, 7 aa, Giardia lamblia
VKQTAPR

SEQ ID NO: 3145693 - protein, 7 aa, Giardia lamblia
VKQTSRF

SEQ ID NO: 3145694 - protein, 15 aa, Giardia lamblia
VKQVTSPSIPPTKEY

SEQ ID NO: 3145695 - protein, 29 aa, Giardia lamblia
VKRDAQERRTKKIPKSVKKRAELLARRRR

SEQ ID NO: 3145696 - protein, 12 aa, Giardia lamblia
VKREGSPRNGTA

SEQ ID NO: 3145697 - protein, 16 aa, Giardia lamblia
VKRKDTDFRESQEQLE

SEQ ID NO: 3145698 - protein, 31 aa, Giardia lamblia
VKRKGTDKNVTPAKASGSKKEHTENSDSDSY

SEQ ID NO: 3145699 - protein, 10 aa, Giardia lamblia
VKRRADGPDF

SEQ ID NO: 3145700 - protein, 17 aa, Giardia lamblia
VKRTSSAPASSSQRPFA

SEQ ID NO: 3145701 - protein, 7 aa, Giardia lamblia
VKSANQD

SEQ ID NO: 3145702 - protein, 13 aa, Giardia lamblia
VKSASAAAAPAAL

SEQ ID NO: 3145703 - protein, 9 aa, Giardia lamblia
VKSENANTG

SEQ ID NO: 3145704 - protein, 5 aa, Giardia lamblia
VKSKG

SEQ ID NO: 3145705 - protein, 8 aa, Giardia lamblia
VKSNEHNE

SEQ ID NO: 3145706 - protein, 34 aa, Giardia lamblia
VKSPQELVEEESNCKTRKPVKVQDAKKPRPGDQG

SEQ ID NO: 3145707 - protein, 8 aa, Giardia lamblia
VKSQTPLA

SEQ ID NO: 3145708 - protein, 18 aa, Giardia lamblia
VKSTPSRGRGTTNTRSQQ

SEQ ID NO: 3145709 - protein, 15 aa, Giardia lamblia
VKSVSDKVEKVDKAL

SEQ ID NO: 3145710 - protein, 9 aa, Giardia lamblia
VKTADSGYV

SEQ ID NO: 3145711 - protein, 8 aa, Giardia lamblia
VKTDRGTT

SEQ ID NO: 3145712 - protein, 11 aa, Giardia lamblia
VKTGKYPGDLT

SEQ ID NO: 3145713 - protein, 4 aa, Giardia lamblia
VKTH

SEQ ID NO: 3145714 - protein, 10 aa, Giardia lamblia
VKTKRRTKDV

SEQ ID NO: 3145715 - protein, 17 aa, Giardia lamblia
VKTKSTRSTHLKISARN

SEQ ID NO: 3145716 - protein, 9 aa, Giardia lamblia
VKTNGERTY

SEQ ID NO: 3145717 - protein, 13 aa, Giardia lamblia
VKTTKYPRSTRIA

SEQ ID NO: 3145718 - protein, 7 aa, Giardia lamblia
VKVKTQA

SEQ ID NO: 3145719 - protein, 5 aa, Giardia lamblia
VKYSD

SEQ ID NO: 3145720 - protein, 11 aa, Giardia lamblia
VLAPSEARERT

SEQ ID NO: 3145721 - protein, 10 aa, Giardia lamblia
VLDERNRQNK

SEQ ID NO: 3145722 - protein, 9 aa, Giardia lamblia
VLDESSPNV

SEQ ID NO: 3145723 - protein, 11 aa, Giardia lamblia
VLDGSTDEASF

SEQ ID NO: 3145724 - protein, 14 aa, Giardia lamblia
VLEEAKKRRESGEN

SEQ ID NO: 3145725 - protein, 4 aa, Giardia lamblia
VLES

SEQ ID NO: 3145726 - protein, 21 aa, Giardia lamblia
VLGDSSRKQQRDVSARPNQRL

SEQ ID NO: 3145727 - protein, 58 aa, Giardia lamblia
VLKGGTGSVMRPSRSFSSSGTVGRSGDTSHSAGFNRHSGSQTLATEPVSGEPKQTTGS

SEQ ID NO: 3145728 - protein, 6 aa, Giardia lamblia
VLPDGR

SEQ ID NO: 3145729 - protein, 5 aa, Giardia lamblia
VLPPA

SEQ ID NO: 3145730 - protein, 22 aa, Giardia lamblia
VLPSSEQAARVSVDGKSYQDGG

SEQ ID NO: 3145731 - protein, 7 aa, Giardia lamblia
VLQPGEK

SEQ ID NO: 3145732 - protein, 29 aa, Giardia lamblia
VLTPEKEKEFAEHEEKISERFSDTSISGR

SEQ ID NO: 3145733 - protein, 8 aa, Giardia lamblia
VMSGPEGS

SEQ ID NO: 3145734 - protein, 5 aa, Giardia lamblia
VMSTA

SEQ ID NO: 3145735 - protein, 8 aa, Giardia lamblia
VNAAESNI

SEQ ID NO: 3145736 - protein, 10 aa, Giardia lamblia
VNADNETTRL

SEQ ID NO: 3145737 - protein, 11 aa, Giardia lamblia
VNAPSESEPFF

SEQ ID NO: 3145738 - protein, 11 aa, Giardia lamblia
VNAQRASPQIS

SEQ ID NO: 3145739 - protein, 12 aa, Giardia lamblia
VNAQTGSGKTAA

SEQ ID NO: 3145740 - protein, 12 aa, Giardia lamblia
VNASETGDTGVQ

SEQ ID NO: 3145741 - protein, 8 aa, Giardia lamblia
VNASSEPL

SEQ ID NO: 3145742 - protein, 6 aa, Giardia lamblia
VNATES

SEQ ID NO: 3145743 - protein, 6 aa, Giardia lamblia
VNATPY

SEQ ID NO: 3145744 - protein, 10 aa, Giardia lamblia
VNDAQNASDN

SEQ ID NO: 3145745 - protein, 11 aa, Giardia lamblia
VNDAQQGNNCN

SEQ ID NO: 3145746 - protein, 9 aa, Giardia lamblia
VNDDDQTAY

SEQ ID NO: 3145747 - protein, 9 aa, Giardia lamblia
VNDEARRKI

SEQ ID NO: 3145748 - protein, 7 aa, Giardia lamblia
VNDEEQA

SEQ ID NO: 3145749 - protein, 8 aa, Giardia lamblia
VNDGEYNE

SEQ ID NO: 3145750 - protein, 6 aa, Giardia lamblia
VNDGTI

SEQ ID NO: 3145751 - protein, 7 aa, Giardia lamblia
VNDKGKM

SEQ ID NO: 3145752 - protein, 11 aa, Giardia lamblia
VNEDGTTALGD

SEQ ID NO: 3145753 - protein, 13 aa, Giardia lamblia
VNEDHESDSSDCQ

SEQ ID NO: 3145754 - protein, 8 aa, Giardia lamblia
VNEENKLT

SEQ ID NO: 3145755 - protein, 4 aa, Giardia lamblia
VNEH

SEQ ID NO: 3145756 - protein, 14 aa, Giardia lamblia
VNEPLSTFNELDID

SEQ ID NO: 3145757 - protein, 12 aa, Giardia lamblia
VNERSGESLKPF

SEQ ID NO: 3145758 - protein, 13 aa, Giardia lamblia
VNESLDQSSVAST

SEQ ID NO: 3145759 - protein, 5 aa, Giardia lamblia
VNETM

SEQ ID NO: 3145760 - protein, 7 aa, Giardia lamblia
VNGEGKT

SEQ ID NO: 3145761 - protein, 27 aa, Giardia lamblia
VNGENKGTARKANSSMSNANNPPARRR

SEQ ID NO: 3145762 - protein, 13 aa, Giardia lamblia
VNGPLTQAICTTK

SEQ ID NO: 3145763 - protein, 4 aa, Giardia lamblia
VNGQ

SEQ ID NO: 3145764 - protein, 8 aa, Giardia lamblia
VNGSSSLS

SEQ ID NO: 3145765 - protein, 13 aa, Giardia lamblia
VNGTTGVTGTAAA

SEQ ID NO: 3145766 - protein, 12 aa, Giardia lamblia
VNGYASDHTRTF

SEQ ID NO: 3145767 - protein, 12 aa, Giardia lamblia
VNHGDSNATSQA

SEQ ID NO: 3145768 - protein, 22 aa, Giardia lamblia
VNKDTVAQVKSPTNRSTVRGRE

SEQ ID NO: 3145769 - protein, 7 aa, Giardia lamblia
VNKGETA

SEQ ID NO: 3145770 - protein, 10 aa, Giardia lamblia
VNKGTRDPVE

SEQ ID NO: 3145771 - protein, 7 aa, Giardia lamblia
VNKNDET

SEQ ID NO: 3145772 - protein, 8 aa, Giardia lamblia
VNKQDTTL

SEQ ID NO: 3145773 - protein, 12 aa, Giardia lamblia
VNLPSDPTTLET

SEQ ID NO: 3145774 - protein, 6 aa, Giardia lamblia
VNNCQG

SEQ ID NO: 3145775 - protein, 6 aa, Giardia lamblia
VNNHGK

SEQ ID NO: 3145776 - protein, 4 aa, Giardia lamblia
VNNR

SEQ ID NO: 3145777 - protein, 6 aa, Giardia lamblia
VNNRDE

SEQ ID NO: 3145778 - protein, 9 aa, Giardia lamblia
VNPDSSEYL

SEQ ID NO: 3145779 - protein, 9 aa, Giardia lamblia
VNPEDKPTF

SEQ ID NO: 3145780 - protein, 6 aa, Giardia lamblia
VNPEQY

SEQ ID NO: 3145781 - protein, 4 aa, Giardia lamblia
VNPG

SEQ ID NO: 3145782 - protein, 7 aa, Giardia lamblia
VNPGQLR

SEQ ID NO: 3145783 - protein, 4 aa, Giardia lamblia
VNPN

SEQ ID NO: 3145784 - protein, 5 aa, Giardia lamblia
VNPNE

SEQ ID NO: 3145785 - protein, 12 aa, Giardia lamblia
VNPNEAGAQEEN

SEQ ID NO: 3145786 - protein, 7 aa, Giardia lamblia
VNPNITG

SEQ ID NO: 3145787 - protein, 6 aa, Giardia lamblia
VNPNTL

SEQ ID NO: 3145788 - protein, 4 aa, Giardia lamblia
VNPP

SEQ ID NO: 3145789 - protein, 9 aa, Giardia lamblia
VNPQATKTF

SEQ ID NO: 3145790 - protein, 18 aa, Giardia lamblia
VNPRDSTVIPNRGGIKEV

SEQ ID NO: 3145791 - protein, 7 aa, Giardia lamblia
VNPSDDP

SEQ ID NO: 3145792 - protein, 14 aa, Giardia lamblia
VNPSGKSSCTGTTS

SEQ ID NO: 3145793 - protein, 17 aa, Giardia lamblia
VNPSGQPVTASSTARSI

SEQ ID NO: 3145794 - protein, 12 aa, Giardia lamblia
VNPSSVQIPRSR

SEQ ID NO: 3145795 - protein, 10 aa, Giardia lamblia
VNPVDSPEHP

SEQ ID NO: 3145796 - protein, 16 aa, Giardia lamblia
VNQEAKRVERTREDKL

SEQ ID NO: 3145797 - protein, 7 aa, Giardia lamblia
VNQEKNK

SEQ ID NO: 3145798 - protein, 4 aa, Giardia lamblia
VNQK

SEQ ID NO: 3145799 - protein, 4 aa, Giardia lamblia
VNQN

SEQ ID NO: 3145800 - protein, 74 aa, Giardia lamblia
VNQPAQRAVSSKTRSSSNSRATSALRTGPQRASTASHSAPKSRNSIQSARGAAQEKDFTKPTKSAKAPTSIADR

SEQ ID NO: 3145801 - protein, 20 aa, Giardia lamblia
VNQQSTSAERVAKSAEKDST

SEQ ID NO: 3145802 - protein, 7 aa, Giardia lamblia
VNRDANP

SEQ ID NO: 3145803 - protein, 4 aa, Giardia lamblia
VNRG

SEQ ID NO: 3145804 - protein, 6 aa, Giardia lamblia
VNRKGC

SEQ ID NO: 3145805 - protein, 18 aa, Giardia lamblia
VNRTQSTGDLGSTSFTGY

SEQ ID NO: 3145806 - protein, 4 aa, Giardia lamblia
VNSA

SEQ ID NO: 3145807 - protein, 7 aa, Giardia lamblia
VNSADLG

SEQ ID NO: 3145808 - protein, 7 aa, Giardia lamblia
VNSDKAM

SEQ ID NO: 3145809 - protein, 8 aa, Giardia lamblia
VNSGEIDI

SEQ ID NO: 3145810 - protein, 7 aa, Giardia lamblia
VNSLSES

SEQ ID NO: 3145811 - protein, 9 aa, Giardia lamblia
VNSPEKVDE

SEQ ID NO: 3145812 - protein, 14 aa, Giardia lamblia
VNSQTQTQTHIAPQ

SEQ ID NO: 3145813 - protein, 13 aa, Giardia lamblia
VNSRGKADCETQT

SEQ ID NO: 3145814 - protein, 21 aa, Giardia lamblia
VNSRRSDRTRSRSRDRPRGGV

SEQ ID NO: 3145815 - protein, 8 aa, Giardia lamblia
VNSRSSKE

SEQ ID NO: 3145816 - protein, 14 aa, Giardia lamblia
VNTARKGQHAPRKT

SEQ ID NO: 3145817 - protein, 6 aa, Giardia lamblia
VNTDGV

SEQ ID NO: 3145818 - protein, 8 aa, Giardia lamblia
VNTGNQEN

SEQ ID NO: 3145819 - protein, 8 aa, Giardia lamblia
VNTHGNAD

SEQ ID NO: 3145820 - protein, 4 aa, Giardia lamblia
VNTK

SEQ ID NO: 3145821 - protein, 7 aa, Giardia lamblia
VNTKGQT

SEQ ID NO: 3145822 - protein, 35 aa, Giardia lamblia
VNTNKESGLTSAEANKLPRAYSANAALKAKRDLAT

SEQ ID NO: 3145823 - protein, 7 aa, Giardia lamblia
VNTQTLT

SEQ ID NO: 3145824 - protein, 9 aa, Giardia lamblia
VNTRTPANG

SEQ ID NO: 3145825 - protein, 6 aa, Giardia lamblia
VNTSRS

SEQ ID NO: 3145826 - protein, 4 aa, Giardia lamblia
VNYG

SEQ ID NO: 3145827 - protein, 4 aa, Giardia lamblia
VPAA

SEQ ID NO: 3145828 - protein, 17 aa, Giardia lamblia
VPAADSASGDCNPKQTT

SEQ ID NO: 3145829 - protein, 11 aa, Giardia lamblia
VPAATRAPVPQ

SEQ ID NO: 3145830 - protein, 7 aa, Giardia lamblia
VPAERSN

SEQ ID NO: 3145831 - protein, 6 aa, Giardia lamblia
VPAETN

SEQ ID NO: 3145832 - protein, 19 aa, Giardia lamblia
VPAGSNNGVGTGQKGLPAK

SEQ ID NO: 3145833 - protein, 8 aa, Giardia lamblia
VPAGTSAL

SEQ ID NO: 3145834 - protein, 10 aa, Giardia lamblia
VPAKYTNASE

SEQ ID NO: 3145835 - protein, 11 aa, Giardia lamblia
VPAPGDGLGPI

SEQ ID NO: 3145836 - protein, 6 aa, Giardia lamblia
VPAPPY

SEQ ID NO: 3145837 - protein, 10 aa, Giardia lamblia
VPAPTPTPVP

SEQ ID NO: 3145838 - protein, 6 aa, Giardia lamblia
VPARNG

SEQ ID NO: 3145839 - protein, 11 aa, Giardia lamblia
VPASAQRLQSP

SEQ ID NO: 3145840 - protein, 6 aa, Giardia lamblia
VPASGD

SEQ ID NO: 3145841 - protein, 27 aa, Giardia lamblia
VPATGASVEPPTETPELHDASQTQPTL

SEQ ID NO: 3145842 - protein, 9 aa, Giardia lamblia
VPATPGPKS

SEQ ID NO: 3145843 - protein, 11 aa, Giardia lamblia
VPCDGSDDDAH

SEQ ID NO: 3145844 - protein, 9 aa, Giardia lamblia
VPDAPAPSC

SEQ ID NO: 3145845 - protein, 7 aa, Giardia lamblia
VPDDAEQ

SEQ ID NO: 3145846 - protein, 10 aa, Giardia lamblia
VPDEPVEGAR

SEQ ID NO: 3145847 - protein, 10 aa, Giardia lamblia
VPDESEKGSL

SEQ ID NO: 3145848 - protein, 6 aa, Giardia lamblia
VPDGNA

SEQ ID NO: 3145849 - protein, 22 aa, Giardia lamblia
VPDNPKPEEPPSDIFADYISDV

SEQ ID NO: 3145850 - protein, 4 aa, Giardia lamblia
VPDP

SEQ ID NO: 3145851 - protein, 8 aa, Giardia lamblia
VPDPTYND

SEQ ID NO: 3145852 - protein, 12 aa, Giardia lamblia
VPDQSYDDIGGL

SEQ ID NO: 3145853 - protein, 12 aa, Giardia lamblia
VPDSPPTRPSIE

SEQ ID NO: 3145854 - protein, 8 aa, Giardia lamblia
VPDSPVRE

SEQ ID NO: 3145855 - protein, 8 aa, Giardia lamblia
VPDSVTSS

SEQ ID NO: 3145856 - protein, 6 aa, Giardia lamblia
VPDVRA

SEQ ID NO: 3145857 - protein, 4 aa, Giardia lamblia
VPEA

SEQ ID NO: 3145858 - protein, 20 aa, Giardia lamblia
VPEASTPRGITDITGSAQSA

SEQ ID NO: 3145859 - protein, 4 aa, Giardia lamblia
VPEG

SEQ ID NO: 3145860 - protein, 30 aa, Giardia lamblia
VPEGDTQGGGCSAGNRGQSEACRSQTKKRA

SEQ ID NO: 3145861 - protein, 7 aa, Giardia lamblia
VPEKPQN

SEQ ID NO: 3145862 - protein, 5 aa, Giardia lamblia
VPELP

SEQ ID NO: 3145863 - protein, 14 aa, Giardia lamblia
VPENATSPSPAPLN

SEQ ID NO: 3145864 - protein, 10 aa, Giardia lamblia
VPENKSRSKC

SEQ ID NO: 3145865 - protein, 9 aa, Giardia lamblia
VPENPADNP

SEQ ID NO: 3145866 - protein, 14 aa, Giardia lamblia
VPEPSKHTEPVRSR

SEQ ID NO: 3145867 - protein, 8 aa, Giardia lamblia
VPETERSK

SEQ ID NO: 3145868 - protein, 9 aa, Giardia lamblia
VPFPNKHND

SEQ ID NO: 3145869 - protein, 11 aa, Giardia lamblia
VPFQSDPGDRL

SEQ ID NO: 3145870 - protein, 30 aa, Giardia lamblia
VPFSSSAPLPGAAISGSQGPQGASYTNQGI

SEQ ID NO: 3145871 - protein, 7 aa, Giardia lamblia
VPGAPPV

SEQ ID NO: 3145872 - protein, 8 aa, Giardia lamblia
VPGDEEDS

SEQ ID NO: 3145873 - protein, 6 aa, Giardia lamblia
VPGDSD

SEQ ID NO: 3145874 - protein, 18 aa, Giardia lamblia
VPGEELPGVPNTSLPGQG

SEQ ID NO: 3145875 - protein, 20 aa, Giardia lamblia
VPGENSEPQRKHSAPLASTQ

SEQ ID NO: 3145876 - protein, 9 aa, Giardia lamblia
VPGEPGQRI

SEQ ID NO: 3145877 - protein, 4 aa, Giardia lamblia
VPGG

SEQ ID NO: 3145878 - protein, 9 aa, Giardia lamblia
VPGGGRNPI

SEQ ID NO: 3145879 - protein, 19 aa, Giardia lamblia
VPGGKAAPLKTKKMPSKYG

SEQ ID NO: 3145880 - protein, 5 aa, Giardia lamblia
VPGLS

SEQ ID NO: 3145881 - protein, 10 aa, Giardia lamblia
VPGNGFQQRE

SEQ ID NO: 3145882 - protein, 6 aa, Giardia lamblia
VPGPKN

SEQ ID NO: 3145883 - protein, 11 aa, Giardia lamblia
VPGPYKDPTSP

SEQ ID NO: 3145884 - protein, 4 aa, Giardia lamblia
VPGQ

SEQ ID NO: 3145885 - protein, 5 aa, Giardia lamblia
VPGQH

SEQ ID NO: 3145886 - protein, 10 aa, Giardia lamblia
VPGRHSESQK

SEQ ID NO: 3145887 - protein, 8 aa, Giardia lamblia
VPGSKPIS

SEQ ID NO: 3145888 - protein, 6 aa, Giardia lamblia
VPGSLP

SEQ ID NO: 3145889 - protein, 11 aa, Giardia lamblia
VPGSNAIGRKD

SEQ ID NO: 3145890 - protein, 11 aa, Giardia lamblia
VPGSPRSSTLS

SEQ ID NO: 3145891 - protein, 13 aa, Giardia lamblia
VPGTHDNNPSDGN

SEQ ID NO: 3145892 - protein, 17 aa, Giardia lamblia
VPGTTASSADSCISTEQ

SEQ ID NO: 3145893 - protein, 4 aa, Giardia lamblia
VPHE

SEQ ID NO: 3145894 - protein, 7 aa, Giardia lamblia
VPHEDDV

SEQ ID NO: 3145895 - protein, 8 aa, Giardia lamblia
VPHPAEPK

SEQ ID NO: 3145896 - protein, 4 aa, Giardia lamblia
VPHR

SEQ ID NO: 3145897 - protein, 5 aa, Giardia lamblia
VPHST

SEQ ID NO: 3145898 - protein, 14 aa, Giardia lamblia
VPIATTKGENLDVR

SEQ ID NO: 3145899 - protein, 14 aa, Giardia lamblia
VPIEDRTAAVQETY

SEQ ID NO: 3145900 - protein, 12 aa, Giardia lamblia
VPKAFSNRAEEL

SEQ ID NO: 3145901 - protein, 14 aa, Giardia lamblia
VPKDTASKHRDPSQ

SEQ ID NO: 3145902 - protein, 8 aa, Giardia lamblia
VPKKGDDT

SEQ ID NO: 3145903 - protein, 9 aa, Giardia lamblia
VPKKKPLEM

SEQ ID NO: 3145904 - protein, 19 aa, Giardia lamblia
VPKKKRSLQEHRPTSSLTQ

SEQ ID NO: 3145905 - protein, 6 aa, Giardia lamblia
VPKPGH

SEQ ID NO: 3145906 - protein, 7 aa, Giardia lamblia
VPKPSPD

SEQ ID NO: 3145907 - protein, 4 aa, Giardia lamblia
VPKQ

SEQ ID NO: 3145908 - protein, 12 aa, Giardia lamblia
VPKQGEKGYSYQ

SEQ ID NO: 3145909 - protein, 5 aa, Giardia lamblia
VPKQH

SEQ ID NO: 3145910 - protein, 9 aa, Giardia lamblia
VPKRDTKSP

SEQ ID NO: 3145911 - protein, 5 aa, Giardia lamblia
VPLGE

SEQ ID NO: 3145912 - protein, 8 aa, Giardia lamblia
VPLGEKGE

SEQ ID NO: 3145913 - protein, 12 aa, Giardia lamblia
VPLKDKNGRTAL

SEQ ID NO: 3145914 - protein, 4 aa, Giardia lamblia
VPLP

SEQ ID NO: 3145915 - protein, 6 aa, Giardia lamblia
VPMPDE

SEQ ID NO: 3145916 - protein, 12 aa, Giardia lamblia
VPNADGSPGIPA

SEQ ID NO: 3145917 - protein, 5 aa, Giardia lamblia
VPNAN

SEQ ID NO: 3145918 - protein, 11 aa, Giardia lamblia
VPNAPQTPVKQ

SEQ ID NO: 3145919 - protein, 6 aa, Giardia lamblia
VPNASE

SEQ ID NO: 3145920 - protein, 8 aa, Giardia lamblia
VPNATVPT

SEQ ID NO: 3145921 - protein, 6 aa, Giardia lamblia
VPNDNG

SEQ ID NO: 3145922 - protein, 11 aa, Giardia lamblia
VPNEEQRDFTQ

SEQ ID NO: 3145923 - protein, 5 aa, Giardia lamblia
VPNFS

SEQ ID NO: 3145924 - protein, 33 aa, Giardia lamblia
VPNGTQKFSKSPLPNTKSPPRSPLYKRPDSTRR

SEQ ID NO: 3145925 - protein, 5 aa, Giardia lamblia
VPNKD

SEQ ID NO: 3145926 - protein, 4 aa, Giardia lamblia
VPNL

SEQ ID NO: 3145927 - protein, 18 aa, Giardia lamblia
VPNNPNKQNATREWKVIV

SEQ ID NO: 3145928 - protein, 12 aa, Giardia lamblia
VPNNTKEDKNIS

SEQ ID NO: 3145929 - protein, 10 aa, Giardia lamblia
VPNPKPTSRL

SEQ ID NO: 3145930 - protein, 7 aa, Giardia lamblia
VPNPSNN

SEQ ID NO: 3145931 - protein, 4 aa, Giardia lamblia
VPNS

SEQ ID NO: 3145932 - protein, 17 aa, Giardia lamblia
VPNTNDTLAHREDTPFD

SEQ ID NO: 3145933 - protein, 33 aa, Giardia lamblia
VPNTTPINGRSLNAPRRGQFSSRPVGSADRAPF

SEQ ID NO: 3145934 - protein, 4 aa, Giardia lamblia
VPPA

SEQ ID NO: 3145935 - protein, 7 aa, Giardia lamblia
VPPAASV

SEQ ID NO: 3145936 - protein, 13 aa, Giardia lamblia
VPPAPGKLATTSL

SEQ ID NO: 3145937 - protein, 6 aa, Giardia lamblia
VPPEDS

SEQ ID NO: 3145938 - protein, 6 aa, Giardia lamblia
VPPEEL

SEQ ID NO: 3145939 - protein, 8 aa, Giardia lamblia
VPPEEYKS

SEQ ID NO: 3145940 - protein, 24 aa, Giardia lamblia
VPPEPSRSQEHDTHYSNSLNKDES

SEQ ID NO: 3145941 - protein, 6 aa, Giardia lamblia
VPPETL

SEQ ID NO: 3145942 - protein, 6 aa, Giardia lamblia
VPPETP

SEQ ID NO: 3145943 - protein, 10 aa, Giardia lamblia
VPPGAGFGQP

SEQ ID NO: 3145944 - protein, 16 aa, Giardia lamblia
VPPGGDPAEPSQRCPR

SEQ ID NO: 3145945 - protein, 7 aa, Giardia lamblia
VPPINES

SEQ ID NO: 3145946 - protein, 6 aa, Giardia lamblia
VPPINK

SEQ ID NO: 3145947 - protein, 4 aa, Giardia lamblia
VPPL

SEQ ID NO: 3145948 - protein, 7 aa, Giardia lamblia
VPPLSDN

SEQ ID NO: 3145949 - protein, 4 aa, Giardia lamblia
VPPN

SEQ ID NO: 3145950 - protein, 5 aa, Giardia lamblia
VPPNR

SEQ ID NO: 3145951 - protein, 6 aa, Giardia lamblia
VPPPDD

SEQ ID NO: 3145952 - protein, 6 aa, Giardia lamblia
VPPPKC

SEQ ID NO: 3145953 - protein, 17 aa, Giardia lamblia
VPPPPLPSGQHSTRARS

SEQ ID NO: 3145954 - protein, 8 aa, Giardia lamblia
VPPPQTTC

SEQ ID NO: 3145955 - protein, 9 aa, Giardia lamblia
VPPPRETKA

SEQ ID NO: 3145956 - protein, 29 aa, Giardia lamblia
VPPPRKSAEAIDPATAESNTLKAEDCERA

SEQ ID NO: 3145957 - protein, 27 aa, Giardia lamblia
VPPPRSSSRVRSRSTTTARGSGHRKEG

SEQ ID NO: 3145958 - protein, 15 aa, Giardia lamblia
VPPPVSKTDRRQRRR

SEQ ID NO: 3145959 - protein, 15 aa, Giardia lamblia
VPPQQAGQNSGPNFV

SEQ ID NO: 3145960 - protein, 4 aa, Giardia lamblia
VPPR

SEQ ID NO: 3145961 - protein, 5 aa, Giardia lamblia
VPPRV

SEQ ID NO: 3145962 - protein, 4 aa, Giardia lamblia
VPPS

SEQ ID NO: 3145963 - protein, 5 aa, Giardia lamblia
VPPSE

SEQ ID NO: 3145964 - protein, 16 aa, Giardia lamblia
VPPSPHPRPPQSEVAD

SEQ ID NO: 3145965 - protein, 9 aa, Giardia lamblia
VPPSSQTRY

SEQ ID NO: 3145966 - protein, 6 aa, Giardia lamblia
VPPSTD

SEQ ID NO: 3145967 - protein, 4 aa, Giardia lamblia
VPPT

SEQ ID NO: 3145968 - protein, 6 aa, Giardia lamblia
VPPTEL

SEQ ID NO: 3145969 - protein, 5 aa, Giardia lamblia
VPQED

SEQ ID NO: 3145970 - protein, 7 aa, Giardia lamblia
VPQEEQE

SEQ ID NO: 3145971 - protein, 9 aa, Giardia lamblia
VPQERVQDT

SEQ ID NO: 3145972 - protein, 5 aa, Giardia lamblia
VPQND

SEQ ID NO: 3145973 - protein, 5 aa, Giardia lamblia
VPQNI

SEQ ID NO: 3145974 - protein, 5 aa, Giardia lamblia
VPQPI

SEQ ID NO: 3145975 - protein, 6 aa, Giardia lamblia
VPQPLG

SEQ ID NO: 3145976 - protein, 7 aa, Giardia lamblia
VPQPPES

SEQ ID NO: 3145977 - protein, 15 aa, Giardia lamblia
VPQSSKDVRSSPLKP

SEQ ID NO: 3145978 - protein, 11 aa, Giardia lamblia
VPQSSRNFPSA

SEQ ID NO: 3145979 - protein, 5 aa, Giardia lamblia
VPQTE

SEQ ID NO: 3145980 - protein, 5 aa, Giardia lamblia
VPRAR

SEQ ID NO: 3145981 - protein, 11 aa, Giardia lamblia
VPRDKEKASLR

SEQ ID NO: 3145982 - protein, 8 aa, Giardia lamblia
VPRDSEGC

SEQ ID NO: 3145983 - protein, 5 aa, Giardia lamblia
VPREN

SEQ ID NO: 3145984 - protein, 21 aa, Giardia lamblia
VPRKSGVKQPQIIGTSGGAPL

SEQ ID NO: 3145985 - protein, 7 aa, Giardia lamblia
VPRPASM

SEQ ID NO: 3145986 - protein, 6 aa, Giardia lamblia
VPRPSL

SEQ ID NO: 3145987 - protein, 11 aa, Giardia lamblia
VPRSHTKKPLQ

SEQ ID NO: 3145988 - protein, 6 aa, Giardia lamblia
VPRSSL

SEQ ID NO: 3145989 - protein, 6 aa, Giardia lamblia
VPRTGQ

SEQ ID NO: 3145990 - protein, 11 aa, Giardia lamblia
VPRTSLDADKS

SEQ ID NO: 3145991 - protein, 4 aa, Giardia lamblia
VPRV

SEQ ID NO: 3145992 - protein, 8 aa, Giardia lamblia
VPSADTTE

SEQ ID NO: 3145993 - protein, 8 aa, Giardia lamblia
VPSANPSI

SEQ ID NO: 3145994 - protein, 9 aa, Giardia lamblia
VPSASVPPI

SEQ ID NO: 3145995 - protein, 9 aa, Giardia lamblia
VPSDAPDDY

SEQ ID NO: 3145996 - protein, 10 aa, Giardia lamblia
VPSDAQETRK

SEQ ID NO: 3145997 - protein, 9 aa, Giardia lamblia
VPSDEQGQF

SEQ ID NO: 3145998 - protein, 13 aa, Giardia lamblia
VPSDSELPKDAKY

SEQ ID NO: 3145999 - protein, 6 aa, Giardia lamblia
VPSEAV

SEQ ID NO: 3146000 - protein, 7 aa, Giardia lamblia
VPSENGD

SEQ ID NO: 3146001 - protein, 8 aa, Giardia lamblia
VPSESREV

SEQ ID NO: 3146002 - protein, 5 aa, Giardia lamblia
VPSGV

SEQ ID NO: 3146003 - protein, 18 aa, Giardia lamblia
VPSIDARSSLDPDAAQRL

SEQ ID NO: 3146004 - protein, 8 aa, Giardia lamblia
VPSIGTSK

SEQ ID NO: 3146005 - protein, 6 aa, Giardia lamblia
VPSKGV

SEQ ID NO: 3146006 - protein, 7 aa, Giardia lamblia
VPSNNQE

SEQ ID NO: 3146007 - protein, 10 aa, Giardia lamblia
VPSNSGRDYE

SEQ ID NO: 3146008 - protein, 9 aa, Giardia lamblia
VPSPPPLTK

SEQ ID NO: 3146009 - protein, 19 aa, Giardia lamblia
VPSQFDSTEENMKSTEIST

SEQ ID NO: 3146010 - protein, 16 aa, Giardia lamblia
VPSQPPVVPTTPAQPA

SEQ ID NO: 3146011 - protein, 7 aa, Giardia lamblia
VPSQTSV

SEQ ID NO: 3146012 - protein, 6 aa, Giardia lamblia
VPSSGL

SEQ ID NO: 3146013 - protein, 9 aa, Giardia lamblia
VPSTASANN

SEQ ID NO: 3146014 - protein, 9 aa, Giardia lamblia
VPSTHQRPI

SEQ ID NO: 3146015 - protein, 7 aa, Giardia lamblia
VPSTPDD

SEQ ID NO: 3146016 - protein, 11 aa, Giardia lamblia
VPSTPDSQQII

SEQ ID NO: 3146017 - protein, 12 aa, Giardia lamblia
VPSTQATTNAGT

SEQ ID NO: 3146018 - protein, 7 aa, Giardia lamblia
VPSVENE

SEQ ID NO: 3146019 - protein, 24 aa, Giardia lamblia
VPTARTRSPPRSATSLPRSTRDLH

SEQ ID NO: 3146020 - protein, 15 aa, Giardia lamblia
VPTASSTFNPGPQPC

SEQ ID NO: 3146021 - protein, 9 aa, Giardia lamblia
VPTATPPPM

SEQ ID NO: 3146022 - protein, 4 aa, Giardia lamblia
VPTD

SEQ ID NO: 3146023 - protein, 9 aa, Giardia lamblia
VPTEEDDMD

SEQ ID NO: 3146024 - protein, 13 aa, Giardia lamblia
VPTEPGAADTAYK

SEQ ID NO: 3146025 - protein, 13 aa, Giardia lamblia
VPTETKIYTQKTK

SEQ ID NO: 3146026 - protein, 11 aa, Giardia lamblia
VPTNVTEAEIE

SEQ ID NO: 3146027 - protein, 6 aa, Giardia lamblia
VPTPDI

SEQ ID NO: 3146028 - protein, 7 aa, Giardia lamblia
VPTPGGD

SEQ ID NO: 3146029 - protein, 8 aa, Giardia lamblia
VPTPPPEM

SEQ ID NO: 3146030 - protein, 6 aa, Giardia lamblia
VPTPRF

SEQ ID NO: 3146031 - protein, 34 aa, Giardia lamblia
VPTPSDSVPIDPSPQTAFAQGPEVVDPAQAEDSA

SEQ ID NO: 3146032 - protein, 14 aa, Giardia lamblia
VPTPTRSSSSGIGI

SEQ ID NO: 3146033 - protein, 19 aa, Giardia lamblia
VPTSHSRSSSTARADTRTA

SEQ ID NO: 3146034 - protein, 16 aa, Giardia lamblia
VPTSRNSDISKASGSL

SEQ ID NO: 3146035 - protein, 21 aa, Giardia lamblia
VPTSTESATSMASSNADALPH

SEQ ID NO: 3146036 - protein, 8 aa, Giardia lamblia
VPTSTTES

SEQ ID NO: 3146037 - protein, 5 aa, Giardia lamblia
VPTTD

SEQ ID NO: 3146038 - protein, 6 aa, Giardia lamblia
VPTVSR

SEQ ID NO: 3146039 - protein, 5 aa, Giardia lamblia
VPVEP

SEQ ID NO: 3146040 - protein, 17 aa, Giardia lamblia
VPVGQYTSSKLSTGAFD

SEQ ID NO: 3146041 - protein, 9 aa, Giardia lamblia
VPVKDGDSY

SEQ ID NO: 3146042 - protein, 7 aa, Giardia lamblia
VPVPNNP

SEQ ID NO: 3146043 - protein, 12 aa, Giardia lamblia
VPVPSGGQSSLT

SEQ ID NO: 3146044 - protein, 4 aa, Giardia lamblia
VPYR

SEQ ID NO: 3146045 - protein, 5 aa, Giardia lamblia
VPYRD

SEQ ID NO: 3146046 - protein, 6 aa, Giardia lamblia
VPYSAG

SEQ ID NO: 3146047 - protein, 6 aa, Giardia lamblia
VPYTTN

SEQ ID NO: 3146048 - protein, 5 aa, Giardia lamblia
VQAPN

SEQ ID NO: 3146049 - protein, 11 aa, Giardia lamblia
VQAPPEGSEQA

SEQ ID NO: 3146050 - protein, 6 aa, Giardia lamblia
VQASGK

SEQ ID NO: 3146051 - protein, 6 aa, Giardia lamblia
VQDADS

SEQ ID NO: 3146052 - protein, 9 aa, Giardia lamblia
VQDAQYKKY

SEQ ID NO: 3146053 - protein, 8 aa, Giardia lamblia
VQDEDALA

SEQ ID NO: 3146054 - protein, 4 aa, Giardia lamblia
VQDK

SEQ ID NO: 3146055 - protein, 4 aa, Giardia lamblia
VQDL

SEQ ID NO: 3146056 - protein, 6 aa, Giardia lamblia
VQDNDG

SEQ ID NO: 3146057 - protein, 22 aa, Giardia lamblia
VQDPDPAGGSRDVSGDNSVDSG

SEQ ID NO: 3146058 - protein, 8 aa, Giardia lamblia
VQDPRTKW

SEQ ID NO: 3146059 - protein, 10 aa, Giardia lamblia
VQDPSNPDIT

SEQ ID NO: 3146060 - protein, 4 aa, Giardia lamblia
VQDQ

SEQ ID NO: 3146061 - protein, 9 aa, Giardia lamblia
VQDSSECPV

SEQ ID NO: 3146062 - protein, 23 aa, Giardia lamblia
VQDTAESENNETDECGAEDPSVD

SEQ ID NO: 3146063 - protein, 15 aa, Giardia lamblia
VQDVNAGRGQTADMK

SEQ ID NO: 3146064 - protein, 6 aa, Giardia lamblia
VQEAQK

SEQ ID NO: 3146065 - protein, 9 aa, Giardia lamblia
VQEDREPLR

SEQ ID NO: 3146066 - protein, 7 aa, Giardia lamblia
VQEGEDG

SEQ ID NO: 3146067 - protein, 5 aa, Giardia lamblia
VQEKD

SEQ ID NO: 3146068 - protein, 17 aa, Giardia lamblia
VQEPAVQPTGQTDDKNA

SEQ ID NO: 3146069 - protein, 11 aa, Giardia lamblia
VQEQVSNEIAG

SEQ ID NO: 3146070 - protein, 7 aa, Giardia lamblia
VQESTKE

SEQ ID NO: 3146071 - protein, 29 aa, Giardia lamblia
VQETSSTSHTAENSRVPSAGVGSGQAGGV

SEQ ID NO: 3146072 - protein, 4 aa, Giardia lamblia
VQEY

SEQ ID NO: 3146073 - protein, 6 aa, Giardia lamblia
VQGDEV

SEQ ID NO: 3146074 - protein, 12 aa, Giardia lamblia
VQGGSNAGAEST

SEQ ID NO: 3146075 - protein, 7 aa, Giardia lamblia
VQGKTCD

SEQ ID NO: 3146076 - protein, 14 aa, Giardia lamblia
VQGPSGSSKRSSFL

SEQ ID NO: 3146077 - protein, 11 aa, Giardia lamblia
VQGRDGKSKGF

SEQ ID NO: 3146078 - protein, 23 aa, Giardia lamblia
VQGRSSKRALEGTMGSGPEMTSA

SEQ ID NO: 3146079 - protein, 37 aa, Giardia lamblia
VQGSSSDSKSSHFKTSHDQHPSSATNATTTADFKERP

SEQ ID NO: 3146080 - protein, 4 aa, Giardia lamblia
VQHA

SEQ ID NO: 3146081 - protein, 9 aa, Giardia lamblia
VQHDATEEL

SEQ ID NO: 3146082 - protein, 5 aa, Giardia lamblia
VQIDS

SEQ ID NO: 3146083 - protein, 14 aa, Giardia lamblia
VQISDDDKKKIETA

SEQ ID NO: 3146084 - protein, 9 aa, Giardia lamblia
VQKEEADAK

SEQ ID NO: 3146085 - protein, 7 aa, Giardia lamblia
VQKERRQ

SEQ ID NO: 3146086 - protein, 21 aa, Giardia lamblia
VQKETGSAADNDAESKSEGDM

SEQ ID NO: 3146087 - protein, 8 aa, Giardia lamblia
VQKGPQKT

SEQ ID NO: 3146088 - protein, 17 aa, Giardia lamblia
VQKGPYSGVQSRKNGNF

SEQ ID NO: 3146089 - protein, 19 aa, Giardia lamblia
VQKNAEQRAGTKTEDGDTG

SEQ ID NO: 3146090 - protein, 15 aa, Giardia lamblia
VQKRPQSATTGNSKE

SEQ ID NO: 3146091 - protein, 14 aa, Giardia lamblia
VQKRQRDREEKAAW

SEQ ID NO: 3146092 - protein, 20 aa, Giardia lamblia
VQKSKTRHGIPNASHEPQVV

SEQ ID NO: 3146093 - protein, 11 aa, Giardia lamblia
VQLDEKASALQ

SEQ ID NO: 3146094 - protein, 23 aa, Giardia lamblia
VQMTSGPSEPLDATQASEAAADS

SEQ ID NO: 3146095 - protein, 7 aa, Giardia lamblia
VQNGEED

SEQ ID NO: 3146096 - protein, 7 aa, Giardia lamblia
VQNKTEG

SEQ ID NO: 3146097 - protein, 13 aa, Giardia lamblia
VQNNKRRASDAAG

SEQ ID NO: 3146098 - protein, 9 aa, Giardia lamblia
VQNNRGESA

SEQ ID NO: 3146099 - protein, 5 aa, Giardia lamblia
VQNPY

SEQ ID NO: 3146100 - protein, 10 aa, Giardia lamblia
VQNSNPTGLH

SEQ ID NO: 3146101 - protein, 12 aa, Giardia lamblia
VQNTVQEDLPDT

SEQ ID NO: 3146102 - protein, 7 aa, Giardia lamblia
VQPATNL

SEQ ID NO: 3146103 - protein, 35 aa, Giardia lamblia
VQPAYPARSESPISASTETKTRTGDVNLEDTGSDT

SEQ ID NO: 3146104 - protein, 5 aa, Giardia lamblia
VQPEL

SEQ ID NO: 3146105 - protein, 13 aa, Giardia lamblia
VQPFESKDYQAEL

SEQ ID NO: 3146106 - protein, 4 aa, Giardia lamblia
VQPG

SEQ ID NO: 3146107 - protein, 6 aa, Giardia lamblia
VQPGAK

SEQ ID NO: 3146108 - protein, 5 aa, Giardia lamblia
VQPHG

SEQ ID NO: 3146109 - protein, 7 aa, Giardia lamblia
VQPKGGD

SEQ ID NO: 3146110 - protein, 5 aa, Giardia lamblia
VQPLG

SEQ ID NO: 3146111 - protein, 9 aa, Giardia lamblia
VQPPNKRAK

SEQ ID NO: 3146112 - protein, 8 aa, Giardia lamblia
VQPPSAQG

SEQ ID NO: 3146113 - protein, 5 aa, Giardia lamblia
VQPPV

SEQ ID NO: 3146114 - protein, 16 aa, Giardia lamblia
VQPSKSSVEQNPNTDI

SEQ ID NO: 3146115 - protein, 16 aa, Giardia lamblia
VQPSNNLAKATSAASF

SEQ ID NO: 3146116 - protein, 24 aa, Giardia lamblia
VQPSVADKQRMNRDRRSKTKQPHE

SEQ ID NO: 3146117 - protein, 4 aa, Giardia lamblia
VQPT

SEQ ID NO: 3146118 - protein, 9 aa, Giardia lamblia
VQQAPIPAK

SEQ ID NO: 3146119 - protein, 10 aa, Giardia lamblia
VQQATGAYPP

SEQ ID NO: 3146120 - protein, 7 aa, Giardia lamblia
VQQEVSQ

SEQ ID NO: 3146121 - protein, 12 aa, Giardia lamblia
VQQGCPSQESFS

SEQ ID NO: 3146122 - protein, 24 aa, Giardia lamblia
VQQPSLKESLSAPQVSGASDDELS

SEQ ID NO: 3146123 - protein, 6 aa, Giardia lamblia
VQQQAN

SEQ ID NO: 3146124 - protein, 6 aa, Giardia lamblia
VQQRAA

SEQ ID NO: 3146125 - protein, 23 aa, Giardia lamblia
VQQTNQESTAKDTAQLDPDSIGD

SEQ ID NO: 3146126 - protein, 7 aa, Giardia lamblia
VQRESEE

SEQ ID NO: 3146127 - protein, 8 aa, Giardia lamblia
VQRNTDSE

SEQ ID NO: 3146128 - protein, 5 aa, Giardia lamblia
VQRPT

SEQ ID NO: 3146129 - protein, 8 aa, Giardia lamblia
VQRRENAV

SEQ ID NO: 3146130 - protein, 14 aa, Giardia lamblia
VQRSADEAAARSSN

SEQ ID NO: 3146131 - protein, 8 aa, Giardia lamblia
VQRSSSNF

SEQ ID NO: 3146132 - protein, 7 aa, Giardia lamblia
VQSDGTQ

SEQ ID NO: 3146133 - protein, 9 aa, Giardia lamblia
VQSEPSQFG

SEQ ID NO: 3146134 - protein, 17 aa, Giardia lamblia
VQSLEKTKRKIQKALLN

SEQ ID NO: 3146135 - protein, 10 aa, Giardia lamblia
VQSNADSKAS

SEQ ID NO: 3146136 - protein, 6 aa, Giardia lamblia
VQSNTE

SEQ ID NO: 3146137 - protein, 6 aa, Giardia lamblia
VQSPDR

SEQ ID NO: 3146138 - protein, 11 aa, Giardia lamblia
VQSPENSETAD

SEQ ID NO: 3146139 - protein, 10 aa, Giardia lamblia
VQSPPAKAQG

SEQ ID NO: 3146140 - protein, 25 aa, Giardia lamblia
VQSQSSTPLASTALSSDPSHSNPIE

SEQ ID NO: 3146141 - protein, 6 aa, Giardia lamblia
VQSRDG

SEQ ID NO: 3146142 - protein, 12 aa, Giardia lamblia
VQSRKNPGASKH

SEQ ID NO: 3146143 - protein, 17 aa, Giardia lamblia
VQSSPRNALDKKGRRKT

SEQ ID NO: 3146144 - protein, 6 aa, Giardia lamblia
VQSTKK

SEQ ID NO: 3146145 - protein, 7 aa, Giardia lamblia
VQSTQTV

SEQ ID NO: 3146146 - protein, 7 aa, Giardia lamblia
VQTASRQ

SEQ ID NO: 3146147 - protein, 5 aa, Giardia lamblia
VQTDI

SEQ ID NO: 3146148 - protein, 6 aa, Giardia lamblia
VQTGAA

SEQ ID NO: 3146149 - protein, 28 aa, Giardia lamblia
VQTKGPQAPLSTQSTRPASLRGEGDSHV

SEQ ID NO: 3146150 - protein, 4 aa, Giardia lamblia
VQTR

SEQ ID NO: 3146151 - protein, 10 aa, Giardia lamblia
VQTTEQNSSL

SEQ ID NO: 3146152 - protein, 23 aa, Giardia lamblia
VRADKPGARKEKDPATKATSSLR

SEQ ID NO: 3146153 - protein, 6 aa, Giardia lamblia
VRADPT

SEQ ID NO: 3146154 - protein, 7 aa, Giardia lamblia
VRAEEQR

SEQ ID NO: 3146155 - protein, 24 aa, Giardia lamblia
VRAEGPSDKITKQPIKGRKRGGGL

SEQ ID NO: 3146156 - protein, 20 aa, Giardia lamblia
VRAEQGKTGASDRPDASRVK

SEQ ID NO: 3146157 - protein, 11 aa, Giardia lamblia
VRARSSRIDGL

SEQ ID NO: 3146158 - protein, 4 aa, Giardia lamblia
VRAT

SEQ ID NO: 3146159 - protein, 6 aa, Giardia lamblia
VRDDEV

SEQ ID NO: 3146160 - protein, 12 aa, Giardia lamblia
VRDENGELIGFT

SEQ ID NO: 3146161 - protein, 9 aa, Giardia lamblia
VRDKHGRSS

SEQ ID NO: 3146162 - protein, 28 aa, Giardia lamblia
VRDSSQSTQSKKKPRSTVPNTNVSITSG

SEQ ID NO: 3146163 - protein, 33 aa, Giardia lamblia
VRDTTDDGLEQRPRAKSDGGAPALDGAQNSSVE

SEQ ID NO: 3146164 - protein, 4 aa, Giardia lamblia
VREA

SEQ ID NO: 3146165 - protein, 8 aa, Giardia lamblia
VREAEARS

SEQ ID NO: 3146166 - protein, 4 aa, Giardia lamblia
VREE

SEQ ID NO: 3146167 - protein, 9 aa, Giardia lamblia
VREKDQLEK

SEQ ID NO: 3146168 - protein, 10 aa, Giardia lamblia
VREKNTRSHL

SEQ ID NO: 3146169 - protein, 4 aa, Giardia lamblia
VRER

SEQ ID NO: 3146170 - protein, 18 aa, Giardia lamblia
VRESPDNHSRAANPLDEE

SEQ ID NO: 3146171 - protein, 7 aa, Giardia lamblia
VRESRRL

SEQ ID NO: 3146172 - protein, 8 aa, Giardia lamblia
VRETEKGV

SEQ ID NO: 3146173 - protein, 30 aa, Giardia lamblia
VRFETTEEPQVSSADSLRPFSESNQVAAPV

SEQ ID NO: 3146174 - protein, 7 aa, Giardia lamblia
VRGAAGG

SEQ ID NO: 3146175 - protein, 9 aa, Giardia lamblia
VRGAKGRTA

SEQ ID NO: 3146176 - protein, 9 aa, Giardia lamblia
VRGGRGNQR

SEQ ID NO: 3146177 - protein, 20 aa, Giardia lamblia
VRGGYAGHPTAPRGPVLAAA

SEQ ID NO: 3146178 - protein, 10 aa, Giardia lamblia
VRGKGGTDGL

SEQ ID NO: 3146179 - protein, 12 aa, Giardia lamblia
VRGKPSKKAAPI

SEQ ID NO: 3146180 - protein, 11 aa, Giardia lamblia
VRGNAEEEHSG

SEQ ID NO: 3146181 - protein, 56 aa, Giardia lamblia
VRGNKTYISNPASPAPETGNRNSVSGVTREPSSAEVSPSNGCIKPSDPMDSTPTEP

SEQ ID NO: 3146182 - protein, 7 aa, Giardia lamblia
VRGPESL

SEQ ID NO: 3146183 - protein, 8 aa, Giardia lamblia
VRGQQPVG

SEQ ID NO: 3146184 - protein, 6 aa, Giardia lamblia
VRGSDA

SEQ ID NO: 3146185 - protein, 17 aa, Giardia lamblia
VRGTDSPLSDERKLKPS

SEQ ID NO: 3146186 - protein, 13 aa, Giardia lamblia
VRKEDNEGDDWEP

SEQ ID NO: 3146187 - protein, 5 aa, Giardia lamblia
VRKNE

SEQ ID NO: 3146188 - protein, 6 aa, Giardia lamblia
VRKPPI

SEQ ID NO: 3146189 - protein, 7 aa, Giardia lamblia
VRKQEEG

SEQ ID NO: 3146190 - protein, 8 aa, Giardia lamblia
VRKQKSQN

SEQ ID NO: 3146191 - protein, 8 aa, Giardia lamblia
VRKQPLPE

SEQ ID NO: 3146192 - protein, 11 aa, Giardia lamblia
VRKRETRPKYM

SEQ ID NO: 3146193 - protein, 7 aa, Giardia lamblia
VRNAAGD

SEQ ID NO: 3146194 - protein, 35 aa, Giardia lamblia
VRNKRARSGAEKDRIARSHTRNQKLGISKKATARR

SEQ ID NO: 3146195 - protein, 55 aa, Giardia lamblia
VRNPSRELRPTANSHNEEKAHPSQASSSSEYKASAHKLTRRTTPAPTPKNQVRQK

SEQ ID NO: 3146196 - protein, 9 aa, Giardia lamblia
VRNPTTDSV

SEQ ID NO: 3146197 - protein, 7 aa, Giardia lamblia
VRNSASL

SEQ ID NO: 3146198 - protein, 4 aa, Giardia lamblia
VRNT

SEQ ID NO: 3146199 - protein, 7 aa, Giardia lamblia
VRPATAE

SEQ ID NO: 3146200 - protein, 27 aa, Giardia lamblia
VRPATPGSALTEEKKQVESEIEQTNSE

SEQ ID NO: 3146201 - protein, 19 aa, Giardia lamblia
VRPDTASAAYTSLDTRPLT

SEQ ID NO: 3146202 - protein, 4 aa, Giardia lamblia
VRPE

SEQ ID NO: 3146203 - protein, 6 aa, Giardia lamblia
VRPGYE

SEQ ID NO: 3146204 - protein, 11 aa, Giardia lamblia
VRPPGANPAMK

SEQ ID NO: 3146205 - protein, 6 aa, Giardia lamblia
VRPPPI

SEQ ID NO: 3146206 - protein, 6 aa, Giardia lamblia
VRPPPY

SEQ ID NO: 3146207 - protein, 5 aa, Giardia lamblia
VRPPS

SEQ ID NO: 3146208 - protein, 7 aa, Giardia lamblia
VRPTNRN

SEQ ID NO: 3146209 - protein, 4 aa, Giardia lamblia
VRQA

SEQ ID NO: 3146210 - protein, 5 aa, Giardia lamblia
VRQAD

SEQ ID NO: 3146211 - protein, 7 aa, Giardia lamblia
VRQGPQE

SEQ ID NO: 3146212 - protein, 17 aa, Giardia lamblia
VRQRGEAEPKDTLRSSS

SEQ ID NO: 3146213 - protein, 12 aa, Giardia lamblia
VRRASRKSSEIN

SEQ ID NO: 3146214 - protein, 7 aa, Giardia lamblia
VRRDSGF

SEQ ID NO: 3146215 - protein, 9 aa, Giardia lamblia
VRRDTHSRA

SEQ ID NO: 3146216 - protein, 4 aa, Giardia lamblia
VRRE

SEQ ID NO: 3146217 - protein, 10 aa, Giardia lamblia
VRRGSEKADI

SEQ ID NO: 3146218 - protein, 4 aa, Giardia lamblia
VRRN

SEQ ID NO: 3146219 - protein, 7 aa, Giardia lamblia
VRRNPRT

SEQ ID NO: 3146220 - protein, 5 aa, Giardia lamblia
VRRPH

SEQ ID NO: 3146221 - protein, 36 aa, Giardia lamblia
VRRSNTNSRAGSRCNTASSVGNSGVRSTRNSLPSSA

SEQ ID NO: 3146222 - protein, 22 aa, Giardia lamblia
VRSAQTSRTASPLRSRSAQQDI

SEQ ID NO: 3146223 - protein, 9 aa, Giardia lamblia
VRSASKSGF

SEQ ID NO: 3146224 - protein, 12 aa, Giardia lamblia
VRSDHEVSKYSR

SEQ ID NO: 3146225 - protein, 10 aa, Giardia lamblia
VRSGDGNLTT

SEQ ID NO: 3146226 - protein, 7 aa, Giardia lamblia
VRSGPGV

SEQ ID NO: 3146227 - protein, 6 aa, Giardia lamblia
VRSGPR

SEQ ID NO: 3146228 - protein, 9 aa, Giardia lamblia
VRSKEDGQI

SEQ ID NO: 3146229 - protein, 13 aa, Giardia lamblia
VRSNEEEKNEVSY

SEQ ID NO: 3146230 - protein, 6 aa, Giardia lamblia
VRSPKK

SEQ ID NO: 3146231 - protein, 24 aa, Giardia lamblia
VRSPPKRAPQRKAQITQQGPTEPL

SEQ ID NO: 3146232 - protein, 8 aa, Giardia lamblia
VRSRGRSL

SEQ ID NO: 3146233 - protein, 8 aa, Giardia lamblia
VRSRKDGR

SEQ ID NO: 3146234 - protein, 9 aa, Giardia lamblia
VRSSDHKTL

SEQ ID NO: 3146235 - protein, 18 aa, Giardia lamblia
VRSSDRGSRATLSPNAPD

SEQ ID NO: 3146236 - protein, 7 aa, Giardia lamblia
VRSSGDA

SEQ ID NO: 3146237 - protein, 10 aa, Giardia lamblia
VRSSSSESTA

SEQ ID NO: 3146238 - protein, 7 aa, Giardia lamblia
VRSTGGT

SEQ ID NO: 3146239 - protein, 5 aa, Giardia lamblia
VRSTK

SEQ ID NO: 3146240 - protein, 8 aa, Giardia lamblia
VRSTRKGL

SEQ ID NO: 3146241 - protein, 32 aa, Giardia lamblia
VRSTSSRMPSRPDSAASSRRGSSVVNEADHNK

SEQ ID NO: 3146242 - protein, 8 aa, Giardia lamblia
VRTADGRT

SEQ ID NO: 3146243 - protein, 24 aa, Giardia lamblia
VRTAPDPTRPRTPPRLRTPSGLSR

SEQ ID NO: 3146244 - protein, 18 aa, Giardia lamblia
VRTDGDSKVSQKFNAAGG

SEQ ID NO: 3146245 - protein, 11 aa, Giardia lamblia
VRTETPDAEAA

SEQ ID NO: 3146246 - protein, 4 aa, Giardia lamblia
VRTN

SEQ ID NO: 3146247 - protein, 8 aa, Giardia lamblia
VRTNTGDT

SEQ ID NO: 3146248 - protein, 7 aa, Giardia lamblia
VRTNTGF

SEQ ID NO: 3146249 - protein, 7 aa, Giardia lamblia
VRTPDTL

SEQ ID NO: 3146250 - protein, 7 aa, Giardia lamblia
VRTPYDD

SEQ ID NO: 3146251 - protein, 11 aa, Giardia lamblia
VRTQQEDQIDG

SEQ ID NO: 3146252 - protein, 4 aa, Giardia lamblia
VRTT

SEQ ID NO: 3146253 - protein, 13 aa, Giardia lamblia
VRVGQDASVRSQV

SEQ ID NO: 3146254 - protein, 4 aa, Giardia lamblia
VSAA

SEQ ID NO: 3146255 - protein, 9 aa, Giardia lamblia
VSAAEGDEL

SEQ ID NO: 3146256 - protein, 9 aa, Giardia lamblia
VSAASPAFY

SEQ ID NO: 3146257 - protein, 8 aa, Giardia lamblia
VSAATGDI

SEQ ID NO: 3146258 - protein, 11 aa, Giardia lamblia
VSAATTEALTN

SEQ ID NO: 3146259 - protein, 10 aa, Giardia lamblia
VSADNSMNAL

SEQ ID NO: 3146260 - protein, 9 aa, Giardia lamblia
VSAEAEAKR

SEQ ID NO: 3146261 - protein, 12 aa, Giardia lamblia
VSAGAQGTYEEL

SEQ ID NO: 3146262 - protein, 13 aa, Giardia lamblia
VSAGKGDKLENER

SEQ ID NO: 3146263 - protein, 11 aa, Giardia lamblia
VSAHEGTDTKV

SEQ ID NO: 3146264 - protein, 11 aa, Giardia lamblia
VSAKRDDDTVL

SEQ ID NO: 3146265 - protein, 7 aa, Giardia lamblia
VSANFPQ

SEQ ID NO: 3146266 - protein, 7 aa, Giardia lamblia
VSANTGD

SEQ ID NO: 3146267 - protein, 23 aa, Giardia lamblia
VSAPPARTKQSVQGTQNTQILPG

SEQ ID NO: 3146268 - protein, 34 aa, Giardia lamblia
VSAPSASKPQFSGRLPPRSAGGDSRRFPAEQSPH

SEQ ID NO: 3146269 - protein, 9 aa, Giardia lamblia
VSAPSSFPF

SEQ ID NO: 3146270 - protein, 8 aa, Giardia lamblia
VSARSRKQ

SEQ ID NO: 3146271 - protein, 5 aa, Giardia lamblia
VSARY

SEQ ID NO: 3146272 - protein, 9 aa, Giardia lamblia
VSASKPDPA

SEQ ID NO: 3146273 - protein, 25 aa, Giardia lamblia
VSASPDNRGRGPAGVTNSYGGTSNR

SEQ ID NO: 3146274 - protein, 11 aa, Giardia lamblia
VSASQAKQAKE

SEQ ID NO: 3146275 - protein, 15 aa, Giardia lamblia
VSASSGMNRDNASTA

SEQ ID NO: 3146276 - protein, 7 aa, Giardia lamblia
VSASTRQ

SEQ ID NO: 3146277 - protein, 6 aa, Giardia lamblia
VSASYA

SEQ ID NO: 3146278 - protein, 6 aa, Giardia lamblia
VSDDGN

SEQ ID NO: 3146279 - protein, 7 aa, Giardia lamblia
VSDDRDS

SEQ ID NO: 3146280 - protein, 4 aa, Giardia lamblia
VSDE

SEQ ID NO: 3146281 - protein, 11 aa, Giardia lamblia
VSDEGVEARPA

SEQ ID NO: 3146282 - protein, 7 aa, Giardia lamblia
VSDGEPE

SEQ ID NO: 3146283 - protein, 14 aa, Giardia lamblia
VSDNAKKYPEAYEK

SEQ ID NO: 3146284 - protein, 6 aa, Giardia lamblia
VSDNYD

SEQ ID NO: 3146285 - protein, 14 aa, Giardia lamblia
VSDPSFARKDDAQD

SEQ ID NO: 3146286 - protein, 14 aa, Giardia lamblia
VSDRAHKDIPENPR

SEQ ID NO: 3146287 - protein, 8 aa, Giardia lamblia
VSDRTSVD

SEQ ID NO: 3146288 - protein, 9 aa, Giardia lamblia
VSDSGGDAG

SEQ ID NO: 3146289 - protein, 7 aa, Giardia lamblia
VSDSQIS

SEQ ID NO: 3146290 - protein, 14 aa, Giardia lamblia
VSDSSETSGSDSTY

SEQ ID NO: 3146291 - protein, 49 aa, Giardia lamblia
VSDSSTGSTGNSDKQTDLPDTALSKSGHRSSVNISSTREFTESLGSKQP

SEQ ID NO: 3146292 - protein, 11 aa, Giardia lamblia
VSDTATPKSLD

SEQ ID NO: 3146293 - protein, 28 aa, Giardia lamblia
VSDTKSGSKIPTVSTQMSPPARHPKSVT

SEQ ID NO: 3146294 - protein, 4 aa, Giardia lamblia
VSDY

SEQ ID NO: 3146295 - protein, 8 aa, Giardia lamblia
VSEALEGQ

SEQ ID NO: 3146296 - protein, 4 aa, Giardia lamblia
VSED

SEQ ID NO: 3146297 - protein, 4 aa, Giardia lamblia
VSEE

SEQ ID NO: 3146298 - protein, 7 aa, Giardia lamblia
VSEEQLT

SEQ ID NO: 3146299 - protein, 11 aa, Giardia lamblia
VSEHATPEERD

SEQ ID NO: 3146300 - protein, 8 aa, Giardia lamblia
VSEHGGVD

SEQ ID NO: 3146301 - protein, 7 aa, Giardia lamblia
VSEHSVT

SEQ ID NO: 3146302 - protein, 5 aa, Giardia lamblia
VSEKE

SEQ ID NO: 3146303 - protein, 5 aa, Giardia lamblia
VSELE

SEQ ID NO: 3146304 - protein, 5 aa, Giardia lamblia
VSELP

SEQ ID NO: 3146305 - protein, 21 aa, Giardia lamblia
VSELSQSNASSKDSEAPGISY

SEQ ID NO: 3146306 - protein, 7 aa, Giardia lamblia
VSENIAT

SEQ ID NO: 3146307 - protein, 10 aa, Giardia lamblia
VSEPGLSDYY

SEQ ID NO: 3146308 - protein, 20 aa, Giardia lamblia
VSEPPDLQERPPNAQGTPLT

SEQ ID NO: 3146309 - protein, 6 aa, Giardia lamblia
VSEQED

SEQ ID NO: 3146310 - protein, 9 aa, Giardia lamblia
VSEQETQIE

SEQ ID NO: 3146311 - protein, 11 aa, Giardia lamblia
VSERSDSHFSE

SEQ ID NO: 3146312 - protein, 22 aa, Giardia lamblia
VSERSSTDLKDVSDSEKQLEAQ

SEQ ID NO: 3146313 - protein, 6 aa, Giardia lamblia
VSERYE

SEQ ID NO: 3146314 - protein, 7 aa, Giardia lamblia
VSESPKI

SEQ ID NO: 3146315 - protein, 10 aa, Giardia lamblia
VSESSAASSD

SEQ ID NO: 3146316 - protein, 17 aa, Giardia lamblia
VSESTDLSDNLEDPRRV

SEQ ID NO: 3146317 - protein, 9 aa, Giardia lamblia
VSETGERSD

SEQ ID NO: 3146318 - protein, 9 aa, Giardia lamblia
VSETPGTFH

SEQ ID NO: 3146319 - protein, 7 aa, Giardia lamblia
VSFPPGT

SEQ ID NO: 3146320 - protein, 22 aa, Giardia lamblia
VSGAKAGEPIQDERREHREKAI

SEQ ID NO: 3146321 - protein, 7 aa, Giardia lamblia
VSGATQQ

SEQ ID NO: 3146322 - protein, 6 aa, Giardia lamblia
VSGAVG

SEQ ID NO: 3146323 - protein, 9 aa, Giardia lamblia
VSGCDSSME

SEQ ID NO: 3146324 - protein, 6 aa, Giardia lamblia
VSGDEG

SEQ ID NO: 3146325 - protein, 7 aa, Giardia lamblia
VSGDKVG

SEQ ID NO: 3146326 - protein, 6 aa, Giardia lamblia
VSGDSN

SEQ ID NO: 3146327 - protein, 8 aa, Giardia lamblia
VSGEGNDK

SEQ ID NO: 3146328 - protein, 9 aa, Giardia lamblia
VSGESAETR

SEQ ID NO: 3146329 - protein, 4 aa, Giardia lamblia
VSGG

SEQ ID NO: 3146330 - protein, 10 aa, Giardia lamblia
VSGGADGNVL

SEQ ID NO: 3146331 - protein, 11 aa, Giardia lamblia
VSGGGKSEISK

SEQ ID NO: 3146332 - protein, 8 aa, Giardia lamblia
VSGGKDSS

SEQ ID NO: 3146333 - protein, 19 aa, Giardia lamblia
VSGGSLSSSLSSSRNVKEP

SEQ ID NO: 3146334 - protein, 9 aa, Giardia lamblia
VSGHGPMNS

SEQ ID NO: 3146335 - protein, 18 aa, Giardia lamblia
VSGIPSRSEHHKNVDEPS

SEQ ID NO: 3146336 - protein, 9 aa, Giardia lamblia
VSGISDSGI

SEQ ID NO: 3146337 - protein, 6 aa, Giardia lamblia
VSGKEN

SEQ ID NO: 3146338 - protein, 5 aa, Giardia lamblia
VSGKT

SEQ ID NO: 3146339 - protein, 17 aa, Giardia lamblia
VSGLSKELSASSQLTTQ

SEQ ID NO: 3146340 - protein, 8 aa, Giardia lamblia
VSGNESDE

SEQ ID NO: 3146341 - protein, 6 aa, Giardia lamblia
VSGPNT

SEQ ID NO: 3146342 - protein, 5 aa, Giardia lamblia
VSGPV

SEQ ID NO: 3146343 - protein, 9 aa, Giardia lamblia
VSGRPKSAV

SEQ ID NO: 3146344 - protein, 11 aa, Giardia lamblia
VSGSASQGHWA

SEQ ID NO: 3146345 - protein, 6 aa, Giardia lamblia
VSGSDS

SEQ ID NO: 3146346 - protein, 10 aa, Giardia lamblia
VSGSQPTPGK

SEQ ID NO: 3146347 - protein, 8 aa, Giardia lamblia
VSGSRGET

SEQ ID NO: 3146348 - protein, 9 aa, Giardia lamblia
VSGSSSSHV

SEQ ID NO: 3146349 - protein, 8 aa, Giardia lamblia
VSGSTGIK

SEQ ID NO: 3146350 - protein, 6 aa, Giardia lamblia
VSGSTR

SEQ ID NO: 3146351 - protein, 33 aa, Giardia lamblia
VSGTPTVPTVPSLSGNVAGTTPISTRPPQNTHK

SEQ ID NO: 3146352 - protein, 6 aa, Giardia lamblia
VSGTSL

SEQ ID NO: 3146353 - protein, 14 aa, Giardia lamblia
VSGTSNETAKSSLD

SEQ ID NO: 3146354 - protein, 17 aa, Giardia lamblia
VSGTSTSMLGSTRQTAM

SEQ ID NO: 3146355 - protein, 18 aa, Giardia lamblia
VSGTTKLSSSSTADTLRR

SEQ ID NO: 3146356 - protein, 10 aa, Giardia lamblia
VSGVSDREYS

SEQ ID NO: 3146357 - protein, 4 aa, Giardia lamblia
VSHA

SEQ ID NO: 3146358 - protein, 11 aa, Giardia lamblia
VSHDDSGFKIS

SEQ ID NO: 3146359 - protein, 18 aa, Giardia lamblia
VSHKQKQDQLKTEDSDDW

SEQ ID NO: 3146360 - protein, 10 aa, Giardia lamblia
VSHPAPTVRP

SEQ ID NO: 3146361 - protein, 18 aa, Giardia lamblia
VSHQDDARNVTKDSPSFH

SEQ ID NO: 3146362 - protein, 12 aa, Giardia lamblia
VSHRQPKKSSKW

SEQ ID NO: 3146363 - protein, 11 aa, Giardia lamblia
VSHSGAETIRG

SEQ ID NO: 3146364 - protein, 8 aa, Giardia lamblia
VSHSSLPT

SEQ ID NO: 3146365 - protein, 8 aa, Giardia lamblia
VSHSSTKG

SEQ ID NO: 3146366 - protein, 23 aa, Giardia lamblia
VSIEPKQSSAFQQHNAASDDRTL

SEQ ID NO: 3146367 - protein, 7 aa, Giardia lamblia
VSKADVE

SEQ ID NO: 3146368 - protein, 31 aa, Giardia lamblia
VSKDEAAQLPPKQPGSASGALTKEIGTDQEP

SEQ ID NO: 3146369 - protein, 20 aa, Giardia lamblia
VSKEDELPTIPEQGTHIDPS

SEQ ID NO: 3146370 - protein, 5 aa, Giardia lamblia
VSKEL

SEQ ID NO: 3146371 - protein, 8 aa, Giardia lamblia
VSKEVANA

SEQ ID NO: 3146372 - protein, 10 aa, Giardia lamblia
VSKGGGGGKT

SEQ ID NO: 3146373 - protein, 9 aa, Giardia lamblia
VSKGHASDA

SEQ ID NO: 3146374 - protein, 7 aa, Giardia lamblia
VSKGNVS

SEQ ID NO: 3146375 - protein, 9 aa, Giardia lamblia
VSKHTRADV

SEQ ID NO: 3146376 - protein, 8 aa, Giardia lamblia
VSKLESEN

SEQ ID NO: 3146377 - protein, 8 aa, Giardia lamblia
VSKNPRYS

SEQ ID NO: 3146378 - protein, 4 aa, Giardia lamblia
VSKP

SEQ ID NO: 3146379 - protein, 8 aa, Giardia lamblia
VSKPGLAA

SEQ ID NO: 3146380 - protein, 8 aa, Giardia lamblia
VSKQEARK

SEQ ID NO: 3146381 - protein, 15 aa, Giardia lamblia
VSKQQSNQVRTVQQD

SEQ ID NO: 3146382 - protein, 5 aa, Giardia lamblia
VSKQS

SEQ ID NO: 3146383 - protein, 11 aa, Giardia lamblia
VSKSPSDRVST

SEQ ID NO: 3146384 - protein, 9 aa, Giardia lamblia
VSKSRNKNS

SEQ ID NO: 3146385 - protein, 9 aa, Giardia lamblia
VSKSSVDFD

SEQ ID NO: 3146386 - protein, 8 aa, Giardia lamblia
VSKSTRIR

SEQ ID NO: 3146387 - protein, 8 aa, Giardia lamblia
VSKTAPAG

SEQ ID NO: 3146388 - protein, 8 aa, Giardia lamblia
VSKTDSGE

SEQ ID NO: 3146389 - protein, 9 aa, Giardia lamblia
VSLEPRRGL

SEQ ID NO: 3146390 - protein, 9 aa, Giardia lamblia
VSLPSTNSY

SEQ ID NO: 3146391 - protein, 7 aa, Giardia lamblia
VSLPTPS

SEQ ID NO: 3146392 - protein, 4 aa, Giardia lamblia
VSLS

SEQ ID NO: 3146393 - protein, 6 aa, Giardia lamblia
VSLSEP

SEQ ID NO: 3146394 - protein, 14 aa, Giardia lamblia
VSLSPHRGSTKDQV

SEQ ID NO: 3146395 - protein, 8 aa, Giardia lamblia
VSLSRTDA

SEQ ID NO: 3146396 - protein, 19 aa, Giardia lamblia
VSMPGDASDIESLSSWSSS

SEQ ID NO: 3146397 - protein, 7 aa, Giardia lamblia
VSNDGSS

SEQ ID NO: 3146398 - protein, 7 aa, Giardia lamblia
VSNEDRQ

SEQ ID NO: 3146399 - protein, 21 aa, Giardia lamblia
VSNEPSQDQEQEQEQITEAHS

SEQ ID NO: 3146400 - protein, 9 aa, Giardia lamblia
VSNGEAKQE

SEQ ID NO: 3146401 - protein, 6 aa, Giardia lamblia
VSNGEL

SEQ ID NO: 3146402 - protein, 13 aa, Giardia lamblia
VSNGKDVETHTRA

SEQ ID NO: 3146403 - protein, 4 aa, Giardia lamblia
VSNP

SEQ ID NO: 3146404 - protein, 4 aa, Giardia lamblia
VSNQ

SEQ ID NO: 3146405 - protein, 8 aa, Giardia lamblia
VSNRPFNP

SEQ ID NO: 3146406 - protein, 10 aa, Giardia lamblia
VSNSESSSCI

SEQ ID NO: 3146407 - protein, 38 aa, Giardia lamblia
VSNTDFAGNPVNSTSNSTPTDRSLEPVPETSETSYDTD

SEQ ID NO: 3146408 - protein, 8 aa, Giardia lamblia
VSNTPNGS

SEQ ID NO: 3146409 - protein, 9 aa, Giardia lamblia
VSNTSPRSK

SEQ ID NO: 3146410 - protein, 6 aa, Giardia lamblia
VSPANE

SEQ ID NO: 3146411 - protein, 10 aa, Giardia lamblia
VSPASTSLRP

SEQ ID NO: 3146412 - protein, 9 aa, Giardia lamblia
VSPDARGTR

SEQ ID NO: 3146413 - protein, 10 aa, Giardia lamblia
VSPDDEHDDV

SEQ ID NO: 3146414 - protein, 19 aa, Giardia lamblia
VSPDGRPGKQLDDENRHEF

SEQ ID NO: 3146415 - protein, 6 aa, Giardia lamblia
VSPDSL

SEQ ID NO: 3146416 - protein, 7 aa, Giardia lamblia
VSPDSQQ

SEQ ID NO: 3146417 - protein, 5 aa, Giardia lamblia
VSPFT

SEQ ID NO: 3146418 - protein, 11 aa, Giardia lamblia
VSPGKRLPSKQ

SEQ ID NO: 3146419 - protein, 7 aa, Giardia lamblia
VSPGTKN

SEQ ID NO: 3146420 - protein, 6 aa, Giardia lamblia
VSPKGV

SEQ ID NO: 3146421 - protein, 15 aa, Giardia lamblia
VSPKKDPSSGRKPDN

SEQ ID NO: 3146422 - protein, 6 aa, Giardia lamblia
VSPNEK

SEQ ID NO: 3146423 - protein, 9 aa, Giardia lamblia
VSPNGPLSS

SEQ ID NO: 3146424 - protein, 18 aa, Giardia lamblia
VSPNMDVSPSAEEIKTYR

SEQ ID NO: 3146425 - protein, 15 aa, Giardia lamblia
VSPNSIADNSREAYN

SEQ ID NO: 3146426 - protein, 8 aa, Giardia lamblia
VSPNSPSA

SEQ ID NO: 3146427 - protein, 7 aa, Giardia lamblia
VSPNTTL

SEQ ID NO: 3146428 - protein, 15 aa, Giardia lamblia
VSPPPRQPGASASTM

SEQ ID NO: 3146429 - protein, 14 aa, Giardia lamblia
VSPQSSSPHDDTAE

SEQ ID NO: 3146430 - protein, 14 aa, Giardia lamblia
VSPQTTVRSDHHGS

SEQ ID NO: 3146431 - protein, 6 aa, Giardia lamblia
VSPRTN

SEQ ID NO: 3146432 - protein, 9 aa, Giardia lamblia
VSPSARSVE

SEQ ID NO: 3146433 - protein, 6 aa, Giardia lamblia
VSPSCP

SEQ ID NO: 3146434 - protein, 23 aa, Giardia lamblia
VSPTPASLAPKAIAGAETAPITI

SEQ ID NO: 3146435 - protein, 24 aa, Giardia lamblia
VSPTTGKDTGPALQRDPKVELSET

SEQ ID NO: 3146436 - protein, 7 aa, Giardia lamblia
VSPTTSQ

SEQ ID NO: 3146437 - protein, 7 aa, Giardia lamblia
VSPVTSG

SEQ ID NO: 3146438 - protein, 8 aa, Giardia lamblia
VSPYSYSD

SEQ ID NO: 3146439 - protein, 4 aa, Giardia lamblia
VSQA

SEQ ID NO: 3146440 - protein, 18 aa, Giardia lamblia
VSQASSVTRAPTSNKQPI

SEQ ID NO: 3146441 - protein, 5 aa, Giardia lamblia
VSQDT

SEQ ID NO: 3146442 - protein, 4 aa, Giardia lamblia
VSQE

SEQ ID NO: 3146443 - protein, 5 aa, Giardia lamblia
VSQEE

SEQ ID NO: 3146444 - protein, 6 aa, Giardia lamblia
VSQHRT

SEQ ID NO: 3146445 - protein, 4 aa, Giardia lamblia
VSQL

SEQ ID NO: 3146446 - protein, 5 aa, Giardia lamblia
VSQPE

SEQ ID NO: 3146447 - protein, 7 aa, Giardia lamblia
VSQPEAC

SEQ ID NO: 3146448 - protein, 8 aa, Giardia lamblia
VSQPEEAA

SEQ ID NO: 3146449 - protein, 9 aa, Giardia lamblia
VSQPPPSLV

SEQ ID NO: 3146450 - protein, 7 aa, Giardia lamblia
VSQPSYL

SEQ ID NO: 3146451 - protein, 5 aa, Giardia lamblia
VSQQN

SEQ ID NO: 3146452 - protein, 13 aa, Giardia lamblia
VSQQVQRAAANNE

SEQ ID NO: 3146453 - protein, 4 aa, Giardia lamblia
VSQS

SEQ ID NO: 3146454 - protein, 8 aa, Giardia lamblia
VSQSGTVE

SEQ ID NO: 3146455 - protein, 5 aa, Giardia lamblia
VSQSH

SEQ ID NO: 3146456 - protein, 10 aa, Giardia lamblia
VSQSKDIQNS

SEQ ID NO: 3146457 - protein, 14 aa, Giardia lamblia
VSQSSQQEKNARPI

SEQ ID NO: 3146458 - protein, 7 aa, Giardia lamblia
VSQTAPK

SEQ ID NO: 3146459 - protein, 18 aa, Giardia lamblia
VSQTEMERGSSKQDRHTY

SEQ ID NO: 3146460 - protein, 23 aa, Giardia lamblia
VSQTPEQYNKAAYQRRTDPRSIN

SEQ ID NO: 3146461 - protein, 5 aa, Giardia lamblia
VSQTQ

SEQ ID NO: 3146462 - protein, 7 aa, Giardia lamblia
VSRDPHA

SEQ ID NO: 3146463 - protein, 6 aa, Giardia lamblia
VSREGS

SEQ ID NO: 3146464 - protein, 23 aa, Giardia lamblia
VSRGKTALSESAHNLESKHSHGS

SEQ ID NO: 3146465 - protein, 35 aa, Giardia lamblia
VSRGTTGPESKKSASNSSAVAPTPSLGSKTVTSED

SEQ ID NO: 3146466 - protein, 4 aa, Giardia lamblia
VSRH

SEQ ID NO: 3146467 - protein, 18 aa, Giardia lamblia
VSRLPAPSAEFRSSARSA

SEQ ID NO: 3146468 - protein, 16 aa, Giardia lamblia
VSRNARSSSADGSLRE

SEQ ID NO: 3146469 - protein, 7 aa, Giardia lamblia
VSRNGTT

SEQ ID NO: 3146470 - protein, 7 aa, Giardia lamblia
VSRPELD

SEQ ID NO: 3146471 - protein, 12 aa, Giardia lamblia
VSRPESADKRLT

SEQ ID NO: 3146472 - protein, 8 aa, Giardia lamblia
VSRPGAPF

SEQ ID NO: 3146473 - protein, 14 aa, Giardia lamblia
VSRPGSPEDEAQRL

SEQ ID NO: 3146474 - protein, 7 aa, Giardia lamblia
VSRSESP

SEQ ID NO: 3146475 - protein, 9 aa, Giardia lamblia
VSRTSQNRI

SEQ ID NO: 3146476 - protein, 13 aa, Giardia lamblia
VSSCSGNCSSCQD

SEQ ID NO: 3146477 - protein, 4 aa, Giardia lamblia
VSSD

SEQ ID NO: 3146478 - protein, 11 aa, Giardia lamblia
VSSDARTSIKP

SEQ ID NO: 3146479 - protein, 8 aa, Giardia lamblia
VSSDEEKA

SEQ ID NO: 3146480 - protein, 5 aa, Giardia lamblia
VSSDG

SEQ ID NO: 3146481 - protein, 7 aa, Giardia lamblia
VSSDGEY

SEQ ID NO: 3146482 - protein, 10 aa, Giardia lamblia
VSSDPGAREQ

SEQ ID NO: 3146483 - protein, 6 aa, Giardia lamblia
VSSDST

SEQ ID NO: 3146484 - protein, 8 aa, Giardia lamblia
VSSDVDEA

SEQ ID NO: 3146485 - protein, 6 aa, Giardia lamblia
VSSEDR

SEQ ID NO: 3146486 - protein, 11 aa, Giardia lamblia
VSSEQSPGGFG

SEQ ID NO: 3146487 - protein, 8 aa, Giardia lamblia
VSSERRQH

SEQ ID NO: 3146488 - protein, 20 aa, Giardia lamblia
VSSETPSRLAKSSVHENHPK

SEQ ID NO: 3146489 - protein, 17 aa, Giardia lamblia
VSSETTSVPRGDNIETT

SEQ ID NO: 3146490 - protein, 6 aa, Giardia lamblia
VSSEVS

SEQ ID NO: 3146491 - protein, 4 aa, Giardia lamblia
VSSF

SEQ ID NO: 3146492 - protein, 8 aa, Giardia lamblia
VSSGEKEY

SEQ ID NO: 3146493 - protein, 6 aa, Giardia lamblia
VSSGEL

SEQ ID NO: 3146494 - protein, 30 aa, Giardia lamblia
VSSGRRAGVGGRSQKGQEGKQRKHKARVSD

SEQ ID NO: 3146495 - protein, 5 aa, Giardia lamblia
VSSGS

SEQ ID NO: 3146496 - protein, 10 aa, Giardia lamblia
VSSGSKNSIH

SEQ ID NO: 3146497 - protein, 55 aa, Giardia lamblia
VSSHTSVAGRSRSGDETTVSQLTNDSNLRGYPAQAGNSTKLSAGPDEAGASEASL

SEQ ID NO: 3146498 - protein, 11 aa, Giardia lamblia
VSSKPGSGYSR

SEQ ID NO: 3146499 - protein, 15 aa, Giardia lamblia
VSSKSARSDGGNKGS

SEQ ID NO: 3146500 - protein, 10 aa, Giardia lamblia
VSSKSNLKSN

SEQ ID NO: 3146501 - protein, 4 aa, Giardia lamblia
VSSL

SEQ ID NO: 3146502 - protein, 5 aa, Giardia lamblia
VSSLH

SEQ ID NO: 3146503 - protein, 5 aa, Giardia lamblia
VSSNE

SEQ ID NO: 3146504 - protein, 6 aa, Giardia lamblia
VSSNEL

SEQ ID NO: 3146505 - protein, 10 aa, Giardia lamblia
VSSPATGPLS

SEQ ID NO: 3146506 - protein, 5 aa, Giardia lamblia
VSSPF

SEQ ID NO: 3146507 - protein, 9 aa, Giardia lamblia
VSSPPGEGI

SEQ ID NO: 3146508 - protein, 18 aa, Giardia lamblia
VSSPPKRSRPVAEEEEDL

SEQ ID NO: 3146509 - protein, 11 aa, Giardia lamblia
VSSQASERLGA

SEQ ID NO: 3146510 - protein, 4 aa, Giardia lamblia
VSSR

SEQ ID NO: 3146511 - protein, 8 aa, Giardia lamblia
VSSRDAGR

SEQ ID NO: 3146512 - protein, 5 aa, Giardia lamblia
VSSSA

SEQ ID NO: 3146513 - protein, 12 aa, Giardia lamblia
VSSSEKHVAQQE

SEQ ID NO: 3146514 - protein, 8 aa, Giardia lamblia
VSSSHGLP

SEQ ID NO: 3146515 - protein, 10 aa, Giardia lamblia
VSSSHSSPYI

SEQ ID NO: 3146516 - protein, 12 aa, Giardia lamblia
VSSSIQQPRQPI

SEQ ID NO: 3146517 - protein, 15 aa, Giardia lamblia
VSSSKDGKYTGPSAH

SEQ ID NO: 3146518 - protein, 113 aa, Giardia lamblia
VSSSNPYAAGNPSAGSNMGPYGAPQQGYSGAVSAPAPMSGSYGAGVPVSTYGSTPAPAGPGASGPYGAPQTSNPYGAPAPASNPYGAATAPNPYGAPSGSNPYKTSSFHSEEL

SEQ ID NO: 3146519 - protein, 10 aa, Giardia lamblia
VSSSQAEEIA

SEQ ID NO: 3146520 - protein, 5 aa, Giardia lamblia
VSSSS

SEQ ID NO: 3146521 - protein, 7 aa, Giardia lamblia
VSSSSQL

SEQ ID NO: 3146522 - protein, 30 aa, Giardia lamblia
VSSSTSPASDRPQGATPVQSCGPEQDTPDI

SEQ ID NO: 3146523 - protein, 11 aa, Giardia lamblia
VSSTDTSIANL

SEQ ID NO: 3146524 - protein, 6 aa, Giardia lamblia
VSSTHR

SEQ ID NO: 3146525 - protein, 23 aa, Giardia lamblia
VSSTSAPINEITEGTYTKVSLFD

SEQ ID NO: 3146526 - protein, 11 aa, Giardia lamblia
VSSTSDTYTDR

SEQ ID NO: 3146527 - protein, 7 aa, Giardia lamblia
VSSTSPV

SEQ ID NO: 3146528 - protein, 14 aa, Giardia lamblia
VSSTSQDRTKSAKH

SEQ ID NO: 3146529 - protein, 13 aa, Giardia lamblia
VSSTTAKSVEDSL

SEQ ID NO: 3146530 - protein, 15 aa, Giardia lamblia
VSTAAANASLPSEVR

SEQ ID NO: 3146531 - protein, 9 aa, Giardia lamblia
VSTAGTSKQ

SEQ ID NO: 3146532 - protein, 12 aa, Giardia lamblia
VSTAPGTRRFSI

SEQ ID NO: 3146533 - protein, 13 aa, Giardia lamblia
VSTASELLQRFTS

SEQ ID NO: 3146534 - protein, 8 aa, Giardia lamblia
VSTDELNE

SEQ ID NO: 3146535 - protein, 24 aa, Giardia lamblia
VSTDEYSTSSDQDVVPSGRSPPPI

SEQ ID NO: 3146536 - protein, 7 aa, Giardia lamblia
VSTDNSM

SEQ ID NO: 3146537 - protein, 9 aa, Giardia lamblia
VSTENTEKY

SEQ ID NO: 3146538 - protein, 13 aa, Giardia lamblia
VSTERTSAASAYG

SEQ ID NO: 3146539 - protein, 5 aa, Giardia lamblia
VSTES

SEQ ID NO: 3146540 - protein, 11 aa, Giardia lamblia
VSTGGSNITVP

SEQ ID NO: 3146541 - protein, 24 aa, Giardia lamblia
VSTGSKSIAHDSEDCGFSSSVNGS

SEQ ID NO: 3146542 - protein, 6 aa, Giardia lamblia
VSTGSL

SEQ ID NO: 3146543 - protein, 8 aa, Giardia lamblia
VSTNPSHD

SEQ ID NO: 3146544 - protein, 10 aa, Giardia lamblia
VSTNTDATEA

SEQ ID NO: 3146545 - protein, 7 aa, Giardia lamblia
VSTPRGS

SEQ ID NO: 3146546 - protein, 9 aa, Giardia lamblia
VSTPRPLSS

SEQ ID NO: 3146547 - protein, 7 aa, Giardia lamblia
VSTQKGS

SEQ ID NO: 3146548 - protein, 7 aa, Giardia lamblia
VSTRDHA

SEQ ID NO: 3146549 - protein, 11 aa, Giardia lamblia
VSTRPNSASER

SEQ ID NO: 3146550 - protein, 9 aa, Giardia lamblia
VSTSAPLKN

SEQ ID NO: 3146551 - protein, 6 aa, Giardia lamblia
VSTSSD

SEQ ID NO: 3146552 - protein, 6 aa, Giardia lamblia
VSTSSR

SEQ ID NO: 3146553 - protein, 16 aa, Giardia lamblia
VSTSSTGTSDSEVEPG

SEQ ID NO: 3146554 - protein, 12 aa, Giardia lamblia
VSTSTNATKANL

SEQ ID NO: 3146555 - protein, 11 aa, Giardia lamblia
VSTTDTNYGCP

SEQ ID NO: 3146556 - protein, 9 aa, Giardia lamblia
VSTTSTGKV

SEQ ID NO: 3146557 - protein, 13 aa, Giardia lamblia
VSTTSTKTNASLD

SEQ ID NO: 3146558 - protein, 6 aa, Giardia lamblia
VSYAER

SEQ ID NO: 3146559 - protein, 9 aa, Giardia lamblia
VSYDKNRAD

SEQ ID NO: 3146560 - protein, 10 aa, Giardia lamblia
VSYDLDESNE

SEQ ID NO: 3146561 - protein, 25 aa, Giardia lamblia
VSYQTATSLDGSQRLRGYSAAAASN

SEQ ID NO: 3146562 - protein, 11 aa, Giardia lamblia
VTAAKPNASID

SEQ ID NO: 3146563 - protein, 13 aa, Giardia lamblia
VTADGRVLERIKL

SEQ ID NO: 3146564 - protein, 7 aa, Giardia lamblia
VTAGEKS

SEQ ID NO: 3146565 - protein, 8 aa, Giardia lamblia
VTAKEEAA

SEQ ID NO: 3146566 - protein, 6 aa, Giardia lamblia
VTAKNS

SEQ ID NO: 3146567 - protein, 12 aa, Giardia lamblia
VTAKTANKDELR

SEQ ID NO: 3146568 - protein, 36 aa, Giardia lamblia
VTANSDATPSASAQGDKAAATGSSTSSSSDSDEDIT

SEQ ID NO: 3146569 - protein, 10 aa, Giardia lamblia
VTAPEATQAQ

SEQ ID NO: 3146570 - protein, 6 aa, Giardia lamblia
VTAPSL

SEQ ID NO: 3146571 - protein, 12 aa, Giardia lamblia
VTARENENAQLK

SEQ ID NO: 3146572 - protein, 5 aa, Giardia lamblia
VTARK

SEQ ID NO: 3146573 - protein, 11 aa, Giardia lamblia
VTASSDQNVDV

SEQ ID NO: 3146574 - protein, 8 aa, Giardia lamblia
VTASTARA

SEQ ID NO: 3146575 - protein, 10 aa, Giardia lamblia
VTASTKEEAE

SEQ ID NO: 3146576 - protein, 10 aa, Giardia lamblia
VTDEKKDSLV

SEQ ID NO: 3146577 - protein, 10 aa, Giardia lamblia
VTDGSGRLAA

SEQ ID NO: 3146578 - protein, 12 aa, Giardia lamblia
VTDKAGTNISQY

SEQ ID NO: 3146579 - protein, 4 aa, Giardia lamblia
VTDQ

SEQ ID NO: 3146580 - protein, 4 aa, Giardia lamblia
VTDR

SEQ ID NO: 3146581 - protein, 14 aa, Giardia lamblia
VTDRKKSRTSKTPI

SEQ ID NO: 3146582 - protein, 9 aa, Giardia lamblia
VTDRPNQTH

SEQ ID NO: 3146583 - protein, 5 aa, Giardia lamblia
VTDRS

SEQ ID NO: 3146584 - protein, 6 aa, Giardia lamblia
VTDSGY

SEQ ID NO: 3146585 - protein, 12 aa, Giardia lamblia
VTDSKALSANTR

SEQ ID NO: 3146586 - protein, 27 aa, Giardia lamblia
VTDTEQMQHETRSARSTKSVRSTRSDV

SEQ ID NO: 3146587 - protein, 80 aa, Giardia lamblia
VTDTSNTDQSSEQLGNAEQKSSEAESQSKAKSKISSKHDSVPQDATRKRQDRTSRGTSGRDQYSKQGGRTLDGLTSTDFS

SEQ ID NO: 3146588 - protein, 12 aa, Giardia lamblia
VTEDDEQQLRRQ

SEQ ID NO: 3146589 - protein, 12 aa, Giardia lamblia
VTEDEISSSQCK

SEQ ID NO: 3146590 - protein, 6 aa, Giardia lamblia
VTEEPS

SEQ ID NO: 3146591 - protein, 19 aa, Giardia lamblia
VTEEQNKNVLDNKQDELES

SEQ ID NO: 3146592 - protein, 7 aa, Giardia lamblia
VTEGDDP

SEQ ID NO: 3146593 - protein, 18 aa, Giardia lamblia
VTELESARAEVKGEVTGL

SEQ ID NO: 3146594 - protein, 12 aa, Giardia lamblia
VTEPEAKRAHQD

SEQ ID NO: 3146595 - protein, 19 aa, Giardia lamblia
VTEPIGSQTHTSSAFPPVS

SEQ ID NO: 3146596 - protein, 12 aa, Giardia lamblia
VTEQAAQPCTTP

SEQ ID NO: 3146597 - protein, 9 aa, Giardia lamblia
VTERDSEIK

SEQ ID NO: 3146598 - protein, 7 aa, Giardia lamblia
VTERNVD

SEQ ID NO: 3146599 - protein, 6 aa, Giardia lamblia
VTESNY

SEQ ID NO: 3146600 - protein, 21 aa, Giardia lamblia
VTESTDVASPEIRDESTDAVQ

SEQ ID NO: 3146601 - protein, 25 aa, Giardia lamblia
VTESTLQNNELASAGSYTDEPSSAE

SEQ ID NO: 3146602 - protein, 22 aa, Giardia lamblia
VTETGSSSTIVTNKEEHEDSQS

SEQ ID NO: 3146603 - protein, 7 aa, Giardia lamblia
VTETGTE

SEQ ID NO: 3146604 - protein, 9 aa, Giardia lamblia
VTGAGTAAV

SEQ ID NO: 3146605 - protein, 6 aa, Giardia lamblia
VTGDAL

SEQ ID NO: 3146606 - protein, 4 aa, Giardia lamblia
VTGE

SEQ ID NO: 3146607 - protein, 12 aa, Giardia lamblia
VTGEEIKTSEDD

SEQ ID NO: 3146608 - protein, 5 aa, Giardia lamblia
VTGER

SEQ ID NO: 3146609 - protein, 11 aa, Giardia lamblia
VTGHNESARTA

SEQ ID NO: 3146610 - protein, 12 aa, Giardia lamblia
VTGIQGDARKSS

SEQ ID NO: 3146611 - protein, 19 aa, Giardia lamblia
VTGKPASSSLSSAFTATGA

SEQ ID NO: 3146612 - protein, 7 aa, Giardia lamblia
VTGLSSR

SEQ ID NO: 3146613 - protein, 10 aa, Giardia lamblia
VTGSGKTGAF

SEQ ID NO: 3146614 - protein, 22 aa, Giardia lamblia
VTGSNAAASTNVVRPNDDTAER

SEQ ID NO: 3146615 - protein, 15 aa, Giardia lamblia
VTGVSSADLSTNTAD

SEQ ID NO: 3146616 - protein, 20 aa, Giardia lamblia
VTHGTSKLSQDVYKPSTSTV

SEQ ID NO: 3146617 - protein, 4 aa, Giardia lamblia
VTHP

SEQ ID NO: 3146618 - protein, 16 aa, Giardia lamblia
VTHSSSQASELSSSTA

SEQ ID NO: 3146619 - protein, 9 aa, Giardia lamblia
VTKGDNSAQ

SEQ ID NO: 3146620 - protein, 9 aa, Giardia lamblia
VTKGPYPAH

SEQ ID NO: 3146621 - protein, 4 aa, Giardia lamblia
VTKH

SEQ ID NO: 3146622 - protein, 12 aa, Giardia lamblia
VTKKGARIPSVP

SEQ ID NO: 3146623 - protein, 42 aa, Giardia lamblia
VTKNRPVSSCARPGSASTKKATKGELRTTQPKSSASSRQTLQ

SEQ ID NO: 3146624 - protein, 8 aa, Giardia lamblia
VTKREDNL

SEQ ID NO: 3146625 - protein, 24 aa, Giardia lamblia
VTLASDKPLRGASDTLKPEKPIHQ

SEQ ID NO: 3146626 - protein, 9 aa, Giardia lamblia
VTNASGTSR

SEQ ID NO: 3146627 - protein, 6 aa, Giardia lamblia
VTNDNY

SEQ ID NO: 3146628 - protein, 4 aa, Giardia lamblia
VTNE

SEQ ID NO: 3146629 - protein, 7 aa, Giardia lamblia
VTNGEVA

SEQ ID NO: 3146630 - protein, 5 aa, Giardia lamblia
VTNGP

SEQ ID NO: 3146631 - protein, 13 aa, Giardia lamblia
VTNNKKDKKGLQS

SEQ ID NO: 3146632 - protein, 8 aa, Giardia lamblia
VTNPSDYN

SEQ ID NO: 3146633 - protein, 16 aa, Giardia lamblia
VTNPSTQATYSTPYPS

SEQ ID NO: 3146634 - protein, 17 aa, Giardia lamblia
VTNRSGQTVNGGYNKSR

SEQ ID NO: 3146635 - protein, 6 aa, Giardia lamblia
VTNSTN

SEQ ID NO: 3146636 - protein, 7 aa, Giardia lamblia
VTNTMGE

SEQ ID NO: 3146637 - protein, 5 aa, Giardia lamblia
VTNTY

SEQ ID NO: 3146638 - protein, 19 aa, Giardia lamblia
VTPATNQPGTVSATPSSTV

SEQ ID NO: 3146639 - protein, 8 aa, Giardia lamblia
VTPDPEFP

SEQ ID NO: 3146640 - protein, 7 aa, Giardia lamblia
VTPEELA

SEQ ID NO: 3146641 - protein, 8 aa, Giardia lamblia
VTPEKKEA

SEQ ID NO: 3146642 - protein, 5 aa, Giardia lamblia
VTPEQ

SEQ ID NO: 3146643 - protein, 5 aa, Giardia lamblia
VTPEV

SEQ ID NO: 3146644 - protein, 8 aa, Giardia lamblia
VTPFGEPP

SEQ ID NO: 3146645 - protein, 12 aa, Giardia lamblia
VTPGPGAYNDDK

SEQ ID NO: 3146646 - protein, 12 aa, Giardia lamblia
VTPGSESEPGSG

SEQ ID NO: 3146647 - protein, 7 aa, Giardia lamblia
VTPGSLP

SEQ ID NO: 3146648 - protein, 5 aa, Giardia lamblia
VTPHT

SEQ ID NO: 3146649 - protein, 5 aa, Giardia lamblia
VTPKS

SEQ ID NO: 3146650 - protein, 7 aa, Giardia lamblia
VTPNNFG

SEQ ID NO: 3146651 - protein, 7 aa, Giardia lamblia
VTPPGTR

SEQ ID NO: 3146652 - protein, 6 aa, Giardia lamblia
VTPPPI

SEQ ID NO: 3146653 - protein, 5 aa, Giardia lamblia
VTPPT

SEQ ID NO: 3146654 - protein, 14 aa, Giardia lamblia
VTPSDLPDTTQSSL

SEQ ID NO: 3146655 - protein, 13 aa, Giardia lamblia
VTPSISSESSSEC

SEQ ID NO: 3146656 - protein, 10 aa, Giardia lamblia
VTPSKPPGSV

SEQ ID NO: 3146657 - protein, 5 aa, Giardia lamblia
VTPSR

SEQ ID NO: 3146658 - protein, 6 aa, Giardia lamblia
VTPSTL

SEQ ID NO: 3146659 - protein, 7 aa, Giardia lamblia
VTPTARM

SEQ ID NO: 3146660 - protein, 5 aa, Giardia lamblia
VTPTG

SEQ ID NO: 3146661 - protein, 21 aa, Giardia lamblia
VTPTTKSHRSDKFSARSSNSL

SEQ ID NO: 3146662 - protein, 6 aa, Giardia lamblia
VTPTTN

SEQ ID NO: 3146663 - protein, 8 aa, Giardia lamblia
VTQEGQEA

SEQ ID NO: 3146664 - protein, 11 aa, Giardia lamblia
VTQENDSSTNL

SEQ ID NO: 3146665 - protein, 32 aa, Giardia lamblia
VTQESAGTPSTCRGQGSSGLLGPRISKPSSVI

SEQ ID NO: 3146666 - protein, 8 aa, Giardia lamblia
VTQGDEGN

SEQ ID NO: 3146667 - protein, 13 aa, Giardia lamblia
VTQGQSLLSGGPV

SEQ ID NO: 3146668 - protein, 4 aa, Giardia lamblia
VTQH

SEQ ID NO: 3146669 - protein, 10 aa, Giardia lamblia
VTQKDSEIRQ

SEQ ID NO: 3146670 - protein, 4 aa, Giardia lamblia
VTQL

SEQ ID NO: 3146671 - protein, 7 aa, Giardia lamblia
VTQQDGA

SEQ ID NO: 3146672 - protein, 18 aa, Giardia lamblia
VTQSGKPDIYATHTYQFM

SEQ ID NO: 3146673 - protein, 10 aa, Giardia lamblia
VTQTKNTVVD

SEQ ID NO: 3146674 - protein, 17 aa, Giardia lamblia
VTQTPVSSLGGKKQHSY

SEQ ID NO: 3146675 - protein, 13 aa, Giardia lamblia
VTQTTCPSDNLQS

SEQ ID NO: 3146676 - protein, 10 aa, Giardia lamblia
VTQVTDNTLR

SEQ ID NO: 3146677 - protein, 5 aa, Giardia lamblia
VTRDN

SEQ ID NO: 3146678 - protein, 10 aa, Giardia lamblia
VTREAQTETA

SEQ ID NO: 3146679 - protein, 19 aa, Giardia lamblia
VTRETAELNDATSKVSETN

SEQ ID NO: 3146680 - protein, 25 aa, Giardia lamblia
VTRGKPQSGQSSELTLSPPRPPHGA

SEQ ID NO: 3146681 - protein, 6 aa, Giardia lamblia
VTRGRA

SEQ ID NO: 3146682 - protein, 5 aa, Giardia lamblia
VTRKG

SEQ ID NO: 3146683 - protein, 25 aa, Giardia lamblia
VTRKGTSASVPRRQEVDDALSKFSG

SEQ ID NO: 3146684 - protein, 16 aa, Giardia lamblia
VTRNNTPVTSNQDQME

SEQ ID NO: 3146685 - protein, 7 aa, Giardia lamblia
VTRNQTP

SEQ ID NO: 3146686 - protein, 4 aa, Giardia lamblia
VTRP

SEQ ID NO: 3146687 - protein, 6 aa, Giardia lamblia
VTSAGT

SEQ ID NO: 3146688 - protein, 13 aa, Giardia lamblia
VTSARNLTKGMTT

SEQ ID NO: 3146689 - protein, 7 aa, Giardia lamblia
VTSERRK

SEQ ID NO: 3146690 - protein, 13 aa, Giardia lamblia
VTSESSSNISGHD

SEQ ID NO: 3146691 - protein, 11 aa, Giardia lamblia
VTSGGKSYASG

SEQ ID NO: 3146692 - protein, 28 aa, Giardia lamblia
VTSPAASKSLLSKRPRSAIASSARESIS

SEQ ID NO: 3146693 - protein, 13 aa, Giardia lamblia
VTSRASERTNASL

SEQ ID NO: 3146694 - protein, 13 aa, Giardia lamblia
VTSSDSMQTAGSI

SEQ ID NO: 3146695 - protein, 6 aa, Giardia lamblia
VTSSKA

SEQ ID NO: 3146696 - protein, 6 aa, Giardia lamblia
VTSSSY

SEQ ID NO: 3146697 - protein, 8 aa, Giardia lamblia
VTSSVTDF

SEQ ID NO: 3146698 - protein, 10 aa, Giardia lamblia
VTSSYPPSCH

SEQ ID NO: 3146699 - protein, 6 aa, Giardia lamblia
VTSTRA

SEQ ID NO: 3146700 - protein, 4 aa, Giardia lamblia
VTTD

SEQ ID NO: 3146701 - protein, 4 aa, Giardia lamblia
VTTE

SEQ ID NO: 3146702 - protein, 7 aa, Giardia lamblia
VTTENET

SEQ ID NO: 3146703 - protein, 9 aa, Giardia lamblia
VTTEPPSSL

SEQ ID NO: 3146704 - protein, 8 aa, Giardia lamblia
VTTESGAS

SEQ ID NO: 3146705 - protein, 5 aa, Giardia lamblia
VTTGN

SEQ ID NO: 3146706 - protein, 7 aa, Giardia lamblia
VTTGPKE

SEQ ID NO: 3146707 - protein, 8 aa, Giardia lamblia
VTTGSEGP

SEQ ID NO: 3146708 - protein, 10 aa, Giardia lamblia
VTTGTESKGT

SEQ ID NO: 3146709 - protein, 18 aa, Giardia lamblia
VTTKAEVAGPYADEEHED

SEQ ID NO: 3146710 - protein, 8 aa, Giardia lamblia
VTTKEQDS

SEQ ID NO: 3146711 - protein, 20 aa, Giardia lamblia
VTTKPKQGSISARTETPLQS

SEQ ID NO: 3146712 - protein, 6 aa, Giardia lamblia
VTTLSS

SEQ ID NO: 3146713 - protein, 8 aa, Giardia lamblia
VTTPDDAD

SEQ ID NO: 3146714 - protein, 6 aa, Giardia lamblia
VTTPKG

SEQ ID NO: 3146715 - protein, 9 aa, Giardia lamblia
VTTPSQQPT

SEQ ID NO: 3146716 - protein, 11 aa, Giardia lamblia
VTTQPERNNLG

SEQ ID NO: 3146717 - protein, 22 aa, Giardia lamblia
VTTRTRPTGRASVQAQPGSRGP

SEQ ID NO: 3146718 - protein, 4 aa, Giardia lamblia
VTTS

SEQ ID NO: 3146719 - protein, 5 aa, Giardia lamblia
VTTSG

SEQ ID NO: 3146720 - protein, 11 aa, Giardia lamblia
VTTSGTFGQSS

SEQ ID NO: 3146721 - protein, 11 aa, Giardia lamblia
VTTTREEQTAA

SEQ ID NO: 3146722 - protein, 9 aa, Giardia lamblia
VVDEDEEPL

SEQ ID NO: 3146723 - protein, 8 aa, Giardia lamblia
VVETESAP

SEQ ID NO: 3146724 - protein, 15 aa, Giardia lamblia
VVGGDDAILRVLGMK

SEQ ID NO: 3146725 - protein, 7 aa, Giardia lamblia
VVGGTES

SEQ ID NO: 3146726 - protein, 42 aa, Giardia lamblia
VVPDEPEEYDSQSDEEQPEGCPEEPQREAPAIQEGAHAPENI

SEQ ID NO: 3146727 - protein, 11 aa, Giardia lamblia
VVPERETKRKK

SEQ ID NO: 3146728 - protein, 5 aa, Giardia lamblia
VVPGS

SEQ ID NO: 3146729 - protein, 25 aa, Giardia lamblia
VVPNTDDGATRVKGRAGASFSTTSR

SEQ ID NO: 3146730 - protein, 4 aa, Giardia lamblia
VVPP

SEQ ID NO: 3146731 - protein, 8 aa, Giardia lamblia
VVQSTSSA

SEQ ID NO: 3146732 - protein, 53 aa, Giardia lamblia
VVSPRGSMRASSGPRSPNRRAINSQGLDASFSSRYSNVEKAGSRLSGSRTTEN

SEQ ID NO: 3146733 - protein, 23 aa, Giardia lamblia
VVSPSGNVSGGSRSFNLSSPASV

SEQ ID NO: 3146734 - protein, 5 aa, Giardia lamblia
VVSRD

SEQ ID NO: 3146735 - protein, 14 aa, Giardia lamblia
VVSSAGPSRQITQR

SEQ ID NO: 3146736 - protein, 9 aa, Giardia lamblia
VVTRPRPPA

SEQ ID NO: 3146737 - protein, 8 aa, Giardia lamblia
VYDESSSV

SEQ ID NO: 3146738 - protein, 5 aa, Giardia lamblia
VYDKD

SEQ ID NO: 3146739 - protein, 10 aa, Giardia lamblia
VYDPPDRTAE

SEQ ID NO: 3146740 - protein, 35 aa, Giardia lamblia
VYDPRPGESPKCRQTASNEQVKPLTNQQKVSSRPV

SEQ ID NO: 3146741 - protein, 5 aa, Giardia lamblia
VYEGG

SEQ ID NO: 3146742 - protein, 7 aa, Giardia lamblia
VYGEDSE

SEQ ID NO: 3146743 - protein, 15 aa, Giardia lamblia
VYNKSSDQISQEDRD

SEQ ID NO: 3146744 - protein, 16 aa, Giardia lamblia
VYPQHPSNHPTAYSDY

SEQ ID NO: 3146745 - protein, 8 aa, Giardia lamblia
VYPSETKE

SEQ ID NO: 3146746 - protein, 8 aa, Giardia lamblia
VYSPSAEA

SEQ ID NO: 3146747 - protein, 4 aa, Giardia lamblia
VYTS

SEQ ID NO: 3146748 - protein, 18 aa, Giardia lamblia
VYYPDGSKKYVAADGSEH

SEQ ID NO: 3146749 - protein, 31 aa, Giardia lamblia
WAAGTTPSWSAPSATRWPPATTACTSTGSSG

SEQ ID NO: 3146750 - protein, 10 aa, Giardia lamblia
WAGGAGRKGV

SEQ ID NO: 3146751 - protein, 7 aa, Giardia lamblia
WANPEGY

SEQ ID NO: 3146752 - protein, 7 aa, Giardia lamblia
WAPGPDA

SEQ ID NO: 3146753 - protein, 20 aa, Giardia lamblia
WASQERCTTGSGRAEQSQGT

SEQ ID NO: 3146754 - protein, 18 aa, Giardia lamblia
WASSQGTSSLKPASELRS

SEQ ID NO: 3146755 - protein, 11 aa, Giardia lamblia
WDAEAKELTEP

SEQ ID NO: 3146756 - protein, 5 aa, Giardia lamblia
WDEDN

SEQ ID NO: 3146757 - protein, 8 aa, Giardia lamblia
WDKKGGCI

SEQ ID NO: 3146758 - protein, 5 aa, Giardia lamblia
WDKKN

SEQ ID NO: 3146759 - protein, 16 aa, Giardia lamblia
WDPEKTNTVEMDNEDE

SEQ ID NO: 3146760 - protein, 7 aa, Giardia lamblia
WDRTSQL

SEQ ID NO: 3146761 - protein, 5 aa, Giardia lamblia
WDSSG

SEQ ID NO: 3146762 - protein, 11 aa, Giardia lamblia
WEATQGRANLS

SEQ ID NO: 3146763 - protein, 14 aa, Giardia lamblia
WEERAGSEDHGREL

SEQ ID NO: 3146764 - protein, 10 aa, Giardia lamblia
WEGGSGCRDR

SEQ ID NO: 3146765 - protein, 4 aa, Giardia lamblia
WENE

SEQ ID NO: 3146766 - protein, 7 aa, Giardia lamblia
WEPSTDN

SEQ ID NO: 3146767 - protein, 4 aa, Giardia lamblia
WERG

SEQ ID NO: 3146768 - protein, 10 aa, Giardia lamblia
WESSSKDRAL

SEQ ID NO: 3146769 - protein, 4 aa, Giardia lamblia
WETD

SEQ ID NO: 3146770 - protein, 5 aa, Giardia lamblia
WGGGP

SEQ ID NO: 3146771 - protein, 8 aa, Giardia lamblia
WGKPQGTV

SEQ ID NO: 3146772 - protein, 4 aa, Giardia lamblia
WGPN

SEQ ID NO: 3146773 - protein, 15 aa, Giardia lamblia
WGSSKDSKVPSTHEK

SEQ ID NO: 3146774 - protein, 4 aa, Giardia lamblia
WGTE

SEQ ID NO: 3146775 - protein, 7 aa, Giardia lamblia
WKADRDK

SEQ ID NO: 3146776 - protein, 19 aa, Giardia lamblia
WKAGSKKGKQSAASKKQMT

SEQ ID NO: 3146777 - protein, 15 aa, Giardia lamblia
WKAPKAQEYKASLQK

SEQ ID NO: 3146778 - protein, 11 aa, Giardia lamblia
WKDDQRNGQGI

SEQ ID NO: 3146779 - protein, 28 aa, Giardia lamblia
WKDPRGGRTESPGYLDEQSGPQYEQREH

SEQ ID NO: 3146780 - protein, 7 aa, Giardia lamblia
WKERGQG

SEQ ID NO: 3146781 - protein, 6 aa, Giardia lamblia
WKPAHD

SEQ ID NO: 3146782 - protein, 7 aa, Giardia lamblia
WKSTYTK

SEQ ID NO: 3146783 - protein, 6 aa, Giardia lamblia
WKTPGN

SEQ ID NO: 3146784 - protein, 9 aa, Giardia lamblia
WKTPNEKKT

SEQ ID NO: 3146785 - protein, 7 aa, Giardia lamblia
WNEQNST

SEQ ID NO: 3146786 - protein, 11 aa, Giardia lamblia
WNGKNTLSLSN

SEQ ID NO: 3146787 - protein, 4 aa, Giardia lamblia
WNTE

SEQ ID NO: 3146788 - protein, 31 aa, Giardia lamblia
WNTSPSTVTYTSGEGSATSRPSRYTYGQPSR

SEQ ID NO: 3146789 - protein, 10 aa, Giardia lamblia
WPEEKARREQ

SEQ ID NO: 3146790 - protein, 9 aa, Giardia lamblia
WPETASSIP

SEQ ID NO: 3146791 - protein, 12 aa, Giardia lamblia
WPGDGEAKKAYY

SEQ ID NO: 3146792 - protein, 19 aa, Giardia lamblia
WPQSQESKYQPDKSATSHV

SEQ ID NO: 3146793 - protein, 4 aa, Giardia lamblia
WPSC

SEQ ID NO: 3146794 - protein, 10 aa, Giardia lamblia
WPSSDDDNEV

SEQ ID NO: 3146795 - protein, 5 aa, Giardia lamblia
WPSSV

SEQ ID NO: 3146796 - protein, 25 aa, Giardia lamblia
WPTEKKDKGITAPASVGSKGSRLKT

SEQ ID NO: 3146797 - protein, 21 aa, Giardia lamblia
WPTPSAKTEPPSYRDGVERKD

SEQ ID NO: 3146798 - protein, 8 aa, Giardia lamblia
WQDEDGKT

SEQ ID NO: 3146799 - protein, 14 aa, Giardia lamblia
WQDKKGVTKVPPVF

SEQ ID NO: 3146800 - protein, 15 aa, Giardia lamblia
WQDPKSIRDRVDAEG

SEQ ID NO: 3146801 - protein, 18 aa, Giardia lamblia
WQKNTTRGKVEDKIAQRA

SEQ ID NO: 3146802 - protein, 5 aa, Giardia lamblia
WQNAG

SEQ ID NO: 3146803 - protein, 5 aa, Giardia lamblia
WQNGA

SEQ ID NO: 3146804 - protein, 5 aa, Giardia lamblia
WQQER

SEQ ID NO: 3146805 - protein, 12 aa, Giardia lamblia
WREDATQNEPKM

SEQ ID NO: 3146806 - protein, 10 aa, Giardia lamblia
WRKPRGIDSP

SEQ ID NO: 3146807 - protein, 9 aa, Giardia lamblia
WRNEGVKDP

SEQ ID NO: 3146808 - protein, 13 aa, Giardia lamblia
WRPRPQKKRKDPD

SEQ ID NO: 3146809 - protein, 19 aa, Giardia lamblia
WRQDREAEARQKCENAKNQ

SEQ ID NO: 3146810 - protein, 14 aa, Giardia lamblia
WRSPSLDGSPSPLV

SEQ ID NO: 3146811 - protein, 9 aa, Giardia lamblia
WSDEDREEH

SEQ ID NO: 3146812 - protein, 9 aa, Giardia lamblia
WSDTASNKK

SEQ ID NO: 3146813 - protein, 6 aa, Giardia lamblia
WSEGTQ

SEQ ID NO: 3146814 - protein, 7 aa, Giardia lamblia
WSETRSN

SEQ ID NO: 3146815 - protein, 10 aa, Giardia lamblia
WSGMSSTDRA

SEQ ID NO: 3146816 - protein, 6 aa, Giardia lamblia
WSGQTG

SEQ ID NO: 3146817 - protein, 17 aa, Giardia lamblia
WSKTDNRSDKRSKPQQI

SEQ ID NO: 3146818 - protein, 13 aa, Giardia lamblia
WSLPTDLDPQERR

SEQ ID NO: 3146819 - protein, 4 aa, Giardia lamblia
WSNP

SEQ ID NO: 3146820 - protein, 8 aa, Giardia lamblia
WSPGEGEH

SEQ ID NO: 3146821 - protein, 9 aa, Giardia lamblia
WSPNESPEI

SEQ ID NO: 3146822 - protein, 12 aa, Giardia lamblia
WSPRVSEANNSL

SEQ ID NO: 3146823 - protein, 7 aa, Giardia lamblia
WSPSESD

SEQ ID NO: 3146824 - protein, 32 aa, Giardia lamblia
WSSETDSHDDKRGREYDQESEDGSTAGTLASA

SEQ ID NO: 3146825 - protein, 6 aa, Giardia lamblia
WSSHGQ

SEQ ID NO: 3146826 - protein, 27 aa, Giardia lamblia
WSSNAEDSRETKDDGESNPGPGSVSTT

SEQ ID NO: 3146827 - protein, 14 aa, Giardia lamblia
WSSPSITPQPPAAP

SEQ ID NO: 3146828 - protein, 18 aa, Giardia lamblia
WSSSSSSSLRWPASSSGG

SEQ ID NO: 3146829 - protein, 12 aa, Giardia lamblia
WSTSPQVFSEAP

SEQ ID NO: 3146830 - protein, 10 aa, Giardia lamblia
WSVPSSNDTA

SEQ ID NO: 3146831 - protein, 12 aa, Giardia lamblia
WTDGSKSKGAQY

SEQ ID NO: 3146832 - protein, 6 aa, Giardia lamblia
WTEKVK

SEQ ID NO: 3146833 - protein, 8 aa, Giardia lamblia
WTETSDLR

SEQ ID NO: 3146834 - protein, 5 aa, Giardia lamblia
WTPEQ

SEQ ID NO: 3146835 - protein, 11 aa, Giardia lamblia
WTPGKSNPARV

SEQ ID NO: 3146836 - protein, 13 aa, Giardia lamblia
WTPGSGRSGPSSW

SEQ ID NO: 3146837 - protein, 11 aa, Giardia lamblia
WTPPDTSSFPS

SEQ ID NO: 3146838 - protein, 11 aa, Giardia lamblia
WTQKDESLTPA

SEQ ID NO: 3146839 - protein, 6 aa, Giardia lamblia
WTRSGT

SEQ ID NO: 3146840 - protein, 7 aa, Giardia lamblia
WYRPDER

SEQ ID NO: 3146841 - protein, 18 aa, Giardia lamblia
YAAAQGSSRPSTANSRGS

SEQ ID NO: 3146842 - protein, 8 aa, Giardia lamblia
YAAGPEAV

SEQ ID NO: 3146843 - protein, 25 aa, Giardia lamblia
YAAQAPPEIPKSAPPGGGHAQRERE

SEQ ID NO: 3146844 - protein, 9 aa, Giardia lamblia
YAASQRGHS

SEQ ID NO: 3146845 - protein, 9 aa, Giardia lamblia
YADNQGQTA

SEQ ID NO: 3146846 - protein, 8 aa, Giardia lamblia
YADPRASQ

SEQ ID NO: 3146847 - protein, 9 aa, Giardia lamblia
YADQATGGV

SEQ ID NO: 3146848 - protein, 5 aa, Giardia lamblia
YADYS

SEQ ID NO: 3146849 - protein, 5 aa, Giardia lamblia
YAEEA

SEQ ID NO: 3146850 - protein, 7 aa, Giardia lamblia
YAEEANT

SEQ ID NO: 3146851 - protein, 8 aa, Giardia lamblia
YAEEGRDE

SEQ ID NO: 3146852 - protein, 11 aa, Giardia lamblia
YAEEKGCPKPI

SEQ ID NO: 3146853 - protein, 12 aa, Giardia lamblia
YAEESRDQAELE

SEQ ID NO: 3146854 - protein, 27 aa, Giardia lamblia
YAEKDPHARPGPTTEESSDNTGNRVEY

SEQ ID NO: 3146855 - protein, 7 aa, Giardia lamblia
YAEKENE

SEQ ID NO: 3146856 - protein, 5 aa, Giardia lamblia
YAEKN

SEQ ID NO: 3146857 - protein, 10 aa, Giardia lamblia
YAEPGTGKTA

SEQ ID NO: 3146858 - protein, 7 aa, Giardia lamblia
YAEQPQE

SEQ ID NO: 3146859 - protein, 11 aa, Giardia lamblia
YAGAAGYYQEA

SEQ ID NO: 3146860 - protein, 4 aa, Giardia lamblia
YAGK

SEQ ID NO: 3146861 - protein, 17 aa, Giardia lamblia
YAGPIGPAPGPAMSPTI

SEQ ID NO: 3146862 - protein, 10 aa, Giardia lamblia
YAGQRNSEGL

SEQ ID NO: 3146863 - protein, 11 aa, Giardia lamblia
YAGQTDAEGST

SEQ ID NO: 3146864 - protein, 8 aa, Giardia lamblia
YAGSGASG

SEQ ID NO: 3146865 - protein, 6 aa, Giardia lamblia
YAGSGS

SEQ ID NO: 3146866 - protein, 10 aa, Giardia lamblia
YAGSPIPESD

SEQ ID NO: 3146867 - protein, 8 aa, Giardia lamblia
YAGSSPLD

SEQ ID NO: 3146868 - protein, 11 aa, Giardia lamblia
YAGTDGVTRKP

SEQ ID NO: 3146869 - protein, 23 aa, Giardia lamblia
YAKEEQDAQQREAKKIAGKRRQR

SEQ ID NO: 3146870 - protein, 8 aa, Giardia lamblia
YAKPPQSV

SEQ ID NO: 3146871 - protein, 7 aa, Giardia lamblia
YAKQPDT

SEQ ID NO: 3146872 - protein, 7 aa, Giardia lamblia
YAKRDEE

SEQ ID NO: 3146873 - protein, 6 aa, Giardia lamblia
YAKSSQ

SEQ ID NO: 3146874 - protein, 10 aa, Giardia lamblia
YALASGASAR

SEQ ID NO: 3146875 - protein, 7 aa, Giardia lamblia
YANDKAK

SEQ ID NO: 3146876 - protein, 6 aa, Giardia lamblia
YANPDA

SEQ ID NO: 3146877 - protein, 4 aa, Giardia lamblia
YANS

SEQ ID NO: 3146878 - protein, 4 aa, Giardia lamblia
YAPA

SEQ ID NO: 3146879 - protein, 29 aa, Giardia lamblia
YAPAKASSRIRSTSTGRRTDKGNDKPGDS

SEQ ID NO: 3146880 - protein, 12 aa, Giardia lamblia
YAPASEGWGLDF

SEQ ID NO: 3146881 - protein, 5 aa, Giardia lamblia
YAPDY

SEQ ID NO: 3146882 - protein, 7 aa, Giardia lamblia
YAPKPKA

SEQ ID NO: 3146883 - protein, 5 aa, Giardia lamblia
YAPLD

SEQ ID NO: 3146884 - protein, 7 aa, Giardia lamblia
YAPLPPP

SEQ ID NO: 3146885 - protein, 5 aa, Giardia lamblia
YAPLS

SEQ ID NO: 3146886 - protein, 7 aa, Giardia lamblia
YAPNDSI

SEQ ID NO: 3146887 - protein, 8 aa, Giardia lamblia
YAPNNETA

SEQ ID NO: 3146888 - protein, 8 aa, Giardia lamblia
YAPPSEAE

SEQ ID NO: 3146889 - protein, 6 aa, Giardia lamblia
YAPSER

SEQ ID NO: 3146890 - protein, 4 aa, Giardia lamblia
YAPT

SEQ ID NO: 3146891 - protein, 5 aa, Giardia lamblia
YAPTL

SEQ ID NO: 3146892 - protein, 8 aa, Giardia lamblia
YAQEERKA

SEQ ID NO: 3146893 - protein, 7 aa, Giardia lamblia
YAQGGAV

SEQ ID NO: 3146894 - protein, 11 aa, Giardia lamblia
YAQKEKRMQED

SEQ ID NO: 3146895 - protein, 15 aa, Giardia lamblia
YAQKGSQPETSVSHE

SEQ ID NO: 3146896 - protein, 4 aa, Giardia lamblia
YAQQ

SEQ ID NO: 3146897 - protein, 6 aa, Giardia lamblia
YAQTDA

SEQ ID NO: 3146898 - protein, 15 aa, Giardia lamblia
YAQYSRKEDAESGFT

SEQ ID NO: 3146899 - protein, 12 aa, Giardia lamblia
YARASPLSERDL

SEQ ID NO: 3146900 - protein, 49 aa, Giardia lamblia
YARDPDDKIEPFSAAASKDTTSKGSSVTTQPMSSQRSKTTSVRQPKAVT

SEQ ID NO: 3146901 - protein, 4 aa, Giardia lamblia
YARF

SEQ ID NO: 3146902 - protein, 9 aa, Giardia lamblia
YARGQEDRR

SEQ ID NO: 3146903 - protein, 13 aa, Giardia lamblia
YARQDSDTGRSPI

SEQ ID NO: 3146904 - protein, 8 aa, Giardia lamblia
YARSSNDG

SEQ ID NO: 3146905 - protein, 11 aa, Giardia lamblia
YARTQNKHGET

SEQ ID NO: 3146906 - protein, 11 aa, Giardia lamblia
YASAGISADFG

SEQ ID NO: 3146907 - protein, 7 aa, Giardia lamblia
YASGERY

SEQ ID NO: 3146908 - protein, 19 aa, Giardia lamblia
YASGGNLDDRATSYSGSIT

SEQ ID NO: 3146909 - protein, 13 aa, Giardia lamblia
YASLESPDNADKI

SEQ ID NO: 3146910 - protein, 7 aa, Giardia lamblia
YASNGSM

SEQ ID NO: 3146911 - protein, 7 aa, Giardia lamblia
YASPATV

SEQ ID NO: 3146912 - protein, 15 aa, Giardia lamblia
YASQTKHAVREADTT

SEQ ID NO: 3146913 - protein, 7 aa, Giardia lamblia
YASSADG

SEQ ID NO: 3146914 - protein, 10 aa, Giardia lamblia
YASSKKNVSV

SEQ ID NO: 3146915 - protein, 10 aa, Giardia lamblia
YASTLDAGTE

SEQ ID NO: 3146916 - protein, 6 aa, Giardia lamblia
YASTNQ

SEQ ID NO: 3146917 - protein, 7 aa, Giardia lamblia
YASTQTT

SEQ ID NO: 3146918 - protein, 8 aa, Giardia lamblia
YATNEGKN

SEQ ID NO: 3146919 - protein, 11 aa, Giardia lamblia
YATPSSTGFHT

SEQ ID NO: 3146920 - protein, 9 aa, Giardia lamblia
YATQTRIGP

SEQ ID NO: 3146921 - protein, 11 aa, Giardia lamblia
YATRGGASGAS

SEQ ID NO: 3146922 - protein, 10 aa, Giardia lamblia
YATSTTSSQF

SEQ ID NO: 3146923 - protein, 10 aa, Giardia lamblia
YATTAAGTTA

SEQ ID NO: 3146924 - protein, 6 aa, Giardia lamblia
YATTEP

SEQ ID NO: 3146925 - protein, 11 aa, Giardia lamblia
YATTGSQPAPY

SEQ ID NO: 3146926 - protein, 8 aa, Giardia lamblia
YATTSEDK

SEQ ID NO: 3146927 - protein, 8 aa, Giardia lamblia
YAYEEPSK

SEQ ID NO: 3146928 - protein, 15 aa, Giardia lamblia
YAYGSKGSGSIPADA

SEQ ID NO: 3146929 - protein, 5 aa, Giardia lamblia
YCDGQ

SEQ ID NO: 3146930 - protein, 13 aa, Giardia lamblia
YCTSSEMKKATKE

SEQ ID NO: 3146931 - protein, 9 aa, Giardia lamblia
YDADDIPMP

SEQ ID NO: 3146932 - protein, 9 aa, Giardia lamblia
YDADGDQDV

SEQ ID NO: 3146933 - protein, 10 aa, Giardia lamblia
YDAKGPNRSN

SEQ ID NO: 3146934 - protein, 7 aa, Giardia lamblia
YDANGYT

SEQ ID NO: 3146935 - protein, 44 aa, Giardia lamblia
YDAPRQQEQQRQERQLRTSLGKQDKPKADELETSPCDTPTYSNP

SEQ ID NO: 3146936 - protein, 9 aa, Giardia lamblia
YDARGDTAL

SEQ ID NO: 3146937 - protein, 7 aa, Giardia lamblia
YDATSHF

SEQ ID NO: 3146938 - protein, 15 aa, Giardia lamblia
YDDALNSNSERDLEN

SEQ ID NO: 3146939 - protein, 46 aa, Giardia lamblia
YDDDTGADADPNGLHRSSSQGIRQTRTSKSQALTLPSKPGKVKQLP

SEQ ID NO: 3146940 - protein, 5 aa, Giardia lamblia
YDDEG

SEQ ID NO: 3146941 - protein, 6 aa, Giardia lamblia
YDDFQD

SEQ ID NO: 3146942 - protein, 8 aa, Giardia lamblia
YDDHENKE

SEQ ID NO: 3146943 - protein, 7 aa, Giardia lamblia
YDDKNSG

SEQ ID NO: 3146944 - protein, 9 aa, Giardia lamblia
YDDRTTHRK

SEQ ID NO: 3146945 - protein, 10 aa, Giardia lamblia
YDDSHGPKVA

SEQ ID NO: 3146946 - protein, 6 aa, Giardia lamblia
YDDTRV

SEQ ID NO: 3146947 - protein, 6 aa, Giardia lamblia
YDDVRR

SEQ ID NO: 3146948 - protein, 9 aa, Giardia lamblia
YDEDHSEEV

SEQ ID NO: 3146949 - protein, 10 aa, Giardia lamblia
YDEDSTSRLR

SEQ ID NO: 3146950 - protein, 4 aa, Giardia lamblia
YDEE

SEQ ID NO: 3146951 - protein, 26 aa, Giardia lamblia
YDEEANSEKRLKEESARRADASINPY

SEQ ID NO: 3146952 - protein, 5 aa, Giardia lamblia
YDELT

SEQ ID NO: 3146953 - protein, 6 aa, Giardia lamblia
YDEPSS

SEQ ID NO: 3146954 - protein, 11 aa, Giardia lamblia
YDEQHQQSVEG

SEQ ID NO: 3146955 - protein, 8 aa, Giardia lamblia
YDESSDGY

SEQ ID NO: 3146956 - protein, 5 aa, Giardia lamblia
YDEYG

SEQ ID NO: 3146957 - protein, 22 aa, Giardia lamblia
YDGGYEPPYVSAQGSGPANGDD

SEQ ID NO: 3146958 - protein, 14 aa, Giardia lamblia
YDGKISRRTECRIL

SEQ ID NO: 3146959 - protein, 8 aa, Giardia lamblia
YDGPSADT

SEQ ID NO: 3146960 - protein, 4 aa, Giardia lamblia
YDGR

SEQ ID NO: 3146961 - protein, 6 aa, Giardia lamblia
YDGRYS

SEQ ID NO: 3146962 - protein, 15 aa, Giardia lamblia
YDGTATVKESIENSI

SEQ ID NO: 3146963 - protein, 36 aa, Giardia lamblia
YDGYEPEARRSSARLPKRPISAVPTKPVPTANPWGA

SEQ ID NO: 3146964 - protein, 7 aa, Giardia lamblia
YDGYGYG

SEQ ID NO: 3146965 - protein, 7 aa, Giardia lamblia
YDKDGRI

SEQ ID NO: 3146966 - protein, 8 aa, Giardia lamblia
YDKEDGLD

SEQ ID NO: 3146967 - protein, 9 aa, Giardia lamblia
YDKEGAETV

SEQ ID NO: 3146968 - protein, 17 aa, Giardia lamblia
YDKGGPQSNKGQITDSQ

SEQ ID NO: 3146969 - protein, 5 aa, Giardia lamblia
YDKHD

SEQ ID NO: 3146970 - protein, 7 aa, Giardia lamblia
YDKPAKW

SEQ ID NO: 3146971 - protein, 9 aa, Giardia lamblia
YDLSETNHE

SEQ ID NO: 3146972 - protein, 5 aa, Giardia lamblia
YDLSS

SEQ ID NO: 3146973 - protein, 5 aa, Giardia lamblia
YDNET

SEQ ID NO: 3146974 - protein, 6 aa, Giardia lamblia
YDNETR

SEQ ID NO: 3146975 - protein, 4 aa, Giardia lamblia
YDNL

SEQ ID NO: 3146976 - protein, 6 aa, Giardia lamblia
YDNSRS

SEQ ID NO: 3146977 - protein, 8 aa, Giardia lamblia
YDNTLSPT

SEQ ID NO: 3146978 - protein, 14 aa, Giardia lamblia
YDPAGTAVGYPGTI

SEQ ID NO: 3146979 - protein, 13 aa, Giardia lamblia
YDPAQKGESNNID

SEQ ID NO: 3146980 - protein, 16 aa, Giardia lamblia
YDPARTRKEADRRDKR

SEQ ID NO: 3146981 - protein, 8 aa, Giardia lamblia
YDPDEELE

SEQ ID NO: 3146982 - protein, 14 aa, Giardia lamblia
YDPDESKKNLSSAA

SEQ ID NO: 3146983 - protein, 9 aa, Giardia lamblia
YDPEEEESK

SEQ ID NO: 3146984 - protein, 26 aa, Giardia lamblia
YDPHEDSKPSSGYYKQRPVSGDSYSN

SEQ ID NO: 3146985 - protein, 11 aa, Giardia lamblia
YDPLGHPEVGG

SEQ ID NO: 3146986 - protein, 7 aa, Giardia lamblia
YDPLPEK

SEQ ID NO: 3146987 - protein, 8 aa, Giardia lamblia
YDPPTELS

SEQ ID NO: 3146988 - protein, 10 aa, Giardia lamblia
YDPQGYSPIQ

SEQ ID NO: 3146989 - protein, 9 aa, Giardia lamblia
YDPQTGKFT

SEQ ID NO: 3146990 - protein, 6 aa, Giardia lamblia
YDPSPG

SEQ ID NO: 3146991 - protein, 19 aa, Giardia lamblia
YDPSSLSSISASPHGEDTT

SEQ ID NO: 3146992 - protein, 8 aa, Giardia lamblia
YDPTKQCY

SEQ ID NO: 3146993 - protein, 6 aa, Giardia lamblia
YDQDSL

SEQ ID NO: 3146994 - protein, 22 aa, Giardia lamblia
YDQDTGGKSAKPPLLQENRSKQ

SEQ ID NO: 3146995 - protein, 9 aa, Giardia lamblia
YDQEGIHPA

SEQ ID NO: 3146996 - protein, 4 aa, Giardia lamblia
YDQR

SEQ ID NO: 3146997 - protein, 6 aa, Giardia lamblia
YDSASG

SEQ ID NO: 3146998 - protein, 8 aa, Giardia lamblia
YDSETKEA

SEQ ID NO: 3146999 - protein, 17 aa, Giardia lamblia
YDSKAQSVEKAEDHLNN

SEQ ID NO: 3147000 - protein, 9 aa, Giardia lamblia
YDSKSNRYE

SEQ ID NO: 3147001 - protein, 14 aa, Giardia lamblia
YDSLNKEPLSDSAT

SEQ ID NO: 3147002 - protein, 5 aa, Giardia lamblia
YDSNG

SEQ ID NO: 3147003 - protein, 8 aa, Giardia lamblia
YDSNTGAY

SEQ ID NO: 3147004 - protein, 13 aa, Giardia lamblia
YDSPELRAARQPK

SEQ ID NO: 3147005 - protein, 10 aa, Giardia lamblia
YDSPSEECEA

SEQ ID NO: 3147006 - protein, 11 aa, Giardia lamblia
YDSPSEECEAQ

SEQ ID NO: 3147007 - protein, 12 aa, Giardia lamblia
YDSSARGHPSEQ

SEQ ID NO: 3147008 - protein, 5 aa, Giardia lamblia
YDSSD

SEQ ID NO: 3147009 - protein, 43 aa, Giardia lamblia
YDSSQSNADVKQQVKPSANAGSLAGGAKRPLEPAKQAALSQQE

SEQ ID NO: 3147010 - protein, 6 aa, Giardia lamblia
YDSSSD

SEQ ID NO: 3147011 - protein, 8 aa, Giardia lamblia
YDSTHSDQ

SEQ ID NO: 3147012 - protein, 7 aa, Giardia lamblia
YDTQQRT

SEQ ID NO: 3147013 - protein, 11 aa, Giardia lamblia
YDTSKDPVRER

SEQ ID NO: 3147014 - protein, 12 aa, Giardia lamblia
YDTSKEQVTPKS

SEQ ID NO: 3147015 - protein, 7 aa, Giardia lamblia
YDTSTPV

SEQ ID NO: 3147016 - protein, 8 aa, Giardia lamblia
YDVPEHEH

SEQ ID NO: 3147017 - protein, 4 aa, Giardia lamblia
YDVR

SEQ ID NO: 3147018 - protein, 5 aa, Giardia lamblia
YDVRD

SEQ ID NO: 3147019 - protein, 25 aa, Giardia lamblia
YDVTKTNETPGPGAYGVQGELGGPA

SEQ ID NO: 3147020 - protein, 4 aa, Giardia lamblia
YDWS

SEQ ID NO: 3147021 - protein, 11 aa, Giardia lamblia
YEADPAAGRIP

SEQ ID NO: 3147022 - protein, 7 aa, Giardia lamblia
YEADSRA

SEQ ID NO: 3147023 - protein, 7 aa, Giardia lamblia
YEAEEDD

SEQ ID NO: 3147024 - protein, 17 aa, Giardia lamblia
YEAGGNPAAGSAGGGMS

SEQ ID NO: 3147025 - protein, 25 aa, Giardia lamblia
YEAGPVKPSRPEREPDDDTPAAVRE

SEQ ID NO: 3147026 - protein, 11 aa, Giardia lamblia
YEAGQQDKQGV

SEQ ID NO: 3147027 - protein, 12 aa, Giardia lamblia
YEAGQQDPDGIP

SEQ ID NO: 3147028 - protein, 23 aa, Giardia lamblia
YEAIGDEKKEIDADFYQDPISDQ

SEQ ID NO: 3147029 - protein, 4 aa, Giardia lamblia
YEAN

SEQ ID NO: 3147030 - protein, 67 aa, Giardia lamblia
YEANGEAESCNNPGLDAPDAVEEELQEPKQRPSERRLGRQKSTQSRQGTASSFGRPVSSASGGKKLT

SEQ ID NO: 3147031 - protein, 16 aa, Giardia lamblia
YEAPPLPDVPTDDGRY

SEQ ID NO: 3147032 - protein, 6 aa, Giardia lamblia
YEARDD

SEQ ID NO: 3147033 - protein, 7 aa, Giardia lamblia
YEASGRA

SEQ ID NO: 3147034 - protein, 8 aa, Giardia lamblia
YEASSSAV

SEQ ID NO: 3147035 - protein, 4 aa, Giardia lamblia
YEDA

SEQ ID NO: 3147036 - protein, 24 aa, Giardia lamblia
YEDALRDGQNVRAEVASKDATIES

SEQ ID NO: 3147037 - protein, 5 aa, Giardia lamblia
YEDAP

SEQ ID NO: 3147038 - protein, 9 aa, Giardia lamblia
YEDEKTSCD

SEQ ID NO: 3147039 - protein, 7 aa, Giardia lamblia
YEDLPDD

SEQ ID NO: 3147040 - protein, 10 aa, Giardia lamblia
YEDPDTYGES

SEQ ID NO: 3147041 - protein, 29 aa, Giardia lamblia
YEDREHERERIASEAAGPVSPPRGGTPIV

SEQ ID NO: 3147042 - protein, 25 aa, Giardia lamblia
YEDSDIDETPKLKKQVEEYKAREAK

SEQ ID NO: 3147043 - protein, 6 aa, Giardia lamblia
YEDSSS

SEQ ID NO: 3147044 - protein, 12 aa, Giardia lamblia
YEEEVRASNERQ

SEQ ID NO: 3147045 - protein, 14 aa, Giardia lamblia
YEEFGSTINDLSHR

SEQ ID NO: 3147046 - protein, 4 aa, Giardia lamblia
YEEG

SEQ ID NO: 3147047 - protein, 7 aa, Giardia lamblia
YEEKRQS

SEQ ID NO: 3147048 - protein, 6 aa, Giardia lamblia
YEENAS

SEQ ID NO: 3147049 - protein, 23 aa, Giardia lamblia
YEEQKRLQAEEEDELKKQKVRQE

SEQ ID NO: 3147050 - protein, 6 aa, Giardia lamblia
YEERDA

SEQ ID NO: 3147051 - protein, 15 aa, Giardia lamblia
YEERKRKREAREPKV

SEQ ID NO: 3147052 - protein, 16 aa, Giardia lamblia
YEETTETLNQENQALT

SEQ ID NO: 3147053 - protein, 8 aa, Giardia lamblia
YEETTGMP

SEQ ID NO: 3147054 - protein, 7 aa, Giardia lamblia
YEEVTSN

SEQ ID NO: 3147055 - protein, 5 aa, Giardia lamblia
YEEYS

SEQ ID NO: 3147056 - protein, 7 aa, Giardia lamblia
YEGEEYA

SEQ ID NO: 3147057 - protein, 8 aa, Giardia lamblia
YEGEYDTI

SEQ ID NO: 3147058 - protein, 4 aa, Giardia lamblia
YEGG

SEQ ID NO: 3147059 - protein, 9 aa, Giardia lamblia
YEGGAKVGG

SEQ ID NO: 3147060 - protein, 4 aa, Giardia lamblia
YEGK

SEQ ID NO: 3147061 - protein, 29 aa, Giardia lamblia
YEGKGKDTPKVERSASRQMKGSKKLKTGT

SEQ ID NO: 3147062 - protein, 11 aa, Giardia lamblia
YEGPADTNKEP

SEQ ID NO: 3147063 - protein, 6 aa, Giardia lamblia
YEGPEP

SEQ ID NO: 3147064 - protein, 19 aa, Giardia lamblia
YEGPSNNLTSDSPGSTARP

SEQ ID NO: 3147065 - protein, 18 aa, Giardia lamblia
YEGTYSAFGSQTTANKTE

SEQ ID NO: 3147066 - protein, 8 aa, Giardia lamblia
YEGYPDAD

SEQ ID NO: 3147067 - protein, 6 aa, Giardia lamblia
YEHTEN

SEQ ID NO: 3147068 - protein, 15 aa, Giardia lamblia
YEKAQEKIRDYESGK

SEQ ID NO: 3147069 - protein, 48 aa, Giardia lamblia
YEKDRDAEQEEQDEDEDEDDEGENEEDEEDSEDPDTSNESISCRETTD

SEQ ID NO: 3147070 - protein, 8 aa, Giardia lamblia
YEKKNRDI

SEQ ID NO: 3147071 - protein, 9 aa, Giardia lamblia
YEKNYAPQV

SEQ ID NO: 3147072 - protein, 4 aa, Giardia lamblia
YEMG

SEQ ID NO: 3147073 - protein, 9 aa, Giardia lamblia
YEPCEPKGH

SEQ ID NO: 3147074 - protein, 16 aa, Giardia lamblia
YEPREADQASDSMSHE

SEQ ID NO: 3147075 - protein, 5 aa, Giardia lamblia
YEPSH

SEQ ID NO: 3147076 - protein, 5 aa, Giardia lamblia
YEQGM

SEQ ID NO: 3147077 - protein, 9 aa, Giardia lamblia
YEQPSPLPI

SEQ ID NO: 3147078 - protein, 9 aa, Giardia lamblia
YERARQGDV

SEQ ID NO: 3147079 - protein, 7 aa, Giardia lamblia
YERERDK

SEQ ID NO: 3147080 - protein, 7 aa, Giardia lamblia
YERGAGI

SEQ ID NO: 3147081 - protein, 10 aa, Giardia lamblia
YERKAISEDA

SEQ ID NO: 3147082 - protein, 5 aa, Giardia lamblia
YERNL

SEQ ID NO: 3147083 - protein, 10 aa, Giardia lamblia
YERSSTDSDK

SEQ ID NO: 3147084 - protein, 7 aa, Giardia lamblia
YESATHE

SEQ ID NO: 3147085 - protein, 8 aa, Giardia lamblia
YESDDELD

SEQ ID NO: 3147086 - protein, 4 aa, Giardia lamblia
YESE

SEQ ID NO: 3147087 - protein, 8 aa, Giardia lamblia
YESEANAE

SEQ ID NO: 3147088 - protein, 10 aa, Giardia lamblia
YESELRNNQT

SEQ ID NO: 3147089 - protein, 4 aa, Giardia lamblia
YESF

SEQ ID NO: 3147090 - protein, 7 aa, Giardia lamblia
YESFTDS

SEQ ID NO: 3147091 - protein, 20 aa, Giardia lamblia
YESGDKEAMDTARSNNGARI

SEQ ID NO: 3147092 - protein, 10 aa, Giardia lamblia
YESKEAIKAK

SEQ ID NO: 3147093 - protein, 4 aa, Giardia lamblia
YESL

SEQ ID NO: 3147094 - protein, 12 aa, Giardia lamblia
YESLKPKDFQNN

SEQ ID NO: 3147095 - protein, 18 aa, Giardia lamblia
YESNSTQGKQPSTATSGV

SEQ ID NO: 3147096 - protein, 4 aa, Giardia lamblia
YESR

SEQ ID NO: 3147097 - protein, 6 aa, Giardia lamblia
YESRKQ

SEQ ID NO: 3147098 - protein, 10 aa, Giardia lamblia
YESSGGSKHI

SEQ ID NO: 3147099 - protein, 5 aa, Giardia lamblia
YESSR

SEQ ID NO: 3147100 - protein, 5 aa, Giardia lamblia
YESSV

SEQ ID NO: 3147101 - protein, 4 aa, Giardia lamblia
YETE

SEQ ID NO: 3147102 - protein, 17 aa, Giardia lamblia
YETEDVEKATDSPSQKV

SEQ ID NO: 3147103 - protein, 23 aa, Giardia lamblia
YETEGHGDTDNLYGRSTQDTTIE

SEQ ID NO: 3147104 - protein, 8 aa, Giardia lamblia
YETGGLPD

SEQ ID NO: 3147105 - protein, 4 aa, Giardia lamblia
YETK

SEQ ID NO: 3147106 - protein, 11 aa, Giardia lamblia
YETQAGPQLTD

SEQ ID NO: 3147107 - protein, 9 aa, Giardia lamblia
YETRSSVQK

SEQ ID NO: 3147108 - protein, 6 aa, Giardia lamblia
YETSTT

SEQ ID NO: 3147109 - protein, 11 aa, Giardia lamblia
YEYPPRGENPL

SEQ ID NO: 3147110 - protein, 5 aa, Giardia lamblia
YFEKP

SEQ ID NO: 3147111 - protein, 13 aa, Giardia lamblia
YFPEGAVQDSSSM

SEQ ID NO: 3147112 - protein, 23 aa, Giardia lamblia
YFSDTGAASSATVGLSSSVASPI

SEQ ID NO: 3147113 - protein, 16 aa, Giardia lamblia
YGAEESGSSETPAKRA

SEQ ID NO: 3147114 - protein, 11 aa, Giardia lamblia
YGAPENTAKKS

SEQ ID NO: 3147115 - protein, 6 aa, Giardia lamblia
YGASNH

SEQ ID NO: 3147116 - protein, 21 aa, Giardia lamblia
YGASTSDSLLRDNGKSAVDKK

SEQ ID NO: 3147117 - protein, 8 aa, Giardia lamblia
YGASTSSL

SEQ ID NO: 3147118 - protein, 7 aa, Giardia lamblia
YGDAPAD

SEQ ID NO: 3147119 - protein, 4 aa, Giardia lamblia
YGDH

SEQ ID NO: 3147120 - protein, 11 aa, Giardia lamblia
YGDSASTQKGQ

SEQ ID NO: 3147121 - protein, 7 aa, Giardia lamblia
YGDSKES

SEQ ID NO: 3147122 - protein, 12 aa, Giardia lamblia
YGDSKKAGAGDM

SEQ ID NO: 3147123 - protein, 6 aa, Giardia lamblia
YGEDEA

SEQ ID NO: 3147124 - protein, 6 aa, Giardia lamblia
YGEEPL

SEQ ID NO: 3147125 - protein, 5 aa, Giardia lamblia
YGEEQ

SEQ ID NO: 3147126 - protein, 8 aa, Giardia lamblia
YGEKQDEI

SEQ ID NO: 3147127 - protein, 10 aa, Giardia lamblia
YGEPPANEFS

SEQ ID NO: 3147128 - protein, 14 aa, Giardia lamblia
YGEQERPKKEDYAT

SEQ ID NO: 3147129 - protein, 8 aa, Giardia lamblia
YGERPNEA

SEQ ID NO: 3147130 - protein, 6 aa, Giardia lamblia
YGGDGE

SEQ ID NO: 3147131 - protein, 12 aa, Giardia lamblia
YGGDPSGPQRDA

SEQ ID NO: 3147132 - protein, 7 aa, Giardia lamblia
YGGEQGF

SEQ ID NO: 3147133 - protein, 12 aa, Giardia lamblia
YGGGEKASSTYY

SEQ ID NO: 3147134 - protein, 6 aa, Giardia lamblia
YGGHAG

SEQ ID NO: 3147135 - protein, 7 aa, Giardia lamblia
YGGKDWR

SEQ ID NO: 3147136 - protein, 8 aa, Giardia lamblia
YGGKSSSF

SEQ ID NO: 3147137 - protein, 32 aa, Giardia lamblia
YGGPAIKDKDSRTASGSAGYSSGDSGKSTNQI

SEQ ID NO: 3147138 - protein, 10 aa, Giardia lamblia
YGGPDQECSS

SEQ ID NO: 3147139 - protein, 13 aa, Giardia lamblia
YGGSNSKQKTVNS

SEQ ID NO: 3147140 - protein, 7 aa, Giardia lamblia
YGGSTEK

SEQ ID NO: 3147141 - protein, 6 aa, Giardia lamblia
YGHKGR

SEQ ID NO: 3147142 - protein, 4 aa, Giardia lamblia
YGIN

SEQ ID NO: 3147143 - protein, 4 aa, Giardia lamblia
YGIT

SEQ ID NO: 3147144 - protein, 14 aa, Giardia lamblia
YGKKGSPPEIPPNS

SEQ ID NO: 3147145 - protein, 7 aa, Giardia lamblia
YGKLDQR

SEQ ID NO: 3147146 - protein, 9 aa, Giardia lamblia
YGKNDTQQL

SEQ ID NO: 3147147 - protein, 5 aa, Giardia lamblia
YGKPG

SEQ ID NO: 3147148 - protein, 6 aa, Giardia lamblia
YGKSSN

SEQ ID NO: 3147149 - protein, 7 aa, Giardia lamblia
YGKTADP

SEQ ID NO: 3147150 - protein, 8 aa, Giardia lamblia
YGLPPPGL

SEQ ID NO: 3147151 - protein, 6 aa, Giardia lamblia
YGLSED

SEQ ID NO: 3147152 - protein, 6 aa, Giardia lamblia
YGNNAE

SEQ ID NO: 3147153 - protein, 12 aa, Giardia lamblia
YGNNKRSAVERN

SEQ ID NO: 3147154 - protein, 6 aa, Giardia lamblia
YGNRHN

SEQ ID NO: 3147155 - protein, 4 aa, Giardia lamblia
YGNS

SEQ ID NO: 3147156 - protein, 9 aa, Giardia lamblia
YGPAARGSV

SEQ ID NO: 3147157 - protein, 24 aa, Giardia lamblia
YGPGGAAEKPACEPPRTPLPAAGA

SEQ ID NO: 3147158 - protein, 24 aa, Giardia lamblia
YGPGGDAEKPACEPPRTPLPAAGA

SEQ ID NO: 3147159 - protein, 44 aa, Giardia lamblia
YGPKPDLPGSGSAEVQSKLDSSAIVTEDSSRTLNSETNEHDPVA

SEQ ID NO: 3147160 - protein, 9 aa, Giardia lamblia
YGPNAPETI

SEQ ID NO: 3147161 - protein, 4 aa, Giardia lamblia
YGPP

SEQ ID NO: 3147162 - protein, 6 aa, Giardia lamblia
YGPPSA

SEQ ID NO: 3147163 - protein, 7 aa, Giardia lamblia
YGPQKHN

SEQ ID NO: 3147164 - protein, 4 aa, Giardia lamblia
YGPS

SEQ ID NO: 3147165 - protein, 6 aa, Giardia lamblia
YGPSEP

SEQ ID NO: 3147166 - protein, 17 aa, Giardia lamblia
YGPSTTAENFNPTESSL

SEQ ID NO: 3147167 - protein, 5 aa, Giardia lamblia
YGPTG

SEQ ID NO: 3147168 - protein, 6 aa, Giardia lamblia
YGPTSP

SEQ ID NO: 3147169 - protein, 10 aa, Giardia lamblia
YGPYSTGPAQ

SEQ ID NO: 3147170 - protein, 6 aa, Giardia lamblia
YGQEPS

SEQ ID NO: 3147171 - protein, 5 aa, Giardia lamblia
YGQGK

SEQ ID NO: 3147172 - protein, 11 aa, Giardia lamblia
YGQQDRSGKTA

SEQ ID NO: 3147173 - protein, 4 aa, Giardia lamblia
YGQT

SEQ ID NO: 3147174 - protein, 6 aa, Giardia lamblia
YGQTET

SEQ ID NO: 3147175 - protein, 11 aa, Giardia lamblia
YGRDNPGTATF

SEQ ID NO: 3147176 - protein, 8 aa, Giardia lamblia
YGREESPI

SEQ ID NO: 3147177 - protein, 5 aa, Giardia lamblia
YGRNS

SEQ ID NO: 3147178 - protein, 18 aa, Giardia lamblia
YGRQKLEAQRKPTIEDDA

SEQ ID NO: 3147179 - protein, 4 aa, Giardia lamblia
YGRT

SEQ ID NO: 3147180 - protein, 7 aa, Giardia lamblia
YGSDKET

SEQ ID NO: 3147181 - protein, 12 aa, Giardia lamblia
YGSDSERAAYRK

SEQ ID NO: 3147182 - protein, 14 aa, Giardia lamblia
YGSFSEKAAPHNDN

SEQ ID NO: 3147183 - protein, 4 aa, Giardia lamblia
YGSG

SEQ ID NO: 3147184 - protein, 6 aa, Giardia lamblia
YGSGMG

SEQ ID NO: 3147185 - protein, 5 aa, Giardia lamblia
YGSLT

SEQ ID NO: 3147186 - protein, 5 aa, Giardia lamblia
YGSNL

SEQ ID NO: 3147187 - protein, 4 aa, Giardia lamblia
YGSP

SEQ ID NO: 3147188 - protein, 8 aa, Giardia lamblia
YGSPGTSS

SEQ ID NO: 3147189 - protein, 4 aa, Giardia lamblia
YGSQ

SEQ ID NO: 3147190 - protein, 21 aa, Giardia lamblia
YGSQPEPFEPYPEYKLLYVPP

SEQ ID NO: 3147191 - protein, 8 aa, Giardia lamblia
YGSRTTAL

SEQ ID NO: 3147192 - protein, 8 aa, Giardia lamblia
YGSSPVDK

SEQ ID NO: 3147193 - protein, 16 aa, Giardia lamblia
YGSSSDHQLKGSNRPL

SEQ ID NO: 3147194 - protein, 7 aa, Giardia lamblia
YGSTQGS

SEQ ID NO: 3147195 - protein, 4 aa, Giardia lamblia
YGTA

SEQ ID NO: 3147196 - protein, 4 aa, Giardia lamblia
YGTD

SEQ ID NO: 3147197 - protein, 18 aa, Giardia lamblia
YGTSTAGLAANAKSNTNT

SEQ ID NO: 3147198 - protein, 11 aa, Giardia lamblia
YGTTDDKGNTA

SEQ ID NO: 3147199 - protein, 7 aa, Giardia lamblia
YGTTSTL

SEQ ID NO: 3147200 - protein, 5 aa, Giardia lamblia
YGTYG

SEQ ID NO: 3147201 - protein, 20 aa, Giardia lamblia
YGYPQSAVSDPSTAETEPIT

SEQ ID NO: 3147202 - protein, 16 aa, Giardia lamblia
YHDPPRPVTQKYSPAE

SEQ ID NO: 3147203 - protein, 10 aa, Giardia lamblia
YHGSPGTQRF

SEQ ID NO: 3147204 - protein, 4 aa, Giardia lamblia
YHGT

SEQ ID NO: 3147205 - protein, 10 aa, Giardia lamblia
YHKDATPPIE

SEQ ID NO: 3147206 - protein, 4 aa, Giardia lamblia
YHNG

SEQ ID NO: 3147207 - protein, 18 aa, Giardia lamblia
YHNSQTSEQTSSKPREIL

SEQ ID NO: 3147208 - protein, 11 aa, Giardia lamblia
YHPDKPTGDEE

SEQ ID NO: 3147209 - protein, 9 aa, Giardia lamblia
YHPGTSKKD

SEQ ID NO: 3147210 - protein, 24 aa, Giardia lamblia
YHPNTTQPIDRSQAREDSSAMHPE

SEQ ID NO: 3147211 - protein, 17 aa, Giardia lamblia
YHPPNRDTQISTKDPTL

SEQ ID NO: 3147212 - protein, 7 aa, Giardia lamblia
YHPSNAD

SEQ ID NO: 3147213 - protein, 10 aa, Giardia lamblia
YHSATDGTAL

SEQ ID NO: 3147214 - protein, 8 aa, Giardia lamblia
YIDSNGGC

SEQ ID NO: 3147215 - protein, 10 aa, Giardia lamblia
YIGQQNDQGL

SEQ ID NO: 3147216 - protein, 8 aa, Giardia lamblia
YIPDDDGN

SEQ ID NO: 3147217 - protein, 6 aa, Giardia lamblia
YIPTRS

SEQ ID NO: 3147218 - protein, 6 aa, Giardia lamblia
YISGRS

SEQ ID NO: 3147219 - protein, 7 aa, Giardia lamblia
YITKEQG

SEQ ID NO: 3147220 - protein, 21 aa, Giardia lamblia
YITSDTSKARRSPYKQASDPC

SEQ ID NO: 3147221 - protein, 10 aa, Giardia lamblia
YKAEEDGFNQ

SEQ ID NO: 3147222 - protein, 8 aa, Giardia lamblia
YKAEEQRL

SEQ ID NO: 3147223 - protein, 7 aa, Giardia lamblia
YKAGKSL

SEQ ID NO: 3147224 - protein, 17 aa, Giardia lamblia
YKAGKYPNKPGKYPSTS

SEQ ID NO: 3147225 - protein, 5 aa, Giardia lamblia
YKAKR

SEQ ID NO: 3147226 - protein, 9 aa, Giardia lamblia
YKAPDGEWR

SEQ ID NO: 3147227 - protein, 21 aa, Giardia lamblia
YKAQAEELAAKAGSKLQPGVA

SEQ ID NO: 3147228 - protein, 18 aa, Giardia lamblia
YKASATSKEKVTGGGKFK

SEQ ID NO: 3147229 - protein, 8 aa, Giardia lamblia
YKASGTEA

SEQ ID NO: 3147230 - protein, 4 aa, Giardia lamblia
YKDA

SEQ ID NO: 3147231 - protein, 5 aa, Giardia lamblia
YKDAT

SEQ ID NO: 3147232 - protein, 4 aa, Giardia lamblia
YKDE

SEQ ID NO: 3147233 - protein, 5 aa, Giardia lamblia
YKDGN

SEQ ID NO: 3147234 - protein, 6 aa, Giardia lamblia
YKDGTF

SEQ ID NO: 3147235 - protein, 10 aa, Giardia lamblia
YKDQAGSGAI

SEQ ID NO: 3147236 - protein, 5 aa, Giardia lamblia
YKDSL

SEQ ID NO: 3147237 - protein, 7 aa, Giardia lamblia
YKDSPVS

SEQ ID NO: 3147238 - protein, 10 aa, Giardia lamblia
YKDSQACSKC

SEQ ID NO: 3147239 - protein, 18 aa, Giardia lamblia
YKDTTTRTASPPKQEDDF

SEQ ID NO: 3147240 - protein, 7 aa, Giardia lamblia
YKDYARR

SEQ ID NO: 3147241 - protein, 12 aa, Giardia lamblia
YKDYPNNSGTID

SEQ ID NO: 3147242 - protein, 8 aa, Giardia lamblia
YKEDPEYW

SEQ ID NO: 3147243 - protein, 8 aa, Giardia lamblia
YKEESEEW

SEQ ID NO: 3147244 - protein, 8 aa, Giardia lamblia
YKEKLAEK

SEQ ID NO: 3147245 - protein, 4 aa, Giardia lamblia
YKEN

SEQ ID NO: 3147246 - protein, 17 aa, Giardia lamblia
YKENPVSTDSIEETVPT

SEQ ID NO: 3147247 - protein, 5 aa, Giardia lamblia
YKESG

SEQ ID NO: 3147248 - protein, 12 aa, Giardia lamblia
YKETQGGSKAVS

SEQ ID NO: 3147249 - protein, 4 aa, Giardia lamblia
YKGD

SEQ ID NO: 3147250 - protein, 6 aa, Giardia lamblia
YKGDDE

SEQ ID NO: 3147251 - protein, 9 aa, Giardia lamblia
YKGQEDKLG

SEQ ID NO: 3147252 - protein, 8 aa, Giardia lamblia
YKGQTQDD

SEQ ID NO: 3147253 - protein, 52 aa, Giardia lamblia
YKGSKSGATESGSANAVTKTSKPGNRSGSTAASMQNPKASSTSGPSIDSKEL

SEQ ID NO: 3147254 - protein, 5 aa, Giardia lamblia
YKGSQ

SEQ ID NO: 3147255 - protein, 6 aa, Giardia lamblia
YKGSRV

SEQ ID NO: 3147256 - protein, 11 aa, Giardia lamblia
YKGTKTPSGLT

SEQ ID NO: 3147257 - protein, 5 aa, Giardia lamblia
YKKCE

SEQ ID NO: 3147258 - protein, 6 aa, Giardia lamblia
YKKEGV

SEQ ID NO: 3147259 - protein, 14 aa, Giardia lamblia
YKKELRSKASISAK

SEQ ID NO: 3147260 - protein, 10 aa, Giardia lamblia
YKKKANTDSL

SEQ ID NO: 3147261 - protein, 6 aa, Giardia lamblia
YKKKYE

SEQ ID NO: 3147262 - protein, 22 aa, Giardia lamblia
YKKQKTPKRNRGGYDHGKTGSQ

SEQ ID NO: 3147263 - protein, 7 aa, Giardia lamblia
YKKSKPH

SEQ ID NO: 3147264 - protein, 8 aa, Giardia lamblia
YKNDKGDR

SEQ ID NO: 3147265 - protein, 11 aa, Giardia lamblia
YKNNDDSLVRP

SEQ ID NO: 3147266 - protein, 7 aa, Giardia lamblia
YKNQSSV

SEQ ID NO: 3147267 - protein, 6 aa, Giardia lamblia
YKNSPN

SEQ ID NO: 3147268 - protein, 9 aa, Giardia lamblia
YKPSKQERI

SEQ ID NO: 3147269 - protein, 15 aa, Giardia lamblia
YKPTVSTSSAMPTKS

SEQ ID NO: 3147270 - protein, 8 aa, Giardia lamblia
YKQELDEA

SEQ ID NO: 3147271 - protein, 22 aa, Giardia lamblia
YKQESFSGIASDESDIPDPERT

SEQ ID NO: 3147272 - protein, 6 aa, Giardia lamblia
YKQKRD

SEQ ID NO: 3147273 - protein, 16 aa, Giardia lamblia
YKQNEATKILEELAKT

SEQ ID NO: 3147274 - protein, 19 aa, Giardia lamblia
YKQSIEKYKSSKMNPPPPK

SEQ ID NO: 3147275 - protein, 10 aa, Giardia lamblia
YKQSRDESGF

SEQ ID NO: 3147276 - protein, 9 aa, Giardia lamblia
YKQTKASTI

SEQ ID NO: 3147277 - protein, 13 aa, Giardia lamblia
YKRAEEKRRDDCE

SEQ ID NO: 3147278 - protein, 11 aa, Giardia lamblia
YKRIPRATKEE

SEQ ID NO: 3147279 - protein, 18 aa, Giardia lamblia
YKRKQQEVQDLNSQAAKL

SEQ ID NO: 3147280 - protein, 24 aa, Giardia lamblia
YKRQERQLAREERNQIQDGVPNEQ

SEQ ID NO: 3147281 - protein, 6 aa, Giardia lamblia
YKSAES

SEQ ID NO: 3147282 - protein, 5 aa, Giardia lamblia
YKSDR

SEQ ID NO: 3147283 - protein, 9 aa, Giardia lamblia
YKSPSPCGT

SEQ ID NO: 3147284 - protein, 26 aa, Giardia lamblia
YKSRTPSYMPSSRSSPRKSGSPQTRN

SEQ ID NO: 3147285 - protein, 8 aa, Giardia lamblia
YKSSGTLI

SEQ ID NO: 3147286 - protein, 8 aa, Giardia lamblia
YKSSQSEL

SEQ ID NO: 3147287 - protein, 14 aa, Giardia lamblia
YKSTERQQSASLSG

SEQ ID NO: 3147288 - protein, 8 aa, Giardia lamblia
YKSTGVGS

SEQ ID NO: 3147289 - protein, 13 aa, Giardia lamblia
YKSTQDPNQKRKD

SEQ ID NO: 3147290 - protein, 10 aa, Giardia lamblia
YKSTQSDAKD

SEQ ID NO: 3147291 - protein, 6 aa, Giardia lamblia
YKSTTN

SEQ ID NO: 3147292 - protein, 8 aa, Giardia lamblia
YKSTTNNR

SEQ ID NO: 3147293 - protein, 10 aa, Giardia lamblia
YKTAERQEIS

SEQ ID NO: 3147294 - protein, 7 aa, Giardia lamblia
YKTDSAE

SEQ ID NO: 3147295 - protein, 16 aa, Giardia lamblia
YKTEKYTTAAGTQKPI

SEQ ID NO: 3147296 - protein, 8 aa, Giardia lamblia
YKTGDGIM

SEQ ID NO: 3147297 - protein, 18 aa, Giardia lamblia
YKTQKKDEIQSGKAVNRQ

SEQ ID NO: 3147298 - protein, 4 aa, Giardia lamblia
YKTS

SEQ ID NO: 3147299 - protein, 11 aa, Giardia lamblia
YKTSEASTTPA

SEQ ID NO: 3147300 - protein, 7 aa, Giardia lamblia
YKVDENR

SEQ ID NO: 3147301 - protein, 14 aa, Giardia lamblia
YKVGDDGRSMSSRA

SEQ ID NO: 3147302 - protein, 7 aa, Giardia lamblia
YKVGSNK

SEQ ID NO: 3147303 - protein, 7 aa, Giardia lamblia
YKVTGKD

SEQ ID NO: 3147304 - protein, 13 aa, Giardia lamblia
YLETDDGKKLATE

SEQ ID NO: 3147305 - protein, 12 aa, Giardia lamblia
YLNTEPKRTKDL

SEQ ID NO: 3147306 - protein, 12 aa, Giardia lamblia
YLPQGSQGLKAV

SEQ ID NO: 3147307 - protein, 20 aa, Giardia lamblia
YLQSQDSRQSLNVSQEEAIK

SEQ ID NO: 3147308 - protein, 8 aa, Giardia lamblia
YLSSSAGD

SEQ ID NO: 3147309 - protein, 6 aa, Giardia lamblia
YLTDGT

SEQ ID NO: 3147310 - protein, 14 aa, Giardia lamblia
YLTEPDDQEESSDL

SEQ ID NO: 3147311 - protein, 15 aa, Giardia lamblia
YLTGSTKQCLPSSAS

SEQ ID NO: 3147312 - protein, 14 aa, Giardia lamblia
YMSKGAERHYDEPN

SEQ ID NO: 3147313 - protein, 5 aa, Giardia lamblia
YNAEL

SEQ ID NO: 3147314 - protein, 7 aa, Giardia lamblia
YNAEPRI

SEQ ID NO: 3147315 - protein, 10 aa, Giardia lamblia
YNAGAPQKNA

SEQ ID NO: 3147316 - protein, 8 aa, Giardia lamblia
YNAKTTAL

SEQ ID NO: 3147317 - protein, 13 aa, Giardia lamblia
YNALESKKEELEN

SEQ ID NO: 3147318 - protein, 8 aa, Giardia lamblia
YNANGRTS

SEQ ID NO: 3147319 - protein, 17 aa, Giardia lamblia
YNDQSTAGEQNPSSYTQ

SEQ ID NO: 3147320 - protein, 6 aa, Giardia lamblia
YNDTYD

SEQ ID NO: 3147321 - protein, 7 aa, Giardia lamblia
YNEDSRL

SEQ ID NO: 3147322 - protein, 8 aa, Giardia lamblia
YNEEGSKR

SEQ ID NO: 3147323 - protein, 16 aa, Giardia lamblia
YNEEQGSDFGSVEDTT

SEQ ID NO: 3147324 - protein, 5 aa, Giardia lamblia
YNENE

SEQ ID NO: 3147325 - protein, 6 aa, Giardia lamblia
YNEPSY

SEQ ID NO: 3147326 - protein, 11 aa, Giardia lamblia
YNEQAASSSTL

SEQ ID NO: 3147327 - protein, 4 aa, Giardia lamblia
YNFE

SEQ ID NO: 3147328 - protein, 10 aa, Giardia lamblia
YNGDESVTDE

SEQ ID NO: 3147329 - protein, 5 aa, Giardia lamblia
YNGMS

SEQ ID NO: 3147330 - protein, 9 aa, Giardia lamblia
YNGPASVSK

SEQ ID NO: 3147331 - protein, 11 aa, Giardia lamblia
YNGSQKHRRDL

SEQ ID NO: 3147332 - protein, 10 aa, Giardia lamblia
YNGTASDGGH

SEQ ID NO: 3147333 - protein, 11 aa, Giardia lamblia
YNGTRDDAGYT

SEQ ID NO: 3147334 - protein, 16 aa, Giardia lamblia
YNHNSEEDAPFAPKTD

SEQ ID NO: 3147335 - protein, 4 aa, Giardia lamblia
YNIP

SEQ ID NO: 3147336 - protein, 13 aa, Giardia lamblia
YNIQNSESAETTL

SEQ ID NO: 3147337 - protein, 22 aa, Giardia lamblia
YNKDSTKKSASGSSTRQLGQGG

SEQ ID NO: 3147338 - protein, 7 aa, Giardia lamblia
YNKQDTR

SEQ ID NO: 3147339 - protein, 7 aa, Giardia lamblia
YNKTHQS

SEQ ID NO: 3147340 - protein, 18 aa, Giardia lamblia
YNLGEDPSAKDGAQTPSY

SEQ ID NO: 3147341 - protein, 10 aa, Giardia lamblia
YNLGRQPANT

SEQ ID NO: 3147342 - protein, 4 aa, Giardia lamblia
YNMS

SEQ ID NO: 3147343 - protein, 15 aa, Giardia lamblia
YNNNDELAGENYTEQ

SEQ ID NO: 3147344 - protein, 7 aa, Giardia lamblia
YNNPGKQ

SEQ ID NO: 3147345 - protein, 9 aa, Giardia lamblia
YNPAPETLQ

SEQ ID NO: 3147346 - protein, 8 aa, Giardia lamblia
YNPASGRR

SEQ ID NO: 3147347 - protein, 12 aa, Giardia lamblia
YNPATSSAANDE

SEQ ID NO: 3147348 - protein, 7 aa, Giardia lamblia
YNPDKTF

SEQ ID NO: 3147349 - protein, 12 aa, Giardia lamblia
YNPEARASFTSK

SEQ ID NO: 3147350 - protein, 7 aa, Giardia lamblia
YNPHNDL

SEQ ID NO: 3147351 - protein, 4 aa, Giardia lamblia
YNPP

SEQ ID NO: 3147352 - protein, 12 aa, Giardia lamblia
YNPPFKPNVSSE

SEQ ID NO: 3147353 - protein, 23 aa, Giardia lamblia
YNPPSIGDQSASLGSSDNTSMAA

SEQ ID NO: 3147354 - protein, 6 aa, Giardia lamblia
YNPRYP

SEQ ID NO: 3147355 - protein, 9 aa, Giardia lamblia
YNPSHSYSA

SEQ ID NO: 3147356 - protein, 11 aa, Giardia lamblia
YNPSVKKASKS

SEQ ID NO: 3147357 - protein, 5 aa, Giardia lamblia
YNPTY

SEQ ID NO: 3147358 - protein, 7 aa, Giardia lamblia
YNREDSK

SEQ ID NO: 3147359 - protein, 8 aa, Giardia lamblia
YNRPQQPY

SEQ ID NO: 3147360 - protein, 9 aa, Giardia lamblia
YNSAAAEEK

SEQ ID NO: 3147361 - protein, 8 aa, Giardia lamblia
YNSAEEAE

SEQ ID NO: 3147362 - protein, 16 aa, Giardia lamblia
YNSAGSMHQEPSEYPR

SEQ ID NO: 3147363 - protein, 10 aa, Giardia lamblia
YNSDQDSTRS

SEQ ID NO: 3147364 - protein, 15 aa, Giardia lamblia
YNSGTLKANARKYLA

SEQ ID NO: 3147365 - protein, 4 aa, Giardia lamblia
YNSK

SEQ ID NO: 3147366 - protein, 7 aa, Giardia lamblia
YNSKAEN

SEQ ID NO: 3147367 - protein, 18 aa, Giardia lamblia
YNSPKISSPIPQQARERN

SEQ ID NO: 3147368 - protein, 9 aa, Giardia lamblia
YNSPNSSLI

SEQ ID NO: 3147369 - protein, 9 aa, Giardia lamblia
YNSSNSQSV

SEQ ID NO: 3147370 - protein, 9 aa, Giardia lamblia
YNSTAEVEH

SEQ ID NO: 3147371 - protein, 6 aa, Giardia lamblia
YNSTPR

SEQ ID NO: 3147372 - protein, 4 aa, Giardia lamblia
YNTD

SEQ ID NO: 3147373 - protein, 8 aa, Giardia lamblia
YNTFTDDD

SEQ ID NO: 3147374 - protein, 5 aa, Giardia lamblia
YNTKE

SEQ ID NO: 3147375 - protein, 6 aa, Giardia lamblia
YNTKGQ

SEQ ID NO: 3147376 - protein, 4 aa, Giardia lamblia
YNTL

SEQ ID NO: 3147377 - protein, 9 aa, Giardia lamblia
YNYQPTESE

SEQ ID NO: 3147378 - protein, 6 aa, Giardia lamblia
YPAATL

SEQ ID NO: 3147379 - protein, 5 aa, Giardia lamblia
YPAET

SEQ ID NO: 3147380 - protein, 10 aa, Giardia lamblia
YPAGQTNPEG

SEQ ID NO: 3147381 - protein, 7 aa, Giardia lamblia
YPAGRKG

SEQ ID NO: 3147382 - protein, 8 aa, Giardia lamblia
YPAGSNPR

SEQ ID NO: 3147383 - protein, 7 aa, Giardia lamblia
YPANTNL

SEQ ID NO: 3147384 - protein, 17 aa, Giardia lamblia
YPATGKRARNGRPSCER

SEQ ID NO: 3147385 - protein, 9 aa, Giardia lamblia
YPDARPSAQ

SEQ ID NO: 3147386 - protein, 9 aa, Giardia lamblia
YPDATDAQK

SEQ ID NO: 3147387 - protein, 6 aa, Giardia lamblia
YPDDAA

SEQ ID NO: 3147388 - protein, 9 aa, Giardia lamblia
YPDEQCPSV

SEQ ID NO: 3147389 - protein, 12 aa, Giardia lamblia
YPDGSVDARPFS

SEQ ID NO: 3147390 - protein, 6 aa, Giardia lamblia
YPDKAY

SEQ ID NO: 3147391 - protein, 9 aa, Giardia lamblia
YPDKLTDYT

SEQ ID NO: 3147392 - protein, 6 aa, Giardia lamblia
YPDNDD

SEQ ID NO: 3147393 - protein, 10 aa, Giardia lamblia
YPDPAHNASH

SEQ ID NO: 3147394 - protein, 9 aa, Giardia lamblia
YPDTEASKM

SEQ ID NO: 3147395 - protein, 6 aa, Giardia lamblia
YPEGPT

SEQ ID NO: 3147396 - protein, 11 aa, Giardia lamblia
YPGNNPSSQSL

SEQ ID NO: 3147397 - protein, 4 aa, Giardia lamblia
YPGP

SEQ ID NO: 3147398 - protein, 7 aa, Giardia lamblia
YPHAEPD

SEQ ID NO: 3147399 - protein, 29 aa, Giardia lamblia
YPHAPTTPTTRGVTKREGHQGPGGYSTPA

SEQ ID NO: 3147400 - protein, 6 aa, Giardia lamblia
YPHKPP

SEQ ID NO: 3147401 - protein, 18 aa, Giardia lamblia
YPHSDSASAAPATAPQSH

SEQ ID NO: 3147402 - protein, 6 aa, Giardia lamblia
YPIKPP

SEQ ID NO: 3147403 - protein, 10 aa, Giardia lamblia
YPKENGEKQL

SEQ ID NO: 3147404 - protein, 8 aa, Giardia lamblia
YPKQANIS

SEQ ID NO: 3147405 - protein, 9 aa, Giardia lamblia
YPKRRAGDT

SEQ ID NO: 3147406 - protein, 6 aa, Giardia lamblia
YPLAQD

SEQ ID NO: 3147407 - protein, 9 aa, Giardia lamblia
YPLPQGNDI

SEQ ID NO: 3147408 - protein, 12 aa, Giardia lamblia
YPLREDDAPSLK

SEQ ID NO: 3147409 - protein, 14 aa, Giardia lamblia
YPLSPPSSPSFQGA

SEQ ID NO: 3147410 - protein, 5 aa, Giardia lamblia
YPNEA

SEQ ID NO: 3147411 - protein, 8 aa, Giardia lamblia
YPNEEVTG

SEQ ID NO: 3147412 - protein, 7 aa, Giardia lamblia
YPNEKGR

SEQ ID NO: 3147413 - protein, 6 aa, Giardia lamblia
YPNHPE

SEQ ID NO: 3147414 - protein, 11 aa, Giardia lamblia
YPNHPSPSMLP

SEQ ID NO: 3147415 - protein, 4 aa, Giardia lamblia
YPNK

SEQ ID NO: 3147416 - protein, 9 aa, Giardia lamblia
YPNTGKSSV

SEQ ID NO: 3147417 - protein, 7 aa, Giardia lamblia
YPNVGKS

SEQ ID NO: 3147418 - protein, 8 aa, Giardia lamblia
YPPAVQEE

SEQ ID NO: 3147419 - protein, 6 aa, Giardia lamblia
YPPGAG

SEQ ID NO: 3147420 - protein, 6 aa, Giardia lamblia
YPPGST

SEQ ID NO: 3147421 - protein, 8 aa, Giardia lamblia
YPPNYGGA

SEQ ID NO: 3147422 - protein, 7 aa, Giardia lamblia
YPPPPAS

SEQ ID NO: 3147423 - protein, 9 aa, Giardia lamblia
YPPQAVQPI

SEQ ID NO: 3147424 - protein, 7 aa, Giardia lamblia
YPPRTTA

SEQ ID NO: 3147425 - protein, 20 aa, Giardia lamblia
YPPSRTSNARPSVDETETAN

SEQ ID NO: 3147426 - protein, 9 aa, Giardia lamblia
YPPTSSMSR

SEQ ID NO: 3147427 - protein, 5 aa, Giardia lamblia
YPQPA

SEQ ID NO: 3147428 - protein, 4 aa, Giardia lamblia
YPQV

SEQ ID NO: 3147429 - protein, 7 aa, Giardia lamblia
YPRAGTE

SEQ ID NO: 3147430 - protein, 7 aa, Giardia lamblia
YPRKPQR

SEQ ID NO: 3147431 - protein, 5 aa, Giardia lamblia
YPRPG

SEQ ID NO: 3147432 - protein, 28 aa, Giardia lamblia
YPRPSTVAGYGSGQLTAQGSLPQPYSYR

SEQ ID NO: 3147433 - protein, 6 aa, Giardia lamblia
YPRQSA

SEQ ID NO: 3147434 - protein, 13 aa, Giardia lamblia
YPRTESTTYPSGY

SEQ ID NO: 3147435 - protein, 13 aa, Giardia lamblia
YPRTETKSYPNTY

SEQ ID NO: 3147436 - protein, 25 aa, Giardia lamblia
YPRTQRDGQTGGRRSKQGKETSMTP

SEQ ID NO: 3147437 - protein, 9 aa, Giardia lamblia
YPSDQVQPY

SEQ ID NO: 3147438 - protein, 5 aa, Giardia lamblia
YPSEE

SEQ ID NO: 3147439 - protein, 8 aa, Giardia lamblia
YPSGEKPY

SEQ ID NO: 3147440 - protein, 13 aa, Giardia lamblia
YPSNMSNGGNSIS

SEQ ID NO: 3147441 - protein, 7 aa, Giardia lamblia
YPSNSTQ

SEQ ID NO: 3147442 - protein, 25 aa, Giardia lamblia
YPSPARLQEDYNEKYESAKWNPKGF

SEQ ID NO: 3147443 - protein, 7 aa, Giardia lamblia
YPSPTID

SEQ ID NO: 3147444 - protein, 4 aa, Giardia lamblia
YPSR

SEQ ID NO: 3147445 - protein, 8 aa, Giardia lamblia
YPSSASSL

SEQ ID NO: 3147446 - protein, 27 aa, Giardia lamblia
YPSSVNRPGIASGRGGRQGASGTYGSV

SEQ ID NO: 3147447 - protein, 6 aa, Giardia lamblia
YPSTHS

SEQ ID NO: 3147448 - protein, 8 aa, Giardia lamblia
YPSTNIPS

SEQ ID NO: 3147449 - protein, 4 aa, Giardia lamblia
YPSV

SEQ ID NO: 3147450 - protein, 9 aa, Giardia lamblia
YPTAPTVPS

SEQ ID NO: 3147451 - protein, 29 aa, Giardia lamblia
YPTATTPYSSPQLSDSQSQSQKPGIPSPS

SEQ ID NO: 3147452 - protein, 9 aa, Giardia lamblia
YPTDDNDNI

SEQ ID NO: 3147453 - protein, 27 aa, Giardia lamblia
YPTDEHGPAPISSGSSLESNPLAPNLE

SEQ ID NO: 3147454 - protein, 9 aa, Giardia lamblia
YPTKTVQDD

SEQ ID NO: 3147455 - protein, 8 aa, Giardia lamblia
YPTNDAPV

SEQ ID NO: 3147456 - protein, 4 aa, Giardia lamblia
YPTQ

SEQ ID NO: 3147457 - protein, 4 aa, Giardia lamblia
YPTS

SEQ ID NO: 3147458 - protein, 11 aa, Giardia lamblia
YPTSGGQQHDT

SEQ ID NO: 3147459 - protein, 9 aa, Giardia lamblia
YPTSRDYDT

SEQ ID NO: 3147460 - protein, 5 aa, Giardia lamblia
YPTSY

SEQ ID NO: 3147461 - protein, 6 aa, Giardia lamblia
YPTTTE

SEQ ID NO: 3147462 - protein, 7 aa, Giardia lamblia
YPTVPRK

SEQ ID NO: 3147463 - protein, 4 aa, Giardia lamblia
YPYQ

SEQ ID NO: 3147464 - protein, 5 aa, Giardia lamblia
YPYSG

SEQ ID NO: 3147465 - protein, 9 aa, Giardia lamblia
YQADTSLSN

SEQ ID NO: 3147466 - protein, 4 aa, Giardia lamblia
YQAE

SEQ ID NO: 3147467 - protein, 4 aa, Giardia lamblia
YQAG

SEQ ID NO: 3147468 - protein, 11 aa, Giardia lamblia
YQAKPSPEAGS

SEQ ID NO: 3147469 - protein, 9 aa, Giardia lamblia
YQAKSNEAT

SEQ ID NO: 3147470 - protein, 8 aa, Giardia lamblia
YQDAEEQR

SEQ ID NO: 3147471 - protein, 4 aa, Giardia lamblia
YQDE

SEQ ID NO: 3147472 - protein, 8 aa, Giardia lamblia
YQDGKDKK

SEQ ID NO: 3147473 - protein, 8 aa, Giardia lamblia
YQDHASKK

SEQ ID NO: 3147474 - protein, 7 aa, Giardia lamblia
YQDPDSV

SEQ ID NO: 3147475 - protein, 7 aa, Giardia lamblia
YQDRSGC

SEQ ID NO: 3147476 - protein, 8 aa, Giardia lamblia
YQDSGKGF

SEQ ID NO: 3147477 - protein, 4 aa, Giardia lamblia
YQDV

SEQ ID NO: 3147478 - protein, 6 aa, Giardia lamblia
YQEARD

SEQ ID NO: 3147479 - protein, 25 aa, Giardia lamblia
YQEDSMDRERSIKKRADERNSQMET

SEQ ID NO: 3147480 - protein, 7 aa, Giardia lamblia
YQEHPKR

SEQ ID NO: 3147481 - protein, 7 aa, Giardia lamblia
YQEHTQS

SEQ ID NO: 3147482 - protein, 8 aa, Giardia lamblia
YQEPLPDD

SEQ ID NO: 3147483 - protein, 8 aa, Giardia lamblia
YQESREFS

SEQ ID NO: 3147484 - protein, 13 aa, Giardia lamblia
YQGSEQHRPMTLE

SEQ ID NO: 3147485 - protein, 9 aa, Giardia lamblia
YQGSYQSAD

SEQ ID NO: 3147486 - protein, 37 aa, Giardia lamblia
YQKQLADSTTDQRPQKSHQSDAADGAALSPEAKERYV

SEQ ID NO: 3147487 - protein, 5 aa, Giardia lamblia
YQKTT

SEQ ID NO: 3147488 - protein, 15 aa, Giardia lamblia
YQNGAQDYDDNDTVE

SEQ ID NO: 3147489 - protein, 8 aa, Giardia lamblia
YQNPGPIQ

SEQ ID NO: 3147490 - protein, 8 aa, Giardia lamblia
YQNRGGQE

SEQ ID NO: 3147491 - protein, 8 aa, Giardia lamblia
YQNSGEDR

SEQ ID NO: 3147492 - protein, 5 aa, Giardia lamblia
YQPFP

SEQ ID NO: 3147493 - protein, 13 aa, Giardia lamblia
YQPLPSSSRRFSD

SEQ ID NO: 3147494 - protein, 12 aa, Giardia lamblia
YQPPPPKTEDEV

SEQ ID NO: 3147495 - protein, 12 aa, Giardia lamblia
YQPTEADEKAAR

SEQ ID NO: 3147496 - protein, 7 aa, Giardia lamblia
YQPVSER

SEQ ID NO: 3147497 - protein, 4 aa, Giardia lamblia
YQQE

SEQ ID NO: 3147498 - protein, 11 aa, Giardia lamblia
YQQGPDAPLQG

SEQ ID NO: 3147499 - protein, 30 aa, Giardia lamblia
YQQLGNESNRRAPASRMANRTAASRYKLVR

SEQ ID NO: 3147500 - protein, 8 aa, Giardia lamblia
YQQNQSIY

SEQ ID NO: 3147501 - protein, 8 aa, Giardia lamblia
YQQPMQQQ

SEQ ID NO: 3147502 - protein, 6 aa, Giardia lamblia
YQQQAQ

SEQ ID NO: 3147503 - protein, 5 aa, Giardia lamblia
YQQSL

SEQ ID NO: 3147504 - protein, 4 aa, Giardia lamblia
YQQT

SEQ ID NO: 3147505 - protein, 13 aa, Giardia lamblia
YQQTPASMYQQFK

SEQ ID NO: 3147506 - protein, 4 aa, Giardia lamblia
YQQY

SEQ ID NO: 3147507 - protein, 5 aa, Giardia lamblia
YQRTG

SEQ ID NO: 3147508 - protein, 15 aa, Giardia lamblia
YQSKSYGGDVRNKPT

SEQ ID NO: 3147509 - protein, 8 aa, Giardia lamblia
YQSRGVSD

SEQ ID NO: 3147510 - protein, 24 aa, Giardia lamblia
YQSSGKDTAQRPIGDDPVSKENVS

SEQ ID NO: 3147511 - protein, 6 aa, Giardia lamblia
YQSTGD

SEQ ID NO: 3147512 - protein, 12 aa, Giardia lamblia
YQSTQSSSSRRL

SEQ ID NO: 3147513 - protein, 6 aa, Giardia lamblia
YQTAPL

SEQ ID NO: 3147514 - protein, 14 aa, Giardia lamblia
YQTATQGNYNTTTM

SEQ ID NO: 3147515 - protein, 4 aa, Giardia lamblia
YQTD

SEQ ID NO: 3147516 - protein, 7 aa, Giardia lamblia
YQTQTGT

SEQ ID NO: 3147517 - protein, 5 aa, Giardia lamblia
YQTRF

SEQ ID NO: 3147518 - protein, 9 aa, Giardia lamblia
YQVDEEGSV

SEQ ID NO: 3147519 - protein, 4 aa, Giardia lamblia
YQYA

SEQ ID NO: 3147520 - protein, 9 aa, Giardia lamblia
YRAAGNPSY

SEQ ID NO: 3147521 - protein, 11 aa, Giardia lamblia
YRADTKGNNLN

SEQ ID NO: 3147522 - protein, 18 aa, Giardia lamblia
YRAPKPIKPQADAEPAGL

SEQ ID NO: 3147523 - protein, 22 aa, Giardia lamblia
YRAPSSGAGTALTPSRRSTYGK

SEQ ID NO: 3147524 - protein, 7 aa, Giardia lamblia
YRDENGR

SEQ ID NO: 3147525 - protein, 8 aa, Giardia lamblia
YRDESGKP

SEQ ID NO: 3147526 - protein, 25 aa, Giardia lamblia
YRDPRNDCSSTSSRSESCSASSDSA

SEQ ID NO: 3147527 - protein, 18 aa, Giardia lamblia
YRDPTETGLTITGGEPNI

SEQ ID NO: 3147528 - protein, 8 aa, Giardia lamblia
YRDSEEAV

SEQ ID NO: 3147529 - protein, 15 aa, Giardia lamblia
YREEDESASEANPGI

SEQ ID NO: 3147530 - protein, 6 aa, Giardia lamblia
YREENY

SEQ ID NO: 3147531 - protein, 11 aa, Giardia lamblia
YREGKSTPEAL

SEQ ID NO: 3147532 - protein, 10 aa, Giardia lamblia
YREGNSNDSY

SEQ ID NO: 3147533 - protein, 22 aa, Giardia lamblia
YREPPTAKLPPLPGTKSNEFTE

SEQ ID NO: 3147534 - protein, 12 aa, Giardia lamblia
YRETAKGTRTAR

SEQ ID NO: 3147535 - protein, 5 aa, Giardia lamblia
YRFTD

SEQ ID NO: 3147536 - protein, 4 aa, Giardia lamblia
YRGA

SEQ ID NO: 3147537 - protein, 5 aa, Giardia lamblia
YRGEN

SEQ ID NO: 3147538 - protein, 4 aa, Giardia lamblia
YRGT

SEQ ID NO: 3147539 - protein, 10 aa, Giardia lamblia
YRGVTPSKDI

SEQ ID NO: 3147540 - protein, 5 aa, Giardia lamblia
YRKEE

SEQ ID NO: 3147541 - protein, 12 aa, Giardia lamblia
YRKSESKLGPKH

SEQ ID NO: 3147542 - protein, 6 aa, Giardia lamblia
YRKSHN

SEQ ID NO: 3147543 - protein, 6 aa, Giardia lamblia
YRNPGT

SEQ ID NO: 3147544 - protein, 6 aa, Giardia lamblia
YRPPEA

SEQ ID NO: 3147545 - protein, 19 aa, Giardia lamblia
YRPPTGRDTKSDDTDAPDY

SEQ ID NO: 3147546 - protein, 4 aa, Giardia lamblia
YRPR

SEQ ID NO: 3147547 - protein, 10 aa, Giardia lamblia
YRPTAPASEV

SEQ ID NO: 3147548 - protein, 19 aa, Giardia lamblia
YRPTPNSTSYMTKTNSQLR

SEQ ID NO: 3147549 - protein, 29 aa, Giardia lamblia
YRQGGSRSSSRRESRTGSRVPSAIRKSTA

SEQ ID NO: 3147550 - protein, 21 aa, Giardia lamblia
YRQIGSGPFSIPESPPIKGSE

SEQ ID NO: 3147551 - protein, 4 aa, Giardia lamblia
YRQN

SEQ ID NO: 3147552 - protein, 11 aa, Giardia lamblia
YRRGRSSYRGA

SEQ ID NO: 3147553 - protein, 8 aa, Giardia lamblia
YRRRTDNT

SEQ ID NO: 3147554 - protein, 12 aa, Giardia lamblia
YRRSMSDTNMFL

SEQ ID NO: 3147555 - protein, 4 aa, Giardia lamblia
YRSP

SEQ ID NO: 3147556 - protein, 6 aa, Giardia lamblia
YRSQTD

SEQ ID NO: 3147557 - protein, 7 aa, Giardia lamblia
YRTAATD

SEQ ID NO: 3147558 - protein, 5 aa, Giardia lamblia
YRTAS

SEQ ID NO: 3147559 - protein, 14 aa, Giardia lamblia
YRTMRSENRVHVEA

SEQ ID NO: 3147560 - protein, 22 aa, Giardia lamblia
YRTQDGFSVPDTAAKLQSINSN

SEQ ID NO: 3147561 - protein, 8 aa, Giardia lamblia
YRTQGNNA

SEQ ID NO: 3147562 - protein, 4 aa, Giardia lamblia
YRTR

SEQ ID NO: 3147563 - protein, 15 aa, Giardia lamblia
YRTRRTHASPGPGDY

SEQ ID NO: 3147564 - protein, 7 aa, Giardia lamblia
YRTSQSA

SEQ ID NO: 3147565 - protein, 10 aa, Giardia lamblia
YSADARQRIA

SEQ ID NO: 3147566 - protein, 23 aa, Giardia lamblia
YSADTRGSSPRRTAGTYPSLDDQ

SEQ ID NO: 3147567 - protein, 8 aa, Giardia lamblia
YSAEATTS

SEQ ID NO: 3147568 - protein, 9 aa, Giardia lamblia
YSAESREKI

SEQ ID NO: 3147569 - protein, 4 aa, Giardia lamblia
YSAG

SEQ ID NO: 3147570 - protein, 7 aa, Giardia lamblia
YSAGEAY

SEQ ID NO: 3147571 - protein, 9 aa, Giardia lamblia
YSAHPTPDA

SEQ ID NO: 3147572 - protein, 7 aa, Giardia lamblia
YSAIDTD

SEQ ID NO: 3147573 - protein, 7 aa, Giardia lamblia
YSAKEED

SEQ ID NO: 3147574 - protein, 15 aa, Giardia lamblia
YSAKQSSGSGRERGV

SEQ ID NO: 3147575 - protein, 5 aa, Giardia lamblia
YSAQE

SEQ ID NO: 3147576 - protein, 8 aa, Giardia lamblia
YSAQGGGS

SEQ ID NO: 3147577 - protein, 4 aa, Giardia lamblia
YSAR

SEQ ID NO: 3147578 - protein, 14 aa, Giardia lamblia
YSARLEKKKKDEAM

SEQ ID NO: 3147579 - protein, 14 aa, Giardia lamblia
YSASDREKVRAQYR

SEQ ID NO: 3147580 - protein, 13 aa, Giardia lamblia
YSASSRSACQLLS

SEQ ID NO: 3147581 - protein, 20 aa, Giardia lamblia
YSATTNQSNLQSEIQRQQRA

SEQ ID NO: 3147582 - protein, 14 aa, Giardia lamblia
YSAYSGKQYDTERD

SEQ ID NO: 3147583 - protein, 20 aa, Giardia lamblia
YSCDSDDDRRSRSAKQKAQT

SEQ ID NO: 3147584 - protein, 14 aa, Giardia lamblia
YSDAGLQTQYARDQ

SEQ ID NO: 3147585 - protein, 17 aa, Giardia lamblia
YSDDSTARETPATGSFS

SEQ ID NO: 3147586 - protein, 9 aa, Giardia lamblia
YSDEKLPSG

SEQ ID NO: 3147587 - protein, 6 aa, Giardia lamblia
YSDGDT

SEQ ID NO: 3147588 - protein, 12 aa, Giardia lamblia
YSDNSEDELQTK

SEQ ID NO: 3147589 - protein, 9 aa, Giardia lamblia
YSDPPSVST

SEQ ID NO: 3147590 - protein, 24 aa, Giardia lamblia
YSDSANRNIAGQSDNTDNGKDEHQ

SEQ ID NO: 3147591 - protein, 9 aa, Giardia lamblia
YSDSGEEKM

SEQ ID NO: 3147592 - protein, 4 aa, Giardia lamblia
YSDT

SEQ ID NO: 3147593 - protein, 8 aa, Giardia lamblia
YSDTSKLS

SEQ ID NO: 3147594 - protein, 4 aa, Giardia lamblia
YSEA

SEQ ID NO: 3147595 - protein, 8 aa, Giardia lamblia
YSEGEPNS

SEQ ID NO: 3147596 - protein, 18 aa, Giardia lamblia
YSEGSSEQSVQEHQRTRP

SEQ ID NO: 3147597 - protein, 10 aa, Giardia lamblia
YSEKDPVQIA

SEQ ID NO: 3147598 - protein, 12 aa, Giardia lamblia
YSENGDGMSPEE

SEQ ID NO: 3147599 - protein, 9 aa, Giardia lamblia
YSENQSAHQ

SEQ ID NO: 3147600 - protein, 24 aa, Giardia lamblia
YSENTGKCPGGQDEENKESVPKKV

SEQ ID NO: 3147601 - protein, 9 aa, Giardia lamblia
YSEPHQPAH

SEQ ID NO: 3147602 - protein, 10 aa, Giardia lamblia
YSERPQHASD

SEQ ID NO: 3147603 - protein, 7 aa, Giardia lamblia
YSERSYY

SEQ ID NO: 3147604 - protein, 8 aa, Giardia lamblia
YSESDANN

SEQ ID NO: 3147605 - protein, 9 aa, Giardia lamblia
YSESNSNAW

SEQ ID NO: 3147606 - protein, 11 aa, Giardia lamblia
YSESTDEGVNP

SEQ ID NO: 3147607 - protein, 4 aa, Giardia lamblia
YSET

SEQ ID NO: 3147608 - protein, 6 aa, Giardia lamblia
YSETTQ

SEQ ID NO: 3147609 - protein, 7 aa, Giardia lamblia
YSGANAY

SEQ ID NO: 3147610 - protein, 6 aa, Giardia lamblia
YSGDEN

SEQ ID NO: 3147611 - protein, 7 aa, Giardia lamblia
YSGEGPR

SEQ ID NO: 3147612 - protein, 10 aa, Giardia lamblia
YSGGEEGDTT

SEQ ID NO: 3147613 - protein, 5 aa, Giardia lamblia
YSGKQ

SEQ ID NO: 3147614 - protein, 7 aa, Giardia lamblia
YSGPDVE

SEQ ID NO: 3147615 - protein, 7 aa, Giardia lamblia
YSGPSAD

SEQ ID NO: 3147616 - protein, 8 aa, Giardia lamblia
YSGQGHSF

SEQ ID NO: 3147617 - protein, 6 aa, Giardia lamblia
YSGREE

SEQ ID NO: 3147618 - protein, 4 aa, Giardia lamblia
YSGT

SEQ ID NO: 3147619 - protein, 6 aa, Giardia lamblia
YSGVNV

SEQ ID NO: 3147620 - protein, 4 aa, Giardia lamblia
YSHE

SEQ ID NO: 3147621 - protein, 4 aa, Giardia lamblia
YSHH

SEQ ID NO: 3147622 - protein, 23 aa, Giardia lamblia
YSHSDGGDSFEPSDNPDAEYQST

SEQ ID NO: 3147623 - protein, 17 aa, Giardia lamblia
YSIPKGGLEDGEDSTVA

SEQ ID NO: 3147624 - protein, 8 aa, Giardia lamblia
YSKDTGEL

SEQ ID NO: 3147625 - protein, 4 aa, Giardia lamblia
YSKE

SEQ ID NO: 3147626 - protein, 6 aa, Giardia lamblia
YSKESS

SEQ ID NO: 3147627 - protein, 19 aa, Giardia lamblia
YSKGSTASRSASMRTPGRG

SEQ ID NO: 3147628 - protein, 6 aa, Giardia lamblia
YSKINR

SEQ ID NO: 3147629 - protein, 12 aa, Giardia lamblia
YSKKAAASGETY

SEQ ID NO: 3147630 - protein, 5 aa, Giardia lamblia
YSKPA

SEQ ID NO: 3147631 - protein, 13 aa, Giardia lamblia
YSKRGSQPARNAT

SEQ ID NO: 3147632 - protein, 8 aa, Giardia lamblia
YSKSPECQ

SEQ ID NO: 3147633 - protein, 6 aa, Giardia lamblia
YSKSSL

SEQ ID NO: 3147634 - protein, 19 aa, Giardia lamblia
YSKSSYHGSTVKDEDGQKI

SEQ ID NO: 3147635 - protein, 4 aa, Giardia lamblia
YSKT

SEQ ID NO: 3147636 - protein, 11 aa, Giardia lamblia
YSKTTDSNYPY

SEQ ID NO: 3147637 - protein, 9 aa, Giardia lamblia
YSLDTTDTT

SEQ ID NO: 3147638 - protein, 6 aa, Giardia lamblia
YSLRPG

SEQ ID NO: 3147639 - protein, 7 aa, Giardia lamblia
YSNAHYD

SEQ ID NO: 3147640 - protein, 8 aa, Giardia lamblia
YSNATNTA

SEQ ID NO: 3147641 - protein, 9 aa, Giardia lamblia
YSNDGPELS

SEQ ID NO: 3147642 - protein, 8 aa, Giardia lamblia
YSNDSQAS

SEQ ID NO: 3147643 - protein, 4 aa, Giardia lamblia
YSNE

SEQ ID NO: 3147644 - protein, 5 aa, Giardia lamblia
YSNEE

SEQ ID NO: 3147645 - protein, 6 aa, Giardia lamblia
YSNEYN

SEQ ID NO: 3147646 - protein, 7 aa, Giardia lamblia
YSNGRLS

SEQ ID NO: 3147647 - protein, 5 aa, Giardia lamblia
YSNIP

SEQ ID NO: 3147648 - protein, 10 aa, Giardia lamblia
YSNNKEGTKI

SEQ ID NO: 3147649 - protein, 12 aa, Giardia lamblia
YSNNYNNRASAI

SEQ ID NO: 3147650 - protein, 11 aa, Giardia lamblia
YSNQASRGPNV

SEQ ID NO: 3147651 - protein, 7 aa, Giardia lamblia
YSNQETM

SEQ ID NO: 3147652 - protein, 20 aa, Giardia lamblia
YSNQPAVAPHSSEKGTHNHN

SEQ ID NO: 3147653 - protein, 6 aa, Giardia lamblia
YSNSPE

SEQ ID NO: 3147654 - protein, 7 aa, Giardia lamblia
YSNSRTR

SEQ ID NO: 3147655 - protein, 15 aa, Giardia lamblia
YSNTGGQRSKATPLG

SEQ ID NO: 3147656 - protein, 7 aa, Giardia lamblia
YSNTTAA

SEQ ID NO: 3147657 - protein, 13 aa, Giardia lamblia
YSNYGHNPASTGI

SEQ ID NO: 3147658 - protein, 26 aa, Giardia lamblia
YSPAPGADLPTFPRPEDQSETIMPQQ

SEQ ID NO: 3147659 - protein, 7 aa, Giardia lamblia
YSPARED

SEQ ID NO: 3147660 - protein, 17 aa, Giardia lamblia
YSPEAVKAYTSPESVDD

SEQ ID NO: 3147661 - protein, 10 aa, Giardia lamblia
YSPEEPNGSI

SEQ ID NO: 3147662 - protein, 6 aa, Giardia lamblia
YSPESQ

SEQ ID NO: 3147663 - protein, 6 aa, Giardia lamblia
YSPEVT

SEQ ID NO: 3147664 - protein, 15 aa, Giardia lamblia
YSPGSFSGERPPPVV

SEQ ID NO: 3147665 - protein, 4 aa, Giardia lamblia
YSPI

SEQ ID NO: 3147666 - protein, 4 aa, Giardia lamblia
YSPL

SEQ ID NO: 3147667 - protein, 15 aa, Giardia lamblia
YSPNDGIWKFSVSFF

SEQ ID NO: 3147668 - protein, 5 aa, Giardia lamblia
YSPNG

SEQ ID NO: 3147669 - protein, 5 aa, Giardia lamblia
YSPNR

SEQ ID NO: 3147670 - protein, 16 aa, Giardia lamblia
YSPPVSPSSGGSDLER

SEQ ID NO: 3147671 - protein, 8 aa, Giardia lamblia
YSPPYTPE

SEQ ID NO: 3147672 - protein, 4 aa, Giardia lamblia
YSPR

SEQ ID NO: 3147673 - protein, 4 aa, Giardia lamblia
YSPS

SEQ ID NO: 3147674 - protein, 4 aa, Giardia lamblia
YSPT

SEQ ID NO: 3147675 - protein, 16 aa, Giardia lamblia
YSPYAQPKSGAKEDTL

SEQ ID NO: 3147676 - protein, 6 aa, Giardia lamblia
YSQEDR

SEQ ID NO: 3147677 - protein, 10 aa, Giardia lamblia
YSQGKSAARA

SEQ ID NO: 3147678 - protein, 4 aa, Giardia lamblia
YSQL

SEQ ID NO: 3147679 - protein, 20 aa, Giardia lamblia
YSQSPQNKPTANPFSPRTSA

SEQ ID NO: 3147680 - protein, 4 aa, Giardia lamblia
YSQT

SEQ ID NO: 3147681 - protein, 10 aa, Giardia lamblia
YSQTRRDSLD

SEQ ID NO: 3147682 - protein, 17 aa, Giardia lamblia
YSQYNSGLGASNRPPIH

SEQ ID NO: 3147683 - protein, 28 aa, Giardia lamblia
YSRASSSDSNTEGSSFSSAGASDNEPSF

SEQ ID NO: 3147684 - protein, 5 aa, Giardia lamblia
YSRDG

SEQ ID NO: 3147685 - protein, 5 aa, Giardia lamblia
YSRDL

SEQ ID NO: 3147686 - protein, 24 aa, Giardia lamblia
YSRDPHKTHGTNRSGSPCSTQASV

SEQ ID NO: 3147687 - protein, 6 aa, Giardia lamblia
YSREKE

SEQ ID NO: 3147688 - protein, 8 aa, Giardia lamblia
YSRESGRV

SEQ ID NO: 3147689 - protein, 19 aa, Giardia lamblia
YSRGSKDTSVEPSDELGAS

SEQ ID NO: 3147690 - protein, 8 aa, Giardia lamblia
YSRHQDSY

SEQ ID NO: 3147691 - protein, 8 aa, Giardia lamblia
YSRHTNSA

SEQ ID NO: 3147692 - protein, 9 aa, Giardia lamblia
YSRPPSSFK

SEQ ID NO: 3147693 - protein, 7 aa, Giardia lamblia
YSRPSNL

SEQ ID NO: 3147694 - protein, 11 aa, Giardia lamblia
YSRPSSSRRGS

SEQ ID NO: 3147695 - protein, 14 aa, Giardia lamblia
YSRSAVRSDVSGID

SEQ ID NO: 3147696 - protein, 23 aa, Giardia lamblia
YSRTGSRPRADSTRRESDASASH

SEQ ID NO: 3147697 - protein, 11 aa, Giardia lamblia
YSRTSANANDV

SEQ ID NO: 3147698 - protein, 4 aa, Giardia lamblia
YSSE

SEQ ID NO: 3147699 - protein, 13 aa, Giardia lamblia
YSSEAQSEKPKRL

SEQ ID NO: 3147700 - protein, 4 aa, Giardia lamblia
YSSG

SEQ ID NO: 3147701 - protein, 16 aa, Giardia lamblia
YSSGEDKEKIAGSALN

SEQ ID NO: 3147702 - protein, 12 aa, Giardia lamblia
YSSHTDTVTEGA

SEQ ID NO: 3147703 - protein, 14 aa, Giardia lamblia
YSSKIEDQLRNAET

SEQ ID NO: 3147704 - protein, 5 aa, Giardia lamblia
YSSMT

SEQ ID NO: 3147705 - protein, 19 aa, Giardia lamblia
YSSNPDADSNQSSTASGYD

SEQ ID NO: 3147706 - protein, 9 aa, Giardia lamblia
YSSNSTQTE

SEQ ID NO: 3147707 - protein, 4 aa, Giardia lamblia
YSSP

SEQ ID NO: 3147708 - protein, 7 aa, Giardia lamblia
YSSPTEA

SEQ ID NO: 3147709 - protein, 6 aa, Giardia lamblia
YSSPTL

SEQ ID NO: 3147710 - protein, 11 aa, Giardia lamblia
YSSSAHTSPPH

SEQ ID NO: 3147711 - protein, 5 aa, Giardia lamblia
YSSSR

SEQ ID NO: 3147712 - protein, 11 aa, Giardia lamblia
YSSSRDEDGVT

SEQ ID NO: 3147713 - protein, 5 aa, Giardia lamblia
YSSSV

SEQ ID NO: 3147714 - protein, 16 aa, Giardia lamblia
YSSSVSVKTTSPVQEA

SEQ ID NO: 3147715 - protein, 22 aa, Giardia lamblia
YSSSYSSTKYYDDSDAYSTYSD

SEQ ID NO: 3147716 - protein, 20 aa, Giardia lamblia
YSSTEDSSAAQVDESGKVNF

SEQ ID NO: 3147717 - protein, 6 aa, Giardia lamblia
YSSTIT

SEQ ID NO: 3147718 - protein, 30 aa, Giardia lamblia
YSSTTSSAGNAHKKGPSVRSVKPAPTQTPM

SEQ ID NO: 3147719 - protein, 27 aa, Giardia lamblia
YSSVTTEAAEATKPNDTLNHPGQPQNM

SEQ ID NO: 3147720 - protein, 14 aa, Giardia lamblia
YSTDSTDLSTRSQS

SEQ ID NO: 3147721 - protein, 23 aa, Giardia lamblia
YSTEGNSKYRRLAEGENKKFREE

SEQ ID NO: 3147722 - protein, 7 aa, Giardia lamblia
YSTEPKL

SEQ ID NO: 3147723 - protein, 18 aa, Giardia lamblia
YSTGQSASQEAPNFPEEP

SEQ ID NO: 3147724 - protein, 6 aa, Giardia lamblia
YSTHPH

SEQ ID NO: 3147725 - protein, 5 aa, Giardia lamblia
YSTKD

SEQ ID NO: 3147726 - protein, 27 aa, Giardia lamblia
YSTLNEQQGYTSVTTSSLSPPRTDGTV

SEQ ID NO: 3147727 - protein, 6 aa, Giardia lamblia
YSTMQA

SEQ ID NO: 3147728 - protein, 10 aa, Giardia lamblia
YSTNTRPNTK

SEQ ID NO: 3147729 - protein, 8 aa, Giardia lamblia
YSTPDNAL

SEQ ID NO: 3147730 - protein, 7 aa, Giardia lamblia
YSTPNEP

SEQ ID NO: 3147731 - protein, 6 aa, Giardia lamblia
YSTPTF

SEQ ID NO: 3147732 - protein, 6 aa, Giardia lamblia
YSTPTS

SEQ ID NO: 3147733 - protein, 17 aa, Giardia lamblia
YSTQGLSSHSSGHASAC

SEQ ID NO: 3147734 - protein, 11 aa, Giardia lamblia
YSTSSSAPVVP

SEQ ID NO: 3147735 - protein, 9 aa, Giardia lamblia
YSTTEEALE

SEQ ID NO: 3147736 - protein, 27 aa, Giardia lamblia
YSTTPSPSCPVSEPIEDGLRGEEDALY

SEQ ID NO: 3147737 - protein, 9 aa, Giardia lamblia
YSTTTGTTC

SEQ ID NO: 3147738 - protein, 15 aa, Giardia lamblia
YSTTTKDNQQTNKDV

SEQ ID NO: 3147739 - protein, 12 aa, Giardia lamblia
YSTTYPDAASAS

SEQ ID NO: 3147740 - protein, 17 aa, Giardia lamblia
YSTYQSERSRYGRPASG

SEQ ID NO: 3147741 - protein, 4 aa, Giardia lamblia
YTAD

SEQ ID NO: 3147742 - protein, 5 aa, Giardia lamblia
YTAED

SEQ ID NO: 3147743 - protein, 10 aa, Giardia lamblia
YTAEDPSNEF

SEQ ID NO: 3147744 - protein, 8 aa, Giardia lamblia
YTAEKERD

SEQ ID NO: 3147745 - protein, 12 aa, Giardia lamblia
YTAEPSPNTSAV

SEQ ID NO: 3147746 - protein, 17 aa, Giardia lamblia
YTAPAKADIKDKKNIVT

SEQ ID NO: 3147747 - protein, 7 aa, Giardia lamblia
YTAPPEK

SEQ ID NO: 3147748 - protein, 6 aa, Giardia lamblia
YTAPVN

SEQ ID NO: 3147749 - protein, 4 aa, Giardia lamblia
YTAR

SEQ ID NO: 3147750 - protein, 10 aa, Giardia lamblia
YTARGDSASV

SEQ ID NO: 3147751 - protein, 9 aa, Giardia lamblia
YTASGEFGT

SEQ ID NO: 3147752 - protein, 16 aa, Giardia lamblia
YTASNQEAGKCAEGAD

SEQ ID NO: 3147753 - protein, 5 aa, Giardia lamblia
YTDEE

SEQ ID NO: 3147754 - protein, 7 aa, Giardia lamblia
YTDEQRE

SEQ ID NO: 3147755 - protein, 25 aa, Giardia lamblia
YTDKAKAKQEQLRQEVESKRNEEVS

SEQ ID NO: 3147756 - protein, 10 aa, Giardia lamblia
YTDKQDSFPV

SEQ ID NO: 3147757 - protein, 34 aa, Giardia lamblia
YTDKQTSSQHGRTHDEFDSPREQISPAVQTPRER

SEQ ID NO: 3147758 - protein, 20 aa, Giardia lamblia
YTDQRNSLSNTTKRPVSTSE

SEQ ID NO: 3147759 - protein, 6 aa, Giardia lamblia
YTDSGE

SEQ ID NO: 3147760 - protein, 14 aa, Giardia lamblia
YTDSNRDKNNISTR

SEQ ID NO: 3147761 - protein, 4 aa, Giardia lamblia
YTEK

SEQ ID NO: 3147762 - protein, 8 aa, Giardia lamblia
YTENRPTL

SEQ ID NO: 3147763 - protein, 5 aa, Giardia lamblia
YTEQH

SEQ ID NO: 3147764 - protein, 13 aa, Giardia lamblia
YTEQRKDKRSADV

SEQ ID NO: 3147765 - protein, 5 aa, Giardia lamblia
YTESD

SEQ ID NO: 3147766 - protein, 6 aa, Giardia lamblia
YTESGD

SEQ ID NO: 3147767 - protein, 35 aa, Giardia lamblia
YTESKQASGSAAASNPPSSAMSTSSVNRSGLRATS

SEQ ID NO: 3147768 - protein, 8 aa, Giardia lamblia
YTETGDAI

SEQ ID NO: 3147769 - protein, 11 aa, Giardia lamblia
YTGEESTRQQR

SEQ ID NO: 3147770 - protein, 6 aa, Giardia lamblia
YTGKTT

SEQ ID NO: 3147771 - protein, 18 aa, Giardia lamblia
YTGPHGDESPKASDAPRL

SEQ ID NO: 3147772 - protein, 14 aa, Giardia lamblia
YTGPRNELGERHGR

SEQ ID NO: 3147773 - protein, 5 aa, Giardia lamblia
YTGPT

SEQ ID NO: 3147774 - protein, 14 aa, Giardia lamblia
YTGYDRKRAEEQAS

SEQ ID NO: 3147775 - protein, 13 aa, Giardia lamblia
YTIAPEKRAKLDK

SEQ ID NO: 3147776 - protein, 6 aa, Giardia lamblia
YTIPEQ

SEQ ID NO: 3147777 - protein, 7 aa, Giardia lamblia
YTKERDT

SEQ ID NO: 3147778 - protein, 28 aa, Giardia lamblia
YTKGKRPPSCQRTNRSGPSTSHRMSSSL

SEQ ID NO: 3147779 - protein, 7 aa, Giardia lamblia
YTKLSAE

SEQ ID NO: 3147780 - protein, 10 aa, Giardia lamblia
YTKPRAIQTQ

SEQ ID NO: 3147781 - protein, 6 aa, Giardia lamblia
YTKQTS

SEQ ID NO: 3147782 - protein, 6 aa, Giardia lamblia
YTKSNL

SEQ ID NO: 3147783 - protein, 7 aa, Giardia lamblia
YTKTSQR

SEQ ID NO: 3147784 - protein, 6 aa, Giardia lamblia
YTLDGS

SEQ ID NO: 3147785 - protein, 8 aa, Giardia lamblia
YTNEDAAE

SEQ ID NO: 3147786 - protein, 8 aa, Giardia lamblia
YTNGTYKF

SEQ ID NO: 3147787 - protein, 6 aa, Giardia lamblia
YTNNSS

SEQ ID NO: 3147788 - protein, 9 aa, Giardia lamblia
YTNPEGKTR

SEQ ID NO: 3147789 - protein, 13 aa, Giardia lamblia
YTNPETSYAECSK

SEQ ID NO: 3147790 - protein, 7 aa, Giardia lamblia
YTNPGAF

SEQ ID NO: 3147791 - protein, 6 aa, Giardia lamblia
YTNRAE

SEQ ID NO: 3147792 - protein, 9 aa, Giardia lamblia
YTNSRAGGD

SEQ ID NO: 3147793 - protein, 9 aa, Giardia lamblia
YTNSSKATR

SEQ ID NO: 3147794 - protein, 12 aa, Giardia lamblia
YTPAAYGANSPS

SEQ ID NO: 3147795 - protein, 5 aa, Giardia lamblia
YTPDG

SEQ ID NO: 3147796 - protein, 11 aa, Giardia lamblia
YTPDHTSSSSY

SEQ ID NO: 3147797 - protein, 5 aa, Giardia lamblia
YTPED

SEQ ID NO: 3147798 - protein, 4 aa, Giardia lamblia
YTPG

SEQ ID NO: 3147799 - protein, 12 aa, Giardia lamblia
YTPKTDAKGRPL

SEQ ID NO: 3147800 - protein, 5 aa, Giardia lamblia
YTPQG

SEQ ID NO: 3147801 - protein, 7 aa, Giardia lamblia
YTPSGIR

SEQ ID NO: 3147802 - protein, 7 aa, Giardia lamblia
YTPSPTS

SEQ ID NO: 3147803 - protein, 37 aa, Giardia lamblia
YTPSTMNYGTPSHQDTDGLSELQQSGRFAQPAPFPSH

SEQ ID NO: 3147804 - protein, 14 aa, Giardia lamblia
YTPTAPRASDAKKM

SEQ ID NO: 3147805 - protein, 4 aa, Giardia lamblia
YTQN

SEQ ID NO: 3147806 - protein, 12 aa, Giardia lamblia
YTQNPDFDPAKV

SEQ ID NO: 3147807 - protein, 29 aa, Giardia lamblia
YTQTKNKGSSDDISRAKEEMRRGFPDRGS

SEQ ID NO: 3147808 - protein, 4 aa, Giardia lamblia
YTRD

SEQ ID NO: 3147809 - protein, 4 aa, Giardia lamblia
YTRG

SEQ ID NO: 3147810 - protein, 9 aa, Giardia lamblia
YTSAKESYE

SEQ ID NO: 3147811 - protein, 5 aa, Giardia lamblia
YTSAT

SEQ ID NO: 3147812 - protein, 14 aa, Giardia lamblia
YTSEERRVEAQTSY

SEQ ID NO: 3147813 - protein, 16 aa, Giardia lamblia
YTSESNHNIPSTESLD

SEQ ID NO: 3147814 - protein, 17 aa, Giardia lamblia
YTSEVSTLGSRDGDGKG

SEQ ID NO: 3147815 - protein, 13 aa, Giardia lamblia
YTSGGSISGQPGH

SEQ ID NO: 3147816 - protein, 12 aa, Giardia lamblia
YTSGKSSTAAGL

SEQ ID NO: 3147817 - protein, 8 aa, Giardia lamblia
YTSGTQKS

SEQ ID NO: 3147818 - protein, 4 aa, Giardia lamblia
YTSL

SEQ ID NO: 3147819 - protein, 9 aa, Giardia lamblia
YTSLGSATH

SEQ ID NO: 3147820 - protein, 9 aa, Giardia lamblia
YTSPGGSDE

SEQ ID NO: 3147821 - protein, 6 aa, Giardia lamblia
YTSPHT

SEQ ID NO: 3147822 - protein, 9 aa, Giardia lamblia
YTSQEKVDL

SEQ ID NO: 3147823 - protein, 19 aa, Giardia lamblia
YTSQGDSVGNASNSGTALR

SEQ ID NO: 3147824 - protein, 29 aa, Giardia lamblia
YTSQNPSTKLVQSNTDSTSLNTSFQSTGQ

SEQ ID NO: 3147825 - protein, 6 aa, Giardia lamblia
YTSQSR

SEQ ID NO: 3147826 - protein, 4 aa, Giardia lamblia
YTSS

SEQ ID NO: 3147827 - protein, 12 aa, Giardia lamblia
YTSSDSESENDI

SEQ ID NO: 3147828 - protein, 16 aa, Giardia lamblia
YTSSEDLSNDDKELAH

SEQ ID NO: 3147829 - protein, 7 aa, Giardia lamblia
YTTAGTA

SEQ ID NO: 3147830 - protein, 10 aa, Giardia lamblia
YTTDNNGNDV

SEQ ID NO: 3147831 - protein, 6 aa, Giardia lamblia
YTTEKG

SEQ ID NO: 3147832 - protein, 7 aa, Giardia lamblia
YTTETST

SEQ ID NO: 3147833 - protein, 7 aa, Giardia lamblia
YTTEYEP

SEQ ID NO: 3147834 - protein, 4 aa, Giardia lamblia
YTTI

SEQ ID NO: 3147835 - protein, 17 aa, Giardia lamblia
YTTNSDRHAYCLVLSTY

SEQ ID NO: 3147836 - protein, 13 aa, Giardia lamblia
YTTPAQTASSFPA

SEQ ID NO: 3147837 - protein, 12 aa, Giardia lamblia
YTTTSQNTSDCG

SEQ ID NO: 3147838 - protein, 11 aa, Giardia lamblia
YTVTTQRPYQN

SEQ ID NO: 3147839 - protein, 5 aa, Giardia lamblia
YTWPD

SEQ ID NO: 3147840 - protein, 4 aa, Giardia lamblia
YTYK

SEQ ID NO: 3147841 - protein, 6 aa, Giardia lamblia
YTYSPN

SEQ ID NO: 3147842 - protein, 9 aa, Giardia lamblia
YVEPTNKRS

SEQ ID NO: 3147843 - protein, 7 aa, Giardia lamblia
YVETGNI

SEQ ID NO: 3147844 - protein, 31 aa, Giardia lamblia
YVGPQRERQGGPSGGRAQRGKGRGRFVKFLK

SEQ ID NO: 3147845 - protein, 8 aa, Giardia lamblia
YVKTTGKA

SEQ ID NO: 3147846 - protein, 4 aa, Giardia lamblia
YVPD

SEQ ID NO: 3147847 - protein, 14 aa, Giardia lamblia
YVPEDTRGSFSHSD

SEQ ID NO: 3147848 - protein, 7 aa, Giardia lamblia
YVPNPSK

SEQ ID NO: 3147849 - protein, 13 aa, Giardia lamblia
YVPPAGVSKVVCH

SEQ ID NO: 3147850 - protein, 14 aa, Giardia lamblia
YVPPDTTNKAMKTP

SEQ ID NO: 3147851 - protein, 15 aa, Giardia lamblia
YVPPSKKNNVEKQTY

SEQ ID NO: 3147852 - protein, 12 aa, Giardia lamblia
YVPSSETDPALG

SEQ ID NO: 3147853 - protein, 5 aa, Giardia lamblia
YVQPT

SEQ ID NO: 3147854 - protein, 10 aa, Giardia lamblia
YVRSDSTPKF

SEQ ID NO: 3147855 - protein, 9 aa, Giardia lamblia
YVSDSSSSF

SEQ ID NO: 3147856 - protein, 7 aa, Giardia lamblia
YVSETST

SEQ ID NO: 3147857 - protein, 25 aa, Giardia lamblia
YVSPGERAKQQRAREFKQQQQKLRE

SEQ ID NO: 3147858 - protein, 11 aa, Giardia lamblia
YVSPKRASLGC

SEQ ID NO: 3147859 - protein, 14 aa, Giardia lamblia
YVSPSEGISSHVES

SEQ ID NO: 3147860 - protein, 7 aa, Giardia lamblia
YVTETDN

SEQ ID NO: 3147861 - protein, 22 aa, Giardia lamblia
YVTPADKTPSSVGVAPTAPSVK

SEQ ID NO: 3147862 - protein, 15 aa, Giardia lamblia
YVTPPLDNQSSHNTS

SEQ ID NO: 3147863 - protein, 4 aa, Giardia lamblia
YWPE

SEQ ID NO: 3147864 - protein, 7 aa, Giardia lamblia
YYDEEKE

SEQ ID NO: 3147865 - protein, 12 aa, Giardia lamblia
YYNPDSKQHPET

SEQ ID NO: 3147866 - protein, 24 aa, Giardia lamblia
YYNTDTSTLRRSAYTGQAPFQTTA

SEQ ID NO: 3147867 - protein, 17 aa, Giardia lamblia
YYPSQKIQTEDDITAST

SEQ ID NO: 3147868 - protein, 7 aa, Giardia lamblia
YYQPQQQ

SEQ ID NO: 3147869 - protein, 5 aa, Giardia lamblia
YYSAS

SEQ ID NO: 3147870 - protein, 8 aa, Giardia lamblia
YYSEDDAR

SEQ ID NO: 3147871 - protein, 33 aa, Giardia lamblia
YYSPPKSELTTTTDETSALTTDASSHIQAPATT

SEQ ID NO: 3147872 - protein, 8 aa, Giardia lamblia
YYSQSKAD

SEQ ID NO: 3147873 - protein, 11 aa, Giardia lamblia
YYSSEGGGLCG

SEQ ID NO: 3147874 - protein, 47 aa, Giardia lamblia
YYSTDEEALPTEAKGSGRVSTTSVAQASRIPRPVSENAATRRQESVQ

SEQ ID NO: 3147875 - protein, 18 aa, Giardia lamblia
QPFLSGLTFSPPVAQLVQ

SEQ ID NO: 3147876 - protein, 19 aa, Giardia lamblia
CPSGEGWCVLLHSQNSPLS

SEQ ID NO: 3147877 - protein, 18 aa, Giardia lamblia
FGTHVCPSGEGWCVLLHS

SEQ ID NO: 3147878 - protein, 18 aa, Giardia lamblia
AKVLRLKTIETMDAAMLE

SEQ ID NO: 3147879 - protein, 19 aa, Giardia lamblia
CLQGFQICHSLGGGTGAGM

SEQ ID NO: 3147880 - protein, 19 aa, Giardia lamblia
CTLLECLHCSSHCRTSHPP

SEQ ID NO: 3147881 - protein, 17 aa, Giardia lamblia
DEDQCLGILKGGIKHLF

SEQ ID NO: 3147882 - protein, 25 aa, Giardia lamblia
DPRHGRYLTAAAMFRGRMSTKEVDE

SEQ ID NO: 3147883 - protein, 17 aa, Giardia lamblia
DSVRAGPFGQIFRPDNF

SEQ ID NO: 3147884 - protein, 20 aa, Giardia lamblia
ETRASVLLELAKQVVAARRL

SEQ ID NO: 3147885 - protein, 17 aa, Giardia lamblia
GGIKHLFMLDSQSETRE

SEQ ID NO: 3147886 - protein, 20 aa, Giardia lamblia
GHLECARLLMDKEKGMQTTR

SEQ ID NO: 3147887 - protein, 22 aa, Giardia lamblia
GIGTRLFRAMGLHTHISAQGWV

SEQ ID NO: 3147888 - protein, 19 aa, Giardia lamblia
GPFGQIFRPDNFVFGQSGA

SEQ ID NO: 3147889 - protein, 23 aa, Giardia lamblia
IPPRGLKMAATFIGNSTCIQELF

SEQ ID NO: 3147890 - protein, 25 aa, Giardia lamblia
LLHRHVLRTAIDWKKIARALSEDRS

SEQ ID NO: 3147891 - protein, 24 aa, Giardia lamblia
LVTLRRPDFLGGKEPAEVFVDGWR

SEQ ID NO: 3147892 - protein, 21 aa, Giardia lamblia
NRLGQRVGRFSCSTGSPSLVT

SEQ ID NO: 3147893 - protein, 20 aa, Giardia lamblia
PQSSLFLLPRLMRAAHTNGM

SEQ ID NO: 3147894 - protein, 25 aa, Giardia lamblia
PRVVPAEMDTTWTLRHVPNVMTTVP

SEQ ID NO: 3147895 - protein, 20 aa, Giardia lamblia
QCLGILKGGIKHLFMLDSQS

SEQ ID NO: 3147896 - protein, 18 aa, Giardia lamblia
QCVMLRYKCGALETTLNS

SEQ ID NO: 3147897 - protein, 19 aa, Giardia lamblia
RPSPKLLAFLSKVYDMHDF

SEQ ID NO: 3147898 - protein, 24 aa, Giardia lamblia
SGCTSCLRFPGQLNADLRKLAVNL

SEQ ID NO: 3147899 - protein, 23 aa, Giardia lamblia
TKPAIRRLARRGGVKRISSTIYQ

SEQ ID NO: 3147900 - protein, 27 aa, Giardia lamblia
VNLIPFPRLHFFLVGFAPLTSRGSQIY

SEQ ID NO: 3147901 - protein, 17 aa, Giardia lamblia
YDICFRTLKLTCPTYGD

SEQ ID NO: 3147902 - protein, 18 aa, Giardia lamblia
AAGRCALMYAASRGHTPA

SEQ ID NO: 3147903 - protein, 18 aa, Giardia lamblia
AARRFVLGCRLLRLQYYF

SEQ ID NO: 3147904 - protein, 17 aa, Giardia lamblia
ADALARCAAGPGGLGEV

SEQ ID NO: 3147905 - protein, 23 aa, Giardia lamblia
ADGEYFIIAGLELCKDALWSEST

SEQ ID NO: 3147906 - protein, 18 aa, Giardia lamblia
AEACRRARDRGVGIRAVQ

SEQ ID NO: 3147907 - protein, 23 aa, Giardia lamblia
AEFRRIHPLSVRVGYGVHPYYLH

SEQ ID NO: 3147908 - protein, 23 aa, Giardia lamblia
AGDGRRVVLADFGFCEGISSGAA

SEQ ID NO: 3147909 - protein, 22 aa, Giardia lamblia
AGRGDCIIVKMVPQKPLCCETF

SEQ ID NO: 3147910 - protein, 19 aa, Giardia lamblia
AGYNEWYDARVCKEEEEHL

SEQ ID NO: 3147911 - protein, 18 aa, Giardia lamblia
AHGHTCISREAAVIYAQS

SEQ ID NO: 3147912 - protein, 18 aa, Giardia lamblia
ALENRLAQFGDRMNTAGP

SEQ ID NO: 3147913 - protein, 24 aa, Giardia lamblia
ANSVISMLIDDMWICNKRLSDTLK

SEQ ID NO: 3147914 - protein, 20 aa, Giardia lamblia
APTIRLILNASILNDDGILL

SEQ ID NO: 3147915 - protein, 20 aa, Giardia lamblia
AQGGCALVKVCVMATIDCPL

SEQ ID NO: 3147916 - protein, 17 aa, Giardia lamblia
AQLEDLSEELARLREQA

SEQ ID NO: 3147917 - protein, 28 aa, Giardia lamblia
AQLVETFSCRPRLAQISLELANNNMDLA

SEQ ID NO: 3147918 - protein, 18 aa, Giardia lamblia
ARAEAAGGNAARELDETR

SEQ ID NO: 3147919 - protein, 19 aa, Giardia lamblia
ARDAEALAERAAELEAQAK

SEQ ID NO: 3147920 - protein, 19 aa, Giardia lamblia
ASIMIGVTLFKIAEFVREL

SEQ ID NO: 3147921 - protein, 19 aa, Giardia lamblia
ASLLVPYEKDRIGSEGKTA

SEQ ID NO: 3147922 - protein, 17 aa, Giardia lamblia
ATLAEVRARLAADQTAF

SEQ ID NO: 3147923 - protein, 28 aa, Giardia lamblia
ATMEIPYPVHCCFGALVAMNINVDETNS

SEQ ID NO: 3147924 - protein, 18 aa, Giardia lamblia
CAYLCPSDYAAVLGNEKS

SEQ ID NO: 3147925 - protein, 23 aa, Giardia lamblia
CDSARLEWVQGLITAQVLLGKVH

SEQ ID NO: 3147926 - protein, 25 aa, Giardia lamblia
CHIPGCLHKTDIGGIMLFKDRSNIE

SEQ ID NO: 3147927 - protein, 17 aa, Giardia lamblia
CKAGKYLDGDQCADICG

SEQ ID NO: 3147928 - protein, 17 aa, Giardia lamblia
CSDCVRLLVDKEDGMKT

SEQ ID NO: 3147929 - protein, 27 aa, Giardia lamblia
CSVIAKRLGCEFVRIISAEQLVMRTST

SEQ ID NO: 3147930 - protein, 21 aa, Giardia lamblia
CSVLIHLPLSLDLVAAMISDA

SEQ ID NO: 3147931 - protein, 24 aa, Giardia lamblia
DADAKKPDAAFVYDHAYWSHDASR

SEQ ID NO: 3147932 - protein, 23 aa, Giardia lamblia
DAGHLACVKHLIDAENAQPNKTG

SEQ ID NO: 3147933 - protein, 23 aa, Giardia lamblia
DAGPRGSQHFAMPDLIDEMSNLI

SEQ ID NO: 3147934 - protein, 18 aa, Giardia lamblia
DALRRAAPVEPLAAAAPA

SEQ ID NO: 3147935 - protein, 17 aa, Giardia lamblia
DELLVGPPRLELRDRHS

SEQ ID NO: 3147936 - protein, 23 aa, Giardia lamblia
DLLIRKLPFSKLVRDIVTSGLSK

SEQ ID NO: 3147937 - protein, 20 aa, Giardia lamblia
DLLRSLRADNEMLMEDVHDK

SEQ ID NO: 3147938 - protein, 19 aa, Giardia lamblia
DMLSRINIRPCECAFLQDT

SEQ ID NO: 3147939 - protein, 22 aa, Giardia lamblia
DNKGRTALMGAVRNNHPECVKL

SEQ ID NO: 3147940 - protein, 17 aa, Giardia lamblia
DPPDCMRKTVALTTETD

SEQ ID NO: 3147941 - protein, 19 aa, Giardia lamblia
DRVKELEALLAGGAPAGDA

SEQ ID NO: 3147942 - protein, 23 aa, Giardia lamblia
DSQKYRDAIGFLKEELAYKDHEI

SEQ ID NO: 3147943 - protein, 29 aa, Giardia lamblia
EAMPEVMAMLEFRAILIPKESDGYRPIAI

SEQ ID NO: 3147944 - protein, 19 aa, Giardia lamblia
EAYRDLGRREGFWCGEDRP

SEQ ID NO: 3147945 - protein, 17 aa, Giardia lamblia
ECVKLLLEKEARMKDSD

SEQ ID NO: 3147946 - protein, 19 aa, Giardia lamblia
EGVEALLLYEARAQTVEGW

SEQ ID NO: 3147947 - protein, 24 aa, Giardia lamblia
EGWVRGVVHISAFLFEETAPGSGK

SEQ ID NO: 3147948 - protein, 19 aa, Giardia lamblia
EHGKLEFLIAWRADKHMLA

SEQ ID NO: 3147949 - protein, 21 aa, Giardia lamblia
EIRKIIINWIRCQQVPDERLY

SEQ ID NO: 3147950 - protein, 20 aa, Giardia lamblia
EQRTFLAFFGLAARTLELTG

SEQ ID NO: 3147951 - protein, 24 aa, Giardia lamblia
ERDEARAALDKALDEAAALEAEHK

SEQ ID NO: 3147952 - protein, 17 aa, Giardia lamblia
EVEPCIVTALILDSRSE

SEQ ID NO: 3147953 - protein, 19 aa, Giardia lamblia
EVRGLLHLLRRCTDAGYPN

SEQ ID NO: 3147954 - protein, 19 aa, Giardia lamblia
EYAEIVSLLAPHKTDSERN

SEQ ID NO: 3147955 - protein, 23 aa, Giardia lamblia
FADPEQLHLVLLISAASVSLCVT

SEQ ID NO: 3147956 - protein, 25 aa, Giardia lamblia
FDLMYAKRAFVHWYVGEGMEEGEFS

SEQ ID NO: 3147957 - protein, 18 aa, Giardia lamblia
FMARQAYAIISLIKYYVA

SEQ ID NO: 3147958 - protein, 19 aa, Giardia lamblia
FWATDALSLLRTEARLQNK

SEQ ID NO: 3147959 - protein, 23 aa, Giardia lamblia
GAGEWPPLFPVAGWLAKYTRRTR

SEQ ID NO: 3147960 - protein, 17 aa, Giardia lamblia
GAHAFDFTIDEDEAILR

SEQ ID NO: 3147961 - protein, 24 aa, Giardia lamblia
GDPLSTFLFCMATERLLRRLEERG

SEQ ID NO: 3147962 - protein, 20 aa, Giardia lamblia
GELAPGMKVVFAPTSQVSEV

SEQ ID NO: 3147963 - protein, 24 aa, Giardia lamblia
GFGRLDCVKLLLEREKDVGGESAL

SEQ ID NO: 3147964 - protein, 19 aa, Giardia lamblia
GGYPRLRVGSSRRPLGRAG

SEQ ID NO: 3147965 - protein, 19 aa, Giardia lamblia
GHARLALSPNVEHFVVQLK

SEQ ID NO: 3147966 - protein, 22 aa, Giardia lamblia
GIPDAYRGAGFRGLGVLKGKTP

SEQ ID NO: 3147967 - protein, 19 aa, Giardia lamblia
GLAVKDLKKGYVVGDVTND

SEQ ID NO: 3147968 - protein, 17 aa, Giardia lamblia
GLLDLYRAWMFKGVLAV

SEQ ID NO: 3147969 - protein, 24 aa, Giardia lamblia
GRHVKRARVSLVDLAGSERQGKTG

SEQ ID NO: 3147970 - protein, 19 aa, Giardia lamblia
GTCHTVALGQVHACAPDPG

SEQ ID NO: 3147971 - protein, 19 aa, Giardia lamblia
GTTAMMFAAHRGFLEIVGA

SEQ ID NO: 3147972 - protein, 24 aa, Giardia lamblia
HLEVVKLLLEKEGHLIDKSNEYFF

SEQ ID NO: 3147973 - protein, 21 aa, Giardia lamblia
HSLPTLPARIAGAVLSIPMMD

SEQ ID NO: 3147974 - protein, 17 aa, Giardia lamblia
HTKGGAHAFDFTIDEDE

SEQ ID NO: 3147975 - protein, 27 aa, Giardia lamblia
IHPCIRSKRTAKDWDVLVLSRAKARGH

SEQ ID NO: 3147976 - protein, 19 aa, Giardia lamblia
IKTSVNWRKIATEINQNRN

SEQ ID NO: 3147977 - protein, 18 aa, Giardia lamblia
ITRWCYRPSGFSSLSSSV

SEQ ID NO: 3147978 - protein, 27 aa, Giardia lamblia
KCDPRHGKYMACCMMYRGDVVPKDVNA

SEQ ID NO: 3147979 - protein, 19 aa, Giardia lamblia
KEPAEVFIDGWRPDLSGVT

SEQ ID NO: 3147980 - protein, 24 aa, Giardia lamblia
KFTVVHCKQYQGAVLPDGPGLTAL

SEQ ID NO: 3147981 - protein, 17 aa, Giardia lamblia
KGGAHAFDFTIDEDEAI

SEQ ID NO: 3147982 - protein, 19 aa, Giardia lamblia
KLLLEKEARMKDSDGKTAL

SEQ ID NO: 3147983 - protein, 19 aa, Giardia lamblia
KLLVHEVNTLKELSHENIV

SEQ ID NO: 3147984 - protein, 19 aa, Giardia lamblia
KPLRLPIQDVYKISGVGTV

SEQ ID NO: 3147985 - protein, 21 aa, Giardia lamblia
KRQRFSSCTILLTDSTQLQNT

SEQ ID NO: 3147986 - protein, 20 aa, Giardia lamblia
KRRRVAGLLSPRRAYQPGTD

SEQ ID NO: 3147987 - protein, 18 aa, Giardia lamblia
KSKLEFVVYPSPQIATAV

SEQ ID NO: 3147988 - protein, 19 aa, Giardia lamblia
KVQRSCLMISNTTAIAEVW

SEQ ID NO: 3147989 - protein, 17 aa, Giardia lamblia
KVTEANSVISMLIDDMW

SEQ ID NO: 3147990 - protein, 24 aa, Giardia lamblia
LADNCSGLQGFLIFHSFGGGTGAG

SEQ ID NO: 3147991 - protein, 30 aa, Giardia lamblia
LANPCLLHSYMLKTSVDWHWISNEVGVDEK

SEQ ID NO: 3147992 - protein, 20 aa, Giardia lamblia
LEFLIAWRADKHMLAFMARQ

SEQ ID NO: 3147993 - protein, 23 aa, Giardia lamblia
LEGFSNDPLRAMAIQSAEALEAI

SEQ ID NO: 3147994 - protein, 17 aa, Giardia lamblia
LFDPIGLGDLGALEVTP

SEQ ID NO: 3147995 - protein, 22 aa, Giardia lamblia
LGNCLLELPVPAFIKPAIASSK

SEQ ID NO: 3147996 - protein, 18 aa, Giardia lamblia
LICTPHLIADAAGPCAGH

SEQ ID NO: 3147997 - protein, 17 aa, Giardia lamblia
LIIVEPGANIWSITPNE

SEQ ID NO: 3147998 - protein, 24 aa, Giardia lamblia
LITSAPLSKFWMFYGDACSISQVD

SEQ ID NO: 3147999 - protein, 27 aa, Giardia lamblia
LKQHEGRRPIGWCGSGPITRMQHPCPC

SEQ ID NO: 3148000 - protein, 17 aa, Giardia lamblia
LLLEKEGGMQKSDGSTA

SEQ ID NO: 3148001 - protein, 17 aa, Giardia lamblia
LMFPLLEQMADALAYLH

SEQ ID NO: 3148002 - protein, 20 aa, Giardia lamblia
LNSRCIRAVLTECNIQRPTR

SEQ ID NO: 3148003 - protein, 23 aa, Giardia lamblia
LPATMIKRLFDPIGLGDLGALEV

SEQ ID NO: 3148004 - protein, 20 aa, Giardia lamblia
LPKAEGRRRILYSFMSPELP

SEQ ID NO: 3148005 - protein, 21 aa, Giardia lamblia
LQCKSDAIAAGYNEWYDARVC

SEQ ID NO: 3148006 - protein, 25 aa, Giardia lamblia
LQQFCAATGRPLCVVNLLADDVEGG

SEQ ID NO: 3148007 - protein, 18 aa, Giardia lamblia
LRADNEMLMEDVHDKRQD

SEQ ID NO: 3148008 - protein, 18 aa, Giardia lamblia
LRAVKVLLKREGGMKTDD

SEQ ID NO: 3148009 - protein, 24 aa, Giardia lamblia
LRDGELDFSFLYAILSTFAILHEL

SEQ ID NO: 3148010 - protein, 22 aa, Giardia lamblia
LRNVYVVVCMHSLKARTRGITA

SEQ ID NO: 3148011 - protein, 25 aa, Giardia lamblia
LSNLCCADFRIAYLGPYPLARLLDD

SEQ ID NO: 3148012 - protein, 19 aa, Giardia lamblia
LSVDYGRKSKLEFVVYPSP

SEQ ID NO: 3148013 - protein, 17 aa, Giardia lamblia
LVAQLVETFSCRPRLAQ

SEQ ID NO: 3148014 - protein, 17 aa, Giardia lamblia
LVLSNLCCADFRIAYLG

SEQ ID NO: 3148015 - protein, 17 aa, Giardia lamblia
MAKYCVYSSPSASANYA

SEQ ID NO: 3148016 - protein, 18 aa, Giardia lamblia
MLLHQACRLCDYPRHVTV

SEQ ID NO: 3148017 - protein, 21 aa, Giardia lamblia
MLRYKCGALETTLNSANARIT

SEQ ID NO: 3148018 - protein, 20 aa, Giardia lamblia
MPPSPGARWQALFPAGTALG

SEQ ID NO: 3148019 - protein, 19 aa, Giardia lamblia
MQTTREWFGFPPGTTALDI

SEQ ID NO: 3148020 - protein, 20 aa, Giardia lamblia
NIALWKFETKKYIVTIIDAP

SEQ ID NO: 3148021 - protein, 22 aa, Giardia lamblia
NIPDGLSPFLLRRLPQHTTNPS

SEQ ID NO: 3148022 - protein, 19 aa, Giardia lamblia
NNRVGCIDRLLPFQHGRQD

SEQ ID NO: 3148023 - protein, 18 aa, Giardia lamblia
NSMTCMIAAISPASTNYD

SEQ ID NO: 3148024 - protein, 17 aa, Giardia lamblia
PASDVWSLGVIIYELVT

SEQ ID NO: 3148025 - protein, 23 aa, Giardia lamblia
PDIWLVDKCKAVDVGVIQPRQMD

SEQ ID NO: 3148026 - protein, 19 aa, Giardia lamblia
PEVAKIIAPYKHRKRNRDS

SEQ ID NO: 3148027 - protein, 20 aa, Giardia lamblia
PHAPGCLVLALPPGVVPGPG

SEQ ID NO: 3148028 - protein, 21 aa, Giardia lamblia
PLVEHILLALVCERSLETKAE

SEQ ID NO: 3148029 - protein, 24 aa, Giardia lamblia
PNEEVFKPPVFRLPGYNDETPSSP

SEQ ID NO: 3148030 - protein, 18 aa, Giardia lamblia
PNGESFYSVLARLEALVH

SEQ ID NO: 3148031 - protein, 17 aa, Giardia lamblia
PPERLGHEFARDALSVL

SEQ ID NO: 3148032 - protein, 19 aa, Giardia lamblia
PQLEMAFEMNRDCNVHIIS

SEQ ID NO: 3148033 - protein, 23 aa, Giardia lamblia
PRGEVWIKGPSVFSGYYNDDAKT

SEQ ID NO: 3148034 - protein, 17 aa, Giardia lamblia
PRRFNYLTEEDVKSVAK

SEQ ID NO: 3148035 - protein, 17 aa, Giardia lamblia
PTAHAACLCAYSVCQRN

SEQ ID NO: 3148036 - protein, 22 aa, Giardia lamblia
PTPYPFGFGVPLTYVPVLIQSP

SEQ ID NO: 3148037 - protein, 22 aa, Giardia lamblia
PTVQLRWPMIWNADTSATVMDG

SEQ ID NO: 3148038 - protein, 25 aa, Giardia lamblia
PVALKAVGISGVFNHLVLREVTLLA

SEQ ID NO: 3148039 - protein, 18 aa, Giardia lamblia
PYLAEPLLAALDLNEPAL

SEQ ID NO: 3148040 - protein, 17 aa, Giardia lamblia
QISDWSPNLVLRFNEDR

SEQ ID NO: 3148041 - protein, 21 aa, Giardia lamblia
QLACIPLIIVEPGANIWSITP

SEQ ID NO: 3148042 - protein, 21 aa, Giardia lamblia
QLKNIGWKKAEEFDYIPTSGW

SEQ ID NO: 3148043 - protein, 20 aa, Giardia lamblia
RAAPVEPLAAAAPADDDLLR

SEQ ID NO: 3148044 - protein, 21 aa, Giardia lamblia
RASEILPLLPYPRALERDKFI

SEQ ID NO: 3148045 - protein, 20 aa, Giardia lamblia
REPISPRLPGSIERAVNSEL

SEQ ID NO: 3148046 - protein, 23 aa, Giardia lamblia
RGFLEIVGALAPFEANLQSTAPL

SEQ ID NO: 3148047 - protein, 24 aa, Giardia lamblia
RHSKDVKCEVCGVPQGDPLSTFLF

SEQ ID NO: 3148048 - protein, 24 aa, Giardia lamblia
RIANRVNNALSFNGCQVLCSLTHP

SEQ ID NO: 3148049 - protein, 22 aa, Giardia lamblia
RIHFPLCSYAPIISSEKAYHEK

SEQ ID NO: 3148050 - protein, 17 aa, Giardia lamblia
RKGLSLSAIPPRQPEVA

SEQ ID NO: 3148051 - protein, 25 aa, Giardia lamblia
RKLSDYKGKYLIVFFYPLDFTFVCP

SEQ ID NO: 3148052 - protein, 19 aa, Giardia lamblia
RLRHPNVVEYGRVVRHEGY

SEQ ID NO: 3148053 - protein, 19 aa, Giardia lamblia
RLTRSAGLCKYRGTRTEEH

SEQ ID NO: 3148054 - protein, 20 aa, Giardia lamblia
RLVVEYLLYLRAAQAVEDTD

SEQ ID NO: 3148055 - protein, 19 aa, Giardia lamblia
RLYTYVIKTSVNWRKIATE

SEQ ID NO: 3148056 - protein, 18 aa, Giardia lamblia
RRAIKAMIIAGVRDRSIL

SEQ ID NO: 3148057 - protein, 20 aa, Giardia lamblia
RRPDDRTALMIAAEKDSAEA

SEQ ID NO: 3148058 - protein, 18 aa, Giardia lamblia
RRVHERFGAKYPRQELRM

SEQ ID NO: 3148059 - protein, 22 aa, Giardia lamblia
RSARAGISFPIGRIHRHLREGR

SEQ ID NO: 3148060 - protein, 17 aa, Giardia lamblia
RSDTGWTALMSAAMHGH

SEQ ID NO: 3148061 - protein, 24 aa, Giardia lamblia
RSTDCTWAAFAWRREAQTDGTQRS

SEQ ID NO: 3148062 - protein, 17 aa, Giardia lamblia
RTCKACSTITGCTACEY

SEQ ID NO: 3148063 - protein, 21 aa, Giardia lamblia
RVREAYVRLGRDMNAVVSVIM

SEQ ID NO: 3148064 - protein, 17 aa, Giardia lamblia
RVVKLLMRCEGGMRSSN

SEQ ID NO: 3148065 - protein, 24 aa, Giardia lamblia
RWYYETHLRHILTIKMTNEDRGEI

SEQ ID NO: 3148066 - protein, 17 aa, Giardia lamblia
SAALLDFLSELFIHVTE

SEQ ID NO: 3148067 - protein, 27 aa, Giardia lamblia
SDAAKWAQICAGAFGASGLSCLVRLRS

SEQ ID NO: 3148068 - protein, 18 aa, Giardia lamblia
SEGVGLEEPCLRMPPRKP

SEQ ID NO: 3148069 - protein, 26 aa, Giardia lamblia
SGAARYTCIWPAWVDKYNNTYIGSRF

SEQ ID NO: 3148070 - protein, 18 aa, Giardia lamblia
SKVLRWLATEIINAIHPE

SEQ ID NO: 3148071 - protein, 20 aa, Giardia lamblia
SLFLERLSVDYGRKSKLEFV

SEQ ID NO: 3148072 - protein, 19 aa, Giardia lamblia
SRPAWRVISAITSFGSPLP

SEQ ID NO: 3148073 - protein, 21 aa, Giardia lamblia
SRSHSVFAIEVVQTAVLRNDA

SEQ ID NO: 3148074 - protein, 23 aa, Giardia lamblia
SRSIALRCVRALALVANAKLFPS

SEQ ID NO: 3148075 - protein, 24 aa, Giardia lamblia
SRTNGRIFACKEIDYAKMSEKEKK

SEQ ID NO: 3148076 - protein, 24 aa, Giardia lamblia
SSAKWFRKRLASALREEGVSGVSV

SEQ ID NO: 3148077 - protein, 23 aa, Giardia lamblia
SSPCGPCSCVLVCPAATAGIEGD

SEQ ID NO: 3148078 - protein, 24 aa, Giardia lamblia
SSSPRPKHSLFWKEVHSSGQPAQM

SEQ ID NO: 3148079 - protein, 24 aa, Giardia lamblia
STCSECLSGFYLEDACKTCDANCA

SEQ ID NO: 3148080 - protein, 34 aa, Giardia lamblia
STLERPLAKHKRGRIPVPITMILSVMKQVAAALA

SEQ ID NO: 3148081 - protein, 19 aa, Giardia lamblia
STLTGHLIYKCGGIDQRTI

SEQ ID NO: 3148082 - protein, 25 aa, Giardia lamblia
TEMGKGSFKYAWVLDQLKDERERGI

SEQ ID NO: 3148083 - protein, 22 aa, Giardia lamblia
TETKAWLDAVYALSKRQRFSSC

SEQ ID NO: 3148084 - protein, 27 aa, Giardia lamblia
TKALLGGRCSLCVTGSAPLSQKVGEFL

SEQ ID NO: 3148085 - protein, 17 aa, Giardia lamblia
TLFKKCGIQHSSRRSRS

SEQ ID NO: 3148086 - protein, 19 aa, Giardia lamblia
TMTPRWRRTWSAPPTAGSM

SEQ ID NO: 3148087 - protein, 24 aa, Giardia lamblia
TNCYFPLTTDRLGIMVFTPPTRAA

SEQ ID NO: 3148088 - protein, 22 aa, Giardia lamblia
TNDGRTALMIAVYSNNIPAIKH

SEQ ID NO: 3148089 - protein, 18 aa, Giardia lamblia
TQVSVSFLEIYNERLRDL

SEQ ID NO: 3148090 - protein, 23 aa, Giardia lamblia
TRDCLGRTPLHYAALSPRDPTVS

SEQ ID NO: 3148091 - protein, 18 aa, Giardia lamblia
TSTEYGRADLICQIFEAA

SEQ ID NO: 3148092 - protein, 20 aa, Giardia lamblia
TWSNLLLCILFSNTKSFYDD

SEQ ID NO: 3148093 - protein, 19 aa, Giardia lamblia
TYATYIYKVLRSENIRSEA

SEQ ID NO: 3148094 - protein, 28 aa, Giardia lamblia
VAATPCCKCPHLYVCGPGSAISPEQCLY

SEQ ID NO: 3148095 - protein, 18 aa, Giardia lamblia
VAHREFLTVLNFRELPKA

SEQ ID NO: 3148096 - protein, 21 aa, Giardia lamblia
VATALRFKALEDEVARLRGEV

SEQ ID NO: 3148097 - protein, 19 aa, Giardia lamblia
VKKVPSWVVLRGGKEIGRI

SEQ ID NO: 3148098 - protein, 20 aa, Giardia lamblia
VPWRPRHWSSLRPSRLRSTD

SEQ ID NO: 3148099 - protein, 20 aa, Giardia lamblia
WCPTGFKVGINYQPPTVIPG

SEQ ID NO: 3148100 - protein, 19 aa, Giardia lamblia
WFRPDHVYLLNATDPTQFE

SEQ ID NO: 3148101 - protein, 20 aa, Giardia lamblia
WKKAEEFDYIPTSGWTGDNI

SEQ ID NO: 3148102 - protein, 17 aa, Giardia lamblia
WLATEIINAIHPEETVE

SEQ ID NO: 3148103 - protein, 24 aa, Giardia lamblia
WRADKHMLAFMARQAYAIISLIKY

SEQ ID NO: 3148104 - protein, 19 aa, Giardia lamblia
WSPNLVLRFNEDRDLLLEV

SEQ ID NO: 3148105 - protein, 19 aa, Giardia lamblia
WTALMWAALVGRTEVVRLL

SEQ ID NO: 3148106 - protein, 17 aa, Giardia lamblia
YDIAMILARHEHGVQDS

SEQ ID NO: 3148107 - protein, 26 aa, Giardia lamblia
YEYEAYELFELIGIKVPEFRYFPLHS

SEQ ID NO: 3148108 - protein, 18 aa, Giardia lamblia
YIPTSGWTGDNIMEKSDK

SEQ ID NO: 3148109 - protein, 20 aa, Giardia lamblia
YKCPVCRRLVLFGQDRELYE

SEQ ID NO: 3148110 - protein, 20 aa, Giardia lamblia
YRAWMFKGVLAVLYRYTSSI

SEQ ID NO: 3148111 - protein, 19 aa, Giardia lamblia
YRETHLRNILNIKMTEEDR

SEQ ID NO: 3148112 - protein, 17 aa, Giardia lamblia
YSYCPSYDQVPGHQGMH

SEQ ID NO: 3148113 - protein, 21 aa, Giardia lamblia
AAAAGRLDCVDLLIHHESQLR

SEQ ID NO: 3148114 - protein, 17 aa, Giardia lamblia
AAAARAAAVGLLPRGSR

SEQ ID NO: 3148115 - protein, 21 aa, Giardia lamblia
AAACGSLLCMEHLLKQGIGKE

SEQ ID NO: 3148116 - protein, 29 aa, Giardia lamblia
AAADFKILWLQILDYKPAPLYFSLLDNSE

SEQ ID NO: 3148117 - protein, 20 aa, Giardia lamblia
AAADNNLVATWCYLPIQGGL

SEQ ID NO: 3148118 - protein, 19 aa, Giardia lamblia
AAAEIARLKELLTQKSDSI

SEQ ID NO: 3148119 - protein, 21 aa, Giardia lamblia
AAAFGNAGLCYQKLKREDEAL

SEQ ID NO: 3148120 - protein, 19 aa, Giardia lamblia
AAAFWPGPLTMVLPAAPCV

SEQ ID NO: 3148121 - protein, 21 aa, Giardia lamblia
AAALEELRRNGLQTDSHHESQ

SEQ ID NO: 3148122 - protein, 25 aa, Giardia lamblia
AAANGHLECVRLLAEKEKNINRSSL

SEQ ID NO: 3148123 - protein, 26 aa, Giardia lamblia
AAANGRANAAFCLLSDPNIYGPDDVK

SEQ ID NO: 3148124 - protein, 20 aa, Giardia lamblia
AAARNRKRWAQEMASSPYRQ

SEQ ID NO: 3148125 - protein, 23 aa, Giardia lamblia
AACAPFIGDVTCWMMDHSRESLM

SEQ ID NO: 3148126 - protein, 18 aa, Giardia lamblia
AACCPLDKIKYVVMNHAE

SEQ ID NO: 3148127 - protein, 28 aa, Giardia lamblia
AACDAYTRPFLREIYKSYERLKCDLMDL

SEQ ID NO: 3148128 - protein, 21 aa, Giardia lamblia
AACEYKKLYLIHGGLTSYWNA

SEQ ID NO: 3148129 - protein, 22 aa, Giardia lamblia
AACGYPSIVSLLVKDEARMTTD

SEQ ID NO: 3148130 - protein, 21 aa, Giardia lamblia
AACQEGVLNTVQRPCARFPQQ

SEQ ID NO: 3148131 - protein, 20 aa, Giardia lamblia
AACTDTGIQVLRVEVNKLKL

SEQ ID NO: 3148132 - protein, 17 aa, Giardia lamblia
AACTIVKAPRLTTTDIP

SEQ ID NO: 3148133 - protein, 24 aa, Giardia lamblia
AADGKRLPSFLKVANVPSGVTFDD

SEQ ID NO: 3148134 - protein, 19 aa, Giardia lamblia
AADGWNYLTAWLSNADHPD

SEQ ID NO: 3148135 - protein, 24 aa, Giardia lamblia
AADISLHLILGINFETPFTDSDLP

SEQ ID NO: 3148136 - protein, 25 aa, Giardia lamblia
AADPECWKAVAAECLEIRDFELAKS

SEQ ID NO: 3148137 - protein, 24 aa, Giardia lamblia
AADRGCVPVCQMLVKLEANRTSLR

SEQ ID NO: 3148138 - protein, 22 aa, Giardia lamblia
AADRIPSFLGLSLLEVNETSEE

SEQ ID NO: 3148139 - protein, 20 aa, Giardia lamblia
AADSSIRFHPIGVFQNLELL

SEQ ID NO: 3148140 - protein, 19 aa, Giardia lamblia
AADTQLLLLRKWRRRTNLG

SEQ ID NO: 3148141 - protein, 29 aa, Giardia lamblia
AAEADNPEVCLCLLDLEGHILLKDLYTAY

SEQ ID NO: 3148142 - protein, 27 aa, Giardia lamblia
AAEAGRLLDCFCYLQLGLAQQRDYRQY

SEQ ID NO: 3148143 - protein, 18 aa, Giardia lamblia
AAEAMAIMQIPDRELVAT

SEQ ID NO: 3148144 - protein, 29 aa, Giardia lamblia
AAEANKGDVCKRLVAYEVNTTYGDFQMTP

SEQ ID NO: 3148145 - protein, 20 aa, Giardia lamblia
AAEHGCCALIIGMLADREHG

SEQ ID NO: 3148146 - protein, 23 aa, Giardia lamblia
AAEHYREALAIFSGRTTERANCL

SEQ ID NO: 3148147 - protein, 18 aa, Giardia lamblia
AAELGDVVLVFSLLASQA

SEQ ID NO: 3148148 - protein, 17 aa, Giardia lamblia
AAELIANEFIDMPDYPT

SEQ ID NO: 3148149 - protein, 18 aa, Giardia lamblia
AAENAIRRYELDRMRYAF

SEQ ID NO: 3148150 - protein, 19 aa, Giardia lamblia
AAERGHLNIVRILLEEGDT

SEQ ID NO: 3148151 - protein, 24 aa, Giardia lamblia
AAERGLDALVCVLVGTEAGMTDIY

SEQ ID NO: 3148152 - protein, 24 aa, Giardia lamblia
AAEWSVATKGIMALPHCFDMKEDN

SEQ ID NO: 3148153 - protein, 18 aa, Giardia lamblia
AAFIKSLKTRTINYKVFP

SEQ ID NO: 3148154 - protein, 21 aa, Giardia lamblia
AAFKMDASFVSRLETPGGMSF

SEQ ID NO: 3148155 - protein, 18 aa, Giardia lamblia
AAGAGVALEIMFDDAPNK

SEQ ID NO: 3148156 - protein, 24 aa, Giardia lamblia
AAGDLEVCRSLLFDHVGKRTNSGK

SEQ ID NO: 3148157 - protein, 41 aa, Giardia lamblia
AAGDPALFCAALAVAEARAAYRSSLIYLFDYAVIKKSFFSL

SEQ ID NO: 3148158 - protein, 18 aa, Giardia lamblia
AAGHADCVSALLEEVTLT

SEQ ID NO: 3148159 - protein, 20 aa, Giardia lamblia
AAGIRPMLRRSLPDKVTMPA

SEQ ID NO: 3148160 - protein, 18 aa, Giardia lamblia
AAGLPGWTPQMSATNEVH

SEQ ID NO: 3148161 - protein, 23 aa, Giardia lamblia
AAGSILRGRVQAIQTERNAAEQH

SEQ ID NO: 3148162 - protein, 26 aa, Giardia lamblia
AAHAFWKDMRLFSCITEFFEECVNGK

SEQ ID NO: 3148163 - protein, 19 aa, Giardia lamblia
AAHFCVFIIRREERHSYVA

SEQ ID NO: 3148164 - protein, 18 aa, Giardia lamblia
AAHLPGYVQQAPRQPSQH

SEQ ID NO: 3148165 - protein, 27 aa, Giardia lamblia
AAHYELLHPARLAFHLLKQALDGKKPD

SEQ ID NO: 3148166 - protein, 20 aa, Giardia lamblia
AAIENACMILRVDDIFSCDG

SEQ ID NO: 3148167 - protein, 20 aa, Giardia lamblia
AAIERMQMAVLLRIVAERHG

SEQ ID NO: 3148168 - protein, 28 aa, Giardia lamblia
AAIRAGCIPPCMLHCINGLKANNKLKYQ

SEQ ID NO: 3148169 - protein, 27 aa, Giardia lamblia
AAISNDLPLCYCLRRLQQGLVDQEKNT

SEQ ID NO: 3148170 - protein, 25 aa, Giardia lamblia
AAKLGRGRCVAILMHHEAQMRSSLG

SEQ ID NO: 3148171 - protein, 24 aa, Giardia lamblia
AAKLIRGSTLFTLSADELIISHIR

SEQ ID NO: 3148172 - protein, 31 aa, Giardia lamblia
AALAEGYAKDMTRLHAYLAQQLKAAATVQPS

SEQ ID NO: 3148173 - protein, 19 aa, Giardia lamblia
AALAKWFQSIVVQDYEYIL

SEQ ID NO: 3148174 - protein, 17 aa, Giardia lamblia
AALDGTWNFLIDDNEDG

SEQ ID NO: 3148175 - protein, 26 aa, Giardia lamblia
AALDLECSLWGPARVKLEEPNLAIDS

SEQ ID NO: 3148176 - protein, 17 aa, Giardia lamblia
AALDTRPSCGIPEIERD

SEQ ID NO: 3148177 - protein, 19 aa, Giardia lamblia
AALEKYRSVVIEKHSVLLD

SEQ ID NO: 3148178 - protein, 19 aa, Giardia lamblia
AALGNMKAILDGVSDSSTG

SEQ ID NO: 3148179 - protein, 28 aa, Giardia lamblia
AALIGKYREIVCCLARLPDAKLPKTLAG

SEQ ID NO: 3148180 - protein, 20 aa, Giardia lamblia
AALKGVERVAVSRSDTQKPC

SEQ ID NO: 3148181 - protein, 22 aa, Giardia lamblia
AALKSLEARGKMGTEEEYESIP

SEQ ID NO: 3148182 - protein, 17 aa, Giardia lamblia
AALLCIHDLPEAMIAAS

SEQ ID NO: 3148183 - protein, 17 aa, Giardia lamblia
AALNAAKAVVNSARGTP

SEQ ID NO: 3148184 - protein, 30 aa, Giardia lamblia
AALNDIRKVVYFWNEIRMSNHLIDALNRYY

SEQ ID NO: 3148185 - protein, 17 aa, Giardia lamblia
AALNIFEHMLVSINGSE

SEQ ID NO: 3148186 - protein, 19 aa, Giardia lamblia
AALNLPWLVQAILDSVPEA

SEQ ID NO: 3148187 - protein, 18 aa, Giardia lamblia
AALPSFTAPMYVHLGSCK

SEQ ID NO: 3148188 - protein, 19 aa, Giardia lamblia
AALQDEIMELNGLATSSTA

SEQ ID NO: 3148189 - protein, 18 aa, Giardia lamblia
AALQLDFPDIESIIQDKL

SEQ ID NO: 3148190 - protein, 26 aa, Giardia lamblia
AALRTRLRNFPSLVNCCTLDWFTGWP

SEQ ID NO: 3148191 - protein, 17 aa, Giardia lamblia
AALSYKIAVTHLDTVLR

SEQ ID NO: 3148192 - protein, 18 aa, Giardia lamblia
AAMRQYRRLAFSFNGGKD

SEQ ID NO: 3148193 - protein, 28 aa, Giardia lamblia
AANALRCIRTEIFSMLSVLKKYKGSRVG

SEQ ID NO: 3148194 - protein, 26 aa, Giardia lamblia
AANAPYRLSGLFFAHYYTYMLPHVIE

SEQ ID NO: 3148195 - protein, 24 aa, Giardia lamblia
AANDHAECVRLWREQYTKPCPVPK

SEQ ID NO: 3148196 - protein, 24 aa, Giardia lamblia
AANEIETAFVPPYLNQGSSTGTTV

SEQ ID NO: 3148197 - protein, 25 aa, Giardia lamblia
AANGCLEIAYLLAPKERGMRTKKGR

SEQ ID NO: 3148198 - protein, 18 aa, Giardia lamblia
AANGVAIEYVIFADVLYG

SEQ ID NO: 3148199 - protein, 21 aa, Giardia lamblia
AANIRYGDWLLDYICDRDQKY

SEQ ID NO: 3148200 - protein, 27 aa, Giardia lamblia
AANSFPHCVLRPFIIVITNSFTQESDL

SEQ ID NO: 3148201 - protein, 20 aa, Giardia lamblia
AANTKLGCKTVFTTINPKAI

SEQ ID NO: 3148202 - protein, 18 aa, Giardia lamblia
AANTRDGPVFSEDDLVEL

SEQ ID NO: 3148203 - protein, 23 aa, Giardia lamblia
AAPADFLCRPRLPGRRITRETTK

SEQ ID NO: 3148204 - protein, 19 aa, Giardia lamblia
AAPAFPLNVAERIEKNIQK

SEQ ID NO: 3148205 - protein, 21 aa, Giardia lamblia
AAPDLPQRYTVDSVLNSDGAE

SEQ ID NO: 3148206 - protein, 25 aa, Giardia lamblia
AAPELREKLLRVCNELKDTKEQCKA

SEQ ID NO: 3148207 - protein, 21 aa, Giardia lamblia
AAPIPNWTVGRVIGRNGEALA

SEQ ID NO: 3148208 - protein, 18 aa, Giardia lamblia
AAPIWPALAEAWLRGTRS

SEQ ID NO: 3148209 - protein, 25 aa, Giardia lamblia
AAPLESGLMPEADFPEHQDPDEENR

SEQ ID NO: 3148210 - protein, 20 aa, Giardia lamblia
AAPLHWDWIFEECYDPNSSI

SEQ ID NO: 3148211 - protein, 24 aa, Giardia lamblia
AAPLILRDDLDFVYLPLENKDYSM

SEQ ID NO: 3148212 - protein, 25 aa, Giardia lamblia
AAPPSEGMLRLSLQSNKRLLMHRLS

SEQ ID NO: 3148213 - protein, 25 aa, Giardia lamblia
AAPQAMCPMHVAGGRHADVEGSEDS

SEQ ID NO: 3148214 - protein, 22 aa, Giardia lamblia
AAPRAGEALAALKNEAANIGNP

SEQ ID NO: 3148215 - protein, 24 aa, Giardia lamblia
AAPVFAALCNRSNDPLVDYIGHVE

SEQ ID NO: 3148216 - protein, 21 aa, Giardia lamblia
AAPVHPFIPSHMPLQPHGTMP

SEQ ID NO: 3148217 - protein, 19 aa, Giardia lamblia
AAPVPNFLAPPATGHSGGG

SEQ ID NO: 3148218 - protein, 18 aa, Giardia lamblia
AAQCSAIEAVTCRINDIL

SEQ ID NO: 3148219 - protein, 24 aa, Giardia lamblia
AAQELMVATQLIFRRYPERYEGII

SEQ ID NO: 3148220 - protein, 25 aa, Giardia lamblia
AAQILKDPIVRRMEILVDRLCLICR

SEQ ID NO: 3148221 - protein, 26 aa, Giardia lamblia
AAQLDRARIAILLAKVIPDQTTPDGM

SEQ ID NO: 3148222 - protein, 26 aa, Giardia lamblia
AAQRGDIVTAWCLLPYQSNKADHLGK

SEQ ID NO: 3148223 - protein, 22 aa, Giardia lamblia
AAQRGHIGCVERLLPHERNLRD

SEQ ID NO: 3148224 - protein, 23 aa, Giardia lamblia
AAQRGHLQIVRMLANKESGLKDE

SEQ ID NO: 3148225 - protein, 23 aa, Giardia lamblia
AAQRLRLANVFGAFADFAYEPLE

SEQ ID NO: 3148226 - protein, 21 aa, Giardia lamblia
AAQTRADVVLNFAEDGISVQP

SEQ ID NO: 3148227 - protein, 23 aa, Giardia lamblia
AARAGLPDIVRCLLPVESGRATL

SEQ ID NO: 3148228 - protein, 24 aa, Giardia lamblia
AARAIELYSAALVRERQRRRRGEH

SEQ ID NO: 3148229 - protein, 24 aa, Giardia lamblia
AARFKHIYSTLPLSTSLTVNSLYI

SEQ ID NO: 3148230 - protein, 20 aa, Giardia lamblia
AARFPIEYKGTVPVVEKASD

SEQ ID NO: 3148231 - protein, 19 aa, Giardia lamblia
AARGCYLNPLLMKTEKAFC

SEQ ID NO: 3148232 - protein, 17 aa, Giardia lamblia
AARGYDVLFSKKERKRI

SEQ ID NO: 3148233 - protein, 21 aa, Giardia lamblia
AARILSCIFLADMLVAACIED

SEQ ID NO: 3148234 - protein, 18 aa, Giardia lamblia
AARITGLFHDLHKFAWVH

SEQ ID NO: 3148235 - protein, 30 aa, Giardia lamblia
AARLDAYYLDFGKRISALEVKLNMAQLRQS

SEQ ID NO: 3148236 - protein, 19 aa, Giardia lamblia
AARVRKCMLSVNVRLEQRT

SEQ ID NO: 3148237 - protein, 24 aa, Giardia lamblia
AARYKLKRASLFLSGKTVLPTHNL

SEQ ID NO: 3148238 - protein, 17 aa, Giardia lamblia
AASALSCAGNTKKKSTP

SEQ ID NO: 3148239 - protein, 25 aa, Giardia lamblia
AASCKDYVTALGRIREAIKLEQKVS

SEQ ID NO: 3148240 - protein, 34 aa, Giardia lamblia
AASDIWSLGALLYELCTFKPLFIAPSHMDKKDVA

SEQ ID NO: 3148241 - protein, 17 aa, Giardia lamblia
AASFAYGIVDPSGASNA

SEQ ID NO: 3148242 - protein, 19 aa, Giardia lamblia
AASLYKLASSTFLAGFIRS

SEQ ID NO: 3148243 - protein, 27 aa, Giardia lamblia
AASPLKLRVCQARIPPLPPGATVHRHF

SEQ ID NO: 3148244 - protein, 17 aa, Giardia lamblia
AASQHQEFHGCKSHSEP

SEQ ID NO: 3148245 - protein, 23 aa, Giardia lamblia
AASRCEAIRALLFQTAHTEAFSS

SEQ ID NO: 3148246 - protein, 24 aa, Giardia lamblia
AASRCPSVKAVIIFDDRLDDRALV

SEQ ID NO: 3148247 - protein, 19 aa, Giardia lamblia
AASRLRFTLHIPQKDLRYC

SEQ ID NO: 3148248 - protein, 19 aa, Giardia lamblia
AASRSGSLCGSNYGSQSMN

SEQ ID NO: 3148249 - protein, 25 aa, Giardia lamblia
AASSGNIWLVRMICSKPDKWYAALK

SEQ ID NO: 3148250 - protein, 23 aa, Giardia lamblia
AASYDLLALMSLLNKLRRSQPVP

SEQ ID NO: 3148251 - protein, 18 aa, Giardia lamblia
AATEAIKGMAARKQRLYT

SEQ ID NO: 3148252 - protein, 20 aa, Giardia lamblia
AATEGYRELCLIANQQYNAL

SEQ ID NO: 3148253 - protein, 27 aa, Giardia lamblia
AATEMPSPEVFKAALSLSSSLQDACGD

SEQ ID NO: 3148254 - protein, 29 aa, Giardia lamblia
AATFCERIASCGFFYTRCTELLNAVTKTN

SEQ ID NO: 3148255 - protein, 18 aa, Giardia lamblia
AATGMRRAISYDINSEGI

SEQ ID NO: 3148256 - protein, 24 aa, Giardia lamblia
AATKGHLEVVKILYEHEAKVSNWN

SEQ ID NO: 3148257 - protein, 18 aa, Giardia lamblia
AAVGDFQGRVSISRHFTI

SEQ ID NO: 3148258 - protein, 18 aa, Giardia lamblia
AAVGLLPRGSRESSESAQ

SEQ ID NO: 3148259 - protein, 17 aa, Giardia lamblia
AAVHFLRTHYQQALECY

SEQ ID NO: 3148260 - protein, 24 aa, Giardia lamblia
AAVKVCPSRNWKAISALMPNRTDV

SEQ ID NO: 3148261 - protein, 17 aa, Giardia lamblia
AAVMALKHNLGLTCDPV

SEQ ID NO: 3148262 - protein, 17 aa, Giardia lamblia
AAVRVKRRCSVAGCSRI

SEQ ID NO: 3148263 - protein, 17 aa, Giardia lamblia
AAVVKIKKIPGITASEV

SEQ ID NO: 3148264 - protein, 18 aa, Giardia lamblia
AAWIPDKAWLNIIALSAL

SEQ ID NO: 3148265 - protein, 19 aa, Giardia lamblia
AAYPMPIHAHTQRGCTALL

SEQ ID NO: 3148266 - protein, 22 aa, Giardia lamblia
AAYRVPRALIILDGIESIIQYT

SEQ ID NO: 3148267 - protein, 25 aa, Giardia lamblia
AAYTAMYAEALKILDWNTHVVSEEL

SEQ ID NO: 3148268 - protein, 18 aa, Giardia lamblia
AAYTFEFLSGVVGLLKEG

SEQ ID NO: 3148269 - protein, 26 aa, Giardia lamblia
ACAANDIARAWCLRFQAGARTAEGKT

SEQ ID NO: 3148270 - protein, 18 aa, Giardia lamblia
ACADSKSAQGMRLSNERT

SEQ ID NO: 3148271 - protein, 20 aa, Giardia lamblia
ACALKRLISELLEHPRAMSP

SEQ ID NO: 3148272 - protein, 21 aa, Giardia lamblia
ACAQEGPSHLQGRPANGFAKA

SEQ ID NO: 3148273 - protein, 19 aa, Giardia lamblia
ACAQILLPYEKDIPDALGK

SEQ ID NO: 3148274 - protein, 17 aa, Giardia lamblia
ACARLLLVEKEIRDNQG

SEQ ID NO: 3148275 - protein, 17 aa, Giardia lamblia
ACAVPFSPDTEGRKGEQ

SEQ ID NO: 3148276 - protein, 25 aa, Giardia lamblia
ACCDCARSIQRQCCEICRGKIEGGI

SEQ ID NO: 3148277 - protein, 17 aa, Giardia lamblia
ACCNVCLEHILNSTRTC

SEQ ID NO: 3148278 - protein, 21 aa, Giardia lamblia
ACCVFRGNEYLVLLIKSTAKL

SEQ ID NO: 3148279 - protein, 20 aa, Giardia lamblia
ACESCAKGLARCPYCRTIIS

SEQ ID NO: 3148280 - protein, 20 aa, Giardia lamblia
ACFFGLLCLDTQTMIASSPE

SEQ ID NO: 3148281 - protein, 17 aa, Giardia lamblia
ACFNRQYECAKILCRYE

SEQ ID NO: 3148282 - protein, 17 aa, Giardia lamblia
ACFQEALFHASRYTSAV

SEQ ID NO: 3148283 - protein, 29 aa, Giardia lamblia
ACGCFFILSRSRWSYLTTYLDPQLVETKK

SEQ ID NO: 3148284 - protein, 21 aa, Giardia lamblia
ACGDVAWSHIRCHSLDSVNRT

SEQ ID NO: 3148285 - protein, 20 aa, Giardia lamblia
ACGDVMRLQIKVGDDGKISE

SEQ ID NO: 3148286 - protein, 18 aa, Giardia lamblia
ACGNSVASMQVCGFCGKD

SEQ ID NO: 3148287 - protein, 19 aa, Giardia lamblia
ACGYEGYLAIFGGRTETRI

SEQ ID NO: 3148288 - protein, 26 aa, Giardia lamblia
ACILIKGSKEEYVWASIREYIEQKFQ

SEQ ID NO: 3148289 - protein, 23 aa, Giardia lamblia
ACINTYASWVVRTLFKEGQIDPA

SEQ ID NO: 3148290 - protein, 21 aa, Giardia lamblia
ACKKLQDKIVREREAREKTHE

SEQ ID NO: 3148291 - protein, 21 aa, Giardia lamblia
ACKQDGAGMTALMHAVVHRRF

SEQ ID NO: 3148292 - protein, 33 aa, Giardia lamblia
ACKTRGVFASALKFPPIEVMMPLVGGYYTGATN

SEQ ID NO: 3148293 - protein, 18 aa, Giardia lamblia
ACLLPRPPMELIALLVNL

SEQ ID NO: 3148294 - protein, 23 aa, Giardia lamblia
ACLPCATPGCKTCGHASFCTECA

SEQ ID NO: 3148295 - protein, 22 aa, Giardia lamblia
ACLQLGPRPHIRRVSTYTNLMK

SEQ ID NO: 3148296 - protein, 19 aa, Giardia lamblia
ACLQMPWLKSQPVQESNRD

SEQ ID NO: 3148297 - protein, 17 aa, Giardia lamblia
ACPGGIGHVQFRLRSAT

SEQ ID NO: 3148298 - protein, 18 aa, Giardia lamblia
ACPGSCYLNRGNHESEMF

SEQ ID NO: 3148299 - protein, 26 aa, Giardia lamblia
ACQHPCNHALISFGYIISMSQHYMNC

SEQ ID NO: 3148300 - protein, 17 aa, Giardia lamblia
ACQNCTESAQIYEQQIA

SEQ ID NO: 3148301 - protein, 24 aa, Giardia lamblia
ACQTLELQAGSLFLDQEFCTTNND

SEQ ID NO: 3148302 - protein, 22 aa, Giardia lamblia
ACRNAMKILSDRVGCECQANFE

SEQ ID NO: 3148303 - protein, 17 aa, Giardia lamblia
ACSDDRFLPGAGAAEMA

SEQ ID NO: 3148304 - protein, 26 aa, Giardia lamblia
ACSIHLQGHFVFCFDSMRAINTRTIK

SEQ ID NO: 3148305 - protein, 18 aa, Giardia lamblia
ACSLRSVSVFVNHEQEYK

SEQ ID NO: 3148306 - protein, 17 aa, Giardia lamblia
ACSSNFVALPIKESDAY

SEQ ID NO: 3148307 - protein, 17 aa, Giardia lamblia
ACSSRAFDALALDADSI

SEQ ID NO: 3148308 - protein, 17 aa, Giardia lamblia
ACTESQRLLFIFITTYA

SEQ ID NO: 3148309 - protein, 19 aa, Giardia lamblia
ACTGLKPAMPDALIDLSSE

SEQ ID NO: 3148310 - protein, 21 aa, Giardia lamblia
ACVDAGLPIKRYYWYLDSRKF

SEQ ID NO: 3148311 - protein, 19 aa, Giardia lamblia
ACVDILLPHEGEFPDSRGE

SEQ ID NO: 3148312 - protein, 26 aa, Giardia lamblia
ACVGALRMVETYAFEQHIKECIAQLL

SEQ ID NO: 3148313 - protein, 18 aa, Giardia lamblia
ACVLKLSSEQDIYFNFSA

SEQ ID NO: 3148314 - protein, 21 aa, Giardia lamblia
ACVQLLIKRCKVYQDRAGRTA

SEQ ID NO: 3148315 - protein, 19 aa, Giardia lamblia
ACVTEACKLDKKLAGPGAP

SEQ ID NO: 3148316 - protein, 17 aa, Giardia lamblia
ADAAIIVQERVLKCPTR

SEQ ID NO: 3148317 - protein, 29 aa, Giardia lamblia
ADAALKEKVRELDTLRLLMDDSTSTAAKA

SEQ ID NO: 3148318 - protein, 22 aa, Giardia lamblia
ADACSGIICCVNCRMYHDQTHD

SEQ ID NO: 3148319 - protein, 21 aa, Giardia lamblia
ADAGIIPRVGRELFRRAAASP

SEQ ID NO: 3148320 - protein, 27 aa, Giardia lamblia
ADAGIIPRVGRELFRRAAASPAETQVS

SEQ ID NO: 3148321 - protein, 21 aa, Giardia lamblia
ADAGLDVFRVFDAFNSLQQME

SEQ ID NO: 3148322 - protein, 25 aa, Giardia lamblia
ADAKMTFAGTFSYMAPEILLRKPYN

SEQ ID NO: 3148323 - protein, 22 aa, Giardia lamblia
ADALVLKRQYFVLFPNLLLPDL

SEQ ID NO: 3148324 - protein, 17 aa, Giardia lamblia
ADAPRSVERFPTTQEPP

SEQ ID NO: 3148325 - protein, 20 aa, Giardia lamblia
ADAPVLVPRTFAEFRESKDI

SEQ ID NO: 3148326 - protein, 26 aa, Giardia lamblia
ADAPYEIPLGWIAEGGRRSASRRHRK

SEQ ID NO: 3148327 - protein, 23 aa, Giardia lamblia
ADCCSHAREGMKILEEKEERASK

SEQ ID NO: 3148328 - protein, 20 aa, Giardia lamblia
ADCFTIRKYIGFTYSSSYQK

SEQ ID NO: 3148329 - protein, 24 aa, Giardia lamblia
ADDAESWLPLALTPSVFVANSSFL

SEQ ID NO: 3148330 - protein, 19 aa, Giardia lamblia
ADDEYWNSFPLPRDYLDKT

SEQ ID NO: 3148331 - protein, 18 aa, Giardia lamblia
ADDKYALSVFLGDNSNFN

SEQ ID NO: 3148332 - protein, 22 aa, Giardia lamblia
ADDNFFPSFGFLAKHSPSDRLV

SEQ ID NO: 3148333 - protein, 23 aa, Giardia lamblia
ADDQLRFLLFQNELTSERVDLEY

SEQ ID NO: 3148334 - protein, 19 aa, Giardia lamblia
ADDSCKEGKILDTIKRLEL

SEQ ID NO: 3148335 - protein, 26 aa, Giardia lamblia
ADEDGWTALMYASWSGNWDCVRYLSH

SEQ ID NO: 3148336 - protein, 19 aa, Giardia lamblia
ADEEYRRLLQLKSVHDRSK

SEQ ID NO: 3148337 - protein, 18 aa, Giardia lamblia
ADEHYLLKIAAWVANRGI

SEQ ID NO: 3148338 - protein, 24 aa, Giardia lamblia
ADERDAREFWNLRLKDKDDEILQL

SEQ ID NO: 3148339 - protein, 24 aa, Giardia lamblia
ADFGDFRHYFVLRYKDPKRGTPQL

SEQ ID NO: 3148340 - protein, 24 aa, Giardia lamblia
ADFGLCKDALWSGSTLIGIMAYVA

SEQ ID NO: 3148341 - protein, 23 aa, Giardia lamblia
ADFGLCKDALWSGSTLMGVAYMA

SEQ ID NO: 3148342 - protein, 18 aa, Giardia lamblia
ADFGLCRNTLWSESTIAG

SEQ ID NO: 3148343 - protein, 24 aa, Giardia lamblia
ADFGLCRNTLWSGSTLIGIMAYVA

SEQ ID NO: 3148344 - protein, 29 aa, Giardia lamblia
ADFGNPMVQFYLHKLIDFMNYKASEVFLD

SEQ ID NO: 3148345 - protein, 17 aa, Giardia lamblia
ADFLAVSTSILNTIASR

SEQ ID NO: 3148346 - protein, 23 aa, Giardia lamblia
ADFLDGYSCTCFVYGQTGSGKTH

SEQ ID NO: 3148347 - protein, 18 aa, Giardia lamblia
ADFTFKLDLDEVTQKPYV

SEQ ID NO: 3148348 - protein, 17 aa, Giardia lamblia
ADFYYDRLHSLCSNTNL

SEQ ID NO: 3148349 - protein, 26 aa, Giardia lamblia
ADGARIRLGYPYICPTMSFKNPGNYR

SEQ ID NO: 3148350 - protein, 20 aa, Giardia lamblia
ADGDAACVLCSDTSGSDPKN

SEQ ID NO: 3148351 - protein, 22 aa, Giardia lamblia
ADGFCPRCDNQWYLEADTGDSE

SEQ ID NO: 3148352 - protein, 20 aa, Giardia lamblia
ADGKTALHLAAERNNKPMID

SEQ ID NO: 3148353 - protein, 20 aa, Giardia lamblia
ADGLDLGWVPVLKVTRLGSD

SEQ ID NO: 3148354 - protein, 18 aa, Giardia lamblia
ADGLIVFFPSYRFMEDLI

SEQ ID NO: 3148355 - protein, 17 aa, Giardia lamblia
ADGLLTYSWAKSKIRNS

SEQ ID NO: 3148356 - protein, 28 aa, Giardia lamblia
ADGQEWARYRRCWGTRASEQGSICTELF

SEQ ID NO: 3148357 - protein, 35 aa, Giardia lamblia
ADGRTALMQAAWNRHLDCVRWLAKKEGGIQDSEGK

SEQ ID NO: 3148358 - protein, 36 aa, Giardia lamblia
ADGRTALMRAARAGFADIVWLLAPQEAGMQLINDTE

SEQ ID NO: 3148359 - protein, 19 aa, Giardia lamblia
ADGTLYCYEIGKGKNNSKS

SEQ ID NO: 3148360 - protein, 20 aa, Giardia lamblia
ADGVVGAAIFSVSRSFPEFI

SEQ ID NO: 3148361 - protein, 23 aa, Giardia lamblia
ADHHGRTALMFAAENRQLDAMRI

SEQ ID NO: 3148362 - protein, 17 aa, Giardia lamblia
ADIAALLLKEGNYEDSS

SEQ ID NO: 3148363 - protein, 24 aa, Giardia lamblia
ADIFLSDEEYVYFMLAIANTGRIE

SEQ ID NO: 3148364 - protein, 24 aa, Giardia lamblia
ADIFSRWRFLYAMRRDQLNDAINY

SEQ ID NO: 3148365 - protein, 19 aa, Giardia lamblia
ADIIRKVDHLDFQAMQRRT

SEQ ID NO: 3148366 - protein, 17 aa, Giardia lamblia
ADIKDLKDELAQLTIKR

SEQ ID NO: 3148367 - protein, 28 aa, Giardia lamblia
ADILCPHCLYFLPCILKIRDRSHLIVVF

SEQ ID NO: 3148368 - protein, 23 aa, Giardia lamblia
ADILCWEPLYDGGRFLLKQSRPL

SEQ ID NO: 3148369 - protein, 19 aa, Giardia lamblia
ADILIHITSPVFNRQTELK

SEQ ID NO: 3148370 - protein, 20 aa, Giardia lamblia
ADILRGRFKKYIVTTSKKSH

SEQ ID NO: 3148371 - protein, 19 aa, Giardia lamblia
ADIWSLGCAIYEVCKGYQL

SEQ ID NO: 3148372 - protein, 26 aa, Giardia lamblia
ADIWSVGVLLYLMLGRTLPFQANTLE

SEQ ID NO: 3148373 - protein, 22 aa, Giardia lamblia
ADKELWLNFWYDLDEENKNKVK

SEQ ID NO: 3148374 - protein, 19 aa, Giardia lamblia
ADKERRCVVSGGDSGVIME

SEQ ID NO: 3148375 - protein, 23 aa, Giardia lamblia
ADKFLWNCSRVMDFLTTAHPSIL

SEQ ID NO: 3148376 - protein, 24 aa, Giardia lamblia
ADKFRFEYELFLRRLARKLHDTGS

SEQ ID NO: 3148377 - protein, 19 aa, Giardia lamblia
ADKGVLLIDEFDKVDADDR

SEQ ID NO: 3148378 - protein, 21 aa, Giardia lamblia
ADKRLGCSYQTLTIGNEERIF

SEQ ID NO: 3148379 - protein, 23 aa, Giardia lamblia
ADLARAVYWTKLGTFYEELAADS

SEQ ID NO: 3148380 - protein, 25 aa, Giardia lamblia
ADLECALPRLSEVVLSPGSGERAFI

SEQ ID NO: 3148381 - protein, 26 aa, Giardia lamblia
ADLEPSFKVEQFFKVDHSPKTTRDPE

SEQ ID NO: 3148382 - protein, 25 aa, Giardia lamblia
ADLHIIKLMGPLCNYSKFRMYAQMA

SEQ ID NO: 3148383 - protein, 24 aa, Giardia lamblia
ADLKKLKADMGYLQTELNDTRASE

SEQ ID NO: 3148384 - protein, 17 aa, Giardia lamblia
ADLKRCYVLVHNTITVS

SEQ ID NO: 3148385 - protein, 19 aa, Giardia lamblia
ADLLFRIVPYPDNLERKFG

SEQ ID NO: 3148386 - protein, 20 aa, Giardia lamblia
ADLNTRRGIVLGVNNRTELM

SEQ ID NO: 3148387 - protein, 22 aa, Giardia lamblia
ADLPPPVSASSLLPVQTLESAK

SEQ ID NO: 3148388 - protein, 17 aa, Giardia lamblia
ADLRLCMRKTDKVMELY

SEQ ID NO: 3148389 - protein, 31 aa, Giardia lamblia
ADLRLCSLLEVLKQDILGCTARLSQKRFNPM

SEQ ID NO: 3148390 - protein, 18 aa, Giardia lamblia
ADLRPVLVGLANKHKNCS

SEQ ID NO: 3148391 - protein, 20 aa, Giardia lamblia
ADLSFFPFDSGFDVDSIEDS

SEQ ID NO: 3148392 - protein, 22 aa, Giardia lamblia
ADLSFLQATVIRLEEEKSVLSD

SEQ ID NO: 3148393 - protein, 31 aa, Giardia lamblia
ADLSKLHLEYARKFRSLLFLEGQLRANDVRE

SEQ ID NO: 3148394 - protein, 18 aa, Giardia lamblia
ADLYPELIIDSLLHNDDV

SEQ ID NO: 3148395 - protein, 23 aa, Giardia lamblia
ADMANRFAREKELLQENIDVLEA

SEQ ID NO: 3148396 - protein, 23 aa, Giardia lamblia
ADMCKNYIPHILGMFTNVMETLR

SEQ ID NO: 3148397 - protein, 20 aa, Giardia lamblia
ADMLDAKFADLQDFINRPVA

SEQ ID NO: 3148398 - protein, 24 aa, Giardia lamblia
ADMPYTAHVLFSLLRDETHAQLTR

SEQ ID NO: 3148399 - protein, 20 aa, Giardia lamblia
ADMWSLGAVLYELATGERPN

SEQ ID NO: 3148400 - protein, 24 aa, Giardia lamblia
ADMYALGCIISLLVTHVDKTNSNF

SEQ ID NO: 3148401 - protein, 18 aa, Giardia lamblia
ADNFWLYQTSDFMTASPS

SEQ ID NO: 3148402 - protein, 20 aa, Giardia lamblia
ADNHCLYNSLIAGLHGPSEN

SEQ ID NO: 3148403 - protein, 26 aa, Giardia lamblia
ADNIRLKLVSVFAEDKKLRIGRLKRK

SEQ ID NO: 3148404 - protein, 25 aa, Giardia lamblia
ADNQEMLRCYPIDYVNSVNLANQRR

SEQ ID NO: 3148405 - protein, 19 aa, Giardia lamblia
ADPAAGRIPAKVEAQTDTD

SEQ ID NO: 3148406 - protein, 30 aa, Giardia lamblia
ADPDPDLSNIGFRLIFPKASIVECAQGGDR

SEQ ID NO: 3148407 - protein, 19 aa, Giardia lamblia
ADPEEIYLCPGYSEELDAL

SEQ ID NO: 3148408 - protein, 20 aa, Giardia lamblia
ADPQSDFLLLPRLIRAAHMN

SEQ ID NO: 3148409 - protein, 25 aa, Giardia lamblia
ADPRPEHRSGISYVRREFRHHEEPL

SEQ ID NO: 3148410 - protein, 22 aa, Giardia lamblia
ADPRQFCMCISETGKHSETHVE

SEQ ID NO: 3148411 - protein, 23 aa, Giardia lamblia
ADPRSFLLLPRLIRAAHMNSTET

SEQ ID NO: 3148412 - protein, 22 aa, Giardia lamblia
ADPRTLFISDLMSFIRNLATSS

SEQ ID NO: 3148413 - protein, 21 aa, Giardia lamblia
ADPTAAIAFLISAATASYKTF

SEQ ID NO: 3148414 - protein, 24 aa, Giardia lamblia
ADQLECVKLLVGGEFSMCDNYQSL

SEQ ID NO: 3148415 - protein, 21 aa, Giardia lamblia
ADQSSSVSFGADFKSTGTGPA

SEQ ID NO: 3148416 - protein, 19 aa, Giardia lamblia
ADRAGHIRRAMSVDDAKKF

SEQ ID NO: 3148417 - protein, 28 aa, Giardia lamblia
ADRETGGFTALVWAAREGHLACIKVLAP

SEQ ID NO: 3148418 - protein, 23 aa, Giardia lamblia
ADRLGLTPMMWAAEKGYHEIVHF

SEQ ID NO: 3148419 - protein, 29 aa, Giardia lamblia
ADRNGNVCWWDCSACKLLGKIKLQSDING

SEQ ID NO: 3148420 - protein, 19 aa, Giardia lamblia
ADRQGRTALMLAVLCQNSY

SEQ ID NO: 3148421 - protein, 21 aa, Giardia lamblia
ADRRHGLGRVIFPNGDVFIGT

SEQ ID NO: 3148422 - protein, 22 aa, Giardia lamblia
ADRYSVPITEFISGRLGCSFKP

SEQ ID NO: 3148423 - protein, 26 aa, Giardia lamblia
ADSFTIICVTDLFYAEPIRRNQIRSS

SEQ ID NO: 3148424 - protein, 21 aa, Giardia lamblia
ADSGARFTVTYGNKIGEMPEG

SEQ ID NO: 3148425 - protein, 18 aa, Giardia lamblia
ADSIVFYLPRGHIQLLMT

SEQ ID NO: 3148426 - protein, 24 aa, Giardia lamblia
ADSKLCLMAFDLMNDLLHRCSHAW

SEQ ID NO: 3148427 - protein, 29 aa, Giardia lamblia
ADSLANCKWLIDLQKEFKAALDHYTKDFQ

SEQ ID NO: 3148428 - protein, 17 aa, Giardia lamblia
ADSLCLMVEKVHNHANS

SEQ ID NO: 3148429 - protein, 18 aa, Giardia lamblia
ADSLFALTGVPLRSIHTA

SEQ ID NO: 3148430 - protein, 19 aa, Giardia lamblia
ADSLNALGLSAGNALCRSP

SEQ ID NO: 3148431 - protein, 22 aa, Giardia lamblia
ADSMAEYVMDYCKYITSTKDMT

SEQ ID NO: 3148432 - protein, 25 aa, Giardia lamblia
ADSREVNRAISIYKRSSDWLAEKKL

SEQ ID NO: 3148433 - protein, 22 aa, Giardia lamblia
ADSRTPWSLASSRMHTSARLNP

SEQ ID NO: 3148434 - protein, 25 aa, Giardia lamblia
ADSSLCIPYMHGFYIDKALYDKAKF

SEQ ID NO: 3148435 - protein, 26 aa, Giardia lamblia
ADTGPEPEQRCCVARPVTVLQAAKSD

SEQ ID NO: 3148436 - protein, 18 aa, Giardia lamblia
ADTGYRAPSYTGMSTANT

SEQ ID NO: 3148437 - protein, 17 aa, Giardia lamblia
ADTLDFVLQRTRVFPAD

SEQ ID NO: 3148438 - protein, 25 aa, Giardia lamblia
ADTLKRFRKLQGFETYLMTGTDEHG

SEQ ID NO: 3148439 - protein, 26 aa, Giardia lamblia
ADTPEEISFIWAFTLIHEVLRYHRDF

SEQ ID NO: 3148440 - protein, 20 aa, Giardia lamblia
ADTSVAPVLVLDPIVALDTQ

SEQ ID NO: 3148441 - protein, 24 aa, Giardia lamblia
ADTTRLTGELSIRDAELLKLAEAC

SEQ ID NO: 3148442 - protein, 25 aa, Giardia lamblia
ADTVFKHSILVLKECADRTVKIHEG

SEQ ID NO: 3148443 - protein, 21 aa, Giardia lamblia
ADTYKAAAIVEELAQNAEAVR

SEQ ID NO: 3148444 - protein, 19 aa, Giardia lamblia
ADVDQLGFLKYYTKLGDCI

SEQ ID NO: 3148445 - protein, 17 aa, Giardia lamblia
ADVEAAYLADAERLQQL

SEQ ID NO: 3148446 - protein, 23 aa, Giardia lamblia
ADVLCWEPLYDGGRFLLKQSKPL

SEQ ID NO: 3148447 - protein, 22 aa, Giardia lamblia
ADVLLCREYWLSGTSSMLPFSL

SEQ ID NO: 3148448 - protein, 24 aa, Giardia lamblia
ADVPFGVLHRIRRNFDDKLFCARE

SEQ ID NO: 3148449 - protein, 18 aa, Giardia lamblia
ADVRKEINFCKQLNLRIR

SEQ ID NO: 3148450 - protein, 17 aa, Giardia lamblia
ADVSGSHQCQCEQLLSA

SEQ ID NO: 3148451 - protein, 19 aa, Giardia lamblia
ADVTTLLGKNVVDFQRAAM

SEQ ID NO: 3148452 - protein, 20 aa, Giardia lamblia
ADVVPRADYDALLAEYTLAQ

SEQ ID NO: 3148453 - protein, 19 aa, Giardia lamblia
ADVWSVGCVIYEFLTGHIL

SEQ ID NO: 3148454 - protein, 18 aa, Giardia lamblia
ADYGDVLMKVELIRKLSL

SEQ ID NO: 3148455 - protein, 22 aa, Giardia lamblia
ADYLKKPGVYRVYLTTEDGTIS

SEQ ID NO: 3148456 - protein, 23 aa, Giardia lamblia
AEAAALLIYRAVADYGDHDRLIR

SEQ ID NO: 3148457 - protein, 17 aa, Giardia lamblia
AEAATLMALKNEVALMY

SEQ ID NO: 3148458 - protein, 21 aa, Giardia lamblia
AEAEAKRKLALSLSMSIAAQD

SEQ ID NO: 3148459 - protein, 18 aa, Giardia lamblia
AEAEKSRNELLFEIEGLK

SEQ ID NO: 3148460 - protein, 21 aa, Giardia lamblia
AEAGIKPIFVFDGKPPEDKQG

SEQ ID NO: 3148461 - protein, 19 aa, Giardia lamblia
AEALLPREKAMISHDEKTA

SEQ ID NO: 3148462 - protein, 27 aa, Giardia lamblia
AEALREISGRLGGIPGEGGYPADLTSK

SEQ ID NO: 3148463 - protein, 25 aa, Giardia lamblia
AEALRKLNIVTRFSIGYKGEHIYMG

SEQ ID NO: 3148464 - protein, 25 aa, Giardia lamblia
AEALSWYGQERLKGLVVRHHGFLGV

SEQ ID NO: 3148465 - protein, 20 aa, Giardia lamblia
AEANCVYGMHGMTALMIAAS

SEQ ID NO: 3148466 - protein, 20 aa, Giardia lamblia
AEAPLLISRLAELFIADVTN

SEQ ID NO: 3148467 - protein, 24 aa, Giardia lamblia
AEAQCVAMAKERVCEGVASSDLDV

SEQ ID NO: 3148468 - protein, 27 aa, Giardia lamblia
AEARLSRPDGWFALMFATQKGSIESIK

SEQ ID NO: 3148469 - protein, 34 aa, Giardia lamblia
AEARSRIYALVYHYSKKVYLWAVHDYINICRTYS

SEQ ID NO: 3148470 - protein, 21 aa, Giardia lamblia
AEARTAIYHIVSRDIACNPYL

SEQ ID NO: 3148471 - protein, 31 aa, Giardia lamblia
AEARVMDPYGWTALMSAVWNNHGSVAELLID

SEQ ID NO: 3148472 - protein, 20 aa, Giardia lamblia
AEASFGYLYRVKKSGTEGFI

SEQ ID NO: 3148473 - protein, 19 aa, Giardia lamblia
AEASYRFTDDSDILMYLIR

SEQ ID NO: 3148474 - protein, 23 aa, Giardia lamblia
AEATELQVLVAHLGVSVSSILSS

SEQ ID NO: 3148475 - protein, 22 aa, Giardia lamblia
AECCAELKTVRTLIESARTIKR

SEQ ID NO: 3148476 - protein, 18 aa, Giardia lamblia
AECRARIDSAEARAVSLD

SEQ ID NO: 3148477 - protein, 28 aa, Giardia lamblia
AEDAVVFFDWSRSFKFLCQVNVTATSLI

SEQ ID NO: 3148478 - protein, 23 aa, Giardia lamblia
AEEAANLLMEYGIAQRNIVLLIQ

SEQ ID NO: 3148479 - protein, 18 aa, Giardia lamblia
AEEALAIQRTEIAKLNCI

SEQ ID NO: 3148480 - protein, 29 aa, Giardia lamblia
AEEIVTNLVCEVCSLIATHGRDSAVSLRL

SEQ ID NO: 3148481 - protein, 20 aa, Giardia lamblia
AEEKAKWYLILESWKDSLKD

SEQ ID NO: 3148482 - protein, 17 aa, Giardia lamblia
AEEKLLSAGMPKNRNRI

SEQ ID NO: 3148483 - protein, 17 aa, Giardia lamblia
AEEKLRILRETEAALER

SEQ ID NO: 3148484 - protein, 17 aa, Giardia lamblia
AEEKPPESVKIVKNAPL

SEQ ID NO: 3148485 - protein, 25 aa, Giardia lamblia
AEERERCLAEALADLKKLKADMGYL

SEQ ID NO: 3148486 - protein, 28 aa, Giardia lamblia
AEERLMNSVGWTPMMIYTMLSDLDSVKQ

SEQ ID NO: 3148487 - protein, 26 aa, Giardia lamblia
AEESAQFVSMRAFLNGTSRDECIQIG

SEQ ID NO: 3148488 - protein, 22 aa, Giardia lamblia
AEEYRRTVLSLGIIDLETKTAD

SEQ ID NO: 3148489 - protein, 17 aa, Giardia lamblia
AEFARRRSKSGARGSSA

SEQ ID NO: 3148490 - protein, 18 aa, Giardia lamblia
AEFFVRRIAATQEELARL

SEQ ID NO: 3148491 - protein, 19 aa, Giardia lamblia
AEFGMGMLVGIQQRRERIL

SEQ ID NO: 3148492 - protein, 17 aa, Giardia lamblia
AEFLIGGTCLNIDPVAG

SEQ ID NO: 3148493 - protein, 20 aa, Giardia lamblia
AEFNSFFKVLFFTRTDAENG

SEQ ID NO: 3148494 - protein, 19 aa, Giardia lamblia
AEFNTRWLVRESTNNDFLV

SEQ ID NO: 3148495 - protein, 19 aa, Giardia lamblia
AEFRRFLQRTGVSDAITKA

SEQ ID NO: 3148496 - protein, 21 aa, Giardia lamblia
AEFRVKLFYTIENLVELEGIA

SEQ ID NO: 3148497 - protein, 24 aa, Giardia lamblia
AEFSAHLLAALTVRGYEPEYEIKL

SEQ ID NO: 3148498 - protein, 22 aa, Giardia lamblia
AEFVCLREVIELAAVTNECKDL

SEQ ID NO: 3148499 - protein, 21 aa, Giardia lamblia
AEFYRKIWDTVCNNENFDAPF

SEQ ID NO: 3148500 - protein, 22 aa, Giardia lamblia
AEGDELSSWLISAPSGSILFTA

SEQ ID NO: 3148501 - protein, 26 aa, Giardia lamblia
AEGDILRTWCLRFQAGLHNTDGTTAL

SEQ ID NO: 3148502 - protein, 19 aa, Giardia lamblia
AEGGLCFVPYTATEPETVH

SEQ ID NO: 3148503 - protein, 18 aa, Giardia lamblia
AEGIPYIMCTTNGLSGRL

SEQ ID NO: 3148504 - protein, 17 aa, Giardia lamblia
AEGIQCFLNASTEPGTF

SEQ ID NO: 3148505 - protein, 22 aa, Giardia lamblia
AEGITALMLAAGAGHKQIVALL

SEQ ID NO: 3148506 - protein, 22 aa, Giardia lamblia
AEGKVLFPNDRVMIINHNTKPF

SEQ ID NO: 3148507 - protein, 18 aa, Giardia lamblia
AEGPLFGASVSRSITPSG

SEQ ID NO: 3148508 - protein, 19 aa, Giardia lamblia
AEGTQFCSGFGGIGGLLRW

SEQ ID NO: 3148509 - protein, 24 aa, Giardia lamblia
AEGYRPTLEEYLSYEMESRRTELE

SEQ ID NO: 3148510 - protein, 19 aa, Giardia lamblia
AEHAKRVTIMKPDMELATR

SEQ ID NO: 3148511 - protein, 17 aa, Giardia lamblia
AEHCIFGSKCVEPSLCS

SEQ ID NO: 3148512 - protein, 26 aa, Giardia lamblia
AEHGELLKVWFYRPYQAGKQDHHGKT

SEQ ID NO: 3148513 - protein, 29 aa, Giardia lamblia
AEHLDDLVDWCVYHITNLISKKFTRLPCA

SEQ ID NO: 3148514 - protein, 23 aa, Giardia lamblia
AEHLMALPVKAREALAEKELLRF

SEQ ID NO: 3148515 - protein, 18 aa, Giardia lamblia
AEHRSWFNFLVHNPSGLD

SEQ ID NO: 3148516 - protein, 26 aa, Giardia lamblia
AEHSITCKKWAKAHAHERAHGFLYSS

SEQ ID NO: 3148517 - protein, 19 aa, Giardia lamblia
AEIAARYSRFNSIALTGYR

SEQ ID NO: 3148518 - protein, 17 aa, Giardia lamblia
AEIAHLASTNIFRDVSM

SEQ ID NO: 3148519 - protein, 18 aa, Giardia lamblia
AEIARLESIYQISMESRA

SEQ ID NO: 3148520 - protein, 18 aa, Giardia lamblia
AEIARLNSVIANMVEASH

SEQ ID NO: 3148521 - protein, 20 aa, Giardia lamblia
AEIIQRLPALQSLSCDLTNY

SEQ ID NO: 3148522 - protein, 17 aa, Giardia lamblia
AEIKGEDYVYVLPKKTT

SEQ ID NO: 3148523 - protein, 20 aa, Giardia lamblia
AEIMPLFFAQMHKKLDTSDC

SEQ ID NO: 3148524 - protein, 23 aa, Giardia lamblia
AEIQELRLLIDTLQNRKPISDDA

SEQ ID NO: 3148525 - protein, 20 aa, Giardia lamblia
AEIQFVVSFLELYLDNTYDL

SEQ ID NO: 3148526 - protein, 28 aa, Giardia lamblia
AEIQTRLNLLDMKLLFAQMRVSTSSAST

SEQ ID NO: 3148527 - protein, 20 aa, Giardia lamblia
AEIRCLKANLSKSIDNPVEV

SEQ ID NO: 3148528 - protein, 23 aa, Giardia lamblia
AEIRDLKEEMAILQIDEHASGAP

SEQ ID NO: 3148529 - protein, 23 aa, Giardia lamblia
AEITAMPALVFRFIPENLAQHGS

SEQ ID NO: 3148530 - protein, 21 aa, Giardia lamblia
AEITGSMNLFIADAVFGDDSS

SEQ ID NO: 3148531 - protein, 27 aa, Giardia lamblia
AEKALNWPYVRARELFKNPAVIDPKEI

SEQ ID NO: 3148532 - protein, 24 aa, Giardia lamblia
AEKATRFALHNTFYCDSAYESSVT

SEQ ID NO: 3148533 - protein, 28 aa, Giardia lamblia
AEKDCRTVRGKGCIDFAKNDLVVRFIQG

SEQ ID NO: 3148534 - protein, 43 aa, Giardia lamblia
AEKFAKCGKKTMPLPGFRWPLAVAFLPCLADFHSLKHVTQHAL

SEQ ID NO: 3148535 - protein, 37 aa, Giardia lamblia
AEKGHLRRWRLVEASRGFKLEATMSLLAPDTPVSLSI

SEQ ID NO: 3148536 - protein, 29 aa, Giardia lamblia
AEKGHPECIKLLLEKEGGMKKNDFFSNGG

SEQ ID NO: 3148537 - protein, 28 aa, Giardia lamblia
AEKGHPECIKLLLEKEGGMQTSGGETAL

SEQ ID NO: 3148538 - protein, 18 aa, Giardia lamblia
AEKQAVIFIDEIDALASA

SEQ ID NO: 3148539 - protein, 26 aa, Giardia lamblia
AEKRCRCWCSAYLTPVVQPGVSANFP

SEQ ID NO: 3148540 - protein, 19 aa, Giardia lamblia
AEKRLAVSCDEGIDLKPAL

SEQ ID NO: 3148541 - protein, 22 aa, Giardia lamblia
AEKSVLMAYLVIRYRYPTIIFV

SEQ ID NO: 3148542 - protein, 19 aa, Giardia lamblia
AEKTVAMLLNVSATLTQLL

SEQ ID NO: 3148543 - protein, 20 aa, Giardia lamblia
AELAKGLVISTGELVKPLNV

SEQ ID NO: 3148544 - protein, 25 aa, Giardia lamblia
AELAMDICKYMIKRNDNLYNGLTEK

SEQ ID NO: 3148545 - protein, 18 aa, Giardia lamblia
AELANARGLIEVPDNPET

SEQ ID NO: 3148546 - protein, 23 aa, Giardia lamblia
AELAYLRARVDTLTRMVNEVSAD

SEQ ID NO: 3148547 - protein, 17 aa, Giardia lamblia
AELCTGKLVADIQKAFD

SEQ ID NO: 3148548 - protein, 26 aa, Giardia lamblia
AELEELRAYHDFIKPQVMEQKLEEMN

SEQ ID NO: 3148549 - protein, 20 aa, Giardia lamblia
AELERSLATPFARTKMMEEE

SEQ ID NO: 3148550 - protein, 18 aa, Giardia lamblia
AELEVLLLQNDATFKDKL

SEQ ID NO: 3148551 - protein, 18 aa, Giardia lamblia
AELGCTYEFVAGIVNDLL

SEQ ID NO: 3148552 - protein, 20 aa, Giardia lamblia
AELGNAYALTVLSAHADLIQ

SEQ ID NO: 3148553 - protein, 18 aa, Giardia lamblia
AELHKLGFVELNNLNQGL

SEQ ID NO: 3148554 - protein, 17 aa, Giardia lamblia
AELLGARAIITERESML

SEQ ID NO: 3148555 - protein, 18 aa, Giardia lamblia
AELLGIQYESIIPVGYSR

SEQ ID NO: 3148556 - protein, 21 aa, Giardia lamblia
AELLHYCRAAFAVYGSYESRY

SEQ ID NO: 3148557 - protein, 23 aa, Giardia lamblia
AELLKREQLLCVGENCRVFSDDW

SEQ ID NO: 3148558 - protein, 19 aa, Giardia lamblia
AELLREIGYVIFDEVHYMR

SEQ ID NO: 3148559 - protein, 17 aa, Giardia lamblia
AELMITYKELLRVHYYK

SEQ ID NO: 3148560 - protein, 35 aa, Giardia lamblia
AELMLREMLYLLTMSGRMYIPFIYALHEINLIDPH

SEQ ID NO: 3148561 - protein, 25 aa, Giardia lamblia
AELNKSKLCRRLVHFEGDLTGGSDD

SEQ ID NO: 3148562 - protein, 18 aa, Giardia lamblia
AELPAGYVHDGAPLWQKT

SEQ ID NO: 3148563 - protein, 20 aa, Giardia lamblia
AELPASPLPSGPKDITTPLS

SEQ ID NO: 3148564 - protein, 21 aa, Giardia lamblia
AELPPSVAAFEKCDIRVSQIL

SEQ ID NO: 3148565 - protein, 19 aa, Giardia lamblia
AELQRKCEQVARVREAIRA

SEQ ID NO: 3148566 - protein, 21 aa, Giardia lamblia
AELRAKPEILKKIIADCNNEK

SEQ ID NO: 3148567 - protein, 17 aa, Giardia lamblia
AELRAVHARAILKETPA

SEQ ID NO: 3148568 - protein, 20 aa, Giardia lamblia
AELRGQLNAKLAEIDAVHKN

SEQ ID NO: 3148569 - protein, 23 aa, Giardia lamblia
AELRLLREKVVVLQEEFSKEHDL

SEQ ID NO: 3148570 - protein, 17 aa, Giardia lamblia
AELRQEARIYQRDLQKL

SEQ ID NO: 3148571 - protein, 22 aa, Giardia lamblia
AELSCSPPLFLELLEEKAANED

SEQ ID NO: 3148572 - protein, 20 aa, Giardia lamblia
AELSFFIKGDISLDQCTVVC

SEQ ID NO: 3148573 - protein, 24 aa, Giardia lamblia
AELTKAEFAARCTSLQSKVTELES

SEQ ID NO: 3148574 - protein, 17 aa, Giardia lamblia
AELTLLIARKEATDRLK

SEQ ID NO: 3148575 - protein, 20 aa, Giardia lamblia
AELTSSLSLLDQIEEKNRSN

SEQ ID NO: 3148576 - protein, 17 aa, Giardia lamblia
AEMEGRILLGDGRSALI

SEQ ID NO: 3148577 - protein, 22 aa, Giardia lamblia
AEMIARTLANLNTWKGGLNTTL

SEQ ID NO: 3148578 - protein, 23 aa, Giardia lamblia
AEMRIAAASTIWMGFSDGRLTME

SEQ ID NO: 3148579 - protein, 21 aa, Giardia lamblia
AENHPGALLYQISTQLRNAKQ

SEQ ID NO: 3148580 - protein, 19 aa, Giardia lamblia
AENIFLSALIEAGSTRAYV

SEQ ID NO: 3148581 - protein, 18 aa, Giardia lamblia
AENIPIYDLVHADIPKGE

SEQ ID NO: 3148582 - protein, 18 aa, Giardia lamblia
AENMPMMVFSDVKEAVTQ

SEQ ID NO: 3148583 - protein, 19 aa, Giardia lamblia
AENPRCCTTEFDLTDKSIN

SEQ ID NO: 3148584 - protein, 20 aa, Giardia lamblia
AENQRLNALVAQRDEERSAL

SEQ ID NO: 3148585 - protein, 19 aa, Giardia lamblia
AEPKKTRMTEAFEEDTGFT

SEQ ID NO: 3148586 - protein, 17 aa, Giardia lamblia
AEPMILQPVVPRSLGRS

SEQ ID NO: 3148587 - protein, 17 aa, Giardia lamblia
AEPRAPENLELPPLPTD

SEQ ID NO: 3148588 - protein, 22 aa, Giardia lamblia
AEPSPKRLVPIHNVISNKDFEV

SEQ ID NO: 3148589 - protein, 20 aa, Giardia lamblia
AEQPDEMFGFGANLADGAAE

SEQ ID NO: 3148590 - protein, 17 aa, Giardia lamblia
AEQRFLYRDRMFTRSLE

SEQ ID NO: 3148591 - protein, 19 aa, Giardia lamblia
AERAAAARNRKRWAQEMAS

SEQ ID NO: 3148592 - protein, 39 aa, Giardia lamblia
AERATLYSDCFLRLYPRFNLRSGCIASIVCRPRPVYMIS

SEQ ID NO: 3148593 - protein, 18 aa, Giardia lamblia
AERDYFKIIRILLERESR

SEQ ID NO: 3148594 - protein, 22 aa, Giardia lamblia
AERFKALEKFIGMLKSGETVAP

SEQ ID NO: 3148595 - protein, 23 aa, Giardia lamblia
AERIRKDRMRYGAPENTAKKSIN

SEQ ID NO: 3148596 - protein, 21 aa, Giardia lamblia
AERKYSKCIEECREISSIIAT

SEQ ID NO: 3148597 - protein, 23 aa, Giardia lamblia
AERLKRIAAISLIADVAEKGSGR

SEQ ID NO: 3148598 - protein, 21 aa, Giardia lamblia
AERLPYFSVYQMILSGVMGLI

SEQ ID NO: 3148599 - protein, 23 aa, Giardia lamblia
AERLSVLLGCRAYFEVSAADGTN

SEQ ID NO: 3148600 - protein, 18 aa, Giardia lamblia
AERMKGALSLLLGADYSD

SEQ ID NO: 3148601 - protein, 23 aa, Giardia lamblia
AERSCPSKSLAQNVCTMRSLEDL

SEQ ID NO: 3148602 - protein, 22 aa, Giardia lamblia
AERSLREAIDINPRHINARLRV

SEQ ID NO: 3148603 - protein, 17 aa, Giardia lamblia
AESAVGISFLDGAVESF

SEQ ID NO: 3148604 - protein, 21 aa, Giardia lamblia
AESFRSSIVSPLFARLFSDAV

SEQ ID NO: 3148605 - protein, 17 aa, Giardia lamblia
AESFSGGVVAPLAAYIW

SEQ ID NO: 3148606 - protein, 21 aa, Giardia lamblia
AESKLDMGLFSEAHQPTSDHP

SEQ ID NO: 3148607 - protein, 24 aa, Giardia lamblia
AESLRPRIAALEMENKGTRDSIAS

SEQ ID NO: 3148608 - protein, 18 aa, Giardia lamblia
AESLVAYAAKMNIPFCLS

SEQ ID NO: 3148609 - protein, 23 aa, Giardia lamblia
AESMGLGMFWCGFLLAAVASSQE

SEQ ID NO: 3148610 - protein, 21 aa, Giardia lamblia
AESMKAQALAAIQAKDTPGCS

SEQ ID NO: 3148611 - protein, 20 aa, Giardia lamblia
AESPFSFYTAALASRSQEIL

SEQ ID NO: 3148612 - protein, 26 aa, Giardia lamblia
AESRDACPRCAAPLKALPPSRPVGAQ

SEQ ID NO: 3148613 - protein, 17 aa, Giardia lamblia
AESSAPVADCLRRADEL

SEQ ID NO: 3148614 - protein, 22 aa, Giardia lamblia
AESYLPSQMGFRNADSETALML

SEQ ID NO: 3148615 - protein, 30 aa, Giardia lamblia
AESYYCSRCSSRLGLQFGASPTRTFTGSGH

SEQ ID NO: 3148616 - protein, 22 aa, Giardia lamblia
AETACPFCTPMSANASSLSQFD

SEQ ID NO: 3148617 - protein, 25 aa, Giardia lamblia
AETFRGGALQRHRFGLYADIVRSSE

SEQ ID NO: 3148618 - protein, 21 aa, Giardia lamblia
AETGLEVGLKVINRKALENDK

SEQ ID NO: 3148619 - protein, 21 aa, Giardia lamblia
AETLFPAAIATLATMANAALA

SEQ ID NO: 3148620 - protein, 20 aa, Giardia lamblia
AETLLDKGIHPIRISDGYDM

SEQ ID NO: 3148621 - protein, 24 aa, Giardia lamblia
AETMVRLSRMAIFYTVDRNVVSGF

SEQ ID NO: 3148622 - protein, 18 aa, Giardia lamblia
AETNMKDERIVALEKELG

SEQ ID NO: 3148623 - protein, 21 aa, Giardia lamblia
AETSYSYEVCNRIKDAEDVMN

SEQ ID NO: 3148624 - protein, 18 aa, Giardia lamblia
AETTSMCLCTEEIVLRIF

SEQ ID NO: 3148625 - protein, 20 aa, Giardia lamblia
AEVAELRLRETLESMQRASD

SEQ ID NO: 3148626 - protein, 18 aa, Giardia lamblia
AEVARLDGHMDAVATFDI

SEQ ID NO: 3148627 - protein, 22 aa, Giardia lamblia
AEVDAEVAKRCSSTDMASLMKD

SEQ ID NO: 3148628 - protein, 25 aa, Giardia lamblia
AEVDEGIEFLCKEHESLKAIIEQYI

SEQ ID NO: 3148629 - protein, 24 aa, Giardia lamblia
AEVDRLESELGYLHQAVSLAGMRT

SEQ ID NO: 3148630 - protein, 24 aa, Giardia lamblia
AEVKDARETSCFLSKSRVPEELHS

SEQ ID NO: 3148631 - protein, 18 aa, Giardia lamblia
AEVLKLRDEIALLTHKHR

SEQ ID NO: 3148632 - protein, 17 aa, Giardia lamblia
AEVMSPTSFSYVKNEIM

SEQ ID NO: 3148633 - protein, 22 aa, Giardia lamblia
AEVRPRPSIANEIIKSYHRTSR

SEQ ID NO: 3148634 - protein, 30 aa, Giardia lamblia
AEVRSLAKAPNWAKVRIAPMPLSQASQILD

SEQ ID NO: 3148635 - protein, 17 aa, Giardia lamblia
AEVRTDLEAQLKTKDEM

SEQ ID NO: 3148636 - protein, 25 aa, Giardia lamblia
AEVSARYRSDFSFIRSGIYSTKECF

SEQ ID NO: 3148637 - protein, 30 aa, Giardia lamblia
AEVSKRPAAACTKYLLGWQPVNRLKNTKSA

SEQ ID NO: 3148638 - protein, 17 aa, Giardia lamblia
AEVTKLIRVIEEKNSQI

SEQ ID NO: 3148639 - protein, 25 aa, Giardia lamblia
AEVTQLKYEIRACVEQITAAHATAT

SEQ ID NO: 3148640 - protein, 21 aa, Giardia lamblia
AEWKLTPIPSELCKKLDFIQK

SEQ ID NO: 3148641 - protein, 21 aa, Giardia lamblia
AEYALQMAVFLPNTHNLLING

SEQ ID NO: 3148642 - protein, 26 aa, Giardia lamblia
AEYISCVQKGCIRRNPNTVDLTSSDV

SEQ ID NO: 3148643 - protein, 22 aa, Giardia lamblia
AEYKPKELFSKPPSRFLADENI

SEQ ID NO: 3148644 - protein, 28 aa, Giardia lamblia
AEYLEFPEKFIPCILQRVKPEYINKTYN

SEQ ID NO: 3148645 - protein, 23 aa, Giardia lamblia
AEYLKVCDFGSCTKAQYPDGSVF

SEQ ID NO: 3148646 - protein, 18 aa, Giardia lamblia
AEYMKLRAIASPSAILLY

SEQ ID NO: 3148647 - protein, 21 aa, Giardia lamblia
AEYRTSFLLATLFRVKPGGIW

SEQ ID NO: 3148648 - protein, 17 aa, Giardia lamblia
AFAAKYAGNCAIVSLGA

SEQ ID NO: 3148649 - protein, 17 aa, Giardia lamblia
AFAKALRSIPVIIANNG

SEQ ID NO: 3148650 - protein, 23 aa, Giardia lamblia
AFALLGVSWIRYNFYDSVSGSQP

SEQ ID NO: 3148651 - protein, 19 aa, Giardia lamblia
AFAPRQYVGEMCWFANKLL

SEQ ID NO: 3148652 - protein, 18 aa, Giardia lamblia
AFAQLAFLKQDPLFETAD

SEQ ID NO: 3148653 - protein, 29 aa, Giardia lamblia
AFCGHLQVVRFLLSCEGRMQTRFGTTALM

SEQ ID NO: 3148654 - protein, 32 aa, Giardia lamblia
AFCKERDLLGRISFDKVFLLSLKRRSLCYPLL

SEQ ID NO: 3148655 - protein, 17 aa, Giardia lamblia
AFCRFCTVEYSLDPGDL

SEQ ID NO: 3148656 - protein, 18 aa, Giardia lamblia
AFDESTFIKNARISKLTT

SEQ ID NO: 3148657 - protein, 18 aa, Giardia lamblia
AFDLVISRLTGKDVTGAF

SEQ ID NO: 3148658 - protein, 19 aa, Giardia lamblia
AFECLAITTFQPFRPMQLN

SEQ ID NO: 3148659 - protein, 17 aa, Giardia lamblia
AFFPNLAAMVMAGPACV

SEQ ID NO: 3148660 - protein, 20 aa, Giardia lamblia
AFGDELFKAFTATYNDLGLE

SEQ ID NO: 3148661 - protein, 19 aa, Giardia lamblia
AFGDNGPAMTFAALCDYHI

SEQ ID NO: 3148662 - protein, 24 aa, Giardia lamblia
AFGPKAIEFEVRRNLERARAAKGM

SEQ ID NO: 3148663 - protein, 20 aa, Giardia lamblia
AFHGLSILSAPIIPSRNAND

SEQ ID NO: 3148664 - protein, 27 aa, Giardia lamblia
AFHGSKRGGLLFRYTLRQARKNPQALF

SEQ ID NO: 3148665 - protein, 19 aa, Giardia lamblia
AFHTWKSQTPLLIMHPAIK

SEQ ID NO: 3148666 - protein, 17 aa, Giardia lamblia
AFILKCLEFTDTGEEVV

SEQ ID NO: 3148667 - protein, 22 aa, Giardia lamblia
AFIQRECALVLLSGAQNPKACA

SEQ ID NO: 3148668 - protein, 25 aa, Giardia lamblia
AFISYAGGLTGRFRSYVLTEWVNAV

SEQ ID NO: 3148669 - protein, 23 aa, Giardia lamblia
AFKTVYRAFDLIAGREVAWNEVV

SEQ ID NO: 3148670 - protein, 18 aa, Giardia lamblia
AFLADLGMAKYCVYSSPS

SEQ ID NO: 3148671 - protein, 20 aa, Giardia lamblia
AFLAEYMIKAADCMLKQIPT

SEQ ID NO: 3148672 - protein, 27 aa, Giardia lamblia
AFLHKEARPLLFARIGGEYTETPVLHN

SEQ ID NO: 3148673 - protein, 17 aa, Giardia lamblia
AFLKDIIYCLKMRSQEQ

SEQ ID NO: 3148674 - protein, 19 aa, Giardia lamblia
AFLLAKRAKLNYTHGYTML

SEQ ID NO: 3148675 - protein, 17 aa, Giardia lamblia
AFLLSTWIHVTKLAQGS

SEQ ID NO: 3148676 - protein, 19 aa, Giardia lamblia
AFLPLEFNALTTITSISLS

SEQ ID NO: 3148677 - protein, 18 aa, Giardia lamblia
AFLPRPNDFPSFSPQDMQ

SEQ ID NO: 3148678 - protein, 32 aa, Giardia lamblia
AFLQAFLTFCERFHLGKKLGLFLTDSITNKVL

SEQ ID NO: 3148679 - protein, 27 aa, Giardia lamblia
AFLTVYCTNWPGSVNLLYGARGKRHSL

SEQ ID NO: 3148680 - protein, 17 aa, Giardia lamblia
AFLYSGKEYSSFIADIQ

SEQ ID NO: 3148681 - protein, 24 aa, Giardia lamblia
AFMKRRFGDRYKPDNIDKAADDGQ

SEQ ID NO: 3148682 - protein, 26 aa, Giardia lamblia
AFNGHLECTRILASVEGGIVDYHGKS

SEQ ID NO: 3148683 - protein, 24 aa, Giardia lamblia
AFNLIIKDMMEYIVANSETPIHNL

SEQ ID NO: 3148684 - protein, 23 aa, Giardia lamblia
AFNVRIPLKLSRARQNSAAGARS

SEQ ID NO: 3148685 - protein, 22 aa, Giardia lamblia
AFPERYSIHGLQFLDDETFVFR

SEQ ID NO: 3148686 - protein, 21 aa, Giardia lamblia
AFPYDCARICVSACGSFVSVW

SEQ ID NO: 3148687 - protein, 18 aa, Giardia lamblia
AFQAEFSRLTRAVLDKAP

SEQ ID NO: 3148688 - protein, 19 aa, Giardia lamblia
AFQAIKWAARRSHRLLSVQ

SEQ ID NO: 3148689 - protein, 18 aa, Giardia lamblia
AFQIPLLGIAGRPFLTLM

SEQ ID NO: 3148690 - protein, 28 aa, Giardia lamblia
AFQLTLSILPVWSYRDLLFKLSHSGSGC

SEQ ID NO: 3148691 - protein, 18 aa, Giardia lamblia
AFSACLQQALATLRCAQL

SEQ ID NO: 3148692 - protein, 17 aa, Giardia lamblia
AFSEVLELTNTVRSRDA

SEQ ID NO: 3148693 - protein, 18 aa, Giardia lamblia
AFSKRPLGIYKVDARYCR

SEQ ID NO: 3148694 - protein, 21 aa, Giardia lamblia
AFSRSDPSGAMFTDNWAPDLS

SEQ ID NO: 3148695 - protein, 18 aa, Giardia lamblia
AFSTRRFVVATSDGTVRL

SEQ ID NO: 3148696 - protein, 31 aa, Giardia lamblia
AFVCSRNTPNWAVKLCQVQQYFAQYLLYTTS

SEQ ID NO: 3148697 - protein, 23 aa, Giardia lamblia
AFVEKRMGLSYGPVAGKKGLVFI

SEQ ID NO: 3148698 - protein, 31 aa, Giardia lamblia
AFWNKLRDFCCVGCKQLLRLPVKLKCGHFYC

SEQ ID NO: 3148699 - protein, 24 aa, Giardia lamblia
AFWRSEKLGGMTVLGESTRRPKWF

SEQ ID NO: 3148700 - protein, 20 aa, Giardia lamblia
AGAIRHIAQYIAFATPRKVI

SEQ ID NO: 3148701 - protein, 17 aa, Giardia lamblia
AGAISGFTMTPSAAYTK

SEQ ID NO: 3148702 - protein, 24 aa, Giardia lamblia
AGAKECVEILIGWEHDIPDKAGNM

SEQ ID NO: 3148703 - protein, 22 aa, Giardia lamblia
AGAKGGNGLVRFGMTLMSSNSK

SEQ ID NO: 3148704 - protein, 26 aa, Giardia lamblia
AGAKGSCPCDIFSIGMVGYAMMTNST

SEQ ID NO: 3148705 - protein, 23 aa, Giardia lamblia
AGALSIGCTVMFAGTDHATPLVL

SEQ ID NO: 3148706 - protein, 20 aa, Giardia lamblia
AGANMAYLLAHKDVELENLN

SEQ ID NO: 3148707 - protein, 26 aa, Giardia lamblia
AGARKAMQIFRGFHDFDVPISKEDRF

SEQ ID NO: 3148708 - protein, 17 aa, Giardia lamblia
AGASIPSSVFKLVSHLR

SEQ ID NO: 3148709 - protein, 19 aa, Giardia lamblia
AGASLIANIAKFYRIPLIV

SEQ ID NO: 3148710 - protein, 25 aa, Giardia lamblia
AGCDFSRLTRLRKIGSRDINISSLQ

SEQ ID NO: 3148711 - protein, 19 aa, Giardia lamblia
AGCHLVGATVLGFPIDARS

SEQ ID NO: 3148712 - protein, 18 aa, Giardia lamblia
AGCLVEVEEQILLWQRKL

SEQ ID NO: 3148713 - protein, 17 aa, Giardia lamblia
AGCSASVRISIRVDGSV

SEQ ID NO: 3148714 - protein, 24 aa, Giardia lamblia
AGDAEDCPICLLPLNTDLSTVKLS

SEQ ID NO: 3148715 - protein, 25 aa, Giardia lamblia
AGDKSLHCRKSYLGKYYSLRYLDRI

SEQ ID NO: 3148716 - protein, 22 aa, Giardia lamblia
AGDPMAFILLCKLFAVTDDTVT

SEQ ID NO: 3148717 - protein, 33 aa, Giardia lamblia
AGDTGPFLPLFSRWAKSLARGVDPFSVPPSELS

SEQ ID NO: 3148718 - protein, 21 aa, Giardia lamblia
AGENKTLWGFNGCLTEHEAHE

SEQ ID NO: 3148719 - protein, 27 aa, Giardia lamblia
AGEVLSLDVCFCFSPGLDAGNTFLVSA

SEQ ID NO: 3148720 - protein, 23 aa, Giardia lamblia
AGFKLCRVQKIFLGDKGMPYLST

SEQ ID NO: 3148721 - protein, 22 aa, Giardia lamblia
AGFMKSSMLAKKFFILYQLCEE

SEQ ID NO: 3148722 - protein, 24 aa, Giardia lamblia
AGFSGLSFGPLVKRVHTEGFCAAL

SEQ ID NO: 3148723 - protein, 22 aa, Giardia lamblia
AGFSMKSGWTALMSAAWNGHLE

SEQ ID NO: 3148724 - protein, 17 aa, Giardia lamblia
AGGDWKTIEEIIRKRLH

SEQ ID NO: 3148725 - protein, 18 aa, Giardia lamblia
AGGKELSNVLILSYSITP

SEQ ID NO: 3148726 - protein, 19 aa, Giardia lamblia
AGGLRRTMIPPVQRKRKFQ

SEQ ID NO: 3148727 - protein, 27 aa, Giardia lamblia
AGGVYRYARPALHLSQADDLLVTDPQG

SEQ ID NO: 3148728 - protein, 20 aa, Giardia lamblia
AGHAELLLLAFLGRRYSCSP

SEQ ID NO: 3148729 - protein, 32 aa, Giardia lamblia
AGHAFYLPISHDLGIFSKFYSYRHETRTYAFV

SEQ ID NO: 3148730 - protein, 24 aa, Giardia lamblia
AGHGHLDCVRLLMKDGAGSTTSMD

SEQ ID NO: 3148731 - protein, 25 aa, Giardia lamblia
AGHIECVRILAPYEACLTDSEDKTA

SEQ ID NO: 3148732 - protein, 19 aa, Giardia lamblia
AGHIGDVRIAKSLFPSLGY

SEQ ID NO: 3148733 - protein, 30 aa, Giardia lamblia
AGHKDCVRGLRFFCPLARDCDGMNALMHAA

SEQ ID NO: 3148734 - protein, 25 aa, Giardia lamblia
AGHLECVKLLLSEIGIQKHTSVTVF

SEQ ID NO: 3148735 - protein, 21 aa, Giardia lamblia
AGHLECVRLLVEKEQRMQVNT

SEQ ID NO: 3148736 - protein, 17 aa, Giardia lamblia
AGHLPCVELLIPDEVGM

SEQ ID NO: 3148737 - protein, 19 aa, Giardia lamblia
AGHNCSLRNSGIGGNSGIP

SEQ ID NO: 3148738 - protein, 25 aa, Giardia lamblia
AGHPEVVELLLPYEYLIKTGDQKSA

SEQ ID NO: 3148739 - protein, 20 aa, Giardia lamblia
AGHSQMVCPGAMLVGNMTEK

SEQ ID NO: 3148740 - protein, 17 aa, Giardia lamblia
AGIAAQRPSLFNVMSQV

SEQ ID NO: 3148741 - protein, 18 aa, Giardia lamblia
AGIALGILLFQYVSSLYD

SEQ ID NO: 3148742 - protein, 20 aa, Giardia lamblia
AGIALRGMFIVSDKGVVRHV

SEQ ID NO: 3148743 - protein, 17 aa, Giardia lamblia
AGIKRKQIKMTNSIDDL

SEQ ID NO: 3148744 - protein, 24 aa, Giardia lamblia
AGISTNWGSTALMWAAQNNHIDSV

SEQ ID NO: 3148745 - protein, 21 aa, Giardia lamblia
AGITRPDGWTAMMYAASFGHC

SEQ ID NO: 3148746 - protein, 23 aa, Giardia lamblia
AGKGGLKALCYARASQPGPVYAL

SEQ ID NO: 3148747 - protein, 18 aa, Giardia lamblia
AGKHAVNGWTALMSACEH

SEQ ID NO: 3148748 - protein, 22 aa, Giardia lamblia
AGKKLAIYKVWLARFRTLCLVY

SEQ ID NO: 3148749 - protein, 24 aa, Giardia lamblia
AGKSLKLSILKSHMDMNTVLGEKN

SEQ ID NO: 3148750 - protein, 17 aa, Giardia lamblia
AGKSNCAQVLLRAEGKL

SEQ ID NO: 3148751 - protein, 22 aa, Giardia lamblia
AGKVLWLYRNVPTVKKAIKNCT

SEQ ID NO: 3148752 - protein, 20 aa, Giardia lamblia
AGLCSVADILSIVGPLNEAT

SEQ ID NO: 3148753 - protein, 17 aa, Giardia lamblia
AGLFARLISDPRAQGSF

SEQ ID NO: 3148754 - protein, 25 aa, Giardia lamblia
AGLGKQVCAAMRTFASKLSEFPKAD

SEQ ID NO: 3148755 - protein, 20 aa, Giardia lamblia
AGLGRAGAISGFTMTPSAAY

SEQ ID NO: 3148756 - protein, 17 aa, Giardia lamblia
AGLKNNDEWTALMISAK

SEQ ID NO: 3148757 - protein, 20 aa, Giardia lamblia
AGLLKCTIHHPVGPEALHPA

SEQ ID NO: 3148758 - protein, 24 aa, Giardia lamblia
AGLLRPGKHTALMLAAECGYHKCV

SEQ ID NO: 3148759 - protein, 25 aa, Giardia lamblia
AGLQTRNGWTALAFACREKNYLVVQ

SEQ ID NO: 3148760 - protein, 18 aa, Giardia lamblia
AGLSNIFRQGIQAMETQD

SEQ ID NO: 3148761 - protein, 23 aa, Giardia lamblia
AGLTRPHGWTALMDAASRNLSDI

SEQ ID NO: 3148762 - protein, 23 aa, Giardia lamblia
AGLVDHYGWFALLYAIDGACIKA

SEQ ID NO: 3148763 - protein, 18 aa, Giardia lamblia
AGLVRSATSFAMERAIEK

SEQ ID NO: 3148764 - protein, 25 aa, Giardia lamblia
AGLYENSNRLLLPIFPRIWSSSNRG

SEQ ID NO: 3148765 - protein, 19 aa, Giardia lamblia
AGMDLGWEASHAARAVLFA

SEQ ID NO: 3148766 - protein, 25 aa, Giardia lamblia
AGMKDSDGWTALRCAAQNGKQDCVK

SEQ ID NO: 3148767 - protein, 25 aa, Giardia lamblia
AGMLRSCGRYLLPGTALMHAVVCGH

SEQ ID NO: 3148768 - protein, 27 aa, Giardia lamblia
AGMNVVVGIIGICFLMRGEPTEEGFEQ

SEQ ID NO: 3148769 - protein, 26 aa, Giardia lamblia
AGMQTCCGWTALMFAAKAGHVKCVEL

SEQ ID NO: 3148770 - protein, 19 aa, Giardia lamblia
AGMTALMYAAARGFSEAVA

SEQ ID NO: 3148771 - protein, 22 aa, Giardia lamblia
AGMTMGDGWTALMCAAQNGHLG

SEQ ID NO: 3148772 - protein, 23 aa, Giardia lamblia
AGMYKEYGIVPSIEVASLLLSGI

SEQ ID NO: 3148773 - protein, 23 aa, Giardia lamblia
AGNFDICRILAAFEAGMSTVTGD

SEQ ID NO: 3148774 - protein, 17 aa, Giardia lamblia
AGNWRRIGDVAVKSGLQ

SEQ ID NO: 3148775 - protein, 25 aa, Giardia lamblia
AGPDVPCQVCSFAPGHTVRVQTDGG

SEQ ID NO: 3148776 - protein, 17 aa, Giardia lamblia
AGPLELLAVPHNKTRQP

SEQ ID NO: 3148777 - protein, 18 aa, Giardia lamblia
AGPSFGVSTGQLGRVGGS

SEQ ID NO: 3148778 - protein, 18 aa, Giardia lamblia
AGQICGGVEEPSYRMLTG

SEQ ID NO: 3148779 - protein, 17 aa, Giardia lamblia
AGQSCIFLWTYESGESV

SEQ ID NO: 3148780 - protein, 22 aa, Giardia lamblia
AGRFPSTRKGALGPEAGMTISK

SEQ ID NO: 3148781 - protein, 18 aa, Giardia lamblia
AGRGGRAPGICRLSTHRG

SEQ ID NO: 3148782 - protein, 20 aa, Giardia lamblia
AGRLPAPGFLAAPTAAGDSH

SEQ ID NO: 3148783 - protein, 23 aa, Giardia lamblia
AGRRRLAIMRSFYLDKLAIYERA

SEQ ID NO: 3148784 - protein, 22 aa, Giardia lamblia
AGSAVGVVRLGMRFPTEYYRSL

SEQ ID NO: 3148785 - protein, 19 aa, Giardia lamblia
AGSDAFLIINICRTTAYYT

SEQ ID NO: 3148786 - protein, 22 aa, Giardia lamblia
AGSDRPAECIYEDISTVFAGRY

SEQ ID NO: 3148787 - protein, 24 aa, Giardia lamblia
AGSFVRLLPFYFKYENIHSTQPDS

SEQ ID NO: 3148788 - protein, 24 aa, Giardia lamblia
AGSIDCVRLLLNYYGMERDNHNLT

SEQ ID NO: 3148789 - protein, 21 aa, Giardia lamblia
AGSIFEWLRTMGMITSVTDID

SEQ ID NO: 3148790 - protein, 19 aa, Giardia lamblia
AGSILKSCMPLIEVNVHPR

SEQ ID NO: 3148791 - protein, 18 aa, Giardia lamblia
AGSIYVLDETMAKALWRA

SEQ ID NO: 3148792 - protein, 25 aa, Giardia lamblia
AGSPGYRAEQIIKLLPRTTDTSRKD

SEQ ID NO: 3148793 - protein, 26 aa, Giardia lamblia
AGSPRSGALLTRFSDFNLREEVLQAI

SEQ ID NO: 3148794 - protein, 19 aa, Giardia lamblia
AGSRFAGPGSQVSASDQRA

SEQ ID NO: 3148795 - protein, 25 aa, Giardia lamblia
AGSVDILRLLLCESRNTNLIGETAL

SEQ ID NO: 3148796 - protein, 19 aa, Giardia lamblia
AGSVIKSIPINSAYLKYLR

SEQ ID NO: 3148797 - protein, 19 aa, Giardia lamblia
AGSVTSFKAVTICRNRSKS

SEQ ID NO: 3148798 - protein, 27 aa, Giardia lamblia
AGSYECCKELLGFLGPERDSNGMGALE

SEQ ID NO: 3148799 - protein, 17 aa, Giardia lamblia
AGTICMKMYEDIREKNT

SEQ ID NO: 3148800 - protein, 19 aa, Giardia lamblia
AGTKEWALAILHRILSLKF

SEQ ID NO: 3148801 - protein, 34 aa, Giardia lamblia
AGTPYRMYWDLKFHHMTTAFVRRIIEYFEAIIHD

SEQ ID NO: 3148802 - protein, 21 aa, Giardia lamblia
AGTVCCFRHTPLFSTASKLVY

SEQ ID NO: 3148803 - protein, 19 aa, Giardia lamblia
AGVALCLLNNPQIRILVCA

SEQ ID NO: 3148804 - protein, 25 aa, Giardia lamblia
AGVLRAATMSDLFDLGRLFVSHRLP

SEQ ID NO: 3148805 - protein, 24 aa, Giardia lamblia
AGVYRNDIAYDFGYYSEAFKTRRF

SEQ ID NO: 3148806 - protein, 17 aa, Giardia lamblia
AGYDCMDDGLKSILSDI

SEQ ID NO: 3148807 - protein, 20 aa, Giardia lamblia
AGYSPRFKKSVNENGMTALM

SEQ ID NO: 3148808 - protein, 17 aa, Giardia lamblia
AHAAAFDLMDRIEKLEN

SEQ ID NO: 3148809 - protein, 25 aa, Giardia lamblia
AHAHAEIQAAIPLFQRSVDSLGQTA

SEQ ID NO: 3148810 - protein, 28 aa, Giardia lamblia
AHAQGRFCILQACLKWAPNSIKLVEACD

SEQ ID NO: 3148811 - protein, 27 aa, Giardia lamblia
AHCHFSSAFVGTWFRPDHVYLLNATDP

SEQ ID NO: 3148812 - protein, 18 aa, Giardia lamblia
AHDAFIRYGGTGHLPGSG

SEQ ID NO: 3148813 - protein, 24 aa, Giardia lamblia
AHEDIRLVPPQVFESMLQTVQQPT

SEQ ID NO: 3148814 - protein, 25 aa, Giardia lamblia
AHEGHLDCVHILIRKENGMVCSNGM

SEQ ID NO: 3148815 - protein, 17 aa, Giardia lamblia
AHELPPSPSVYIGPGRS

SEQ ID NO: 3148816 - protein, 17 aa, Giardia lamblia
AHGACLASDIYLSDPRS

SEQ ID NO: 3148817 - protein, 20 aa, Giardia lamblia
AHGGDPIFHGAPWLILISTG

SEQ ID NO: 3148818 - protein, 26 aa, Giardia lamblia
AHGGGKFSSQRPQGFTSESNRSERDA

SEQ ID NO: 3148819 - protein, 19 aa, Giardia lamblia
AHHSCAFYTPEVAFLKAKD

SEQ ID NO: 3148820 - protein, 18 aa, Giardia lamblia
AHIEMGRLVTQLPNPVVL

SEQ ID NO: 3148821 - protein, 23 aa, Giardia lamblia
AHILKLKHLRLIGTEGTSGIRIF

SEQ ID NO: 3148822 - protein, 18 aa, Giardia lamblia
AHINIADLRLCMRKTDKV

SEQ ID NO: 3148823 - protein, 22 aa, Giardia lamblia
AHIQCLPPQFQGHLRTSGHYMC

SEQ ID NO: 3148824 - protein, 37 aa, Giardia lamblia
AHKGAIKALCWQPYYRLLFSGGVDGLVKVWDPSFTDF

SEQ ID NO: 3148825 - protein, 23 aa, Giardia lamblia
AHKKHCLELILSEIINANSQCKA

SEQ ID NO: 3148826 - protein, 20 aa, Giardia lamblia
AHKVPRAGVIVRDPALDDSK

SEQ ID NO: 3148827 - protein, 19 aa, Giardia lamblia
AHLAFCAKKDIVLSKSDEI

SEQ ID NO: 3148828 - protein, 18 aa, Giardia lamblia
AHLCFRLAEMKYISGDAA

SEQ ID NO: 3148829 - protein, 23 aa, Giardia lamblia
AHLGLLFTPSFESVVLDRRQEAP

SEQ ID NO: 3148830 - protein, 24 aa, Giardia lamblia
AHLHEACIFPPVTTKLSSTLETVL

SEQ ID NO: 3148831 - protein, 17 aa, Giardia lamblia
AHLKGSKLFDVLNNSKT

SEQ ID NO: 3148832 - protein, 33 aa, Giardia lamblia
AHLKTTLKSCLPAYLQSCQTYPPLDGKVNTNEA

SEQ ID NO: 3148833 - protein, 17 aa, Giardia lamblia
AHLLEAYLANPRSVSPS

SEQ ID NO: 3148834 - protein, 20 aa, Giardia lamblia
AHLSPCFRVKEGDIVTIGEC

SEQ ID NO: 3148835 - protein, 29 aa, Giardia lamblia
AHLTPKVMYRFVTWLPAVVKRSLDSEFIR

SEQ ID NO: 3148836 - protein, 24 aa, Giardia lamblia
AHNLAMPVAMRLAGTCAQLHLQNG

SEQ ID NO: 3148837 - protein, 22 aa, Giardia lamblia
AHNPRPPLPSYLESPPTVDLPG

SEQ ID NO: 3148838 - protein, 19 aa, Giardia lamblia
AHNRFGLSGTSSFGAAAAR

SEQ ID NO: 3148839 - protein, 25 aa, Giardia lamblia
AHNSLDCLKALAPHESGRKAIKEDG

SEQ ID NO: 3148840 - protein, 26 aa, Giardia lamblia
AHNSPFCSVYFLALCERSKQTHKAGA

SEQ ID NO: 3148841 - protein, 26 aa, Giardia lamblia
AHPDSCNLVLIKILFGSPEFTRFSHE

SEQ ID NO: 3148842 - protein, 19 aa, Giardia lamblia
AHPFEAYNIECYYAASKFL

SEQ ID NO: 3148843 - protein, 20 aa, Giardia lamblia
AHPIIPKLCFLGNSTDQRPA

SEQ ID NO: 3148844 - protein, 22 aa, Giardia lamblia
AHPRLGPGPGLASRRPPALREK

SEQ ID NO: 3148845 - protein, 23 aa, Giardia lamblia
AHPTQRLALLSSFAKEPMVFMRR

SEQ ID NO: 3148846 - protein, 21 aa, Giardia lamblia
AHPVQCVWLSDVWAGPSSHRT

SEQ ID NO: 3148847 - protein, 23 aa, Giardia lamblia
AHQLRGLASFRMGDRHAAEKHLF

SEQ ID NO: 3148848 - protein, 17 aa, Giardia lamblia
AHQVPRKAKHGGNGGKA

SEQ ID NO: 3148849 - protein, 24 aa, Giardia lamblia
AHREFMVLYEFDYRLTEFSLITYL

SEQ ID NO: 3148850 - protein, 21 aa, Giardia lamblia
AHRILCYLVEEGLRSGHSYSA

SEQ ID NO: 3148851 - protein, 27 aa, Giardia lamblia
AHRLVPFSLAVINWLGSHYIKNELYEQ

SEQ ID NO: 3148852 - protein, 25 aa, Giardia lamblia
AHRVPLRYIRALRRVIPLKLLVQVG

SEQ ID NO: 3148853 - protein, 22 aa, Giardia lamblia
AHSKINHYAICRIEEMHHDQHR

SEQ ID NO: 3148854 - protein, 18 aa, Giardia lamblia
AHSLLRWHAVPLSVHPSF

SEQ ID NO: 3148855 - protein, 22 aa, Giardia lamblia
AHSNIIRYHGLFVHAYYVYNVT

SEQ ID NO: 3148856 - protein, 25 aa, Giardia lamblia
AHTAFKSSFTCFTRRVKKEISPIEI

SEQ ID NO: 3148857 - protein, 23 aa, Giardia lamblia
AHTEVTTVCGFKMQDTIPSTYRI

SEQ ID NO: 3148858 - protein, 21 aa, Giardia lamblia
AHTGAVLSCRLLTKLEILGQG

SEQ ID NO: 3148859 - protein, 18 aa, Giardia lamblia
AHTKYGLYSLHTQQIEWQ

SEQ ID NO: 3148860 - protein, 21 aa, Giardia lamblia
AHTRGGLLHRAFSVVTVDNQK

SEQ ID NO: 3148861 - protein, 20 aa, Giardia lamblia
AHVQALREEVERVRHTSENL

SEQ ID NO: 3148862 - protein, 26 aa, Giardia lamblia
AHYAFGEEITSIFAGLEPAIKAFGVE

SEQ ID NO: 3148863 - protein, 18 aa, Giardia lamblia
AHYREAPLYRKIGTAVCY

SEQ ID NO: 3148864 - protein, 25 aa, Giardia lamblia
AIAALRNYSSVCLLLVKYEKSVPLH

SEQ ID NO: 3148865 - protein, 18 aa, Giardia lamblia
AIAGLCFDESCLHLTHAL

SEQ ID NO: 3148866 - protein, 25 aa, Giardia lamblia
AIAIFRSVLKFSVEQVADVFALYAR

SEQ ID NO: 3148867 - protein, 26 aa, Giardia lamblia
AIAKNAISCAFTLLPSERKKTDLTGL

SEQ ID NO: 3148868 - protein, 19 aa, Giardia lamblia
AIALITGARIIPRFEDISS

SEQ ID NO: 3148869 - protein, 24 aa, Giardia lamblia
AIARDFYPVCARLFELESKMILPN

SEQ ID NO: 3148870 - protein, 18 aa, Giardia lamblia
AIAVSALRSVDPDSGLAF

SEQ ID NO: 3148871 - protein, 23 aa, Giardia lamblia
AIAYDIAQGLAYFHTRHYTDSNR

SEQ ID NO: 3148872 - protein, 18 aa, Giardia lamblia
AIAYFRKFIFPCVRAGYT

SEQ ID NO: 3148873 - protein, 19 aa, Giardia lamblia
AICGHVEMARLLVEREARI

SEQ ID NO: 3148874 - protein, 18 aa, Giardia lamblia
AICKSFTNIEQFNIQTNF

SEQ ID NO: 3148875 - protein, 22 aa, Giardia lamblia
AIDHCCRIARILSSPSGHALLI

SEQ ID NO: 3148876 - protein, 27 aa, Giardia lamblia
AIDNCYEEGCAVLCQYEAKILNKQGKY

SEQ ID NO: 3148877 - protein, 20 aa, Giardia lamblia
AIDSYPAIRYFFNLADGDHD

SEQ ID NO: 3148878 - protein, 25 aa, Giardia lamblia
AIDYEKFLRICGLADNEARPSDDLS

SEQ ID NO: 3148879 - protein, 21 aa, Giardia lamblia
AIELCLGRTDYDYCVDVYSLG

SEQ ID NO: 3148880 - protein, 19 aa, Giardia lamblia
AIERLRSSSSITVPFVKCI

SEQ ID NO: 3148881 - protein, 18 aa, Giardia lamblia
AIESRPSKHVLLTSPNDS

SEQ ID NO: 3148882 - protein, 24 aa, Giardia lamblia
AIFFFRPVYTYPFGLIQLLSDTRV

SEQ ID NO: 3148883 - protein, 18 aa, Giardia lamblia
AIFPSPRGSDLLLQSLLV

SEQ ID NO: 3148884 - protein, 23 aa, Giardia lamblia
AIGGGVWYRLFVDVKPAFQALCF

SEQ ID NO: 3148885 - protein, 19 aa, Giardia lamblia
AIGTCYEGGTFSDTHDFIG

SEQ ID NO: 3148886 - protein, 19 aa, Giardia lamblia
AIHETPCIISKAYSNILQK

SEQ ID NO: 3148887 - protein, 27 aa, Giardia lamblia
AIHNHIECARILIAYERACRDANGMTA

SEQ ID NO: 3148888 - protein, 26 aa, Giardia lamblia
AIHTERWEFGHGFIDSMANKAEDAAA

SEQ ID NO: 3148889 - protein, 24 aa, Giardia lamblia
AIIADDYLLGWSLFQVQSGLQDKD

SEQ ID NO: 3148890 - protein, 26 aa, Giardia lamblia
AIIEGLRSRCFLLSFNALTSKDILQI

SEQ ID NO: 3148891 - protein, 19 aa, Giardia lamblia
AIIESGCYPAVNQAIREAH

SEQ ID NO: 3148892 - protein, 18 aa, Giardia lamblia
AIIHRDLKPTNILVNSTE

SEQ ID NO: 3148893 - protein, 19 aa, Giardia lamblia
AIIHSSINRFSFYRDEDPR

SEQ ID NO: 3148894 - protein, 25 aa, Giardia lamblia
AIIKKNYLLCLLRLTFHTWLSTFLH

SEQ ID NO: 3148895 - protein, 25 aa, Giardia lamblia
AIISLLPYQKCRADVDGRTAMMHAV

SEQ ID NO: 3148896 - protein, 23 aa, Giardia lamblia
AIITCPTWRCLRYYNTHYERCLE

SEQ ID NO: 3148897 - protein, 21 aa, Giardia lamblia
AIKAGFTGGLIIDYPNSTMAK

SEQ ID NO: 3148898 - protein, 17 aa, Giardia lamblia
AIKARMIIDSRGTPTTE

SEQ ID NO: 3148899 - protein, 19 aa, Giardia lamblia
AIKGMAARKQRLYTEELST

SEQ ID NO: 3148900 - protein, 29 aa, Giardia lamblia
AIKHICRLALPILTAHVIKYNLLGRVSVQ

SEQ ID NO: 3148901 - protein, 18 aa, Giardia lamblia
AIKKDLYALARASRQSRH

SEQ ID NO: 3148902 - protein, 27 aa, Giardia lamblia
AIKKYSPRLPVLIFVASRRQTRRTAMA

SEQ ID NO: 3148903 - protein, 18 aa, Giardia lamblia
AIKLRTMSRHKLSPKELD

SEQ ID NO: 3148904 - protein, 23 aa, Giardia lamblia
AIKLSDIRLGPLFDDDEPTAFRA

SEQ ID NO: 3148905 - protein, 18 aa, Giardia lamblia
AIKNNLYSIPAWKPGRHH

SEQ ID NO: 3148906 - protein, 17 aa, Giardia lamblia
AIKRAYRKQALRWHPDK

SEQ ID NO: 3148907 - protein, 26 aa, Giardia lamblia
AIKSRYRLRLERILAKCKKICINPDD

SEQ ID NO: 3148908 - protein, 19 aa, Giardia lamblia
AIKYCFLKKSANYAPGYMH

SEQ ID NO: 3148909 - protein, 24 aa, Giardia lamblia
AILAGENARLRACIGSLVEPSALP

SEQ ID NO: 3148910 - protein, 24 aa, Giardia lamblia
AILCALGSIVTARAWTLIEYSNKI

SEQ ID NO: 3148911 - protein, 19 aa, Giardia lamblia
AILCDRFTENFNRSVKKSR

SEQ ID NO: 3148912 - protein, 18 aa, Giardia lamblia
AILEFGRELIRHSPQDIC

SEQ ID NO: 3148913 - protein, 27 aa, Giardia lamblia
AILISAIYFKANWALKFSKDDTKMLPF

SEQ ID NO: 3148914 - protein, 24 aa, Giardia lamblia
AILNHEVNSILLLDVAPLSLGLET

SEQ ID NO: 3148915 - protein, 21 aa, Giardia lamblia
AILPKECDQFIKGVLSAYQRA

SEQ ID NO: 3148916 - protein, 17 aa, Giardia lamblia
AILPRNEYFLDYMAVTA

SEQ ID NO: 3148917 - protein, 17 aa, Giardia lamblia
AILSRKLECTVILAPYE

SEQ ID NO: 3148918 - protein, 26 aa, Giardia lamblia
AILTRYKDLLGIFAAESFFKDMADSA

SEQ ID NO: 3148919 - protein, 17 aa, Giardia lamblia
AILWDFKQVCLGVTDYS

SEQ ID NO: 3148920 - protein, 18 aa, Giardia lamblia
AIMKSFYETGFVSLKQLS

SEQ ID NO: 3148921 - protein, 18 aa, Giardia lamblia
AIMNACIQSLPIYYSDEL

SEQ ID NO: 3148922 - protein, 31 aa, Giardia lamblia
AINHDIRPSFIFKLLDHFLSVFPGVAFHSAI

SEQ ID NO: 3148923 - protein, 21 aa, Giardia lamblia
AINILCFLNTFSPIGINIPNY

SEQ ID NO: 3148924 - protein, 42 aa, Giardia lamblia
AIPEGMPALSGRIMWSRILLNRVRVPFTRFEVLNDALIQLRT

SEQ ID NO: 3148925 - protein, 17 aa, Giardia lamblia
AIPGAKNPPIFSAELSY

SEQ ID NO: 3148926 - protein, 33 aa, Giardia lamblia
AIPKQGWDIKDRWYAGASALHFAAHGNQKAVIG

SEQ ID NO: 3148927 - protein, 22 aa, Giardia lamblia
AIPYPRSLAYIYYKLITLSYLS

SEQ ID NO: 3148928 - protein, 24 aa, Giardia lamblia
AIQGIRGSHLIKCTPPEELHSRPA

SEQ ID NO: 3148929 - protein, 26 aa, Giardia lamblia
AIQNDFYEAIKILLPLEGIDISQNNV

SEQ ID NO: 3148930 - protein, 19 aa, Giardia lamblia
AIREAKISGFRGFLAEHIN

SEQ ID NO: 3148931 - protein, 19 aa, Giardia lamblia
AIRIVRLLIQHFKDISPET

SEQ ID NO: 3148932 - protein, 22 aa, Giardia lamblia
AIRKEIFAQIASQVYSVTDPSF

SEQ ID NO: 3148933 - protein, 19 aa, Giardia lamblia
AIRLCKRCGDMDALTDVCL

SEQ ID NO: 3148934 - protein, 21 aa, Giardia lamblia
AIRRASGKILKTIPESLSRYD

SEQ ID NO: 3148935 - protein, 23 aa, Giardia lamblia
AIRRRCLPLIYARLTEDQADATA

SEQ ID NO: 3148936 - protein, 25 aa, Giardia lamblia
AIRVVNPRTGIDMGNGAVNRTQDSS

SEQ ID NO: 3148937 - protein, 19 aa, Giardia lamblia
AISAFLIRPNDPMIRKQIV

SEQ ID NO: 3148938 - protein, 22 aa, Giardia lamblia
AISEIYSQFSFVERLSVAGRRL

SEQ ID NO: 3148939 - protein, 27 aa, Giardia lamblia
AISHRLICLLSGWTRAPLRVLGNGRKS

SEQ ID NO: 3148940 - protein, 23 aa, Giardia lamblia
AISKILCRRIAGCQGTDSISPPA

SEQ ID NO: 3148941 - protein, 24 aa, Giardia lamblia
AISMQCSRLLPLQGQQHYTLSFLP

SEQ ID NO: 3148942 - protein, 20 aa, Giardia lamblia
AISPAFRTAFVKEVRAGQRL

SEQ ID NO: 3148943 - protein, 22 aa, Giardia lamblia
AISPRLAQRLINRGLNKVTTRN

SEQ ID NO: 3148944 - protein, 22 aa, Giardia lamblia
AISQDTLMIFCVQRGFACGNST

SEQ ID NO: 3148945 - protein, 18 aa, Giardia lamblia
AISRCKDCNYFKKRLEEA

SEQ ID NO: 3148946 - protein, 24 aa, Giardia lamblia
AISRCKYVEQCIMHGSRFESCVLC

SEQ ID NO: 3148947 - protein, 25 aa, Giardia lamblia
AISSTFVAAWSWALPAIYFENKRFD

SEQ ID NO: 3148948 - protein, 24 aa, Giardia lamblia
AISSYKPAIRNLCPQPESHPRDYS

SEQ ID NO: 3148949 - protein, 19 aa, Giardia lamblia
AITLEAGLLALRDRRIRVC

SEQ ID NO: 3148950 - protein, 17 aa, Giardia lamblia
AITLRLLSSPVLINALR

SEQ ID NO: 3148951 - protein, 33 aa, Giardia lamblia
AITRGYRLVFHTGQFRYLFSDMLLGRPTIFAAS

SEQ ID NO: 3148952 - protein, 22 aa, Giardia lamblia
AIVELYAAHGIQGITDDEYATY

SEQ ID NO: 3148953 - protein, 19 aa, Giardia lamblia
AIYHQHCASVAAPGMAPEL

SEQ ID NO: 3148954 - protein, 29 aa, Giardia lamblia
AIYLRSAICAICHAPAPFSARFSAQTEEI

SEQ ID NO: 3148955 - protein, 20 aa, Giardia lamblia
AIYMHMALCYYKLGDYLKSE

SEQ ID NO: 3148956 - protein, 17 aa, Giardia lamblia
AKAALSRCLGSDHISTR

SEQ ID NO: 3148957 - protein, 19 aa, Giardia lamblia
AKAAMLNHYFARAYKGRLH

SEQ ID NO: 3148958 - protein, 23 aa, Giardia lamblia
AKADIYPSLFYVCHRDGYLREAG

SEQ ID NO: 3148959 - protein, 19 aa, Giardia lamblia
AKAGPGRPSSARSPYPGID

SEQ ID NO: 3148960 - protein, 23 aa, Giardia lamblia
AKAIDCVKVLLPYESNIKTFKEK

SEQ ID NO: 3148961 - protein, 17 aa, Giardia lamblia
AKAKLAALQKLEKDHDK

SEQ ID NO: 3148962 - protein, 17 aa, Giardia lamblia
AKAKLLRGRRHANKRSW

SEQ ID NO: 3148963 - protein, 26 aa, Giardia lamblia
AKALNRESWKYAFAMDTSEEEREKGK

SEQ ID NO: 3148964 - protein, 28 aa, Giardia lamblia
AKALRARQLRMMFGLSRVSEANGGTSQE

SEQ ID NO: 3148965 - protein, 22 aa, Giardia lamblia
AKAMVYPEMVSLLSSSVSSTGG

SEQ ID NO: 3148966 - protein, 32 aa, Giardia lamblia
AKAPDFFAKLSHFLMQMGLEYVNQMNKQNDTT

SEQ ID NO: 3148967 - protein, 24 aa, Giardia lamblia
AKASEASGFCYANDLVLGILELLK

SEQ ID NO: 3148968 - protein, 20 aa, Giardia lamblia
AKASSFQSIVEVLRTADENL

SEQ ID NO: 3148969 - protein, 17 aa, Giardia lamblia
AKASYTSSVMRLSGAQQ

SEQ ID NO: 3148970 - protein, 18 aa, Giardia lamblia
AKAYIERPLLVSGGSLLA

SEQ ID NO: 3148971 - protein, 25 aa, Giardia lamblia
AKCCRVECVEILAPYEAKMTDKKGH

SEQ ID NO: 3148972 - protein, 23 aa, Giardia lamblia
AKCIESFALLYVLFLARYSFIDT

SEQ ID NO: 3148973 - protein, 30 aa, Giardia lamblia
AKDGVQWRIFVLIAKIYFIRSCKSNVSDYW

SEQ ID NO: 3148974 - protein, 17 aa, Giardia lamblia
AKDMFYFVQEYFPCTLH

SEQ ID NO: 3148975 - protein, 25 aa, Giardia lamblia
AKDMLPLFYLIGALTVEYHKESRLT

SEQ ID NO: 3148976 - protein, 29 aa, Giardia lamblia
AKDMQLHPVWKYLFAFYAALYKAHGENGA

SEQ ID NO: 3148977 - protein, 20 aa, Giardia lamblia
AKDSCIERLVALLYVSPNTL

SEQ ID NO: 3148978 - protein, 19 aa, Giardia lamblia
AKDSFGYTALMIASLKGHI

SEQ ID NO: 3148979 - protein, 25 aa, Giardia lamblia
AKDVLIKRLCVFQHVSHPHVLEYFW

SEQ ID NO: 3148980 - protein, 22 aa, Giardia lamblia
AKDYRQYICSYIRRNRIQLDVP

SEQ ID NO: 3148981 - protein, 19 aa, Giardia lamblia
AKEAERLASPRLRSNEHTS

SEQ ID NO: 3148982 - protein, 18 aa, Giardia lamblia
AKEALQIELARMETAMAR

SEQ ID NO: 3148983 - protein, 23 aa, Giardia lamblia
AKEEEKARCLEVTYETLKAQYTD

SEQ ID NO: 3148984 - protein, 23 aa, Giardia lamblia
AKEGRLADAIDCYTKAINIDGSN

SEQ ID NO: 3148985 - protein, 25 aa, Giardia lamblia
AKEKPASASSNWDAVASIDEEVTRL

SEQ ID NO: 3148986 - protein, 23 aa, Giardia lamblia
AKEKRSRLLGKMRCFICGARDHY

SEQ ID NO: 3148987 - protein, 17 aa, Giardia lamblia
AKELISSVCKVIEANIV

SEQ ID NO: 3148988 - protein, 21 aa, Giardia lamblia
AKELLIALCALMKRVDDEACA

SEQ ID NO: 3148989 - protein, 25 aa, Giardia lamblia
AKELRANSFALKYAGTVLEVLGSAR

SEQ ID NO: 3148990 - protein, 26 aa, Giardia lamblia
AKENDGVGCAILFIDEIDCIAGNRAE

SEQ ID NO: 3148991 - protein, 18 aa, Giardia lamblia
AKESPPPHKLRHDLTGSC

SEQ ID NO: 3148992 - protein, 22 aa, Giardia lamblia
AKEVTFPVVMKIVSPQIIHKSD

SEQ ID NO: 3148993 - protein, 22 aa, Giardia lamblia
AKEYLSQLIINGDLPFVIEEGA

SEQ ID NO: 3148994 - protein, 20 aa, Giardia lamblia
AKFEDLCIDLFRKCLDPVDR

SEQ ID NO: 3148995 - protein, 20 aa, Giardia lamblia
AKFGSVVLRDFIVGTSRGSI

SEQ ID NO: 3148996 - protein, 21 aa, Giardia lamblia
AKFPFLVELEHSIADGKKWTS

SEQ ID NO: 3148997 - protein, 18 aa, Giardia lamblia
AKFPRFVVSSEHGLLALK

SEQ ID NO: 3148998 - protein, 18 aa, Giardia lamblia
AKFSREWKLHQVVKARLD

SEQ ID NO: 3148999 - protein, 18 aa, Giardia lamblia
AKFVPTEEIIRIEKIDPP

SEQ ID NO: 3149000 - protein, 21 aa, Giardia lamblia
AKGECGLPPLLYSANTITSYL

SEQ ID NO: 3149001 - protein, 19 aa, Giardia lamblia
AKGHLYFLALDRELYIDAA

SEQ ID NO: 3149002 - protein, 25 aa, Giardia lamblia
AKGSNIRVSLCFAKDELNEGELNPT

SEQ ID NO: 3149003 - protein, 26 aa, Giardia lamblia
AKGTSPHCVALAWHVKKWNTSMYSVI

SEQ ID NO: 3149004 - protein, 19 aa, Giardia lamblia
AKGVMRLAFMTRALQEQRD

SEQ ID NO: 3149005 - protein, 20 aa, Giardia lamblia
AKGVWPSVLSATSINSSGMY

SEQ ID NO: 3149006 - protein, 33 aa, Giardia lamblia
AKHEGGCKMIKGWTAMMCCVCRASSTTAQNLCT

SEQ ID NO: 3149007 - protein, 25 aa, Giardia lamblia
AKHFFFSSFICMTFFQEEAQLRDAL

SEQ ID NO: 3149008 - protein, 21 aa, Giardia lamblia
AKHLCIRFYNILNVMQRRYTQ

SEQ ID NO: 3149009 - protein, 20 aa, Giardia lamblia
AKIAVLTCPFEPPKPKTTYK

SEQ ID NO: 3149010 - protein, 20 aa, Giardia lamblia
AKIELSLSCNSDGTLTLESR

SEQ ID NO: 3149011 - protein, 27 aa, Giardia lamblia
AKIKGNYPTSLPFIVPHADGDRTLSLV

SEQ ID NO: 3149012 - protein, 18 aa, Giardia lamblia
AKILKLRASVEEIPLTSA

SEQ ID NO: 3149013 - protein, 17 aa, Giardia lamblia
AKILTEYGVLPVICDLT

SEQ ID NO: 3149014 - protein, 26 aa, Giardia lamblia
AKIQSIWRDRLRSVKKTELIKQIESL

SEQ ID NO: 3149015 - protein, 20 aa, Giardia lamblia
AKIRHLRAVSSFAGNQTKTH

SEQ ID NO: 3149016 - protein, 24 aa, Giardia lamblia
AKIRSCKRCQETSIELRILEKENR

SEQ ID NO: 3149017 - protein, 20 aa, Giardia lamblia
AKISGFRGFLAEHINAAVGS

SEQ ID NO: 3149018 - protein, 28 aa, Giardia lamblia
AKITGNIPLLIRRIRLSFLQLAECEDSE

SEQ ID NO: 3149019 - protein, 25 aa, Giardia lamblia
AKIYELRKISALLAMEGKTVAGIYE

SEQ ID NO: 3149020 - protein, 24 aa, Giardia lamblia
AKIYRISPEMVIQMNMLLILKELL

SEQ ID NO: 3149021 - protein, 19 aa, Giardia lamblia
AKKCNIKSSSVRSLLWRLR

SEQ ID NO: 3149022 - protein, 20 aa, Giardia lamblia
AKKFAFPCHFCHDLEVDHHT

SEQ ID NO: 3149023 - protein, 21 aa, Giardia lamblia
AKKLGNVKVRWLDELYPSLHM

SEQ ID NO: 3149024 - protein, 23 aa, Giardia lamblia
AKKLVICRCFASRHPVSMYFIGP

SEQ ID NO: 3149025 - protein, 17 aa, Giardia lamblia
AKKNMKPIYERYAETME

SEQ ID NO: 3149026 - protein, 25 aa, Giardia lamblia
AKKPKSGSSLGHISSMPPHRAGSNL

SEQ ID NO: 3149027 - protein, 24 aa, Giardia lamblia
AKLIPTSALCQWAVELLSGTHSSL

SEQ ID NO: 3149028 - protein, 20 aa, Giardia lamblia
AKLKDTILIYEQMLTKTKQR

SEQ ID NO: 3149029 - protein, 27 aa, Giardia lamblia
AKLLDFDYRLSLFFEKCTQYLYERIFE

SEQ ID NO: 3149030 - protein, 17 aa, Giardia lamblia
AKLLFGIPQLFSEEVTN

SEQ ID NO: 3149031 - protein, 20 aa, Giardia lamblia
AKLLLEKEGCMQRSYGQTAL

SEQ ID NO: 3149032 - protein, 20 aa, Giardia lamblia
AKLLLERESCVQSRDGWTAL

SEQ ID NO: 3149033 - protein, 19 aa, Giardia lamblia
AKLPLFMRQKIAKVKSITA

SEQ ID NO: 3149034 - protein, 20 aa, Giardia lamblia
AKLPLHKYCNLIGSAVLSVN

SEQ ID NO: 3149035 - protein, 19 aa, Giardia lamblia
AKLPPLYQPMHSYAKTANL

SEQ ID NO: 3149036 - protein, 20 aa, Giardia lamblia
AKLRIEYERVLTELQETHAA

SEQ ID NO: 3149037 - protein, 24 aa, Giardia lamblia
AKLTGRPVPQRKALNSDDSNDFTD

SEQ ID NO: 3149038 - protein, 18 aa, Giardia lamblia
AKMFLERFDSLIQDTREN

SEQ ID NO: 3149039 - protein, 25 aa, Giardia lamblia
AKNARLNIVPVRRGFWGGKLGDPHT

SEQ ID NO: 3149040 - protein, 25 aa, Giardia lamblia
AKNDVYTVWCLRSLQGGLTDLSGRT

SEQ ID NO: 3149041 - protein, 20 aa, Giardia lamblia
AKNGNVECCLLLIDHEKRRQ

SEQ ID NO: 3149042 - protein, 23 aa, Giardia lamblia
AKNLRPAVPQHLLDTYVMTYIQD

SEQ ID NO: 3149043 - protein, 25 aa, Giardia lamblia
AKNNRPSTCELLLGEAGLRTSEGHP

SEQ ID NO: 3149044 - protein, 18 aa, Giardia lamblia
AKNPYKILPEKREYMQEA

SEQ ID NO: 3149045 - protein, 17 aa, Giardia lamblia
AKNYVAFTADARDTQLH

SEQ ID NO: 3149046 - protein, 25 aa, Giardia lamblia
AKPLLPFTIGLSYIFQDVYTHLTAT

SEQ ID NO: 3149047 - protein, 23 aa, Giardia lamblia
AKPRTVSRVSVLRSPTVPTREAT

SEQ ID NO: 3149048 - protein, 30 aa, Giardia lamblia
AKPTKKRRIRVCLDYCKYSVIHEICERRGW

SEQ ID NO: 3149049 - protein, 32 aa, Giardia lamblia
AKPYVPETCKVRYPRLPIPSGDVGETDSVLSI

SEQ ID NO: 3149050 - protein, 20 aa, Giardia lamblia
AKQDGCISYSRSRAGSRALS

SEQ ID NO: 3149051 - protein, 18 aa, Giardia lamblia
AKQEGRRTLAQGGMAAES

SEQ ID NO: 3149052 - protein, 19 aa, Giardia lamblia
AKQEMILKLEMALDDLSSK

SEQ ID NO: 3149053 - protein, 17 aa, Giardia lamblia
AKQFKFSNVGIYLNASS

SEQ ID NO: 3149054 - protein, 22 aa, Giardia lamblia
AKQIRCGRVFSEISRDLRDYTL

SEQ ID NO: 3149055 - protein, 24 aa, Giardia lamblia
AKQITWGDLKAVFEHASPIMNYLM

SEQ ID NO: 3149056 - protein, 23 aa, Giardia lamblia
AKQKRVGLCSLLAPLEAGIQDQA

SEQ ID NO: 3149057 - protein, 25 aa, Giardia lamblia
AKQLFKEEIDSFLIKAAAEKGDKVE

SEQ ID NO: 3149058 - protein, 18 aa, Giardia lamblia
AKRAEDRYNESIQKVSDL

SEQ ID NO: 3149059 - protein, 35 aa, Giardia lamblia
AKRAYAERLAWFLLLRTRFIGLLSARDQYVRRIRS

SEQ ID NO: 3149060 - protein, 17 aa, Giardia lamblia
AKRDYSLELQRIHESLS

SEQ ID NO: 3149061 - protein, 30 aa, Giardia lamblia
AKRFSASDLYSFPALRDYYAPASEGWGLDF

SEQ ID NO: 3149062 - protein, 23 aa, Giardia lamblia
AKRGPRLALPETISTSTVVNGTI

SEQ ID NO: 3149063 - protein, 23 aa, Giardia lamblia
AKRGYTEIVEILAPHEANYTRSN

SEQ ID NO: 3149064 - protein, 17 aa, Giardia lamblia
AKRKLQAEIDRLKELAD

SEQ ID NO: 3149065 - protein, 31 aa, Giardia lamblia
AKRLLEEAVVLPMLLPDFFTGVRSPWRGVLL

SEQ ID NO: 3149066 - protein, 24 aa, Giardia lamblia
AKRPGCLGCTCVTVAAITEQGTVS

SEQ ID NO: 3149067 - protein, 28 aa, Giardia lamblia
AKRQLGAPCNRCLCVSGNATWARDQTSP

SEQ ID NO: 3149068 - protein, 19 aa, Giardia lamblia
AKRRSLLPCSDFLRTPYTV

SEQ ID NO: 3149069 - protein, 17 aa, Giardia lamblia
AKRSIKFTVQKTTALPA

SEQ ID NO: 3149070 - protein, 17 aa, Giardia lamblia
AKRTIVPPFSYFRDPER

SEQ ID NO: 3149071 - protein, 17 aa, Giardia lamblia
AKSAPSIDQRELNPNES

SEQ ID NO: 3149072 - protein, 25 aa, Giardia lamblia
AKSCIPKLLVQFGLLKNNDGLTAAQ

SEQ ID NO: 3149073 - protein, 19 aa, Giardia lamblia
AKSISMLFLPALLKGINHP

SEQ ID NO: 3149074 - protein, 25 aa, Giardia lamblia
AKSKSFVPCRIIFALVEASSPAEKL

SEQ ID NO: 3149075 - protein, 19 aa, Giardia lamblia
AKSSCLAKESEYQFVQVGS

SEQ ID NO: 3149076 - protein, 20 aa, Giardia lamblia
AKSTLVDRSKWEGHEVAEGG

SEQ ID NO: 3149077 - protein, 19 aa, Giardia lamblia
AKTALILAAQNKHWDVARI

SEQ ID NO: 3149078 - protein, 22 aa, Giardia lamblia
AKTPFEYRQCILPQKQKPIDYV

SEQ ID NO: 3149079 - protein, 17 aa, Giardia lamblia
AKTSPLRKRAVARQSLA

SEQ ID NO: 3149080 - protein, 22 aa, Giardia lamblia
AKTSRRGSIRGGEPSETPNPDS

SEQ ID NO: 3149081 - protein, 17 aa, Giardia lamblia
AKVAKLKADLEAEIQQR

SEQ ID NO: 3149082 - protein, 19 aa, Giardia lamblia
AKVDEFWTRSARLGTSGRG

SEQ ID NO: 3149083 - protein, 17 aa, Giardia lamblia
AKVGGWTALVFAARSGR

SEQ ID NO: 3149084 - protein, 20 aa, Giardia lamblia
AKVKEVLGFVRILKAAVPKK

SEQ ID NO: 3149085 - protein, 20 aa, Giardia lamblia
AKVKQGARPAIPAHYSSDLS

SEQ ID NO: 3149086 - protein, 29 aa, Giardia lamblia
AKVPMWKKENCIQCGFCSVQCPHAAVRCF

SEQ ID NO: 3149087 - protein, 25 aa, Giardia lamblia
AKVQHARLPPRVKSLEREKPSSEPA

SEQ ID NO: 3149088 - protein, 21 aa, Giardia lamblia
AKWPRGMRANGHLQLNDAKMS

SEQ ID NO: 3149089 - protein, 21 aa, Giardia lamblia
AKYIPLKKHREVTGSALSTSA

SEQ ID NO: 3149090 - protein, 23 aa, Giardia lamblia
AKYLEVINIYQAVVIGHAQPSSF

SEQ ID NO: 3149091 - protein, 32 aa, Giardia lamblia
AKYLQRRIPLHVAENFCRLIIMLVRSPVRLKK

SEQ ID NO: 3149092 - protein, 18 aa, Giardia lamblia
AKYRRHILTLSKGNISVL

SEQ ID NO: 3149093 - protein, 17 aa, Giardia lamblia
AKYSTMRLGDLLVSVKS

SEQ ID NO: 3149094 - protein, 22 aa, Giardia lamblia
AKYYRATTAYILLDLEAGIQDA

SEQ ID NO: 3149095 - protein, 18 aa, Giardia lamblia
ALAADKRLGCSYQTLTIG

SEQ ID NO: 3149096 - protein, 20 aa, Giardia lamblia
ALAADLSSPVFKDLVYLDFT

SEQ ID NO: 3149097 - protein, 26 aa, Giardia lamblia
ALAADTRLAAAFVHLHSLRNKKGETA

SEQ ID NO: 3149098 - protein, 19 aa, Giardia lamblia
ALAARRCFSAETGAILRHN

SEQ ID NO: 3149099 - protein, 18 aa, Giardia lamblia
ALAAVSHSFIRLYDEEPS

SEQ ID NO: 3149100 - protein, 20 aa, Giardia lamblia
ALAEEVARLEHLLHQKIAEQ

SEQ ID NO: 3149101 - protein, 19 aa, Giardia lamblia
ALAERGIEYLHYNGISTNP

SEQ ID NO: 3149102 - protein, 17 aa, Giardia lamblia
ALAFMVASCLSVCDRDR

SEQ ID NO: 3149103 - protein, 19 aa, Giardia lamblia
ALAGNIARKSAASIRSSRH

SEQ ID NO: 3149104 - protein, 18 aa, Giardia lamblia
ALAQPVIVFNCSEGLDYK

SEQ ID NO: 3149105 - protein, 24 aa, Giardia lamblia
ALARPSMLRRLQIRNQNFTDENIV

SEQ ID NO: 3149106 - protein, 27 aa, Giardia lamblia
ALASSCTRQRAGIGIGDGRHNCQIYSR

SEQ ID NO: 3149107 - protein, 17 aa, Giardia lamblia
ALASSLCEGTPKDKLTP

SEQ ID NO: 3149108 - protein, 29 aa, Giardia lamblia
ALASVALLRLFFRMHHIPFSVYPTYTDFH

SEQ ID NO: 3149109 - protein, 26 aa, Giardia lamblia
ALCALPKNRFIQFYPLVFDGDDGYIV

SEQ ID NO: 3149110 - protein, 23 aa, Giardia lamblia
ALCDPLAAMVCCNEAIIEEEMRG

SEQ ID NO: 3149111 - protein, 20 aa, Giardia lamblia
ALCREAERKSSEKLAELNTF

SEQ ID NO: 3149112 - protein, 18 aa, Giardia lamblia
ALCSQKFLVIPVICEHAM

SEQ ID NO: 3149113 - protein, 20 aa, Giardia lamblia
ALDAIGYGLTCQRPFTGKLM

SEQ ID NO: 3149114 - protein, 23 aa, Giardia lamblia
ALDARFYALLLHRNTSEVLACLK

SEQ ID NO: 3149115 - protein, 17 aa, Giardia lamblia
ALDEFLKNRPHQLAEAR

SEQ ID NO: 3149116 - protein, 18 aa, Giardia lamblia
ALDGNEWAPARGPRKIEK

SEQ ID NO: 3149117 - protein, 24 aa, Giardia lamblia
ALDGYNCSIFAYGATGAGKSHTMS

SEQ ID NO: 3149118 - protein, 26 aa, Giardia lamblia
ALDHGKKRAWRCLRRHEKALRDQLAT

SEQ ID NO: 3149119 - protein, 26 aa, Giardia lamblia
ALDIWSCGCIFYECVTGKPLFPAKTE

SEQ ID NO: 3149120 - protein, 18 aa, Giardia lamblia
ALDRIYKERCLVTVPELE

SEQ ID NO: 3149121 - protein, 29 aa, Giardia lamblia
ALDVAKVLIPREVCMVNKAGLTALMQAAL

SEQ ID NO: 3149122 - protein, 19 aa, Giardia lamblia
ALEAETCLLSQKLEFYHSI

SEQ ID NO: 3149123 - protein, 26 aa, Giardia lamblia
ALEALAYLACLSRVWGLELDIQNINW

SEQ ID NO: 3149124 - protein, 22 aa, Giardia lamblia
ALEDLQCVYDRMIPTTSEPIQH

SEQ ID NO: 3149125 - protein, 32 aa, Giardia lamblia
ALEDRYDNCIKFFESMCTIKGLCEDASVQSTS

SEQ ID NO: 3149126 - protein, 19 aa, Giardia lamblia
ALEEAIICRGISFKRSTEK

SEQ ID NO: 3149127 - protein, 18 aa, Giardia lamblia
ALEEIKRYYIDKTEAEKQ

SEQ ID NO: 3149128 - protein, 17 aa, Giardia lamblia
ALEESRTSLADIQNKLS

SEQ ID NO: 3149129 - protein, 32 aa, Giardia lamblia
ALEHAGACLYILSRKEIKTFIPTNLVPALHAT

SEQ ID NO: 3149130 - protein, 25 aa, Giardia lamblia
ALEIAFYQDRIHALTGQSDKSITRS

SEQ ID NO: 3149131 - protein, 22 aa, Giardia lamblia
ALEILLPYEMCYASECLAVAKI

SEQ ID NO: 3149132 - protein, 25 aa, Giardia lamblia
ALEKGHIRIAEILAPYECPDVTNVD

SEQ ID NO: 3149133 - protein, 19 aa, Giardia lamblia
ALEKIGVGMRCRLSGDRRG

SEQ ID NO: 3149134 - protein, 22 aa, Giardia lamblia
ALELARCFTENTVPAAHQLIKA

SEQ ID NO: 3149135 - protein, 20 aa, Giardia lamblia
ALEMGMLKIAMLLAPYELMI

SEQ ID NO: 3149136 - protein, 19 aa, Giardia lamblia
ALEPELRKLGLPTSLQNTV

SEQ ID NO: 3149137 - protein, 24 aa, Giardia lamblia
ALEPFGLPVVRVVSLARQRLAEYE

SEQ ID NO: 3149138 - protein, 25 aa, Giardia lamblia
ALEQKLKMEIGVNVRSRLDEEQAFN

SEQ ID NO: 3149139 - protein, 17 aa, Giardia lamblia
ALERLRLSGNTSKEAII

SEQ ID NO: 3149140 - protein, 25 aa, Giardia lamblia
ALESARSALWLEIEQFLRLEFNISL

SEQ ID NO: 3149141 - protein, 18 aa, Giardia lamblia
ALESCDSPQGFLFFSSLG

SEQ ID NO: 3149142 - protein, 25 aa, Giardia lamblia
ALESQMKFSLGLIVEPLSAIGDTTV

SEQ ID NO: 3149143 - protein, 19 aa, Giardia lamblia
ALEWEVFVPTSLTFAEDCL

SEQ ID NO: 3149144 - protein, 18 aa, Giardia lamblia
ALFIVPFLNILGASPGSP

SEQ ID NO: 3149145 - protein, 18 aa, Giardia lamblia
ALFRKIKTGEYVIPDYVD

SEQ ID NO: 3149146 - protein, 22 aa, Giardia lamblia
ALGCELLKQFALIGAATDTQSL

SEQ ID NO: 3149147 - protein, 19 aa, Giardia lamblia
ALGCVLVELCTLRAPCWDP

SEQ ID NO: 3149148 - protein, 17 aa, Giardia lamblia
ALGGEAFIYSWGSAADA

SEQ ID NO: 3149149 - protein, 19 aa, Giardia lamblia
ALGGLRYGTLPKLNYPLSN

SEQ ID NO: 3149150 - protein, 19 aa, Giardia lamblia
ALGIFRRAYAKLRHKQTIE

SEQ ID NO: 3149151 - protein, 22 aa, Giardia lamblia
ALGKLPEFYALNSPNKNIQALF

SEQ ID NO: 3149152 - protein, 18 aa, Giardia lamblia
ALGLKNLFVGSAQQLLEI

SEQ ID NO: 3149153 - protein, 20 aa, Giardia lamblia
ALGSILRQIQLELSKLPYTI

SEQ ID NO: 3149154 - protein, 26 aa, Giardia lamblia
ALGSSRCILCASAGARVSEGLDFKDN

SEQ ID NO: 3149155 - protein, 20 aa, Giardia lamblia
ALGVPLPAFHTMQSNLDSVT

SEQ ID NO: 3149156 - protein, 17 aa, Giardia lamblia
ALHAILPRNEYFLDYMA

SEQ ID NO: 3149157 - protein, 19 aa, Giardia lamblia
ALHNACIRGNKNAARALYR

SEQ ID NO: 3149158 - protein, 24 aa, Giardia lamblia
ALHQKKELVSLCVSEVNRVVDNLA

SEQ ID NO: 3149159 - protein, 19 aa, Giardia lamblia
ALHSSCLTLVLSLDDQKDA

SEQ ID NO: 3149160 - protein, 18 aa, Giardia lamblia
ALHWPEAESYFRRRFSYF

SEQ ID NO: 3149161 - protein, 17 aa, Giardia lamblia
ALIKAIRRGHIACVGAL

SEQ ID NO: 3149162 - protein, 18 aa, Giardia lamblia
ALIKALRYELPAIAKLLI

SEQ ID NO: 3149163 - protein, 17 aa, Giardia lamblia
ALILAVKVRDYELIKRL

SEQ ID NO: 3149164 - protein, 18 aa, Giardia lamblia
ALINGHSALFVYLLPERG

SEQ ID NO: 3149165 - protein, 17 aa, Giardia lamblia
ALIPRATAQASIMNIEV

SEQ ID NO: 3149166 - protein, 27 aa, Giardia lamblia
ALIQNLEFVRLYLSNTFEKNDAVKSLY

SEQ ID NO: 3149167 - protein, 18 aa, Giardia lamblia
ALKDKRRTPDLSFMNPDG

SEQ ID NO: 3149168 - protein, 20 aa, Giardia lamblia
ALKGMRIIKYYPYLDTERAE

SEQ ID NO: 3149169 - protein, 26 aa, Giardia lamblia
ALKIFKKFFYYYGFYLGNICVLFRPK

SEQ ID NO: 3149170 - protein, 23 aa, Giardia lamblia
ALKISLGVGSYVGFNIDPDISTH

SEQ ID NO: 3149171 - protein, 20 aa, Giardia lamblia
ALKKRLDELTDYTVDEIIEL

SEQ ID NO: 3149172 - protein, 27 aa, Giardia lamblia
ALKLSQARLKAWVPLDCNFQNNKMLVL

SEQ ID NO: 3149173 - protein, 23 aa, Giardia lamblia
ALKRIIMARMHDIRCLIVENNQL

SEQ ID NO: 3149174 - protein, 24 aa, Giardia lamblia
ALKRIVKRLDGLRYIEAPSPLIHV

SEQ ID NO: 3149175 - protein, 26 aa, Giardia lamblia
ALKRRLEKRIYIPLPDFESRKQLLKL

SEQ ID NO: 3149176 - protein, 26 aa, Giardia lamblia
ALKSAIYLECNFVKSISGAGPPSKQI

SEQ ID NO: 3149177 - protein, 17 aa, Giardia lamblia
ALLAELQRVCPLLAASP

SEQ ID NO: 3149178 - protein, 27 aa, Giardia lamblia
ALLAKMCARPELFLVCVGQRISDLAPY

SEQ ID NO: 3149179 - protein, 17 aa, Giardia lamblia
ALLDELAHFAASARRLS

SEQ ID NO: 3149180 - protein, 34 aa, Giardia lamblia
ALLEAVLRLNLSFVRVLGRLEFDLLLGQDKRYTA

SEQ ID NO: 3149181 - protein, 23 aa, Giardia lamblia
ALLEDILDVFLLPILEIYKDPEL

SEQ ID NO: 3149182 - protein, 25 aa, Giardia lamblia
ALLFKIPKLIILYKVLGWPTAALDE

SEQ ID NO: 3149183 - protein, 18 aa, Giardia lamblia
ALLGLKMLVTDVADIRTE

SEQ ID NO: 3149184 - protein, 23 aa, Giardia lamblia
ALLKDPRIYAQEGWHLHLETEDG

SEQ ID NO: 3149185 - protein, 18 aa, Giardia lamblia
ALLKFVCGSARAPVGGLS

SEQ ID NO: 3149186 - protein, 17 aa, Giardia lamblia
ALLKGEASIKMPDGYTI

SEQ ID NO: 3149187 - protein, 17 aa, Giardia lamblia
ALLLFLHNGGSFFRQVL

SEQ ID NO: 3149188 - protein, 20 aa, Giardia lamblia
ALLLLPSYVCSSALLKTARE

SEQ ID NO: 3149189 - protein, 26 aa, Giardia lamblia
ALLLPREARIPILLDPHGPEYGETAF

SEQ ID NO: 3149190 - protein, 17 aa, Giardia lamblia
ALLLQAVLLCYSGSIID

SEQ ID NO: 3149191 - protein, 18 aa, Giardia lamblia
ALLLSDPAVSIFIKLKML

SEQ ID NO: 3149192 - protein, 21 aa, Giardia lamblia
ALLPIVCLLWNRARLEPSSTR

SEQ ID NO: 3149193 - protein, 19 aa, Giardia lamblia
ALLPYEDFIVVALLMNLVV

SEQ ID NO: 3149194 - protein, 18 aa, Giardia lamblia
ALLRARLVFVLFQSLHTL

SEQ ID NO: 3149195 - protein, 19 aa, Giardia lamblia
ALLRCNRKITPRRPLPSAK

SEQ ID NO: 3149196 - protein, 17 aa, Giardia lamblia
ALLRPGRIDRKVEFPLP

SEQ ID NO: 3149197 - protein, 18 aa, Giardia lamblia
ALLRSSGIAQGFMSHLGQ

SEQ ID NO: 3149198 - protein, 17 aa, Giardia lamblia
ALLSCGYTNLMIATISG

SEQ ID NO: 3149199 - protein, 19 aa, Giardia lamblia
ALLSELGIQSRRGWTALQD

SEQ ID NO: 3149200 - protein, 17 aa, Giardia lamblia
ALLSQVRAKPYADLLGS

SEQ ID NO: 3149201 - protein, 27 aa, Giardia lamblia
ALLTKASGKMIQWFKERPKDMPNALDI

SEQ ID NO: 3149202 - protein, 18 aa, Giardia lamblia
ALLTYRILSQFWILPSKT

SEQ ID NO: 3149203 - protein, 22 aa, Giardia lamblia
ALMAACDRQHLNIVKLLKHREG

SEQ ID NO: 3149204 - protein, 22 aa, Giardia lamblia
ALMEAASWGHSEIVKLLIDHEG

SEQ ID NO: 3149205 - protein, 31 aa, Giardia lamblia
ALMHACYNGSLDAVMCLVSLEAELRDSNNRT

SEQ ID NO: 3149206 - protein, 17 aa, Giardia lamblia
ALMKAARCDSVNAISLL

SEQ ID NO: 3149207 - protein, 17 aa, Giardia lamblia
ALMKAVRAQDSQMVKIL

SEQ ID NO: 3149208 - protein, 18 aa, Giardia lamblia
ALMLAAAAGRLDCVDLLI

SEQ ID NO: 3149209 - protein, 17 aa, Giardia lamblia
ALMLATRANHPMIVEAL

SEQ ID NO: 3149210 - protein, 23 aa, Giardia lamblia
ALMLKLSTFFYSTWDVVSQSYKA

SEQ ID NO: 3149211 - protein, 26 aa, Giardia lamblia
ALMLMSRAQVLFDIGELAAAIRDLKA

SEQ ID NO: 3149212 - protein, 18 aa, Giardia lamblia
ALMNAVWGDHIECVELLL

SEQ ID NO: 3149213 - protein, 17 aa, Giardia lamblia
ALMPQEISARIGPGLTT

SEQ ID NO: 3149214 - protein, 20 aa, Giardia lamblia
ALMRAVKAGNTFIVQELLDT

SEQ ID NO: 3149215 - protein, 24 aa, Giardia lamblia
ALMSAAIAERREAVLGKERLERQM

SEQ ID NO: 3149216 - protein, 17 aa, Giardia lamblia
ALMSAAWNGHYSVVKFL

SEQ ID NO: 3149217 - protein, 17 aa, Giardia lamblia
ALMSRFDLICVVKDMVN

SEQ ID NO: 3149218 - protein, 18 aa, Giardia lamblia
ALMWTIRLYTQIKESGTP

SEQ ID NO: 3149219 - protein, 18 aa, Giardia lamblia
ALMYAARSNKPEVVRLLM

SEQ ID NO: 3149220 - protein, 26 aa, Giardia lamblia
ALMYAASFGHLACVKVLAEKEASFKR

SEQ ID NO: 3149221 - protein, 24 aa, Giardia lamblia
ALNKPELCRALRALSTVSTAFEVV

SEQ ID NO: 3149222 - protein, 23 aa, Giardia lamblia
ALNNCLRMSYFSSDRSIRDYCEK

SEQ ID NO: 3149223 - protein, 24 aa, Giardia lamblia
ALPELSHPGVLRYHQVIEHMNFVY

SEQ ID NO: 3149224 - protein, 17 aa, Giardia lamblia
ALPLRVPADDNALLKAI

SEQ ID NO: 3149225 - protein, 24 aa, Giardia lamblia
ALPRMPRDYITRLVFNTSHETACL

SEQ ID NO: 3149226 - protein, 23 aa, Giardia lamblia
ALPRRVPWARGLRGRPSDPCSAR

SEQ ID NO: 3149227 - protein, 23 aa, Giardia lamblia
ALPSLRVVTFLSEVRATDREGED

SEQ ID NO: 3149228 - protein, 27 aa, Giardia lamblia
ALPVSSKSFRCEFCGRSNAIISSVTVR

SEQ ID NO: 3149229 - protein, 19 aa, Giardia lamblia
ALQHRFCKLLYDASLAKRN

SEQ ID NO: 3149230 - protein, 24 aa, Giardia lamblia
ALQKITMCRDVMIRRVKVVKRPRN

SEQ ID NO: 3149231 - protein, 17 aa, Giardia lamblia
ALQLFFKHFSDISRQKM

SEQ ID NO: 3149232 - protein, 23 aa, Giardia lamblia
ALQLKQPLVIAGSLGSQNMHDVL

SEQ ID NO: 3149233 - protein, 18 aa, Giardia lamblia
ALQLWDAFHNDVMPPNIF

SEQ ID NO: 3149234 - protein, 25 aa, Giardia lamblia
ALQNHVRLLSDYRYGGFAMSARDDR

SEQ ID NO: 3149235 - protein, 23 aa, Giardia lamblia
ALQRLRVSCNLSIPPILTNDVLQ

SEQ ID NO: 3149236 - protein, 20 aa, Giardia lamblia
ALQSELFDTVPLLLQDTPLT

SEQ ID NO: 3149237 - protein, 18 aa, Giardia lamblia
ALQSLGHPQSPQWCLEQS

SEQ ID NO: 3149238 - protein, 18 aa, Giardia lamblia
ALRAHYAATMSMSNAHDE

SEQ ID NO: 3149239 - protein, 17 aa, Giardia lamblia
ALRAVLYVRDLQGPLLL

SEQ ID NO: 3149240 - protein, 21 aa, Giardia lamblia
ALRCKTFIGRYNFVSQVIDVL

SEQ ID NO: 3149241 - protein, 24 aa, Giardia lamblia
ALRDIRMILKMLGHDPQLFDIKLI

SEQ ID NO: 3149242 - protein, 24 aa, Giardia lamblia
ALRFISPRIPAQWLNATCYRNSAI

SEQ ID NO: 3149243 - protein, 24 aa, Giardia lamblia
ALRGKAFVVFLCFPDAVACAARLH

SEQ ID NO: 3149244 - protein, 28 aa, Giardia lamblia
ALRGTERTRWRALPEENLLDEFIRTANP

SEQ ID NO: 3149245 - protein, 17 aa, Giardia lamblia
ALRLELTSAKSIKDKRE

SEQ ID NO: 3149246 - protein, 24 aa, Giardia lamblia
ALRRASFGHLERSHGVMLTQAEAE

SEQ ID NO: 3149247 - protein, 17 aa, Giardia lamblia
ALRRLSHARAEDPATKS

SEQ ID NO: 3149248 - protein, 20 aa, Giardia lamblia
ALRRPWQSLLHCSSSNDNTE

SEQ ID NO: 3149249 - protein, 21 aa, Giardia lamblia
ALRSIFRETMRFCTKVNSMML

SEQ ID NO: 3149250 - protein, 21 aa, Giardia lamblia
ALRSIKRWMAVLGAADNLTVM

SEQ ID NO: 3149251 - protein, 25 aa, Giardia lamblia
ALRTCSYTYSAMCGTKSLLFNYYVA

SEQ ID NO: 3149252 - protein, 21 aa, Giardia lamblia
ALRYAHYYCARDCHVLKEGVL

SEQ ID NO: 3149253 - protein, 23 aa, Giardia lamblia
ALSAKVDACIRERANMEALLVEK

SEQ ID NO: 3149254 - protein, 26 aa, Giardia lamblia
ALSDGEHLTCINIGLTEDLQAKTEQV

SEQ ID NO: 3149255 - protein, 22 aa, Giardia lamblia
ALSDWCPNMTVVTLIGTKEDRE

SEQ ID NO: 3149256 - protein, 23 aa, Giardia lamblia
ALSEIKRFELIFLSTEDALNRQH

SEQ ID NO: 3149257 - protein, 23 aa, Giardia lamblia
ALSGSALLYFFAAIFEERVNEVP

SEQ ID NO: 3149258 - protein, 18 aa, Giardia lamblia
ALSHRRQGIIYKRNEIFI

SEQ ID NO: 3149259 - protein, 20 aa, Giardia lamblia
ALSLEHLQAKHGIRPVHTST

SEQ ID NO: 3149260 - protein, 24 aa, Giardia lamblia
ALSLNFLDSLGFIMFLCTQKWHKL

SEQ ID NO: 3149261 - protein, 19 aa, Giardia lamblia
ALSQSWRTPVKPIRRSCRT

SEQ ID NO: 3149262 - protein, 19 aa, Giardia lamblia
ALSSAILLVRYSDFETDAK

SEQ ID NO: 3149263 - protein, 43 aa, Giardia lamblia
ALSSFKRFVFFAAYGSRRKALLAGRPWPGLTNKIFSSTKALLG

SEQ ID NO: 3149264 - protein, 21 aa, Giardia lamblia
ALSSVICSLVTKTPHVPYRDS

SEQ ID NO: 3149265 - protein, 25 aa, Giardia lamblia
ALTDRLRSYLGMGGGVGGLRLDNPD

SEQ ID NO: 3149266 - protein, 19 aa, Giardia lamblia
ALTESLTLNGWDMLDTNDG

SEQ ID NO: 3149267 - protein, 22 aa, Giardia lamblia
ALTFEFSVMFQHGRMLAEVILD

SEQ ID NO: 3149268 - protein, 25 aa, Giardia lamblia
ALTGLRLSQLMIYDFTVTAEEALAH

SEQ ID NO: 3149269 - protein, 20 aa, Giardia lamblia
ALTRPCAHFMSPSMLQNKKA

SEQ ID NO: 3149270 - protein, 19 aa, Giardia lamblia
ALTTEEGRPFPGCFATCRT

SEQ ID NO: 3149271 - protein, 17 aa, Giardia lamblia
ALVAYSRCNDVQECRFV

SEQ ID NO: 3149272 - protein, 17 aa, Giardia lamblia
ALVFGKLLREIGRRPEE

SEQ ID NO: 3149273 - protein, 17 aa, Giardia lamblia
ALVGRTEVVRLLLKIEG

SEQ ID NO: 3149274 - protein, 20 aa, Giardia lamblia
ALVIDLGMHTVRMGFACDPC

SEQ ID NO: 3149275 - protein, 22 aa, Giardia lamblia
ALVKVIRISGGLTEQSGQSARL

SEQ ID NO: 3149276 - protein, 18 aa, Giardia lamblia
ALVKYIETMAEAFAVSDP

SEQ ID NO: 3149277 - protein, 19 aa, Giardia lamblia
ALVLRPGRSTQKKWDFDAP

SEQ ID NO: 3149278 - protein, 18 aa, Giardia lamblia
ALVLVPGEYAIVRFDGVE

SEQ ID NO: 3149279 - protein, 28 aa, Giardia lamblia
ALVRERGFCMACPTLIINSSGNLQPYIM

SEQ ID NO: 3149280 - protein, 22 aa, Giardia lamblia
ALVRSRTLGPYLRQITYTESSI

SEQ ID NO: 3149281 - protein, 18 aa, Giardia lamblia
ALVSACRKDLISTALQLA

SEQ ID NO: 3149282 - protein, 17 aa, Giardia lamblia
ALVSELGGTPGLSAPGI

SEQ ID NO: 3149283 - protein, 17 aa, Giardia lamblia
ALVSWLLSSHTLYSRSS

SEQ ID NO: 3149284 - protein, 18 aa, Giardia lamblia
ALVYELCTGTPLIKQKTK

SEQ ID NO: 3149285 - protein, 20 aa, Giardia lamblia
ALYARLCHSFLLPTLRHQKL

SEQ ID NO: 3149286 - protein, 17 aa, Giardia lamblia
ALYARRRVTSTSALITP

SEQ ID NO: 3149287 - protein, 18 aa, Giardia lamblia
ALYDSLSIPAVWIGDLIN

SEQ ID NO: 3149288 - protein, 21 aa, Giardia lamblia
AMAKRLLKLECRRRDHHGCTA

SEQ ID NO: 3149289 - protein, 18 aa, Giardia lamblia
AMALLGLGAGDTTDERTD

SEQ ID NO: 3149290 - protein, 18 aa, Giardia lamblia
AMAPVESPLLFVLPPLLA

SEQ ID NO: 3149291 - protein, 25 aa, Giardia lamblia
AMAPVLRPLLLPPLGLVDTHASPSS

SEQ ID NO: 3149292 - protein, 27 aa, Giardia lamblia
AMDGIHRYGRWNIFNPTALMLAAAYNN

SEQ ID NO: 3149293 - protein, 17 aa, Giardia lamblia
AMDQVCIVFTDGTSALM

SEQ ID NO: 3149294 - protein, 19 aa, Giardia lamblia
AMEIADLLCNLRQILPNVV

SEQ ID NO: 3149295 - protein, 25 aa, Giardia lamblia
AMFEPICLCNAYLLQKLERMAPPPI

SEQ ID NO: 3149296 - protein, 18 aa, Giardia lamblia
AMGSFALAIVKNHEAPGE

SEQ ID NO: 3149297 - protein, 26 aa, Giardia lamblia
AMHEYPEACSILAPYEKMVTLPDKRT

SEQ ID NO: 3149298 - protein, 23 aa, Giardia lamblia
AMHSHKGLFAFDLHRRTEAKLSA

SEQ ID NO: 3149299 - protein, 27 aa, Giardia lamblia
AMIDELRYLSLQFERISAIGVQLSSII

SEQ ID NO: 3149300 - protein, 22 aa, Giardia lamblia
AMIKALENRLAQFGDRMNTADP

SEQ ID NO: 3149301 - protein, 22 aa, Giardia lamblia
AMILNLPMELVRKASDYYANCL

SEQ ID NO: 3149302 - protein, 18 aa, Giardia lamblia
AMINRRCVHSSLSSDVLS

SEQ ID NO: 3149303 - protein, 24 aa, Giardia lamblia
AMIQRSRDLIAMFEKQVSKDEAAQ

SEQ ID NO: 3149304 - protein, 17 aa, Giardia lamblia
AMIRATWQLERYTKRLR

SEQ ID NO: 3149305 - protein, 18 aa, Giardia lamblia
AMKQRVVELERRLESRAM

SEQ ID NO: 3149306 - protein, 20 aa, Giardia lamblia
AMLCGCLPFEGSTTQSLYIK

SEQ ID NO: 3149307 - protein, 20 aa, Giardia lamblia
AMLDEVLRIRTIIQQSKDAS

SEQ ID NO: 3149308 - protein, 22 aa, Giardia lamblia
AMLEARPAYAHRANHDSLYEIQ

SEQ ID NO: 3149309 - protein, 21 aa, Giardia lamblia
AMLETGCVYETTSFRPASNLA

SEQ ID NO: 3149310 - protein, 18 aa, Giardia lamblia
AMLMCLQFDDNLSEIAIE

SEQ ID NO: 3149311 - protein, 18 aa, Giardia lamblia
AMNCNLEGIKLLLETPSE

SEQ ID NO: 3149312 - protein, 31 aa, Giardia lamblia
AMNLCPRLLDWLIRLALKYIESPEEFKAIWS

SEQ ID NO: 3149313 - protein, 26 aa, Giardia lamblia
AMQDFIHLIKAVSYLAIPAPIGTVET

SEQ ID NO: 3149314 - protein, 32 aa, Giardia lamblia
AMQMGHPELRGCWAMNGDMCHICGHSYMEHMH

SEQ ID NO: 3149315 - protein, 17 aa, Giardia lamblia
AMQRVATIVTHCHESIY

SEQ ID NO: 3149316 - protein, 19 aa, Giardia lamblia
AMQSHALEIAFYQDRIHAL

SEQ ID NO: 3149317 - protein, 18 aa, Giardia lamblia
AMSALIMIQFSIRCRHLT

SEQ ID NO: 3149318 - protein, 20 aa, Giardia lamblia
AMSHKGHLSDRLTCLRASLH

SEQ ID NO: 3149319 - protein, 19 aa, Giardia lamblia
AMSIRDFSPRFRKNPDAFQ

SEQ ID NO: 3149320 - protein, 19 aa, Giardia lamblia
AMSPCKSVSSSVSKPPISP

SEQ ID NO: 3149321 - protein, 17 aa, Giardia lamblia
AMSRLKLYNRLPPNGLA

SEQ ID NO: 3149322 - protein, 25 aa, Giardia lamblia
AMSSFGGILSCRFVRGTRTTTGFGA

SEQ ID NO: 3149323 - protein, 18 aa, Giardia lamblia
AMSSVLQSLILLLKEEPL

SEQ ID NO: 3149324 - protein, 19 aa, Giardia lamblia
AMTAPRFVPHILAVCNVEN

SEQ ID NO: 3149325 - protein, 22 aa, Giardia lamblia
AMTGAAGAFVMQRCSLNAVKDL

SEQ ID NO: 3149326 - protein, 18 aa, Giardia lamblia
AMVAVAGLQRSCADLTEE

SEQ ID NO: 3149327 - protein, 19 aa, Giardia lamblia
AMVDARFIYASTILNDFAD

SEQ ID NO: 3149328 - protein, 25 aa, Giardia lamblia
AMVPARPDLLASLVREYYPTLPEIP

SEQ ID NO: 3149329 - protein, 25 aa, Giardia lamblia
AMWDSLCILDKMPAFSNLLPSIEQR

SEQ ID NO: 3149330 - protein, 17 aa, Giardia lamblia
AMYYATHCSSIVTPEKK

SEQ ID NO: 3149331 - protein, 18 aa, Giardia lamblia
ANAARILSDDDMEYVRSL

SEQ ID NO: 3149332 - protein, 24 aa, Giardia lamblia
ANACDCLRLLAPKEAGRCTNDEFL

SEQ ID NO: 3149333 - protein, 24 aa, Giardia lamblia
ANAEGRTALMIAARAGDLNGVRLL

SEQ ID NO: 3149334 - protein, 21 aa, Giardia lamblia
ANALPCIRLLAAKESGLRTTA

SEQ ID NO: 3149335 - protein, 23 aa, Giardia lamblia
ANARLRLNMLLEIQQLMDALASL

SEQ ID NO: 3149336 - protein, 21 aa, Giardia lamblia
ANAVEVCKVLLTAEAGSVRKD

SEQ ID NO: 3149337 - protein, 20 aa, Giardia lamblia
ANAYTFPSVLFVVINSAVSI

SEQ ID NO: 3149338 - protein, 26 aa, Giardia lamblia
ANDACSGFCLIRFVNPSGAEKCVREF

SEQ ID NO: 3149339 - protein, 24 aa, Giardia lamblia
ANDFKRKSIALSMPIPTREMTMAL

SEQ ID NO: 3149340 - protein, 19 aa, Giardia lamblia
ANDGHRLASVLVEMITNSM

SEQ ID NO: 3149341 - protein, 24 aa, Giardia lamblia
ANDGTECYVPSLLNRLTKGESVLT

SEQ ID NO: 3149342 - protein, 24 aa, Giardia lamblia
ANDLDRRRCEIILRRGKELVSTKA

SEQ ID NO: 3149343 - protein, 30 aa, Giardia lamblia
ANECGCNYISIKGPELLSKWVGESEQNIRN

SEQ ID NO: 3149344 - protein, 18 aa, Giardia lamblia
ANELFIDEFRLLRHFGWT

SEQ ID NO: 3149345 - protein, 26 aa, Giardia lamblia
ANELVTIFFKFFSLFYYQLRDHSLVK

SEQ ID NO: 3149346 - protein, 26 aa, Giardia lamblia
ANFAAHIVEGYNCTCFAYGQSCSGKT

SEQ ID NO: 3149347 - protein, 18 aa, Giardia lamblia
ANFALLIDFYNNVNLTYN

SEQ ID NO: 3149348 - protein, 18 aa, Giardia lamblia
ANGDVRFIARNYLSNAKR

SEQ ID NO: 3149349 - protein, 21 aa, Giardia lamblia
ANGDVYSGEWVRGLKEGTGTM

SEQ ID NO: 3149350 - protein, 23 aa, Giardia lamblia
ANGETPFHLAVRADDTAYLDILI

SEQ ID NO: 3149351 - protein, 19 aa, Giardia lamblia
ANGHFDCVKVLLDHEHGMQ

SEQ ID NO: 3149352 - protein, 30 aa, Giardia lamblia
ANGHLQCVHKLVPLEGCIHSRNGTTALMLA

SEQ ID NO: 3149353 - protein, 18 aa, Giardia lamblia
ANGNWRDYFIIDYTNKPP

SEQ ID NO: 3149354 - protein, 24 aa, Giardia lamblia
ANGSRAIEILMMISKQLMEEAKGR

SEQ ID NO: 3149355 - protein, 24 aa, Giardia lamblia
ANGWELCGDALLQHMKKGRELAPD

SEQ ID NO: 3149356 - protein, 23 aa, Giardia lamblia
ANHKAVLGNYVFVIPIEFKQSII

SEQ ID NO: 3149357 - protein, 17 aa, Giardia lamblia
ANIAITPRGEWRLVGFS

SEQ ID NO: 3149358 - protein, 28 aa, Giardia lamblia
ANIAKFYRIPLIVGCETYKVTDQIYINA

SEQ ID NO: 3149359 - protein, 36 aa, Giardia lamblia
ANILNAPFLKPGEAPYRYTGVIKLAGTDLRTQESFD

SEQ ID NO: 3149360 - protein, 20 aa, Giardia lamblia
ANINAVWGLRDKYLGRKDQH

SEQ ID NO: 3149361 - protein, 24 aa, Giardia lamblia
ANIPPHRIRMGYGDDLTALVLGIA

SEQ ID NO: 3149362 - protein, 19 aa, Giardia lamblia
ANKAKLLAMAKQHGNKECA

SEQ ID NO: 3149363 - protein, 23 aa, Giardia lamblia
ANKINCARLLLKEAGRRDHNGQT

SEQ ID NO: 3149364 - protein, 20 aa, Giardia lamblia
ANKLSVRKSYGFLDFSYTLI

SEQ ID NO: 3149365 - protein, 28 aa, Giardia lamblia
ANKWNLGAWSSFFAFRLITQEEFQNVIT

SEQ ID NO: 3149366 - protein, 21 aa, Giardia lamblia
ANLAMSYGWSVMVSHRSGETE

SEQ ID NO: 3149367 - protein, 18 aa, Giardia lamblia
ANLAVRCTLPSPSVLQQM

SEQ ID NO: 3149368 - protein, 19 aa, Giardia lamblia
ANLDTASSVVIKRRPTKSS

SEQ ID NO: 3149369 - protein, 25 aa, Giardia lamblia
ANLHMTFKLSSSHYLNIGLIEELIV

SEQ ID NO: 3149370 - protein, 26 aa, Giardia lamblia
ANLIPEFTRPSLMNFSSSQVGNPALD

SEQ ID NO: 3149371 - protein, 21 aa, Giardia lamblia
ANLKTCVFVGIEHTSQMFTTT

SEQ ID NO: 3149372 - protein, 17 aa, Giardia lamblia
ANLKYAGLSCADGTTGL

SEQ ID NO: 3149373 - protein, 17 aa, Giardia lamblia
ANLPAFDGDLSFNQYRS

SEQ ID NO: 3149374 - protein, 18 aa, Giardia lamblia
ANLPAQRAHVSMSPEYDV

SEQ ID NO: 3149375 - protein, 17 aa, Giardia lamblia
ANLPSLLEQSPWTSQGP

SEQ ID NO: 3149376 - protein, 17 aa, Giardia lamblia
ANLPVRYRQSVLLATKE

SEQ ID NO: 3149377 - protein, 24 aa, Giardia lamblia
ANLQKKYAVELFIVQKTIESCYDE

SEQ ID NO: 3149378 - protein, 17 aa, Giardia lamblia
ANLSTRIKYEKLISKYI

SEQ ID NO: 3149379 - protein, 24 aa, Giardia lamblia
ANMIRPVLCSICQQELGASDLFIG

SEQ ID NO: 3149380 - protein, 24 aa, Giardia lamblia
ANMKFTCSECGMCHSSILRELEEL

SEQ ID NO: 3149381 - protein, 18 aa, Giardia lamblia
ANMLTTELLEITTARMYE

SEQ ID NO: 3149382 - protein, 23 aa, Giardia lamblia
ANNAIPIIIRRHLPDGTYEDWKL

SEQ ID NO: 3149383 - protein, 17 aa, Giardia lamblia
ANNFRGFNIDWTRELSR

SEQ ID NO: 3149384 - protein, 21 aa, Giardia lamblia
ANNPEICKILVTEEKHIVTLD

SEQ ID NO: 3149385 - protein, 19 aa, Giardia lamblia
ANPACFVRPLGCGTTENVH

SEQ ID NO: 3149386 - protein, 21 aa, Giardia lamblia
ANPQLGRLCVRPVVDDGDTSG

SEQ ID NO: 3149387 - protein, 25 aa, Giardia lamblia
ANPRMPKPRFSLRQYAPLDKKVEIG

SEQ ID NO: 3149388 - protein, 25 aa, Giardia lamblia
ANPYYDLFVKWQFRKLYRDGYIKFG

SEQ ID NO: 3149389 - protein, 26 aa, Giardia lamblia
ANQGHLECVKLLIASERKYKNNLNYD

SEQ ID NO: 3149390 - protein, 20 aa, Giardia lamblia
ANRAAARLGLKAEEETALAA

SEQ ID NO: 3149391 - protein, 21 aa, Giardia lamblia
ANRLRKILADFDIIASRDMDT

SEQ ID NO: 3149392 - protein, 23 aa, Giardia lamblia
ANRRGLCVDRVLAESLALKSYIG

SEQ ID NO: 3149393 - protein, 23 aa, Giardia lamblia
ANSEKRLKEESARRADASINPYT

SEQ ID NO: 3149394 - protein, 22 aa, Giardia lamblia
ANSGDFGLAFYIASKKSNKELL

SEQ ID NO: 3149395 - protein, 27 aa, Giardia lamblia
ANSHLECIKLLLAREGGLQDIEGWTSL

SEQ ID NO: 3149396 - protein, 21 aa, Giardia lamblia
ANSKFLITVWDLLQTYLNEDS

SEQ ID NO: 3149397 - protein, 18 aa, Giardia lamblia
ANSLGRRLNAEMHTEPKH

SEQ ID NO: 3149398 - protein, 20 aa, Giardia lamblia
ANSLKLGLKQLISLVPEIDE

SEQ ID NO: 3149399 - protein, 23 aa, Giardia lamblia
ANSLKYSILLTEERNVCASCSCV

SEQ ID NO: 3149400 - protein, 25 aa, Giardia lamblia
ANSQCKASCQVLVILATVSASSLSA

SEQ ID NO: 3149401 - protein, 27 aa, Giardia lamblia
ANSTGRMAYSKVYECWVTLDENGDEIP

SEQ ID NO: 3149402 - protein, 17 aa, Giardia lamblia
ANSTPLIEAVKMGDLPG

SEQ ID NO: 3149403 - protein, 17 aa, Giardia lamblia
ANTEEICVGRADKQMSQ

SEQ ID NO: 3149404 - protein, 18 aa, Giardia lamblia
ANTGFFYKNAEEMQELAK

SEQ ID NO: 3149405 - protein, 27 aa, Giardia lamblia
ANTKPLNMYIAWDIIRQITMVLDWLHN

SEQ ID NO: 3149406 - protein, 21 aa, Giardia lamblia
ANTMRPCINFLSGAEVTAKDN

SEQ ID NO: 3149407 - protein, 20 aa, Giardia lamblia
ANTVSSEWEKIVAITEEALG

SEQ ID NO: 3149408 - protein, 17 aa, Giardia lamblia
ANVIPLAAPSYVSQEEY

SEQ ID NO: 3149409 - protein, 18 aa, Giardia lamblia
ANVLPKLLALFISESSSD

SEQ ID NO: 3149410 - protein, 36 aa, Giardia lamblia
ANWDLDVGYLKEPRLMDLYLTLPIIRFKPQEAKKKT

SEQ ID NO: 3149411 - protein, 17 aa, Giardia lamblia
ANYAKNLLRDGCSATVR

SEQ ID NO: 3149412 - protein, 23 aa, Giardia lamblia
ANYTRLMSLVSIVSEMRHPNICT

SEQ ID NO: 3149413 - protein, 28 aa, Giardia lamblia
APAALPERTAEIFPAVSVETLAPQAEPE

SEQ ID NO: 3149414 - protein, 18 aa, Giardia lamblia
APAEFSSKAAIDFIDGRT

SEQ ID NO: 3149415 - protein, 19 aa, Giardia lamblia
APAFSLKGRTSSAVQGEGP

SEQ ID NO: 3149416 - protein, 25 aa, Giardia lamblia
APAGLSECRAGVLVADMESNCLRFI

SEQ ID NO: 3149417 - protein, 27 aa, Giardia lamblia
APANWERGYCDLCCLSLSKAFMLGCGH

SEQ ID NO: 3149418 - protein, 31 aa, Giardia lamblia
APAVLRHWHRLIFGVAFFYSSLLERKRFGSV

SEQ ID NO: 3149419 - protein, 20 aa, Giardia lamblia
APAWSLKGRHPQKGENIGPG

SEQ ID NO: 3149420 - protein, 17 aa, Giardia lamblia
APCEMRYTTQYATNGFG

SEQ ID NO: 3149421 - protein, 25 aa, Giardia lamblia
APCGHSICESCFYNLSGQVYMGQVV

SEQ ID NO: 3149422 - protein, 26 aa, Giardia lamblia
APCRSRLQHRLALRLEQLKRAAPGEF

SEQ ID NO: 3149423 - protein, 23 aa, Giardia lamblia
APDGEWRGHTALMITAVTGNLAA

SEQ ID NO: 3149424 - protein, 18 aa, Giardia lamblia
APDILDRVIFLSMLPMKV

SEQ ID NO: 3149425 - protein, 20 aa, Giardia lamblia
APDNRIALASSFLELNLFGF

SEQ ID NO: 3149426 - protein, 25 aa, Giardia lamblia
APDSKCPYCLSCMHVSGPMWLGDLH

SEQ ID NO: 3149427 - protein, 20 aa, Giardia lamblia
APDSKDIFCQLVDQIKSTST

SEQ ID NO: 3149428 - protein, 18 aa, Giardia lamblia
APDVERYLTKFGHVERLT

SEQ ID NO: 3149429 - protein, 19 aa, Giardia lamblia
APEAPPLRCEPAPPSEFSD

SEQ ID NO: 3149430 - protein, 17 aa, Giardia lamblia
APEDVYTIIGSVSTRPS

SEQ ID NO: 3149431 - protein, 25 aa, Giardia lamblia
APEHKPELVMPPAASPPVAPPTSTQ

SEQ ID NO: 3149432 - protein, 19 aa, Giardia lamblia
APESCVYAVQVGDPRLISI

SEQ ID NO: 3149433 - protein, 20 aa, Giardia lamblia
APESTLRCYDFLSTNGSLFD

SEQ ID NO: 3149434 - protein, 17 aa, Giardia lamblia
APFASASLMVFHGASVL

SEQ ID NO: 3149435 - protein, 21 aa, Giardia lamblia
APFESWRLGSRAVARETEAIT

SEQ ID NO: 3149436 - protein, 26 aa, Giardia lamblia
APFIQGYNCTAFAYGQTGAGKSYTIG

SEQ ID NO: 3149437 - protein, 26 aa, Giardia lamblia
APGAALRLVKITVKPGHERLIEIITK

SEQ ID NO: 3149438 - protein, 18 aa, Giardia lamblia
APGGWSYTILERFPRARG

SEQ ID NO: 3149439 - protein, 21 aa, Giardia lamblia
APGHKLYGPLYASLRKYQQTG

SEQ ID NO: 3149440 - protein, 19 aa, Giardia lamblia
APGTLKERMMNLDKTAHMI

SEQ ID NO: 3149441 - protein, 22 aa, Giardia lamblia
APGTTALMFACFNRQYECAKIL

SEQ ID NO: 3149442 - protein, 20 aa, Giardia lamblia
APHDIHFSFHLTTTVCQDNN

SEQ ID NO: 3149443 - protein, 26 aa, Giardia lamblia
APHFHWAVLSVRNFLTAGVQIIVTGS

SEQ ID NO: 3149444 - protein, 18 aa, Giardia lamblia
APHKDFRLWISSDPTNVF

SEQ ID NO: 3149445 - protein, 25 aa, Giardia lamblia
APHYICGLNGFWTSDIDLFIHSCSV

SEQ ID NO: 3149446 - protein, 32 aa, Giardia lamblia
APIACLLRKLYVFKVFPMINPDGVILGNYRCN

SEQ ID NO: 3149447 - protein, 23 aa, Giardia lamblia
APIDRPAFNSSLNVSGFQQSSYV

SEQ ID NO: 3149448 - protein, 22 aa, Giardia lamblia
APIGSAMGYVMFLSDEEADRAV

SEQ ID NO: 3149449 - protein, 28 aa, Giardia lamblia
APIGVLRRQLRHVGCVRPDGTTALMLAS

SEQ ID NO: 3149450 - protein, 23 aa, Giardia lamblia
APILRLLVYEDGMARFATEPYAE

SEQ ID NO: 3149451 - protein, 19 aa, Giardia lamblia
APILRRGRDTTVNRTPAYL

SEQ ID NO: 3149452 - protein, 18 aa, Giardia lamblia
APIMPRSGPPPISDSQQH

SEQ ID NO: 3149453 - protein, 21 aa, Giardia lamblia
APISCLPKYSSDAMVATAAGI

SEQ ID NO: 3149454 - protein, 19 aa, Giardia lamblia
APKMCTRDTQTYSFKNAIV

SEQ ID NO: 3149455 - protein, 17 aa, Giardia lamblia
APKPGVTAFAFNMGEDR

SEQ ID NO: 3149456 - protein, 19 aa, Giardia lamblia
APKVIFELRISRQGSSPVY

SEQ ID NO: 3149457 - protein, 27 aa, Giardia lamblia
APLAKLHTWIGPAFKLPTNTQKSGASL

SEQ ID NO: 3149458 - protein, 24 aa, Giardia lamblia
APLDRLEELQRLYRELSASKDVID

SEQ ID NO: 3149459 - protein, 25 aa, Giardia lamblia
APLEHSISFVGKWSSGIWAFDFPSP

SEQ ID NO: 3149460 - protein, 22 aa, Giardia lamblia
APLPSFKAIQCELLQPPSNADR

SEQ ID NO: 3149461 - protein, 26 aa, Giardia lamblia
APLQFDKPELCAKTAKSLASDIRKAL

SEQ ID NO: 3149462 - protein, 25 aa, Giardia lamblia
APLSINLFICTQITLSTYSISQDKE

SEQ ID NO: 3149463 - protein, 18 aa, Giardia lamblia
APLSRPGKAYKHIGHDPK

SEQ ID NO: 3149464 - protein, 19 aa, Giardia lamblia
APLSVGLDMADPLHLKPDG

SEQ ID NO: 3149465 - protein, 18 aa, Giardia lamblia
APLSWSHSTRSWMPAEYS

SEQ ID NO: 3149466 - protein, 17 aa, Giardia lamblia
APMCTVGTIPFRRLCIH

SEQ ID NO: 3149467 - protein, 25 aa, Giardia lamblia
APMGCLRLPLLTKRELFELSGKLRP

SEQ ID NO: 3149468 - protein, 17 aa, Giardia lamblia
APMHFLAILARIYETRS

SEQ ID NO: 3149469 - protein, 21 aa, Giardia lamblia
APMKIHLLSPFVGKMSNTTPV

SEQ ID NO: 3149470 - protein, 19 aa, Giardia lamblia
APNELPLKTLFTAPTSNWG

SEQ ID NO: 3149471 - protein, 18 aa, Giardia lamblia
APNFPEEPPIVISATTSI

SEQ ID NO: 3149472 - protein, 22 aa, Giardia lamblia
APNFPLQMYIAGLQNVNIPLTL

SEQ ID NO: 3149473 - protein, 21 aa, Giardia lamblia
APNLMTCCIFGGKYVGIGARD

SEQ ID NO: 3149474 - protein, 29 aa, Giardia lamblia
APNNLRIFFIVGYVLKYAERHNGRPIPND

SEQ ID NO: 3149475 - protein, 26 aa, Giardia lamblia
APPDLFLRRICKGIIEGLVVLEAING

SEQ ID NO: 3149476 - protein, 26 aa, Giardia lamblia
APPDSHGPESLLLPSEDLVVDRVATP

SEQ ID NO: 3149477 - protein, 24 aa, Giardia lamblia
APPIRCQRCRGYMNPYNILLNESW

SEQ ID NO: 3149478 - protein, 24 aa, Giardia lamblia
APPLAYRPDFVPLHVLHPPEHGNV

SEQ ID NO: 3149479 - protein, 17 aa, Giardia lamblia
APPNFSVEIPKPCASNT

SEQ ID NO: 3149480 - protein, 17 aa, Giardia lamblia
APPPGTIKIIFATNVAE

SEQ ID NO: 3149481 - protein, 18 aa, Giardia lamblia
APPPKPTAMMGIQPSLHS

SEQ ID NO: 3149482 - protein, 20 aa, Giardia lamblia
APPPSLPSFDSFTGNFNPSI

SEQ ID NO: 3149483 - protein, 32 aa, Giardia lamblia
APPRIRKIFASKSCKASVRLGDPLLDSTAKRI

SEQ ID NO: 3149484 - protein, 26 aa, Giardia lamblia
APPRKWKRITPDAAMLGKNYSAHPTP

SEQ ID NO: 3149485 - protein, 18 aa, Giardia lamblia
APPSFKSDPLLTGKDANI

SEQ ID NO: 3149486 - protein, 23 aa, Giardia lamblia
APPSLKPVLPLTMPALNTDTSKE

SEQ ID NO: 3149487 - protein, 25 aa, Giardia lamblia
APPTCVDCNTFLAGTLDQKSGSRGG

SEQ ID NO: 3149488 - protein, 18 aa, Giardia lamblia
APPTEAICIALLATKDIN

SEQ ID NO: 3149489 - protein, 18 aa, Giardia lamblia
APPYMSCGLKRRDAGRLF

SEQ ID NO: 3149490 - protein, 20 aa, Giardia lamblia
APQEAGCFHGKNGSTALMQA

SEQ ID NO: 3149491 - protein, 22 aa, Giardia lamblia
APQLPLTLPIREADDSKEHINV

SEQ ID NO: 3149492 - protein, 21 aa, Giardia lamblia
APQLYWSLYLNMMDADVYEDT

SEQ ID NO: 3149493 - protein, 25 aa, Giardia lamblia
APQTGAKQTGAFSFQVSTPPVQFGA

SEQ ID NO: 3149494 - protein, 18 aa, Giardia lamblia
APRGALRGRREALCPGCL

SEQ ID NO: 3149495 - protein, 27 aa, Giardia lamblia
APRPPELRRPGEFPVKSFSTSLANILI

SEQ ID NO: 3149496 - protein, 18 aa, Giardia lamblia
APRSCILSAITDMLVFMI

SEQ ID NO: 3149497 - protein, 18 aa, Giardia lamblia
APRSVLLAFAAFFSKKNM

SEQ ID NO: 3149498 - protein, 34 aa, Giardia lamblia
APRTDVLRWIKFGNLCLRFLAKFAPCDCNKPVHI

SEQ ID NO: 3149499 - protein, 18 aa, Giardia lamblia
APRVSTRDHADWKLEKYS

SEQ ID NO: 3149500 - protein, 21 aa, Giardia lamblia
APSCKLCRLYYSCSQTILPRR

SEQ ID NO: 3149501 - protein, 17 aa, Giardia lamblia
APSFNAASFITPKVETP

SEQ ID NO: 3149502 - protein, 32 aa, Giardia lamblia
APSGEMVHFILKRARWQDIIILGRLAASFNAF

SEQ ID NO: 3149503 - protein, 18 aa, Giardia lamblia
APSRQSLSMHAPENDEVL

SEQ ID NO: 3149504 - protein, 18 aa, Giardia lamblia
APSSAWGARSLFTSSGLT

SEQ ID NO: 3149505 - protein, 17 aa, Giardia lamblia
APSSFPFPQDLLVPTVS

SEQ ID NO: 3149506 - protein, 17 aa, Giardia lamblia
APSSIFLLIPLDPTVTV

SEQ ID NO: 3149507 - protein, 21 aa, Giardia lamblia
APSSMDLRASVLTKHSIAVPP

SEQ ID NO: 3149508 - protein, 17 aa, Giardia lamblia
APSTLSMLLSQKAGPSF

SEQ ID NO: 3149509 - protein, 20 aa, Giardia lamblia
APTAGFSFTAPQTGAKQTGA

SEQ ID NO: 3149510 - protein, 30 aa, Giardia lamblia
APTEQEYVIFPASIINMYMAMRNKGTDVAQ

SEQ ID NO: 3149511 - protein, 18 aa, Giardia lamblia
APTGSGKTLAFLVPLIIH

SEQ ID NO: 3149512 - protein, 24 aa, Giardia lamblia
APTLDRLRRAFADRNLRLRRALAA

SEQ ID NO: 3149513 - protein, 25 aa, Giardia lamblia
APTLKQLRKMYGSYCEAADLVLETM

SEQ ID NO: 3149514 - protein, 17 aa, Giardia lamblia
APTLPLSDSVMARMGVS

SEQ ID NO: 3149515 - protein, 19 aa, Giardia lamblia
APVCASCKAGKYATVDVLP

SEQ ID NO: 3149516 - protein, 17 aa, Giardia lamblia
APVDAWASLNTAPQFLD

SEQ ID NO: 3149517 - protein, 23 aa, Giardia lamblia
APVPMSHRIIWRNDHQPVIDSIY

SEQ ID NO: 3149518 - protein, 22 aa, Giardia lamblia
APVRSMRLWRTPMIMKVESEML

SEQ ID NO: 3149519 - protein, 18 aa, Giardia lamblia
APVSLPARDELYNQLCQI

SEQ ID NO: 3149520 - protein, 19 aa, Giardia lamblia
APVSSHMKVFFAASELIST

SEQ ID NO: 3149521 - protein, 27 aa, Giardia lamblia
APYLHNTWMGICLVMVKMRIRVTHTEE

SEQ ID NO: 3149522 - protein, 29 aa, Giardia lamblia
APYQRWPARMIAVVGCKSYIAILTLKTNT

SEQ ID NO: 3149523 - protein, 25 aa, Giardia lamblia
APYRAPEVILGLPFDEKADVWSVGC

SEQ ID NO: 3149524 - protein, 19 aa, Giardia lamblia
AQAAPDCRPLLVLIDGPPC

SEQ ID NO: 3149525 - protein, 20 aa, Giardia lamblia
AQAEKEWASYVQLRQDALDG

SEQ ID NO: 3149526 - protein, 22 aa, Giardia lamblia
AQAENVVSLWGQMTARELVHGG

SEQ ID NO: 3149527 - protein, 19 aa, Giardia lamblia
AQAKFYIFASVGLSSVQQL

SEQ ID NO: 3149528 - protein, 17 aa, Giardia lamblia
AQALAFLHKEARPLLFA

SEQ ID NO: 3149529 - protein, 19 aa, Giardia lamblia
AQANGRLALLKSLIAQMET

SEQ ID NO: 3149530 - protein, 26 aa, Giardia lamblia
AQASLVKTLECFQSEWLEVNAQGNLP

SEQ ID NO: 3149531 - protein, 20 aa, Giardia lamblia
AQAVQCTILASTLQADLNNL

SEQ ID NO: 3149532 - protein, 26 aa, Giardia lamblia
AQAYYKRLTLLLSYRHQYDEAMLNRR

SEQ ID NO: 3149533 - protein, 17 aa, Giardia lamblia
AQCELAKAQNANCDVDQ

SEQ ID NO: 3149534 - protein, 25 aa, Giardia lamblia
AQDLITHCRICRALQAEASSAGQQT

SEQ ID NO: 3149535 - protein, 22 aa, Giardia lamblia
AQEYKPGMAYMIEVFTTWCPPC

SEQ ID NO: 3149536 - protein, 19 aa, Giardia lamblia
AQFGVSVTLYIPVITECLL

SEQ ID NO: 3149537 - protein, 20 aa, Giardia lamblia
AQFLKGDKLIPVAEGGWLMD

SEQ ID NO: 3149538 - protein, 23 aa, Giardia lamblia
AQFYRACSYLHFNKMVSNDILTH

SEQ ID NO: 3149539 - protein, 22 aa, Giardia lamblia
AQGETALMLAVRSRDIQMVKLL

SEQ ID NO: 3149540 - protein, 20 aa, Giardia lamblia
AQGLGPCLFCGASCSNEQFA

SEQ ID NO: 3149541 - protein, 19 aa, Giardia lamblia
AQGLTALMCAAKNGSKDIV

SEQ ID NO: 3149542 - protein, 18 aa, Giardia lamblia
AQGSLLRISIQNTDATGP

SEQ ID NO: 3149543 - protein, 22 aa, Giardia lamblia
AQHFCIPGAGNVIVKSMKQLPD

SEQ ID NO: 3149544 - protein, 18 aa, Giardia lamblia
AQHLSSLVMAPGFSSPGN

SEQ ID NO: 3149545 - protein, 18 aa, Giardia lamblia
AQHTCRFTSLLQACDAAE

SEQ ID NO: 3149546 - protein, 18 aa, Giardia lamblia
AQIAGVVTETCRYGLPFT

SEQ ID NO: 3149547 - protein, 23 aa, Giardia lamblia
AQIKLRASANLSLLEQQVSDALN

SEQ ID NO: 3149548 - protein, 20 aa, Giardia lamblia
AQINELYILIGGILQNRDMS

SEQ ID NO: 3149549 - protein, 18 aa, Giardia lamblia
AQISRLRTLFAVDEPPSS

SEQ ID NO: 3149550 - protein, 24 aa, Giardia lamblia
AQKDFNERVAVLFACKQAVVECVN

SEQ ID NO: 3149551 - protein, 25 aa, Giardia lamblia
AQKRIIELLSEFLLKASVEACQQII

SEQ ID NO: 3149552 - protein, 20 aa, Giardia lamblia
AQKTSFCIFTGPQRIASPRV

SEQ ID NO: 3149553 - protein, 25 aa, Giardia lamblia
AQLCTHPKIVFYLTHNIQLQGISVA

SEQ ID NO: 3149554 - protein, 23 aa, Giardia lamblia
AQLEAQIAGLERLLADAQGGDDE

SEQ ID NO: 3149555 - protein, 19 aa, Giardia lamblia
AQLERRVAEQEVRILDQQE

SEQ ID NO: 3149556 - protein, 25 aa, Giardia lamblia
AQLGYLRIVQELSPLEAHILDQRGR

SEQ ID NO: 3149557 - protein, 19 aa, Giardia lamblia
AQLHDRIRYEMEARKHESE

SEQ ID NO: 3149558 - protein, 19 aa, Giardia lamblia
AQLILSTTALNIWSSETAG

SEQ ID NO: 3149559 - protein, 21 aa, Giardia lamblia
AQLIRRRPRTKIPSAPSDSET

SEQ ID NO: 3149560 - protein, 18 aa, Giardia lamblia
AQLKMYQKDVVDLTKEND

SEQ ID NO: 3149561 - protein, 17 aa, Giardia lamblia
AQLLLPEINCVRYNERT

SEQ ID NO: 3149562 - protein, 19 aa, Giardia lamblia
AQLPCKFNDRVFFGKHKFC

SEQ ID NO: 3149563 - protein, 20 aa, Giardia lamblia
AQLSPLILLQIENIKLKKQL

SEQ ID NO: 3149564 - protein, 26 aa, Giardia lamblia
AQLTDYCIVCLSLVPHHENLFLKIRC

SEQ ID NO: 3149565 - protein, 20 aa, Giardia lamblia
AQMSSMTQAFVRDTAETRRK

SEQ ID NO: 3149566 - protein, 19 aa, Giardia lamblia
AQNFLGGLYNLYADLYNGV

SEQ ID NO: 3149567 - protein, 22 aa, Giardia lamblia
AQNGLSETVLLYIQKILDADCD

SEQ ID NO: 3149568 - protein, 19 aa, Giardia lamblia
AQPGPLVFVLRGRDDDSTV

SEQ ID NO: 3149569 - protein, 21 aa, Giardia lamblia
AQPKFLVEIADNLSFTLFTHT

SEQ ID NO: 3149570 - protein, 25 aa, Giardia lamblia
AQPNLKFPGLNSFVGQSKIIDPCKY

SEQ ID NO: 3149571 - protein, 19 aa, Giardia lamblia
AQPSFARGSGIFWHDSLIH

SEQ ID NO: 3149572 - protein, 21 aa, Giardia lamblia
AQPVLRVRRVIIESMKNALKK

SEQ ID NO: 3149573 - protein, 23 aa, Giardia lamblia
AQQEYKAAVGAARSVDQQDEDLS

SEQ ID NO: 3149574 - protein, 17 aa, Giardia lamblia
AQQKYLQAVQEIRVRDL

SEQ ID NO: 3149575 - protein, 20 aa, Giardia lamblia
AQQSFKARWDGAKIASEQII

SEQ ID NO: 3149576 - protein, 21 aa, Giardia lamblia
AQRAFNLLIDRRRSCRRFLTA

SEQ ID NO: 3149577 - protein, 19 aa, Giardia lamblia
AQRANGIVIEHFLVTRLLI

SEQ ID NO: 3149578 - protein, 19 aa, Giardia lamblia
AQREIDLLKERLRDSEEDC

SEQ ID NO: 3149579 - protein, 22 aa, Giardia lamblia
AQRGDCAYLKQHIATMRRAVDS

SEQ ID NO: 3149580 - protein, 27 aa, Giardia lamblia
AQRGHLECVKLLLEKEGGMQNEDGETA

SEQ ID NO: 3149581 - protein, 21 aa, Giardia lamblia
AQRGIKPGIAPKEPRDQKDQE

SEQ ID NO: 3149582 - protein, 17 aa, Giardia lamblia
AQRGRTAFIPLLVDKEK

SEQ ID NO: 3149583 - protein, 19 aa, Giardia lamblia
AQRLPLPKLLELIRQKEVA

SEQ ID NO: 3149584 - protein, 19 aa, Giardia lamblia
AQRPSLFNVMSQVVDVLSH

SEQ ID NO: 3149585 - protein, 24 aa, Giardia lamblia
AQRRESHLRRSLSRQEAKLATKSS

SEQ ID NO: 3149586 - protein, 19 aa, Giardia lamblia
AQSACVVVKGLRRIFYILP

SEQ ID NO: 3149587 - protein, 20 aa, Giardia lamblia
AQSAPPRYATDVFVAEPENS

SEQ ID NO: 3149588 - protein, 25 aa, Giardia lamblia
AQSIAISNGIAFLVGARLIEYHDFS

SEQ ID NO: 3149589 - protein, 18 aa, Giardia lamblia
AQSISGLVTDFGKQLERI

SEQ ID NO: 3149590 - protein, 26 aa, Giardia lamblia
AQSKQGETALMFAAINGYTELVRMLK

SEQ ID NO: 3149591 - protein, 20 aa, Giardia lamblia
AQSPLWQNMEHRGGDVAPAA

SEQ ID NO: 3149592 - protein, 25 aa, Giardia lamblia
AQSRGAGLVTRIPFLNAKHAPVQGN

SEQ ID NO: 3149593 - protein, 17 aa, Giardia lamblia
AQSRGQILFNLFSNLVK

SEQ ID NO: 3149594 - protein, 22 aa, Giardia lamblia
AQSRLGYTALMEAARKGHTEVI

SEQ ID NO: 3149595 - protein, 18 aa, Giardia lamblia
AQTADAWSKQTDGIVMQC

SEQ ID NO: 3149596 - protein, 25 aa, Giardia lamblia
AQTALKRTTCPLSLDTLDDHWNSNS

SEQ ID NO: 3149597 - protein, 23 aa, Giardia lamblia
AQTLREVREFPLLRGQSKSRKGV

SEQ ID NO: 3149598 - protein, 24 aa, Giardia lamblia
AQTMLLRDRWSNAYSAFVEAFTLA

SEQ ID NO: 3149599 - protein, 18 aa, Giardia lamblia
AQTSYSFYQDDRRPNRYA

SEQ ID NO: 3149600 - protein, 40 aa, Giardia lamblia
AQVISPIWAIGVPWRIRPRHSGLWTYCYDQNVELAVPKVE

SEQ ID NO: 3149601 - protein, 33 aa, Giardia lamblia
AQVLKALQYLHSWCQKGYLGIVHRDIKPENLLI

SEQ ID NO: 3149602 - protein, 23 aa, Giardia lamblia
AQVLLPLHRIMYVKTILPQLSYC

SEQ ID NO: 3149603 - protein, 20 aa, Giardia lamblia
AQVLLRAEGKLVRPDGKSAL

SEQ ID NO: 3149604 - protein, 18 aa, Giardia lamblia
AQVNPGFTKVEIVDKQLN

SEQ ID NO: 3149605 - protein, 26 aa, Giardia lamblia
AQVPISARFGWLVINLKPAKQTLITN

SEQ ID NO: 3149606 - protein, 20 aa, Giardia lamblia
AQVPLYYFNRMAEFVCLREV

SEQ ID NO: 3149607 - protein, 17 aa, Giardia lamblia
AQVRGNELLRLERESVL

SEQ ID NO: 3149608 - protein, 18 aa, Giardia lamblia
AQYNRIVEMLAHRKQSAR

SEQ ID NO: 3149609 - protein, 19 aa, Giardia lamblia
AQYSWLRGRAGVLRIGDRR

SEQ ID NO: 3149610 - protein, 29 aa, Giardia lamblia
AQYTPRLRKFLGVCLRFDVTKRHLTNGLM

SEQ ID NO: 3149611 - protein, 17 aa, Giardia lamblia
ARAAAYAAYGLMEAQPN

SEQ ID NO: 3149612 - protein, 23 aa, Giardia lamblia
ARAALEGGLLPGGGVAFLRAAQV

SEQ ID NO: 3149613 - protein, 20 aa, Giardia lamblia
ARAGASFGDPACVVRLTGIP

SEQ ID NO: 3149614 - protein, 28 aa, Giardia lamblia
ARAGNIGCIPFLITDSLLVRDCEGRTAL

SEQ ID NO: 3149615 - protein, 27 aa, Giardia lamblia
ARAGPPFKSFCGQVGRLLGRITADCAE

SEQ ID NO: 3149616 - protein, 19 aa, Giardia lamblia
ARAIVKLLDVMALAPNPTT

SEQ ID NO: 3149617 - protein, 20 aa, Giardia lamblia
ARATDNYGWTALMMAADSGH

SEQ ID NO: 3149618 - protein, 23 aa, Giardia lamblia
ARAVEYLSRCKLVASSYDYLSVF

SEQ ID NO: 3149619 - protein, 26 aa, Giardia lamblia
ARAYIRCSWNKLGYGRQKLEAQRKPT

SEQ ID NO: 3149620 - protein, 19 aa, Giardia lamblia
ARCDILVALLWIFNTEGTK

SEQ ID NO: 3149621 - protein, 25 aa, Giardia lamblia
ARCHPGEAPGSYVLDGLLSSLEVLL

SEQ ID NO: 3149622 - protein, 21 aa, Giardia lamblia
ARCILRPDRQALFNQTVLPSF

SEQ ID NO: 3149623 - protein, 19 aa, Giardia lamblia
ARCMIGITRSIMKRHIEQN

SEQ ID NO: 3149624 - protein, 18 aa, Giardia lamblia
ARCSSYFLPKLRWMGDLL

SEQ ID NO: 3149625 - protein, 24 aa, Giardia lamblia
ARDAEHHECLILKQKLMVLEKDYL

SEQ ID NO: 3149626 - protein, 17 aa, Giardia lamblia
ARDCAPGNIAQKKALED

SEQ ID NO: 3149627 - protein, 26 aa, Giardia lamblia
ARDFIKENKWLAAHPDLIHEVPPSTH

SEQ ID NO: 3149628 - protein, 22 aa, Giardia lamblia
ARDFLSLKLWDIRSEGRPLITL

SEQ ID NO: 3149629 - protein, 25 aa, Giardia lamblia
ARDFYEVCAILGPYEADVRTADGRT

SEQ ID NO: 3149630 - protein, 31 aa, Giardia lamblia
ARDKGLCVYRFKRSDFIPPFPKAYDRSLAAL

SEQ ID NO: 3149631 - protein, 19 aa, Giardia lamblia
ARDLCSRMMSYDALERPDA

SEQ ID NO: 3149632 - protein, 25 aa, Giardia lamblia
ARDPRIFDKDVRFFSDDALPQAPAS

SEQ ID NO: 3149633 - protein, 19 aa, Giardia lamblia
ARDSKGWTALMYAVNTGDE

SEQ ID NO: 3149634 - protein, 20 aa, Giardia lamblia
ARDSLPYAHEYRSIHRMPQT

SEQ ID NO: 3149635 - protein, 19 aa, Giardia lamblia
ARDVERLGTPVLQLNSPLR

SEQ ID NO: 3149636 - protein, 22 aa, Giardia lamblia
AREATLCTLESTLLSRLLSTEA

SEQ ID NO: 3149637 - protein, 22 aa, Giardia lamblia
ARECALAGHYVTIFEALDQPGG

SEQ ID NO: 3149638 - protein, 24 aa, Giardia lamblia
AREFAKTLSWERCMVIEKNSSLDL

SEQ ID NO: 3149639 - protein, 22 aa, Giardia lamblia
AREGHLACIKVLAPYEAALSGG

SEQ ID NO: 3149640 - protein, 20 aa, Giardia lamblia
AREISRCRMAGATISQNRLF

SEQ ID NO: 3149641 - protein, 20 aa, Giardia lamblia
AREKYPFRKAHWSSKEDEAH

SEQ ID NO: 3149642 - protein, 20 aa, Giardia lamblia
AREPLRVFPYVYKRDELAKM

SEQ ID NO: 3149643 - protein, 25 aa, Giardia lamblia
ARERLRARISRRCKVATSQAEVLTK

SEQ ID NO: 3149644 - protein, 19 aa, Giardia lamblia
ARESFLTPNGRRITIIDAP

SEQ ID NO: 3149645 - protein, 18 aa, Giardia lamblia
ARFGKPLVRETKRTRPTF

SEQ ID NO: 3149646 - protein, 20 aa, Giardia lamblia
ARFIYASTILNDFADKHPQI

SEQ ID NO: 3149647 - protein, 22 aa, Giardia lamblia
ARFNPFPHRSFTHTLIFNTSLG

SEQ ID NO: 3149648 - protein, 19 aa, Giardia lamblia
ARFRCLKRELSNMSVYEDF

SEQ ID NO: 3149649 - protein, 17 aa, Giardia lamblia
ARFYESRLERERKRLEC

SEQ ID NO: 3149650 - protein, 25 aa, Giardia lamblia
ARFYRAASMKLAITAGVLLISSNTN

SEQ ID NO: 3149651 - protein, 23 aa, Giardia lamblia
ARGALIKHLRKTPVLDTYFAMIY

SEQ ID NO: 3149652 - protein, 17 aa, Giardia lamblia
ARGDLRRAFLLLQTYQY

SEQ ID NO: 3149653 - protein, 25 aa, Giardia lamblia
ARGDYEWYSYLDVLRMSSELFYGLQ

SEQ ID NO: 3149654 - protein, 19 aa, Giardia lamblia
ARGGHLACVQELIPHESTL

SEQ ID NO: 3149655 - protein, 20 aa, Giardia lamblia
ARGKTACKIASDYSYFEIVN

SEQ ID NO: 3149656 - protein, 18 aa, Giardia lamblia
ARGKTALMYAAENNSLAY

SEQ ID NO: 3149657 - protein, 21 aa, Giardia lamblia
ARGLRRVSFNSHVLYSSPTSP

SEQ ID NO: 3149658 - protein, 18 aa, Giardia lamblia
ARGPISRFRGVFDGDAMR

SEQ ID NO: 3149659 - protein, 22 aa, Giardia lamblia
ARGSIPVAKFLLEKASTSGGAV

SEQ ID NO: 3149660 - protein, 26 aa, Giardia lamblia
ARGYASCVRLLLGEVGFRDENGRTAL

SEQ ID NO: 3149661 - protein, 20 aa, Giardia lamblia
ARHEIYLWVDGIPLSRSKGY

SEQ ID NO: 3149662 - protein, 18 aa, Giardia lamblia
ARHGAGYEGGYVMDPVAG

SEQ ID NO: 3149663 - protein, 24 aa, Giardia lamblia
ARHILPIECLMIKIGFIPETQRAI

SEQ ID NO: 3149664 - protein, 18 aa, Giardia lamblia
ARHLARRQVQGSGRGCHP

SEQ ID NO: 3149665 - protein, 20 aa, Giardia lamblia
ARHPAARMLIELSQSQDIEA

SEQ ID NO: 3149666 - protein, 18 aa, Giardia lamblia
ARHPYKYRMIVPEVDCIF

SEQ ID NO: 3149667 - protein, 19 aa, Giardia lamblia
ARHSFTFNQVFGPNVSQAQ

SEQ ID NO: 3149668 - protein, 17 aa, Giardia lamblia
ARIAAALEREKKAASGS

SEQ ID NO: 3149669 - protein, 19 aa, Giardia lamblia
ARIDLRKKQLRHFAQIGES

SEQ ID NO: 3149670 - protein, 17 aa, Giardia lamblia
ARIIPRFEDISSDKLGY

SEQ ID NO: 3149671 - protein, 18 aa, Giardia lamblia
ARILVLHPVVAHLMVAAH

SEQ ID NO: 3149672 - protein, 17 aa, Giardia lamblia
ARILYYSLVATWAELLL

SEQ ID NO: 3149673 - protein, 18 aa, Giardia lamblia
ARIPRFVFLSHFLTRSGL

SEQ ID NO: 3149674 - protein, 21 aa, Giardia lamblia
ARIPTRRGFSALMFAVQEGHT

SEQ ID NO: 3149675 - protein, 18 aa, Giardia lamblia
ARIQTHFGTTALMDAACN

SEQ ID NO: 3149676 - protein, 22 aa, Giardia lamblia
ARITEKFVHLPLAIGQDLAISD

SEQ ID NO: 3149677 - protein, 27 aa, Giardia lamblia
ARKADFLRRVFAPQLVRGLRTYLGSVF

SEQ ID NO: 3149678 - protein, 20 aa, Giardia lamblia
ARKLVYLWANECTRVLPDKF

SEQ ID NO: 3149679 - protein, 21 aa, Giardia lamblia
ARKLYNWLNSYNCAMSISGKS

SEQ ID NO: 3149680 - protein, 18 aa, Giardia lamblia
ARKRICTALYHLLPKRVV

SEQ ID NO: 3149681 - protein, 22 aa, Giardia lamblia
ARKVCLLRSAQIVSERYSIYAP

SEQ ID NO: 3149682 - protein, 18 aa, Giardia lamblia
ARLADWYPSSALRSITDE

SEQ ID NO: 3149683 - protein, 18 aa, Giardia lamblia
ARLAREMEAGHKLAAEKD

SEQ ID NO: 3149684 - protein, 18 aa, Giardia lamblia
ARLCLRPLEAATCGFFQI

SEQ ID NO: 3149685 - protein, 19 aa, Giardia lamblia
ARLDGFVVILDCNPALAEL

SEQ ID NO: 3149686 - protein, 23 aa, Giardia lamblia
ARLDKLKVGIFPSSGPSPAEDTG

SEQ ID NO: 3149687 - protein, 18 aa, Giardia lamblia
ARLEQLSFVRCCITDTLL

SEQ ID NO: 3149688 - protein, 19 aa, Giardia lamblia
ARLETERSSFVLRLAENNS

SEQ ID NO: 3149689 - protein, 25 aa, Giardia lamblia
ARLFPDETGKEWARNIIEVEGEILL

SEQ ID NO: 3149690 - protein, 25 aa, Giardia lamblia
ARLGSLECVRLLKPYELGMKNDSGE

SEQ ID NO: 3149691 - protein, 24 aa, Giardia lamblia
ARLINASIVKRIRCTQKVSISLED

SEQ ID NO: 3149692 - protein, 18 aa, Giardia lamblia
ARLKELLQQKEFQLDQAL

SEQ ID NO: 3149693 - protein, 19 aa, Giardia lamblia
ARLKLQAECEAVKARIGLC

SEQ ID NO: 3149694 - protein, 19 aa, Giardia lamblia
ARLKTYYAQCEKLNRELEE

SEQ ID NO: 3149695 - protein, 17 aa, Giardia lamblia
ARLLAPHEAGLRLPSGQ

SEQ ID NO: 3149696 - protein, 19 aa, Giardia lamblia
ARLLDRLATVLGIIRKYLS

SEQ ID NO: 3149697 - protein, 19 aa, Giardia lamblia
ARLLKHFDHVLSESSVTLR

SEQ ID NO: 3149698 - protein, 28 aa, Giardia lamblia
ARLLPMSPRARRGSINPQNFFTADANGS

SEQ ID NO: 3149699 - protein, 21 aa, Giardia lamblia
ARLMMWYKIYKKGLAERYRVH

SEQ ID NO: 3149700 - protein, 17 aa, Giardia lamblia
ARLMSRDRIETHPAHMG

SEQ ID NO: 3149701 - protein, 18 aa, Giardia lamblia
ARLPGSPDDAGFDNRTLL

SEQ ID NO: 3149702 - protein, 31 aa, Giardia lamblia
ARLQIPSEIVLLMELCVGGSIVDVMQRAPNS

SEQ ID NO: 3149703 - protein, 18 aa, Giardia lamblia
ARLQRVILSKDASTQKIL

SEQ ID NO: 3149704 - protein, 25 aa, Giardia lamblia
ARLRARRILCQMVMLSLPSDDTKAY

SEQ ID NO: 3149705 - protein, 17 aa, Giardia lamblia
ARLRHFLENNKALLDEK

SEQ ID NO: 3149706 - protein, 25 aa, Giardia lamblia
ARLRMDKGKVYTWYFNTWSNKTLGP

SEQ ID NO: 3149707 - protein, 17 aa, Giardia lamblia
ARLSMGLPRQIFKMHSL

SEQ ID NO: 3149708 - protein, 21 aa, Giardia lamblia
ARLSPSAARPNISIHAAASAL

SEQ ID NO: 3149709 - protein, 24 aa, Giardia lamblia
ARLSQKRFNPMLTDVTVFSSGRQS

SEQ ID NO: 3149710 - protein, 17 aa, Giardia lamblia
ARLTFSLQPPQILMFDT

SEQ ID NO: 3149711 - protein, 17 aa, Giardia lamblia
ARLTLDLQTAWTQFHTA

SEQ ID NO: 3149712 - protein, 30 aa, Giardia lamblia
ARLVSKIPGARLCALSGGSAHNAIPGSCQA

SEQ ID NO: 3149713 - protein, 19 aa, Giardia lamblia
ARMAQAFPTELGNMSGGLT

SEQ ID NO: 3149714 - protein, 18 aa, Giardia lamblia
ARMERRRQLYIAAQRRAE

SEQ ID NO: 3149715 - protein, 20 aa, Giardia lamblia
ARMFDVPFIMGACSDDEREC

SEQ ID NO: 3149716 - protein, 23 aa, Giardia lamblia
ARMHAPSGWTAMMFASSEGNTSL

SEQ ID NO: 3149717 - protein, 17 aa, Giardia lamblia
ARMKKELNDVLSNQKYK

SEQ ID NO: 3149718 - protein, 18 aa, Giardia lamblia
ARMKMCKIMLEEYQARLI

SEQ ID NO: 3149719 - protein, 17 aa, Giardia lamblia
ARMLARYEGIDVRDVST

SEQ ID NO: 3149720 - protein, 18 aa, Giardia lamblia
ARMRRDILAQKALTRSGI

SEQ ID NO: 3149721 - protein, 17 aa, Giardia lamblia
ARMVAKLVRAGMVEIYE

SEQ ID NO: 3149722 - protein, 25 aa, Giardia lamblia
ARNGHAAVCKLLVGLEKGCKLPNGQ

SEQ ID NO: 3149723 - protein, 26 aa, Giardia lamblia
ARNGHPECVRLLLGRESGMKNDKGWT

SEQ ID NO: 3149724 - protein, 26 aa, Giardia lamblia
ARNGHPECVRLLLKEEGGMRNNKGWT

SEQ ID NO: 3149725 - protein, 19 aa, Giardia lamblia
ARNPLLKRFYDAIKPANIS

SEQ ID NO: 3149726 - protein, 25 aa, Giardia lamblia
ARNRGYNFALARVFNSVVQDIMMGV

SEQ ID NO: 3149727 - protein, 18 aa, Giardia lamblia
ARNSIRIMEPEASNDRSM

SEQ ID NO: 3149728 - protein, 19 aa, Giardia lamblia
ARNTIDGMFAIIEKDPEEF

SEQ ID NO: 3149729 - protein, 25 aa, Giardia lamblia
ARNTIPWAETIVHGAITPDNILLLD

SEQ ID NO: 3149730 - protein, 21 aa, Giardia lamblia
ARNTLRYGHVMIMTDQDPDGS

SEQ ID NO: 3149731 - protein, 20 aa, Giardia lamblia
ARPDDFARQLGIEEVEPRTY

SEQ ID NO: 3149732 - protein, 20 aa, Giardia lamblia
ARPEGLQVLLSFHNDPIQKA

SEQ ID NO: 3149733 - protein, 22 aa, Giardia lamblia
ARPGHLVKVAVKFFTRKKDSIS

SEQ ID NO: 3149734 - protein, 20 aa, Giardia lamblia
ARPGSAFSGRSKRASSATVF

SEQ ID NO: 3149735 - protein, 21 aa, Giardia lamblia
ARPITNMGMPGTRAVGGQRQV

SEQ ID NO: 3149736 - protein, 20 aa, Giardia lamblia
ARPKPAVGVEKSVKLPSSSI

SEQ ID NO: 3149737 - protein, 21 aa, Giardia lamblia
ARPLPYAGVRGSFITTQLMKE

SEQ ID NO: 3149738 - protein, 22 aa, Giardia lamblia
ARPRAKGGYSYVYQGWHESDER

SEQ ID NO: 3149739 - protein, 21 aa, Giardia lamblia
ARQEILASIVLAIPYNMEPQT

SEQ ID NO: 3149740 - protein, 22 aa, Giardia lamblia
ARQFVRVCLALTVAEQASLLRF

SEQ ID NO: 3149741 - protein, 37 aa, Giardia lamblia
ARQGRKEIVAFLAPRMAGLQGRSGWTALMAAATSDSV

SEQ ID NO: 3149742 - protein, 19 aa, Giardia lamblia
ARQKCRFTVPRAFWEAVRD

SEQ ID NO: 3149743 - protein, 28 aa, Giardia lamblia
ARQKRIFLPPVFLTLLLEITRYELHVMS

SEQ ID NO: 3149744 - protein, 25 aa, Giardia lamblia
ARQNDVVALWSFLPVQSGLQDAQGR

SEQ ID NO: 3149745 - protein, 21 aa, Giardia lamblia
ARQRPQPVNSYNAANTIQNNA

SEQ ID NO: 3149746 - protein, 21 aa, Giardia lamblia
ARQRRGRRAAIAAPAENREID

SEQ ID NO: 3149747 - protein, 21 aa, Giardia lamblia
ARQSSHCKFGPLSTSTLSLMV

SEQ ID NO: 3149748 - protein, 20 aa, Giardia lamblia
ARRAMQRKGIDIGSPSLSHN

SEQ ID NO: 3149749 - protein, 20 aa, Giardia lamblia
ARRAQLDFIERYRTALVEGR

SEQ ID NO: 3149750 - protein, 21 aa, Giardia lamblia
ARRDIGEIVEQLILNLSAQET

SEQ ID NO: 3149751 - protein, 26 aa, Giardia lamblia
ARRDVWGVLFDRFIDRALTWVDACNK

SEQ ID NO: 3149752 - protein, 19 aa, Giardia lamblia
ARREIRRKAALRTEQKLKL

SEQ ID NO: 3149753 - protein, 28 aa, Giardia lamblia
ARRIAYSSSLGFKCITLDGDVVSPSGNV

SEQ ID NO: 3149754 - protein, 18 aa, Giardia lamblia
ARRIKRCEQEFLIDVFRY

SEQ ID NO: 3149755 - protein, 20 aa, Giardia lamblia
ARRMAHCRATGIPYQSPLQL

SEQ ID NO: 3149756 - protein, 17 aa, Giardia lamblia
ARRMRRGGRKVVLVPKK

SEQ ID NO: 3149757 - protein, 23 aa, Giardia lamblia
ARRRPPCANFAVQVRPRSDFAAE

SEQ ID NO: 3149758 - protein, 21 aa, Giardia lamblia
ARRSGCIEFDLTQLSRLDYSV

SEQ ID NO: 3149759 - protein, 21 aa, Giardia lamblia
ARRVMYRQLMFPRSQSERRPR

SEQ ID NO: 3149760 - protein, 35 aa, Giardia lamblia
ARSGGDGIPVFAPRHLRYKLAFDAPAFRYVKAYSN

SEQ ID NO: 3149761 - protein, 24 aa, Giardia lamblia
ARSGKRPSTDLLFTGRPDAKVPST

SEQ ID NO: 3149762 - protein, 20 aa, Giardia lamblia
ARSIAWDLVVDELKKVRESV

SEQ ID NO: 3149763 - protein, 19 aa, Giardia lamblia
ARSKLPESAVWEIVAQVLK

SEQ ID NO: 3149764 - protein, 21 aa, Giardia lamblia
ARSKMAASIAESRLEAYLREK

SEQ ID NO: 3149765 - protein, 22 aa, Giardia lamblia
ARSLGSLLYYLTTGMELKLPLS

SEQ ID NO: 3149766 - protein, 21 aa, Giardia lamblia
ARSLLSDKLGANWTREFDKYM

SEQ ID NO: 3149767 - protein, 20 aa, Giardia lamblia
ARSPPFLPPFSRPFRYAKLK

SEQ ID NO: 3149768 - protein, 18 aa, Giardia lamblia
ARSPTGWLAASSTGALIG

SEQ ID NO: 3149769 - protein, 20 aa, Giardia lamblia
ARSQDFYTMYNVCTDSVDSF

SEQ ID NO: 3149770 - protein, 20 aa, Giardia lamblia
ARTGVIGNLAMDKHVLEENE

SEQ ID NO: 3149771 - protein, 26 aa, Giardia lamblia
ARTGVQIPVTIPSTITPLVVDPPSIL

SEQ ID NO: 3149772 - protein, 29 aa, Giardia lamblia
ARTHNKPILGLCLGFQMMVCEFARNVCGL

SEQ ID NO: 3149773 - protein, 21 aa, Giardia lamblia
ARTIYQLALEKQRLMAVEEDL

SEQ ID NO: 3149774 - protein, 18 aa, Giardia lamblia
ARTKQCVTQLMLENHKLV

SEQ ID NO: 3149775 - protein, 17 aa, Giardia lamblia
ARTLYRSMHLLELQCLE

SEQ ID NO: 3149776 - protein, 27 aa, Giardia lamblia
ARTMLSIVCPFCSRVKISEADRLKYKV

SEQ ID NO: 3149777 - protein, 24 aa, Giardia lamblia
ARTNLDGLIAFCIEYKGSRSLLEM

SEQ ID NO: 3149778 - protein, 21 aa, Giardia lamblia
ARTNVMKTIWSLLSSTNSKSW

SEQ ID NO: 3149779 - protein, 20 aa, Giardia lamblia
ARTSIKPAARLVFPVPPKRH

SEQ ID NO: 3149780 - protein, 28 aa, Giardia lamblia
ARTTQFSWIFNRLIGLRMHTDAIYHPYK

SEQ ID NO: 3149781 - protein, 23 aa, Giardia lamblia
ARVCRCYHSSYPLLDAEKEADRT

SEQ ID NO: 3149782 - protein, 17 aa, Giardia lamblia
ARVEAYGAGAAGTRLLG

SEQ ID NO: 3149783 - protein, 18 aa, Giardia lamblia
ARVGGPMDPLLKEDDVPN

SEQ ID NO: 3149784 - protein, 19 aa, Giardia lamblia
ARVIRCIDTESGLLTTDSQ

SEQ ID NO: 3149785 - protein, 25 aa, Giardia lamblia
ARVKNARHIIVWPISQKDERVTNSK

SEQ ID NO: 3149786 - protein, 19 aa, Giardia lamblia
ARVLPAVRGRLRRRPGGGP

SEQ ID NO: 3149787 - protein, 21 aa, Giardia lamblia
ARVRRQVCSALSQLAKHSVEL

SEQ ID NO: 3149788 - protein, 24 aa, Giardia lamblia
ARVRSSINIKELFSSSSRNAAILS

SEQ ID NO: 3149789 - protein, 19 aa, Giardia lamblia
ARWPNFHILCIKDMAGLLR

SEQ ID NO: 3149790 - protein, 37 aa, Giardia lamblia
ARYGHINIVKALMCYELGIKDRNGWTALLHAVDADQL

SEQ ID NO: 3149791 - protein, 17 aa, Giardia lamblia
ARYNFLQHLNLFLEIVP

SEQ ID NO: 3149792 - protein, 19 aa, Giardia lamblia
ARYPAFPFNPLSIVTEESR

SEQ ID NO: 3149793 - protein, 22 aa, Giardia lamblia
ARYRIKRLEKEYTDLKSTHIHN

SEQ ID NO: 3149794 - protein, 20 aa, Giardia lamblia
ARYTDMWDVQGGLDDVRKRE

SEQ ID NO: 3149795 - protein, 20 aa, Giardia lamblia
ASAAELLRRVRYEAAAAQFI

SEQ ID NO: 3149796 - protein, 29 aa, Giardia lamblia
ASADFLRQSLCLAYGPAFISKCFITLNGY

SEQ ID NO: 3149797 - protein, 18 aa, Giardia lamblia
ASAEELVGYLGYGLERRH

SEQ ID NO: 3149798 - protein, 20 aa, Giardia lamblia
ASAESSAFCTASKDGTVRLW

SEQ ID NO: 3149799 - protein, 20 aa, Giardia lamblia
ASAKPSKGSIAFLSQSGAML

SEQ ID NO: 3149800 - protein, 24 aa, Giardia lamblia
ASALKLPKYPVFTATPIDDPGKIL

SEQ ID NO: 3149801 - protein, 18 aa, Giardia lamblia
ASAMRGAIERVCAKIEGI

SEQ ID NO: 3149802 - protein, 17 aa, Giardia lamblia
ASARLPVNLQKLTYINK

SEQ ID NO: 3149803 - protein, 23 aa, Giardia lamblia
ASARTALFHAVENGFLAIARFLA

SEQ ID NO: 3149804 - protein, 27 aa, Giardia lamblia
ASASRASCLTGLLPRSVSASVRVNPHP

SEQ ID NO: 3149805 - protein, 24 aa, Giardia lamblia
ASASRLEALSAMFPTDGNPESPPP

SEQ ID NO: 3149806 - protein, 24 aa, Giardia lamblia
ASAYKKACLKWHPDRHRDPVKKRF

SEQ ID NO: 3149807 - protein, 25 aa, Giardia lamblia
ASCDLCGKCALCLMEKSFCNQQLRR

SEQ ID NO: 3149808 - protein, 18 aa, Giardia lamblia
ASCFGCESHSTALHVILS

SEQ ID NO: 3149809 - protein, 20 aa, Giardia lamblia
ASCHFYRFINCHTHCYTVDT

SEQ ID NO: 3149810 - protein, 20 aa, Giardia lamblia
ASCIWYMIIGTSVKASDLSV

SEQ ID NO: 3149811 - protein, 17 aa, Giardia lamblia
ASCPPAFAPDGSAIYSA

SEQ ID NO: 3149812 - protein, 18 aa, Giardia lamblia
ASCSVIFEHDYSKLIQSL

SEQ ID NO: 3149813 - protein, 26 aa, Giardia lamblia
ASDAEFKRSLQGGAFPTTQSLSAKGQ

SEQ ID NO: 3149814 - protein, 19 aa, Giardia lamblia
ASDAFLRKITEPWHLSVYV

SEQ ID NO: 3149815 - protein, 24 aa, Giardia lamblia
ASDCATHLLVSYKSVRNLTPQQHW

SEQ ID NO: 3149816 - protein, 24 aa, Giardia lamblia
ASDFSLPCNAVIFLNLHGKVDGFF

SEQ ID NO: 3149817 - protein, 34 aa, Giardia lamblia
ASDGRRAVQFAAEWGCLACVDMLMDYEGDQAKLT

SEQ ID NO: 3149818 - protein, 19 aa, Giardia lamblia
ASDLLEIGIKLGIPDLKGT

SEQ ID NO: 3149819 - protein, 18 aa, Giardia lamblia
ASDLPIVHLAASPSSSYI

SEQ ID NO: 3149820 - protein, 23 aa, Giardia lamblia
ASDMSRIVRFSGHAIYDYEQEPA

SEQ ID NO: 3149821 - protein, 32 aa, Giardia lamblia
ASDNRLGIHHFIKFNCTILRLSSNLVTDDVIE

SEQ ID NO: 3149822 - protein, 22 aa, Giardia lamblia
ASDPKLSLTLGINTMPEENNGH

SEQ ID NO: 3149823 - protein, 24 aa, Giardia lamblia
ASDTKFGGIFGIRRRPRQMATDTS

SEQ ID NO: 3149824 - protein, 23 aa, Giardia lamblia
ASDVFPIRGLLCISIIDYCKTHT

SEQ ID NO: 3149825 - protein, 17 aa, Giardia lamblia
ASEDSPCPLTMTDEELR

SEQ ID NO: 3149826 - protein, 24 aa, Giardia lamblia
ASEILLLREVQGIIYRRTAPSEQK

SEQ ID NO: 3149827 - protein, 26 aa, Giardia lamblia
ASEKASSCSKCKLLMAQNTALTRENE

SEQ ID NO: 3149828 - protein, 24 aa, Giardia lamblia
ASEKLPEDYLWAVVSQVVQAIKTL

SEQ ID NO: 3149829 - protein, 22 aa, Giardia lamblia
ASESRMYVRGRFIYTPEETDIN

SEQ ID NO: 3149830 - protein, 19 aa, Giardia lamblia
ASFCGRVLANCGICLLIER

SEQ ID NO: 3149831 - protein, 17 aa, Giardia lamblia
ASFDFPDIDPSVITASM

SEQ ID NO: 3149832 - protein, 17 aa, Giardia lamblia
ASFELRIAQLERELDGA

SEQ ID NO: 3149833 - protein, 18 aa, Giardia lamblia
ASFEVGYRPEAFPKERHC

SEQ ID NO: 3149834 - protein, 17 aa, Giardia lamblia
ASFFGLRGYYNCEVRDF

SEQ ID NO: 3149835 - protein, 26 aa, Giardia lamblia
ASFGKAECIPALLVETAEIDNKGMTA

SEQ ID NO: 3149836 - protein, 19 aa, Giardia lamblia
ASFLEKFIDYGLINIGKVS

SEQ ID NO: 3149837 - protein, 25 aa, Giardia lamblia
ASFLIPYERNLILDGAFTPLMVCAL

SEQ ID NO: 3149838 - protein, 21 aa, Giardia lamblia
ASFLLPLKPLFGALSEQMDPV

SEQ ID NO: 3149839 - protein, 29 aa, Giardia lamblia
ASFLRTSRFLRFCSYIGGTFTEASDHTLG

SEQ ID NO: 3149840 - protein, 19 aa, Giardia lamblia
ASFQPRIAMNSVNIKRLLS

SEQ ID NO: 3149841 - protein, 27 aa, Giardia lamblia
ASFRMLEPRSGFSTVPPGPYPVGRQSF

SEQ ID NO: 3149842 - protein, 24 aa, Giardia lamblia
ASFTFLPQNRFPGGAGPVNPVASE

SEQ ID NO: 3149843 - protein, 27 aa, Giardia lamblia
ASFVSRLETPGGMSFSRPFSRLNSNIP

SEQ ID NO: 3149844 - protein, 25 aa, Giardia lamblia
ASGAEFGFDIIMLCPEGSDAESFRL

SEQ ID NO: 3149845 - protein, 35 aa, Giardia lamblia
ASGESSFLLASNMRAFRALKCLLTAPQTALSQDEL

SEQ ID NO: 3149846 - protein, 24 aa, Giardia lamblia
ASGFTRIANMLVIKEAGERDNQGR

SEQ ID NO: 3149847 - protein, 18 aa, Giardia lamblia
ASGKIAQCIAENGDAPTM

SEQ ID NO: 3149848 - protein, 18 aa, Giardia lamblia
ASGKPVHTVSLLNASGSD

SEQ ID NO: 3149849 - protein, 17 aa, Giardia lamblia
ASGSPGYGASYPLATQP

SEQ ID NO: 3149850 - protein, 25 aa, Giardia lamblia
ASHAKRLEDAIAWMYHWHTDRSTWT

SEQ ID NO: 3149851 - protein, 17 aa, Giardia lamblia
ASIAALCLTGATEFQNK

SEQ ID NO: 3149852 - protein, 28 aa, Giardia lamblia
ASIADPHFAGWRPKSLRGPSTPSPMQSK

SEQ ID NO: 3149853 - protein, 26 aa, Giardia lamblia
ASIERINKAWLLKTLLYQAKQVNNHG

SEQ ID NO: 3149854 - protein, 20 aa, Giardia lamblia
ASIGRAKSLIAFQHLLFIVL

SEQ ID NO: 3149855 - protein, 22 aa, Giardia lamblia
ASILNTIGLCFTQLLDYEAATV

SEQ ID NO: 3149856 - protein, 18 aa, Giardia lamblia
ASILRRKTFERRWNPLRK

SEQ ID NO: 3149857 - protein, 21 aa, Giardia lamblia
ASILYFCCCDMANIDSMYQYS

SEQ ID NO: 3149858 - protein, 19 aa, Giardia lamblia
ASINHFLSLACDFASKCTI

SEQ ID NO: 3149859 - protein, 22 aa, Giardia lamblia
ASKAFCPPQDFNKVLRPKSVGF

SEQ ID NO: 3149860 - protein, 23 aa, Giardia lamblia
ASKELPCTYSFDTVEDLFDHLHP

SEQ ID NO: 3149861 - protein, 17 aa, Giardia lamblia
ASKIRRLFGLPTTKVDP

SEQ ID NO: 3149862 - protein, 17 aa, Giardia lamblia
ASKQISHTVILPKIIAR

SEQ ID NO: 3149863 - protein, 26 aa, Giardia lamblia
ASKRQGGQLGIWFRVSIFDMTNRLIV

SEQ ID NO: 3149864 - protein, 29 aa, Giardia lamblia
ASLAYWSNHKQIFCMLAQAELSIRDARGN

SEQ ID NO: 3149865 - protein, 23 aa, Giardia lamblia
ASLCDNCAKLTRQNNELSAELNR

SEQ ID NO: 3149866 - protein, 17 aa, Giardia lamblia
ASLDMLCRAIIRYKSQR

SEQ ID NO: 3149867 - protein, 24 aa, Giardia lamblia
ASLEKRYADLLADLFTRSDGFATQ

SEQ ID NO: 3149868 - protein, 31 aa, Giardia lamblia
ASLEQRFCIVPSKMRLALLISTLAFETVKAS

SEQ ID NO: 3149869 - protein, 20 aa, Giardia lamblia
ASLERRRSLILQKLAGAQAR

SEQ ID NO: 3149870 - protein, 26 aa, Giardia lamblia
ASLGNLEICKLLAPYENSFSTVSATA

SEQ ID NO: 3149871 - protein, 24 aa, Giardia lamblia
ASLGSSKLHHCAQCDQYREELENA

SEQ ID NO: 3149872 - protein, 24 aa, Giardia lamblia
ASLHYRISVQFAPGLLTNFAYAFV

SEQ ID NO: 3149873 - protein, 22 aa, Giardia lamblia
ASLKATADWLKLQRPDISSTTP

SEQ ID NO: 3149874 - protein, 20 aa, Giardia lamblia
ASLLRFCTGIPYLESNVLVT

SEQ ID NO: 3149875 - protein, 18 aa, Giardia lamblia
ASLLVPYEKDRIGSEGKT

SEQ ID NO: 3149876 - protein, 29 aa, Giardia lamblia
ASLNSVEIMPCCTLLRVFTVKTCPLPTLE

SEQ ID NO: 3149877 - protein, 26 aa, Giardia lamblia
ASLNYSGICKALIPYEKAICTPDGRN

SEQ ID NO: 3149878 - protein, 25 aa, Giardia lamblia
ASLPQRMVTTDVMWTSDVQHLLDTK

SEQ ID NO: 3149879 - protein, 25 aa, Giardia lamblia
ASLPSYKKTCTIPLQTEEEPLNNLG

SEQ ID NO: 3149880 - protein, 17 aa, Giardia lamblia
ASLRPIAHRLGTVPRPA

SEQ ID NO: 3149881 - protein, 23 aa, Giardia lamblia
ASLRYGVNCDFSAQLKEHCQVLH

SEQ ID NO: 3149882 - protein, 19 aa, Giardia lamblia
ASLSSPCYSSLPEKPKGAS

SEQ ID NO: 3149883 - protein, 17 aa, Giardia lamblia
ASLTHCFRQSDKSFINM

SEQ ID NO: 3149884 - protein, 20 aa, Giardia lamblia
ASLTRKQPGPSILSQQTATA

SEQ ID NO: 3149885 - protein, 27 aa, Giardia lamblia
ASLVKLWKNEFMRVFADRLICPEDHAV

SEQ ID NO: 3149886 - protein, 19 aa, Giardia lamblia
ASLVKPRVIVLLVQADAVD

SEQ ID NO: 3149887 - protein, 17 aa, Giardia lamblia
ASLYAGIRRQCIGPEPW

SEQ ID NO: 3149888 - protein, 22 aa, Giardia lamblia
ASMQVCGFCGKDSGVQPTCPYC

SEQ ID NO: 3149889 - protein, 21 aa, Giardia lamblia
ASMRGSNGWTALMLAAANGYS

SEQ ID NO: 3149890 - protein, 25 aa, Giardia lamblia
ASNRQAPSWPTQRLSGSRTQYSAKR

SEQ ID NO: 3149891 - protein, 21 aa, Giardia lamblia
ASPDLFPTHIVELKVDQEAVV

SEQ ID NO: 3149892 - protein, 20 aa, Giardia lamblia
ASPFCKKCGNKTMMKVAMYI

SEQ ID NO: 3149893 - protein, 19 aa, Giardia lamblia
ASPFPIAIARILIQRLKCI

SEQ ID NO: 3149894 - protein, 26 aa, Giardia lamblia
ASPLIYSLLHLFGYNLSMDDLRHFRQ

SEQ ID NO: 3149895 - protein, 25 aa, Giardia lamblia
ASPNRRPTVPKSFVHPGHGESTYLI

SEQ ID NO: 3149896 - protein, 17 aa, Giardia lamblia
ASPRRVLANAFISGAHI

SEQ ID NO: 3149897 - protein, 19 aa, Giardia lamblia
ASQEALSCYGKVYNALEKT

SEQ ID NO: 3149898 - protein, 17 aa, Giardia lamblia
ASQLHRGTMVLAIVANV

SEQ ID NO: 3149899 - protein, 18 aa, Giardia lamblia
ASQLKLVTIYVVKMSEKR

SEQ ID NO: 3149900 - protein, 18 aa, Giardia lamblia
ASRALALLVRAYVGRDTI

SEQ ID NO: 3149901 - protein, 18 aa, Giardia lamblia
ASRAPLMDGNGYAYSYSH

SEQ ID NO: 3149902 - protein, 19 aa, Giardia lamblia
ASRARWLLLGKETELRLLV

SEQ ID NO: 3149903 - protein, 17 aa, Giardia lamblia
ASRCPRHDPSIFRTSFY

SEQ ID NO: 3149904 - protein, 21 aa, Giardia lamblia
ASRDASCRVWYVPKEQSDSSR

SEQ ID NO: 3149905 - protein, 17 aa, Giardia lamblia
ASREFALFCHRQKKWNI

SEQ ID NO: 3149906 - protein, 24 aa, Giardia lamblia
ASRFQFCLKDKVSVREISPAVDSK

SEQ ID NO: 3149907 - protein, 19 aa, Giardia lamblia
ASRIPRPVSENAATRRQES

SEQ ID NO: 3149908 - protein, 28 aa, Giardia lamblia
ASRKHPGWMCSPVLKVLASVLEILSLHV

SEQ ID NO: 3149909 - protein, 17 aa, Giardia lamblia
ASRKIVDPPEKWMPNPD

SEQ ID NO: 3149910 - protein, 27 aa, Giardia lamblia
ASRPVCVFPDIRQCATTMWNDTIIVGL

SEQ ID NO: 3149911 - protein, 31 aa, Giardia lamblia
ASRSIRRICYSHGGPVRSIACVNSSSSLLLS

SEQ ID NO: 3149912 - protein, 20 aa, Giardia lamblia
ASSAPSDYTALMVAAGLNDI

SEQ ID NO: 3149913 - protein, 17 aa, Giardia lamblia
ASSCRDAFAKGLIRKYD

SEQ ID NO: 3149914 - protein, 19 aa, Giardia lamblia
ASSCYSELSANRVSLTEGI

SEQ ID NO: 3149915 - protein, 18 aa, Giardia lamblia
ASSELLGSLSSLQKNHIS

SEQ ID NO: 3149916 - protein, 18 aa, Giardia lamblia
ASSELPRPHTDAGALDQS

SEQ ID NO: 3149917 - protein, 24 aa, Giardia lamblia
ASSESRPTNSLPRAQRRAKSKSSI

SEQ ID NO: 3149918 - protein, 18 aa, Giardia lamblia
ASSGRSSAKPVLAKSGTK

SEQ ID NO: 3149919 - protein, 33 aa, Giardia lamblia
ASSIDSRGTFPIMRNRPSLYFQELEGQYHSWRF

SEQ ID NO: 3149920 - protein, 20 aa, Giardia lamblia
ASSIKLLLLEPTHEEVKITE

SEQ ID NO: 3149921 - protein, 20 aa, Giardia lamblia
ASSIVDLLAYVRLARINNTT

SEQ ID NO: 3149922 - protein, 24 aa, Giardia lamblia
ASSLDDLKYVLGNFFDQSDALREE

SEQ ID NO: 3149923 - protein, 18 aa, Giardia lamblia
ASSMLFEARGPTAHGSSV

SEQ ID NO: 3149924 - protein, 25 aa, Giardia lamblia
ASSNARYAAPEIRAGAEYSSAADMW

SEQ ID NO: 3149925 - protein, 23 aa, Giardia lamblia
ASSPSLLCAMQYPTQHQYPSSFP

SEQ ID NO: 3149926 - protein, 17 aa, Giardia lamblia
ASSQGPRHNVWLDFLNS

SEQ ID NO: 3149927 - protein, 17 aa, Giardia lamblia
ASSRRGSVASVDHSDAE

SEQ ID NO: 3149928 - protein, 18 aa, Giardia lamblia
ASSRSLFGTILHKIGLGG

SEQ ID NO: 3149929 - protein, 19 aa, Giardia lamblia
ASSRTRWDAAKTMGITEAG

SEQ ID NO: 3149930 - protein, 39 aa, Giardia lamblia
ASSSQRPASVFLPRSHPLSEYRSASVLRTSSGDEKIPSS

SEQ ID NO: 3149931 - protein, 19 aa, Giardia lamblia
ASSVISWFTAYERRLSVVK

SEQ ID NO: 3149932 - protein, 17 aa, Giardia lamblia
ASSVRRDSGFSPIYGFR

SEQ ID NO: 3149933 - protein, 19 aa, Giardia lamblia
ASTANHCRTALMAAAACGY

SEQ ID NO: 3149934 - protein, 30 aa, Giardia lamblia
ASTDLLIKYPLEWLELNPTKIQACKLPALG

SEQ ID NO: 3149935 - protein, 18 aa, Giardia lamblia
ASTIKWPNDIIVDGEKCA

SEQ ID NO: 3149936 - protein, 17 aa, Giardia lamblia
ASTILYFITEEPQSAFS

SEQ ID NO: 3149937 - protein, 20 aa, Giardia lamblia
ASTLLPYGGGLTMPDGTTAL

SEQ ID NO: 3149938 - protein, 18 aa, Giardia lamblia
ASTPIEWHTKSNSHFTRS

SEQ ID NO: 3149939 - protein, 31 aa, Giardia lamblia
ASTSLFKAKLLPALARYVVANAYFNGNRLSN

SEQ ID NO: 3149940 - protein, 27 aa, Giardia lamblia
ASTSTLRLPGFMSNDLLSLVSSLVPTP

SEQ ID NO: 3149941 - protein, 20 aa, Giardia lamblia
ASTTPAIYWKKVAKEYPEFI

SEQ ID NO: 3149942 - protein, 23 aa, Giardia lamblia
ASTTRLYLRKGRGDTRVAKIYDS

SEQ ID NO: 3149943 - protein, 25 aa, Giardia lamblia
ASVAELLVDCAFGLPNGIFPEYSYY

SEQ ID NO: 3149944 - protein, 21 aa, Giardia lamblia
ASVARPCLARGGDVATKTIVI

SEQ ID NO: 3149945 - protein, 19 aa, Giardia lamblia
ASVGFCPRERITVPSSAVV

SEQ ID NO: 3149946 - protein, 17 aa, Giardia lamblia
ASVGICSDPILNRSGDK

SEQ ID NO: 3149947 - protein, 23 aa, Giardia lamblia
ASVGLKAAHFLAAGIDITNLPVL

SEQ ID NO: 3149948 - protein, 21 aa, Giardia lamblia
ASVILPFLRLVWGDASPSKIT

SEQ ID NO: 3149949 - protein, 20 aa, Giardia lamblia
ASVKRGKIISPIQCTNCDSL

SEQ ID NO: 3149950 - protein, 28 aa, Giardia lamblia
ASVKVLYKYLYLREALTAAIMILPERFQ

SEQ ID NO: 3149951 - protein, 26 aa, Giardia lamblia
ASVLCLVGPGIKDAFFTGQFMGQLAD

SEQ ID NO: 3149952 - protein, 60 aa, Giardia lamblia
ASVLKVLFRTGARDFLCSACSQVVRHPCRLRCGHLVCRSCAVTYYVGRMGCLVCDTNVLS

SEQ ID NO: 3149953 - protein, 18 aa, Giardia lamblia
ASVNQASCCCRPSQVLQL

SEQ ID NO: 3149954 - protein, 20 aa, Giardia lamblia
ASVSKWIGAMARSVDGNGET

SEQ ID NO: 3149955 - protein, 22 aa, Giardia lamblia
ASVSLAISWSIIRSIVIGEIGK

SEQ ID NO: 3149956 - protein, 19 aa, Giardia lamblia
ASVTKLMHRLMQLANTPIT

SEQ ID NO: 3149957 - protein, 22 aa, Giardia lamblia
ASWKACYDELSLIYAKLEGYYN

SEQ ID NO: 3149958 - protein, 27 aa, Giardia lamblia
ASYAPVRCSGCSAVLSPFTYVDYQKKS

SEQ ID NO: 3149959 - protein, 26 aa, Giardia lamblia
ASYDNNICLYKRCIEVADELGEEEIE

SEQ ID NO: 3149960 - protein, 24 aa, Giardia lamblia
ASYLEWREHPNIQYIARFLTQLKG

SEQ ID NO: 3149961 - protein, 23 aa, Giardia lamblia
ASYPEFSASIGFCTPPTSDTGLP

SEQ ID NO: 3149962 - protein, 21 aa, Giardia lamblia
ASYRASVAQMLAEKRKEWDKR

SEQ ID NO: 3149963 - protein, 19 aa, Giardia lamblia
ATAARGAECIRAKRPELVI

SEQ ID NO: 3149964 - protein, 23 aa, Giardia lamblia
ATACVIVRVPVRAIRRASGKILK

SEQ ID NO: 3149965 - protein, 19 aa, Giardia lamblia
ATAFNGIDFSPNFALTEYP

SEQ ID NO: 3149966 - protein, 20 aa, Giardia lamblia
ATAGLIAAQGIEFTRAFYER

SEQ ID NO: 3149967 - protein, 32 aa, Giardia lamblia
ATAKLKQRLGTAFSRSKFRNFLFEKVLEHMQP

SEQ ID NO: 3149968 - protein, 19 aa, Giardia lamblia
ATAKRMVSVYVLGQSEPTL

SEQ ID NO: 3149969 - protein, 17 aa, Giardia lamblia
ATALCLAALVGGCSDNK

SEQ ID NO: 3149970 - protein, 26 aa, Giardia lamblia
ATALPAEYVSICKKYFEMKGTVLRQD

SEQ ID NO: 3149971 - protein, 18 aa, Giardia lamblia
ATALTKLSFPPREVEPED

SEQ ID NO: 3149972 - protein, 17 aa, Giardia lamblia
ATAYIPLPQDLAYDASN

SEQ ID NO: 3149973 - protein, 25 aa, Giardia lamblia
ATAYPVFFKNLGVLMFDYLDNSTMA

SEQ ID NO: 3149974 - protein, 24 aa, Giardia lamblia
ATCQELCCIYCIVSGSHPPGPDHI

SEQ ID NO: 3149975 - protein, 21 aa, Giardia lamblia
ATCSLSSTLRSALEKSAIHSM

SEQ ID NO: 3149976 - protein, 18 aa, Giardia lamblia
ATDLRKITLMPSISAQSI

SEQ ID NO: 3149977 - protein, 25 aa, Giardia lamblia
ATDLYKYLLCNMGIHSMDNFTALQD

SEQ ID NO: 3149978 - protein, 18 aa, Giardia lamblia
ATDPISFRNYLKDFTQES

SEQ ID NO: 3149979 - protein, 24 aa, Giardia lamblia
ATDREGKCALSYAIENKSYDSIYA

SEQ ID NO: 3149980 - protein, 33 aa, Giardia lamblia
ATEELRMQVSRGFRLNNLIPMCDSSWTPLMHAV

SEQ ID NO: 3149981 - protein, 25 aa, Giardia lamblia
ATEIEIRLGYYSKYRRLPPTLLSAL

SEQ ID NO: 3149982 - protein, 18 aa, Giardia lamblia
ATEQPRVVSIQRANLEVD

SEQ ID NO: 3149983 - protein, 19 aa, Giardia lamblia
ATERTLCCLVENYQTPTGI

SEQ ID NO: 3149984 - protein, 20 aa, Giardia lamblia
ATFERPGATVLKAAAFGVVD

SEQ ID NO: 3149985 - protein, 19 aa, Giardia lamblia
ATFLMFFSYCCAGIRNGAL

SEQ ID NO: 3149986 - protein, 17 aa, Giardia lamblia
ATGDYPALLTHLSTNAE

SEQ ID NO: 3149987 - protein, 28 aa, Giardia lamblia
ATGIFHGSCPLSVLRVCSAITSGEDESL

SEQ ID NO: 3149988 - protein, 19 aa, Giardia lamblia
ATGKTALGWASEFNRSDAV

SEQ ID NO: 3149989 - protein, 25 aa, Giardia lamblia
ATGRPDVFTLLALPIVKDKLKFFNL

SEQ ID NO: 3149990 - protein, 20 aa, Giardia lamblia
ATGRSALMCAAERDNYEVAV

SEQ ID NO: 3149991 - protein, 24 aa, Giardia lamblia
ATGTPSLNEPYSWQKETAQKYLSP

SEQ ID NO: 3149992 - protein, 19 aa, Giardia lamblia
ATHGARCAPIPGLQSSSKR

SEQ ID NO: 3149993 - protein, 20 aa, Giardia lamblia
ATHGERRGAFSLPVTAIYQL

SEQ ID NO: 3149994 - protein, 18 aa, Giardia lamblia
ATHGPVLTAFHVPSVPNT

SEQ ID NO: 3149995 - protein, 20 aa, Giardia lamblia
ATICKLLATRERTILNSANR

SEQ ID NO: 3149996 - protein, 18 aa, Giardia lamblia
ATIGKYIFHSEMVLTQAG

SEQ ID NO: 3149997 - protein, 23 aa, Giardia lamblia
ATIGRLQADIVFYKDNLQLSEAR

SEQ ID NO: 3149998 - protein, 25 aa, Giardia lamblia
ATIIKRARTLIEMIGFVLELDTDGI

SEQ ID NO: 3149999 - protein, 33 aa, Giardia lamblia
ATIKHTWPRFIYLLFRGSLPVYVSDPGVRYIYK

SEQ ID NO: 3150000 - protein, 22 aa, Giardia lamblia
ATIKPRVGVAVMRETALMAATR

SEQ ID NO: 3150001 - protein, 21 aa, Giardia lamblia
ATIKQCFTNPYTGLPCGSQML

SEQ ID NO: 3150002 - protein, 17 aa, Giardia lamblia
ATINIPRFNGSKRFAAG

SEQ ID NO: 3150003 - protein, 17 aa, Giardia lamblia
ATISHQVYVYKRPYVDE

SEQ ID NO: 3150004 - protein, 26 aa, Giardia lamblia
ATIVSNCWDELPVLRAKHLSKALKGS

SEQ ID NO: 3150005 - protein, 20 aa, Giardia lamblia
ATKMYTSVMPLDGTRTPRSK

SEQ ID NO: 3150006 - protein, 35 aa, Giardia lamblia
ATLAESGHLCGFLGPTHLRALALFAQAQSLESTAV

SEQ ID NO: 3150007 - protein, 25 aa, Giardia lamblia
ATLCHCERFAMEMLLFESTIEDGSS

SEQ ID NO: 3150008 - protein, 30 aa, Giardia lamblia
ATLEGSMILGRGCTALIYAASVQDADVVPL

SEQ ID NO: 3150009 - protein, 28 aa, Giardia lamblia
ATLFELCMRRPYVTGWTRQQVLELSLAP

SEQ ID NO: 3150010 - protein, 17 aa, Giardia lamblia
ATLFKLKEFERAKESAA

SEQ ID NO: 3150011 - protein, 26 aa, Giardia lamblia
ATLHCPARGAAYLLSLACQKKGDTDR

SEQ ID NO: 3150012 - protein, 24 aa, Giardia lamblia
ATLKDMAPRCLLDMVNGKLPLEIL

SEQ ID NO: 3150013 - protein, 18 aa, Giardia lamblia
ATLLGAQMFNYFVCILLT

SEQ ID NO: 3150014 - protein, 17 aa, Giardia lamblia
ATLLPRFINAASNICHF

SEQ ID NO: 3150015 - protein, 18 aa, Giardia lamblia
ATLLRSLSYLHVLEDQLI

SEQ ID NO: 3150016 - protein, 25 aa, Giardia lamblia
ATLSPRLGNSAIRDRDGLIQMGSPV

SEQ ID NO: 3150017 - protein, 22 aa, Giardia lamblia
ATLVKRILAFLVAKIGLCVTGY

SEQ ID NO: 3150018 - protein, 25 aa, Giardia lamblia
ATLYPRKPQRLSWHGITNVKQGGTS

SEQ ID NO: 3150019 - protein, 22 aa, Giardia lamblia
ATMCLPAAAYITGVDPRTAALG

SEQ ID NO: 3150020 - protein, 17 aa, Giardia lamblia
ATMELRGATALVGLFST

SEQ ID NO: 3150021 - protein, 17 aa, Giardia lamblia
ATMGTKYLLSASRDMLV

SEQ ID NO: 3150022 - protein, 23 aa, Giardia lamblia
ATMPTMIAVYYLRGETSSVFKHN

SEQ ID NO: 3150023 - protein, 17 aa, Giardia lamblia
ATMRFAASLAVLIGPMG

SEQ ID NO: 3150024 - protein, 23 aa, Giardia lamblia
ATNFPWEIDQAMLRRLEKRIFIE

SEQ ID NO: 3150025 - protein, 26 aa, Giardia lamblia
ATNFPWKLDGPILRRFTNRVYIGLPD

SEQ ID NO: 3150026 - protein, 19 aa, Giardia lamblia
ATNICFIFFSLSHHCTYGR

SEQ ID NO: 3150027 - protein, 17 aa, Giardia lamblia
ATPDAWDPQVLRQYIYF

SEQ ID NO: 3150028 - protein, 22 aa, Giardia lamblia
ATPEGRRPRRNSLYSSDMADKE

SEQ ID NO: 3150029 - protein, 23 aa, Giardia lamblia
ATPEISWSLYVVLGIDSTQTSLS

SEQ ID NO: 3150030 - protein, 25 aa, Giardia lamblia
ATPIECSLCRYLYVQGNIYKIPTGE

SEQ ID NO: 3150031 - protein, 24 aa, Giardia lamblia
ATPIPEGYLWAQVWSGYDIDERVC

SEQ ID NO: 3150032 - protein, 18 aa, Giardia lamblia
ATPLKSHYSFNVRDIARV

SEQ ID NO: 3150033 - protein, 20 aa, Giardia lamblia
ATPLVLRFLADRVAHGHHHI

SEQ ID NO: 3150034 - protein, 17 aa, Giardia lamblia
ATPPGAPVKVVINTQKT

SEQ ID NO: 3150035 - protein, 24 aa, Giardia lamblia
ATPYEYAIALAFKCLSHNNHDGAI

SEQ ID NO: 3150036 - protein, 18 aa, Giardia lamblia
ATQDRILLFDSFFNVLVW

SEQ ID NO: 3150037 - protein, 29 aa, Giardia lamblia
ATQVLQKGSCVKVFRTKFDRNHKGNIGVQ

SEQ ID NO: 3150038 - protein, 17 aa, Giardia lamblia
ATRHIKSAVYSKAELAN

SEQ ID NO: 3150039 - protein, 26 aa, Giardia lamblia
ATRHLYGHPHWQFPDDSVVFQAPKQY

SEQ ID NO: 3150040 - protein, 46 aa, Giardia lamblia
ATRKLKFVRVQHAFVPWLRRYHGRCRPTFLFFVGGSLKEIVEGIDT

SEQ ID NO: 3150041 - protein, 26 aa, Giardia lamblia
ATRLHLPKLVKLLVNYEAGFKNGDGI

SEQ ID NO: 3150042 - protein, 20 aa, Giardia lamblia
ATRNLLCLDLDETLVCSKQR

SEQ ID NO: 3150043 - protein, 23 aa, Giardia lamblia
ATRVKGRAGASFSTTSRSICVQV

SEQ ID NO: 3150044 - protein, 27 aa, Giardia lamblia
ATRWYRAPEIILGWPQYGKPVDIFSVG

SEQ ID NO: 3150045 - protein, 19 aa, Giardia lamblia
ATSEELWASVLVPYMEKRG

SEQ ID NO: 3150046 - protein, 26 aa, Giardia lamblia
ATSHLLCLVSDPLLNYNKITLCNDSC

SEQ ID NO: 3150047 - protein, 19 aa, Giardia lamblia
ATSKANFALLIDFYNNVNL

SEQ ID NO: 3150048 - protein, 25 aa, Giardia lamblia
ATSLKRINLEAALPHSSLTDATLKR

SEQ ID NO: 3150049 - protein, 31 aa, Giardia lamblia
ATSVGCLRCLRILLEYGQCFEMSEFDEALAR

SEQ ID NO: 3150050 - protein, 25 aa, Giardia lamblia
ATSYGELLFGHMLYDYSHSAAHKQR

SEQ ID NO: 3150051 - protein, 20 aa, Giardia lamblia
ATTPVTRLKGVRVGLVDDEV

SEQ ID NO: 3150052 - protein, 23 aa, Giardia lamblia
ATTTDILKCFQLHKKNRLYREFF

SEQ ID NO: 3150053 - protein, 25 aa, Giardia lamblia
ATTTGRTALFWALLNGYDACAEILY

SEQ ID NO: 3150054 - protein, 17 aa, Giardia lamblia
ATVAFSLIEDVLRRSVI

SEQ ID NO: 3150055 - protein, 24 aa, Giardia lamblia
ATVAGSCCKGVSDGTLLAASFNGP

SEQ ID NO: 3150056 - protein, 19 aa, Giardia lamblia
ATVIPGVLFIDECHMLNIE

SEQ ID NO: 3150057 - protein, 17 aa, Giardia lamblia
ATVIRKPKPTVWSKEPS

SEQ ID NO: 3150058 - protein, 24 aa, Giardia lamblia
ATVLNVFFNLCLDMKGHQPVLDFI

SEQ ID NO: 3150059 - protein, 19 aa, Giardia lamblia
ATVRACLQMPWLKSQPVQE

SEQ ID NO: 3150060 - protein, 17 aa, Giardia lamblia
ATVSRCGMIYFSDDFIG

SEQ ID NO: 3150061 - protein, 18 aa, Giardia lamblia
ATVTTNFPSNIPKDLMPI

SEQ ID NO: 3150062 - protein, 17 aa, Giardia lamblia
ATVYINMGIAYMAQSDP

SEQ ID NO: 3150063 - protein, 22 aa, Giardia lamblia
ATWACPGMDGLIALSPAPCEKA

SEQ ID NO: 3150064 - protein, 25 aa, Giardia lamblia
ATYLSTAVGPEWQSMTGYRGSIQAG

SEQ ID NO: 3150065 - protein, 23 aa, Giardia lamblia
ATYMPAPHLKYSRQMTKWECERV

SEQ ID NO: 3150066 - protein, 30 aa, Giardia lamblia
ATYPNKVLCLLSWFFDCSKYSHIQQSWRRI

SEQ ID NO: 3150067 - protein, 31 aa, Giardia lamblia
ATYRGCASCKCALRDSPICPKCQETSAGEKY

SEQ ID NO: 3150068 - protein, 25 aa, Giardia lamblia
AVAAHLKAAISVFSSEGYLFAAGIS

SEQ ID NO: 3150069 - protein, 24 aa, Giardia lamblia
AVAALAMKLAHMIFSSLITKQHRT

SEQ ID NO: 3150070 - protein, 25 aa, Giardia lamblia
AVACKPCGVTQGFNKFLSIIQVTFR

SEQ ID NO: 3150071 - protein, 19 aa, Giardia lamblia
AVACVEKGGTILVGIVDGP

SEQ ID NO: 3150072 - protein, 17 aa, Giardia lamblia
AVAGNLWAVKQLAHSEA

SEQ ID NO: 3150073 - protein, 24 aa, Giardia lamblia
AVAKRLTSISSLAWSQSPKENKSS

SEQ ID NO: 3150074 - protein, 18 aa, Giardia lamblia
AVALRGKYGAYLMGHLDL

SEQ ID NO: 3150075 - protein, 27 aa, Giardia lamblia
AVANLCFSSPFYRQGRQNLQDSDTQVD

SEQ ID NO: 3150076 - protein, 23 aa, Giardia lamblia
AVARALVPLLYDKSRAQVVGRQI

SEQ ID NO: 3150077 - protein, 23 aa, Giardia lamblia
AVCAQLRAGIPPRVITRIPSLTS

SEQ ID NO: 3150078 - protein, 21 aa, Giardia lamblia
AVCFLPRPPYYVSTLTEEERN

SEQ ID NO: 3150079 - protein, 18 aa, Giardia lamblia
AVCLAHMLCVPRISQVNQ

SEQ ID NO: 3150080 - protein, 21 aa, Giardia lamblia
AVCRTCGTALLWHKSYPFTYC

SEQ ID NO: 3150081 - protein, 24 aa, Giardia lamblia
AVDARLKNEIKLRQLQRQERELSA

SEQ ID NO: 3150082 - protein, 24 aa, Giardia lamblia
AVDISPVFCCGSLRETSTEESKGF

SEQ ID NO: 3150083 - protein, 19 aa, Giardia lamblia
AVDTYTIYSPNRAKNATSE

SEQ ID NO: 3150084 - protein, 17 aa, Giardia lamblia
AVDVAGCNIGLKLIING

SEQ ID NO: 3150085 - protein, 20 aa, Giardia lamblia
AVEFLPRLHTLSILATSCHM

SEQ ID NO: 3150086 - protein, 26 aa, Giardia lamblia
AVEKGHKACARFLSKYEEHLTVAYRV

SEQ ID NO: 3150087 - protein, 26 aa, Giardia lamblia
AVEQDCWQCFKTMYEYEARAVIGTRE

SEQ ID NO: 3150088 - protein, 17 aa, Giardia lamblia
AVEQKRTFCARILATAE

SEQ ID NO: 3150089 - protein, 28 aa, Giardia lamblia
AVFAGDDLPICWDAHLHALKGCYTNITD

SEQ ID NO: 3150090 - protein, 21 aa, Giardia lamblia
AVFDEWRYAVIRRHRLISMRG

SEQ ID NO: 3150091 - protein, 17 aa, Giardia lamblia
AVFKNIEACMQLVRITR

SEQ ID NO: 3150092 - protein, 26 aa, Giardia lamblia
AVFNLELYDLLLGYFLTASTPSLTEK

SEQ ID NO: 3150093 - protein, 19 aa, Giardia lamblia
AVFPTVVGRPKRETVLVGS

SEQ ID NO: 3150094 - protein, 24 aa, Giardia lamblia
AVGADCVFSRNCVAGGDFQAQPLS

SEQ ID NO: 3150095 - protein, 17 aa, Giardia lamblia
AVGCTNVSIPEEIHKVT

SEQ ID NO: 3150096 - protein, 26 aa, Giardia lamblia
AVGHPMAYCPLTVPGLSPLGYEDTGD

SEQ ID NO: 3150097 - protein, 22 aa, Giardia lamblia
AVGKSCLLLQFTEQRFQNAHDM

SEQ ID NO: 3150098 - protein, 17 aa, Giardia lamblia
AVGKSCLLLRFVEQKFI

SEQ ID NO: 3150099 - protein, 23 aa, Giardia lamblia
AVGLPDWQALASILNNLRASYPH

SEQ ID NO: 3150100 - protein, 23 aa, Giardia lamblia
AVGMGPLIRMIRSGVYPEMPQFY

SEQ ID NO: 3150101 - protein, 25 aa, Giardia lamblia
AVGVPSRCLFYIRNLGYKHNVKLTI

SEQ ID NO: 3150102 - protein, 19 aa, Giardia lamblia
AVHADAWQTGVMLFHSLTG

SEQ ID NO: 3150103 - protein, 17 aa, Giardia lamblia
AVHAFKLGSLQDAIMTE

SEQ ID NO: 3150104 - protein, 17 aa, Giardia lamblia
AVHARAILKETPAEEKE

SEQ ID NO: 3150105 - protein, 31 aa, Giardia lamblia
AVHEFSHRSAWYFVLSELVRLFILNTTSNAK

SEQ ID NO: 3150106 - protein, 21 aa, Giardia lamblia
AVHVWCAIWMICKQYRESQVY

SEQ ID NO: 3150107 - protein, 27 aa, Giardia lamblia
AVINYCYEMVRYLAPFEGGYQDRSGNS

SEQ ID NO: 3150108 - protein, 29 aa, Giardia lamblia
AVIPLWAKRNECVIHLRQPVPVYSPPLLT

SEQ ID NO: 3150109 - protein, 19 aa, Giardia lamblia
AVIPRERQLAPVFVPAMTP

SEQ ID NO: 3150110 - protein, 20 aa, Giardia lamblia
AVIPSCLFSQPFYELLTIPF

SEQ ID NO: 3150111 - protein, 26 aa, Giardia lamblia
AVIQRKFSCVMYLLNHKIFTKRDLEH

SEQ ID NO: 3150112 - protein, 18 aa, Giardia lamblia
AVIRGHIDVALTLLEHAY

SEQ ID NO: 3150113 - protein, 25 aa, Giardia lamblia
AVIRRYRSRLVRWFEDMQHDPLAFD

SEQ ID NO: 3150114 - protein, 24 aa, Giardia lamblia
AVIRTSQVYKEFIQMKVRHDILVY

SEQ ID NO: 3150115 - protein, 25 aa, Giardia lamblia
AVIVKLLVCRALYPHYTYKLDAEEA

SEQ ID NO: 3150116 - protein, 24 aa, Giardia lamblia
AVKAGAPPNCIAWITKPSVPLAKA

SEQ ID NO: 3150117 - protein, 26 aa, Giardia lamblia
AVKLRRYKIASLLVAEEIRLQTTNDW

SEQ ID NO: 3150118 - protein, 28 aa, Giardia lamblia
AVKPNIIVTFKFPAARAHKNVSSQLIVY

SEQ ID NO: 3150119 - protein, 27 aa, Giardia lamblia
AVKRIGTEYNHFLLLYRIAFAVQAMED

SEQ ID NO: 3150120 - protein, 24 aa, Giardia lamblia
AVKSLSCGPQLGKDWTYFASLQKA

SEQ ID NO: 3150121 - protein, 18 aa, Giardia lamblia
AVKVLRLRTASFLFRIPL

SEQ ID NO: 3150122 - protein, 28 aa, Giardia lamblia
AVLCEHCSLNIKKMCPICRHTVTDTIEI

SEQ ID NO: 3150123 - protein, 25 aa, Giardia lamblia
AVLDGDMKLAWSLIPLQAGLQDEEG

SEQ ID NO: 3150124 - protein, 23 aa, Giardia lamblia
AVLEAAGLASLVAEKATPSATIG

SEQ ID NO: 3150125 - protein, 26 aa, Giardia lamblia
AVLENECHKMYLTLQGLTKLQASLLS

SEQ ID NO: 3150126 - protein, 28 aa, Giardia lamblia
AVLEYRNYLKFCEFWTTRNAALAATAQR

SEQ ID NO: 3150127 - protein, 27 aa, Giardia lamblia
AVLLCTRLAVDSGYYFSVRKRILKNRS

SEQ ID NO: 3150128 - protein, 19 aa, Giardia lamblia
AVLLCYSGSIIDCLNTLSL

SEQ ID NO: 3150129 - protein, 17 aa, Giardia lamblia
AVLNLAKDCPQRRRTFL

SEQ ID NO: 3150130 - protein, 24 aa, Giardia lamblia
AVLPDGRDALILAAQIGNLEAMHE

SEQ ID NO: 3150131 - protein, 29 aa, Giardia lamblia
AVLPFCSNCGNSLHSRCIQLFHQHARQTK

SEQ ID NO: 3150132 - protein, 17 aa, Giardia lamblia
AVLRLIFHEILGGSIVG

SEQ ID NO: 3150133 - protein, 26 aa, Giardia lamblia
AVLSSCALWELFPVTWFDINNPSTYL

SEQ ID NO: 3150134 - protein, 19 aa, Giardia lamblia
AVLTYPAPENIGFVNVTLN

SEQ ID NO: 3150135 - protein, 19 aa, Giardia lamblia
AVLYVRDLQGPLLLRYDAN

SEQ ID NO: 3150136 - protein, 19 aa, Giardia lamblia
AVMEVCGPGMDLIQTFCEC

SEQ ID NO: 3150137 - protein, 19 aa, Giardia lamblia
AVNCTRFLARYYDAEADSS

SEQ ID NO: 3150138 - protein, 21 aa, Giardia lamblia
AVNDCVFFYLLGQTTCSEILS

SEQ ID NO: 3150139 - protein, 17 aa, Giardia lamblia
AVNLSVIDPSIFTDILS

SEQ ID NO: 3150140 - protein, 19 aa, Giardia lamblia
AVNVINGLLLLKLAVLIKG

SEQ ID NO: 3150141 - protein, 25 aa, Giardia lamblia
AVPLPPRAGPFSAGPPTLPAVPVTS

SEQ ID NO: 3150142 - protein, 23 aa, Giardia lamblia
AVPRFTSLCVPLFSLRSALSTGV

SEQ ID NO: 3150143 - protein, 17 aa, Giardia lamblia
AVPRVQLSSALLRSSGI

SEQ ID NO: 3150144 - protein, 27 aa, Giardia lamblia
AVPTPAEWEECPGRDHVHNAVEVKFRD

SEQ ID NO: 3150145 - protein, 18 aa, Giardia lamblia
AVQILAAHEFGCRSDNGK

SEQ ID NO: 3150146 - protein, 17 aa, Giardia lamblia
AVQRMQNCRIAVYGCAI

SEQ ID NO: 3150147 - protein, 26 aa, Giardia lamblia
AVQRYRDLCSWVFVASVELSLMVIKA

SEQ ID NO: 3150148 - protein, 18 aa, Giardia lamblia
AVQYKRLKVDADSRRSFS

SEQ ID NO: 3150149 - protein, 17 aa, Giardia lamblia
AVREFMFHQALQHPNLV

SEQ ID NO: 3150150 - protein, 24 aa, Giardia lamblia
AVRELCKDILPAYAPASISSGGLI

SEQ ID NO: 3150151 - protein, 23 aa, Giardia lamblia
AVRELHGPYALFLADGGFLIEGP

SEQ ID NO: 3150152 - protein, 27 aa, Giardia lamblia
AVRENGLRYTIAFNLGFLNANISNKEV

SEQ ID NO: 3150153 - protein, 25 aa, Giardia lamblia
AVRTICYKMLISINYHKMADAPLPA

SEQ ID NO: 3150154 - protein, 17 aa, Giardia lamblia
AVSATKAPIVFLGTGEK

SEQ ID NO: 3150155 - protein, 25 aa, Giardia lamblia
AVSCGPDYLLSVLNWAQRRLLLKAP

SEQ ID NO: 3150156 - protein, 23 aa, Giardia lamblia
AVSCSQIECARLLAEKEKNINRR

SEQ ID NO: 3150157 - protein, 26 aa, Giardia lamblia
AVSELFKRRLEELQRSCRRSYRQPIV

SEQ ID NO: 3150158 - protein, 18 aa, Giardia lamblia
AVSEPRPGSASTKNEPVV

SEQ ID NO: 3150159 - protein, 24 aa, Giardia lamblia
AVSEVRITPAYLKAECEIHNVEFI

SEQ ID NO: 3150160 - protein, 20 aa, Giardia lamblia
AVSFAKARYDGATDMEGRPK

SEQ ID NO: 3150161 - protein, 18 aa, Giardia lamblia
AVSGARVAVKTDFYRCVF

SEQ ID NO: 3150162 - protein, 24 aa, Giardia lamblia
AVSHVLDFIALYKVTSDRAYIRTY

SEQ ID NO: 3150163 - protein, 26 aa, Giardia lamblia
AVSIFIKLKMLNLLLLLSNEAKEHKY

SEQ ID NO: 3150164 - protein, 22 aa, Giardia lamblia
AVSIPEEFIWFLLVAVAEMLAE

SEQ ID NO: 3150165 - protein, 26 aa, Giardia lamblia
AVSLIKDFKFPIALSPALLFLLLHCT

SEQ ID NO: 3150166 - protein, 17 aa, Giardia lamblia
AVSMPGMMDTILNLGLN

SEQ ID NO: 3150167 - protein, 24 aa, Giardia lamblia
AVSRHKAGAFIPVRALLVEENGDK

SEQ ID NO: 3150168 - protein, 22 aa, Giardia lamblia
AVTELICFVALQAQTYAVSHRR

SEQ ID NO: 3150169 - protein, 17 aa, Giardia lamblia
AVTKARKFLDAKDAKDF

SEQ ID NO: 3150170 - protein, 19 aa, Giardia lamblia
AVTKKLLYFSMHAQQLVSL

SEQ ID NO: 3150171 - protein, 26 aa, Giardia lamblia
AVTLICFKRSIFPPSAFGIKRMMEVD

SEQ ID NO: 3150172 - protein, 25 aa, Giardia lamblia
AVTRGHYDCVRILCETQKPTLENID

SEQ ID NO: 3150173 - protein, 21 aa, Giardia lamblia
AVVDPRIVGYLATLKGVDFVS

SEQ ID NO: 3150174 - protein, 25 aa, Giardia lamblia
AVVIRPGFGPLNWNSLSVDDYLERA

SEQ ID NO: 3150175 - protein, 20 aa, Giardia lamblia
AVVLCGGNIDLTRVRQIYNY

SEQ ID NO: 3150176 - protein, 18 aa, Giardia lamblia
AVVRAAGAVHWEQPSTPT

SEQ ID NO: 3150177 - protein, 22 aa, Giardia lamblia
AVVRALAPFFGRETDKDGRTAL

SEQ ID NO: 3150178 - protein, 25 aa, Giardia lamblia
AVVSCLRAAGVFPRRTKELEIEALN

SEQ ID NO: 3150179 - protein, 18 aa, Giardia lamblia
AVVSLRHILDFMSDTIAS

SEQ ID NO: 3150180 - protein, 30 aa, Giardia lamblia
AVYPCTQQLIARLGALLGPGKAGMLKLSLK

SEQ ID NO: 3150181 - protein, 23 aa, Giardia lamblia
AVYPPMFRDIFQKLLAHTGFGGP

SEQ ID NO: 3150182 - protein, 19 aa, Giardia lamblia
AVYQLDWSPFYPSYILSGS

SEQ ID NO: 3150183 - protein, 18 aa, Giardia lamblia
AWCTGEDSLSLAVGSSNS

SEQ ID NO: 3150184 - protein, 19 aa, Giardia lamblia
AWDVSRLVNMESFRAKATI

SEQ ID NO: 3150185 - protein, 19 aa, Giardia lamblia
AWEGHKRAFLDSSVTTTKT

SEQ ID NO: 3150186 - protein, 20 aa, Giardia lamblia
AWFCQWLNQLGVIFRFVKRP

SEQ ID NO: 3150187 - protein, 18 aa, Giardia lamblia
AWHVKKWNTSMYSVIPKS

SEQ ID NO: 3150188 - protein, 21 aa, Giardia lamblia
AWKEYGESVLALYMGDAASTN

SEQ ID NO: 3150189 - protein, 19 aa, Giardia lamblia
AWNKYCVLSRSKGPIIRSS

SEQ ID NO: 3150190 - protein, 18 aa, Giardia lamblia
AWSGIPVLHRTGLMECAK

SEQ ID NO: 3150191 - protein, 28 aa, Giardia lamblia
AWSSEYMDLVIIILRTGGLAMDNYDHST

SEQ ID NO: 3150192 - protein, 23 aa, Giardia lamblia
AWYLREGFCALRELYKYRSVKII

SEQ ID NO: 3150193 - protein, 18 aa, Giardia lamblia
AYAAVPGYDRCRLHDLAS

SEQ ID NO: 3150194 - protein, 26 aa, Giardia lamblia
AYALKEACRLKEFRAVIAKALGYQQV

SEQ ID NO: 3150195 - protein, 21 aa, Giardia lamblia
AYCPHSILAVGVFGVPMAHLS

SEQ ID NO: 3150196 - protein, 24 aa, Giardia lamblia
AYDEPRQVYYLSLANLGSDPLFSS

SEQ ID NO: 3150197 - protein, 24 aa, Giardia lamblia
AYDFLIFREFDSVFVQRSDLASPE

SEQ ID NO: 3150198 - protein, 28 aa, Giardia lamblia
AYDFSLETFGQFPLKTTEDYVFKVGQLA

SEQ ID NO: 3150199 - protein, 18 aa, Giardia lamblia
AYDGRTALMLAADQGHAQ

SEQ ID NO: 3150200 - protein, 19 aa, Giardia lamblia
AYDILGIIGHGPYATVFKC

SEQ ID NO: 3150201 - protein, 17 aa, Giardia lamblia
AYDRLCFYGLIDRPPDS

SEQ ID NO: 3150202 - protein, 18 aa, Giardia lamblia
AYEEFELFMTMYRRECAF

SEQ ID NO: 3150203 - protein, 23 aa, Giardia lamblia
AYEVLRALMSIPRQGEGNQSYVA

SEQ ID NO: 3150204 - protein, 23 aa, Giardia lamblia
AYFGCLDCVKVLLEKEKYISSRS

SEQ ID NO: 3150205 - protein, 25 aa, Giardia lamblia
AYFKEICGPSLLLIIMESVQGTCFC

SEQ ID NO: 3150206 - protein, 22 aa, Giardia lamblia
AYGDAVNLMLSRDVSGESAETR

SEQ ID NO: 3150207 - protein, 23 aa, Giardia lamblia
AYGELGLDYARLHFAGKEIQKLA

SEQ ID NO: 3150208 - protein, 17 aa, Giardia lamblia
AYGSRAPMRARTISDSA

SEQ ID NO: 3150209 - protein, 18 aa, Giardia lamblia
AYHLLRLSQEATTSFIHN

SEQ ID NO: 3150210 - protein, 26 aa, Giardia lamblia
AYHVHICILAAKVAAIKVIEEIYPLH

SEQ ID NO: 3150211 - protein, 20 aa, Giardia lamblia
AYICSRYYRAPELIFGSRYY

SEQ ID NO: 3150212 - protein, 17 aa, Giardia lamblia
AYILIPIGQKIYAACGG

SEQ ID NO: 3150213 - protein, 19 aa, Giardia lamblia
AYISLKRAINIILATVSKT

SEQ ID NO: 3150214 - protein, 24 aa, Giardia lamblia
AYKMAGQDFMEWIQTVVITYLPAR

SEQ ID NO: 3150215 - protein, 26 aa, Giardia lamblia
AYKSIRLRLTAMQKRAIKRNEALVAQ

SEQ ID NO: 3150216 - protein, 23 aa, Giardia lamblia
AYKVMPHLCRLVAATKTPITLSW

SEQ ID NO: 3150217 - protein, 18 aa, Giardia lamblia
AYLGLPFDQTLDIWSCGC

SEQ ID NO: 3150218 - protein, 18 aa, Giardia lamblia
AYLIQSGKQNRDGWSALM

SEQ ID NO: 3150219 - protein, 18 aa, Giardia lamblia
AYLKEIAQHFNIDLPSSR

SEQ ID NO: 3150220 - protein, 22 aa, Giardia lamblia
AYLKYLRCNPAYESDFLATYAF

SEQ ID NO: 3150221 - protein, 29 aa, Giardia lamblia
AYLLSLHCRARFGVHIVELVERMTRTVAK

SEQ ID NO: 3150222 - protein, 17 aa, Giardia lamblia
AYLPKERMNSLQFRPLT

SEQ ID NO: 3150223 - protein, 23 aa, Giardia lamblia
AYLRRQGSEFLHVFLEFIPPIIR

SEQ ID NO: 3150224 - protein, 21 aa, Giardia lamblia
AYLYGAMGLVKLREGAFQEAI

SEQ ID NO: 3150225 - protein, 21 aa, Giardia lamblia
AYMAMSLINGFALKIPFIKYI

SEQ ID NO: 3150226 - protein, 25 aa, Giardia lamblia
AYMGRSGIIPLLIKEEAKLCDSYGR

SEQ ID NO: 3150227 - protein, 29 aa, Giardia lamblia
AYMIKRGFCPWCILRVSLWDDISLCGFSC

SEQ ID NO: 3150228 - protein, 18 aa, Giardia lamblia
AYMLKSIIKENAYSKDLV

SEQ ID NO: 3150229 - protein, 26 aa, Giardia lamblia
AYNGHLECIRLLLSEEGGMQDNKGRT

SEQ ID NO: 3150230 - protein, 19 aa, Giardia lamblia
AYNKNCMGWSNAVRENFQS

SEQ ID NO: 3150231 - protein, 19 aa, Giardia lamblia
AYNMLSERIIELVAEQHET

SEQ ID NO: 3150232 - protein, 24 aa, Giardia lamblia
AYNRFMRPPLVGIVLFDDALSHLV

SEQ ID NO: 3150233 - protein, 22 aa, Giardia lamblia
AYPLQLDCCGLIRQALMDLKDE

SEQ ID NO: 3150234 - protein, 21 aa, Giardia lamblia
AYPLSFKFLMELYTCVDSSSI

SEQ ID NO: 3150235 - protein, 21 aa, Giardia lamblia
AYPRMTTVILRNLPFTVYANT

SEQ ID NO: 3150236 - protein, 20 aa, Giardia lamblia
AYQGVKRSAPRLDPEVDQLL

SEQ ID NO: 3150237 - protein, 24 aa, Giardia lamblia
AYQMCLRELVPYALSPVHSLRVIA

SEQ ID NO: 3150238 - protein, 25 aa, Giardia lamblia
AYQPGTCQFIQKWKPLYQNTVDLLL

SEQ ID NO: 3150239 - protein, 19 aa, Giardia lamblia
AYRAVSMLYIQEARYQSML

SEQ ID NO: 3150240 - protein, 27 aa, Giardia lamblia
AYRCYAYSIGKITGWDKSKSICFKVTN

SEQ ID NO: 3150241 - protein, 23 aa, Giardia lamblia
AYRDFCGQAGTSLSPYKELRSIA

SEQ ID NO: 3150242 - protein, 19 aa, Giardia lamblia
AYRQGIKALTIFTENIIST

SEQ ID NO: 3150243 - protein, 19 aa, Giardia lamblia
AYRTVFWLWEEQLVDKDLI

SEQ ID NO: 3150244 - protein, 27 aa, Giardia lamblia
AYRVKNKIRVGTFIPAIGAIAKSEKDG

SEQ ID NO: 3150245 - protein, 24 aa, Giardia lamblia
AYSAVKRVFSTWVDPIKRTLLSVK

SEQ ID NO: 3150246 - protein, 25 aa, Giardia lamblia
AYSDIKTGLLLQCFGGVQKDSYRGQ

SEQ ID NO: 3150247 - protein, 18 aa, Giardia lamblia
AYSDVMKQLSGLNTELLI

SEQ ID NO: 3150248 - protein, 22 aa, Giardia lamblia
AYSEQLRPLLGSGVSAAEGDEL

SEQ ID NO: 3150249 - protein, 18 aa, Giardia lamblia
AYSGPRLVIDELVARGVP

SEQ ID NO: 3150250 - protein, 19 aa, Giardia lamblia
AYSHCLRRLLTDDEMLTTP

SEQ ID NO: 3150251 - protein, 18 aa, Giardia lamblia
AYSIPLVNLLGCHRATTG

SEQ ID NO: 3150252 - protein, 25 aa, Giardia lamblia
AYSKSSLPLAIAFPRPEFIKDTVRF

SEQ ID NO: 3150253 - protein, 18 aa, Giardia lamblia
AYTASSFRKSTAASSSSK

SEQ ID NO: 3150254 - protein, 19 aa, Giardia lamblia
AYTCKLNSIPYHKFYYAHR

SEQ ID NO: 3150255 - protein, 20 aa, Giardia lamblia
AYTRFHFCAPGGKHYYVSGE

SEQ ID NO: 3150256 - protein, 25 aa, Giardia lamblia
AYTSHKGMCPKYLRNLRRSRANDPR

SEQ ID NO: 3150257 - protein, 25 aa, Giardia lamblia
AYTSRPDFVAQLAVELRNYDTLVQD

SEQ ID NO: 3150258 - protein, 18 aa, Giardia lamblia
AYTWIKSIAKWPHGEVYL

SEQ ID NO: 3150259 - protein, 22 aa, Giardia lamblia
AYVSHCVVLAFALHKFSVATKE

SEQ ID NO: 3150260 - protein, 22 aa, Giardia lamblia
AYWLFTQPYFYGLIIDQHGCFV

SEQ ID NO: 3150261 - protein, 18 aa, Giardia lamblia
AYYEKLYSLEGIRIYCSA

SEQ ID NO: 3150262 - protein, 31 aa, Giardia lamblia
AYYTFYLPLIMGYRSGVLFGNMAIGTTAASE

SEQ ID NO: 3150263 - protein, 20 aa, Giardia lamblia
CAAAALALLRILSAQVAEED

SEQ ID NO: 3150264 - protein, 23 aa, Giardia lamblia
CAACGQARPLAADRFTKYVTKVM

SEQ ID NO: 3150265 - protein, 19 aa, Giardia lamblia
CAAILKGQKYAQGEEYVRY

SEQ ID NO: 3150266 - protein, 20 aa, Giardia lamblia
CAAIPLKLVRQIVDNVEANM

SEQ ID NO: 3150267 - protein, 19 aa, Giardia lamblia
CAASARSADFYKLSDLLAF

SEQ ID NO: 3150268 - protein, 20 aa, Giardia lamblia
CACEAACLLLPHEATLINAF

SEQ ID NO: 3150269 - protein, 45 aa, Giardia lamblia
CADCTSRSVKWACFNHGTFVCIKCSGIHRSLGRHISKVKSLTLDK

SEQ ID NO: 3150270 - protein, 21 aa, Giardia lamblia
CADPAIKLAHRIAEVVRSKPN

SEQ ID NO: 3150271 - protein, 18 aa, Giardia lamblia
CADQEFYSRTGSRPRADS

SEQ ID NO: 3150272 - protein, 18 aa, Giardia lamblia
CADQERLAITRSELSAAR

SEQ ID NO: 3150273 - protein, 21 aa, Giardia lamblia
CAEETRIIMHLDRWSEQRHQF

SEQ ID NO: 3150274 - protein, 17 aa, Giardia lamblia
CAEGAQHIRIIYGGSAN

SEQ ID NO: 3150275 - protein, 25 aa, Giardia lamblia
CAEQLKTSLLRTIAALKHETDAFQL

SEQ ID NO: 3150276 - protein, 30 aa, Giardia lamblia
CAERNMPATAALCYKEAGILYSVDQDRLTA

SEQ ID NO: 3150277 - protein, 23 aa, Giardia lamblia
CAESDLRVAKLLGQSVVLLEWMN

SEQ ID NO: 3150278 - protein, 22 aa, Giardia lamblia
CAESNCILMARVLLETEAGLIL

SEQ ID NO: 3150279 - protein, 20 aa, Giardia lamblia
CAETAELLAPLEANISMPDG

SEQ ID NO: 3150280 - protein, 23 aa, Giardia lamblia
CAFARANSRVTLWPVDPHSGVLT

SEQ ID NO: 3150281 - protein, 22 aa, Giardia lamblia
CAGEIQCAELFYNNEKDKVKIT

SEQ ID NO: 3150282 - protein, 19 aa, Giardia lamblia
CAGYPHFFRGMFRSWGRDI

SEQ ID NO: 3150283 - protein, 31 aa, Giardia lamblia
CAHSSTLGFYVFRVLKVILAYSRFNSSLVTR

SEQ ID NO: 3150284 - protein, 32 aa, Giardia lamblia
CAIASRLGKLSGLMWPKILRYINKELQLRDVF

SEQ ID NO: 3150285 - protein, 26 aa, Giardia lamblia
CAICLTRPPDCVLLPCRHLIVCLACV

SEQ ID NO: 3150286 - protein, 17 aa, Giardia lamblia
CAILGPRMQVWAQQKNA

SEQ ID NO: 3150287 - protein, 18 aa, Giardia lamblia
CAINEKLVPMMFSEKMKA

SEQ ID NO: 3150288 - protein, 25 aa, Giardia lamblia
CAIPDYSEKLLVLTIDIGGGETREF

SEQ ID NO: 3150289 - protein, 19 aa, Giardia lamblia
CAISCGRIVALVDVPKRRQ

SEQ ID NO: 3150290 - protein, 17 aa, Giardia lamblia
CAISTSFLREIYSLSAL

SEQ ID NO: 3150291 - protein, 34 aa, Giardia lamblia
CAKQLKLIRESLELPLLHPQRFTNLGIEPCKGLL

SEQ ID NO: 3150292 - protein, 17 aa, Giardia lamblia
CALAEVSVLPRCSTHPR

SEQ ID NO: 3150293 - protein, 36 aa, Giardia lamblia
CALATSRLRAEIIALRRRLSMGIPYEKVLSDNQIYR

SEQ ID NO: 3150294 - protein, 18 aa, Giardia lamblia
CALDKPCVDIHYNEKDTK

SEQ ID NO: 3150295 - protein, 18 aa, Giardia lamblia
CALLRHPDIPHRSTLTNN

SEQ ID NO: 3150296 - protein, 20 aa, Giardia lamblia
CALLSTELYTCFTSIRAEVQ

SEQ ID NO: 3150297 - protein, 19 aa, Giardia lamblia
CAMISSPTPHRVPVELPNG

SEQ ID NO: 3150298 - protein, 18 aa, Giardia lamblia
CAPLALSAVPVGRSAMVE

SEQ ID NO: 3150299 - protein, 25 aa, Giardia lamblia
CAPQRRISLSQVDKVTALSVHDNTL

SEQ ID NO: 3150300 - protein, 22 aa, Giardia lamblia
CAPSTSGDPMFWSTLAQNVTAT

SEQ ID NO: 3150301 - protein, 19 aa, Giardia lamblia
CAQDELRVELDHTRTELAS

SEQ ID NO: 3150302 - protein, 21 aa, Giardia lamblia
CAQLLEHPWIKSVDNAPLDLS

SEQ ID NO: 3150303 - protein, 18 aa, Giardia lamblia
CARREGNEVLKELLKYEG

SEQ ID NO: 3150304 - protein, 33 aa, Giardia lamblia
CARYKRVVCPSAMAYLCLRPERRRCEVGRVAHE

SEQ ID NO: 3150305 - protein, 25 aa, Giardia lamblia
CASLSPDLTAAMAMQPRSGDAPDAD

SEQ ID NO: 3150306 - protein, 19 aa, Giardia lamblia
CASSSRISVVDIRGLANEA

SEQ ID NO: 3150307 - protein, 25 aa, Giardia lamblia
CATCGKDTKMCIGHFGTISLALPVF

SEQ ID NO: 3150308 - protein, 18 aa, Giardia lamblia
CATICPVDAIAPKNNLEI

SEQ ID NO: 3150309 - protein, 19 aa, Giardia lamblia
CAVLLASLEAGLAVTTGNR

SEQ ID NO: 3150310 - protein, 19 aa, Giardia lamblia
CAVRASHAPLHRSGSTPMK

SEQ ID NO: 3150311 - protein, 20 aa, Giardia lamblia
CAVVNRARAQLCKYVVEICS

SEQ ID NO: 3150312 - protein, 21 aa, Giardia lamblia
CAYHLEDSCRLTCCSVFERCG

SEQ ID NO: 3150313 - protein, 25 aa, Giardia lamblia
CAYNNYKGFVPLFVEREHGMVMLDG

SEQ ID NO: 3150314 - protein, 18 aa, Giardia lamblia
CAYSLAYFLMKSTVVSDF

SEQ ID NO: 3150315 - protein, 23 aa, Giardia lamblia
CCADIPRRPEGVLKMSKDELLQA

SEQ ID NO: 3150316 - protein, 28 aa, Giardia lamblia
CCERVMCAQCGVYLGKIQKRPCMVCASC

SEQ ID NO: 3150317 - protein, 19 aa, Giardia lamblia
CCGERCSRNSLAGSCAACG

SEQ ID NO: 3150318 - protein, 24 aa, Giardia lamblia
CCILPESYYLLAYTSTGLMALYCI

SEQ ID NO: 3150319 - protein, 21 aa, Giardia lamblia
CCKEVDRKALRYEHARNTFES

SEQ ID NO: 3150320 - protein, 21 aa, Giardia lamblia
CCKMRASGHLLTLRDLSEVEL

SEQ ID NO: 3150321 - protein, 22 aa, Giardia lamblia
CCLLQHVRLFVSFRIQCLSLVL

SEQ ID NO: 3150322 - protein, 21 aa, Giardia lamblia
CCLQSKTGLTALMYAARRGHA

SEQ ID NO: 3150323 - protein, 19 aa, Giardia lamblia
CCSVLSFEGIYYIFGDLYM

SEQ ID NO: 3150324 - protein, 17 aa, Giardia lamblia
CCVNSHNILSMNDIPMA

SEQ ID NO: 3150325 - protein, 29 aa, Giardia lamblia
CCVSSVLACLKRVIEATVTIGESCLSAIT

SEQ ID NO: 3150326 - protein, 21 aa, Giardia lamblia
CCWPRCFQASTLRDASSQKME

SEQ ID NO: 3150327 - protein, 21 aa, Giardia lamblia
CCYFIAVKYGALILELNQHII

SEQ ID NO: 3150328 - protein, 19 aa, Giardia lamblia
CDAEFRYSHEYLGCTARLV

SEQ ID NO: 3150329 - protein, 18 aa, Giardia lamblia
CDATRLFISVARAKNPPH

SEQ ID NO: 3150330 - protein, 20 aa, Giardia lamblia
CDCPGLIFPSFTHCRSDLLC

SEQ ID NO: 3150331 - protein, 23 aa, Giardia lamblia
CDEKWKFPDIPADLLEEVAQLTK

SEQ ID NO: 3150332 - protein, 20 aa, Giardia lamblia
CDELGMSLKQYERIEDPKVV

SEQ ID NO: 3150333 - protein, 29 aa, Giardia lamblia
CDERTWNPANVKRLYSLVSAVIVPRDGGA

SEQ ID NO: 3150334 - protein, 33 aa, Giardia lamblia
CDESGRLVIDFSQLKPASYWWFDGLVQETYVME

SEQ ID NO: 3150335 - protein, 20 aa, Giardia lamblia
CDGDIGECCTQALIRIDHTI

SEQ ID NO: 3150336 - protein, 18 aa, Giardia lamblia
CDGLRELLGLPLPTQDIY

SEQ ID NO: 3150337 - protein, 19 aa, Giardia lamblia
CDGQRVFTKSSAGQITARS

SEQ ID NO: 3150338 - protein, 23 aa, Giardia lamblia
CDHRGVSALMCLGRISNAQQIST

SEQ ID NO: 3150339 - protein, 17 aa, Giardia lamblia
CDILACNLLPNRSESPK

SEQ ID NO: 3150340 - protein, 20 aa, Giardia lamblia
CDILTDRVGSLTCAASGKPM

SEQ ID NO: 3150341 - protein, 20 aa, Giardia lamblia
CDIVQGIACLLHIYVTAKDA

SEQ ID NO: 3150342 - protein, 21 aa, Giardia lamblia
CDKINRTALMYAAQRGNDEVV

SEQ ID NO: 3150343 - protein, 25 aa, Giardia lamblia
CDKPQWLPLVYCIAFIHTTLIERKK

SEQ ID NO: 3150344 - protein, 26 aa, Giardia lamblia
CDLFIVGAICPPRCNDNLMELLLAID

SEQ ID NO: 3150345 - protein, 17 aa, Giardia lamblia
CDLHKRYSEHWVQDKDV

SEQ ID NO: 3150346 - protein, 19 aa, Giardia lamblia
CDLHKRYSEHWVQDKDVTV

SEQ ID NO: 3150347 - protein, 32 aa, Giardia lamblia
CDLKPQNFMFYKGRLRLIDFGISKAMQQDTTC

SEQ ID NO: 3150348 - protein, 18 aa, Giardia lamblia
CDLQAKFKLFERVDTQKF

SEQ ID NO: 3150349 - protein, 19 aa, Giardia lamblia
CDMALKLSMDANIDVHSHA

SEQ ID NO: 3150350 - protein, 21 aa, Giardia lamblia
CDMDLKIQDMRSHIVDLETKL

SEQ ID NO: 3150351 - protein, 24 aa, Giardia lamblia
CDNFPGTRGRRGASASQQLVTVNE

SEQ ID NO: 3150352 - protein, 18 aa, Giardia lamblia
CDNRPDIVTILAHNESAI

SEQ ID NO: 3150353 - protein, 27 aa, Giardia lamblia
CDPTCLGCTAPGPGRCTRCPSDKLLKR

SEQ ID NO: 3150354 - protein, 19 aa, Giardia lamblia
CDQWETVCQLGTGFSDADL

SEQ ID NO: 3150355 - protein, 17 aa, Giardia lamblia
CDSPYLGGGPEFHLHRK

SEQ ID NO: 3150356 - protein, 22 aa, Giardia lamblia
CDSRGRSALFYLIDNPHVHGLT

SEQ ID NO: 3150357 - protein, 17 aa, Giardia lamblia
CDTFRTGAFDQLKQNCT

SEQ ID NO: 3150358 - protein, 20 aa, Giardia lamblia
CDTLKQTALMFAVQNKHADC

SEQ ID NO: 3150359 - protein, 18 aa, Giardia lamblia
CDTPFAMLAHLAHKRFLK

SEQ ID NO: 3150360 - protein, 25 aa, Giardia lamblia
CDYDMWLERRLCLLKIPVDKLKEVI

SEQ ID NO: 3150361 - protein, 25 aa, Giardia lamblia
CDYTEFRIPYMMARSPAAFRSFTSK

SEQ ID NO: 3150362 - protein, 23 aa, Giardia lamblia
CEAIDPDAAMGLLGHRIANHSIT

SEQ ID NO: 3150363 - protein, 17 aa, Giardia lamblia
CEAKKFGGRGARARRQK

SEQ ID NO: 3150364 - protein, 19 aa, Giardia lamblia
CEALYRSICDEFRVPCLYT

SEQ ID NO: 3150365 - protein, 18 aa, Giardia lamblia
CEAYCYNCDVSIDSIFTV

SEQ ID NO: 3150366 - protein, 32 aa, Giardia lamblia
CECYTEVFLYLCINCGIRALKITGLGHNGPHA

SEQ ID NO: 3150367 - protein, 29 aa, Giardia lamblia
CEDMYLLTLRRLYCYTPFDLFVYEKIFEL

SEQ ID NO: 3150368 - protein, 29 aa, Giardia lamblia
CEERVPIPALRPVSAIARALVEPAGLGLC

SEQ ID NO: 3150369 - protein, 28 aa, Giardia lamblia
CEESVRLCPSYHKAWFRLGNIRESAGNK

SEQ ID NO: 3150370 - protein, 20 aa, Giardia lamblia
CEGETALMIAVREGHFKIAR

SEQ ID NO: 3150371 - protein, 25 aa, Giardia lamblia
CEGSVPSMRYLLGLSEESESQPPSM

SEQ ID NO: 3150372 - protein, 24 aa, Giardia lamblia
CEHIFYKALCLMIDDRNLKVVDQL

SEQ ID NO: 3150373 - protein, 18 aa, Giardia lamblia
CEIATFTCEVCGSSQYVV

SEQ ID NO: 3150374 - protein, 19 aa, Giardia lamblia
CELDLKTYLKHGSLYSAKE

SEQ ID NO: 3150375 - protein, 17 aa, Giardia lamblia
CELERRATEKVATPERV

SEQ ID NO: 3150376 - protein, 25 aa, Giardia lamblia
CELGLCYSLDYVICRLYSTVAITSG

SEQ ID NO: 3150377 - protein, 27 aa, Giardia lamblia
CELKNFWSDLCGGALGIFRRAYAKLRH

SEQ ID NO: 3150378 - protein, 29 aa, Giardia lamblia
CELLMAREDFLNWCKWSIAKVSRNSYTSA

SEQ ID NO: 3150379 - protein, 18 aa, Giardia lamblia
CELPDPIRAFPVMETNTH

SEQ ID NO: 3150380 - protein, 18 aa, Giardia lamblia
CENPELILATAMMQELPD

SEQ ID NO: 3150381 - protein, 25 aa, Giardia lamblia
CEPPAELPVKFPYELDPFQRRAIGA

SEQ ID NO: 3150382 - protein, 23 aa, Giardia lamblia
CEQLCPDRVLIGVGINVAVAPPG

SEQ ID NO: 3150383 - protein, 17 aa, Giardia lamblia
CEQPFSLFQPHRCSVKT

SEQ ID NO: 3150384 - protein, 28 aa, Giardia lamblia
CEQTREVQRLKLLLLDRDSQIQRVRDIN

SEQ ID NO: 3150385 - protein, 19 aa, Giardia lamblia
CERFSNLKTVVCLKDTSTN

SEQ ID NO: 3150386 - protein, 17 aa, Giardia lamblia
CESTLWDIAAQLFNLLA

SEQ ID NO: 3150387 - protein, 23 aa, Giardia lamblia
CESVPAHPASTFSINNVSSETIS

SEQ ID NO: 3150388 - protein, 34 aa, Giardia lamblia
CETDLRLLARELWRKLGCEVILCIGVQKRAYPEL

SEQ ID NO: 3150389 - protein, 18 aa, Giardia lamblia
CETEWKDPRGGRTESPGY

SEQ ID NO: 3150390 - protein, 21 aa, Giardia lamblia
CEVAELCTRMYAKYPDRLVVS

SEQ ID NO: 3150391 - protein, 23 aa, Giardia lamblia
CEVERLRKLLVSRDLEIKRLKNS

SEQ ID NO: 3150392 - protein, 17 aa, Giardia lamblia
CEVPWELNHTDSVWMPS

SEQ ID NO: 3150393 - protein, 19 aa, Giardia lamblia
CFDESCLHLTHALEHTLSA

SEQ ID NO: 3150394 - protein, 17 aa, Giardia lamblia
CFEGCFNLNTAPLLFVR

SEQ ID NO: 3150395 - protein, 20 aa, Giardia lamblia
CFETLIRLFLGYPQQNIPRT

SEQ ID NO: 3150396 - protein, 19 aa, Giardia lamblia
CFFNLPMLLNEDFGSHAVQ

SEQ ID NO: 3150397 - protein, 23 aa, Giardia lamblia
CFHHKDPLIIGVRIDKGSLHPQQ

SEQ ID NO: 3150398 - protein, 20 aa, Giardia lamblia
CFIPRMPTDYIKRIAAEQHK

SEQ ID NO: 3150399 - protein, 17 aa, Giardia lamblia
CFKSRRAPSRTVTALPK

SEQ ID NO: 3150400 - protein, 18 aa, Giardia lamblia
CFLTCYDPIISTGKSTRD

SEQ ID NO: 3150401 - protein, 18 aa, Giardia lamblia
CFLTLPNPHPMVIQVVQL

SEQ ID NO: 3150402 - protein, 20 aa, Giardia lamblia
CFQHGCSGVTAFMIAAEAGY

SEQ ID NO: 3150403 - protein, 19 aa, Giardia lamblia
CFSMVPFVIDLSMSDQDDY

SEQ ID NO: 3150404 - protein, 20 aa, Giardia lamblia
CFSNTRPGVFATARSDGYLD

SEQ ID NO: 3150405 - protein, 19 aa, Giardia lamblia
CFTSSELLVKLPYTHPSAS

SEQ ID NO: 3150406 - protein, 18 aa, Giardia lamblia
CFVDSSVNCITEFVSNST

SEQ ID NO: 3150407 - protein, 23 aa, Giardia lamblia
CFYGQRCRFLLVKDRTHIVTQKS

SEQ ID NO: 3150408 - protein, 19 aa, Giardia lamblia
CGANGVLPAIPYPVDTNGF

SEQ ID NO: 3150409 - protein, 20 aa, Giardia lamblia
CGAQILSALMYVYHPRKKQR

SEQ ID NO: 3150410 - protein, 27 aa, Giardia lamblia
CGCGNGRNMLLCPGFAEFGIDYSSNLC

SEQ ID NO: 3150411 - protein, 43 aa, Giardia lamblia
CGCLSCMICSFDCYHHGWPCFGCGAPITFLGLSFSRLRANPQT

SEQ ID NO: 3150412 - protein, 22 aa, Giardia lamblia
CGDECFRLTARFPPLSKSQLKR

SEQ ID NO: 3150413 - protein, 23 aa, Giardia lamblia
CGDFGETGLQYAVQMKNAEIVRL

SEQ ID NO: 3150414 - protein, 19 aa, Giardia lamblia
CGDKYMWAKLINAVATGDR

SEQ ID NO: 3150415 - protein, 17 aa, Giardia lamblia
CGDSRRFVATKIMNYYA

SEQ ID NO: 3150416 - protein, 28 aa, Giardia lamblia
CGELVPFLRNIICTGVPVEVWLGQVEDC

SEQ ID NO: 3150417 - protein, 17 aa, Giardia lamblia
CGFLRYVQEAVKTDHFF

SEQ ID NO: 3150418 - protein, 17 aa, Giardia lamblia
CGHKYRQALVSGLDAIV

SEQ ID NO: 3150419 - protein, 20 aa, Giardia lamblia
CGHLAWSPVSMQFALATSSA

SEQ ID NO: 3150420 - protein, 23 aa, Giardia lamblia
CGHLTCCKSCLSKVHKVCPVCRA

SEQ ID NO: 3150421 - protein, 40 aa, Giardia lamblia
CGHTFCAACIYACTLYWRQHTCPICMEHLPSVPKIDDVID

SEQ ID NO: 3150422 - protein, 17 aa, Giardia lamblia
CGKRRVRFNPAHEKYIE

SEQ ID NO: 3150423 - protein, 20 aa, Giardia lamblia
CGLAALRYQVDLMLLAGDNM

SEQ ID NO: 3150424 - protein, 19 aa, Giardia lamblia
CGLKAYNLTVSRLRRLVEL

SEQ ID NO: 3150425 - protein, 19 aa, Giardia lamblia
CGMTALMYAVVLGREQHID

SEQ ID NO: 3150426 - protein, 17 aa, Giardia lamblia
CGNILSFERRLLPESGN

SEQ ID NO: 3150427 - protein, 18 aa, Giardia lamblia
CGPTSEFNGTGTGVSNEI

SEQ ID NO: 3150428 - protein, 19 aa, Giardia lamblia
CGQALHCFIRSGSATLHDE

SEQ ID NO: 3150429 - protein, 17 aa, Giardia lamblia
CGQEMAMPSFLTPEAFY

SEQ ID NO: 3150430 - protein, 21 aa, Giardia lamblia
CGQILSKELYNLVSNLRTKEC

SEQ ID NO: 3150431 - protein, 19 aa, Giardia lamblia
CGQTLPGRYAKSALSEHLS

SEQ ID NO: 3150432 - protein, 25 aa, Giardia lamblia
CGRFGRKGLSVSLLIAENQKCMDDV

SEQ ID NO: 3150433 - protein, 17 aa, Giardia lamblia
CGRRGCMDSCEGPLEPK

SEQ ID NO: 3150434 - protein, 17 aa, Giardia lamblia
CGSQMLSTGQVYNTQNF

SEQ ID NO: 3150435 - protein, 26 aa, Giardia lamblia
CGSSGMLWLQCGRANGSILRALPLPI

SEQ ID NO: 3150436 - protein, 37 aa, Giardia lamblia
CGTHKTIYLDTYRFSTMSLRNALGIHVEGGGQYEDTT

SEQ ID NO: 3150437 - protein, 20 aa, Giardia lamblia
CGTQYFRPYSFPVIERATAL

SEQ ID NO: 3150438 - protein, 20 aa, Giardia lamblia
CGVATRPPAIPQQAVATTDS

SEQ ID NO: 3150439 - protein, 22 aa, Giardia lamblia
CGVCGRERFEYVALPCRHVTVC

SEQ ID NO: 3150440 - protein, 19 aa, Giardia lamblia
CGVDLGAVFAKLPSLAHIQ

SEQ ID NO: 3150441 - protein, 26 aa, Giardia lamblia
CGWEQCVRMLLPLEWHIMHSNGLTAD

SEQ ID NO: 3150442 - protein, 20 aa, Giardia lamblia
CGYRDLIRPLLCEAGSQSLV

SEQ ID NO: 3150443 - protein, 17 aa, Giardia lamblia
CGYSRVLATFIISCLTF

SEQ ID NO: 3150444 - protein, 19 aa, Giardia lamblia
CHANNKPGAGLTHIEEKLS

SEQ ID NO: 3150445 - protein, 17 aa, Giardia lamblia
CHAQELIPSFLASQKNA

SEQ ID NO: 3150446 - protein, 19 aa, Giardia lamblia
CHEELKDRYSELVLACKKL

SEQ ID NO: 3150447 - protein, 26 aa, Giardia lamblia
CHIMCCLRSDVLPPLSVRNADMRDHD

SEQ ID NO: 3150448 - protein, 18 aa, Giardia lamblia
CHLAVSWMPELDKIIEQL

SEQ ID NO: 3150449 - protein, 22 aa, Giardia lamblia
CHLCGLCTGFTDSLLLGYASVE

SEQ ID NO: 3150450 - protein, 19 aa, Giardia lamblia
CHLLPKWLKTLEKILEGPM

SEQ ID NO: 3150451 - protein, 25 aa, Giardia lamblia
CHRRLRQLVCIAALCHDLGHGPFSH

SEQ ID NO: 3150452 - protein, 18 aa, Giardia lamblia
CHSPFKFNPATSKGPSTG

SEQ ID NO: 3150453 - protein, 22 aa, Giardia lamblia
CHVPYRNSMMTMFLRDSIGGNC

SEQ ID NO: 3150454 - protein, 20 aa, Giardia lamblia
CHYGPRFQFTPMIQGKTANE

SEQ ID NO: 3150455 - protein, 27 aa, Giardia lamblia
CIAMLSSNIQFCFLSATVPNASEFAGW

SEQ ID NO: 3150456 - protein, 23 aa, Giardia lamblia
CIAPGLISEADWEQELMAVDSQL

SEQ ID NO: 3150457 - protein, 21 aa, Giardia lamblia
CIASPRFLLSTTLHAALQQSF

SEQ ID NO: 3150458 - protein, 25 aa, Giardia lamblia
CIDDHWLKERCILKSNTIKSKKSVF

SEQ ID NO: 3150459 - protein, 18 aa, Giardia lamblia
CIDFVKKLWDKEGSITGL

SEQ ID NO: 3150460 - protein, 19 aa, Giardia lamblia
CIDGAGWTAMMYAAREGHC

SEQ ID NO: 3150461 - protein, 25 aa, Giardia lamblia
CIDLFRKCLDPVDRVLRDSKLGKND

SEQ ID NO: 3150462 - protein, 24 aa, Giardia lamblia
CIDLIKHLICEPEERYDFEQIKAH

SEQ ID NO: 3150463 - protein, 18 aa, Giardia lamblia
CIDRALIRPGRADHKILI

SEQ ID NO: 3150464 - protein, 28 aa, Giardia lamblia
CIDVNGRTALMWAAYRGNSMLVRLLHDA

SEQ ID NO: 3150465 - protein, 24 aa, Giardia lamblia
CIEECREISSIIATCVPEEKGFVS

SEQ ID NO: 3150466 - protein, 18 aa, Giardia lamblia
CIETAKLVIKYDGGAQDI

SEQ ID NO: 3150467 - protein, 20 aa, Giardia lamblia
CIETFAPKDCTFIYDQIIRE

SEQ ID NO: 3150468 - protein, 20 aa, Giardia lamblia
CIGCGRVVAQGAKLVNMSLE

SEQ ID NO: 3150469 - protein, 20 aa, Giardia lamblia
CIGPEPWKYLVQQWVTFNHG

SEQ ID NO: 3150470 - protein, 21 aa, Giardia lamblia
CIKLLYRAEKDCRTVRGKGCI

SEQ ID NO: 3150471 - protein, 18 aa, Giardia lamblia
CIKWTTRWMQEMVRGKNS

SEQ ID NO: 3150472 - protein, 25 aa, Giardia lamblia
CILLEMCSLSYPALIKSGVPLEDNF

SEQ ID NO: 3150473 - protein, 20 aa, Giardia lamblia
CILMKDCANKELINLGFSAA

SEQ ID NO: 3150474 - protein, 22 aa, Giardia lamblia
CIMSGQVARAYIRCSWNKLGYG

SEQ ID NO: 3150475 - protein, 25 aa, Giardia lamblia
CINCGIRFLTVYAFSTENWSRPPTE

SEQ ID NO: 3150476 - protein, 18 aa, Giardia lamblia
CINDRRHALATWKKDYDR

SEQ ID NO: 3150477 - protein, 26 aa, Giardia lamblia
CIRELRKGRIRPYRYTRIFINHEPML

SEQ ID NO: 3150478 - protein, 26 aa, Giardia lamblia
CISECSSVVFLLFCFMHRDLDPDKLL

SEQ ID NO: 3150479 - protein, 18 aa, Giardia lamblia
CISELRSLIKTLYTSGQA

SEQ ID NO: 3150480 - protein, 20 aa, Giardia lamblia
CISHYCKLALHGNPSNYSTG

SEQ ID NO: 3150481 - protein, 21 aa, Giardia lamblia
CISSGITPWQLARDSGFMDAL

SEQ ID NO: 3150482 - protein, 19 aa, Giardia lamblia
CISVDSCLNSKSSTWHSSV

SEQ ID NO: 3150483 - protein, 24 aa, Giardia lamblia
CISVLCTNISPASSCFQESLNTLK

SEQ ID NO: 3150484 - protein, 22 aa, Giardia lamblia
CISVSALQWLCYSNKKSENPRA

SEQ ID NO: 3150485 - protein, 21 aa, Giardia lamblia
CITIKSTGVSLYYEWTDENKV

SEQ ID NO: 3150486 - protein, 19 aa, Giardia lamblia
CITMKASAVSLLHLSDNQM

SEQ ID NO: 3150487 - protein, 25 aa, Giardia lamblia
CITQLSQGWARFSLYGNTSAKEGEL

SEQ ID NO: 3150488 - protein, 18 aa, Giardia lamblia
CIYEDLASLGIAKCPVCF

SEQ ID NO: 3150489 - protein, 18 aa, Giardia lamblia
CKAGAQVNEQAILHMFER

SEQ ID NO: 3150490 - protein, 17 aa, Giardia lamblia
CKCRCIVGTFTEVRHDE

SEQ ID NO: 3150491 - protein, 20 aa, Giardia lamblia
CKDEGLTPRCLVLINPNNPT

SEQ ID NO: 3150492 - protein, 19 aa, Giardia lamblia
CKDFNYSRMNSGAEVKEAA

SEQ ID NO: 3150493 - protein, 19 aa, Giardia lamblia
CKDLIKRLLDINPKTRLGS

SEQ ID NO: 3150494 - protein, 19 aa, Giardia lamblia
CKDPELLAYAQYQQHLLEK

SEQ ID NO: 3150495 - protein, 26 aa, Giardia lamblia
CKDTSNRIAVFVARMLIKCSQIKNLK

SEQ ID NO: 3150496 - protein, 24 aa, Giardia lamblia
CKDVKRLPYEIEFTPILTDNTLLF

SEQ ID NO: 3150497 - protein, 19 aa, Giardia lamblia
CKDVLRSGNAFVGARPYTA

SEQ ID NO: 3150498 - protein, 19 aa, Giardia lamblia
CKEAANIYSLQFAIPLALT

SEQ ID NO: 3150499 - protein, 22 aa, Giardia lamblia
CKEEKRAWVANHLGYKFVDKMI

SEQ ID NO: 3150500 - protein, 19 aa, Giardia lamblia
CKEKIRSGQYPAGSVPLRA

SEQ ID NO: 3150501 - protein, 18 aa, Giardia lamblia
CKEYCLRYDEAHQVLTTA

SEQ ID NO: 3150502 - protein, 17 aa, Giardia lamblia
CKGRSASTSSHALNSTV

SEQ ID NO: 3150503 - protein, 20 aa, Giardia lamblia
CKHKNWRIRETSLRILESED

SEQ ID NO: 3150504 - protein, 17 aa, Giardia lamblia
CKICKQRFESRTKLFKH

SEQ ID NO: 3150505 - protein, 24 aa, Giardia lamblia
CKISSCKALLYGGIGKRKVPCGDA

SEQ ID NO: 3150506 - protein, 19 aa, Giardia lamblia
CKKQLGIDRSVLKKLRQNE

SEQ ID NO: 3150507 - protein, 31 aa, Giardia lamblia
CKNCGSPIVRSALSLKILPLVLAEPDDETSI

SEQ ID NO: 3150508 - protein, 22 aa, Giardia lamblia
CKNKALGCSFMQPYIIVAYHGI

SEQ ID NO: 3150509 - protein, 19 aa, Giardia lamblia
CKNNCPVCRMEHYQPSELC

SEQ ID NO: 3150510 - protein, 18 aa, Giardia lamblia
CKNRIIQILQQYILTPTE

SEQ ID NO: 3150511 - protein, 17 aa, Giardia lamblia
CKPEVPLTAEEIQLQRA

SEQ ID NO: 3150512 - protein, 19 aa, Giardia lamblia
CKRFRQFIQRTSAHGDVSQ

SEQ ID NO: 3150513 - protein, 20 aa, Giardia lamblia
CKSDSSPLLTRSSTSDQVLL

SEQ ID NO: 3150514 - protein, 23 aa, Giardia lamblia
CKSGDLVEILGIFNPSVHHRAGE

SEQ ID NO: 3150515 - protein, 17 aa, Giardia lamblia
CKSILMDFFRGPTITAM

SEQ ID NO: 3150516 - protein, 18 aa, Giardia lamblia
CKSLVLASHLGRPKGTGP

SEQ ID NO: 3150517 - protein, 19 aa, Giardia lamblia
CKSNGYRPILIEINSNPCL

SEQ ID NO: 3150518 - protein, 21 aa, Giardia lamblia
CKSVCPLHQWERATVGFTRGS

SEQ ID NO: 3150519 - protein, 18 aa, Giardia lamblia
CKTGLSLDVIATLQNELR

SEQ ID NO: 3150520 - protein, 25 aa, Giardia lamblia
CKTIPSLKHPLHIDLEALHQREYLR

SEQ ID NO: 3150521 - protein, 19 aa, Giardia lamblia
CKTLEAELVKLSEATQNNL

SEQ ID NO: 3150522 - protein, 24 aa, Giardia lamblia
CKTLKRAALGRMISLLRKQNEYLA

SEQ ID NO: 3150523 - protein, 18 aa, Giardia lamblia
CKVLWKYEGGMTTSNGFT

SEQ ID NO: 3150524 - protein, 23 aa, Giardia lamblia
CKVSAESGQPCVFLSEENYKFRL

SEQ ID NO: 3150525 - protein, 21 aa, Giardia lamblia
CKVYEYGRLSPHEAAVLHREV

SEQ ID NO: 3150526 - protein, 23 aa, Giardia lamblia
CKYTHATAFPGRFIPGNFTNRMN

SEQ ID NO: 3150527 - protein, 31 aa, Giardia lamblia
CLAKLFRCIGGIERLMVRWLENIYIGDEYAQ

SEQ ID NO: 3150528 - protein, 18 aa, Giardia lamblia
CLAKLQPNIVSWKSLGSE

SEQ ID NO: 3150529 - protein, 20 aa, Giardia lamblia
CLALHTCFSLLLNDYPDNDD

SEQ ID NO: 3150530 - protein, 20 aa, Giardia lamblia
CLAMAKAGCHIIDLASSSLA

SEQ ID NO: 3150531 - protein, 18 aa, Giardia lamblia
CLARECKGTYSVLSSVFE

SEQ ID NO: 3150532 - protein, 26 aa, Giardia lamblia
CLATFRKGKSLDILCESYADSSAAPS

SEQ ID NO: 3150533 - protein, 21 aa, Giardia lamblia
CLCAYQTSYVRLFSPLARAHC

SEQ ID NO: 3150534 - protein, 23 aa, Giardia lamblia
CLDILKKEWSPVLTIAKILLSIC

SEQ ID NO: 3150535 - protein, 22 aa, Giardia lamblia
CLDSPPLRYCHLNRYNLLSGSF

SEQ ID NO: 3150536 - protein, 24 aa, Giardia lamblia
CLDWHPERSDLLLVGLYDGNIAMY

SEQ ID NO: 3150537 - protein, 19 aa, Giardia lamblia
CLEIILSALVPDIPSVSTN

SEQ ID NO: 3150538 - protein, 19 aa, Giardia lamblia
CLENTDFRSQLAYLTGLGL

SEQ ID NO: 3150539 - protein, 21 aa, Giardia lamblia
CLGKPFKACSYSIIYEAADLR

SEQ ID NO: 3150540 - protein, 23 aa, Giardia lamblia
CLHDYADLVPFFLGKETGILSND

SEQ ID NO: 3150541 - protein, 20 aa, Giardia lamblia
CLHPVYNKLVMRLSGKLGNK

SEQ ID NO: 3150542 - protein, 24 aa, Giardia lamblia
CLICRSDRGFTQLMTAAKENNENE

SEQ ID NO: 3150543 - protein, 22 aa, Giardia lamblia
CLISYCPYDNHFIFSDDKGLYS

SEQ ID NO: 3150544 - protein, 28 aa, Giardia lamblia
CLIYEICLRKKPSFEVLRQERPAFSSID

SEQ ID NO: 3150545 - protein, 27 aa, Giardia lamblia
CLKALRPGFHPTIYASGFFGAFRLIDM

SEQ ID NO: 3150546 - protein, 19 aa, Giardia lamblia
CLLVNRLSLYSRLQRELLL

SEQ ID NO: 3150547 - protein, 26 aa, Giardia lamblia
CLMLCAEKGLAHSVRLLVGREAGMQD

SEQ ID NO: 3150548 - protein, 26 aa, Giardia lamblia
CLNELKKDRSLIHMTGERVKELLTDF

SEQ ID NO: 3150549 - protein, 18 aa, Giardia lamblia
CLQHLPLPYDLSQEEIEG

SEQ ID NO: 3150550 - protein, 19 aa, Giardia lamblia
CLQNFARKYVIAIDKLIFR

SEQ ID NO: 3150551 - protein, 20 aa, Giardia lamblia
CLRTSSGIGISFGGSTNNHL

SEQ ID NO: 3150552 - protein, 18 aa, Giardia lamblia
CLSAALQLLERIKDEPEL

SEQ ID NO: 3150553 - protein, 22 aa, Giardia lamblia
CLSATDCLEWLLDENIARDAGC

SEQ ID NO: 3150554 - protein, 24 aa, Giardia lamblia
CLSDKVCKVLWRIVSEKKTVLGQD

SEQ ID NO: 3150555 - protein, 26 aa, Giardia lamblia
CLSLCKKSAIIAVPFVALADELVGKL

SEQ ID NO: 3150556 - protein, 24 aa, Giardia lamblia
CLSNKRSLLDFVWDQEGHELREYL

SEQ ID NO: 3150557 - protein, 20 aa, Giardia lamblia
CLSSAGLIYVHYGRSILKQL

SEQ ID NO: 3150558 - protein, 17 aa, Giardia lamblia
CLTQRTLEMTASKKDIS

SEQ ID NO: 3150559 - protein, 18 aa, Giardia lamblia
CLTRDSLQRLLNGYASHV

SEQ ID NO: 3150560 - protein, 32 aa, Giardia lamblia
CLTYQLPYLSFGKRMIKVFPNLNITNAHREFM

SEQ ID NO: 3150561 - protein, 23 aa, Giardia lamblia
CLVESFQPLVAWICREGFARFSL

SEQ ID NO: 3150562 - protein, 23 aa, Giardia lamblia
CLVNFRQAYAYPKRRAGDTLIEV

SEQ ID NO: 3150563 - protein, 25 aa, Giardia lamblia
CLVRYECRYQIVANGEWRGMTALMF

SEQ ID NO: 3150564 - protein, 19 aa, Giardia lamblia
CLYHIPVALLALANDSGIA

SEQ ID NO: 3150565 - protein, 25 aa, Giardia lamblia
CMAISTRLLVAVAFTDGDVCLFSSL

SEQ ID NO: 3150566 - protein, 30 aa, Giardia lamblia
CMCYILTDQCCYVCSASIDGSILCLIHPLV

SEQ ID NO: 3150567 - protein, 25 aa, Giardia lamblia
CMDEARVLCTIASIFAAQDSATIAP

SEQ ID NO: 3150568 - protein, 20 aa, Giardia lamblia
CMDMSKLMRRGYTMAANLKK

SEQ ID NO: 3150569 - protein, 41 aa, Giardia lamblia
CMEKCRGCTALSFAACYGRLDCVKLLLKREKNVGGMSALSV

SEQ ID NO: 3150570 - protein, 18 aa, Giardia lamblia
CMIFCSSVSGALHMERCR

SEQ ID NO: 3150571 - protein, 24 aa, Giardia lamblia
CMSANLRGLLAIHIAALKGHATVV

SEQ ID NO: 3150572 - protein, 18 aa, Giardia lamblia
CMSLCFMGTDLRPFILQA

SEQ ID NO: 3150573 - protein, 17 aa, Giardia lamblia
CMSLLAGNGLQFLLEKK

SEQ ID NO: 3150574 - protein, 25 aa, Giardia lamblia
CNALNLEKRLQCLESEHKASLEENK

SEQ ID NO: 3150575 - protein, 17 aa, Giardia lamblia
CNDGTIVQLSWVSGVQH

SEQ ID NO: 3150576 - protein, 24 aa, Giardia lamblia
CNIDGSAAIHWAAEQGHLCIVEEL

SEQ ID NO: 3150577 - protein, 26 aa, Giardia lamblia
CNIMKHLPRLLARQSVRYLTVMFPDP

SEQ ID NO: 3150578 - protein, 23 aa, Giardia lamblia
CNKKLKDIRKFIAEHEKEGLLTT

SEQ ID NO: 3150579 - protein, 24 aa, Giardia lamblia
CNKRAHPVITLKAGSCVLQGCSLR

SEQ ID NO: 3150580 - protein, 17 aa, Giardia lamblia
CNMGMTIVFDVHALQSF

SEQ ID NO: 3150581 - protein, 26 aa, Giardia lamblia
CNNCDQAFCGSNLFAEILISALVASR

SEQ ID NO: 3150582 - protein, 25 aa, Giardia lamblia
CNNNLECVRLLASKEGDIKTTHNVY

SEQ ID NO: 3150583 - protein, 32 aa, Giardia lamblia
CNNSRPYLDEVLAHPFIFGFMVKSGSRENERV

SEQ ID NO: 3150584 - protein, 22 aa, Giardia lamblia
CNPRARDTLPYYLEPPQNTYST

SEQ ID NO: 3150585 - protein, 17 aa, Giardia lamblia
CNSGLVVLPCGAGKSLL

SEQ ID NO: 3150586 - protein, 24 aa, Giardia lamblia
CNSKDCVRILAPYERSIANEDGKK

SEQ ID NO: 3150587 - protein, 18 aa, Giardia lamblia
CNSTDPMVYKQFLEEKSR

SEQ ID NO: 3150588 - protein, 18 aa, Giardia lamblia
CNVAHSWVGIHKMIEPLH

SEQ ID NO: 3150589 - protein, 21 aa, Giardia lamblia
CNVLRVDVIVMRKQAGGPKPQ

SEQ ID NO: 3150590 - protein, 18 aa, Giardia lamblia
CNVTKALQRTGRRTDEHE

SEQ ID NO: 3150591 - protein, 17 aa, Giardia lamblia
CNYIHMKQILGIFHNDT

SEQ ID NO: 3150592 - protein, 18 aa, Giardia lamblia
CNYYRTLWVSQLSAPTSR

SEQ ID NO: 3150593 - protein, 18 aa, Giardia lamblia
CPAEQVFFPLHTRELCTL

SEQ ID NO: 3150594 - protein, 18 aa, Giardia lamblia
CPAPAGISYDFYKGSQAF

SEQ ID NO: 3150595 - protein, 21 aa, Giardia lamblia
CPAPPYWPYYSMPPNPGVYSG

SEQ ID NO: 3150596 - protein, 18 aa, Giardia lamblia
CPCGCLSVANLTRAQQIH

SEQ ID NO: 3150597 - protein, 18 aa, Giardia lamblia
CPCYYYPVRTGSREQPSF

SEQ ID NO: 3150598 - protein, 21 aa, Giardia lamblia
CPDLSPRFVDVCSASLSDKAH

SEQ ID NO: 3150599 - protein, 29 aa, Giardia lamblia
CPDPEAVRCDLFWRRGRKLEIEGRLKEAE

SEQ ID NO: 3150600 - protein, 19 aa, Giardia lamblia
CPECCSCHDYTPPPFLFEM

SEQ ID NO: 3150601 - protein, 23 aa, Giardia lamblia
CPEGETAVLAWGCVPDACVTEYA

SEQ ID NO: 3150602 - protein, 20 aa, Giardia lamblia
CPEHCSDVLKLLEDSYGMQW

SEQ ID NO: 3150603 - protein, 25 aa, Giardia lamblia
CPFWCPHARAGIFNLSYSTTPSHIV

SEQ ID NO: 3150604 - protein, 17 aa, Giardia lamblia
CPGRISMDILPNIIHDY

SEQ ID NO: 3150605 - protein, 27 aa, Giardia lamblia
CPGRLARMFYGCCVFNLTKNQLISERI

SEQ ID NO: 3150606 - protein, 19 aa, Giardia lamblia
CPGTGKSFLAKAVAAECDA

SEQ ID NO: 3150607 - protein, 21 aa, Giardia lamblia
CPHEMKTYTAITFDRYNTTER

SEQ ID NO: 3150608 - protein, 17 aa, Giardia lamblia
CPHLVLTGAAVYVFTSY

SEQ ID NO: 3150609 - protein, 17 aa, Giardia lamblia
CPHMLQILSAKLMPEHS

SEQ ID NO: 3150610 - protein, 17 aa, Giardia lamblia
CPIPYVCDVKIYRLRLA

SEQ ID NO: 3150611 - protein, 26 aa, Giardia lamblia
CPKVPKLVHRHVSSFSILIGENTSML

SEQ ID NO: 3150612 - protein, 19 aa, Giardia lamblia
CPLCKRPQYDNDSYKDHLL

SEQ ID NO: 3150613 - protein, 33 aa, Giardia lamblia
CPLERGVGYYLEYFVLIAMFCKFQLRLTLTGVT

SEQ ID NO: 3150614 - protein, 21 aa, Giardia lamblia
CPLLAALMSRSARFSVPFPVQ

SEQ ID NO: 3150615 - protein, 20 aa, Giardia lamblia
CPLSSIKVMVIIAAPEGIDN

SEQ ID NO: 3150616 - protein, 23 aa, Giardia lamblia
CPMARAVPHSNTLLIYGAPGVGK

SEQ ID NO: 3150617 - protein, 19 aa, Giardia lamblia
CPMPSGRPAIISAAEAGNT

SEQ ID NO: 3150618 - protein, 19 aa, Giardia lamblia
CPPLVKSQVDYLCHLSKTP

SEQ ID NO: 3150619 - protein, 17 aa, Giardia lamblia
CPQDVALWPEARSSMSS

SEQ ID NO: 3150620 - protein, 19 aa, Giardia lamblia
CPQLDWDFDPSISVRISYL

SEQ ID NO: 3150621 - protein, 21 aa, Giardia lamblia
CPRARVPRYVAEQAKNNTSPK

SEQ ID NO: 3150622 - protein, 19 aa, Giardia lamblia
CPSCLRKFPITALNEHINE

SEQ ID NO: 3150623 - protein, 17 aa, Giardia lamblia
CPSFGDAPRSSRFYEIA

SEQ ID NO: 3150624 - protein, 20 aa, Giardia lamblia
CPSISLPSQRVISSTTQHSG

SEQ ID NO: 3150625 - protein, 24 aa, Giardia lamblia
CPSLRYDPASSLLYVLAPTTDAGV

SEQ ID NO: 3150626 - protein, 24 aa, Giardia lamblia
CPSLRYDPASSLLYVLASTTDAEV

SEQ ID NO: 3150627 - protein, 18 aa, Giardia lamblia
CPSQESFSETIVPQQNTG

SEQ ID NO: 3150628 - protein, 18 aa, Giardia lamblia
CPTLEVINDIPVTDVDLT

SEQ ID NO: 3150629 - protein, 18 aa, Giardia lamblia
CPTSIFYEPFRAETLKEP

SEQ ID NO: 3150630 - protein, 17 aa, Giardia lamblia
CPTSSVPAKPCPNEEPV

SEQ ID NO: 3150631 - protein, 19 aa, Giardia lamblia
CPVAESLWSGEKLETRHYI

SEQ ID NO: 3150632 - protein, 18 aa, Giardia lamblia
CPVQEILDFCQTSPRRVL

SEQ ID NO: 3150633 - protein, 18 aa, Giardia lamblia
CPVQVPIPQFIKKITERD

SEQ ID NO: 3150634 - protein, 17 aa, Giardia lamblia
CQAYRMTYDVAPSVEII

SEQ ID NO: 3150635 - protein, 23 aa, Giardia lamblia
CQEKSRAGAPLFASPELYKELEE

SEQ ID NO: 3150636 - protein, 30 aa, Giardia lamblia
CQFGHIDCVRMLIPKEIRLRDRRGRSALHY

SEQ ID NO: 3150637 - protein, 19 aa, Giardia lamblia
CQFNPISGFMIKNVGSQLR

SEQ ID NO: 3150638 - protein, 18 aa, Giardia lamblia
CQHNCGLEGRILAMRPAP

SEQ ID NO: 3150639 - protein, 17 aa, Giardia lamblia
CQILCEMMSVVASVKLP

SEQ ID NO: 3150640 - protein, 19 aa, Giardia lamblia
CQILRSLNFLLKHLISENQ

SEQ ID NO: 3150641 - protein, 22 aa, Giardia lamblia
CQKCSDEALLLNGRCVALACVS

SEQ ID NO: 3150642 - protein, 19 aa, Giardia lamblia
CQKSICEICICFTGDFLDT

SEQ ID NO: 3150643 - protein, 17 aa, Giardia lamblia
CQLLFGGDLGSACVNDL

SEQ ID NO: 3150644 - protein, 21 aa, Giardia lamblia
CQLLLKLEGSMALDYDNKTAL

SEQ ID NO: 3150645 - protein, 20 aa, Giardia lamblia
CQLLNGLHFLHSRRIVHRDL

SEQ ID NO: 3150646 - protein, 18 aa, Giardia lamblia
CQLWREAICRAIIEKARP

SEQ ID NO: 3150647 - protein, 19 aa, Giardia lamblia
CQTPTLSFCVSRHDEIQRF

SEQ ID NO: 3150648 - protein, 22 aa, Giardia lamblia
CQVPDKRARKSALRSGEGDDLD

SEQ ID NO: 3150649 - protein, 19 aa, Giardia lamblia
CRAQMRLGKLENHAHAQYR

SEQ ID NO: 3150650 - protein, 17 aa, Giardia lamblia
CRDALWSESTLMGIMAY

SEQ ID NO: 3150651 - protein, 26 aa, Giardia lamblia
CREELELCAGCTTIVLDKSGLTNGLY

SEQ ID NO: 3150652 - protein, 19 aa, Giardia lamblia
CRESVVMNLLIRAVSGAAA

SEQ ID NO: 3150653 - protein, 17 aa, Giardia lamblia
CRFIRELSHHCPSHHSY

SEQ ID NO: 3150654 - protein, 17 aa, Giardia lamblia
CRFKVIKVAGIGLLALF

SEQ ID NO: 3150655 - protein, 18 aa, Giardia lamblia
CRGMRKTELMQVAEVGDI

SEQ ID NO: 3150656 - protein, 17 aa, Giardia lamblia
CRGRYGFSSLATHLCLE

SEQ ID NO: 3150657 - protein, 22 aa, Giardia lamblia
CRHLSICELCNNLLHDRKCPLC

SEQ ID NO: 3150658 - protein, 17 aa, Giardia lamblia
CRIFIVYALLVNGETPK

SEQ ID NO: 3150659 - protein, 18 aa, Giardia lamblia
CRILIPFEKGVFLPDGRT

SEQ ID NO: 3150660 - protein, 21 aa, Giardia lamblia
CRIPEDLRSLLSVTISVYCIE

SEQ ID NO: 3150661 - protein, 17 aa, Giardia lamblia
CRIPMSIMDNTWTVPDP

SEQ ID NO: 3150662 - protein, 17 aa, Giardia lamblia
CRIRLAELGACLGSNYE

SEQ ID NO: 3150663 - protein, 18 aa, Giardia lamblia
CRKGNLGYLPRKRCTRGR

SEQ ID NO: 3150664 - protein, 17 aa, Giardia lamblia
CRKLLQGELTKTQSEIL

SEQ ID NO: 3150665 - protein, 24 aa, Giardia lamblia
CRKNHLNCVFPLLQLEARMQDARG

SEQ ID NO: 3150666 - protein, 18 aa, Giardia lamblia
CRLDDRYDYVLDYHYRKS

SEQ ID NO: 3150667 - protein, 20 aa, Giardia lamblia
CRLDVFVYCFNYLFDRTVLF

SEQ ID NO: 3150668 - protein, 18 aa, Giardia lamblia
CRLGCTFEPKITKFVTLT

SEQ ID NO: 3150669 - protein, 17 aa, Giardia lamblia
CRMLGPLEKGMFNRHGE

SEQ ID NO: 3150670 - protein, 19 aa, Giardia lamblia
CRNICLVARLFLQHKTLVA

SEQ ID NO: 3150671 - protein, 18 aa, Giardia lamblia
CRNTYAIELLVNSFEYDE

SEQ ID NO: 3150672 - protein, 18 aa, Giardia lamblia
CRPSEKNLSIGVLDRTTG

SEQ ID NO: 3150673 - protein, 24 aa, Giardia lamblia
CRQNNKPILGICLGMQCMAIEFAN

SEQ ID NO: 3150674 - protein, 23 aa, Giardia lamblia
CRREKLLKLYSLDFERQRQELQR

SEQ ID NO: 3150675 - protein, 26 aa, Giardia lamblia
CRRTARKIGAVPIIIGLLRQAMKDYQ

SEQ ID NO: 3150676 - protein, 18 aa, Giardia lamblia
CRSCYCCREHLLLDDLAC

SEQ ID NO: 3150677 - protein, 19 aa, Giardia lamblia
CRSEVFTRLYNSGVSSMKK

SEQ ID NO: 3150678 - protein, 19 aa, Giardia lamblia
CRSIIRFNDSASFEKESDS

SEQ ID NO: 3150679 - protein, 18 aa, Giardia lamblia
CRSIPIPVLDEFDYSHYE

SEQ ID NO: 3150680 - protein, 18 aa, Giardia lamblia
CRSKAASALELHLILYTT

SEQ ID NO: 3150681 - protein, 17 aa, Giardia lamblia
CRSLVLSRYAKSLTTVH

SEQ ID NO: 3150682 - protein, 21 aa, Giardia lamblia
CRSMSELQQLLAIGENNKIFA

SEQ ID NO: 3150683 - protein, 25 aa, Giardia lamblia
CRSRGICLKGDLSFGTSPVGVDSWV

SEQ ID NO: 3150684 - protein, 21 aa, Giardia lamblia
CRTAPLGGRRGRPLRRGQQSS

SEQ ID NO: 3150685 - protein, 20 aa, Giardia lamblia
CRTIDSICVIIQCAEPEVVM

SEQ ID NO: 3150686 - protein, 23 aa, Giardia lamblia
CRTPLSFKSIRSLGSLSAERRPS

SEQ ID NO: 3150687 - protein, 20 aa, Giardia lamblia
CRVDYTLELMCYIPRPSSPM

SEQ ID NO: 3150688 - protein, 23 aa, Giardia lamblia
CRVGLLKCFARIYAGHDLQDTEL

SEQ ID NO: 3150689 - protein, 27 aa, Giardia lamblia
CRVSGSAMCLSKLYGIVAHIDSLLWHR

SEQ ID NO: 3150690 - protein, 18 aa, Giardia lamblia
CSAAYSFLTPNKVDIYYE

SEQ ID NO: 3150691 - protein, 19 aa, Giardia lamblia
CSANASFSAVAYMIASLPL

SEQ ID NO: 3150692 - protein, 25 aa, Giardia lamblia
CSASRLRTAIYLLHSNLSWTVSVVE

SEQ ID NO: 3150693 - protein, 24 aa, Giardia lamblia
CSCCGWPVHYCKYRKPSKQAELGC

SEQ ID NO: 3150694 - protein, 17 aa, Giardia lamblia
CSCINCRQVSPICAVTG

SEQ ID NO: 3150695 - protein, 17 aa, Giardia lamblia
CSCYPLITKIISIKADE

SEQ ID NO: 3150696 - protein, 18 aa, Giardia lamblia
CSDPRFVSILSTATKVSI

SEQ ID NO: 3150697 - protein, 20 aa, Giardia lamblia
CSEAEILRVECKQIHGASEQ

SEQ ID NO: 3150698 - protein, 19 aa, Giardia lamblia
CSEIAKERAALLAFDSVTL

SEQ ID NO: 3150699 - protein, 19 aa, Giardia lamblia
CSELLPYLRDIQAYVPPQI

SEQ ID NO: 3150700 - protein, 19 aa, Giardia lamblia
CSFMQPYIIVAYHGINCEN

SEQ ID NO: 3150701 - protein, 18 aa, Giardia lamblia
CSHCCKYHGDAHELTDND

SEQ ID NO: 3150702 - protein, 20 aa, Giardia lamblia
CSICDLIFDVPLFKTIHRDD

SEQ ID NO: 3150703 - protein, 19 aa, Giardia lamblia
CSILSRYNRTGQWEATYKR

SEQ ID NO: 3150704 - protein, 17 aa, Giardia lamblia
CSIYCLEALNSRLPIVL

SEQ ID NO: 3150705 - protein, 19 aa, Giardia lamblia
CSKGLLKVVDYVLPDSLSI

SEQ ID NO: 3150706 - protein, 24 aa, Giardia lamblia
CSLCQANKIPLATLIAAYDNPQNW

SEQ ID NO: 3150707 - protein, 19 aa, Giardia lamblia
CSLGSIIGLSLKIKLDRCL

SEQ ID NO: 3150708 - protein, 19 aa, Giardia lamblia
CSLHSGWLAPCKEPPGSQP

SEQ ID NO: 3150709 - protein, 17 aa, Giardia lamblia
CSLKCVVSFDASVSPTA

SEQ ID NO: 3150710 - protein, 18 aa, Giardia lamblia
CSLLHIRTMDSLVRRLKS

SEQ ID NO: 3150711 - protein, 18 aa, Giardia lamblia
CSMGKQASGAIAFNQLER

SEQ ID NO: 3150712 - protein, 17 aa, Giardia lamblia
CSNEVGIYLQRYAKGDS

SEQ ID NO: 3150713 - protein, 18 aa, Giardia lamblia
CSNGRTALMTAAMHGNVE

SEQ ID NO: 3150714 - protein, 18 aa, Giardia lamblia
CSNWEYTNVTALMIAAFK

SEQ ID NO: 3150715 - protein, 20 aa, Giardia lamblia
CSPAEVAKCDYKQVVRNEIE

SEQ ID NO: 3150716 - protein, 19 aa, Giardia lamblia
CSPDSYFKIRDDIRHQAAE

SEQ ID NO: 3150717 - protein, 21 aa, Giardia lamblia
CSPLKCLRACHKLATSYPRVA

SEQ ID NO: 3150718 - protein, 22 aa, Giardia lamblia
CSPSELMGSLTTRASVKPTMRG

SEQ ID NO: 3150719 - protein, 27 aa, Giardia lamblia
CSQCVASLRGRCPYCQRAVTEHFEIAL

SEQ ID NO: 3150720 - protein, 20 aa, Giardia lamblia
CSQVYAKLCDYVVNLRFINF

SEQ ID NO: 3150721 - protein, 20 aa, Giardia lamblia
CSSCGIDKCQTCASDSGVVK

SEQ ID NO: 3150722 - protein, 17 aa, Giardia lamblia
CSSEALLAMLRKEANLF

SEQ ID NO: 3150723 - protein, 21 aa, Giardia lamblia
CSSRSFALCASDFSLRDLNLM

SEQ ID NO: 3150724 - protein, 21 aa, Giardia lamblia
CSSTAERIVCSVIRNDVVAGV

SEQ ID NO: 3150725 - protein, 20 aa, Giardia lamblia
CSSTFYGTRVWPFNSSFAIN

SEQ ID NO: 3150726 - protein, 18 aa, Giardia lamblia
CSSTTCTYAGKTMTIGEC

SEQ ID NO: 3150727 - protein, 22 aa, Giardia lamblia
CSTDDSICLERTLGRAVQEYAR

SEQ ID NO: 3150728 - protein, 17 aa, Giardia lamblia
CSTMTRLLSTVKQSPSS

SEQ ID NO: 3150729 - protein, 25 aa, Giardia lamblia
CSTNEFRKQFVLEELTVIGSLKTDR

SEQ ID NO: 3150730 - protein, 21 aa, Giardia lamblia
CSTNLLPFMEDLCGADVSSLA

SEQ ID NO: 3150731 - protein, 17 aa, Giardia lamblia
CSTQISLALEELDVEAL

SEQ ID NO: 3150732 - protein, 20 aa, Giardia lamblia
CSVCSRCRRGTLASFVSAGG

SEQ ID NO: 3150733 - protein, 19 aa, Giardia lamblia
CSVFRSSPRVFPVMQYTLK

SEQ ID NO: 3150734 - protein, 19 aa, Giardia lamblia
CSVHDFHKYFAIQLNDTHP

SEQ ID NO: 3150735 - protein, 18 aa, Giardia lamblia
CSVQCPHAAVRCFVMNED

SEQ ID NO: 3150736 - protein, 17 aa, Giardia lamblia
CSVSLPSATHIGASISS

SEQ ID NO: 3150737 - protein, 26 aa, Giardia lamblia
CSVSRPHCFPVVKGLVESEHEILEKF

SEQ ID NO: 3150738 - protein, 20 aa, Giardia lamblia
CSWSPYDAALYFLLDILQDC

SEQ ID NO: 3150739 - protein, 18 aa, Giardia lamblia
CSYLHTFQSLTTLNLSGR

SEQ ID NO: 3150740 - protein, 19 aa, Giardia lamblia
CSYLKRMSIRAEVVQAKSD

SEQ ID NO: 3150741 - protein, 26 aa, Giardia lamblia
CSYSTLMGRCLAILIVIFTNQQLAQR

SEQ ID NO: 3150742 - protein, 24 aa, Giardia lamblia
CSYVCALSGCVLLMNAADIAFGFN

SEQ ID NO: 3150743 - protein, 19 aa, Giardia lamblia
CTACSPLRRRSSMHSELRT

SEQ ID NO: 3150744 - protein, 19 aa, Giardia lamblia
CTADSLLPDRAWTDPSKLF

SEQ ID NO: 3150745 - protein, 20 aa, Giardia lamblia
CTAIKNFVYDILGNISGIDP

SEQ ID NO: 3150746 - protein, 32 aa, Giardia lamblia
CTALFLAVFWNHIECARILAPLEAGITTNYKH

SEQ ID NO: 3150747 - protein, 17 aa, Giardia lamblia
CTALMISVRLRLTPITK

SEQ ID NO: 3150748 - protein, 18 aa, Giardia lamblia
CTARETAIALRERELERM

SEQ ID NO: 3150749 - protein, 18 aa, Giardia lamblia
CTAVPPFAEAHGMDSAAL

SEQ ID NO: 3150750 - protein, 18 aa, Giardia lamblia
CTCNSSLNISAIYAAHPF

SEQ ID NO: 3150751 - protein, 22 aa, Giardia lamblia
CTDAIEADMRRHYILERESKTK

SEQ ID NO: 3150752 - protein, 23 aa, Giardia lamblia
CTDEAITAIPIYSINKTRAHIIR

SEQ ID NO: 3150753 - protein, 20 aa, Giardia lamblia
CTDISPVIHPPSFPAITQNY

SEQ ID NO: 3150754 - protein, 34 aa, Giardia lamblia
CTDLSEWLLMPAICCVNCKMVAQLPIQLQCGCLS

SEQ ID NO: 3150755 - protein, 19 aa, Giardia lamblia
CTDQCRMICSIDGGESYSY

SEQ ID NO: 3150756 - protein, 18 aa, Giardia lamblia
CTDVLKRAMSIKAGQLNI

SEQ ID NO: 3150757 - protein, 22 aa, Giardia lamblia
CTELQCTLYLSFLGCEHTEEGY

SEQ ID NO: 3150758 - protein, 19 aa, Giardia lamblia
CTESKKVEELLKQRINNCL

SEQ ID NO: 3150759 - protein, 23 aa, Giardia lamblia
CTESVKALLVFYSNERDEFKWSA

SEQ ID NO: 3150760 - protein, 18 aa, Giardia lamblia
CTFFAGHKLSVFISNKQH

SEQ ID NO: 3150761 - protein, 24 aa, Giardia lamblia
CTFLRGVPGFVPLVNKTIMVKYLS

SEQ ID NO: 3150762 - protein, 20 aa, Giardia lamblia
CTGLILSVCFNYGGHTEIAQ

SEQ ID NO: 3150763 - protein, 18 aa, Giardia lamblia
CTGLRIMQKTTLVTPGLR

SEQ ID NO: 3150764 - protein, 21 aa, Giardia lamblia
CTGRASCTICGSTKLMTIIDN

SEQ ID NO: 3150765 - protein, 31 aa, Giardia lamblia
CTHAVHKLCAILGSLLCKPEAVFTTLDRQES

SEQ ID NO: 3150766 - protein, 20 aa, Giardia lamblia
CTHCKGEVAKSFCPKCNYIS

SEQ ID NO: 3150767 - protein, 19 aa, Giardia lamblia
CTHLLRFTNRLGKTALMVA

SEQ ID NO: 3150768 - protein, 21 aa, Giardia lamblia
CTHLSIKGIAYESGMGEESRF

SEQ ID NO: 3150769 - protein, 20 aa, Giardia lamblia
CTHRLLCISCASCFQKTSDQ

SEQ ID NO: 3150770 - protein, 19 aa, Giardia lamblia
CTHVDRWKICGGTALMRAA

SEQ ID NO: 3150771 - protein, 17 aa, Giardia lamblia
CTIEFLNVTLLWQHTKG

SEQ ID NO: 3150772 - protein, 21 aa, Giardia lamblia
CTIHEMCMYYSPFHNQSITQA

SEQ ID NO: 3150773 - protein, 26 aa, Giardia lamblia
CTIYEVCVGEPLFKGVDAPEVLRELR

SEQ ID NO: 3150774 - protein, 19 aa, Giardia lamblia
CTKPLRLSSDITKIITSVN

SEQ ID NO: 3150775 - protein, 20 aa, Giardia lamblia
CTLAREVVFLVARYLPRALA

SEQ ID NO: 3150776 - protein, 25 aa, Giardia lamblia
CTLNARCSVLAAANPVYGFFDPKRS

SEQ ID NO: 3150777 - protein, 19 aa, Giardia lamblia
CTLRAKSPSDGLCRSKSRG

SEQ ID NO: 3150778 - protein, 17 aa, Giardia lamblia
CTLRHPLFNLDEVTEEP

SEQ ID NO: 3150779 - protein, 17 aa, Giardia lamblia
CTLVYRAPESTLRCYDF

SEQ ID NO: 3150780 - protein, 23 aa, Giardia lamblia
CTMKPRGLVSILRHGDRIPKFKL

SEQ ID NO: 3150781 - protein, 17 aa, Giardia lamblia
CTMRASAAAAAILQSGD

SEQ ID NO: 3150782 - protein, 17 aa, Giardia lamblia
CTPLFQAVFWNKPDCVR

SEQ ID NO: 3150783 - protein, 19 aa, Giardia lamblia
CTPLMCAAMNGHAELVRKL

SEQ ID NO: 3150784 - protein, 19 aa, Giardia lamblia
CTPLYRYVPESVYSDQVIT

SEQ ID NO: 3150785 - protein, 21 aa, Giardia lamblia
CTPPRDDRCAIQLDAAERQLL

SEQ ID NO: 3150786 - protein, 24 aa, Giardia lamblia
CTRHLEVVKLLAPVESKMQKATGE

SEQ ID NO: 3150787 - protein, 21 aa, Giardia lamblia
CTSCSELELTLAELKFPVCAL

SEQ ID NO: 3150788 - protein, 23 aa, Giardia lamblia
CTTERLQMILTFYKKMIPTQQEL

SEQ ID NO: 3150789 - protein, 39 aa, Giardia lamblia
CTTKLIPFLCSGCPLNSRRVCLINIPPSGVVALNVFVPE

SEQ ID NO: 3150790 - protein, 17 aa, Giardia lamblia
CTVEINLLKKMCEAKDA

SEQ ID NO: 3150791 - protein, 26 aa, Giardia lamblia
CTVSNSLLLFGFRFDHRGKYITVKKL

SEQ ID NO: 3150792 - protein, 20 aa, Giardia lamblia
CTYIECINALAPYEQGMTSE

SEQ ID NO: 3150793 - protein, 35 aa, Giardia lamblia
CVAHILRISRIIRMPRGHCLLVGVGGSGKQSCTKL

SEQ ID NO: 3150794 - protein, 20 aa, Giardia lamblia
CVAPHASVISCYPIYEDAAG

SEQ ID NO: 3150795 - protein, 19 aa, Giardia lamblia
CVCILHIVDSYMECISVID

SEQ ID NO: 3150796 - protein, 21 aa, Giardia lamblia
CVDFLLKEEGKLCRVSGETPL

SEQ ID NO: 3150797 - protein, 17 aa, Giardia lamblia
CVDKIQRRYAHLYMNNR

SEQ ID NO: 3150798 - protein, 31 aa, Giardia lamblia
CVDNIKAKMIFNIDALLRFITVCINPKVSGV

SEQ ID NO: 3150799 - protein, 27 aa, Giardia lamblia
CVDRAYSTCKACLCKSGGSSIKAQSTT

SEQ ID NO: 3150800 - protein, 17 aa, Giardia lamblia
CVDVAIILAASGHSAVN

SEQ ID NO: 3150801 - protein, 18 aa, Giardia lamblia
CVELLLKTEFTLKNEDGN

SEQ ID NO: 3150802 - protein, 17 aa, Giardia lamblia
CVFLKYADKLALLIHTR

SEQ ID NO: 3150803 - protein, 20 aa, Giardia lamblia
CVFRIDILEMRSRKHEEDSI

SEQ ID NO: 3150804 - protein, 20 aa, Giardia lamblia
CVFTAVDGARLFLCMASMQV

SEQ ID NO: 3150805 - protein, 20 aa, Giardia lamblia
CVFTAVDGARLFLCMASTQV

SEQ ID NO: 3150806 - protein, 20 aa, Giardia lamblia
CVGAILCLDALSGDREAAGF

SEQ ID NO: 3150807 - protein, 17 aa, Giardia lamblia
CVGDCAGAPAMTTTIQI

SEQ ID NO: 3150808 - protein, 23 aa, Giardia lamblia
CVGFHHFKVGLVIYPTSKPGIKL

SEQ ID NO: 3150809 - protein, 19 aa, Giardia lamblia
CVICLDRPREIVYLPCRHF

SEQ ID NO: 3150810 - protein, 20 aa, Giardia lamblia
CVIGFPLGCMTTAAKISETR

SEQ ID NO: 3150811 - protein, 18 aa, Giardia lamblia
CVIGSELSERIKVTNPYS

SEQ ID NO: 3150812 - protein, 23 aa, Giardia lamblia
CVLFHPLHEQFLYTGTSAGDVYQ

SEQ ID NO: 3150813 - protein, 18 aa, Giardia lamblia
CVLGCATPPLVPPVGGPV

SEQ ID NO: 3150814 - protein, 17 aa, Giardia lamblia
CVLLLRELEAQLVDKRG

SEQ ID NO: 3150815 - protein, 19 aa, Giardia lamblia
CVLMSCLPASYTASPLSNY

SEQ ID NO: 3150816 - protein, 24 aa, Giardia lamblia
CVLQRKLSHYGCKDVAKLFYQAAN

SEQ ID NO: 3150817 - protein, 26 aa, Giardia lamblia
CVLYEICTLQHAFEAQNMKGLVVKIL

SEQ ID NO: 3150818 - protein, 20 aa, Giardia lamblia
CVLYEILTFNPLFSGGNFFA

SEQ ID NO: 3150819 - protein, 21 aa, Giardia lamblia
CVLYELCTLFSRTFHESPVDY

SEQ ID NO: 3150820 - protein, 17 aa, Giardia lamblia
CVNIILSSQRISNIELK

SEQ ID NO: 3150821 - protein, 18 aa, Giardia lamblia
CVNLKCLTFLLGFEKAMK

SEQ ID NO: 3150822 - protein, 25 aa, Giardia lamblia
CVNPTLFTLGLDFDGLLGKELSTAM

SEQ ID NO: 3150823 - protein, 27 aa, Giardia lamblia
CVQNKWVSWWTDRVLNWALQKTAATLQ

SEQ ID NO: 3150824 - protein, 23 aa, Giardia lamblia
CVRLYRISKDFDLIKKVQVADTS

SEQ ID NO: 3150825 - protein, 33 aa, Giardia lamblia
CVTESLRAYPFGGLFTSLLCHMWLAYDVTNELN

SEQ ID NO: 3150826 - protein, 18 aa, Giardia lamblia
CVTIPRINLEKFRPIATL

SEQ ID NO: 3150827 - protein, 18 aa, Giardia lamblia
CVVARKGYARCLRGLLDT

SEQ ID NO: 3150828 - protein, 25 aa, Giardia lamblia
CVVFHPKRPWVIFSCQNGVVELWDY

SEQ ID NO: 3150829 - protein, 18 aa, Giardia lamblia
CVVIPKYHAALFHELPPA

SEQ ID NO: 3150830 - protein, 19 aa, Giardia lamblia
CVYGFKKVLLSLVSCPSGS

SEQ ID NO: 3150831 - protein, 31 aa, Giardia lamblia
CWHEIVMQIRLSPLFAFDWWFKTRTEDEIAH

SEQ ID NO: 3150832 - protein, 19 aa, Giardia lamblia
CWQGISWSRHESGRRHPCY

SEQ ID NO: 3150833 - protein, 19 aa, Giardia lamblia
CWSGRACTCGGLVVPYIAV

SEQ ID NO: 3150834 - protein, 19 aa, Giardia lamblia
CYADIRSQDCLLAVPNPSS

SEQ ID NO: 3150835 - protein, 28 aa, Giardia lamblia
CYAFNKVKRTSCELVFPLMLAQNCATFG

SEQ ID NO: 3150836 - protein, 18 aa, Giardia lamblia
CYALAFATDCEPLNFVYR

SEQ ID NO: 3150837 - protein, 18 aa, Giardia lamblia
CYEGFVLMFGDLLSTVWS

SEQ ID NO: 3150838 - protein, 20 aa, Giardia lamblia
CYEVLGFDIMIDSLFKPWLI

SEQ ID NO: 3150839 - protein, 19 aa, Giardia lamblia
CYGKSILKPVFKRMNTVDR

SEQ ID NO: 3150840 - protein, 27 aa, Giardia lamblia
CYHGRLKAATILLPFEGGMKDSIGRGP

SEQ ID NO: 3150841 - protein, 25 aa, Giardia lamblia
CYHTFLDTMHRLGCSIYTEPWNEFG

SEQ ID NO: 3150842 - protein, 18 aa, Giardia lamblia
CYHYIDGLIWVFRYYFLP

SEQ ID NO: 3150843 - protein, 19 aa, Giardia lamblia
CYLLGAIIDYCRCQNSPMF

SEQ ID NO: 3150844 - protein, 23 aa, Giardia lamblia
CYLSFLRLAYFYHDKDLYSVYLQ

SEQ ID NO: 3150845 - protein, 17 aa, Giardia lamblia
CYMRCLKTDPVLSSVFR

SEQ ID NO: 3150846 - protein, 20 aa, Giardia lamblia
CYMTKEMLPHLVYIGYMSLQ

SEQ ID NO: 3150847 - protein, 20 aa, Giardia lamblia
CYPCNHTVCCEECAERLMTT

SEQ ID NO: 3150848 - protein, 24 aa, Giardia lamblia
CYPPRKRKRAFYRDPRNDCSSTSS

SEQ ID NO: 3150849 - protein, 48 aa, Giardia lamblia
CYPSHLRKFLRIITDFTMWYSYRDFCCSGCRGLLRFPVRTLCGHYYCY

SEQ ID NO: 3150850 - protein, 19 aa, Giardia lamblia
CYQLTFKTNLIVRLVYGGE

SEQ ID NO: 3150851 - protein, 21 aa, Giardia lamblia
CYRTTTPGVYRGWLYNLYETV

SEQ ID NO: 3150852 - protein, 21 aa, Giardia lamblia
CYSCGYDRDGLLNVFLFGEDT

SEQ ID NO: 3150853 - protein, 26 aa, Giardia lamblia
CYTDIRRGREFAVSLNLEPLEIYGLI

SEQ ID NO: 3150854 - protein, 25 aa, Giardia lamblia
CYTEFILNVCLHFRTAGRRRSSTVG

SEQ ID NO: 3150855 - protein, 17 aa, Giardia lamblia
CYVVIQITDDEKFLRNR

SEQ ID NO: 3150856 - protein, 24 aa, Giardia lamblia
DAAACSLMNLITGYCVEHPYTDKD

SEQ ID NO: 3150857 - protein, 21 aa, Giardia lamblia
DAADSFLFKMTLDPIKNMQAL

SEQ ID NO: 3150858 - protein, 29 aa, Giardia lamblia
DAAHVRIRRLLLMEAYEVYASLLAQSRGA

SEQ ID NO: 3150859 - protein, 20 aa, Giardia lamblia
DAAIREARNALVAQKKEAER

SEQ ID NO: 3150860 - protein, 25 aa, Giardia lamblia
DAAIWYPERLCMMDLSCNKITTVTE

SEQ ID NO: 3150861 - protein, 20 aa, Giardia lamblia
DAALPLQEYIEGLRNAYSEL

SEQ ID NO: 3150862 - protein, 17 aa, Giardia lamblia
DAAQLIDGIALYVQQCY

SEQ ID NO: 3150863 - protein, 17 aa, Giardia lamblia
DAARILAEYEAGMCDND

SEQ ID NO: 3150864 - protein, 18 aa, Giardia lamblia
DAAVPLSLKMQFRPVDLF

SEQ ID NO: 3150865 - protein, 23 aa, Giardia lamblia
DAAYLDVIWRSPSANWSILVDAC

SEQ ID NO: 3150866 - protein, 18 aa, Giardia lamblia
DACLLFFDVTNRVTYKNV

SEQ ID NO: 3150867 - protein, 19 aa, Giardia lamblia
DADCCTALQLAKQYGQQDV

SEQ ID NO: 3150868 - protein, 26 aa, Giardia lamblia
DADEIARLRERLDLKEKEVATIRPLL

SEQ ID NO: 3150869 - protein, 19 aa, Giardia lamblia
DADKPFFIEGVVYTVDGVP

SEQ ID NO: 3150870 - protein, 23 aa, Giardia lamblia
DADLPRKAVLVLGNERKGCPEEI

SEQ ID NO: 3150871 - protein, 18 aa, Giardia lamblia
DADLRLISNLRQRYNKQL

SEQ ID NO: 3150872 - protein, 31 aa, Giardia lamblia
DADRELGIVFRLCPVAAIGCRNNSVMLIQPK

SEQ ID NO: 3150873 - protein, 24 aa, Giardia lamblia
DAEAEFQTSGPFDVFSPAATAFSI

SEQ ID NO: 3150874 - protein, 18 aa, Giardia lamblia
DAEALLLAYPAALLGLKM

SEQ ID NO: 3150875 - protein, 24 aa, Giardia lamblia
DAEDLCKILLSYESAYTLADGTTA

SEQ ID NO: 3150876 - protein, 24 aa, Giardia lamblia
DAEIDRLKKQLAYQENPILERTAI

SEQ ID NO: 3150877 - protein, 32 aa, Giardia lamblia
DAELKLCGEYGLKCKREIYRARYMLAKIRRTA

SEQ ID NO: 3150878 - protein, 17 aa, Giardia lamblia
DAELKRRQMDSVELTNL

SEQ ID NO: 3150879 - protein, 19 aa, Giardia lamblia
DAELLKLAEACTALEKERD

SEQ ID NO: 3150880 - protein, 27 aa, Giardia lamblia
DAELLSKLRAMLKFGVREYAESIIQAG

SEQ ID NO: 3150881 - protein, 19 aa, Giardia lamblia
DAELQWMSPGLLLQRSLIV

SEQ ID NO: 3150882 - protein, 17 aa, Giardia lamblia
DAEMVRLLIPFQSRKQT

SEQ ID NO: 3150883 - protein, 25 aa, Giardia lamblia
DAERRRPRISVAFGAITMPNAPSSD

SEQ ID NO: 3150884 - protein, 24 aa, Giardia lamblia
DAESFRLVPSFNLNSAASFAYGIV

SEQ ID NO: 3150885 - protein, 23 aa, Giardia lamblia
DAESIKVCQDWVASQTGEVHAED

SEQ ID NO: 3150886 - protein, 24 aa, Giardia lamblia
DAETVKILAPKECGILSQTSHSTA

SEQ ID NO: 3150887 - protein, 18 aa, Giardia lamblia
DAFKEWKERENASELHII

SEQ ID NO: 3150888 - protein, 19 aa, Giardia lamblia
DAFSGFLPILVELEAGCSA

SEQ ID NO: 3150889 - protein, 20 aa, Giardia lamblia
DAGRGWRVVVPSPRPLEIVE

SEQ ID NO: 3150890 - protein, 28 aa, Giardia lamblia
DAGSNSCLWFYFCVNSIVINKPFLFHII

SEQ ID NO: 3150891 - protein, 18 aa, Giardia lamblia
DAGVPIYLSILLNQQVEP

SEQ ID NO: 3150892 - protein, 23 aa, Giardia lamblia
DAGVVLCCVCFQEPATLDLVLRG

SEQ ID NO: 3150893 - protein, 36 aa, Giardia lamblia
DAHAEIMRMVYFCCIDQGLRLLHPFMPFLSEELFQH

SEQ ID NO: 3150894 - protein, 24 aa, Giardia lamblia
DAHIDRFPSLRYCNLSHNRITSIE

SEQ ID NO: 3150895 - protein, 20 aa, Giardia lamblia
DAHKRQKCIKDFATEKVDSF

SEQ ID NO: 3150896 - protein, 25 aa, Giardia lamblia
DAHTHPAIFCWIARVINMVLDTPPM

SEQ ID NO: 3150897 - protein, 23 aa, Giardia lamblia
DAIDRGGVRFGEMNVPGSKPISR

SEQ ID NO: 3150898 - protein, 18 aa, Giardia lamblia
DAIFEMHTKLAIKNSLET

SEQ ID NO: 3150899 - protein, 23 aa, Giardia lamblia
DAIGKQLFICFHMHMPDRVVLRG

SEQ ID NO: 3150900 - protein, 17 aa, Giardia lamblia
DAIKLLVELEARIRNSK

SEQ ID NO: 3150901 - protein, 19 aa, Giardia lamblia
DAIKPAGGFTVQLPGEASL

SEQ ID NO: 3150902 - protein, 24 aa, Giardia lamblia
DAIKTRLTVILTLSHPGVLKHHQV

SEQ ID NO: 3150903 - protein, 19 aa, Giardia lamblia
DAIPLLAPKEAGMLRSCGR

SEQ ID NO: 3150904 - protein, 18 aa, Giardia lamblia
DAIPRYLQAILEKIITSP

SEQ ID NO: 3150905 - protein, 24 aa, Giardia lamblia
DAIRFLKLANRMYAECVAEAVVYI

SEQ ID NO: 3150906 - protein, 18 aa, Giardia lamblia
DAIRQKAPAYSMASRTEM

SEQ ID NO: 3150907 - protein, 25 aa, Giardia lamblia
DAKFSELRNKVLVYKESVQKERRQN

SEQ ID NO: 3150908 - protein, 24 aa, Giardia lamblia
DAKIECARFVVAVDFSRSNISRGQ

SEQ ID NO: 3150909 - protein, 19 aa, Giardia lamblia
DAKIGLLKKELEELAKLSA

SEQ ID NO: 3150910 - protein, 21 aa, Giardia lamblia
DAKLFLIDRFLGWSQMALCLL

SEQ ID NO: 3150911 - protein, 19 aa, Giardia lamblia
DALCLAGKLYYGSNSIDES

SEQ ID NO: 3150912 - protein, 24 aa, Giardia lamblia
DALEALFLLCSRFNRKHEFIAVTD

SEQ ID NO: 3150913 - protein, 32 aa, Giardia lamblia
DALESCANISSAFRYYLNYLLATDKRLTPIQQ

SEQ ID NO: 3150914 - protein, 22 aa, Giardia lamblia
DALHYKSLFEIAREKLLSLPSV

SEQ ID NO: 3150915 - protein, 17 aa, Giardia lamblia
DALIKDLSDGLTESQDL

SEQ ID NO: 3150916 - protein, 20 aa, Giardia lamblia
DALLKIARIDLLGFLLSLYN

SEQ ID NO: 3150917 - protein, 22 aa, Giardia lamblia
DALNYMPFLPIRPYSPTHFEQV

SEQ ID NO: 3150918 - protein, 24 aa, Giardia lamblia
DALQEELLCLLGYSNIDVIGSLLT

SEQ ID NO: 3150919 - protein, 24 aa, Giardia lamblia
DALRSLIVAVLCERKETALYLSRY

SEQ ID NO: 3150920 - protein, 24 aa, Giardia lamblia
DALYHIHCKSVYEGLLFSVRADSV

SEQ ID NO: 3150921 - protein, 22 aa, Giardia lamblia
DAMAAAMVRNMREVATLEHQIN

SEQ ID NO: 3150922 - protein, 18 aa, Giardia lamblia
DAMGLAIAEYDRWSKGQH

SEQ ID NO: 3150923 - protein, 18 aa, Giardia lamblia
DAMINFRKLTAFEARDPY

SEQ ID NO: 3150924 - protein, 23 aa, Giardia lamblia
DAMKRTALMHAARLGNYNSAKLL

SEQ ID NO: 3150925 - protein, 26 aa, Giardia lamblia
DAMMGSCLRCLAVIIAYLQDNDIAET

SEQ ID NO: 3150926 - protein, 18 aa, Giardia lamblia
DAMMRAHILSKVRQRTDA

SEQ ID NO: 3150927 - protein, 25 aa, Giardia lamblia
DAMMVPGTMIPRPTQLLKNQINLLK

SEQ ID NO: 3150928 - protein, 18 aa, Giardia lamblia
DAMSRKVAITSEHPCQTV

SEQ ID NO: 3150929 - protein, 27 aa, Giardia lamblia
DANDCLFLIAAYKCFSDAVVDITCSQE

SEQ ID NO: 3150930 - protein, 25 aa, Giardia lamblia
DANEELLLMRALRDMNLPKFVFEDV

SEQ ID NO: 3150931 - protein, 27 aa, Giardia lamblia
DANGETALMKAVRRRDTAIVKILASHE

SEQ ID NO: 3150932 - protein, 25 aa, Giardia lamblia
DANIKRMVTPIARLRDPSRSLNPFE

SEQ ID NO: 3150933 - protein, 23 aa, Giardia lamblia
DAPEERRRPVLKKSVQLAKSRGV

SEQ ID NO: 3150934 - protein, 20 aa, Giardia lamblia
DAPFIQMVFLTKMLDDNGVT

SEQ ID NO: 3150935 - protein, 22 aa, Giardia lamblia
DAPLERSLLWVANFGEIKAAFH

SEQ ID NO: 3150936 - protein, 21 aa, Giardia lamblia
DAQGRTALAHAVDAGAVEAAR

SEQ ID NO: 3150937 - protein, 19 aa, Giardia lamblia
DAQHMCDILATVPFPGTEY

SEQ ID NO: 3150938 - protein, 20 aa, Giardia lamblia
DARGDTALTYSIKRKLKGST

SEQ ID NO: 3150939 - protein, 30 aa, Giardia lamblia
DARGMTALLYACEFGCRYCVHLLKDEAHIY

SEQ ID NO: 3150940 - protein, 23 aa, Giardia lamblia
DARPRLSTLQFYGKFLGSQALLK

SEQ ID NO: 3150941 - protein, 17 aa, Giardia lamblia
DARRRLRESGAYTSPPE

SEQ ID NO: 3150942 - protein, 33 aa, Giardia lamblia
DARVPSRWLNVSWPASTLGFWLSDVTNRCTQFT

SEQ ID NO: 3150943 - protein, 19 aa, Giardia lamblia
DASFPGLAYASPEFLNREY

SEQ ID NO: 3150944 - protein, 17 aa, Giardia lamblia
DASINVIIHHSRKNVAA

SEQ ID NO: 3150945 - protein, 24 aa, Giardia lamblia
DASQRLRILLLIQDSLFDICQNLH

SEQ ID NO: 3150946 - protein, 19 aa, Giardia lamblia
DATGMTALMHAARNNQRIH

SEQ ID NO: 3150947 - protein, 19 aa, Giardia lamblia
DATPLLYLVAVVSHCYCSD

SEQ ID NO: 3150948 - protein, 25 aa, Giardia lamblia
DATPMPRHALFFLSKINPSDCSDWF

SEQ ID NO: 3150949 - protein, 22 aa, Giardia lamblia
DATRLVGLGLKFVAEGANMPST

SEQ ID NO: 3150950 - protein, 23 aa, Giardia lamblia
DATVKFCLDNGIGVTAYSPMGGS

SEQ ID NO: 3150951 - protein, 26 aa, Giardia lamblia
DATYKRHVSAIARLCAYNPSVWSYLT

SEQ ID NO: 3150952 - protein, 17 aa, Giardia lamblia
DAVCLRNTPQILGSITH

SEQ ID NO: 3150953 - protein, 28 aa, Giardia lamblia
DAVICSPHPSFLIDVSDNLVLRDHQIDG

SEQ ID NO: 3150954 - protein, 18 aa, Giardia lamblia
DAVIPIRAVGASLSTRQP

SEQ ID NO: 3150955 - protein, 28 aa, Giardia lamblia
DAVREIYMDPAFCQSVYRETGLVCPCSD

SEQ ID NO: 3150956 - protein, 17 aa, Giardia lamblia
DAVRFLLEYEKGIKDKN

SEQ ID NO: 3150957 - protein, 25 aa, Giardia lamblia
DAVRRLPISRVRAICRTVPTITLLS

SEQ ID NO: 3150958 - protein, 29 aa, Giardia lamblia
DAVVRTILLRRLSYACICSSTRRSIYHQV

SEQ ID NO: 3150959 - protein, 17 aa, Giardia lamblia
DAVWRKLMGNTYKTPNV

SEQ ID NO: 3150960 - protein, 18 aa, Giardia lamblia
DAVYPFHIFYPVKQARAA

SEQ ID NO: 3150961 - protein, 25 aa, Giardia lamblia
DAYANRFMRFCRVIFQVPVSEDSGL

SEQ ID NO: 3150962 - protein, 22 aa, Giardia lamblia
DAYDCIRILAPLESGHRDSKGW

SEQ ID NO: 3150963 - protein, 17 aa, Giardia lamblia
DAYDFLDIKLILSGDIS

SEQ ID NO: 3150964 - protein, 22 aa, Giardia lamblia
DAYPIHGSLEYSGKKEDMEDVV

SEQ ID NO: 3150965 - protein, 25 aa, Giardia lamblia
DCAADALGLATLVDREFLETPVTER

SEQ ID NO: 3150966 - protein, 25 aa, Giardia lamblia
DCAPFPSLETLILHHNRIRDIRNLS

SEQ ID NO: 3150967 - protein, 25 aa, Giardia lamblia
DCASLKLSQLYSFFGESLSSIPAEF

SEQ ID NO: 3150968 - protein, 19 aa, Giardia lamblia
DCDQPEPCMGATLTTMVNN

SEQ ID NO: 3150969 - protein, 18 aa, Giardia lamblia
DCEARASTANHCRTALMA

SEQ ID NO: 3150970 - protein, 19 aa, Giardia lamblia
DCEGCPKAQIDDGRHGTPS

SEQ ID NO: 3150971 - protein, 17 aa, Giardia lamblia
DCLFSAGCIVYLGAFTS

SEQ ID NO: 3150972 - protein, 17 aa, Giardia lamblia
DCLLAAFSDQLSIDQSS

SEQ ID NO: 3150973 - protein, 18 aa, Giardia lamblia
DCLLELDDLLAIDLDEGS

SEQ ID NO: 3150974 - protein, 23 aa, Giardia lamblia
DCLSKRLRSINSMTERRDNISTA

SEQ ID NO: 3150975 - protein, 18 aa, Giardia lamblia
DCNGQYTIAQGFQYFKTM

SEQ ID NO: 3150976 - protein, 20 aa, Giardia lamblia
DCPECVAQLLAEAGHISRGR

SEQ ID NO: 3150977 - protein, 22 aa, Giardia lamblia
DCPELCAPFSAYNVLEIMAQIM

SEQ ID NO: 3150978 - protein, 17 aa, Giardia lamblia
DCPICRRPIEKWQPIQS

SEQ ID NO: 3150979 - protein, 17 aa, Giardia lamblia
DCPLEYKKAQSMMNVEL

SEQ ID NO: 3150980 - protein, 20 aa, Giardia lamblia
DCPNNMLAILSDLELPSSQQ

SEQ ID NO: 3150981 - protein, 21 aa, Giardia lamblia
DCPQIPPTTVEWLKTSWEDIL

SEQ ID NO: 3150982 - protein, 18 aa, Giardia lamblia
DCQYSIPVFNRIMTYVTN

SEQ ID NO: 3150983 - protein, 19 aa, Giardia lamblia
DCRPEIVHQFCLWNYEHNL

SEQ ID NO: 3150984 - protein, 19 aa, Giardia lamblia
DCSKNRIRLYFSTANKVVK

SEQ ID NO: 3150985 - protein, 30 aa, Giardia lamblia
DCTLRACSAFERCSFREGLIISFNELGHSR

SEQ ID NO: 3150986 - protein, 21 aa, Giardia lamblia
DCTQTDCLLVLPRQSSLVKLT

SEQ ID NO: 3150987 - protein, 17 aa, Giardia lamblia
DCVKLLINEETGFQDID

SEQ ID NO: 3150988 - protein, 17 aa, Giardia lamblia
DCVKLLVKHKGERDVSG

SEQ ID NO: 3150989 - protein, 23 aa, Giardia lamblia
DCVRLDHILGLFRTWELPLTAGK

SEQ ID NO: 3150990 - protein, 18 aa, Giardia lamblia
DDAALFLRDAEIDASGAT

SEQ ID NO: 3150991 - protein, 23 aa, Giardia lamblia
DDAERRASTLLKLQQGEERLAKR

SEQ ID NO: 3150992 - protein, 17 aa, Giardia lamblia
DDALRSVARYALELSDH

SEQ ID NO: 3150993 - protein, 23 aa, Giardia lamblia
DDALYRQPLPGFPVTVSTTTTTQ

SEQ ID NO: 3150994 - protein, 18 aa, Giardia lamblia
DDASELMGAMKRLEDANL

SEQ ID NO: 3150995 - protein, 21 aa, Giardia lamblia
DDAWSYIGKCMEWTEEDKIIA

SEQ ID NO: 3150996 - protein, 21 aa, Giardia lamblia
DDAYRKLLFGISFYHTLLVER

SEQ ID NO: 3150997 - protein, 21 aa, Giardia lamblia
DDCQIPSYYGTVRMEHRTQAL

SEQ ID NO: 3150998 - protein, 19 aa, Giardia lamblia
DDDEFPFDLEADIYNQTLT

SEQ ID NO: 3150999 - protein, 18 aa, Giardia lamblia
DDDGFRYIPNEALTAATL

SEQ ID NO: 3151000 - protein, 22 aa, Giardia lamblia
DDDLKAVLSLAQRTLSMFNEKQ

SEQ ID NO: 3151001 - protein, 24 aa, Giardia lamblia
DDDMGFPYPKMFISISGLIGAGKT

SEQ ID NO: 3151002 - protein, 17 aa, Giardia lamblia
DDEACALATSRLRAEII

SEQ ID NO: 3151003 - protein, 25 aa, Giardia lamblia
DDEARAAMMSYMFKREKSLKEAELN

SEQ ID NO: 3151004 - protein, 33 aa, Giardia lamblia
DDEIRCMQETIAALEMSHRVPSSGLYQDTCIHD

SEQ ID NO: 3151005 - protein, 17 aa, Giardia lamblia
DDEIRRLTDDLAAEKRN

SEQ ID NO: 3151006 - protein, 25 aa, Giardia lamblia
DDELTFFRLILCYNGTKYTKFAKNF

SEQ ID NO: 3151007 - protein, 24 aa, Giardia lamblia
DDERECLVNAFATRTISCLMLSSV

SEQ ID NO: 3151008 - protein, 22 aa, Giardia lamblia
DDFEFLSEFLLLISDLFFSPER

SEQ ID NO: 3151009 - protein, 38 aa, Giardia lamblia
DDFGFKRHICPKCGTLYWRRTELRTICGDSECLGEYSF

SEQ ID NO: 3151010 - protein, 24 aa, Giardia lamblia
DDFLSEMDYCLSSGLDSIFNGRNN

SEQ ID NO: 3151011 - protein, 23 aa, Giardia lamblia
DDFSKKLLGAADCNKKHQQTVNE

SEQ ID NO: 3151012 - protein, 24 aa, Giardia lamblia
DDGDCPRVAGMLAVSRAIGDSPFK

SEQ ID NO: 3151013 - protein, 25 aa, Giardia lamblia
DDGFLNRFGHCIGQGVYGTVYSLSD

SEQ ID NO: 3151014 - protein, 27 aa, Giardia lamblia
DDGLNVARILSFFRISFESEDEHLAIV

SEQ ID NO: 3151015 - protein, 26 aa, Giardia lamblia
DDGRTALMICVEVGFMKGLKVLLEYE

SEQ ID NO: 3151016 - protein, 36 aa, Giardia lamblia
DDGWTCLMSACATDNLAIAKMFIKEAGFTKSDGTCA

SEQ ID NO: 3151017 - protein, 17 aa, Giardia lamblia
DDHVSFDFCSSRFSESL

SEQ ID NO: 3151018 - protein, 23 aa, Giardia lamblia
DDIELQLALQLSRQEAEEAARRN

SEQ ID NO: 3151019 - protein, 25 aa, Giardia lamblia
DDIKIIQLLCLIRLETIGHISAGTV

SEQ ID NO: 3151020 - protein, 18 aa, Giardia lamblia
DDILKCLEMNPTETLKQM

SEQ ID NO: 3151021 - protein, 23 aa, Giardia lamblia
DDIPPQFKALFSEHYAEKYQYIL

SEQ ID NO: 3151022 - protein, 19 aa, Giardia lamblia
DDIPVILFQCRLEDIIRGS

SEQ ID NO: 3151023 - protein, 26 aa, Giardia lamblia
DDITKSCLRLEISVTSMDVAEAGGTA

SEQ ID NO: 3151024 - protein, 23 aa, Giardia lamblia
DDKHCKGNPVLKYIFADNHENVA

SEQ ID NO: 3151025 - protein, 17 aa, Giardia lamblia
DDKNVYIILDFIQGGEL

SEQ ID NO: 3151026 - protein, 26 aa, Giardia lamblia
DDKPLRGFTVGFFRDYMLRGNMAEEI

SEQ ID NO: 3151027 - protein, 23 aa, Giardia lamblia
DDKRINIIGVFLFPLDTVPAEIT

SEQ ID NO: 3151028 - protein, 21 aa, Giardia lamblia
DDKSRTALMLAAQNGRVNVLR

SEQ ID NO: 3151029 - protein, 18 aa, Giardia lamblia
DDKYIYNRYEVIETVTTV

SEQ ID NO: 3151030 - protein, 20 aa, Giardia lamblia
DDLAGLGCVCHMQYNVTDID

SEQ ID NO: 3151031 - protein, 23 aa, Giardia lamblia
DDLEALAYVFLYFLRGFLPWQGL

SEQ ID NO: 3151032 - protein, 25 aa, Giardia lamblia
DDLKDRLKMEVIRYDVIEFNQPRTV

SEQ ID NO: 3151033 - protein, 21 aa, Giardia lamblia
DDLKFIRASLIDKDGQLLLKD

SEQ ID NO: 3151034 - protein, 17 aa, Giardia lamblia
DDLKLLYQQDADRFSAV

SEQ ID NO: 3151035 - protein, 23 aa, Giardia lamblia
DDLLCETSLRPTQRALLKEIQVL

SEQ ID NO: 3151036 - protein, 20 aa, Giardia lamblia
DDLMSFQWRLLAIDEAHSLK

SEQ ID NO: 3151037 - protein, 17 aa, Giardia lamblia
DDLSINYTTRDMYHSTH

SEQ ID NO: 3151038 - protein, 24 aa, Giardia lamblia
DDLSRPDALIKIGDQVSLRLKNDG

SEQ ID NO: 3151039 - protein, 20 aa, Giardia lamblia
DDLYLYLVMEFAIGGDLMGL

SEQ ID NO: 3151040 - protein, 24 aa, Giardia lamblia
DDMEFGAALDLCLLTGRTSLARPQ

SEQ ID NO: 3151041 - protein, 25 aa, Giardia lamblia
DDMNLHPDLLFGIFTYGYKIPSAIQ

SEQ ID NO: 3151042 - protein, 18 aa, Giardia lamblia
DDMPAHALSTLAGCSLTI

SEQ ID NO: 3151043 - protein, 23 aa, Giardia lamblia
DDNCTALIYAVEFQNFECAEILA

SEQ ID NO: 3151044 - protein, 20 aa, Giardia lamblia
DDNIILAAIFYYVGDYNTID

SEQ ID NO: 3151045 - protein, 17 aa, Giardia lamblia
DDNNPWERYWLNAPRPD

SEQ ID NO: 3151046 - protein, 23 aa, Giardia lamblia
DDNRTNLARFCRDLLASLSSPCY

SEQ ID NO: 3151047 - protein, 29 aa, Giardia lamblia
DDPHPFKDLLCSTDHLPAHIIKNPATSYI

SEQ ID NO: 3151048 - protein, 21 aa, Giardia lamblia
DDPKTLRVCLFLFNEHIFPSQ

SEQ ID NO: 3151049 - protein, 22 aa, Giardia lamblia
DDPQNFFGATCHDYGEYYHPHS

SEQ ID NO: 3151050 - protein, 17 aa, Giardia lamblia
DDPVLRKYLDTKNIDNV

SEQ ID NO: 3151051 - protein, 19 aa, Giardia lamblia
DDRFAAVLQNGREFHIDTS

SEQ ID NO: 3151052 - protein, 17 aa, Giardia lamblia
DDRPDYAYLRKIFRELF

SEQ ID NO: 3151053 - protein, 23 aa, Giardia lamblia
DDRPELLPLPGVYSDNPFITDLQ

SEQ ID NO: 3151054 - protein, 23 aa, Giardia lamblia
DDRRARYWLTYAAAIAGLCFDES

SEQ ID NO: 3151055 - protein, 18 aa, Giardia lamblia
DDRWGARFIDVSGICNKG

SEQ ID NO: 3151056 - protein, 27 aa, Giardia lamblia
DDSDSLVCCICLDKLRNVILYPCKHVV

SEQ ID NO: 3151057 - protein, 20 aa, Giardia lamblia
DDSFPYVVLFNGSHYDLFIA

SEQ ID NO: 3151058 - protein, 18 aa, Giardia lamblia
DDSGFKISTTTWKITESS

SEQ ID NO: 3151059 - protein, 24 aa, Giardia lamblia
DDSICLKPLRKAGMSVKQVTAHFL

SEQ ID NO: 3151060 - protein, 25 aa, Giardia lamblia
DDSLCTAMSIMSLFFQERRINSVNS

SEQ ID NO: 3151061 - protein, 26 aa, Giardia lamblia
DDSPMPLPNFLFRSRTLNALIDLSDI

SEQ ID NO: 3151062 - protein, 17 aa, Giardia lamblia
DDSRVVETIKIYDKLSE

SEQ ID NO: 3151063 - protein, 24 aa, Giardia lamblia
DDTMFPDMRGFREMVQKNKDKLGD

SEQ ID NO: 3151064 - protein, 17 aa, Giardia lamblia
DDTTAVIAFSWAAGQTF

SEQ ID NO: 3151065 - protein, 26 aa, Giardia lamblia
DDVIPEPYRPASCVPSGNGVLSGLES

SEQ ID NO: 3151066 - protein, 24 aa, Giardia lamblia
DDVKAVYPCPDFQVIILDEADALT

SEQ ID NO: 3151067 - protein, 26 aa, Giardia lamblia
DDVKYLAELAVRVAGVRKRLSKDATY

SEQ ID NO: 3151068 - protein, 20 aa, Giardia lamblia
DDVYACRWDFATPDKDLFVL

SEQ ID NO: 3151069 - protein, 21 aa, Giardia lamblia
DDWTDMFLQRVVHKLKTYSKV

SEQ ID NO: 3151070 - protein, 22 aa, Giardia lamblia
DDWVSYCGFILGIANSLTLLAD

SEQ ID NO: 3151071 - protein, 17 aa, Giardia lamblia
DDYDFIDGASWDNFKSS

SEQ ID NO: 3151072 - protein, 18 aa, Giardia lamblia
DEAKLLTYVVTFRNGIGV

SEQ ID NO: 3151073 - protein, 21 aa, Giardia lamblia
DEAKYDFGYDLDYLRETTDEM

SEQ ID NO: 3151074 - protein, 23 aa, Giardia lamblia
DECDDIFEPLNFSTKDLVNIFAD

SEQ ID NO: 3151075 - protein, 22 aa, Giardia lamblia
DECRRVAYLESRRHVLEGNNEL

SEQ ID NO: 3151076 - protein, 17 aa, Giardia lamblia
DEDIVFLASAFPYTYTD

SEQ ID NO: 3151077 - protein, 23 aa, Giardia lamblia
DEDSICRRFIALHANPEYSKPWV

SEQ ID NO: 3151078 - protein, 23 aa, Giardia lamblia
DEDTECLCLNRLNRSLYTIVLLL

SEQ ID NO: 3151079 - protein, 17 aa, Giardia lamblia
DEEGVDRGINVRKRAET

SEQ ID NO: 3151080 - protein, 26 aa, Giardia lamblia
DEEVCAVCLRALCRAAIVVLNCNHYF

SEQ ID NO: 3151081 - protein, 19 aa, Giardia lamblia
DEFASLFSVPGGKAAPLKT

SEQ ID NO: 3151082 - protein, 25 aa, Giardia lamblia
DEFAVKCIWYSRRSRSYISASVALS

SEQ ID NO: 3151083 - protein, 18 aa, Giardia lamblia
DEFGAAILRAFVAEEVDL

SEQ ID NO: 3151084 - protein, 23 aa, Giardia lamblia
DEGHGALFDFHWEQHNYGTDPWL

SEQ ID NO: 3151085 - protein, 21 aa, Giardia lamblia
DEGLKRTSLQCAECLRKKITL

SEQ ID NO: 3151086 - protein, 26 aa, Giardia lamblia
DEGSCAICLDSLPSIVYLPCRHLSIC

SEQ ID NO: 3151087 - protein, 17 aa, Giardia lamblia
DEGSGWAYVRARNSLYP

SEQ ID NO: 3151088 - protein, 24 aa, Giardia lamblia
DEGSLKIPFAVYIESEVMEYAEPI

SEQ ID NO: 3151089 - protein, 24 aa, Giardia lamblia
DEGVEARPAFKPFGVYNPSELQEP

SEQ ID NO: 3151090 - protein, 17 aa, Giardia lamblia
DEHKAIIEAAGKEDDTQ

SEQ ID NO: 3151091 - protein, 29 aa, Giardia lamblia
DEIFGRPCFKTVSDLLLFRAGKAIDLAVV

SEQ ID NO: 3151092 - protein, 17 aa, Giardia lamblia
DEIIKLKGLPDYSDGKF

SEQ ID NO: 3151093 - protein, 23 aa, Giardia lamblia
DEIKENLSAKGRRLCDVPSVQEP

SEQ ID NO: 3151094 - protein, 23 aa, Giardia lamblia
DEIKKIAKRVAVIETVIDTKTIE

SEQ ID NO: 3151095 - protein, 25 aa, Giardia lamblia
DEIKRLKEAMFSREEVIAKVSYIDA

SEQ ID NO: 3151096 - protein, 22 aa, Giardia lamblia
DEIKRLNEVIGVQQNYLELKEI

SEQ ID NO: 3151097 - protein, 25 aa, Giardia lamblia
DEILIPRVIDISALPSLEETTFYSK

SEQ ID NO: 3151098 - protein, 21 aa, Giardia lamblia
DEINKRIPVRRVEMDDPLVSE

SEQ ID NO: 3151099 - protein, 19 aa, Giardia lamblia
DEIPEGFLSVQSQLASKDS

SEQ ID NO: 3151100 - protein, 23 aa, Giardia lamblia
DEIQRLQSLLLHTADVRAASLTY

SEQ ID NO: 3151101 - protein, 17 aa, Giardia lamblia
DEKKRTAILTSLTQGMK

SEQ ID NO: 3151102 - protein, 18 aa, Giardia lamblia
DEKLSLSFLDLLETANGP

SEQ ID NO: 3151103 - protein, 36 aa, Giardia lamblia
DEKRIGDCFLWEIPLYKCMLLWNVHSFYKSPGPLRL

SEQ ID NO: 3151104 - protein, 26 aa, Giardia lamblia
DEKVDVWSIGALGYYLCSLAPVVSGS

SEQ ID NO: 3151105 - protein, 20 aa, Giardia lamblia
DEKYLFWTLFRATDESKLIP

SEQ ID NO: 3151106 - protein, 17 aa, Giardia lamblia
DELCAVGGSIGIERIFA

SEQ ID NO: 3151107 - protein, 25 aa, Giardia lamblia
DELDPRPRLPLFEEHIKLYNTSRRK

SEQ ID NO: 3151108 - protein, 25 aa, Giardia lamblia
DELEYYKRRCAALEHQVETLREALL

SEQ ID NO: 3151109 - protein, 21 aa, Giardia lamblia
DELFMEMQVRIASLTKENKAL

SEQ ID NO: 3151110 - protein, 23 aa, Giardia lamblia
DELHGAWLKSLLRILQLHATYHS

SEQ ID NO: 3151111 - protein, 17 aa, Giardia lamblia
DELIGRNMHPTIVIEGY

SEQ ID NO: 3151112 - protein, 17 aa, Giardia lamblia
DELKTFLFKFAIVHADG

SEQ ID NO: 3151113 - protein, 24 aa, Giardia lamblia
DELNELKENLFLLREKGISDGILD

SEQ ID NO: 3151114 - protein, 20 aa, Giardia lamblia
DELQRLAIPLAKTRDHKGRT

SEQ ID NO: 3151115 - protein, 17 aa, Giardia lamblia
DELQRWFMAARQGEEDY

SEQ ID NO: 3151116 - protein, 19 aa, Giardia lamblia
DELRAFAAVIGLDGPAQMY

SEQ ID NO: 3151117 - protein, 22 aa, Giardia lamblia
DELRAKIVTMLNLEVSKTNALK

SEQ ID NO: 3151118 - protein, 21 aa, Giardia lamblia
DELSAFICAMLKPDPSARSSV

SEQ ID NO: 3151119 - protein, 22 aa, Giardia lamblia
DELSCSILDKYGFDILVRGHEC

SEQ ID NO: 3151120 - protein, 28 aa, Giardia lamblia
DELSLCFLPGIGAPLNWVGSTFPAEAPN

SEQ ID NO: 3151121 - protein, 27 aa, Giardia lamblia
DEMKQILTCRICAAEAEQQILKAELEQ

SEQ ID NO: 3151122 - protein, 20 aa, Giardia lamblia
DEMMDCYLFLLDGEDDPDRT

SEQ ID NO: 3151123 - protein, 23 aa, Giardia lamblia
DENEAKEALDFFNANITSNSAAL

SEQ ID NO: 3151124 - protein, 19 aa, Giardia lamblia
DENGIFFVNEFTFQEDQEN

SEQ ID NO: 3151125 - protein, 20 aa, Giardia lamblia
DENGRTALMLAAQNGHLECV

SEQ ID NO: 3151126 - protein, 21 aa, Giardia lamblia
DENHVCLGLCDIHAGTTQYAA

SEQ ID NO: 3151127 - protein, 21 aa, Giardia lamblia
DENRPILAMELLRNDKLVVSG

SEQ ID NO: 3151128 - protein, 27 aa, Giardia lamblia
DENRYLIRLRYRFSRGVPLEAVVAHHI

SEQ ID NO: 3151129 - protein, 26 aa, Giardia lamblia
DENVLRIITVPGWLRGPFESESGSTK

SEQ ID NO: 3151130 - protein, 19 aa, Giardia lamblia
DEPRYVMRTAVSKSRNKNS

SEQ ID NO: 3151131 - protein, 18 aa, Giardia lamblia
DEPSTFFIVGDAFGNLAC

SEQ ID NO: 3151132 - protein, 23 aa, Giardia lamblia
DEPTWRGTILAGHGSIYTLRGSS

SEQ ID NO: 3151133 - protein, 19 aa, Giardia lamblia
DEQAITFTTIDTFKPKTHT

SEQ ID NO: 3151134 - protein, 20 aa, Giardia lamblia
DEQGRTALFYAASADSIEAV

SEQ ID NO: 3151135 - protein, 31 aa, Giardia lamblia
DEQIRIVLFQTLRALEWFHIHGIVHRDTKPG

SEQ ID NO: 3151136 - protein, 20 aa, Giardia lamblia
DEQKELLGLFELIYTEYRPQ

SEQ ID NO: 3151137 - protein, 17 aa, Giardia lamblia
DEQKILKICDLIISSEI

SEQ ID NO: 3151138 - protein, 28 aa, Giardia lamblia
DEQKRIAEFAVYFSTYFYSMMSYVTDFY

SEQ ID NO: 3151139 - protein, 24 aa, Giardia lamblia
DERECCRQGPGPYCCDRERRKFWK

SEQ ID NO: 3151140 - protein, 24 aa, Giardia lamblia
DERGCTALMMAAERGDVRSVAALV

SEQ ID NO: 3151141 - protein, 24 aa, Giardia lamblia
DERKISWIVIRSFGRINESEARAM

SEQ ID NO: 3151142 - protein, 19 aa, Giardia lamblia
DERKNWLLSNDDWKYDAIP

SEQ ID NO: 3151143 - protein, 26 aa, Giardia lamblia
DERNFYLLMEFCNGGEFAEVLKRQPN

SEQ ID NO: 3151144 - protein, 24 aa, Giardia lamblia
DERPKAIRYWPLYKSKEHDPIYTD

SEQ ID NO: 3151145 - protein, 17 aa, Giardia lamblia
DERPRRRLLRLARGTRI

SEQ ID NO: 3151146 - protein, 22 aa, Giardia lamblia
DERRALRTTWTMRQPADYLQWG

SEQ ID NO: 3151147 - protein, 23 aa, Giardia lamblia
DERSLVWSIGYLVLSMCIYSRRE

SEQ ID NO: 3151148 - protein, 23 aa, Giardia lamblia
DESGRTALMYAAMNGASSAARLL

SEQ ID NO: 3151149 - protein, 25 aa, Giardia lamblia
DESKLKAADLVGAMMRTSSDVQKIV

SEQ ID NO: 3151150 - protein, 21 aa, Giardia lamblia
DESKRYFQVDFDFGEFQTALG

SEQ ID NO: 3151151 - protein, 17 aa, Giardia lamblia
DESYYLIDLSKLARSLC

SEQ ID NO: 3151152 - protein, 19 aa, Giardia lamblia
DETYYELNLLKKDDLDMTG

SEQ ID NO: 3151153 - protein, 21 aa, Giardia lamblia
DEVDCLMNPQFIEQIDAVLEW

SEQ ID NO: 3151154 - protein, 24 aa, Giardia lamblia
DEVGKLLHMAGCYNKAGRTALMEA

SEQ ID NO: 3151155 - protein, 18 aa, Giardia lamblia
DEVLPFDVTETVTPSMIQ

SEQ ID NO: 3151156 - protein, 22 aa, Giardia lamblia
DEVREAYEYLGIPIDDDHVSLD

SEQ ID NO: 3151157 - protein, 23 aa, Giardia lamblia
DEVSTWIRIFATYTRADFRQLHK

SEQ ID NO: 3151158 - protein, 22 aa, Giardia lamblia
DEYKRYAGLTTRSAVLDLKAAM

SEQ ID NO: 3151159 - protein, 20 aa, Giardia lamblia
DEYMGRTALMLAAEKNQTRT

SEQ ID NO: 3151160 - protein, 21 aa, Giardia lamblia
DEYRISPNMSEIQVLQDYETL

SEQ ID NO: 3151161 - protein, 21 aa, Giardia lamblia
DEYRRKIALRRFASADKHATK

SEQ ID NO: 3151162 - protein, 30 aa, Giardia lamblia
DEYSFELFKSWVSRRFPFQFREGNFPLRHR

SEQ ID NO: 3151163 - protein, 23 aa, Giardia lamblia
DFAELRKLLKLYKEEAAAKDLAL

SEQ ID NO: 3151164 - protein, 20 aa, Giardia lamblia
DFAFCRALTAVSLMSPSFGD

SEQ ID NO: 3151165 - protein, 23 aa, Giardia lamblia
DFATPDKDLFVLFSDRPSYLKRD

SEQ ID NO: 3151166 - protein, 24 aa, Giardia lamblia
DFAWKDGGGHRVIMSNGVQLRPGG

SEQ ID NO: 3151167 - protein, 17 aa, Giardia lamblia
DFCRVVAYCCEKLPKDK

SEQ ID NO: 3151168 - protein, 17 aa, Giardia lamblia
DFDSIIRVFGLRLPEEW

SEQ ID NO: 3151169 - protein, 25 aa, Giardia lamblia
DFELARMRLQATIKRIEDDMMNRPT

SEQ ID NO: 3151170 - protein, 19 aa, Giardia lamblia
DFFACVSANIFRATAKPAC

SEQ ID NO: 3151171 - protein, 19 aa, Giardia lamblia
DFFILMVVGMFGDNREIVS

SEQ ID NO: 3151172 - protein, 19 aa, Giardia lamblia
DFFPAESLVAYAAKMNIPF

SEQ ID NO: 3151173 - protein, 25 aa, Giardia lamblia
DFHGCTALLMATEYNRLDIIKLLID

SEQ ID NO: 3151174 - protein, 17 aa, Giardia lamblia
DFHLARVETLIGCVQSV

SEQ ID NO: 3151175 - protein, 20 aa, Giardia lamblia
DFHPQLCVLAAGGIYKESGA

SEQ ID NO: 3151176 - protein, 17 aa, Giardia lamblia
DFIKVVVGMEWVRRNRE

SEQ ID NO: 3151177 - protein, 24 aa, Giardia lamblia
DFINGFNCTIFAYGQTGSGKSYTM

SEQ ID NO: 3151178 - protein, 23 aa, Giardia lamblia
DFIRDVYLSICRDNEELPSREGL

SEQ ID NO: 3151179 - protein, 25 aa, Giardia lamblia
DFITQCLKPAISERITARKALQHPW

SEQ ID NO: 3151180 - protein, 21 aa, Giardia lamblia
DFKSGMCYDVDAGIKRICNAI

SEQ ID NO: 3151181 - protein, 25 aa, Giardia lamblia
DFLDGFNCTLFAYGQTGTGKTYTMI

SEQ ID NO: 3151182 - protein, 20 aa, Giardia lamblia
DFLFTAVVYFVARFQNADII

SEQ ID NO: 3151183 - protein, 22 aa, Giardia lamblia
DFLKNLGVSVLTRFPPEPNGYL

SEQ ID NO: 3151184 - protein, 18 aa, Giardia lamblia
DFLLISAPDMKIPFHNLW

SEQ ID NO: 3151185 - protein, 19 aa, Giardia lamblia
DFLMALYLADSVVVFTGTP

SEQ ID NO: 3151186 - protein, 19 aa, Giardia lamblia
DFLQQMWTIGRLGHRPDDG

SEQ ID NO: 3151187 - protein, 18 aa, Giardia lamblia
DFMGECSVCHANISHGIA

SEQ ID NO: 3151188 - protein, 20 aa, Giardia lamblia
DFMTRMQVQRCIQLLLHEAY

SEQ ID NO: 3151189 - protein, 26 aa, Giardia lamblia
DFPDGCSVVAMLFRSSILAIVGTGMN

SEQ ID NO: 3151190 - protein, 24 aa, Giardia lamblia
DFPDKSRYLLDVFIAEYSTPSLME

SEQ ID NO: 3151191 - protein, 23 aa, Giardia lamblia
DFPGKRCKYTVFTELSPRHNYCF

SEQ ID NO: 3151192 - protein, 24 aa, Giardia lamblia
DFQKSCDGHTWFLPITSVLNPQHP

SEQ ID NO: 3151193 - protein, 24 aa, Giardia lamblia
DFRGHLQNIYAFYLVMAGDFLSCF

SEQ ID NO: 3151194 - protein, 22 aa, Giardia lamblia
DFRLRLLSWYENLACGPITSVS

SEQ ID NO: 3151195 - protein, 18 aa, Giardia lamblia
DFSKRPAANELLRYPKIQ

SEQ ID NO: 3151196 - protein, 39 aa, Giardia lamblia
DFSSLRIPLGKFLRVCPRIDPRLYSVASLPHPDEDSNTV

SEQ ID NO: 3151197 - protein, 24 aa, Giardia lamblia
DFSVCKAVAFAAADNTLLMHRDDE

SEQ ID NO: 3151198 - protein, 30 aa, Giardia lamblia
DFTRYEIYKDLPVAELISGLSEVDMDASAI

SEQ ID NO: 3151199 - protein, 21 aa, Giardia lamblia
DFVAICGAGSFGKVHKVRSKE

SEQ ID NO: 3151200 - protein, 18 aa, Giardia lamblia
DFWRRIKDTIAANTSNDG

SEQ ID NO: 3151201 - protein, 19 aa, Giardia lamblia
DFYRCVFVTDINFYLNSGI

SEQ ID NO: 3151202 - protein, 22 aa, Giardia lamblia
DGAARLGRCVVLGTSRMFADGF

SEQ ID NO: 3151203 - protein, 18 aa, Giardia lamblia
DGAFARCSVASGVTVASP

SEQ ID NO: 3151204 - protein, 23 aa, Giardia lamblia
DGAHSKSLLSFTGYANATNSQDS

SEQ ID NO: 3151205 - protein, 20 aa, Giardia lamblia
DGAKHLHALEGHLHNKDGQT

SEQ ID NO: 3151206 - protein, 26 aa, Giardia lamblia
DGALPVFRKAFNFTLYPMFHIELCHK

SEQ ID NO: 3151207 - protein, 24 aa, Giardia lamblia
DGAPCGILTHLCYKATVLSSTPTT

SEQ ID NO: 3151208 - protein, 18 aa, Giardia lamblia
DGARLVCFYDNRLSLLTV

SEQ ID NO: 3151209 - protein, 25 aa, Giardia lamblia
DGASRPMAFLYVKGFALLEALEQGG

SEQ ID NO: 3151210 - protein, 19 aa, Giardia lamblia
DGAVCLSVINIATGTAAPI

SEQ ID NO: 3151211 - protein, 20 aa, Giardia lamblia
DGCQIISGWSDGAVRSHAPQ

SEQ ID NO: 3151212 - protein, 23 aa, Giardia lamblia
DGDLEGVLYLSKRYQFTKETCDY

SEQ ID NO: 3151213 - protein, 26 aa, Giardia lamblia
DGDLLRVRRKYLLWVSYMQIYNESIN

SEQ ID NO: 3151214 - protein, 21 aa, Giardia lamblia
DGDMLRFVLSEVFNTKTTENY

SEQ ID NO: 3151215 - protein, 19 aa, Giardia lamblia
DGEALPLAVQHDFLYGVEA

SEQ ID NO: 3151216 - protein, 25 aa, Giardia lamblia
DGEEVLRPIFPVSCRAMVDEYSYYS

SEQ ID NO: 3151217 - protein, 21 aa, Giardia lamblia
DGEKCKGLILSYGSGADMAGL

SEQ ID NO: 3151218 - protein, 20 aa, Giardia lamblia
DGFIKNVLERIFVLEPKERL

SEQ ID NO: 3151219 - protein, 23 aa, Giardia lamblia
DGFLKDILRRLLVLNPTNRLSAI

SEQ ID NO: 3151220 - protein, 19 aa, Giardia lamblia
DGFLNKRDMFLATQTELPG

SEQ ID NO: 3151221 - protein, 22 aa, Giardia lamblia
DGFSSLMICAQYNYVEIGRKLL

SEQ ID NO: 3151222 - protein, 17 aa, Giardia lamblia
DGHAMWVGDTVTLHFNP

SEQ ID NO: 3151223 - protein, 27 aa, Giardia lamblia
DGHAVCVGAGFAALVEFNGEKCAITKT

SEQ ID NO: 3151224 - protein, 20 aa, Giardia lamblia
DGHMSLMLFTRILTSEERHD

SEQ ID NO: 3151225 - protein, 32 aa, Giardia lamblia
DGHPICPHCKYYLRPRVLMFDDAMFMELTDEE

SEQ ID NO: 3151226 - protein, 24 aa, Giardia lamblia
DGHSALCYACRALNTDGIKRLWRE

SEQ ID NO: 3151227 - protein, 22 aa, Giardia lamblia
DGHSRGGGALAAVSATKAPIVF

SEQ ID NO: 3151228 - protein, 23 aa, Giardia lamblia
DGHSRSASFSSVFSDEEDELPPI

SEQ ID NO: 3151229 - protein, 20 aa, Giardia lamblia
DGHTAMMWASRNGHSKSVSL

SEQ ID NO: 3151230 - protein, 18 aa, Giardia lamblia
DGHVDCLLHLRPYEQQMA

SEQ ID NO: 3151231 - protein, 17 aa, Giardia lamblia
DGICIMISMCQHNCGLE

SEQ ID NO: 3151232 - protein, 25 aa, Giardia lamblia
DGIRKQLKELLVNSAYSTTSASKEV

SEQ ID NO: 3151233 - protein, 25 aa, Giardia lamblia
DGIWCCLPSSFPETCTFTIIDPGNT

SEQ ID NO: 3151234 - protein, 24 aa, Giardia lamblia
DGKKRKYPLLSLSITHLLTELVTI

SEQ ID NO: 3151235 - protein, 24 aa, Giardia lamblia
DGKKYYGVFPLRGKVINVRNESID

SEQ ID NO: 3151236 - protein, 20 aa, Giardia lamblia
DGKLACLVCNKLSKDIEYCL

SEQ ID NO: 3151237 - protein, 18 aa, Giardia lamblia
DGKLKLDYPSAIVEHVVE

SEQ ID NO: 3151238 - protein, 25 aa, Giardia lamblia
DGKSAYRIWWLLNFFSHPKVSIYPG

SEQ ID NO: 3151239 - protein, 19 aa, Giardia lamblia
DGKTALMCAAEAGHLPLVS

SEQ ID NO: 3151240 - protein, 20 aa, Giardia lamblia
DGKTALMLAAEYNRVSSVPL

SEQ ID NO: 3151241 - protein, 20 aa, Giardia lamblia
DGKVFYKSQIKYVSNNSILD

SEQ ID NO: 3151242 - protein, 18 aa, Giardia lamblia
DGLGRTALMYATEVCSLD

SEQ ID NO: 3151243 - protein, 18 aa, Giardia lamblia
DGLILRQSTGFGNNKEKH

SEQ ID NO: 3151244 - protein, 21 aa, Giardia lamblia
DGLKIGLSVVRAQFSSQIPFV

SEQ ID NO: 3151245 - protein, 17 aa, Giardia lamblia
DGLLRMENMHTWVKAAS

SEQ ID NO: 3151246 - protein, 18 aa, Giardia lamblia
DGLLTRISRRAIDADAAV

SEQ ID NO: 3151247 - protein, 20 aa, Giardia lamblia
DGLSCGIYCDLLSIHGIFLP

SEQ ID NO: 3151248 - protein, 19 aa, Giardia lamblia
DGLSSFLFHNFTLPQAILA

SEQ ID NO: 3151249 - protein, 18 aa, Giardia lamblia
DGLVLPRSYFLIDREYNF

SEQ ID NO: 3151250 - protein, 23 aa, Giardia lamblia
DGLWLRVHETGVRWKDEKEDDLP

SEQ ID NO: 3151251 - protein, 19 aa, Giardia lamblia
DGMILVCTCNSSLNISAIY

SEQ ID NO: 3151252 - protein, 23 aa, Giardia lamblia
DGNGRTALMYAAFAGNVNAVRDL

SEQ ID NO: 3151253 - protein, 22 aa, Giardia lamblia
DGPASIDFISLIATQDSLQKAI

SEQ ID NO: 3151254 - protein, 25 aa, Giardia lamblia
DGPLPTGWTRLMVCTIANKVDCFSQ

SEQ ID NO: 3151255 - protein, 19 aa, Giardia lamblia
DGPRYCGVTTLNPCKCCEC

SEQ ID NO: 3151256 - protein, 19 aa, Giardia lamblia
DGPRYCGVTTLNPCRCCEC

SEQ ID NO: 3151257 - protein, 22 aa, Giardia lamblia
DGQGRTALMFAAQVGAEEALSM

SEQ ID NO: 3151258 - protein, 19 aa, Giardia lamblia
DGQLIKFLNQWCYGAPFTP

SEQ ID NO: 3151259 - protein, 21 aa, Giardia lamblia
DGQPILLSREVILSSISNIGL

SEQ ID NO: 3151260 - protein, 19 aa, Giardia lamblia
DGQRKFIHRRGGLAPFTND

SEQ ID NO: 3151261 - protein, 20 aa, Giardia lamblia
DGRADVWSLGPILTELITGK

SEQ ID NO: 3151262 - protein, 24 aa, Giardia lamblia
DGRLLPPIIHRDIKPENILVSKDR

SEQ ID NO: 3151263 - protein, 23 aa, Giardia lamblia
DGRTSVSVGSRLASRKVSAVHGT

SEQ ID NO: 3151264 - protein, 24 aa, Giardia lamblia
DGRVKLIDFGICKELVDCSVTHTR

SEQ ID NO: 3151265 - protein, 20 aa, Giardia lamblia
DGSEQFAALQAELDVMRKVN

SEQ ID NO: 3151266 - protein, 22 aa, Giardia lamblia
DGSGKPALYYALEGRNMTHVRE

SEQ ID NO: 3151267 - protein, 24 aa, Giardia lamblia
DGSIKLGDFGLCRSLGELSQAKTN

SEQ ID NO: 3151268 - protein, 24 aa, Giardia lamblia
DGSIKLGDFGLCRTLGEDSVAQTN

SEQ ID NO: 3151269 - protein, 20 aa, Giardia lamblia
DGSIKLWDIRATTPECVQTL

SEQ ID NO: 3151270 - protein, 33 aa, Giardia lamblia
DGSILCLIHPLVGDFRLQYSVWSKFVSDLDNEA

SEQ ID NO: 3151271 - protein, 17 aa, Giardia lamblia
DGSRYEGEWVKGLMCGQ

SEQ ID NO: 3151272 - protein, 23 aa, Giardia lamblia
DGSTRACKLELFISQLILLEKTA

SEQ ID NO: 3151273 - protein, 26 aa, Giardia lamblia
DGTFSSCMWCSPRLTAESIYFNSDGC

SEQ ID NO: 3151274 - protein, 31 aa, Giardia lamblia
DGTLRKAPDIWPRWSPHGGLSLHPLQLRILL

SEQ ID NO: 3151275 - protein, 24 aa, Giardia lamblia
DGTPRRERPCIIHTMQSAVLRQGI

SEQ ID NO: 3151276 - protein, 35 aa, Giardia lamblia
DGTTALMCAAHSNSLDCVRLLLPLEEGLQTNNLHS

SEQ ID NO: 3151277 - protein, 19 aa, Giardia lamblia
DGTTGLMLAAQYGLSEAVP

SEQ ID NO: 3151278 - protein, 18 aa, Giardia lamblia
DGVTAWYLAYKVQSPDLC

SEQ ID NO: 3151279 - protein, 17 aa, Giardia lamblia
DGWTALMMAALRGHAEC

SEQ ID NO: 3151280 - protein, 19 aa, Giardia lamblia
DGYAASALEAQRVATMDKI

SEQ ID NO: 3151281 - protein, 24 aa, Giardia lamblia
DGYEPEARRSSARLPKRPISAVPT

SEQ ID NO: 3151282 - protein, 21 aa, Giardia lamblia
DGYGCIVCPPFSKQSQTAQSI

SEQ ID NO: 3151283 - protein, 22 aa, Giardia lamblia
DGYIKVWSLQCVDRDTTRSDLT

SEQ ID NO: 3151284 - protein, 26 aa, Giardia lamblia
DGYISAGADGGCWVSLTFTVACQDTD

SEQ ID NO: 3151285 - protein, 19 aa, Giardia lamblia
DGYLARGVLYAELHRFETA

SEQ ID NO: 3151286 - protein, 24 aa, Giardia lamblia
DGYVDFRSALLLPDGKSKGPEKEK

SEQ ID NO: 3151287 - protein, 18 aa, Giardia lamblia
DHAFTLVNQCMGRGIRHK

SEQ ID NO: 3151288 - protein, 17 aa, Giardia lamblia
DHDKFYSYWKMSGQQTD

SEQ ID NO: 3151289 - protein, 22 aa, Giardia lamblia
DHEIAKCKERIIQLTTSGSMEK

SEQ ID NO: 3151290 - protein, 18 aa, Giardia lamblia
DHEMVWHLTQYIAEHTDT

SEQ ID NO: 3151291 - protein, 21 aa, Giardia lamblia
DHFGRSVLMAAIEVDNAVGLS

SEQ ID NO: 3151292 - protein, 20 aa, Giardia lamblia
DHFIRRIAYRESDGLNEEPS

SEQ ID NO: 3151293 - protein, 18 aa, Giardia lamblia
DHGVCKRGPDGFSCACDE

SEQ ID NO: 3151294 - protein, 18 aa, Giardia lamblia
DHIDGYLVFIQAIIDRFE

SEQ ID NO: 3151295 - protein, 24 aa, Giardia lamblia
DHIKGFEAECFWVEKGGLQPLEER

SEQ ID NO: 3151296 - protein, 25 aa, Giardia lamblia
DHISRRVSPEIALSEIKRFELIFLS

SEQ ID NO: 3151297 - protein, 25 aa, Giardia lamblia
DHKGSRWAESIARKLESNKSLSNIQ

SEQ ID NO: 3151298 - protein, 26 aa, Giardia lamblia
DHLCTLPSPRVARFVRYTILENFGGS

SEQ ID NO: 3151299 - protein, 23 aa, Giardia lamblia
DHLDYRYCQVFGDCCDPLSIPRT

SEQ ID NO: 3151300 - protein, 23 aa, Giardia lamblia
DHLISAYSRWSSPSITPQPPAAP

SEQ ID NO: 3151301 - protein, 20 aa, Giardia lamblia
DHLTCAICYGLFSHPVVLTC

SEQ ID NO: 3151302 - protein, 20 aa, Giardia lamblia
DHPDSLVLQPIIPIEQSNSS

SEQ ID NO: 3151303 - protein, 18 aa, Giardia lamblia
DHQEVVKLLAPVEGHIRN

SEQ ID NO: 3151304 - protein, 18 aa, Giardia lamblia
DHSGYCAIYYSLFAEQQL

SEQ ID NO: 3151305 - protein, 35 aa, Giardia lamblia
DHSMAIKLAVYRQAFPTLVSLRFDAGDMLLFEPVA

SEQ ID NO: 3151306 - protein, 18 aa, Giardia lamblia
DHSRGPALTIEELGNRLL

SEQ ID NO: 3151307 - protein, 22 aa, Giardia lamblia
DHVDNRLGLVVNNSGVGRKDHT

SEQ ID NO: 3151308 - protein, 19 aa, Giardia lamblia
DIAAAFKAFTDPAVYNQPI

SEQ ID NO: 3151309 - protein, 19 aa, Giardia lamblia
DIAAQLFNLLAVMHSPLDL

SEQ ID NO: 3151310 - protein, 28 aa, Giardia lamblia
DIACPGKMLSSICKKSTLSLTSFWSRSL

SEQ ID NO: 3151311 - protein, 26 aa, Giardia lamblia
DIAEACGNTAVAALLRTVEKPLANST

SEQ ID NO: 3151312 - protein, 20 aa, Giardia lamblia
DIASRLGITCSVGVAINQQV

SEQ ID NO: 3151313 - protein, 25 aa, Giardia lamblia
DICAEKRKPFVLVMNKVDLVPQQVA

SEQ ID NO: 3151314 - protein, 19 aa, Giardia lamblia
DICKVLAPLEARIQRKDGF

SEQ ID NO: 3151315 - protein, 21 aa, Giardia lamblia
DIDFSRPWRRVPIIETLEQLL

SEQ ID NO: 3151316 - protein, 19 aa, Giardia lamblia
DIDISLPFVSQFKQPSAEA

SEQ ID NO: 3151317 - protein, 20 aa, Giardia lamblia
DIDLPFSHSTLRPLLKILKG

SEQ ID NO: 3151318 - protein, 20 aa, Giardia lamblia
DIDPACTVNYSYLFKTDSFA

SEQ ID NO: 3151319 - protein, 19 aa, Giardia lamblia
DIDTLVAFYETLLKHSVNT

SEQ ID NO: 3151320 - protein, 23 aa, Giardia lamblia
DIDVIKLLRIEASITVGETLPWK

SEQ ID NO: 3151321 - protein, 18 aa, Giardia lamblia
DIEAIALITGARIIPRFE

SEQ ID NO: 3151322 - protein, 22 aa, Giardia lamblia
DIEGVELLLPFQARRNTGCVEL

SEQ ID NO: 3151323 - protein, 28 aa, Giardia lamblia
DIESEWHLKHIFAWFSRKSIAVYVDPLV

SEQ ID NO: 3151324 - protein, 25 aa, Giardia lamblia
DIFAICRLCTSLFCKRTGKDNQRYQ

SEQ ID NO: 3151325 - protein, 17 aa, Giardia lamblia
DIFKALGDDVLKQAPDL

SEQ ID NO: 3151326 - protein, 19 aa, Giardia lamblia
DIFLGLRIADGVSDLDPSA

SEQ ID NO: 3151327 - protein, 24 aa, Giardia lamblia
DIFLKGDLPISTSCDMAIGDDSQL

SEQ ID NO: 3151328 - protein, 19 aa, Giardia lamblia
DIFMPYRLDVYVPEEAVET

SEQ ID NO: 3151329 - protein, 22 aa, Giardia lamblia
DIFRRAFMSRIFPPDKLAKLGQ

SEQ ID NO: 3151330 - protein, 18 aa, Giardia lamblia
DIGFVGLVALQFYDSEGV

SEQ ID NO: 3151331 - protein, 24 aa, Giardia lamblia
DIGHRKLMLDYAIIQKKNESINLT

SEQ ID NO: 3151332 - protein, 29 aa, Giardia lamblia
DIGKCFRGDVGALLSYWWSDPLDLQCRLL

SEQ ID NO: 3151333 - protein, 20 aa, Giardia lamblia
DIGLILANWCLENFHNNPLT

SEQ ID NO: 3151334 - protein, 28 aa, Giardia lamblia
DIGNMSVIRGWDEGVCGMRVGEKSLFTI

SEQ ID NO: 3151335 - protein, 18 aa, Giardia lamblia
DIGRVNAIEFSRAYAKSI

SEQ ID NO: 3151336 - protein, 25 aa, Giardia lamblia
DIHNCYRNASNFVLIRSIQAYNMLL

SEQ ID NO: 3151337 - protein, 19 aa, Giardia lamblia
DIIFTMWMGYDISKSLMAL

SEQ ID NO: 3151338 - protein, 17 aa, Giardia lamblia
DIIICKNEQIRRLLEDA

SEQ ID NO: 3151339 - protein, 21 aa, Giardia lamblia
DIIKCLAPTYLGDWKTDGAML

SEQ ID NO: 3151340 - protein, 20 aa, Giardia lamblia
DIIKSLNIHSLFSGAPSFLS

SEQ ID NO: 3151341 - protein, 22 aa, Giardia lamblia
DIIPRDLGLLLSPHYPPVLPID

SEQ ID NO: 3151342 - protein, 17 aa, Giardia lamblia
DIIRSVRDPEHMNMTLE

SEQ ID NO: 3151343 - protein, 20 aa, Giardia lamblia
DIITMLLKYEKDSSWTSLMC

SEQ ID NO: 3151344 - protein, 20 aa, Giardia lamblia
DIIVCTPGRILHIHDQVSTF

SEQ ID NO: 3151345 - protein, 27 aa, Giardia lamblia
DIKACLKTLCHGRVPIQYVSDGTEASD

SEQ ID NO: 3151346 - protein, 21 aa, Giardia lamblia
DIKRLGKTQFVLTNQISELKA

SEQ ID NO: 3151347 - protein, 24 aa, Giardia lamblia
DIKTMGKQRLDAMSDAISTSEPIS

SEQ ID NO: 3151348 - protein, 17 aa, Giardia lamblia
DILAGKQPHVFSEVPTM

SEQ ID NO: 3151349 - protein, 23 aa, Giardia lamblia
DILEIDSAPCFYQIEDSIVIAVA

SEQ ID NO: 3151350 - protein, 27 aa, Giardia lamblia
DILERYCFYKKYKFQRLQGSMTSEQRR

SEQ ID NO: 3151351 - protein, 21 aa, Giardia lamblia
DILGELIVVLGCKLTKGTDSG

SEQ ID NO: 3151352 - protein, 17 aa, Giardia lamblia
DILLRGSEKKREIEEAV

SEQ ID NO: 3151353 - protein, 19 aa, Giardia lamblia
DILQSQWSPCFTILSVLLS

SEQ ID NO: 3151354 - protein, 26 aa, Giardia lamblia
DILRRIPLFADHAFMTIGEVFSGLFA

SEQ ID NO: 3151355 - protein, 25 aa, Giardia lamblia
DILSKDFYCCLSDVITTMMTTEQTL

SEQ ID NO: 3151356 - protein, 17 aa, Giardia lamblia
DILVSGLRYELRRLFSA

SEQ ID NO: 3151357 - protein, 18 aa, Giardia lamblia
DIMPNCRLHTVSAANHDW

SEQ ID NO: 3151358 - protein, 18 aa, Giardia lamblia
DIMTRYSSWISLKTGRHL

SEQ ID NO: 3151359 - protein, 23 aa, Giardia lamblia
DINGFCGKTPIHGGINAENIYIS

SEQ ID NO: 3151360 - protein, 23 aa, Giardia lamblia
DINRIQRFFSYEHFYVIYCKFWE

SEQ ID NO: 3151361 - protein, 23 aa, Giardia lamblia
DINSFQPGPLFPVAEVQSQPHML

SEQ ID NO: 3151362 - protein, 20 aa, Giardia lamblia
DINVDALFRCDLLGRTPLHY

SEQ ID NO: 3151363 - protein, 27 aa, Giardia lamblia
DIPAKYFADPAVKEWLLDSKNGILLSL

SEQ ID NO: 3151364 - protein, 19 aa, Giardia lamblia
DIPKKETLTSISSDQIATA

SEQ ID NO: 3151365 - protein, 25 aa, Giardia lamblia
DIPLAECYSSGIVIGGWFTLSNTSY

SEQ ID NO: 3151366 - protein, 26 aa, Giardia lamblia
DIQLSFKTYYKGVAMHGACTYDSLLK

SEQ ID NO: 3151367 - protein, 18 aa, Giardia lamblia
DIRDCYCVSAKLYAEDMI

SEQ ID NO: 3151368 - protein, 19 aa, Giardia lamblia
DIRSLEGLLHVKQDLNLVP

SEQ ID NO: 3151369 - protein, 23 aa, Giardia lamblia
DISAVPICVSRVPTPSDSVPIDP

SEQ ID NO: 3151370 - protein, 24 aa, Giardia lamblia
DISDAQRSIACFIPDNLPNPCTVV

SEQ ID NO: 3151371 - protein, 23 aa, Giardia lamblia
DISECVCCGLQLVMYPNLYRGAL

SEQ ID NO: 3151372 - protein, 25 aa, Giardia lamblia
DISFPFASLSAAWKRIEDTTKRLEK

SEQ ID NO: 3151373 - protein, 19 aa, Giardia lamblia
DISHKARILQVVYNSTSNE

SEQ ID NO: 3151374 - protein, 18 aa, Giardia lamblia
DISKAYHPIALKLSQARL

SEQ ID NO: 3151375 - protein, 24 aa, Giardia lamblia
DISLVKRYHHMVGRINGQNKTACQ

SEQ ID NO: 3151376 - protein, 19 aa, Giardia lamblia
DISNLIWRAFKQRVCGYDF

SEQ ID NO: 3151377 - protein, 18 aa, Giardia lamblia
DISYSCVSRRSHLNISCI

SEQ ID NO: 3151378 - protein, 24 aa, Giardia lamblia
DITCGLMGCTLCNKDVSDRRPRCA

SEQ ID NO: 3151379 - protein, 18 aa, Giardia lamblia
DITLLYDKYIDVFIEKDT

SEQ ID NO: 3151380 - protein, 22 aa, Giardia lamblia
DITRLPAILDPYLKAETFNQFK

SEQ ID NO: 3151381 - protein, 20 aa, Giardia lamblia
DITRRASFEHVANWLEECRT

SEQ ID NO: 3151382 - protein, 18 aa, Giardia lamblia
DITTAACRNALTEKLKGW

SEQ ID NO: 3151383 - protein, 19 aa, Giardia lamblia
DIVGGLAWLDFDSRKSLIS

SEQ ID NO: 3151384 - protein, 20 aa, Giardia lamblia
DIVKRPPFSSTIKTCCQDAR

SEQ ID NO: 3151385 - protein, 24 aa, Giardia lamblia
DIVRFLREFDFRFTYTRSSIDVSD

SEQ ID NO: 3151386 - protein, 18 aa, Giardia lamblia
DIVRLQRELKLIDQPTKS

SEQ ID NO: 3151387 - protein, 19 aa, Giardia lamblia
DIVSLLLMYECCRKDKTGT

SEQ ID NO: 3151388 - protein, 17 aa, Giardia lamblia
DIVVIPLGMSPRIGNSC

SEQ ID NO: 3151389 - protein, 19 aa, Giardia lamblia
DIYAKVFAEIEPKRERLAQ

SEQ ID NO: 3151390 - protein, 23 aa, Giardia lamblia
DIYATMRGCVAPHASVISCYPIY

SEQ ID NO: 3151391 - protein, 18 aa, Giardia lamblia
DIYFDVRTGILIFVVPSI

SEQ ID NO: 3151392 - protein, 25 aa, Giardia lamblia
DIYLKDSFLRDSVTGIRLMDSSSLV

SEQ ID NO: 3151393 - protein, 20 aa, Giardia lamblia
DKAGHLALHNACIRGNKNAA

SEQ ID NO: 3151394 - protein, 17 aa, Giardia lamblia
DKAKIELSLSCNSDGTL

SEQ ID NO: 3151395 - protein, 21 aa, Giardia lamblia
DKAKSYGYCKTDLINAVIANK

SEQ ID NO: 3151396 - protein, 23 aa, Giardia lamblia
DKATGKLFCKVCNQRFQMEGEFK

SEQ ID NO: 3151397 - protein, 37 aa, Giardia lamblia
DKAYTLEFAKAYYAYSRLKVKFLQKLAAFRSSPNYQI

SEQ ID NO: 3151398 - protein, 23 aa, Giardia lamblia
DKCGPICPHERALNDLLKAIRQE

SEQ ID NO: 3151399 - protein, 22 aa, Giardia lamblia
DKCKCLEAALNESAQTNTNQRI

SEQ ID NO: 3151400 - protein, 18 aa, Giardia lamblia
DKDGRTALIKAILAGHQS

SEQ ID NO: 3151401 - protein, 20 aa, Giardia lamblia
DKDILLRCFYKSNTPESYVM

SEQ ID NO: 3151402 - protein, 24 aa, Giardia lamblia
DKDVRFLLSVMLCMDPAERISAAE

SEQ ID NO: 3151403 - protein, 24 aa, Giardia lamblia
DKEGGIRMKDGWTALMSAANHGYY

SEQ ID NO: 3151404 - protein, 23 aa, Giardia lamblia
DKEIKSIVAAIGLHKLSAKKTIN

SEQ ID NO: 3151405 - protein, 17 aa, Giardia lamblia
DKEILSLQEQVKRKDTD

SEQ ID NO: 3151406 - protein, 20 aa, Giardia lamblia
DKEKLLEIAARNAHLSQTFT

SEQ ID NO: 3151407 - protein, 23 aa, Giardia lamblia
DKEMVCEIYAKFLLETLPSLFVF

SEQ ID NO: 3151408 - protein, 26 aa, Giardia lamblia
DKERWRAGQMLDFMVRASGAREIDNL

SEQ ID NO: 3151409 - protein, 20 aa, Giardia lamblia
DKEVEWNDNFRIFVSTRLPN

SEQ ID NO: 3151410 - protein, 18 aa, Giardia lamblia
DKFMIVFAGIGLSHEQAM

SEQ ID NO: 3151411 - protein, 17 aa, Giardia lamblia
DKFPRKVSYTIRDVCFH

SEQ ID NO: 3151412 - protein, 20 aa, Giardia lamblia
DKFTEAFLAEYMIKAADCML

SEQ ID NO: 3151413 - protein, 24 aa, Giardia lamblia
DKGDRFLGCLSQLLTTQNDQEPSL

SEQ ID NO: 3151414 - protein, 17 aa, Giardia lamblia
DKGIVCIDELDKMNETD

SEQ ID NO: 3151415 - protein, 20 aa, Giardia lamblia
DKHGRSSLFSAAEVGNTTAI

SEQ ID NO: 3151416 - protein, 19 aa, Giardia lamblia
DKIGQMLHNLMIFSISYDN

SEQ ID NO: 3151417 - protein, 19 aa, Giardia lamblia
DKIHSRGTGPITMLTRQPT

SEQ ID NO: 3151418 - protein, 25 aa, Giardia lamblia
DKIKLPEQCQAALNDIRKVVYFWNE

SEQ ID NO: 3151419 - protein, 18 aa, Giardia lamblia
DKIPKLFVDYEISQKVKL

SEQ ID NO: 3151420 - protein, 33 aa, Giardia lamblia
DKITALWLHKPECLTAFLKLMFSTETTLQYDDL

SEQ ID NO: 3151421 - protein, 20 aa, Giardia lamblia
DKITELYDRIRALTDELHLA

SEQ ID NO: 3151422 - protein, 17 aa, Giardia lamblia
DKKAAVVYVPYPMLQSF

SEQ ID NO: 3151423 - protein, 29 aa, Giardia lamblia
DKKLRIGRLKRKQELEVSVVEAQFEEERL

SEQ ID NO: 3151424 - protein, 17 aa, Giardia lamblia
DKKNKICAYKHDNESMF

SEQ ID NO: 3151425 - protein, 25 aa, Giardia lamblia
DKKSHIRIGLVGKYVELRDAYISVY

SEQ ID NO: 3151426 - protein, 22 aa, Giardia lamblia
DKKVPEHIVHQGAAFLQTPLGR

SEQ ID NO: 3151427 - protein, 29 aa, Giardia lamblia
DKLFEVDKHIGICISGIYADAYKMLRLLR

SEQ ID NO: 3151428 - protein, 17 aa, Giardia lamblia
DKLGPACILALPPEPAR

SEQ ID NO: 3151429 - protein, 32 aa, Giardia lamblia
DKLKDQFRLSFPERYLDRLSFDKSETFDKRLM

SEQ ID NO: 3151430 - protein, 19 aa, Giardia lamblia
DKLKSCTKQAALLEAQLSE

SEQ ID NO: 3151431 - protein, 23 aa, Giardia lamblia
DKLLEILAFKQGRLLKGGEPDTR

SEQ ID NO: 3151432 - protein, 18 aa, Giardia lamblia
DKLRFWTPGIAFTETNDP

SEQ ID NO: 3151433 - protein, 17 aa, Giardia lamblia
DKLRQDNRVMAMELTEL

SEQ ID NO: 3151434 - protein, 19 aa, Giardia lamblia
DKLRTGFVSKDNFARAFVI

SEQ ID NO: 3151435 - protein, 19 aa, Giardia lamblia
DKLYEDIKFLSDERAQLNV

SEQ ID NO: 3151436 - protein, 25 aa, Giardia lamblia
DKMQWLRTAWESFVVDGATLLRRAL

SEQ ID NO: 3151437 - protein, 23 aa, Giardia lamblia
DKNGRNALYLAIAVNNMETALAL

SEQ ID NO: 3151438 - protein, 25 aa, Giardia lamblia
DKNPKLRVVVMSATIAAASFVRYFG

SEQ ID NO: 3151439 - protein, 19 aa, Giardia lamblia
DKPHAVITCPAYFNNDQRR

SEQ ID NO: 3151440 - protein, 18 aa, Giardia lamblia
DKPSIPVRFYPNGIFIKR

SEQ ID NO: 3151441 - protein, 20 aa, Giardia lamblia
DKPVRLIEMGPRYTLELIKI

SEQ ID NO: 3151442 - protein, 19 aa, Giardia lamblia
DKQAISLLKMMLKMDPAER

SEQ ID NO: 3151443 - protein, 18 aa, Giardia lamblia
DKQCKIDQILYVMIDDSV

SEQ ID NO: 3151444 - protein, 25 aa, Giardia lamblia
DKQYIVISCHPYRSVGVCIMNQPID

SEQ ID NO: 3151445 - protein, 19 aa, Giardia lamblia
DKRFKIVNILAEHEKGIRD

SEQ ID NO: 3151446 - protein, 23 aa, Giardia lamblia
DKRGYTALMYACIFGDINCILQL

SEQ ID NO: 3151447 - protein, 25 aa, Giardia lamblia
DKRMGAPALISWSPRCTVFRAVPQT

SEQ ID NO: 3151448 - protein, 22 aa, Giardia lamblia
DKRPQPLIFNFFKPSKSKQEGD

SEQ ID NO: 3151449 - protein, 18 aa, Giardia lamblia
DKRTEMSLVPGMPSYAIF

SEQ ID NO: 3151450 - protein, 23 aa, Giardia lamblia
DKRYVNLLVSYLCTQENLRQSAN

SEQ ID NO: 3151451 - protein, 23 aa, Giardia lamblia
DKSGWTAMIWAAQRCAYWCMKLL

SEQ ID NO: 3151452 - protein, 20 aa, Giardia lamblia
DKSNMLWSGYMQKIIEIIDD

SEQ ID NO: 3151453 - protein, 20 aa, Giardia lamblia
DKSRPRTPPMCGPKRSTADP

SEQ ID NO: 3151454 - protein, 17 aa, Giardia lamblia
DKTEHWVAACSEEEARR

SEQ ID NO: 3151455 - protein, 24 aa, Giardia lamblia
DKTVRAQHSFSMFMVPSTDNAIMA

SEQ ID NO: 3151456 - protein, 23 aa, Giardia lamblia
DKVANFLSIMGFNPSSQGYTFAV

SEQ ID NO: 3151457 - protein, 27 aa, Giardia lamblia
DKVDMQFTLCKRISGLIHMLPEPSPKE

SEQ ID NO: 3151458 - protein, 24 aa, Giardia lamblia
DKVSEVCKLGRDREHLGPGSYNDT

SEQ ID NO: 3151459 - protein, 23 aa, Giardia lamblia
DKVTELSRMIALKDAEISLLRKQ

SEQ ID NO: 3151460 - protein, 18 aa, Giardia lamblia
DKWTEAIDVWSVGCIAYH

SEQ ID NO: 3151461 - protein, 23 aa, Giardia lamblia
DKYDLVSGLSRPTSASSRSSSRA

SEQ ID NO: 3151462 - protein, 21 aa, Giardia lamblia
DKYEGWYCVADEAFVTETNLK

SEQ ID NO: 3151463 - protein, 24 aa, Giardia lamblia
DKYGETALMWAVRLNQVEMIHLLI

SEQ ID NO: 3151464 - protein, 18 aa, Giardia lamblia
DKYGRTALMLAAAAGRLD

SEQ ID NO: 3151465 - protein, 22 aa, Giardia lamblia
DKYLRARVESLVFDTDGSEEHV

SEQ ID NO: 3151466 - protein, 23 aa, Giardia lamblia
DKYYRLGAHGPAISIGTKYRTRR

SEQ ID NO: 3151467 - protein, 17 aa, Giardia lamblia
DLAAFGLGLRYADQEFR

SEQ ID NO: 3151468 - protein, 18 aa, Giardia lamblia
DLAECLIPLEACLQDGNG

SEQ ID NO: 3151469 - protein, 25 aa, Giardia lamblia
DLALCGRLMIIHCFEMVSRTIPYTK

SEQ ID NO: 3151470 - protein, 26 aa, Giardia lamblia
DLALENWPFPIGKISCHFSLHTDGQT

SEQ ID NO: 3151471 - protein, 24 aa, Giardia lamblia
DLALKYRIACAIGNDKLAYQALDG

SEQ ID NO: 3151472 - protein, 28 aa, Giardia lamblia
DLASLGIAKCPVCFVDNLINRERNKSAA

SEQ ID NO: 3151473 - protein, 27 aa, Giardia lamblia
DLCANLSKQGAFCYVVCNNILKGMSSL

SEQ ID NO: 3151474 - protein, 18 aa, Giardia lamblia
DLCDAIGMMLIKDPQRRP

SEQ ID NO: 3151475 - protein, 22 aa, Giardia lamblia
DLCSPQFKKLFAVLEYSHATVF

SEQ ID NO: 3151476 - protein, 28 aa, Giardia lamblia
DLCYSYHQGCFALFCYRGETGKQANRNA

SEQ ID NO: 3151477 - protein, 26 aa, Giardia lamblia
DLDAALSVVCGELFLQQHPDWLKAVV

SEQ ID NO: 3151478 - protein, 20 aa, Giardia lamblia
DLDAIGAYLLDHPTKGSFVT

SEQ ID NO: 3151479 - protein, 19 aa, Giardia lamblia
DLDALCAIMDNFYDDKIPI

SEQ ID NO: 3151480 - protein, 19 aa, Giardia lamblia
DLDEALKRRLEKRIYIPLP

SEQ ID NO: 3151481 - protein, 19 aa, Giardia lamblia
DLDGDTGLIKAVRGNDIEM

SEQ ID NO: 3151482 - protein, 41 aa, Giardia lamblia
DLDICQRIELVKAIIRFLYLPDFCHVCCRDKSSFGRQISNV

SEQ ID NO: 3151483 - protein, 26 aa, Giardia lamblia
DLDRDLLRAHWANIVSIIDVSYYTTL

SEQ ID NO: 3151484 - protein, 23 aa, Giardia lamblia
DLDTLRMLVPYSLNSSLPTNEDA

SEQ ID NO: 3151485 - protein, 17 aa, Giardia lamblia
DLEAFFRPEEERIVTCF

SEQ ID NO: 3151486 - protein, 25 aa, Giardia lamblia
DLEELPSLRFCPNLVNLDLSRNKLF

SEQ ID NO: 3151487 - protein, 19 aa, Giardia lamblia
DLEELRRIYEKEIPEASRS

SEQ ID NO: 3151488 - protein, 19 aa, Giardia lamblia
DLEGRALALLSLFVGCSLP

SEQ ID NO: 3151489 - protein, 25 aa, Giardia lamblia
DLEGRWHLVYDTTYLRRGISLLSYL

SEQ ID NO: 3151490 - protein, 18 aa, Giardia lamblia
DLEIRLLLEAGYDNTLSP

SEQ ID NO: 3151491 - protein, 20 aa, Giardia lamblia
DLEKHRFVLDFKIKELRKCI

SEQ ID NO: 3151492 - protein, 23 aa, Giardia lamblia
DLEKRPYVISNLGFILQLYQDHF

SEQ ID NO: 3151493 - protein, 23 aa, Giardia lamblia
DLEPGCIGLACACNGGGGGYAVC

SEQ ID NO: 3151494 - protein, 23 aa, Giardia lamblia
DLESLGRRSFCEEVVITIDPDTA

SEQ ID NO: 3151495 - protein, 25 aa, Giardia lamblia
DLESLLPRFVDSILKEEFTTAFQDN

SEQ ID NO: 3151496 - protein, 24 aa, Giardia lamblia
DLETFKACLRRLACNCLNIREEQI

SEQ ID NO: 3151497 - protein, 28 aa, Giardia lamblia
DLETSLVIPRMDMVKHLEQSADLLGSLA

SEQ ID NO: 3151498 - protein, 21 aa, Giardia lamblia
DLEVERCSSDLFPQSSTLLSS

SEQ ID NO: 3151499 - protein, 24 aa, Giardia lamblia
DLEYNKIRMRVMKIPRQQVPAPVP

SEQ ID NO: 3151500 - protein, 19 aa, Giardia lamblia
DLFLFETREAILGNRDKAE

SEQ ID NO: 3151501 - protein, 19 aa, Giardia lamblia
DLFLVKMLVRYEHSITTKA

SEQ ID NO: 3151502 - protein, 30 aa, Giardia lamblia
DLGALLRLDFFCILARLLLNTELLSPEMTK

SEQ ID NO: 3151503 - protein, 18 aa, Giardia lamblia
DLGCSLASTPARLQTHHP

SEQ ID NO: 3151504 - protein, 24 aa, Giardia lamblia
DLGEGRATVEISRMSPVAQIIIDI

SEQ ID NO: 3151505 - protein, 20 aa, Giardia lamblia
DLGEIFRRNLAMRNKSVRSA

SEQ ID NO: 3151506 - protein, 20 aa, Giardia lamblia
DLGKFTWREPGAIPKSMKIH

SEQ ID NO: 3151507 - protein, 18 aa, Giardia lamblia
DLGMTALMHAARTQSLDV

SEQ ID NO: 3151508 - protein, 19 aa, Giardia lamblia
DLGTPRAFRLVNNSEADGI

SEQ ID NO: 3151509 - protein, 19 aa, Giardia lamblia
DLHAIRLLLPYAAGIPDKN

SEQ ID NO: 3151510 - protein, 21 aa, Giardia lamblia
DLHDLKEGLLHLQDTLSRTIE

SEQ ID NO: 3151511 - protein, 25 aa, Giardia lamblia
DLHGRCLFHPILLGKKVPIVLDDVL

SEQ ID NO: 3151512 - protein, 23 aa, Giardia lamblia
DLHGRTALMYAARAGHKDCVRGL

SEQ ID NO: 3151513 - protein, 26 aa, Giardia lamblia
DLIAKIRIGEPLVLIAVKLSDQTIAV

SEQ ID NO: 3151514 - protein, 27 aa, Giardia lamblia
DLIECARLAAREGYRQIASWLDNWLLT

SEQ ID NO: 3151515 - protein, 24 aa, Giardia lamblia
DLIEGLVSRLVRWYNITYNHVRLP

SEQ ID NO: 3151516 - protein, 22 aa, Giardia lamblia
DLIELIKSVTLRSIKPKSIGAS

SEQ ID NO: 3151517 - protein, 17 aa, Giardia lamblia
DLIFNYLKAYHVLDEII

SEQ ID NO: 3151518 - protein, 24 aa, Giardia lamblia
DLIFRWSTSITILPVFVPIASYDT

SEQ ID NO: 3151519 - protein, 22 aa, Giardia lamblia
DLIKAFFKRDLSIKVRGEEGYL

SEQ ID NO: 3151520 - protein, 18 aa, Giardia lamblia
DLIKLGYFSLHQVLGSNS

SEQ ID NO: 3151521 - protein, 17 aa, Giardia lamblia
DLIKRLISKEACPEEIY

SEQ ID NO: 3151522 - protein, 38 aa, Giardia lamblia
DLIMELKRALLIKIREIYKIKLGLGIVNTVQDEILKSD

SEQ ID NO: 3151523 - protein, 22 aa, Giardia lamblia
DLIPRPLASMQSFLMKDILDKL

SEQ ID NO: 3151524 - protein, 19 aa, Giardia lamblia
DLIRFCLNSTQSRRTIIID

SEQ ID NO: 3151525 - protein, 21 aa, Giardia lamblia
DLIRLRGIVAHQAYDQDTGGK

SEQ ID NO: 3151526 - protein, 17 aa, Giardia lamblia
DLISEFLVAQGISMKVS

SEQ ID NO: 3151527 - protein, 19 aa, Giardia lamblia
DLKAAVVARLCLRPLEAAT

SEQ ID NO: 3151528 - protein, 20 aa, Giardia lamblia
DLKARLLGRRDYTGDTALIY

SEQ ID NO: 3151529 - protein, 25 aa, Giardia lamblia
DLKDVKHLNIWGSELRDVSVLRELI

SEQ ID NO: 3151530 - protein, 22 aa, Giardia lamblia
DLKEVLPALIKTVSRATTDRHW

SEQ ID NO: 3151531 - protein, 23 aa, Giardia lamblia
DLKFKLSSIHFYKLRELYKRTSG

SEQ ID NO: 3151532 - protein, 24 aa, Giardia lamblia
DLKKTQFSPSDWREEQRVGDAELL

SEQ ID NO: 3151533 - protein, 21 aa, Giardia lamblia
DLKLAESIERIELVKQIKAML

SEQ ID NO: 3151534 - protein, 24 aa, Giardia lamblia
DLKRNYWCPWSQFVKPYTPPSDGR

SEQ ID NO: 3151535 - protein, 23 aa, Giardia lamblia
DLKSLCSSLSYSNLVDGLLAVTW

SEQ ID NO: 3151536 - protein, 20 aa, Giardia lamblia
DLKSPGLLFYFTSESHLHGL

SEQ ID NO: 3151537 - protein, 18 aa, Giardia lamblia
DLKTGKVKPEYIVSTEPL

SEQ ID NO: 3151538 - protein, 27 aa, Giardia lamblia
DLLASCSKLAATVICCPEALSQQLIAE

SEQ ID NO: 3151539 - protein, 25 aa, Giardia lamblia
DLLAVLPASCFDLCRKLLEFDPESR

SEQ ID NO: 3151540 - protein, 22 aa, Giardia lamblia
DLLCNLRQILPNVVDRDIASYM

SEQ ID NO: 3151541 - protein, 17 aa, Giardia lamblia
DLLEIRKTPGLLLTDDQ

SEQ ID NO: 3151542 - protein, 25 aa, Giardia lamblia
DLLERRLDFAGGFDDDGRTALMICV

SEQ ID NO: 3151543 - protein, 20 aa, Giardia lamblia
DLLGLPKFGAIGVHKTILDA

SEQ ID NO: 3151544 - protein, 29 aa, Giardia lamblia
DLLHVFKARISPCYVAPAGPFRSPMVATA

SEQ ID NO: 3151545 - protein, 24 aa, Giardia lamblia
DLLISPNYHPWISNPINKSLHRPS

SEQ ID NO: 3151546 - protein, 22 aa, Giardia lamblia
DLLKQRKCGLFGEPDIEGHEEE

SEQ ID NO: 3151547 - protein, 26 aa, Giardia lamblia
DLLKRFLEHVPLPIFIRYLGANHSNY

SEQ ID NO: 3151548 - protein, 20 aa, Giardia lamblia
DLLLPRMPIQTIKESTSSTR

SEQ ID NO: 3151549 - protein, 18 aa, Giardia lamblia
DLLLWIYAEMQSRTVKFV

SEQ ID NO: 3151550 - protein, 26 aa, Giardia lamblia
DLLNEAARALPPLSPYVDNGLNADLE

SEQ ID NO: 3151551 - protein, 26 aa, Giardia lamblia
DLLNFTARLSGIAQYNAIYSSLIPIL

SEQ ID NO: 3151552 - protein, 18 aa, Giardia lamblia
DLLNGCLTRDSLQRLLNG

SEQ ID NO: 3151553 - protein, 19 aa, Giardia lamblia
DLLNQRIYNLLSENAALKK

SEQ ID NO: 3151554 - protein, 18 aa, Giardia lamblia
DLLPRFIARLDAHGEMAR

SEQ ID NO: 3151555 - protein, 20 aa, Giardia lamblia
DLLRDICAHIFDIVLVGSSY

SEQ ID NO: 3151556 - protein, 18 aa, Giardia lamblia
DLLRLLLERYELLSQNGS

SEQ ID NO: 3151557 - protein, 30 aa, Giardia lamblia
DLLRLSAKGKLDFVYALPCTVTHLSAVHVD

SEQ ID NO: 3151558 - protein, 27 aa, Giardia lamblia
DLLSFRPRTAPAFGMLPLHSPAHLRLL

SEQ ID NO: 3151559 - protein, 19 aa, Giardia lamblia
DLLSSYGFINICMQSDFGP

SEQ ID NO: 3151560 - protein, 18 aa, Giardia lamblia
DLMAVKALLPLQGGQKAT

SEQ ID NO: 3151561 - protein, 19 aa, Giardia lamblia
DLNATLSAIAARQDEILKE

SEQ ID NO: 3151562 - protein, 22 aa, Giardia lamblia
DLNCQLLDLGTRFSGMQTEMKT

SEQ ID NO: 3151563 - protein, 23 aa, Giardia lamblia
DLNDPIRRLYLLYLSQQADITEV

SEQ ID NO: 3151564 - protein, 27 aa, Giardia lamblia
DLNEWLAVNVYEFFESIQLIYSTCEKV

SEQ ID NO: 3151565 - protein, 26 aa, Giardia lamblia
DLNLPKAVWLPALFNPQSFLRAVLQS

SEQ ID NO: 3151566 - protein, 22 aa, Giardia lamblia
DLNQLKFNIVVSGTPGSGVTTL

SEQ ID NO: 3151567 - protein, 17 aa, Giardia lamblia
DLPDRLQNVLAKGAPSQ

SEQ ID NO: 3151568 - protein, 19 aa, Giardia lamblia
DLPIGVWTESYREEIETWV

SEQ ID NO: 3151569 - protein, 23 aa, Giardia lamblia
DLPKWRAVPDEQYAALKTNARSP

SEQ ID NO: 3151570 - protein, 18 aa, Giardia lamblia
DLPPCPICSHHPTNKHEL

SEQ ID NO: 3151571 - protein, 36 aa, Giardia lamblia
DLPPEYNGRISVFQKLLLVRCLREDRTMLAVNEYII

SEQ ID NO: 3151572 - protein, 27 aa, Giardia lamblia
DLPPLRLFLQYIMHLHSTYKLAADRWV

SEQ ID NO: 3151573 - protein, 24 aa, Giardia lamblia
DLPRLNSHLETRAYMAGFVPSLND

SEQ ID NO: 3151574 - protein, 18 aa, Giardia lamblia
DLPRRKAQFYLYIGCTYF

SEQ ID NO: 3151575 - protein, 21 aa, Giardia lamblia
DLPTSYRIVERRGRTLINDLL

SEQ ID NO: 3151576 - protein, 25 aa, Giardia lamblia
DLQASDGKTAWLIAFDGGFKEVLDQ

SEQ ID NO: 3151577 - protein, 20 aa, Giardia lamblia
DLQCKSRFRDVDALKAQIKE

SEQ ID NO: 3151578 - protein, 24 aa, Giardia lamblia
DLQDLYLYMCSTIAGHPFFCELQH

SEQ ID NO: 3151579 - protein, 18 aa, Giardia lamblia
DLQDNWVIANKSFQPYDR

SEQ ID NO: 3151580 - protein, 20 aa, Giardia lamblia
DLQERVSFIRSWTVEGVPKV

SEQ ID NO: 3151581 - protein, 24 aa, Giardia lamblia
DLQPPSCLPSIGSHRGTRNAATSD

SEQ ID NO: 3151582 - protein, 20 aa, Giardia lamblia
DLRALGLIYPLVIDTCVLYQ

SEQ ID NO: 3151583 - protein, 20 aa, Giardia lamblia
DLRDNCPRNLGSVDIDVAIS

SEQ ID NO: 3151584 - protein, 21 aa, Giardia lamblia
DLREFAKKRLVGYSLECPPFY

SEQ ID NO: 3151585 - protein, 21 aa, Giardia lamblia
DLREVIRMRVNPVALDTDPES

SEQ ID NO: 3151586 - protein, 20 aa, Giardia lamblia
DLRFTFHSLMKCCGTLGSGN

SEQ ID NO: 3151587 - protein, 24 aa, Giardia lamblia
DLRLMSNCLMQYAIVHGTMQKQWF

SEQ ID NO: 3151588 - protein, 19 aa, Giardia lamblia
DLRNCNFMSMFSSETMDTT

SEQ ID NO: 3151589 - protein, 21 aa, Giardia lamblia
DLRNLIKQKLIGMSEPASSGQ

SEQ ID NO: 3151590 - protein, 21 aa, Giardia lamblia
DLRPVPLLNFVASHTTYFSGQ

SEQ ID NO: 3151591 - protein, 19 aa, Giardia lamblia
DLRRAFLLLQTYQYASSKK

SEQ ID NO: 3151592 - protein, 27 aa, Giardia lamblia
DLRSRMWKRMHEWRIFEDRLMVSSWID

SEQ ID NO: 3151593 - protein, 25 aa, Giardia lamblia
DLRVELRPAWAQTIDFSKAAYDLPG

SEQ ID NO: 3151594 - protein, 28 aa, Giardia lamblia
DLRVSPHLMPVLYCHTGEQGKNLTYLEV

SEQ ID NO: 3151595 - protein, 17 aa, Giardia lamblia
DLRWERKMSHCYIPEYR

SEQ ID NO: 3151596 - protein, 18 aa, Giardia lamblia
DLSAHKSFMLNEDRKFVI

SEQ ID NO: 3151597 - protein, 27 aa, Giardia lamblia
DLSDIEWRWLYRHGIDKFYRSRTRNEL

SEQ ID NO: 3151598 - protein, 25 aa, Giardia lamblia
DLSEIQYRLHLGLRYKAKGDRTLDP

SEQ ID NO: 3151599 - protein, 24 aa, Giardia lamblia
DLSGRTALMYAAKRSAVNCLKILD

SEQ ID NO: 3151600 - protein, 25 aa, Giardia lamblia
DLSKSQVPVADWAVDALLSKCINQS

SEQ ID NO: 3151601 - protein, 24 aa, Giardia lamblia
DLSNRLREVLTIIEAKACRISIKQ

SEQ ID NO: 3151602 - protein, 36 aa, Giardia lamblia
DLSSLIKCYRVLPEDWTRFLIAEIILGLEGLHSIGY

SEQ ID NO: 3151603 - protein, 25 aa, Giardia lamblia
DLTEPEILRRISVLNRSINNAVAAN

SEQ ID NO: 3151604 - protein, 20 aa, Giardia lamblia
DLTIAFGVAKRASLASMTEL

SEQ ID NO: 3151605 - protein, 19 aa, Giardia lamblia
DLTKYTDLHTFKFDHVFNE

SEQ ID NO: 3151606 - protein, 39 aa, Giardia lamblia
DLTLLGLFCQYITKYSYRVIYFSPELICKKGADASSTST

SEQ ID NO: 3151607 - protein, 23 aa, Giardia lamblia
DLTLSVTDLANWNLYLKQEAFYT

SEQ ID NO: 3151608 - protein, 18 aa, Giardia lamblia
DLTRVSIINANFFLLSML

SEQ ID NO: 3151609 - protein, 21 aa, Giardia lamblia
DLTSHRVCLELPLYRKNIRAL

SEQ ID NO: 3151610 - protein, 19 aa, Giardia lamblia
DLTSRIEILIREASDRVAE

SEQ ID NO: 3151611 - protein, 18 aa, Giardia lamblia
DLVARAQIQGAKLLEADS

SEQ ID NO: 3151612 - protein, 25 aa, Giardia lamblia
DLVDALDFLIEYVRYGEEGHASTWT

SEQ ID NO: 3151613 - protein, 19 aa, Giardia lamblia
DLVDEVNAFIGAKMLRRNL

SEQ ID NO: 3151614 - protein, 17 aa, Giardia lamblia
DLVDLLREVRCDKKAEL

SEQ ID NO: 3151615 - protein, 24 aa, Giardia lamblia
DLVDLRKMETEWLIDTKATKEENA

SEQ ID NO: 3151616 - protein, 19 aa, Giardia lamblia
DLVDRCFAQPGTISYQVLD

SEQ ID NO: 3151617 - protein, 20 aa, Giardia lamblia
DLVIGGGFGDLVVTVPWRLE

SEQ ID NO: 3151618 - protein, 25 aa, Giardia lamblia
DLVNGLLFKVRRTRISYELWLHKEP

SEQ ID NO: 3151619 - protein, 18 aa, Giardia lamblia
DLVVSKGRVGRAICILKG

SEQ ID NO: 3151620 - protein, 17 aa, Giardia lamblia
DLYRLLVAFDVKQPFFS

SEQ ID NO: 3151621 - protein, 20 aa, Giardia lamblia
DLYVDFPFLPLLDIIDVSSS

SEQ ID NO: 3151622 - protein, 19 aa, Giardia lamblia
DMACCTQLLLYEMSADTHA

SEQ ID NO: 3151623 - protein, 20 aa, Giardia lamblia
DMALIKSVCNKFNDMEELSR

SEQ ID NO: 3151624 - protein, 24 aa, Giardia lamblia
DMAQIMLMYCHFMDTHVVHIYSAT

SEQ ID NO: 3151625 - protein, 18 aa, Giardia lamblia
DMDFLRAHYIDWSQIVDF

SEQ ID NO: 3151626 - protein, 20 aa, Giardia lamblia
DMDRRLKQVINHTGEGDVVE

SEQ ID NO: 3151627 - protein, 25 aa, Giardia lamblia
DMEVKRLLEHANILRAEHMASLTRA

SEQ ID NO: 3151628 - protein, 22 aa, Giardia lamblia
DMFHAKYGRLDTESELEKRIIK

SEQ ID NO: 3151629 - protein, 20 aa, Giardia lamblia
DMFISFGGLIAKLQAPAFRL

SEQ ID NO: 3151630 - protein, 32 aa, Giardia lamblia
DMGPWCLRATLELRLLQIVLHGVHTFQECESD

SEQ ID NO: 3151631 - protein, 19 aa, Giardia lamblia
DMHVRMLFNFYEKLGQREA

SEQ ID NO: 3151632 - protein, 20 aa, Giardia lamblia
DMIFGQIVLRDPIFETTSQQ

SEQ ID NO: 3151633 - protein, 19 aa, Giardia lamblia
DMIIRKGGGCIVLSRSSHV

SEQ ID NO: 3151634 - protein, 21 aa, Giardia lamblia
DMKIPFHNLWVVKTNQAVMQS

SEQ ID NO: 3151635 - protein, 26 aa, Giardia lamblia
DMLDWYRLGIQFSHRSGLSGPGGVVS

SEQ ID NO: 3151636 - protein, 17 aa, Giardia lamblia
DMLHKQWALETVEDNAD

SEQ ID NO: 3151637 - protein, 18 aa, Giardia lamblia
DMLKGCGPTSEFNGTGTG

SEQ ID NO: 3151638 - protein, 26 aa, Giardia lamblia
DMLYWIRKALLKTFGIKIKDSDSEQT

SEQ ID NO: 3151639 - protein, 27 aa, Giardia lamblia
DMMQHHNLCPRRARSEHAAMCSPAMSQ

SEQ ID NO: 3151640 - protein, 24 aa, Giardia lamblia
DMMREDRLSAIMTGFIELNSRVDQ

SEQ ID NO: 3151641 - protein, 19 aa, Giardia lamblia
DMPEPRAYEYPPRGENPLY

SEQ ID NO: 3151642 - protein, 23 aa, Giardia lamblia
DMQARGHPPKDILSQVLHLTLDV

SEQ ID NO: 3151643 - protein, 21 aa, Giardia lamblia
DMQIQELLAIISQLNKSNEAL

SEQ ID NO: 3151644 - protein, 25 aa, Giardia lamblia
DMRFWSCNRPGTLLHDIFHHSGDHT

SEQ ID NO: 3151645 - protein, 21 aa, Giardia lamblia
DMRHADCFVILQSQGRGSSDP

SEQ ID NO: 3151646 - protein, 22 aa, Giardia lamblia
DMRRCMEADKGLLRPDLVIFLD

SEQ ID NO: 3151647 - protein, 26 aa, Giardia lamblia
DMSADWWAFGVLIYEMLTGSPPFFDD

SEQ ID NO: 3151648 - protein, 26 aa, Giardia lamblia
DMSARLGKTCKLEFLTFDDPRAREVF

SEQ ID NO: 3151649 - protein, 23 aa, Giardia lamblia
DMSKIFDLTVAFAQSQLMNNINE

SEQ ID NO: 3151650 - protein, 27 aa, Giardia lamblia
DMSMQCKAIERMSRFVSMESSSYSDST

SEQ ID NO: 3151651 - protein, 24 aa, Giardia lamblia
DMTNRLSFENLLYWKDLAANVKSA

SEQ ID NO: 3151652 - protein, 20 aa, Giardia lamblia
DMVRTHCDLVDSIYEQEDLI

SEQ ID NO: 3151653 - protein, 18 aa, Giardia lamblia
DMVVNFLRDHMSEVHNAE

SEQ ID NO: 3151654 - protein, 20 aa, Giardia lamblia
DMYSNAYVKIFNGFQTHQVN

SEQ ID NO: 3151655 - protein, 21 aa, Giardia lamblia
DMYTAISCLRRHVLEVDARTN

SEQ ID NO: 3151656 - protein, 22 aa, Giardia lamblia
DNADMIIPLSIEDPVSKATISH

SEQ ID NO: 3151657 - protein, 18 aa, Giardia lamblia
DNADSCRALERFCEQQDA

SEQ ID NO: 3151658 - protein, 23 aa, Giardia lamblia
DNAIKVLVRKGFTEVDAHDLVSS

SEQ ID NO: 3151659 - protein, 20 aa, Giardia lamblia
DNAILPKIRKLGILLDGKLN

SEQ ID NO: 3151660 - protein, 18 aa, Giardia lamblia
DNAIMFFADHYTKKINKG

SEQ ID NO: 3151661 - protein, 25 aa, Giardia lamblia
DNALKEIAEAVSLLEGLKERLSALE

SEQ ID NO: 3151662 - protein, 28 aa, Giardia lamblia
DNARTNYWRIWAKTVVQGPVGFSSINKA

SEQ ID NO: 3151663 - protein, 20 aa, Giardia lamblia
DNAYRPERVSAHHEHYSEPG

SEQ ID NO: 3151664 - protein, 26 aa, Giardia lamblia
DNCKRLCREWDAFIAATGCLVRAFVS

SEQ ID NO: 3151665 - protein, 25 aa, Giardia lamblia
DNDLRYNYRAEFSFQDKRVKYSDAL

SEQ ID NO: 3151666 - protein, 25 aa, Giardia lamblia
DNDRLHILRAIRFNAELKLQAIQLA

SEQ ID NO: 3151667 - protein, 25 aa, Giardia lamblia
DNDTRKALEAAGFFRDEAASARQQS

SEQ ID NO: 3151668 - protein, 24 aa, Giardia lamblia
DNEEGFLFKCKRDRKVINVNPTAV

SEQ ID NO: 3151669 - protein, 24 aa, Giardia lamblia
DNEIAQLKGLLSFQNQRLPLSTAR

SEQ ID NO: 3151670 - protein, 20 aa, Giardia lamblia
DNERLVMLAHPLKTDQSNKQ

SEQ ID NO: 3151671 - protein, 18 aa, Giardia lamblia
DNFARAFVIANMEKITDA

SEQ ID NO: 3151672 - protein, 22 aa, Giardia lamblia
DNFEWIQKLSVHLRVIGQGFAK

SEQ ID NO: 3151673 - protein, 20 aa, Giardia lamblia
DNGKRTALDIARQLGQKKII

SEQ ID NO: 3151674 - protein, 22 aa, Giardia lamblia
DNGSGMCKAGFAGDDAPRAVFP

SEQ ID NO: 3151675 - protein, 25 aa, Giardia lamblia
DNHLKGRTALMFACRKNHLNCVFPL

SEQ ID NO: 3151676 - protein, 26 aa, Giardia lamblia
DNIGKTALMAAAFCGHLQVVRFLLSC

SEQ ID NO: 3151677 - protein, 23 aa, Giardia lamblia
DNIKRLSVSKAQILSLQMNMQLA

SEQ ID NO: 3151678 - protein, 20 aa, Giardia lamblia
DNINGIKLLLPHESGMHDRY

SEQ ID NO: 3151679 - protein, 18 aa, Giardia lamblia
DNIPRIQRSLSIKQDSAG

SEQ ID NO: 3151680 - protein, 17 aa, Giardia lamblia
DNIVWSAIRPCVFVLAF

SEQ ID NO: 3151681 - protein, 19 aa, Giardia lamblia
DNKALFLEVEHLRMVASFV

SEQ ID NO: 3151682 - protein, 20 aa, Giardia lamblia
DNKCSLCELLSLEGTEKTLR

SEQ ID NO: 3151683 - protein, 24 aa, Giardia lamblia
DNKKLATGALWLSRTFSFVSTLMC

SEQ ID NO: 3151684 - protein, 24 aa, Giardia lamblia
DNKRYITIPVLTGFLTQCEVVADD

SEQ ID NO: 3151685 - protein, 22 aa, Giardia lamblia
DNKVPFLVHERLSTAASGRSCN

SEQ ID NO: 3151686 - protein, 24 aa, Giardia lamblia
DNLARSSLYLDNGEPYLVSSQQHA

SEQ ID NO: 3151687 - protein, 18 aa, Giardia lamblia
DNLAVKWNEFLSKRNGAY

SEQ ID NO: 3151688 - protein, 25 aa, Giardia lamblia
DNLCRRLVVVGIPFPNLGDPIVREK

SEQ ID NO: 3151689 - protein, 23 aa, Giardia lamblia
DNLFRLTQILTFELVSRSLNSGD

SEQ ID NO: 3151690 - protein, 20 aa, Giardia lamblia
DNLFTDAELQWMSPGLLLQR

SEQ ID NO: 3151691 - protein, 25 aa, Giardia lamblia
DNLGILRLLLTRDFTMEQVLQALRT

SEQ ID NO: 3151692 - protein, 25 aa, Giardia lamblia
DNLKLSDFGSCRGIHTQLPYTEYIS

SEQ ID NO: 3151693 - protein, 19 aa, Giardia lamblia
DNLLMCFTVAQLKKRRLEF

SEQ ID NO: 3151694 - protein, 25 aa, Giardia lamblia
DNLLPRLLCAGGFLKTYILPNSNKH

SEQ ID NO: 3151695 - protein, 25 aa, Giardia lamblia
DNLLRAKRFITCFMDDDVVEAKDKS

SEQ ID NO: 3151696 - protein, 51 aa, Giardia lamblia
DNLMQCLRPSMTSSFFQEGLRIVADFVARILRFQPLTTLLAIYKAIIGLYC

SEQ ID NO: 3151697 - protein, 25 aa, Giardia lamblia
DNLSCLVCATAWPAPYIAYIHDGVK

SEQ ID NO: 3151698 - protein, 18 aa, Giardia lamblia
DNMRLVNVLTDYLRENEI

SEQ ID NO: 3151699 - protein, 25 aa, Giardia lamblia
DNMTAFKRLLALEGAHLTKKNILPL

SEQ ID NO: 3151700 - protein, 18 aa, Giardia lamblia
DNNGCTALSCAARAGHRD

SEQ ID NO: 3151701 - protein, 18 aa, Giardia lamblia
DNNIPSCVLDIFDSAVPH

SEQ ID NO: 3151702 - protein, 20 aa, Giardia lamblia
DNNLRSGLREAIAVPIQIED

SEQ ID NO: 3151703 - protein, 23 aa, Giardia lamblia
DNNPEMVQMFLSYAGIYDSMKMT

SEQ ID NO: 3151704 - protein, 24 aa, Giardia lamblia
DNNSVCCFEHLMTAFTNIPNSYIN

SEQ ID NO: 3151705 - protein, 20 aa, Giardia lamblia
DNPAARVLIDISRVQDETVG

SEQ ID NO: 3151706 - protein, 19 aa, Giardia lamblia
DNPCGFLKNYFDPAKTTCK

SEQ ID NO: 3151707 - protein, 23 aa, Giardia lamblia
DNPRAAKLLSRLTVFKKDTEEFK

SEQ ID NO: 3151708 - protein, 24 aa, Giardia lamblia
DNPRRLHDLRELVADLPTILARLT

SEQ ID NO: 3151709 - protein, 22 aa, Giardia lamblia
DNQGRTALTYAMEAGIPIDTCV

SEQ ID NO: 3151710 - protein, 24 aa, Giardia lamblia
DNQQGYCLYPKMIAVYVSVLDSKY

SEQ ID NO: 3151711 - protein, 22 aa, Giardia lamblia
DNSELERLLCVISEKDRELVSL

SEQ ID NO: 3151712 - protein, 23 aa, Giardia lamblia
DNSKLVFRRELLESADSVALKTE

SEQ ID NO: 3151713 - protein, 24 aa, Giardia lamblia
DNSPCGRLLIRGDYTSQTSCILQD

SEQ ID NO: 3151714 - protein, 24 aa, Giardia lamblia
DNSPFPEERIWAIISQILQSLAYL

SEQ ID NO: 3151715 - protein, 17 aa, Giardia lamblia
DNSSAFLPLEFNALTTI

SEQ ID NO: 3151716 - protein, 24 aa, Giardia lamblia
DNTGCTALSYAARAGHRDVTMLLM

SEQ ID NO: 3151717 - protein, 23 aa, Giardia lamblia
DNTGRTALHYAIFAASSPCIRLL

SEQ ID NO: 3151718 - protein, 22 aa, Giardia lamblia
DNVDQVRFLLPMHGGETTTKGI

SEQ ID NO: 3151719 - protein, 20 aa, Giardia lamblia
DNWGTTALMMACMRGHDTIV

SEQ ID NO: 3151720 - protein, 19 aa, Giardia lamblia
DNYGWSALMFAARDSNIPM

SEQ ID NO: 3151721 - protein, 22 aa, Giardia lamblia
DPALCDAGFLAKFVANSINYEP

SEQ ID NO: 3151722 - protein, 21 aa, Giardia lamblia
DPALMRPGRCDVKIEIRLPDP

SEQ ID NO: 3151723 - protein, 20 aa, Giardia lamblia
DPASGFPVEVEASVTGANLE

SEQ ID NO: 3151724 - protein, 18 aa, Giardia lamblia
DPASQLTQMKVCDSVVSL

SEQ ID NO: 3151725 - protein, 24 aa, Giardia lamblia
DPASVQMLLEFGCDPLMADDEGQT

SEQ ID NO: 3151726 - protein, 17 aa, Giardia lamblia
DPAYEFAYNRIAEQLDG

SEQ ID NO: 3151727 - protein, 24 aa, Giardia lamblia
DPAYRVLLSRCEDLGGKLLESRKQ

SEQ ID NO: 3151728 - protein, 25 aa, Giardia lamblia
DPCLDGHAYRRCLSGFLTAELSCSP

SEQ ID NO: 3151729 - protein, 22 aa, Giardia lamblia
DPDADCTVEFSCQQKNAPQELS

SEQ ID NO: 3151730 - protein, 26 aa, Giardia lamblia
DPDELCPASPTLRNAAQRKGVGKGNR

SEQ ID NO: 3151731 - protein, 19 aa, Giardia lamblia
DPDGIEWVSCHITERVAGG

SEQ ID NO: 3151732 - protein, 34 aa, Giardia lamblia
DPDLSKPMEVLRCIGNLLSICFPQVEASSTAFRR

SEQ ID NO: 3151733 - protein, 20 aa, Giardia lamblia
DPDMYKLVTIQSGTLGVDES

SEQ ID NO: 3151734 - protein, 20 aa, Giardia lamblia
DPDNRHAFCNYIHMKQILGI

SEQ ID NO: 3151735 - protein, 17 aa, Giardia lamblia
DPDPSKRPTAWDIAEQS

SEQ ID NO: 3151736 - protein, 23 aa, Giardia lamblia
DPDVLRKFARDFAKESPPPHKLR

SEQ ID NO: 3151737 - protein, 23 aa, Giardia lamblia
DPEEFERRIDLRTFTLLLDRMEG

SEQ ID NO: 3151738 - protein, 23 aa, Giardia lamblia
DPEKRLTVREALLHPYFDCIREK

SEQ ID NO: 3151739 - protein, 23 aa, Giardia lamblia
DPEPVIPMRAHLRPFKSHFEPGY

SEQ ID NO: 3151740 - protein, 24 aa, Giardia lamblia
DPETDCIMETSCARELQSTNQSQF

SEQ ID NO: 3151741 - protein, 27 aa, Giardia lamblia
DPEVARRIYRCPAYRTLARAGVLSTTG

SEQ ID NO: 3151742 - protein, 18 aa, Giardia lamblia
DPEVPLKYITKAIDACGY

SEQ ID NO: 3151743 - protein, 23 aa, Giardia lamblia
DPEYLPDMSRFCSEHRKYKPELY

SEQ ID NO: 3151744 - protein, 23 aa, Giardia lamblia
DPFAGVCSNLFIPFSQALYKTLQ

SEQ ID NO: 3151745 - protein, 22 aa, Giardia lamblia
DPFCFKNYLGKYECKLCGTRHV

SEQ ID NO: 3151746 - protein, 20 aa, Giardia lamblia
DPFMVFCHLGQVGLVDNDGF

SEQ ID NO: 3151747 - protein, 19 aa, Giardia lamblia
DPFPTRDICQIDNKSDAFS

SEQ ID NO: 3151748 - protein, 19 aa, Giardia lamblia
DPFSYASLDIERRIREMKA

SEQ ID NO: 3151749 - protein, 26 aa, Giardia lamblia
DPGFFDYLKTLSWRQLELYAPKEGTI

SEQ ID NO: 3151750 - protein, 31 aa, Giardia lamblia
DPGKSYPFGYLWRFSYKVIPSYLADKSEADL

SEQ ID NO: 3151751 - protein, 18 aa, Giardia lamblia
DPGKYFPIDEGYLQRLQY

SEQ ID NO: 3151752 - protein, 21 aa, Giardia lamblia
DPGNCVYCLDGLRDNIYPYIV

SEQ ID NO: 3151753 - protein, 20 aa, Giardia lamblia
DPGYELCLPLADISDDTQAL

SEQ ID NO: 3151754 - protein, 24 aa, Giardia lamblia
DPIASCALGPVAASRLLTELAAEA

SEQ ID NO: 3151755 - protein, 23 aa, Giardia lamblia
DPIHLRPLETITRAHRSTKDTQQ

SEQ ID NO: 3151756 - protein, 40 aa, Giardia lamblia
DPILGSWAKGVICAHVQGWKGRRMARSLITPRDVLPLTEM

SEQ ID NO: 3151757 - protein, 21 aa, Giardia lamblia
DPILRKYGLNKNVLLALESIN

SEQ ID NO: 3151758 - protein, 23 aa, Giardia lamblia
DPIMPKPPSFSLKSRTTQESQNT

SEQ ID NO: 3151759 - protein, 18 aa, Giardia lamblia
DPIPCGANGVLPAIPYPV

SEQ ID NO: 3151760 - protein, 23 aa, Giardia lamblia
DPKCAGPLGAILDQNTLLIIDEA

SEQ ID NO: 3151761 - protein, 20 aa, Giardia lamblia
DPKDVFPLSPAGTGRLSKDL

SEQ ID NO: 3151762 - protein, 19 aa, Giardia lamblia
DPKLLIKRLKAENKALKEE

SEQ ID NO: 3151763 - protein, 21 aa, Giardia lamblia
DPKMCSLCENIIRQKNLSGSI

SEQ ID NO: 3151764 - protein, 24 aa, Giardia lamblia
DPLAYVIFCACLDRKNLLEAVKAY

SEQ ID NO: 3151765 - protein, 20 aa, Giardia lamblia
DPLLTRIFFTIAKCYKNYKI

SEQ ID NO: 3151766 - protein, 17 aa, Giardia lamblia
DPLPRYLVVKPPDSTHN

SEQ ID NO: 3151767 - protein, 17 aa, Giardia lamblia
DPLRALLKHVPRSMQTM

SEQ ID NO: 3151768 - protein, 18 aa, Giardia lamblia
DPLRRPAEIHARENKIYK

SEQ ID NO: 3151769 - protein, 17 aa, Giardia lamblia
DPLTGLQKQYGFVDVGT

SEQ ID NO: 3151770 - protein, 19 aa, Giardia lamblia
DPMEHGIHISEYICQLAQK

SEQ ID NO: 3151771 - protein, 26 aa, Giardia lamblia
DPNGIPLPCCPIISPRYFIYPISPDL

SEQ ID NO: 3151772 - protein, 17 aa, Giardia lamblia
DPPEKWMPNPDSVLSEF

SEQ ID NO: 3151773 - protein, 23 aa, Giardia lamblia
DPPISCKFIESFMQGNHYCIVME

SEQ ID NO: 3151774 - protein, 25 aa, Giardia lamblia
DPPYKGSRGDFEWYSYAQVYKMTVE

SEQ ID NO: 3151775 - protein, 20 aa, Giardia lamblia
DPQAALTIGDQVYLTVDDTG

SEQ ID NO: 3151776 - protein, 28 aa, Giardia lamblia
DPQGAIFYLAFLLRTAVDPLYIARRLII

SEQ ID NO: 3151777 - protein, 24 aa, Giardia lamblia
DPQLLLIHECQLFQAVLNEVSKGN

SEQ ID NO: 3151778 - protein, 24 aa, Giardia lamblia
DPQSAVVGSIFPLAEYAVSIDLSP

SEQ ID NO: 3151779 - protein, 22 aa, Giardia lamblia
DPQSSLFLLPRLMRAAHTNSTE

SEQ ID NO: 3151780 - protein, 21 aa, Giardia lamblia
DPRFNLPLVLPHIAKQNLKLC

SEQ ID NO: 3151781 - protein, 23 aa, Giardia lamblia
DPRLCDALRNLGLYEALPIQKLA

SEQ ID NO: 3151782 - protein, 19 aa, Giardia lamblia
DPRMNAICDTFRLVMAKPN

SEQ ID NO: 3151783 - protein, 28 aa, Giardia lamblia
DPRTRPDWREIFNYPWIASRVALVDEAG

SEQ ID NO: 3151784 - protein, 25 aa, Giardia lamblia
DPSAEFLVFLGLPCLDQALHPCMLS

SEQ ID NO: 3151785 - protein, 26 aa, Giardia lamblia
DPSGESFQKILLILANVTRSMNPASQ

SEQ ID NO: 3151786 - protein, 22 aa, Giardia lamblia
DPSHVKPEWKLFKEYATPSCIA

SEQ ID NO: 3151787 - protein, 21 aa, Giardia lamblia
DPSQCCTGYSFGQELHMKGVP

SEQ ID NO: 3151788 - protein, 19 aa, Giardia lamblia
DPSVFTFDCFNGVIEGHNN

SEQ ID NO: 3151789 - protein, 29 aa, Giardia lamblia
DPSVLCCICNVRLSSYVFYPCRHVCACSV

SEQ ID NO: 3151790 - protein, 29 aa, Giardia lamblia
DPSVSCSCKVEFVRYLLSAVMSDEEIRAN

SEQ ID NO: 3151791 - protein, 24 aa, Giardia lamblia
DPSVSFRASLAFNSAVIPDASSLS

SEQ ID NO: 3151792 - protein, 26 aa, Giardia lamblia
DPTALRRSHLPYPMQAQMLTKETEHQ

SEQ ID NO: 3151793 - protein, 23 aa, Giardia lamblia
DPTELTILGSFCEHLAHNLAMPV

SEQ ID NO: 3151794 - protein, 26 aa, Giardia lamblia
DPTGDFKANVAFISRLRLTVDKLSKA

SEQ ID NO: 3151795 - protein, 20 aa, Giardia lamblia
DPTGRTALIIAIEKGIVNMV

SEQ ID NO: 3151796 - protein, 17 aa, Giardia lamblia
DPTLSRVNTVLADSTMS

SEQ ID NO: 3151797 - protein, 25 aa, Giardia lamblia
DPTTCHPTKFVARLTAHTWCIEQKS

SEQ ID NO: 3151798 - protein, 27 aa, Giardia lamblia
DPVFPYACSMCRARYKTERGLKAHIAR

SEQ ID NO: 3151799 - protein, 20 aa, Giardia lamblia
DPVLLAYSFSMQTIGPAVLD

SEQ ID NO: 3151800 - protein, 25 aa, Giardia lamblia
DPVTRAHILLVEYAHDWLAHEKRSI

SEQ ID NO: 3151801 - protein, 25 aa, Giardia lamblia
DPVVSPLIRCVKSWASARGLCNTWQ

SEQ ID NO: 3151802 - protein, 24 aa, Giardia lamblia
DPWLDSRIGAMAFLPPEVLTSSTL

SEQ ID NO: 3151803 - protein, 28 aa, Giardia lamblia
DPWVPPPKCRPHRCLGAALSIATSILQS

SEQ ID NO: 3151804 - protein, 26 aa, Giardia lamblia
DPYGDRWYRDFTVRILPVEWKVAKQS

SEQ ID NO: 3151805 - protein, 19 aa, Giardia lamblia
DPYHRKRIAISDLLISPYL

SEQ ID NO: 3151806 - protein, 19 aa, Giardia lamblia
DPYRLVRQLGQMGLEAYNR

SEQ ID NO: 3151807 - protein, 19 aa, Giardia lamblia
DQALHPCMLSGDVFQKSMC

SEQ ID NO: 3151808 - protein, 17 aa, Giardia lamblia
DQCDIVAARYSNFEAAK

SEQ ID NO: 3151809 - protein, 26 aa, Giardia lamblia
DQDGFFPLHRLMRIAPKTLDAQLFIK

SEQ ID NO: 3151810 - protein, 23 aa, Giardia lamblia
DQDKRPTIFDVIVHPLIVSAAES

SEQ ID NO: 3151811 - protein, 34 aa, Giardia lamblia
DQDMRCEMCKGRLFKNGFCNTCGNVAQVSNNGSS

SEQ ID NO: 3151812 - protein, 37 aa, Giardia lamblia
DQDPSVLCPGHLGVVKFGYDIFHPMIIDDLATLMNCF

SEQ ID NO: 3151813 - protein, 25 aa, Giardia lamblia
DQEFSPRPQRALTRNTEECQSKYKE

SEQ ID NO: 3151814 - protein, 21 aa, Giardia lamblia
DQEILRLQTLLVQLSSHMKLK

SEQ ID NO: 3151815 - protein, 20 aa, Giardia lamblia
DQEVKRGAFVPAPGAYDAYT

SEQ ID NO: 3151816 - protein, 25 aa, Giardia lamblia
DQGDIVAAYCFKDQYYSSNINGMTP

SEQ ID NO: 3151817 - protein, 19 aa, Giardia lamblia
DQGELRHELGVLKKANDDQ

SEQ ID NO: 3151818 - protein, 23 aa, Giardia lamblia
DQHHPFLLCFHGANNVTGTYWAK

SEQ ID NO: 3151819 - protein, 23 aa, Giardia lamblia
DQHHPFLLCFHGINNVTGTYWAK

SEQ ID NO: 3151820 - protein, 29 aa, Giardia lamblia
DQIDFSVTILTRFDLVFMLKDKQSPERDA

SEQ ID NO: 3151821 - protein, 22 aa, Giardia lamblia
DQIGSFLLKLFLERPPQERTYR

SEQ ID NO: 3151822 - protein, 18 aa, Giardia lamblia
DQIIPYNPNFRVYLVTSL

SEQ ID NO: 3151823 - protein, 25 aa, Giardia lamblia
DQIKLCELRQFIVSMFVPEEYQRSI

SEQ ID NO: 3151824 - protein, 24 aa, Giardia lamblia
DQISELQGAVTMFRMERDEATSRL

SEQ ID NO: 3151825 - protein, 17 aa, Giardia lamblia
DQLFKIFEVLGLPDDTT

SEQ ID NO: 3151826 - protein, 20 aa, Giardia lamblia
DQLGKICELLGMPPNDMIFK

SEQ ID NO: 3151827 - protein, 27 aa, Giardia lamblia
DQLKIHSGPVFRLSSITSLEHTQNGEA

SEQ ID NO: 3151828 - protein, 23 aa, Giardia lamblia
DQLKLADFGFCRTIGLDTMAQTK

SEQ ID NO: 3151829 - protein, 18 aa, Giardia lamblia
DQLKRFSNVYVLCTTNLI

SEQ ID NO: 3151830 - protein, 22 aa, Giardia lamblia
DQLYREFEGFKASDDVITSQAT

SEQ ID NO: 3151831 - protein, 26 aa, Giardia lamblia
DQMSLLRWNPLYGYESCQLQHDPDCL

SEQ ID NO: 3151832 - protein, 22 aa, Giardia lamblia
DQNFPAAISVLLKYEAGLCNDD

SEQ ID NO: 3151833 - protein, 19 aa, Giardia lamblia
DQPGRRLPLGLGEDRETFT

SEQ ID NO: 3151834 - protein, 30 aa, Giardia lamblia
DQPKCDDFFFGFVYRSKYVLLLYHHNLKNL

SEQ ID NO: 3151835 - protein, 19 aa, Giardia lamblia
DQQAIAFLPKRCINETCRS

SEQ ID NO: 3151836 - protein, 29 aa, Giardia lamblia
DQRLDVLLQVKWCLKEFDCDLTREAISLI

SEQ ID NO: 3151837 - protein, 21 aa, Giardia lamblia
DQRLMRCEAVIRRYRSRLVRW

SEQ ID NO: 3151838 - protein, 17 aa, Giardia lamblia
DQRRWQVYARLATGAQV

SEQ ID NO: 3151839 - protein, 24 aa, Giardia lamblia
DQSNRTALDYAVMSMKQGIVISLG

SEQ ID NO: 3151840 - protein, 18 aa, Giardia lamblia
DQVLPFPKLQTLNLSHNR

SEQ ID NO: 3151841 - protein, 27 aa, Giardia lamblia
DQVSLYYKHWLYFSNTGKLAMDPSTTS

SEQ ID NO: 3151842 - protein, 17 aa, Giardia lamblia
DQWHRLSLFKMRSDHTV

SEQ ID NO: 3151843 - protein, 23 aa, Giardia lamblia
DRAIETRGPYLLKKTTAEKNTLA

SEQ ID NO: 3151844 - protein, 28 aa, Giardia lamblia
DRARCNECVLFWKPGLQAPYQRWPARMI

SEQ ID NO: 3151845 - protein, 25 aa, Giardia lamblia
DRCLGLRLAYIFSELATNNYRIEEF

SEQ ID NO: 3151846 - protein, 19 aa, Giardia lamblia
DRCSEEYWPTAPHTHCLLI

SEQ ID NO: 3151847 - protein, 24 aa, Giardia lamblia
DREAGLCTNSKFTAGAGLTALMAA

SEQ ID NO: 3151848 - protein, 24 aa, Giardia lamblia
DREGRTALMRGARRGSLEACALLL

SEQ ID NO: 3151849 - protein, 22 aa, Giardia lamblia
DREKRRAREGLIQQASDGIVTA

SEQ ID NO: 3151850 - protein, 17 aa, Giardia lamblia
DREVIVTHEFYFKPEGD

SEQ ID NO: 3151851 - protein, 18 aa, Giardia lamblia
DREYIRMATLQPPETHYK

SEQ ID NO: 3151852 - protein, 28 aa, Giardia lamblia
DRFKEYDIEISRVFTMLLLFVKNQINLC

SEQ ID NO: 3151853 - protein, 18 aa, Giardia lamblia
DRFLDALLTRKAEKPVTD

SEQ ID NO: 3151854 - protein, 17 aa, Giardia lamblia
DRFLLQLIKTARSPPFL

SEQ ID NO: 3151855 - protein, 25 aa, Giardia lamblia
DRFLSPTDFCICKEGSIPTAVVGCN

SEQ ID NO: 3151856 - protein, 17 aa, Giardia lamblia
DRFLTLKSEIGHIYNVD

SEQ ID NO: 3151857 - protein, 19 aa, Giardia lamblia
DRFRECQSRLLKAEDKVKE

SEQ ID NO: 3151858 - protein, 23 aa, Giardia lamblia
DRFSKPGKPGFQIKYDRTPRDWT

SEQ ID NO: 3151859 - protein, 20 aa, Giardia lamblia
DRFTFVHWAAQYAKKSMAQQ

SEQ ID NO: 3151860 - protein, 22 aa, Giardia lamblia
DRFTHTQVLMFIFAVSSQERKL

SEQ ID NO: 3151861 - protein, 17 aa, Giardia lamblia
DRGCLARASGTYCLVVA

SEQ ID NO: 3151862 - protein, 18 aa, Giardia lamblia
DRGFGRCSIYRSVSTELN

SEQ ID NO: 3151863 - protein, 20 aa, Giardia lamblia
DRGISMAALGHWRSEQPGLW

SEQ ID NO: 3151864 - protein, 40 aa, Giardia lamblia
DRGKIHAKWCPAACVVLRPLARIILCDEFERLPQQHNDVA

SEQ ID NO: 3151865 - protein, 19 aa, Giardia lamblia
DRGLRRFDLQASLYDMAIP

SEQ ID NO: 3151866 - protein, 19 aa, Giardia lamblia
DRGMTALMYCVQYNAYETA

SEQ ID NO: 3151867 - protein, 21 aa, Giardia lamblia
DRGRIAYSIGGMLLDAVLGDL

SEQ ID NO: 3151868 - protein, 26 aa, Giardia lamblia
DRGYRPMRGYFNWTRDIAKEVPTTPD

SEQ ID NO: 3151869 - protein, 17 aa, Giardia lamblia
DRHCVAMDFTIYRCSIR

SEQ ID NO: 3151870 - protein, 26 aa, Giardia lamblia
DRIAILRMLDVMIKKFDMVIQNLKTL

SEQ ID NO: 3151871 - protein, 22 aa, Giardia lamblia
DRIANRKMYVLFEEQLKCNTKT

SEQ ID NO: 3151872 - protein, 20 aa, Giardia lamblia
DRIEKFCRPIGPNIKGIKDP

SEQ ID NO: 3151873 - protein, 18 aa, Giardia lamblia
DRIERGKSCVDIDLLTLH

SEQ ID NO: 3151874 - protein, 27 aa, Giardia lamblia
DRIFRYFDDMRYRVAVIHGDMTQKERE

SEQ ID NO: 3151875 - protein, 22 aa, Giardia lamblia
DRIGYCAGSYFLQLERYEEAAL

SEQ ID NO: 3151876 - protein, 19 aa, Giardia lamblia
DRIKCGSAAQSSFYRYYDP

SEQ ID NO: 3151877 - protein, 28 aa, Giardia lamblia
DRILNVDLPNMMCNFFGISTPQTKKGQK

SEQ ID NO: 3151878 - protein, 17 aa, Giardia lamblia
DRILYDMARIIITTVQA

SEQ ID NO: 3151879 - protein, 22 aa, Giardia lamblia
DRINSVTILTSFFEDFRVRDEL

SEQ ID NO: 3151880 - protein, 20 aa, Giardia lamblia
DRIQEEMKNSAALQERVDAL

SEQ ID NO: 3151881 - protein, 18 aa, Giardia lamblia
DRIQEYLADLGYQGVPEE

SEQ ID NO: 3151882 - protein, 20 aa, Giardia lamblia
DRIRHSIPSSHRFVTTEAST

SEQ ID NO: 3151883 - protein, 23 aa, Giardia lamblia
DRISSPCVDMWSLGCIVYELCTG

SEQ ID NO: 3151884 - protein, 20 aa, Giardia lamblia
DRKKLCWYRLIMQNKIATAE

SEQ ID NO: 3151885 - protein, 19 aa, Giardia lamblia
DRKMISWRSKEDAIANAHQ

SEQ ID NO: 3151886 - protein, 24 aa, Giardia lamblia
DRKRDAVVLVLDFLRAEGYVTALA

SEQ ID NO: 3151887 - protein, 21 aa, Giardia lamblia
DRKTVAKAMECCKNKETLAFL

SEQ ID NO: 3151888 - protein, 18 aa, Giardia lamblia
DRLEFIKHMFAFQNTLQE

SEQ ID NO: 3151889 - protein, 19 aa, Giardia lamblia
DRLIFVGDLHGCFETLIRL

SEQ ID NO: 3151890 - protein, 28 aa, Giardia lamblia
DRLIKFSGLLKKTCSTIVLRGASMHILD

SEQ ID NO: 3151891 - protein, 17 aa, Giardia lamblia
DRLIKFYRKSGHMFRNL

SEQ ID NO: 3151892 - protein, 32 aa, Giardia lamblia
DRLKLVQLESCIPFEFLTIMLRNQLVSFDGLS

SEQ ID NO: 3151893 - protein, 24 aa, Giardia lamblia
DRLMLRGGHKMEFTCVAHSDDTIY

SEQ ID NO: 3151894 - protein, 24 aa, Giardia lamblia
DRLMNCLKTALDVAAFESRPNALR

SEQ ID NO: 3151895 - protein, 17 aa, Giardia lamblia
DRLNPLLEWIDKQTDET

SEQ ID NO: 3151896 - protein, 34 aa, Giardia lamblia
DRLNRIRKAHLVFKAARLWPNSRQIPSFGELNPV

SEQ ID NO: 3151897 - protein, 17 aa, Giardia lamblia
DRLSDRYPKALLQTYSV

SEQ ID NO: 3151898 - protein, 20 aa, Giardia lamblia
DRLSEKIAHRESIQAEDLDK

SEQ ID NO: 3151899 - protein, 18 aa, Giardia lamblia
DRLSYCLSSPSVSHFLIS

SEQ ID NO: 3151900 - protein, 20 aa, Giardia lamblia
DRLTAFYAECEKAVRQASKH

SEQ ID NO: 3151901 - protein, 17 aa, Giardia lamblia
DRLVAITLPPANDLIQY

SEQ ID NO: 3151902 - protein, 19 aa, Giardia lamblia
DRLVDTPCILVTAEWGWTA

SEQ ID NO: 3151903 - protein, 19 aa, Giardia lamblia
DRMGRLVKRAGPSNKSTDS

SEQ ID NO: 3151904 - protein, 19 aa, Giardia lamblia
DRMKEEFFSILNLSEVRTG

SEQ ID NO: 3151905 - protein, 17 aa, Giardia lamblia
DRMKRIDFEQIKIENQT

SEQ ID NO: 3151906 - protein, 22 aa, Giardia lamblia
DRNLFYFAISFMKSLMQRDERG

SEQ ID NO: 3151907 - protein, 18 aa, Giardia lamblia
DRNLKAVKAFFYTPSSSP

SEQ ID NO: 3151908 - protein, 25 aa, Giardia lamblia
DRNNQYWWFCDKLGLRKPELYDFSR

SEQ ID NO: 3151909 - protein, 34 aa, Giardia lamblia
DRNPKSLMWRKILDVYILGCLKPVGGSSNKLDPR

SEQ ID NO: 3151910 - protein, 17 aa, Giardia lamblia
DRPECVRVLAEYESGHR

SEQ ID NO: 3151911 - protein, 17 aa, Giardia lamblia
DRPRGGVQMGSLGPQLD

SEQ ID NO: 3151912 - protein, 25 aa, Giardia lamblia
DRPSYKSTMSVKAFGDSKIGSISHS

SEQ ID NO: 3151913 - protein, 22 aa, Giardia lamblia
DRQKRDGMCWASEDELYNGGKA

SEQ ID NO: 3151914 - protein, 23 aa, Giardia lamblia
DRQVPIAVCILDMNIATDDLPGA

SEQ ID NO: 3151915 - protein, 18 aa, Giardia lamblia
DRRCKGFAPAGVSINAHE

SEQ ID NO: 3151916 - protein, 23 aa, Giardia lamblia
DRRELKRLPEEFVNELDTFEDIT

SEQ ID NO: 3151917 - protein, 17 aa, Giardia lamblia
DRRHLLGALSDEDISAI

SEQ ID NO: 3151918 - protein, 18 aa, Giardia lamblia
DRRLKRRQIREMSQELKV

SEQ ID NO: 3151919 - protein, 24 aa, Giardia lamblia
DRRRVKEMFCLTCNKVGRIGFRCE

SEQ ID NO: 3151920 - protein, 19 aa, Giardia lamblia
DRRSAELLEVYKVGTANAL

SEQ ID NO: 3151921 - protein, 17 aa, Giardia lamblia
DRRVVVLALAYQCLFSN

SEQ ID NO: 3151922 - protein, 27 aa, Giardia lamblia
DRRYPVKGCVVFRPYGFFMENAIMRLC

SEQ ID NO: 3151923 - protein, 18 aa, Giardia lamblia
DRSFVCGDDAVLILIPDG

SEQ ID NO: 3151924 - protein, 20 aa, Giardia lamblia
DRSGCTALMYAAEKGLTEIV

SEQ ID NO: 3151925 - protein, 21 aa, Giardia lamblia
DRSGRTPLDYSALSGQTHSLE

SEQ ID NO: 3151926 - protein, 24 aa, Giardia lamblia
DRSIMAQSLILSRSISRSSGSDNA

SEQ ID NO: 3151927 - protein, 22 aa, Giardia lamblia
DRSNLPVPLALQYQTLKEAQND

SEQ ID NO: 3151928 - protein, 25 aa, Giardia lamblia
DRSRPGISVVDPWGGAGHIIDSLVV

SEQ ID NO: 3151929 - protein, 18 aa, Giardia lamblia
DRSVVPASILPKTRTTEE

SEQ ID NO: 3151930 - protein, 25 aa, Giardia lamblia
DRTEACTLCRECIAAFTDEQNQCGI

SEQ ID NO: 3151931 - protein, 24 aa, Giardia lamblia
DRTFSSDVLVQWAARRPEAVAFAQ

SEQ ID NO: 3151932 - protein, 29 aa, Giardia lamblia
DRTLYLQTCIKVRHEVRYVVSILSAINQL

SEQ ID NO: 3151933 - protein, 21 aa, Giardia lamblia
DRTRLKAGMTLVTQKRTRDER

SEQ ID NO: 3151934 - protein, 25 aa, Giardia lamblia
DRTTKSGAVLDRFLQRELDLSDWDC

SEQ ID NO: 3151935 - protein, 30 aa, Giardia lamblia
DRVFFGKHKFCLATLPYTRVELGLELGSES

SEQ ID NO: 3151936 - protein, 21 aa, Giardia lamblia
DRVGLLFISLAGRLCGVDVTS

SEQ ID NO: 3151937 - protein, 21 aa, Giardia lamblia
DRVKRGLNMELYKRIKYSDGD

SEQ ID NO: 3151938 - protein, 25 aa, Giardia lamblia
DRVMLRKRVLPKWHVDEVIHPESGK

SEQ ID NO: 3151939 - protein, 20 aa, Giardia lamblia
DRVTNEIGMILLASQVHDMV

SEQ ID NO: 3151940 - protein, 22 aa, Giardia lamblia
DRWWTKNISALIFTYEGGSYAF

SEQ ID NO: 3151941 - protein, 23 aa, Giardia lamblia
DRYAANLLCCLKVIQRICASLLP

SEQ ID NO: 3151942 - protein, 21 aa, Giardia lamblia
DRYDCSLDVFLRERRHKGVPM

SEQ ID NO: 3151943 - protein, 24 aa, Giardia lamblia
DRYDDRWFLHKAWAHATKIKHPLP

SEQ ID NO: 3151944 - protein, 17 aa, Giardia lamblia
DRYKEAFLLHTDERGSL

SEQ ID NO: 3151945 - protein, 19 aa, Giardia lamblia
DRYLDFFIIKLVRSSDSMQ

SEQ ID NO: 3151946 - protein, 20 aa, Giardia lamblia
DRYNKTLGRLLIEHMQMKSP

SEQ ID NO: 3151947 - protein, 19 aa, Giardia lamblia
DSACTRCDGFVPGCAVCTP

SEQ ID NO: 3151948 - protein, 20 aa, Giardia lamblia
DSAEKAACCVFRGNEYLVLL

SEQ ID NO: 3151949 - protein, 28 aa, Giardia lamblia
DSAIRRRFEKRIEIVLPDAAARANIIKN

SEQ ID NO: 3151950 - protein, 22 aa, Giardia lamblia
DSAKAKPSWLNKNRVLKNDACS

SEQ ID NO: 3151951 - protein, 18 aa, Giardia lamblia
DSAKAVSILLEYSNNKAR

SEQ ID NO: 3151952 - protein, 24 aa, Giardia lamblia
DSALKLAQVELLRCRKVKEEFGDI

SEQ ID NO: 3151953 - protein, 23 aa, Giardia lamblia
DSANMRVLLSAILKDLAASRETI

SEQ ID NO: 3151954 - protein, 19 aa, Giardia lamblia
DSCFITRFTAGTFQAFAQA

SEQ ID NO: 3151955 - protein, 19 aa, Giardia lamblia
DSCPICLDGFMESDEEEIN

SEQ ID NO: 3151956 - protein, 18 aa, Giardia lamblia
DSCRDDRLTFTLHIADRD

SEQ ID NO: 3151957 - protein, 26 aa, Giardia lamblia
DSCRLLRTIWASAIVYNTVYYLGKTK

SEQ ID NO: 3151958 - protein, 26 aa, Giardia lamblia
DSCRYFESWFPASFMALINEKAEMMG

SEQ ID NO: 3151959 - protein, 18 aa, Giardia lamblia
DSDRMLAILERWELNQSG

SEQ ID NO: 3151960 - protein, 26 aa, Giardia lamblia
DSDSCDKSRCLLKLVGKPHSYTNRSS

SEQ ID NO: 3151961 - protein, 19 aa, Giardia lamblia
DSEKLILDVCNLIQEGFLQ

SEQ ID NO: 3151962 - protein, 17 aa, Giardia lamblia
DSERIVDGCLWKHQTSL

SEQ ID NO: 3151963 - protein, 19 aa, Giardia lamblia
DSFCSTDLSKLIEVLDHKT

SEQ ID NO: 3151964 - protein, 17 aa, Giardia lamblia
DSFHPQFGSITFLLCVS

SEQ ID NO: 3151965 - protein, 18 aa, Giardia lamblia
DSFQAVALNIEYLVLPDA

SEQ ID NO: 3151966 - protein, 17 aa, Giardia lamblia
DSFTKLRTSIICMEDEH

SEQ ID NO: 3151967 - protein, 23 aa, Giardia lamblia
DSGGRTALMYAVMGKQLDCAKDL

SEQ ID NO: 3151968 - protein, 24 aa, Giardia lamblia
DSGNLWFTRLYLPMQAGKVTTAGE

SEQ ID NO: 3151969 - protein, 27 aa, Giardia lamblia
DSGPTECQCRIALVSKLGVLGEHFIIS

SEQ ID NO: 3151970 - protein, 21 aa, Giardia lamblia
DSGSFAQKWRESFRASQVGPT

SEQ ID NO: 3151971 - protein, 20 aa, Giardia lamblia
DSGSTMMIWGDRSPSSLAQE

SEQ ID NO: 3151972 - protein, 28 aa, Giardia lamblia
DSGVGKSALLLRLCDKIFNASYITTIGV

SEQ ID NO: 3151973 - protein, 18 aa, Giardia lamblia
DSHFKHGLIFPEAEIWNV

SEQ ID NO: 3151974 - protein, 17 aa, Giardia lamblia
DSHKVLEFEQGYMQLQK

SEQ ID NO: 3151975 - protein, 24 aa, Giardia lamblia
DSHQRLEAAGLDRLHHGSTARTQK

SEQ ID NO: 3151976 - protein, 17 aa, Giardia lamblia
DSICNFYSERLRKLVQM

SEQ ID NO: 3151977 - protein, 18 aa, Giardia lamblia
DSICSALQGYLVSLGARS

SEQ ID NO: 3151978 - protein, 19 aa, Giardia lamblia
DSIDIMLIQAIALIDDTEK

SEQ ID NO: 3151979 - protein, 19 aa, Giardia lamblia
DSIGFKCMSTSLKVIDPTM

SEQ ID NO: 3151980 - protein, 34 aa, Giardia lamblia
DSIGGNCKTYLLACIRPEPEFLLDTISTLRFAQR

SEQ ID NO: 3151981 - protein, 24 aa, Giardia lamblia
DSIGGNCRTIMLATIAVETQNMNE

SEQ ID NO: 3151982 - protein, 18 aa, Giardia lamblia
DSIGRTPIYAPFDECSIV

SEQ ID NO: 3151983 - protein, 36 aa, Giardia lamblia
DSIIEAWPAPTFFLTDLRIKHMQAIPVTTQPERNNL

SEQ ID NO: 3151984 - protein, 18 aa, Giardia lamblia
DSIITLSGIQYAELLQSI

SEQ ID NO: 3151985 - protein, 22 aa, Giardia lamblia
DSILAIPAYDPFSGGYSLLSYP

SEQ ID NO: 3151986 - protein, 17 aa, Giardia lamblia
DSIQMSFSTLKVHNTAS

SEQ ID NO: 3151987 - protein, 20 aa, Giardia lamblia
DSIRLLGPREGKAFGKAARA

SEQ ID NO: 3151988 - protein, 17 aa, Giardia lamblia
DSIRVIIHRDVKPGNIM

SEQ ID NO: 3151989 - protein, 23 aa, Giardia lamblia
DSISFPEVVQFTGTQAKCTGLGL

SEQ ID NO: 3151990 - protein, 22 aa, Giardia lamblia
DSKALEIARLTAELEATRKECA

SEQ ID NO: 3151991 - protein, 28 aa, Giardia lamblia
DSKEIRKSIDLALRFLIKNSTHGEELLK

SEQ ID NO: 3151992 - protein, 20 aa, Giardia lamblia
DSKFRLILVESRIHRLARYY

SEQ ID NO: 3151993 - protein, 22 aa, Giardia lamblia
DSKISLKNIVQFVCDEADLIFD

SEQ ID NO: 3151994 - protein, 19 aa, Giardia lamblia
DSKLLPSIVREPFPESRRP

SEQ ID NO: 3151995 - protein, 20 aa, Giardia lamblia
DSKLTIFEWKFGKDRKPMLS

SEQ ID NO: 3151996 - protein, 25 aa, Giardia lamblia
DSKMAGKSILPWPERNREIANVEFV

SEQ ID NO: 3151997 - protein, 23 aa, Giardia lamblia
DSKRLASSYSDYFKKVLTDLSVP

SEQ ID NO: 3151998 - protein, 23 aa, Giardia lamblia
DSKYCSPLSVFPPVHAAKIRRLV

SEQ ID NO: 3151999 - protein, 18 aa, Giardia lamblia
DSKYIIVYLYKTWPYTLV

SEQ ID NO: 3152000 - protein, 19 aa, Giardia lamblia
DSLAALEEVILTGALPSHL

SEQ ID NO: 3152001 - protein, 24 aa, Giardia lamblia
DSLCYEIIIYFSIVGHQMTGHHTM

SEQ ID NO: 3152002 - protein, 17 aa, Giardia lamblia
DSLEHNRAYLLDIKYPK

SEQ ID NO: 3152003 - protein, 26 aa, Giardia lamblia
DSLFPIHSIHCRYWYVGQNGLCSEHS

SEQ ID NO: 3152004 - protein, 19 aa, Giardia lamblia
DSLGCSALVYAIKAEHIPS

SEQ ID NO: 3152005 - protein, 26 aa, Giardia lamblia
DSLGFDVCICTMPLPYDKEDWCKEEK

SEQ ID NO: 3152006 - protein, 17 aa, Giardia lamblia
DSLGRSSLQVILSSPRS

SEQ ID NO: 3152007 - protein, 26 aa, Giardia lamblia
DSLKKDLFEISSYCPNISKLKEILTN

SEQ ID NO: 3152008 - protein, 24 aa, Giardia lamblia
DSLKRLTIVLFSYLCENISDIRKR

SEQ ID NO: 3152009 - protein, 19 aa, Giardia lamblia
DSLLEYCHQILSFGNQEIY

SEQ ID NO: 3152010 - protein, 23 aa, Giardia lamblia
DSLLICSLINYTGSMSLLAKLDF

SEQ ID NO: 3152011 - protein, 24 aa, Giardia lamblia
DSLLKRALLEFEYGIASRSIIFKG

SEQ ID NO: 3152012 - protein, 23 aa, Giardia lamblia
DSLLSRYDLVFLVRDDHTMDAKI

SEQ ID NO: 3152013 - protein, 20 aa, Giardia lamblia
DSLLYRLPSPVLNERTRSKQ

SEQ ID NO: 3152014 - protein, 19 aa, Giardia lamblia
DSLNIVTLYGVFIQTGTGT

SEQ ID NO: 3152015 - protein, 17 aa, Giardia lamblia
DSLPYLTNVGLYYDASK

SEQ ID NO: 3152016 - protein, 20 aa, Giardia lamblia
DSLRKLRVMQVLSSDARKDL

SEQ ID NO: 3152017 - protein, 20 aa, Giardia lamblia
DSLSILRLSATRPVIGNEGT

SEQ ID NO: 3152018 - protein, 24 aa, Giardia lamblia
DSLWEIRCNQAMMRQHELEAEIHR

SEQ ID NO: 3152019 - protein, 19 aa, Giardia lamblia
DSMGMPFSTTFISPTATAM

SEQ ID NO: 3152020 - protein, 23 aa, Giardia lamblia
DSMHPARHCILFHENLAKETTSG

SEQ ID NO: 3152021 - protein, 19 aa, Giardia lamblia
DSMQTCIFETAKLLSQLPT

SEQ ID NO: 3152022 - protein, 18 aa, Giardia lamblia
DSMSTFFRNVDARGRDLG

SEQ ID NO: 3152023 - protein, 21 aa, Giardia lamblia
DSNGRTAMMFAAQNGHAKVVQ

SEQ ID NO: 3152024 - protein, 21 aa, Giardia lamblia
DSNMTMPACIGVMHITNNFSL

SEQ ID NO: 3152025 - protein, 28 aa, Giardia lamblia
DSNSCIFCNDCFNIPISLGEQGDNANTI

SEQ ID NO: 3152026 - protein, 21 aa, Giardia lamblia
DSPEAYIASALMQMSPGPCTI

SEQ ID NO: 3152027 - protein, 22 aa, Giardia lamblia
DSPMNARWGNFEVWMRQTYMPG

SEQ ID NO: 3152028 - protein, 25 aa, Giardia lamblia
DSPNSRSYLVPKFFDLAHTLGKSQS

SEQ ID NO: 3152029 - protein, 25 aa, Giardia lamblia
DSPRHILHAYVLFLERLAASGCVDY

SEQ ID NO: 3152030 - protein, 24 aa, Giardia lamblia
DSQFIRANCAVFRTATTTDGMTAL

SEQ ID NO: 3152031 - protein, 24 aa, Giardia lamblia
DSQFPRRFGSAWRHEGGISRDDFG

SEQ ID NO: 3152032 - protein, 32 aa, Giardia lamblia
DSQYAINCCRVWLTQWKKKGLLCPQNPNRKDI

SEQ ID NO: 3152033 - protein, 21 aa, Giardia lamblia
DSRGETALMFAAKANNPEAVR

SEQ ID NO: 3152034 - protein, 20 aa, Giardia lamblia
DSRGLSFIMRFHSDNGAITK

SEQ ID NO: 3152035 - protein, 21 aa, Giardia lamblia
DSRGRTALMIAAQKGNLEIVR

SEQ ID NO: 3152036 - protein, 19 aa, Giardia lamblia
DSRPTILSRNACASGAAPR

SEQ ID NO: 3152037 - protein, 21 aa, Giardia lamblia
DSRQLALRSAIIENLQSQLSI

SEQ ID NO: 3152038 - protein, 19 aa, Giardia lamblia
DSRTRYTVMKTLPDSVTVY

SEQ ID NO: 3152039 - protein, 18 aa, Giardia lamblia
DSSALAKVVFDVEKNITE

SEQ ID NO: 3152040 - protein, 19 aa, Giardia lamblia
DSSCAKVLEYLRSKIPHDH

SEQ ID NO: 3152041 - protein, 21 aa, Giardia lamblia
DSSCRIFKQKISEQGIDPDEL

SEQ ID NO: 3152042 - protein, 24 aa, Giardia lamblia
DSSFLRPWLHYFSRHQVPDAPAPS

SEQ ID NO: 3152043 - protein, 24 aa, Giardia lamblia
DSSGQMAIHIALHRGHYEVAEKLR

SEQ ID NO: 3152044 - protein, 23 aa, Giardia lamblia
DSSGRTALMYALDHDHSRCAKIL

SEQ ID NO: 3152045 - protein, 20 aa, Giardia lamblia
DSSKLPRNVHFGRVIEGPGE

SEQ ID NO: 3152046 - protein, 26 aa, Giardia lamblia
DSSMAMGLAHSFSRYRVKFNADSIDI

SEQ ID NO: 3152047 - protein, 25 aa, Giardia lamblia
DSSPENCKTCISVGVYDMGKPRWAS

SEQ ID NO: 3152048 - protein, 17 aa, Giardia lamblia
DSSRLSLFSRLKSSTSS

SEQ ID NO: 3152049 - protein, 27 aa, Giardia lamblia
DSSRSHAILQIALKYTKSGKEYSRISF

SEQ ID NO: 3152050 - protein, 24 aa, Giardia lamblia
DSSSRIPIQSVFIVPSTEGTRLAW

SEQ ID NO: 3152051 - protein, 28 aa, Giardia lamblia
DSSTVRLVFQRPGGKKCHEGRIEYMSCD

SEQ ID NO: 3152052 - protein, 18 aa, Giardia lamblia
DSTCSFLLSVAAFQSAFA

SEQ ID NO: 3152053 - protein, 25 aa, Giardia lamblia
DSTEACKLLMSFELDSILPDGRTPL

SEQ ID NO: 3152054 - protein, 21 aa, Giardia lamblia
DSTESMGLIIDRSRAATGASK

SEQ ID NO: 3152055 - protein, 20 aa, Giardia lamblia
DSTHALFSVILFKKDQQRCL

SEQ ID NO: 3152056 - protein, 24 aa, Giardia lamblia
DSTIEVPPTFGLILVSMCDIHIPP

SEQ ID NO: 3152057 - protein, 20 aa, Giardia lamblia
DSTLRELRRSSIILDTLTSS

SEQ ID NO: 3152058 - protein, 17 aa, Giardia lamblia
DSVAYKGHYISGSFLPT

SEQ ID NO: 3152059 - protein, 24 aa, Giardia lamblia
DSVCNKSRLVLCEMARQSLRLAFH

SEQ ID NO: 3152060 - protein, 23 aa, Giardia lamblia
DSVDAWVAFLNKYVGAVLEEVNG

SEQ ID NO: 3152061 - protein, 25 aa, Giardia lamblia
DSVDSFFTFLAQRVEALEGALSLLS

SEQ ID NO: 3152062 - protein, 23 aa, Giardia lamblia
DSVPHMISTVFIRGGNNMIIEEA

SEQ ID NO: 3152063 - protein, 26 aa, Giardia lamblia
DSVSITFRSACKAVEDMSVRLRVSKI

SEQ ID NO: 3152064 - protein, 23 aa, Giardia lamblia
DSVVCACDLIFLLDEPIMQLQDM

SEQ ID NO: 3152065 - protein, 20 aa, Giardia lamblia
DSVVSLKLVPKGAIDLATVD

SEQ ID NO: 3152066 - protein, 21 aa, Giardia lamblia
DSVWEPLFVGVFLRLDDTLRL

SEQ ID NO: 3152067 - protein, 17 aa, Giardia lamblia
DSYEMKQLLTLLRDTPG

SEQ ID NO: 3152068 - protein, 25 aa, Giardia lamblia
DSYGRFCFTDLFPAESGQMEGQTSQ

SEQ ID NO: 3152069 - protein, 20 aa, Giardia lamblia
DSYGRLASCIAIERGNTEFL

SEQ ID NO: 3152070 - protein, 19 aa, Giardia lamblia
DSYGRTAMMYATLNNEVEC

SEQ ID NO: 3152071 - protein, 18 aa, Giardia lamblia
DSYHFVGFFSKEKQQENS

SEQ ID NO: 3152072 - protein, 17 aa, Giardia lamblia
DSYRRFMQMFGDVCLGI

SEQ ID NO: 3152073 - protein, 25 aa, Giardia lamblia
DSYTKACIMVSLAYGHYQIAAYLLR

SEQ ID NO: 3152074 - protein, 23 aa, Giardia lamblia
DSYYNLRLKNCIEKSREGKCALS

SEQ ID NO: 3152075 - protein, 18 aa, Giardia lamblia
DTAKSIYCYLLLTREYIC

SEQ ID NO: 3152076 - protein, 19 aa, Giardia lamblia
DTALSLAVRAEMYDIARLL

SEQ ID NO: 3152077 - protein, 18 aa, Giardia lamblia
DTARSCLKINLPSKTVCT

SEQ ID NO: 3152078 - protein, 18 aa, Giardia lamblia
DTATFAKRIHAMVRVSLG

SEQ ID NO: 3152079 - protein, 24 aa, Giardia lamblia
DTAWLDGKHVVFGRVLDGMDVVKA

SEQ ID NO: 3152080 - protein, 24 aa, Giardia lamblia
DTCDELRPPSARFRGTDSLSGLES

SEQ ID NO: 3152081 - protein, 21 aa, Giardia lamblia
DTDCLLKYNIYAILEECCNRA

SEQ ID NO: 3152082 - protein, 18 aa, Giardia lamblia
DTDLRLTIKEDLFDLNKN

SEQ ID NO: 3152083 - protein, 25 aa, Giardia lamblia
DTEADRALASWLVSMYISSGQAEHS

SEQ ID NO: 3152084 - protein, 31 aa, Giardia lamblia
DTEFACLKYLPKPLETIPIRTEIGVEDTLQL

SEQ ID NO: 3152085 - protein, 26 aa, Giardia lamblia
DTEPELKRRGSLKVDDLAVSKAAEKQ

SEQ ID NO: 3152086 - protein, 22 aa, Giardia lamblia
DTEVKPMLAIGAAFFPNDSMDI

SEQ ID NO: 3152087 - protein, 24 aa, Giardia lamblia
DTFCDFPGIGIPLVSEEAFINDGI

SEQ ID NO: 3152088 - protein, 33 aa, Giardia lamblia
DTGFIALAFACLNLPSLVCLNLRDNFIGSKGGD

SEQ ID NO: 3152089 - protein, 25 aa, Giardia lamblia
DTGYCSSHLYLLRGVFGSGKSRVLT

SEQ ID NO: 3152090 - protein, 18 aa, Giardia lamblia
DTHMTALMVAARIGDIAN

SEQ ID NO: 3152091 - protein, 18 aa, Giardia lamblia
DTHRCVATALNLYTDGNV

SEQ ID NO: 3152092 - protein, 19 aa, Giardia lamblia
DTHSFKTALMAAAMGGHPH

SEQ ID NO: 3152093 - protein, 19 aa, Giardia lamblia
DTIELKSKLLAKETELEIL

SEQ ID NO: 3152094 - protein, 17 aa, Giardia lamblia
DTIKGPLALLFLALRAN

SEQ ID NO: 3152095 - protein, 20 aa, Giardia lamblia
DTIMLSRLVLLTCHELISSG

SEQ ID NO: 3152096 - protein, 18 aa, Giardia lamblia
DTIQRFPYAKAFLDLNEE

SEQ ID NO: 3152097 - protein, 18 aa, Giardia lamblia
DTIRAIAFVAQRVTAHAL

SEQ ID NO: 3152098 - protein, 24 aa, Giardia lamblia
DTIRYNPALKRLGIDVKQSRDMEA

SEQ ID NO: 3152099 - protein, 20 aa, Giardia lamblia
DTKEQCKALRDLYTETDSSC

SEQ ID NO: 3152100 - protein, 18 aa, Giardia lamblia
DTKIIKYLLQRFSFTEQE

SEQ ID NO: 3152101 - protein, 18 aa, Giardia lamblia
DTKLAFYFECDKAESTED

SEQ ID NO: 3152102 - protein, 19 aa, Giardia lamblia
DTKMVRFLLQNNARSYNDL

SEQ ID NO: 3152103 - protein, 23 aa, Giardia lamblia
DTKRLRESGIFSIQGVLMQTHKD

SEQ ID NO: 3152104 - protein, 18 aa, Giardia lamblia
DTKSGGFMRFVAVEQDGL

SEQ ID NO: 3152105 - protein, 18 aa, Giardia lamblia
DTLCAIGHGCSHIVLMGD

SEQ ID NO: 3152106 - protein, 17 aa, Giardia lamblia
DTLKRKIQVAIENKYPS

SEQ ID NO: 3152107 - protein, 23 aa, Giardia lamblia
DTLPDGRTALMLAAEAGSLESVQ

SEQ ID NO: 3152108 - protein, 22 aa, Giardia lamblia
DTLPSCISPSMLGLGITAGLSL

SEQ ID NO: 3152109 - protein, 21 aa, Giardia lamblia
DTLRSRFLLLKEVLDGDKDKV

SEQ ID NO: 3152110 - protein, 23 aa, Giardia lamblia
DTMKDGVLFTWAKYLFNKEDQSA

SEQ ID NO: 3152111 - protein, 18 aa, Giardia lamblia
DTMPDGKTAFMVAAHAGA

SEQ ID NO: 3152112 - protein, 20 aa, Giardia lamblia
DTMQRAAVQMGLIDQQQLKA

SEQ ID NO: 3152113 - protein, 27 aa, Giardia lamblia
DTMSAITFLDRFYKAMGAFLKEKELAG

SEQ ID NO: 3152114 - protein, 24 aa, Giardia lamblia
DTNGGGGICFLQFDAVPDNEREKP

SEQ ID NO: 3152115 - protein, 23 aa, Giardia lamblia
DTNLELPPEVTFEATRRASVAYQ

SEQ ID NO: 3152116 - protein, 24 aa, Giardia lamblia
DTNTAFECVVRFQRRNNLNNVDGS

SEQ ID NO: 3152117 - protein, 22 aa, Giardia lamblia
DTPCSSLQCEIRAIEAEIERNT

SEQ ID NO: 3152118 - protein, 17 aa, Giardia lamblia
DTPKNVFVEGWTPDLSE

SEQ ID NO: 3152119 - protein, 18 aa, Giardia lamblia
DTPLFGFEAMAKKDSHAK

SEQ ID NO: 3152120 - protein, 20 aa, Giardia lamblia
DTPPELPFDTWMVSEPVPAE

SEQ ID NO: 3152121 - protein, 31 aa, Giardia lamblia
DTPQIRMCLEEFRAFLLLCSSLQRVKLLLHG

SEQ ID NO: 3152122 - protein, 21 aa, Giardia lamblia
DTPRYVIPFFSLIDAVHCPPI

SEQ ID NO: 3152123 - protein, 26 aa, Giardia lamblia
DTQQATICMPEWLKLDRTRTYINNEM

SEQ ID NO: 3152124 - protein, 24 aa, Giardia lamblia
DTRCTSHSPMLFNRPVAPRPNSYN

SEQ ID NO: 3152125 - protein, 18 aa, Giardia lamblia
DTRFGVALKNMLEDRITF

SEQ ID NO: 3152126 - protein, 23 aa, Giardia lamblia
DTRLSELKEFYAIADQLQSSVNK

SEQ ID NO: 3152127 - protein, 20 aa, Giardia lamblia
DTRQIINYARNVFRSIRETR

SEQ ID NO: 3152128 - protein, 23 aa, Giardia lamblia
DTRRRLRVLGDFNRHTVGGALPA

SEQ ID NO: 3152129 - protein, 17 aa, Giardia lamblia
DTSGRTALMIAAANNQV

SEQ ID NO: 3152130 - protein, 33 aa, Giardia lamblia
DTSKTFPTYFLAGASLHTSWFINRLKALAYVSC

SEQ ID NO: 3152131 - protein, 24 aa, Giardia lamblia
DTTEEFDRIMSLDGQFRASKISPE

SEQ ID NO: 3152132 - protein, 19 aa, Giardia lamblia
DTVRKCLKETGSPQKAAFE

SEQ ID NO: 3152133 - protein, 32 aa, Giardia lamblia
DTVWDYKVDHGRRSWVHWNEVLPRGWRPNPAI

SEQ ID NO: 3152134 - protein, 17 aa, Giardia lamblia
DTWFKCAFVGDKDRMSS

SEQ ID NO: 3152135 - protein, 21 aa, Giardia lamblia
DTWFSSGLFPFSCFADSERDF

SEQ ID NO: 3152136 - protein, 24 aa, Giardia lamblia
DTWHEHLQVLPLSASFRTLSASLA

SEQ ID NO: 3152137 - protein, 23 aa, Giardia lamblia
DTWKLSAGEAIAYAKADLFVLVP

SEQ ID NO: 3152138 - protein, 26 aa, Giardia lamblia
DTWSHPLELFDIAALPNTLQFLSNYV

SEQ ID NO: 3152139 - protein, 23 aa, Giardia lamblia
DTYICAVIEFLGSRIDIMRIDSL

SEQ ID NO: 3152140 - protein, 27 aa, Giardia lamblia
DTYRGLRPLALAIFLKCYDMVRFFLQE

SEQ ID NO: 3152141 - protein, 23 aa, Giardia lamblia
DVAEEFVQLIPIYAQRLADLAQE

SEQ ID NO: 3152142 - protein, 24 aa, Giardia lamblia
DVAWHCWTIFLASNCGLDLSPFVE

SEQ ID NO: 3152143 - protein, 18 aa, Giardia lamblia
DVAYWKAQCELAKAQNAN

SEQ ID NO: 3152144 - protein, 20 aa, Giardia lamblia
DVCAVKENLHEKGRQDDAGI

SEQ ID NO: 3152145 - protein, 24 aa, Giardia lamblia
DVCHSGTVGACFEAANMGYHAISY

SEQ ID NO: 3152146 - protein, 21 aa, Giardia lamblia
DVCSLLRPREEAITHRSGASL

SEQ ID NO: 3152147 - protein, 25 aa, Giardia lamblia
DVCYKEIRRRTAYDFSDEDDDTIES

SEQ ID NO: 3152148 - protein, 19 aa, Giardia lamblia
DVDEALVFNHLIVLEDSQV

SEQ ID NO: 3152149 - protein, 22 aa, Giardia lamblia
DVDGETGLMLATRNSDMEMIRI

SEQ ID NO: 3152150 - protein, 22 aa, Giardia lamblia
DVDGKTALMYACERGHVQCARL

SEQ ID NO: 3152151 - protein, 27 aa, Giardia lamblia
DVEEICALLKAGIKYQYDHEEMKHLRT

SEQ ID NO: 3152152 - protein, 25 aa, Giardia lamblia
DVEIYEPCVLCLSKMVQYNNQAVLQ

SEQ ID NO: 3152153 - protein, 19 aa, Giardia lamblia
DVELARLVTPGFDTTKDQI

SEQ ID NO: 3152154 - protein, 18 aa, Giardia lamblia
DVERCFDKRMAPILCTLW

SEQ ID NO: 3152155 - protein, 19 aa, Giardia lamblia
DVESLKLLLTESSRCDEDG

SEQ ID NO: 3152156 - protein, 21 aa, Giardia lamblia
DVESPPQVTICLANAQRAADL

SEQ ID NO: 3152157 - protein, 22 aa, Giardia lamblia
DVESRTALQRILMLPVDDSNME

SEQ ID NO: 3152158 - protein, 17 aa, Giardia lamblia
DVFGRPAIIDKYKEYAD

SEQ ID NO: 3152159 - protein, 17 aa, Giardia lamblia
DVFRIEFQGSGVAVAKA

SEQ ID NO: 3152160 - protein, 25 aa, Giardia lamblia
DVFRKECIYHSGNLVAFDGSIIECG

SEQ ID NO: 3152161 - protein, 25 aa, Giardia lamblia
DVFTRLFCLSKMYVTRIGRIVFRLC

SEQ ID NO: 3152162 - protein, 25 aa, Giardia lamblia
DVGDSFDLVPVAAWMGTGKRTGVLG

SEQ ID NO: 3152163 - protein, 20 aa, Giardia lamblia
DVGLMLEPYSPLPIIEIPDI

SEQ ID NO: 3152164 - protein, 22 aa, Giardia lamblia
DVGRGRYALIRDLARQAHRLDH

SEQ ID NO: 3152165 - protein, 23 aa, Giardia lamblia
DVGRTALMYAAFLGNYAMAKRLL

SEQ ID NO: 3152166 - protein, 17 aa, Giardia lamblia
DVHGPVGAVSWGGGPAF

SEQ ID NO: 3152167 - protein, 25 aa, Giardia lamblia
DVIRECRSAAALERSISKGGEPTSI

SEQ ID NO: 3152168 - protein, 19 aa, Giardia lamblia
DVIRFYRKEHTQIEEDRIW

SEQ ID NO: 3152169 - protein, 19 aa, Giardia lamblia
DVIRPEFDSTVSIDSGRFA

SEQ ID NO: 3152170 - protein, 21 aa, Giardia lamblia
DVIYIAIDCTLFFARFPHSRP

SEQ ID NO: 3152171 - protein, 25 aa, Giardia lamblia
DVKFKIAEETIHFACKSGGNDYACK

SEQ ID NO: 3152172 - protein, 23 aa, Giardia lamblia
DVKIGRWPICKGTALMRAAARGH

SEQ ID NO: 3152173 - protein, 18 aa, Giardia lamblia
DVKIIGKLEVKRYEDSTT

SEQ ID NO: 3152174 - protein, 22 aa, Giardia lamblia
DVKLKRMCLAYNDIVLINTDNG

SEQ ID NO: 3152175 - protein, 19 aa, Giardia lamblia
DVKQSISIIQSERQINTKT

SEQ ID NO: 3152176 - protein, 26 aa, Giardia lamblia
DVLEAWIICQRQWLYLEGIFSGSEDL

SEQ ID NO: 3152177 - protein, 18 aa, Giardia lamblia
DVLFIWDVISGYKKYVPP

SEQ ID NO: 3152178 - protein, 27 aa, Giardia lamblia
DVLKASYKWICIVSVLRIRVGGETLLV

SEQ ID NO: 3152179 - protein, 17 aa, Giardia lamblia
DVLKSFSISELRSKRRA

SEQ ID NO: 3152180 - protein, 21 aa, Giardia lamblia
DVLNDIKLDPTVLLNKYMEGE

SEQ ID NO: 3152181 - protein, 27 aa, Giardia lamblia
DVLPMARLLKIPAHMEQILSSKDNKGT

SEQ ID NO: 3152182 - protein, 18 aa, Giardia lamblia
DVLPPAPMLTEFAPILPE

SEQ ID NO: 3152183 - protein, 18 aa, Giardia lamblia
DVLQILLDLAEFWENRSR

SEQ ID NO: 3152184 - protein, 17 aa, Giardia lamblia
DVLQRRGYTAGNVADSL

SEQ ID NO: 3152185 - protein, 23 aa, Giardia lamblia
DVLRCGCRLNLGCFVSSLHKQLA

SEQ ID NO: 3152186 - protein, 20 aa, Giardia lamblia
DVLRHTGLLLSKYKSGTLPK

SEQ ID NO: 3152187 - protein, 17 aa, Giardia lamblia
DVLRVAYQILRAVGIMH

SEQ ID NO: 3152188 - protein, 20 aa, Giardia lamblia
DVLWLTLMCHTHRAADLECY

SEQ ID NO: 3152189 - protein, 21 aa, Giardia lamblia
DVMAKFPLVLDKLLYRDLLSC

SEQ ID NO: 3152190 - protein, 24 aa, Giardia lamblia
DVMERAFCTLYHQIQLKADADQVR

SEQ ID NO: 3152191 - protein, 25 aa, Giardia lamblia
DVNPQVICLPTIHRYNSPQLLSSSR

SEQ ID NO: 3152192 - protein, 18 aa, Giardia lamblia
DVNRKGCNNIMAHVVGGG

SEQ ID NO: 3152193 - protein, 24 aa, Giardia lamblia
DVPDPEGLLPLELAVRTENFEATV

SEQ ID NO: 3152194 - protein, 17 aa, Giardia lamblia
DVPHKWPQIPPRFLCGY

SEQ ID NO: 3152195 - protein, 23 aa, Giardia lamblia
DVPIPCILCCNKIDSEAANAWYA

SEQ ID NO: 3152196 - protein, 21 aa, Giardia lamblia
DVPVIRWQHVVGMDNPSTTLL

SEQ ID NO: 3152197 - protein, 19 aa, Giardia lamblia
DVQILKTLAMIKARDPRIF

SEQ ID NO: 3152198 - protein, 24 aa, Giardia lamblia
DVRARAGQLLAHLASEYGFAPPGP

SEQ ID NO: 3152199 - protein, 17 aa, Giardia lamblia
DVRCRLIKKAFKGGNDE

SEQ ID NO: 3152200 - protein, 18 aa, Giardia lamblia
DVRDKKKNFIRFSFTPDY

SEQ ID NO: 3152201 - protein, 30 aa, Giardia lamblia
DVRIAKSLFPSLGYYYWFLGNVADTTILPK

SEQ ID NO: 3152202 - protein, 23 aa, Giardia lamblia
DVRILPCEHCDRGVDFVQTMLDL

SEQ ID NO: 3152203 - protein, 23 aa, Giardia lamblia
DVRLDPSVNVFVWSRGIRHVPRR

SEQ ID NO: 3152204 - protein, 19 aa, Giardia lamblia
DVRTGILIFVVPSICNKVS

SEQ ID NO: 3152205 - protein, 25 aa, Giardia lamblia
DVSAEKAALVNLKFLAMQENNESLA

SEQ ID NO: 3152206 - protein, 22 aa, Giardia lamblia
DVSCSIIEPGLVYYHYLDDLSK

SEQ ID NO: 3152207 - protein, 26 aa, Giardia lamblia
DVSDRRPRCAILLPTPAVLLLHTTLF

SEQ ID NO: 3152208 - protein, 26 aa, Giardia lamblia
DVSEARFKRMLSHLLPCLSKYCPEAS

SEQ ID NO: 3152209 - protein, 25 aa, Giardia lamblia
DVSEKEILNTPAFVEPQMATFIRIM

SEQ ID NO: 3152210 - protein, 26 aa, Giardia lamblia
DVSLLLDYAKEYGYDTIIQMLTEYDP

SEQ ID NO: 3152211 - protein, 17 aa, Giardia lamblia
DVSRLDDEFEVEREMTM

SEQ ID NO: 3152212 - protein, 22 aa, Giardia lamblia
DVSRLHPVLAPDVANAAVTTLI

SEQ ID NO: 3152213 - protein, 17 aa, Giardia lamblia
DVSRLPRSLEILCVSEG

SEQ ID NO: 3152214 - protein, 18 aa, Giardia lamblia
DVSTFCKKLLTMSTKELT

SEQ ID NO: 3152215 - protein, 24 aa, Giardia lamblia
DVTKRTSFEHCTEWLTELRNASAN

SEQ ID NO: 3152216 - protein, 24 aa, Giardia lamblia
DVTRSFCWGILPGIGVYSPLDTRI

SEQ ID NO: 3152217 - protein, 23 aa, Giardia lamblia
DVTYKSGIDLATFDDKSFDNYST

SEQ ID NO: 3152218 - protein, 18 aa, Giardia lamblia
DVVGRTALMHAVLSNNQP

SEQ ID NO: 3152219 - protein, 27 aa, Giardia lamblia
DVVNFKRIEAMLGIRMEPYTPDFSEAA

SEQ ID NO: 3152220 - protein, 24 aa, Giardia lamblia
DVVPDLPRSISLLSTQTSNEHQAL

SEQ ID NO: 3152221 - protein, 19 aa, Giardia lamblia
DVVSFLLQREATLLNNDGE

SEQ ID NO: 3152222 - protein, 27 aa, Giardia lamblia
DVYECLAPEFLVEPWGSSLRTYNFDIT

SEQ ID NO: 3152223 - protein, 20 aa, Giardia lamblia
DVYIVFNLLGLQAKLQDSEG

SEQ ID NO: 3152224 - protein, 19 aa, Giardia lamblia
DVYLKLNWPQSEWYTPCIT

SEQ ID NO: 3152225 - protein, 22 aa, Giardia lamblia
DWCARLCADIPPVAPSPLLAET

SEQ ID NO: 3152226 - protein, 24 aa, Giardia lamblia
DWDHIKAADLYVVLHSFLPATGKL

SEQ ID NO: 3152227 - protein, 19 aa, Giardia lamblia
DWEAPKLLIYQEFTDRVPV

SEQ ID NO: 3152228 - protein, 24 aa, Giardia lamblia
DWERPVCKTCGKAHANGAVGGCEY

SEQ ID NO: 3152229 - protein, 29 aa, Giardia lamblia
DWFTELLKHMEIHGFIILRANYCTDPQGL

SEQ ID NO: 3152230 - protein, 30 aa, Giardia lamblia
DWIQCDLCKEWLHQQCDGIYNALLAEKIHY

SEQ ID NO: 3152231 - protein, 21 aa, Giardia lamblia
DWKTVIVSMLCRYLNLLEQSR

SEQ ID NO: 3152232 - protein, 19 aa, Giardia lamblia
DWRGKTALITAIQNGHAEV

SEQ ID NO: 3152233 - protein, 25 aa, Giardia lamblia
DWSALKFSWLQTRSHVRSVWRNGEW

SEQ ID NO: 3152234 - protein, 26 aa, Giardia lamblia
DWWSMGAILYECVFGYPPFGSDNPRD

SEQ ID NO: 3152235 - protein, 26 aa, Giardia lamblia
DWWTLGIFIYECLYGVTPFMSKGASL

SEQ ID NO: 3152236 - protein, 24 aa, Giardia lamblia
DYAGNCPNCAELASQNQRNTDKVK

SEQ ID NO: 3152237 - protein, 24 aa, Giardia lamblia
DYALALEMHELWCAYCQKIMCLDQ

SEQ ID NO: 3152238 - protein, 18 aa, Giardia lamblia
DYAVPPFIFPGPEVSGAQ

SEQ ID NO: 3152239 - protein, 24 aa, Giardia lamblia
DYCSFDFYNIDNWCICLMTQELVD

SEQ ID NO: 3152240 - protein, 18 aa, Giardia lamblia
DYDDGPGYGRRDDRGGRG

SEQ ID NO: 3152241 - protein, 19 aa, Giardia lamblia
DYDGVPLALPLPRGSDNYN

SEQ ID NO: 3152242 - protein, 19 aa, Giardia lamblia
DYEEKCGFIVQLEQRVSVV

SEQ ID NO: 3152243 - protein, 20 aa, Giardia lamblia
DYERGICDSAGMTPLKWIEK

SEQ ID NO: 3152244 - protein, 19 aa, Giardia lamblia
DYERVTAWFCQWLNQLGVI

SEQ ID NO: 3152245 - protein, 23 aa, Giardia lamblia
DYETPCYNAPELLAGARPFHTMD

SEQ ID NO: 3152246 - protein, 21 aa, Giardia lamblia
DYFYYGHRLIIIFELLTSNLF

SEQ ID NO: 3152247 - protein, 18 aa, Giardia lamblia
DYGLYYIRPLFGKKNRYP

SEQ ID NO: 3152248 - protein, 22 aa, Giardia lamblia
DYHERCCLADIIVFYHSHKKYI

SEQ ID NO: 3152249 - protein, 19 aa, Giardia lamblia
DYHPSMAYTIPELDEQDAV

SEQ ID NO: 3152250 - protein, 25 aa, Giardia lamblia
DYIFLRLHYCIGIKAFANGRMHQAS

SEQ ID NO: 3152251 - protein, 18 aa, Giardia lamblia
DYITGFAWSEFQSKLYAS

SEQ ID NO: 3152252 - protein, 18 aa, Giardia lamblia
DYKCPGRLARMFYGCCVF

SEQ ID NO: 3152253 - protein, 45 aa, Giardia lamblia
DYKFSTTVMLGFRSDPLLTVYYYLLLICLRDFCLVGIRVGMDPYP

SEQ ID NO: 3152254 - protein, 21 aa, Giardia lamblia
DYKFTSIEAAAFKSTLEKHPG

SEQ ID NO: 3152255 - protein, 21 aa, Giardia lamblia
DYKISIKSGTIITLLSAASTA

SEQ ID NO: 3152256 - protein, 23 aa, Giardia lamblia
DYKLKMFPDYCIACKTPYLSEWV

SEQ ID NO: 3152257 - protein, 20 aa, Giardia lamblia
DYLPPEVMLGQSYDKACDIW

SEQ ID NO: 3152258 - protein, 21 aa, Giardia lamblia
DYLQVCNEFGQTIYGHLAQII

SEQ ID NO: 3152259 - protein, 19 aa, Giardia lamblia
DYLWCLEDHICFDSVIETA

SEQ ID NO: 3152260 - protein, 18 aa, Giardia lamblia
DYNEKADIWSLGCVIYEL

SEQ ID NO: 3152261 - protein, 20 aa, Giardia lamblia
DYNLLLFYLFQSCAVIHPNL

SEQ ID NO: 3152262 - protein, 19 aa, Giardia lamblia
DYNSLPFKLEKYIYELNLA

SEQ ID NO: 3152263 - protein, 18 aa, Giardia lamblia
DYNTCERTARYDGMSEPL

SEQ ID NO: 3152264 - protein, 22 aa, Giardia lamblia
DYRGFIDLMLCVSFPRSKAAAV

SEQ ID NO: 3152265 - protein, 18 aa, Giardia lamblia
DYSESSGFTKYWSLEDVN

SEQ ID NO: 3152266 - protein, 18 aa, Giardia lamblia
DYSSLQLHSAMFDEPPAS

SEQ ID NO: 3152267 - protein, 17 aa, Giardia lamblia
DYTALMVAAGLNDIDDL

SEQ ID NO: 3152268 - protein, 20 aa, Giardia lamblia
DYTPSIGDVDPFIKVPRPDN

SEQ ID NO: 3152269 - protein, 21 aa, Giardia lamblia
DYVECFLFLHDISGLKLISRA

SEQ ID NO: 3152270 - protein, 17 aa, Giardia lamblia
DYVSAKCICHVYEEDSE

SEQ ID NO: 3152271 - protein, 19 aa, Giardia lamblia
DYYTGMVFEAKLISDHGER

SEQ ID NO: 3152272 - protein, 35 aa, Giardia lamblia
EAADLLSAYEGVECEWRYTFKNAKQHIVTQQTALM

SEQ ID NO: 3152273 - protein, 17 aa, Giardia lamblia
EAAEFLYQFEGDIKTNR

SEQ ID NO: 3152274 - protein, 17 aa, Giardia lamblia
EAAEILTPYEGVKLSRV

SEQ ID NO: 3152275 - protein, 17 aa, Giardia lamblia
EAAEPLVVFRAGSDLTF

SEQ ID NO: 3152276 - protein, 20 aa, Giardia lamblia
EAAFYRQSLAALKAELLGAR

SEQ ID NO: 3152277 - protein, 20 aa, Giardia lamblia
EAAIPPSIFTKSCAIVTDVL

SEQ ID NO: 3152278 - protein, 18 aa, Giardia lamblia
EAAIRYAIVEHRFYDIYL

SEQ ID NO: 3152279 - protein, 24 aa, Giardia lamblia
EAAKVTGLRFLWLDDNRITHVAEL

SEQ ID NO: 3152280 - protein, 24 aa, Giardia lamblia
EAAYRVPRALIILDGIESIIQYTP

SEQ ID NO: 3152281 - protein, 26 aa, Giardia lamblia
EACKVRLGDTLGRVFSKFSRMSDRFT

SEQ ID NO: 3152282 - protein, 21 aa, Giardia lamblia
EACLPLCRECFQSFRRSFLCE

SEQ ID NO: 3152283 - protein, 17 aa, Giardia lamblia
EACRFLCQLLNGLHFLH

SEQ ID NO: 3152284 - protein, 18 aa, Giardia lamblia
EADCELLQVRAKLESAME

SEQ ID NO: 3152285 - protein, 23 aa, Giardia lamblia
EADGADSLAGFSLTHSIAGGTGS

SEQ ID NO: 3152286 - protein, 27 aa, Giardia lamblia
EADIANLRLQWELTLNAIEKRSANIRT

SEQ ID NO: 3152287 - protein, 26 aa, Giardia lamblia
EADIEAGMIGQLFILKAISLDLQNVW

SEQ ID NO: 3152288 - protein, 20 aa, Giardia lamblia
EADIKAYLIQSGKQNRDGWS

SEQ ID NO: 3152289 - protein, 18 aa, Giardia lamblia
EADIVVRLVDYFVSLLSS

SEQ ID NO: 3152290 - protein, 18 aa, Giardia lamblia
EADIWKYTYQLLSALHYL

SEQ ID NO: 3152291 - protein, 23 aa, Giardia lamblia
EADKKFRRIAALRKMKELSKAQE

SEQ ID NO: 3152292 - protein, 20 aa, Giardia lamblia
EADKLRGLVDYEEDDRLRTL

SEQ ID NO: 3152293 - protein, 22 aa, Giardia lamblia
EADLALLMRNPHVVKLYNAAKE

SEQ ID NO: 3152294 - protein, 19 aa, Giardia lamblia
EADRLLCGDPEFNKQLTMI

SEQ ID NO: 3152295 - protein, 21 aa, Giardia lamblia
EADRVPPIKIIISIDINAEAI

SEQ ID NO: 3152296 - protein, 17 aa, Giardia lamblia
EAEEARVSLAQVTADLD

SEQ ID NO: 3152297 - protein, 25 aa, Giardia lamblia
EAEKLKKCKGGCFAVLADTTQHNPP

SEQ ID NO: 3152298 - protein, 22 aa, Giardia lamblia
EAELRITEILDLVREMGELAAT

SEQ ID NO: 3152299 - protein, 18 aa, Giardia lamblia
EAEQKLRQKLAIKLHAEL

SEQ ID NO: 3152300 - protein, 25 aa, Giardia lamblia
EAESYFRRRFSYFNLLQSVMFHKLF

SEQ ID NO: 3152301 - protein, 24 aa, Giardia lamblia
EAEWFRAIMDRNYLRVKASVNDFK

SEQ ID NO: 3152302 - protein, 17 aa, Giardia lamblia
EAFACISKGAGPNDTDE

SEQ ID NO: 3152303 - protein, 26 aa, Giardia lamblia
EAFATWCPPCRGMIPHLAKIPTKYPN

SEQ ID NO: 3152304 - protein, 25 aa, Giardia lamblia
EAFGSSIKGLGRFMEKQELARKKVE

SEQ ID NO: 3152305 - protein, 18 aa, Giardia lamblia
EAFKRPIGSVSFTTPGNI

SEQ ID NO: 3152306 - protein, 23 aa, Giardia lamblia
EAFMGSGVCKIFAGKAASAYVTA

SEQ ID NO: 3152307 - protein, 23 aa, Giardia lamblia
EAFSKRIPAHFNFNEASQDVSYK

SEQ ID NO: 3152308 - protein, 38 aa, Giardia lamblia
EAFVAKAADCLLRLYDNWSLGESCVYLQEALAKKAISL

SEQ ID NO: 3152309 - protein, 18 aa, Giardia lamblia
EAGAHEFRSLVDYACEQG

SEQ ID NO: 3152310 - protein, 17 aa, Giardia lamblia
EAGEIMSALGVTNVADV

SEQ ID NO: 3152311 - protein, 26 aa, Giardia lamblia
EAGGCSLSGPAKEDFMISANVTDTDI

SEQ ID NO: 3152312 - protein, 27 aa, Giardia lamblia
EAGGLQNPWMAIGFSRPISQAVAPVSN

SEQ ID NO: 3152313 - protein, 26 aa, Giardia lamblia
EAGHIGCVQLLIGFEVRLVNKQYETA

SEQ ID NO: 3152314 - protein, 21 aa, Giardia lamblia
EAGIHGCRIFIVYALLVNGET

SEQ ID NO: 3152315 - protein, 17 aa, Giardia lamblia
EAGKIFKQLGAMDRAQI

SEQ ID NO: 3152316 - protein, 19 aa, Giardia lamblia
EAGKTDWQGTALIKAARKG

SEQ ID NO: 3152317 - protein, 17 aa, Giardia lamblia
EAGLICKKCPGMDAISI

SEQ ID NO: 3152318 - protein, 17 aa, Giardia lamblia
EAGLNCVGGLFAIAHAI

SEQ ID NO: 3152319 - protein, 17 aa, Giardia lamblia
EAGLTGRDGRTALLVAT

SEQ ID NO: 3152320 - protein, 24 aa, Giardia lamblia
EAGSIHALRVLFFHYGNESDNMGL

SEQ ID NO: 3152321 - protein, 25 aa, Giardia lamblia
EAGVCKDNGWSCLMTAAKLGNFEAA

SEQ ID NO: 3152322 - protein, 21 aa, Giardia lamblia
EAHGFVLPGGFGDIGVNGLML

SEQ ID NO: 3152323 - protein, 17 aa, Giardia lamblia
EAIAAICNLYANTLRTA

SEQ ID NO: 3152324 - protein, 25 aa, Giardia lamblia
EAICRKPKDAIEFIGNYLVEASKEF

SEQ ID NO: 3152325 - protein, 20 aa, Giardia lamblia
EAIGFVSLIIHPSRIIYAST

SEQ ID NO: 3152326 - protein, 25 aa, Giardia lamblia
EAIHKNTYCLLKCSENLCAHIRDPL

SEQ ID NO: 3152327 - protein, 24 aa, Giardia lamblia
EAILATAKVIWACHDHINDPEFTL

SEQ ID NO: 3152328 - protein, 26 aa, Giardia lamblia
EAILSDFLYCFSKLALYDSLSIPAVW

SEQ ID NO: 3152329 - protein, 22 aa, Giardia lamblia
EAINELELLLTVPFGAGSADIY

SEQ ID NO: 3152330 - protein, 27 aa, Giardia lamblia
EAIRAARLRFFLSRLRAALKEGKPPIL

SEQ ID NO: 3152331 - protein, 20 aa, Giardia lamblia
EAKERIKLIERLIAESPASE

SEQ ID NO: 3152332 - protein, 19 aa, Giardia lamblia
EAKEVLSLIDKERAKKLTT

SEQ ID NO: 3152333 - protein, 22 aa, Giardia lamblia
EAKKIRTNVHFFRPKTLVHKKA

SEQ ID NO: 3152334 - protein, 19 aa, Giardia lamblia
EAKMTIDVTFKCMSANLRG

SEQ ID NO: 3152335 - protein, 20 aa, Giardia lamblia
EAKNKLRAERIAAYTDQVAA

SEQ ID NO: 3152336 - protein, 24 aa, Giardia lamblia
EAKQPRTVYVAGWTPNLSAIKDVT

SEQ ID NO: 3152337 - protein, 19 aa, Giardia lamblia
EAKRKNWETLQQKVLKRLQ

SEQ ID NO: 3152338 - protein, 27 aa, Giardia lamblia
EAKRQAFPRFYFLSDAELLSILSQTRD

SEQ ID NO: 3152339 - protein, 24 aa, Giardia lamblia
EAKRRQRANLSWESSLRTLQTTQV

SEQ ID NO: 3152340 - protein, 19 aa, Giardia lamblia
EAKRVCSLSSLSTSTTTST

SEQ ID NO: 3152341 - protein, 19 aa, Giardia lamblia
EAKRYCCHGKTALMYASEA

SEQ ID NO: 3152342 - protein, 19 aa, Giardia lamblia
EALEAIDMLQCSPGSRHGS

SEQ ID NO: 3152343 - protein, 18 aa, Giardia lamblia
EALFNLSSARARDSDSEW

SEQ ID NO: 3152344 - protein, 26 aa, Giardia lamblia
EALIASGFRPDKLVSALANRKDGSQA

SEQ ID NO: 3152345 - protein, 24 aa, Giardia lamblia
EALISRFDILFVIRDKIHEEEDMN

SEQ ID NO: 3152346 - protein, 23 aa, Giardia lamblia
EALKDRLVCLGKQLAEAPLDSFT

SEQ ID NO: 3152347 - protein, 17 aa, Giardia lamblia
EALKELISISGNDVRSC

SEQ ID NO: 3152348 - protein, 18 aa, Giardia lamblia
EALKKRLFLAQTREADIR

SEQ ID NO: 3152349 - protein, 20 aa, Giardia lamblia
EALLAMLRKEANLFSRLAHR

SEQ ID NO: 3152350 - protein, 26 aa, Giardia lamblia
EALLDNIKGIIAFHYHGREDAYQPDN

SEQ ID NO: 3152351 - protein, 19 aa, Giardia lamblia
EALLREKEDTILKLNLECD

SEQ ID NO: 3152352 - protein, 20 aa, Giardia lamblia
EALLRQIFCPSSSLRLPQLL

SEQ ID NO: 3152353 - protein, 18 aa, Giardia lamblia
EALMVPIRELQRAEYFTK

SEQ ID NO: 3152354 - protein, 30 aa, Giardia lamblia
EALPEATDSWVFRPRILVVANTNVAVDNLL

SEQ ID NO: 3152355 - protein, 17 aa, Giardia lamblia
EALRHPFFKDIGEIVRL

SEQ ID NO: 3152356 - protein, 17 aa, Giardia lamblia
EALRTIVDRCRESGVLY

SEQ ID NO: 3152357 - protein, 20 aa, Giardia lamblia
EALRYIKAMCLGLIQEIEYV

SEQ ID NO: 3152358 - protein, 19 aa, Giardia lamblia
EALVPFFYSKSLRVPTSIA

SEQ ID NO: 3152359 - protein, 20 aa, Giardia lamblia
EALYVGYVMARGCRHTSFDC

SEQ ID NO: 3152360 - protein, 18 aa, Giardia lamblia
EAMDCLREYIFVEPVECL

SEQ ID NO: 3152361 - protein, 19 aa, Giardia lamblia
EAMDMLRARIAESRQEEEE

SEQ ID NO: 3152362 - protein, 17 aa, Giardia lamblia
EAMIMIVMYHLADCTMA

SEQ ID NO: 3152363 - protein, 24 aa, Giardia lamblia
EAMLRDFHKYRIFSHKACKQLLGG

SEQ ID NO: 3152364 - protein, 29 aa, Giardia lamblia
EAMVSSFYSFWSRFQSVKEFLHENYYSTE

SEQ ID NO: 3152365 - protein, 20 aa, Giardia lamblia
EANELWKKSMTRIHREKRVL

SEQ ID NO: 3152366 - protein, 19 aa, Giardia lamblia
EANLLRKGGLTALMTGAMQ

SEQ ID NO: 3152367 - protein, 17 aa, Giardia lamblia
EANMERASILRKDTQSI

SEQ ID NO: 3152368 - protein, 26 aa, Giardia lamblia
EANVWCPGCDSSLIYAIKANKLPFAQ

SEQ ID NO: 3152369 - protein, 19 aa, Giardia lamblia
EAPASWELAQEKLKDKCRQ

SEQ ID NO: 3152370 - protein, 19 aa, Giardia lamblia
EAPEIKFRRLEKAYLELML

SEQ ID NO: 3152371 - protein, 32 aa, Giardia lamblia
EAPLYRKIGTAVCYRVFKAYLYGAMGLVKLRE

SEQ ID NO: 3152372 - protein, 21 aa, Giardia lamblia
EAPMSDWSLFKHKYDEELAAL

SEQ ID NO: 3152373 - protein, 22 aa, Giardia lamblia
EAPSKFQMSDCLSKRLRSINSM

SEQ ID NO: 3152374 - protein, 19 aa, Giardia lamblia
EAPSWTLLMCAAFTGDATM

SEQ ID NO: 3152375 - protein, 24 aa, Giardia lamblia
EAQAEIQAALQFGQQLENPQCTAD

SEQ ID NO: 3152376 - protein, 26 aa, Giardia lamblia
EAQALRLLLLNIKRGVLRSKVTGERI

SEQ ID NO: 3152377 - protein, 25 aa, Giardia lamblia
EAQKLNCLQVLLLHVYEENVQINIP

SEQ ID NO: 3152378 - protein, 27 aa, Giardia lamblia
EAQLRAWYSDICEEISRLREDHAKITI

SEQ ID NO: 3152379 - protein, 19 aa, Giardia lamblia
EAQNMKGLVVKILRGQYQP

SEQ ID NO: 3152380 - protein, 32 aa, Giardia lamblia
EARARAKEVSRLKVEISDVLSLLHSSGLTVSS

SEQ ID NO: 3152381 - protein, 29 aa, Giardia lamblia
EAREFAKTLSWERCMVIEKNSSLDLAELH

SEQ ID NO: 3152382 - protein, 24 aa, Giardia lamblia
EARIFPDERGGALLVAVQNDAYDC

SEQ ID NO: 3152383 - protein, 24 aa, Giardia lamblia
EARIVMPGKLLVRQHVGGLKNVPE

SEQ ID NO: 3152384 - protein, 20 aa, Giardia lamblia
EARMSPDVLMDIMDLATPSS

SEQ ID NO: 3152385 - protein, 22 aa, Giardia lamblia
EARPRSAFTKRLLLGRPSNNNT

SEQ ID NO: 3152386 - protein, 21 aa, Giardia lamblia
EARQLKLSRFINVRLSGNLSR

SEQ ID NO: 3152387 - protein, 22 aa, Giardia lamblia
EARRSPEIIEFLQGSGSFLIAG

SEQ ID NO: 3152388 - protein, 26 aa, Giardia lamblia
EARSVSFVASCTWPEGCVHGTPSTVS

SEQ ID NO: 3152389 - protein, 22 aa, Giardia lamblia
EARVRLGAVKGQLLVQQVLGNL

SEQ ID NO: 3152390 - protein, 21 aa, Giardia lamblia
EASDEFFRWAISSPGGIIDAH

SEQ ID NO: 3152391 - protein, 23 aa, Giardia lamblia
EASDLRISPSLSKRFTNPPRNIN

SEQ ID NO: 3152392 - protein, 22 aa, Giardia lamblia
EASFMKQLIKENGYLKQRLNQI

SEQ ID NO: 3152393 - protein, 18 aa, Giardia lamblia
EASIKMPDGYTILDYAVI

SEQ ID NO: 3152394 - protein, 29 aa, Giardia lamblia
EASIPLGILACALFGYTYRDYGVKYPVSG

SEQ ID NO: 3152395 - protein, 26 aa, Giardia lamblia
EASIYCHYCYGKLFLFGEKLNILSSF

SEQ ID NO: 3152396 - protein, 18 aa, Giardia lamblia
EASLSFVGGFLVPKLLSP

SEQ ID NO: 3152397 - protein, 17 aa, Giardia lamblia
EASLTFSMEGVIKNLKV

SEQ ID NO: 3152398 - protein, 17 aa, Giardia lamblia
EASNLNPLVAMQLLEQK

SEQ ID NO: 3152399 - protein, 25 aa, Giardia lamblia
EASPLTRGWFHYGLKGDSMLQRFAR

SEQ ID NO: 3152400 - protein, 19 aa, Giardia lamblia
EASYARAQEANRMYKSFSE

SEQ ID NO: 3152401 - protein, 21 aa, Giardia lamblia
EATCAARVSIIAGILGGDVRE

SEQ ID NO: 3152402 - protein, 25 aa, Giardia lamblia
EATCFDVYCSLHLPKQISVKHVLGT

SEQ ID NO: 3152403 - protein, 26 aa, Giardia lamblia
EATEFAFSAVCFMSGKAYDMHDTIST

SEQ ID NO: 3152404 - protein, 26 aa, Giardia lamblia
EATMALKAPRIFEGETALMQVARRGF

SEQ ID NO: 3152405 - protein, 24 aa, Giardia lamblia
EATQRCLRELLKILDAVDGLHAQA

SEQ ID NO: 3152406 - protein, 20 aa, Giardia lamblia
EATVQIFPSGAVELISNVIR

SEQ ID NO: 3152407 - protein, 19 aa, Giardia lamblia
EAVAQTGKFPLAYQNLKTA

SEQ ID NO: 3152408 - protein, 29 aa, Giardia lamblia
EAVEFPLKSPELFAALNIQPPNAVLLHGP

SEQ ID NO: 3152409 - protein, 20 aa, Giardia lamblia
EAVEILAPHEAMMKRNDGAT

SEQ ID NO: 3152410 - protein, 24 aa, Giardia lamblia
EAVFRPRMAFTDEVEKERRSLVDS

SEQ ID NO: 3152411 - protein, 17 aa, Giardia lamblia
EAVIKELLDEHSPSRPL

SEQ ID NO: 3152412 - protein, 24 aa, Giardia lamblia
EAVKHIAYCLGYKPYIINPTYTVH

SEQ ID NO: 3152413 - protein, 18 aa, Giardia lamblia
EAVKMGDLPGLKRYLQEH

SEQ ID NO: 3152414 - protein, 24 aa, Giardia lamblia
EAVLRLKILQKLDRCWRGSLETGL

SEQ ID NO: 3152415 - protein, 18 aa, Giardia lamblia
EAVNKCFEKILFTLIHSL

SEQ ID NO: 3152416 - protein, 21 aa, Giardia lamblia
EAVPCPEPVALERLTGHQNIV

SEQ ID NO: 3152417 - protein, 19 aa, Giardia lamblia
EAVRFGFTAVCVNGCYARQ

SEQ ID NO: 3152418 - protein, 23 aa, Giardia lamblia
EAVSERLIECNLVKLDDSSSTEE

SEQ ID NO: 3152419 - protein, 19 aa, Giardia lamblia
EAYIPPVLTTAQFRRLRFG

SEQ ID NO: 3152420 - protein, 20 aa, Giardia lamblia
EAYLALRPCEPALAIWADFV

SEQ ID NO: 3152421 - protein, 19 aa, Giardia lamblia
EAYQKFTREFIIEATNYKN

SEQ ID NO: 3152422 - protein, 19 aa, Giardia lamblia
EAYSLKSDIWSFGCVIYYM

SEQ ID NO: 3152423 - protein, 17 aa, Giardia lamblia
EAYVWSTALYLSCTDTS

SEQ ID NO: 3152424 - protein, 17 aa, Giardia lamblia
ECARELLQEVGITTPSD

SEQ ID NO: 3152425 - protein, 17 aa, Giardia lamblia
ECCLPLFQYELSIPNDI

SEQ ID NO: 3152426 - protein, 22 aa, Giardia lamblia
ECDSGLGFIDCNGQYTIAQGFQ

SEQ ID NO: 3152427 - protein, 28 aa, Giardia lamblia
ECEAVKARIGLCLSNPIFDGIEENDEAR

SEQ ID NO: 3152428 - protein, 21 aa, Giardia lamblia
ECGFSKFASMLLKYNNISFVG

SEQ ID NO: 3152429 - protein, 25 aa, Giardia lamblia
ECGIIPRSQGHLVIPVAFTSDAFEK

SEQ ID NO: 3152430 - protein, 19 aa, Giardia lamblia
ECHFSRLAMRMDQAVELYY

SEQ ID NO: 3152431 - protein, 19 aa, Giardia lamblia
ECILWKATEIDYLTKQMEF

SEQ ID NO: 3152432 - protein, 30 aa, Giardia lamblia
ECINRGFCSFKIKTDRTIFCTNKYNITGIC

SEQ ID NO: 3152433 - protein, 19 aa, Giardia lamblia
ECIPLLLCELSVLDSHGKA

SEQ ID NO: 3152434 - protein, 23 aa, Giardia lamblia
ECLCYRCSNVLDFPSNSSSRLGT

SEQ ID NO: 3152435 - protein, 21 aa, Giardia lamblia
ECLHMCGPSLLISSTHQGQID

SEQ ID NO: 3152436 - protein, 25 aa, Giardia lamblia
ECLLEVIRCAKGIHGTEGSTMGDLQ

SEQ ID NO: 3152437 - protein, 26 aa, Giardia lamblia
ECLTGFKWLGTLSESARSRGLIPCFT

SEQ ID NO: 3152438 - protein, 36 aa, Giardia lamblia
ECMGYLRNCEPWVCLHDADISYLRYIGMLHQLIDSS

SEQ ID NO: 3152439 - protein, 27 aa, Giardia lamblia
ECPLELRIISPRSRMYSALMMAAELGN

SEQ ID NO: 3152440 - protein, 20 aa, Giardia lamblia
ECPYDEGGYFIIRGAEKAVI

SEQ ID NO: 3152441 - protein, 19 aa, Giardia lamblia
ECQERSDLLYTLSSLKAQN

SEQ ID NO: 3152442 - protein, 18 aa, Giardia lamblia
ECSRHWFAAAASGDCDYI

SEQ ID NO: 3152443 - protein, 21 aa, Giardia lamblia
ECSRRIKAEILTQMQGVTTAN

SEQ ID NO: 3152444 - protein, 22 aa, Giardia lamblia
ECTDMAGLRVRLQKLYNAYTGS

SEQ ID NO: 3152445 - protein, 33 aa, Giardia lamblia
ECTHKGKLQYSLDLCKNCRCIIESKYMASHMVT

SEQ ID NO: 3152446 - protein, 22 aa, Giardia lamblia
ECTKEHRIALEQALQSLTAEHK

SEQ ID NO: 3152447 - protein, 24 aa, Giardia lamblia
ECTKHLLCEMGVYLNSKCTSLTYA

SEQ ID NO: 3152448 - protein, 19 aa, Giardia lamblia
ECTRMLSMMKDYAAVFRAF

SEQ ID NO: 3152449 - protein, 20 aa, Giardia lamblia
ECTRTMKPRTSRITMSTVGA

SEQ ID NO: 3152450 - protein, 19 aa, Giardia lamblia
ECVHHCIMEAKQVDNSNKT

SEQ ID NO: 3152451 - protein, 17 aa, Giardia lamblia
ECVKLLLCELGIVGSNE

SEQ ID NO: 3152452 - protein, 20 aa, Giardia lamblia
ECVKLLLMMEKCIKDNSDMT

SEQ ID NO: 3152453 - protein, 17 aa, Giardia lamblia
ECVTGKPLFPAKTEKDE

SEQ ID NO: 3152454 - protein, 17 aa, Giardia lamblia
ECYRVMKNAGYSCSRYH

SEQ ID NO: 3152455 - protein, 25 aa, Giardia lamblia
EDAAEFRRARATRREAEREFAMIRE

SEQ ID NO: 3152456 - protein, 32 aa, Giardia lamblia
EDAASPFLVCPLNLLIARPIIVIAPVPNRLCD

SEQ ID NO: 3152457 - protein, 23 aa, Giardia lamblia
EDADEPCIVWKRETASGLVPSGA

SEQ ID NO: 3152458 - protein, 27 aa, Giardia lamblia
EDAKELSDVCARISVEMYRKEAEKKKK

SEQ ID NO: 3152459 - protein, 24 aa, Giardia lamblia
EDALECITVLLSYECGMTNANGMT

SEQ ID NO: 3152460 - protein, 17 aa, Giardia lamblia
EDAPTLVVANSVDQIDP

SEQ ID NO: 3152461 - protein, 20 aa, Giardia lamblia
EDAPVRYGERVYITCNQDMI

SEQ ID NO: 3152462 - protein, 23 aa, Giardia lamblia
EDARCDFRPGESHREIDAWFTLS

SEQ ID NO: 3152463 - protein, 22 aa, Giardia lamblia
EDARSAPTLSALPGHTSGHPEM

SEQ ID NO: 3152464 - protein, 25 aa, Giardia lamblia
EDASRREICCKIMVPIHMQTDLLEI

SEQ ID NO: 3152465 - protein, 17 aa, Giardia lamblia
EDCERRCVPSLKLSSQT

SEQ ID NO: 3152466 - protein, 21 aa, Giardia lamblia
EDCKDRIIFVPGINLDHLEWY

SEQ ID NO: 3152467 - protein, 20 aa, Giardia lamblia
EDCKMEFYRNNTIHTLMRHL

SEQ ID NO: 3152468 - protein, 25 aa, Giardia lamblia
EDDDKRTGFIFTVHDKLDFQRFYRL

SEQ ID NO: 3152469 - protein, 20 aa, Giardia lamblia
EDDETLTLRKSLRTTTAELS

SEQ ID NO: 3152470 - protein, 24 aa, Giardia lamblia
EDDGLCAVGAHLKTGDIVINKGRH

SEQ ID NO: 3152471 - protein, 18 aa, Giardia lamblia
EDDLVELLALYKELIGQY

SEQ ID NO: 3152472 - protein, 18 aa, Giardia lamblia
EDDMMNRPTWDMAGEISA

SEQ ID NO: 3152473 - protein, 17 aa, Giardia lamblia
EDEAALLAARRLANYLT

SEQ ID NO: 3152474 - protein, 24 aa, Giardia lamblia
EDEALFKKKVLGVVSKELEHVEYV

SEQ ID NO: 3152475 - protein, 18 aa, Giardia lamblia
EDEIKGLQLRLTENDFTK

SEQ ID NO: 3152476 - protein, 24 aa, Giardia lamblia
EDERNNCLMRHLIVKIVEEEILIS

SEQ ID NO: 3152477 - protein, 23 aa, Giardia lamblia
EDERVRRAYAIVIRNINRRDRSI

SEQ ID NO: 3152478 - protein, 25 aa, Giardia lamblia
EDFCKCLDYGLPPTGGIGIGIDRLV

SEQ ID NO: 3152479 - protein, 25 aa, Giardia lamblia
EDFECELKAAISRQISEKDATAKDL

SEQ ID NO: 3152480 - protein, 21 aa, Giardia lamblia
EDFKARIQLSDFVDLYKGKFL

SEQ ID NO: 3152481 - protein, 21 aa, Giardia lamblia
EDFPSAPALHLLYIYQVALTL

SEQ ID NO: 3152482 - protein, 23 aa, Giardia lamblia
EDGEVILEQGLWVILSQLISVLD

SEQ ID NO: 3152483 - protein, 20 aa, Giardia lamblia
EDGFVRFILTQAITAENHFI

SEQ ID NO: 3152484 - protein, 17 aa, Giardia lamblia
EDGIRFDAAQLLHRLFP

SEQ ID NO: 3152485 - protein, 17 aa, Giardia lamblia
EDGRTALMHAAECDSVE

SEQ ID NO: 3152486 - protein, 20 aa, Giardia lamblia
EDGSECIEEFAADTQLLLLR

SEQ ID NO: 3152487 - protein, 25 aa, Giardia lamblia
EDGSIKLGDFGLCRVLEQSTMAKTN

SEQ ID NO: 3152488 - protein, 19 aa, Giardia lamblia
EDHPTCTVSNLLNAIKARA

SEQ ID NO: 3152489 - protein, 24 aa, Giardia lamblia
EDHQKVCFIAGRMIILHNIQTNTY

SEQ ID NO: 3152490 - protein, 25 aa, Giardia lamblia
EDIDKWPAVDVIIGFHSKGFPLRKA

SEQ ID NO: 3152491 - protein, 19 aa, Giardia lamblia
EDIFLRLAQLGPMQDFLVA

SEQ ID NO: 3152492 - protein, 28 aa, Giardia lamblia
EDIGRGCQFSFYDFHVLTETTVSWYLTI

SEQ ID NO: 3152493 - protein, 23 aa, Giardia lamblia
EDIGSGTYARCWSANLEGSTEKV

SEQ ID NO: 3152494 - protein, 17 aa, Giardia lamblia
EDIKIINGFLIDQEMSH

SEQ ID NO: 3152495 - protein, 24 aa, Giardia lamblia
EDILTVKTPNAWLNDEVINAQVSL

SEQ ID NO: 3152496 - protein, 19 aa, Giardia lamblia
EDIRLLRAKITDLRRQIVS

SEQ ID NO: 3152497 - protein, 23 aa, Giardia lamblia
EDKCLTCKTGFFLVEVTQPAGKC

SEQ ID NO: 3152498 - protein, 20 aa, Giardia lamblia
EDKGAVLLDESLLRILSLLP

SEQ ID NO: 3152499 - protein, 18 aa, Giardia lamblia
EDKGLKLMVMDASEISLE

SEQ ID NO: 3152500 - protein, 17 aa, Giardia lamblia
EDKLGQCSICLDACCTM

SEQ ID NO: 3152501 - protein, 22 aa, Giardia lamblia
EDLACEACIDMQAHIMDRTSPQ

SEQ ID NO: 3152502 - protein, 22 aa, Giardia lamblia
EDLDCGLAPPSQWDIEGDAAIV

SEQ ID NO: 3152503 - protein, 18 aa, Giardia lamblia
EDLEFFDPSRFVSVMLGY

SEQ ID NO: 3152504 - protein, 31 aa, Giardia lamblia
EDLERVAWILLRLHPGLSFLAETPQFQVKYA

SEQ ID NO: 3152505 - protein, 19 aa, Giardia lamblia
EDLEWRLRNYESMLRMKIE

SEQ ID NO: 3152506 - protein, 19 aa, Giardia lamblia
EDLFGINYLFGGMDPVLCF

SEQ ID NO: 3152507 - protein, 31 aa, Giardia lamblia
EDLHEVNPMLGFRGVRLGIVYPEISEMQVRA

SEQ ID NO: 3152508 - protein, 17 aa, Giardia lamblia
EDLPGVFTANEFLKRCN

SEQ ID NO: 3152509 - protein, 21 aa, Giardia lamblia
EDLRFKSVFDDGLYDNQDLVP

SEQ ID NO: 3152510 - protein, 23 aa, Giardia lamblia
EDLRKNSRCNYYSPAKVLVGTAL

SEQ ID NO: 3152511 - protein, 17 aa, Giardia lamblia
EDLSFIVLQHDKILDAG

SEQ ID NO: 3152512 - protein, 27 aa, Giardia lamblia
EDLSVLECLRSIIITLIRCGNLQDIVL

SEQ ID NO: 3152513 - protein, 23 aa, Giardia lamblia
EDLYCMIKKAVAIRKHLERSRRD

SEQ ID NO: 3152514 - protein, 39 aa, Giardia lamblia
EDMALNMYRHLLIKCPCCCACPACEAIIEIPCLPEHMIY

SEQ ID NO: 3152515 - protein, 28 aa, Giardia lamblia
EDMASFLRSRFTLIPTSGMQHMSSIALP

SEQ ID NO: 3152516 - protein, 17 aa, Giardia lamblia
EDMEPHFTKGLISANKS

SEQ ID NO: 3152517 - protein, 22 aa, Giardia lamblia
EDMIREMCSIFSQVDVLCCFSK

SEQ ID NO: 3152518 - protein, 23 aa, Giardia lamblia
EDMLRRIPFSSGLQSNIPPSPLP

SEQ ID NO: 3152519 - protein, 29 aa, Giardia lamblia
EDMTILPAAEPYYGLPQPDFESFNHSIQS

SEQ ID NO: 3152520 - protein, 20 aa, Giardia lamblia
EDNARIQTSIKHQALAQPPF

SEQ ID NO: 3152521 - protein, 21 aa, Giardia lamblia
EDNDLLLGRIASLARELDTTK

SEQ ID NO: 3152522 - protein, 19 aa, Giardia lamblia
EDNRVLLIVSENDFSRACI

SEQ ID NO: 3152523 - protein, 17 aa, Giardia lamblia
EDPKIAAIAGRSVTGIF

SEQ ID NO: 3152524 - protein, 24 aa, Giardia lamblia
EDPLLSGLLRYRIVGKETDKSHYV

SEQ ID NO: 3152525 - protein, 24 aa, Giardia lamblia
EDPLSHGIPAWMLNRNNDFESGKD

SEQ ID NO: 3152526 - protein, 19 aa, Giardia lamblia
EDPPRGSILKRIQQLMRLV

SEQ ID NO: 3152527 - protein, 22 aa, Giardia lamblia
EDPTVECYNCYNRDTRIDIPIC

SEQ ID NO: 3152528 - protein, 17 aa, Giardia lamblia
EDPVKGVFIKDLSEHPV

SEQ ID NO: 3152529 - protein, 24 aa, Giardia lamblia
EDQFSSLCNLLFNGSSRCKSHAFR

SEQ ID NO: 3152530 - protein, 24 aa, Giardia lamblia
EDQKRLLATYIKARKKQLLLSKKA

SEQ ID NO: 3152531 - protein, 27 aa, Giardia lamblia
EDRCGCALRIIGFLVDCLKDTSCEDDW

SEQ ID NO: 3152532 - protein, 20 aa, Giardia lamblia
EDREKERLFRISNGPANAGS

SEQ ID NO: 3152533 - protein, 22 aa, Giardia lamblia
EDSRPFLLICKLRQCSKFVRQE

SEQ ID NO: 3152534 - protein, 21 aa, Giardia lamblia
EDSSLDFGVHPEFDNDSFESE

SEQ ID NO: 3152535 - protein, 24 aa, Giardia lamblia
EDTLKRLLPFLTNIIPETSEEVLV

SEQ ID NO: 3152536 - protein, 22 aa, Giardia lamblia
EDVMLCKPCLLVNRLSLYSRLQ

SEQ ID NO: 3152537 - protein, 18 aa, Giardia lamblia
EDVPDILSQLSFSEESAS

SEQ ID NO: 3152538 - protein, 18 aa, Giardia lamblia
EDWYCSSIRREQLHQEIL

SEQ ID NO: 3152539 - protein, 22 aa, Giardia lamblia
EEAAKLCKRYLSDKAQLDEKNA

SEQ ID NO: 3152540 - protein, 27 aa, Giardia lamblia
EEAHCIAETVVVPGLLGYISIGKDNPL

SEQ ID NO: 3152541 - protein, 25 aa, Giardia lamblia
EEAKTGEAAFCFNSNIPQITVIRHL

SEQ ID NO: 3152542 - protein, 17 aa, Giardia lamblia
EEALSYAHFGYVLLHPA

SEQ ID NO: 3152543 - protein, 22 aa, Giardia lamblia
EEARMRLEVEKKLLSEKLEENE

SEQ ID NO: 3152544 - protein, 27 aa, Giardia lamblia
EEAYSCKEIPALLAGVRVFQFVLDAHS

SEQ ID NO: 3152545 - protein, 21 aa, Giardia lamblia
EECLRREVQELTDKLSDATHQ

SEQ ID NO: 3152546 - protein, 19 aa, Giardia lamblia
EECRLYFQYQHHKIVQFNE

SEQ ID NO: 3152547 - protein, 20 aa, Giardia lamblia
EEDKRRCPALVGVEDILYGD

SEQ ID NO: 3152548 - protein, 31 aa, Giardia lamblia
EEDRIWRIFAQLLIAMEYCHSVRKPNAIHVG

SEQ ID NO: 3152549 - protein, 23 aa, Giardia lamblia
EEDRRRAEIEAKIKEEQDRVAEE

SEQ ID NO: 3152550 - protein, 26 aa, Giardia lamblia
EEEEAFKQRMHETLFDARNMRLEVTR

SEQ ID NO: 3152551 - protein, 23 aa, Giardia lamblia
EEEERKKLKAAREEELANTIRDL

SEQ ID NO: 3152552 - protein, 20 aa, Giardia lamblia
EEEFRLFSYRLNKVDSAPIL

SEQ ID NO: 3152553 - protein, 19 aa, Giardia lamblia
EEEIESWVLAGATKSELDL

SEQ ID NO: 3152554 - protein, 24 aa, Giardia lamblia
EEEILRLNQELELVVISNESLESR

SEQ ID NO: 3152555 - protein, 23 aa, Giardia lamblia
EEEKRKNLNIVFIGHVDAGKSTI

SEQ ID NO: 3152556 - protein, 17 aa, Giardia lamblia
EEELKQIRAIEEHCEPI

SEQ ID NO: 3152557 - protein, 25 aa, Giardia lamblia
EEELSRLKIYLARAEEDIRAYKTTL

SEQ ID NO: 3152558 - protein, 25 aa, Giardia lamblia
EEEPPRKGDIFKRVTRKPPTATPTL

SEQ ID NO: 3152559 - protein, 26 aa, Giardia lamblia
EEESSCSRPDCKILLTLTELLGAGAF

SEQ ID NO: 3152560 - protein, 21 aa, Giardia lamblia
EEFIKGKIDGIISSMKANIGI

SEQ ID NO: 3152561 - protein, 17 aa, Giardia lamblia
EEFRGWTAMTWAVSNGN

SEQ ID NO: 3152562 - protein, 17 aa, Giardia lamblia
EEFSQYAVNGFNKRLNS

SEQ ID NO: 3152563 - protein, 23 aa, Giardia lamblia
EEGRKFAEELGISFIETSSKSGE

SEQ ID NO: 3152564 - protein, 25 aa, Giardia lamblia
EEGRPFPGCFATCRTIVEISSYLEF

SEQ ID NO: 3152565 - protein, 24 aa, Giardia lamblia
EEHRVEILCLFYGVCAESDLRVAK

SEQ ID NO: 3152566 - protein, 19 aa, Giardia lamblia
EEHYQAAKVLREYEGVPLS

SEQ ID NO: 3152567 - protein, 24 aa, Giardia lamblia
EEIAKPIRFSSCVDATNQLWEMIN

SEQ ID NO: 3152568 - protein, 17 aa, Giardia lamblia
EEIARIALQHGIDVNAT

SEQ ID NO: 3152569 - protein, 24 aa, Giardia lamblia
EEIARLVREISLLRASLSEAQENA

SEQ ID NO: 3152570 - protein, 26 aa, Giardia lamblia
EEIECLRRQLQVMKSLPISRSATPAD

SEQ ID NO: 3152571 - protein, 17 aa, Giardia lamblia
EEIKLPCGHTITLNQEL

SEQ ID NO: 3152572 - protein, 25 aa, Giardia lamblia
EEILKHGYEAFTWDNDETKVKKFIS

SEQ ID NO: 3152573 - protein, 24 aa, Giardia lamblia
EEIPAIKVKWIFSQGTTSEHDDVI

SEQ ID NO: 3152574 - protein, 26 aa, Giardia lamblia
EEIQADCLLVASVLDLICGVTQLRQE

SEQ ID NO: 3152575 - protein, 21 aa, Giardia lamblia
EEITLFLGGQVFLRSVALVRC

SEQ ID NO: 3152576 - protein, 23 aa, Giardia lamblia
EEIVYRHPITWSLDDISYMFEKA

SEQ ID NO: 3152577 - protein, 18 aa, Giardia lamblia
EEKCRLYEKIVLGRDKEK

SEQ ID NO: 3152578 - protein, 20 aa, Giardia lamblia
EEKEASVITVTRLTSQNSNL

SEQ ID NO: 3152579 - protein, 22 aa, Giardia lamblia
EEKKAMNLWNIVFQKTLELTSD

SEQ ID NO: 3152580 - protein, 23 aa, Giardia lamblia
EEKLSDLRLLMSNIEQKRLESKE

SEQ ID NO: 3152581 - protein, 25 aa, Giardia lamblia
EEKNPIYAGHLFKVCTRDRNYPSFF

SEQ ID NO: 3152582 - protein, 19 aa, Giardia lamblia
EEKQRLEMRLAELKIKVNN

SEQ ID NO: 3152583 - protein, 28 aa, Giardia lamblia
EEKRRNWRVIEQCLKAVTVPIEIFEFGK

SEQ ID NO: 3152584 - protein, 20 aa, Giardia lamblia
EEKVKMCLEIEELSAQVARV

SEQ ID NO: 3152585 - protein, 17 aa, Giardia lamblia
EELFNPDIMTYISEKYI

SEQ ID NO: 3152586 - protein, 24 aa, Giardia lamblia
EELHSRLKPGLVVQCAVVDLNASG

SEQ ID NO: 3152587 - protein, 24 aa, Giardia lamblia
EELHSRPALYRLAPYNDMMPDMIV

SEQ ID NO: 3152588 - protein, 21 aa, Giardia lamblia
EELILDFAFRPSKYTLVKSDS

SEQ ID NO: 3152589 - protein, 18 aa, Giardia lamblia
EELIPLLIEKEAKKGLTR

SEQ ID NO: 3152590 - protein, 25 aa, Giardia lamblia
EELKKLEMEDALKLAASLKTLSPTG

SEQ ID NO: 3152591 - protein, 23 aa, Giardia lamblia
EELPDEWKAVVSKSYGAKDKLTP

SEQ ID NO: 3152592 - protein, 17 aa, Giardia lamblia
EELPFSVGTARATKELS

SEQ ID NO: 3152593 - protein, 26 aa, Giardia lamblia
EELRKLNVNWERAIDARIERLTDELR

SEQ ID NO: 3152594 - protein, 20 aa, Giardia lamblia
EELRKLSSELLRSTESKKRL

SEQ ID NO: 3152595 - protein, 23 aa, Giardia lamblia
EELRPYEGIPVARIPVLHREQKH

SEQ ID NO: 3152596 - protein, 25 aa, Giardia lamblia
EELSDLFPPIVMPFIQAIKHELDIY

SEQ ID NO: 3152597 - protein, 19 aa, Giardia lamblia
EELSRLQSRLSQSSDQARS

SEQ ID NO: 3152598 - protein, 17 aa, Giardia lamblia
EEMKWSSLLARRSNEKS

SEQ ID NO: 3152599 - protein, 24 aa, Giardia lamblia
EEMLGFKAVILLSSAFYENVLSLI

SEQ ID NO: 3152600 - protein, 24 aa, Giardia lamblia
EEMRTVDFQLVFSLYQILEAAVSE

SEQ ID NO: 3152601 - protein, 18 aa, Giardia lamblia
EENAKILTEYGVLPVICD

SEQ ID NO: 3152602 - protein, 24 aa, Giardia lamblia
EENARLISEIRIFEAQVKQLSSDI

SEQ ID NO: 3152603 - protein, 24 aa, Giardia lamblia
EENDRLRTMLSIQARLRATENKSS

SEQ ID NO: 3152604 - protein, 25 aa, Giardia lamblia
EENIKRCFVCLNVFVSKLHKVLVSS

SEQ ID NO: 3152605 - protein, 25 aa, Giardia lamblia
EENKRLRADLVLARERVSEKRLADV

SEQ ID NO: 3152606 - protein, 24 aa, Giardia lamblia
EENQRLRQKLTFVNSRDHFSQSLE

SEQ ID NO: 3152607 - protein, 23 aa, Giardia lamblia
EENYKRLLALESRVKKYYNEQIR

SEQ ID NO: 3152608 - protein, 36 aa, Giardia lamblia
EEPFTRLPLEGNLESIPSYWLERLQKTRAGLSRGRS

SEQ ID NO: 3152609 - protein, 17 aa, Giardia lamblia
EEPFVLQPYATVFTYIC

SEQ ID NO: 3152610 - protein, 27 aa, Giardia lamblia
EEPREIPAWITRMSKWNKPAVTTEQVF

SEQ ID NO: 3152611 - protein, 23 aa, Giardia lamblia
EEQIKELVKLAGENQQLLNEMTL

SEQ ID NO: 3152612 - protein, 24 aa, Giardia lamblia
EEQIMRHVVRFGAEQLTKMDHNAG

SEQ ID NO: 3152613 - protein, 24 aa, Giardia lamblia
EEQRSGMFTRIFPTKEAASYMPLF

SEQ ID NO: 3152614 - protein, 18 aa, Giardia lamblia
EEQVCSWSPYDAALYFLL

SEQ ID NO: 3152615 - protein, 27 aa, Giardia lamblia
EERCVLRATLFGNWALCNLRMKDYADC

SEQ ID NO: 3152616 - protein, 23 aa, Giardia lamblia
EERFKRIVSTPVASSHIDRNVSP

SEQ ID NO: 3152617 - protein, 17 aa, Giardia lamblia
EERKLRLVVKQYSFTQA

SEQ ID NO: 3152618 - protein, 18 aa, Giardia lamblia
EERLKEFLQQQASVTEIL

SEQ ID NO: 3152619 - protein, 25 aa, Giardia lamblia
EERNAYCELCLTLLACNISVQSILQ

SEQ ID NO: 3152620 - protein, 26 aa, Giardia lamblia
EERQRRIALEKERIAAEKQIIKEKRE

SEQ ID NO: 3152621 - protein, 39 aa, Giardia lamblia
EERRVEAQTSYRGFLRNKWKTLCKLINGAGATITEQGDE

SEQ ID NO: 3152622 - protein, 22 aa, Giardia lamblia
EESEQRTANAFIYSTYTHICYM

SEQ ID NO: 3152623 - protein, 25 aa, Giardia lamblia
EESGPRTPSEWSLSFHVNLRREKQS

SEQ ID NO: 3152624 - protein, 18 aa, Giardia lamblia
EESKRTGALETPASSSLA

SEQ ID NO: 3152625 - protein, 22 aa, Giardia lamblia
EESLRAAKFEIVRLEDANSRLL

SEQ ID NO: 3152626 - protein, 17 aa, Giardia lamblia
EESLRIMSMELKSMREG

SEQ ID NO: 3152627 - protein, 19 aa, Giardia lamblia
EESLVWRVLAQIAAKLYAL

SEQ ID NO: 3152628 - protein, 20 aa, Giardia lamblia
EESRLVLLYEKFHRKHNMTH

SEQ ID NO: 3152629 - protein, 27 aa, Giardia lamblia
EESVWRCAICLILAVAYLHSSHAKDNS

SEQ ID NO: 3152630 - protein, 24 aa, Giardia lamblia
EETEFIPGYHIVFISTYQMLTNAK

SEQ ID NO: 3152631 - protein, 23 aa, Giardia lamblia
EETICPLCGELLPNSEAALTHYS

SEQ ID NO: 3152632 - protein, 18 aa, Giardia lamblia
EETIRTSVSVVMDKLQEQ

SEQ ID NO: 3152633 - protein, 19 aa, Giardia lamblia
EETLDEFDIEMARKEAEML

SEQ ID NO: 3152634 - protein, 19 aa, Giardia lamblia
EETLRFLTDGNDAAKQLSM

SEQ ID NO: 3152635 - protein, 22 aa, Giardia lamblia
EETRLGDSILELTVDSPMILGF

SEQ ID NO: 3152636 - protein, 18 aa, Giardia lamblia
EETVPLLLLEAGMKSQTG

SEQ ID NO: 3152637 - protein, 21 aa, Giardia lamblia
EETYKLFLFDILGDSQDNKPL

SEQ ID NO: 3152638 - protein, 17 aa, Giardia lamblia
EEVDAREATLCTLESTL

SEQ ID NO: 3152639 - protein, 18 aa, Giardia lamblia
EEVDLRPTYVDLRASTSA

SEQ ID NO: 3152640 - protein, 21 aa, Giardia lamblia
EEVHAFKAFLDIGLARASTGA

SEQ ID NO: 3152641 - protein, 17 aa, Giardia lamblia
EEVIRKHAMFLLRLNKL

SEQ ID NO: 3152642 - protein, 19 aa, Giardia lamblia
EEVKRVAMFRPYREFVEAA

SEQ ID NO: 3152643 - protein, 24 aa, Giardia lamblia
EEVLSRIGAKYGNSRIAASLESYL

SEQ ID NO: 3152644 - protein, 17 aa, Giardia lamblia
EEVPLAYTLYVARLSCI

SEQ ID NO: 3152645 - protein, 19 aa, Giardia lamblia
EEWHPSTKLGRLVKAGKIE

SEQ ID NO: 3152646 - protein, 19 aa, Giardia lamblia
EEYLRRMNFVEQRDMIGEC

SEQ ID NO: 3152647 - protein, 24 aa, Giardia lamblia
EEYMPRVRSRAIAYGAGNECVAYI

SEQ ID NO: 3152648 - protein, 27 aa, Giardia lamblia
EEYRIPQESLIKMAFYLREKGDEVTKL

SEQ ID NO: 3152649 - protein, 24 aa, Giardia lamblia
EEYWILRGRFAKTMAKMDQRHKLE

SEQ ID NO: 3152650 - protein, 20 aa, Giardia lamblia
EFAHLGIHPANIFLYADGAR

SEQ ID NO: 3152651 - protein, 38 aa, Giardia lamblia
EFASRCKRDYFNILSVYLDAVFRPALLKDPRIYAQEGW

SEQ ID NO: 3152652 - protein, 19 aa, Giardia lamblia
EFEAPASLCPECAGEESLL

SEQ ID NO: 3152653 - protein, 19 aa, Giardia lamblia
EFETCDLLAEQPEETYEET

SEQ ID NO: 3152654 - protein, 19 aa, Giardia lamblia
EFFAKRRLVTIFSAPNYCD

SEQ ID NO: 3152655 - protein, 17 aa, Giardia lamblia
EFFKDCLENTDFRSQLA

SEQ ID NO: 3152656 - protein, 25 aa, Giardia lamblia
EFFTRALRVYLRFSGDGSISISDSY

SEQ ID NO: 3152657 - protein, 24 aa, Giardia lamblia
EFHLPDKTGHFFMYQAGLTGSRQL

SEQ ID NO: 3152658 - protein, 27 aa, Giardia lamblia
EFIDGLFVTACELFRNFDINLLQLDMA

SEQ ID NO: 3152659 - protein, 18 aa, Giardia lamblia
EFIMELFEAGDLVEPSTM

SEQ ID NO: 3152660 - protein, 28 aa, Giardia lamblia
EFIRERARLLEAYLYSMHSITFVRTSNI

SEQ ID NO: 3152661 - protein, 26 aa, Giardia lamblia
EFISGCMLECGFAEGWVPDLSSVEDV

SEQ ID NO: 3152662 - protein, 17 aa, Giardia lamblia
EFLAAGVYQAMHPSLAD

SEQ ID NO: 3152663 - protein, 22 aa, Giardia lamblia
EFLHSLPTFLAIPCDLGASSGL

SEQ ID NO: 3152664 - protein, 24 aa, Giardia lamblia
EFLRELESRAGPINREFSKGRYML

SEQ ID NO: 3152665 - protein, 27 aa, Giardia lamblia
EFLRTILGCHGCQLVGYSELTGGGLYN

SEQ ID NO: 3152666 - protein, 24 aa, Giardia lamblia
EFLVCQNCGIICWHADSRKLTTKK

SEQ ID NO: 3152667 - protein, 17 aa, Giardia lamblia
EFNTCKVLNDILENVAS

SEQ ID NO: 3152668 - protein, 30 aa, Giardia lamblia
EFPCCVCIDRPAFVIIRPCMHMCICSQCVA

SEQ ID NO: 3152669 - protein, 22 aa, Giardia lamblia
EFPGCSLPPCTENGSLTPLMQA

SEQ ID NO: 3152670 - protein, 24 aa, Giardia lamblia
EFPKNASEIFTCLTSTVEAHSAIC

SEQ ID NO: 3152671 - protein, 21 aa, Giardia lamblia
EFPVEASPSLFGLHANAELTY

SEQ ID NO: 3152672 - protein, 19 aa, Giardia lamblia
EFQGSGVAVAKALVELRRR

SEQ ID NO: 3152673 - protein, 24 aa, Giardia lamblia
EFRFFKTNLDNIAYVYEVRTKCSA

SEQ ID NO: 3152674 - protein, 18 aa, Giardia lamblia
EFRGRNTLELSGELSSCR

SEQ ID NO: 3152675 - protein, 24 aa, Giardia lamblia
EFSDMPDCFSHFVSEEAEELLYHM

SEQ ID NO: 3152676 - protein, 26 aa, Giardia lamblia
EFSNLLPRFSEILNLKETIRAQASEV

SEQ ID NO: 3152677 - protein, 21 aa, Giardia lamblia
EFSSFCAIYRLGPTLLETIYI

SEQ ID NO: 3152678 - protein, 21 aa, Giardia lamblia
EFSVIKRPGLDVFLVSLAELY

SEQ ID NO: 3152679 - protein, 22 aa, Giardia lamblia
EFTDCIKILLPLEYTIRDKGKY

SEQ ID NO: 3152680 - protein, 19 aa, Giardia lamblia
EFVDKCINQPINRSSLQNL

SEQ ID NO: 3152681 - protein, 18 aa, Giardia lamblia
EFVKRLAPYEAGMQDRYS

SEQ ID NO: 3152682 - protein, 24 aa, Giardia lamblia
EFYALKLVAYHGMSTKLYDMQTSE

SEQ ID NO: 3152683 - protein, 30 aa, Giardia lamblia
EFYSIAAVFSCLRYSQLYIVLERAIMRKEH

SEQ ID NO: 3152684 - protein, 26 aa, Giardia lamblia
EFYSRGRASQMIPSISSITLGSGTDS

SEQ ID NO: 3152685 - protein, 32 aa, Giardia lamblia
EGACNCKKCWIYPRLGCYCFNFNKHLATHPQG

SEQ ID NO: 3152686 - protein, 23 aa, Giardia lamblia
EGAEINKSLLALKECIRAMDKSN

SEQ ID NO: 3152687 - protein, 20 aa, Giardia lamblia
EGALRCVFTAVDGARLFLCM

SEQ ID NO: 3152688 - protein, 24 aa, Giardia lamblia
EGAPKPKAYCILGAGVSTAVGLSA

SEQ ID NO: 3152689 - protein, 17 aa, Giardia lamblia
EGARWCMETSTIQESYS

SEQ ID NO: 3152690 - protein, 26 aa, Giardia lamblia
EGATLYSYWIPCRKIVAANDFIDRAI

SEQ ID NO: 3152691 - protein, 19 aa, Giardia lamblia
EGCYFPLDPPLSGMRTKLG

SEQ ID NO: 3152692 - protein, 23 aa, Giardia lamblia
EGDAVSVYCLLPSQGGLVDVDGK

SEQ ID NO: 3152693 - protein, 27 aa, Giardia lamblia
EGEASSYLCFRNSRTSMEIYFPIISTS

SEQ ID NO: 3152694 - protein, 25 aa, Giardia lamblia
EGEASYRICNSLALILESETPTEYS

SEQ ID NO: 3152695 - protein, 26 aa, Giardia lamblia
EGEKSCIPLFIQMCKVSSNLLIDLEA

SEQ ID NO: 3152696 - protein, 18 aa, Giardia lamblia
EGFFNRRFGADIVLPRYN

SEQ ID NO: 3152697 - protein, 23 aa, Giardia lamblia
EGFTCPSCGNIVVPPKTADIASY

SEQ ID NO: 3152698 - protein, 17 aa, Giardia lamblia
EGGGHEVLLCISDSVIV

SEQ ID NO: 3152699 - protein, 22 aa, Giardia lamblia
EGGGSLAFLLAYKVDDEDEEDG

SEQ ID NO: 3152700 - protein, 30 aa, Giardia lamblia
EGGLRRKDGKLALHLALKREDFKVAQLLTK

SEQ ID NO: 3152701 - protein, 21 aa, Giardia lamblia
EGHFKIARLLVKSEKRYQNSE

SEQ ID NO: 3152702 - protein, 21 aa, Giardia lamblia
EGHIDCVRVLMTREAGFMRPD

SEQ ID NO: 3152703 - protein, 18 aa, Giardia lamblia
EGHILWLLTDTYSSLMHQ

SEQ ID NO: 3152704 - protein, 18 aa, Giardia lamblia
EGHLDCVRVLIRSYEITL

SEQ ID NO: 3152705 - protein, 25 aa, Giardia lamblia
EGHMKCVQLLYGEINLGGFTMLMYA

SEQ ID NO: 3152706 - protein, 18 aa, Giardia lamblia
EGHSRLTYDTSINLLVLN

SEQ ID NO: 3152707 - protein, 19 aa, Giardia lamblia
EGHTALMIASRYAHTNMIK

SEQ ID NO: 3152708 - protein, 20 aa, Giardia lamblia
EGIIGRIYYLFDLRDATPLL

SEQ ID NO: 3152709 - protein, 17 aa, Giardia lamblia
EGIKNKLLEDVKKEMDY

SEQ ID NO: 3152710 - protein, 20 aa, Giardia lamblia
EGIQPGSIAPAFSESSSTIG

SEQ ID NO: 3152711 - protein, 17 aa, Giardia lamblia
EGIRSTYQGSFAIGSHK

SEQ ID NO: 3152712 - protein, 20 aa, Giardia lamblia
EGISSPRLIGSALSHTHTTE

SEQ ID NO: 3152713 - protein, 21 aa, Giardia lamblia
EGKCALSSLKDMFIRCTSVHL

SEQ ID NO: 3152714 - protein, 17 aa, Giardia lamblia
EGKGILQELARAVEESH

SEQ ID NO: 3152715 - protein, 48 aa, Giardia lamblia
EGKHSPRLCPATTLWAQYRCCRPVADLAGALFYGRRVCTMGTEHPPVV

SEQ ID NO: 3152716 - protein, 18 aa, Giardia lamblia
EGKLCTDCGQTALMNAVA

SEQ ID NO: 3152717 - protein, 20 aa, Giardia lamblia
EGKPPVVLESPLLVAESQRP

SEQ ID NO: 3152718 - protein, 24 aa, Giardia lamblia
EGKTALMFAARNGHLQAVTLLMEK

SEQ ID NO: 3152719 - protein, 19 aa, Giardia lamblia
EGKTALMLAAERDLCSIVK

SEQ ID NO: 3152720 - protein, 24 aa, Giardia lamblia
EGKVPAEVFVDGWRPDLSDVTDGF

SEQ ID NO: 3152721 - protein, 19 aa, Giardia lamblia
EGKYFRWEGPPDSSIAGEP

SEQ ID NO: 3152722 - protein, 24 aa, Giardia lamblia
EGLEKHIPPLLALLSEEHPFNITH

SEQ ID NO: 3152723 - protein, 18 aa, Giardia lamblia
EGLERWLSANSHLLTPKS

SEQ ID NO: 3152724 - protein, 20 aa, Giardia lamblia
EGLILGSLLLSFFPQKATRI

SEQ ID NO: 3152725 - protein, 20 aa, Giardia lamblia
EGLLSRSTGCTMSYCEHLRE

SEQ ID NO: 3152726 - protein, 24 aa, Giardia lamblia
EGLNRQRCASFGISRPLSCAPSCT

SEQ ID NO: 3152727 - protein, 24 aa, Giardia lamblia
EGLRSFKHLFLKHVYYADPGTKEP

SEQ ID NO: 3152728 - protein, 19 aa, Giardia lamblia
EGLSYADIAFIFVQLRHHI

SEQ ID NO: 3152729 - protein, 26 aa, Giardia lamblia
EGLVVPFCLNVAFILMDFDDTGKLLD

SEQ ID NO: 3152730 - protein, 19 aa, Giardia lamblia
EGMKLLISEMLKPDYNSRP

SEQ ID NO: 3152731 - protein, 21 aa, Giardia lamblia
EGMPGVSLFMTYSVDKSTLPP

SEQ ID NO: 3152732 - protein, 27 aa, Giardia lamblia
EGNLLPGNRLPTGYLHPTGNLQEFTVD

SEQ ID NO: 3152733 - protein, 20 aa, Giardia lamblia
EGNMGAGFTGYTADEMANVQ

SEQ ID NO: 3152734 - protein, 26 aa, Giardia lamblia
EGNRSGPCYRCSREAIIDTEESILHT

SEQ ID NO: 3152735 - protein, 17 aa, Giardia lamblia
EGPERLERIVLLSDLQL

SEQ ID NO: 3152736 - protein, 20 aa, Giardia lamblia
EGPISGKLALKVLRQTGIDS

SEQ ID NO: 3152737 - protein, 18 aa, Giardia lamblia
EGRAPWLAHQLRGLASFR

SEQ ID NO: 3152738 - protein, 20 aa, Giardia lamblia
EGRTALHHAAEHDSLDAFQI

SEQ ID NO: 3152739 - protein, 21 aa, Giardia lamblia
EGSGELLFRVETVACVQEYNA

SEQ ID NO: 3152740 - protein, 22 aa, Giardia lamblia
EGSKRYMALLSYNYKCTLEDYL

SEQ ID NO: 3152741 - protein, 18 aa, Giardia lamblia
EGSPRNGTAFYRTDSLQA

SEQ ID NO: 3152742 - protein, 28 aa, Giardia lamblia
EGSPVICRATSPLRISRSLTPAVYSATM

SEQ ID NO: 3152743 - protein, 22 aa, Giardia lamblia
EGSSEMQGIFGVATYDEPSSLL

SEQ ID NO: 3152744 - protein, 21 aa, Giardia lamblia
EGTFYTFNWASCRITEVAKLE

SEQ ID NO: 3152745 - protein, 26 aa, Giardia lamblia
EGTGRPNRFAHLTANSSGRSFTRPPQ

SEQ ID NO: 3152746 - protein, 22 aa, Giardia lamblia
EGTSERRSFCIVELDKSCWPLD

SEQ ID NO: 3152747 - protein, 24 aa, Giardia lamblia
EGVAAYLRNLHLFGQWGNPRYTAG

SEQ ID NO: 3152748 - protein, 21 aa, Giardia lamblia
EGVKNCATRKLVEAEYFIKNA

SEQ ID NO: 3152749 - protein, 18 aa, Giardia lamblia
EGVVTRWGVTRLPRKTRR

SEQ ID NO: 3152750 - protein, 25 aa, Giardia lamblia
EGWFDPRFPTVQGLMRRGLRPDALR

SEQ ID NO: 3152751 - protein, 20 aa, Giardia lamblia
EGWFSWAIKGDYEKIKENSY

SEQ ID NO: 3152752 - protein, 19 aa, Giardia lamblia
EGYLRKLAYSPIVTGESTL

SEQ ID NO: 3152753 - protein, 24 aa, Giardia lamblia
EGYVPVLQIRFAKRGNKKGVTQVF

SEQ ID NO: 3152754 - protein, 28 aa, Giardia lamblia
EGYYTLINTYLWDISRFNQLIDAFSEYL

SEQ ID NO: 3152755 - protein, 20 aa, Giardia lamblia
EHADDYVFHALALVRRLGTG

SEQ ID NO: 3152756 - protein, 18 aa, Giardia lamblia
EHAKRVTIMKPDMELATR

SEQ ID NO: 3152757 - protein, 18 aa, Giardia lamblia
EHALLSGRLELVRALLPL

SEQ ID NO: 3152758 - protein, 32 aa, Giardia lamblia
EHCSICLDEVAIIRALPCTHRLLCISCASCFQ

SEQ ID NO: 3152759 - protein, 25 aa, Giardia lamblia
EHDALAVPIHQSWRARGPRRRGCKI

SEQ ID NO: 3152760 - protein, 17 aa, Giardia lamblia
EHDCAPPLMSEKNTDDE

SEQ ID NO: 3152761 - protein, 27 aa, Giardia lamblia
EHDKLQLLYNFYLMKAKSFSARHKAEN

SEQ ID NO: 3152762 - protein, 26 aa, Giardia lamblia
EHENAICFKVKMTTALSKVFDAYCSK

SEQ ID NO: 3152763 - protein, 18 aa, Giardia lamblia
EHFSCGEWYLDRVGCDGV

SEQ ID NO: 3152764 - protein, 33 aa, Giardia lamblia
EHFYFKALNRLSPYFSIKDCRYSIGKQKECTQR

SEQ ID NO: 3152765 - protein, 25 aa, Giardia lamblia
EHGMVLRLSLYPSMKDSGISEEAAP

SEQ ID NO: 3152766 - protein, 18 aa, Giardia lamblia
EHGWRSISNRSFLRKPLR

SEQ ID NO: 3152767 - protein, 21 aa, Giardia lamblia
EHHPMCVKVLVDYEAGIKDQI

SEQ ID NO: 3152768 - protein, 17 aa, Giardia lamblia
EHIKLWSLLLLSELMHN

SEQ ID NO: 3152769 - protein, 21 aa, Giardia lamblia
EHIREAGNEYVGWLSYTDTTG

SEQ ID NO: 3152770 - protein, 23 aa, Giardia lamblia
EHIREMLEESSIERDILIDGSVI

SEQ ID NO: 3152771 - protein, 23 aa, Giardia lamblia
EHITHSLCTLEFGIRRESYDWVT

SEQ ID NO: 3152772 - protein, 17 aa, Giardia lamblia
EHLFPHYREAYGVPSID

SEQ ID NO: 3152773 - protein, 29 aa, Giardia lamblia
EHLMHLKSRLRTMSARGFTSADRLQDASF

SEQ ID NO: 3152774 - protein, 18 aa, Giardia lamblia
EHLNRIALIKNTPSKSYM

SEQ ID NO: 3152775 - protein, 26 aa, Giardia lamblia
EHMAYSLLCWLVKLLTTAEQSVAVAI

SEQ ID NO: 3152776 - protein, 17 aa, Giardia lamblia
EHMSAELSVNMQLKHAP

SEQ ID NO: 3152777 - protein, 23 aa, Giardia lamblia
EHNALHLPRSLFFTPDGKYKNYV

SEQ ID NO: 3152778 - protein, 24 aa, Giardia lamblia
EHNEPEFARLLIQCEAGLSRADGR

SEQ ID NO: 3152779 - protein, 18 aa, Giardia lamblia
EHNMRRLEESIATKLQSK

SEQ ID NO: 3152780 - protein, 18 aa, Giardia lamblia
EHPCSKTLLLTDYLSRGT

SEQ ID NO: 3152781 - protein, 18 aa, Giardia lamblia
EHPECALGGEELVELKSV

SEQ ID NO: 3152782 - protein, 21 aa, Giardia lamblia
EHPFIIRAMRNLGLVSHSSSP

SEQ ID NO: 3152783 - protein, 23 aa, Giardia lamblia
EHPPASKEFIAWLQTVNPSLRPF

SEQ ID NO: 3152784 - protein, 20 aa, Giardia lamblia
EHQLPHFLCREVQPTYFEKL

SEQ ID NO: 3152785 - protein, 18 aa, Giardia lamblia
EHRAEISLLTAKNADLLA

SEQ ID NO: 3152786 - protein, 20 aa, Giardia lamblia
EHRSIIKGKIAYVNMRMADL

SEQ ID NO: 3152787 - protein, 21 aa, Giardia lamblia
EHSIDLLPFYSGIKLNFIDVP

SEQ ID NO: 3152788 - protein, 20 aa, Giardia lamblia
EHSMLYSKFSSLITSTKEFL

SEQ ID NO: 3152789 - protein, 18 aa, Giardia lamblia
EHSYEIRYNNLLSKYTSM

SEQ ID NO: 3152790 - protein, 19 aa, Giardia lamblia
EHTKKGLLRGLSMATNVPV

SEQ ID NO: 3152791 - protein, 23 aa, Giardia lamblia
EHTKRELIELIQYPIRYKEKYQQ

SEQ ID NO: 3152792 - protein, 21 aa, Giardia lamblia
EHTRVGFLRSQFFRISLQTLF

SEQ ID NO: 3152793 - protein, 26 aa, Giardia lamblia
EHTTRPVSRTKFLSLTLIPPHMSAQQ

SEQ ID NO: 3152794 - protein, 17 aa, Giardia lamblia
EHVPRLRRQSSLLEARN

SEQ ID NO: 3152795 - protein, 24 aa, Giardia lamblia
EHVVCAACGSLLGMQLGGSVCREC

SEQ ID NO: 3152796 - protein, 17 aa, Giardia lamblia
EHWNNYEACCNRLGAIS

SEQ ID NO: 3152797 - protein, 24 aa, Giardia lamblia
EHYLVPVDILLDWDSKSSTSAPTA

SEQ ID NO: 3152798 - protein, 19 aa, Giardia lamblia
EIAAEFIFRVLPLSRFILL

SEQ ID NO: 3152799 - protein, 22 aa, Giardia lamblia
EIARSYPPNQLRNMQRTFQAIT

SEQ ID NO: 3152800 - protein, 24 aa, Giardia lamblia
EIAVALRRVLKLPATQICAPLLSL

SEQ ID NO: 3152801 - protein, 20 aa, Giardia lamblia
EICSGGVMIFALPHDIVGEL

SEQ ID NO: 3152802 - protein, 18 aa, Giardia lamblia
EICYTKGFYTGIMKMGPF

SEQ ID NO: 3152803 - protein, 18 aa, Giardia lamblia
EIDCLASFSYVSAGTLGE

SEQ ID NO: 3152804 - protein, 18 aa, Giardia lamblia
EIDEFVNVCMYLKSDGRL

SEQ ID NO: 3152805 - protein, 18 aa, Giardia lamblia
EIDELKKTVKAQEAEIAR

SEQ ID NO: 3152806 - protein, 17 aa, Giardia lamblia
EIDELNDALIYQERTVS

SEQ ID NO: 3152807 - protein, 23 aa, Giardia lamblia
EIDLLKAEINSLVQANGATITSG

SEQ ID NO: 3152808 - protein, 18 aa, Giardia lamblia
EIEARYKQEIARKDNLIS

SEQ ID NO: 3152809 - protein, 17 aa, Giardia lamblia
EIEATACVIVRVPVRAI

SEQ ID NO: 3152810 - protein, 18 aa, Giardia lamblia
EIEELKREIMEKNARIQE

SEQ ID NO: 3152811 - protein, 24 aa, Giardia lamblia
EIELLKRLKVEAVRRKQRHLQDEL

SEQ ID NO: 3152812 - protein, 17 aa, Giardia lamblia
EIEQLDFHHYLPIFFEG

SEQ ID NO: 3152813 - protein, 21 aa, Giardia lamblia
EIFHPRRISHVILTGNVTSAG

SEQ ID NO: 3152814 - protein, 21 aa, Giardia lamblia
EIFRILKKRLHKLQHDAKKTL

SEQ ID NO: 3152815 - protein, 22 aa, Giardia lamblia
EIGPRFCLHPYMIRLDTMESTA

SEQ ID NO: 3152816 - protein, 21 aa, Giardia lamblia
EIGRLQNLLMLMADRSLDNDA

SEQ ID NO: 3152817 - protein, 18 aa, Giardia lamblia
EIHKRFGTRYSRQELRMT

SEQ ID NO: 3152818 - protein, 22 aa, Giardia lamblia
EIIKAARPVDSLAQYRYNKDST

SEQ ID NO: 3152819 - protein, 20 aa, Giardia lamblia
EIILHIAYCVAGYNSVGDMY

SEQ ID NO: 3152820 - protein, 26 aa, Giardia lamblia
EIISQFIFPYCGLFDDTLTQAWLTSE

SEQ ID NO: 3152821 - protein, 22 aa, Giardia lamblia
EIKELSEAIAYPIAAFPTNKQI

SEQ ID NO: 3152822 - protein, 25 aa, Giardia lamblia
EIKILKSLYYRPSVTQKFDEVIMEK

SEQ ID NO: 3152823 - protein, 22 aa, Giardia lamblia
EIKSLVERHKRGLFECRETIVA

SEQ ID NO: 3152824 - protein, 20 aa, Giardia lamblia
EILAIRSIIGTDRFIQGMSR

SEQ ID NO: 3152825 - protein, 22 aa, Giardia lamblia
EILARMRILYTSLFNLYTNSNK

SEQ ID NO: 3152826 - protein, 20 aa, Giardia lamblia
EILCYMMVDILGYPPKEMIM

SEQ ID NO: 3152827 - protein, 21 aa, Giardia lamblia
EILDIIRRWDLFPDKNSLESF

SEQ ID NO: 3152828 - protein, 21 aa, Giardia lamblia
EILLPFIKAGLYNVLRRNSSG

SEQ ID NO: 3152829 - protein, 21 aa, Giardia lamblia
EILSLRRKLEDYVELSEVQRL

SEQ ID NO: 3152830 - protein, 21 aa, Giardia lamblia
EILSSLPKVSHCAAPSASLSR

SEQ ID NO: 3152831 - protein, 19 aa, Giardia lamblia
EILTGVFGSRAIKQSESTI

SEQ ID NO: 3152832 - protein, 21 aa, Giardia lamblia
EILVSSYLMGWLRASNHQKVY

SEQ ID NO: 3152833 - protein, 27 aa, Giardia lamblia
EIMEIPSLDFFLGVQFHPELLSRPLKP

SEQ ID NO: 3152834 - protein, 17 aa, Giardia lamblia
EIMELKKEMVFTASTPA

SEQ ID NO: 3152835 - protein, 18 aa, Giardia lamblia
EIMRVLSKYVGWTDLICA

SEQ ID NO: 3152836 - protein, 22 aa, Giardia lamblia
EINELLPMLRIEEIDAVNTDMF

SEQ ID NO: 3152837 - protein, 20 aa, Giardia lamblia
EINHRFEVLTGKSVQEAIET

SEQ ID NO: 3152838 - protein, 22 aa, Giardia lamblia
EIPCGYHKFFSAIQEKHSNAEL

SEQ ID NO: 3152839 - protein, 21 aa, Giardia lamblia
EIPEVTLFFAGKLYRGNRTQK

SEQ ID NO: 3152840 - protein, 20 aa, Giardia lamblia
EIPPQLGFQRDVRFNPCDYR

SEQ ID NO: 3152841 - protein, 20 aa, Giardia lamblia
EIPQEVKASIVNFLTDLQNR

SEQ ID NO: 3152842 - protein, 17 aa, Giardia lamblia
EIPRILRDNALRIAALR

SEQ ID NO: 3152843 - protein, 26 aa, Giardia lamblia
EIPSRKCPYDGWPLILHMAEATQKRT

SEQ ID NO: 3152844 - protein, 24 aa, Giardia lamblia
EIQCDEFLRRLGIAPEAETIERSV

SEQ ID NO: 3152845 - protein, 22 aa, Giardia lamblia
EIQEYAQALGFILPDDNDLLYI

SEQ ID NO: 3152846 - protein, 21 aa, Giardia lamblia
EIQLPVLGIRVSNTVTDLPTV

SEQ ID NO: 3152847 - protein, 17 aa, Giardia lamblia
EIQNLKARIDLRKKQLR

SEQ ID NO: 3152848 - protein, 24 aa, Giardia lamblia
EIQSRYSFPHYLILERLEDKASIS

SEQ ID NO: 3152849 - protein, 19 aa, Giardia lamblia
EIRASFDTVTFLGETVIPR

SEQ ID NO: 3152850 - protein, 23 aa, Giardia lamblia
EIRDVHLTFQMRRDLVKAYDVYA

SEQ ID NO: 3152851 - protein, 27 aa, Giardia lamblia
EIREISCQCALGLIRIAEKQGQSRRIL

SEQ ID NO: 3152852 - protein, 25 aa, Giardia lamblia
EIRELKELRICDSFIDGASRDRTDA

SEQ ID NO: 3152853 - protein, 27 aa, Giardia lamblia
EIRKKFATTKERAVCVVDPSTNKLTGV

SEQ ID NO: 3152854 - protein, 26 aa, Giardia lamblia
EIRKMSAEFDFNYSFLHQTLTDLKKI

SEQ ID NO: 3152855 - protein, 19 aa, Giardia lamblia
EIRQLQIKLAKQFIEEVAG

SEQ ID NO: 3152856 - protein, 18 aa, Giardia lamblia
EIRRAALNAAKAVVNSAR

SEQ ID NO: 3152857 - protein, 20 aa, Giardia lamblia
EISIRFSPSHINTILHAAKV

SEQ ID NO: 3152858 - protein, 25 aa, Giardia lamblia
EISKRIPVIRIRWANYRSAKELAMR

SEQ ID NO: 3152859 - protein, 24 aa, Giardia lamblia
EISLKRTCGVFITMNPGYAGRSEL

SEQ ID NO: 3152860 - protein, 19 aa, Giardia lamblia
EISPLDARGPHTALRGPDN

SEQ ID NO: 3152861 - protein, 20 aa, Giardia lamblia
EISPRNSLLRVREFEQCEIE

SEQ ID NO: 3152862 - protein, 25 aa, Giardia lamblia
EISPRRGASLLAFGSNLLVIGGRND

SEQ ID NO: 3152863 - protein, 19 aa, Giardia lamblia
EISQLKGRLVDAVASAKEE

SEQ ID NO: 3152864 - protein, 17 aa, Giardia lamblia
EISRFENEFSYISRQFL

SEQ ID NO: 3152865 - protein, 27 aa, Giardia lamblia
EISRLKERCSVMEGCNKDLQARADVSE

SEQ ID NO: 3152866 - protein, 28 aa, Giardia lamblia
EISRPVCAMGRLFQCIVLKPFAIFGDDN

SEQ ID NO: 3152867 - protein, 24 aa, Giardia lamblia
EISRREFNLLLTALCDYDVELYAD

SEQ ID NO: 3152868 - protein, 24 aa, Giardia lamblia
EISRWTDEFIQLFKGQEACLATVH

SEQ ID NO: 3152869 - protein, 19 aa, Giardia lamblia
EISYWKMAPATAMMIAAMN

SEQ ID NO: 3152870 - protein, 19 aa, Giardia lamblia
EITCPCMKYEAGGHCAILP

SEQ ID NO: 3152871 - protein, 19 aa, Giardia lamblia
EITDTGVLCRVMRKKKVHM

SEQ ID NO: 3152872 - protein, 20 aa, Giardia lamblia
EITLNVGMRMVVVEVQIGNQ

SEQ ID NO: 3152873 - protein, 23 aa, Giardia lamblia
EITRLRMKVDALLGTGNQSLNTL

SEQ ID NO: 3152874 - protein, 24 aa, Giardia lamblia
EITYRNVIIGSHIYCKMSKDIFGP

SEQ ID NO: 3152875 - protein, 20 aa, Giardia lamblia
EIVQLLAPLEADMHIVEDVP

SEQ ID NO: 3152876 - protein, 19 aa, Giardia lamblia
EIVSLREALQCLKATDPTI

SEQ ID NO: 3152877 - protein, 18 aa, Giardia lamblia
EIYGVDVSHGMVASSKSI

SEQ ID NO: 3152878 - protein, 21 aa, Giardia lamblia
EIYVLRVALRAKIAAITEGTD

SEQ ID NO: 3152879 - protein, 21 aa, Giardia lamblia
EKADIWALGCTIYEVCVGEPL

SEQ ID NO: 3152880 - protein, 17 aa, Giardia lamblia
EKADIWSLGCAIYEVCK

SEQ ID NO: 3152881 - protein, 34 aa, Giardia lamblia
EKADIWSLGCVIFHLCSLEFPFQAMTHADLARNV

SEQ ID NO: 3152882 - protein, 28 aa, Giardia lamblia
EKADLWSLGCLIYEFITGLKPLRVSPVM

SEQ ID NO: 3152883 - protein, 17 aa, Giardia lamblia
EKAEYKPKELFSKPPSR

SEQ ID NO: 3152884 - protein, 23 aa, Giardia lamblia
EKAPEHMPEAAFKSHIAKKIEET

SEQ ID NO: 3152885 - protein, 20 aa, Giardia lamblia
EKARSLGDCKKTAKHSQHGS

SEQ ID NO: 3152886 - protein, 17 aa, Giardia lamblia
EKAYRILTSTTLSDSVV

SEQ ID NO: 3152887 - protein, 24 aa, Giardia lamblia
EKCDIRVSQILTCAIPDYSEKLLV

SEQ ID NO: 3152888 - protein, 25 aa, Giardia lamblia
EKCIELKPSFGKGFLRKADALAAMG

SEQ ID NO: 3152889 - protein, 21 aa, Giardia lamblia
EKCPICRADVPSVGDTLSDPI

SEQ ID NO: 3152890 - protein, 18 aa, Giardia lamblia
EKCVREFNGNTSIFGDDY

SEQ ID NO: 3152891 - protein, 23 aa, Giardia lamblia
EKDAKSEVQIVRFTIGDAAHSTS

SEQ ID NO: 3152892 - protein, 19 aa, Giardia lamblia
EKDLLKADGFTDLMIAAVL

SEQ ID NO: 3152893 - protein, 29 aa, Giardia lamblia
EKDMRLSALSSTKCSSTMEQPCRETDGRR

SEQ ID NO: 3152894 - protein, 17 aa, Giardia lamblia
EKEACRFLCQLLNGLHF

SEQ ID NO: 3152895 - protein, 24 aa, Giardia lamblia
EKEACSVYIGDFCDGEPDGIGMSI

SEQ ID NO: 3152896 - protein, 24 aa, Giardia lamblia
EKEALKFNRLEAENAELRERVRTM

SEQ ID NO: 3152897 - protein, 17 aa, Giardia lamblia
EKEEFIMSLSVGSVLAE

SEQ ID NO: 3152898 - protein, 20 aa, Giardia lamblia
EKEFESFCDKCAVLKDQREA

SEQ ID NO: 3152899 - protein, 18 aa, Giardia lamblia
EKEGGLRDNGGWTALMSA

SEQ ID NO: 3152900 - protein, 21 aa, Giardia lamblia
EKEGLLKLVSQLKLTINELTL

SEQ ID NO: 3152901 - protein, 27 aa, Giardia lamblia
EKEIRLHSRLALISGIQPEMDNIEAMS

SEQ ID NO: 3152902 - protein, 19 aa, Giardia lamblia
EKEKLYLLFYHLCITGIES

SEQ ID NO: 3152903 - protein, 18 aa, Giardia lamblia
EKELFNLFHAFQPVELSL

SEQ ID NO: 3152904 - protein, 23 aa, Giardia lamblia
EKELNTCRAYRTFQSTINSTHRP

SEQ ID NO: 3152905 - protein, 24 aa, Giardia lamblia
EKELPSEALIPWRSQTGNQYHKIT

SEQ ID NO: 3152906 - protein, 18 aa, Giardia lamblia
EKEPRPSAVIPVKKAVAL

SEQ ID NO: 3152907 - protein, 20 aa, Giardia lamblia
EKERRAGETTVKEELLKQRD

SEQ ID NO: 3152908 - protein, 22 aa, Giardia lamblia
EKESTCKLGISTVLKGFYCPMI

SEQ ID NO: 3152909 - protein, 20 aa, Giardia lamblia
EKEVNLLLDLTKSREDRINV

SEQ ID NO: 3152910 - protein, 27 aa, Giardia lamblia
EKFATWCPPCRAMIPHLSKMAKKYKNV

SEQ ID NO: 3152911 - protein, 31 aa, Giardia lamblia
EKFGYKEGLNLFAFTYDWRQALHIASIQSAF

SEQ ID NO: 3152912 - protein, 22 aa, Giardia lamblia
EKFIFNEELDRLIAQLQEDIEA

SEQ ID NO: 3152913 - protein, 19 aa, Giardia lamblia
EKFLGAGVQQVLRERGSKT

SEQ ID NO: 3152914 - protein, 17 aa, Giardia lamblia
EKFRKRETNCLITTDGL

SEQ ID NO: 3152915 - protein, 19 aa, Giardia lamblia
EKFSACIELAAKRVPCVAG

SEQ ID NO: 3152916 - protein, 19 aa, Giardia lamblia
EKGERWCHLEVDPFGVVDS

SEQ ID NO: 3152917 - protein, 17 aa, Giardia lamblia
EKGHLSCASLVINKEAK

SEQ ID NO: 3152918 - protein, 22 aa, Giardia lamblia
EKGMWRWRNYRLRADYYPSQKI

SEQ ID NO: 3152919 - protein, 22 aa, Giardia lamblia
EKGRYDILCIHSKKIKLIGRSD

SEQ ID NO: 3152920 - protein, 21 aa, Giardia lamblia
EKHLRALKRLGPCPSCKKSRS

SEQ ID NO: 3152921 - protein, 17 aa, Giardia lamblia
EKHRLEIRYTKHSMQVS

SEQ ID NO: 3152922 - protein, 18 aa, Giardia lamblia
EKHTMLVQKLIYLLEGLG

SEQ ID NO: 3152923 - protein, 18 aa, Giardia lamblia
EKIARAISQERLVTTESL

SEQ ID NO: 3152924 - protein, 21 aa, Giardia lamblia
EKIEECFELLVPSFARLQDAT

SEQ ID NO: 3152925 - protein, 25 aa, Giardia lamblia
EKIEIKRLTAMYSKLESELTVKAIS

SEQ ID NO: 3152926 - protein, 21 aa, Giardia lamblia
EKIEQRRAAFASEREQLQAQA

SEQ ID NO: 3152927 - protein, 34 aa, Giardia lamblia
EKITCLTSQCPRCGVHLTILPRNAVESFAQAMSL

SEQ ID NO: 3152928 - protein, 20 aa, Giardia lamblia
EKITECDGLAVKLSLLEDEH

SEQ ID NO: 3152929 - protein, 25 aa, Giardia lamblia
EKKEGGLYRCARLVMADNAESLEDL

SEQ ID NO: 3152930 - protein, 30 aa, Giardia lamblia
EKKLHILLDCLRLLPFSQAVIFARDISRVT

SEQ ID NO: 3152931 - protein, 22 aa, Giardia lamblia
EKKQGFFRFEKPHAILLHSPVA

SEQ ID NO: 3152932 - protein, 22 aa, Giardia lamblia
EKKQRLNVDLSMKVKSLNEAEN

SEQ ID NO: 3152933 - protein, 28 aa, Giardia lamblia
EKKRFLYRRFLKYLHQWAPKQPSQLVPF

SEQ ID NO: 3152934 - protein, 21 aa, Giardia lamblia
EKKRLLLCYDGTYVTVLYVCH

SEQ ID NO: 3152935 - protein, 31 aa, Giardia lamblia
EKKTLECIRYAGMSTCFRKEVGRHGHDTLGI

SEQ ID NO: 3152936 - protein, 19 aa, Giardia lamblia
EKKYRLLLHRDQTLKCAVN

SEQ ID NO: 3152937 - protein, 20 aa, Giardia lamblia
EKLAKFLRHDREVLRFYAIW

SEQ ID NO: 3152938 - protein, 30 aa, Giardia lamblia
EKLARRLVTEIKRSEVASAVSAQASNSHES

SEQ ID NO: 3152939 - protein, 21 aa, Giardia lamblia
EKLCTLDHFRQIIAKASKQKG

SEQ ID NO: 3152940 - protein, 26 aa, Giardia lamblia
EKLDPNGLCVHRLYRDSCIQSNGVFV

SEQ ID NO: 3152941 - protein, 22 aa, Giardia lamblia
EKLELFIYDFFRTAPGDTQYAA

SEQ ID NO: 3152942 - protein, 23 aa, Giardia lamblia
EKLFECKDEPLGTGGFYTIHASN

SEQ ID NO: 3152943 - protein, 31 aa, Giardia lamblia
EKLHKEMPDVIGFIFILKALYRPSWGDYDSW

SEQ ID NO: 3152944 - protein, 25 aa, Giardia lamblia
EKLIYRFVFESGGAPVVGRAALETT

SEQ ID NO: 3152945 - protein, 17 aa, Giardia lamblia
EKLKEALDFALAENLSL

SEQ ID NO: 3152946 - protein, 17 aa, Giardia lamblia
EKLKVQYNTAIKERDIL

SEQ ID NO: 3152947 - protein, 19 aa, Giardia lamblia
EKLRLECKHLSDLERQLER

SEQ ID NO: 3152948 - protein, 21 aa, Giardia lamblia
EKLSPVLGICWAETFEKAVDI

SEQ ID NO: 3152949 - protein, 22 aa, Giardia lamblia
EKLSVRAAFAIAHMAAEANEHL

SEQ ID NO: 3152950 - protein, 29 aa, Giardia lamblia
EKMRVYKERAEFEVCTFKPELSARTEKIM

SEQ ID NO: 3152951 - protein, 17 aa, Giardia lamblia
EKNAELEVLLLQNDATF

SEQ ID NO: 3152952 - protein, 26 aa, Giardia lamblia
EKNARPIRPLVRIRESDLDVCDLTSS

SEQ ID NO: 3152953 - protein, 23 aa, Giardia lamblia
EKNASATLRGWESMQRRRIATII

SEQ ID NO: 3152954 - protein, 20 aa, Giardia lamblia
EKNGFGVIVHRDISLKNILV

SEQ ID NO: 3152955 - protein, 28 aa, Giardia lamblia
EKNPKIYPVWEHRAFVFHRLLALADDPE

SEQ ID NO: 3152956 - protein, 21 aa, Giardia lamblia
EKNQRGFAIYVMDPILQLFDA

SEQ ID NO: 3152957 - protein, 25 aa, Giardia lamblia
EKNSLQRRWDCILRQLDDYEALIAA

SEQ ID NO: 3152958 - protein, 25 aa, Giardia lamblia
EKPEIVRAAAIPRKHSALTNHADMP

SEQ ID NO: 3152959 - protein, 28 aa, Giardia lamblia
EKPFNCPHGRPVLRFLDLAPRADSTDED

SEQ ID NO: 3152960 - protein, 17 aa, Giardia lamblia
EKPLGMKPARPIDEEIQ

SEQ ID NO: 3152961 - protein, 18 aa, Giardia lamblia
EKPMSLQQFLSRVKGTCV

SEQ ID NO: 3152962 - protein, 17 aa, Giardia lamblia
EKPPESVKIVKNAPLIQ

SEQ ID NO: 3152963 - protein, 20 aa, Giardia lamblia
EKPYKSSLMYGIDLSNLYNL

SEQ ID NO: 3152964 - protein, 20 aa, Giardia lamblia
EKQDRPALSESYRTMLADRL

SEQ ID NO: 3152965 - protein, 19 aa, Giardia lamblia
EKRAGPRASTQAWLDLCLT

SEQ ID NO: 3152966 - protein, 29 aa, Giardia lamblia
EKRDALMLHRLLLRWKRNARLEASHNHVI

SEQ ID NO: 3152967 - protein, 20 aa, Giardia lamblia
EKRHAEEVVFLKKQVVQLKS

SEQ ID NO: 3152968 - protein, 25 aa, Giardia lamblia
EKRKVSRLPAPSAEFRSSARSADLH

SEQ ID NO: 3152969 - protein, 22 aa, Giardia lamblia
EKRLNEYAKLVNLQAQCSKDDQ

SEQ ID NO: 3152970 - protein, 19 aa, Giardia lamblia
EKRLRDRELAHLRDRMSEY

SEQ ID NO: 3152971 - protein, 20 aa, Giardia lamblia
EKRMLNLRYLLAEEEKIRME

SEQ ID NO: 3152972 - protein, 24 aa, Giardia lamblia
EKRPKNCPNDGFLGSTLTIGGRSL

SEQ ID NO: 3152973 - protein, 18 aa, Giardia lamblia
EKSELCRVDYTLELMCYI

SEQ ID NO: 3152974 - protein, 23 aa, Giardia lamblia
EKSELQASLSVARAEYDILVRKL

SEQ ID NO: 3152975 - protein, 24 aa, Giardia lamblia
EKSIKRYSIGRVYRRDKPVMEKGR

SEQ ID NO: 3152976 - protein, 20 aa, Giardia lamblia
EKSKGALRLIEDQIAANENA

SEQ ID NO: 3152977 - protein, 19 aa, Giardia lamblia
EKSLLCLLHNNIAPPRIRK

SEQ ID NO: 3152978 - protein, 17 aa, Giardia lamblia
EKSRLQVLLDEKTKEVG

SEQ ID NO: 3152979 - protein, 17 aa, Giardia lamblia
EKSSACIDSTPSSTPYS

SEQ ID NO: 3152980 - protein, 19 aa, Giardia lamblia
EKSYHCSLHDASRGETPYI

SEQ ID NO: 3152981 - protein, 23 aa, Giardia lamblia
EKTDIWSFGSLAVYMLTGAPPAF

SEQ ID NO: 3152982 - protein, 22 aa, Giardia lamblia
EKTETDMTAWAQAYNVANDLLE

SEQ ID NO: 3152983 - protein, 23 aa, Giardia lamblia
EKTGEYRPRYGYRRRTDNTIEFD

SEQ ID NO: 3152984 - protein, 19 aa, Giardia lamblia
EKTLECDILNDKLQKLSAE

SEQ ID NO: 3152985 - protein, 24 aa, Giardia lamblia
EKTPWDRFCKIQYDIFVNSSGSYE

SEQ ID NO: 3152986 - protein, 24 aa, Giardia lamblia
EKTTEFFLLKLLRINHLVVSGEAL

SEQ ID NO: 3152987 - protein, 18 aa, Giardia lamblia
EKVKWLSLGKDLANYPLY

SEQ ID NO: 3152988 - protein, 26 aa, Giardia lamblia
EKVLKELLAMEVSYRTSRIITEKLFE

SEQ ID NO: 3152989 - protein, 24 aa, Giardia lamblia
EKVLRTNLWARFSFTESADEFEAM

SEQ ID NO: 3152990 - protein, 18 aa, Giardia lamblia
EKVMPRVYFKLASELGYK

SEQ ID NO: 3152991 - protein, 20 aa, Giardia lamblia
EKVTMRLIEFQKSLYDQTYA

SEQ ID NO: 3152992 - protein, 19 aa, Giardia lamblia
EKVTYWDVGAFSEITKENR

SEQ ID NO: 3152993 - protein, 24 aa, Giardia lamblia
EKYARPDYYKMLGVGKSVDPSSQE

SEQ ID NO: 3152994 - protein, 21 aa, Giardia lamblia
EKYAVLPSEFTQVKTLFIPVS

SEQ ID NO: 3152995 - protein, 21 aa, Giardia lamblia
EKYEEACKMLATKENGEDAVK

SEQ ID NO: 3152996 - protein, 19 aa, Giardia lamblia
EKYIPPLIDYVLNGVKLNS

SEQ ID NO: 3152997 - protein, 18 aa, Giardia lamblia
EKYLCGMASTSVERTEGA

SEQ ID NO: 3152998 - protein, 19 aa, Giardia lamblia
EKYLRCLAKARLDYRDGPF

SEQ ID NO: 3152999 - protein, 17 aa, Giardia lamblia
EKYPACFSAGKINIIEK

SEQ ID NO: 3153000 - protein, 27 aa, Giardia lamblia
EKYQVVCKALRLFDSRLLLSALQSVNS

SEQ ID NO: 3153001 - protein, 19 aa, Giardia lamblia
EKYSLLRLDELVYFHSPLR

SEQ ID NO: 3153002 - protein, 26 aa, Giardia lamblia
ELAALKPHILTVAGRMAAAKCLFAER

SEQ ID NO: 3153003 - protein, 17 aa, Giardia lamblia
ELAEKLLTLNAVDENYM

SEQ ID NO: 3153004 - protein, 17 aa, Giardia lamblia
ELAERWYSNEAFSEQPG

SEQ ID NO: 3153005 - protein, 17 aa, Giardia lamblia
ELAHIKPQFDLRIHLED

SEQ ID NO: 3153006 - protein, 25 aa, Giardia lamblia
ELAKLPFFVNQPIRVMPDCHSGKGT

SEQ ID NO: 3153007 - protein, 20 aa, Giardia lamblia
ELAKRVRRLLTLQHRSALSQ

SEQ ID NO: 3153008 - protein, 28 aa, Giardia lamblia
ELANIYLGWCRRYPIVSFEDPFDEEDHT

SEQ ID NO: 3153009 - protein, 24 aa, Giardia lamblia
ELAQEREHCFAIRNQLVDTRNNAL

SEQ ID NO: 3153010 - protein, 19 aa, Giardia lamblia
ELAQSIIESMLKYDSSSRS

SEQ ID NO: 3153011 - protein, 17 aa, Giardia lamblia
ELARCKQELEGYKSKLA

SEQ ID NO: 3153012 - protein, 17 aa, Giardia lamblia
ELARCRERNTAIREQIA

SEQ ID NO: 3153013 - protein, 24 aa, Giardia lamblia
ELARIPSDITATIKRLQDAENECE

SEQ ID NO: 3153014 - protein, 26 aa, Giardia lamblia
ELARLRLRLDESLPALDTLRSEVELL

SEQ ID NO: 3153015 - protein, 24 aa, Giardia lamblia
ELAVPRFNEQWLDACHTNHLVGVL

SEQ ID NO: 3153016 - protein, 24 aa, Giardia lamblia
ELAYLYRNIDIFEVVFAAERSLIL

SEQ ID NO: 3153017 - protein, 21 aa, Giardia lamblia
ELCAQFVGGASYVDISNLERA

SEQ ID NO: 3153018 - protein, 21 aa, Giardia lamblia
ELCDILAPLEWPLTLSDGKDA

SEQ ID NO: 3153019 - protein, 17 aa, Giardia lamblia
ELCMLYERLHTQENILR

SEQ ID NO: 3153020 - protein, 26 aa, Giardia lamblia
ELCTVRCLPCSHDVACPSCVRDILEA

SEQ ID NO: 3153021 - protein, 19 aa, Giardia lamblia
ELDAPVIAAVVARVCGGDA

SEQ ID NO: 3153022 - protein, 18 aa, Giardia lamblia
ELDEAACQEGVLNTVQRP

SEQ ID NO: 3153023 - protein, 17 aa, Giardia lamblia
ELDELRDKFELTDEERN

SEQ ID NO: 3153024 - protein, 24 aa, Giardia lamblia
ELDFQEIANFLAPLEGTFLSGVRR

SEQ ID NO: 3153025 - protein, 24 aa, Giardia lamblia
ELDKSCWPLDNRIWLTEDTIPDTE

SEQ ID NO: 3153026 - protein, 22 aa, Giardia lamblia
ELDKSKGALVLLRNEREDLLQQ

SEQ ID NO: 3153027 - protein, 36 aa, Giardia lamblia
ELDRLSCALRECQPCTRPLLLETQVNAIWNFSNDAF

SEQ ID NO: 3153028 - protein, 26 aa, Giardia lamblia
ELEAGCSAFMRLEWSIVKNRLDMADF

SEQ ID NO: 3153029 - protein, 27 aa, Giardia lamblia
ELEARKNMFDDYRWKKIEELKSMGVED

SEQ ID NO: 3153030 - protein, 31 aa, Giardia lamblia
ELEATFAPTFFRVIQLFSLLPERLNYMMNMA

SEQ ID NO: 3153031 - protein, 20 aa, Giardia lamblia
ELEAYPFAGTMKDIIFTMWM

SEQ ID NO: 3153032 - protein, 25 aa, Giardia lamblia
ELECSVAAKVLRVRIHLLTPDDDVR

SEQ ID NO: 3153033 - protein, 21 aa, Giardia lamblia
ELEGPCRRRSLSSKGSEGRVS

SEQ ID NO: 3153034 - protein, 20 aa, Giardia lamblia
ELEGSALLKRCHHSKDTDAT

SEQ ID NO: 3153035 - protein, 27 aa, Giardia lamblia
ELEISCNLCKGYIPPVKDLVLTEWQDV

SEQ ID NO: 3153036 - protein, 23 aa, Giardia lamblia
ELEKEMRARVEVMVEKEKELQER

SEQ ID NO: 3153037 - protein, 22 aa, Giardia lamblia
ELELKQRPLAREYTTVDMTITQ

SEQ ID NO: 3153038 - protein, 23 aa, Giardia lamblia
ELELRGAILNELTVAFSEPIHIA

SEQ ID NO: 3153039 - protein, 18 aa, Giardia lamblia
ELEPELPERMTVGEEMDG

SEQ ID NO: 3153040 - protein, 23 aa, Giardia lamblia
ELERLRLQVASLTIGAHILDHKI

SEQ ID NO: 3153041 - protein, 19 aa, Giardia lamblia
ELESDVVRLTQKVSSHTSV

SEQ ID NO: 3153042 - protein, 18 aa, Giardia lamblia
ELESGVTLHAGMQKAALW

SEQ ID NO: 3153043 - protein, 22 aa, Giardia lamblia
ELESISAEAARVLQTMEANNSR

SEQ ID NO: 3153044 - protein, 22 aa, Giardia lamblia
ELEVSRFKALIEEMHSEIRMLS

SEQ ID NO: 3153045 - protein, 27 aa, Giardia lamblia
ELFDWYVQLPIFFPHIQKYFHPDKHIL

SEQ ID NO: 3153046 - protein, 17 aa, Giardia lamblia
ELFGKYAKTGYISEDGF

SEQ ID NO: 3153047 - protein, 26 aa, Giardia lamblia
ELFLFNILLSQKWGHLDMSFTDCKNV

SEQ ID NO: 3153048 - protein, 32 aa, Giardia lamblia
ELFLRCRSDPLLKACTYLAMASNGVYTVYTQK

SEQ ID NO: 3153049 - protein, 23 aa, Giardia lamblia
ELFRLDIDHNIEFSSKDLLSYTD

SEQ ID NO: 3153050 - protein, 19 aa, Giardia lamblia
ELFSPSLFSSVYESVCSDY

SEQ ID NO: 3153051 - protein, 20 aa, Giardia lamblia
ELFYTCQYQSYAIAKLEEHI

SEQ ID NO: 3153052 - protein, 23 aa, Giardia lamblia
ELGAQLKESVNWQRDARSSDYPQ

SEQ ID NO: 3153053 - protein, 25 aa, Giardia lamblia
ELGDFKARLADAIREISDLRSSARD

SEQ ID NO: 3153054 - protein, 25 aa, Giardia lamblia
ELGGRLSTLLNQWSNYRTQDGFSVP

SEQ ID NO: 3153055 - protein, 19 aa, Giardia lamblia
ELGIKLTLLKKAAAEIARL

SEQ ID NO: 3153056 - protein, 27 aa, Giardia lamblia
ELGISREEFLFLGSPPEIKKLVNEDLS

SEQ ID NO: 3153057 - protein, 29 aa, Giardia lamblia
ELGQFVCFTARLALLFQVATRFCEIRMNN

SEQ ID NO: 3153058 - protein, 20 aa, Giardia lamblia
ELHADLSRLRADHIRTKRTQ

SEQ ID NO: 3153059 - protein, 20 aa, Giardia lamblia
ELHILMTSRHPFIMTLHASF

SEQ ID NO: 3153060 - protein, 21 aa, Giardia lamblia
ELHITGGCKRVIISAPSADAP

SEQ ID NO: 3153061 - protein, 28 aa, Giardia lamblia
ELHVDLCPGCLRHRPHGCRGERAPDEAD

SEQ ID NO: 3153062 - protein, 24 aa, Giardia lamblia
ELIAFHGPWCKDCQYSIPVFNRIM

SEQ ID NO: 3153063 - protein, 20 aa, Giardia lamblia
ELIEKLLMLHQIRLAETENQ

SEQ ID NO: 3153064 - protein, 19 aa, Giardia lamblia
ELIELARNVVKCARKRRRL

SEQ ID NO: 3153065 - protein, 17 aa, Giardia lamblia
ELIIKHRLSLHHCNLPS

SEQ ID NO: 3153066 - protein, 20 aa, Giardia lamblia
ELIMRLNRCCIYYREMQIIS

SEQ ID NO: 3153067 - protein, 24 aa, Giardia lamblia
ELIMRSCIMSSVFISLTEPSPGIH

SEQ ID NO: 3153068 - protein, 22 aa, Giardia lamblia
ELIRKLPPPSVHVSTQRPKDQF

SEQ ID NO: 3153069 - protein, 23 aa, Giardia lamblia
ELIRRGDRVSCHTTRKIIREKGD

SEQ ID NO: 3153070 - protein, 18 aa, Giardia lamblia
ELISISGNDVRSCLNSLQ

SEQ ID NO: 3153071 - protein, 25 aa, Giardia lamblia
ELITFHGPWCKDCQYSIPVFNRIMT

SEQ ID NO: 3153072 - protein, 18 aa, Giardia lamblia
ELITYPWIQKNWALNHDG

SEQ ID NO: 3153073 - protein, 18 aa, Giardia lamblia
ELIVDRFGNYVFQYSLEK

SEQ ID NO: 3153074 - protein, 20 aa, Giardia lamblia
ELKAECAARETELKALLQKH

SEQ ID NO: 3153075 - protein, 24 aa, Giardia lamblia
ELKDAGEVLIQWVGEHDAYTHITK

SEQ ID NO: 3153076 - protein, 31 aa, Giardia lamblia
ELKEHLRPLLGARLLMRPQLFRPHQDQRLVE

SEQ ID NO: 3153077 - protein, 23 aa, Giardia lamblia
ELKFACQDCAKFYTSSILPLLDS

SEQ ID NO: 3153078 - protein, 25 aa, Giardia lamblia
ELKGHKFVICNGLVIPKDLLEDKVL

SEQ ID NO: 3153079 - protein, 20 aa, Giardia lamblia
ELKHAVKHKLAYFAKSSMCS

SEQ ID NO: 3153080 - protein, 28 aa, Giardia lamblia
ELKKSEGNSILFIDEIHTLIGAGGSKGT

SEQ ID NO: 3153081 - protein, 18 aa, Giardia lamblia
ELKMPYKSLQFFDEATVL

SEQ ID NO: 3153082 - protein, 23 aa, Giardia lamblia
ELKRAINHLKIIKPQSGKAISQL

SEQ ID NO: 3153083 - protein, 22 aa, Giardia lamblia
ELKTRCIELLESLTMAQSEVAR

SEQ ID NO: 3153084 - protein, 28 aa, Giardia lamblia
ELKYGSFKCAFSYIFQYFLREEILYSPL

SEQ ID NO: 3153085 - protein, 27 aa, Giardia lamblia
ELLASRVYRIIGFKCASMLPLAAALFT

SEQ ID NO: 3153086 - protein, 25 aa, Giardia lamblia
ELLCLQNPLFPWVSLYRAADVVYNP

SEQ ID NO: 3153087 - protein, 23 aa, Giardia lamblia
ELLDRIWEKLGIIRVYTKPRAGK

SEQ ID NO: 3153088 - protein, 17 aa, Giardia lamblia
ELLECLYETINLLTPNS

SEQ ID NO: 3153089 - protein, 22 aa, Giardia lamblia
ELLEHKRKLHAKDQELSSVIIK

SEQ ID NO: 3153090 - protein, 25 aa, Giardia lamblia
ELLEIKRGIKESAFHAEDISWELED

SEQ ID NO: 3153091 - protein, 18 aa, Giardia lamblia
ELLEISRIYKEVMAQQSK

SEQ ID NO: 3153092 - protein, 21 aa, Giardia lamblia
ELLENREIILAGLAEVPFTRT

SEQ ID NO: 3153093 - protein, 29 aa, Giardia lamblia
ELLESCFKQAIAFSAHLVLPILAENLLAA

SEQ ID NO: 3153094 - protein, 25 aa, Giardia lamblia
ELLGKEFRRGYALLRKTEKPLDRLF

SEQ ID NO: 3153095 - protein, 19 aa, Giardia lamblia
ELLGMITICGSTLCEDDQY

SEQ ID NO: 3153096 - protein, 29 aa, Giardia lamblia
ELLLKDEACMFRKDGMRALDIAEACGNTA

SEQ ID NO: 3153097 - protein, 18 aa, Giardia lamblia
ELLLKRPFSASILSEVGK

SEQ ID NO: 3153098 - protein, 21 aa, Giardia lamblia
ELLLLRLFKVYNRSWSQYVAY

SEQ ID NO: 3153099 - protein, 19 aa, Giardia lamblia
ELLNHPWLIKNANSLMRQK

SEQ ID NO: 3153100 - protein, 18 aa, Giardia lamblia
ELLNQIWAKGHPQPQAES

SEQ ID NO: 3153101 - protein, 20 aa, Giardia lamblia
ELLQQKEFQLDQALQQSVKS

SEQ ID NO: 3153102 - protein, 22 aa, Giardia lamblia
ELLRCMVVPDIPSVPEKTSKDR

SEQ ID NO: 3153103 - protein, 19 aa, Giardia lamblia
ELLRCRKVKEEFGDIFELV

SEQ ID NO: 3153104 - protein, 25 aa, Giardia lamblia
ELLSCHRPGLFVGDWDVELPAEAQE

SEQ ID NO: 3153105 - protein, 26 aa, Giardia lamblia
ELLSIPPPCLPQWGTPFSIQQIPSSS

SEQ ID NO: 3153106 - protein, 21 aa, Giardia lamblia
ELLSSDAFYKFVLALDPADLP

SEQ ID NO: 3153107 - protein, 21 aa, Giardia lamblia
ELLSSDAFYKFVLALEPADLP

SEQ ID NO: 3153108 - protein, 17 aa, Giardia lamblia
ELLVQPAILRLLLEIAF

SEQ ID NO: 3153109 - protein, 21 aa, Giardia lamblia
ELLVREVEDILGYKVAPSQVV

SEQ ID NO: 3153110 - protein, 17 aa, Giardia lamblia
ELLYVDHIEAIKAIMDS

SEQ ID NO: 3153111 - protein, 19 aa, Giardia lamblia
ELMEKRIIEYIAEKHQVNL

SEQ ID NO: 3153112 - protein, 17 aa, Giardia lamblia
ELMKRVLQLQASPDRVA

SEQ ID NO: 3153113 - protein, 25 aa, Giardia lamblia
ELMPSGCLKKYLKKNPTALTTPVLK

SEQ ID NO: 3153114 - protein, 21 aa, Giardia lamblia
ELMTVLLCGVRAPKYNSKDPG

SEQ ID NO: 3153115 - protein, 19 aa, Giardia lamblia
ELNCAQVFSLYVGHTEKNI

SEQ ID NO: 3153116 - protein, 25 aa, Giardia lamblia
ELNDLRLKYNVLYKEYQELQSTHSI

SEQ ID NO: 3153117 - protein, 24 aa, Giardia lamblia
ELNRRSPLDLVFFDACVAHILRIS

SEQ ID NO: 3153118 - protein, 20 aa, Giardia lamblia
ELNSMLSLPPGRNGPYFLKN

SEQ ID NO: 3153119 - protein, 22 aa, Giardia lamblia
ELPADFPFFSVSAFNDAVIQLR

SEQ ID NO: 3153120 - protein, 23 aa, Giardia lamblia
ELPDKPWRSRDCTPAKLSQYFNY

SEQ ID NO: 3153121 - protein, 20 aa, Giardia lamblia
ELPLSRTLRPDLSKMADDFS

SEQ ID NO: 3153122 - protein, 21 aa, Giardia lamblia
ELQEHKIFFGDNLQFESDNWN

SEQ ID NO: 3153123 - protein, 17 aa, Giardia lamblia
ELQIWEILAQIAAGLAY

SEQ ID NO: 3153124 - protein, 20 aa, Giardia lamblia
ELQIYLKEVVDLREALRNKI

SEQ ID NO: 3153125 - protein, 25 aa, Giardia lamblia
ELQLIPYGSFVTRIFLPDGDIDLAI

SEQ ID NO: 3153126 - protein, 19 aa, Giardia lamblia
ELQNKIVRIEHYMEDMMRE

SEQ ID NO: 3153127 - protein, 19 aa, Giardia lamblia
ELQSFPLVKDLAAMGTEYI

SEQ ID NO: 3153128 - protein, 20 aa, Giardia lamblia
ELRALKKPSLDDVHSSLMQL

SEQ ID NO: 3153129 - protein, 43 aa, Giardia lamblia
ELRDLHYYRVRTVRIFAKLLHDLQLRWIRHSSERMRGTDGFIV

SEQ ID NO: 3153130 - protein, 17 aa, Giardia lamblia
ELRECLTQRTLEMTASK

SEQ ID NO: 3153131 - protein, 20 aa, Giardia lamblia
ELRHMAVQAFSMYIRGYSMK

SEQ ID NO: 3153132 - protein, 28 aa, Giardia lamblia
ELRKLLPKDCFFISRSVFQKNFLSVCKS

SEQ ID NO: 3153133 - protein, 31 aa, Giardia lamblia
ELRNCEAGMQCARGYTALMYAAAAGHKAAVA

SEQ ID NO: 3153134 - protein, 24 aa, Giardia lamblia
ELRSMKDSVIERLTRQVRSTSSRM

SEQ ID NO: 3153135 - protein, 21 aa, Giardia lamblia
ELSEFRKLHQADIESHQSTLT

SEQ ID NO: 3153136 - protein, 21 aa, Giardia lamblia
ELSGSVLRLACPGGIGHVQFR

SEQ ID NO: 3153137 - protein, 22 aa, Giardia lamblia
ELSHPNLIRYEGIYKSNNAIYM

SEQ ID NO: 3153138 - protein, 23 aa, Giardia lamblia
ELSKKLCSNICSMNYEALGFNYS

SEQ ID NO: 3153139 - protein, 24 aa, Giardia lamblia
ELSKNKKCAILFRQNGGIYGLLTL

SEQ ID NO: 3153140 - protein, 36 aa, Giardia lamblia
ELSLPEIHGLSVLLPGEMKPVLTVGSSRFANPSLIC

SEQ ID NO: 3153141 - protein, 18 aa, Giardia lamblia
ELSNCIRSICSEMSSKNV

SEQ ID NO: 3153142 - protein, 24 aa, Giardia lamblia
ELSNLKNYCRFLENEVAALRSDLI

SEQ ID NO: 3153143 - protein, 23 aa, Giardia lamblia
ELSSKLKTPFLLEAKQPRTVYVA

SEQ ID NO: 3153144 - protein, 25 aa, Giardia lamblia
ELSSRSHAILSIAVEQAVQVKNTSD

SEQ ID NO: 3153145 - protein, 19 aa, Giardia lamblia
ELTACPQILSASIREVRLS

SEQ ID NO: 3153146 - protein, 19 aa, Giardia lamblia
ELTARLQIVSRQRYNKELI

SEQ ID NO: 3153147 - protein, 20 aa, Giardia lamblia
ELTDLPSFAFWVLLDAAQAY

SEQ ID NO: 3153148 - protein, 33 aa, Giardia lamblia
ELTKITGCILPFGGLSCRLTMSYLNKLYNRYSS

SEQ ID NO: 3153149 - protein, 20 aa, Giardia lamblia
ELTKSRRGYGHKISSDNDNI

SEQ ID NO: 3153150 - protein, 24 aa, Giardia lamblia
ELTLHAGSFSWIKCTSELMRYLYT

SEQ ID NO: 3153151 - protein, 18 aa, Giardia lamblia
ELTLTGAEFLKGLDTNPK

SEQ ID NO: 3153152 - protein, 19 aa, Giardia lamblia
ELTNDVSFIRWYEAERDPE

SEQ ID NO: 3153153 - protein, 20 aa, Giardia lamblia
ELTQQIAFMCYQLTFKTNLI

SEQ ID NO: 3153154 - protein, 19 aa, Giardia lamblia
ELTQRCSELELLRKEVDSL

SEQ ID NO: 3153155 - protein, 31 aa, Giardia lamblia
ELTTLYFKALCDFHVLFPLLQDIRSVVAQIS

SEQ ID NO: 3153156 - protein, 27 aa, Giardia lamblia
ELTTSLPRKLIWMNPVYREPFNDVRDL

SEQ ID NO: 3153157 - protein, 21 aa, Giardia lamblia
ELTVACWNCVEAVYMVAPAGI

SEQ ID NO: 3153158 - protein, 24 aa, Giardia lamblia
ELTWLELESLFALLQAYNAEVRIK

SEQ ID NO: 3153159 - protein, 18 aa, Giardia lamblia
ELVAIVLALRKEVEVKNK

SEQ ID NO: 3153160 - protein, 17 aa, Giardia lamblia
ELVALGTCDKVIAERAT

SEQ ID NO: 3153161 - protein, 21 aa, Giardia lamblia
ELVDICTVYSIYNSFGLVLVT

SEQ ID NO: 3153162 - protein, 17 aa, Giardia lamblia
ELVDIRAAFDDFLSEMD

SEQ ID NO: 3153163 - protein, 29 aa, Giardia lamblia
ELVHPLQVLFKFFAFYSAFDFTNNTITAF

SEQ ID NO: 3153164 - protein, 24 aa, Giardia lamblia
ELVKEARLTFMDNVFPGILPLTNV

SEQ ID NO: 3153165 - protein, 18 aa, Giardia lamblia
ELVLSVLRQLAAALAYLH

SEQ ID NO: 3153166 - protein, 25 aa, Giardia lamblia
ELVPKTWRLLVFVATKHHCEYLTSI

SEQ ID NO: 3153167 - protein, 17 aa, Giardia lamblia
ELVREFLHEAGRQNTYG

SEQ ID NO: 3153168 - protein, 17 aa, Giardia lamblia
ELVRRIREETSRVPKNS

SEQ ID NO: 3153169 - protein, 17 aa, Giardia lamblia
ELVSCIDMATTQGDVQM

SEQ ID NO: 3153170 - protein, 25 aa, Giardia lamblia
ELVSLPVKVRQAATVMAKYHDWSSF

SEQ ID NO: 3153171 - protein, 20 aa, Giardia lamblia
ELVSRIKALKGYDVSVSEEL

SEQ ID NO: 3153172 - protein, 19 aa, Giardia lamblia
ELVSSMAVLPSFTDESALT

SEQ ID NO: 3153173 - protein, 22 aa, Giardia lamblia
ELVTKLPPAVPQQHGKNPPISS

SEQ ID NO: 3153174 - protein, 19 aa, Giardia lamblia
ELVTSFVRTSICGVLNKSA

SEQ ID NO: 3153175 - protein, 25 aa, Giardia lamblia
ELVVYGLDYHKAWQRDVAPEISFAP

SEQ ID NO: 3153176 - protein, 25 aa, Giardia lamblia
ELYGTTLLGLCLGFSMVAKPPEYRR

SEQ ID NO: 3153177 - protein, 20 aa, Giardia lamblia
ELYMKCYIHLFVRVCADLQP

SEQ ID NO: 3153178 - protein, 19 aa, Giardia lamblia
ELYMNGSRYRAIKRRQERN

SEQ ID NO: 3153179 - protein, 23 aa, Giardia lamblia
EMADGKRGFTIIIDDPLDASFIK

SEQ ID NO: 3153180 - protein, 21 aa, Giardia lamblia
EMANEDWSRFIPTFKKKNTKP

SEQ ID NO: 3153181 - protein, 25 aa, Giardia lamblia
EMARIKKELEEAARTASEEKRKLLL

SEQ ID NO: 3153182 - protein, 18 aa, Giardia lamblia
EMCTMKALVSDTLDAASS

SEQ ID NO: 3153183 - protein, 20 aa, Giardia lamblia
EMCVCLAELQPRSASGESGS

SEQ ID NO: 3153184 - protein, 33 aa, Giardia lamblia
EMDLFGVGCVMFEITALFPLFPGKDELDQITRI

SEQ ID NO: 3153185 - protein, 20 aa, Giardia lamblia
EMELTWSPIHYATPFTAVNT

SEQ ID NO: 3153186 - protein, 28 aa, Giardia lamblia
EMERRERRLLKVLPTVYYRITGQQNGNS

SEQ ID NO: 3153187 - protein, 18 aa, Giardia lamblia
EMERRICMQISDEEQRSG

SEQ ID NO: 3153188 - protein, 22 aa, Giardia lamblia
EMGDSLVTPMSFCDKSLASTPT

SEQ ID NO: 3153189 - protein, 20 aa, Giardia lamblia
EMIEQLKLAEVAARQRLLLN

SEQ ID NO: 3153190 - protein, 19 aa, Giardia lamblia
EMIEYGPCINEMYSPETGT

SEQ ID NO: 3153191 - protein, 24 aa, Giardia lamblia
EMKHEIREAFDLFDADRSGRIDFH

SEQ ID NO: 3153192 - protein, 19 aa, Giardia lamblia
EMLDRRVAEMEQHTAQLTS

SEQ ID NO: 3153193 - protein, 22 aa, Giardia lamblia
EMLELKEGFELQMRGDDQSDKR

SEQ ID NO: 3153194 - protein, 21 aa, Giardia lamblia
EMLPLRYAITRAIQLGGVPVL

SEQ ID NO: 3153195 - protein, 23 aa, Giardia lamblia
EMLPYVISSAVIRGFFRCFPVYS

SEQ ID NO: 3153196 - protein, 24 aa, Giardia lamblia
EMMTYRIFIGPTFYQRLKHMVLDK

SEQ ID NO: 3153197 - protein, 21 aa, Giardia lamblia
EMNERIKAMPAYAAQAPPEIP

SEQ ID NO: 3153198 - protein, 17 aa, Giardia lamblia
EMNSFCRGTMAMVDAVV

SEQ ID NO: 3153199 - protein, 21 aa, Giardia lamblia
EMNSLICSAVEFTEEKVKVAE

SEQ ID NO: 3153200 - protein, 28 aa, Giardia lamblia
EMPLHVCGAMSQGFIGYMMSQAMDNVFC

SEQ ID NO: 3153201 - protein, 19 aa, Giardia lamblia
EMPLMTTLMPYTVHPSLKY

SEQ ID NO: 3153202 - protein, 19 aa, Giardia lamblia
EMQHLKLAVRLEEQETKSC

SEQ ID NO: 3153203 - protein, 18 aa, Giardia lamblia
EMRLIRTAFAGVKQFIDA

SEQ ID NO: 3153204 - protein, 24 aa, Giardia lamblia
EMRNAMTLLSLCERYNSKAENMKV

SEQ ID NO: 3153205 - protein, 21 aa, Giardia lamblia
EMRSRRAAMREMYKQWSEDAI

SEQ ID NO: 3153206 - protein, 20 aa, Giardia lamblia
EMSTPRFSVQDIYSASVSSI

SEQ ID NO: 3153207 - protein, 24 aa, Giardia lamblia
EMVKLICKRFPPAGDALHRALNLA

SEQ ID NO: 3153208 - protein, 17 aa, Giardia lamblia
EMVRLLIPFQSRKQTSL

SEQ ID NO: 3153209 - protein, 20 aa, Giardia lamblia
ENAHTEWICKNFSCRCRLVD

SEQ ID NO: 3153210 - protein, 25 aa, Giardia lamblia
ENAKLKAGMNASLAGSVISSSRLQD

SEQ ID NO: 3153211 - protein, 20 aa, Giardia lamblia
ENAKMFIVMEYCENGDLAKY

SEQ ID NO: 3153212 - protein, 21 aa, Giardia lamblia
ENAKMFIVMEYCENGDLARYI

SEQ ID NO: 3153213 - protein, 22 aa, Giardia lamblia
ENARGLCIAHYYNLAPARAVAY

SEQ ID NO: 3153214 - protein, 17 aa, Giardia lamblia
ENASLKATADWLKLQRP

SEQ ID NO: 3153215 - protein, 19 aa, Giardia lamblia
ENAWRARLVLLMLHNLVVA

SEQ ID NO: 3153216 - protein, 18 aa, Giardia lamblia
ENCTRQVTSFPLKYTSVT

SEQ ID NO: 3153217 - protein, 37 aa, Giardia lamblia
ENDEVLKLLPYSTPDLFFRQFNDSVLAYVKDAQILEQ

SEQ ID NO: 3153218 - protein, 24 aa, Giardia lamblia
ENDRLKKKIALMLDGESVEPDSIE

SEQ ID NO: 3153219 - protein, 20 aa, Giardia lamblia
ENDWPEVLVPLIDDEAKHVD

SEQ ID NO: 3153220 - protein, 22 aa, Giardia lamblia
ENEEAVRLLLKWESIDQSQYSS

SEQ ID NO: 3153221 - protein, 32 aa, Giardia lamblia
ENEEMDLRFSFELDGSGGIFLKRRDGSARVSL

SEQ ID NO: 3153222 - protein, 19 aa, Giardia lamblia
ENEFTSFKAFLEYNQLKTA

SEQ ID NO: 3153223 - protein, 23 aa, Giardia lamblia
ENEKHCRSVEEMITTTGLEAEGF

SEQ ID NO: 3153224 - protein, 23 aa, Giardia lamblia
ENERLRRAAVSAGKGDKLENERL

SEQ ID NO: 3153225 - protein, 18 aa, Giardia lamblia
ENFAKYFSLAARKEAGYK

SEQ ID NO: 3153226 - protein, 24 aa, Giardia lamblia
ENFCLESLRILLPEEGHMLHHTGK

SEQ ID NO: 3153227 - protein, 20 aa, Giardia lamblia
ENFDQLTWREKVRIEKERKE

SEQ ID NO: 3153228 - protein, 20 aa, Giardia lamblia
ENFKGFKYIDIISLPVESAT

SEQ ID NO: 3153229 - protein, 19 aa, Giardia lamblia
ENFSDCWSETISVSDEGVE

SEQ ID NO: 3153230 - protein, 24 aa, Giardia lamblia
ENFSRYRQAVVLTEKMGQFCAQNG

SEQ ID NO: 3153231 - protein, 30 aa, Giardia lamblia
ENGDLPGVWSYRFQLGLQDKRGYTALMYAC

SEQ ID NO: 3153232 - protein, 22 aa, Giardia lamblia
ENGMRTAVFAIRYADQLIDLNV

SEQ ID NO: 3153233 - protein, 17 aa, Giardia lamblia
ENGQFNLATALRELTKL

SEQ ID NO: 3153234 - protein, 17 aa, Giardia lamblia
ENGREINGATALQLAIA

SEQ ID NO: 3153235 - protein, 30 aa, Giardia lamblia
ENGRPCIDPGCPPRSFSQCSPRPGPRAFGE

SEQ ID NO: 3153236 - protein, 30 aa, Giardia lamblia
ENGRPCIDPGCPPRSFSQCSPRPGSRAFGE

SEQ ID NO: 3153237 - protein, 17 aa, Giardia lamblia
ENGRSLLILAVLSGNDK

SEQ ID NO: 3153238 - protein, 17 aa, Giardia lamblia
ENIGYDIIEIFCSVLPA

SEQ ID NO: 3153239 - protein, 18 aa, Giardia lamblia
ENILQLPLEKLVRMLNGE

SEQ ID NO: 3153240 - protein, 18 aa, Giardia lamblia
ENIPEIVDELILGCSLFT

SEQ ID NO: 3153241 - protein, 17 aa, Giardia lamblia
ENIPVDHSCLPRDHSTG

SEQ ID NO: 3153242 - protein, 18 aa, Giardia lamblia
ENIVKLLLPHEGGRQTND

SEQ ID NO: 3153243 - protein, 26 aa, Giardia lamblia
ENKALRPLLFKGKLSQLPKGRCNLPK

SEQ ID NO: 3153244 - protein, 17 aa, Giardia lamblia
ENKDIRDKLAFLENKAK

SEQ ID NO: 3153245 - protein, 23 aa, Giardia lamblia
ENKRLKKRLAASMDQSTSIASQV

SEQ ID NO: 3153246 - protein, 17 aa, Giardia lamblia
ENLALRKDVDFARNEAA

SEQ ID NO: 3153247 - protein, 17 aa, Giardia lamblia
ENLHLINRTILFDGSIA

SEQ ID NO: 3153248 - protein, 23 aa, Giardia lamblia
ENLKDCELELARVHEANIALQTD

SEQ ID NO: 3153249 - protein, 18 aa, Giardia lamblia
ENLLAYLAHIAYVQYQTM

SEQ ID NO: 3153250 - protein, 23 aa, Giardia lamblia
ENLQEMIPLLKAKDVQIIQLTEQ

SEQ ID NO: 3153251 - protein, 18 aa, Giardia lamblia
ENLWNFFLDRVKANLHVV

SEQ ID NO: 3153252 - protein, 21 aa, Giardia lamblia
ENNDVYAVWSLIPTQGALQDA

SEQ ID NO: 3153253 - protein, 21 aa, Giardia lamblia
ENNLAIGLRRKRRLQREASNA

SEQ ID NO: 3153254 - protein, 27 aa, Giardia lamblia
ENNPLTVWCLIPLQGRVQDWSGKTALM

SEQ ID NO: 3153255 - protein, 26 aa, Giardia lamblia
ENPDLPFSIPRFNFRCLSPAERRLYL

SEQ ID NO: 3153256 - protein, 17 aa, Giardia lamblia
ENPFSKQIRLFFVKYND

SEQ ID NO: 3153257 - protein, 25 aa, Giardia lamblia
ENPLICWLHPSYVKEVYTDKQTSSQ

SEQ ID NO: 3153258 - protein, 18 aa, Giardia lamblia
ENPLVVFSPRAEEYITQV

SEQ ID NO: 3153259 - protein, 20 aa, Giardia lamblia
ENPRAAYPCEYIDTVRPTST

SEQ ID NO: 3153260 - protein, 22 aa, Giardia lamblia
ENPRARLIRFFQSLYSCLCHGA

SEQ ID NO: 3153261 - protein, 19 aa, Giardia lamblia
ENQILAAELDRVYSENTGK

SEQ ID NO: 3153262 - protein, 23 aa, Giardia lamblia
ENRGKLAKLLRYYSTKSKDKRTS

SEQ ID NO: 3153263 - protein, 19 aa, Giardia lamblia
ENRGKRISLLREELNQHLD

SEQ ID NO: 3153264 - protein, 24 aa, Giardia lamblia
ENRLRSDLAAPSFCESNFNRLLAL

SEQ ID NO: 3153265 - protein, 19 aa, Giardia lamblia
ENRRHALEVLERIKYEEML

SEQ ID NO: 3153266 - protein, 17 aa, Giardia lamblia
ENSEVPVTIPLRNDVSP

SEQ ID NO: 3153267 - protein, 24 aa, Giardia lamblia
ENSNVPMLLGIVSVYAGCRNHVGQ

SEQ ID NO: 3153268 - protein, 24 aa, Giardia lamblia
ENSQCFFHVVLLSSKYKLVEVLFY

SEQ ID NO: 3153269 - protein, 19 aa, Giardia lamblia
ENSRVSLQLEPDGPEISIK

SEQ ID NO: 3153270 - protein, 18 aa, Giardia lamblia
ENTFKLFFIDIAQDVKLG

SEQ ID NO: 3153271 - protein, 23 aa, Giardia lamblia
ENVDAIIIPGGFGSRGVSGKLEA

SEQ ID NO: 3153272 - protein, 18 aa, Giardia lamblia
ENVLKCAYTRITDDLRQA

SEQ ID NO: 3153273 - protein, 19 aa, Giardia lamblia
ENVVALRLLHFLLKKTRCD

SEQ ID NO: 3153274 - protein, 17 aa, Giardia lamblia
ENVWETFFKICEVPHGS

SEQ ID NO: 3153275 - protein, 32 aa, Giardia lamblia
ENYIGCVLDCKRIPMTSAWLYTPSLLIKPDPD

SEQ ID NO: 3153276 - protein, 22 aa, Giardia lamblia
EPADLRLFFMTSTYNVNLAKLN

SEQ ID NO: 3153277 - protein, 17 aa, Giardia lamblia
EPAHAITMAAQRDTPTF

SEQ ID NO: 3153278 - protein, 22 aa, Giardia lamblia
EPDDSVLLKLGQLNIQINALTK

SEQ ID NO: 3153279 - protein, 24 aa, Giardia lamblia
EPDKLCTQLDILASLASSELQSHG

SEQ ID NO: 3153280 - protein, 20 aa, Giardia lamblia
EPDLACGVIATIGGCAVHPS

SEQ ID NO: 3153281 - protein, 21 aa, Giardia lamblia
EPDLDFPVRCEYDPQGYSPIQ

SEQ ID NO: 3153282 - protein, 17 aa, Giardia lamblia
EPDWKTLDLEQVLGDHP

SEQ ID NO: 3153283 - protein, 24 aa, Giardia lamblia
EPELVQMAAINLAVQYKRLKVDAD

SEQ ID NO: 3153284 - protein, 23 aa, Giardia lamblia
EPEVFPNIDVFACRDDKSVELFK

SEQ ID NO: 3153285 - protein, 24 aa, Giardia lamblia
EPEVKRVQLSAAIQTAPELDYLSA

SEQ ID NO: 3153286 - protein, 24 aa, Giardia lamblia
EPGEDCTLRNGIWTDQKRIYTTFR

SEQ ID NO: 3153287 - protein, 19 aa, Giardia lamblia
EPHCIKLAGMEREFVATTT

SEQ ID NO: 3153288 - protein, 23 aa, Giardia lamblia
EPHELAYNILLILFQSKTIFKSE

SEQ ID NO: 3153289 - protein, 19 aa, Giardia lamblia
EPIDIGVLLSKRFNMSPHA

SEQ ID NO: 3153290 - protein, 24 aa, Giardia lamblia
EPIDIRCEFCCSFSTNMCAAACGH

SEQ ID NO: 3153291 - protein, 18 aa, Giardia lamblia
EPIIEGFPPATCVSPDSA

SEQ ID NO: 3153292 - protein, 20 aa, Giardia lamblia
EPIKSLYEFLGPVIEASSFS

SEQ ID NO: 3153293 - protein, 26 aa, Giardia lamblia
EPIPNRSGSVMKLDLTLPSISIQLQP

SEQ ID NO: 3153294 - protein, 19 aa, Giardia lamblia
EPIPYRPMVAATYVELLEN

SEQ ID NO: 3153295 - protein, 28 aa, Giardia lamblia
EPKLVCRMLIRLGAWYSDLLTPLDHKSC

SEQ ID NO: 3153296 - protein, 24 aa, Giardia lamblia
EPKRCVWLRCGSAAAVDKRNSSGH

SEQ ID NO: 3153297 - protein, 17 aa, Giardia lamblia
EPLKLLLPHEKGMQKKD

SEQ ID NO: 3153298 - protein, 20 aa, Giardia lamblia
EPLNILWKTILDYNTTYTEV

SEQ ID NO: 3153299 - protein, 20 aa, Giardia lamblia
EPLPPEFVLLDLKVYHPYIE

SEQ ID NO: 3153300 - protein, 18 aa, Giardia lamblia
EPLPVFTHQNLKTDNILT

SEQ ID NO: 3153301 - protein, 19 aa, Giardia lamblia
EPLSEDIRIGASNHTDRDQ

SEQ ID NO: 3153302 - protein, 29 aa, Giardia lamblia
EPLSRALELYSIYKFHVLPVINSQDQCIG

SEQ ID NO: 3153303 - protein, 19 aa, Giardia lamblia
EPLSVLIQKAILRQHKEKL

SEQ ID NO: 3153304 - protein, 18 aa, Giardia lamblia
EPLTELRPGAPNPVVELA

SEQ ID NO: 3153305 - protein, 25 aa, Giardia lamblia
EPLVVFRAGSDLTFKYLHANIEHFK

SEQ ID NO: 3153306 - protein, 18 aa, Giardia lamblia
EPLYLGSLTTYSGIGHLG

SEQ ID NO: 3153307 - protein, 18 aa, Giardia lamblia
EPLYRRSNDVLAISQHLT

SEQ ID NO: 3153308 - protein, 23 aa, Giardia lamblia
EPMARYFFSQIMSAVLYMHLHGV

SEQ ID NO: 3153309 - protein, 18 aa, Giardia lamblia
EPMFPPRSLNQMQQTRAK

SEQ ID NO: 3153310 - protein, 17 aa, Giardia lamblia
EPMIYVFGGSDGITAFN

SEQ ID NO: 3153311 - protein, 29 aa, Giardia lamblia
EPNPTSMCLPCLRARVNITKGIDTEQTLI

SEQ ID NO: 3153312 - protein, 19 aa, Giardia lamblia
EPPMGAGLRRNKQRQSSFL

SEQ ID NO: 3153313 - protein, 30 aa, Giardia lamblia
EPQSVCFIFCKTCMKEFYKQFFSEPFPFES

SEQ ID NO: 3153314 - protein, 22 aa, Giardia lamblia
EPQYFRGLSIPYGSRTTALTAG

SEQ ID NO: 3153315 - protein, 23 aa, Giardia lamblia
EPRFKNRHYCISKDGTLTLVPDR

SEQ ID NO: 3153316 - protein, 19 aa, Giardia lamblia
EPRFKRWIRERFDNSLSRR

SEQ ID NO: 3153317 - protein, 20 aa, Giardia lamblia
EPRIACSVLEDGNTHTLSLL

SEQ ID NO: 3153318 - protein, 31 aa, Giardia lamblia
EPRKASPHETAWCSFIWPRCDTEGLCLAAAN

SEQ ID NO: 3153319 - protein, 21 aa, Giardia lamblia
EPRKGTEVGVEMKVDSDNDSR

SEQ ID NO: 3153320 - protein, 29 aa, Giardia lamblia
EPRPGMKRSSSCILFGGVHRAQMSPWATI

SEQ ID NO: 3153321 - protein, 18 aa, Giardia lamblia
EPRQTVVHVIDLEHPELY

SEQ ID NO: 3153322 - protein, 21 aa, Giardia lamblia
EPSALELLVTYGFTEGDSVHI

SEQ ID NO: 3153323 - protein, 23 aa, Giardia lamblia
EPSEARPVLSPRRSAVSYVTSEV

SEQ ID NO: 3153324 - protein, 21 aa, Giardia lamblia
EPSHVLFALGLDPEFAHTAVR

SEQ ID NO: 3153325 - protein, 19 aa, Giardia lamblia
EPSIKRQERPYSHSEKTSS

SEQ ID NO: 3153326 - protein, 25 aa, Giardia lamblia
EPSLCSLCRCKYSWNTAPSINPDPS

SEQ ID NO: 3153327 - protein, 18 aa, Giardia lamblia
EPSLRSLLQTDIRPSFLL

SEQ ID NO: 3153328 - protein, 22 aa, Giardia lamblia
EPSNVWSAIVTKECGEMMTDPT

SEQ ID NO: 3153329 - protein, 32 aa, Giardia lamblia
EPSVAFLKYPSCTVGLFLRVEFTHQMDAIFAQ

SEQ ID NO: 3153330 - protein, 20 aa, Giardia lamblia
EPVGPLQSNCIVLYNERTRS

SEQ ID NO: 3153331 - protein, 20 aa, Giardia lamblia
EPVSSPVYYCTRTYTTEKGV

SEQ ID NO: 3153332 - protein, 26 aa, Giardia lamblia
EPVTAPRLFTSIGLKHIFYADCFEAP

SEQ ID NO: 3153333 - protein, 24 aa, Giardia lamblia
EPYGFKADVWALGITAIELTEGKP

SEQ ID NO: 3153334 - protein, 20 aa, Giardia lamblia
EPYTVESFLQYFPKNTATLI

SEQ ID NO: 3153335 - protein, 17 aa, Giardia lamblia
EQACNRQSMVLVPIYDS

SEQ ID NO: 3153336 - protein, 27 aa, Giardia lamblia
EQCCLPVPGKLHFTASVYDPLTDKPTG

SEQ ID NO: 3153337 - protein, 27 aa, Giardia lamblia
EQCERRLPHASRPVCLDSSQSQRDHTL

SEQ ID NO: 3153338 - protein, 17 aa, Giardia lamblia
EQCKTLEAELVKLSEAT

SEQ ID NO: 3153339 - protein, 29 aa, Giardia lamblia
EQCLQNWQGRFALAEGFQSHSLAPERDHR

SEQ ID NO: 3153340 - protein, 18 aa, Giardia lamblia
EQCNACFPDEIVKYYTRK

SEQ ID NO: 3153341 - protein, 18 aa, Giardia lamblia
EQCQSRAISECLLAFQAV

SEQ ID NO: 3153342 - protein, 21 aa, Giardia lamblia
EQDFREFKQAYGAPTDVLPPW

SEQ ID NO: 3153343 - protein, 18 aa, Giardia lamblia
EQEFLIDVFRYLQLQHLT

SEQ ID NO: 3153344 - protein, 24 aa, Giardia lamblia
EQEILRRLTPILATHESQWIFAEK

SEQ ID NO: 3153345 - protein, 23 aa, Giardia lamblia
EQELRRLILEKSRLLRSVSSLYC

SEQ ID NO: 3153346 - protein, 25 aa, Giardia lamblia
EQGHLDCVRLLSPHEKDIHDNSGYD

SEQ ID NO: 3153347 - protein, 24 aa, Giardia lamblia
EQGRRLTKECFKGTGLSGSSNFLH

SEQ ID NO: 3153348 - protein, 17 aa, Giardia lamblia
EQIFFDEMDAVQLSREI

SEQ ID NO: 3153349 - protein, 19 aa, Giardia lamblia
EQIFTWLYSHDFKYDSKSN

SEQ ID NO: 3153350 - protein, 18 aa, Giardia lamblia
EQIWKSNRLPIVGRFAAL

SEQ ID NO: 3153351 - protein, 20 aa, Giardia lamblia
EQKKKLLTFFNSFTAMFDGE

SEQ ID NO: 3153352 - protein, 21 aa, Giardia lamblia
EQKLLPSLKELQCTNDVLTDN

SEQ ID NO: 3153353 - protein, 18 aa, Giardia lamblia
EQKPAWIVSDNTISPLET

SEQ ID NO: 3153354 - protein, 25 aa, Giardia lamblia
EQKRILFPRFYFLADSDVLEILSTG

SEQ ID NO: 3153355 - protein, 26 aa, Giardia lamblia
EQKSEWWTAYCAQAVPANGLCYMNVG

SEQ ID NO: 3153356 - protein, 22 aa, Giardia lamblia
EQKSRGYGYVKFASRAVAKIAA

SEQ ID NO: 3153357 - protein, 17 aa, Giardia lamblia
EQLCIDGATATSMMVYR

SEQ ID NO: 3153358 - protein, 22 aa, Giardia lamblia
EQLEALPAYSSDEFLQLTPEQQ

SEQ ID NO: 3153359 - protein, 25 aa, Giardia lamblia
EQLEERKRLLGRYMSQLNQIAVIRT

SEQ ID NO: 3153360 - protein, 26 aa, Giardia lamblia
EQLFEASDIFSCWYQPLNASEIDPSV

SEQ ID NO: 3153361 - protein, 30 aa, Giardia lamblia
EQLFQKKVRIGGLYKPDFAPGSGMDATAVM

SEQ ID NO: 3153362 - protein, 23 aa, Giardia lamblia
EQLIAKICIHFNVTSIPVGRVNV

SEQ ID NO: 3153363 - protein, 19 aa, Giardia lamblia
EQLILKALKLYESIGEYDS

SEQ ID NO: 3153364 - protein, 20 aa, Giardia lamblia
EQLIQMLVERDMKIAAILEE

SEQ ID NO: 3153365 - protein, 17 aa, Giardia lamblia
EQLKLKSAELEDSTMEL

SEQ ID NO: 3153366 - protein, 24 aa, Giardia lamblia
EQLLRIREAQLFTARKQELLADRQ

SEQ ID NO: 3153367 - protein, 34 aa, Giardia lamblia
EQLLSELRKSLQLELKRLNSFSVANDSMQLIKAR

SEQ ID NO: 3153368 - protein, 24 aa, Giardia lamblia
EQLRHWVHCRPIIGKLFYQDFDLH

SEQ ID NO: 3153369 - protein, 17 aa, Giardia lamblia
EQLVRMLPGMLVEDRVD

SEQ ID NO: 3153370 - protein, 18 aa, Giardia lamblia
EQMEILSTNYSRLIEQHE

SEQ ID NO: 3153371 - protein, 23 aa, Giardia lamblia
EQMSEKKFALLIIDSLTALFRVD

SEQ ID NO: 3153372 - protein, 27 aa, Giardia lamblia
EQNAMNMHACLSLLTKQIHDVRSKSAG

SEQ ID NO: 3153373 - protein, 21 aa, Giardia lamblia
EQNGRVSFEARYAKCSQENER

SEQ ID NO: 3153374 - protein, 23 aa, Giardia lamblia
EQPEFRYTVQLGNRLILSSNPFL

SEQ ID NO: 3153375 - protein, 19 aa, Giardia lamblia
EQPRTAPAPQRKMHRQDIN

SEQ ID NO: 3153376 - protein, 20 aa, Giardia lamblia
EQQKTISFDPLFDRSPDEAK

SEQ ID NO: 3153377 - protein, 23 aa, Giardia lamblia
EQQVCDHLKQFIMTGEINSNDGE

SEQ ID NO: 3153378 - protein, 23 aa, Giardia lamblia
EQRAQFFKAQWVSEEERLKREIA

SEQ ID NO: 3153379 - protein, 17 aa, Giardia lamblia
EQRERWSSLLVGLQEMA

SEQ ID NO: 3153380 - protein, 21 aa, Giardia lamblia
EQRLSYKICLLMDEQVFLYYV

SEQ ID NO: 3153381 - protein, 30 aa, Giardia lamblia
EQRSYQWLHMCWGCRPVLHPGNIDSMKTLI

SEQ ID NO: 3153382 - protein, 21 aa, Giardia lamblia
EQRTCRLIRPLTLPEQRKLLG

SEQ ID NO: 3153383 - protein, 24 aa, Giardia lamblia
EQSAQSALGRFLAEHSLESGSEPE

SEQ ID NO: 3153384 - protein, 19 aa, Giardia lamblia
EQSEVWALGCILYEALAAR

SEQ ID NO: 3153385 - protein, 26 aa, Giardia lamblia
EQSFSEAVSNNWRRSMLSTSLSTPSL

SEQ ID NO: 3153386 - protein, 27 aa, Giardia lamblia
EQSKRASVAVLRQELAAAYATLSEEYD

SEQ ID NO: 3153387 - protein, 20 aa, Giardia lamblia
EQSMSFPLAVILSPTRELTQ

SEQ ID NO: 3153388 - protein, 17 aa, Giardia lamblia
EQSRANSALARIHSLEK

SEQ ID NO: 3153389 - protein, 23 aa, Giardia lamblia
EQSSNYCGVEWDSSVGKYDGEYQ

SEQ ID NO: 3153390 - protein, 31 aa, Giardia lamblia
EQSTSGWNDLFLAAFTHNAALVARTISLVST

SEQ ID NO: 3153391 - protein, 26 aa, Giardia lamblia
EQTEILEIFSSLYLAQRRIGDHINIP

SEQ ID NO: 3153392 - protein, 20 aa, Giardia lamblia
EQTPSGWSALMAAVSNNNLT

SEQ ID NO: 3153393 - protein, 25 aa, Giardia lamblia
EQVKLLYRYECGLLYVDKETQEELT

SEQ ID NO: 3153394 - protein, 18 aa, Giardia lamblia
EQVQKLWLDNENLHKKET

SEQ ID NO: 3153395 - protein, 19 aa, Giardia lamblia
EQVVNCLNQNAAHVPYRTS

SEQ ID NO: 3153396 - protein, 29 aa, Giardia lamblia
ERAALLAFDSVTLWSWIPNIFNYTQSTLT

SEQ ID NO: 3153397 - protein, 26 aa, Giardia lamblia
ERAKKSGATGLQFKEMVGINSGLLAL

SEQ ID NO: 3153398 - protein, 18 aa, Giardia lamblia
ERALAECRARIDSAEARA

SEQ ID NO: 3153399 - protein, 19 aa, Giardia lamblia
ERARKEALLASLTDDIVRL

SEQ ID NO: 3153400 - protein, 22 aa, Giardia lamblia
ERARKELLGRIAELTKSESDYQ

SEQ ID NO: 3153401 - protein, 17 aa, Giardia lamblia
ERARLEKRLSDLEARSK

SEQ ID NO: 3153402 - protein, 18 aa, Giardia lamblia
ERARRRIQLLENRAVMED

SEQ ID NO: 3153403 - protein, 22 aa, Giardia lamblia
ERARVPHGTRLVGPEEKEQLLS

SEQ ID NO: 3153404 - protein, 19 aa, Giardia lamblia
ERCASTLRMDRIFRAIGTA

SEQ ID NO: 3153405 - protein, 18 aa, Giardia lamblia
ERCGEVLPDSAAIDVHIG

SEQ ID NO: 3153406 - protein, 18 aa, Giardia lamblia
ERCIRWLLMDFVPTLAEK

SEQ ID NO: 3153407 - protein, 17 aa, Giardia lamblia
ERCLNREILPEADVLAL

SEQ ID NO: 3153408 - protein, 18 aa, Giardia lamblia
ERDAWAAEWLKLDEAKRL

SEQ ID NO: 3153409 - protein, 19 aa, Giardia lamblia
ERDEFKWSALDYAVSKNHV

SEQ ID NO: 3153410 - protein, 20 aa, Giardia lamblia
ERDKLLFILQLCLKIDLKAG

SEQ ID NO: 3153411 - protein, 23 aa, Giardia lamblia
ERDLCSIVKMLSSIEAGLRDYRG

SEQ ID NO: 3153412 - protein, 25 aa, Giardia lamblia
ERDSMGWSALIWASAKGHLKVVMEL

SEQ ID NO: 3153413 - protein, 18 aa, Giardia lamblia
ERDTCAALLRVVDEDGAQ

SEQ ID NO: 3153414 - protein, 21 aa, Giardia lamblia
ERDTLRFQGAVALLTMNDKDS

SEQ ID NO: 3153415 - protein, 25 aa, Giardia lamblia
ERDTLSFTLSERVEQLTIKSAECAK

SEQ ID NO: 3153416 - protein, 25 aa, Giardia lamblia
ERDTRFCYCAVLSLTILLKRVPSLI

SEQ ID NO: 3153417 - protein, 25 aa, Giardia lamblia
ERDVNGRTALMWAAMNGHKEVVEML

SEQ ID NO: 3153418 - protein, 18 aa, Giardia lamblia
ERECEVERLRKLLVSRDL

SEQ ID NO: 3153419 - protein, 21 aa, Giardia lamblia
EREDICLGLSPTIQNKAVLSP

SEQ ID NO: 3153420 - protein, 24 aa, Giardia lamblia
EREEARTEIRIHKLERMRTTHEMK

SEQ ID NO: 3153421 - protein, 25 aa, Giardia lamblia
EREFKARLVEAARKTITLPIETLPR

SEQ ID NO: 3153422 - protein, 25 aa, Giardia lamblia
EREGHILCSIGFTDLMTSAFFGDLR

SEQ ID NO: 3153423 - protein, 24 aa, Giardia lamblia
ERERSPRPSLPVYALEEPYSQRTY

SEQ ID NO: 3153424 - protein, 19 aa, Giardia lamblia
ERESECSGIEPAIMPGPTI

SEQ ID NO: 3153425 - protein, 20 aa, Giardia lamblia
EREVRSLKLALKDLTVTLKQ

SEQ ID NO: 3153426 - protein, 26 aa, Giardia lamblia
EREYKLALFGVCHFRGNVVASQGTLS

SEQ ID NO: 3153427 - protein, 20 aa, Giardia lamblia
ERFGECIKWTTRWMQEMVRG

SEQ ID NO: 3153428 - protein, 17 aa, Giardia lamblia
ERFHEVVAGRELPPQQA

SEQ ID NO: 3153429 - protein, 22 aa, Giardia lamblia
ERFIRERPLILVGTPGRLYDIS

SEQ ID NO: 3153430 - protein, 27 aa, Giardia lamblia
ERFMRKRPYMRIGIGEVIGRAMLTIDN

SEQ ID NO: 3153431 - protein, 19 aa, Giardia lamblia
ERFRPVAQRGRILYEVIAS

SEQ ID NO: 3153432 - protein, 20 aa, Giardia lamblia
ERFYISIWFIGAMKLSGDDL

SEQ ID NO: 3153433 - protein, 22 aa, Giardia lamblia
ERGETGLMRAVRAKDTEMVHLL

SEQ ID NO: 3153434 - protein, 22 aa, Giardia lamblia
ERGGMFTRMISVIRGAFGRRSR

SEQ ID NO: 3153435 - protein, 27 aa, Giardia lamblia
ERGLNFAIPLLISREGKMTTTTGETAL

SEQ ID NO: 3153436 - protein, 17 aa, Giardia lamblia
ERGMMRVDGGIAYKLAR

SEQ ID NO: 3153437 - protein, 17 aa, Giardia lamblia
ERGRKLALYNLLGYTQS

SEQ ID NO: 3153438 - protein, 20 aa, Giardia lamblia
ERGWLAKALMGAHLLTPDCV

SEQ ID NO: 3153439 - protein, 33 aa, Giardia lamblia
ERHRLGFLFLERVRTVLNLPRCDQEVVAVTGRT

SEQ ID NO: 3153440 - protein, 23 aa, Giardia lamblia
ERIPLHVRYIFGLLTNQLSVLVS

SEQ ID NO: 3153441 - protein, 17 aa, Giardia lamblia
ERIPWLLNRSVTSYITA

SEQ ID NO: 3153442 - protein, 17 aa, Giardia lamblia
ERIRAVPTLPNDAKRGK

SEQ ID NO: 3153443 - protein, 22 aa, Giardia lamblia
ERISFERAHSILVDMGHFPDNE

SEQ ID NO: 3153444 - protein, 30 aa, Giardia lamblia
ERKALGAFSRRPAPEYYGIYPSYKEEKLIE

SEQ ID NO: 3153445 - protein, 18 aa, Giardia lamblia
ERKARLIERQEKKLEDPA

SEQ ID NO: 3153446 - protein, 19 aa, Giardia lamblia
ERKIEEKRQLIAQLNAKNE

SEQ ID NO: 3153447 - protein, 18 aa, Giardia lamblia
ERLAEAIAINKSLTALSS

SEQ ID NO: 3153448 - protein, 19 aa, Giardia lamblia
ERLDSIYFLECKKYTRLIL

SEQ ID NO: 3153449 - protein, 25 aa, Giardia lamblia
ERLEELRIALAAAYEEQKRLQAEEE

SEQ ID NO: 3153450 - protein, 24 aa, Giardia lamblia
ERLEWSEAWTIVSNTFCYTNHTVL

SEQ ID NO: 3153451 - protein, 22 aa, Giardia lamblia
ERLKARLTAVHDAIFRDIIKVN

SEQ ID NO: 3153452 - protein, 20 aa, Giardia lamblia
ERLLKAMAEKCNLREDQMAN

SEQ ID NO: 3153453 - protein, 19 aa, Giardia lamblia
ERLLPECAGVCGDFGETGL

SEQ ID NO: 3153454 - protein, 29 aa, Giardia lamblia
ERLPDVARFSRRVLCMGVIPKKAIPNHAN

SEQ ID NO: 3153455 - protein, 20 aa, Giardia lamblia
ERLPIPISDCDPVKKTITFI

SEQ ID NO: 3153456 - protein, 22 aa, Giardia lamblia
ERLRKKLAEFRVSLDSAGIEPT

SEQ ID NO: 3153457 - protein, 25 aa, Giardia lamblia
ERLSLLKYLLCFHFEDMAKALMRNP

SEQ ID NO: 3153458 - protein, 24 aa, Giardia lamblia
ERLSRAEELIWSFLHATDSASQEK

SEQ ID NO: 3153459 - protein, 22 aa, Giardia lamblia
ERLSSWIRNRVQPVDSIEGAIE

SEQ ID NO: 3153460 - protein, 20 aa, Giardia lamblia
ERLVAEILFADVVSDYKFWS

SEQ ID NO: 3153461 - protein, 18 aa, Giardia lamblia
ERMIKKLQMQVMSKDIEI

SEQ ID NO: 3153462 - protein, 25 aa, Giardia lamblia
ERMQVEMVKLLGVELTDMHDRCATQ

SEQ ID NO: 3153463 - protein, 17 aa, Giardia lamblia
ERMRCIKDYVDFKPNGS

SEQ ID NO: 3153464 - protein, 25 aa, Giardia lamblia
ERMRRAGDIIAYLAVLYENYKNIIK

SEQ ID NO: 3153465 - protein, 18 aa, Giardia lamblia
ERNCKPEVPLTAEEIQLQ

SEQ ID NO: 3153466 - protein, 24 aa, Giardia lamblia
ERNFMPGVESLLYYEKDLRLPDGR

SEQ ID NO: 3153467 - protein, 24 aa, Giardia lamblia
ERNFPLRMGYRFRENEYSRLLHAY

SEQ ID NO: 3153468 - protein, 18 aa, Giardia lamblia
ERNGISFTDPVGGIIDMS

SEQ ID NO: 3153469 - protein, 19 aa, Giardia lamblia
ERNKALLSCIQRLQTGLGS

SEQ ID NO: 3153470 - protein, 24 aa, Giardia lamblia
ERNMRLFNCAAYLMSYSNERRAKV

SEQ ID NO: 3153471 - protein, 24 aa, Giardia lamblia
ERNRADCIPLLLRELGIQVWDGQT

SEQ ID NO: 3153472 - protein, 20 aa, Giardia lamblia
ERNSLLLVCSREIKVFQLIG

SEQ ID NO: 3153473 - protein, 20 aa, Giardia lamblia
ERPALRRKIADLANTIDELQ

SEQ ID NO: 3153474 - protein, 21 aa, Giardia lamblia
ERPGPCTLAASPLPAKRAHVS

SEQ ID NO: 3153475 - protein, 26 aa, Giardia lamblia
ERPPHTVYVGTRWYRAVELFLKDSSY

SEQ ID NO: 3153476 - protein, 19 aa, Giardia lamblia
ERPPLLPVAGWLVKYMRHT

SEQ ID NO: 3153477 - protein, 23 aa, Giardia lamblia
ERQKDCSCTFSLPSSSPDRSYSS

SEQ ID NO: 3153478 - protein, 23 aa, Giardia lamblia
ERQRKRLSGLRLYIKNLSLTGAI

SEQ ID NO: 3153479 - protein, 19 aa, Giardia lamblia
ERQYNFIIAELPTFKCSKN

SEQ ID NO: 3153480 - protein, 27 aa, Giardia lamblia
ERRIARFKYNLIRRIVENWSSVTSFDW

SEQ ID NO: 3153481 - protein, 17 aa, Giardia lamblia
ERRKFKITVRVEDVPNV

SEQ ID NO: 3153482 - protein, 19 aa, Giardia lamblia
ERRRLLKLERMRSKIYECN

SEQ ID NO: 3153483 - protein, 23 aa, Giardia lamblia
ERRRPHPDFRILLTTEKDIAKRL

SEQ ID NO: 3153484 - protein, 17 aa, Giardia lamblia
ERSAIYITCFPPEDKSY

SEQ ID NO: 3153485 - protein, 24 aa, Giardia lamblia
ERSEANRAPAIFSNIEVIEEIHRK

SEQ ID NO: 3153486 - protein, 18 aa, Giardia lamblia
ERSEPSLQRIRRYLDAMA

SEQ ID NO: 3153487 - protein, 23 aa, Giardia lamblia
ERSIDKLLYLIAIGDKATQTSAA

SEQ ID NO: 3153488 - protein, 21 aa, Giardia lamblia
ERSKCPAALPADKNRSKPKLL

SEQ ID NO: 3153489 - protein, 23 aa, Giardia lamblia
ERSKELLYHMGCFTAKLTGAGLG

SEQ ID NO: 3153490 - protein, 23 aa, Giardia lamblia
ERSKRIMSAKCDIPVYDRLYQDS

SEQ ID NO: 3153491 - protein, 18 aa, Giardia lamblia
ERSLERPSLFDSKDSPSC

SEQ ID NO: 3153492 - protein, 17 aa, Giardia lamblia
ERSRNSVRWAPDVVDNS

SEQ ID NO: 3153493 - protein, 19 aa, Giardia lamblia
ERTAPSILASDRVDGSGSS

SEQ ID NO: 3153494 - protein, 19 aa, Giardia lamblia
ERTCPICNERSIIYDYQTM

SEQ ID NO: 3153495 - protein, 21 aa, Giardia lamblia
ERTDYSLLCHRFATSKIETFS

SEQ ID NO: 3153496 - protein, 19 aa, Giardia lamblia
ERTFLQGRVSRLETENVEL

SEQ ID NO: 3153497 - protein, 17 aa, Giardia lamblia
ERTRFRNKLALIGASEK

SEQ ID NO: 3153498 - protein, 22 aa, Giardia lamblia
ERTRRINLFLGAFADLKKHWET

SEQ ID NO: 3153499 - protein, 24 aa, Giardia lamblia
ERTRRPLSGTSMMRKAPCSVDRTQ

SEQ ID NO: 3153500 - protein, 18 aa, Giardia lamblia
ERVALHLATINELLTTNA

SEQ ID NO: 3153501 - protein, 24 aa, Giardia lamblia
ERVDARAVAVLNLMRAKNNSAQIV

SEQ ID NO: 3153502 - protein, 19 aa, Giardia lamblia
ERVHPVIKLLADLEAGVKT

SEQ ID NO: 3153503 - protein, 24 aa, Giardia lamblia
ERVIPVPKVRVITPLAYILLYRRI

SEQ ID NO: 3153504 - protein, 19 aa, Giardia lamblia
ERVLLPFGSGPVRHECNSN

SEQ ID NO: 3153505 - protein, 21 aa, Giardia lamblia
ERVSCMIIRDILKALNHLHEN

SEQ ID NO: 3153506 - protein, 18 aa, Giardia lamblia
ERVWWEVYSSTWSETSRP

SEQ ID NO: 3153507 - protein, 20 aa, Giardia lamblia
ERWLPVHTVSSIILSVISLL

SEQ ID NO: 3153508 - protein, 25 aa, Giardia lamblia
ERYDGLRTAPLFLFLNVVAAGFWMD

SEQ ID NO: 3153509 - protein, 20 aa, Giardia lamblia
ERYDKIVFATGSWPIIPDIP

SEQ ID NO: 3153510 - protein, 22 aa, Giardia lamblia
ERYGAEIRAHFNLDAKMPLGER

SEQ ID NO: 3153511 - protein, 18 aa, Giardia lamblia
ERYHRFLSVMYVKDLSAV

SEQ ID NO: 3153512 - protein, 21 aa, Giardia lamblia
ERYKRLCLHLHMSDFPQKHKT

SEQ ID NO: 3153513 - protein, 27 aa, Giardia lamblia
ERYLALSFAVAELWSQWIDPKTHNGGV

SEQ ID NO: 3153514 - protein, 23 aa, Giardia lamblia
ERYLKTSFFLPFYDVTADEMRQI

SEQ ID NO: 3153515 - protein, 17 aa, Giardia lamblia
ESACIPPNVKITSSIGV

SEQ ID NO: 3153516 - protein, 25 aa, Giardia lamblia
ESACNWRLKYEKANAERKEMRARAR

SEQ ID NO: 3153517 - protein, 25 aa, Giardia lamblia
ESADNLARKCERRGSAKSELQNALK

SEQ ID NO: 3153518 - protein, 18 aa, Giardia lamblia
ESAFQCSRTPTSAGSGSL

SEQ ID NO: 3153519 - protein, 26 aa, Giardia lamblia
ESALDRISTTLGYKVIFPLIKDFVSY

SEQ ID NO: 3153520 - protein, 22 aa, Giardia lamblia
ESALERSKRLLASKDLKSCTFH

SEQ ID NO: 3153521 - protein, 20 aa, Giardia lamblia
ESALFKAVRWEHPDCVTLLA

SEQ ID NO: 3153522 - protein, 17 aa, Giardia lamblia
ESALLFWKADCKSKSRA

SEQ ID NO: 3153523 - protein, 20 aa, Giardia lamblia
ESAQKFWPELVARRQSYMHD

SEQ ID NO: 3153524 - protein, 24 aa, Giardia lamblia
ESATARAVAFLRAYESQLEALFAN

SEQ ID NO: 3153525 - protein, 18 aa, Giardia lamblia
ESDELDRLLAEMHANYDA

SEQ ID NO: 3153526 - protein, 25 aa, Giardia lamblia
ESDILCFDCGVYLKYGKSGHICTHA

SEQ ID NO: 3153527 - protein, 26 aa, Giardia lamblia
ESECLLEDIGVQWRRYVSSLEVKHAE

SEQ ID NO: 3153528 - protein, 23 aa, Giardia lamblia
ESEEARATLAMELSNALDRIAEL

SEQ ID NO: 3153529 - protein, 20 aa, Giardia lamblia
ESEIERLRMEIISKNTEILS

SEQ ID NO: 3153530 - protein, 23 aa, Giardia lamblia
ESEKELKIQVLMDDLARTKGIVN

SEQ ID NO: 3153531 - protein, 19 aa, Giardia lamblia
ESEPFFGGTRQFIINMGTG

SEQ ID NO: 3153532 - protein, 18 aa, Giardia lamblia
ESEYCLISYCPYDNHFIF

SEQ ID NO: 3153533 - protein, 20 aa, Giardia lamblia
ESFLPSVVIPADLKIYDRDM

SEQ ID NO: 3153534 - protein, 23 aa, Giardia lamblia
ESFLSNNYPQIWSQYYTEAQVEQ

SEQ ID NO: 3153535 - protein, 19 aa, Giardia lamblia
ESFVIELDISFLVDSLFLR

SEQ ID NO: 3153536 - protein, 25 aa, Giardia lamblia
ESFVSTKRTVHFEAPSKDTVGLSNS

SEQ ID NO: 3153537 - protein, 18 aa, Giardia lamblia
ESGFTRQILNKSLLDVAS

SEQ ID NO: 3153538 - protein, 32 aa, Giardia lamblia
ESGGEAMRSKGYRYVWKVSEALRNVLRTHTTA

SEQ ID NO: 3153539 - protein, 21 aa, Giardia lamblia
ESGHKEILLGIFDGHGGTECS

SEQ ID NO: 3153540 - protein, 37 aa, Giardia lamblia
ESGKSGYCVSLWCPKMKVGIPRYRIVSTYDQSIEPVS

SEQ ID NO: 3153541 - protein, 22 aa, Giardia lamblia
ESGNIIKAWHFLNAQANILDVN

SEQ ID NO: 3153542 - protein, 25 aa, Giardia lamblia
ESGNLEICKLLAPKEANMQYKTYTA

SEQ ID NO: 3153543 - protein, 23 aa, Giardia lamblia
ESICRDTELPGCCICLEQEAEEV

SEQ ID NO: 3153544 - protein, 25 aa, Giardia lamblia
ESIDRRRICNFIKQLPAAAKQDSTH

SEQ ID NO: 3153545 - protein, 18 aa, Giardia lamblia
ESIEVLRSRVDPLEEPQA

SEQ ID NO: 3153546 - protein, 19 aa, Giardia lamblia
ESIHAIPELGMLFRKADTT

SEQ ID NO: 3153547 - protein, 20 aa, Giardia lamblia
ESIKICPGASIFDSSIEPSS

SEQ ID NO: 3153548 - protein, 19 aa, Giardia lamblia
ESILSKKAMLIESLQPNNL

SEQ ID NO: 3153549 - protein, 27 aa, Giardia lamblia
ESIREGGSFGGVFRLKSTRDRVVQKIV

SEQ ID NO: 3153550 - protein, 25 aa, Giardia lamblia
ESIRKRILNLMGMLIHINAAIPHCI

SEQ ID NO: 3153551 - protein, 26 aa, Giardia lamblia
ESIRLARLVMRNMLLLSGKYWRRKIY

SEQ ID NO: 3153552 - protein, 23 aa, Giardia lamblia
ESISELDRGLAYFSDQFAVAHPP

SEQ ID NO: 3153553 - protein, 19 aa, Giardia lamblia
ESITSGYSVSECVNDALTP

SEQ ID NO: 3153554 - protein, 24 aa, Giardia lamblia
ESIVRSVLCLARGVADDYDFIDGA

SEQ ID NO: 3153555 - protein, 30 aa, Giardia lamblia
ESKDKEICMLKEMLARLYAKPEGIQPGSIA

SEQ ID NO: 3153556 - protein, 21 aa, Giardia lamblia
ESKEIYLLTEYCGKGDLLKFV

SEQ ID NO: 3153557 - protein, 20 aa, Giardia lamblia
ESKEKECEKLLATIKSMSRD

SEQ ID NO: 3153558 - protein, 25 aa, Giardia lamblia
ESKHIPSHIIIFGVFCEGRQSSPSN

SEQ ID NO: 3153559 - protein, 18 aa, Giardia lamblia
ESKMLWKEVVIAYEPVWS

SEQ ID NO: 3153560 - protein, 24 aa, Giardia lamblia
ESKRLAFPRFFFLSNDELLQILAQ

SEQ ID NO: 3153561 - protein, 30 aa, Giardia lamblia
ESKTPLTPVELWRLLSPVISALAYLHGSYK

SEQ ID NO: 3153562 - protein, 21 aa, Giardia lamblia
ESKVSGLGRLCLSREEAGGAV

SEQ ID NO: 3153563 - protein, 21 aa, Giardia lamblia
ESKVSGLGRLCLSREETKGAV

SEQ ID NO: 3153564 - protein, 20 aa, Giardia lamblia
ESLDLVEPVARPIIESLSIH

SEQ ID NO: 3153565 - protein, 24 aa, Giardia lamblia
ESLEMCGRGLFGKINRVRIQETEE

SEQ ID NO: 3153566 - protein, 17 aa, Giardia lamblia
ESLHIGLSLGYTATEIE

SEQ ID NO: 3153567 - protein, 24 aa, Giardia lamblia
ESLKEQLNAFSFQLEQLQSDKSAL

SEQ ID NO: 3153568 - protein, 22 aa, Giardia lamblia
ESLKRIEDIISHINYTPEEPNY

SEQ ID NO: 3153569 - protein, 18 aa, Giardia lamblia
ESLLGQLLGHRVAGVTLK

SEQ ID NO: 3153570 - protein, 18 aa, Giardia lamblia
ESLLPPKIMDPGVQNRND

SEQ ID NO: 3153571 - protein, 19 aa, Giardia lamblia
ESLLRILSLLPTTPAEDEF

SEQ ID NO: 3153572 - protein, 28 aa, Giardia lamblia
ESLNRVVYRGGVDFLIQDSVGWTALHYS

SEQ ID NO: 3153573 - protein, 17 aa, Giardia lamblia
ESLRKTMSPGLFDGRAR

SEQ ID NO: 3153574 - protein, 17 aa, Giardia lamblia
ESLRLLAPREGQITNFR

SEQ ID NO: 3153575 - protein, 36 aa, Giardia lamblia
ESLRRRLRMFPALSSCMTIDWFANWNAEALAGVAMY

SEQ ID NO: 3153576 - protein, 32 aa, Giardia lamblia
ESLVRLSEAFARLCLATAITKEHVKKAAELVS

SEQ ID NO: 3153577 - protein, 20 aa, Giardia lamblia
ESLYSLLVNQCFYIDNLYQQ

SEQ ID NO: 3153578 - protein, 18 aa, Giardia lamblia
ESMGLIISMLNIDPAKRP

SEQ ID NO: 3153579 - protein, 21 aa, Giardia lamblia
ESMLKSYLCTVSSLPEDAIER

SEQ ID NO: 3153580 - protein, 21 aa, Giardia lamblia
ESMRSGGRIVTRFADLATYEK

SEQ ID NO: 3153581 - protein, 19 aa, Giardia lamblia
ESNIPRGAWILYCKQQALR

SEQ ID NO: 3153582 - protein, 33 aa, Giardia lamblia
ESNLFLFFVSLFRFFLHTCKLPNHGFRFQSALR

SEQ ID NO: 3153583 - protein, 23 aa, Giardia lamblia
ESNSRVLLCSAIKSLLILVKCCS

SEQ ID NO: 3153584 - protein, 30 aa, Giardia lamblia
ESNYRRILARLCMRRQLLMLNIIHEYIVTM

SEQ ID NO: 3153585 - protein, 20 aa, Giardia lamblia
ESPARILLAGQVRKISEDRT

SEQ ID NO: 3153586 - protein, 18 aa, Giardia lamblia
ESPCPCTQQPNAAKTTTQ

SEQ ID NO: 3153587 - protein, 25 aa, Giardia lamblia
ESPDKLSQRLGHLFYLEPNVLAMAV

SEQ ID NO: 3153588 - protein, 23 aa, Giardia lamblia
ESPIRRAAPAFSLSSRPVLNSRN

SEQ ID NO: 3153589 - protein, 23 aa, Giardia lamblia
ESPKSTPCLLTIGRGQSKGSAGA

SEQ ID NO: 3153590 - protein, 19 aa, Giardia lamblia
ESPPSVSAEPFYKRIFSYI

SEQ ID NO: 3153591 - protein, 17 aa, Giardia lamblia
ESPRDPISGCVDTAFRS

SEQ ID NO: 3153592 - protein, 20 aa, Giardia lamblia
ESPSDLTPLAFDIFSAFPSN

SEQ ID NO: 3153593 - protein, 19 aa, Giardia lamblia
ESPSTLLGELVKSQEELAS

SEQ ID NO: 3153594 - protein, 24 aa, Giardia lamblia
ESPYRLLFSEMIFPIMLQNNKENY

SEQ ID NO: 3153595 - protein, 23 aa, Giardia lamblia
ESQESRKAIVAQIYDTLIDEKET

SEQ ID NO: 3153596 - protein, 18 aa, Giardia lamblia
ESQGCSKFLSSHDAATIL

SEQ ID NO: 3153597 - protein, 37 aa, Giardia lamblia
ESQGRFSLLLEYARFFARIVSIPASMKAHIYDMLKGC

SEQ ID NO: 3153598 - protein, 19 aa, Giardia lamblia
ESQGTIIRREIETTLMRLL

SEQ ID NO: 3153599 - protein, 24 aa, Giardia lamblia
ESRAPRPLTSQPLLGDRHITETRR

SEQ ID NO: 3153600 - protein, 24 aa, Giardia lamblia
ESRGVVKDTFAWRHHYYLLTEKGE

SEQ ID NO: 3153601 - protein, 17 aa, Giardia lamblia
ESRITELEVLLSEAESF

SEQ ID NO: 3153602 - protein, 26 aa, Giardia lamblia
ESRLRTEHLWTYRADVLRGMSAVCCE

SEQ ID NO: 3153603 - protein, 28 aa, Giardia lamblia
ESSADPRRAFGCEDLKAAIPSDSPSAPR

SEQ ID NO: 3153604 - protein, 24 aa, Giardia lamblia
ESSAEILSMITGLEKIREEQAAVE

SEQ ID NO: 3153605 - protein, 21 aa, Giardia lamblia
ESSCFATCSCDGRLIIHDPRT

SEQ ID NO: 3153606 - protein, 23 aa, Giardia lamblia
ESSCGVGAILRRTSDFAPNLYEE

SEQ ID NO: 3153607 - protein, 18 aa, Giardia lamblia
ESSCKLTYLMEQLTTLWS

SEQ ID NO: 3153608 - protein, 32 aa, Giardia lamblia
ESSFPRGLFLRRLRTLLIGRINLPLHWINASI

SEQ ID NO: 3153609 - protein, 26 aa, Giardia lamblia
ESSIRSIFCFNREAFVGLSNGEIYLI

SEQ ID NO: 3153610 - protein, 23 aa, Giardia lamblia
ESSKRLQDALARENYDSKRRCED

SEQ ID NO: 3153611 - protein, 22 aa, Giardia lamblia
ESSLDCKAQHAVTSISSTAQMC

SEQ ID NO: 3153612 - protein, 18 aa, Giardia lamblia
ESSLRIKLLEKEIATLRR

SEQ ID NO: 3153613 - protein, 24 aa, Giardia lamblia
ESSREILKRLSLYRRGTEPHNQSR

SEQ ID NO: 3153614 - protein, 24 aa, Giardia lamblia
ESSSAFAPIIRRVIGPSLLNTIAY

SEQ ID NO: 3153615 - protein, 20 aa, Giardia lamblia
ESSSICRFGVKFGASPSECY

SEQ ID NO: 3153616 - protein, 25 aa, Giardia lamblia
ESSYKFKLGTTVARLKRLHLTQMSD

SEQ ID NO: 3153617 - protein, 23 aa, Giardia lamblia
ESTICRDFRLSLSSSDYKETLPS

SEQ ID NO: 3153618 - protein, 25 aa, Giardia lamblia
ESTQKGLDCALKIFQNVISTGLTGD

SEQ ID NO: 3153619 - protein, 17 aa, Giardia lamblia
ESTRAGVEEGFFILRIP

SEQ ID NO: 3153620 - protein, 18 aa, Giardia lamblia
ESTSLAIVNMDWDHIKAA

SEQ ID NO: 3153621 - protein, 18 aa, Giardia lamblia
ESTVYHIHFDIMKKRDAE

SEQ ID NO: 3153622 - protein, 19 aa, Giardia lamblia
ESVEYFFVIMFTQGNGFVK

SEQ ID NO: 3153623 - protein, 24 aa, Giardia lamblia
ESVGRVCGVIDVINMLKEAHIIPD

SEQ ID NO: 3153624 - protein, 23 aa, Giardia lamblia
ESVILPRRYPHLFEGGNGQGSLA

SEQ ID NO: 3153625 - protein, 17 aa, Giardia lamblia
ESVIRLYRNYYLLGASD

SEQ ID NO: 3153626 - protein, 30 aa, Giardia lamblia
ESVPRPRVPPNIGDALRFLQALSKELQDIP

SEQ ID NO: 3153627 - protein, 24 aa, Giardia lamblia
ESVRAADVLRVFRYPPEVPDAEVS

SEQ ID NO: 3153628 - protein, 23 aa, Giardia lamblia
ESVSDALLAKVDITRLPAILDPY

SEQ ID NO: 3153629 - protein, 25 aa, Giardia lamblia
ESVSIPLIVCPESLDNIARIVRQRL

SEQ ID NO: 3153630 - protein, 27 aa, Giardia lamblia
ESVSLCLRLPLEVGLEGFLGAQGSHSA

SEQ ID NO: 3153631 - protein, 18 aa, Giardia lamblia
ESVVKIHRIWPRKEDRLL

SEQ ID NO: 3153632 - protein, 17 aa, Giardia lamblia
ESVVSIPLLKAAVDAVY

SEQ ID NO: 3153633 - protein, 17 aa, Giardia lamblia
ESVWRMHHEAFVTGTDS

SEQ ID NO: 3153634 - protein, 25 aa, Giardia lamblia
ESVYPQVYSVRRFVNAPCALSSDHD

SEQ ID NO: 3153635 - protein, 26 aa, Giardia lamblia
ESYKDFFTRYHCDAIRNDQKDVPQKG

SEQ ID NO: 3153636 - protein, 27 aa, Giardia lamblia
ESYKLTSQFFKGRYFKTDADSFRATVN

SEQ ID NO: 3153637 - protein, 24 aa, Giardia lamblia
ESYLRKVVMPLEYLLKSYKRIFVK

SEQ ID NO: 3153638 - protein, 17 aa, Giardia lamblia
ESYRVSSKHVVKFPQRG

SEQ ID NO: 3153639 - protein, 20 aa, Giardia lamblia
ESYSTLQFATRCMSLRTNFV

SEQ ID NO: 3153640 - protein, 29 aa, Giardia lamblia
ESYSYQAFVRSWRCFFDQLVQAARQEETE

SEQ ID NO: 3153641 - protein, 18 aa, Giardia lamblia
ETADTCFEDWGSTIDSFK

SEQ ID NO: 3153642 - protein, 20 aa, Giardia lamblia
ETAHPLPLRNDHPISSLNIV

SEQ ID NO: 3153643 - protein, 17 aa, Giardia lamblia
ETALHIATRLHLPKLVK

SEQ ID NO: 3153644 - protein, 20 aa, Giardia lamblia
ETALMIAVCRGLVDCVKILA

SEQ ID NO: 3153645 - protein, 18 aa, Giardia lamblia
ETALMLAAASGFTRIANM

SEQ ID NO: 3153646 - protein, 29 aa, Giardia lamblia
ETALMLACKARCFTNALIAVDAEAGLKTC

SEQ ID NO: 3153647 - protein, 19 aa, Giardia lamblia
ETANRISAIILKDPSDFLA

SEQ ID NO: 3153648 - protein, 18 aa, Giardia lamblia
ETARFCFSVRNCSKTVFF

SEQ ID NO: 3153649 - protein, 17 aa, Giardia lamblia
ETAVIRFYILEPEKEES

SEQ ID NO: 3153650 - protein, 30 aa, Giardia lamblia
ETCAILEAFSHLSSRPAFRRSVEKKTLDTV

SEQ ID NO: 3153651 - protein, 28 aa, Giardia lamblia
ETDAILCPRPGFPLYASTIVYYGGKEVS

SEQ ID NO: 3153652 - protein, 28 aa, Giardia lamblia
ETDLAKIQVVIEWLLSYGRYEVLSDTDM

SEQ ID NO: 3153653 - protein, 24 aa, Giardia lamblia
ETDLCDALKKLEMESEKLAHVEEL

SEQ ID NO: 3153654 - protein, 21 aa, Giardia lamblia
ETDRRNSVVIIRPTVNSAETN

SEQ ID NO: 3153655 - protein, 23 aa, Giardia lamblia
ETDSLPIYTSFLCEYVVDPRTIP

SEQ ID NO: 3153656 - protein, 23 aa, Giardia lamblia
ETEEVYACMEIDYSIISTEERIR

SEQ ID NO: 3153657 - protein, 18 aa, Giardia lamblia
ETEKCTNMAHKLSEATYL

SEQ ID NO: 3153658 - protein, 19 aa, Giardia lamblia
ETERLKEDLAHMNTTMGEF

SEQ ID NO: 3153659 - protein, 21 aa, Giardia lamblia
ETESLWYPAASVLYSRTSLSG

SEQ ID NO: 3153660 - protein, 17 aa, Giardia lamblia
ETEYMLSGRGWERGGFD

SEQ ID NO: 3153661 - protein, 18 aa, Giardia lamblia
ETFIDLFVAVGIGVSVAD

SEQ ID NO: 3153662 - protein, 22 aa, Giardia lamblia
ETFRASLTRVLRRTANVQKAVR

SEQ ID NO: 3153663 - protein, 20 aa, Giardia lamblia
ETFTTMPRRTYTVSSAARNR

SEQ ID NO: 3153664 - protein, 20 aa, Giardia lamblia
ETGCSGLIRAIYAHKLASVE

SEQ ID NO: 3153665 - protein, 20 aa, Giardia lamblia
ETGLVYAIKHNRVDIASFLI

SEQ ID NO: 3153666 - protein, 19 aa, Giardia lamblia
ETGPSFVLIPFQILSSVMC

SEQ ID NO: 3153667 - protein, 26 aa, Giardia lamblia
ETGQGISLRLPRLLRARPDKRPWDCT

SEQ ID NO: 3153668 - protein, 23 aa, Giardia lamblia
ETHARFKEATIWTLMAQLYDVLL

SEQ ID NO: 3153669 - protein, 18 aa, Giardia lamblia
ETHDPWNALFFCSTPAIK

SEQ ID NO: 3153670 - protein, 18 aa, Giardia lamblia
ETHLRKIIDAKVTFDDKE

SEQ ID NO: 3153671 - protein, 18 aa, Giardia lamblia
ETHLRMQELFNMKSPDRH

SEQ ID NO: 3153672 - protein, 18 aa, Giardia lamblia
ETHRCINGLPATTLGSAT

SEQ ID NO: 3153673 - protein, 29 aa, Giardia lamblia
ETIDAIFLPRLAQYLFPLMALQEVERRHA

SEQ ID NO: 3153674 - protein, 27 aa, Giardia lamblia
ETIEAYCKRMFLTRICTETGLTKIDRF

SEQ ID NO: 3153675 - protein, 22 aa, Giardia lamblia
ETIKRLDLENGELRERVVYLEE

SEQ ID NO: 3153676 - protein, 21 aa, Giardia lamblia
ETILRLSQRIDTISDFLSNQE

SEQ ID NO: 3153677 - protein, 31 aa, Giardia lamblia
ETINAMDAAFCIKYFLVCTLKTKTGNYSGDT

SEQ ID NO: 3153678 - protein, 19 aa, Giardia lamblia
ETITSISILDYILQDIIAS

SEQ ID NO: 3153679 - protein, 26 aa, Giardia lamblia
ETKLSEIKRWLFAFRRDVLADPQAAL

SEQ ID NO: 3153680 - protein, 22 aa, Giardia lamblia
ETKNFIIQWFGSESILASRPNA

SEQ ID NO: 3153681 - protein, 19 aa, Giardia lamblia
ETKQTSCMQMNLSRTPSLK

SEQ ID NO: 3153682 - protein, 23 aa, Giardia lamblia
ETLDLLFFELLTRTLLMKQASLT

SEQ ID NO: 3153683 - protein, 18 aa, Giardia lamblia
ETLFCVCETEWKDPRGGR

SEQ ID NO: 3153684 - protein, 17 aa, Giardia lamblia
ETLFSGFCLKYLKEVLP

SEQ ID NO: 3153685 - protein, 21 aa, Giardia lamblia
ETLGKCAPYVPAQCRESQMKP

SEQ ID NO: 3153686 - protein, 18 aa, Giardia lamblia
ETLHLSAFDNKDSSAQFV

SEQ ID NO: 3153687 - protein, 17 aa, Giardia lamblia
ETLKRKLAEYEKGGTLG

SEQ ID NO: 3153688 - protein, 19 aa, Giardia lamblia
ETLNRWLFDMLATPSESIA

SEQ ID NO: 3153689 - protein, 24 aa, Giardia lamblia
ETLPWKLATELGLSEIASLIKPAI

SEQ ID NO: 3153690 - protein, 17 aa, Giardia lamblia
ETMAEAFAVSDPLRIIR

SEQ ID NO: 3153691 - protein, 22 aa, Giardia lamblia
ETMHAVACYRKCCDSGRGAVLF

SEQ ID NO: 3153692 - protein, 19 aa, Giardia lamblia
ETMLARMMSVGDWSCSRDQ

SEQ ID NO: 3153693 - protein, 17 aa, Giardia lamblia
ETNFDFDKAIDLLISPN

SEQ ID NO: 3153694 - protein, 18 aa, Giardia lamblia
ETNFERTTLLSIRDKLNK

SEQ ID NO: 3153695 - protein, 18 aa, Giardia lamblia
ETNFRYFAICGSGCKTPL

SEQ ID NO: 3153696 - protein, 25 aa, Giardia lamblia
ETNSILKNRLGEIEAKASTDESLAK

SEQ ID NO: 3153697 - protein, 26 aa, Giardia lamblia
ETPDGRFRFAIGLLLSARNLDRVTAA

SEQ ID NO: 3153698 - protein, 17 aa, Giardia lamblia
ETPEKRPSNAMVVQQYI

SEQ ID NO: 3153699 - protein, 24 aa, Giardia lamblia
ETPIPEPQIWWLLAQMGSALRFLH

SEQ ID NO: 3153700 - protein, 30 aa, Giardia lamblia
ETPQHRLLYLAIRFRLELISTDDNYQSLFL

SEQ ID NO: 3153701 - protein, 21 aa, Giardia lamblia
ETPRSFELFTKLFKELILVES

SEQ ID NO: 3153702 - protein, 22 aa, Giardia lamblia
ETPYIRALRIMSHIVKNFDDDD

SEQ ID NO: 3153703 - protein, 25 aa, Giardia lamblia
ETQALEWKQRVSAFDAESVLRGKQA

SEQ ID NO: 3153704 - protein, 23 aa, Giardia lamblia
ETQRFKSLLQEAADSNEQLVSQC

SEQ ID NO: 3153705 - protein, 18 aa, Giardia lamblia
ETQVLCLRWQRLERPLSR

SEQ ID NO: 3153706 - protein, 17 aa, Giardia lamblia
ETQVSFPGAAAPSTAMP

SEQ ID NO: 3153707 - protein, 26 aa, Giardia lamblia
ETQYLACSLFHRFLSICQIKKTEIRL

SEQ ID NO: 3153708 - protein, 20 aa, Giardia lamblia
ETRAEIAMRGFIASRAQKRA

SEQ ID NO: 3153709 - protein, 23 aa, Giardia lamblia
ETREYEVWLSYIQIFNEIGYDLL

SEQ ID NO: 3153710 - protein, 21 aa, Giardia lamblia
ETRFCHFDFVLPDPSTRRVMV

SEQ ID NO: 3153711 - protein, 18 aa, Giardia lamblia
ETRMCYGITLASLMHMHR

SEQ ID NO: 3153712 - protein, 22 aa, Giardia lamblia
ETRSWATAILITGNQRLMTKDT

SEQ ID NO: 3153713 - protein, 21 aa, Giardia lamblia
ETRSYCYRRALVIDPSCIDID

SEQ ID NO: 3153714 - protein, 23 aa, Giardia lamblia
ETSACMICGRIADGRRVIDRVRS

SEQ ID NO: 3153715 - protein, 18 aa, Giardia lamblia
ETSDIWSLGCILYEMCTM

SEQ ID NO: 3153716 - protein, 20 aa, Giardia lamblia
ETSIIRFDYTPTRESTRAGV

SEQ ID NO: 3153717 - protein, 21 aa, Giardia lamblia
ETSKLQALRLRVCDGSKAKSQ

SEQ ID NO: 3153718 - protein, 24 aa, Giardia lamblia
ETSQWKRAIACLYDKKSPSLSAYT

SEQ ID NO: 3153719 - protein, 24 aa, Giardia lamblia
ETSRLGRFAFSFAPTTVGRFNINL

SEQ ID NO: 3153720 - protein, 20 aa, Giardia lamblia
ETSSVFKHNGLRLSERQQPR

SEQ ID NO: 3153721 - protein, 18 aa, Giardia lamblia
ETSYRPIRTPSIESSTTH

SEQ ID NO: 3153722 - protein, 18 aa, Giardia lamblia
ETTALLFGTFGNPKAEQL

SEQ ID NO: 3153723 - protein, 18 aa, Giardia lamblia
ETTALVFAILKFMPEMTL

SEQ ID NO: 3153724 - protein, 17 aa, Giardia lamblia
ETTDIWSLGATLYEFFT

SEQ ID NO: 3153725 - protein, 19 aa, Giardia lamblia
ETTERLAGLIKKTTADLSG

SEQ ID NO: 3153726 - protein, 31 aa, Giardia lamblia
ETVFKLTFYLKAGLIWEFQRLFRRIRYCMLN

SEQ ID NO: 3153727 - protein, 19 aa, Giardia lamblia
ETVKSLLAQEIRLLTQDLS

SEQ ID NO: 3153728 - protein, 19 aa, Giardia lamblia
ETVWPILFGKPAADIKKPA

SEQ ID NO: 3153729 - protein, 18 aa, Giardia lamblia
ETWPELFQKPEALPYNLD

SEQ ID NO: 3153730 - protein, 22 aa, Giardia lamblia
ETYKLAALYSAFSISKLSVDYD

SEQ ID NO: 3153731 - protein, 21 aa, Giardia lamblia
ETYLRNVHVFEALPVEHVHVD

SEQ ID NO: 3153732 - protein, 20 aa, Giardia lamblia
ETYLVEFLAAPGFTPELASS

SEQ ID NO: 3153733 - protein, 19 aa, Giardia lamblia
ETYYFFRYKFFSELTSEGA

SEQ ID NO: 3153734 - protein, 17 aa, Giardia lamblia
EVAAAVLERQYLEDQLA

SEQ ID NO: 3153735 - protein, 22 aa, Giardia lamblia
EVADSILPPVIDKAIGGCISAV

SEQ ID NO: 3153736 - protein, 17 aa, Giardia lamblia
EVAELRGQLNAKLAEID

SEQ ID NO: 3153737 - protein, 17 aa, Giardia lamblia
EVAIWFDNDCVFAINYL

SEQ ID NO: 3153738 - protein, 25 aa, Giardia lamblia
EVALIKRLRHPLLVHYLSVLHDRAG

SEQ ID NO: 3153739 - protein, 23 aa, Giardia lamblia
EVAMSHPWIQEGIRQINERNARP

SEQ ID NO: 3153740 - protein, 17 aa, Giardia lamblia
EVARILYYREAGITRPD

SEQ ID NO: 3153741 - protein, 21 aa, Giardia lamblia
EVCGGRCLYANQTLWWGDDGH

SEQ ID NO: 3153742 - protein, 19 aa, Giardia lamblia
EVCGIYDAEFHKLRCENLQ

SEQ ID NO: 3153743 - protein, 20 aa, Giardia lamblia
EVCLCVGEFAIVLVDKSRNL

SEQ ID NO: 3153744 - protein, 19 aa, Giardia lamblia
EVCPICTLNSHLLDVNEAI

SEQ ID NO: 3153745 - protein, 20 aa, Giardia lamblia
EVCVLPSNRNIVISGSWDSH

SEQ ID NO: 3153746 - protein, 24 aa, Giardia lamblia
EVDGICSPGLHVLGSKEAVTQPNG

SEQ ID NO: 3153747 - protein, 30 aa, Giardia lamblia
EVDMPAFLSSLLRLALCGVPHMLETVLSAK

SEQ ID NO: 3153748 - protein, 27 aa, Giardia lamblia
EVDSTLPYRVLHGLSAWISDEGVEYLQ

SEQ ID NO: 3153749 - protein, 20 aa, Giardia lamblia
EVDWLRLCNTWHAKHGTDLR

SEQ ID NO: 3153750 - protein, 25 aa, Giardia lamblia
EVEKIRTAINYDFPELYGVQITKTV

SEQ ID NO: 3153751 - protein, 40 aa, Giardia lamblia
EVELHILERLFKYCINFYAAFLILELWCYYITSRDGHLPG

SEQ ID NO: 3153752 - protein, 26 aa, Giardia lamblia
EVELKATSFLAGRVRLPYSPINIIEV

SEQ ID NO: 3153753 - protein, 23 aa, Giardia lamblia
EVELKYRDARALNDLYTKLRRQL

SEQ ID NO: 3153754 - protein, 20 aa, Giardia lamblia
EVEMLKRRMVELENEVIVLR

SEQ ID NO: 3153755 - protein, 24 aa, Giardia lamblia
EVERYKRECCALHTQNDELKKKLD

SEQ ID NO: 3153756 - protein, 31 aa, Giardia lamblia
EVEVCLLKEIMCLRAIVVGYLEYTDTWHEHL

SEQ ID NO: 3153757 - protein, 21 aa, Giardia lamblia
EVEYCRVCIANKPSFMSDQLT

SEQ ID NO: 3153758 - protein, 17 aa, Giardia lamblia
EVFARLSHMKRLPNDIT

SEQ ID NO: 3153759 - protein, 24 aa, Giardia lamblia
EVFFNCTVHAYSMMLRSLRKSVAD

SEQ ID NO: 3153760 - protein, 17 aa, Giardia lamblia
EVFGCVHCNDELFQTVS

SEQ ID NO: 3153761 - protein, 23 aa, Giardia lamblia
EVFPRSAVLLGPRPADNVARLGR

SEQ ID NO: 3153762 - protein, 19 aa, Giardia lamblia
EVFRRRFTFEAAIQSSDIF

SEQ ID NO: 3153763 - protein, 20 aa, Giardia lamblia
EVGLLSFRNGNITGEMHQTD

SEQ ID NO: 3153764 - protein, 17 aa, Giardia lamblia
EVICALAKLKAGDLETP

SEQ ID NO: 3153765 - protein, 21 aa, Giardia lamblia
EVIHHFLPKLVELHNYQSTTN

SEQ ID NO: 3153766 - protein, 20 aa, Giardia lamblia
EVIHQREMVDLAGEDMNRRL

SEQ ID NO: 3153767 - protein, 20 aa, Giardia lamblia
EVIKTRAIYLLSKIILKKEV

SEQ ID NO: 3153768 - protein, 17 aa, Giardia lamblia
EVIPLVFTSTFSTGLTA

SEQ ID NO: 3153769 - protein, 17 aa, Giardia lamblia
EVIYRFYNLTALCKEEE

SEQ ID NO: 3153770 - protein, 25 aa, Giardia lamblia
EVKEFKLNRAVRLFIQEQVLEHLVS

SEQ ID NO: 3153771 - protein, 24 aa, Giardia lamblia
EVKEYCPNVPMILVGTKYDLLSDE

SEQ ID NO: 3153772 - protein, 20 aa, Giardia lamblia
EVKTCCVIGFPLGCMTTAAK

SEQ ID NO: 3153773 - protein, 23 aa, Giardia lamblia
EVLAKLRPIIGCLDELDDSEEDI

SEQ ID NO: 3153774 - protein, 18 aa, Giardia lamblia
EVLCQCKSVLNQYKREDV

SEQ ID NO: 3153775 - protein, 18 aa, Giardia lamblia
EVLENLYTGMAFESVLRA

SEQ ID NO: 3153776 - protein, 17 aa, Giardia lamblia
EVLESGLSLSEHRKRCM

SEQ ID NO: 3153777 - protein, 19 aa, Giardia lamblia
EVLEYSLYYQNAYFFEQST

SEQ ID NO: 3153778 - protein, 32 aa, Giardia lamblia
EVLGIKTVKPVSCIQFHPKFHDLFAAAYGSFE

SEQ ID NO: 3153779 - protein, 27 aa, Giardia lamblia
EVLKRLVALKKPYKYLVSCVLMQKMGA

SEQ ID NO: 3153780 - protein, 24 aa, Giardia lamblia
EVLMEHFRRAIGLRIKEVKEVFEG

SEQ ID NO: 3153781 - protein, 20 aa, Giardia lamblia
EVLNRLDAYSPLYSEKYAHL

SEQ ID NO: 3153782 - protein, 19 aa, Giardia lamblia
EVLPGVGVGDLALLYGAPR

SEQ ID NO: 3153783 - protein, 26 aa, Giardia lamblia
EVLPRGWRPNPAIPLYSTLVPTVDTL

SEQ ID NO: 3153784 - protein, 17 aa, Giardia lamblia
EVLQELVEYVILSLEQD

SEQ ID NO: 3153785 - protein, 26 aa, Giardia lamblia
EVLQLKVQLSRLVICETLEVARTVLE

SEQ ID NO: 3153786 - protein, 19 aa, Giardia lamblia
EVLRELRTNIGPYMLPGYT

SEQ ID NO: 3153787 - protein, 26 aa, Giardia lamblia
EVLYTVRFCEILRSFTYQLKPGNFNK

SEQ ID NO: 3153788 - protein, 20 aa, Giardia lamblia
EVMDDADLALLILKEYNIKP

SEQ ID NO: 3153789 - protein, 29 aa, Giardia lamblia
EVMTRLEATRLMYAGSLLETSTLLRSSKM

SEQ ID NO: 3153790 - protein, 21 aa, Giardia lamblia
EVNAFIGAKMLRRNLSTERRT

SEQ ID NO: 3153791 - protein, 18 aa, Giardia lamblia
EVNVLLRKVEALEAENTS

SEQ ID NO: 3153792 - protein, 20 aa, Giardia lamblia
EVPAALKAAEGVAMELVDCA

SEQ ID NO: 3153793 - protein, 19 aa, Giardia lamblia
EVPFMPTLGQRGSGSDFQC

SEQ ID NO: 3153794 - protein, 25 aa, Giardia lamblia
EVPFPPRTGHVWVLDIGCGTGSLAF

SEQ ID NO: 3153795 - protein, 23 aa, Giardia lamblia
EVPIVRRQCMRSTLKSNNAKKQK

SEQ ID NO: 3153796 - protein, 22 aa, Giardia lamblia
EVPLKLKEQITYLSHKLQEVAD

SEQ ID NO: 3153797 - protein, 20 aa, Giardia lamblia
EVPQGVILLSTFHRTKWAAP

SEQ ID NO: 3153798 - protein, 17 aa, Giardia lamblia
EVQAEYCYTAKKAPLAM

SEQ ID NO: 3153799 - protein, 23 aa, Giardia lamblia
EVQIKQVMKFMCLIDHEQNLGTV

SEQ ID NO: 3153800 - protein, 17 aa, Giardia lamblia
EVQKCLFELKEQYETVH

SEQ ID NO: 3153801 - protein, 23 aa, Giardia lamblia
EVQKELFLNKALKGGGARTAALS

SEQ ID NO: 3153802 - protein, 25 aa, Giardia lamblia
EVRCIAIQRVVRVASRISPANILAY

SEQ ID NO: 3153803 - protein, 18 aa, Giardia lamblia
EVRHANAPFAGRDPSNAA

SEQ ID NO: 3153804 - protein, 19 aa, Giardia lamblia
EVRKVKALIPKQAGLANRA

SEQ ID NO: 3153805 - protein, 23 aa, Giardia lamblia
EVRRAPCLGSCLLPPWSSADSLQ

SEQ ID NO: 3153806 - protein, 21 aa, Giardia lamblia
EVSDLRTCEAFLAQFMEYLGP

SEQ ID NO: 3153807 - protein, 17 aa, Giardia lamblia
EVSEIQTAIGTLLQGIT

SEQ ID NO: 3153808 - protein, 26 aa, Giardia lamblia
EVSELRRKFRVLSHVIDQLKSEIQTK

SEQ ID NO: 3153809 - protein, 20 aa, Giardia lamblia
EVSESCNFYTGLTDKQALEL

SEQ ID NO: 3153810 - protein, 19 aa, Giardia lamblia
EVSLKRYLFEQANDGTECY

SEQ ID NO: 3153811 - protein, 20 aa, Giardia lamblia
EVSLWKERCTEKDLLVESLE

SEQ ID NO: 3153812 - protein, 27 aa, Giardia lamblia
EVSNRYPCPVYRTSLRRGVLTTTGHSS

SEQ ID NO: 3153813 - protein, 24 aa, Giardia lamblia
EVSRLEQYIQWRLEKDAKSEVQIV

SEQ ID NO: 3153814 - protein, 24 aa, Giardia lamblia
EVSSRPVPVPGGLQVSQPPPSLVA

SEQ ID NO: 3153815 - protein, 24 aa, Giardia lamblia
EVSSTRLASLLAQENSNNDLIEGL

SEQ ID NO: 3153816 - protein, 22 aa, Giardia lamblia
EVSWIICDGVGKMDHLGSILNG

SEQ ID NO: 3153817 - protein, 17 aa, Giardia lamblia
EVTNLLKSIEQLSTDVE

SEQ ID NO: 3153818 - protein, 20 aa, Giardia lamblia
EVVDLPFNFGKPGITRFNGV

SEQ ID NO: 3153819 - protein, 19 aa, Giardia lamblia
EVVELLLPHEGGMRLKCDR

SEQ ID NO: 3153820 - protein, 19 aa, Giardia lamblia
EVVKLLAPVEGHIRNAAGL

SEQ ID NO: 3153821 - protein, 17 aa, Giardia lamblia
EVVKLLLDVEGGMQING

SEQ ID NO: 3153822 - protein, 17 aa, Giardia lamblia
EVVKLLLDVEGGMTKDK

SEQ ID NO: 3153823 - protein, 17 aa, Giardia lamblia
EVVKLLLPFETKMKTTA

SEQ ID NO: 3153824 - protein, 30 aa, Giardia lamblia
EVVNNVCFVYPLAPLFGSRSFHSKAKLVDL

SEQ ID NO: 3153825 - protein, 19 aa, Giardia lamblia
EVVNRGTFRTTYRVYDNQS

SEQ ID NO: 3153826 - protein, 21 aa, Giardia lamblia
EVVQLLRMVLARCQMTSDNHL

SEQ ID NO: 3153827 - protein, 17 aa, Giardia lamblia
EVVRLLLEVEGCMEKCR

SEQ ID NO: 3153828 - protein, 17 aa, Giardia lamblia
EVVRLLLKIEGGMQKGR

SEQ ID NO: 3153829 - protein, 18 aa, Giardia lamblia
EVVSDLIPDPAKLSKDDP

SEQ ID NO: 3153830 - protein, 21 aa, Giardia lamblia
EVVSLAHLFLTYVGRKDPQAL

SEQ ID NO: 3153831 - protein, 27 aa, Giardia lamblia
EVWEQLKMPIMERLDLFAVLSSKDTDL

SEQ ID NO: 3153832 - protein, 19 aa, Giardia lamblia
EVYARLDSITKPWVTERVP

SEQ ID NO: 3153833 - protein, 20 aa, Giardia lamblia
EVYDTLLGYGRVPIIKAADT

SEQ ID NO: 3153834 - protein, 32 aa, Giardia lamblia
EVYFRPSPSSTWKPERGCFVSFKAKWVDSKAQ

SEQ ID NO: 3153835 - protein, 18 aa, Giardia lamblia
EVYSSTWSETSRPKTESS

SEQ ID NO: 3153836 - protein, 17 aa, Giardia lamblia
EVYTCVSTSTILSAFMA

SEQ ID NO: 3153837 - protein, 20 aa, Giardia lamblia
EWARRHRLREQKIIEALQLA

SEQ ID NO: 3153838 - protein, 21 aa, Giardia lamblia
EWDIELLKRNFEVFPREHQQI

SEQ ID NO: 3153839 - protein, 24 aa, Giardia lamblia
EWFYQKRLGILRGILDSLSTVSHS

SEQ ID NO: 3153840 - protein, 30 aa, Giardia lamblia
EWGKCSPSDLFTCGVHFKANAVFKKHVLRP

SEQ ID NO: 3153841 - protein, 17 aa, Giardia lamblia
EWHKVEHPFVPAKSAKK

SEQ ID NO: 3153842 - protein, 18 aa, Giardia lamblia
EWHNLRSSLKPDLNRQKL

SEQ ID NO: 3153843 - protein, 19 aa, Giardia lamblia
EWIEKGMPIDSKRKVQQIS

SEQ ID NO: 3153844 - protein, 17 aa, Giardia lamblia
EWKGVLEQCEKLKRQKE

SEQ ID NO: 3153845 - protein, 19 aa, Giardia lamblia
EWLCIFSIMSESSFPEFCA

SEQ ID NO: 3153846 - protein, 18 aa, Giardia lamblia
EWMHRRLYMAHLRASRVH

SEQ ID NO: 3153847 - protein, 24 aa, Giardia lamblia
EWMSQLRYYVCNVPDQSKPEDLLD

SEQ ID NO: 3153848 - protein, 20 aa, Giardia lamblia
EWRDGCSHFYIIEASNRKLY

SEQ ID NO: 3153849 - protein, 19 aa, Giardia lamblia
EYALLSAWWELLQRTNEPD

SEQ ID NO: 3153850 - protein, 18 aa, Giardia lamblia
EYARQIFCDSFTVALQAA

SEQ ID NO: 3153851 - protein, 21 aa, Giardia lamblia
EYDARLAHFNKLLRSNPGMTL

SEQ ID NO: 3153852 - protein, 20 aa, Giardia lamblia
EYDERCAVAYDPLEGLDRTQ

SEQ ID NO: 3153853 - protein, 30 aa, Giardia lamblia
EYDKSGKFVRWRMTGCFSVVDLKTIQITDL

SEQ ID NO: 3153854 - protein, 20 aa, Giardia lamblia
EYDLNCGVTSLLSRHEALLE

SEQ ID NO: 3153855 - protein, 21 aa, Giardia lamblia
EYDYPQCSFNFAVRNLPPSLL

SEQ ID NO: 3153856 - protein, 18 aa, Giardia lamblia
EYEAGLKNNDEWTALMIS

SEQ ID NO: 3153857 - protein, 18 aa, Giardia lamblia
EYEERGVFVGAIRSYKLA

SEQ ID NO: 3153858 - protein, 19 aa, Giardia lamblia
EYEGVPLSIPFEHTNKTEN

SEQ ID NO: 3153859 - protein, 21 aa, Giardia lamblia
EYEIPIKLSTYVRFNTSGGIL

SEQ ID NO: 3153860 - protein, 22 aa, Giardia lamblia
EYFPCTLHDLLIKHQHSGTYFS

SEQ ID NO: 3153861 - protein, 19 aa, Giardia lamblia
EYGETALMCAIKNSDTALV

SEQ ID NO: 3153862 - protein, 23 aa, Giardia lamblia
EYGFKDLHGCTALMMAVKDKRFK

SEQ ID NO: 3153863 - protein, 25 aa, Giardia lamblia
EYGKCPRYLCSGQRLLPYSAVEKPG

SEQ ID NO: 3153864 - protein, 26 aa, Giardia lamblia
EYGLPDICKILAPREHTIITPEGQTA

SEQ ID NO: 3153865 - protein, 22 aa, Giardia lamblia
EYHERYPIVSARRIHDRYQVIN

SEQ ID NO: 3153866 - protein, 22 aa, Giardia lamblia
EYHFRKTRHRKLIEHPDSQEFR

SEQ ID NO: 3153867 - protein, 27 aa, Giardia lamblia
EYHGACAGCGETAYITHVTRLFGSRLI

SEQ ID NO: 3153868 - protein, 25 aa, Giardia lamblia
EYKELRASHFVGVPLSDLFTMALNP

SEQ ID NO: 3153869 - protein, 18 aa, Giardia lamblia
EYLAWLLRYNKSTITNGH

SEQ ID NO: 3153870 - protein, 19 aa, Giardia lamblia
EYLCGVLAKYLTALNPHQA

SEQ ID NO: 3153871 - protein, 30 aa, Giardia lamblia
EYLNILQATGFPRVFTVFTHLDEFHKIKAL

SEQ ID NO: 3153872 - protein, 22 aa, Giardia lamblia
EYLRRRPPYSATHVPEDSTDVI

SEQ ID NO: 3153873 - protein, 33 aa, Giardia lamblia
EYLRSLSVHLYRRCKIYRRAACEKNQQGAYTSR

SEQ ID NO: 3153874 - protein, 26 aa, Giardia lamblia
EYMLSGRGWERGGFDVAYYSNSRYLN

SEQ ID NO: 3153875 - protein, 17 aa, Giardia lamblia
EYMPNGPTFDFLNALIK

SEQ ID NO: 3153876 - protein, 25 aa, Giardia lamblia
EYNEKVDVWSLGCVILELCSLHKPK

SEQ ID NO: 3153877 - protein, 26 aa, Giardia lamblia
EYNELRQEYKTVIDLLSTLQGKSLAS

SEQ ID NO: 3153878 - protein, 22 aa, Giardia lamblia
EYNPDLIFVKLWVSDPVLAVIL

SEQ ID NO: 3153879 - protein, 23 aa, Giardia lamblia
EYNRLLEELNRVLAEVRDDDSAQ

SEQ ID NO: 3153880 - protein, 25 aa, Giardia lamblia
EYPDLKAQVLFQIISACFNQEQIQQ

SEQ ID NO: 3153881 - protein, 22 aa, Giardia lamblia
EYPLCASLYIGQIVREEIQRQT

SEQ ID NO: 3153882 - protein, 23 aa, Giardia lamblia
EYPLEEYLIRLAVPASAVGMEVT

SEQ ID NO: 3153883 - protein, 20 aa, Giardia lamblia
EYPVHCCAIHPNIPNLMVYA

SEQ ID NO: 3153884 - protein, 22 aa, Giardia lamblia
EYRELMAIKRGHYGIVHKVEHI

SEQ ID NO: 3153885 - protein, 17 aa, Giardia lamblia
EYRIFIKDLRIVLIAPR

SEQ ID NO: 3153886 - protein, 27 aa, Giardia lamblia
EYSEFPAVYPCYLDIFGTESVWRMHHE

SEQ ID NO: 3153887 - protein, 19 aa, Giardia lamblia
EYSKAIMECERLRKEVQHQ

SEQ ID NO: 3153888 - protein, 19 aa, Giardia lamblia
EYSKITLLLGENGTGKSTL

SEQ ID NO: 3153889 - protein, 18 aa, Giardia lamblia
EYSKMMTYLLSYVSHNSS

SEQ ID NO: 3153890 - protein, 28 aa, Giardia lamblia
EYSKPWVFVCDSGWKFHELRMEMMKHGV

SEQ ID NO: 3153891 - protein, 25 aa, Giardia lamblia
EYSLPECAEDLLPCSNISKDVDDLA

SEQ ID NO: 3153892 - protein, 25 aa, Giardia lamblia
EYSLRLGPLEPLLSFRTRSTYLSSG

SEQ ID NO: 3153893 - protein, 18 aa, Giardia lamblia
EYSNKELVLCGGTCKVEL

SEQ ID NO: 3153894 - protein, 18 aa, Giardia lamblia
EYTLEKYPSISILRRHPK

SEQ ID NO: 3153895 - protein, 17 aa, Giardia lamblia
EYTRLLAKYEALLAESK

SEQ ID NO: 3153896 - protein, 21 aa, Giardia lamblia
EYTSKEVIELLATYDPSSLSS

SEQ ID NO: 3153897 - protein, 28 aa, Giardia lamblia
EYTVGFLMARFLVLFCIPLQEYKYIPLP

SEQ ID NO: 3153898 - protein, 17 aa, Giardia lamblia
EYVKPPHTTFCDAPVAR

SEQ ID NO: 3153899 - protein, 27 aa, Giardia lamblia
EYVNLFALKTSYYVDWSRLLSQDSMKQ

SEQ ID NO: 3153900 - protein, 23 aa, Giardia lamblia
EYVPPCYRHILISAPTSAGKSLV

SEQ ID NO: 3153901 - protein, 19 aa, Giardia lamblia
EYVVRRVGTGVGRNYESIT

SEQ ID NO: 3153902 - protein, 25 aa, Giardia lamblia
EYYAAIKAIRARVLVYTGYQQVMEY

SEQ ID NO: 3153903 - protein, 26 aa, Giardia lamblia
EYYERCCLMDVILFYRMKERVIPEET

SEQ ID NO: 3153904 - protein, 26 aa, Giardia lamblia
EYYYCQSCKLKFKTEEEAMAHQETPE

SEQ ID NO: 3153905 - protein, 17 aa, Giardia lamblia
FAAERGYSDVVSYLLPH

SEQ ID NO: 3153906 - protein, 27 aa, Giardia lamblia
FAAHVFPLPVCLLVVMEELISEEQFQL

SEQ ID NO: 3153907 - protein, 17 aa, Giardia lamblia
FAAIFARDYEKIKSDLG

SEQ ID NO: 3153908 - protein, 18 aa, Giardia lamblia
FAAIPYFFRLIYLPQSLC

SEQ ID NO: 3153909 - protein, 26 aa, Giardia lamblia
FAALNGHLDCARLLLETDEKTADDRG

SEQ ID NO: 3153910 - protein, 17 aa, Giardia lamblia
FAALQAELDVMRKVNGS

SEQ ID NO: 3153911 - protein, 25 aa, Giardia lamblia
FAAVEAFSRLCFVRQLPDRKAANLV

SEQ ID NO: 3153912 - protein, 17 aa, Giardia lamblia
FAAVLGYRDIAEILLPY

SEQ ID NO: 3153913 - protein, 23 aa, Giardia lamblia
FACDPCPTCTIDVSALFQDKELS

SEQ ID NO: 3153914 - protein, 21 aa, Giardia lamblia
FADELVSVFWKATKAVKSSLV

SEQ ID NO: 3153915 - protein, 21 aa, Giardia lamblia
FADEVFKEFLAQNSSTIQDSI

SEQ ID NO: 3153916 - protein, 20 aa, Giardia lamblia
FADGCAEAAILGFNDELISW

SEQ ID NO: 3153917 - protein, 19 aa, Giardia lamblia
FADLCSAPGGWSYTILERF

SEQ ID NO: 3153918 - protein, 30 aa, Giardia lamblia
FADLIRRMLCIDPRSRASVTYICGLEPVVN

SEQ ID NO: 3153919 - protein, 24 aa, Giardia lamblia
FADLKSARDWALKRGYTDAVDVLD

SEQ ID NO: 3153920 - protein, 17 aa, Giardia lamblia
FADLSKRNAALERKCTD

SEQ ID NO: 3153921 - protein, 18 aa, Giardia lamblia
FADLYIFLSSLVELQQNP

SEQ ID NO: 3153922 - protein, 28 aa, Giardia lamblia
FADSLSKVDAWISILERFMRKRPYMRIG

SEQ ID NO: 3153923 - protein, 23 aa, Giardia lamblia
FAEAKGGVIERVYCDVTQPLKID

SEQ ID NO: 3153924 - protein, 20 aa, Giardia lamblia
FAEIEQFFAYVITKYDLQLR

SEQ ID NO: 3153925 - protein, 22 aa, Giardia lamblia
FAEKCRPHLFPDTSHLSFGNLI

SEQ ID NO: 3153926 - protein, 18 aa, Giardia lamblia
FAELQKFQFSSAILSSKE

SEQ ID NO: 3153927 - protein, 22 aa, Giardia lamblia
FAEPRTRPLGARRPIQYNQISE

SEQ ID NO: 3153928 - protein, 18 aa, Giardia lamblia
FAESWRGYHVKYFTADRI

SEQ ID NO: 3153929 - protein, 18 aa, Giardia lamblia
FAFFYKLPFLPTALSSCF

SEQ ID NO: 3153930 - protein, 26 aa, Giardia lamblia
FAFGILLYRLMYRRLPFPDNDLRYNY

SEQ ID NO: 3153931 - protein, 25 aa, Giardia lamblia
FAFLSRAGVLTIWPSKGVFLEPLLF

SEQ ID NO: 3153932 - protein, 23 aa, Giardia lamblia
FAFRSAEHLERFSREIKRYNEEV

SEQ ID NO: 3153933 - protein, 18 aa, Giardia lamblia
FAGATGGNTIRWGDAEKQ

SEQ ID NO: 3153934 - protein, 20 aa, Giardia lamblia
FAGEVYKHLLLNSVTNKTRF

SEQ ID NO: 3153935 - protein, 17 aa, Giardia lamblia
FAGLCKFLSSGPVCAMV

SEQ ID NO: 3153936 - protein, 24 aa, Giardia lamblia
FAGRKPRGSMPGGVDDGASYEHYD

SEQ ID NO: 3153937 - protein, 17 aa, Giardia lamblia
FAGSVLPAPSHDGSRES

SEQ ID NO: 3153938 - protein, 28 aa, Giardia lamblia
FAHIETLTFLWSLVAHGKFYTRGGTCLH

SEQ ID NO: 3153939 - protein, 18 aa, Giardia lamblia
FAHRERILIDSYVSRIEN

SEQ ID NO: 3153940 - protein, 18 aa, Giardia lamblia
FAIDPAVCEDHIKDRASD

SEQ ID NO: 3153941 - protein, 24 aa, Giardia lamblia
FAILGHSWAANWAAARGDSDDLVQ

SEQ ID NO: 3153942 - protein, 18 aa, Giardia lamblia
FAILKFMPEMTLPEIQEV

SEQ ID NO: 3153943 - protein, 17 aa, Giardia lamblia
FAIMTCNSMLLKENKEE

SEQ ID NO: 3153944 - protein, 17 aa, Giardia lamblia
FAIPLALTITRTINPNK

SEQ ID NO: 3153945 - protein, 19 aa, Giardia lamblia
FAISLTIPGYLSPSIAPRN

SEQ ID NO: 3153946 - protein, 28 aa, Giardia lamblia
FAITSMRCLLCDKVGPIGLRCTHCKGEV

SEQ ID NO: 3153947 - protein, 21 aa, Giardia lamblia
FAKAYPPEACELIRENYYALN

SEQ ID NO: 3153948 - protein, 21 aa, Giardia lamblia
FAKCCGFNIIQLLPLQDTITG

SEQ ID NO: 3153949 - protein, 21 aa, Giardia lamblia
FAKELRYLFPNTQRVNRGRHV

SEQ ID NO: 3153950 - protein, 17 aa, Giardia lamblia
FAKSCGRADKLDQISLG

SEQ ID NO: 3153951 - protein, 17 aa, Giardia lamblia
FALAQACTPEYYIDGQD

SEQ ID NO: 3153952 - protein, 29 aa, Giardia lamblia
FALDCARAGVCFGGVLILHEDMNTTWITD

SEQ ID NO: 3153953 - protein, 28 aa, Giardia lamblia
FALEEPCIFCSMCLLHARVKRVFYSAFM

SEQ ID NO: 3153954 - protein, 23 aa, Giardia lamblia
FALIAGAFCDAALRGDDVYADEL

SEQ ID NO: 3153955 - protein, 32 aa, Giardia lamblia
FALRTAQPHWSVCGPRLPRYAEIRFDSYPDKL

SEQ ID NO: 3153956 - protein, 18 aa, Giardia lamblia
FALSLSLRPEKKMGSDEL

SEQ ID NO: 3153957 - protein, 17 aa, Giardia lamblia
FALSRISKVDALSSKVT

SEQ ID NO: 3153958 - protein, 22 aa, Giardia lamblia
FANARIPDYYDMGSALPPEDIE

SEQ ID NO: 3153959 - protein, 26 aa, Giardia lamblia
FANCIAKVAVMLARLGDVEGASEALV

SEQ ID NO: 3153960 - protein, 22 aa, Giardia lamblia
FANEGWFHVDCLGLRSHSNETD

SEQ ID NO: 3153961 - protein, 22 aa, Giardia lamblia
FANRAAARLGLKAEEETALAAK

SEQ ID NO: 3153962 - protein, 17 aa, Giardia lamblia
FANWDIVERGYLAHIYG

SEQ ID NO: 3153963 - protein, 23 aa, Giardia lamblia
FARGILSCAAIIYDLLAPDEAIA

SEQ ID NO: 3153964 - protein, 18 aa, Giardia lamblia
FASALAYIREVDTIGIIV

SEQ ID NO: 3153965 - protein, 19 aa, Giardia lamblia
FASARAVLPSNDFVIRDED

SEQ ID NO: 3153966 - protein, 19 aa, Giardia lamblia
FASASLMVFHGASVLVCMG

SEQ ID NO: 3153967 - protein, 29 aa, Giardia lamblia
FASAVDRFSIKYDKDMLEIAPNTYKVEDV

SEQ ID NO: 3153968 - protein, 19 aa, Giardia lamblia
FASEYYFNVLKEFCERNAL

SEQ ID NO: 3153969 - protein, 24 aa, Giardia lamblia
FASRTRSAVAYSLPKSSGERIKHR

SEQ ID NO: 3153970 - protein, 17 aa, Giardia lamblia
FASSILLSFVATLHEAA

SEQ ID NO: 3153971 - protein, 20 aa, Giardia lamblia
FATEELRDTCLAAMPQKDSS

SEQ ID NO: 3153972 - protein, 19 aa, Giardia lamblia
FATEFLKMYQKELGVQTPS

SEQ ID NO: 3153973 - protein, 25 aa, Giardia lamblia
FATGAPRLQLFFSVPSAGERSIQVN

SEQ ID NO: 3153974 - protein, 17 aa, Giardia lamblia
FATICSLSRAAVHYYKV

SEQ ID NO: 3153975 - protein, 25 aa, Giardia lamblia
FATYCLEYYKKIAFSGDLTLVHLKH

SEQ ID NO: 3153976 - protein, 18 aa, Giardia lamblia
FAVDKKPLVFGGIRVGID

SEQ ID NO: 3153977 - protein, 24 aa, Giardia lamblia
FAVETRYLLAVALTNQIKLYPVTY

SEQ ID NO: 3153978 - protein, 17 aa, Giardia lamblia
FAVLCRDPPPATPLKLI

SEQ ID NO: 3153979 - protein, 17 aa, Giardia lamblia
FAVQVRPRSDFAAEVSK

SEQ ID NO: 3153980 - protein, 21 aa, Giardia lamblia
FCACGRIKLRATDLLDKKSAS

SEQ ID NO: 3153981 - protein, 17 aa, Giardia lamblia
FCAKEQFQRIFSAMSSP

SEQ ID NO: 3153982 - protein, 21 aa, Giardia lamblia
FCARPERPRSPAAVAANKLHS

SEQ ID NO: 3153983 - protein, 27 aa, Giardia lamblia
FCCICDELTRLPPAYSALLRNVNMTRP

SEQ ID NO: 3153984 - protein, 23 aa, Giardia lamblia
FCDPVKELACSSMLEQTPLYLTG

SEQ ID NO: 3153985 - protein, 22 aa, Giardia lamblia
FCDYDRFESIFGQVFSLAHTGR

SEQ ID NO: 3153986 - protein, 17 aa, Giardia lamblia
FCEACSHTAVHMYNGLL

SEQ ID NO: 3153987 - protein, 22 aa, Giardia lamblia
FCELCIRTLNPLAFEVMAAKLL

SEQ ID NO: 3153988 - protein, 17 aa, Giardia lamblia
FCERCIGQLIAFEERVV

SEQ ID NO: 3153989 - protein, 29 aa, Giardia lamblia
FCFCGTPSGELCVFNLKTSTLRTILKYFK

SEQ ID NO: 3153990 - protein, 30 aa, Giardia lamblia
FCFSVRNCSKTVFFPFIVSINLKSHAVSIT

SEQ ID NO: 3153991 - protein, 19 aa, Giardia lamblia
FCGALTPSRSTACCNTDHI

SEQ ID NO: 3153992 - protein, 18 aa, Giardia lamblia
FCGILRRNSLSYGSLQTQ

SEQ ID NO: 3153993 - protein, 19 aa, Giardia lamblia
FCGPEDWYEMGAHYTRIFQ

SEQ ID NO: 3153994 - protein, 19 aa, Giardia lamblia
FCHMYRASLSFIGFEPSHS

SEQ ID NO: 3153995 - protein, 20 aa, Giardia lamblia
FCHTLTMFVGNVFDQLHLYE

SEQ ID NO: 3153996 - protein, 20 aa, Giardia lamblia
FCICDHPIDLLSLVYNVSGK

SEQ ID NO: 3153997 - protein, 20 aa, Giardia lamblia
FCIIGLKALDYQEARDYTVR

SEQ ID NO: 3153998 - protein, 17 aa, Giardia lamblia
FCIYRAQEVLLLNEHTK

SEQ ID NO: 3153999 - protein, 20 aa, Giardia lamblia
FCKHLKKYLIDQGFEATIIE

SEQ ID NO: 3154000 - protein, 18 aa, Giardia lamblia
FCKQLNLRIRGVIENMSG

SEQ ID NO: 3154001 - protein, 21 aa, Giardia lamblia
FCLFCRATGPIGLRCTHCQMP

SEQ ID NO: 3154002 - protein, 17 aa, Giardia lamblia
FCLPQPFDESTTRIIRG

SEQ ID NO: 3154003 - protein, 19 aa, Giardia lamblia
FCLYMSRLFSILKDNQVYV

SEQ ID NO: 3154004 - protein, 17 aa, Giardia lamblia
FCNINGFGPDLYQKSWS

SEQ ID NO: 3154005 - protein, 23 aa, Giardia lamblia
FCPFIKTDLMLRNIVHYYESCKT

SEQ ID NO: 3154006 - protein, 17 aa, Giardia lamblia
FCRGSLLHFHRMPVESG

SEQ ID NO: 3154007 - protein, 19 aa, Giardia lamblia
FCSKPVYPGKGICFVRNDS

SEQ ID NO: 3154008 - protein, 27 aa, Giardia lamblia
FCSSVSGALHMERCRGLVVIASCHQLR

SEQ ID NO: 3154009 - protein, 21 aa, Giardia lamblia
FCTLTGALEQVEWKTISPEET

SEQ ID NO: 3154010 - protein, 20 aa, Giardia lamblia
FCVDESWRVRHACADIFINV

SEQ ID NO: 3154011 - protein, 19 aa, Giardia lamblia
FDAAQLLHRLFPYQSVKQH

SEQ ID NO: 3154012 - protein, 21 aa, Giardia lamblia
FDCDLDASFDFAKDKLQPSGA

SEQ ID NO: 3154013 - protein, 18 aa, Giardia lamblia
FDCGKIMEHIVPFDEPSN

SEQ ID NO: 3154014 - protein, 21 aa, Giardia lamblia
FDCNATMKGLYDTKTVIVMAL

SEQ ID NO: 3154015 - protein, 17 aa, Giardia lamblia
FDDCFGVGIDEGHATVQ

SEQ ID NO: 3154016 - protein, 23 aa, Giardia lamblia
FDDCVPASFHLPKNWDKMITDKN

SEQ ID NO: 3154017 - protein, 18 aa, Giardia lamblia
FDDDLSRSRSIINTLTDS

SEQ ID NO: 3154018 - protein, 22 aa, Giardia lamblia
FDDLLCPDFRTAGGKESISDSF

SEQ ID NO: 3154019 - protein, 21 aa, Giardia lamblia
FDEEYDMRVCTSSESSESSYK

SEQ ID NO: 3154020 - protein, 24 aa, Giardia lamblia
FDEKLSGLCMNWLSDTVNYIRRAA

SEQ ID NO: 3154021 - protein, 19 aa, Giardia lamblia
FDEKYYLNADLRDRNNKSK

SEQ ID NO: 3154022 - protein, 24 aa, Giardia lamblia
FDETRRFTSNDVRNFPKSRHVLDQ

SEQ ID NO: 3154023 - protein, 17 aa, Giardia lamblia
FDEVDSWGLKRSVNASE

SEQ ID NO: 3154024 - protein, 29 aa, Giardia lamblia
FDEVSLTLLRRAGAILKRGDGEAELIPGL

SEQ ID NO: 3154025 - protein, 20 aa, Giardia lamblia
FDFACPLTLLADKEQLQVYG

SEQ ID NO: 3154026 - protein, 21 aa, Giardia lamblia
FDFAEGGKFHNFRARAVTKLN

SEQ ID NO: 3154027 - protein, 20 aa, Giardia lamblia
FDFCVRYSAIDARREGFEVR

SEQ ID NO: 3154028 - protein, 23 aa, Giardia lamblia
FDFEFRPATPNDRRQILERILLK

SEQ ID NO: 3154029 - protein, 25 aa, Giardia lamblia
FDGLFKHLIVAISIAANIFREYTKT

SEQ ID NO: 3154030 - protein, 17 aa, Giardia lamblia
FDGVKELARYEASIRDN

SEQ ID NO: 3154031 - protein, 26 aa, Giardia lamblia
FDHARLRSYFHFVLTYLKSCSKRKTT

SEQ ID NO: 3154032 - protein, 30 aa, Giardia lamblia
FDHCSRILRATAFRRLCLEYQNAQWKIVKR

SEQ ID NO: 3154033 - protein, 17 aa, Giardia lamblia
FDHCSRTVAYGSNLDSK

SEQ ID NO: 3154034 - protein, 25 aa, Giardia lamblia
FDHSGALPFLFSLFPNFNRPVYTTE

SEQ ID NO: 3154035 - protein, 27 aa, Giardia lamblia
FDIFHFCPLERFGIIISDRATDFSPIK

SEQ ID NO: 3154036 - protein, 20 aa, Giardia lamblia
FDINLGVCMTALAHKNAGVR

SEQ ID NO: 3154037 - protein, 18 aa, Giardia lamblia
FDIPISYNKSISRINGQG

SEQ ID NO: 3154038 - protein, 24 aa, Giardia lamblia
FDIQIRPAPNLGLAVEQAAEIQSF

SEQ ID NO: 3154039 - protein, 24 aa, Giardia lamblia
FDIQSLKLLLPMIPVSGISTCSRA

SEQ ID NO: 3154040 - protein, 30 aa, Giardia lamblia
FDKARQAAPCVLFFDEIESITQHRGTSASG

SEQ ID NO: 3154041 - protein, 19 aa, Giardia lamblia
FDKDIPIPIPSKRQRIDIL

SEQ ID NO: 3154042 - protein, 21 aa, Giardia lamblia
FDKGILKKKFLGFDEFGGDKP

SEQ ID NO: 3154043 - protein, 19 aa, Giardia lamblia
FDKNLPQLVQFLSLLGYFG

SEQ ID NO: 3154044 - protein, 18 aa, Giardia lamblia
FDKPRLDAILRVLNGEMR

SEQ ID NO: 3154045 - protein, 21 aa, Giardia lamblia
FDKRGHTALMYAIQAKNIAAV

SEQ ID NO: 3154046 - protein, 25 aa, Giardia lamblia
FDKVSVDPMFGFVVGSDGAFLRIWK

SEQ ID NO: 3154047 - protein, 27 aa, Giardia lamblia
FDLAEKAALCALELMEQRGFYKIEQAE

SEQ ID NO: 3154048 - protein, 26 aa, Giardia lamblia
FDLCHSETRTICAIYTTRVYKFVSSL

SEQ ID NO: 3154049 - protein, 20 aa, Giardia lamblia
FDLKLLREVIDEASQFTVGF

SEQ ID NO: 3154050 - protein, 17 aa, Giardia lamblia
FDLLATRGKSSSYRTRR

SEQ ID NO: 3154051 - protein, 31 aa, Giardia lamblia
FDLSYYCLRPRPFSSLSVSIFPSYKYKPTMA

SEQ ID NO: 3154052 - protein, 21 aa, Giardia lamblia
FDLTKKVTFRKLSINTRIIAN

SEQ ID NO: 3154053 - protein, 19 aa, Giardia lamblia
FDLTLPVNRPLISLERRCL

SEQ ID NO: 3154054 - protein, 26 aa, Giardia lamblia
FDMRPFPAIHVEFGYAPYELVMASVG

SEQ ID NO: 3154055 - protein, 17 aa, Giardia lamblia
FDNDCVFAINYLSVLLL

SEQ ID NO: 3154056 - protein, 25 aa, Giardia lamblia
FDNIPWAFGEYFINHYLNFNAKVPS

SEQ ID NO: 3154057 - protein, 22 aa, Giardia lamblia
FDNWLRARINEGGYLADFPLPE

SEQ ID NO: 3154058 - protein, 20 aa, Giardia lamblia
FDPAIPLPRCKRMHRAKHTS

SEQ ID NO: 3154059 - protein, 29 aa, Giardia lamblia
FDPDSNILFCSSVTGLIRIYNYDVTPIPI

SEQ ID NO: 3154060 - protein, 17 aa, Giardia lamblia
FDPFYTYHVFNIPEASS

SEQ ID NO: 3154061 - protein, 17 aa, Giardia lamblia
FDPLLPVPVKEAQISAS

SEQ ID NO: 3154062 - protein, 18 aa, Giardia lamblia
FDPLYTVLIGYYALGVPE

SEQ ID NO: 3154063 - protein, 20 aa, Giardia lamblia
FDPPKLIATYTHRAGRTARC

SEQ ID NO: 3154064 - protein, 17 aa, Giardia lamblia
FDPRFPKSNIIIVDTPP

SEQ ID NO: 3154065 - protein, 17 aa, Giardia lamblia
FDPSRFVSVMLGYGDIV

SEQ ID NO: 3154066 - protein, 19 aa, Giardia lamblia
FDPTIPETYLQHGISSIKA

SEQ ID NO: 3154067 - protein, 24 aa, Giardia lamblia
FDQEFLKHLSPWGVTPRALVFEKD

SEQ ID NO: 3154068 - protein, 18 aa, Giardia lamblia
FDQNKRLSAQDCLRHPWF

SEQ ID NO: 3154069 - protein, 29 aa, Giardia lamblia
FDQPCFYNPCLDDLYIAFIVQYPLAQSTI

SEQ ID NO: 3154070 - protein, 26 aa, Giardia lamblia
FDQTLRSCDVIREIKQQMTAFKAEFS

SEQ ID NO: 3154071 - protein, 17 aa, Giardia lamblia
FDRDCEGNTPLMLAVEE

SEQ ID NO: 3154072 - protein, 25 aa, Giardia lamblia
FDRFISGSIGVCFGRVDKRKTPRSP

SEQ ID NO: 3154073 - protein, 23 aa, Giardia lamblia
FDRIRKEEWAKIKKEKQQLDDRR

SEQ ID NO: 3154074 - protein, 23 aa, Giardia lamblia
FDRPSPKLLAFLSKVYDMHDFKA

SEQ ID NO: 3154075 - protein, 23 aa, Giardia lamblia
FDRRLVYDSARLIILQTLDNTSR

SEQ ID NO: 3154076 - protein, 25 aa, Giardia lamblia
FDRRRPRPAFRATIYEDSPKAPKAF

SEQ ID NO: 3154077 - protein, 24 aa, Giardia lamblia
FDRSCAPPPSSTYVMDRADRDIAT

SEQ ID NO: 3154078 - protein, 24 aa, Giardia lamblia
FDSACFPCLAQWGATISVHDEFVM

SEQ ID NO: 3154079 - protein, 33 aa, Giardia lamblia
FDSIICILVKLLAPSIPVFLLFLGDNETVAPYM

SEQ ID NO: 3154080 - protein, 23 aa, Giardia lamblia
FDSIPYRIEEAFDLLHRKTGRRY

SEQ ID NO: 3154081 - protein, 31 aa, Giardia lamblia
FDSKAGIMLNSRFVKLVAWYDNEFGYANKLV

SEQ ID NO: 3154082 - protein, 26 aa, Giardia lamblia
FDTEGFNRLFGWMILLCECIISYSVL

SEQ ID NO: 3154083 - protein, 17 aa, Giardia lamblia
FDTVLDIAKELRANSFA

SEQ ID NO: 3154084 - protein, 27 aa, Giardia lamblia
FDVDLLLIRCCIMQFNTDRAMEVIEHY

SEQ ID NO: 3154085 - protein, 17 aa, Giardia lamblia
FDVLLQSCFLHDRGEIL

SEQ ID NO: 3154086 - protein, 18 aa, Giardia lamblia
FDVLVTFQPAMAAKLPEV

SEQ ID NO: 3154087 - protein, 31 aa, Giardia lamblia
FDVRVHRPAFRFSLWSRPSCITFNNYYPNVL

SEQ ID NO: 3154088 - protein, 26 aa, Giardia lamblia
FDWPFVDVRAAAYGMDLLDEIGVLKS

SEQ ID NO: 3154089 - protein, 22 aa, Giardia lamblia
FDWSEKISPLDVYIGSSQNAVE

SEQ ID NO: 3154090 - protein, 27 aa, Giardia lamblia
FDYFIQIACALRYCHRFGICHRDLKFE

SEQ ID NO: 3154091 - protein, 22 aa, Giardia lamblia
FDYHTRFSLEIRSLIEPDQESN

SEQ ID NO: 3154092 - protein, 17 aa, Giardia lamblia
FDYKFDFYPGVKPKYPC

SEQ ID NO: 3154093 - protein, 27 aa, Giardia lamblia
FEAATTGRPVWRPKIISYDSSQSNADV

SEQ ID NO: 3154094 - protein, 25 aa, Giardia lamblia
FEADRMTIMLVFNLLGNENFTPEAK

SEQ ID NO: 3154095 - protein, 17 aa, Giardia lamblia
FEAGEQFIEANNPEASP

SEQ ID NO: 3154096 - protein, 22 aa, Giardia lamblia
FEAICRRLYGRLFISSHPVECD

SEQ ID NO: 3154097 - protein, 26 aa, Giardia lamblia
FEALCSWRGGCIIRMNLLTPLADFYK

SEQ ID NO: 3154098 - protein, 28 aa, Giardia lamblia
FEALEGWLKDMLAGVGMEASPNGVSGMV

SEQ ID NO: 3154099 - protein, 26 aa, Giardia lamblia
FEALHLRGGYVKRVKEPLDMPFLPYS

SEQ ID NO: 3154100 - protein, 18 aa, Giardia lamblia
FEALPHLCERVALRNAKI

SEQ ID NO: 3154101 - protein, 18 aa, Giardia lamblia
FEANLSRAAYRSFQSQRL

SEQ ID NO: 3154102 - protein, 18 aa, Giardia lamblia
FEAPTVFYFTVDELKTFL

SEQ ID NO: 3154103 - protein, 19 aa, Giardia lamblia
FEARYELAAGVYAKAMIPK

SEQ ID NO: 3154104 - protein, 21 aa, Giardia lamblia
FEAYCKSAFVSWVKANMLTTE

SEQ ID NO: 3154105 - protein, 21 aa, Giardia lamblia
FECGPPYTLECMDRTAKHIIR

SEQ ID NO: 3154106 - protein, 24 aa, Giardia lamblia
FEDAEVMPAAWLEVAREYQQNQSI

SEQ ID NO: 3154107 - protein, 17 aa, Giardia lamblia
FEDESFRAYLRYLQYVR

SEQ ID NO: 3154108 - protein, 19 aa, Giardia lamblia
FEDPCSFTNPEQGKRYRQL

SEQ ID NO: 3154109 - protein, 20 aa, Giardia lamblia
FEEICAMLRPYELNLTKDDG

SEQ ID NO: 3154110 - protein, 19 aa, Giardia lamblia
FEEIEEWRNKLSRTIEDAD

SEQ ID NO: 3154111 - protein, 17 aa, Giardia lamblia
FEEKIGLSISEVSGHIY

SEQ ID NO: 3154112 - protein, 19 aa, Giardia lamblia
FEERKGLRRPRSPSELFSN

SEQ ID NO: 3154113 - protein, 21 aa, Giardia lamblia
FEFNDKVLLYIAHHAYSGWHG

SEQ ID NO: 3154114 - protein, 20 aa, Giardia lamblia
FEGIRLIYLIAKARSQGKIV

SEQ ID NO: 3154115 - protein, 21 aa, Giardia lamblia
FEGKNCTVFAYGQTGSGKSFT

SEQ ID NO: 3154116 - protein, 20 aa, Giardia lamblia
FEHFHGLQMARIIEERADGK

SEQ ID NO: 3154117 - protein, 25 aa, Giardia lamblia
FEHPQPPGLLAIRTNKYISMNTSNT

SEQ ID NO: 3154118 - protein, 23 aa, Giardia lamblia
FEHPSHLYYFITYYSKQDDDSVS

SEQ ID NO: 3154119 - protein, 17 aa, Giardia lamblia
FEHSGSYMPLRRERTLP

SEQ ID NO: 3154120 - protein, 17 aa, Giardia lamblia
FEIAREKLLSLPSVRLN

SEQ ID NO: 3154121 - protein, 17 aa, Giardia lamblia
FEICGSRFLSLPATSSD

SEQ ID NO: 3154122 - protein, 18 aa, Giardia lamblia
FEIIPLTLAENAGLSPIT

SEQ ID NO: 3154123 - protein, 35 aa, Giardia lamblia
FEIRDGLARILVCFYLHDFKAGILRLLQMNLDHIS

SEQ ID NO: 3154124 - protein, 17 aa, Giardia lamblia
FEKCTQYLYERIFEGAA

SEQ ID NO: 3154125 - protein, 17 aa, Giardia lamblia
FEKGFNFNVADPAIHGG

SEQ ID NO: 3154126 - protein, 21 aa, Giardia lamblia
FEKLWCFPTDGGFSGMYFVSI

SEQ ID NO: 3154127 - protein, 23 aa, Giardia lamblia
FEKRHKRDRVCGVDCSPDGQVYA

SEQ ID NO: 3154128 - protein, 22 aa, Giardia lamblia
FELAKSVFLNLVLVESELPSIV

SEQ ID NO: 3154129 - protein, 17 aa, Giardia lamblia
FELARAEKQAVIFIDEI

SEQ ID NO: 3154130 - protein, 20 aa, Giardia lamblia
FELLNLYRAITFAGLSYLSG

SEQ ID NO: 3154131 - protein, 20 aa, Giardia lamblia
FELLPSYLALDGHCVTVAIE

SEQ ID NO: 3154132 - protein, 18 aa, Giardia lamblia
FELMCARVRELFDFVNYT

SEQ ID NO: 3154133 - protein, 17 aa, Giardia lamblia
FELRKQIRELVKVRFVL

SEQ ID NO: 3154134 - protein, 17 aa, Giardia lamblia
FELWLLDAHPSTEIPDV

SEQ ID NO: 3154135 - protein, 31 aa, Giardia lamblia
FELYSLYSFFSFCLQRKCRRRVLLDYFNSGV

SEQ ID NO: 3154136 - protein, 17 aa, Giardia lamblia
FEMHTKLAIKNSLETAR

SEQ ID NO: 3154137 - protein, 22 aa, Giardia lamblia
FENIALPIADKVLDGYNGTICC

SEQ ID NO: 3154138 - protein, 17 aa, Giardia lamblia
FENRYLPFLQLPDTRLK

SEQ ID NO: 3154139 - protein, 17 aa, Giardia lamblia
FEPESFDLITISMTLHH

SEQ ID NO: 3154140 - protein, 26 aa, Giardia lamblia
FEPIECVTVVDVLRRGGVSVTLAGTE

SEQ ID NO: 3154141 - protein, 23 aa, Giardia lamblia
FEPLIVEAIRIVLNTTLAPYRGA

SEQ ID NO: 3154142 - protein, 33 aa, Giardia lamblia
FEQEIQAAYAIRSRWASLLSIVKEVDRLLVEIK

SEQ ID NO: 3154143 - protein, 27 aa, Giardia lamblia
FEQILRCAMPYNIFNAMFSVKRFIYFE

SEQ ID NO: 3154144 - protein, 26 aa, Giardia lamblia
FEQKLLFNAAVVRRKSLFFSGSAGTG

SEQ ID NO: 3154145 - protein, 29 aa, Giardia lamblia
FEQVIALLARYCEPGFVIHPPLKFVKEKY

SEQ ID NO: 3154146 - protein, 29 aa, Giardia lamblia
FERMHVIDHYCHFCRNAAMASPLLTYCMD

SEQ ID NO: 3154147 - protein, 23 aa, Giardia lamblia
FERRLLPESGNDSFVIHPLQYYT

SEQ ID NO: 3154148 - protein, 36 aa, Giardia lamblia
FERTGSATALWYAAYCGHLDCVELLAPLEANLKRRE

SEQ ID NO: 3154149 - protein, 24 aa, Giardia lamblia
FERYRLVLRETLHRQARPKTAGTI

SEQ ID NO: 3154150 - protein, 17 aa, Giardia lamblia
FESKFQLPMSAYSPGSF

SEQ ID NO: 3154151 - protein, 23 aa, Giardia lamblia
FESLCTCRCEACLHHLAYKHNHI

SEQ ID NO: 3154152 - protein, 26 aa, Giardia lamblia
FESPALRSASSFSALPDRNSSKASNT

SEQ ID NO: 3154153 - protein, 25 aa, Giardia lamblia
FESSLGMLNIRSGFYDLRNPSIHAI

SEQ ID NO: 3154154 - protein, 25 aa, Giardia lamblia
FESVLPSILADWFGQYILRSIMLVM

SEQ ID NO: 3154155 - protein, 22 aa, Giardia lamblia
FETCVILLSTYQSWLQFRDVPP

SEQ ID NO: 3154156 - protein, 18 aa, Giardia lamblia
FETIYALCRIDINTFSVE

SEQ ID NO: 3154157 - protein, 24 aa, Giardia lamblia
FETQLARTQFRMMPLVTPHPTITS

SEQ ID NO: 3154158 - protein, 22 aa, Giardia lamblia
FETRLAVSDIFEFSKMSFEQHA

SEQ ID NO: 3154159 - protein, 17 aa, Giardia lamblia
FEVLGLPDDTTWPGVTA

SEQ ID NO: 3154160 - protein, 20 aa, Giardia lamblia
FEVLSRFDPRVEIDVLEACT

SEQ ID NO: 3154161 - protein, 28 aa, Giardia lamblia
FEVNNRLAFNCLRIVLEIITNQAEEHGI

SEQ ID NO: 3154162 - protein, 22 aa, Giardia lamblia
FEYFQCKLQEIIASNEKNIEAA

SEQ ID NO: 3154163 - protein, 19 aa, Giardia lamblia
FFAPYPLAGYIALKIPGGS

SEQ ID NO: 3154164 - protein, 19 aa, Giardia lamblia
FFARCFKYSPNERITAYEA

SEQ ID NO: 3154165 - protein, 19 aa, Giardia lamblia
FFARQGIPVLSAREVLAFI

SEQ ID NO: 3154166 - protein, 30 aa, Giardia lamblia
FFDDRIFSSEAWSAAASRSITYSRLKGQAA

SEQ ID NO: 3154167 - protein, 18 aa, Giardia lamblia
FFDEVDSILSSRTADGEH

SEQ ID NO: 3154168 - protein, 19 aa, Giardia lamblia
FFDRFCALIMENLTGSSAY

SEQ ID NO: 3154169 - protein, 18 aa, Giardia lamblia
FFESIQLIYSTCEKVCNE

SEQ ID NO: 3154170 - protein, 19 aa, Giardia lamblia
FFFDVGACRTMVISNTLGE

SEQ ID NO: 3154171 - protein, 20 aa, Giardia lamblia
FFGAFRLIDMCVGPDNSVLV

SEQ ID NO: 3154172 - protein, 22 aa, Giardia lamblia
FFGESLSSIPAEFGKDNEWSID

SEQ ID NO: 3154173 - protein, 18 aa, Giardia lamblia
FFGIKDIQRDGAGKIVSC

SEQ ID NO: 3154174 - protein, 17 aa, Giardia lamblia
FFINNCHHFVAAVLKTL

SEQ ID NO: 3154175 - protein, 22 aa, Giardia lamblia
FFKHIINCLGELTSDHLPRGTH

SEQ ID NO: 3154176 - protein, 19 aa, Giardia lamblia
FFKSELDRRVKEKTETDMT

SEQ ID NO: 3154177 - protein, 18 aa, Giardia lamblia
FFMEEHLFSKVNIKPENV

SEQ ID NO: 3154178 - protein, 27 aa, Giardia lamblia
FFMRLQEWYSYHFPELKRIMVDHHEEY

SEQ ID NO: 3154179 - protein, 22 aa, Giardia lamblia
FFNDNLKCFSIIAAYGDDRESC

SEQ ID NO: 3154180 - protein, 24 aa, Giardia lamblia
FFNQKRICRYLGFSDDSFAVAVPI

SEQ ID NO: 3154181 - protein, 21 aa, Giardia lamblia
FFNRERCDYFCFSYANEGPHY

SEQ ID NO: 3154182 - protein, 18 aa, Giardia lamblia
FFNTIIWRCEGFNHETVV

SEQ ID NO: 3154183 - protein, 18 aa, Giardia lamblia
FFQEIIGMGVFPRIEVET

SEQ ID NO: 3154184 - protein, 25 aa, Giardia lamblia
FFRDVLKVRIEHVGLRYLSGKERKF

SEQ ID NO: 3154185 - protein, 25 aa, Giardia lamblia
FFRQVLKRFGVLAGECAVSLSDLRA

SEQ ID NO: 3154186 - protein, 24 aa, Giardia lamblia
FFRSRLGIAVSPLIILQTFKLGGN

SEQ ID NO: 3154187 - protein, 17 aa, Giardia lamblia
FFRTGLPASMKRGTAAI

SEQ ID NO: 3154188 - protein, 18 aa, Giardia lamblia
FFSFETRLGYTVKASLAC

SEQ ID NO: 3154189 - protein, 18 aa, Giardia lamblia
FFSHPKVSIYPGGLKEWI

SEQ ID NO: 3154190 - protein, 23 aa, Giardia lamblia
FFSTCAPLRFIDCQLQIEVLIPY

SEQ ID NO: 3154191 - protein, 26 aa, Giardia lamblia
FGAENFRYRSCFRVIGVELLITVALN

SEQ ID NO: 3154192 - protein, 26 aa, Giardia lamblia
FGAIKLCRCANLVILEPDWKTLDLEQ

SEQ ID NO: 3154193 - protein, 19 aa, Giardia lamblia
FGAIVVKRDTTILAQRLFN

SEQ ID NO: 3154194 - protein, 18 aa, Giardia lamblia
FGALAKRDPARFEEMAAA

SEQ ID NO: 3154195 - protein, 23 aa, Giardia lamblia
FGAQLRFKPDFYLSDSILGSEDL

SEQ ID NO: 3154196 - protein, 17 aa, Giardia lamblia
FGASDLFACYRNFSASG

SEQ ID NO: 3154197 - protein, 28 aa, Giardia lamblia
FGASPSECYRLIRLCKHLGANLVGFSFH

SEQ ID NO: 3154198 - protein, 17 aa, Giardia lamblia
FGCPAMAGLSFANDARS

SEQ ID NO: 3154199 - protein, 25 aa, Giardia lamblia
FGDIQKCFRIMYTIVGGISPQKQER

SEQ ID NO: 3154200 - protein, 17 aa, Giardia lamblia
FGDYCFSDLVPDTRIFD

SEQ ID NO: 3154201 - protein, 19 aa, Giardia lamblia
FGEALKMDPGVEVTYYSVD

SEQ ID NO: 3154202 - protein, 17 aa, Giardia lamblia
FGECISNGFNGKVHKVF

SEQ ID NO: 3154203 - protein, 23 aa, Giardia lamblia
FGEKLNILSSFWSTGPSTAGALA

SEQ ID NO: 3154204 - protein, 17 aa, Giardia lamblia
FGERKFEKALDYYECAG

SEQ ID NO: 3154205 - protein, 18 aa, Giardia lamblia
FGESPSPYLSSRLPGDPF

SEQ ID NO: 3154206 - protein, 24 aa, Giardia lamblia
FGESSCVLSVLKYASTRRRNLSVI

SEQ ID NO: 3154207 - protein, 17 aa, Giardia lamblia
FGEVKCITMSNEDNLAL

SEQ ID NO: 3154208 - protein, 17 aa, Giardia lamblia
FGFARISSVLNVKAPSA

SEQ ID NO: 3154209 - protein, 25 aa, Giardia lamblia
FGFRGEALSSISYVSRMIVVSKTKN

SEQ ID NO: 3154210 - protein, 19 aa, Giardia lamblia
FGFSKSCGLNEVAVTILGS

SEQ ID NO: 3154211 - protein, 25 aa, Giardia lamblia
FGGRPCKYSSSSPCMQHMSTEELCE

SEQ ID NO: 3154212 - protein, 20 aa, Giardia lamblia
FGGTQPVWRACIDLFGHLNY

SEQ ID NO: 3154213 - protein, 21 aa, Giardia lamblia
FGGVHRAQMSPWATIEGGALS

SEQ ID NO: 3154214 - protein, 26 aa, Giardia lamblia
FGGVMLSNLMAIVFPQGTWYTLSPDE

SEQ ID NO: 3154215 - protein, 17 aa, Giardia lamblia
FGHLEMMEILMSAEAGH

SEQ ID NO: 3154216 - protein, 26 aa, Giardia lamblia
FGIRLNKRPPLIKVDRKDRGGITFSI

SEQ ID NO: 3154217 - protein, 18 aa, Giardia lamblia
FGKEVFATAGVTKRHTAS

SEQ ID NO: 3154218 - protein, 17 aa, Giardia lamblia
FGKLGWNVNYDFNASDF

SEQ ID NO: 3154219 - protein, 20 aa, Giardia lamblia
FGLDGHVILSAALDGRVLHY

SEQ ID NO: 3154220 - protein, 31 aa, Giardia lamblia
FGLEIARPLLRPSLWDTFFYNSFLEFFSNPG

SEQ ID NO: 3154221 - protein, 26 aa, Giardia lamblia
FGLKPGSMVMLWSCNSPEWIITEQAC

SEQ ID NO: 3154222 - protein, 28 aa, Giardia lamblia
FGLTKMKADSVIMLASFEKTGEHLFNAA

SEQ ID NO: 3154223 - protein, 25 aa, Giardia lamblia
FGMARCEIPFFGRFGHKGCYNHSTK

SEQ ID NO: 3154224 - protein, 19 aa, Giardia lamblia
FGNDNFWLLVCANHEDATR

SEQ ID NO: 3154225 - protein, 31 aa, Giardia lamblia
FGNEVCQWKADRKCLTHSKGYELAPQYSGIR

SEQ ID NO: 3154226 - protein, 23 aa, Giardia lamblia
FGNRLQDLISRASLFVIGAGALG

SEQ ID NO: 3154227 - protein, 22 aa, Giardia lamblia
FGNRLRLPNNLFTKTHSPSSSI

SEQ ID NO: 3154228 - protein, 17 aa, Giardia lamblia
FGPCQVPTLGLVHSNDL

SEQ ID NO: 3154229 - protein, 25 aa, Giardia lamblia
FGPEQYCSACFITLTSGMYKKKNRR

SEQ ID NO: 3154230 - protein, 19 aa, Giardia lamblia
FGPIKRVPSASFWDRVVSR

SEQ ID NO: 3154231 - protein, 20 aa, Giardia lamblia
FGPRFWRARVSEFNASTDRG

SEQ ID NO: 3154232 - protein, 17 aa, Giardia lamblia
FGPVRFRYTSVTPNNFG

SEQ ID NO: 3154233 - protein, 20 aa, Giardia lamblia
FGQCLGVFPPFAIIRAVAHI

SEQ ID NO: 3154234 - protein, 19 aa, Giardia lamblia
FGQGCTGAAHLATHSSSPK

SEQ ID NO: 3154235 - protein, 26 aa, Giardia lamblia
FGQLDCVKALIPHCLAIKRNDGFTSL

SEQ ID NO: 3154236 - protein, 19 aa, Giardia lamblia
FGSCGYPGCTAPVANMKIL

SEQ ID NO: 3154237 - protein, 24 aa, Giardia lamblia
FGSILAPGALRFGTNVECLLSTSL

SEQ ID NO: 3154238 - protein, 17 aa, Giardia lamblia
FGSLDGLGGSAGNGGDE

SEQ ID NO: 3154239 - protein, 17 aa, Giardia lamblia
FGSNRCRNGYCTHCVVG

SEQ ID NO: 3154240 - protein, 19 aa, Giardia lamblia
FGSPLLVDLFGYRLIMGST

SEQ ID NO: 3154241 - protein, 25 aa, Giardia lamblia
FGTAGLRASYGAGFTKLNELVVTQT

SEQ ID NO: 3154242 - protein, 24 aa, Giardia lamblia
FGTPEFLLGLKIKGLLVDIYQYLN

SEQ ID NO: 3154243 - protein, 18 aa, Giardia lamblia
FGTSGFTFGKPAASAATT

SEQ ID NO: 3154244 - protein, 17 aa, Giardia lamblia
FGTVINGVYDASQPSVI

SEQ ID NO: 3154245 - protein, 19 aa, Giardia lamblia
FGVALYSVLIGKHRELPLQ

SEQ ID NO: 3154246 - protein, 17 aa, Giardia lamblia
FGVKFGASPSECYRLIR

SEQ ID NO: 3154247 - protein, 19 aa, Giardia lamblia
FGVLEAKPFGSIRYYHYRA

SEQ ID NO: 3154248 - protein, 18 aa, Giardia lamblia
FGVNLSIMNKASLLPEDK

SEQ ID NO: 3154249 - protein, 17 aa, Giardia lamblia
FGYFYGRNLINLSRVTY

SEQ ID NO: 3154250 - protein, 19 aa, Giardia lamblia
FGYLRSGLQRPEFFSMSSA

SEQ ID NO: 3154251 - protein, 20 aa, Giardia lamblia
FHCESCTFCRVGKQGEHKHC

SEQ ID NO: 3154252 - protein, 18 aa, Giardia lamblia
FHDCPVRITLNAIGPDIV

SEQ ID NO: 3154253 - protein, 28 aa, Giardia lamblia
FHDELKEICALCPVARQTLLFSATMEKE

SEQ ID NO: 3154254 - protein, 18 aa, Giardia lamblia
FHDTFMKTCCGSPAYAPP

SEQ ID NO: 3154255 - protein, 26 aa, Giardia lamblia
FHEVSLALCAPCFLYDNLHSFYTLES

SEQ ID NO: 3154256 - protein, 24 aa, Giardia lamblia
FHEYKIPISLFCRVLSCVTESLRA

SEQ ID NO: 3154257 - protein, 17 aa, Giardia lamblia
FHGIPLSTNSSMNDETP

SEQ ID NO: 3154258 - protein, 17 aa, Giardia lamblia
FHHCVRLGNFAVDRSIA

SEQ ID NO: 3154259 - protein, 23 aa, Giardia lamblia
FHIEAPSVRSGRNSPYIDPDEDL

SEQ ID NO: 3154260 - protein, 26 aa, Giardia lamblia
FHIYKNRRLGCMEPKTQFIVAVEDLD

SEQ ID NO: 3154261 - protein, 22 aa, Giardia lamblia
FHKAEGMIKIRPLLKTLNLPES

SEQ ID NO: 3154262 - protein, 18 aa, Giardia lamblia
FHKPKFDNSLAIFSVTNG

SEQ ID NO: 3154263 - protein, 26 aa, Giardia lamblia
FHKYLKMDFKFDIKDYSFSYWLDTLE

SEQ ID NO: 3154264 - protein, 17 aa, Giardia lamblia
FHLDKAFFIGYMTNLLL

SEQ ID NO: 3154265 - protein, 23 aa, Giardia lamblia
FHLKGHSALLLAARSNYHEIVKL

SEQ ID NO: 3154266 - protein, 18 aa, Giardia lamblia
FHLRVIYIQNMLRLSSAV

SEQ ID NO: 3154267 - protein, 17 aa, Giardia lamblia
FHMNLRSEFTMDPESTL

SEQ ID NO: 3154268 - protein, 18 aa, Giardia lamblia
FHPDAVFCGNCGSKRQSY

SEQ ID NO: 3154269 - protein, 18 aa, Giardia lamblia
FHPYAHVVASCSKDSTIR

SEQ ID NO: 3154270 - protein, 19 aa, Giardia lamblia
FHRDRELTLLLPVRPKGKR

SEQ ID NO: 3154271 - protein, 19 aa, Giardia lamblia
FHRITGGKARLTLSTHGDE

SEQ ID NO: 3154272 - protein, 24 aa, Giardia lamblia
FHRPICPWDLPLLDNKTNIPLPQL

SEQ ID NO: 3154273 - protein, 19 aa, Giardia lamblia
FHRRCLSLSSIAAELPPSG

SEQ ID NO: 3154274 - protein, 17 aa, Giardia lamblia
FHTLIPLFAENIQLTEA

SEQ ID NO: 3154275 - protein, 20 aa, Giardia lamblia
FHVRADPALEEASLHTSIGI

SEQ ID NO: 3154276 - protein, 18 aa, Giardia lamblia
FHYASALMRSDLVFDKAL

SEQ ID NO: 3154277 - protein, 24 aa, Giardia lamblia
FIALLEYLPRFLLVNDTLEVIQIT

SEQ ID NO: 3154278 - protein, 18 aa, Giardia lamblia
FIARLDAHGEMARIVVGN

SEQ ID NO: 3154279 - protein, 34 aa, Giardia lamblia
FICDEDLKVLAYLVKWLTDKGMVNTLKVLELESG

SEQ ID NO: 3154280 - protein, 19 aa, Giardia lamblia
FICISCVFLKYADKLALLI

SEQ ID NO: 3154281 - protein, 25 aa, Giardia lamblia
FIDRLKDSMNFQRMRQLEKNLLIYY

SEQ ID NO: 3154282 - protein, 26 aa, Giardia lamblia
FIDSALPEHVVWEFMYSMLSAVKEAQ

SEQ ID NO: 3154283 - protein, 17 aa, Giardia lamblia
FIEDKATLFDIYVAIAC

SEQ ID NO: 3154284 - protein, 22 aa, Giardia lamblia
FIEFLQKCVFDMAPFTKDEQAV

SEQ ID NO: 3154285 - protein, 20 aa, Giardia lamblia
FIEQCLNINAPVRISSADAL

SEQ ID NO: 3154286 - protein, 24 aa, Giardia lamblia
FIFGSAYPFPLGVVYYSTESLCLT

SEQ ID NO: 3154287 - protein, 19 aa, Giardia lamblia
FIFSCPELSSADLSNNNIQ

SEQ ID NO: 3154288 - protein, 24 aa, Giardia lamblia
FIGDSADWVFSLRGADALTPSEIL

SEQ ID NO: 3154289 - protein, 23 aa, Giardia lamblia
FIGHSLGGLLCLKVASMLPPDQQ

SEQ ID NO: 3154290 - protein, 24 aa, Giardia lamblia
FIHGHLCPAALFITHEGQVKLGHL

SEQ ID NO: 3154291 - protein, 18 aa, Giardia lamblia
FIIAHALHTEFLKKKFSL

SEQ ID NO: 3154292 - protein, 25 aa, Giardia lamblia
FIIARLLGGVSLHFEFAPVAKSGAV

SEQ ID NO: 3154293 - protein, 19 aa, Giardia lamblia
FIILESLDFSKAQELFQQR

SEQ ID NO: 3154294 - protein, 24 aa, Giardia lamblia
FIKDCKACHYVIGFSSGDLVLLEA

SEQ ID NO: 3154295 - protein, 24 aa, Giardia lamblia
FIKETRFLDILKENFTCHSVLSLA

SEQ ID NO: 3154296 - protein, 24 aa, Giardia lamblia
FIKLNRILADFPYNAALNAKLSPR

SEQ ID NO: 3154297 - protein, 17 aa, Giardia lamblia
FIKMCAVTQSLLRNGNN

SEQ ID NO: 3154298 - protein, 27 aa, Giardia lamblia
FILAWGNAICCYNFSGEEVWSVSPLLA

SEQ ID NO: 3154299 - protein, 26 aa, Giardia lamblia
FILERNGCIPIRLFVFQSELEYSKSS

SEQ ID NO: 3154300 - protein, 21 aa, Giardia lamblia
FILHPRIVFYAPVLGLSEDFL

SEQ ID NO: 3154301 - protein, 17 aa, Giardia lamblia
FILHQPLPHQNNNYNQV

SEQ ID NO: 3154302 - protein, 20 aa, Giardia lamblia
FILKAISLDLQNVWIGAVNI

SEQ ID NO: 3154303 - protein, 30 aa, Giardia lamblia
FILKEALYVPGRFNAVFSECMKILHKGLEK

SEQ ID NO: 3154304 - protein, 18 aa, Giardia lamblia
FILRSCADKDPVMVESVI

SEQ ID NO: 3154305 - protein, 19 aa, Giardia lamblia
FILSHRPLIRVAFMTLQNS

SEQ ID NO: 3154306 - protein, 17 aa, Giardia lamblia
FILTQAITAENHFINLN

SEQ ID NO: 3154307 - protein, 19 aa, Giardia lamblia
FINAASNICHFFFLCEESS

SEQ ID NO: 3154308 - protein, 19 aa, Giardia lamblia
FINICMQSDFGPRISTKGF

SEQ ID NO: 3154309 - protein, 20 aa, Giardia lamblia
FINSDWRYRCDVVETLVKIV

SEQ ID NO: 3154310 - protein, 23 aa, Giardia lamblia
FIPLCQICSHSILKNQLSKQAKE

SEQ ID NO: 3154311 - protein, 23 aa, Giardia lamblia
FIPQPNRLAMFNILAISGGLFMS

SEQ ID NO: 3154312 - protein, 20 aa, Giardia lamblia
FIPTGLWYDKTHIVAYNDTN

SEQ ID NO: 3154313 - protein, 19 aa, Giardia lamblia
FIQRVRIVIRHDRTPVVGD

SEQ ID NO: 3154314 - protein, 18 aa, Giardia lamblia
FIRAINWLSFHAHRKNLS

SEQ ID NO: 3154315 - protein, 28 aa, Giardia lamblia
FIRDRTWRQFLCAIDRLLPKEAGLQNNE

SEQ ID NO: 3154316 - protein, 25 aa, Giardia lamblia
FIRDTRLGLAASRDGRLSYWDLDSF

SEQ ID NO: 3154317 - protein, 17 aa, Giardia lamblia
FIRKLYALLYISTALHI

SEQ ID NO: 3154318 - protein, 17 aa, Giardia lamblia
FIRMKYVEKRFCHEQPQ

SEQ ID NO: 3154319 - protein, 23 aa, Giardia lamblia
FIRPEVISPAAHRGPLMDAPALK

SEQ ID NO: 3154320 - protein, 17 aa, Giardia lamblia
FIRSTQIQLVFLLEYIK

SEQ ID NO: 3154321 - protein, 18 aa, Giardia lamblia
FISCMKPSAFVTLISEQL

SEQ ID NO: 3154322 - protein, 17 aa, Giardia lamblia
FISDDELLFLLGNSSDP

SEQ ID NO: 3154323 - protein, 21 aa, Giardia lamblia
FISEPFRQYFVLKDNPQSSGS

SEQ ID NO: 3154324 - protein, 19 aa, Giardia lamblia
FISGKLFAGTLSFVAHETN

SEQ ID NO: 3154325 - protein, 19 aa, Giardia lamblia
FISPLIFNVPEDFVGLVRG

SEQ ID NO: 3154326 - protein, 23 aa, Giardia lamblia
FISRLKIQKMESIYNLANTDQRL

SEQ ID NO: 3154327 - protein, 17 aa, Giardia lamblia
FISSQLMTKGYRVYNYT

SEQ ID NO: 3154328 - protein, 24 aa, Giardia lamblia
FISSSFCDDGPFLAEELADQMESI

SEQ ID NO: 3154329 - protein, 22 aa, Giardia lamblia
FISVKGPELLNMYYGESERAIR

SEQ ID NO: 3154330 - protein, 28 aa, Giardia lamblia
FITDLQKLCILRCLRPDRVYIAVQLFVA

SEQ ID NO: 3154331 - protein, 18 aa, Giardia lamblia
FITGLKPLRVSPVMEAYN

SEQ ID NO: 3154332 - protein, 18 aa, Giardia lamblia
FITKKICDLISRLDVTNY

SEQ ID NO: 3154333 - protein, 18 aa, Giardia lamblia
FITSEKYTALALAMQEGH

SEQ ID NO: 3154334 - protein, 18 aa, Giardia lamblia
FITVCINPKVSGVADRPE

SEQ ID NO: 3154335 - protein, 29 aa, Giardia lamblia
FITYCKFSREHSRYLPAVREIVSSYMHTI

SEQ ID NO: 3154336 - protein, 18 aa, Giardia lamblia
FIVGAKWGVSKQSQHFLA

SEQ ID NO: 3154337 - protein, 28 aa, Giardia lamblia
FIVGDAFGNLACTTWPVAVAATQAMDDD

SEQ ID NO: 3154338 - protein, 18 aa, Giardia lamblia
FIVPHADGDRTLSLVAKE

SEQ ID NO: 3154339 - protein, 22 aa, Giardia lamblia
FIVRLVKTCGPLSRREIIDRCV

SEQ ID NO: 3154340 - protein, 18 aa, Giardia lamblia
FKAAKANQPTIIFIDEVD

SEQ ID NO: 3154341 - protein, 17 aa, Giardia lamblia
FKACYYCNKLMHMLQPS

SEQ ID NO: 3154342 - protein, 22 aa, Giardia lamblia
FKAKNWRKIADFIYINGHNLPR

SEQ ID NO: 3154343 - protein, 21 aa, Giardia lamblia
FKAPEYSFAYKQRVEAAEVYG

SEQ ID NO: 3154344 - protein, 21 aa, Giardia lamblia
FKAVSKRLVRNVGRAISTYKL

SEQ ID NO: 3154345 - protein, 18 aa, Giardia lamblia
FKERMAAEARSKSTGKPQ

SEQ ID NO: 3154346 - protein, 26 aa, Giardia lamblia
FKEYAKSSIIEGWRCGKENHQNPSGK

SEQ ID NO: 3154347 - protein, 17 aa, Giardia lamblia
FKFAIVHADGNISFESG

SEQ ID NO: 3154348 - protein, 23 aa, Giardia lamblia
FKFCKCDPLPPFIVFADTDKDTL

SEQ ID NO: 3154349 - protein, 26 aa, Giardia lamblia
FKGQKLRRVCWDRFPGADYSEVSDVV

SEQ ID NO: 3154350 - protein, 19 aa, Giardia lamblia
FKHARLQILEGEMAKTAMT

SEQ ID NO: 3154351 - protein, 19 aa, Giardia lamblia
FKHGLIFPEAEIWNVVAHI

SEQ ID NO: 3154352 - protein, 21 aa, Giardia lamblia
FKHNGLRLSERQQPRLLRLTQ

SEQ ID NO: 3154353 - protein, 26 aa, Giardia lamblia
FKHVDYLVSIMARFYRAASMKLAITA

SEQ ID NO: 3154354 - protein, 26 aa, Giardia lamblia
FKIILLKYWLGNAVKSLYNPSVSFHK

SEQ ID NO: 3154355 - protein, 18 aa, Giardia lamblia
FKKGVPFNPVRRKIIALC

SEQ ID NO: 3154356 - protein, 24 aa, Giardia lamblia
FKKHPFRLSFDINHHQPEKLEALN

SEQ ID NO: 3154357 - protein, 27 aa, Giardia lamblia
FKKLARLIPFKGFAGPNGLLWVTGSTL

SEQ ID NO: 3154358 - protein, 17 aa, Giardia lamblia
FKKLHQYLVEFLTKVSA

SEQ ID NO: 3154359 - protein, 17 aa, Giardia lamblia
FKKLVCAQDELRVELDH

SEQ ID NO: 3154360 - protein, 17 aa, Giardia lamblia
FKLACQQIEEQKQKIKQ

SEQ ID NO: 3154361 - protein, 23 aa, Giardia lamblia
FKLASTRVGHHLSIDCLDLSYNN

SEQ ID NO: 3154362 - protein, 17 aa, Giardia lamblia
FKLDEIQALGGNDLDKR

SEQ ID NO: 3154363 - protein, 29 aa, Giardia lamblia
FKLDGSIRPSNMWLYNERNMLCLYHTPFK

SEQ ID NO: 3154364 - protein, 20 aa, Giardia lamblia
FKLFLVPSAGYLVLGDDVDA

SEQ ID NO: 3154365 - protein, 21 aa, Giardia lamblia
FKLSIVCRHESPLIGKIFGSG

SEQ ID NO: 3154366 - protein, 19 aa, Giardia lamblia
FKNIEACMQLVRITRTSMG

SEQ ID NO: 3154367 - protein, 21 aa, Giardia lamblia
FKNNGLRSLVCACDSFRSGAV

SEQ ID NO: 3154368 - protein, 27 aa, Giardia lamblia
FKNPFLTSSLLRFEYENSPDLQFNIRP

SEQ ID NO: 3154369 - protein, 24 aa, Giardia lamblia
FKNTLKCVDLIFNRLFDDRNGALT

SEQ ID NO: 3154370 - protein, 21 aa, Giardia lamblia
FKPDRKGNIPFFITADYDSTH

SEQ ID NO: 3154371 - protein, 20 aa, Giardia lamblia
FKPEHAVLDRVVMRFFAWFM

SEQ ID NO: 3154372 - protein, 22 aa, Giardia lamblia
FKPGARGGAYTNPNMEGVFTRI

SEQ ID NO: 3154373 - protein, 19 aa, Giardia lamblia
FKPGEIVIHRDIKPANVLI

SEQ ID NO: 3154374 - protein, 19 aa, Giardia lamblia
FKPSTAAEYVLFSTPCASV

SEQ ID NO: 3154375 - protein, 20 aa, Giardia lamblia
FKQAYGAPTDVLPPWRNDSS

SEQ ID NO: 3154376 - protein, 17 aa, Giardia lamblia
FKQDRFDALVKASIDTQ

SEQ ID NO: 3154377 - protein, 21 aa, Giardia lamblia
FKQPESVVAYGSNYGKIRDIY

SEQ ID NO: 3154378 - protein, 24 aa, Giardia lamblia
FKQPNWKPSLLKVAPQYELWEEYS

SEQ ID NO: 3154379 - protein, 17 aa, Giardia lamblia
FKQREWRQDREAEARQK

SEQ ID NO: 3154380 - protein, 20 aa, Giardia lamblia
FKSDSSLVLKEILNDHVSTA

SEQ ID NO: 3154381 - protein, 18 aa, Giardia lamblia
FKSEALKDLVIDMFNYSV

SEQ ID NO: 3154382 - protein, 22 aa, Giardia lamblia
FKSESDIRLAIDRVKTISDLTG

SEQ ID NO: 3154383 - protein, 19 aa, Giardia lamblia
FKSKGGIDVKAYVVSSQLN

SEQ ID NO: 3154384 - protein, 17 aa, Giardia lamblia
FKSKYSHMTIRGKEKPT

SEQ ID NO: 3154385 - protein, 26 aa, Giardia lamblia
FKSLYPHNLSILFVRLTTLRKRIPAE

SEQ ID NO: 3154386 - protein, 25 aa, Giardia lamblia
FKSPPELVRYVMEAVCILMETPKQD

SEQ ID NO: 3154387 - protein, 17 aa, Giardia lamblia
FKTDESFVVTLDLEDGD

SEQ ID NO: 3154388 - protein, 23 aa, Giardia lamblia
FKTEPLPQFAMNYPALCITAGFK

SEQ ID NO: 3154389 - protein, 23 aa, Giardia lamblia
FKTGQAVLRASCQAGTYMRTLCV

SEQ ID NO: 3154390 - protein, 20 aa, Giardia lamblia
FKTSMSIYLAQNFNSEVVFL

SEQ ID NO: 3154391 - protein, 17 aa, Giardia lamblia
FKVATLHINKHNFSQLH

SEQ ID NO: 3154392 - protein, 23 aa, Giardia lamblia
FKVRRTVIEMLIDRGYMVQSDDM

SEQ ID NO: 3154393 - protein, 22 aa, Giardia lamblia
FKVSPCERFLLTFSYTANVDEL

SEQ ID NO: 3154394 - protein, 23 aa, Giardia lamblia
FKYAHYYCARDCHVLKDGVMGFR

SEQ ID NO: 3154395 - protein, 21 aa, Giardia lamblia
FKYDDSIFVCRSIKLSSFNDR

SEQ ID NO: 3154396 - protein, 20 aa, Giardia lamblia
FKYGCGEAELGHKYNDTYDR

SEQ ID NO: 3154397 - protein, 17 aa, Giardia lamblia
FKYLPVIVRGSYPHAEP

SEQ ID NO: 3154398 - protein, 17 aa, Giardia lamblia
FLAAPGFTPELASSLFD

SEQ ID NO: 3154399 - protein, 22 aa, Giardia lamblia
FLADLFIKREEEIYAATEGCKG

SEQ ID NO: 3154400 - protein, 17 aa, Giardia lamblia
FLADMLVAACIEDKGAC

SEQ ID NO: 3154401 - protein, 22 aa, Giardia lamblia
FLADTRFAVLFTTDISARGLDI

SEQ ID NO: 3154402 - protein, 17 aa, Giardia lamblia
FLAHARAGRDGVIDSAC

SEQ ID NO: 3154403 - protein, 27 aa, Giardia lamblia
FLAKAASMCKIFYGEGSADYCRELLSL

SEQ ID NO: 3154404 - protein, 24 aa, Giardia lamblia
FLAKEKRMAHDFLEPDSTVDALGC

SEQ ID NO: 3154405 - protein, 22 aa, Giardia lamblia
FLAKERCITRNISYLANVHFVL

SEQ ID NO: 3154406 - protein, 19 aa, Giardia lamblia
FLALSAIKYCFLKKSANYA

SEQ ID NO: 3154407 - protein, 26 aa, Giardia lamblia
FLASLKLLDLLAWNKYCVLSRSKGPI

SEQ ID NO: 3154408 - protein, 24 aa, Giardia lamblia
FLAYVCETCGLFSYEKNGVLWCPT

SEQ ID NO: 3154409 - protein, 25 aa, Giardia lamblia
FLCCDKRTGLHVVIKEISMEDMQDT

SEQ ID NO: 3154410 - protein, 17 aa, Giardia lamblia
FLCHPSAVIFFDYAPGQ

SEQ ID NO: 3154411 - protein, 17 aa, Giardia lamblia
FLCKAETAPLQTAASHG

SEQ ID NO: 3154412 - protein, 19 aa, Giardia lamblia
FLDELTEALYISDSRDYVR

SEQ ID NO: 3154413 - protein, 19 aa, Giardia lamblia
FLDHLMRKLAKSFKLIGED

SEQ ID NO: 3154414 - protein, 19 aa, Giardia lamblia
FLDKFHIRSSLSYVAVIPS

SEQ ID NO: 3154415 - protein, 23 aa, Giardia lamblia
FLDPNLLLHLGRLIMESSCPALP

SEQ ID NO: 3154416 - protein, 23 aa, Giardia lamblia
FLEAVKILYDREGKLVDKNGRDA

SEQ ID NO: 3154417 - protein, 17 aa, Giardia lamblia
FLECKKYTRLILESSEA

SEQ ID NO: 3154418 - protein, 17 aa, Giardia lamblia
FLEEAIEVLHSHIVDDN

SEQ ID NO: 3154419 - protein, 19 aa, Giardia lamblia
FLEKECDRLKNSNQEVVNL

SEQ ID NO: 3154420 - protein, 22 aa, Giardia lamblia
FLEKYMSSLALLFRKIPVQILY

SEQ ID NO: 3154421 - protein, 17 aa, Giardia lamblia
FLENPRAAYPCEYIDTV

SEQ ID NO: 3154422 - protein, 22 aa, Giardia lamblia
FLEQVSDLWKGSADAFLGSCAS

SEQ ID NO: 3154423 - protein, 21 aa, Giardia lamblia
FLERRSYRILAHAYFHHKDIF

SEQ ID NO: 3154424 - protein, 26 aa, Giardia lamblia
FLETFIPVYLPNLFSTGLLRDHIVEV

SEQ ID NO: 3154425 - protein, 24 aa, Giardia lamblia
FLFTKASAIAMFSFVAGIQRGYCV

SEQ ID NO: 3154426 - protein, 18 aa, Giardia lamblia
FLGRAIRAAFSYNCTIFL

SEQ ID NO: 3154427 - protein, 24 aa, Giardia lamblia
FLGSYVRPYMCYRPDGYYRTIDDL

SEQ ID NO: 3154428 - protein, 34 aa, Giardia lamblia
FLGWSQMALCLLTNFRVSYMHKIRENNEFQTYSY

SEQ ID NO: 3154429 - protein, 24 aa, Giardia lamblia
FLHLKNFLHRDIKPDNFLIGLGRR

SEQ ID NO: 3154430 - protein, 27 aa, Giardia lamblia
FLHNILSIYWLPSFLQAGTMNEISNHL

SEQ ID NO: 3154431 - protein, 18 aa, Giardia lamblia
FLHRVDPESLKIPEEDAF

SEQ ID NO: 3154432 - protein, 18 aa, Giardia lamblia
FLHTLLVIIPEQFTNTPF

SEQ ID NO: 3154433 - protein, 18 aa, Giardia lamblia
FLHYDLRVSPHLMPVLYC

SEQ ID NO: 3154434 - protein, 23 aa, Giardia lamblia
FLIDLLGAVKFVFDRHMHKEAIK

SEQ ID NO: 3154435 - protein, 18 aa, Giardia lamblia
FLIDTWPTSIVWSPDGTS

SEQ ID NO: 3154436 - protein, 17 aa, Giardia lamblia
FLIKSDLSLSVLSKTFL

SEQ ID NO: 3154437 - protein, 20 aa, Giardia lamblia
FLISCPYFQPHFSEQLCVRL

SEQ ID NO: 3154438 - protein, 25 aa, Giardia lamblia
FLIVACGLIECSVQPRGVRLDSGDL

SEQ ID NO: 3154439 - protein, 24 aa, Giardia lamblia
FLIVPRPVRYAPLIREHSFGSGGK

SEQ ID NO: 3154440 - protein, 20 aa, Giardia lamblia
FLKEHLPSMIDSAQYLTAVV

SEQ ID NO: 3154441 - protein, 29 aa, Giardia lamblia
FLKGSPREKACVMHFLLMIADRHEAQQQF

SEQ ID NO: 3154442 - protein, 17 aa, Giardia lamblia
FLKIFRVLVRDAANAAV

SEQ ID NO: 3154443 - protein, 27 aa, Giardia lamblia
FLKIRCPTCQAVEFCSGFCSLEQNTHP

SEQ ID NO: 3154444 - protein, 18 aa, Giardia lamblia
FLKLLSCQEYLVPLQLPN

SEQ ID NO: 3154445 - protein, 19 aa, Giardia lamblia
FLKPLRHIDNPEILVTYSD

SEQ ID NO: 3154446 - protein, 21 aa, Giardia lamblia
FLKQMFGGFAGFGEEPATSGV

SEQ ID NO: 3154447 - protein, 20 aa, Giardia lamblia
FLKQRLRPHNQRLVSEALVH

SEQ ID NO: 3154448 - protein, 25 aa, Giardia lamblia
FLKRCNLEDNCVFPFISRADSNEPR

SEQ ID NO: 3154449 - protein, 29 aa, Giardia lamblia
FLKTQNFYLYFRYLEKRSNDKICVAMFRK

SEQ ID NO: 3154450 - protein, 17 aa, Giardia lamblia
FLLDEKTQCTKIIKNLN

SEQ ID NO: 3154451 - protein, 26 aa, Giardia lamblia
FLLDKRIGLSCPKEISNARVLVANTP

SEQ ID NO: 3154452 - protein, 17 aa, Giardia lamblia
FLLELLNTYFTSSIFED

SEQ ID NO: 3154453 - protein, 26 aa, Giardia lamblia
FLLETLPSLFVFLLFVTSTLESITLY

SEQ ID NO: 3154454 - protein, 21 aa, Giardia lamblia
FLLGYKSFFQITGIDYSEELI

SEQ ID NO: 3154455 - protein, 20 aa, Giardia lamblia
FLLNISRGCVTVETLANRSA

SEQ ID NO: 3154456 - protein, 19 aa, Giardia lamblia
FLLRVAKLLIKIYYDILQL

SEQ ID NO: 3154457 - protein, 19 aa, Giardia lamblia
FLNFDRFYVLHPDVLNMIS

SEQ ID NO: 3154458 - protein, 27 aa, Giardia lamblia
FLNHPSVPYQWLMYWLPAAGSGQPVMG

SEQ ID NO: 3154459 - protein, 26 aa, Giardia lamblia
FLNSLKHILAIYAYRVLDNKEFSVQN

SEQ ID NO: 3154460 - protein, 18 aa, Giardia lamblia
FLNVTLLWQHTKGHVYPH

SEQ ID NO: 3154461 - protein, 20 aa, Giardia lamblia
FLPHHWLLTSVCQGGQLHYL

SEQ ID NO: 3154462 - protein, 18 aa, Giardia lamblia
FLPICERLKDPLMAGKVY

SEQ ID NO: 3154463 - protein, 28 aa, Giardia lamblia
FLPLMCIRPDKIIAYSRIYIEQELGPRF

SEQ ID NO: 3154464 - protein, 22 aa, Giardia lamblia
FLPNGRTALSLAAEAGHDECVM

SEQ ID NO: 3154465 - protein, 19 aa, Giardia lamblia
FLPRGRRSSLRDIYTALRT

SEQ ID NO: 3154466 - protein, 20 aa, Giardia lamblia
FLPSVHAFEAESIVSWLDSD

SEQ ID NO: 3154467 - protein, 19 aa, Giardia lamblia
FLPVPIICAVSISIPLPEQ

SEQ ID NO: 3154468 - protein, 23 aa, Giardia lamblia
FLQECDCALLLMSEKDASEEGAG

SEQ ID NO: 3154469 - protein, 22 aa, Giardia lamblia
FLQECDCALLLMSEKNTSEESA

SEQ ID NO: 3154470 - protein, 21 aa, Giardia lamblia
FLQHVKRWVDFEERYPKPQVP

SEQ ID NO: 3154471 - protein, 24 aa, Giardia lamblia
FLQPYLSALYIHFKREVKHEPIWF

SEQ ID NO: 3154472 - protein, 18 aa, Giardia lamblia
FLQQYTRRRSSRPAIPVP

SEQ ID NO: 3154473 - protein, 27 aa, Giardia lamblia
FLQTREIMKIVKLLRRFGTTTNAHIQQ

SEQ ID NO: 3154474 - protein, 17 aa, Giardia lamblia
FLRAEGYVTALANLEGE

SEQ ID NO: 3154475 - protein, 18 aa, Giardia lamblia
FLRDKMCGVTIIRDGEEA

SEQ ID NO: 3154476 - protein, 27 aa, Giardia lamblia
FLRHDREVLRFYAIWDNRHLVYGELRQ

SEQ ID NO: 3154477 - protein, 19 aa, Giardia lamblia
FLRKECRRPEEKRQIEEFL

SEQ ID NO: 3154478 - protein, 26 aa, Giardia lamblia
FLRMSTSIIVKMGLNMMSLIKPFPVD

SEQ ID NO: 3154479 - protein, 17 aa, Giardia lamblia
FLRPEMFIYSAEGELIL

SEQ ID NO: 3154480 - protein, 20 aa, Giardia lamblia
FLRQECKRLSTVLDAKEDIL

SEQ ID NO: 3154481 - protein, 19 aa, Giardia lamblia
FLSAIKSLIFCSGKVTFTP

SEQ ID NO: 3154482 - protein, 27 aa, Giardia lamblia
FLSATVPNASEFAGWVASLHSIPVHVV

SEQ ID NO: 3154483 - protein, 17 aa, Giardia lamblia
FLSGEKVVIDWSAQGSK

SEQ ID NO: 3154484 - protein, 21 aa, Giardia lamblia
FLSHPMILSALIKFDNINLQL

SEQ ID NO: 3154485 - protein, 19 aa, Giardia lamblia
FLSIISWNLLIERATFAFA

SEQ ID NO: 3154486 - protein, 17 aa, Giardia lamblia
FLSKFSFVDLAGSERAK

SEQ ID NO: 3154487 - protein, 18 aa, Giardia lamblia
FLSLVAMYTQAYVRDTCM

SEQ ID NO: 3154488 - protein, 19 aa, Giardia lamblia
FLSNDVILFGNIVKDMFPG

SEQ ID NO: 3154489 - protein, 18 aa, Giardia lamblia
FLSSGPVCAMVWEGANVV

SEQ ID NO: 3154490 - protein, 20 aa, Giardia lamblia
FLSVLKFAAWTLKLDGHLVF

SEQ ID NO: 3154491 - protein, 20 aa, Giardia lamblia
FLTALNRPLDPCVLKELRLI

SEQ ID NO: 3154492 - protein, 18 aa, Giardia lamblia
FLTCCGFRTKILAYNVLD

SEQ ID NO: 3154493 - protein, 18 aa, Giardia lamblia
FLTDMLVGSGLRVRAITS

SEQ ID NO: 3154494 - protein, 19 aa, Giardia lamblia
FLTDRGYQAMQTPFFMEQE

SEQ ID NO: 3154495 - protein, 23 aa, Giardia lamblia
FLTERLRNLSKLTGYKVTGKDEF

SEQ ID NO: 3154496 - protein, 17 aa, Giardia lamblia
FLTHITIYCPLTDTRPF

SEQ ID NO: 3154497 - protein, 20 aa, Giardia lamblia
FLTLLNCLTMLFHAKLIMTQ

SEQ ID NO: 3154498 - protein, 21 aa, Giardia lamblia
FLVGKFRLPSKILQTPVLSLI

SEQ ID NO: 3154499 - protein, 18 aa, Giardia lamblia
FLVIPVICEHAMTKRKRI

SEQ ID NO: 3154500 - protein, 18 aa, Giardia lamblia
FLVLLGRHHGHLALTIHY

SEQ ID NO: 3154501 - protein, 26 aa, Giardia lamblia
FLVLQGRITTILSMKPMELLGLIEEC

SEQ ID NO: 3154502 - protein, 17 aa, Giardia lamblia
FLYDNLHSFYTLESPPS

SEQ ID NO: 3154503 - protein, 24 aa, Giardia lamblia
FLYFLRGFLPWQGLKANTKRQKYE

SEQ ID NO: 3154504 - protein, 23 aa, Giardia lamblia
FLYGHGYTALMFAASNGNLDSVK

SEQ ID NO: 3154505 - protein, 18 aa, Giardia lamblia
FLYKHRFGPYFISPIIAG

SEQ ID NO: 3154506 - protein, 18 aa, Giardia lamblia
FMAAETLGKCAPYVPAQC

SEQ ID NO: 3154507 - protein, 19 aa, Giardia lamblia
FMDLKLGFITFPLGAQQSK

SEQ ID NO: 3154508 - protein, 17 aa, Giardia lamblia
FMDSVLTYGWAFGSKAV

SEQ ID NO: 3154509 - protein, 18 aa, Giardia lamblia
FMEDLCGADVSSLASFSS

SEQ ID NO: 3154510 - protein, 17 aa, Giardia lamblia
FMEREANTLLSITHENI

SEQ ID NO: 3154511 - protein, 17 aa, Giardia lamblia
FMFHQALQHPNLVRCLC

SEQ ID NO: 3154512 - protein, 17 aa, Giardia lamblia
FMKAVCSPLPPELEERV

SEQ ID NO: 3154513 - protein, 23 aa, Giardia lamblia
FMLATPHGISFCDINGEVAQYIY

SEQ ID NO: 3154514 - protein, 26 aa, Giardia lamblia
FMLGCGHTFCDRCIVVLVEGNKSLPP

SEQ ID NO: 3154515 - protein, 17 aa, Giardia lamblia
FMLPAGVSVEPEKVSRL

SEQ ID NO: 3154516 - protein, 22 aa, Giardia lamblia
FMLSLRPKKGRHLRAMRMGKEY

SEQ ID NO: 3154517 - protein, 18 aa, Giardia lamblia
FMNPDGFINISLTQQKQQ

SEQ ID NO: 3154518 - protein, 23 aa, Giardia lamblia
FMNRSLMVSIQWHAMTGAAGAFV

SEQ ID NO: 3154519 - protein, 17 aa, Giardia lamblia
FMPGTAFPDPHRTNFPV

SEQ ID NO: 3154520 - protein, 24 aa, Giardia lamblia
FMQIEGFASYAIDVFHGEKGDRKA

SEQ ID NO: 3154521 - protein, 20 aa, Giardia lamblia
FMQRIAVKALQKFTQQGTIA

SEQ ID NO: 3154522 - protein, 25 aa, Giardia lamblia
FMRAARTLYPLSIAMEAIPDRPMNW

SEQ ID NO: 3154523 - protein, 18 aa, Giardia lamblia
FMRFCRVIFQVPVSEDSE

SEQ ID NO: 3154524 - protein, 20 aa, Giardia lamblia
FMSDFARYFFLISDLSAGNT

SEQ ID NO: 3154525 - protein, 18 aa, Giardia lamblia
FMSPEGIQDFPLDEKTDI

SEQ ID NO: 3154526 - protein, 25 aa, Giardia lamblia
FMTCSMSQYMSFAFTHIFELLPDQQ

SEQ ID NO: 3154527 - protein, 18 aa, Giardia lamblia
FMTKLSGLFDCYDTFASQ

SEQ ID NO: 3154528 - protein, 24 aa, Giardia lamblia
FMTMYRRECAFARIHLPELDILLT

SEQ ID NO: 3154529 - protein, 25 aa, Giardia lamblia
FMTYRGCPFLSKKVLKDAGEDRVEK

SEQ ID NO: 3154530 - protein, 18 aa, Giardia lamblia
FMVDLWRLVHLQDNHLTN

SEQ ID NO: 3154531 - protein, 18 aa, Giardia lamblia
FMVEFELSYNDQKHTLES

SEQ ID NO: 3154532 - protein, 24 aa, Giardia lamblia
FMVGVAGCMRAKWIRIISSGKKDP

SEQ ID NO: 3154533 - protein, 17 aa, Giardia lamblia
FMVGVGFLHDLGYIHTD

SEQ ID NO: 3154534 - protein, 19 aa, Giardia lamblia
FMVKLSFLEVYCERLYDLQ

SEQ ID NO: 3154535 - protein, 21 aa, Giardia lamblia
FMVRQRLLVVDVHTSKRYYLN

SEQ ID NO: 3154536 - protein, 17 aa, Giardia lamblia
FMYQLLQGLSLVHKNEI

SEQ ID NO: 3154537 - protein, 25 aa, Giardia lamblia
FNAKGSRAYPFCIIMSPTRELVQQT

SEQ ID NO: 3154538 - protein, 23 aa, Giardia lamblia
FNDGPAPTGLRFCINSASILLRP

SEQ ID NO: 3154539 - protein, 18 aa, Giardia lamblia
FNDVLKWKPLSAAQTRAD

SEQ ID NO: 3154540 - protein, 22 aa, Giardia lamblia
FNEDFTGLGIAKLNQSKLRALA

SEQ ID NO: 3154541 - protein, 19 aa, Giardia lamblia
FNELCDWTAYGRFVNPFKR

SEQ ID NO: 3154542 - protein, 17 aa, Giardia lamblia
FNELLLDAIELMRPSSL

SEQ ID NO: 3154543 - protein, 23 aa, Giardia lamblia
FNERIDRAIKLCEPELARMLSPP

SEQ ID NO: 3154544 - protein, 20 aa, Giardia lamblia
FNEVLGVCAIHPSGNYVAIA

SEQ ID NO: 3154545 - protein, 24 aa, Giardia lamblia
FNEYRLCQWVETLIGLDVAGIAKF

SEQ ID NO: 3154546 - protein, 22 aa, Giardia lamblia
FNFGGALPSAFSKPSDNAAQAG

SEQ ID NO: 3154547 - protein, 17 aa, Giardia lamblia
FNFPFSLLSEESIEKLR

SEQ ID NO: 3154548 - protein, 22 aa, Giardia lamblia
FNGSFIKLYIFGGRGADSSLND

SEQ ID NO: 3154549 - protein, 18 aa, Giardia lamblia
FNGTHCRGIEAIQQQLER

SEQ ID NO: 3154550 - protein, 20 aa, Giardia lamblia
FNIIRLPPRPVKKATKETPT

SEQ ID NO: 3154551 - protein, 19 aa, Giardia lamblia
FNINLSYQQVTVWSCQMHI

SEQ ID NO: 3154552 - protein, 19 aa, Giardia lamblia
FNIRAELLNLMSATETQVH

SEQ ID NO: 3154553 - protein, 27 aa, Giardia lamblia
FNITNACKSCWSLDSGKIAMGDVDGHV

SEQ ID NO: 3154554 - protein, 20 aa, Giardia lamblia
FNIVRQCLRINPVGPCLYCG

SEQ ID NO: 3154555 - protein, 24 aa, Giardia lamblia
FNKAMRDAQQWYKDEGNIDRFCEC

SEQ ID NO: 3154556 - protein, 24 aa, Giardia lamblia
FNLGIKGSPYWIAPECVRSTLYDI

SEQ ID NO: 3154557 - protein, 21 aa, Giardia lamblia
FNLKVTPSRGVAVAKTDVGRH

SEQ ID NO: 3154558 - protein, 25 aa, Giardia lamblia
FNLLNPRSLLSAGLSIAAQQVSLGI

SEQ ID NO: 3154559 - protein, 26 aa, Giardia lamblia
FNLQPIKARLWSAITNDHYIYTSEGF

SEQ ID NO: 3154560 - protein, 24 aa, Giardia lamblia
FNLRGETALIIAMQAHKLKIVQLL

SEQ ID NO: 3154561 - protein, 22 aa, Giardia lamblia
FNLSPLMFHKSIGPGLLGLSFR

SEQ ID NO: 3154562 - protein, 28 aa, Giardia lamblia
FNLVRLCSTLSCKIYGPEFNRFFDESAP

SEQ ID NO: 3154563 - protein, 19 aa, Giardia lamblia
FNMFSRMGGMGGRSGNVQF

SEQ ID NO: 3154564 - protein, 27 aa, Giardia lamblia
FNMKNRFSCLNAFYGDMAIRLVRLKIS

SEQ ID NO: 3154565 - protein, 18 aa, Giardia lamblia
FNNLDPCYSSLSGYTAYQ

SEQ ID NO: 3154566 - protein, 24 aa, Giardia lamblia
FNNSCNVLLCAPTGAGKTVCALLC

SEQ ID NO: 3154567 - protein, 20 aa, Giardia lamblia
FNNSGCLVHPMTSRQEQDEL

SEQ ID NO: 3154568 - protein, 24 aa, Giardia lamblia
FNPDLLVSCSEDFTCKIWKRDRAT

SEQ ID NO: 3154569 - protein, 19 aa, Giardia lamblia
FNPGDPMAIVVAMQHLITG

SEQ ID NO: 3154570 - protein, 18 aa, Giardia lamblia
FNPSILFNIESGGAAQQT

SEQ ID NO: 3154571 - protein, 17 aa, Giardia lamblia
FNPTALMLAAAYNNVDG

SEQ ID NO: 3154572 - protein, 18 aa, Giardia lamblia
FNPTPNVLCFITGAVSAS

SEQ ID NO: 3154573 - protein, 19 aa, Giardia lamblia
FNREKKPGASEPLATNKAG

SEQ ID NO: 3154574 - protein, 20 aa, Giardia lamblia
FNRHGENAITIAIKKRALDS

SEQ ID NO: 3154575 - protein, 21 aa, Giardia lamblia
FNRLMRPCVQFIRDHELFEEE

SEQ ID NO: 3154576 - protein, 17 aa, Giardia lamblia
FNRTVDGFREWAASRSF

SEQ ID NO: 3154577 - protein, 30 aa, Giardia lamblia
FNSFTAMHYACYFNHLQVVQKLFDFEYMIK

SEQ ID NO: 3154578 - protein, 19 aa, Giardia lamblia
FNSKLAGAIRHEHQKSLRE

SEQ ID NO: 3154579 - protein, 17 aa, Giardia lamblia
FNVPLDIWKDSQISDKA

SEQ ID NO: 3154580 - protein, 26 aa, Giardia lamblia
FNWLPKAVYLATMIRRAILFDFGVIK

SEQ ID NO: 3154581 - protein, 18 aa, Giardia lamblia
FNYFQLLDKINVHAIPGT

SEQ ID NO: 3154582 - protein, 23 aa, Giardia lamblia
FNYPSITGAFPLYADEDEQRTET

SEQ ID NO: 3154583 - protein, 22 aa, Giardia lamblia
FPACCAGSMGFRPRELAWAVCS

SEQ ID NO: 3154584 - protein, 19 aa, Giardia lamblia
FPADLATVLGEVFSSVYPQ

SEQ ID NO: 3154585 - protein, 20 aa, Giardia lamblia
FPAHLKSFYMARCSDDPSSP

SEQ ID NO: 3154586 - protein, 18 aa, Giardia lamblia
FPCNLRNTQALDVFSQST

SEQ ID NO: 3154587 - protein, 43 aa, Giardia lamblia
FPCTCNYQVCAFCFDKVKGGQCPHCRTVYDPKVYRRLTPEEFM

SEQ ID NO: 3154588 - protein, 20 aa, Giardia lamblia
FPDAYALLRSRRSCINPNDG

SEQ ID NO: 3154589 - protein, 18 aa, Giardia lamblia
FPDEFEALCTTNLSTTSD

SEQ ID NO: 3154590 - protein, 19 aa, Giardia lamblia
FPDIESIIQDKLCLLQQIN

SEQ ID NO: 3154591 - protein, 24 aa, Giardia lamblia
FPDLKAIGMDGCISTTLQSTNIRT

SEQ ID NO: 3154592 - protein, 25 aa, Giardia lamblia
FPDSRGENALFWAIRNNDLTYIDKL

SEQ ID NO: 3154593 - protein, 21 aa, Giardia lamblia
FPEAFELLLPLEHRRARKDGS

SEQ ID NO: 3154594 - protein, 18 aa, Giardia lamblia
FPECMLLNEDIDKWPAVD

SEQ ID NO: 3154595 - protein, 18 aa, Giardia lamblia
FPEEVVKNLGAELQLQVQ

SEQ ID NO: 3154596 - protein, 17 aa, Giardia lamblia
FPEISLKYSNELYNVVQ

SEQ ID NO: 3154597 - protein, 17 aa, Giardia lamblia
FPFDLEADIYNQTLTHL

SEQ ID NO: 3154598 - protein, 30 aa, Giardia lamblia
FPGEHGIRPGRRFIHCQLKPSNIFLSQALT

SEQ ID NO: 3154599 - protein, 18 aa, Giardia lamblia
FPGIEDRTQLGVTPTELV

SEQ ID NO: 3154600 - protein, 21 aa, Giardia lamblia
FPGKRLLVGVFDEWATRTEML

SEQ ID NO: 3154601 - protein, 19 aa, Giardia lamblia
FPGLSYLQALERLQMQALV

SEQ ID NO: 3154602 - protein, 25 aa, Giardia lamblia
FPGPTYDLFDICIAPYFKDKCRPVT

SEQ ID NO: 3154603 - protein, 20 aa, Giardia lamblia
FPGTPEVLKRSIQLIYRALR

SEQ ID NO: 3154604 - protein, 36 aa, Giardia lamblia
FPHLLPYKVHEILSRGYVELALRFLHTLLVIIPEQF

SEQ ID NO: 3154605 - protein, 18 aa, Giardia lamblia
FPIAAAKSLIRCVSSKPS

SEQ ID NO: 3154606 - protein, 21 aa, Giardia lamblia
FPIDARSSLVGCLQIGSCQPT

SEQ ID NO: 3154607 - protein, 23 aa, Giardia lamblia
FPIPDVYETRGFKNVAVENSILD

SEQ ID NO: 3154608 - protein, 23 aa, Giardia lamblia
FPKSTLTLSEFVSAFQHNATMLG

SEQ ID NO: 3154609 - protein, 18 aa, Giardia lamblia
FPLFARSGFIDNIELSYS

SEQ ID NO: 3154610 - protein, 20 aa, Giardia lamblia
FPLGSFYVVVRVRPFNSKEL

SEQ ID NO: 3154611 - protein, 21 aa, Giardia lamblia
FPLICAGATSLLRSALSDETL

SEQ ID NO: 3154612 - protein, 24 aa, Giardia lamblia
FPLKNRYTNIFPYLRTQPIALYTD

SEQ ID NO: 3154613 - protein, 17 aa, Giardia lamblia
FPLLSALDKEAAELNKT

SEQ ID NO: 3154614 - protein, 17 aa, Giardia lamblia
FPLPPLIDPLVSLMQVD

SEQ ID NO: 3154615 - protein, 18 aa, Giardia lamblia
FPLSLDVHIHRVGRTGRA

SEQ ID NO: 3154616 - protein, 17 aa, Giardia lamblia
FPLSLSIGSVIGDYSPS

SEQ ID NO: 3154617 - protein, 26 aa, Giardia lamblia
FPNEHLQEMSVRCFALLMNNIKGSAF

SEQ ID NO: 3154618 - protein, 17 aa, Giardia lamblia
FPNEIIFTIAVKAANIT

SEQ ID NO: 3154619 - protein, 22 aa, Giardia lamblia
FPPCVTKALFRYCTVGISEKLR

SEQ ID NO: 3154620 - protein, 19 aa, Giardia lamblia
FPPDVSILMQHVGHGLSNA

SEQ ID NO: 3154621 - protein, 18 aa, Giardia lamblia
FPPFPTIPDVAYPCINYS

SEQ ID NO: 3154622 - protein, 18 aa, Giardia lamblia
FPPILPVEVIKIVLSCLT

SEQ ID NO: 3154623 - protein, 21 aa, Giardia lamblia
FPPKKVRRASNMPVSLTGTSF

SEQ ID NO: 3154624 - protein, 17 aa, Giardia lamblia
FPPNQPVAAALREDGAA

SEQ ID NO: 3154625 - protein, 20 aa, Giardia lamblia
FPPPRAYRDKLWKAYSEARS

SEQ ID NO: 3154626 - protein, 18 aa, Giardia lamblia
FPPSFSFYDSIPCLYGSQ

SEQ ID NO: 3154627 - protein, 18 aa, Giardia lamblia
FPPSTEWYRSGDCGLMNE

SEQ ID NO: 3154628 - protein, 23 aa, Giardia lamblia
FPQDDAWSLGIILYECITNQKFN

SEQ ID NO: 3154629 - protein, 17 aa, Giardia lamblia
FPQLKKFNGRDVQDLSV

SEQ ID NO: 3154630 - protein, 21 aa, Giardia lamblia
FPQSYKAAVIDRAIETRGPYL

SEQ ID NO: 3154631 - protein, 20 aa, Giardia lamblia
FPRFCKDVMNYLHLILSNPV

SEQ ID NO: 3154632 - protein, 17 aa, Giardia lamblia
FPSKRSPTELIPFKPNE

SEQ ID NO: 3154633 - protein, 26 aa, Giardia lamblia
FPSKWKASDLFAHLDMNRDCFDSKDP

SEQ ID NO: 3154634 - protein, 20 aa, Giardia lamblia
FPTANEGFKGKFSETQDEYR

SEQ ID NO: 3154635 - protein, 29 aa, Giardia lamblia
FPTDGGFSGMYFVSIRVCLQQYRNVMDLL

SEQ ID NO: 3154636 - protein, 21 aa, Giardia lamblia
FPTILTSRLLSFIKTSFPHNA

SEQ ID NO: 3154637 - protein, 20 aa, Giardia lamblia
FPTLPLVVSCSLVVGGQEYL

SEQ ID NO: 3154638 - protein, 22 aa, Giardia lamblia
FPTPDLENVTGYGLIADTNINM

SEQ ID NO: 3154639 - protein, 20 aa, Giardia lamblia
FPTPMAFCPGTNSLVIATFD

SEQ ID NO: 3154640 - protein, 18 aa, Giardia lamblia
FPTSSSRFTITRFTITRD

SEQ ID NO: 3154641 - protein, 19 aa, Giardia lamblia
FPVINQVATIPRFQEFQEF

SEQ ID NO: 3154642 - protein, 21 aa, Giardia lamblia
FPVVVPPRYLAESLSAPYHGF

SEQ ID NO: 3154643 - protein, 18 aa, Giardia lamblia
FPYAKAFLDLNEELLDRY

SEQ ID NO: 3154644 - protein, 21 aa, Giardia lamblia
FPYGLSPPVAMLVHLIIEHPA

SEQ ID NO: 3154645 - protein, 23 aa, Giardia lamblia
FPYSNSLLHLAHWMLAVESTTRI

SEQ ID NO: 3154646 - protein, 18 aa, Giardia lamblia
FQARASFYRRAPNAYGVQ

SEQ ID NO: 3154647 - protein, 19 aa, Giardia lamblia
FQARIKSRMSKEYHRAEFT

SEQ ID NO: 3154648 - protein, 21 aa, Giardia lamblia
FQCLKALRAECGISVPASNPT

SEQ ID NO: 3154649 - protein, 21 aa, Giardia lamblia
FQCTVCKDVKKASVKRGKIIS

SEQ ID NO: 3154650 - protein, 29 aa, Giardia lamblia
FQDRVSPMIFLKLGCKFKKMERRLIDESD

SEQ ID NO: 3154651 - protein, 24 aa, Giardia lamblia
FQEDLRISAVDLRQHFRIKDTLLD

SEQ ID NO: 3154652 - protein, 24 aa, Giardia lamblia
FQEEYIVRLKMALKARASDLKVDE

SEQ ID NO: 3154653 - protein, 27 aa, Giardia lamblia
FQEGFRCGFIWGVRFYDPDPSCAVADG

SEQ ID NO: 3154654 - protein, 17 aa, Giardia lamblia
FQELNGFSIRRVHQDAD

SEQ ID NO: 3154655 - protein, 17 aa, Giardia lamblia
FQGAASLSWLADLPPRP

SEQ ID NO: 3154656 - protein, 29 aa, Giardia lamblia
FQGKREPWRGILLYGCPGTGKSFLAKAVA

SEQ ID NO: 3154657 - protein, 20 aa, Giardia lamblia
FQGLMLTPRMNSIANASECT

SEQ ID NO: 3154658 - protein, 23 aa, Giardia lamblia
FQGTLCLRLNPNRAIEAKTIRHI

SEQ ID NO: 3154659 - protein, 18 aa, Giardia lamblia
FQHKIYIDCLTRVTKPQF

SEQ ID NO: 3154660 - protein, 18 aa, Giardia lamblia
FQHLPRWSKEEGLETLMY

SEQ ID NO: 3154661 - protein, 19 aa, Giardia lamblia
FQILCLLGIGDAGRVYLVK

SEQ ID NO: 3154662 - protein, 17 aa, Giardia lamblia
FQIPVAEYYPRTQRDGQ

SEQ ID NO: 3154663 - protein, 17 aa, Giardia lamblia
FQKELRETLSRQLILLR

SEQ ID NO: 3154664 - protein, 18 aa, Giardia lamblia
FQKHMDFVGAVENNLAQS

SEQ ID NO: 3154665 - protein, 19 aa, Giardia lamblia
FQLAFQPPVPEKWEPLDTV

SEQ ID NO: 3154666 - protein, 17 aa, Giardia lamblia
FQLAMPTILTFLRRYAR

SEQ ID NO: 3154667 - protein, 24 aa, Giardia lamblia
FQLASCIYTIFGGRPCKYSSSSPC

SEQ ID NO: 3154668 - protein, 24 aa, Giardia lamblia
FQLLPRPDVRIGLQSLADLHGGYM

SEQ ID NO: 3154669 - protein, 20 aa, Giardia lamblia
FQLPHACLQQDLAPLDALPP

SEQ ID NO: 3154670 - protein, 21 aa, Giardia lamblia
FQLSYPGSFVLCQNGNRAFIF

SEQ ID NO: 3154671 - protein, 17 aa, Giardia lamblia
FQMREGRTMPLSRFTNP

SEQ ID NO: 3154672 - protein, 23 aa, Giardia lamblia
FQNFECAEILAPREKALEDTRGL

SEQ ID NO: 3154673 - protein, 22 aa, Giardia lamblia
FQNKDLKVRRSAMKIAALLAMK

SEQ ID NO: 3154674 - protein, 31 aa, Giardia lamblia
FQNQRLPLSTARPSIETPICMSTDTHAESID

SEQ ID NO: 3154675 - protein, 27 aa, Giardia lamblia
FQPYDRKFCAPYSFAEPDKRLYALSPV

SEQ ID NO: 3154676 - protein, 18 aa, Giardia lamblia
FQQACILSGCDYTPSLVG

SEQ ID NO: 3154677 - protein, 26 aa, Giardia lamblia
FQQADTLWKQHFEKVEEDMRTLFQEL

SEQ ID NO: 3154678 - protein, 18 aa, Giardia lamblia
FQQIVSMALVIVSKLITL

SEQ ID NO: 3154679 - protein, 18 aa, Giardia lamblia
FQQMYTLAISPQFSMLSR

SEQ ID NO: 3154680 - protein, 23 aa, Giardia lamblia
FQRFYRLRLPFERASDRSLAEYL

SEQ ID NO: 3154681 - protein, 28 aa, Giardia lamblia
FQRLFRRIRYCMLNAFASTATDDKANTN

SEQ ID NO: 3154682 - protein, 19 aa, Giardia lamblia
FQRRAFWTWARRLRHLNQA

SEQ ID NO: 3154683 - protein, 21 aa, Giardia lamblia
FQRRAIGALHIGHSVLVAAHT

SEQ ID NO: 3154684 - protein, 17 aa, Giardia lamblia
FQRSRSFFQAAFSEKED

SEQ ID NO: 3154685 - protein, 20 aa, Giardia lamblia
FQRYCPPILPFNCGSLGFLT

SEQ ID NO: 3154686 - protein, 18 aa, Giardia lamblia
FQSAALIFSSDKHMAKDS

SEQ ID NO: 3154687 - protein, 17 aa, Giardia lamblia
FQSEYRLYTNLSKQPGF

SEQ ID NO: 3154688 - protein, 19 aa, Giardia lamblia
FQTSLPFWPIVRSPVGSME

SEQ ID NO: 3154689 - protein, 23 aa, Giardia lamblia
FQVACGLLSGFLTIFLVAGSGEF

SEQ ID NO: 3154690 - protein, 21 aa, Giardia lamblia
FQVAYKAIIERPMRNERAVAY

SEQ ID NO: 3154691 - protein, 21 aa, Giardia lamblia
FQVPERLSIPPGGMDFKVMYS

SEQ ID NO: 3154692 - protein, 17 aa, Giardia lamblia
FRAALGPANEHTIDEVG

SEQ ID NO: 3154693 - protein, 23 aa, Giardia lamblia
FRACASGLRGSRGLSSSELNLIF

SEQ ID NO: 3154694 - protein, 17 aa, Giardia lamblia
FRADNFSLLLIAGGDHN

SEQ ID NO: 3154695 - protein, 25 aa, Giardia lamblia
FRADRAPVSLALLAYVGGVHANYVA

SEQ ID NO: 3154696 - protein, 17 aa, Giardia lamblia
FRAELRASEEDHQSAHA

SEQ ID NO: 3154697 - protein, 19 aa, Giardia lamblia
FRAHIGKILLHLSPELLAK

SEQ ID NO: 3154698 - protein, 17 aa, Giardia lamblia
FRAIYEPQYGKLHQNKN

SEQ ID NO: 3154699 - protein, 21 aa, Giardia lamblia
FRALESMGLIFTDSERYYLEQ

SEQ ID NO: 3154700 - protein, 17 aa, Giardia lamblia
FRAMPISDRVSASPDNR

SEQ ID NO: 3154701 - protein, 18 aa, Giardia lamblia
FRAPELRSSGSFSAKTDI

SEQ ID NO: 3154702 - protein, 18 aa, Giardia lamblia
FRCERACSLGVRTASFLK

SEQ ID NO: 3154703 - protein, 23 aa, Giardia lamblia
FRCNKCSTPLFLEEHVQQHESVA

SEQ ID NO: 3154704 - protein, 17 aa, Giardia lamblia
FRCPQDVALWPEARSSM

SEQ ID NO: 3154705 - protein, 24 aa, Giardia lamblia
FRDAIEYWAKITLPRLTTEEQERI

SEQ ID NO: 3154706 - protein, 24 aa, Giardia lamblia
FRDFPEGLSCLFSDLLWSDPSAEV

SEQ ID NO: 3154707 - protein, 19 aa, Giardia lamblia
FRDGCLSESALRNYSSIKC

SEQ ID NO: 3154708 - protein, 24 aa, Giardia lamblia
FRECKGCKYYYKKVYGQAFDERCA

SEQ ID NO: 3154709 - protein, 24 aa, Giardia lamblia
FREDMKKLFLMAGVDNQAVCFLLS

SEQ ID NO: 3154710 - protein, 24 aa, Giardia lamblia
FREEARLQFSIRVRDMAAYLKRRD

SEQ ID NO: 3154711 - protein, 17 aa, Giardia lamblia
FREKAMYAIRKQDSRGR

SEQ ID NO: 3154712 - protein, 25 aa, Giardia lamblia
FRELRHCIQGPFAIVRIGTCGTPLE

SEQ ID NO: 3154713 - protein, 21 aa, Giardia lamblia
FREQVCLAVANLCFSSPFYRQ

SEQ ID NO: 3154714 - protein, 20 aa, Giardia lamblia
FRESGCENIGGISAISDNIE

SEQ ID NO: 3154715 - protein, 17 aa, Giardia lamblia
FREYLTKLIYQLSISPC

SEQ ID NO: 3154716 - protein, 23 aa, Giardia lamblia
FRGTSIAGIRPRVGIDRPASSTT

SEQ ID NO: 3154717 - protein, 17 aa, Giardia lamblia
FRHDVGYFSVRRILTNH

SEQ ID NO: 3154718 - protein, 18 aa, Giardia lamblia
FRHTPLFSTASKLVYLEN

SEQ ID NO: 3154719 - protein, 17 aa, Giardia lamblia
FRIGERNLIASALARSI

SEQ ID NO: 3154720 - protein, 19 aa, Giardia lamblia
FRISCGLPVGAVINCADNS

SEQ ID NO: 3154721 - protein, 24 aa, Giardia lamblia
FRKLYRDGYIKFGKRNCIWSPLDG

SEQ ID NO: 3154722 - protein, 21 aa, Giardia lamblia
FRKRETNCLITTDGLARGIDV

SEQ ID NO: 3154723 - protein, 18 aa, Giardia lamblia
FRLEEFVHLLKAMVTNGM

SEQ ID NO: 3154724 - protein, 19 aa, Giardia lamblia
FRLGTLCEDFTSVSQTAPK

SEQ ID NO: 3154725 - protein, 19 aa, Giardia lamblia
FRLVLSCFSSARLSTISIT

SEQ ID NO: 3154726 - protein, 30 aa, Giardia lamblia
FRMISVWGARSMEPGVHFGRVHVVPEEEIR

SEQ ID NO: 3154727 - protein, 20 aa, Giardia lamblia
FRNALIYFTHVKAIREAVFG

SEQ ID NO: 3154728 - protein, 20 aa, Giardia lamblia
FRNTVLRLLANVQEDVQGYI

SEQ ID NO: 3154729 - protein, 19 aa, Giardia lamblia
FRPEKIGPIAERYKLDPTT

SEQ ID NO: 3154730 - protein, 17 aa, Giardia lamblia
FRPEKVAPIAERFGLNP

SEQ ID NO: 3154731 - protein, 21 aa, Giardia lamblia
FRPFAGYRWRRKGLINKVVSF

SEQ ID NO: 3154732 - protein, 29 aa, Giardia lamblia
FRPKESTLFRVILRQCLSSKSCCYKYRLT

SEQ ID NO: 3154733 - protein, 19 aa, Giardia lamblia
FRPLVKLGDLLSVGDIFGI

SEQ ID NO: 3154734 - protein, 20 aa, Giardia lamblia
FRPNTFVLGTRVIYGSPAIE

SEQ ID NO: 3154735 - protein, 18 aa, Giardia lamblia
FRPYSFPVIERATALYKA

SEQ ID NO: 3154736 - protein, 17 aa, Giardia lamblia
FRQPCQFQNVDSQDHYV

SEQ ID NO: 3154737 - protein, 25 aa, Giardia lamblia
FRQYRLADAESFSFTRRTNVILSLK

SEQ ID NO: 3154738 - protein, 23 aa, Giardia lamblia
FRRIATLANRAWSRILSADDTDC

SEQ ID NO: 3154739 - protein, 17 aa, Giardia lamblia
FRRMKYLVLDEADRLLC

SEQ ID NO: 3154740 - protein, 21 aa, Giardia lamblia
FRRRLLDMGYTFQTASSSDLS

SEQ ID NO: 3154741 - protein, 22 aa, Giardia lamblia
FRRVKEAAILCYLSDSVLLESL

SEQ ID NO: 3154742 - protein, 26 aa, Giardia lamblia
FRRYPERYEGIIGILCETIVTLDDPD

SEQ ID NO: 3154743 - protein, 18 aa, Giardia lamblia
FRSAHALYLTSTVSTISV

SEQ ID NO: 3154744 - protein, 18 aa, Giardia lamblia
FRSDGILMGIHFISSSPM

SEQ ID NO: 3154745 - protein, 22 aa, Giardia lamblia
FRSFHHFFLFIYAYHASLCRAS

SEQ ID NO: 3154746 - protein, 23 aa, Giardia lamblia
FRSKLKASLSRNYHRAEFTMTYN

SEQ ID NO: 3154747 - protein, 21 aa, Giardia lamblia
FRSLKKYQLDIASRESKLLYY

SEQ ID NO: 3154748 - protein, 20 aa, Giardia lamblia
FRSLVRIYRLGIPVYKGRVF

SEQ ID NO: 3154749 - protein, 22 aa, Giardia lamblia
FRSRGLSVACFFDDVSQQSAVC

SEQ ID NO: 3154750 - protein, 25 aa, Giardia lamblia
FRSRVRRIAIGSGHTIEEVLEFFDK

SEQ ID NO: 3154751 - protein, 19 aa, Giardia lamblia
FRSVGGHDFHLVYPVETLK

SEQ ID NO: 3154752 - protein, 26 aa, Giardia lamblia
FRSYSPEFRKIFSLFVSPGIYIQENA

SEQ ID NO: 3154753 - protein, 22 aa, Giardia lamblia
FRTADLWILVCTDVLARGLDFP

SEQ ID NO: 3154754 - protein, 20 aa, Giardia lamblia
FRTAPGAALTEIFHGRVTSV

SEQ ID NO: 3154755 - protein, 19 aa, Giardia lamblia
FRTLFSGAIVNPSGKSSCT

SEQ ID NO: 3154756 - protein, 31 aa, Giardia lamblia
FRVETCDELKQLLCKLSWSGSIDECSLEYLF

SEQ ID NO: 3154757 - protein, 24 aa, Giardia lamblia
FRVIECADEFSVSTICDILACNLL

SEQ ID NO: 3154758 - protein, 38 aa, Giardia lamblia
FRVLVSFETLPLCWCVIHGCSIFDILALEPRNQQSFAM

SEQ ID NO: 3154759 - protein, 19 aa, Giardia lamblia
FRVSIFDMTNRLIVGNELV

SEQ ID NO: 3154760 - protein, 19 aa, Giardia lamblia
FRVTEEVKEPFSIKPIVTV

SEQ ID NO: 3154761 - protein, 19 aa, Giardia lamblia
FRVVVRIRPLIDREKSAGD

SEQ ID NO: 3154762 - protein, 22 aa, Giardia lamblia
FRWICGVPGKKGTIWEGCTLRV

SEQ ID NO: 3154763 - protein, 17 aa, Giardia lamblia
FRYFAICGSGCKTPLHV

SEQ ID NO: 3154764 - protein, 21 aa, Giardia lamblia
FRYLELMPFRAELRASEEDHQ

SEQ ID NO: 3154765 - protein, 19 aa, Giardia lamblia
FRYNASLTDKFFFDVGACR

SEQ ID NO: 3154766 - protein, 20 aa, Giardia lamblia
FRYVHKKRPSMAVLSCSLNT

SEQ ID NO: 3154767 - protein, 22 aa, Giardia lamblia
FRYVKAYSNGVGHYLMRYYNNE

SEQ ID NO: 3154768 - protein, 17 aa, Giardia lamblia
FRYYCTRSLFVSLGPAE

SEQ ID NO: 3154769 - protein, 31 aa, Giardia lamblia
FRYYFLPKVEDWGWYYPYHHSPLLADLASAS

SEQ ID NO: 3154770 - protein, 17 aa, Giardia lamblia
FSACLPLLEILRADACA

SEQ ID NO: 3154771 - protein, 24 aa, Giardia lamblia
FSADFRNLLNLGRKSYEQYWNEFQ

SEQ ID NO: 3154772 - protein, 18 aa, Giardia lamblia
FSAGCIVYLGAFTSQFRT

SEQ ID NO: 3154773 - protein, 19 aa, Giardia lamblia
FSAICSAPKLILTTASGLN

SEQ ID NO: 3154774 - protein, 18 aa, Giardia lamblia
FSAKCGLYQLGRHDYTEG

SEQ ID NO: 3154775 - protein, 19 aa, Giardia lamblia
FSALQRPSSNRAMHSSMYI

SEQ ID NO: 3154776 - protein, 19 aa, Giardia lamblia
FSALTRSGIFLSHTSDHDI

SEQ ID NO: 3154777 - protein, 24 aa, Giardia lamblia
FSANSDPSFLLVVYSRNFGFDPVS

SEQ ID NO: 3154778 - protein, 18 aa, Giardia lamblia
FSAPPLETRLHSADESGG

SEQ ID NO: 3154779 - protein, 17 aa, Giardia lamblia
FSCREYSVRHLDSGYNG

SEQ ID NO: 3154780 - protein, 17 aa, Giardia lamblia
FSCSNNVWITQLFSASK

SEQ ID NO: 3154781 - protein, 17 aa, Giardia lamblia
FSDCVSLLLPEVGKEDD

SEQ ID NO: 3154782 - protein, 25 aa, Giardia lamblia
FSDHHPVCLLSTINVRVLDDAKLKA

SEQ ID NO: 3154783 - protein, 18 aa, Giardia lamblia
FSDICKNCGSPIVRSALS

SEQ ID NO: 3154784 - protein, 18 aa, Giardia lamblia
FSDIWAVGICLYELIFGH

SEQ ID NO: 3154785 - protein, 19 aa, Giardia lamblia
FSDKLVAPGEETSIPITFY

SEQ ID NO: 3154786 - protein, 24 aa, Giardia lamblia
FSDNYRWLVITGNTNFYHLFDLET

SEQ ID NO: 3154787 - protein, 17 aa, Giardia lamblia
FSDSHPQGHILPNNRNG

SEQ ID NO: 3154788 - protein, 21 aa, Giardia lamblia
FSDVFPAVYLDCQWKFDPALS

SEQ ID NO: 3154789 - protein, 18 aa, Giardia lamblia
FSEAEALIAKKALFEQKI

SEQ ID NO: 3154790 - protein, 21 aa, Giardia lamblia
FSEEGRRAYKEGIIDTHPANR

SEQ ID NO: 3154791 - protein, 26 aa, Giardia lamblia
FSEILLARSGDMGITPDVADFCLSRP

SEQ ID NO: 3154792 - protein, 26 aa, Giardia lamblia
FSEISYYPAALSFIGYIFCNSGKADE

SEQ ID NO: 3154793 - protein, 24 aa, Giardia lamblia
FSENPAAAVEEIMQLKAQIDELKY

SEQ ID NO: 3154794 - protein, 21 aa, Giardia lamblia
FSEYSKALGLEEVFHNIQNKK

SEQ ID NO: 3154795 - protein, 17 aa, Giardia lamblia
FSFDGVYDPSVTTRELY

SEQ ID NO: 3154796 - protein, 17 aa, Giardia lamblia
FSFIRLSILSERDDFIN

SEQ ID NO: 3154797 - protein, 22 aa, Giardia lamblia
FSFSGREGVEYANISPGPAAYS

SEQ ID NO: 3154798 - protein, 17 aa, Giardia lamblia
FSGDGRFLLTGSDDANL

SEQ ID NO: 3154799 - protein, 24 aa, Giardia lamblia
FSGENRFGICLPGRSSELVKLVEA

SEQ ID NO: 3154800 - protein, 17 aa, Giardia lamblia
FSGFCLKYLKEVLPIVY

SEQ ID NO: 3154801 - protein, 23 aa, Giardia lamblia
FSGGELMDALSILAGGGTSSDTL

SEQ ID NO: 3154802 - protein, 17 aa, Giardia lamblia
FSGHLMRGLFLMPDGEE

SEQ ID NO: 3154803 - protein, 18 aa, Giardia lamblia
FSGKRSYTNPAWKDVPFP

SEQ ID NO: 3154804 - protein, 26 aa, Giardia lamblia
FSGMPFANLDEAFKLFEQVFGSMDPF

SEQ ID NO: 3154805 - protein, 25 aa, Giardia lamblia
FSGRSKRASSATVFVPARSSVATTR

SEQ ID NO: 3154806 - protein, 18 aa, Giardia lamblia
FSHCCFGCNTIELKRITM

SEQ ID NO: 3154807 - protein, 24 aa, Giardia lamblia
FSHDGRYLFSAGMDGIVNCFDVKE

SEQ ID NO: 3154808 - protein, 24 aa, Giardia lamblia
FSHFPSTLQFLSLRNNKLTSIAST

SEQ ID NO: 3154809 - protein, 24 aa, Giardia lamblia
FSHRGVVLPYRCDYNIEELIMRLC

SEQ ID NO: 3154810 - protein, 24 aa, Giardia lamblia
FSHSTLRPLLKILKGSARLEQLSF

SEQ ID NO: 3154811 - protein, 27 aa, Giardia lamblia
FSIARQRRPLCFGEDNLGKASVVSGID

SEQ ID NO: 3154812 - protein, 23 aa, Giardia lamblia
FSILPCIRLLTILSTRDRVSVYI

SEQ ID NO: 3154813 - protein, 24 aa, Giardia lamblia
FSIQRRSIPFFTKRTVLTLESSIV

SEQ ID NO: 3154814 - protein, 27 aa, Giardia lamblia
FSIYKDYKWERFCDIITVFHYVNGIVD

SEQ ID NO: 3154815 - protein, 18 aa, Giardia lamblia
FSKAHIPTAAQFRVQLDI

SEQ ID NO: 3154816 - protein, 17 aa, Giardia lamblia
FSKEHDLRVASEKLNTC

SEQ ID NO: 3154817 - protein, 21 aa, Giardia lamblia
FSKGRYMLKIRGINDDTDAYV

SEQ ID NO: 3154818 - protein, 19 aa, Giardia lamblia
FSKHIPLTMYQQLRQDQPL

SEQ ID NO: 3154819 - protein, 24 aa, Giardia lamblia
FSKLFSIRSLEKWANEIQARTHAS

SEQ ID NO: 3154820 - protein, 27 aa, Giardia lamblia
FSKLSRIYAHVPWSYPLFQPPVHEQEH

SEQ ID NO: 3154821 - protein, 24 aa, Giardia lamblia
FSKMASTRVCLLAANRIRVAGMNG

SEQ ID NO: 3154822 - protein, 25 aa, Giardia lamblia
FSLCYRYTPAVSLDFENFCEKKIGT

SEQ ID NO: 3154823 - protein, 19 aa, Giardia lamblia
FSLEDRFLLVQLAPPEWPI

SEQ ID NO: 3154824 - protein, 19 aa, Giardia lamblia
FSLFQPHRCSVKTLRNRDP

SEQ ID NO: 3154825 - protein, 19 aa, Giardia lamblia
FSLGKLCRAHRSSDAVPVL

SEQ ID NO: 3154826 - protein, 23 aa, Giardia lamblia
FSLKFSTTCPFFLAGADRNGNVC

SEQ ID NO: 3154827 - protein, 20 aa, Giardia lamblia
FSLLKPGLKALILSDNNITE

SEQ ID NO: 3154828 - protein, 18 aa, Giardia lamblia
FSLNLLSTLLLNRANFNA

SEQ ID NO: 3154829 - protein, 19 aa, Giardia lamblia
FSMRVMASSVRRDSGFSPI

SEQ ID NO: 3154830 - protein, 21 aa, Giardia lamblia
FSMTLHDWFRAAEIGDTDYIK

SEQ ID NO: 3154831 - protein, 29 aa, Giardia lamblia
FSNDCQYFAACGCYPPMLRLYDLGNTGLK

SEQ ID NO: 3154832 - protein, 17 aa, Giardia lamblia
FSPGFARDVSLTSTYSN

SEQ ID NO: 3154833 - protein, 22 aa, Giardia lamblia
FSPQQVCRHFIPSIPVECTLEG

SEQ ID NO: 3154834 - protein, 17 aa, Giardia lamblia
FSPQRGGKPSHFGAPQP

SEQ ID NO: 3154835 - protein, 17 aa, Giardia lamblia
FSPSLWTRSMERRTQIL

SEQ ID NO: 3154836 - protein, 18 aa, Giardia lamblia
FSPYCKACKMEMLNSPYD

SEQ ID NO: 3154837 - protein, 23 aa, Giardia lamblia
FSQIEAWKSTLFTDINTDYMEDT

SEQ ID NO: 3154838 - protein, 24 aa, Giardia lamblia
FSQRVMLYRSRLPVFEKTMTVLKL

SEQ ID NO: 3154839 - protein, 19 aa, Giardia lamblia
FSRGLNLILARIILNSIFV

SEQ ID NO: 3154840 - protein, 22 aa, Giardia lamblia
FSRIHCLQAGYMVGYSRRTKSG

SEQ ID NO: 3154841 - protein, 23 aa, Giardia lamblia
FSRLPQKIDFVIHLAAAVSVAES

SEQ ID NO: 3154842 - protein, 25 aa, Giardia lamblia
FSRPFSRLNSNIPFYMPDAENYPEN

SEQ ID NO: 3154843 - protein, 19 aa, Giardia lamblia
FSRSLPVPPLRKLTKNSKN

SEQ ID NO: 3154844 - protein, 17 aa, Giardia lamblia
FSRSSWTNEGIVVSGPG

SEQ ID NO: 3154845 - protein, 21 aa, Giardia lamblia
FSRVRPAVVAGLSLPQNEDEF

SEQ ID NO: 3154846 - protein, 17 aa, Giardia lamblia
FSSALKIAARKGHVESL

SEQ ID NO: 3154847 - protein, 24 aa, Giardia lamblia
FSSDGEIFCELFLDLIGNEVISEW

SEQ ID NO: 3154848 - protein, 17 aa, Giardia lamblia
FSSDMWSLGVIAYELLT

SEQ ID NO: 3154849 - protein, 19 aa, Giardia lamblia
FSSERRAQAAAQFRERSNV

SEQ ID NO: 3154850 - protein, 19 aa, Giardia lamblia
FSSFPLFDLAFMAPEVLSG

SEQ ID NO: 3154851 - protein, 24 aa, Giardia lamblia
FSSIEHLDNLFINKIDPGKYFPID

SEQ ID NO: 3154852 - protein, 18 aa, Giardia lamblia
FSSIKYSLVVFWQDASRV

SEQ ID NO: 3154853 - protein, 21 aa, Giardia lamblia
FSSKGRTALSLAAEHGCCALI

SEQ ID NO: 3154854 - protein, 21 aa, Giardia lamblia
FSSKLFRKSKHDVLNHTGYRI

SEQ ID NO: 3154855 - protein, 23 aa, Giardia lamblia
FSSKNPFQIVLHLGYSCTTAYPL

SEQ ID NO: 3154856 - protein, 20 aa, Giardia lamblia
FSSNILFAFESLDSCISVTL

SEQ ID NO: 3154857 - protein, 19 aa, Giardia lamblia
FSSQIPFVAGIKARALRMI

SEQ ID NO: 3154858 - protein, 30 aa, Giardia lamblia
FSSSDLTWCLGLFLSSLCLLKEPKDILDNL

SEQ ID NO: 3154859 - protein, 27 aa, Giardia lamblia
FSSWKELTFGGSFIKTAGFTDAPKALK

SEQ ID NO: 3154860 - protein, 21 aa, Giardia lamblia
FSSYLPLPVFAGTFNVGNRKF

SEQ ID NO: 3154861 - protein, 17 aa, Giardia lamblia
FSTANPFPNSSLLLPPD

SEQ ID NO: 3154862 - protein, 19 aa, Giardia lamblia
FSTDGYLVLSGRDAQSNEL

SEQ ID NO: 3154863 - protein, 22 aa, Giardia lamblia
FSTPIKATCLVKINDQMHVAAG

SEQ ID NO: 3154864 - protein, 17 aa, Giardia lamblia
FSTRLAYILVKSHSRNA

SEQ ID NO: 3154865 - protein, 25 aa, Giardia lamblia
FSTSVCDSCDPYALKVYTDGSHFKY

SEQ ID NO: 3154866 - protein, 20 aa, Giardia lamblia
FSVETFLLLIAFKVKFPTRI

SEQ ID NO: 3154867 - protein, 20 aa, Giardia lamblia
FSVGCIFAELIARKPLFPGR

SEQ ID NO: 3154868 - protein, 20 aa, Giardia lamblia
FSVGTARATKELSLAQKNTH

SEQ ID NO: 3154869 - protein, 18 aa, Giardia lamblia
FSVNVDIDGADNFYELDI

SEQ ID NO: 3154870 - protein, 26 aa, Giardia lamblia
FSVSTKKEWFASILAHRYETVRASMK

SEQ ID NO: 3154871 - protein, 26 aa, Giardia lamblia
FSVYPNQMPCVLKIKRVAAPPSEGML

SEQ ID NO: 3154872 - protein, 19 aa, Giardia lamblia
FSYCCAGIRNGALSEVPAI

SEQ ID NO: 3154873 - protein, 19 aa, Giardia lamblia
FSYKAGKYPSTSLLETNCA

SEQ ID NO: 3154874 - protein, 17 aa, Giardia lamblia
FSYRYQHCDADLRIRTI

SEQ ID NO: 3154875 - protein, 20 aa, Giardia lamblia
FTAHYPCVVSKGLVITEKRE

SEQ ID NO: 3154876 - protein, 17 aa, Giardia lamblia
FTALMILAQQSPITKGH

SEQ ID NO: 3154877 - protein, 17 aa, Giardia lamblia
FTALTLAIKARNTAAIK

SEQ ID NO: 3154878 - protein, 35 aa, Giardia lamblia
FTANGWITAFDWPFRIPKAIYRRRLHGSDITAAKL

SEQ ID NO: 3154879 - protein, 19 aa, Giardia lamblia
FTANLRATMLPNILQDGNT

SEQ ID NO: 3154880 - protein, 18 aa, Giardia lamblia
FTAPMYVHLGSCKSDALP

SEQ ID NO: 3154881 - protein, 19 aa, Giardia lamblia
FTCEVCGSSQYVVVPHDQY

SEQ ID NO: 3154882 - protein, 25 aa, Giardia lamblia
FTDAICKRVQEEAYMASQGRMVVDP

SEQ ID NO: 3154883 - protein, 22 aa, Giardia lamblia
FTDFYLRLLLNAPYSTLNEQQG

SEQ ID NO: 3154884 - protein, 18 aa, Giardia lamblia
FTDIALLRVELKSLAEKY

SEQ ID NO: 3154885 - protein, 24 aa, Giardia lamblia
FTDIFMPAFKRYKAQLHNISEFLW

SEQ ID NO: 3154886 - protein, 18 aa, Giardia lamblia
FTDLLAIQRERVIDAIAD

SEQ ID NO: 3154887 - protein, 38 aa, Giardia lamblia
FTDQLSGDEWLRFCDHWFCDGHRIFLYAALAAFPVVVP

SEQ ID NO: 3154888 - protein, 23 aa, Giardia lamblia
FTEAEARLKAALATSEDLAEQLA

SEQ ID NO: 3154889 - protein, 24 aa, Giardia lamblia
FTEFPLQLLCEANTKPLNMYIAWD

SEQ ID NO: 3154890 - protein, 23 aa, Giardia lamblia
FTEGPRLSNYVQQMHSSAPTLPL

SEQ ID NO: 3154891 - protein, 18 aa, Giardia lamblia
FTEIASIVALRLTNPATG

SEQ ID NO: 3154892 - protein, 18 aa, Giardia lamblia
FTEKELNEQLIVAMQSII

SEQ ID NO: 3154893 - protein, 18 aa, Giardia lamblia
FTELSSWFTSEQNYLKTN

SEQ ID NO: 3154894 - protein, 17 aa, Giardia lamblia
FTENHVFHLKKLLKPST

SEQ ID NO: 3154895 - protein, 21 aa, Giardia lamblia
FTEPASCPRCSARSSVGGTTF

SEQ ID NO: 3154896 - protein, 30 aa, Giardia lamblia
FTETHKKCCIWWDEWKGMTMDDIKKMENDA

SEQ ID NO: 3154897 - protein, 20 aa, Giardia lamblia
FTFFTPLIVCNNEISNLIVP

SEQ ID NO: 3154898 - protein, 19 aa, Giardia lamblia
FTGLEEVFLTIAHMVEPPP

SEQ ID NO: 3154899 - protein, 26 aa, Giardia lamblia
FTGNGLLLKHLIPLQSVIVMNLVLKS

SEQ ID NO: 3154900 - protein, 26 aa, Giardia lamblia
FTGPDWYRCFESFMRENIHTVENSSS

SEQ ID NO: 3154901 - protein, 17 aa, Giardia lamblia
FTGPNGTTCTWADLYAH

SEQ ID NO: 3154902 - protein, 17 aa, Giardia lamblia
FTGTLPAEKRCRCWCSA

SEQ ID NO: 3154903 - protein, 17 aa, Giardia lamblia
FTHFTLISFRRLEDLEE

SEQ ID NO: 3154904 - protein, 17 aa, Giardia lamblia
FTHGARLTALMAAALQD

SEQ ID NO: 3154905 - protein, 29 aa, Giardia lamblia
FTHIRPNPSFRGRIPKRFTLSSPPALCSQ

SEQ ID NO: 3154906 - protein, 26 aa, Giardia lamblia
FTHIRTARPNIFATFNGDFFDWPFVD

SEQ ID NO: 3154907 - protein, 20 aa, Giardia lamblia
FTIHRHGFVFPLPRRRFSVT

SEQ ID NO: 3154908 - protein, 24 aa, Giardia lamblia
FTIKSEKGITHLVNEVEHLKLILE

SEQ ID NO: 3154909 - protein, 19 aa, Giardia lamblia
FTISLCFVSGRATTLSRNN

SEQ ID NO: 3154910 - protein, 17 aa, Giardia lamblia
FTISNVMVNTTNFLNEG

SEQ ID NO: 3154911 - protein, 23 aa, Giardia lamblia
FTIYKELICYVDWPTGYLHAGLT

SEQ ID NO: 3154912 - protein, 20 aa, Giardia lamblia
FTKEEVSAFVNLTRWLNTVQ

SEQ ID NO: 3154913 - protein, 18 aa, Giardia lamblia
FTKELLKKLDHYRACEQC

SEQ ID NO: 3154914 - protein, 27 aa, Giardia lamblia
FTKSDGTCALMWAASKGNEAICKLLSK

SEQ ID NO: 3154915 - protein, 18 aa, Giardia lamblia
FTKTPSINTIVPLGTAAG

SEQ ID NO: 3154916 - protein, 21 aa, Giardia lamblia
FTKTQLVLEVESFRRLNTKEF

SEQ ID NO: 3154917 - protein, 17 aa, Giardia lamblia
FTLAATKVMSWKDVGVK

SEQ ID NO: 3154918 - protein, 20 aa, Giardia lamblia
FTLKDIYLKSNVRITTNPGA

SEQ ID NO: 3154919 - protein, 27 aa, Giardia lamblia
FTLKGRHPEHLDMTGPGPGAYATPEGT

SEQ ID NO: 3154920 - protein, 17 aa, Giardia lamblia
FTLKVFAIPLLKSVPQS

SEQ ID NO: 3154921 - protein, 19 aa, Giardia lamblia
FTLLCPGTSLGQLSSDTQA

SEQ ID NO: 3154922 - protein, 20 aa, Giardia lamblia
FTLMRPDLITGILQLAPHVG

SEQ ID NO: 3154923 - protein, 24 aa, Giardia lamblia
FTMLDRWILEASNFDILRNYKFFK

SEQ ID NO: 3154924 - protein, 25 aa, Giardia lamblia
FTNLGIEPCKGLLFYGSPGSGKTLT

SEQ ID NO: 3154925 - protein, 17 aa, Giardia lamblia
FTNPLLIKQHTIPALEA

SEQ ID NO: 3154926 - protein, 18 aa, Giardia lamblia
FTNRILVLTNELVELEGQ

SEQ ID NO: 3154927 - protein, 17 aa, Giardia lamblia
FTPARSRFQGCALRGTG

SEQ ID NO: 3154928 - protein, 28 aa, Giardia lamblia
FTPDVRKSAEISLDYGMFQREYTRLQGL

SEQ ID NO: 3154929 - protein, 29 aa, Giardia lamblia
FTPELRMVINWLLMQSFPDQLAFRESTDS

SEQ ID NO: 3154930 - protein, 17 aa, Giardia lamblia
FTPFNIWACHHLYSVLE

SEQ ID NO: 3154931 - protein, 18 aa, Giardia lamblia
FTPPECRHSAQGTATEPA

SEQ ID NO: 3154932 - protein, 18 aa, Giardia lamblia
FTRESLKGRSMRADSLGG

SEQ ID NO: 3154933 - protein, 30 aa, Giardia lamblia
FTRHQMLFMLKEMIAAFDMHSLLSVPRFDC

SEQ ID NO: 3154934 - protein, 19 aa, Giardia lamblia
FTRRTNVILSLKALGLLLY

SEQ ID NO: 3154935 - protein, 27 aa, Giardia lamblia
FTSAHLRFGDKPIRCEYLIHDADFTAV

SEQ ID NO: 3154936 - protein, 30 aa, Giardia lamblia
FTSALRSPECSRCLGYWIAALENSGVAEAL

SEQ ID NO: 3154937 - protein, 20 aa, Giardia lamblia
FTSDILPRFQQYINSNMASW

SEQ ID NO: 3154938 - protein, 23 aa, Giardia lamblia
FTSGDLDMCFKQLGLFIDSYTSV

SEQ ID NO: 3154939 - protein, 24 aa, Giardia lamblia
FTSGVSLECVCWIRTDVFIAGCAL

SEQ ID NO: 3154940 - protein, 17 aa, Giardia lamblia
FTSLGVAVSEILKNVSL

SEQ ID NO: 3154941 - protein, 17 aa, Giardia lamblia
FTSLPIYHRMREFDRRY

SEQ ID NO: 3154942 - protein, 25 aa, Giardia lamblia
FTSNCLKPPLPSYRDRVFVMDCVGF

SEQ ID NO: 3154943 - protein, 26 aa, Giardia lamblia
FTSSMLRDQLLFFSLLFDLTSVLYTV

SEQ ID NO: 3154944 - protein, 24 aa, Giardia lamblia
FTSTWRPSSFMDYYLENARLNLHT

SEQ ID NO: 3154945 - protein, 24 aa, Giardia lamblia
FTTEAEFRRACDLIAKQVAHLRDL

SEQ ID NO: 3154946 - protein, 19 aa, Giardia lamblia
FTTEVLPDISLVAVSVQSV

SEQ ID NO: 3154947 - protein, 24 aa, Giardia lamblia
FTTKARYFMPCAAIYLDHRRYEIV

SEQ ID NO: 3154948 - protein, 18 aa, Giardia lamblia
FTTLGFFSRAVIVGNEVL

SEQ ID NO: 3154949 - protein, 26 aa, Giardia lamblia
FTTNRVSIRPGISLNSFCSAPESISA

SEQ ID NO: 3154950 - protein, 25 aa, Giardia lamblia
FTTNWTQSRCCFGDTYNSITQGHHP

SEQ ID NO: 3154951 - protein, 18 aa, Giardia lamblia
FTTPMFHPNVKFANGEIC

SEQ ID NO: 3154952 - protein, 26 aa, Giardia lamblia
FTTTNFRGGMKLKKWVQADLCNNGTL

SEQ ID NO: 3154953 - protein, 21 aa, Giardia lamblia
FTTVKGKEGLSLKDALINKVR

SEQ ID NO: 3154954 - protein, 23 aa, Giardia lamblia
FTVLKRCIENSALEEDYGKLAKA

SEQ ID NO: 3154955 - protein, 18 aa, Giardia lamblia
FTVPRAFWEAVRDPWDPV

SEQ ID NO: 3154956 - protein, 18 aa, Giardia lamblia
FTVSCLNVDLSIRHLESV

SEQ ID NO: 3154957 - protein, 24 aa, Giardia lamblia
FTVSCSPGRCYYASRTDELFDTIY

SEQ ID NO: 3154958 - protein, 23 aa, Giardia lamblia
FTYAGSNAIRFFKRCGLDDDPMI

SEQ ID NO: 3154959 - protein, 23 aa, Giardia lamblia
FTYCVDCAEKVTLCEGTTSPPVD

SEQ ID NO: 3154960 - protein, 25 aa, Giardia lamblia
FTYKSEIRTVLALKDGSIFPGAQPV

SEQ ID NO: 3154961 - protein, 17 aa, Giardia lamblia
FTYRLTTQPELISATVS

SEQ ID NO: 3154962 - protein, 17 aa, Giardia lamblia
FTYYDCIGILSRVLQTR

SEQ ID NO: 3154963 - protein, 17 aa, Giardia lamblia
FVACSSFGPVLRVSSNR

SEQ ID NO: 3154964 - protein, 19 aa, Giardia lamblia
FVAMMCFNIAVKVEGEKSC

SEQ ID NO: 3154965 - protein, 18 aa, Giardia lamblia
FVCPCCNKETQIFNPSSG

SEQ ID NO: 3154966 - protein, 18 aa, Giardia lamblia
FVCSFLQTRLRERIATIF

SEQ ID NO: 3154967 - protein, 24 aa, Giardia lamblia
FVDIPKFQQCIVSSFRCRHCGFKG

SEQ ID NO: 3154968 - protein, 25 aa, Giardia lamblia
FVDMGLDCVICMDAIPNAVLVPCRH

SEQ ID NO: 3154969 - protein, 20 aa, Giardia lamblia
FVEKAVRLTNVIHFIVINVL

SEQ ID NO: 3154970 - protein, 18 aa, Giardia lamblia
FVENCKFDTKPFNFIPGE

SEQ ID NO: 3154971 - protein, 21 aa, Giardia lamblia
FVERVNIYLGNSVQFSLCCTE

SEQ ID NO: 3154972 - protein, 17 aa, Giardia lamblia
FVFLTFLVGNDFLPHIQ

SEQ ID NO: 3154973 - protein, 18 aa, Giardia lamblia
FVGLHYASYFDRLDVVRS

SEQ ID NO: 3154974 - protein, 17 aa, Giardia lamblia
FVGMGFEQMKTPKLVES

SEQ ID NO: 3154975 - protein, 23 aa, Giardia lamblia
FVGSGCPTPGLLTAAGVSVPSPL

SEQ ID NO: 3154976 - protein, 29 aa, Giardia lamblia
FVGTCGDGFVPFRCATGMGITEDQVLISS

SEQ ID NO: 3154977 - protein, 17 aa, Giardia lamblia
FVGTTLVSPEKFSGARS

SEQ ID NO: 3154978 - protein, 19 aa, Giardia lamblia
FVHPGHGESTYLIDYIPPA

SEQ ID NO: 3154979 - protein, 17 aa, Giardia lamblia
FVIERSFLEEKLAILER

SEQ ID NO: 3154980 - protein, 20 aa, Giardia lamblia
FVILNEFLDYMAYLNQKPCQ

SEQ ID NO: 3154981 - protein, 23 aa, Giardia lamblia
FVIPIEFKQSIIGFLTCNVSVTL

SEQ ID NO: 3154982 - protein, 20 aa, Giardia lamblia
FVIQVIGIIYKLVFKDKTSK

SEQ ID NO: 3154983 - protein, 17 aa, Giardia lamblia
FVKFWSFGVTEDGGVSL

SEQ ID NO: 3154984 - protein, 17 aa, Giardia lamblia
FVLSREKSSACIDSTPS

SEQ ID NO: 3154985 - protein, 22 aa, Giardia lamblia
FVLTAFRLAAGIPDMHLYTHKK

SEQ ID NO: 3154986 - protein, 28 aa, Giardia lamblia
FVMKTVESLRGMPAFTITSLKLHPSGRH

SEQ ID NO: 3154987 - protein, 29 aa, Giardia lamblia
FVMYCANELLRVCATLLLPFIPQKAPLIL

SEQ ID NO: 3154988 - protein, 25 aa, Giardia lamblia
FVNFDKGRMGICEMSKLGSALTFMH

SEQ ID NO: 3154989 - protein, 24 aa, Giardia lamblia
FVNIMKRAHFRDMADDPLDTRYSD

SEQ ID NO: 3154990 - protein, 17 aa, Giardia lamblia
FVNPDCYAFNKVKRTSC

SEQ ID NO: 3154991 - protein, 20 aa, Giardia lamblia
FVNPSGAEKCVREFNGNTSI

SEQ ID NO: 3154992 - protein, 17 aa, Giardia lamblia
FVNRKIRHIQRQQGRLL

SEQ ID NO: 3154993 - protein, 20 aa, Giardia lamblia
FVNSLFLYVQFILSHRPLIR

SEQ ID NO: 3154994 - protein, 22 aa, Giardia lamblia
FVPKASVDVGLFLPNGSTGMVY

SEQ ID NO: 3154995 - protein, 23 aa, Giardia lamblia
FVQDWKPDLILVRDKEIKKIIER

SEQ ID NO: 3154996 - protein, 25 aa, Giardia lamblia
FVQLVKRIQCCIQEKEVELLTEICE

SEQ ID NO: 3154997 - protein, 18 aa, Giardia lamblia
FVQRDVMAKFPLVLDKLL

SEQ ID NO: 3154998 - protein, 26 aa, Giardia lamblia
FVRASCPSSVWARRGPWQSSRECTAA

SEQ ID NO: 3154999 - protein, 17 aa, Giardia lamblia
FVRDGVCAVDVISSASD

SEQ ID NO: 3155000 - protein, 20 aa, Giardia lamblia
FVRDSIISASSFDWESQLRF

SEQ ID NO: 3155001 - protein, 17 aa, Giardia lamblia
FVRRRAASLDQYFVFSL

SEQ ID NO: 3155002 - protein, 21 aa, Giardia lamblia
FVRTSICGVLNKSAPASLYPQ

SEQ ID NO: 3155003 - protein, 18 aa, Giardia lamblia
FVRTSRFVPINSPLLDAI

SEQ ID NO: 3155004 - protein, 19 aa, Giardia lamblia
FVSGNLLQFVKRLLDASVS

SEQ ID NO: 3155005 - protein, 19 aa, Giardia lamblia
FVSSNCYDLLMVCDTGHGI

SEQ ID NO: 3155006 - protein, 21 aa, Giardia lamblia
FVTFCLPEAAFRAKKQRDTII

SEQ ID NO: 3155007 - protein, 18 aa, Giardia lamblia
FVTFPYPYMNGRLHLGHL

SEQ ID NO: 3155008 - protein, 24 aa, Giardia lamblia
FVVADCGLCRSALEGAPAGFGSST

SEQ ID NO: 3155009 - protein, 18 aa, Giardia lamblia
FVVEMTLAEFRRRYEGKC

SEQ ID NO: 3155010 - protein, 17 aa, Giardia lamblia
FVVFPWFIYHDLFTIVF

SEQ ID NO: 3155011 - protein, 17 aa, Giardia lamblia
FVVTRSLSLPLFSSALV

SEQ ID NO: 3155012 - protein, 17 aa, Giardia lamblia
FWAIHGTDFRIFIRMQR

SEQ ID NO: 3155013 - protein, 25 aa, Giardia lamblia
FWCGEDRPLLWWNLLSRVVQDEGGG

SEQ ID NO: 3155014 - protein, 26 aa, Giardia lamblia
FWGPIVPANTGFLFFDTIDDTQRSFR

SEQ ID NO: 3155015 - protein, 18 aa, Giardia lamblia
FWKHGPPFSHFIKGRGHH

SEQ ID NO: 3155016 - protein, 19 aa, Giardia lamblia
FWPFHKYGYYHLLHSLFEH

SEQ ID NO: 3155017 - protein, 24 aa, Giardia lamblia
FWRPCSDSPDYDCIGLFNNHTEDI

SEQ ID NO: 3155018 - protein, 24 aa, Giardia lamblia
FWSKDLIQRVRWNLAQFRVNEKNP

SEQ ID NO: 3155019 - protein, 26 aa, Giardia lamblia
FWSYHIPYQRIKVIGFCSPPCGSKSL

SEQ ID NO: 3155020 - protein, 21 aa, Giardia lamblia
FWYDDLCDVFLELVKPIIASM

SEQ ID NO: 3155021 - protein, 19 aa, Giardia lamblia
FYADLPIELNDPGNNSLAK

SEQ ID NO: 3155022 - protein, 17 aa, Giardia lamblia
FYARLPSLPALSPSKHL

SEQ ID NO: 3155023 - protein, 17 aa, Giardia lamblia
FYASCGSIFTDILYFIT

SEQ ID NO: 3155024 - protein, 18 aa, Giardia lamblia
FYCPMIQSIVPYTATVPH

SEQ ID NO: 3155025 - protein, 25 aa, Giardia lamblia
FYDAFPRDKASIALTRRSSGYGKFG

SEQ ID NO: 3155026 - protein, 19 aa, Giardia lamblia
FYDQCINCDETGDLFDLYD

SEQ ID NO: 3155027 - protein, 25 aa, Giardia lamblia
FYEGKAFHFEPYFARLKKEKLKDIL

SEQ ID NO: 3155028 - protein, 18 aa, Giardia lamblia
FYEIYMNPLLKWNNTNII

SEQ ID NO: 3155029 - protein, 26 aa, Giardia lamblia
FYFAEYKSSGGARCSEKSALLLKKVN

SEQ ID NO: 3155030 - protein, 26 aa, Giardia lamblia
FYGALCKFREFLLGLGGCFGVIYIDG

SEQ ID NO: 3155031 - protein, 26 aa, Giardia lamblia
FYGYNWQLAPMVLRFKYATRVEKAMP

SEQ ID NO: 3155032 - protein, 25 aa, Giardia lamblia
FYHFIKKEVEYCVVDCISKHIQEHE

SEQ ID NO: 3155033 - protein, 20 aa, Giardia lamblia
FYHTCVEPLLKDSRPLPPTN

SEQ ID NO: 3155034 - protein, 18 aa, Giardia lamblia
FYIAGGLFTPDMREETFS

SEQ ID NO: 3155035 - protein, 20 aa, Giardia lamblia
FYIMCSKSDLFIPAELQEAI

SEQ ID NO: 3155036 - protein, 17 aa, Giardia lamblia
FYKARTQAISALIKQHP

SEQ ID NO: 3155037 - protein, 24 aa, Giardia lamblia
FYKEQARFVFLFRSLCNAMIAQIK

SEQ ID NO: 3155038 - protein, 24 aa, Giardia lamblia
FYKGGRRGIPVVLQRMCFTEDALI

SEQ ID NO: 3155039 - protein, 18 aa, Giardia lamblia
FYLGPGERKVLNVEYSSP

SEQ ID NO: 3155040 - protein, 19 aa, Giardia lamblia
FYLNICFPSDYPFKPPKVT

SEQ ID NO: 3155041 - protein, 17 aa, Giardia lamblia
FYLSFGLIMGFLDMNIE

SEQ ID NO: 3155042 - protein, 26 aa, Giardia lamblia
FYLVMAGDFLSCFVESAISELVLSRS

SEQ ID NO: 3155043 - protein, 18 aa, Giardia lamblia
FYMNNAGFCRLDVFVYCF

SEQ ID NO: 3155044 - protein, 19 aa, Giardia lamblia
FYPHKDPYFLSLRGTVITK

SEQ ID NO: 3155045 - protein, 20 aa, Giardia lamblia
FYPIPFTDPRKMSASGALNN

SEQ ID NO: 3155046 - protein, 18 aa, Giardia lamblia
FYQKETVNFLILRYNEYM

SEQ ID NO: 3155047 - protein, 19 aa, Giardia lamblia
FYRAFPGKRLLVGVFDEWA

SEQ ID NO: 3155048 - protein, 17 aa, Giardia lamblia
FYRDRRPICEFAAENVR

SEQ ID NO: 3155049 - protein, 18 aa, Giardia lamblia
FYRKSGHMFRNLSRRKVY

SEQ ID NO: 3155050 - protein, 17 aa, Giardia lamblia
FYRNLLVSIAWRHISSL

SEQ ID NO: 3155051 - protein, 24 aa, Giardia lamblia
FYRQCKGAFRITRTCDTLLGPCDK

SEQ ID NO: 3155052 - protein, 17 aa, Giardia lamblia
FYRSFLPLFKELKDLHG

SEQ ID NO: 3155053 - protein, 18 aa, Giardia lamblia
FYSEALKILFAGDGLGFS

SEQ ID NO: 3155054 - protein, 25 aa, Giardia lamblia
FYSERLRKLVQMLLSINPLDRPSAA

SEQ ID NO: 3155055 - protein, 20 aa, Giardia lamblia
FYSKSLRVPTSIAITGQTST

SEQ ID NO: 3155056 - protein, 18 aa, Giardia lamblia
FYSRRPSLDIPLLNSKVG

SEQ ID NO: 3155057 - protein, 19 aa, Giardia lamblia
FYTHMGIVTQCLLAPKSSQ

SEQ ID NO: 3155058 - protein, 26 aa, Giardia lamblia
FYTMNCPLFRFIEAVFNQNNYFVNLQ

SEQ ID NO: 3155059 - protein, 17 aa, Giardia lamblia
FYTQFQYISLATFAEAT

SEQ ID NO: 3155060 - protein, 23 aa, Giardia lamblia
FYVVLSRPGFRVNKRRAQQQHVG

SEQ ID NO: 3155061 - protein, 27 aa, Giardia lamblia
FYWHRRSPEAFRCLGTYFSYVTPVAYT

SEQ ID NO: 3155062 - protein, 26 aa, Giardia lamblia
FYYCLESRAAFPVLFSTYRAACISPG

SEQ ID NO: 3155063 - protein, 17 aa, Giardia lamblia
FYYNDFRSLQSEEDQGV

SEQ ID NO: 3155064 - protein, 17 aa, Giardia lamblia
FYYPCEANDPGAEKLSL

SEQ ID NO: 3155065 - protein, 21 aa, Giardia lamblia
FYYPKYYAINKIRTHRLLNFI

SEQ ID NO: 3155066 - protein, 22 aa, Giardia lamblia
GAAESGFSYVVEQFISQQKRKQ

SEQ ID NO: 3155067 - protein, 34 aa, Giardia lamblia
GAAGMPPGGFPGGMPPGGFPGGFPGGMPGGAAPG

SEQ ID NO: 3155068 - protein, 17 aa, Giardia lamblia
GAAIPRILALSDSKEST

SEQ ID NO: 3155069 - protein, 19 aa, Giardia lamblia
GAAIQELWAISRRLDELSA

SEQ ID NO: 3155070 - protein, 20 aa, Giardia lamblia
GAALLRRLHMLGILDEEKDQ

SEQ ID NO: 3155071 - protein, 26 aa, Giardia lamblia
GAALNLCFVCDLPILYVGTGQSYPDF

SEQ ID NO: 3155072 - protein, 18 aa, Giardia lamblia
GAASLSWLADLPPRPDST

SEQ ID NO: 3155073 - protein, 25 aa, Giardia lamblia
GAAYPRTLIEFAMKNDLHYRVTQQP

SEQ ID NO: 3155074 - protein, 27 aa, Giardia lamblia
GADDIAVCLALLWERLSVLGAGKQGGR

SEQ ID NO: 3155075 - protein, 25 aa, Giardia lamblia
GADGARLKLDYAALCSCLGTSKFVQ

SEQ ID NO: 3155076 - protein, 21 aa, Giardia lamblia
GADGGASIWALHGTVGQPMDE

SEQ ID NO: 3155077 - protein, 34 aa, Giardia lamblia
GADMRDELPCLWPLCVLCIIHRLSVPRAKLLILR

SEQ ID NO: 3155078 - protein, 18 aa, Giardia lamblia
GAEIGRVAARIAAEQALR

SEQ ID NO: 3155079 - protein, 17 aa, Giardia lamblia
GAEPCYLDLAVGVCANI

SEQ ID NO: 3155080 - protein, 18 aa, Giardia lamblia
GAEPLRLDVIEALYSGNR

SEQ ID NO: 3155081 - protein, 24 aa, Giardia lamblia
GAFDLLRKEFITLGVRLAQLANRR

SEQ ID NO: 3155082 - protein, 17 aa, Giardia lamblia
GAFDLSASGFVRAGERF

SEQ ID NO: 3155083 - protein, 23 aa, Giardia lamblia
GAFHPLMEMRRLFVEAFVGMGFE

SEQ ID NO: 3155084 - protein, 20 aa, Giardia lamblia
GAFHTFKLRGRVPSVITNGR

SEQ ID NO: 3155085 - protein, 24 aa, Giardia lamblia
GAFRSLRILSTFLCDSSTGEHETA

SEQ ID NO: 3155086 - protein, 27 aa, Giardia lamblia
GAFTPLMVCALYNCVDVAIILAASGHS

SEQ ID NO: 3155087 - protein, 18 aa, Giardia lamblia
GAFVAKLKKTGLFDFAKS

SEQ ID NO: 3155088 - protein, 30 aa, Giardia lamblia
GAGDPGAFMRNMFNAEGMAKIRANPKTAKY

SEQ ID NO: 3155089 - protein, 17 aa, Giardia lamblia
GAGIPITNPISGASSIS

SEQ ID NO: 3155090 - protein, 24 aa, Giardia lamblia
GAGKSNFYSAILFALMDPLYDLKT

SEQ ID NO: 3155091 - protein, 17 aa, Giardia lamblia
GAGNIWTKGFQCGEAGF

SEQ ID NO: 3155092 - protein, 31 aa, Giardia lamblia
GAGSFPPFKPLRAVLELEYTRWTTTDKDARD

SEQ ID NO: 3155093 - protein, 18 aa, Giardia lamblia
GAGSVFRAHVARRLGAAK

SEQ ID NO: 3155094 - protein, 20 aa, Giardia lamblia
GAGSYRCVKDLLQYEQGMVS

SEQ ID NO: 3155095 - protein, 25 aa, Giardia lamblia
GAHACDGCFELFGFDFMIDCKSNGY

SEQ ID NO: 3155096 - protein, 18 aa, Giardia lamblia
GAHPEDAEALLLAYPAAL

SEQ ID NO: 3155097 - protein, 18 aa, Giardia lamblia
GAHPEIAELGHLRRSIRA

SEQ ID NO: 3155098 - protein, 19 aa, Giardia lamblia
GAIERVCAKIEGIYSGLLF

SEQ ID NO: 3155099 - protein, 18 aa, Giardia lamblia
GAIGSSFKKAYYSSNTVW

SEQ ID NO: 3155100 - protein, 27 aa, Giardia lamblia
GAIVQISWNPKVPRICCTASQDGTVSI

SEQ ID NO: 3155101 - protein, 19 aa, Giardia lamblia
GAKAADLRPVLVGLANKHK

SEQ ID NO: 3155102 - protein, 25 aa, Giardia lamblia
GAKDWKRYKDAFIFLDRSSNLRQAK

SEQ ID NO: 3155103 - protein, 18 aa, Giardia lamblia
GAKPRFVPYEQYEDVAAQ

SEQ ID NO: 3155104 - protein, 24 aa, Giardia lamblia
GAKYKTEFCNCFAEFGRCDYGDRC

SEQ ID NO: 3155105 - protein, 22 aa, Giardia lamblia
GALDILLPLGPYVDEFQRRTVK

SEQ ID NO: 3155106 - protein, 23 aa, Giardia lamblia
GALEYPQFLAAASLCCLNYSILQ

SEQ ID NO: 3155107 - protein, 20 aa, Giardia lamblia
GALISRIHSVSFFLLGADML

SEQ ID NO: 3155108 - protein, 17 aa, Giardia lamblia
GALKALRKEHAKEHEAL

SEQ ID NO: 3155109 - protein, 24 aa, Giardia lamblia
GALLNRYLTGGFFFNADLAPKAQQ

SEQ ID NO: 3155110 - protein, 17 aa, Giardia lamblia
GALRCVFTAVDGARLFL

SEQ ID NO: 3155111 - protein, 18 aa, Giardia lamblia
GALSLGVRCSSVGNQHVH

SEQ ID NO: 3155112 - protein, 19 aa, Giardia lamblia
GALVLADKGIVCIDELDKM

SEQ ID NO: 3155113 - protein, 29 aa, Giardia lamblia
GALVYDIFLVFSHYKYVSALFKLSLDILP

SEQ ID NO: 3155114 - protein, 17 aa, Giardia lamblia
GAMASLRGRLCTESDAT

SEQ ID NO: 3155115 - protein, 25 aa, Giardia lamblia
GAMDAICILAPGWPVRRTTEGIAAI

SEQ ID NO: 3155116 - protein, 25 aa, Giardia lamblia
GAMFRFRLDCTDFFGSNLVLFHPIV

SEQ ID NO: 3155117 - protein, 26 aa, Giardia lamblia
GAMIAWCGACMLQAPLSMDLLIPYTE

SEQ ID NO: 3155118 - protein, 18 aa, Giardia lamblia
GAMLRHIAENEIAAYGKA

SEQ ID NO: 3155119 - protein, 23 aa, Giardia lamblia
GAMQSRAGFKHTTKVQAYQERAR

SEQ ID NO: 3155120 - protein, 19 aa, Giardia lamblia
GAMSIAHGLSCSRSLTTLA

SEQ ID NO: 3155121 - protein, 18 aa, Giardia lamblia
GANISLLYIQRLVLQCPE

SEQ ID NO: 3155122 - protein, 17 aa, Giardia lamblia
GANLLFYGAPFYSRVYL

SEQ ID NO: 3155123 - protein, 31 aa, Giardia lamblia
GANPKDFPCIFFLHNCCDKGDKCKYSHNNDT

SEQ ID NO: 3155124 - protein, 27 aa, Giardia lamblia
GANRTFCSLPHIIKAGLGRVGVVYLVC

SEQ ID NO: 3155125 - protein, 20 aa, Giardia lamblia
GANVALKLAIAVTILSDGLD

SEQ ID NO: 3155126 - protein, 20 aa, Giardia lamblia
GAPAPVEWCRVQALSDSGYR

SEQ ID NO: 3155127 - protein, 18 aa, Giardia lamblia
GAPELQRSSLQTPRQRRI

SEQ ID NO: 3155128 - protein, 24 aa, Giardia lamblia
GAPGCGKSAVARAVAHHCGCTFIR

SEQ ID NO: 3155129 - protein, 17 aa, Giardia lamblia
GAPKELSEIYALRDQAY

SEQ ID NO: 3155130 - protein, 26 aa, Giardia lamblia
GAPQDARKAFNMLAFKRVGKLKVPMF

SEQ ID NO: 3155131 - protein, 28 aa, Giardia lamblia
GAPTPRYGCSMVPTADGIQIFGGYSTHY

SEQ ID NO: 3155132 - protein, 17 aa, Giardia lamblia
GAPVADVEPVFVVYPYR

SEQ ID NO: 3155133 - protein, 18 aa, Giardia lamblia
GAPVTAPRAYAIQSGESD

SEQ ID NO: 3155134 - protein, 24 aa, Giardia lamblia
GAQMFNYFVCILLTNSYSIEDKTG

SEQ ID NO: 3155135 - protein, 18 aa, Giardia lamblia
GAQPGQFVARNMTRSIVR

SEQ ID NO: 3155136 - protein, 25 aa, Giardia lamblia
GARDFRIGSVVSIYGRPVYIYDCDN

SEQ ID NO: 3155137 - protein, 22 aa, Giardia lamblia
GARGALDVPDYLSLSTQCKTHL

SEQ ID NO: 3155138 - protein, 27 aa, Giardia lamblia
GARLGSKGELIFSGFQAIEIPLSTSLL

SEQ ID NO: 3155139 - protein, 17 aa, Giardia lamblia
GARNVRHIVHICFSEEI

SEQ ID NO: 3155140 - protein, 23 aa, Giardia lamblia
GARPFHTMDIWSLGATLFELCMR

SEQ ID NO: 3155141 - protein, 25 aa, Giardia lamblia
GARPLRRFIEREITTAVARKLIEVP

SEQ ID NO: 3155142 - protein, 17 aa, Giardia lamblia
GASCLKPQRDARYGYGG

SEQ ID NO: 3155143 - protein, 26 aa, Giardia lamblia
GASDPGLRSTLFAGVLYPDSLSFASH

SEQ ID NO: 3155144 - protein, 34 aa, Giardia lamblia
GASEAYGYFAREFLRKRLAGHRIHLEITKELQAS

SEQ ID NO: 3155145 - protein, 25 aa, Giardia lamblia
GASERRSSCLQRHPINPLAKEFDYR

SEQ ID NO: 3155146 - protein, 23 aa, Giardia lamblia
GASGRLRFSDMLSQMEASCSPKV

SEQ ID NO: 3155147 - protein, 23 aa, Giardia lamblia
GASIPSDEAIVFSTDNPITIGDS

SEQ ID NO: 3155148 - protein, 24 aa, Giardia lamblia
GASNSRLLFTLARADIVLNQKHPS

SEQ ID NO: 3155149 - protein, 24 aa, Giardia lamblia
GASSAARLLVPIQLQCRDKYGNTA

SEQ ID NO: 3155150 - protein, 21 aa, Giardia lamblia
GASTLNFTFNYIFHSASQEEI

SEQ ID NO: 3155151 - protein, 20 aa, Giardia lamblia
GATGVYRAGLSNIFRQGIQA

SEQ ID NO: 3155152 - protein, 20 aa, Giardia lamblia
GATIESCYKKLYAKTKAMTT

SEQ ID NO: 3155153 - protein, 25 aa, Giardia lamblia
GATIRLGRVSAFIEKPCFVAVESQQ

SEQ ID NO: 3155154 - protein, 18 aa, Giardia lamblia
GATSCLRTKAAPELSAII

SEQ ID NO: 3155155 - protein, 29 aa, Giardia lamblia
GATSICGTIWWRAPEQSFRKNVNCSGFIG

SEQ ID NO: 3155156 - protein, 17 aa, Giardia lamblia
GATSLLRSALSDETLHN

SEQ ID NO: 3155157 - protein, 24 aa, Giardia lamblia
GATYKDLLCLLNEKMKRVDQLNAD

SEQ ID NO: 3155158 - protein, 18 aa, Giardia lamblia
GAVAPPMSFEENIALLQS

SEQ ID NO: 3155159 - protein, 18 aa, Giardia lamblia
GAVEAARLLAPSEAQLVD

SEQ ID NO: 3155160 - protein, 24 aa, Giardia lamblia
GAVECVRLLASKEICIVNSAGHTA

SEQ ID NO: 3155161 - protein, 24 aa, Giardia lamblia
GAVLCGVSPFLAVEGGVGFHYFAH

SEQ ID NO: 3155162 - protein, 19 aa, Giardia lamblia
GAVPLHIVLAPVVGSRPPV

SEQ ID NO: 3155163 - protein, 18 aa, Giardia lamblia
GAYGIAWLAKDTETGASV

SEQ ID NO: 3155164 - protein, 18 aa, Giardia lamblia
GAYIYGLYMEGARWDKKG

SEQ ID NO: 3155165 - protein, 20 aa, Giardia lamblia
GAYLPMLVHGGIKPANILVD

SEQ ID NO: 3155166 - protein, 25 aa, Giardia lamblia
GCAIYEVCKGYQLFYNEAISDIIRA

SEQ ID NO: 3155167 - protein, 21 aa, Giardia lamblia
GCALTNGYTALMFACERDNKG

SEQ ID NO: 3155168 - protein, 25 aa, Giardia lamblia
GCCYDPVLVIMVFRLVQALRLASLG

SEQ ID NO: 3155169 - protein, 19 aa, Giardia lamblia
GCDCQQCGGTGIVPTVLNQ

SEQ ID NO: 3155170 - protein, 19 aa, Giardia lamblia
GCETPLRTCLQVGDHGSTL

SEQ ID NO: 3155171 - protein, 19 aa, Giardia lamblia
GCFWGLQALMDSFKGICTT

SEQ ID NO: 3155172 - protein, 22 aa, Giardia lamblia
GCFWMGSSLSAAITNLGDVLIF

SEQ ID NO: 3155173 - protein, 22 aa, Giardia lamblia
GCGNSELVRLMIGKEAGMKDAM

SEQ ID NO: 3155174 - protein, 17 aa, Giardia lamblia
GCIKLPQYYPLQDSSIK

SEQ ID NO: 3155175 - protein, 17 aa, Giardia lamblia
GCILESWLRNIDPKVAS

SEQ ID NO: 3155176 - protein, 21 aa, Giardia lamblia
GCILYEALAARRCFSAETGAI

SEQ ID NO: 3155177 - protein, 19 aa, Giardia lamblia
GCINCAKLTTENARLKHQI

SEQ ID NO: 3155178 - protein, 19 aa, Giardia lamblia
GCIPRIMEHRNFVPGVARL

SEQ ID NO: 3155179 - protein, 19 aa, Giardia lamblia
GCIYISCLTGSYVQSLQHV

SEQ ID NO: 3155180 - protein, 21 aa, Giardia lamblia
GCKGGWRQTRTFRVEEKTRVN

SEQ ID NO: 3155181 - protein, 24 aa, Giardia lamblia
GCKISSRLRPPCEGCGGRRGRQPS

SEQ ID NO: 3155182 - protein, 25 aa, Giardia lamblia
GCLIWKHDLAFSAMRSRCNTLMTSS

SEQ ID NO: 3155183 - protein, 21 aa, Giardia lamblia
GCLLYLFTYHASYMIHGTEFQ

SEQ ID NO: 3155184 - protein, 34 aa, Giardia lamblia
GCMGSCTYCKTCHSRGRLRSVPLDTLLARIRSSL

SEQ ID NO: 3155185 - protein, 22 aa, Giardia lamblia
GCNGCRFLISAIGICIEHEQTD

SEQ ID NO: 3155186 - protein, 18 aa, Giardia lamblia
GCNIGLKLIINGTELKIA

SEQ ID NO: 3155187 - protein, 17 aa, Giardia lamblia
GCPSLHLLYDTAVLGPR

SEQ ID NO: 3155188 - protein, 33 aa, Giardia lamblia
GCQNFKTGLFGSFAELCRFIFRATRRHPVVLID

SEQ ID NO: 3155189 - protein, 17 aa, Giardia lamblia
GCRIIYCNCKSNSYSEA

SEQ ID NO: 3155190 - protein, 35 aa, Giardia lamblia
GCSVYKFYKVCTHGAEFLYEHHLRNILSTRCGIML

SEQ ID NO: 3155191 - protein, 21 aa, Giardia lamblia
GCTAIRDRLSYCLSSPSVSHF

SEQ ID NO: 3155192 - protein, 20 aa, Giardia lamblia
GCTALMFAAERGHLQIVKGL

SEQ ID NO: 3155193 - protein, 20 aa, Giardia lamblia
GCTALSCAARAGHRDVAMLL

SEQ ID NO: 3155194 - protein, 20 aa, Giardia lamblia
GCTDITWMTALMRAAQRGHQ

SEQ ID NO: 3155195 - protein, 18 aa, Giardia lamblia
GCVDCIPLLSNELTIKDN

SEQ ID NO: 3155196 - protein, 18 aa, Giardia lamblia
GDAAILCIGFRPVTEMIL

SEQ ID NO: 3155197 - protein, 17 aa, Giardia lamblia
GDAELLFSAIAGDLKLT

SEQ ID NO: 3155198 - protein, 20 aa, Giardia lamblia
GDAFTKLMTILSFTFSADIC

SEQ ID NO: 3155199 - protein, 20 aa, Giardia lamblia
GDAKSLLLRDTFLVTKGSGD

SEQ ID NO: 3155200 - protein, 19 aa, Giardia lamblia
GDAVSFWRIGISGLPDSVL

SEQ ID NO: 3155201 - protein, 24 aa, Giardia lamblia
GDAYKGALATRLLGKQVIIPPGTS

SEQ ID NO: 3155202 - protein, 25 aa, Giardia lamblia
GDAYQRAGLYVARRVSDSSILERFV

SEQ ID NO: 3155203 - protein, 18 aa, Giardia lamblia
GDCNTIIDALHTHATPPR

SEQ ID NO: 3155204 - protein, 20 aa, Giardia lamblia
GDCSLAHLIHTARRQQTSFE

SEQ ID NO: 3155205 - protein, 26 aa, Giardia lamblia
GDDKMLFLWRVRDWEPMLTLRRHRHP

SEQ ID NO: 3155206 - protein, 24 aa, Giardia lamblia
GDDSIRPSIDLTRTPLHRPPSGAA

SEQ ID NO: 3155207 - protein, 27 aa, Giardia lamblia
GDEKRMRRITGMMVDKCLAAKYAYKTY

SEQ ID NO: 3155208 - protein, 27 aa, Giardia lamblia
GDEKRMRRITGMMVDKCLGAKHAYKIY

SEQ ID NO: 3155209 - protein, 18 aa, Giardia lamblia
GDEMLRLRQDAVGGSTKT

SEQ ID NO: 3155210 - protein, 20 aa, Giardia lamblia
GDERLSFKLIARARMNFAEE

SEQ ID NO: 3155211 - protein, 26 aa, Giardia lamblia
GDESHGGQTFCCVATMHLLDSLHLIP

SEQ ID NO: 3155212 - protein, 20 aa, Giardia lamblia
GDETFLKDNIDTFAQQQDKQ

SEQ ID NO: 3155213 - protein, 18 aa, Giardia lamblia
GDEYPKYIIAALLLEGFN

SEQ ID NO: 3155214 - protein, 21 aa, Giardia lamblia
GDFGGSVTMELADGAIVYHAF

SEQ ID NO: 3155215 - protein, 22 aa, Giardia lamblia
GDFGTGCFDLLLNCAELPSINE

SEQ ID NO: 3155216 - protein, 21 aa, Giardia lamblia
GDGTRALTCGGIIDINVVHPL

SEQ ID NO: 3155217 - protein, 18 aa, Giardia lamblia
GDGYELTSSISLQDAYPN

SEQ ID NO: 3155218 - protein, 20 aa, Giardia lamblia
GDHIECVELLLGERQLMTVY

SEQ ID NO: 3155219 - protein, 19 aa, Giardia lamblia
GDIAETFARGAPDTKSMKA

SEQ ID NO: 3155220 - protein, 23 aa, Giardia lamblia
GDIARSGRKFVVARKEEATPADL

SEQ ID NO: 3155221 - protein, 17 aa, Giardia lamblia
GDIGALGGRILLEKPIS

SEQ ID NO: 3155222 - protein, 18 aa, Giardia lamblia
GDIQRRLHSQFSSQSRKH

SEQ ID NO: 3155223 - protein, 26 aa, Giardia lamblia
GDIRNACRLGMDWIALSFVQTKADVI

SEQ ID NO: 3155224 - protein, 20 aa, Giardia lamblia
GDITNCFATAAGRHTSQAKV

SEQ ID NO: 3155225 - protein, 21 aa, Giardia lamblia
GDIVKVWSLLPYQKRMTDATG

SEQ ID NO: 3155226 - protein, 17 aa, Giardia lamblia
GDKIYKYLALKRQLERL

SEQ ID NO: 3155227 - protein, 25 aa, Giardia lamblia
GDKLCSDAKIALVAAAMNKHSKIID

SEQ ID NO: 3155228 - protein, 19 aa, Giardia lamblia
GDKLIPVAEGGWLMDACFS

SEQ ID NO: 3155229 - protein, 21 aa, Giardia lamblia
GDKRMQCLYPEIVQANKDLHS

SEQ ID NO: 3155230 - protein, 22 aa, Giardia lamblia
GDKRPKPIILRLSPETAQEIGA

SEQ ID NO: 3155231 - protein, 18 aa, Giardia lamblia
GDLAAVKILVDYENSLLN

SEQ ID NO: 3155232 - protein, 24 aa, Giardia lamblia
GDLAPPVVHHILLNSGLLRSYSAI

SEQ ID NO: 3155233 - protein, 22 aa, Giardia lamblia
GDLARMEWIFAKAIFPLQKYSF

SEQ ID NO: 3155234 - protein, 17 aa, Giardia lamblia
GDLDLGVRLSLAQRRYY

SEQ ID NO: 3155235 - protein, 32 aa, Giardia lamblia
GDLEMIRVLIASWPSSCMEDLLAANDVVDLGP

SEQ ID NO: 3155236 - protein, 20 aa, Giardia lamblia
GDLLKSSLFSKIKDTKIALD

SEQ ID NO: 3155237 - protein, 22 aa, Giardia lamblia
GDLMLLHHEFVLLSKEGKSCLH

SEQ ID NO: 3155238 - protein, 20 aa, Giardia lamblia
GDLPALVSLLRYTEVTMNDM

SEQ ID NO: 3155239 - protein, 37 aa, Giardia lamblia
GDLQPRVSLPPCIQADALFRRSRHRSDGIEICFTDDV

SEQ ID NO: 3155240 - protein, 17 aa, Giardia lamblia
GDLRYPRKAYYYKKQAD

SEQ ID NO: 3155241 - protein, 27 aa, Giardia lamblia
GDMHILEGFKGCSHLAQHWGISVIHAL

SEQ ID NO: 3155242 - protein, 21 aa, Giardia lamblia
GDMRIAAVLVKYEAGLTNAVR

SEQ ID NO: 3155243 - protein, 19 aa, Giardia lamblia
GDNIKRSLVSRSCSTSKHV

SEQ ID NO: 3155244 - protein, 24 aa, Giardia lamblia
GDNKPRVGVARVIANRAALKADLT

SEQ ID NO: 3155245 - protein, 23 aa, Giardia lamblia
GDNQGRTALMYAVAAKSYECAKV

SEQ ID NO: 3155246 - protein, 25 aa, Giardia lamblia
GDNQLAGAMVLDFSHFPSTLQFLSL

SEQ ID NO: 3155247 - protein, 18 aa, Giardia lamblia
GDNSIYCISFCLCPQYPL

SEQ ID NO: 3155248 - protein, 19 aa, Giardia lamblia
GDPFSASPLCLSVRGRAVQ

SEQ ID NO: 3155249 - protein, 24 aa, Giardia lamblia
GDPIRCSFCPELFASTTKAAAHER

SEQ ID NO: 3155250 - protein, 25 aa, Giardia lamblia
GDPPSKRYGAMMGFLDTSIIVAGGS

SEQ ID NO: 3155251 - protein, 25 aa, Giardia lamblia
GDPTRLGLTPVPFSAVPNGTQKFSK

SEQ ID NO: 3155252 - protein, 32 aa, Giardia lamblia
GDQCCVKVLSSFYFRSHLCIAFELLSINLYEL

SEQ ID NO: 3155253 - protein, 38 aa, Giardia lamblia
GDQKSALYYAIEFNKPECVKLLLPHLFTDTYRGLRPLA

SEQ ID NO: 3155254 - protein, 24 aa, Giardia lamblia
GDRDPAEVFVDGWRPDLSGIADDL

SEQ ID NO: 3155255 - protein, 22 aa, Giardia lamblia
GDRPRTLHLYKFSSPVDSKTRS

SEQ ID NO: 3155256 - protein, 17 aa, Giardia lamblia
GDRRGEVAFVGPVPSLG

SEQ ID NO: 3155257 - protein, 26 aa, Giardia lamblia
GDSAHVWKYLNYQAGLQDEEGKTALM

SEQ ID NO: 3155258 - protein, 23 aa, Giardia lamblia
GDSEHLPECILRRIDSIVSSLIL

SEQ ID NO: 3155259 - protein, 18 aa, Giardia lamblia
GDSIKSPARHSAPTHQEP

SEQ ID NO: 3155260 - protein, 26 aa, Giardia lamblia
GDSIPNYSSMRLTEGMINHIVDSFIV

SEQ ID NO: 3155261 - protein, 19 aa, Giardia lamblia
GDSLLKSSIVTNVLDTSSS

SEQ ID NO: 3155262 - protein, 30 aa, Giardia lamblia
GDSMLQRFARRCLYGLVKRKIGVNFKLMIS

SEQ ID NO: 3155263 - protein, 38 aa, Giardia lamblia
GDSRSVVLLAGYLVHRFHWPPHRALQFITTKRFSSKPH

SEQ ID NO: 3155264 - protein, 24 aa, Giardia lamblia
GDSTMVQMLLKFGVNPLVRDNNGY

SEQ ID NO: 3155265 - protein, 18 aa, Giardia lamblia
GDSTVKWFSLPLSAETTP

SEQ ID NO: 3155266 - protein, 20 aa, Giardia lamblia
GDTALILALRSEHFETAELL

SEQ ID NO: 3155267 - protein, 18 aa, Giardia lamblia
GDTALIWAVKNGKIKYQP

SEQ ID NO: 3155268 - protein, 21 aa, Giardia lamblia
GDTALLLAMRARERSCVKLLE

SEQ ID NO: 3155269 - protein, 24 aa, Giardia lamblia
GDTIPELTFRATDWLFAHLPACAG

SEQ ID NO: 3155270 - protein, 18 aa, Giardia lamblia
GDTNIQRIVWYHVAPENR

SEQ ID NO: 3155271 - protein, 24 aa, Giardia lamblia
GDTSLRIASRRGLFSIVRLLLSEL

SEQ ID NO: 3155272 - protein, 18 aa, Giardia lamblia
GDTVEIRPGYTIMNEKTG

SEQ ID NO: 3155273 - protein, 19 aa, Giardia lamblia
GDTYDIVWSDFSGIPLSKV

SEQ ID NO: 3155274 - protein, 26 aa, Giardia lamblia
GDTYIEWLRLLVIKYLVYGTNISSVV

SEQ ID NO: 3155275 - protein, 22 aa, Giardia lamblia
GDVDPFIKVPRPDNKVEALGLV

SEQ ID NO: 3155276 - protein, 30 aa, Giardia lamblia
GDVGSLVRLKGFRILRSVLRKNGCVTAFLS

SEQ ID NO: 3155277 - protein, 22 aa, Giardia lamblia
GDVHLDRCCEQLDSFLIDIYGR

SEQ ID NO: 3155278 - protein, 18 aa, Giardia lamblia
GDVIPVYIFNGPIYYQKL

SEQ ID NO: 3155279 - protein, 19 aa, Giardia lamblia
GDVLIPVPFQLADQPPGSI

SEQ ID NO: 3155280 - protein, 20 aa, Giardia lamblia
GDVNLRLPFVTMARPADAEV

SEQ ID NO: 3155281 - protein, 20 aa, Giardia lamblia
GDVRSVAALVEYEHGQKDSR

SEQ ID NO: 3155282 - protein, 19 aa, Giardia lamblia
GDVSRLIRVSSLFFDSCNK

SEQ ID NO: 3155283 - protein, 20 aa, Giardia lamblia
GDVTMVRLLAPYEAGVQNAQ

SEQ ID NO: 3155284 - protein, 29 aa, Giardia lamblia
GDVWCLGRIAFELCCVGFPGFVGSGCPTP

SEQ ID NO: 3155285 - protein, 21 aa, Giardia lamblia
GDWGTQFGMLITHLTDMHPEI

SEQ ID NO: 3155286 - protein, 26 aa, Giardia lamblia
GDYIRRLEMQNACFQEALFHASRYTS

SEQ ID NO: 3155287 - protein, 24 aa, Giardia lamblia
GDYLQKQVHLFQSMKLFFQNKPTV

SEQ ID NO: 3155288 - protein, 30 aa, Giardia lamblia
GDYQVSMTPLWPRIHGGTIGMRPVSSPATG

SEQ ID NO: 3155289 - protein, 21 aa, Giardia lamblia
GEADLAWAIVNGHKEIMRVLS

SEQ ID NO: 3155290 - protein, 18 aa, Giardia lamblia
GEAGLRTSEGHPNKEGLT

SEQ ID NO: 3155291 - protein, 25 aa, Giardia lamblia
GEAIRLDFLPGSDLCLDHLDTSTNP

SEQ ID NO: 3155292 - protein, 17 aa, Giardia lamblia
GEAKEDFCRVVAYCCEK

SEQ ID NO: 3155293 - protein, 21 aa, Giardia lamblia
GEAVLCVRALYTIARACAPSV

SEQ ID NO: 3155294 - protein, 24 aa, Giardia lamblia
GECAPEKCSGCPARGACSSRGADN

SEQ ID NO: 3155295 - protein, 21 aa, Giardia lamblia
GECRIHPASCLKQNPNFVLYN

SEQ ID NO: 3155296 - protein, 17 aa, Giardia lamblia
GEDAFDYLVSNKIIDQA

SEQ ID NO: 3155297 - protein, 26 aa, Giardia lamblia
GEDAVRRKAPAYTLAGRTAAHRPEDT

SEQ ID NO: 3155298 - protein, 22 aa, Giardia lamblia
GEDELRDAALLVFANKQDLPKA

SEQ ID NO: 3155299 - protein, 20 aa, Giardia lamblia
GEDIIPVLMELERANMQGKS

SEQ ID NO: 3155300 - protein, 19 aa, Giardia lamblia
GEDRRYFVQIGMRRINAFV

SEQ ID NO: 3155301 - protein, 19 aa, Giardia lamblia
GEEGIRMVGPDGSVAASGQ

SEQ ID NO: 3155302 - protein, 30 aa, Giardia lamblia
GEELLKMSLRLRKYHFWVTVRRRDKLVREN

SEQ ID NO: 3155303 - protein, 24 aa, Giardia lamblia
GEERVIDLLIDYECGMQTPEGITA

SEQ ID NO: 3155304 - protein, 23 aa, Giardia lamblia
GEESRAANYIATIREQYHTQIDN

SEQ ID NO: 3155305 - protein, 23 aa, Giardia lamblia
GEFSFFACSMIIVAVGFGPNNII

SEQ ID NO: 3155306 - protein, 25 aa, Giardia lamblia
GEFYTCLEPRPGKGVKKVIPDDPAS

SEQ ID NO: 3155307 - protein, 33 aa, Giardia lamblia
GEGFTALMEAARWGRHDIVKLLLPHEGDMRDSS

SEQ ID NO: 3155308 - protein, 25 aa, Giardia lamblia
GEGHAPWTQMAMNIGGAMPYSLVPP

SEQ ID NO: 3155309 - protein, 20 aa, Giardia lamblia
GEGKTAIMIAAEANKGDVCK

SEQ ID NO: 3155310 - protein, 25 aa, Giardia lamblia
GEGLDFKVPMSDLIVSGDHTSSAAS

SEQ ID NO: 3155311 - protein, 17 aa, Giardia lamblia
GEGLRRGYQPDQTYIKN

SEQ ID NO: 3155312 - protein, 18 aa, Giardia lamblia
GEGPWFLHKCPPLPQMAG

SEQ ID NO: 3155313 - protein, 22 aa, Giardia lamblia
GEGSFGECFLCCDKRTGLHVVI

SEQ ID NO: 3155314 - protein, 18 aa, Giardia lamblia
GEHARIMAEMDALKEDLR

SEQ ID NO: 3155315 - protein, 22 aa, Giardia lamblia
GEHARTFRGWIIALRKDGEQKS

SEQ ID NO: 3155316 - protein, 19 aa, Giardia lamblia
GEHKIMSFVRIQRSQPGYD

SEQ ID NO: 3155317 - protein, 25 aa, Giardia lamblia
GEICTPEIIANVSVCIKKAASDENA

SEQ ID NO: 3155318 - protein, 26 aa, Giardia lamblia
GEICVSCAGGFRVTFTHTIKRVDAGT

SEQ ID NO: 3155319 - protein, 19 aa, Giardia lamblia
GEIMSALGVTNVADVIPAI

SEQ ID NO: 3155320 - protein, 17 aa, Giardia lamblia
GEIPEEFNMTDATDILR

SEQ ID NO: 3155321 - protein, 22 aa, Giardia lamblia
GEIPKCEVFTVLSLSDPGTPRW

SEQ ID NO: 3155322 - protein, 22 aa, Giardia lamblia
GEIPRPRGITLYTEESLDGSEE

SEQ ID NO: 3155323 - protein, 23 aa, Giardia lamblia
GEKASHTKTTFTLEDVDKTDPNY

SEQ ID NO: 3155324 - protein, 17 aa, Giardia lamblia
GEKSISITECPRCGVQP

SEQ ID NO: 3155325 - protein, 24 aa, Giardia lamblia
GEKVEIQLTFAPRLDLNRIERVCR

SEQ ID NO: 3155326 - protein, 18 aa, Giardia lamblia
GEKVPSCILKRERDLQAQ

SEQ ID NO: 3155327 - protein, 24 aa, Giardia lamblia
GEKYYWRIGGNISDVLAHTRITIF

SEQ ID NO: 3155328 - protein, 17 aa, Giardia lamblia
GELDACIPYLVDECRIT

SEQ ID NO: 3155329 - protein, 25 aa, Giardia lamblia
GELENFPNFRLFQTIFLGHTNLAYS

SEQ ID NO: 3155330 - protein, 18 aa, Giardia lamblia
GELFGRMLNTARISNDPS

SEQ ID NO: 3155331 - protein, 17 aa, Giardia lamblia
GELHLEICLKDLREDFC

SEQ ID NO: 3155332 - protein, 20 aa, Giardia lamblia
GELHWAKLKDCVSKEDLVRI

SEQ ID NO: 3155333 - protein, 18 aa, Giardia lamblia
GELIKLVYLVLLRDQEVC

SEQ ID NO: 3155334 - protein, 17 aa, Giardia lamblia
GELPSDMIDRLFKPPQR

SEQ ID NO: 3155335 - protein, 20 aa, Giardia lamblia
GELRERLTFSIYRNVSAQTR

SEQ ID NO: 3155336 - protein, 19 aa, Giardia lamblia
GELRIAMVCLSKAADGGLY

SEQ ID NO: 3155337 - protein, 26 aa, Giardia lamblia
GELRLIDRKGCIFKLSQGEFICTTTI

SEQ ID NO: 3155338 - protein, 25 aa, Giardia lamblia
GELRQSKSFFSYVLKSIIRQFKGED

SEQ ID NO: 3155339 - protein, 23 aa, Giardia lamblia
GELTLLKSSICQFDNKVQGGSNA

SEQ ID NO: 3155340 - protein, 18 aa, Giardia lamblia
GELVCKSLQISSGTDSIY

SEQ ID NO: 3155341 - protein, 21 aa, Giardia lamblia
GELVKRLDAAREEYLNMQRMN

SEQ ID NO: 3155342 - protein, 24 aa, Giardia lamblia
GELYPIKSGIGFEFLYPDYSIDDI

SEQ ID NO: 3155343 - protein, 26 aa, Giardia lamblia
GEMRLLKLISGLTMVIYRLVYFQEEI

SEQ ID NO: 3155344 - protein, 25 aa, Giardia lamblia
GEMSILRPPPLVAELTASRREGKLL

SEQ ID NO: 3155345 - protein, 23 aa, Giardia lamblia
GENCKYLWQDGRVYKKPTPVTAP

SEQ ID NO: 3155346 - protein, 20 aa, Giardia lamblia
GENISSLSLYTPIGDVTGTE

SEQ ID NO: 3155347 - protein, 23 aa, Giardia lamblia
GENPWLKLVRLAENTSFKGAPEL

SEQ ID NO: 3155348 - protein, 22 aa, Giardia lamblia
GEPKVACNHLFELVHGDVRIDL

SEQ ID NO: 3155349 - protein, 25 aa, Giardia lamblia
GEPRKFSDLCTGLSMTCGQLIHLLN

SEQ ID NO: 3155350 - protein, 33 aa, Giardia lamblia
GEQHVTASLCMHCNRMGKTKLLFVDIPKFQQCI

SEQ ID NO: 3155351 - protein, 25 aa, Giardia lamblia
GEQQLRLISAVKMSPHKGGISKEIL

SEQ ID NO: 3155352 - protein, 22 aa, Giardia lamblia
GERISFPKAVNFLFEANDLSQA

SEQ ID NO: 3155353 - protein, 25 aa, Giardia lamblia
GERKRARSRSGLSIPSKCQRACSNT

SEQ ID NO: 3155354 - protein, 25 aa, Giardia lamblia
GERVLSFFKNNVCDLHTVLDNAIEG

SEQ ID NO: 3155355 - protein, 24 aa, Giardia lamblia
GESHREIDAWFTLSIPDNPRDVWK

SEQ ID NO: 3155356 - protein, 19 aa, Giardia lamblia
GESMLHYVGLPLVDGSSEE

SEQ ID NO: 3155357 - protein, 34 aa, Giardia lamblia
GESTFISLCFMVSCWLVIKTRYAQIDEWDVFMDA

SEQ ID NO: 3155358 - protein, 25 aa, Giardia lamblia
GESTRRPKWFVAINEKAQRVLNRGK

SEQ ID NO: 3155359 - protein, 18 aa, Giardia lamblia
GESTYLIDYIPPAKGGIA

SEQ ID NO: 3155360 - protein, 25 aa, Giardia lamblia
GESVNNCLDLVSGVPLDLQDIELPD

SEQ ID NO: 3155361 - protein, 17 aa, Giardia lamblia
GETALAIALAKGNLAAA

SEQ ID NO: 3155362 - protein, 34 aa, Giardia lamblia
GETALCGLRGLFNMHIFEEIFLYILNTSMNKELN

SEQ ID NO: 3155363 - protein, 21 aa, Giardia lamblia
GETALLIAIRAGHLNAIQLLA

SEQ ID NO: 3155364 - protein, 17 aa, Giardia lamblia
GETALLLGMQAQSMRAV

SEQ ID NO: 3155365 - protein, 19 aa, Giardia lamblia
GETALLWAAFFNNSDLCRL

SEQ ID NO: 3155366 - protein, 19 aa, Giardia lamblia
GETALMFAAANGYDACVKL

SEQ ID NO: 3155367 - protein, 21 aa, Giardia lamblia
GETALMIASKIDFADGAKHLH

SEQ ID NO: 3155368 - protein, 22 aa, Giardia lamblia
GETALMIAVDLSFMDAVRVLVD

SEQ ID NO: 3155369 - protein, 20 aa, Giardia lamblia
GETALMIAVRTGYHEGVNLL

SEQ ID NO: 3155370 - protein, 17 aa, Giardia lamblia
GETALMLAIPTRNEEII

SEQ ID NO: 3155371 - protein, 17 aa, Giardia lamblia
GETALSLALKEEHYQAA

SEQ ID NO: 3155372 - protein, 21 aa, Giardia lamblia
GETALSMAIEQAFEPAVQILL

SEQ ID NO: 3155373 - protein, 21 aa, Giardia lamblia
GETDSVLSICVDEQNLRKQGP

SEQ ID NO: 3155374 - protein, 32 aa, Giardia lamblia
GETGLMKAVRLRYPVLIKLLAPYEAGMTNNRG

SEQ ID NO: 3155375 - protein, 22 aa, Giardia lamblia
GETGLMLACRINDLEMIRLLAP

SEQ ID NO: 3155376 - protein, 18 aa, Giardia lamblia
GETPIRLMRECAARASPS

SEQ ID NO: 3155377 - protein, 27 aa, Giardia lamblia
GEVDGCGRTALMYAAEYGHLECVKSLL

SEQ ID NO: 3155378 - protein, 17 aa, Giardia lamblia
GEVPKLLLSSSYLAKTE

SEQ ID NO: 3155379 - protein, 23 aa, Giardia lamblia
GEVPTPVRILRFMSPFYPDLTQK

SEQ ID NO: 3155380 - protein, 23 aa, Giardia lamblia
GEVSINPHVRSWVTLDLPPISQE

SEQ ID NO: 3155381 - protein, 25 aa, Giardia lamblia
GEVTVKFADFGICRTIGDGIMATTN

SEQ ID NO: 3155382 - protein, 25 aa, Giardia lamblia
GEWFFFCLNGPVDAVWIENLNTVLD

SEQ ID NO: 3155383 - protein, 21 aa, Giardia lamblia
GEWMARLKALWKKYQAFHDDI

SEQ ID NO: 3155384 - protein, 25 aa, Giardia lamblia
GEYPKDMQATLGDRLYLAAQLTDYC

SEQ ID NO: 3155385 - protein, 19 aa, Giardia lamblia
GFACPDLIGKYVLPTDVEL

SEQ ID NO: 3155386 - protein, 26 aa, Giardia lamblia
GFAEAVPLLIEKEAKMTIDVTFKCMS

SEQ ID NO: 3155387 - protein, 24 aa, Giardia lamblia
GFAKAYQLLCSMIGIQATCVRGDY

SEQ ID NO: 3155388 - protein, 20 aa, Giardia lamblia
GFALKIPFIKYITARNFQAS

SEQ ID NO: 3155389 - protein, 17 aa, Giardia lamblia
GFCLPKACIFEITTLTN

SEQ ID NO: 3155390 - protein, 21 aa, Giardia lamblia
GFCPQPASPAHVITLSRSTIK

SEQ ID NO: 3155391 - protein, 22 aa, Giardia lamblia
GFEVVPRSEFLGFSAKYMNMVF

SEQ ID NO: 3155392 - protein, 19 aa, Giardia lamblia
GFFALLWAIVCNNPPCVSF

SEQ ID NO: 3155393 - protein, 24 aa, Giardia lamblia
GFFSNGWTALMWAVSCSQIECARL

SEQ ID NO: 3155394 - protein, 17 aa, Giardia lamblia
GFGRIGRMALRASLNID

SEQ ID NO: 3155395 - protein, 23 aa, Giardia lamblia
GFGVCFLYPIGIISCICYPSTVL

SEQ ID NO: 3155396 - protein, 24 aa, Giardia lamblia
GFIPRAADRLLFPRTHEDVLGFHT

SEQ ID NO: 3155397 - protein, 23 aa, Giardia lamblia
GFLEVLRIFADLKDDTMFPDMRG

SEQ ID NO: 3155398 - protein, 22 aa, Giardia lamblia
GFLQSPVLRRGYTLEYDASGTV

SEQ ID NO: 3155399 - protein, 22 aa, Giardia lamblia
GFLREVILGIFLNRDAPMELIE

SEQ ID NO: 3155400 - protein, 23 aa, Giardia lamblia
GFLRKADALAAMGKREEAVEVLR

SEQ ID NO: 3155401 - protein, 23 aa, Giardia lamblia
GFLSKSVEELLELTVDEYVSQSG

SEQ ID NO: 3155402 - protein, 23 aa, Giardia lamblia
GFLYHQRNLLMAVRAFQERGLKV

SEQ ID NO: 3155403 - protein, 18 aa, Giardia lamblia
GFLYIAMTYCEHGELTSL

SEQ ID NO: 3155404 - protein, 24 aa, Giardia lamblia
GFPVPSLPPPSVFQQLCGPRATLA

SEQ ID NO: 3155405 - protein, 17 aa, Giardia lamblia
GFRAIKLTPLQASYPEF

SEQ ID NO: 3155406 - protein, 17 aa, Giardia lamblia
GFSALLYAIEVDSLPCV

SEQ ID NO: 3155407 - protein, 18 aa, Giardia lamblia
GFSPRLEILYGTLKLTAS

SEQ ID NO: 3155408 - protein, 29 aa, Giardia lamblia
GFSYDEFLDLCILCGCDYANSLEGIGPKT

SEQ ID NO: 3155409 - protein, 18 aa, Giardia lamblia
GFTAIMFAAAGHNWDAVN

SEQ ID NO: 3155410 - protein, 17 aa, Giardia lamblia
GFTALGYAIRASSIDAA

SEQ ID NO: 3155411 - protein, 20 aa, Giardia lamblia
GFTALMCAARSGCIELVQRL

SEQ ID NO: 3155412 - protein, 21 aa, Giardia lamblia
GFTALMLAAERDYFKIIRILL

SEQ ID NO: 3155413 - protein, 18 aa, Giardia lamblia
GFTALMYALRAHAPELAE

SEQ ID NO: 3155414 - protein, 19 aa, Giardia lamblia
GFTKEIYKYYGSHSPIYQA

SEQ ID NO: 3155415 - protein, 18 aa, Giardia lamblia
GFTTDLFQGMIRSEYTQL

SEQ ID NO: 3155416 - protein, 22 aa, Giardia lamblia
GFVCPFCEAETPVIEATTGGVK

SEQ ID NO: 3155417 - protein, 18 aa, Giardia lamblia
GFVELVKLLIPYEAGKVA

SEQ ID NO: 3155418 - protein, 25 aa, Giardia lamblia
GFVEPLGVAALCFTEVATGETFKLF

SEQ ID NO: 3155419 - protein, 18 aa, Giardia lamblia
GFVSEMYRPEEIMKRVEG

SEQ ID NO: 3155420 - protein, 27 aa, Giardia lamblia
GFVSISLCIECKDSLMEQLLELMAAAE

SEQ ID NO: 3155421 - protein, 23 aa, Giardia lamblia
GGDPTKPILFFGRNYEEELAMQL

SEQ ID NO: 3155422 - protein, 19 aa, Giardia lamblia
GGEAADFDAIIAAKNSEIA

SEQ ID NO: 3155423 - protein, 20 aa, Giardia lamblia
GGEIKIKVVDVIFRTNEDTT

SEQ ID NO: 3155424 - protein, 26 aa, Giardia lamblia
GGELGRLASEIPRSSLSDVHYSEELY

SEQ ID NO: 3155425 - protein, 22 aa, Giardia lamblia
GGELQRVALILALGKPADVYLI

SEQ ID NO: 3155426 - protein, 19 aa, Giardia lamblia
GGFGDLVVTVPWRLERSYA

SEQ ID NO: 3155427 - protein, 19 aa, Giardia lamblia
GGFGGFPGMGGFGSSGDAP

SEQ ID NO: 3155428 - protein, 26 aa, Giardia lamblia
GGFIDYASIRLVKPGAYRERILKSQQ

SEQ ID NO: 3155429 - protein, 19 aa, Giardia lamblia
GGFKNCKLLAINLVPGHGL

SEQ ID NO: 3155430 - protein, 19 aa, Giardia lamblia
GGGAIHILSGLPGIGKTYS

SEQ ID NO: 3155431 - protein, 23 aa, Giardia lamblia
GGGLYMQIPVLDFLMHPSPITLL

SEQ ID NO: 3155432 - protein, 18 aa, Giardia lamblia
GGGMYPSSVNRPGIASGR

SEQ ID NO: 3155433 - protein, 25 aa, Giardia lamblia
GGGYTARSAAKCWTYETSLVCNQVL

SEQ ID NO: 3155434 - protein, 21 aa, Giardia lamblia
GGGYYDEFGNFLGTDIFCPHC

SEQ ID NO: 3155435 - protein, 23 aa, Giardia lamblia
GGHHECVRLLLLESDISGCTMLM

SEQ ID NO: 3155436 - protein, 23 aa, Giardia lamblia
GGHLKCVQLLVAEVPSLTVSDFE

SEQ ID NO: 3155437 - protein, 26 aa, Giardia lamblia
GGHVECVRALMLKEARMQDDEGRTAL

SEQ ID NO: 3155438 - protein, 21 aa, Giardia lamblia
GGHVGCCRLLYRELGMQDKRG

SEQ ID NO: 3155439 - protein, 24 aa, Giardia lamblia
GGHYECVRLLLIEAGYVDLENKTA

SEQ ID NO: 3155440 - protein, 17 aa, Giardia lamblia
GGIADTIVYSRRIHPDT

SEQ ID NO: 3155441 - protein, 18 aa, Giardia lamblia
GGIGNKFRISCGLPVGAV

SEQ ID NO: 3155442 - protein, 17 aa, Giardia lamblia
GGIKIGRIEDSTPIPTD

SEQ ID NO: 3155443 - protein, 18 aa, Giardia lamblia
GGIRAGAREKSLLQNLKV

SEQ ID NO: 3155444 - protein, 19 aa, Giardia lamblia
GGIVKIAIHRSFLTADKAG

SEQ ID NO: 3155445 - protein, 20 aa, Giardia lamblia
GGKEPFKLIHHVVIQTSQPT

SEQ ID NO: 3155446 - protein, 22 aa, Giardia lamblia
GGKGRATGSIILRGPNIHMVEE

SEQ ID NO: 3155447 - protein, 20 aa, Giardia lamblia
GGKNPKAICDYILTTNPDEW

SEQ ID NO: 3155448 - protein, 17 aa, Giardia lamblia
GGLEALMRLISLHTETP

SEQ ID NO: 3155449 - protein, 18 aa, Giardia lamblia
GGLGQPFGQQAFGQGVSQ

SEQ ID NO: 3155450 - protein, 18 aa, Giardia lamblia
GGLHAESYYCSRCSSRLG

SEQ ID NO: 3155451 - protein, 24 aa, Giardia lamblia
GGLLDCPVLTGFSLYDDIYMCRII

SEQ ID NO: 3155452 - protein, 17 aa, Giardia lamblia
GGLVLPPLIAPIHVVII

SEQ ID NO: 3155453 - protein, 17 aa, Giardia lamblia
GGMKRPDGSTALEIALL

SEQ ID NO: 3155454 - protein, 17 aa, Giardia lamblia
GGMPSLLPIPVSNDDYN

SEQ ID NO: 3155455 - protein, 20 aa, Giardia lamblia
GGMQMKGCTHVDRWKICGGT

SEQ ID NO: 3155456 - protein, 21 aa, Giardia lamblia
GGMRSGYGWTALMLAAENGYV

SEQ ID NO: 3155457 - protein, 17 aa, Giardia lamblia
GGMRSSNGWTALMWAAL

SEQ ID NO: 3155458 - protein, 21 aa, Giardia lamblia
GGMVQPGMPSGGYGQPQMGYG

SEQ ID NO: 3155459 - protein, 18 aa, Giardia lamblia
GGNFKCNGSLDFIKSHVA

SEQ ID NO: 3155460 - protein, 18 aa, Giardia lamblia
GGNIKRRALRLSHGSFAW

SEQ ID NO: 3155461 - protein, 17 aa, Giardia lamblia
GGNKAMAEFLRGVKNAE

SEQ ID NO: 3155462 - protein, 20 aa, Giardia lamblia
GGNRCKWAGANNERVYDACT

SEQ ID NO: 3155463 - protein, 23 aa, Giardia lamblia
GGPCAHVDVLNALYNMGAYEVTL

SEQ ID NO: 3155464 - protein, 26 aa, Giardia lamblia
GGPDIKELLNRLSICRPTTSEANGAY

SEQ ID NO: 3155465 - protein, 17 aa, Giardia lamblia
GGPRVADVLDVLVWSRR

SEQ ID NO: 3155466 - protein, 18 aa, Giardia lamblia
GGQRIVPVIPQLILPIKQ

SEQ ID NO: 3155467 - protein, 19 aa, Giardia lamblia
GGQTLCYRTALMGAVANGH

SEQ ID NO: 3155468 - protein, 23 aa, Giardia lamblia
GGQYCLIKAAAVTRQFAITDAWF

SEQ ID NO: 3155469 - protein, 20 aa, Giardia lamblia
GGRNCGRIGTIQAIDKHMGS

SEQ ID NO: 3155470 - protein, 20 aa, Giardia lamblia
GGRTKTCIIATITTADLALD

SEQ ID NO: 3155471 - protein, 20 aa, Giardia lamblia
GGRYLVKVSGLLSIDDSNQP

SEQ ID NO: 3155472 - protein, 18 aa, Giardia lamblia
GGSADAKAVQSLRDQVSE

SEQ ID NO: 3155473 - protein, 19 aa, Giardia lamblia
GGSALHYAVIYEYLDSIPI

SEQ ID NO: 3155474 - protein, 17 aa, Giardia lamblia
GGSALMRAASNGHSNIV

SEQ ID NO: 3155475 - protein, 20 aa, Giardia lamblia
GGSALMWAAYNGNPECVKLL

SEQ ID NO: 3155476 - protein, 28 aa, Giardia lamblia
GGSIECDKCTKLNRRIVELEARAGSLLH

SEQ ID NO: 3155477 - protein, 19 aa, Giardia lamblia
GGSLPSIYGPQALVKYLEV

SEQ ID NO: 3155478 - protein, 23 aa, Giardia lamblia
GGSSLRIPSKLSSIAPLTSLEYE

SEQ ID NO: 3155479 - protein, 28 aa, Giardia lamblia
GGSVLCSMTYRSLCKFLVGKFRLPSKIL

SEQ ID NO: 3155480 - protein, 24 aa, Giardia lamblia
GGSYRWDKETALAIVESILPNLQK

SEQ ID NO: 3155481 - protein, 19 aa, Giardia lamblia
GGTALMWAARHGHTQAISL

SEQ ID NO: 3155482 - protein, 17 aa, Giardia lamblia
GGTEGCFLVSRKTNTYE

SEQ ID NO: 3155483 - protein, 18 aa, Giardia lamblia
GGTEVSYIDLMHESKYLT

SEQ ID NO: 3155484 - protein, 21 aa, Giardia lamblia
GGTGSVMRPSRSFSSSGTVGR

SEQ ID NO: 3155485 - protein, 24 aa, Giardia lamblia
GGTSLEKKATFIFNVYDVDRNAII

SEQ ID NO: 3155486 - protein, 19 aa, Giardia lamblia
GGTVFRLFDCAPQRRISLS

SEQ ID NO: 3155487 - protein, 25 aa, Giardia lamblia
GGVEFARPTALMIASRSGSAAACEK

SEQ ID NO: 3155488 - protein, 17 aa, Giardia lamblia
GGVFPFLPSGSLYYHDY

SEQ ID NO: 3155489 - protein, 18 aa, Giardia lamblia
GGVFWEIISIFRGPGPRK

SEQ ID NO: 3155490 - protein, 17 aa, Giardia lamblia
GGVGGLRLDNPDNSDLF

SEQ ID NO: 3155491 - protein, 19 aa, Giardia lamblia
GGVIPCGWTPEKNDTIIPD

SEQ ID NO: 3155492 - protein, 24 aa, Giardia lamblia
GGVKIDRWRMTGGTALMTAAEYGH

SEQ ID NO: 3155493 - protein, 27 aa, Giardia lamblia
GGVRRCWCERGFLPALDRSECVLPTEC

SEQ ID NO: 3155494 - protein, 19 aa, Giardia lamblia
GGYCTRPECVGIVIHNGEI

SEQ ID NO: 3155495 - protein, 22 aa, Giardia lamblia
GGYGHKVDWWSMGAILYECVFG

SEQ ID NO: 3155496 - protein, 17 aa, Giardia lamblia
GGYLCLDVGTARRLPGI

SEQ ID NO: 3155497 - protein, 26 aa, Giardia lamblia
GGYNISIRAPLDFLFEKSPVHDTLQT

SEQ ID NO: 3155498 - protein, 30 aa, Giardia lamblia
GGYTECVRFLHSSCLDRGLSLTTQGFTNLM

SEQ ID NO: 3155499 - protein, 17 aa, Giardia lamblia
GHADCIRVLLGELGITD

SEQ ID NO: 3155500 - protein, 22 aa, Giardia lamblia
GHADCLKLLLEKESGMKSDKGR

SEQ ID NO: 3155501 - protein, 23 aa, Giardia lamblia
GHADCVRSLLPYEKGIVRRGNMT

SEQ ID NO: 3155502 - protein, 21 aa, Giardia lamblia
GHAECVKLLLEKEGGMQRRSL

SEQ ID NO: 3155503 - protein, 23 aa, Giardia lamblia
GHAEISRVLAPIEACIIAKNGLS

SEQ ID NO: 3155504 - protein, 20 aa, Giardia lamblia
GHAEVARILVPYETGLRDTD

SEQ ID NO: 3155505 - protein, 18 aa, Giardia lamblia
GHARGCFSEVGGTNYLKL

SEQ ID NO: 3155506 - protein, 22 aa, Giardia lamblia
GHASCVQALVSEACEISSEGFT

SEQ ID NO: 3155507 - protein, 20 aa, Giardia lamblia
GHASSRRALLHGEFARNSRL

SEQ ID NO: 3155508 - protein, 29 aa, Giardia lamblia
GHCALIYSLKARWPMITEYLQPLEGDLVN

SEQ ID NO: 3155509 - protein, 26 aa, Giardia lamblia
GHCCGCCYCHWWSRRLPLLVVPLPRE

SEQ ID NO: 3155510 - protein, 17 aa, Giardia lamblia
GHCEVVAILAAHEGSMQ

SEQ ID NO: 3155511 - protein, 19 aa, Giardia lamblia
GHDECVMILAKYLSTERDC

SEQ ID NO: 3155512 - protein, 18 aa, Giardia lamblia
GHDRCVLLLRELEAQLVD

SEQ ID NO: 3155513 - protein, 17 aa, Giardia lamblia
GHEALGRIILRHESDTV

SEQ ID NO: 3155514 - protein, 22 aa, Giardia lamblia
GHEEVCRILLPREGGMANNSKS

SEQ ID NO: 3155515 - protein, 23 aa, Giardia lamblia
GHEKCARLLLPEMGIQRHDGMTT

SEQ ID NO: 3155516 - protein, 21 aa, Giardia lamblia
GHGFTNRWLASHIDSESTFCF

SEQ ID NO: 3155517 - protein, 20 aa, Giardia lamblia
GHGLPNVPFYESVLPKNERI

SEQ ID NO: 3155518 - protein, 24 aa, Giardia lamblia
GHGVTSLKDYLCDLGQQCLAPICL

SEQ ID NO: 3155519 - protein, 20 aa, Giardia lamblia
GHHRRYMLSKVFAEPRTRPL

SEQ ID NO: 3155520 - protein, 25 aa, Giardia lamblia
GHIDCVKLLLPHEYSFCKAHIINEI

SEQ ID NO: 3155521 - protein, 23 aa, Giardia lamblia
GHIDVLKILAPLEGGMSVQSGKQ

SEQ ID NO: 3155522 - protein, 20 aa, Giardia lamblia
GHIECIRILAPLERNLTDKK

SEQ ID NO: 3155523 - protein, 24 aa, Giardia lamblia
GHIECVKILVKHELKMRNNSGITA

SEQ ID NO: 3155524 - protein, 25 aa, Giardia lamblia
GHIECVKLLLEKEGRMQGSGGMTAL

SEQ ID NO: 3155525 - protein, 30 aa, Giardia lamblia
GHIHLVCFPLMAAVKLPFIESAGMQINVMG

SEQ ID NO: 3155526 - protein, 17 aa, Giardia lamblia
GHILKLRPVDGVSTESL

SEQ ID NO: 3155527 - protein, 18 aa, Giardia lamblia
GHIQCATILVRAFPPTKK

SEQ ID NO: 3155528 - protein, 19 aa, Giardia lamblia
GHISEFCARPERPRSPAAV

SEQ ID NO: 3155529 - protein, 23 aa, Giardia lamblia
GHISPGGFRLWILSLLELGVPPT

SEQ ID NO: 3155530 - protein, 22 aa, Giardia lamblia
GHKECFKVLAKLEVGLAGVTPL

SEQ ID NO: 3155531 - protein, 19 aa, Giardia lamblia
GHKGPACRLNESVRPLTHY

SEQ ID NO: 3155532 - protein, 25 aa, Giardia lamblia
GHKRKRLEKQLALIREKEPQFTDAF

SEQ ID NO: 3155533 - protein, 35 aa, Giardia lamblia
GHKVSFVQSFCPICFDKIRLCYSTAIFALQNGMTI

SEQ ID NO: 3155534 - protein, 26 aa, Giardia lamblia
GHLCVCSSCAELLMRVDAKCPYCRAR

SEQ ID NO: 3155535 - protein, 23 aa, Giardia lamblia
GHLDVCKLLIPHEAGMSRKDGWT

SEQ ID NO: 3155536 - protein, 25 aa, Giardia lamblia
GHLECIKLLLEKEGRMKDSNDKTAL

SEQ ID NO: 3155537 - protein, 27 aa, Giardia lamblia
GHLECVKCLLCELGIRTSLGNTALMFA

SEQ ID NO: 3155538 - protein, 22 aa, Giardia lamblia
GHLECVKLLKPYLGNSRNPAGQ

SEQ ID NO: 3155539 - protein, 21 aa, Giardia lamblia
GHLECVKLLLEKEKNIDRRKL

SEQ ID NO: 3155540 - protein, 20 aa, Giardia lamblia
GHLGCGTCGVYLDKKTYKRI

SEQ ID NO: 3155541 - protein, 21 aa, Giardia lamblia
GHLNIPFPYDNNGIISVFRCL

SEQ ID NO: 3155542 - protein, 18 aa, Giardia lamblia
GHLPAIKILAPIEATMTV

SEQ ID NO: 3155543 - protein, 20 aa, Giardia lamblia
GHLQLVKWLAPYEYSIRDNK

SEQ ID NO: 3155544 - protein, 18 aa, Giardia lamblia
GHLRVAEMIIPYEDPIDE

SEQ ID NO: 3155545 - protein, 25 aa, Giardia lamblia
GHMASRYALLNGHREVFNALLPAEQ

SEQ ID NO: 3155546 - protein, 29 aa, Giardia lamblia
GHMPLMGYNWRIIRHAAKHILFDNMKVAV

SEQ ID NO: 3155547 - protein, 23 aa, Giardia lamblia
GHMPPIRLNITIYYELMHQLISA

SEQ ID NO: 3155548 - protein, 18 aa, Giardia lamblia
GHNIPVGLNINRHHGTLR

SEQ ID NO: 3155549 - protein, 24 aa, Giardia lamblia
GHNNCVRILAKREGRARNDKGFTA

SEQ ID NO: 3155550 - protein, 22 aa, Giardia lamblia
GHPCIAMALDLYTSGHARVAKD

SEQ ID NO: 3155551 - protein, 19 aa, Giardia lamblia
GHPELNFSYPYQAQVEPYA

SEQ ID NO: 3155552 - protein, 23 aa, Giardia lamblia
GHQDCVKLLLPYESGLVSNDGSS

SEQ ID NO: 3155553 - protein, 26 aa, Giardia lamblia
GHQDLSWKGMKAFLSQSGVLRTIANF

SEQ ID NO: 3155554 - protein, 24 aa, Giardia lamblia
GHQECVQLLLPYEAALQHSSGRTA

SEQ ID NO: 3155555 - protein, 20 aa, Giardia lamblia
GHSALFVYLLPERGIRGIYG

SEQ ID NO: 3155556 - protein, 24 aa, Giardia lamblia
GHSDCARLLLEREKDIKNNDRETA

SEQ ID NO: 3155557 - protein, 20 aa, Giardia lamblia
GHSNIMRILAAKEVAICTAT

SEQ ID NO: 3155558 - protein, 26 aa, Giardia lamblia
GHSSSLRYAMQLLFPAFVVAKLEAAG

SEQ ID NO: 3155559 - protein, 19 aa, Giardia lamblia
GHTAFLHALLRGHKEAATL

SEQ ID NO: 3155560 - protein, 20 aa, Giardia lamblia
GHTDCVRLLVKKEGGVQDSY

SEQ ID NO: 3155561 - protein, 20 aa, Giardia lamblia
GHTDCVRLLVKKEGGVQNKY

SEQ ID NO: 3155562 - protein, 21 aa, Giardia lamblia
GHTECARLLLEKEGGMRDSNG

SEQ ID NO: 3155563 - protein, 23 aa, Giardia lamblia
GHTECMKILLPKEVKMQSSNGTT

SEQ ID NO: 3155564 - protein, 20 aa, Giardia lamblia
GHTECVRLLVETEKCIQRQN

SEQ ID NO: 3155565 - protein, 20 aa, Giardia lamblia
GHTEIASFLALHEGGLADSR

SEQ ID NO: 3155566 - protein, 18 aa, Giardia lamblia
GHTEVIRLLVEVEENLRA

SEQ ID NO: 3155567 - protein, 23 aa, Giardia lamblia
GHTGCARLLLKKEGCMQRGDGMT

SEQ ID NO: 3155568 - protein, 23 aa, Giardia lamblia
GHTMCARILTAWEARLTDKTHTT

SEQ ID NO: 3155569 - protein, 18 aa, Giardia lamblia
GHTPLWPMIIVLKNTIGQ

SEQ ID NO: 3155570 - protein, 24 aa, Giardia lamblia
GHTSMCFLTATSPVEFCSRRGLFL

SEQ ID NO: 3155571 - protein, 19 aa, Giardia lamblia
GHTSTIIAILTYRQSPSNP

SEQ ID NO: 3155572 - protein, 17 aa, Giardia lamblia
GHVACVQALYPLEKDLL

SEQ ID NO: 3155573 - protein, 18 aa, Giardia lamblia
GHVACVRILAQLEYSLVT

SEQ ID NO: 3155574 - protein, 19 aa, Giardia lamblia
GHVDCVRILIPAEAQLVTE

SEQ ID NO: 3155575 - protein, 20 aa, Giardia lamblia
GHVDLVSMLLPFEGKIRDKL

SEQ ID NO: 3155576 - protein, 23 aa, Giardia lamblia
GHVECVKMLVAKEGGMRQKDGTT

SEQ ID NO: 3155577 - protein, 25 aa, Giardia lamblia
GHVECVRLLADRELSMRCANGKNAI

SEQ ID NO: 3155578 - protein, 17 aa, Giardia lamblia
GHVKCLFKSNKDPIADQ

SEQ ID NO: 3155579 - protein, 19 aa, Giardia lamblia
GHVKCVELLLQEAGIHNGD

SEQ ID NO: 3155580 - protein, 23 aa, Giardia lamblia
GHVKSTRVLSLWEAEMQAGKGQT

SEQ ID NO: 3155581 - protein, 23 aa, Giardia lamblia
GHVKYHCEYCDKRFTEADLYKLN

SEQ ID NO: 3155582 - protein, 18 aa, Giardia lamblia
GHVPSGLLKPESEDTKKH

SEQ ID NO: 3155583 - protein, 20 aa, Giardia lamblia
GHVTETFYACDMFPDVMNMV

SEQ ID NO: 3155584 - protein, 24 aa, Giardia lamblia
GHYSCISMLIPSEIHFRRKDGRTA

SEQ ID NO: 3155585 - protein, 19 aa, Giardia lamblia
GIALRGMFIVSDKGVVRHV

SEQ ID NO: 3155586 - protein, 24 aa, Giardia lamblia
GIARSKELLALTAPVVPTSLARFL

SEQ ID NO: 3155587 - protein, 25 aa, Giardia lamblia
GIATGRFYLPMTFVRGGSLRDWMVE

SEQ ID NO: 3155588 - protein, 18 aa, Giardia lamblia
GIAYESGMGEESRFFKAL

SEQ ID NO: 3155589 - protein, 17 aa, Giardia lamblia
GICQPICQKISDYQRTS

SEQ ID NO: 3155590 - protein, 17 aa, Giardia lamblia
GICTTVVGYANASTDAR

SEQ ID NO: 3155591 - protein, 18 aa, Giardia lamblia
GICVSRRLGTSITKLMKC

SEQ ID NO: 3155592 - protein, 31 aa, Giardia lamblia
GIDCPFYPGSSLRPVAFRSPFQFLHVSRLRE

SEQ ID NO: 3155593 - protein, 26 aa, Giardia lamblia
GIDEWVRLGLHPVLCKYLVRAGYTKP

SEQ ID NO: 3155594 - protein, 25 aa, Giardia lamblia
GIDFPRLSRDGIHPVAFSYEIQISG

SEQ ID NO: 3155595 - protein, 25 aa, Giardia lamblia
GIDGTRYLSDFWRCDLATGVFEEIH

SEQ ID NO: 3155596 - protein, 26 aa, Giardia lamblia
GIDIPNLNCVINYNFPSSGKNYVHRV

SEQ ID NO: 3155597 - protein, 24 aa, Giardia lamblia
GIDTPRLDTLIPQLAPENEVPLEK

SEQ ID NO: 3155598 - protein, 22 aa, Giardia lamblia
GIEAARALFIKQIRATLDKVDL

SEQ ID NO: 3155599 - protein, 19 aa, Giardia lamblia
GIFCRLRSILLSYRNMLLN

SEQ ID NO: 3155600 - protein, 30 aa, Giardia lamblia
GIFERLSGKYGRMRSNLMGKRVNYCSRSVI

SEQ ID NO: 3155601 - protein, 29 aa, Giardia lamblia
GIFSSIWRRCTKREGEWFFFCLNGPVDAV

SEQ ID NO: 3155602 - protein, 19 aa, Giardia lamblia
GIGARVLIFSIAIDRPEGP

SEQ ID NO: 3155603 - protein, 27 aa, Giardia lamblia
GIHTIRLKYERGLMQSEDFLSALHRDA

SEQ ID NO: 3155604 - protein, 18 aa, Giardia lamblia
GIIARLVSRAELHGSNEV

SEQ ID NO: 3155605 - protein, 18 aa, Giardia lamblia
GIIQSMFMLFLSNAPFDS

SEQ ID NO: 3155606 - protein, 26 aa, Giardia lamblia
GIKELKGHPWFNGINWDKLYRKEYTI

SEQ ID NO: 3155607 - protein, 24 aa, Giardia lamblia
GIKERSEAAITMWEPMNNTVQMLA

SEQ ID NO: 3155608 - protein, 24 aa, Giardia lamblia
GIKGFKPSVSLVFHEKVFSLISKA

SEQ ID NO: 3155609 - protein, 25 aa, Giardia lamblia
GIKGRSQWVRRFFAQGVLAASQLFF

SEQ ID NO: 3155610 - protein, 28 aa, Giardia lamblia
GIKLNFIDVPPLYAFPGARLNATNGCTT

SEQ ID NO: 3155611 - protein, 25 aa, Giardia lamblia
GILDRRGYCALNYCIENYKVTFYPY

SEQ ID NO: 3155612 - protein, 18 aa, Giardia lamblia
GILERFGAVTGQVYHDGY

SEQ ID NO: 3155613 - protein, 19 aa, Giardia lamblia
GILGCKNQSIATLTFTYSK

SEQ ID NO: 3155614 - protein, 19 aa, Giardia lamblia
GILKLPGFGPKMGHLLVQI

SEQ ID NO: 3155615 - protein, 17 aa, Giardia lamblia
GILMRRISGDGAIYKEI

SEQ ID NO: 3155616 - protein, 36 aa, Giardia lamblia
GIMPRAVEQIFLFASETARDKWSYELTASFFEIYND

SEQ ID NO: 3155617 - protein, 24 aa, Giardia lamblia
GINKTSPTSLAWDVKLSGRPVYVH

SEQ ID NO: 3155618 - protein, 24 aa, Giardia lamblia
GINLNRPYIKAILVEEARKREEQM

SEQ ID NO: 3155619 - protein, 18 aa, Giardia lamblia
GINSICFATGNPRRITFE

SEQ ID NO: 3155620 - protein, 18 aa, Giardia lamblia
GIPIKRPPFKSAQRGVSV

SEQ ID NO: 3155621 - protein, 18 aa, Giardia lamblia
GIPIMCLSGRMKAGKRHD

SEQ ID NO: 3155622 - protein, 19 aa, Giardia lamblia
GIPNVQAYRGSSIDTCNKK

SEQ ID NO: 3155623 - protein, 26 aa, Giardia lamblia
GIPPPGQYRPAFGLATANQDTILREH

SEQ ID NO: 3155624 - protein, 17 aa, Giardia lamblia
GIPSLGQTSKVHIIFPG

SEQ ID NO: 3155625 - protein, 22 aa, Giardia lamblia
GIQATCVRGDYSVRDVAADVSI

SEQ ID NO: 3155626 - protein, 25 aa, Giardia lamblia
GIQDCRGRTALMYAVQQDNPKMVQL

SEQ ID NO: 3155627 - protein, 19 aa, Giardia lamblia
GIQDNSKWTALMIAAEQGY

SEQ ID NO: 3155628 - protein, 20 aa, Giardia lamblia
GIQDPLLLKIYRERQAAAQN

SEQ ID NO: 3155629 - protein, 17 aa, Giardia lamblia
GIQKLVFLDECDAMTEA

SEQ ID NO: 3155630 - protein, 19 aa, Giardia lamblia
GIQRGYCVQRPTYLTREAE

SEQ ID NO: 3155631 - protein, 22 aa, Giardia lamblia
GIREGLRRFAGIRDELGDTALM

SEQ ID NO: 3155632 - protein, 26 aa, Giardia lamblia
GISEFPDMHLPLIINVMLGERAKTPL

SEQ ID NO: 3155633 - protein, 19 aa, Giardia lamblia
GISLSKYQVCDNVDLLHVV

SEQ ID NO: 3155634 - protein, 19 aa, Giardia lamblia
GISLYKAVKLISSLDQDVR

SEQ ID NO: 3155635 - protein, 20 aa, Giardia lamblia
GISNIKGRILEAVVIELINI

SEQ ID NO: 3155636 - protein, 17 aa, Giardia lamblia
GISTCLAMAKAGCHIID

SEQ ID NO: 3155637 - protein, 20 aa, Giardia lamblia
GITIPTRILPLSGLSPKDLG

SEQ ID NO: 3155638 - protein, 19 aa, Giardia lamblia
GIVGEVSILLMKRFLSVFV

SEQ ID NO: 3155639 - protein, 24 aa, Giardia lamblia
GIVKFPFQIDNGFDALVHNELLMS

SEQ ID NO: 3155640 - protein, 18 aa, Giardia lamblia
GIVSALLSVHGRKVLHID

SEQ ID NO: 3155641 - protein, 19 aa, Giardia lamblia
GIVTQCLLAPKSSQNELQW

SEQ ID NO: 3155642 - protein, 24 aa, Giardia lamblia
GIYAFPGPCGTYFVTRNSYLFVLK

SEQ ID NO: 3155643 - protein, 22 aa, Giardia lamblia
GIYHGRILLDMAHPTKPPNIQM

SEQ ID NO: 3155644 - protein, 22 aa, Giardia lamblia
GIYTINGFPIWFKHLEMNVFPT

SEQ ID NO: 3155645 - protein, 19 aa, Giardia lamblia
GIYVQRPLTLAELAMDICK

SEQ ID NO: 3155646 - protein, 21 aa, Giardia lamblia
GIYYIFGDLYMKSEIQDQYDE

SEQ ID NO: 3155647 - protein, 27 aa, Giardia lamblia
GKACKNFCIVGDFLICAGDSKYIIVYL

SEQ ID NO: 3155648 - protein, 24 aa, Giardia lamblia
GKAKSRCLFVTNSPASVTKGVVSV

SEQ ID NO: 3155649 - protein, 19 aa, Giardia lamblia
GKAVGPVRPYIVSAIVRGV

SEQ ID NO: 3155650 - protein, 19 aa, Giardia lamblia
GKDAYYILVDPSGKVGDIC

SEQ ID NO: 3155651 - protein, 28 aa, Giardia lamblia
GKDCGVPGCGGMLVPVFTSSMLRDQLLF

SEQ ID NO: 3155652 - protein, 25 aa, Giardia lamblia
GKDIARFHCVYWLAFLMGASIPCPR

SEQ ID NO: 3155653 - protein, 24 aa, Giardia lamblia
GKDILRPFFGYDITEACNVAHSWV

SEQ ID NO: 3155654 - protein, 22 aa, Giardia lamblia
GKDLYKADGISLAQLAGISQKD

SEQ ID NO: 3155655 - protein, 25 aa, Giardia lamblia
GKDNRIKFLMGCIAQSISFLSRPNI

SEQ ID NO: 3155656 - protein, 21 aa, Giardia lamblia
GKDSLCLLLHLSLLSLMARRG

SEQ ID NO: 3155657 - protein, 18 aa, Giardia lamblia
GKEIKTKAEFYFIDINGP

SEQ ID NO: 3155658 - protein, 17 aa, Giardia lamblia
GKELIDIPQDCRSLFTV

SEQ ID NO: 3155659 - protein, 20 aa, Giardia lamblia
GKEPAEVFVDGWRPDLSGLT

SEQ ID NO: 3155660 - protein, 21 aa, Giardia lamblia
GKEPAEVFVDGWRPDLSGVAD

SEQ ID NO: 3155661 - protein, 22 aa, Giardia lamblia
GKEPAEVFVDGWRPDLSGVADG

SEQ ID NO: 3155662 - protein, 20 aa, Giardia lamblia
GKEPAEVFVDGWRPDLSGVT

SEQ ID NO: 3155663 - protein, 23 aa, Giardia lamblia
GKEPAEVFVDGWRPDLSGVTDGF

SEQ ID NO: 3155664 - protein, 22 aa, Giardia lamblia
GKEPEFLFQAFVGCTGGKSKFQ

SEQ ID NO: 3155665 - protein, 26 aa, Giardia lamblia
GKERRLGLVRELRLAHELVAARNEDE

SEQ ID NO: 3155666 - protein, 18 aa, Giardia lamblia
GKESHLLRCVIARIQHEC

SEQ ID NO: 3155667 - protein, 26 aa, Giardia lamblia
GKFFTGLAMSGAWSCFDEFNRIDIEV

SEQ ID NO: 3155668 - protein, 19 aa, Giardia lamblia
GKFGHAISIFLPCTDRQMV

SEQ ID NO: 3155669 - protein, 19 aa, Giardia lamblia
GKFLTKYKSTCAIPTPLIL

SEQ ID NO: 3155670 - protein, 24 aa, Giardia lamblia
GKFYTRGGTCLHISDIQVALTTKT

SEQ ID NO: 3155671 - protein, 24 aa, Giardia lamblia
GKGKDTRALVNFSQLSGNILELEP

SEQ ID NO: 3155672 - protein, 21 aa, Giardia lamblia
GKGQLPHANFRLILTTDPHPQ

SEQ ID NO: 3155673 - protein, 18 aa, Giardia lamblia
GKGTKVLFIHNGVCLVAG

SEQ ID NO: 3155674 - protein, 18 aa, Giardia lamblia
GKIADLSASLAYSEQQCA

SEQ ID NO: 3155675 - protein, 19 aa, Giardia lamblia
GKIGRLLRYRSGKVVLVLN

SEQ ID NO: 3155676 - protein, 19 aa, Giardia lamblia
GKIISPIQCTNCDSLQSIE

SEQ ID NO: 3155677 - protein, 18 aa, Giardia lamblia
GKIKEIVCENNAKRPSSP

SEQ ID NO: 3155678 - protein, 19 aa, Giardia lamblia
GKIRRIRQTLGPGLSENDR

SEQ ID NO: 3155679 - protein, 27 aa, Giardia lamblia
GKISKRTPCSMPATPTKFISPKQPQAK

SEQ ID NO: 3155680 - protein, 26 aa, Giardia lamblia
GKKGVLPHYWPRVGNVRGKGGTDGLI

SEQ ID NO: 3155681 - protein, 26 aa, Giardia lamblia
GKKIDFYKILGLETWPGDGEAKKAYY

SEQ ID NO: 3155682 - protein, 20 aa, Giardia lamblia
GKKLKFGSTALMIAATSGHI

SEQ ID NO: 3155683 - protein, 24 aa, Giardia lamblia
GKLACAKILCQYESRMINKDGKTA

SEQ ID NO: 3155684 - protein, 19 aa, Giardia lamblia
GKLALKVLRQTGIDSDGGL

SEQ ID NO: 3155685 - protein, 18 aa, Giardia lamblia
GKLHPRDLDVVAAEPRVS

SEQ ID NO: 3155686 - protein, 27 aa, Giardia lamblia
GKLLPGGIPDLDWAARNCIRDWNRGTV

SEQ ID NO: 3155687 - protein, 21 aa, Giardia lamblia
GKLLRLKQEYFFVSASLQDMI

SEQ ID NO: 3155688 - protein, 19 aa, Giardia lamblia
GKLPKCLNRKKSLRSPYYD

SEQ ID NO: 3155689 - protein, 31 aa, Giardia lamblia
GKLPNPSLRRYHGLALDGGVLQREHEQNTNL

SEQ ID NO: 3155690 - protein, 23 aa, Giardia lamblia
GKLQDLRFLLEMNTYHKQVSFDV

SEQ ID NO: 3155691 - protein, 26 aa, Giardia lamblia
GKLQNTAFMDSCVPFLQSEAQGAKTF

SEQ ID NO: 3155692 - protein, 23 aa, Giardia lamblia
GKLRANAIFTPLIETPESFNALM

SEQ ID NO: 3155693 - protein, 24 aa, Giardia lamblia
GKLSICKLLAPYEACVPVLLHGEE

SEQ ID NO: 3155694 - protein, 17 aa, Giardia lamblia
GKLVYKSLPLRSAVTDT

SEQ ID NO: 3155695 - protein, 34 aa, Giardia lamblia
GKLYSGPSADLWSTGIILYAMLCGCLPFEGSTTQ

SEQ ID NO: 3155696 - protein, 17 aa, Giardia lamblia
GKMALMIAKEAGHKIIV

SEQ ID NO: 3155697 - protein, 18 aa, Giardia lamblia
GKMTRFTIRNHLDVLSAD

SEQ ID NO: 3155698 - protein, 24 aa, Giardia lamblia
GKNRGCNFTKLFVNLTLAYFSHHN

SEQ ID NO: 3155699 - protein, 20 aa, Giardia lamblia
GKNVKELLTTLGSASAAPAP

SEQ ID NO: 3155700 - protein, 23 aa, Giardia lamblia
GKNVKWGGSFIRPEATGYGAVYF

SEQ ID NO: 3155701 - protein, 29 aa, Giardia lamblia
GKPFKLNCAEAFAAGLWICGYRDQALDTI

SEQ ID NO: 3155702 - protein, 24 aa, Giardia lamblia
GKPIPVPHKLSARVPGVDELQGKG

SEQ ID NO: 3155703 - protein, 20 aa, Giardia lamblia
GKPLPAIIHRDLKPTNILVN

SEQ ID NO: 3155704 - protein, 17 aa, Giardia lamblia
GKPSITFMSSFQMSLNI

SEQ ID NO: 3155705 - protein, 30 aa, Giardia lamblia
GKPTILVCLAGCYRVDFVIFGKQRPTVQLH

SEQ ID NO: 3155706 - protein, 20 aa, Giardia lamblia
GKPYFIPLFGILPNKLYEFR

SEQ ID NO: 3155707 - protein, 17 aa, Giardia lamblia
GKQGMLISVNDRGEGQV

SEQ ID NO: 3155708 - protein, 25 aa, Giardia lamblia
GKQNRDGWSALMFAAQQGNMRAVKL

SEQ ID NO: 3155709 - protein, 17 aa, Giardia lamblia
GKQVLATARLVACTLNG

SEQ ID NO: 3155710 - protein, 17 aa, Giardia lamblia
GKRCIACVVEVLHESGI

SEQ ID NO: 3155711 - protein, 19 aa, Giardia lamblia
GKRGREHPMTGFETRATPL

SEQ ID NO: 3155712 - protein, 24 aa, Giardia lamblia
GKRKVSWTAPQMVTSIAFTKNKFS

SEQ ID NO: 3155713 - protein, 23 aa, Giardia lamblia
GKRNALPRTICSHIENMFKGVTY

SEQ ID NO: 3155714 - protein, 21 aa, Giardia lamblia
GKRRVRSCRKVRGAAGGHVHA

SEQ ID NO: 3155715 - protein, 23 aa, Giardia lamblia
GKRSSLPGLRRGKAVGAATSVPV

SEQ ID NO: 3155716 - protein, 19 aa, Giardia lamblia
GKRYMELDNTPSWPVLPDE

SEQ ID NO: 3155717 - protein, 26 aa, Giardia lamblia
GKSAECQRCVKIGPAVPNKMHPKMQQ

SEQ ID NO: 3155718 - protein, 19 aa, Giardia lamblia
GKSAITEAFPYGGISPYAE

SEQ ID NO: 3155719 - protein, 21 aa, Giardia lamblia
GKSAKRVCSFINRQDSIVFRN

SEQ ID NO: 3155720 - protein, 20 aa, Giardia lamblia
GKSALELALERSYFEVAEAI

SEQ ID NO: 3155721 - protein, 19 aa, Giardia lamblia
GKSALIWAAERGHIEAVKV

SEQ ID NO: 3155722 - protein, 17 aa, Giardia lamblia
GKSALMIAMELNAPLRS

SEQ ID NO: 3155723 - protein, 19 aa, Giardia lamblia
GKSGSKCAHGLSCSFVHKF

SEQ ID NO: 3155724 - protein, 17 aa, Giardia lamblia
GKSLGLLSFNRSHCIPP

SEQ ID NO: 3155725 - protein, 21 aa, Giardia lamblia
GKSLICKCLANSLGISYIKCV

SEQ ID NO: 3155726 - protein, 19 aa, Giardia lamblia
GKSLVAFIYILRCLSLCKK

SEQ ID NO: 3155727 - protein, 17 aa, Giardia lamblia
GKSPYVINPHSCVYIDQ

SEQ ID NO: 3155728 - protein, 22 aa, Giardia lamblia
GKSRLPRPILTDDLSLAAHNPR

SEQ ID NO: 3155729 - protein, 22 aa, Giardia lamblia
GKSSILQAIHFVLGGKAKNIRD

SEQ ID NO: 3155730 - protein, 17 aa, Giardia lamblia
GKSTVIGRFCQEYPLCA

SEQ ID NO: 3155731 - protein, 19 aa, Giardia lamblia
GKTAISFTEDVARRYQAYG

SEQ ID NO: 3155732 - protein, 19 aa, Giardia lamblia
GKTALAYAIANKDIELIRV

SEQ ID NO: 3155733 - protein, 18 aa, Giardia lamblia
GKTALICAAERNHIACVC

SEQ ID NO: 3155734 - protein, 18 aa, Giardia lamblia
GKTALMFAAERNNLEAVN

SEQ ID NO: 3155735 - protein, 17 aa, Giardia lamblia
GKTALMHAAERGDAEMV

SEQ ID NO: 3155736 - protein, 19 aa, Giardia lamblia
GKTALMIAAEKGYTKVCSL

SEQ ID NO: 3155737 - protein, 18 aa, Giardia lamblia
GKTALMLAVANRNAIAVK

SEQ ID NO: 3155738 - protein, 19 aa, Giardia lamblia
GKTALMYAAERGHEEIANL

SEQ ID NO: 3155739 - protein, 18 aa, Giardia lamblia
GKTALMYAAQKGHIEIVK

SEQ ID NO: 3155740 - protein, 21 aa, Giardia lamblia
GKTALMYAAYKGNTCFVNMLK

SEQ ID NO: 3155741 - protein, 17 aa, Giardia lamblia
GKTALQWAQEKPYKTTA

SEQ ID NO: 3155742 - protein, 19 aa, Giardia lamblia
GKTAMLFHTAWDWINSLEN

SEQ ID NO: 3155743 - protein, 24 aa, Giardia lamblia
GKTCAFIIPILHRIATEKLKLYTM

SEQ ID NO: 3155744 - protein, 21 aa, Giardia lamblia
GKTIIKPFVREVPAKDQDEPS

SEQ ID NO: 3155745 - protein, 22 aa, Giardia lamblia
GKTLICKALSAKAEINFISVKG

SEQ ID NO: 3155746 - protein, 17 aa, Giardia lamblia
GKTTIIRRLSCLMNTLS

SEQ ID NO: 3155747 - protein, 21 aa, Giardia lamblia
GKVGDICRILGRLIGNDPQDI

SEQ ID NO: 3155748 - protein, 25 aa, Giardia lamblia
GKVLRGCVIYIPFLPNAADLVTEGP

SEQ ID NO: 3155749 - protein, 18 aa, Giardia lamblia
GKVPAKRYHILTMKEKIA

SEQ ID NO: 3155750 - protein, 17 aa, Giardia lamblia
GKVPAKVRGASVKKTDG

SEQ ID NO: 3155751 - protein, 18 aa, Giardia lamblia
GKVPEVINGGALYDNTLF

SEQ ID NO: 3155752 - protein, 17 aa, Giardia lamblia
GKVVLVLNGGITMNLTQ

SEQ ID NO: 3155753 - protein, 21 aa, Giardia lamblia
GKVYFWRGDFKSLLRDMQDVK

SEQ ID NO: 3155754 - protein, 23 aa, Giardia lamblia
GKYLKRDASGAIECIDSVDCGEG

SEQ ID NO: 3155755 - protein, 23 aa, Giardia lamblia
GKYPSNLEYLGPRSDVFNYLQIP

SEQ ID NO: 3155756 - protein, 20 aa, Giardia lamblia
GLACILRVYSKLFAHSVAIT

SEQ ID NO: 3155757 - protein, 24 aa, Giardia lamblia
GLAEKTCKGHTHLDADFPADNSLL

SEQ ID NO: 3155758 - protein, 17 aa, Giardia lamblia
GLAELCTELVSWKHEIT

SEQ ID NO: 3155759 - protein, 17 aa, Giardia lamblia
GLAKLLLNHDAGKRNDA

SEQ ID NO: 3155760 - protein, 32 aa, Giardia lamblia
GLAPSEGRCLSSLIFEQDFCYIVSGCGTHKTI

SEQ ID NO: 3155761 - protein, 26 aa, Giardia lamblia
GLAQARVLYRLALLYKESNRQALGAK

SEQ ID NO: 3155762 - protein, 19 aa, Giardia lamblia
GLARLVTKEDIVFTIDTLL

SEQ ID NO: 3155763 - protein, 28 aa, Giardia lamblia
GLARSNKFLDFFITPIVRCTQARNMKTF

SEQ ID NO: 3155764 - protein, 17 aa, Giardia lamblia
GLCKKDGATKQAELRAG

SEQ ID NO: 3155765 - protein, 24 aa, Giardia lamblia
GLCVTGYASLCFSASAGYFPEGAV

SEQ ID NO: 3155766 - protein, 18 aa, Giardia lamblia
GLDAEWCDEMLPGEFPLD

SEQ ID NO: 3155767 - protein, 34 aa, Giardia lamblia
GLDEYAFKLAHDFLYDPCCAAAFSMNVAFAGSGS

SEQ ID NO: 3155768 - protein, 25 aa, Giardia lamblia
GLDFTRVDVVLNFDCPVSSINYIHR

SEQ ID NO: 3155769 - protein, 28 aa, Giardia lamblia
GLDLVRRDWCPISRTISKRALEIIMGYP

SEQ ID NO: 3155770 - protein, 18 aa, Giardia lamblia
GLDMCSQLKCADLSHNLI

SEQ ID NO: 3155771 - protein, 17 aa, Giardia lamblia
GLDPRLDLDVIKIPKKV

SEQ ID NO: 3155772 - protein, 17 aa, Giardia lamblia
GLDSEMKSRLAALFAGN

SEQ ID NO: 3155773 - protein, 19 aa, Giardia lamblia
GLDSKLLTCSIIIDSPISP

SEQ ID NO: 3155774 - protein, 19 aa, Giardia lamblia
GLDSLRHMIDKSGISSAII

SEQ ID NO: 3155775 - protein, 20 aa, Giardia lamblia
GLEDGRTALFLAASENHDTC

SEQ ID NO: 3155776 - protein, 18 aa, Giardia lamblia
GLEGRILAMRPAPIQISY

SEQ ID NO: 3155777 - protein, 23 aa, Giardia lamblia
GLELRKVKEYSVHDSTDYLLPAN

SEQ ID NO: 3155778 - protein, 22 aa, Giardia lamblia
GLEMYRFGRTVSIPIFTSTWRP

SEQ ID NO: 3155779 - protein, 20 aa, Giardia lamblia
GLEPPCLQRIALFSEKREED

SEQ ID NO: 3155780 - protein, 21 aa, Giardia lamblia
GLERKPLRRDLVVKMEQLELP

SEQ ID NO: 3155781 - protein, 27 aa, Giardia lamblia
GLFAASLGMLIKSYGYDVVMQKCDPYI

SEQ ID NO: 3155782 - protein, 20 aa, Giardia lamblia
GLFCANKECCGLLIDNLTRS

SEQ ID NO: 3155783 - protein, 19 aa, Giardia lamblia
GLFEKKRMANLFEYITSFE

SEQ ID NO: 3155784 - protein, 18 aa, Giardia lamblia
GLFPLAIGATAAIPGGFG

SEQ ID NO: 3155785 - protein, 30 aa, Giardia lamblia
GLFTIARARAPSCIFIDEIDAIMSARGSGE

SEQ ID NO: 3155786 - protein, 22 aa, Giardia lamblia
GLFYAHRDFEEFLSYYEKGHPI

SEQ ID NO: 3155787 - protein, 27 aa, Giardia lamblia
GLGASGFCKDCFFINLLTMESVYAGDL

SEQ ID NO: 3155788 - protein, 34 aa, Giardia lamblia
GLGKLCPMHPSLALPISICCRLFDGERMYSMDSR

SEQ ID NO: 3155789 - protein, 24 aa, Giardia lamblia
GLGLPRLKELIDFRNPKISVSTIY

SEQ ID NO: 3155790 - protein, 23 aa, Giardia lamblia
GLGLRNMHDFFWKNLSGLASPVL

SEQ ID NO: 3155791 - protein, 21 aa, Giardia lamblia
GLGRRRRMAIERAINSGRLVR

SEQ ID NO: 3155792 - protein, 19 aa, Giardia lamblia
GLHELSMASSRVGTDAYMA

SEQ ID NO: 3155793 - protein, 18 aa, Giardia lamblia
GLHRSRIPQPDFSPTGGY

SEQ ID NO: 3155794 - protein, 24 aa, Giardia lamblia
GLIAIWDMRSFRVPVTTLSHSHAV

SEQ ID NO: 3155795 - protein, 17 aa, Giardia lamblia
GLIASNAIEVFILAWGN

SEQ ID NO: 3155796 - protein, 26 aa, Giardia lamblia
GLICKKCPGMDAISIGPTIKNPHSPQ

SEQ ID NO: 3155797 - protein, 21 aa, Giardia lamblia
GLILWQIADSLVLYLEDKCGK

SEQ ID NO: 3155798 - protein, 17 aa, Giardia lamblia
GLINAFKSGEINEKTLS

SEQ ID NO: 3155799 - protein, 18 aa, Giardia lamblia
GLISARPVSQENISSVMH

SEQ ID NO: 3155800 - protein, 24 aa, Giardia lamblia
GLKLSCARWDIADMVNWKTHGMIY

SEQ ID NO: 3155801 - protein, 23 aa, Giardia lamblia
GLKTLMLRFLIGQMEEIQNPTLM

SEQ ID NO: 3155802 - protein, 17 aa, Giardia lamblia
GLLASICNSFELISIEL

SEQ ID NO: 3155803 - protein, 27 aa, Giardia lamblia
GLLGRICAARRSLFNNWLAKYKDLILN

SEQ ID NO: 3155804 - protein, 17 aa, Giardia lamblia
GLLKEKKDLFAQSWSPR

SEQ ID NO: 3155805 - protein, 17 aa, Giardia lamblia
GLLKKSKYSALYYASTH

SEQ ID NO: 3155806 - protein, 24 aa, Giardia lamblia
GLLLHAAAALGFVCNPIRSQLMNI

SEQ ID NO: 3155807 - protein, 18 aa, Giardia lamblia
GLLNEKTLECDILNDKLQ

SEQ ID NO: 3155808 - protein, 22 aa, Giardia lamblia
GLLYELCCALDYRKRPDLAKAR

SEQ ID NO: 3155809 - protein, 19 aa, Giardia lamblia
GLMAPSMKLLMAQLEDKEQ

SEQ ID NO: 3155810 - protein, 18 aa, Giardia lamblia
GLMASGSYTSHRDRASAS

SEQ ID NO: 3155811 - protein, 26 aa, Giardia lamblia
GLMEKLEVMIMRGLQVVKGIDNVEAF

SEQ ID NO: 3155812 - protein, 18 aa, Giardia lamblia
GLMLAARLGYESLVNFLL

SEQ ID NO: 3155813 - protein, 28 aa, Giardia lamblia
GLMLENKRLNSIIDELKLALNNTPLEAN

SEQ ID NO: 3155814 - protein, 18 aa, Giardia lamblia
GLMNAARTNDCELAKILC

SEQ ID NO: 3155815 - protein, 29 aa, Giardia lamblia
GLMSYLSYWKRRICEVLVRNTTSEISLFE

SEQ ID NO: 3155816 - protein, 25 aa, Giardia lamblia
GLNLAHSLLRSCSQSGYFESFTLET

SEQ ID NO: 3155817 - protein, 25 aa, Giardia lamblia
GLNLSEYPFLFALAQREEQVRDGRL

SEQ ID NO: 3155818 - protein, 25 aa, Giardia lamblia
GLNPRDRDAFLLKLYGQRDLLRMAS

SEQ ID NO: 3155819 - protein, 21 aa, Giardia lamblia
GLNRFSGIIMFSVPGQGKTLI

SEQ ID NO: 3155820 - protein, 17 aa, Giardia lamblia
GLPELSQDIAFTYKSEI

SEQ ID NO: 3155821 - protein, 25 aa, Giardia lamblia
GLPEVLSVESVRHFSPPSTPQLHAK

SEQ ID NO: 3155822 - protein, 24 aa, Giardia lamblia
GLPLLHSCIPYPAMDMPVPPETPW

SEQ ID NO: 3155823 - protein, 27 aa, Giardia lamblia
GLPRNAWPQECLWMISTYNGLYIRAFT

SEQ ID NO: 3155824 - protein, 25 aa, Giardia lamblia
GLQADKCAGCDCSLATTSQEEQASL

SEQ ID NO: 3155825 - protein, 25 aa, Giardia lamblia
GLQDAEGWSAMMMAVLDNQAEIVKS

SEQ ID NO: 3155826 - protein, 18 aa, Giardia lamblia
GLQLRLTENDFTKERSIL

SEQ ID NO: 3155827 - protein, 20 aa, Giardia lamblia
GLQNKFGFTAMMIAAKRGFV

SEQ ID NO: 3155828 - protein, 22 aa, Giardia lamblia
GLQPRARKLFLNTLESKQIHKK

SEQ ID NO: 3155829 - protein, 22 aa, Giardia lamblia
GLQRLDGATALMLAAKKNIHSV

SEQ ID NO: 3155830 - protein, 19 aa, Giardia lamblia
GLQVGEGFTALMMAAQQGH

SEQ ID NO: 3155831 - protein, 24 aa, Giardia lamblia
GLRALRYSRELHVTVPLHIIAVDI

SEQ ID NO: 3155832 - protein, 25 aa, Giardia lamblia
GLRAMKAVLLTAGMLKRSHPEYPED

SEQ ID NO: 3155833 - protein, 20 aa, Giardia lamblia
GLRDLLDFILDFRFSDDDIS

SEQ ID NO: 3155834 - protein, 33 aa, Giardia lamblia
GLRFIKSLFGMAELRLSIPPAVLQQMVALAAEI

SEQ ID NO: 3155835 - protein, 28 aa, Giardia lamblia
GLRHMVYKKLKLVGAVNKVFRNTAFIEK

SEQ ID NO: 3155836 - protein, 24 aa, Giardia lamblia
GLRILRETNMRYGLGNMEPNNRPI

SEQ ID NO: 3155837 - protein, 18 aa, Giardia lamblia
GLRKAGVESMQMVVGIDF

SEQ ID NO: 3155838 - protein, 28 aa, Giardia lamblia
GLRLYYAYLNMMQWSPPLIDTVIHEYLK

SEQ ID NO: 3155839 - protein, 18 aa, Giardia lamblia
GLSAMSFSSRHSLNSGQN

SEQ ID NO: 3155840 - protein, 27 aa, Giardia lamblia
GLSEIYLWKIVKYLLDTFVRLHDPYAW

SEQ ID NO: 3155841 - protein, 24 aa, Giardia lamblia
GLSFDFLSTMTRRIIVPKELSSLL

SEQ ID NO: 3155842 - protein, 26 aa, Giardia lamblia
GLSFEEYPLIYGYDFRFSSLDGAKMA

SEQ ID NO: 3155843 - protein, 25 aa, Giardia lamblia
GLSKADGWTALMFAAQAGYADIVSL

SEQ ID NO: 3155844 - protein, 31 aa, Giardia lamblia
GLSLKIKLDRCLPRRFCSVVYCKDGTHENAI

SEQ ID NO: 3155845 - protein, 19 aa, Giardia lamblia
GLSMVCAACGQARPLAADR

SEQ ID NO: 3155846 - protein, 20 aa, Giardia lamblia
GLSSLRTSYMLIIRDTARAD

SEQ ID NO: 3155847 - protein, 18 aa, Giardia lamblia
GLSSYGFVLLVIFYLQIL

SEQ ID NO: 3155848 - protein, 22 aa, Giardia lamblia
GLSTPKSLGFIVAFDGGVVQEV

SEQ ID NO: 3155849 - protein, 17 aa, Giardia lamblia
GLSVLTVDVIKEYCMNT

SEQ ID NO: 3155850 - protein, 21 aa, Giardia lamblia
GLSVVRLEMSSALDLLQQKSS

SEQ ID NO: 3155851 - protein, 20 aa, Giardia lamblia
GLSWPRLHVGCSISGDKFLE

SEQ ID NO: 3155852 - protein, 17 aa, Giardia lamblia
GLTALMFAARHNLHDSI

SEQ ID NO: 3155853 - protein, 18 aa, Giardia lamblia
GLTALMFAASHGNSNVIP

SEQ ID NO: 3155854 - protein, 17 aa, Giardia lamblia
GLTALMYAAQWNYPEIV

SEQ ID NO: 3155855 - protein, 18 aa, Giardia lamblia
GLTALMYAARRGHADLVS

SEQ ID NO: 3155856 - protein, 26 aa, Giardia lamblia
GLTARKRRSALHMAVERANVDTVRLL

SEQ ID NO: 3155857 - protein, 17 aa, Giardia lamblia
GLTARLSANTEIFYPDF

SEQ ID NO: 3155858 - protein, 23 aa, Giardia lamblia
GLTCHPDFAVACFSRTSEAVSDK

SEQ ID NO: 3155859 - protein, 18 aa, Giardia lamblia
GLTEGKHSPRLCPATTLW

SEQ ID NO: 3155860 - protein, 18 aa, Giardia lamblia
GLTFKGGVILAADTRSTG

SEQ ID NO: 3155861 - protein, 19 aa, Giardia lamblia
GLTLIPLSAVWKHLFSQLV

SEQ ID NO: 3155862 - protein, 24 aa, Giardia lamblia
GLTPADCKEAWDLLLKTLQSNILS

SEQ ID NO: 3155863 - protein, 19 aa, Giardia lamblia
GLTRTALCHAHRSESEGGP

SEQ ID NO: 3155864 - protein, 19 aa, Giardia lamblia
GLVASYAVSLWCKYFMGSL

SEQ ID NO: 3155865 - protein, 22 aa, Giardia lamblia
GLVCLRRHGEAVVHEDFVEAIN

SEQ ID NO: 3155866 - protein, 20 aa, Giardia lamblia
GLVGIEFYKVLLWNNPDLSA

SEQ ID NO: 3155867 - protein, 17 aa, Giardia lamblia
GLVHLQLAGEKVKSVLS

SEQ ID NO: 3155868 - protein, 32 aa, Giardia lamblia
GLVHSLLLICARLVDCTSYIPVYPLATSTAVN

SEQ ID NO: 3155869 - protein, 17 aa, Giardia lamblia
GLVKLLLENEAGYQNKS

SEQ ID NO: 3155870 - protein, 17 aa, Giardia lamblia
GLVKLSLNEPIRYAPND

SEQ ID NO: 3155871 - protein, 17 aa, Giardia lamblia
GLVSILCTLLDYIDVEI

SEQ ID NO: 3155872 - protein, 20 aa, Giardia lamblia
GLWPCIEGFAPVVALSVDLS

SEQ ID NO: 3155873 - protein, 21 aa, Giardia lamblia
GLYCSLPLEVKEMLISDEEYL

SEQ ID NO: 3155874 - protein, 18 aa, Giardia lamblia
GLYDICKVTNILQNLFQF

SEQ ID NO: 3155875 - protein, 17 aa, Giardia lamblia
GLYKIYSNASVDPWPGL

SEQ ID NO: 3155876 - protein, 19 aa, Giardia lamblia
GLYPSGRVQRLFITQDEIV

SEQ ID NO: 3155877 - protein, 26 aa, Giardia lamblia
GMAAAYNGLVTYTFLTRVEGLHAAAG

SEQ ID NO: 3155878 - protein, 19 aa, Giardia lamblia
GMAKIRANPKTAKYLADDP

SEQ ID NO: 3155879 - protein, 27 aa, Giardia lamblia
GMALPDGRTALFLAIELKYMDIAEELR

SEQ ID NO: 3155880 - protein, 24 aa, Giardia lamblia
GMANPRLTDILGYVTAAVHVVPPV

SEQ ID NO: 3155881 - protein, 17 aa, Giardia lamblia
GMCGSKIGRKGGLTHSS

SEQ ID NO: 3155882 - protein, 21 aa, Giardia lamblia
GMDEMWSFINLIKLIDTNEYS

SEQ ID NO: 3155883 - protein, 32 aa, Giardia lamblia
GMDPVLCFSPAVSRPGAPFPVALPGYSTSLKK

SEQ ID NO: 3155884 - protein, 18 aa, Giardia lamblia
GMELFKLIVNGSIAYTVY

SEQ ID NO: 3155885 - protein, 17 aa, Giardia lamblia
GMFKEMQRIVAAQRLRL

SEQ ID NO: 3155886 - protein, 20 aa, Giardia lamblia
GMGKCCVAGADCCQINYATK

SEQ ID NO: 3155887 - protein, 36 aa, Giardia lamblia
GMGMGMGPRPGFSMGKPAGGAGFSFQGPGLGGGTGA

SEQ ID NO: 3155888 - protein, 23 aa, Giardia lamblia
GMGNFSACIVLLLIRVFDDETAL

SEQ ID NO: 3155889 - protein, 20 aa, Giardia lamblia
GMHLAAYALVRLFRDQRVRV

SEQ ID NO: 3155890 - protein, 25 aa, Giardia lamblia
GMIPELKASILAACEAELTSKLTHE

SEQ ID NO: 3155891 - protein, 19 aa, Giardia lamblia
GMIYMSHWILGWRPVLESW

SEQ ID NO: 3155892 - protein, 17 aa, Giardia lamblia
GMKDFKGYSAILYAIKW

SEQ ID NO: 3155893 - protein, 25 aa, Giardia lamblia
GMKTKRLNSLAGISVKSRTALMGAA

SEQ ID NO: 3155894 - protein, 22 aa, Giardia lamblia
GMLDRADPYFILNAITESLYTE

SEQ ID NO: 3155895 - protein, 33 aa, Giardia lamblia
GMMEKWCRQVKLTARRMVFDGSIKIMYDELPNL

SEQ ID NO: 3155896 - protein, 26 aa, Giardia lamblia
GMMSLPVMPMMPMVSPMCMTSISGAP

SEQ ID NO: 3155897 - protein, 18 aa, Giardia lamblia
GMRGDCGELVPFLRNIIC

SEQ ID NO: 3155898 - protein, 22 aa, Giardia lamblia
GMRSCSGYTALMHAAKAGNVHL

SEQ ID NO: 3155899 - protein, 27 aa, Giardia lamblia
GMRVACDRSKYAIRFPLPPLIDPLVSL

SEQ ID NO: 3155900 - protein, 21 aa, Giardia lamblia
GMSALMYSALFCRPESTALIL

SEQ ID NO: 3155901 - protein, 18 aa, Giardia lamblia
GMSKRLADVEAAYLADAE

SEQ ID NO: 3155902 - protein, 27 aa, Giardia lamblia
GMSPLKGPCLVFLVKFMEEIIGFKNTP

SEQ ID NO: 3155903 - protein, 22 aa, Giardia lamblia
GMTALMYAARDGYTDIVAVLAC

SEQ ID NO: 3155904 - protein, 25 aa, Giardia lamblia
GMTALMYGASYGLREVVTALLHPEK

SEQ ID NO: 3155905 - protein, 23 aa, Giardia lamblia
GMTELYTIAWVRKRPYLEDFLAS

SEQ ID NO: 3155906 - protein, 25 aa, Giardia lamblia
GMTQADGWTALMWAASEGQYRCVRL

SEQ ID NO: 3155907 - protein, 36 aa, Giardia lamblia
GMTQSGLAGDVWRLCVNESHALSWVQLDPVSKTQIF

SEQ ID NO: 3155908 - protein, 23 aa, Giardia lamblia
GMTSRGTGPVSIWEMKNQKLSVQ

SEQ ID NO: 3155909 - protein, 19 aa, Giardia lamblia
GMVLQPAYRQSLSKTQSAR

SEQ ID NO: 3155910 - protein, 19 aa, Giardia lamblia
GMWPLETILSSTLTTTTAS

SEQ ID NO: 3155911 - protein, 26 aa, Giardia lamblia
GNAAIKRRLNDLLGIVESHKLPPSVS

SEQ ID NO: 3155912 - protein, 17 aa, Giardia lamblia
GNAKACELLASAEYMDT

SEQ ID NO: 3155913 - protein, 18 aa, Giardia lamblia
GNCDAVNCVVPYAQEETS

SEQ ID NO: 3155914 - protein, 19 aa, Giardia lamblia
GNDGLRPAELSTYSIVLPP

SEQ ID NO: 3155915 - protein, 23 aa, Giardia lamblia
GNDIEMIRILAPHENRSVNRDGR

SEQ ID NO: 3155916 - protein, 24 aa, Giardia lamblia
GNDYACKLTLFAPINPDESKYKVT

SEQ ID NO: 3155917 - protein, 27 aa, Giardia lamblia
GNENDVYWKTALEYAILGSKQRNLQIL

SEQ ID NO: 3155918 - protein, 18 aa, Giardia lamblia
GNEYVGWLSYTDTTGKGY

SEQ ID NO: 3155919 - protein, 17 aa, Giardia lamblia
GNFARFLNHSCAPTAES

SEQ ID NO: 3155920 - protein, 23 aa, Giardia lamblia
GNFASLFLNCFYELTKSGRAVVQ

SEQ ID NO: 3155921 - protein, 32 aa, Giardia lamblia
GNFKREPFELIPRLFPLASAIYLRSAICAICH

SEQ ID NO: 3155922 - protein, 17 aa, Giardia lamblia
GNFNKLATLCLSSISVG

SEQ ID NO: 3155923 - protein, 18 aa, Giardia lamblia
GNFNSARVLLPLEKGMQT

SEQ ID NO: 3155924 - protein, 21 aa, Giardia lamblia
GNFPGVVELLKMSLRVYVDEI

SEQ ID NO: 3155925 - protein, 17 aa, Giardia lamblia
GNFVERAINLFLSSKEM

SEQ ID NO: 3155926 - protein, 25 aa, Giardia lamblia
GNGQGSLAWKGLLVYGSPGSGKTCL

SEQ ID NO: 3155927 - protein, 19 aa, Giardia lamblia
GNGSFGKVFSAQRVSDSKT

SEQ ID NO: 3155928 - protein, 25 aa, Giardia lamblia
GNHLECVRTLLNRMPYTVSDIYTVL

SEQ ID NO: 3155929 - protein, 25 aa, Giardia lamblia
GNHYEICKILAPFEARDTLPDGRTA

SEQ ID NO: 3155930 - protein, 21 aa, Giardia lamblia
GNIECFLRPLLEHLQGNAYVA

SEQ ID NO: 3155931 - protein, 25 aa, Giardia lamblia
GNIFKGLAQSGAWGCFDEFNRISIE

SEQ ID NO: 3155932 - protein, 24 aa, Giardia lamblia
GNIHLSSKRCCLIVAAVANAGDAV

SEQ ID NO: 3155933 - protein, 22 aa, Giardia lamblia
GNIKAAEFFLWQVGAKDNYGYT

SEQ ID NO: 3155934 - protein, 19 aa, Giardia lamblia
GNIKLANALIEREAGAVDV

SEQ ID NO: 3155935 - protein, 26 aa, Giardia lamblia
GNILCMGCAGSGKTFLIRRLIRQLSG

SEQ ID NO: 3155936 - protein, 17 aa, Giardia lamblia
GNIPELLVRDILHQLSK

SEQ ID NO: 3155937 - protein, 17 aa, Giardia lamblia
GNIVTRAYVELRVTGRR

SEQ ID NO: 3155938 - protein, 21 aa, Giardia lamblia
GNKPEEFGMLISTDKELLLLK

SEQ ID NO: 3155939 - protein, 17 aa, Giardia lamblia
GNKRLTCYDGFEPSGRI

SEQ ID NO: 3155940 - protein, 27 aa, Giardia lamblia
GNKRYRIVRKSDYLRIFKEQSMKSHAV

SEQ ID NO: 3155941 - protein, 22 aa, Giardia lamblia
GNLEAIRLLAPYEAKNYASAAL

SEQ ID NO: 3155942 - protein, 25 aa, Giardia lamblia
GNLEAVKLLAPREGDLYAEDALKVC

SEQ ID NO: 3155943 - protein, 22 aa, Giardia lamblia
GNLKMAHILIPYEAGLVSTSGY

SEQ ID NO: 3155944 - protein, 18 aa, Giardia lamblia
GNLLSLWRTAANAQQTIK

SEQ ID NO: 3155945 - protein, 20 aa, Giardia lamblia
GNLMPGALVDPARYIEASPD

SEQ ID NO: 3155946 - protein, 19 aa, Giardia lamblia
GNLRCVVEIVTQYKPSKQE

SEQ ID NO: 3155947 - protein, 21 aa, Giardia lamblia
GNLRKFIPLIHELLDEMIDNG

SEQ ID NO: 3155948 - protein, 23 aa, Giardia lamblia
GNLRVVELLLQFEARMQDSNGCT

SEQ ID NO: 3155949 - protein, 20 aa, Giardia lamblia
GNMPVAKFLTPYEGLDFSHV

SEQ ID NO: 3155950 - protein, 19 aa, Giardia lamblia
GNNELFNEFIYRITTNEFE

SEQ ID NO: 3155951 - protein, 25 aa, Giardia lamblia
GNNIELIKILLPYEAGIRVLDDKDF

SEQ ID NO: 3155952 - protein, 24 aa, Giardia lamblia
GNNQYPEWHAPECDQQAYCMSQSM

SEQ ID NO: 3155953 - protein, 38 aa, Giardia lamblia
GNNYHVVELWKGQSIVLRFGITWSMYRHTYSEMSAGVS

SEQ ID NO: 3155954 - protein, 21 aa, Giardia lamblia
GNPFAKEFDLLAAMHAANPAC

SEQ ID NO: 3155955 - protein, 17 aa, Giardia lamblia
GNRAFIFNVSYLGQSLV

SEQ ID NO: 3155956 - protein, 23 aa, Giardia lamblia
GNSGLLPGHLAKFNVSFVGQTNE

SEQ ID NO: 3155957 - protein, 25 aa, Giardia lamblia
GNSGPGVGFGSGFGLGNTQQKPQSG

SEQ ID NO: 3155958 - protein, 25 aa, Giardia lamblia
GNSHADCVHALTIYIRDGKINYLAT

SEQ ID NO: 3155959 - protein, 20 aa, Giardia lamblia
GNSMCDPVDYVILGSDGVWA

SEQ ID NO: 3155960 - protein, 18 aa, Giardia lamblia
GNSTAVRILAQYEAGLQD

SEQ ID NO: 3155961 - protein, 20 aa, Giardia lamblia
GNSTPIYTNHLLKVSLSGND

SEQ ID NO: 3155962 - protein, 21 aa, Giardia lamblia
GNTALRLCAERNMPATAALCY

SEQ ID NO: 3155963 - protein, 22 aa, Giardia lamblia
GNTEAVKLLFPREKLMKDAESQ

SEQ ID NO: 3155964 - protein, 24 aa, Giardia lamblia
GNTECIKLLLAEVGIVTAKGETAL

SEQ ID NO: 3155965 - protein, 23 aa, Giardia lamblia
GNTEIIRLLAPREAGLQLKDGKT

SEQ ID NO: 3155966 - protein, 17 aa, Giardia lamblia
GNTIRWGDAEKQRSGAS

SEQ ID NO: 3155967 - protein, 23 aa, Giardia lamblia
GNTLLMRAVMTFNYKKMLDYSSI

SEQ ID NO: 3155968 - protein, 23 aa, Giardia lamblia
GNTLLMRAVMTFNYKKMPDYSSI

SEQ ID NO: 3155969 - protein, 24 aa, Giardia lamblia
GNTRPLFNRLRCLATGRMDSSDLQ

SEQ ID NO: 3155970 - protein, 18 aa, Giardia lamblia
GNVAWKDKVRYNIEKYLN

SEQ ID NO: 3155971 - protein, 19 aa, Giardia lamblia
GNVEACIYLVSREAGFSMK

SEQ ID NO: 3155972 - protein, 19 aa, Giardia lamblia
GNVEIVRILAPREAGSRRR

SEQ ID NO: 3155973 - protein, 22 aa, Giardia lamblia
GNVGCVMLLLTLVSQRSSKGQT

SEQ ID NO: 3155974 - protein, 21 aa, Giardia lamblia
GNVNFMAEFVFLGPLSDDRAQ

SEQ ID NO: 3155975 - protein, 17 aa, Giardia lamblia
GNVRLDGILNCLPDTEK

SEQ ID NO: 3155976 - protein, 25 aa, Giardia lamblia
GNWNPRSRSSIIFNHVGERRFEAPT

SEQ ID NO: 3155977 - protein, 23 aa, Giardia lamblia
GNYEVMKLLLPEAGIVDRKGKTA

SEQ ID NO: 3155978 - protein, 17 aa, Giardia lamblia
GNYGSQFFLKFVGLFTV

SEQ ID NO: 3155979 - protein, 22 aa, Giardia lamblia
GNYKIGGSYLKIKNLKKLSQGR

SEQ ID NO: 3155980 - protein, 25 aa, Giardia lamblia
GNYLACKELCYRDWDSSELSLLEHE

SEQ ID NO: 3155981 - protein, 40 aa, Giardia lamblia
GNYLYLLSYRSVYVFSFLEIRLVKRINLSQRFAFLPRPND

SEQ ID NO: 3155982 - protein, 18 aa, Giardia lamblia
GNYTRLLIAYMTRMRPTK

SEQ ID NO: 3155983 - protein, 21 aa, Giardia lamblia
GPAGYIALHKPIIVVGRSADC

SEQ ID NO: 3155984 - protein, 29 aa, Giardia lamblia
GPAVVGPVRYISCPCPSIFSPTSLTYSQT

SEQ ID NO: 3155985 - protein, 27 aa, Giardia lamblia
GPCRGYCGACMSFIPGEECLLEVIRCA

SEQ ID NO: 3155986 - protein, 17 aa, Giardia lamblia
GPCRKPSDVGPSNRSIS

SEQ ID NO: 3155987 - protein, 22 aa, Giardia lamblia
GPCSYGMTVADCLFAMEKAMSK

SEQ ID NO: 3155988 - protein, 18 aa, Giardia lamblia
GPDGFSCACDEGYTSVSP

SEQ ID NO: 3155989 - protein, 22 aa, Giardia lamblia
GPDGLASILTRSVPASAQRLQS

SEQ ID NO: 3155990 - protein, 18 aa, Giardia lamblia
GPDRYYLLVYIALDCLAK

SEQ ID NO: 3155991 - protein, 17 aa, Giardia lamblia
GPEFLEIVLQLLKEQGA

SEQ ID NO: 3155992 - protein, 24 aa, Giardia lamblia
GPEGPSPRYGHSMVTVGKDIFVIG

SEQ ID NO: 3155993 - protein, 28 aa, Giardia lamblia
GPENRRVLGCLIGTCSEGTVRVTTSFPV

SEQ ID NO: 3155994 - protein, 21 aa, Giardia lamblia
GPEPGRLALTNVICAVTRNGM

SEQ ID NO: 3155995 - protein, 26 aa, Giardia lamblia
GPEPSNLLISRFVDHMHRIQSQLEEL

SEQ ID NO: 3155996 - protein, 17 aa, Giardia lamblia
GPFDFLAGRGSFRHHSQ

SEQ ID NO: 3155997 - protein, 21 aa, Giardia lamblia
GPGAGVAFCTLTGALEQVEWK

SEQ ID NO: 3155998 - protein, 19 aa, Giardia lamblia
GPGCVLLSDARLEAPLVYI

SEQ ID NO: 3155999 - protein, 29 aa, Giardia lamblia
GPGGHFAFATWLLLWIARSAILPYTGEES

SEQ ID NO: 3156000 - protein, 18 aa, Giardia lamblia
GPGMDLIQTFCECVESFT

SEQ ID NO: 3156001 - protein, 25 aa, Giardia lamblia
GPGQRSRGAWPHVSQYSTTYPDAAS

SEQ ID NO: 3156002 - protein, 30 aa, Giardia lamblia
GPHCICSACKTCACDQYLKASCPVCELGTF

SEQ ID NO: 3156003 - protein, 23 aa, Giardia lamblia
GPHYEFIGLAFVDQAVQAFVSRA

SEQ ID NO: 3156004 - protein, 19 aa, Giardia lamblia
GPIEIKDVMGYPNYEDYDM

SEQ ID NO: 3156005 - protein, 17 aa, Giardia lamblia
GPIPRDMILAGRESHKL

SEQ ID NO: 3156006 - protein, 19 aa, Giardia lamblia
GPIVRGCSLLHIRTMDSLV

SEQ ID NO: 3156007 - protein, 21 aa, Giardia lamblia
GPKGVSLNCWDVGGQKAIRTY

SEQ ID NO: 3156008 - protein, 20 aa, Giardia lamblia
GPLPEAFRVLDNLKSEAQSL

SEQ ID NO: 3156009 - protein, 21 aa, Giardia lamblia
GPLQANCYVAFDPKSCNALIV

SEQ ID NO: 3156010 - protein, 24 aa, Giardia lamblia
GPLRSFKYCNWSLEGTHRQRLYTP

SEQ ID NO: 3156011 - protein, 19 aa, Giardia lamblia
GPNGIYGCEEFLAKTLMSP

SEQ ID NO: 3156012 - protein, 19 aa, Giardia lamblia
GPNGLLWVTGSTLYDSITA

SEQ ID NO: 3156013 - protein, 28 aa, Giardia lamblia
GPNGTTCTWADLYAHCSIRAQKAVLDAF

SEQ ID NO: 3156014 - protein, 20 aa, Giardia lamblia
GPNPSGPYIAAWLDGDDLVL

SEQ ID NO: 3156015 - protein, 20 aa, Giardia lamblia
GPNTLGFVWQDLVNTIFVSS

SEQ ID NO: 3156016 - protein, 18 aa, Giardia lamblia
GPNVEFRGTCTIDNTSHL

SEQ ID NO: 3156017 - protein, 17 aa, Giardia lamblia
GPPQGALRNRPRKTGAI

SEQ ID NO: 3156018 - protein, 23 aa, Giardia lamblia
GPRSMLKMILDSMGSVVMTNDGN

SEQ ID NO: 3156019 - protein, 17 aa, Giardia lamblia
GPSLRSLIIKRRIAQQW

SEQ ID NO: 3156020 - protein, 18 aa, Giardia lamblia
GPSPREARAAKEKQKTLV

SEQ ID NO: 3156021 - protein, 29 aa, Giardia lamblia
GPSSGALHLGHLLPFIFTKYLQDAFKCYV

SEQ ID NO: 3156022 - protein, 27 aa, Giardia lamblia
GPVGAVSWGGGPAFLAEAAPFHSQFMD

SEQ ID NO: 3156023 - protein, 21 aa, Giardia lamblia
GPVIECPNQYGSYVNFKEASS

SEQ ID NO: 3156024 - protein, 37 aa, Giardia lamblia
GPVSAARIMLRFAKVAARFLMNYGFTIGIDDVMPSQR

SEQ ID NO: 3156025 - protein, 24 aa, Giardia lamblia
GQAERGDAVVLVFGTPFSDVNRKG

SEQ ID NO: 3156026 - protein, 25 aa, Giardia lamblia
GQAHLRPPPIRELPDEVIVPPTVPQ

SEQ ID NO: 3156027 - protein, 23 aa, Giardia lamblia
GQCVMLRYRCRSLEAALNGANAR

SEQ ID NO: 3156028 - protein, 17 aa, Giardia lamblia
GQCYRLYTRNMYLQMPA

SEQ ID NO: 3156029 - protein, 18 aa, Giardia lamblia
GQDAGGWTALMYAAAQGH

SEQ ID NO: 3156030 - protein, 19 aa, Giardia lamblia
GQDIPEWMVTLEGFKGAKD

SEQ ID NO: 3156031 - protein, 24 aa, Giardia lamblia
GQDLRPLLDKHPDPMMEYMIEAEI

SEQ ID NO: 3156032 - protein, 20 aa, Giardia lamblia
GQEIGVIFKLIKVVIASNQP

SEQ ID NO: 3156033 - protein, 17 aa, Giardia lamblia
GQELGRIVCEPRGSFAE

SEQ ID NO: 3156034 - protein, 24 aa, Giardia lamblia
GQEVKKGDALLRIGSAKLDLVLTA

SEQ ID NO: 3156035 - protein, 18 aa, Giardia lamblia
GQEYIIFSEECFHLSLYM

SEQ ID NO: 3156036 - protein, 21 aa, Giardia lamblia
GQFAAKFAMLAGNYKLAKILI

SEQ ID NO: 3156037 - protein, 17 aa, Giardia lamblia
GQFEAAQHLVLREKEHI

SEQ ID NO: 3156038 - protein, 25 aa, Giardia lamblia
GQGKALKLLLPHEAKMQSKDGHTAL

SEQ ID NO: 3156039 - protein, 19 aa, Giardia lamblia
GQGVVRVDESFVASVVGNM

SEQ ID NO: 3156040 - protein, 27 aa, Giardia lamblia
GQHVRCLSELLLPCTSCDLLWPVTFEV

SEQ ID NO: 3156041 - protein, 19 aa, Giardia lamblia
GQICLNMKLFRRGSEDLSH

SEQ ID NO: 3156042 - protein, 18 aa, Giardia lamblia
GQIKSQFELLRTASNTTN

SEQ ID NO: 3156043 - protein, 23 aa, Giardia lamblia
GQIYKNRTALMLAAEHGSVECIK

SEQ ID NO: 3156044 - protein, 24 aa, Giardia lamblia
GQKDLMLHLNIKVEDLAGISDSQT

SEQ ID NO: 3156045 - protein, 27 aa, Giardia lamblia
GQKDSRGRTALMYAASFGKAECIPALL

SEQ ID NO: 3156046 - protein, 23 aa, Giardia lamblia
GQKECIQALFPFEGSLRNSQGDL

SEQ ID NO: 3156047 - protein, 25 aa, Giardia lamblia
GQKISFAGSFMAMFGDKSKADTRPA

SEQ ID NO: 3156048 - protein, 20 aa, Giardia lamblia
GQLESVRILLPYEASISTHN

SEQ ID NO: 3156049 - protein, 19 aa, Giardia lamblia
GQLPPALTPYAPLPPPIHL

SEQ ID NO: 3156050 - protein, 23 aa, Giardia lamblia
GQLPRPITRPATRAIPMDIAPIS

SEQ ID NO: 3156051 - protein, 19 aa, Giardia lamblia
GQLRLLPRAGAPADPPRVD

SEQ ID NO: 3156052 - protein, 27 aa, Giardia lamblia
GQLSDILFRRALRSIGIHGPVELLNRA

SEQ ID NO: 3156053 - protein, 24 aa, Giardia lamblia
GQLTCLRAKISIDDPNKCMRDPVI

SEQ ID NO: 3156054 - protein, 26 aa, Giardia lamblia
GQNVSCANLLLAEVHLWGGTYLMAYA

SEQ ID NO: 3156055 - protein, 21 aa, Giardia lamblia
GQPECVKALLEAEFDELDVGM

SEQ ID NO: 3156056 - protein, 19 aa, Giardia lamblia
GQPLTGPFSLEFSFSTNSK

SEQ ID NO: 3156057 - protein, 18 aa, Giardia lamblia
GQRDITCNTAGVSVTAVV

SEQ ID NO: 3156058 - protein, 17 aa, Giardia lamblia
GQRFLHILVHLFDFLRV

SEQ ID NO: 3156059 - protein, 18 aa, Giardia lamblia
GQRHCIHEFQYLLKRQAS

SEQ ID NO: 3156060 - protein, 24 aa, Giardia lamblia
GQRIKGMVKSLFGTKPLIQEDMEP

SEQ ID NO: 3156061 - protein, 17 aa, Giardia lamblia
GQRKLIHRRGGMAPFTN

SEQ ID NO: 3156062 - protein, 23 aa, Giardia lamblia
GQRSRPYVICMTGVNGVGKTTSI

SEQ ID NO: 3156063 - protein, 17 aa, Giardia lamblia
GQRYFLFMEQVKQETLS

SEQ ID NO: 3156064 - protein, 23 aa, Giardia lamblia
GQSEIRLLKWYKVLLAAEQAAAI

SEQ ID NO: 3156065 - protein, 25 aa, Giardia lamblia
GQSLECGRCLIKQAGMRSRDGYTAI

SEQ ID NO: 3156066 - protein, 17 aa, Giardia lamblia
GQSLLSFCTEHYATAGI

SEQ ID NO: 3156067 - protein, 20 aa, Giardia lamblia
GQSQLCRLLATRELDTSNLK

SEQ ID NO: 3156068 - protein, 19 aa, Giardia lamblia
GQSSVRFARLREEARHNYV

SEQ ID NO: 3156069 - protein, 17 aa, Giardia lamblia
GQSVQFYKGLSLDVTIG

SEQ ID NO: 3156070 - protein, 17 aa, Giardia lamblia
GQTAIMIALGRENLAVV

SEQ ID NO: 3156071 - protein, 19 aa, Giardia lamblia
GQTALMLAAARDFYEVCAI

SEQ ID NO: 3156072 - protein, 20 aa, Giardia lamblia
GQTALMWAARNGHPECVRLL

SEQ ID NO: 3156073 - protein, 28 aa, Giardia lamblia
GQTTDLFCALSLALKAGHWSCVKQLAQY

SEQ ID NO: 3156074 - protein, 18 aa, Giardia lamblia
GQVDCLLAAFSDQLSIDQ

SEQ ID NO: 3156075 - protein, 19 aa, Giardia lamblia
GQVLIELHCWIAGTPFAQA

SEQ ID NO: 3156076 - protein, 21 aa, Giardia lamblia
GQYHKSRVYISPDFKYSPEEP

SEQ ID NO: 3156077 - protein, 20 aa, Giardia lamblia
GRAARLRAKLVQDIMKVKPA

SEQ ID NO: 3156078 - protein, 27 aa, Giardia lamblia
GRACQRCGRPLYVPRLHLDASSQVLSA

SEQ ID NO: 3156079 - protein, 21 aa, Giardia lamblia
GRAEISRLQLQIDNLGEALLQ

SEQ ID NO: 3156080 - protein, 24 aa, Giardia lamblia
GRAEKLLCWCVWQTDRERGKRRVR

SEQ ID NO: 3156081 - protein, 23 aa, Giardia lamblia
GRAGRPGLAVTFVCPDRDNVGAL

SEQ ID NO: 3156082 - protein, 18 aa, Giardia lamblia
GRAIASDGMLAFRPIFQD

SEQ ID NO: 3156083 - protein, 20 aa, Giardia lamblia
GRAMPLYTLECQNTSIEQSV

SEQ ID NO: 3156084 - protein, 20 aa, Giardia lamblia
GRASRPLAEALCYWNMAVEY

SEQ ID NO: 3156085 - protein, 18 aa, Giardia lamblia
GRASYSLVSRALLTIAPT

SEQ ID NO: 3156086 - protein, 23 aa, Giardia lamblia
GRAVSKVQGCFRVFCYTGTTLDC

SEQ ID NO: 3156087 - protein, 18 aa, Giardia lamblia
GRCSRIEVYWSRGSAHSP

SEQ ID NO: 3156088 - protein, 17 aa, Giardia lamblia
GRDALYYAQQKNLGDII

SEQ ID NO: 3156089 - protein, 29 aa, Giardia lamblia
GRDGDKLSLFGKIGCYWVFRAETDAYIEP

SEQ ID NO: 3156090 - protein, 21 aa, Giardia lamblia
GRDGMFPLEYVMRKGMKQLAL

SEQ ID NO: 3156091 - protein, 21 aa, Giardia lamblia
GRDKISLSFVDQWNHTHAPEE

SEQ ID NO: 3156092 - protein, 18 aa, Giardia lamblia
GRDLRMFLQQRASAHGYE

SEQ ID NO: 3156093 - protein, 21 aa, Giardia lamblia
GRDVRSLVGFFSFETRLGYTV

SEQ ID NO: 3156094 - protein, 20 aa, Giardia lamblia
GREAYRWYNEVHVRKLFRGI

SEQ ID NO: 3156095 - protein, 19 aa, Giardia lamblia
GREEMALLLLEYEKSVLSG

SEQ ID NO: 3156096 - protein, 25 aa, Giardia lamblia
GRELVRISVPGVRALSVLISEDGCQ

SEQ ID NO: 3156097 - protein, 23 aa, Giardia lamblia
GREPMTQRALMLARRRELIEETK

SEQ ID NO: 3156098 - protein, 25 aa, Giardia lamblia
GREVQAEAPLVWAGAEIGRVAARIA

SEQ ID NO: 3156099 - protein, 22 aa, Giardia lamblia
GRFETCKILFARESGMQSQEGD

SEQ ID NO: 3156100 - protein, 20 aa, Giardia lamblia
GRFFDCKDAELTVTMKVNDE

SEQ ID NO: 3156101 - protein, 20 aa, Giardia lamblia
GRFGHKGCYNHSTKRYLRNK

SEQ ID NO: 3156102 - protein, 18 aa, Giardia lamblia
GRFPFWISPRQIVVIPLH

SEQ ID NO: 3156103 - protein, 22 aa, Giardia lamblia
GRFVCMSGRPLIYCTNKYVPSL

SEQ ID NO: 3156104 - protein, 21 aa, Giardia lamblia
GRFVILTCRPQLQSKPGVSTK

SEQ ID NO: 3156105 - protein, 27 aa, Giardia lamblia
GRGLDFPSVCLIINYDIPRCAEYYVHQ

SEQ ID NO: 3156106 - protein, 24 aa, Giardia lamblia
GRGPVCGPLVYGIAWMPAEVYQTG

SEQ ID NO: 3156107 - protein, 21 aa, Giardia lamblia
GRGRCVFPNKDVYVGDYENGL

SEQ ID NO: 3156108 - protein, 23 aa, Giardia lamblia
GRGRESVALFKLHSFLPLTEQNS

SEQ ID NO: 3156109 - protein, 26 aa, Giardia lamblia
GRGSAELAKACYWLKKARDFADNDSQ

SEQ ID NO: 3156110 - protein, 24 aa, Giardia lamblia
GRGVLFPHDLCKLHIGNLGTTTVR

SEQ ID NO: 3156111 - protein, 19 aa, Giardia lamblia
GRGYTALVLAARHDHLDCV

SEQ ID NO: 3156112 - protein, 20 aa, Giardia lamblia
GRHVISELVDVARSSGFTDL

SEQ ID NO: 3156113 - protein, 21 aa, Giardia lamblia
GRICYILTEFGSAMYNYQQGS

SEQ ID NO: 3156114 - protein, 23 aa, Giardia lamblia
GRIEMNKGLGLIHARTLLSRLHV

SEQ ID NO: 3156115 - protein, 20 aa, Giardia lamblia
GRIEPSRNWFGNTRVVGQQD

SEQ ID NO: 3156116 - protein, 17 aa, Giardia lamblia
GRIGTIQAIDKHMGSYT

SEQ ID NO: 3156117 - protein, 17 aa, Giardia lamblia
GRIIHPVGFCRRKAEYM

SEQ ID NO: 3156118 - protein, 19 aa, Giardia lamblia
GRILRAFRNHFYFKGWTEV

SEQ ID NO: 3156119 - protein, 20 aa, Giardia lamblia
GRIMPLKVLHNYLNKDRPSA

SEQ ID NO: 3156120 - protein, 19 aa, Giardia lamblia
GRINELFSTNGFREGIVNM

SEQ ID NO: 3156121 - protein, 17 aa, Giardia lamblia
GRIRKSDLLRFLRALGL

SEQ ID NO: 3156122 - protein, 20 aa, Giardia lamblia
GRISLPYALIDVRHEATHQQ

SEQ ID NO: 3156123 - protein, 21 aa, Giardia lamblia
GRITQSIGMKGYFKAFFDGKV

SEQ ID NO: 3156124 - protein, 19 aa, Giardia lamblia
GRKAEYVKIDKWEIYEGTA

SEQ ID NO: 3156125 - protein, 22 aa, Giardia lamblia
GRKAFDLGTSIMCKIWDSAKNL

SEQ ID NO: 3156126 - protein, 21 aa, Giardia lamblia
GRKAIHYAAWNDMDEVLRVLL

SEQ ID NO: 3156127 - protein, 24 aa, Giardia lamblia
GRKEDWCLLMEKWMAHERVSRPGS

SEQ ID NO: 3156128 - protein, 21 aa, Giardia lamblia
GRKENWCLFMEKWMAHERTSR

SEQ ID NO: 3156129 - protein, 28 aa, Giardia lamblia
GRKGEQFCPASCFGCESHSTALHVILSK

SEQ ID NO: 3156130 - protein, 24 aa, Giardia lamblia
GRKTLEQMVYPLIRQFRDLSTSIA

SEQ ID NO: 3156131 - protein, 21 aa, Giardia lamblia
GRKYKMSVGLITGGHDVKEEQ

SEQ ID NO: 3156132 - protein, 18 aa, Giardia lamblia
GRLALCYCESNTEKLSRK

SEQ ID NO: 3156133 - protein, 19 aa, Giardia lamblia
GRLALLKSLIAQMETCQKA

SEQ ID NO: 3156134 - protein, 25 aa, Giardia lamblia
GRLGCSFKPSTGRARAVRDILPPYA

SEQ ID NO: 3156135 - protein, 24 aa, Giardia lamblia
GRLLANCLDLFKLGIHPTAISEAY

SEQ ID NO: 3156136 - protein, 18 aa, Giardia lamblia
GRLLCHRLRQESLHWEAY

SEQ ID NO: 3156137 - protein, 25 aa, Giardia lamblia
GRLLGSRAPKVFGVNYFLKDPTTGE

SEQ ID NO: 3156138 - protein, 27 aa, Giardia lamblia
GRLLPQEVWFGKSIIFSYARLDYSAAQ

SEQ ID NO: 3156139 - protein, 24 aa, Giardia lamblia
GRLNKAGVISPRFDIPANDIEKWV

SEQ ID NO: 3156140 - protein, 21 aa, Giardia lamblia
GRLPFLFADEVIVEILSYFSP

SEQ ID NO: 3156141 - protein, 20 aa, Giardia lamblia
GRLPSPPKLSSRSPSSGSPA

SEQ ID NO: 3156142 - protein, 20 aa, Giardia lamblia
GRLQESVGLCTSTSSTSTQD

SEQ ID NO: 3156143 - protein, 25 aa, Giardia lamblia
GRLQRLAPMLLERGILTADQLPPVS

SEQ ID NO: 3156144 - protein, 17 aa, Giardia lamblia
GRLRKADGSLRFILPEI

SEQ ID NO: 3156145 - protein, 20 aa, Giardia lamblia
GRLSFVQRVIYDSAACSFDN

SEQ ID NO: 3156146 - protein, 21 aa, Giardia lamblia
GRLSKDLSIDAFDKLPLLAAD

SEQ ID NO: 3156147 - protein, 25 aa, Giardia lamblia
GRLWFGRLTDLLPFNADLYPLGTRP

SEQ ID NO: 3156148 - protein, 26 aa, Giardia lamblia
GRMFSGLCQTGAWSCFDEFNRLYVDV

SEQ ID NO: 3156149 - protein, 19 aa, Giardia lamblia
GRMTMIRAYKYRGVRYQGL

SEQ ID NO: 3156150 - protein, 26 aa, Giardia lamblia
GRNDIPTRLKGHFITINVGLPASDQL

SEQ ID NO: 3156151 - protein, 23 aa, Giardia lamblia
GRNETVFALKVCSQHDLTKRNKV

SEQ ID NO: 3156152 - protein, 27 aa, Giardia lamblia
GRPDKEPDTCYSWWIGSPAYILLDYLL

SEQ ID NO: 3156153 - protein, 19 aa, Giardia lamblia
GRPGSMGSLGNVLNHESTV

SEQ ID NO: 3156154 - protein, 21 aa, Giardia lamblia
GRPIFLYKGGCYVITDPLGDT

SEQ ID NO: 3156155 - protein, 21 aa, Giardia lamblia
GRPQPSIPILLTSGSIADRPS

SEQ ID NO: 3156156 - protein, 21 aa, Giardia lamblia
GRPSMGLLVSFRLRPGTLVRF

SEQ ID NO: 3156157 - protein, 20 aa, Giardia lamblia
GRPVFLYKGGCYVITDPLGD

SEQ ID NO: 3156158 - protein, 18 aa, Giardia lamblia
GRQLRKLPYTALSLCSDD

SEQ ID NO: 3156159 - protein, 26 aa, Giardia lamblia
GRQVCLPGSCVLKLKQPRDSRGSCAV

SEQ ID NO: 3156160 - protein, 18 aa, Giardia lamblia
GRRGVVSAVCTFLTPVSL

SEQ ID NO: 3156161 - protein, 17 aa, Giardia lamblia
GRRHARYTFLVLHQDYS

SEQ ID NO: 3156162 - protein, 22 aa, Giardia lamblia
GRRIKFMDCSTSSSGALSSASK

SEQ ID NO: 3156163 - protein, 19 aa, Giardia lamblia
GRRVFIRGSAIQFLYLNDV

SEQ ID NO: 3156164 - protein, 22 aa, Giardia lamblia
GRRVHGGLRMGEMERDCAISYG

SEQ ID NO: 3156165 - protein, 21 aa, Giardia lamblia
GRSAIRMAGMHGCSKVVSFLE

SEQ ID NO: 3156166 - protein, 17 aa, Giardia lamblia
GRSALMYASSYDKLELV

SEQ ID NO: 3156167 - protein, 23 aa, Giardia lamblia
GRSAYDHAIEIGSSFIKNLSELY

SEQ ID NO: 3156168 - protein, 27 aa, Giardia lamblia
GRSFKPYPKFSALSDHLSAPLYEKIAD

SEQ ID NO: 3156169 - protein, 27 aa, Giardia lamblia
GRSGSYFSRGHFGECTSLCVSSAGRFV

SEQ ID NO: 3156170 - protein, 26 aa, Giardia lamblia
GRSMALCSWIAGRSCRWSVTQHEIMS

SEQ ID NO: 3156171 - protein, 17 aa, Giardia lamblia
GRSPLSIAASEGACNSV

SEQ ID NO: 3156172 - protein, 23 aa, Giardia lamblia
GRSREIISYLILHTKEPGPVIVD

SEQ ID NO: 3156173 - protein, 20 aa, Giardia lamblia
GRSRFYQALTDLTFQSLFTS

SEQ ID NO: 3156174 - protein, 21 aa, Giardia lamblia
GRSRGFTSLHYAIAVKDDKMF

SEQ ID NO: 3156175 - protein, 19 aa, Giardia lamblia
GRSSVFLPCVAEEQGWDQS

SEQ ID NO: 3156176 - protein, 17 aa, Giardia lamblia
GRTALEYAAARGSAEII

SEQ ID NO: 3156177 - protein, 19 aa, Giardia lamblia
GRTALICAVVNFEDGSDGQ

SEQ ID NO: 3156178 - protein, 20 aa, Giardia lamblia
GRTALIKAILAGHQSAALLL

SEQ ID NO: 3156179 - protein, 20 aa, Giardia lamblia
GRTALMAAAALGRVDVVRVL

SEQ ID NO: 3156180 - protein, 31 aa, Giardia lamblia
GRTALMHAAEHGFDIIVHLLAGSEAGMQDVD

SEQ ID NO: 3156181 - protein, 17 aa, Giardia lamblia
GRTALMHAVKYNRQRIV

SEQ ID NO: 3156182 - protein, 19 aa, Giardia lamblia
GRTALMIAAGNGFVEAVQL

SEQ ID NO: 3156183 - protein, 17 aa, Giardia lamblia
GRTALMIACQNSHLPCV

SEQ ID NO: 3156184 - protein, 19 aa, Giardia lamblia
GRTALMLAASDCDTVFVTM

SEQ ID NO: 3156185 - protein, 19 aa, Giardia lamblia
GRTALMLAASLGHRSICDF

SEQ ID NO: 3156186 - protein, 17 aa, Giardia lamblia
GRTALMVAAELDQLDIV

SEQ ID NO: 3156187 - protein, 20 aa, Giardia lamblia
GRTALMWAAMHNHGETIKIL

SEQ ID NO: 3156188 - protein, 19 aa, Giardia lamblia
GRTALMYAAELGRQQMAER

SEQ ID NO: 3156189 - protein, 18 aa, Giardia lamblia
GRTAMMFAAQYNSSKCTS

SEQ ID NO: 3156190 - protein, 25 aa, Giardia lamblia
GRTARCYRSGDAGIFLGLEEIGIVS

SEQ ID NO: 3156191 - protein, 27 aa, Giardia lamblia
GRTHLKFWKMAQTFTGVKLQGELAKFG

SEQ ID NO: 3156192 - protein, 17 aa, Giardia lamblia
GRTPLMLAAERGNLHAI

SEQ ID NO: 3156193 - protein, 19 aa, Giardia lamblia
GRTPLTYAVAKGNTDIIRV

SEQ ID NO: 3156194 - protein, 22 aa, Giardia lamblia
GRTRKGFHAIDIKTGKLDVSAE

SEQ ID NO: 3156195 - protein, 21 aa, Giardia lamblia
GRTVIFAWRHAILDLRKERVA

SEQ ID NO: 3156196 - protein, 25 aa, Giardia lamblia
GRTYQLRHKLGFMYDSIKRFYGTTQ

SEQ ID NO: 3156197 - protein, 20 aa, Giardia lamblia
GRVALMYAARNGHLECAKLL

SEQ ID NO: 3156198 - protein, 24 aa, Giardia lamblia
GRVARNLACSIARTAKMDCYGISR

SEQ ID NO: 3156199 - protein, 22 aa, Giardia lamblia
GRVETRCFFLTASEKGICGYCL

SEQ ID NO: 3156200 - protein, 19 aa, Giardia lamblia
GRVGRAICILKGPIPECDQ

SEQ ID NO: 3156201 - protein, 22 aa, Giardia lamblia
GRVPPSCLPCVGLKIQSDSCHL

SEQ ID NO: 3156202 - protein, 24 aa, Giardia lamblia
GRVPSAYLSAHWLVVDVGESGTTA

SEQ ID NO: 3156203 - protein, 18 aa, Giardia lamblia
GRVRLPYSPINIIEVIDN

SEQ ID NO: 3156204 - protein, 24 aa, Giardia lamblia
GRVVPFLDCRLLQMVAENLDIIVL

SEQ ID NO: 3156205 - protein, 22 aa, Giardia lamblia
GRWRGKGAPVGVPFGVQNYQST

SEQ ID NO: 3156206 - protein, 27 aa, Giardia lamblia
GRWSAKRFRKAKCPVVERLTNSLMMHG

SEQ ID NO: 3156207 - protein, 19 aa, Giardia lamblia
GRYPKGVVNRLVYSNENSR

SEQ ID NO: 3156208 - protein, 21 aa, Giardia lamblia
GSACGSCDASALSATADSADD

SEQ ID NO: 3156209 - protein, 23 aa, Giardia lamblia
GSAELVALLAGYECKLKNQSGMT

SEQ ID NO: 3156210 - protein, 28 aa, Giardia lamblia
GSAFIIFKKRGAALCAMEYYNSLKNQAF

SEQ ID NO: 3156211 - protein, 17 aa, Giardia lamblia
GSAFIVFSTLEDCEECW

SEQ ID NO: 3156212 - protein, 17 aa, Giardia lamblia
GSAFNICTGMKNLVSLI

SEQ ID NO: 3156213 - protein, 17 aa, Giardia lamblia
GSAHFVCVTPKRLSGLC

SEQ ID NO: 3156214 - protein, 17 aa, Giardia lamblia
GSAKCREAFRLENGISV

SEQ ID NO: 3156215 - protein, 24 aa, Giardia lamblia
GSALLRLSTSYARASPLSERDLAA

SEQ ID NO: 3156216 - protein, 26 aa, Giardia lamblia
GSAPCPACNGTGCDCQQCGGTGIVPT

SEQ ID NO: 3156217 - protein, 22 aa, Giardia lamblia
GSARRPKASDVYRLDTRSLFAS

SEQ ID NO: 3156218 - protein, 21 aa, Giardia lamblia
GSARSVSPLALRATSQSTYRL

SEQ ID NO: 3156219 - protein, 19 aa, Giardia lamblia
GSASGLCNALLELGFLRVA

SEQ ID NO: 3156220 - protein, 30 aa, Giardia lamblia
GSATFSNVFSCLDLKDNVTYCLKIIKQEKE

SEQ ID NO: 3156221 - protein, 37 aa, Giardia lamblia
GSCKHASHSYRWFRFACGLAYPCDTCHSKACACGNSV

SEQ ID NO: 3156222 - protein, 22 aa, Giardia lamblia
GSDDTKCKLWHLTRGSSTGLSL

SEQ ID NO: 3156223 - protein, 23 aa, Giardia lamblia
GSDIFKASAILSLGNTTPFYSVH

SEQ ID NO: 3156224 - protein, 17 aa, Giardia lamblia
GSDLLLQSLLVRVLTDI

SEQ ID NO: 3156225 - protein, 21 aa, Giardia lamblia
GSDMFKIIFAVNMQAITKRID

SEQ ID NO: 3156226 - protein, 20 aa, Giardia lamblia
GSDPKRWIVPGGTEEEWRPG

SEQ ID NO: 3156227 - protein, 21 aa, Giardia lamblia
GSDSCCRLMLRLEALPDGTLL

SEQ ID NO: 3156228 - protein, 23 aa, Giardia lamblia
GSEKRLDYGTGHELNFVCWAFSF

SEQ ID NO: 3156229 - protein, 20 aa, Giardia lamblia
GSEVGLCLKATDALVKQIPE

SEQ ID NO: 3156230 - protein, 17 aa, Giardia lamblia
GSFEIRAGVAGLDGPTY

SEQ ID NO: 3156231 - protein, 30 aa, Giardia lamblia
GSFGAERYPSILFCKFCGNEIGTLSETDES

SEQ ID NO: 3156232 - protein, 24 aa, Giardia lamblia
GSFIKRYSIQTIQWNRQYNSMASY

SEQ ID NO: 3156233 - protein, 23 aa, Giardia lamblia
GSFSIEIFIVLLAIKIARPDAVH

SEQ ID NO: 3156234 - protein, 21 aa, Giardia lamblia
GSFSKVRLGTHVLTNERIALK

SEQ ID NO: 3156235 - protein, 25 aa, Giardia lamblia
GSFVTSFQFFLSTIFHLEYSTTVDN

SEQ ID NO: 3156236 - protein, 29 aa, Giardia lamblia
GSGADMAGLCAYDILRYAIAAAKEGESGT

SEQ ID NO: 3156237 - protein, 25 aa, Giardia lamblia
GSGKTFLCKCVAAAAGVSFFIVTAS

SEQ ID NO: 3156238 - protein, 24 aa, Giardia lamblia
GSGLPGKFLERLKGILERFGAVTG

SEQ ID NO: 3156239 - protein, 21 aa, Giardia lamblia
GSGLSGFADRMFSTGYTEIDY

SEQ ID NO: 3156240 - protein, 26 aa, Giardia lamblia
GSGPKGRPRPGTLFPATTAGPVANGS

SEQ ID NO: 3156241 - protein, 24 aa, Giardia lamblia
GSGQAGGVGVRFNPTTTIAPASGK

SEQ ID NO: 3156242 - protein, 24 aa, Giardia lamblia
GSGRRSLVRLAAFAAGAKVVYPAA

SEQ ID NO: 3156243 - protein, 19 aa, Giardia lamblia
GSGSYGCVLEGHLKSDPAV

SEQ ID NO: 3156244 - protein, 22 aa, Giardia lamblia
GSHRIVRMLLAREVGLITQEGK

SEQ ID NO: 3156245 - protein, 27 aa, Giardia lamblia
GSHVWIPKQSVCLIVCRNMGILAVAVP

SEQ ID NO: 3156246 - protein, 20 aa, Giardia lamblia
GSICTELFLFSSERLSTLTL

SEQ ID NO: 3156247 - protein, 17 aa, Giardia lamblia
GSIDCISILAPLEKMLR

SEQ ID NO: 3156248 - protein, 32 aa, Giardia lamblia
GSIDCVRVLLGKEAKLGYRPTISPDALSSSAE

SEQ ID NO: 3156249 - protein, 19 aa, Giardia lamblia
GSILSRIDSIKSFKASMKE

SEQ ID NO: 3156250 - protein, 24 aa, Giardia lamblia
GSIPSVLFPYIRYSGGGYRASESA

SEQ ID NO: 3156251 - protein, 25 aa, Giardia lamblia
GSIRPLRLLAIKFFDTLAQRVTAFA

SEQ ID NO: 3156252 - protein, 17 aa, Giardia lamblia
GSKDCVEKAHGKHLYQT

SEQ ID NO: 3156253 - protein, 22 aa, Giardia lamblia
GSKKYKISRSMPTEKLLEELAP

SEQ ID NO: 3156254 - protein, 21 aa, Giardia lamblia
GSKPWSLFICKGSSVFMYNLE

SEQ ID NO: 3156255 - protein, 27 aa, Giardia lamblia
GSKTFWARLCLSWIAFRRAPRNDPAGD

SEQ ID NO: 3156256 - protein, 31 aa, Giardia lamblia
GSKTRLCVCRPQRCYAWTWHGSISSFCKAYR

SEQ ID NO: 3156257 - protein, 23 aa, Giardia lamblia
GSLAELYSALVLQKIIPEIPSLI

SEQ ID NO: 3156258 - protein, 21 aa, Giardia lamblia
GSLCNPRAVSIYAPDNPPYSA

SEQ ID NO: 3156259 - protein, 18 aa, Giardia lamblia
GSLDVLFTVLKRCIENSA

SEQ ID NO: 3156260 - protein, 18 aa, Giardia lamblia
GSLECAVLLASLEAGLAV

SEQ ID NO: 3156261 - protein, 24 aa, Giardia lamblia
GSLENHFYICWIAASVAFKGYGLG

SEQ ID NO: 3156262 - protein, 26 aa, Giardia lamblia
GSLHIGFEFLHLWMPKAEFYMPSTTW

SEQ ID NO: 3156263 - protein, 17 aa, Giardia lamblia
GSLKAVIPSCLFSQPFY

SEQ ID NO: 3156264 - protein, 21 aa, Giardia lamblia
GSLKCVRLLVREEARMVDSQG

SEQ ID NO: 3156265 - protein, 18 aa, Giardia lamblia
GSLKEYRANTVVTEPMAR

SEQ ID NO: 3156266 - protein, 20 aa, Giardia lamblia
GSLLRGWERLQSFDERSLVW

SEQ ID NO: 3156267 - protein, 24 aa, Giardia lamblia
GSLNRKGESIFLISALSTVLVTSS

SEQ ID NO: 3156268 - protein, 17 aa, Giardia lamblia
GSLPEREATLCNALGEN

SEQ ID NO: 3156269 - protein, 22 aa, Giardia lamblia
GSLPSLRFGVKCGTMTCPPGTK

SEQ ID NO: 3156270 - protein, 19 aa, Giardia lamblia
GSLRLGDGSAPIWPANSDG

SEQ ID NO: 3156271 - protein, 22 aa, Giardia lamblia
GSLSCVLMVPNINNERPFIVYN

SEQ ID NO: 3156272 - protein, 25 aa, Giardia lamblia
GSLSGRSSFSGGIPMPQSNAVQQNP

SEQ ID NO: 3156273 - protein, 19 aa, Giardia lamblia
GSLSKEFIAQGLAFDKATG

SEQ ID NO: 3156274 - protein, 18 aa, Giardia lamblia
GSLTKLRPPTPPRKLEEL

SEQ ID NO: 3156275 - protein, 21 aa, Giardia lamblia
GSLYRDRHWLWAVFPELFPLP

SEQ ID NO: 3156276 - protein, 23 aa, Giardia lamblia
GSMAGFPISIKFVNITPNYADII

SEQ ID NO: 3156277 - protein, 34 aa, Giardia lamblia
GSMLERINLWTGCPIQCTELIYGRWANPGGTYGD

SEQ ID NO: 3156278 - protein, 17 aa, Giardia lamblia
GSMRSSVLRQMIMNAMG

SEQ ID NO: 3156279 - protein, 24 aa, Giardia lamblia
GSMSGPRPSKRMYLQAPTQDPDNV

SEQ ID NO: 3156280 - protein, 24 aa, Giardia lamblia
GSNFTLSFCASVLKLYVSEPKAMM

SEQ ID NO: 3156281 - protein, 36 aa, Giardia lamblia
GSNGICLNAVYPKWMYNPPVIKRKKQKIARDFIKEN

SEQ ID NO: 3156282 - protein, 23 aa, Giardia lamblia
GSNPRLQVVLPKAVYNEVSERTK

SEQ ID NO: 3156283 - protein, 27 aa, Giardia lamblia
GSNPTVLRFSGFRGITELALSKVGSLK

SEQ ID NO: 3156284 - protein, 18 aa, Giardia lamblia
GSPDVLQLLQSVEGMQQE

SEQ ID NO: 3156285 - protein, 22 aa, Giardia lamblia
GSPFKKVHVSTAYTMATSIVNS

SEQ ID NO: 3156286 - protein, 19 aa, Giardia lamblia
GSPIPLLSVSKAWNILNDV

SEQ ID NO: 3156287 - protein, 20 aa, Giardia lamblia
GSPKFGLQMCQKDFLEVGRD

SEQ ID NO: 3156288 - protein, 17 aa, Giardia lamblia
GSPLCEWRAELDAPVIA

SEQ ID NO: 3156289 - protein, 17 aa, Giardia lamblia
GSPRTTLVGSRYGYPQS

SEQ ID NO: 3156290 - protein, 17 aa, Giardia lamblia
GSPSGILHRNIRPSSII

SEQ ID NO: 3156291 - protein, 22 aa, Giardia lamblia
GSPSRRPSPHLSKLTDNITINI

SEQ ID NO: 3156292 - protein, 23 aa, Giardia lamblia
GSPTGYRFAARAIYLANRLSIPV

SEQ ID NO: 3156293 - protein, 17 aa, Giardia lamblia
GSPVYDYSDMPPSEAEL

SEQ ID NO: 3156294 - protein, 17 aa, Giardia lamblia
GSQHVMTAIISLLNELD

SEQ ID NO: 3156295 - protein, 19 aa, Giardia lamblia
GSQMLCELIAYLSTSTDEV

SEQ ID NO: 3156296 - protein, 20 aa, Giardia lamblia
GSREQPSFVINIWLHSGYDK

SEQ ID NO: 3156297 - protein, 18 aa, Giardia lamblia
GSRIFVNRSVSPMLSSSL

SEQ ID NO: 3156298 - protein, 18 aa, Giardia lamblia
GSRLENLGIGELHESSEI

SEQ ID NO: 3156299 - protein, 21 aa, Giardia lamblia
GSRRVVDRLEFNISEEKFRNS

SEQ ID NO: 3156300 - protein, 20 aa, Giardia lamblia
GSRTEVFSVASPIQLNTVQT

SEQ ID NO: 3156301 - protein, 24 aa, Giardia lamblia
GSSARPNLYLPSLGQSTEMISSVE

SEQ ID NO: 3156302 - protein, 17 aa, Giardia lamblia
GSSCELMRLRTPQENGA

SEQ ID NO: 3156303 - protein, 20 aa, Giardia lamblia
GSSLAKYLLKDGVVKDAFTA

SEQ ID NO: 3156304 - protein, 19 aa, Giardia lamblia
GSSLKLQKLASEEKLCPQM

SEQ ID NO: 3156305 - protein, 22 aa, Giardia lamblia
GSSPLCNPRDAIKAPPNSPYFS

SEQ ID NO: 3156306 - protein, 17 aa, Giardia lamblia
GSSPSLPISKRFESDEE

SEQ ID NO: 3156307 - protein, 25 aa, Giardia lamblia
GSSRELGIAVGRQFNVSIMTILEAG

SEQ ID NO: 3156308 - protein, 24 aa, Giardia lamblia
GSSTKRLASIIVETLLSDYSAVIL

SEQ ID NO: 3156309 - protein, 17 aa, Giardia lamblia
GSSVPGISMIGDANEVY

SEQ ID NO: 3156310 - protein, 26 aa, Giardia lamblia
GSTALCLALLKGNMPVAKFLTPYEGL

SEQ ID NO: 3156311 - protein, 18 aa, Giardia lamblia
GSTALIFASRHCRLNVIK

SEQ ID NO: 3156312 - protein, 20 aa, Giardia lamblia
GSTDCVKLLLAEATSQDEQG

SEQ ID NO: 3156313 - protein, 19 aa, Giardia lamblia
GSTFAFGIVDTEYDFEMTE

SEQ ID NO: 3156314 - protein, 27 aa, Giardia lamblia
GSTHPFKLLTHWGIHAHLYMHFTSPIR

SEQ ID NO: 3156315 - protein, 33 aa, Giardia lamblia
GSTICDWNSFVEPEMVSRVGVTMTEVTSAGGPR

SEQ ID NO: 3156316 - protein, 25 aa, Giardia lamblia
GSTPLRLAMDLNHIDCVKALSIYYD

SEQ ID NO: 3156317 - protein, 23 aa, Giardia lamblia
GSTRFCLACNNISKVIEPVQSRC

SEQ ID NO: 3156318 - protein, 18 aa, Giardia lamblia
GSTSLFGMFEVRTKEVHV

SEQ ID NO: 3156319 - protein, 26 aa, Giardia lamblia
GSVAACENCGSAIKPGIVCYDEDIDL

SEQ ID NO: 3156320 - protein, 20 aa, Giardia lamblia
GSVAIWRVSKDLSLQPVQRL

SEQ ID NO: 3156321 - protein, 23 aa, Giardia lamblia
GSVDCVNVLWPLEHHITDAQGMA

SEQ ID NO: 3156322 - protein, 27 aa, Giardia lamblia
GSVGKSSICSRFAKDFFATSYKQTIGV

SEQ ID NO: 3156323 - protein, 23 aa, Giardia lamblia
GSVGKTCLLFVYANNSFPEDYLP

SEQ ID NO: 3156324 - protein, 21 aa, Giardia lamblia
GSVKPIISSGIEFIDKRSEFW

SEQ ID NO: 3156325 - protein, 17 aa, Giardia lamblia
GSVKYGGYIVWKPTALM

SEQ ID NO: 3156326 - protein, 26 aa, Giardia lamblia
GSVSGWPRRRIAISSTANFLAQTVLG

SEQ ID NO: 3156327 - protein, 22 aa, Giardia lamblia
GSWIILMNCHLAVSWMPELDKI

SEQ ID NO: 3156328 - protein, 18 aa, Giardia lamblia
GSWLTCAILGPRMQVWAQ

SEQ ID NO: 3156329 - protein, 21 aa, Giardia lamblia
GSYEYRLASKLNDLATSHPQG

SEQ ID NO: 3156330 - protein, 23 aa, Giardia lamblia
GSYGCTKILLPYEAHLTQETGKS

SEQ ID NO: 3156331 - protein, 23 aa, Giardia lamblia
GSYMKKLLRPSVQDCTESYPADK

SEQ ID NO: 3156332 - protein, 19 aa, Giardia lamblia
GSYNLSFASLRPLSRSQLN

SEQ ID NO: 3156333 - protein, 17 aa, Giardia lamblia
GSYQRVLHGRKAPEAQI

SEQ ID NO: 3156334 - protein, 19 aa, Giardia lamblia
GSYQYSMTFDESAHSDLAA

SEQ ID NO: 3156335 - protein, 18 aa, Giardia lamblia
GTAAIDVCTHMFHSGVGA

SEQ ID NO: 3156336 - protein, 25 aa, Giardia lamblia
GTCCHCKQPFLPRHHLVCKAINGIH

SEQ ID NO: 3156337 - protein, 24 aa, Giardia lamblia
GTCDLPPQFAYFFQFSHLSATRNL

SEQ ID NO: 3156338 - protein, 17 aa, Giardia lamblia
GTCKVELLAGDEELQYY

SEQ ID NO: 3156339 - protein, 18 aa, Giardia lamblia
GTCSGLVRVCSFESNSIV

SEQ ID NO: 3156340 - protein, 25 aa, Giardia lamblia
GTDIDPRLGNSLVRQYNAHRELDRS

SEQ ID NO: 3156341 - protein, 17 aa, Giardia lamblia
GTDIELAMMKTIKDSMA

SEQ ID NO: 3156342 - protein, 23 aa, Giardia lamblia
GTDMFQIPGYQMVHMPMPMMNGM

SEQ ID NO: 3156343 - protein, 23 aa, Giardia lamblia
GTDPLPGRKWIDVDSAASCLSLT

SEQ ID NO: 3156344 - protein, 18 aa, Giardia lamblia
GTEAEFSHEPFVTAEGKK

SEQ ID NO: 3156345 - protein, 17 aa, Giardia lamblia
GTEELYDRLVLRGYSSK

SEQ ID NO: 3156346 - protein, 20 aa, Giardia lamblia
GTEGCMALAEILQGGTGLEA

SEQ ID NO: 3156347 - protein, 18 aa, Giardia lamblia
GTFLPKLVIPNLMATCAM

SEQ ID NO: 3156348 - protein, 28 aa, Giardia lamblia
GTFMKRSATPVAVGAPWPSSYESALSEK

SEQ ID NO: 3156349 - protein, 23 aa, Giardia lamblia
GTGHGRGVNWVSWMPDAGNYFLS

SEQ ID NO: 3156350 - protein, 17 aa, Giardia lamblia
GTGLYGFVDASEDSRSH

SEQ ID NO: 3156351 - protein, 25 aa, Giardia lamblia
GTGNMKACMNGGVIVGTMDGANVEI

SEQ ID NO: 3156352 - protein, 24 aa, Giardia lamblia
GTGRKIDAYHFLKLLEEITNKSPR

SEQ ID NO: 3156353 - protein, 23 aa, Giardia lamblia
GTHSNWTALVWASSHGQREAVLE

SEQ ID NO: 3156354 - protein, 17 aa, Giardia lamblia
GTIIQFYAPYVIGIQHY

SEQ ID NO: 3156355 - protein, 17 aa, Giardia lamblia
GTIKGVIAKDMLKGFII

SEQ ID NO: 3156356 - protein, 19 aa, Giardia lamblia
GTIMTGVISTIFAIFLEQL

SEQ ID NO: 3156357 - protein, 18 aa, Giardia lamblia
GTITRPTGWTALMEAAYH

SEQ ID NO: 3156358 - protein, 19 aa, Giardia lamblia
GTIYPSSKCTFTVTFQPSV

SEQ ID NO: 3156359 - protein, 17 aa, Giardia lamblia
GTKIKRTLKPEVLAHYG

SEQ ID NO: 3156360 - protein, 24 aa, Giardia lamblia
GTKMKGCALVGDWKIYEGTALIRA

SEQ ID NO: 3156361 - protein, 23 aa, Giardia lamblia
GTKRGMEAGCLMLINDQMSLLRW

SEQ ID NO: 3156362 - protein, 21 aa, Giardia lamblia
GTKVPSYWVDYIDLVYGCETS

SEQ ID NO: 3156363 - protein, 26 aa, Giardia lamblia
GTLFRLAEAHARLHLRKSVTKDDGNF

SEQ ID NO: 3156364 - protein, 23 aa, Giardia lamblia
GTLHLFNLCSLESGPLKSMSYHT

SEQ ID NO: 3156365 - protein, 17 aa, Giardia lamblia
GTLKITWVGKSRTVKRV

SEQ ID NO: 3156366 - protein, 17 aa, Giardia lamblia
GTLKTAALTTEEGRPFP

SEQ ID NO: 3156367 - protein, 17 aa, Giardia lamblia
GTLPGFKVSAGRGLPAA

SEQ ID NO: 3156368 - protein, 20 aa, Giardia lamblia
GTLPQLFAPHIDPLLTAIME

SEQ ID NO: 3156369 - protein, 17 aa, Giardia lamblia
GTLRERMFIELTLEKLE

SEQ ID NO: 3156370 - protein, 27 aa, Giardia lamblia
GTLSGCCSCATLIVLGHQSRDYVEKVL

SEQ ID NO: 3156371 - protein, 28 aa, Giardia lamblia
GTLSKKDKIHFCKWISRLQYICRTKHER

SEQ ID NO: 3156372 - protein, 18 aa, Giardia lamblia
GTLSVCRSFGDFVYKPSI

SEQ ID NO: 3156373 - protein, 23 aa, Giardia lamblia
GTLTYPETFGFDFSGNTLPCETI

SEQ ID NO: 3156374 - protein, 19 aa, Giardia lamblia
GTLVQWKTALIDAAINNDP

SEQ ID NO: 3156375 - protein, 19 aa, Giardia lamblia
GTMDIFSTYVLALLGGAGL

SEQ ID NO: 3156376 - protein, 23 aa, Giardia lamblia
GTMDTWLLWNLSKEKSYLTDVTA

SEQ ID NO: 3156377 - protein, 24 aa, Giardia lamblia
GTMKLQIPHRGEINIKFQNNDLKQ

SEQ ID NO: 3156378 - protein, 26 aa, Giardia lamblia
GTPAWPAACGSVWCPGACEEDEGFTL

SEQ ID NO: 3156379 - protein, 22 aa, Giardia lamblia
GTPCFSTAAGYIGHKFKVDHDI

SEQ ID NO: 3156380 - protein, 17 aa, Giardia lamblia
GTPGANLRGSMMDSQSG

SEQ ID NO: 3156381 - protein, 18 aa, Giardia lamblia
GTPMIRHSMTLKRLCRKC

SEQ ID NO: 3156382 - protein, 17 aa, Giardia lamblia
GTPQLSFSDVKVEKANF

SEQ ID NO: 3156383 - protein, 19 aa, Giardia lamblia
GTPRPDPYAKATFVEGSIP

SEQ ID NO: 3156384 - protein, 24 aa, Giardia lamblia
GTPTSVCFINGRILLSVQESKDVY

SEQ ID NO: 3156385 - protein, 17 aa, Giardia lamblia
GTPYWLSPQQIKGEPYG

SEQ ID NO: 3156386 - protein, 25 aa, Giardia lamblia
GTQRPSNVIGVDWTGPITGKPNLAS

SEQ ID NO: 3156387 - protein, 26 aa, Giardia lamblia
GTRLFRAMELHTHISAQGWAFDRPSP

SEQ ID NO: 3156388 - protein, 19 aa, Giardia lamblia
GTRRGRRRAPARSQVGPPV

SEQ ID NO: 3156389 - protein, 21 aa, Giardia lamblia
GTRVPSCKGRSASTSSHALNS

SEQ ID NO: 3156390 - protein, 23 aa, Giardia lamblia
GTRVWPFNSSFAINSPPKRVYIC

SEQ ID NO: 3156391 - protein, 25 aa, Giardia lamblia
GTRYFNDFWLYDSVSMQWREINIYG

SEQ ID NO: 3156392 - protein, 19 aa, Giardia lamblia
GTSALRLALDYNNQELARF

SEQ ID NO: 3156393 - protein, 19 aa, Giardia lamblia
GTSILYCVSLRGSSSQLEN

SEQ ID NO: 3156394 - protein, 20 aa, Giardia lamblia
GTSMKSRLGVTERYSDVAKR

SEQ ID NO: 3156395 - protein, 29 aa, Giardia lamblia
GTSNCSFCARLRRGTLYTHCQKLGINKLA

SEQ ID NO: 3156396 - protein, 18 aa, Giardia lamblia
GTSVRPYVRLDVSLVNHN

SEQ ID NO: 3156397 - protein, 18 aa, Giardia lamblia
GTTALIMAAERGHTMCAR

SEQ ID NO: 3156398 - protein, 19 aa, Giardia lamblia
GTTALMFAAERGYSDVVSY

SEQ ID NO: 3156399 - protein, 17 aa, Giardia lamblia
GTTALMIAAERGYLQCV

SEQ ID NO: 3156400 - protein, 17 aa, Giardia lamblia
GTTALMLAAEQGHLDCV

SEQ ID NO: 3156401 - protein, 17 aa, Giardia lamblia
GTTALMYAAEREFCDAI

SEQ ID NO: 3156402 - protein, 19 aa, Giardia lamblia
GTTARALLEQHWREENPQI

SEQ ID NO: 3156403 - protein, 44 aa, Giardia lamblia
GTVDESRLTTGLAFARRPTEGPGFCEKVKIGIARFCLSPPKTDM

SEQ ID NO: 3156404 - protein, 25 aa, Giardia lamblia
GTVPGASTNLVFPDLPPPQFSNYSQ

SEQ ID NO: 3156405 - protein, 23 aa, Giardia lamblia
GTVPRPASMNAVADVKTRLKEYK

SEQ ID NO: 3156406 - protein, 23 aa, Giardia lamblia
GTVVHLPKFLTLESVENSNTIVR

SEQ ID NO: 3156407 - protein, 25 aa, Giardia lamblia
GTWFAVLYLPPGIYQYKFIVDGNWV

SEQ ID NO: 3156408 - protein, 21 aa, Giardia lamblia
GTYRYIPQNVTLTMQPPTTGP

SEQ ID NO: 3156409 - protein, 19 aa, Giardia lamblia
GTYTKASTIMMIRKQIGEL

SEQ ID NO: 3156410 - protein, 23 aa, Giardia lamblia
GVAEALRNFIICQDDFPQTCKNE

SEQ ID NO: 3156411 - protein, 23 aa, Giardia lamblia
GVAETCLRFISYMKKSPIENVKE

SEQ ID NO: 3156412 - protein, 17 aa, Giardia lamblia
GVARTGVIGNLAMDKHV

SEQ ID NO: 3156413 - protein, 17 aa, Giardia lamblia
GVAVHCKAGLGRTGSLI

SEQ ID NO: 3156414 - protein, 20 aa, Giardia lamblia
GVAVSEILKNVSLEGPQIYF

SEQ ID NO: 3156415 - protein, 20 aa, Giardia lamblia
GVAYAGYWLQLEALRTGAIP

SEQ ID NO: 3156416 - protein, 22 aa, Giardia lamblia
GVCTSFSFSACFLAAICSCIDA

SEQ ID NO: 3156417 - protein, 25 aa, Giardia lamblia
GVDAGRPLWTYVRMLDRMRSKTQDT

SEQ ID NO: 3156418 - protein, 26 aa, Giardia lamblia
GVDGNYRAGALLSDIVDVDMSRAAKT

SEQ ID NO: 3156419 - protein, 22 aa, Giardia lamblia
GVDIGCGMFVIRLPNKLLEPYE

SEQ ID NO: 3156420 - protein, 25 aa, Giardia lamblia
GVDLIPRLMSAYYRVIRKKIEDSVP

SEQ ID NO: 3156421 - protein, 23 aa, Giardia lamblia
GVEECPTCHTPVGCIHAENQGVS

SEQ ID NO: 3156422 - protein, 17 aa, Giardia lamblia
GVENVVMSHIFAVREEN

SEQ ID NO: 3156423 - protein, 22 aa, Giardia lamblia
GVESTFLLDLFESVIQDEARLQ

SEQ ID NO: 3156424 - protein, 25 aa, Giardia lamblia
GVEVQELKEAISLLTTTNETLEKQV

SEQ ID NO: 3156425 - protein, 25 aa, Giardia lamblia
GVFADPGLNRYLIDEALSYQYGILD

SEQ ID NO: 3156426 - protein, 25 aa, Giardia lamblia
GVFLPDGRTPLMLAVEAGSIDCVRL

SEQ ID NO: 3156427 - protein, 20 aa, Giardia lamblia
GVFLPGEFVVIHYSNKELHL

SEQ ID NO: 3156428 - protein, 17 aa, Giardia lamblia
GVFTLRLTPSFDPGHVS

SEQ ID NO: 3156429 - protein, 22 aa, Giardia lamblia
GVGGVEGLVRWMLVEDSTSQDK

SEQ ID NO: 3156430 - protein, 29 aa, Giardia lamblia
GVGKAPCPNCPAVLEPRDNPAPSFPPNLE

SEQ ID NO: 3156431 - protein, 17 aa, Giardia lamblia
GVGKTGGNVLVLGATNY

SEQ ID NO: 3156432 - protein, 17 aa, Giardia lamblia
GVGPELQQKVQLYHKEA

SEQ ID NO: 3156433 - protein, 29 aa, Giardia lamblia
GVGTERPADWAWRLFIGLFTDQLSGDEWL

SEQ ID NO: 3156434 - protein, 18 aa, Giardia lamblia
GVHDECRFIPEINQHSKN

SEQ ID NO: 3156435 - protein, 27 aa, Giardia lamblia
GVHGRYCYDSRMALIIAAEKHYEELAK

SEQ ID NO: 3156436 - protein, 17 aa, Giardia lamblia
GVIHNMLDFVKLLYNER

SEQ ID NO: 3156437 - protein, 18 aa, Giardia lamblia
GVIPRWSEYIDVFSTGPC

SEQ ID NO: 3156438 - protein, 35 aa, Giardia lamblia
GVKCKIVDLSEGWFPDILTRLVLDSVTPSLHTVSR

SEQ ID NO: 3156439 - protein, 18 aa, Giardia lamblia
GVKLFAKLVDKLSEQKVH

SEQ ID NO: 3156440 - protein, 18 aa, Giardia lamblia
GVKMMSDLYLRQMCAELV

SEQ ID NO: 3156441 - protein, 24 aa, Giardia lamblia
GVKNIKLGPSLPLFLTDEILQFLE

SEQ ID NO: 3156442 - protein, 22 aa, Giardia lamblia
GVKRFDGRLEMLSYLKEAALYR

SEQ ID NO: 3156443 - protein, 28 aa, Giardia lamblia
GVLAKVKAFMYAQVWGILHHRELNEVDP

SEQ ID NO: 3156444 - protein, 25 aa, Giardia lamblia
GVLDICTFLPSTYFCCANLEIEEVT

SEQ ID NO: 3156445 - protein, 21 aa, Giardia lamblia
GVLPEVSFSPQFVNLGKITVG

SEQ ID NO: 3156446 - protein, 18 aa, Giardia lamblia
GVLQRFELLTTRGSAEQR

SEQ ID NO: 3156447 - protein, 17 aa, Giardia lamblia
GVLRKLYTAARHDGVSC

SEQ ID NO: 3156448 - protein, 22 aa, Giardia lamblia
GVLRYDPRISIGDTVVLVSTKG

SEQ ID NO: 3156449 - protein, 18 aa, Giardia lamblia
GVLTRYSYYTVRLISLIH

SEQ ID NO: 3156450 - protein, 23 aa, Giardia lamblia
GVLYPWHRICVLQGSSKPVQTLQ

SEQ ID NO: 3156451 - protein, 25 aa, Giardia lamblia
GVMAKIDALGSWYSKEVERLEGIKY

SEQ ID NO: 3156452 - protein, 26 aa, Giardia lamblia
GVMWYCSGATGFWCGSIKGLTNDIQA

SEQ ID NO: 3156453 - protein, 18 aa, Giardia lamblia
GVNLCMKEHSAVATTGVQ

SEQ ID NO: 3156454 - protein, 23 aa, Giardia lamblia
GVNQEFKDLLGAARKGAANSADL

SEQ ID NO: 3156455 - protein, 20 aa, Giardia lamblia
GVPCEFRYHRSVVESRYREV

SEQ ID NO: 3156456 - protein, 29 aa, Giardia lamblia
GVPLQRYDFDLMFLAPRTQNTWETLYEPE

SEQ ID NO: 3156457 - protein, 23 aa, Giardia lamblia
GVPMGPDLLSWIGPYLPPDQQYA

SEQ ID NO: 3156458 - protein, 28 aa, Giardia lamblia
GVPMLSILPLFWSLGLNKIVNYAPDLTL

SEQ ID NO: 3156459 - protein, 19 aa, Giardia lamblia
GVPMPRREPPQIARTPLEP

SEQ ID NO: 3156460 - protein, 25 aa, Giardia lamblia
GVPNLACLLLKLRDTGLENIDSLFL

SEQ ID NO: 3156461 - protein, 20 aa, Giardia lamblia
GVPTGQIVDVWGSVDSPIYT

SEQ ID NO: 3156462 - protein, 26 aa, Giardia lamblia
GVPTVRCVLKAPGLYCTQVEDTTAAP

SEQ ID NO: 3156463 - protein, 25 aa, Giardia lamblia
GVPVLAHACLKYDWDATVKVLEEAV

SEQ ID NO: 3156464 - protein, 17 aa, Giardia lamblia
GVPYPSLIMPLSTNSLA

SEQ ID NO: 3156465 - protein, 20 aa, Giardia lamblia
GVQDIDGWTALMVAACINNA

SEQ ID NO: 3156466 - protein, 19 aa, Giardia lamblia
GVQLLEGVASYCLTDNGVD

SEQ ID NO: 3156467 - protein, 23 aa, Giardia lamblia
GVQLRPGGIVSCDFGADSFISST

SEQ ID NO: 3156468 - protein, 23 aa, Giardia lamblia
GVSALICDLCHYQGLTVSESLNV

SEQ ID NO: 3156469 - protein, 19 aa, Giardia lamblia
GVSCRDITTIVLRAATQSV

SEQ ID NO: 3156470 - protein, 25 aa, Giardia lamblia
GVSGRKQLFCIPTNELQEMGTVLDK

SEQ ID NO: 3156471 - protein, 23 aa, Giardia lamblia
GVSIICGVLSNPLIDVSLDRDHF

SEQ ID NO: 3156472 - protein, 24 aa, Giardia lamblia
GVSKGSPLVNVFTYIIRDTQLVVS

SEQ ID NO: 3156473 - protein, 23 aa, Giardia lamblia
GVSLHRIVCLLSYPYTKTSQRLV

SEQ ID NO: 3156474 - protein, 24 aa, Giardia lamblia
GVSVQRFRHALTLNTGIKDVRGII

SEQ ID NO: 3156475 - protein, 17 aa, Giardia lamblia
GVTAFAFNMGEDRNSPA

SEQ ID NO: 3156476 - protein, 18 aa, Giardia lamblia
GVTALMIAAGNGFTNIVK

SEQ ID NO: 3156477 - protein, 19 aa, Giardia lamblia
GVTALMIAAVLGYHEMIEL

SEQ ID NO: 3156478 - protein, 26 aa, Giardia lamblia
GVTLSRPRLAAAPGSHARHCAIDAAM

SEQ ID NO: 3156479 - protein, 18 aa, Giardia lamblia
GVTRLPGPSGDAVASSDS

SEQ ID NO: 3156480 - protein, 20 aa, Giardia lamblia
GVTVKRAAAVLADHQQRHKL

SEQ ID NO: 3156481 - protein, 21 aa, Giardia lamblia
GVTVLRRVRKTDNVRLAAVSG

SEQ ID NO: 3156482 - protein, 19 aa, Giardia lamblia
GVVNYLLFLLATFGEQDIE

SEQ ID NO: 3156483 - protein, 17 aa, Giardia lamblia
GVVSSLLVLDPALRYSA

SEQ ID NO: 3156484 - protein, 29 aa, Giardia lamblia
GVVTECPHCSLCRSTLRAALDEVTALTSG

SEQ ID NO: 3156485 - protein, 27 aa, Giardia lamblia
GVYKLCDCWCGGISMSATIDETNQDWI

SEQ ID NO: 3156486 - protein, 21 aa, Giardia lamblia
GVYPDRVYVAYGDRLFFSTVP

SEQ ID NO: 3156487 - protein, 26 aa, Giardia lamblia
GVYSAIELLKLAGLYEDVADILQGNS

SEQ ID NO: 3156488 - protein, 24 aa, Giardia lamblia
GWDSDEAKQIWSFGPVGASSGHMT

SEQ ID NO: 3156489 - protein, 18 aa, Giardia lamblia
GWFALAIASQRGYLDILN

SEQ ID NO: 3156490 - protein, 20 aa, Giardia lamblia
GWHAFPKPTPLILAAGHGHL

SEQ ID NO: 3156491 - protein, 21 aa, Giardia lamblia
GWIIKPKDLVTGLPLLALDDE

SEQ ID NO: 3156492 - protein, 21 aa, Giardia lamblia
GWRGDPRAGPVPLHEHYDRCV

SEQ ID NO: 3156493 - protein, 19 aa, Giardia lamblia
GWSALMFAAYYGYTDMVGL

SEQ ID NO: 3156494 - protein, 18 aa, Giardia lamblia
GWSALVWAASSPEASLAC

SEQ ID NO: 3156495 - protein, 18 aa, Giardia lamblia
GWTALIYAVMNNYIDCAK

SEQ ID NO: 3156496 - protein, 23 aa, Giardia lamblia
GWTALKIASNFGYPDIVESLVSF

SEQ ID NO: 3156497 - protein, 17 aa, Giardia lamblia
GWTALMCAAQNGHLGVV

SEQ ID NO: 3156498 - protein, 18 aa, Giardia lamblia
GWTALMFSAKGNFIKCMD

SEQ ID NO: 3156499 - protein, 18 aa, Giardia lamblia
GWTALMMASYLGYTQIIK

SEQ ID NO: 3156500 - protein, 18 aa, Giardia lamblia
GWTALTIAAYFGCLECVK

SEQ ID NO: 3156501 - protein, 18 aa, Giardia lamblia
GWTALVWCAYLDNKCSLC

SEQ ID NO: 3156502 - protein, 19 aa, Giardia lamblia
GWTPLFLAAYNVDFGALNT

SEQ ID NO: 3156503 - protein, 19 aa, Giardia lamblia
GWYLAGTKLFIDIYTPELT

SEQ ID NO: 3156504 - protein, 22 aa, Giardia lamblia
GYADDSSYCFSQSSQPGEDASS

SEQ ID NO: 3156505 - protein, 21 aa, Giardia lamblia
GYADIVRLLAKYEARCIESSF

SEQ ID NO: 3156506 - protein, 17 aa, Giardia lamblia
GYALHYLYIKELSMFAI

SEQ ID NO: 3156507 - protein, 25 aa, Giardia lamblia
GYANAKIFKCPKCPEPHNYFPTSSS

SEQ ID NO: 3156508 - protein, 19 aa, Giardia lamblia
GYARSFLFLCNRLGIPCIF

SEQ ID NO: 3156509 - protein, 21 aa, Giardia lamblia
GYATLCLSAAIAGLKLSCARW

SEQ ID NO: 3156510 - protein, 23 aa, Giardia lamblia
GYAVCGLADPCIHVVSFPIPKIS

SEQ ID NO: 3156511 - protein, 26 aa, Giardia lamblia
GYAVHYFKHSHYMGAGQASNNYRAIT

SEQ ID NO: 3156512 - protein, 18 aa, Giardia lamblia
GYDKVELTTHLRAHADIL

SEQ ID NO: 3156513 - protein, 23 aa, Giardia lamblia
GYDLLSIKFNFAGFTPDINNMKY

SEQ ID NO: 3156514 - protein, 23 aa, Giardia lamblia
GYEAFYGCATQFYFGSKDEALRK

SEQ ID NO: 3156515 - protein, 19 aa, Giardia lamblia
GYETHSWTPLMRAALTGDT

SEQ ID NO: 3156516 - protein, 17 aa, Giardia lamblia
GYFKEAYLNNLSLSSFL

SEQ ID NO: 3156517 - protein, 22 aa, Giardia lamblia
GYFSRSSLLGIYDVALQYHNAY

SEQ ID NO: 3156518 - protein, 18 aa, Giardia lamblia
GYGELVYLLATSTSTIEQ

SEQ ID NO: 3156519 - protein, 22 aa, Giardia lamblia
GYHKCVEILLPYEKRMQNTDGY

SEQ ID NO: 3156520 - protein, 20 aa, Giardia lamblia
GYHPRLLRRSAPAFTIQRKG

SEQ ID NO: 3156521 - protein, 30 aa, Giardia lamblia
GYIAPEIAEYCPFKPPADVWSLGTCLYELC

SEQ ID NO: 3156522 - protein, 25 aa, Giardia lamblia
GYIDRCFRSLQRLHYAAARSALRKP

SEQ ID NO: 3156523 - protein, 24 aa, Giardia lamblia
GYIGVELAEAFGLKNQPCTLIDGS

SEQ ID NO: 3156524 - protein, 17 aa, Giardia lamblia
GYISMLSLLLIFEAGKR

SEQ ID NO: 3156525 - protein, 21 aa, Giardia lamblia
GYKFDLRIYVLITSVDPLIMY

SEQ ID NO: 3156526 - protein, 19 aa, Giardia lamblia
GYKGIRVKVRIVSKNRQPT

SEQ ID NO: 3156527 - protein, 24 aa, Giardia lamblia
GYKLLEVPICFSERVNGSSSLSCK

SEQ ID NO: 3156528 - protein, 18 aa, Giardia lamblia
GYKLLKILGSGGFGSVYL

SEQ ID NO: 3156529 - protein, 25 aa, Giardia lamblia
GYKRIKASAGSILLTGIMLDVNRVK

SEQ ID NO: 3156530 - protein, 26 aa, Giardia lamblia
GYLLGRLMREYHALDVYEAVRAHDSH

SEQ ID NO: 3156531 - protein, 18 aa, Giardia lamblia
GYLLRYIDRDLIIQLNVS

SEQ ID NO: 3156532 - protein, 21 aa, Giardia lamblia
GYLLTKLIYFAPWPAIEDILV

SEQ ID NO: 3156533 - protein, 24 aa, Giardia lamblia
GYLQRRLVKCLEDLSVSYDFTVRN

SEQ ID NO: 3156534 - protein, 17 aa, Giardia lamblia
GYLVHRRYCIVNESAIV

SEQ ID NO: 3156535 - protein, 24 aa, Giardia lamblia
GYMRECLDKEEFEQVLSVRRKLDH

SEQ ID NO: 3156536 - protein, 19 aa, Giardia lamblia
GYNILSRNVRKVFPVTDKI

SEQ ID NO: 3156537 - protein, 20 aa, Giardia lamblia
GYPECVRLLKDRENDIVDRD

SEQ ID NO: 3156538 - protein, 22 aa, Giardia lamblia
GYPREVTALMKAAELGDVVLVF

SEQ ID NO: 3156539 - protein, 22 aa, Giardia lamblia
GYPSIEAVCLFNLADVPTIIKT

SEQ ID NO: 3156540 - protein, 18 aa, Giardia lamblia
GYQAYGWGDYGTSQDETT

SEQ ID NO: 3156541 - protein, 29 aa, Giardia lamblia
GYQGGPCNCAQCITFPHLPYKCIPFQQQL

SEQ ID NO: 3156542 - protein, 22 aa, Giardia lamblia
GYRDIAEILLPYEEDVTEEHGR

SEQ ID NO: 3156543 - protein, 27 aa, Giardia lamblia
GYRPEAFPKERHCLSRGSRSSSSHADT

SEQ ID NO: 3156544 - protein, 17 aa, Giardia lamblia
GYRPILIEINSNPCLAL

SEQ ID NO: 3156545 - protein, 24 aa, Giardia lamblia
GYRPMQWEFSRLNITYNVMSKRRL

SEQ ID NO: 3156546 - protein, 21 aa, Giardia lamblia
GYRQIASWLDNWLLTNKQIEN

SEQ ID NO: 3156547 - protein, 18 aa, Giardia lamblia
GYSALYLALLSNHVGIAR

SEQ ID NO: 3156548 - protein, 20 aa, Giardia lamblia
GYSECAKLLLEKEGCMQRSY

SEQ ID NO: 3156549 - protein, 18 aa, Giardia lamblia
GYSKDGFDSSALRDRIMG

SEQ ID NO: 3156550 - protein, 26 aa, Giardia lamblia
GYSMRCTAEIFPIHGYTVSVSQSKDI

SEQ ID NO: 3156551 - protein, 25 aa, Giardia lamblia
GYSRVKLRVPIPINEDPRCLDVTVD

SEQ ID NO: 3156552 - protein, 22 aa, Giardia lamblia
GYSSEELVRIGGRKTELMEAAM

SEQ ID NO: 3156553 - protein, 20 aa, Giardia lamblia
GYTACWLALLNGHHDCAECL

SEQ ID NO: 3156554 - protein, 18 aa, Giardia lamblia
GYTAIFIGTGVGIPRSLG

SEQ ID NO: 3156555 - protein, 17 aa, Giardia lamblia
GYTALMYAAERNYVDIV

SEQ ID NO: 3156556 - protein, 17 aa, Giardia lamblia
GYTALVLAARHDHLECV

SEQ ID NO: 3156557 - protein, 24 aa, Giardia lamblia
GYTDIVAVLACFEAGLADNDGKTA

SEQ ID NO: 3156558 - protein, 22 aa, Giardia lamblia
GYTDLLPLLGTVVPAPVATTPF

SEQ ID NO: 3156559 - protein, 19 aa, Giardia lamblia
GYTGLMIAANLGYTLVVTE

SEQ ID NO: 3156560 - protein, 18 aa, Giardia lamblia
GYTKLVMYLADYEAGLQD

SEQ ID NO: 3156561 - protein, 18 aa, Giardia lamblia
GYTSIGFQHGIGLSLPLP

SEQ ID NO: 3156562 - protein, 18 aa, Giardia lamblia
GYTYICLHGCEYDEDSTS

SEQ ID NO: 3156563 - protein, 22 aa, Giardia lamblia
GYVECVRILAPYEQKLQDAHSN

SEQ ID NO: 3156564 - protein, 23 aa, Giardia lamblia
GYYECAKLLANREHCLQNCEGET

SEQ ID NO: 3156565 - protein, 20 aa, Giardia lamblia
HAALHGYSYLVYRLISENTE

SEQ ID NO: 3156566 - protein, 29 aa, Giardia lamblia
HAASLLCKRIMPCIIDLQKHCRELYSNGH

SEQ ID NO: 3156567 - protein, 19 aa, Giardia lamblia
HADCSLTIMFYEDECICAL

SEQ ID NO: 3156568 - protein, 23 aa, Giardia lamblia
HADCVKLLLEKEGSMRDNNGQTA

SEQ ID NO: 3156569 - protein, 18 aa, Giardia lamblia
HADGAILQQARYINQSLF

SEQ ID NO: 3156570 - protein, 28 aa, Giardia lamblia
HADHSACYKELLALHSRCEAFQSFIETS

SEQ ID NO: 3156571 - protein, 25 aa, Giardia lamblia
HADLGSWPLLGPRYRVDILGACTEA

SEQ ID NO: 3156572 - protein, 20 aa, Giardia lamblia
HADMPPKSFKLSSASTAIPL

SEQ ID NO: 3156573 - protein, 19 aa, Giardia lamblia
HADTIRILLDIEKKITNTQ

SEQ ID NO: 3156574 - protein, 17 aa, Giardia lamblia
HADVLRFLSNMKEKPRI

SEQ ID NO: 3156575 - protein, 17 aa, Giardia lamblia
HAECVGAILCLDALSGD

SEQ ID NO: 3156576 - protein, 24 aa, Giardia lamblia
HAENPASFCPRVCSKIEKPTAVLD

SEQ ID NO: 3156577 - protein, 17 aa, Giardia lamblia
HAESRIMILTKELRETQ

SEQ ID NO: 3156578 - protein, 22 aa, Giardia lamblia
HAETLFPLSVILLSSITKSSAI

SEQ ID NO: 3156579 - protein, 21 aa, Giardia lamblia
HAFEDSSLCMDMIQGGAVTAA

SEQ ID NO: 3156580 - protein, 17 aa, Giardia lamblia
HAFPSRMTVGMLIESLA

SEQ ID NO: 3156581 - protein, 25 aa, Giardia lamblia
HAGCVRLLLEREGCMYDKSGRTGLM

SEQ ID NO: 3156582 - protein, 23 aa, Giardia lamblia
HAGDLGRACADVFVHITRNKDFD

SEQ ID NO: 3156583 - protein, 19 aa, Giardia lamblia
HAGLSVALIEAFKILISAG

SEQ ID NO: 3156584 - protein, 17 aa, Giardia lamblia
HAGVWKLFMELFDHLPI

SEQ ID NO: 3156585 - protein, 17 aa, Giardia lamblia
HAGVWKMYMELFDQLPL

SEQ ID NO: 3156586 - protein, 20 aa, Giardia lamblia
HAGYASICRILGPMENGFRD

SEQ ID NO: 3156587 - protein, 17 aa, Giardia lamblia
HAHALLSRLTRLIDSQR

SEQ ID NO: 3156588 - protein, 27 aa, Giardia lamblia
HAHIRCPRAFRNVIFPSTTELFSALTR

SEQ ID NO: 3156589 - protein, 22 aa, Giardia lamblia
HAHPAPLLQHFSIFDKRHTGVI

SEQ ID NO: 3156590 - protein, 18 aa, Giardia lamblia
HAIKALLPHNRFIYDENG

SEQ ID NO: 3156591 - protein, 18 aa, Giardia lamblia
HAIPEAFPSLAALESQLT

SEQ ID NO: 3156592 - protein, 17 aa, Giardia lamblia
HAKAMFISFNYALLNNG

SEQ ID NO: 3156593 - protein, 19 aa, Giardia lamblia
HAKCSITAVDIFTGKKYED

SEQ ID NO: 3156594 - protein, 19 aa, Giardia lamblia
HAKFLEFHQGSFGPERLCL

SEQ ID NO: 3156595 - protein, 20 aa, Giardia lamblia
HAKPPKFGMEETLLKLSCVG

SEQ ID NO: 3156596 - protein, 19 aa, Giardia lamblia
HAKSLWQRCLTFNGDASDR

SEQ ID NO: 3156597 - protein, 24 aa, Giardia lamblia
HAKSRPMPELDAVVSHNKTAYTAS

SEQ ID NO: 3156598 - protein, 18 aa, Giardia lamblia
HALACIDIIFNVLDPITH

SEQ ID NO: 3156599 - protein, 26 aa, Giardia lamblia
HALCPRIVPEEIMYSFASARAVLPSN

SEQ ID NO: 3156600 - protein, 18 aa, Giardia lamblia
HALFERISLLSSDADKDD

SEQ ID NO: 3156601 - protein, 18 aa, Giardia lamblia
HALGKRIISEYMDKKENY

SEQ ID NO: 3156602 - protein, 20 aa, Giardia lamblia
HALLELLAMKYSEHQPFTFG

SEQ ID NO: 3156603 - protein, 30 aa, Giardia lamblia
HALLNIVSLVPIDLEIYWYQELDDNERVYI

SEQ ID NO: 3156604 - protein, 24 aa, Giardia lamblia
HALSALRSSACGLDGATVMGALTP

SEQ ID NO: 3156605 - protein, 19 aa, Giardia lamblia
HALYAARVRKCMLSVNVRL

SEQ ID NO: 3156606 - protein, 23 aa, Giardia lamblia
HALYAARVRKCMLSVNVRLEQRT

SEQ ID NO: 3156607 - protein, 21 aa, Giardia lamblia
HAMKRLRSVMLQRRDSGGRTA

SEQ ID NO: 3156608 - protein, 18 aa, Giardia lamblia
HANKRSWSRGKERHASLK

SEQ ID NO: 3156609 - protein, 20 aa, Giardia lamblia
HAPDCRGHSISPYPPSLSLL

SEQ ID NO: 3156610 - protein, 25 aa, Giardia lamblia
HAPFRMHATEFIFTAGLNSQALKDV

SEQ ID NO: 3156611 - protein, 19 aa, Giardia lamblia
HAQCVKLLLEKEAQQTDVL

SEQ ID NO: 3156612 - protein, 24 aa, Giardia lamblia
HAQGSKAFTAQKCVEKSSFATEFL

SEQ ID NO: 3156613 - protein, 18 aa, Giardia lamblia
HAQHEELVLLTAKDDEIA

SEQ ID NO: 3156614 - protein, 27 aa, Giardia lamblia
HAQKSYLFYRQRYRKIDPIPGVHVSEL

SEQ ID NO: 3156615 - protein, 21 aa, Giardia lamblia
HARAGHFDESEFVPAEPAPRT

SEQ ID NO: 3156616 - protein, 24 aa, Giardia lamblia
HAREDRLRLATTPAPVRTLVAGCF

SEQ ID NO: 3156617 - protein, 18 aa, Giardia lamblia
HARIKLSGLTRMIVLNSS

SEQ ID NO: 3156618 - protein, 23 aa, Giardia lamblia
HASASLKHRSRVCLMAIVRRAFL

SEQ ID NO: 3156619 - protein, 26 aa, Giardia lamblia
HASGCSREELLACQALNAEYEKKLAA

SEQ ID NO: 3156620 - protein, 25 aa, Giardia lamblia
HASIPDCFLFGNSVFENGLPSVPKD

SEQ ID NO: 3156621 - protein, 19 aa, Giardia lamblia
HASIPNCFLFGNSQIGDAS

SEQ ID NO: 3156622 - protein, 26 aa, Giardia lamblia
HASLLEIIKLLAPREARFISTRDKRS

SEQ ID NO: 3156623 - protein, 23 aa, Giardia lamblia
HASPCYTCGGDVFKELPTGEIIN

SEQ ID NO: 3156624 - protein, 21 aa, Giardia lamblia
HASQCSMTRSLLRRSDLQHSH

SEQ ID NO: 3156625 - protein, 18 aa, Giardia lamblia
HASRSGACVGALRMVETY

SEQ ID NO: 3156626 - protein, 25 aa, Giardia lamblia
HASSEYPPELTFEFVEGTGDLVVKV

SEQ ID NO: 3156627 - protein, 23 aa, Giardia lamblia
HATGARITPKMKYCVSDEYKRKV

SEQ ID NO: 3156628 - protein, 18 aa, Giardia lamblia
HATVCLMHQTRLVWQTSV

SEQ ID NO: 3156629 - protein, 24 aa, Giardia lamblia
HAVAARADLILGFGEDEEPPNPPD

SEQ ID NO: 3156630 - protein, 23 aa, Giardia lamblia
HAVRSAFEIQRLLDIGDKNRTVA

SEQ ID NO: 3156631 - protein, 19 aa, Giardia lamblia
HAYIRGGVVSHGVAEILSY

SEQ ID NO: 3156632 - protein, 19 aa, Giardia lamblia
HCAVPVGEGRLLIHGGEYG

SEQ ID NO: 3156633 - protein, 20 aa, Giardia lamblia
HCDICRQCYKKQFFDTHKCD

SEQ ID NO: 3156634 - protein, 22 aa, Giardia lamblia
HCDLRPATILRKQNIFKLSFFS

SEQ ID NO: 3156635 - protein, 24 aa, Giardia lamblia
HCEIESYTLLGYVVGLIPYPHHNQ

SEQ ID NO: 3156636 - protein, 23 aa, Giardia lamblia
HCFMERPMRCFFSQFGKVLQVRV

SEQ ID NO: 3156637 - protein, 26 aa, Giardia lamblia
HCHFSPAFIGTWFRPDHVYLLNATDP

SEQ ID NO: 3156638 - protein, 22 aa, Giardia lamblia
HCIAGACLYAIVGSGAVFRFEL

SEQ ID NO: 3156639 - protein, 24 aa, Giardia lamblia
HCLARLGASELVLFGGVSNKQLST

SEQ ID NO: 3156640 - protein, 19 aa, Giardia lamblia
HCPETGLLESIFKRLDSLL

SEQ ID NO: 3156641 - protein, 24 aa, Giardia lamblia
HCPSPEDWFSAAINQEYASVSKWI

SEQ ID NO: 3156642 - protein, 24 aa, Giardia lamblia
HCQHARSMLQLEVQKDKQLQDGTD

SEQ ID NO: 3156643 - protein, 20 aa, Giardia lamblia
HCRHGTAAYSVRFESTVTPH

SEQ ID NO: 3156644 - protein, 48 aa, Giardia lamblia
HCSPSWPQFMRVCPILYWSYVDVWDFLKRFRIHYCTLYDQGYTSLGSA

SEQ ID NO: 3156645 - protein, 20 aa, Giardia lamblia
HCVALKLSSLSASVCEAYCY

SEQ ID NO: 3156646 - protein, 17 aa, Giardia lamblia
HCVDTGLALTVNIPYCW

SEQ ID NO: 3156647 - protein, 23 aa, Giardia lamblia
HDAIKLNPMTAVLKVDSIKIDCS

SEQ ID NO: 3156648 - protein, 23 aa, Giardia lamblia
HDDHELRCLILMELPAIHASGGM

SEQ ID NO: 3156649 - protein, 24 aa, Giardia lamblia
HDDTQRTALMWAARYNNSAAVKLL

SEQ ID NO: 3156650 - protein, 18 aa, Giardia lamblia
HDEIKRLREDWEQARAQA

SEQ ID NO: 3156651 - protein, 27 aa, Giardia lamblia
HDELLRLILRLTGYKLAITGYRFVHSM

SEQ ID NO: 3156652 - protein, 17 aa, Giardia lamblia
HDGGLCIFSTQLEESVG

SEQ ID NO: 3156653 - protein, 19 aa, Giardia lamblia
HDGGPNLILCRNARQEAAS

SEQ ID NO: 3156654 - protein, 17 aa, Giardia lamblia
HDINLFAYHLPMDAHPI

SEQ ID NO: 3156655 - protein, 17 aa, Giardia lamblia
HDKILKTKNPVFVSCGW

SEQ ID NO: 3156656 - protein, 19 aa, Giardia lamblia
HDKYGWTALIWAIDNNNIE

SEQ ID NO: 3156657 - protein, 22 aa, Giardia lamblia
HDLESMILDWVRQIRTVLSSSP

SEQ ID NO: 3156658 - protein, 25 aa, Giardia lamblia
HDLHKFAWVHYACWGVMRDDILSRF

SEQ ID NO: 3156659 - protein, 19 aa, Giardia lamblia
HDLIAPFIFELNLPHPESF

SEQ ID NO: 3156660 - protein, 24 aa, Giardia lamblia
HDLLCVCGKPVGNCCTLNRELVSQ

SEQ ID NO: 3156661 - protein, 25 aa, Giardia lamblia
HDMASYRAGIIELRQKLLEQEKKRQ

SEQ ID NO: 3156662 - protein, 27 aa, Giardia lamblia
HDMIVACLYLRVSGKFNAELEVKTHSH

SEQ ID NO: 3156663 - protein, 17 aa, Giardia lamblia
HDMVDMLLLLTAAQEKG

SEQ ID NO: 3156664 - protein, 25 aa, Giardia lamblia
HDPLLQWLLTMVWQQYKTHIDALSN

SEQ ID NO: 3156665 - protein, 26 aa, Giardia lamblia
HDPSDLKPLLSISCLKLIVIKHNSLC

SEQ ID NO: 3156666 - protein, 25 aa, Giardia lamblia
HDRLIRVTAFCYDRVKDIGEHYKRY

SEQ ID NO: 3156667 - protein, 20 aa, Giardia lamblia
HDSTMRCTRCYMEWEDAFLK

SEQ ID NO: 3156668 - protein, 21 aa, Giardia lamblia
HDTKCREFNSLLSSLKQCEGE

SEQ ID NO: 3156669 - protein, 29 aa, Giardia lamblia
HDTRGRTALMIAAAWGKINVVRDLIPFQK

SEQ ID NO: 3156670 - protein, 19 aa, Giardia lamblia
HDVSRLAAQLQEAHAQIAD

SEQ ID NO: 3156671 - protein, 28 aa, Giardia lamblia
HDVYLRIAPELFLKRLVVGGLNRVFEIN

SEQ ID NO: 3156672 - protein, 38 aa, Giardia lamblia
HDYKFKRIYKFLTDDLFYRFEFIWNEFSHINRDVSLVH

SEQ ID NO: 3156673 - protein, 23 aa, Giardia lamblia
HEAKMSYLLMEHFTLGDLADVIR

SEQ ID NO: 3156674 - protein, 21 aa, Giardia lamblia
HEAVVRILLNYETLYVNQDGD

SEQ ID NO: 3156675 - protein, 31 aa, Giardia lamblia
HEDKIYFSHGFPLEKSRVIRKPEELNPVIFD

SEQ ID NO: 3156676 - protein, 22 aa, Giardia lamblia
HEDYPAGGIGLEYDTYGHASAD

SEQ ID NO: 3156677 - protein, 17 aa, Giardia lamblia
HEECVRILLELTQEAYT

SEQ ID NO: 3156678 - protein, 21 aa, Giardia lamblia
HEEPCFTFSALIIASLSAGGT

SEQ ID NO: 3156679 - protein, 19 aa, Giardia lamblia
HEEYCVVSSLPRITGTKPD

SEQ ID NO: 3156680 - protein, 17 aa, Giardia lamblia
HEGHTALYYALLSRNMV

SEQ ID NO: 3156681 - protein, 23 aa, Giardia lamblia
HEHGMRARARFVVGNSYFDEATA

SEQ ID NO: 3156682 - protein, 27 aa, Giardia lamblia
HEHLFLRTSRVLAWVALPSEFLFTKAS

SEQ ID NO: 3156683 - protein, 22 aa, Giardia lamblia
HEHPFILYVGFRRLYTVPLPSQ

SEQ ID NO: 3156684 - protein, 20 aa, Giardia lamblia
HEHRSCVIFEDLLKYIRDNH

SEQ ID NO: 3156685 - protein, 24 aa, Giardia lamblia
HEHVECIPRFFKLGDCCGDIIEAL

SEQ ID NO: 3156686 - protein, 22 aa, Giardia lamblia
HEIAVPSFHHFFDKHKHRLLQP

SEQ ID NO: 3156687 - protein, 18 aa, Giardia lamblia
HEILLKHSILTLNMEKDL

SEQ ID NO: 3156688 - protein, 22 aa, Giardia lamblia
HEKNCRLKILSTIKVLEGRYHK

SEQ ID NO: 3156689 - protein, 19 aa, Giardia lamblia
HELARGIVPANRFLENPRA

SEQ ID NO: 3156690 - protein, 23 aa, Giardia lamblia
HELERFKDSYITNINQLRRDAES

SEQ ID NO: 3156691 - protein, 22 aa, Giardia lamblia
HELGSTFTISAFKPRSQRLDQS

SEQ ID NO: 3156692 - protein, 24 aa, Giardia lamblia
HELLRSRFIFFYVHNEVQIKQVMK

SEQ ID NO: 3156693 - protein, 22 aa, Giardia lamblia
HELPARWSAVASHLSSFLQCEN

SEQ ID NO: 3156694 - protein, 30 aa, Giardia lamblia
HELSIRQLHRYRLFLDQLISIKDRELLVGR

SEQ ID NO: 3156695 - protein, 19 aa, Giardia lamblia
HELWRLLTQLSEIVMHIGF

SEQ ID NO: 3156696 - protein, 19 aa, Giardia lamblia
HELYRLCVENGLIRPSTEQ

SEQ ID NO: 3156697 - protein, 18 aa, Giardia lamblia
HENEKLLVQRVRELAQNL

SEQ ID NO: 3156698 - protein, 24 aa, Giardia lamblia
HENISDRCLLMIKQYFKRNMAQLG

SEQ ID NO: 3156699 - protein, 20 aa, Giardia lamblia
HENLEIFNILVPYNPSLLDI

SEQ ID NO: 3156700 - protein, 20 aa, Giardia lamblia
HENLSHAESRIMILTKELRE

SEQ ID NO: 3156701 - protein, 22 aa, Giardia lamblia
HEQAGYYLGWALTYSLDSAQCA

SEQ ID NO: 3156702 - protein, 18 aa, Giardia lamblia
HEQIAHMLLLKESGLETK

SEQ ID NO: 3156703 - protein, 25 aa, Giardia lamblia
HERCQLEPLFYCHAADADARKREEL

SEQ ID NO: 3156704 - protein, 19 aa, Giardia lamblia
HERNLPIPINPDSIYLQKT

SEQ ID NO: 3156705 - protein, 24 aa, Giardia lamblia
HESGRKAIKEDGSGLGYTALMVAA

SEQ ID NO: 3156706 - protein, 18 aa, Giardia lamblia
HETIAILAGENARLRACI

SEQ ID NO: 3156707 - protein, 25 aa, Giardia lamblia
HETLPSCKFVHKWLESSSAKDMLPL

SEQ ID NO: 3156708 - protein, 17 aa, Giardia lamblia
HETRACLQRGQLFQELI

SEQ ID NO: 3156709 - protein, 20 aa, Giardia lamblia
HETYGFPLELVRDAVASAGD

SEQ ID NO: 3156710 - protein, 22 aa, Giardia lamblia
HEVSFWARFVDWLFENIGFVKS

SEQ ID NO: 3156711 - protein, 23 aa, Giardia lamblia
HEVSKRLAEYTVEKISGIYDMLD

SEQ ID NO: 3156712 - protein, 17 aa, Giardia lamblia
HEYSFCKAHIINEIRTR

SEQ ID NO: 3156713 - protein, 23 aa, Giardia lamblia
HFAFGEGFGALSIAILLDNIDTV

SEQ ID NO: 3156714 - protein, 17 aa, Giardia lamblia
HFALRLATVSGKTECAN

SEQ ID NO: 3156715 - protein, 25 aa, Giardia lamblia
HFARVRCLSEQLALLKGQESQLNAK

SEQ ID NO: 3156716 - protein, 25 aa, Giardia lamblia
HFDCIKLLLCEQGITGPDCVTALMV

SEQ ID NO: 3156717 - protein, 18 aa, Giardia lamblia
HFDIMKKRDAEAVRVIAD

SEQ ID NO: 3156718 - protein, 23 aa, Giardia lamblia
HFFEVSRRLLIVFREHPDEHASA

SEQ ID NO: 3156719 - protein, 19 aa, Giardia lamblia
HFFSFDWNIPSFLTLPKIT

SEQ ID NO: 3156720 - protein, 29 aa, Giardia lamblia
HFISLQCHFCYSCNCRFLYVLDFMPSELT

SEQ ID NO: 3156721 - protein, 18 aa, Giardia lamblia
HFLDAVVVLYSESIRYRF

SEQ ID NO: 3156722 - protein, 25 aa, Giardia lamblia
HFMADPVIRVPFKTVPGSLPRSIAL

SEQ ID NO: 3156723 - protein, 20 aa, Giardia lamblia
HFRRPYWKGTTALMIASAMG

SEQ ID NO: 3156724 - protein, 21 aa, Giardia lamblia
HFSNMWSFLEDRVYTYKAPTF

SEQ ID NO: 3156725 - protein, 25 aa, Giardia lamblia
HGAFAQNCTWVYIGNPGVKKGQGNT

SEQ ID NO: 3156726 - protein, 25 aa, Giardia lamblia
HGAGHTALMCAADWGDVECVKLLLS

SEQ ID NO: 3156727 - protein, 24 aa, Giardia lamblia
HGALKRARDSAGMTSFELACSLGK

SEQ ID NO: 3156728 - protein, 17 aa, Giardia lamblia
HGASFFGLRGYYNCEVR

SEQ ID NO: 3156729 - protein, 19 aa, Giardia lamblia
HGASFFGLRGYYNCEVRDF

SEQ ID NO: 3156730 - protein, 26 aa, Giardia lamblia
HGASRWKDYEPLLIAMQARHQAKRSL

SEQ ID NO: 3156731 - protein, 25 aa, Giardia lamblia
HGAVLSFSLTRGFEKLRSMLPNASF

SEQ ID NO: 3156732 - protein, 25 aa, Giardia lamblia
HGAYDIAKLLAPYEAGMVCPADNSC

SEQ ID NO: 3156733 - protein, 22 aa, Giardia lamblia
HGCNCFCTMGGGIAASISSRFP

SEQ ID NO: 3156734 - protein, 25 aa, Giardia lamblia
HGCSARTGLSVSYSRTFSGGKIGSN

SEQ ID NO: 3156735 - protein, 24 aa, Giardia lamblia
HGDLLKKHELEVAALKKKLDDGNA

SEQ ID NO: 3156736 - protein, 35 aa, Giardia lamblia
HGDRILCGACLESSFFCYNDPIAVKYANDKAKASS

SEQ ID NO: 3156737 - protein, 18 aa, Giardia lamblia
HGDRSILELLLIFRNKKE

SEQ ID NO: 3156738 - protein, 17 aa, Giardia lamblia
HGDTALMYAVRVNNPSL

SEQ ID NO: 3156739 - protein, 18 aa, Giardia lamblia
HGEARSLLKKNLGDAEQS

SEQ ID NO: 3156740 - protein, 18 aa, Giardia lamblia
HGELKSSIQSAAPYLQEL

SEQ ID NO: 3156741 - protein, 24 aa, Giardia lamblia
HGESEKLVRCLFIMARQYESAVIF

SEQ ID NO: 3156742 - protein, 19 aa, Giardia lamblia
HGEVVRILLEKEAGISTNW

SEQ ID NO: 3156743 - protein, 23 aa, Giardia lamblia
HGEYNLTPAVLWSLIVMTLTSYG

SEQ ID NO: 3156744 - protein, 28 aa, Giardia lamblia
HGFVFPLPRRRFSVTLMQAGKEVCALDG

SEQ ID NO: 3156745 - protein, 17 aa, Giardia lamblia
HGGAPLRADVCGDEINK

SEQ ID NO: 3156746 - protein, 18 aa, Giardia lamblia
HGGMKIGGATFDPMNPLG

SEQ ID NO: 3156747 - protein, 17 aa, Giardia lamblia
HGGYMAMRYSCDARESV

SEQ ID NO: 3156748 - protein, 25 aa, Giardia lamblia
HGHAACVELLMPFERRIRDKRGKTA

SEQ ID NO: 3156749 - protein, 25 aa, Giardia lamblia
HGHLECVKYFATAYPKRFTAYADLI

SEQ ID NO: 3156750 - protein, 25 aa, Giardia lamblia
HGHRKCSLLLLSEACISDPSGKLCF

SEQ ID NO: 3156751 - protein, 31 aa, Giardia lamblia
HGIMTTPLVDRLCLFMYGIARVLQIKMGGRY

SEQ ID NO: 3156752 - protein, 19 aa, Giardia lamblia
HGISSTLLIRGLRGSGKTQ

SEQ ID NO: 3156753 - protein, 23 aa, Giardia lamblia
HGKACAIFLIAYLNICKQHSETH

SEQ ID NO: 3156754 - protein, 28 aa, Giardia lamblia
HGKAFRYRELYSLLSCMLIINPDKRPPV

SEQ ID NO: 3156755 - protein, 18 aa, Giardia lamblia
HGKFDYVQNMARFTRLDP

SEQ ID NO: 3156756 - protein, 28 aa, Giardia lamblia
HGKRAYRKDSCCVLEIKNQTALVAVLPR

SEQ ID NO: 3156757 - protein, 24 aa, Giardia lamblia
HGLALRACCCPVCEYRVVYQSTYV

SEQ ID NO: 3156758 - protein, 19 aa, Giardia lamblia
HGLCVARHLLDSGMLSSIC

SEQ ID NO: 3156759 - protein, 17 aa, Giardia lamblia
HGLSALMYAVLRSDATS

SEQ ID NO: 3156760 - protein, 21 aa, Giardia lamblia
HGLSYKITYFKGVPHGKACAI

SEQ ID NO: 3156761 - protein, 27 aa, Giardia lamblia
HGLYPRNGIKFGCDYTVYRVPTPEQAH

SEQ ID NO: 3156762 - protein, 17 aa, Giardia lamblia
HGMTGLHIAARGGDTDQ

SEQ ID NO: 3156763 - protein, 32 aa, Giardia lamblia
HGRLHLNNVMLRWDGSVALCDMAYLFPNSTPY

SEQ ID NO: 3156764 - protein, 17 aa, Giardia lamblia
HGSEIAAEFGGRDQSLI

SEQ ID NO: 3156765 - protein, 18 aa, Giardia lamblia
HGSFPMLRSIHVESRAGR

SEQ ID NO: 3156766 - protein, 25 aa, Giardia lamblia
HGSVECIKLLLGELAIQNSMGETAL

SEQ ID NO: 3156767 - protein, 17 aa, Giardia lamblia
HGTCIFLYPKYVAENEM

SEQ ID NO: 3156768 - protein, 26 aa, Giardia lamblia
HGTGFYECPFCYAVVCDISECVCCGL

SEQ ID NO: 3156769 - protein, 21 aa, Giardia lamblia
HGVAFKKTFTYAGHEQLPKRI

SEQ ID NO: 3156770 - protein, 26 aa, Giardia lamblia
HGVMACGRKASAYRGVDFRKAYLSPD

SEQ ID NO: 3156771 - protein, 24 aa, Giardia lamblia
HGYIDCFHALLSHEVLVRSSKGLS

SEQ ID NO: 3156772 - protein, 19 aa, Giardia lamblia
HGYLEIVQLLMPFEGHIYT

SEQ ID NO: 3156773 - protein, 19 aa, Giardia lamblia
HGYLPPSRIPEVFDVTKKS

SEQ ID NO: 3156774 - protein, 22 aa, Giardia lamblia
HHCTYGRQLLRQNIPDALIRLI

SEQ ID NO: 3156775 - protein, 19 aa, Giardia lamblia
HHGCTALYYAARGGHKSIV

SEQ ID NO: 3156776 - protein, 29 aa, Giardia lamblia
HHGGLRPYGVSFLFGGWDAHLGFQLYQTD

SEQ ID NO: 3156777 - protein, 19 aa, Giardia lamblia
HHKMIRKKEDISISFSTMD

SEQ ID NO: 3156778 - protein, 23 aa, Giardia lamblia
HHLGRLKAKLARLESQLISEVTK

SEQ ID NO: 3156779 - protein, 27 aa, Giardia lamblia
HHLLLKLPFSYTIESMIERIGDALNID

SEQ ID NO: 3156780 - protein, 19 aa, Giardia lamblia
HHNCVPVPVHWRLRNGRFL

SEQ ID NO: 3156781 - protein, 30 aa, Giardia lamblia
HHNDHYVCTAPACKTVMVAFGTKDELLAHQ

SEQ ID NO: 3156782 - protein, 22 aa, Giardia lamblia
HHPFNIRPGLRRIPLYDEGQLL

SEQ ID NO: 3156783 - protein, 23 aa, Giardia lamblia
HHPKTAAEFSRWYMQQTVYWTEL

SEQ ID NO: 3156784 - protein, 17 aa, Giardia lamblia
HHPSGLVHLQLAGEKVK

SEQ ID NO: 3156785 - protein, 18 aa, Giardia lamblia
HHSPCGRVDCYLIENISD

SEQ ID NO: 3156786 - protein, 39 aa, Giardia lamblia
HHSYKYDLTLPFFPHLLPYKLAFAGFLRRESRTNDTLAR

SEQ ID NO: 3156787 - protein, 24 aa, Giardia lamblia
HHTPRSGTPWGTILSAADQSQSDC

SEQ ID NO: 3156788 - protein, 18 aa, Giardia lamblia
HHTRVSLFAPQSFTETIS

SEQ ID NO: 3156789 - protein, 19 aa, Giardia lamblia
HHYCMALNLVYPGQVNMHR

SEQ ID NO: 3156790 - protein, 26 aa, Giardia lamblia
HIAIHRGCTCIHTLEPGMTPTDIAAK

SEQ ID NO: 3156791 - protein, 25 aa, Giardia lamblia
HIAKIWDEIYIAYKPTDPHAVLSVE

SEQ ID NO: 3156792 - protein, 24 aa, Giardia lamblia
HICFYTSVCAPIFSIDLPYVPFYT

SEQ ID NO: 3156793 - protein, 27 aa, Giardia lamblia
HICICVDCCRHCYDTNAGVCPACDQES

SEQ ID NO: 3156794 - protein, 19 aa, Giardia lamblia
HIDCVKLLLQEAGSKTQSG

SEQ ID NO: 3156795 - protein, 19 aa, Giardia lamblia
HIDCVKLLLQKEAGMRQND

SEQ ID NO: 3156796 - protein, 17 aa, Giardia lamblia
HIDLRLRILDSPGVVLN

SEQ ID NO: 3156797 - protein, 25 aa, Giardia lamblia
HIDQAGKLCNGWTALMTAAYRGHID

SEQ ID NO: 3156798 - protein, 19 aa, Giardia lamblia
HIDVALTLLEHAYKHEASH

SEQ ID NO: 3156799 - protein, 17 aa, Giardia lamblia
HIECVKLLVEEFDIVDN

SEQ ID NO: 3156800 - protein, 17 aa, Giardia lamblia
HIFNLKSLHLGHIAKGF

SEQ ID NO: 3156801 - protein, 27 aa, Giardia lamblia
HIFSVKFRLSIYENVIYYLTGVPPYID

SEQ ID NO: 3156802 - protein, 25 aa, Giardia lamblia
HIGDVFCDLCLTISNAMTFNKSNTV

SEQ ID NO: 3156803 - protein, 28 aa, Giardia lamblia
HIGSKLVYRLVRYAAIVLLECVESQGCS

SEQ ID NO: 3156804 - protein, 22 aa, Giardia lamblia
HIHAEEVISIYFDHRSDHRLLS

SEQ ID NO: 3156805 - protein, 20 aa, Giardia lamblia
HIHFLRLPFYNRNYRSKRTY

SEQ ID NO: 3156806 - protein, 21 aa, Giardia lamblia
HIKKLFSAIETLVFGEPLVMA

SEQ ID NO: 3156807 - protein, 18 aa, Giardia lamblia
HIKVSKSRGLYTLLGLTS

SEQ ID NO: 3156808 - protein, 17 aa, Giardia lamblia
HILARISSRPGQVGTAD

SEQ ID NO: 3156809 - protein, 26 aa, Giardia lamblia
HILKKHCPEQLVWSIIRQVAEAFNYI

SEQ ID NO: 3156810 - protein, 24 aa, Giardia lamblia
HILVADADFLWVFSERNLVEPLIR

SEQ ID NO: 3156811 - protein, 31 aa, Giardia lamblia
HILVKSVPCRMNISFISPIFRSGDSFWEENL

SEQ ID NO: 3156812 - protein, 20 aa, Giardia lamblia
HIMDVYKMRGEFSVEGGTPL

SEQ ID NO: 3156813 - protein, 19 aa, Giardia lamblia
HINEVFQTIFVRKLDHVVA

SEQ ID NO: 3156814 - protein, 17 aa, Giardia lamblia
HINPKLYRPEYRQSSSS

SEQ ID NO: 3156815 - protein, 26 aa, Giardia lamblia
HINRRRCELEVKKIRTTYVSPSFPVR

SEQ ID NO: 3156816 - protein, 25 aa, Giardia lamblia
HIPAPPEWEPWILPPKVSLAEYNNY

SEQ ID NO: 3156817 - protein, 19 aa, Giardia lamblia
HIPELMDVMLKRDSDKYTT

SEQ ID NO: 3156818 - protein, 17 aa, Giardia lamblia
HIPLPKHLLTPILASAT

SEQ ID NO: 3156819 - protein, 22 aa, Giardia lamblia
HIPPQVCSLKTQPQEHFQPVYV

SEQ ID NO: 3156820 - protein, 21 aa, Giardia lamblia
HIPTNCTVAIKILSKSKITQM

SEQ ID NO: 3156821 - protein, 27 aa, Giardia lamblia
HIQKLSFLFRCYERLALDAIDHVRAVN

SEQ ID NO: 3156822 - protein, 19 aa, Giardia lamblia
HIRAYGCILMKDCANKELI

SEQ ID NO: 3156823 - protein, 24 aa, Giardia lamblia
HIREGLRLHVRFADVLRLPRVYAL

SEQ ID NO: 3156824 - protein, 27 aa, Giardia lamblia
HIRGLFRYGALPAREIVPILSQCTEEL

SEQ ID NO: 3156825 - protein, 19 aa, Giardia lamblia
HIRKCFDAMKSLDVTDKAG

SEQ ID NO: 3156826 - protein, 23 aa, Giardia lamblia
HISAIIRKSVPYAKHTAFLDEHI

SEQ ID NO: 3156827 - protein, 25 aa, Giardia lamblia
HISRGRRSALLIAMELPRRDCADLL

SEQ ID NO: 3156828 - protein, 24 aa, Giardia lamblia
HISRTGGTITELMKAAADNNLVAT

SEQ ID NO: 3156829 - protein, 25 aa, Giardia lamblia
HIVDLKKVYSGFAIDKSSFSTENSA

SEQ ID NO: 3156830 - protein, 20 aa, Giardia lamblia
HIVLPEARRTRTELVHSQTT

SEQ ID NO: 3156831 - protein, 22 aa, Giardia lamblia
HIVRSNRLCTILNIMRNYKEST

SEQ ID NO: 3156832 - protein, 20 aa, Giardia lamblia
HIYCKMSKDIFGPVPEGGNQ

SEQ ID NO: 3156833 - protein, 17 aa, Giardia lamblia
HIYIYSSNVDSHFEKIG

SEQ ID NO: 3156834 - protein, 20 aa, Giardia lamblia
HIYNNVDVLYRYKLKLKEVK

SEQ ID NO: 3156835 - protein, 31 aa, Giardia lamblia
HIYRVPVKRGKQFICLLKMHHRLIELKVRAN

SEQ ID NO: 3156836 - protein, 17 aa, Giardia lamblia
HKACKQLLGGKFRMILS

SEQ ID NO: 3156837 - protein, 26 aa, Giardia lamblia
HKAQPVCLPFSIIVLIPITVNSINSG

SEQ ID NO: 3156838 - protein, 23 aa, Giardia lamblia
HKDAHSLSRLFPISDRRLLVRLQ

SEQ ID NO: 3156839 - protein, 28 aa, Giardia lamblia
HKDIFLPRCEFCLGWGAIDVLPALFSSQ

SEQ ID NO: 3156840 - protein, 17 aa, Giardia lamblia
HKDIITMLLKYEKDSSW

SEQ ID NO: 3156841 - protein, 26 aa, Giardia lamblia
HKDNGIYVLACFDILEYLRVYNGSQG

SEQ ID NO: 3156842 - protein, 25 aa, Giardia lamblia
HKDSRGWTALMYAAFLSFNSSIPLL

SEQ ID NO: 3156843 - protein, 24 aa, Giardia lamblia
HKEGEGYCACMIAAKKNNLESLRL

SEQ ID NO: 3156844 - protein, 22 aa, Giardia lamblia
HKEILNRMKSAIVYGTSAKHLG

SEQ ID NO: 3156845 - protein, 17 aa, Giardia lamblia
HKEIVCLLRNYEAGERD

SEQ ID NO: 3156846 - protein, 35 aa, Giardia lamblia
HKELVGAFGYSAVPGLPSFRSMNMGGGRHEVIHDT

SEQ ID NO: 3156847 - protein, 24 aa, Giardia lamblia
HKFSDKILFCDQCGHFCLQEILDS

SEQ ID NO: 3156848 - protein, 26 aa, Giardia lamblia
HKHALFRAAIHYERHLLLQEGFTELM

SEQ ID NO: 3156849 - protein, 17 aa, Giardia lamblia
HKIEYLLAGRFMCDPKN

SEQ ID NO: 3156850 - protein, 19 aa, Giardia lamblia
HKIIYRRYAGLYFTICCDL

SEQ ID NO: 3156851 - protein, 21 aa, Giardia lamblia
HKILLPCPQWDDLHLEQSAAT

SEQ ID NO: 3156852 - protein, 23 aa, Giardia lamblia
HKIMKREQHCFIHYYRPKGSILL

SEQ ID NO: 3156853 - protein, 23 aa, Giardia lamblia
HKISRLRDTACDGILELLLITSP

SEQ ID NO: 3156854 - protein, 20 aa, Giardia lamblia
HKKLRLLKYFDREYREKTKR

SEQ ID NO: 3156855 - protein, 18 aa, Giardia lamblia
HKKYPYELEIVGFEERYG

SEQ ID NO: 3156856 - protein, 17 aa, Giardia lamblia
HKLAYFAKSSMCSKESE

SEQ ID NO: 3156857 - protein, 19 aa, Giardia lamblia
HKLDKHFYTTVSQRIGFQR

SEQ ID NO: 3156858 - protein, 19 aa, Giardia lamblia
HKLINDFKARSDAISQTLS

SEQ ID NO: 3156859 - protein, 19 aa, Giardia lamblia
HKLPYVRHDLSIKGHTTLL

SEQ ID NO: 3156860 - protein, 20 aa, Giardia lamblia
HKLRKSMHISSIPKNLLDFN

SEQ ID NO: 3156861 - protein, 18 aa, Giardia lamblia
HKLRREYNIGSLLTSAAE

SEQ ID NO: 3156862 - protein, 21 aa, Giardia lamblia
HKLTNGSFFSRSSWTNEGIVV

SEQ ID NO: 3156863 - protein, 17 aa, Giardia lamblia
HKMLLLHSVPGCGKTSI

SEQ ID NO: 3156864 - protein, 25 aa, Giardia lamblia
HKPDFGRLGPEFDMTVLHSDQNSES

SEQ ID NO: 3156865 - protein, 25 aa, Giardia lamblia
HKRGLFECRETIVAGFSDLNRAIEE

SEQ ID NO: 3156866 - protein, 20 aa, Giardia lamblia
HKRRIVQLLFLRASDSQLLI

SEQ ID NO: 3156867 - protein, 17 aa, Giardia lamblia
HKRSLLVATDEGEKEAE

SEQ ID NO: 3156868 - protein, 18 aa, Giardia lamblia
HKSFFVALVRCSHSHASM

SEQ ID NO: 3156869 - protein, 19 aa, Giardia lamblia
HKSRLKPAAEVEGCEANLE

SEQ ID NO: 3156870 - protein, 23 aa, Giardia lamblia
HKSTDFRGSSHLNTIDSHNVSIS

SEQ ID NO: 3156871 - protein, 26 aa, Giardia lamblia
HKSYLVLPMLCRRIVERNLCVSVKKR

SEQ ID NO: 3156872 - protein, 20 aa, Giardia lamblia
HKTLVPRTEWIQDKDVNNCQ

SEQ ID NO: 3156873 - protein, 18 aa, Giardia lamblia
HKVEHPFVPAKSAKKLTV

SEQ ID NO: 3156874 - protein, 24 aa, Giardia lamblia
HKVPMNRIRVLRGYYYDEGKNFAI

SEQ ID NO: 3156875 - protein, 25 aa, Giardia lamblia
HKVPMNRIRVLRGYYYDEGKNTNIQ

SEQ ID NO: 3156876 - protein, 18 aa, Giardia lamblia
HKVWVRARIHTVRATGKS

SEQ ID NO: 3156877 - protein, 17 aa, Giardia lamblia
HKYDEELAALKLEVEQL

SEQ ID NO: 3156878 - protein, 27 aa, Giardia lamblia
HKYGSLFRKGCDCIDVFMDIPTTDGYL

SEQ ID NO: 3156879 - protein, 18 aa, Giardia lamblia
HLAALYVTQIVKGLIFIH

SEQ ID NO: 3156880 - protein, 19 aa, Giardia lamblia
HLAGSWLQRLESICDAISD

SEQ ID NO: 3156881 - protein, 17 aa, Giardia lamblia
HLAMIKALENRFTEFSG

SEQ ID NO: 3156882 - protein, 19 aa, Giardia lamblia
HLAQHWGISVIHALNPKFM

SEQ ID NO: 3156883 - protein, 26 aa, Giardia lamblia
HLASEIPCLACGVAVTDISKVRYEVD

SEQ ID NO: 3156884 - protein, 19 aa, Giardia lamblia
HLDCVKLLLEKERDISGVD

SEQ ID NO: 3156885 - protein, 23 aa, Giardia lamblia
HLDFLRILLSICGRTKNISANII

SEQ ID NO: 3156886 - protein, 20 aa, Giardia lamblia
HLDLKCSNIMIGGDGLVKLV

SEQ ID NO: 3156887 - protein, 24 aa, Giardia lamblia
HLDLPCIIAIVGKFVAREDSYLSI

SEQ ID NO: 3156888 - protein, 20 aa, Giardia lamblia
HLEAIKLLREAELKCVDTSG

SEQ ID NO: 3156889 - protein, 23 aa, Giardia lamblia
HLECCKLLCSQEIFMVDNEGHDA

SEQ ID NO: 3156890 - protein, 20 aa, Giardia lamblia
HLECVKLLLEKERDISGVDA

SEQ ID NO: 3156891 - protein, 23 aa, Giardia lamblia
HLEGCIVCSGEGLAQGKHYYNKI

SEQ ID NO: 3156892 - protein, 23 aa, Giardia lamblia
HLEIVKLLAERQIRLQANNGLSA

SEQ ID NO: 3156893 - protein, 20 aa, Giardia lamblia
HLEIVKLLIDHEARRQTKDG

SEQ ID NO: 3156894 - protein, 23 aa, Giardia lamblia
HLEKTKDLKGRTCLTYAACNGKL

SEQ ID NO: 3156895 - protein, 20 aa, Giardia lamblia
HLESVKLLLSEACLLDHTGY

SEQ ID NO: 3156896 - protein, 19 aa, Giardia lamblia
HLETKALELSERVVRSEQK

SEQ ID NO: 3156897 - protein, 22 aa, Giardia lamblia
HLGKRCKRSSCNGTALMLAASN

SEQ ID NO: 3156898 - protein, 26 aa, Giardia lamblia
HLGPCSHKLCKACLRKMFDQLNDECL

SEQ ID NO: 3156899 - protein, 27 aa, Giardia lamblia
HLGPTRIAPRLALKIEQKSGCTNLVLD

SEQ ID NO: 3156900 - protein, 20 aa, Giardia lamblia
HLGSKLKAGAQFKTQVIPEL

SEQ ID NO: 3156901 - protein, 17 aa, Giardia lamblia
HLIRCMLHMDPRRRPSI

SEQ ID NO: 3156902 - protein, 27 aa, Giardia lamblia
HLIYKEWAENAVFLSIIGDFNFWDKAA

SEQ ID NO: 3156903 - protein, 20 aa, Giardia lamblia
HLKDYLLPHDQLFQTIVTKD

SEQ ID NO: 3156904 - protein, 19 aa, Giardia lamblia
HLKHCRFIRELSHHCPSHH

SEQ ID NO: 3156905 - protein, 20 aa, Giardia lamblia
HLKKLLKPSTLCISQPIYKD

SEQ ID NO: 3156906 - protein, 21 aa, Giardia lamblia
HLKLTGLQILLGVQSSDASVI

SEQ ID NO: 3156907 - protein, 18 aa, Giardia lamblia
HLKTTVSLEEHRLLEEEA

SEQ ID NO: 3156908 - protein, 17 aa, Giardia lamblia
HLLAEKMPVDWICYSHI

SEQ ID NO: 3156909 - protein, 20 aa, Giardia lamblia
HLLCRSRIAVAEGIEKKCSG

SEQ ID NO: 3156910 - protein, 27 aa, Giardia lamblia
HLLDLHMCFIGRLIARKQLENLNPYSQ

SEQ ID NO: 3156911 - protein, 17 aa, Giardia lamblia
HLLDVIYADVLRTLGEY

SEQ ID NO: 3156912 - protein, 19 aa, Giardia lamblia
HLLEHVLRLELDPIAERTM

SEQ ID NO: 3156913 - protein, 25 aa, Giardia lamblia
HLLEKLSSPLVWSVEYVDGVSPEQS

SEQ ID NO: 3156914 - protein, 24 aa, Giardia lamblia
HLLHENRLLLAVFDEWRYAVIRRH

SEQ ID NO: 3156915 - protein, 17 aa, Giardia lamblia
HLLMARPMLTTTKLKQL

SEQ ID NO: 3156916 - protein, 19 aa, Giardia lamblia
HLMEEARQGLSSFIVNPQI

SEQ ID NO: 3156917 - protein, 20 aa, Giardia lamblia
HLNACKLLLPFEKQMQNTID

SEQ ID NO: 3156918 - protein, 17 aa, Giardia lamblia
HLNHGMCDVALNWMGGF

SEQ ID NO: 3156919 - protein, 18 aa, Giardia lamblia
HLNIVRILLEEGDTASPA

SEQ ID NO: 3156920 - protein, 24 aa, Giardia lamblia
HLNPKSTLPIFLPFLDEAESSIYS

SEQ ID NO: 3156921 - protein, 17 aa, Giardia lamblia
HLNRVGYMFQGRSALFK

SEQ ID NO: 3156922 - protein, 17 aa, Giardia lamblia
HLNSVLYPQTYVPDRAT

SEQ ID NO: 3156923 - protein, 19 aa, Giardia lamblia
HLPAYRLSPVTGVYESIRY

SEQ ID NO: 3156924 - protein, 26 aa, Giardia lamblia
HLPLEVRKRIFIWLSDEREDTCARNN

SEQ ID NO: 3156925 - protein, 21 aa, Giardia lamblia
HLPPDIRIVLLSRVAGKPQSM

SEQ ID NO: 3156926 - protein, 20 aa, Giardia lamblia
HLQPESFIRSKLCAGTKNSR

SEQ ID NO: 3156927 - protein, 20 aa, Giardia lamblia
HLREEEFRRASARVSALEAS

SEQ ID NO: 3156928 - protein, 25 aa, Giardia lamblia
HLRGALKKRRVMMHAGDLVLVSLRE

SEQ ID NO: 3156929 - protein, 24 aa, Giardia lamblia
HLRKKCATVFLGIKTLLSQGKEDE

SEQ ID NO: 3156930 - protein, 19 aa, Giardia lamblia
HLRKLKTLDMPCAIQTQTV

SEQ ID NO: 3156931 - protein, 22 aa, Giardia lamblia
HLRKMFEGVQTFQFQRGGTNTV

SEQ ID NO: 3156932 - protein, 24 aa, Giardia lamblia
HLSLLRKSFTCFFNDLVRQRILPQ

SEQ ID NO: 3156933 - protein, 26 aa, Giardia lamblia
HLSYLKWRKAIMFQILTEVYKAVECS

SEQ ID NO: 3156934 - protein, 24 aa, Giardia lamblia
HLTVFQFPAHLPVAKMTRTQSAAR

SEQ ID NO: 3156935 - protein, 26 aa, Giardia lamblia
HLVICSFCTDKIYTVESIWKCPYCRA

SEQ ID NO: 3156936 - protein, 17 aa, Giardia lamblia
HLVLEWVSFRPEFLSAA

SEQ ID NO: 3156937 - protein, 24 aa, Giardia lamblia
HLVLVCKGQSPGSAPLVQVTRRPV

SEQ ID NO: 3156938 - protein, 19 aa, Giardia lamblia
HLVMTALVRRCLMSDSMVR

SEQ ID NO: 3156939 - protein, 26 aa, Giardia lamblia
HLYDILSCQSTILSHFVLFSSSAGAS

SEQ ID NO: 3156940 - protein, 18 aa, Giardia lamblia
HLYELCPGIPNYSGLPYS

SEQ ID NO: 3156941 - protein, 25 aa, Giardia lamblia
HLYPDGFARFLLFCRHPTVISEQRL

SEQ ID NO: 3156942 - protein, 24 aa, Giardia lamblia
HLYQDVCGLYSTYPHHAVPKQSIR

SEQ ID NO: 3156943 - protein, 19 aa, Giardia lamblia
HMDEEKRSLVGILTATHKE

SEQ ID NO: 3156944 - protein, 17 aa, Giardia lamblia
HMGRTALMHAVKYNRQR

SEQ ID NO: 3156945 - protein, 18 aa, Giardia lamblia
HMKECTRAHKTRRSQLND

SEQ ID NO: 3156946 - protein, 18 aa, Giardia lamblia
HMLCVPRISQVNQHYFEA

SEQ ID NO: 3156947 - protein, 19 aa, Giardia lamblia
HMLPSMILPHELLRRPYYK

SEQ ID NO: 3156948 - protein, 19 aa, Giardia lamblia
HMLPVCPLLLTLTLSCNDL

SEQ ID NO: 3156949 - protein, 21 aa, Giardia lamblia
HMLRLYKQLFFRAFHLRVIYI

SEQ ID NO: 3156950 - protein, 19 aa, Giardia lamblia
HMPPEEVLRKIEVLESANL

SEQ ID NO: 3156951 - protein, 24 aa, Giardia lamblia
HMQQQLKSLLGMRLGRDGQDSEKE

SEQ ID NO: 3156952 - protein, 24 aa, Giardia lamblia
HMTERGRELWAKHTRGLSLGEPLD

SEQ ID NO: 3156953 - protein, 24 aa, Giardia lamblia
HNALKQLCADVCWVTDRSFSVLGD

SEQ ID NO: 3156954 - protein, 23 aa, Giardia lamblia
HNAVEMITKLAPLVPNNTKEDKN

SEQ ID NO: 3156955 - protein, 20 aa, Giardia lamblia
HNCFSSCASCDVSNNLWLCL

SEQ ID NO: 3156956 - protein, 21 aa, Giardia lamblia
HNEIARVLAPYEYDIKDSRGL

SEQ ID NO: 3156957 - protein, 25 aa, Giardia lamblia
HNGEIRATLLMQIFEVLSRFDPRVE

SEQ ID NO: 3156958 - protein, 18 aa, Giardia lamblia
HNGGSFFRQVLKRFGVLA

SEQ ID NO: 3156959 - protein, 24 aa, Giardia lamblia
HNGHYEICKLLAPKEIGKTRRDGW

SEQ ID NO: 3156960 - protein, 17 aa, Giardia lamblia
HNGRTALMLAAMAGHSD

SEQ ID NO: 3156961 - protein, 23 aa, Giardia lamblia
HNHELKATLMLKDSEIAKSMQAN

SEQ ID NO: 3156962 - protein, 24 aa, Giardia lamblia
HNHFHVPGPFLIVVPISTLSAWQM

SEQ ID NO: 3156963 - protein, 20 aa, Giardia lamblia
HNIINCKYAPLPSSVSEGMK

SEQ ID NO: 3156964 - protein, 19 aa, Giardia lamblia
HNIPEKKGLGLATRGTIAA

SEQ ID NO: 3156965 - protein, 31 aa, Giardia lamblia
HNKMMSIRAFLECWDSIDVLGRVGEMVGINL

SEQ ID NO: 3156966 - protein, 25 aa, Giardia lamblia
HNKRLQEVTPMKGLSIVVPISDSLS

SEQ ID NO: 3156967 - protein, 20 aa, Giardia lamblia
HNLECIRLLKQYEGKTLNAN

SEQ ID NO: 3156968 - protein, 22 aa, Giardia lamblia
HNLKMKISLHIYDLSQGIAKTV

SEQ ID NO: 3156969 - protein, 23 aa, Giardia lamblia
HNLMFIACTAFSNAISESDLMFV

SEQ ID NO: 3156970 - protein, 17 aa, Giardia lamblia
HNPEVYTLLKAFHEYKI

SEQ ID NO: 3156971 - protein, 19 aa, Giardia lamblia
HNRLVEALESIAFSLTLGD

SEQ ID NO: 3156972 - protein, 20 aa, Giardia lamblia
HNSLCIPFEPLFTTRMSNQQ

SEQ ID NO: 3156973 - protein, 31 aa, Giardia lamblia
HNTDLAKMYLCLEKEAKKYSSLLSVTCVEAA

SEQ ID NO: 3156974 - protein, 25 aa, Giardia lamblia
HNTMPWQMLTDYLLKHHKCYPRAVS

SEQ ID NO: 3156975 - protein, 18 aa, Giardia lamblia
HNVGGFCDPLLQQAILRF

SEQ ID NO: 3156976 - protein, 32 aa, Giardia lamblia
HNVTWIKRFLLLRQRCLELHGPSLLSELVRSM

SEQ ID NO: 3156977 - protein, 22 aa, Giardia lamblia
HPADKIDILFSFLKSKSNSKIV

SEQ ID NO: 3156978 - protein, 23 aa, Giardia lamblia
HPALGRELLRPMPYVEKYGQIQG

SEQ ID NO: 3156979 - protein, 17 aa, Giardia lamblia
HPCIFTIHDCVLSLAET

SEQ ID NO: 3156980 - protein, 19 aa, Giardia lamblia
HPDCARLLCKRTSEHDVSS

SEQ ID NO: 3156981 - protein, 17 aa, Giardia lamblia
HPDCVKLLVKHKGERDV

SEQ ID NO: 3156982 - protein, 23 aa, Giardia lamblia
HPDGIRIPWPEYIIDLPKLDRYG

SEQ ID NO: 3156983 - protein, 21 aa, Giardia lamblia
HPEDTLSCVWIFRYAATSPVA

SEQ ID NO: 3156984 - protein, 21 aa, Giardia lamblia
HPFIKKGRRPVVLCIVDGMGY

SEQ ID NO: 3156985 - protein, 19 aa, Giardia lamblia
HPFNPDYEAIIPVRQQGTY

SEQ ID NO: 3156986 - protein, 21 aa, Giardia lamblia
HPFTVRHVLQDGSSTHFLTHN

SEQ ID NO: 3156987 - protein, 17 aa, Giardia lamblia
HPHISRITAAVKDKSDY

SEQ ID NO: 3156988 - protein, 20 aa, Giardia lamblia
HPHLIPCMFHIYGNHILQAM

SEQ ID NO: 3156989 - protein, 22 aa, Giardia lamblia
HPILRFYLRVLTFYEGRYSFTL

SEQ ID NO: 3156990 - protein, 24 aa, Giardia lamblia
HPKKGNMAYRVKVRLLLNKDDCVK

SEQ ID NO: 3156991 - protein, 23 aa, Giardia lamblia
HPLCPLERYHVHLTKLPSHSSSF

SEQ ID NO: 3156992 - protein, 20 aa, Giardia lamblia
HPLIPARTGALMCLNCGNIV

SEQ ID NO: 3156993 - protein, 21 aa, Giardia lamblia
HPLTIRLYLAIAKTYEQICIE

SEQ ID NO: 3156994 - protein, 18 aa, Giardia lamblia
HPLYPPKLDVERLPIYIN

SEQ ID NO: 3156995 - protein, 18 aa, Giardia lamblia
HPMLRRGLFYAHRDFEEF

SEQ ID NO: 3156996 - protein, 20 aa, Giardia lamblia
HPMNLSELESLLSRSLATHL

SEQ ID NO: 3156997 - protein, 23 aa, Giardia lamblia
HPMRNCISCPAVWNRDRSRHLSP

SEQ ID NO: 3156998 - protein, 19 aa, Giardia lamblia
HPNCVRLLLEKQGGMQRHD

SEQ ID NO: 3156999 - protein, 24 aa, Giardia lamblia
HPNFKAVTSAFCLALHTCFSLLLN

SEQ ID NO: 3157000 - protein, 22 aa, Giardia lamblia
HPNGRLAIVSSLDNRLRLFEID

SEQ ID NO: 3157001 - protein, 28 aa, Giardia lamblia
HPNKEGLTALCFACMYGSIDCVRVLLGK

SEQ ID NO: 3157002 - protein, 30 aa, Giardia lamblia
HPNLPECKRAFRVSDYLYLQVTRYHGSLES

SEQ ID NO: 3157003 - protein, 20 aa, Giardia lamblia
HPPIPEPPLPGSLSEGGQIS

SEQ ID NO: 3157004 - protein, 23 aa, Giardia lamblia
HPPIQDFLLQLGFQDKDGLTYRE

SEQ ID NO: 3157005 - protein, 21 aa, Giardia lamblia
HPQCVRLLLDEAGMQDISGNT

SEQ ID NO: 3157006 - protein, 17 aa, Giardia lamblia
HPQDLNHAFALSDSLTT

SEQ ID NO: 3157007 - protein, 34 aa, Giardia lamblia
HPQIRRCAEAWVFRAEFEMAIFRRNAAIDAITEG

SEQ ID NO: 3157008 - protein, 23 aa, Giardia lamblia
HPQPRIPPTNSWSNLTKIVKHLV

SEQ ID NO: 3157009 - protein, 21 aa, Giardia lamblia
HPRALEVKAWKLIRDLSSALL

SEQ ID NO: 3157010 - protein, 21 aa, Giardia lamblia
HPRAPEFLFKKVVFSHFDVDL

SEQ ID NO: 3157011 - protein, 19 aa, Giardia lamblia
HPRELKLGGSSGISLDRSE

SEQ ID NO: 3157012 - protein, 19 aa, Giardia lamblia
HPRLPCQGISLIQTPRYIP

SEQ ID NO: 3157013 - protein, 18 aa, Giardia lamblia
HPRQLITRYNIRKLMIVL

SEQ ID NO: 3157014 - protein, 19 aa, Giardia lamblia
HPSEFVDRLIAANCLTGLP

SEQ ID NO: 3157015 - protein, 19 aa, Giardia lamblia
HPSIEYDFMLEFQSHVAEY

SEQ ID NO: 3157016 - protein, 18 aa, Giardia lamblia
HPSNSMDIYSTLWAKMPQ

SEQ ID NO: 3157017 - protein, 27 aa, Giardia lamblia
HPSPSMLPRGSLVDIVLKSGCSARSSI

SEQ ID NO: 3157018 - protein, 21 aa, Giardia lamblia
HPSSFDVAVGMDKLPGDIQRR

SEQ ID NO: 3157019 - protein, 25 aa, Giardia lamblia
HPSTEIPDVLPFVIISIKIQQLRSK

SEQ ID NO: 3157020 - protein, 18 aa, Giardia lamblia
HPTHTGYVLWPENLLLNL

SEQ ID NO: 3157021 - protein, 17 aa, Giardia lamblia
HPTLMKVYDIFYAPYKS

SEQ ID NO: 3157022 - protein, 20 aa, Giardia lamblia
HPTLRDGAIMHRRIASMVHE

SEQ ID NO: 3157023 - protein, 20 aa, Giardia lamblia
HPTSLPGFQCPHPFKVSPPF

SEQ ID NO: 3157024 - protein, 21 aa, Giardia lamblia
HPVECDDLFDAYLTSHHMDHG

SEQ ID NO: 3157025 - protein, 20 aa, Giardia lamblia
HPVPSLLGTLLLSQEVHTAA

SEQ ID NO: 3157026 - protein, 21 aa, Giardia lamblia
HPVQHIKTLMIKRELAKIPEM

SEQ ID NO: 3157027 - protein, 19 aa, Giardia lamblia
HPYFDCIREKITDMAIEEV

SEQ ID NO: 3157028 - protein, 18 aa, Giardia lamblia
HPYMPLITNLRVCLPHAV

SEQ ID NO: 3157029 - protein, 26 aa, Giardia lamblia
HPYYFSCPPFPYSAGSLHSQPPVHSH

SEQ ID NO: 3157030 - protein, 23 aa, Giardia lamblia
HQASRPISHFNPGTVPPPMYSNP

SEQ ID NO: 3157031 - protein, 17 aa, Giardia lamblia
HQCKICKQRFESRTKLF

SEQ ID NO: 3157032 - protein, 17 aa, Giardia lamblia
HQCKLKQVLRSVVSQAL

SEQ ID NO: 3157033 - protein, 19 aa, Giardia lamblia
HQDKDGWTALMFAVDKRCT

SEQ ID NO: 3157034 - protein, 21 aa, Giardia lamblia
HQFLPRSKSAIQFTTSESVQE

SEQ ID NO: 3157035 - protein, 27 aa, Giardia lamblia
HQFLRDLYRLYADFVVKNPFFVPNQLI

SEQ ID NO: 3157036 - protein, 28 aa, Giardia lamblia
HQGSFGPERLCLLSASVYRELEAYPFAG

SEQ ID NO: 3157037 - protein, 20 aa, Giardia lamblia
HQHIFRFIAIGPPYDNSSAY

SEQ ID NO: 3157038 - protein, 17 aa, Giardia lamblia
HQHPTLIQAIHNVEDSL

SEQ ID NO: 3157039 - protein, 24 aa, Giardia lamblia
HQKLGVRLLHHISRRVYKYDWFAR

SEQ ID NO: 3157040 - protein, 18 aa, Giardia lamblia
HQLSKWHSLSPFNRLKSK

SEQ ID NO: 3157041 - protein, 20 aa, Giardia lamblia
HQLSLKIAEHNSFQEQIQMA

SEQ ID NO: 3157042 - protein, 17 aa, Giardia lamblia
HQMLLKRVRHMQILYPS

SEQ ID NO: 3157043 - protein, 23 aa, Giardia lamblia
HQNLCRKRTLVAIGTHDLDKIDT

SEQ ID NO: 3157044 - protein, 19 aa, Giardia lamblia
HQQEVKRQLAPAPLKEQAK

SEQ ID NO: 3157045 - protein, 20 aa, Giardia lamblia
HQQRFRLSGSASMIAATRKI

SEQ ID NO: 3157046 - protein, 20 aa, Giardia lamblia
HQRLFLLIEFTFLADLNKEG

SEQ ID NO: 3157047 - protein, 22 aa, Giardia lamblia
HQRYPIRVCVSEYPTLDGFLNA

SEQ ID NO: 3157048 - protein, 23 aa, Giardia lamblia
HQSTPCIPEHSIKNTSAPNQMYL

SEQ ID NO: 3157049 - protein, 27 aa, Giardia lamblia
HQVRCFNWKTGRLVRSYEGHTGPVVCI

SEQ ID NO: 3157050 - protein, 26 aa, Giardia lamblia
HQVSFKSWFNFCIFSPSSQPISEQLL

SEQ ID NO: 3157051 - protein, 18 aa, Giardia lamblia
HRAAALGLVSAVKLLITT

SEQ ID NO: 3157052 - protein, 19 aa, Giardia lamblia
HRAMACGYVVSDLVQTVLA

SEQ ID NO: 3157053 - protein, 24 aa, Giardia lamblia
HRAPHTLIFLAFVCTKCGEKTKEI

SEQ ID NO: 3157054 - protein, 25 aa, Giardia lamblia
HRDAFNRSALDYAIQSGHSAIVNYL

SEQ ID NO: 3157055 - protein, 18 aa, Giardia lamblia
HRDIEVVIYFTAKLVDMA

SEQ ID NO: 3157056 - protein, 18 aa, Giardia lamblia
HRDIKSLNIFLAENSEPM

SEQ ID NO: 3157057 - protein, 17 aa, Giardia lamblia
HRDLKLLNFLLAADGTV

SEQ ID NO: 3157058 - protein, 24 aa, Giardia lamblia
HRDSKGWTALIWAAFHNKPRAVEL

SEQ ID NO: 3157059 - protein, 17 aa, Giardia lamblia
HREYGLQNAGGWTALMD

SEQ ID NO: 3157060 - protein, 26 aa, Giardia lamblia
HRFTDVVKQLVQWEGKMANERGETAL

SEQ ID NO: 3157061 - protein, 22 aa, Giardia lamblia
HRHEIIELLAPYEAMLQDTLMH

SEQ ID NO: 3157062 - protein, 30 aa, Giardia lamblia
HRHMIYLLNKCDLVPTWVTASWISKLSKLR

SEQ ID NO: 3157063 - protein, 21 aa, Giardia lamblia
HRHSLLMKSNLPIESTAVQED

SEQ ID NO: 3157064 - protein, 20 aa, Giardia lamblia
HRICRHAGFKDPMPDIVSLH

SEQ ID NO: 3157065 - protein, 25 aa, Giardia lamblia
HRIRKLPGIPLMSVLRGRYGIERLA

SEQ ID NO: 3157066 - protein, 22 aa, Giardia lamblia
HRISWEKFRLGTSIYSSTTSSA

SEQ ID NO: 3157067 - protein, 20 aa, Giardia lamblia
HRKRCMAVLQQAYPTQYDFL

SEQ ID NO: 3157068 - protein, 18 aa, Giardia lamblia
HRKREIVQDITLHDLDIA

SEQ ID NO: 3157069 - protein, 19 aa, Giardia lamblia
HRKRKKRSASSVKLTEEAH

SEQ ID NO: 3157070 - protein, 17 aa, Giardia lamblia
HRLIIIFELLTSNLFSY

SEQ ID NO: 3157071 - protein, 19 aa, Giardia lamblia
HRLSEFPRNNHLTTRPDQK

SEQ ID NO: 3157072 - protein, 37 aa, Giardia lamblia
HRLSLFKMRSDHTVAVFRNNYLLLFGGVDAGKLYADL

SEQ ID NO: 3157073 - protein, 20 aa, Giardia lamblia
HRLYFRTYYRVLKACLYGDL

SEQ ID NO: 3157074 - protein, 18 aa, Giardia lamblia
HRLYYLISEVCVSNLQLL

SEQ ID NO: 3157075 - protein, 19 aa, Giardia lamblia
HRMALALLDGARSTGCETV

SEQ ID NO: 3157076 - protein, 26 aa, Giardia lamblia
HRMNLDAVECIRGLFLGKHNASTATY

SEQ ID NO: 3157077 - protein, 24 aa, Giardia lamblia
HRNCVPALLPELGLRDQASGTTAL

SEQ ID NO: 3157078 - protein, 24 aa, Giardia lamblia
HRNEAFQGYISWLGDYSIANYAMF

SEQ ID NO: 3157079 - protein, 26 aa, Giardia lamblia
HRNEFGDTISTCWQPSLKSNISSVRT

SEQ ID NO: 3157080 - protein, 23 aa, Giardia lamblia
HRNIRPSSIIVVGEREYKLALFG

SEQ ID NO: 3157081 - protein, 22 aa, Giardia lamblia
HRNRAPKAWSIFMDLGARDIDQ

SEQ ID NO: 3157082 - protein, 18 aa, Giardia lamblia
HRPFFMTILFKLALSLSQ

SEQ ID NO: 3157083 - protein, 18 aa, Giardia lamblia
HRPLIRVAFMTLQNSLCY

SEQ ID NO: 3157084 - protein, 17 aa, Giardia lamblia
HRREAGLRRPVDKLTAY

SEQ ID NO: 3157085 - protein, 17 aa, Giardia lamblia
HRREIQLISSINLEASP

SEQ ID NO: 3157086 - protein, 20 aa, Giardia lamblia
HRRVPVIRLLIDQEARLQNK

SEQ ID NO: 3157087 - protein, 26 aa, Giardia lamblia
HRSGSIRKSAALAFRTSDAQTEARLS

SEQ ID NO: 3157088 - protein, 24 aa, Giardia lamblia
HRSLPCYSPFSSLNMESRGYIFNS

SEQ ID NO: 3157089 - protein, 26 aa, Giardia lamblia
HRSMKMCPVHSLLSINDRGASYYRMH

SEQ ID NO: 3157090 - protein, 18 aa, Giardia lamblia
HRSSPFGCLSRNWQQSAF

SEQ ID NO: 3157091 - protein, 26 aa, Giardia lamblia
HRTSYGFLMGDLRGALYRFEGIPIGT

SEQ ID NO: 3157092 - protein, 18 aa, Giardia lamblia
HRVIPKFMIQGGDFTNHN

SEQ ID NO: 3157093 - protein, 25 aa, Giardia lamblia
HRVLNAVCSPAIYAKISTRMEDTNE

SEQ ID NO: 3157094 - protein, 17 aa, Giardia lamblia
HRVRSFHLAMAEFLDAN

SEQ ID NO: 3157095 - protein, 17 aa, Giardia lamblia
HRYLRMLHHPPITNDNL

SEQ ID NO: 3157096 - protein, 26 aa, Giardia lamblia
HRYTLFECMYHPAVNPRQFKLPMSIP

SEQ ID NO: 3157097 - protein, 19 aa, Giardia lamblia
HRYYLKFLQINSMSRITVP

SEQ ID NO: 3157098 - protein, 20 aa, Giardia lamblia
HRYYLKFLQINSMSRITVPL

SEQ ID NO: 3157099 - protein, 20 aa, Giardia lamblia
HSAAKFKVIPADEIFSLLNH

SEQ ID NO: 3157100 - protein, 17 aa, Giardia lamblia
HSAFSIIKENVRHFSYP

SEQ ID NO: 3157101 - protein, 23 aa, Giardia lamblia
HSAKRLLNFFSAFISAAGPSELL

SEQ ID NO: 3157102 - protein, 18 aa, Giardia lamblia
HSALKRINVCVDKHSQVK

SEQ ID NO: 3157103 - protein, 27 aa, Giardia lamblia
HSALRPSAYHALQWFKRIHAGVDLSCV

SEQ ID NO: 3157104 - protein, 18 aa, Giardia lamblia
HSAMKILSLDRFTYPTLY

SEQ ID NO: 3157105 - protein, 24 aa, Giardia lamblia
HSASRAQEALALYSKVSANYISYI

SEQ ID NO: 3157106 - protein, 28 aa, Giardia lamblia
HSAYAFVEPCTYKCTFATIAATRIFFDA

SEQ ID NO: 3157107 - protein, 17 aa, Giardia lamblia
HSCEEMRAAVAQLADSV

SEQ ID NO: 3157108 - protein, 22 aa, Giardia lamblia
HSCPFAFVGEGTTNLMVAASHG

SEQ ID NO: 3157109 - protein, 22 aa, Giardia lamblia
HSDCVRQLLDIEGKIYTPSGIR

SEQ ID NO: 3157110 - protein, 19 aa, Giardia lamblia
HSDVLVFRDMLLKENSLDT

SEQ ID NO: 3157111 - protein, 19 aa, Giardia lamblia
HSEIVKLLIDHEGGMQDIF

SEQ ID NO: 3157112 - protein, 17 aa, Giardia lamblia
HSFNPGDPMAIVVAMQH

SEQ ID NO: 3157113 - protein, 24 aa, Giardia lamblia
HSFTLRYLKTLALKLQREPTLLCL

SEQ ID NO: 3157114 - protein, 20 aa, Giardia lamblia
HSGEVPSSFVMHGLLEYLTT

SEQ ID NO: 3157115 - protein, 19 aa, Giardia lamblia
HSGLPPRKASFDISDVKTE

SEQ ID NO: 3157116 - protein, 22 aa, Giardia lamblia
HSHPALQPSPRVDLQTQPLRPQ

SEQ ID NO: 3157117 - protein, 21 aa, Giardia lamblia
HSIAAGGSRGTSAFLAALPPD

SEQ ID NO: 3157118 - protein, 17 aa, Giardia lamblia
HSICEPIATPGAVLTDV

SEQ ID NO: 3157119 - protein, 21 aa, Giardia lamblia
HSIGGALIRNGRTVVSDLGPF

SEQ ID NO: 3157120 - protein, 26 aa, Giardia lamblia
HSIISETCLLRFLDLYVGQNMNDLAT

SEQ ID NO: 3157121 - protein, 19 aa, Giardia lamblia
HSKRIKVRLLIQAEVQQGA

SEQ ID NO: 3157122 - protein, 19 aa, Giardia lamblia
HSLCVFDYLAETFVIQEVP

SEQ ID NO: 3157123 - protein, 24 aa, Giardia lamblia
HSLEILLRSSLFGKQAILNTIQRL

SEQ ID NO: 3157124 - protein, 18 aa, Giardia lamblia
HSLFSAVHADAWQTGVML

SEQ ID NO: 3157125 - protein, 24 aa, Giardia lamblia
HSLGCLFCLRLPSFPLPQQSMEQW

SEQ ID NO: 3157126 - protein, 17 aa, Giardia lamblia
HSLGCSVYKFYKVCTHG

SEQ ID NO: 3157127 - protein, 24 aa, Giardia lamblia
HSLKCRHLSEAAALRQQGRQPTYP

SEQ ID NO: 3157128 - protein, 17 aa, Giardia lamblia
HSLKLVFLPPAAVPVSF

SEQ ID NO: 3157129 - protein, 20 aa, Giardia lamblia
HSLKSDVWALGATLVDMCVG

SEQ ID NO: 3157130 - protein, 29 aa, Giardia lamblia
HSLLSVPRFDCFENVSFSWSLLSVPELRS

SEQ ID NO: 3157131 - protein, 20 aa, Giardia lamblia
HSLPRFPLLSALDKEAAELN

SEQ ID NO: 3157132 - protein, 17 aa, Giardia lamblia
HSMFKANADGVSRVYHQ

SEQ ID NO: 3157133 - protein, 24 aa, Giardia lamblia
HSMGTPLLRPHNRPSSASMTHYPG

SEQ ID NO: 3157134 - protein, 23 aa, Giardia lamblia
HSNFRFYILLCTYISTAGLTVKI

SEQ ID NO: 3157135 - protein, 25 aa, Giardia lamblia
HSNLGRFKSIYMISSLQDGYVDFRS

SEQ ID NO: 3157136 - protein, 20 aa, Giardia lamblia
HSPFNGVGVVPHCNIKPSNI

SEQ ID NO: 3157137 - protein, 20 aa, Giardia lamblia
HSPPLWRSSGSPAILVLETV

SEQ ID NO: 3157138 - protein, 21 aa, Giardia lamblia
HSPQHKIRLLVHQLLVLIGTE

SEQ ID NO: 3157139 - protein, 26 aa, Giardia lamblia
HSPSRPLLCCSICDISVRYRKNKTLI

SEQ ID NO: 3157140 - protein, 22 aa, Giardia lamblia
HSPVAGPVPFYFTPHTAPQLAY

SEQ ID NO: 3157141 - protein, 25 aa, Giardia lamblia
HSQLRFLKRANLKGRTALMHAACNY

SEQ ID NO: 3157142 - protein, 26 aa, Giardia lamblia
HSQMLSSYALRVMVINILLNCRDIYT

SEQ ID NO: 3157143 - protein, 18 aa, Giardia lamblia
HSQRKKWTMDKNQVQNGD

SEQ ID NO: 3157144 - protein, 21 aa, Giardia lamblia
HSRTWPSMHATGGNYAVQDTP

SEQ ID NO: 3157145 - protein, 23 aa, Giardia lamblia
HSSDCASACRSSDAFQQREPADN

SEQ ID NO: 3157146 - protein, 24 aa, Giardia lamblia
HSSDLCVASGELHREESHGIASIS

SEQ ID NO: 3157147 - protein, 24 aa, Giardia lamblia
HSSLKRYKTILALHETTERISKEI

SEQ ID NO: 3157148 - protein, 31 aa, Giardia lamblia
HSTDISIALLRDFRPSNFFLSSRGIIQIKSL

SEQ ID NO: 3157149 - protein, 23 aa, Giardia lamblia
HSTFKNNYIIKFRESFMHAPNDM

SEQ ID NO: 3157150 - protein, 17 aa, Giardia lamblia
HSTWQFNLAFDEATSIV

SEQ ID NO: 3157151 - protein, 18 aa, Giardia lamblia
HSVELGQENYIFGEFVET

SEQ ID NO: 3157152 - protein, 17 aa, Giardia lamblia
HSVLEDFIALDRYKQAF

SEQ ID NO: 3157153 - protein, 24 aa, Giardia lamblia
HSVLLDCYDACYMPADDLLLLELE

SEQ ID NO: 3157154 - protein, 29 aa, Giardia lamblia
HSVLMKLALPSGILLYLRILPEGYEIVGF

SEQ ID NO: 3157155 - protein, 24 aa, Giardia lamblia
HSVPGCGKTSIATALAQELSVDLA

SEQ ID NO: 3157156 - protein, 19 aa, Giardia lamblia
HSVPSFKLLAQGHGNRVQQ

SEQ ID NO: 3157157 - protein, 23 aa, Giardia lamblia
HSVSIPESIPLGGNIKTAIEAIT

SEQ ID NO: 3157158 - protein, 28 aa, Giardia lamblia
HSVSLDKYWRVIFFGAYLEMLQGNHGRS

SEQ ID NO: 3157159 - protein, 27 aa, Giardia lamblia
HSVVAARCLRDKIIVVTARTFFFISAH

SEQ ID NO: 3157160 - protein, 17 aa, Giardia lamblia
HSVVLTAILERTLSKLP

SEQ ID NO: 3157161 - protein, 22 aa, Giardia lamblia
HSVVTCLRNLHRLGIAHRDVKP

SEQ ID NO: 3157162 - protein, 20 aa, Giardia lamblia
HSWPRGQCSHQCPTVPVFWA

SEQ ID NO: 3157163 - protein, 17 aa, Giardia lamblia
HTALILAACYDHHEICD

SEQ ID NO: 3157164 - protein, 19 aa, Giardia lamblia
HTALMLAAWHGHKDCVKVL

SEQ ID NO: 3157165 - protein, 17 aa, Giardia lamblia
HTALMLATRANHPMIVE

SEQ ID NO: 3157166 - protein, 26 aa, Giardia lamblia
HTDHFPPKVCLHTNMSRTHKTSEVST

SEQ ID NO: 3157167 - protein, 25 aa, Giardia lamblia
HTEAVWSVRWRKDLVGSNSLAFFSA

SEQ ID NO: 3157168 - protein, 19 aa, Giardia lamblia
HTECARLLLEEEGDMRDNG

SEQ ID NO: 3157169 - protein, 25 aa, Giardia lamblia
HTEIVLKLVLMQAGLQNIDGVTALM

SEQ ID NO: 3157170 - protein, 21 aa, Giardia lamblia
HTEVARLLVDREARLVKKNGY

SEQ ID NO: 3157171 - protein, 21 aa, Giardia lamblia
HTFRYILRVIKQCGVEEKERT

SEQ ID NO: 3157172 - protein, 19 aa, Giardia lamblia
HTGKFVCVIISLKHVSSIQ

SEQ ID NO: 3157173 - protein, 19 aa, Giardia lamblia
HTGRISRIQSLFMTDSAGS

SEQ ID NO: 3157174 - protein, 20 aa, Giardia lamblia
HTHLLGPLVLVIGEDSCSCA

SEQ ID NO: 3157175 - protein, 21 aa, Giardia lamblia
HTHNARLSYLLIEELMVKVRA

SEQ ID NO: 3157176 - protein, 24 aa, Giardia lamblia
HTIELRKNYGIPEWRDDLKKILMT

SEQ ID NO: 3157177 - protein, 18 aa, Giardia lamblia
HTIFGLSPANYVSFDATR

SEQ ID NO: 3157178 - protein, 17 aa, Giardia lamblia
HTIGYTCILSLKRHNST

SEQ ID NO: 3157179 - protein, 19 aa, Giardia lamblia
HTISGIFGAAIPRILALSD

SEQ ID NO: 3157180 - protein, 27 aa, Giardia lamblia
HTKELRADKVISCYPEKLPVIRQSGTR

SEQ ID NO: 3157181 - protein, 37 aa, Giardia lamblia
HTLELHKIVVARNMALVRLQAIILCLQKNNEKNIREV

SEQ ID NO: 3157182 - protein, 18 aa, Giardia lamblia
HTLSGIKNSVVYNSQAHN

SEQ ID NO: 3157183 - protein, 21 aa, Giardia lamblia
HTNMIKDLIPKEARFLDSNGQ

SEQ ID NO: 3157184 - protein, 19 aa, Giardia lamblia
HTPTRISAVVGNNIMINQL

SEQ ID NO: 3157185 - protein, 19 aa, Giardia lamblia
HTRHFLKYKELYFDKTNST

SEQ ID NO: 3157186 - protein, 21 aa, Giardia lamblia
HTRMASIVAVGIYWNLLQPED

SEQ ID NO: 3157187 - protein, 21 aa, Giardia lamblia
HTRRIHAFLAEYLKIHIEAPD

SEQ ID NO: 3157188 - protein, 22 aa, Giardia lamblia
HTRSCLAPGLLRAVSAQQHISL

SEQ ID NO: 3157189 - protein, 17 aa, Giardia lamblia
HTRTASVVEVLYETLGL

SEQ ID NO: 3157190 - protein, 24 aa, Giardia lamblia
HTSCAKLLLEYEGGMVTNECYKSG

SEQ ID NO: 3157191 - protein, 19 aa, Giardia lamblia
HTSCVRILADYEAGRRLDN

SEQ ID NO: 3157192 - protein, 19 aa, Giardia lamblia
HTSEFMVEFELSYNDQKHT

SEQ ID NO: 3157193 - protein, 25 aa, Giardia lamblia
HTTIDVSGRFTIMVVSNFGDSRRET

SEQ ID NO: 3157194 - protein, 20 aa, Giardia lamblia
HTTSGLQCLLLLNKFSETVS

SEQ ID NO: 3157195 - protein, 26 aa, Giardia lamblia
HTVCSVCLDCFASVIHLPCRHMAMCS

SEQ ID NO: 3157196 - protein, 18 aa, Giardia lamblia
HTVFFYCLGTSATIPPMY

SEQ ID NO: 3157197 - protein, 35 aa, Giardia lamblia
HTYAVYKYCCRGLFTRHKILLSLHMCVKILESYGR

SEQ ID NO: 3157198 - protein, 20 aa, Giardia lamblia
HTYDIPWPSIFGEPSGLCFS

SEQ ID NO: 3157199 - protein, 25 aa, Giardia lamblia
HVAEGDACFRLGLFQKAISSYTAAL

SEQ ID NO: 3157200 - protein, 28 aa, Giardia lamblia
HVAKAHLGNTVFYKPGLEKYERQRLSDE

SEQ ID NO: 3157201 - protein, 18 aa, Giardia lamblia
HVAMGFALSPIVVSNVSL

SEQ ID NO: 3157202 - protein, 18 aa, Giardia lamblia
HVANLLKPIEDVWRDDKG

SEQ ID NO: 3157203 - protein, 22 aa, Giardia lamblia
HVDPVKPYRSWYLANLSSLPMA

SEQ ID NO: 3157204 - protein, 22 aa, Giardia lamblia
HVECLKLLLDKEEGMQRPDGWT

SEQ ID NO: 3157205 - protein, 19 aa, Giardia lamblia
HVECVSALLSELGIQSRRG

SEQ ID NO: 3157206 - protein, 19 aa, Giardia lamblia
HVEPAFLAVMVDNVDALQF

SEQ ID NO: 3157207 - protein, 18 aa, Giardia lamblia
HVFCEGCVQAIYEGQPEK

SEQ ID NO: 3157208 - protein, 18 aa, Giardia lamblia
HVFHLKKLLKPSTLCISQ

SEQ ID NO: 3157209 - protein, 22 aa, Giardia lamblia
HVFRRPNFESVPAISNESLEEH

SEQ ID NO: 3157210 - protein, 23 aa, Giardia lamblia
HVFRRPNFESVPAISNESLEEHP

SEQ ID NO: 3157211 - protein, 17 aa, Giardia lamblia
HVGDWGTQFGMLITHLT

SEQ ID NO: 3157212 - protein, 24 aa, Giardia lamblia
HVGIARLLLPYEGFAYEEDQQELA

SEQ ID NO: 3157213 - protein, 18 aa, Giardia lamblia
HVGKGAFSKVFLAYTPEF

SEQ ID NO: 3157214 - protein, 18 aa, Giardia lamblia
HVGLECRQDDISIIPQQA

SEQ ID NO: 3157215 - protein, 25 aa, Giardia lamblia
HVHFTARCTLLLFRPEPESLIHATI

SEQ ID NO: 3157216 - protein, 17 aa, Giardia lamblia
HVHHFYKVYFEAAYDTF

SEQ ID NO: 3157217 - protein, 17 aa, Giardia lamblia
HVIEKFLECCTVKERID

SEQ ID NO: 3157218 - protein, 19 aa, Giardia lamblia
HVIKCFVKLVQDEKELKVG

SEQ ID NO: 3157219 - protein, 23 aa, Giardia lamblia
HVKEISQRYIACIDSELHEGLTK

SEQ ID NO: 3157220 - protein, 25 aa, Giardia lamblia
HVKELKRRRFLELQDCEREQQRQKG

SEQ ID NO: 3157221 - protein, 18 aa, Giardia lamblia
HVKEVLFLPSTVEELLEN

SEQ ID NO: 3157222 - protein, 22 aa, Giardia lamblia
HVKFREICQALCYVKEPTDAVA

SEQ ID NO: 3157223 - protein, 17 aa, Giardia lamblia
HVKLVLENAHLRQELSK

SEQ ID NO: 3157224 - protein, 20 aa, Giardia lamblia
HVLDAFGAWARRPRTKRAHS

SEQ ID NO: 3157225 - protein, 26 aa, Giardia lamblia
HVLIKEIKENFLLAFLDLIENSSVWR

SEQ ID NO: 3157226 - protein, 23 aa, Giardia lamblia
HVLMHCLRRWQLFSLMESDKHKN

SEQ ID NO: 3157227 - protein, 25 aa, Giardia lamblia
HVLNCLKLSHPSTFYINRSGSQSIL

SEQ ID NO: 3157228 - protein, 17 aa, Giardia lamblia
HVLQDGSSTHFLTHNNL

SEQ ID NO: 3157229 - protein, 18 aa, Giardia lamblia
HVLQYKRTVSVVTDNELL

SEQ ID NO: 3157230 - protein, 25 aa, Giardia lamblia
HVMQNPRVSWDMPDQGSISAALGLT

SEQ ID NO: 3157231 - protein, 21 aa, Giardia lamblia
HVNACGQTALMLAAKNNHPEV

SEQ ID NO: 3157232 - protein, 22 aa, Giardia lamblia
HVPAELGHACFAKRQTALMKAI

SEQ ID NO: 3157233 - protein, 24 aa, Giardia lamblia
HVPDLRGPLAAPHQIHGTGLQTKR

SEQ ID NO: 3157234 - protein, 18 aa, Giardia lamblia
HVPPAGLLYYGQEYRPVP

SEQ ID NO: 3157235 - protein, 17 aa, Giardia lamblia
HVPRRDGEITALDFYSM

SEQ ID NO: 3157236 - protein, 26 aa, Giardia lamblia
HVPVLGCKAAVLGHRYYSVKYAYSIP

SEQ ID NO: 3157237 - protein, 25 aa, Giardia lamblia
HVTLPDGRTALMLCAAAGSYDTVRA

SEQ ID NO: 3157238 - protein, 19 aa, Giardia lamblia
HVTLSPGLGRLMRNTMENG

SEQ ID NO: 3157239 - protein, 24 aa, Giardia lamblia
HVTPKLEADFGFADESGFLVPVAC

SEQ ID NO: 3157240 - protein, 22 aa, Giardia lamblia
HVTQCMAMRLMGLFAKNAHSKD

SEQ ID NO: 3157241 - protein, 25 aa, Giardia lamblia
HVTVCGSCRALGPSCPVCSEQPISY

SEQ ID NO: 3157242 - protein, 17 aa, Giardia lamblia
HVVKPDLLAGCKLIVTG

SEQ ID NO: 3157243 - protein, 28 aa, Giardia lamblia
HVYHQARSRPGFSYNFVDRTKDFYLNSR

SEQ ID NO: 3157244 - protein, 31 aa, Giardia lamblia
HVYIFLIKWQRKAHCHATWELEDYLMHLSSY

SEQ ID NO: 3157245 - protein, 25 aa, Giardia lamblia
HVYLLKETCFLEWRYHAYIRRERAK

SEQ ID NO: 3157246 - protein, 24 aa, Giardia lamblia
HWDNLPILLRRTLMDSGNVLWSEA

SEQ ID NO: 3157247 - protein, 17 aa, Giardia lamblia
HWIELDLPSITELKAKK

SEQ ID NO: 3157248 - protein, 21 aa, Giardia lamblia
HWIHILTIRLRSVRRAAQAAA

SEQ ID NO: 3157249 - protein, 17 aa, Giardia lamblia
HYDFGLRALKSVLVNAG

SEQ ID NO: 3157250 - protein, 18 aa, Giardia lamblia
HYEELAKLLADYISEAQP

SEQ ID NO: 3157251 - protein, 25 aa, Giardia lamblia
HYFDKPFLFKKFRKLEKKRCLLQQG

SEQ ID NO: 3157252 - protein, 32 aa, Giardia lamblia
HYGDAAPIFVASGMDCFTELAELAALKPHILT

SEQ ID NO: 3157253 - protein, 30 aa, Giardia lamblia
HYGQVSLVASMIWWVFDAESAFKDLEAGEN

SEQ ID NO: 3157254 - protein, 22 aa, Giardia lamblia
HYHTCSLLDPIDCSICQLYRLY

SEQ ID NO: 3157255 - protein, 27 aa, Giardia lamblia
HYIPPRSCTALRLIVQDVHYEDNAILL

SEQ ID NO: 3157256 - protein, 18 aa, Giardia lamblia
HYKSCSVMEGSAFIVDPR

SEQ ID NO: 3157257 - protein, 25 aa, Giardia lamblia
HYLPELRPSASVLRDLCARRSASAL

SEQ ID NO: 3157258 - protein, 18 aa, Giardia lamblia
HYPANPKIRIIESSGTES

SEQ ID NO: 3157259 - protein, 23 aa, Giardia lamblia
HYPCDTCRELSFYFVDPVDHSRQ

SEQ ID NO: 3157260 - protein, 17 aa, Giardia lamblia
HYPGLAAAPGPYAAYPT

SEQ ID NO: 3157261 - protein, 20 aa, Giardia lamblia
HYPSGCLVSVEYPHHVDQLT

SEQ ID NO: 3157262 - protein, 29 aa, Giardia lamblia
HYQIAAYLLRYCVDIGALSGCDLYRSIQL

SEQ ID NO: 3157263 - protein, 17 aa, Giardia lamblia
HYRFIGLANIGGDELIY

SEQ ID NO: 3157264 - protein, 18 aa, Giardia lamblia
HYSKEFVDTIGMMMRLNP

SEQ ID NO: 3157265 - protein, 20 aa, Giardia lamblia
HYTAFCRRASDGVRSAFYLL

SEQ ID NO: 3157266 - protein, 25 aa, Giardia lamblia
IAAAEKRPGLVWLYINQANARDSKG

SEQ ID NO: 3157267 - protein, 24 aa, Giardia lamblia
IAAEAGAMNACLALAREFPVERDP

SEQ ID NO: 3157268 - protein, 19 aa, Giardia lamblia
IAAECGHSEIVQLLLKHEA

SEQ ID NO: 3157269 - protein, 18 aa, Giardia lamblia
IAAFPRELLPQSIADDVL

SEQ ID NO: 3157270 - protein, 21 aa, Giardia lamblia
IAAGDRGGRVIIFERADSANK

SEQ ID NO: 3157271 - protein, 18 aa, Giardia lamblia
IAAGGSRGTSAFLAALPP

SEQ ID NO: 3157272 - protein, 21 aa, Giardia lamblia
IAAGLSWLHSPFNGVGVVPHC

SEQ ID NO: 3157273 - protein, 24 aa, Giardia lamblia
IAAKRILDVTSFYTSYCKDTQAIA

SEQ ID NO: 3157274 - protein, 17 aa, Giardia lamblia
IAALCSLLMGLDDEHVL

SEQ ID NO: 3157275 - protein, 17 aa, Giardia lamblia
IAALYEKVVEWGGTVDT

SEQ ID NO: 3157276 - protein, 17 aa, Giardia lamblia
IAAQRPSLFNVMSQVVD

SEQ ID NO: 3157277 - protein, 18 aa, Giardia lamblia
IAASRYFILDGFVTDHCQ

SEQ ID NO: 3157278 - protein, 17 aa, Giardia lamblia
IAATCSLSSTLRSALEK

SEQ ID NO: 3157279 - protein, 25 aa, Giardia lamblia
IAAYFGCLECVKLLLEKEKYISSRS

SEQ ID NO: 3157280 - protein, 26 aa, Giardia lamblia
IAAYFGCLECVKLLLEKEKYISSRSA

SEQ ID NO: 3157281 - protein, 26 aa, Giardia lamblia
IACAVCFTLQCDTCFNGSCPTCPATV

SEQ ID NO: 3157282 - protein, 18 aa, Giardia lamblia
IACKTPYLSEWVRGSKLA

SEQ ID NO: 3157283 - protein, 19 aa, Giardia lamblia
IACRIDAPAITPEFSNVTF

SEQ ID NO: 3157284 - protein, 17 aa, Giardia lamblia
IACSLEYQGKICSIKGG

SEQ ID NO: 3157285 - protein, 19 aa, Giardia lamblia
IACTRMLVTWEAKARDQYG

SEQ ID NO: 3157286 - protein, 25 aa, Giardia lamblia
IADALTRCWEQLSKLIVDKSKLSCV

SEQ ID NO: 3157287 - protein, 21 aa, Giardia lamblia
IADFGLCRDALWSESTLMGIM

SEQ ID NO: 3157288 - protein, 25 aa, Giardia lamblia
IADFGLCRDALWSGSTLIGIMAYVA

SEQ ID NO: 3157289 - protein, 22 aa, Giardia lamblia
IADFKLYMPLLVALRNPGMRKR

SEQ ID NO: 3157290 - protein, 24 aa, Giardia lamblia
IADISYKIVHHSVTASMVGEPETD

SEQ ID NO: 3157291 - protein, 26 aa, Giardia lamblia
IADLLDLLQFILLPHKQYFADDEHID

SEQ ID NO: 3157292 - protein, 20 aa, Giardia lamblia
IADMYRVMRDLLGADPSTQP

SEQ ID NO: 3157293 - protein, 23 aa, Giardia lamblia
IADRSVPVGALLTLLEKGMQLLD

SEQ ID NO: 3157294 - protein, 20 aa, Giardia lamblia
IAECCNFPGSNCMGLCQSPD

SEQ ID NO: 3157295 - protein, 19 aa, Giardia lamblia
IAEEDKRVLELEGNSKLEE

SEQ ID NO: 3157296 - protein, 25 aa, Giardia lamblia
IAEEIPRVLLRLVIGSLTSPYRSVV

SEQ ID NO: 3157297 - protein, 27 aa, Giardia lamblia
IAEELLWRIFYCLLHAIQHLELNKIST

SEQ ID NO: 3157298 - protein, 21 aa, Giardia lamblia
IAEEYRLLLRESTEKYTEAKL

SEQ ID NO: 3157299 - protein, 24 aa, Giardia lamblia
IAEFKESASVLKLFYSQSSDLIII

SEQ ID NO: 3157300 - protein, 18 aa, Giardia lamblia
IAELGHLRRSIRAQIEAM

SEQ ID NO: 3157301 - protein, 17 aa, Giardia lamblia
IAEPAALPEMISSNQLI

SEQ ID NO: 3157302 - protein, 17 aa, Giardia lamblia
IAERDNAIMFFADHYTK

SEQ ID NO: 3157303 - protein, 21 aa, Giardia lamblia
IAESTGKVILLDRLMAEMKTL

SEQ ID NO: 3157304 - protein, 20 aa, Giardia lamblia
IAFCVAHWDGTVRVFVSSDN

SEQ ID NO: 3157305 - protein, 27 aa, Giardia lamblia
IAFGSWKRRYVCVVSMEIRADEHYRRN

SEQ ID NO: 3157306 - protein, 34 aa, Giardia lamblia
IAFVLKAARSVYLKMLPSFRAQFYGYLTHQDLKA

SEQ ID NO: 3157307 - protein, 19 aa, Giardia lamblia
IAFVPRLITKASLYPVSNR

SEQ ID NO: 3157308 - protein, 17 aa, Giardia lamblia
IAFVQSIYTIGPIGYIE

SEQ ID NO: 3157309 - protein, 17 aa, Giardia lamblia
IAGCALGLLVHTLEKRK

SEQ ID NO: 3157310 - protein, 20 aa, Giardia lamblia
IAGCKACTKTASANPTCSEC

SEQ ID NO: 3157311 - protein, 24 aa, Giardia lamblia
IAGKRLPEIAKYIIEHFQLTNVSQ

SEQ ID NO: 3157312 - protein, 25 aa, Giardia lamblia
IAGLELCRNILWSGSTLIGIGAHTA

SEQ ID NO: 3157313 - protein, 25 aa, Giardia lamblia
IAGLKRGAELTARRLSELEALCDDQ

SEQ ID NO: 3157314 - protein, 18 aa, Giardia lamblia
IAGLPYKDLVLLLTAINE

SEQ ID NO: 3157315 - protein, 28 aa, Giardia lamblia
IAGVKRAACRRYQFELGVPLQHPEDTLS

SEQ ID NO: 3157316 - protein, 27 aa, Giardia lamblia
IAHGLSCSRSLTTLAMENCALGDDGVS

SEQ ID NO: 3157317 - protein, 25 aa, Giardia lamblia
IAHKKCKRSIIFFGSITDLNSFYSL

SEQ ID NO: 3157318 - protein, 24 aa, Giardia lamblia
IAHNASWNDCYTLSFHSNWSEKYG

SEQ ID NO: 3157319 - protein, 18 aa, Giardia lamblia
IAHNRIRSINPFSKTSIT

SEQ ID NO: 3157320 - protein, 24 aa, Giardia lamblia
IAIDASVMLYQFITTITSGDGTAL

SEQ ID NO: 3157321 - protein, 25 aa, Giardia lamblia
IAIDQLEWGFQVTRYLDPLRDIDDR

SEQ ID NO: 3157322 - protein, 37 aa, Giardia lamblia
IAITPRGEWRLVGFSCCLPGGINFEFSSDSGALTRPC

SEQ ID NO: 3157323 - protein, 18 aa, Giardia lamblia
IAITSLWVIVTTVEDTVF

SEQ ID NO: 3157324 - protein, 29 aa, Giardia lamblia
IAIVRRNFKLAKYIIDWLRDRRKDSKKLS

SEQ ID NO: 3157325 - protein, 24 aa, Giardia lamblia
IAKAISWSHHWQALHLIGSHPTTS

SEQ ID NO: 3157326 - protein, 23 aa, Giardia lamblia
IAKFHIAKKLVFVPVEEEFRLFS

SEQ ID NO: 3157327 - protein, 17 aa, Giardia lamblia
IAKICDFGLSRGLHELS

SEQ ID NO: 3157328 - protein, 23 aa, Giardia lamblia
IAKKCSKLFVGNYHPIINLLSQY

SEQ ID NO: 3157329 - protein, 18 aa, Giardia lamblia
IAKLEYAVVLSLIDSESR

SEQ ID NO: 3157330 - protein, 23 aa, Giardia lamblia
IAKRSPVKFTVIPVTVETGYPGF

SEQ ID NO: 3157331 - protein, 20 aa, Giardia lamblia
IAKRVYRSQAPLEYDTQEYD

SEQ ID NO: 3157332 - protein, 30 aa, Giardia lamblia
IAKSLNILLFWKLLPPILEGSPYNYPTCEV

SEQ ID NO: 3157333 - protein, 19 aa, Giardia lamblia
IAKTRLVESARSYQRSDSG

SEQ ID NO: 3157334 - protein, 18 aa, Giardia lamblia
IAKVPGRSITDSFVVRGF

SEQ ID NO: 3157335 - protein, 27 aa, Giardia lamblia
IAKYKAVIYRARYMFFKDLSPPEAASP

SEQ ID NO: 3157336 - protein, 17 aa, Giardia lamblia
IALAKRLSRSIVQTVVQ

SEQ ID NO: 3157337 - protein, 20 aa, Giardia lamblia
IALGGFKLGVKLSGAQEESI

SEQ ID NO: 3157338 - protein, 19 aa, Giardia lamblia
IALKCVKLSIFETTFLMYF

SEQ ID NO: 3157339 - protein, 29 aa, Giardia lamblia
IALLALVFCLHRYKTLPFLLLDEVDKNLD

SEQ ID NO: 3157340 - protein, 24 aa, Giardia lamblia
IALLLCDLCTSGVQPFESKDYQAE

SEQ ID NO: 3157341 - protein, 27 aa, Giardia lamblia
IALNADHAFPLVFVRFDKFVRSGDITL

SEQ ID NO: 3157342 - protein, 20 aa, Giardia lamblia
IALQAEIERLQLWGETQKLD

SEQ ID NO: 3157343 - protein, 17 aa, Giardia lamblia
IALRDFFINQLKQFQRE

SEQ ID NO: 3157344 - protein, 17 aa, Giardia lamblia
IALRPVYQYFPLIMMMS

SEQ ID NO: 3157345 - protein, 20 aa, Giardia lamblia
IALSEPKKPYLAILGGAKVA

SEQ ID NO: 3157346 - protein, 23 aa, Giardia lamblia
IALSSTVCLLDIVHAVYNGYNFT

SEQ ID NO: 3157347 - protein, 25 aa, Giardia lamblia
IALTLIKNTGCRVIRHPVSETNRSR

SEQ ID NO: 3157348 - protein, 25 aa, Giardia lamblia
IAMRCGYTALMECCKNGYSEMICHL

SEQ ID NO: 3157349 - protein, 17 aa, Giardia lamblia
IANELLQPHMLQLGTDD

SEQ ID NO: 3157350 - protein, 20 aa, Giardia lamblia
IANLLLPFEGGMQLKNGGTA

SEQ ID NO: 3157351 - protein, 24 aa, Giardia lamblia
IANPRCVLQELYLSGNPLGLDGAM

SEQ ID NO: 3157352 - protein, 19 aa, Giardia lamblia
IAPCCGRQFDTLGRFNRHV

SEQ ID NO: 3157353 - protein, 23 aa, Giardia lamblia
IAPDIPFLSPLIMKHIPNPDHRG

SEQ ID NO: 3157354 - protein, 18 aa, Giardia lamblia
IAPRLAALDKSYAENFVG

SEQ ID NO: 3157355 - protein, 20 aa, Giardia lamblia
IAPSYWKLSGLASEDPIGLT

SEQ ID NO: 3157356 - protein, 19 aa, Giardia lamblia
IAPTLGFKISTWRPQNTSM

SEQ ID NO: 3157357 - protein, 27 aa, Giardia lamblia
IAQGKKKACYHFLVMMYFIGAIHSGTA

SEQ ID NO: 3157358 - protein, 18 aa, Giardia lamblia
IAQHFNIDLPSSREFIQN

SEQ ID NO: 3157359 - protein, 26 aa, Giardia lamblia
IAQITCRAVIKLELCPHKAARIFGLH

SEQ ID NO: 3157360 - protein, 17 aa, Giardia lamblia
IAQRKALYTSLKNYIMD

SEQ ID NO: 3157361 - protein, 18 aa, Giardia lamblia
IAQSFFLRMWSKGKLLTE

SEQ ID NO: 3157362 - protein, 18 aa, Giardia lamblia
IAQYIAFATPRKVIGLMR

SEQ ID NO: 3157363 - protein, 17 aa, Giardia lamblia
IAREKLLSLPSVRLNGP

SEQ ID NO: 3157364 - protein, 26 aa, Giardia lamblia
IARHKTLCKLYFKACIQKIEDLILFI

SEQ ID NO: 3157365 - protein, 18 aa, Giardia lamblia
IARILIQRLKCIKKQESS

SEQ ID NO: 3157366 - protein, 19 aa, Giardia lamblia
IARLKLKIKTLTDEHDITL

SEQ ID NO: 3157367 - protein, 17 aa, Giardia lamblia
IARSCGYITSSAVSDTT

SEQ ID NO: 3157368 - protein, 23 aa, Giardia lamblia
IASCLKIDPSHRITVPQALRHPR

SEQ ID NO: 3157369 - protein, 17 aa, Giardia lamblia
IASICFAITTAVIAWTA

SEQ ID NO: 3157370 - protein, 18 aa, Giardia lamblia
IASIVALRLTNPATGAAY

SEQ ID NO: 3157371 - protein, 17 aa, Giardia lamblia
IASLIQCLLMYTNNQSL

SEQ ID NO: 3157372 - protein, 21 aa, Giardia lamblia
IASLRSIIARDIAKIQDALSD

SEQ ID NO: 3157373 - protein, 25 aa, Giardia lamblia
IASLRSSSFLQLRPTTEIARLILAS

SEQ ID NO: 3157374 - protein, 17 aa, Giardia lamblia
IASQIAAGLSWLHSPFN

SEQ ID NO: 3157375 - protein, 28 aa, Giardia lamblia
IASSEYVLFCVIYYDRVEKIHQFPIPFC

SEQ ID NO: 3157376 - protein, 23 aa, Giardia lamblia
IATEGNCCLVADVDANQDSKLDG

SEQ ID NO: 3157377 - protein, 25 aa, Giardia lamblia
IATIKQRFEEIAGMVTSLQESLADV

SEQ ID NO: 3157378 - protein, 24 aa, Giardia lamblia
IATISRLFCQRALKTPRRRCLGTR

SEQ ID NO: 3157379 - protein, 19 aa, Giardia lamblia
IAVARGHHHIVKFLLSYTA

SEQ ID NO: 3157380 - protein, 25 aa, Giardia lamblia
IAVDRCVKLPIVVNCDIRSILNHVL

SEQ ID NO: 3157381 - protein, 25 aa, Giardia lamblia
IAVEPVPWLPDSAFDPMEIPNFSSF

SEQ ID NO: 3157382 - protein, 19 aa, Giardia lamblia
IAVGMFKAKNWRKIADFIY

SEQ ID NO: 3157383 - protein, 18 aa, Giardia lamblia
IAVPNLFGSYSLHILGRT

SEQ ID NO: 3157384 - protein, 25 aa, Giardia lamblia
IAVTSCCPLCTQFARNGVTVEQVAQ

SEQ ID NO: 3157385 - protein, 20 aa, Giardia lamblia
IAYATLLDWMLKDKSTPFNL

SEQ ID NO: 3157386 - protein, 24 aa, Giardia lamblia
IAYDYNTSMLYRFSDLSHMESSPL

SEQ ID NO: 3157387 - protein, 25 aa, Giardia lamblia
IAYGLEYLHSLLIVHHDIKLENVLI

SEQ ID NO: 3157388 - protein, 21 aa, Giardia lamblia
IAYKNGEQIILEKVKCPCCDD

SEQ ID NO: 3157389 - protein, 23 aa, Giardia lamblia
IAYLKSLRYFDHKVIRESDKASA

SEQ ID NO: 3157390 - protein, 17 aa, Giardia lamblia
IAYWAYRNKIPIFCPAI

SEQ ID NO: 3157391 - protein, 20 aa, Giardia lamblia
ICAASPFPPGSSVSGLLKSK

SEQ ID NO: 3157392 - protein, 27 aa, Giardia lamblia
ICAFLKPLKPDACKGAMHALPRFITEN

SEQ ID NO: 3157393 - protein, 27 aa, Giardia lamblia
ICAHVPLLQYRSMRHCIVGSPIHTSIS

SEQ ID NO: 3157394 - protein, 17 aa, Giardia lamblia
ICATCGCETNPHMDGTI

SEQ ID NO: 3157395 - protein, 20 aa, Giardia lamblia
ICAVNRAKIQSIWRDRLRSV

SEQ ID NO: 3157396 - protein, 22 aa, Giardia lamblia
ICAVSISIPLPEQIGIKSVQMN

SEQ ID NO: 3157397 - protein, 17 aa, Giardia lamblia
ICAVTGCHVINPNTHML

SEQ ID NO: 3157398 - protein, 21 aa, Giardia lamblia
ICCPNEPGCAFLWQAGHYRTS

SEQ ID NO: 3157399 - protein, 24 aa, Giardia lamblia
ICDKCKDYDALLSKLANAEAELSV

SEQ ID NO: 3157400 - protein, 23 aa, Giardia lamblia
ICDSAGMTPLKWIEKEREEHGCT

SEQ ID NO: 3157401 - protein, 29 aa, Giardia lamblia
ICFKVTNYKAFPLLIPLVGAAASLHYRIS

SEQ ID NO: 3157402 - protein, 20 aa, Giardia lamblia
ICGAAKKLADEIEHYGCPPV

SEQ ID NO: 3157403 - protein, 21 aa, Giardia lamblia
ICGDSECLGEYSFFDKPERKD

SEQ ID NO: 3157404 - protein, 26 aa, Giardia lamblia
ICGDSGRFQANIAFITRLRAAILNAA

SEQ ID NO: 3157405 - protein, 21 aa, Giardia lamblia
ICGERACPHFHNMQSSIAPSA

SEQ ID NO: 3157406 - protein, 23 aa, Giardia lamblia
ICGTASFDGSCRLWNTDTGAPMG

SEQ ID NO: 3157407 - protein, 19 aa, Giardia lamblia
ICIAIRRYNEVVALQEELR

SEQ ID NO: 3157408 - protein, 26 aa, Giardia lamblia
ICIDASECQCGLDIIKKLSQAGIPCF

SEQ ID NO: 3157409 - protein, 25 aa, Giardia lamblia
ICIHLFKIHVFPAIVANLKQRHTDE

SEQ ID NO: 3157410 - protein, 18 aa, Giardia lamblia
ICIMISMCQHNCGLEGRI

SEQ ID NO: 3157411 - protein, 17 aa, Giardia lamblia
ICKRHFMTALSQTKASV

SEQ ID NO: 3157412 - protein, 22 aa, Giardia lamblia
ICKTIKRLCVMFSSEQPANLPV

SEQ ID NO: 3157413 - protein, 25 aa, Giardia lamblia
ICLMQCGDIFLPMNFAVLDSVCDTL

SEQ ID NO: 3157414 - protein, 20 aa, Giardia lamblia
ICLVQEILQGAFLMIDDVID

SEQ ID NO: 3157415 - protein, 20 aa, Giardia lamblia
ICNRLADLAMEYSTKKPAFT

SEQ ID NO: 3157416 - protein, 24 aa, Giardia lamblia
ICNSKAQDVFLFFLTNYQTRTDAM

SEQ ID NO: 3157417 - protein, 27 aa, Giardia lamblia
ICNTPTIALFCISRWDSYGMKNSQPCA

SEQ ID NO: 3157418 - protein, 24 aa, Giardia lamblia
ICPDSDAVSECSVCEEINDSRQNL

SEQ ID NO: 3157419 - protein, 21 aa, Giardia lamblia
ICPYLSIVTNLAFWNKLRDFC

SEQ ID NO: 3157420 - protein, 17 aa, Giardia lamblia
ICQGHLDLSPGGFRDQC

SEQ ID NO: 3157421 - protein, 31 aa, Giardia lamblia
ICRARSESLLLWLTANGFKLRTFPFLSPPSL

SEQ ID NO: 3157422 - protein, 26 aa, Giardia lamblia
ICRRKLTLSDDAIWGIIAQVFNGLYF

SEQ ID NO: 3157423 - protein, 18 aa, Giardia lamblia
ICRVLRCLQLLVSSDDLV

SEQ ID NO: 3157424 - protein, 24 aa, Giardia lamblia
ICSGMGLRYVDEWIDVGADAVKKA

SEQ ID NO: 3157425 - protein, 23 aa, Giardia lamblia
ICSHKATSVVFLISGETIHSSDK

SEQ ID NO: 3157426 - protein, 25 aa, Giardia lamblia
ICSKLIRYVSKWCYTDIRRGREFAV

SEQ ID NO: 3157427 - protein, 19 aa, Giardia lamblia
ICSKPDKWYAALKAQTYEG

SEQ ID NO: 3157428 - protein, 22 aa, Giardia lamblia
ICTLKMKECAKVFKQDVNLIRS

SEQ ID NO: 3157429 - protein, 17 aa, Giardia lamblia
ICTRYKLMATHTAYLAA

SEQ ID NO: 3157430 - protein, 19 aa, Giardia lamblia
ICTSFTSFHPESWNPTWGI

SEQ ID NO: 3157431 - protein, 19 aa, Giardia lamblia
ICVKAMLPYQGCLQDENGT

SEQ ID NO: 3157432 - protein, 20 aa, Giardia lamblia
ICVVRRAIRHPRFIAGGGSI

SEQ ID NO: 3157433 - protein, 18 aa, Giardia lamblia
IDAAMLLSTCLSSQAGAL

SEQ ID NO: 3157434 - protein, 24 aa, Giardia lamblia
IDACGYNGLMGICIDAAASEFYSK

SEQ ID NO: 3157435 - protein, 21 aa, Giardia lamblia
IDACTKTALMYAAENNNADAV

SEQ ID NO: 3157436 - protein, 25 aa, Giardia lamblia
IDAFDKLPLLAADLNDSGPTALPSS

SEQ ID NO: 3157437 - protein, 19 aa, Giardia lamblia
IDAIELLNAIFDRFKEYDI

SEQ ID NO: 3157438 - protein, 25 aa, Giardia lamblia
IDAIGKQLFVCFHMHMADRVVLKGA

SEQ ID NO: 3157439 - protein, 21 aa, Giardia lamblia
IDALLLRLIHHNTYFNLISYG

SEQ ID NO: 3157440 - protein, 21 aa, Giardia lamblia
IDAPELCKLLAREEGGIALPD

SEQ ID NO: 3157441 - protein, 18 aa, Giardia lamblia
IDAQGWTALDYAVTRGHY

SEQ ID NO: 3157442 - protein, 27 aa, Giardia lamblia
IDASFEAEPFKSCGVELFEGQAKLMID

SEQ ID NO: 3157443 - protein, 23 aa, Giardia lamblia
IDASNPLGGLIVVPPEQIVVLKK

SEQ ID NO: 3157444 - protein, 23 aa, Giardia lamblia
IDAYRVKYLLALKRTTSSGKDAD

SEQ ID NO: 3157445 - protein, 19 aa, Giardia lamblia
IDCGAKFPMELLRRTVVEE

SEQ ID NO: 3157446 - protein, 17 aa, Giardia lamblia
IDCTLFFARFPHSRPDS

SEQ ID NO: 3157447 - protein, 18 aa, Giardia lamblia
IDCVRLLLCEAGAQTSSD

SEQ ID NO: 3157448 - protein, 28 aa, Giardia lamblia
IDDLSRKCLFQRKLIIQISDKHAAEREL

SEQ ID NO: 3157449 - protein, 17 aa, Giardia lamblia
IDDLVKIDKEFRAQYLQ

SEQ ID NO: 3157450 - protein, 18 aa, Giardia lamblia
IDDPELATILAVQEAGLV

SEQ ID NO: 3157451 - protein, 23 aa, Giardia lamblia
IDDWLVKLSDILSRKEEAITTLK

SEQ ID NO: 3157452 - protein, 18 aa, Giardia lamblia
IDEAHLVLEWVSFRPEFL

SEQ ID NO: 3157453 - protein, 17 aa, Giardia lamblia
IDEIDAIGGRRSDTGGY

SEQ ID NO: 3157454 - protein, 18 aa, Giardia lamblia
IDEIDAMGSFALAIVKNH

SEQ ID NO: 3157455 - protein, 19 aa, Giardia lamblia
IDEKAPFDVLVTFQPAMAA

SEQ ID NO: 3157456 - protein, 24 aa, Giardia lamblia
IDELEIFAGVSPRRILQCHGSYCK

SEQ ID NO: 3157457 - protein, 27 aa, Giardia lamblia
IDELFSYKCLHLIFSFVGDGAHELSLH

SEQ ID NO: 3157458 - protein, 20 aa, Giardia lamblia
IDELRAALLSKLNNLQSPLV

SEQ ID NO: 3157459 - protein, 18 aa, Giardia lamblia
IDEQLDFEISKRAPMSAV

SEQ ID NO: 3157460 - protein, 17 aa, Giardia lamblia
IDERIRAVPTLPNDAKR

SEQ ID NO: 3157461 - protein, 26 aa, Giardia lamblia
IDERVCDILARAPRSVLLAFAAFFSK

SEQ ID NO: 3157462 - protein, 19 aa, Giardia lamblia
IDEWYKFDIGKIVMVTGGR

SEQ ID NO: 3157463 - protein, 27 aa, Giardia lamblia
IDFKYHHARSIILIGVPYLYSGSTLIH

SEQ ID NO: 3157464 - protein, 23 aa, Giardia lamblia
IDFLPMELMKLQFYPAELAQNTI

SEQ ID NO: 3157465 - protein, 20 aa, Giardia lamblia
IDFLSKVGFSTSLRYAIQLI

SEQ ID NO: 3157466 - protein, 26 aa, Giardia lamblia
IDFNWKVLLIETIDKFIGWSSVGGLP

SEQ ID NO: 3157467 - protein, 25 aa, Giardia lamblia
IDFPRVGNSWSYHYCRRQWNLDYWG

SEQ ID NO: 3157468 - protein, 19 aa, Giardia lamblia
IDFQNCYDAITLVGKELFV

SEQ ID NO: 3157469 - protein, 24 aa, Giardia lamblia
IDFSKLRRDGIHPLMLSYELQVSG

SEQ ID NO: 3157470 - protein, 20 aa, Giardia lamblia
IDFSPKLYLTEFRELHKTRS

SEQ ID NO: 3157471 - protein, 19 aa, Giardia lamblia
IDFSSRILLLTGPNAGGKT

SEQ ID NO: 3157472 - protein, 18 aa, Giardia lamblia
IDGFCERCIGQLIAFEER

SEQ ID NO: 3157473 - protein, 25 aa, Giardia lamblia
IDGFDFSYIFKRAEVSQVLVQSLPG

SEQ ID NO: 3157474 - protein, 24 aa, Giardia lamblia
IDGGCMRGGALSTVLREIDQIPDQ

SEQ ID NO: 3157475 - protein, 21 aa, Giardia lamblia
IDGHSALMWAAKYGNSELITL

SEQ ID NO: 3157476 - protein, 18 aa, Giardia lamblia
IDGQWKHPMNLSELESLL

SEQ ID NO: 3157477 - protein, 23 aa, Giardia lamblia
IDGRECIRVGKLNLVDLAGSERQ

SEQ ID NO: 3157478 - protein, 20 aa, Giardia lamblia
IDHANIFLYTAFYLDENTII

SEQ ID NO: 3157479 - protein, 19 aa, Giardia lamblia
IDHIFDLKTPFGTLVTYRK

SEQ ID NO: 3157480 - protein, 17 aa, Giardia lamblia
IDHLITLVYVEKRAIPS

SEQ ID NO: 3157481 - protein, 17 aa, Giardia lamblia
IDHTSIPVLSHVPFISD

SEQ ID NO: 3157482 - protein, 32 aa, Giardia lamblia
IDHYMLRAGILPAFHVRFAIDPAVCEDHIKDR

SEQ ID NO: 3157483 - protein, 24 aa, Giardia lamblia
IDIDGVLIKGIWGQSGSLVKQKEV

SEQ ID NO: 3157484 - protein, 17 aa, Giardia lamblia
IDIEAANLLAKDIHTQM

SEQ ID NO: 3157485 - protein, 17 aa, Giardia lamblia
IDIGLKSPQAIILSPTR

SEQ ID NO: 3157486 - protein, 23 aa, Giardia lamblia
IDILPRLAHQNVLEYHQVLTAKD

SEQ ID NO: 3157487 - protein, 23 aa, Giardia lamblia
IDILQKLLIGCKIDPNLDIQRIA

SEQ ID NO: 3157488 - protein, 18 aa, Giardia lamblia
IDISRLRADVQRAISGEG

SEQ ID NO: 3157489 - protein, 19 aa, Giardia lamblia
IDITRFFPQSYRVVNASDA

SEQ ID NO: 3157490 - protein, 19 aa, Giardia lamblia
IDIWSFGCIMAEILLGQPL

SEQ ID NO: 3157491 - protein, 22 aa, Giardia lamblia
IDKDIRCNIWASPESTPDITKW

SEQ ID NO: 3157492 - protein, 17 aa, Giardia lamblia
IDKGFALIKEAVVSDNA

SEQ ID NO: 3157493 - protein, 29 aa, Giardia lamblia
IDKGVECYLSLIAGRGWLCNEAEKGDTTS

SEQ ID NO: 3157494 - protein, 22 aa, Giardia lamblia
IDKLIFRFTISNVMVNTTNFLN

SEQ ID NO: 3157495 - protein, 25 aa, Giardia lamblia
IDKWEIYEGTALMRAAIYGYTEAVR

SEQ ID NO: 3157496 - protein, 20 aa, Giardia lamblia
IDLFTSVFTKGSFNTQELRK

SEQ ID NO: 3157497 - protein, 17 aa, Giardia lamblia
IDLGGNVLIGSSVQPAY

SEQ ID NO: 3157498 - protein, 25 aa, Giardia lamblia
IDLHEVHDVYSLPFNKNLVAEPDKM

SEQ ID NO: 3157499 - protein, 23 aa, Giardia lamblia
IDLLQPRIDMIHRFWTITYEHCT

SEQ ID NO: 3157500 - protein, 25 aa, Giardia lamblia
IDLPPLAASVVWARSLFVAVKEPYR

SEQ ID NO: 3157501 - protein, 24 aa, Giardia lamblia
IDLQGRTALIIAVQLENISAIKVL

SEQ ID NO: 3157502 - protein, 19 aa, Giardia lamblia
IDLRNAGVVNDIIVGPEYS

SEQ ID NO: 3157503 - protein, 25 aa, Giardia lamblia
IDLSDCPSCLGILPYCSQESFKNDL

SEQ ID NO: 3157504 - protein, 25 aa, Giardia lamblia
IDLVACFSAKILAGGTPSYEANDVH

SEQ ID NO: 3157505 - protein, 18 aa, Giardia lamblia
IDLYLSITRLPRPIELPT

SEQ ID NO: 3157506 - protein, 18 aa, Giardia lamblia
IDLYRDFMVEVSYMTTIR

SEQ ID NO: 3157507 - protein, 19 aa, Giardia lamblia
IDMAMPPTLILSGDNADLV

SEQ ID NO: 3157508 - protein, 24 aa, Giardia lamblia
IDMGQPVCLTRVGIFLHGENSQNP

SEQ ID NO: 3157509 - protein, 21 aa, Giardia lamblia
IDMKDRLERQISEINDKAMEY

SEQ ID NO: 3157510 - protein, 17 aa, Giardia lamblia
IDMLKGEESFKRTLRMV

SEQ ID NO: 3157511 - protein, 18 aa, Giardia lamblia
IDNKLAILERRIMEARDC

SEQ ID NO: 3157512 - protein, 24 aa, Giardia lamblia
IDNVKRNLLQLSFNVQFKLVSVRE

SEQ ID NO: 3157513 - protein, 24 aa, Giardia lamblia
IDNYLRPGALDELETRREVIQNNL

SEQ ID NO: 3157514 - protein, 22 aa, Giardia lamblia
IDPDMAMGLYIDTACFASRKLV

SEQ ID NO: 3157515 - protein, 23 aa, Giardia lamblia
IDPEFPLGTAVDVFAFGILLYRL

SEQ ID NO: 3157516 - protein, 25 aa, Giardia lamblia
IDPGLLRPGRFDKIIYIPLPNLEDR

SEQ ID NO: 3157517 - protein, 20 aa, Giardia lamblia
IDPQLCGKWMYFWNDRAFVA

SEQ ID NO: 3157518 - protein, 17 aa, Giardia lamblia
IDQGMSVFIVRSYADGV

SEQ ID NO: 3157519 - protein, 18 aa, Giardia lamblia
IDQIAVALGPKRTRDEFI

SEQ ID NO: 3157520 - protein, 25 aa, Giardia lamblia
IDQILRLRAAVGADRVFRDIQPQQL

SEQ ID NO: 3157521 - protein, 30 aa, Giardia lamblia
IDQMCPLEALKAVLLLPYAVYSRKLKAIIL

SEQ ID NO: 3157522 - protein, 19 aa, Giardia lamblia
IDQSLALKPVFPPERPPAN

SEQ ID NO: 3157523 - protein, 20 aa, Giardia lamblia
IDQVCPRSAQSPAAPLSILS

SEQ ID NO: 3157524 - protein, 33 aa, Giardia lamblia
IDQWIAAMLAHFAEWPDVIFVIFDDVPLTVTAD

SEQ ID NO: 3157525 - protein, 20 aa, Giardia lamblia
IDREGLESALALGINVPLSI

SEQ ID NO: 3157526 - protein, 22 aa, Giardia lamblia
IDRIKSLGGTVIFGRVNGFISV

SEQ ID NO: 3157527 - protein, 19 aa, Giardia lamblia
IDRKVLIQRIITLKEQLHW

SEQ ID NO: 3157528 - protein, 18 aa, Giardia lamblia
IDRPDLIEKFVITATDRS

SEQ ID NO: 3157529 - protein, 20 aa, Giardia lamblia
IDRPSYRYATYYDIDLSPED

SEQ ID NO: 3157530 - protein, 24 aa, Giardia lamblia
IDRSRLPTSASIVYTRSSSKGKTS

SEQ ID NO: 3157531 - protein, 20 aa, Giardia lamblia
IDRTMWRSSAQLSQIIDNAE

SEQ ID NO: 3157532 - protein, 25 aa, Giardia lamblia
IDRVVSICRPRRLLYLAVDGPAPRA

SEQ ID NO: 3157533 - protein, 17 aa, Giardia lamblia
IDSAGIRKSMSIAAESL

SEQ ID NO: 3157534 - protein, 17 aa, Giardia lamblia
IDSARKLVYLWANECTR

SEQ ID NO: 3157535 - protein, 25 aa, Giardia lamblia
IDSIYRLPFYYRFNINKQTMRCSTG

SEQ ID NO: 3157536 - protein, 18 aa, Giardia lamblia
IDSKRKVQQISVPKTAFS

SEQ ID NO: 3157537 - protein, 17 aa, Giardia lamblia
IDSMYQYSLQWYVSLFV

SEQ ID NO: 3157538 - protein, 26 aa, Giardia lamblia
IDSPFPRLRILNNLIITVDDYDRAKQ

SEQ ID NO: 3157539 - protein, 18 aa, Giardia lamblia
IDSVFPGLMRAFSNENPD

SEQ ID NO: 3157540 - protein, 24 aa, Giardia lamblia
IDTRGLIRLCDFGLSMALQAGNPP

SEQ ID NO: 3157541 - protein, 23 aa, Giardia lamblia
IDTVSAFPGIFALIDTSLSAEHS

SEQ ID NO: 3157542 - protein, 20 aa, Giardia lamblia
IDTVSCFDLSRDRGPGHDSE

SEQ ID NO: 3157543 - protein, 17 aa, Giardia lamblia
IDTWLDGVCKSVCPLHQ

SEQ ID NO: 3157544 - protein, 19 aa, Giardia lamblia
IDTYLKLASTLVARGHINS

SEQ ID NO: 3157545 - protein, 18 aa, Giardia lamblia
IDVALKRPKNLRGQEIGY

SEQ ID NO: 3157546 - protein, 30 aa, Giardia lamblia
IDVEMARQLAVLSCVNLSASTMPLVQVIGA

SEQ ID NO: 3157547 - protein, 17 aa, Giardia lamblia
IDVLLGRGSSSAVYSIK

SEQ ID NO: 3157548 - protein, 17 aa, Giardia lamblia
IDWTRELSRSFMVGVGF

SEQ ID NO: 3157549 - protein, 31 aa, Giardia lamblia
IDYAKCIGCNMCIKACDVQGIGVYKQNEKPK

SEQ ID NO: 3157550 - protein, 17 aa, Giardia lamblia
IDYAKLFDNMELIDLLE

SEQ ID NO: 3157551 - protein, 23 aa, Giardia lamblia
IDYKRLSGFARERSQEFIIPFVS

SEQ ID NO: 3157552 - protein, 18 aa, Giardia lamblia
IDYLTCFYNSTYSSEIRL

SEQ ID NO: 3157553 - protein, 19 aa, Giardia lamblia
IEAAACNKIVLPTSSNLTK

SEQ ID NO: 3157554 - protein, 31 aa, Giardia lamblia
IEAHVSKPRVRECVFKCFIDIIQDMHKMVLN

SEQ ID NO: 3157555 - protein, 23 aa, Giardia lamblia
IEAKFSLDLLPFVQSSHGANVSI

SEQ ID NO: 3157556 - protein, 24 aa, Giardia lamblia
IEALQLKCRSLQLELDDTRAQLEK

SEQ ID NO: 3157557 - protein, 24 aa, Giardia lamblia
IEALSLARAFVVRKLATIVQDDVV

SEQ ID NO: 3157558 - protein, 19 aa, Giardia lamblia
IEANLEYAGQVAPDGKTAL

SEQ ID NO: 3157559 - protein, 26 aa, Giardia lamblia
IEARLEVAGILWGLGISVGMSCKEGC

SEQ ID NO: 3157560 - protein, 19 aa, Giardia lamblia
IEASMQCSYLHTFQSLTTL

SEQ ID NO: 3157561 - protein, 17 aa, Giardia lamblia
IEATMAKGTFKDRIATM

SEQ ID NO: 3157562 - protein, 17 aa, Giardia lamblia
IEAVLSLIPEQAGLQNI

SEQ ID NO: 3157563 - protein, 26 aa, Giardia lamblia
IEAYLRKIHEILCISTCPVCGHVNLA

SEQ ID NO: 3157564 - protein, 17 aa, Giardia lamblia
IECIVVFPGESKDLDSI

SEQ ID NO: 3157565 - protein, 25 aa, Giardia lamblia
IECPCSTKPLPACFFHLLDPIQKPR

SEQ ID NO: 3157566 - protein, 18 aa, Giardia lamblia
IECPLCRKVAIKAQKLYF

SEQ ID NO: 3157567 - protein, 23 aa, Giardia lamblia
IECSCICGLLVVYLTSKGTKYLS

SEQ ID NO: 3157568 - protein, 18 aa, Giardia lamblia
IEDAFKALSIDTSVTGTR

SEQ ID NO: 3157569 - protein, 22 aa, Giardia lamblia
IEEELRMALEENLELKREVELL

SEQ ID NO: 3157570 - protein, 18 aa, Giardia lamblia
IEEKCQYTLVPLEDLEVE

SEQ ID NO: 3157571 - protein, 20 aa, Giardia lamblia
IEEVIMLIDLIKRGAPNESF

SEQ ID NO: 3157572 - protein, 19 aa, Giardia lamblia
IEFSIKYFKQLSALRPNSV

SEQ ID NO: 3157573 - protein, 25 aa, Giardia lamblia
IEGDVLKIFCLLPYQSREKDEDGNT

SEQ ID NO: 3157574 - protein, 18 aa, Giardia lamblia
IEGLKRQVNEFSNKLLEA

SEQ ID NO: 3157575 - protein, 29 aa, Giardia lamblia
IEGLLKCTRLFPEYYEPFYNLGNILKADE

SEQ ID NO: 3157576 - protein, 26 aa, Giardia lamblia
IEGLPCPASGFSSDFGFARISSVLNV

SEQ ID NO: 3157577 - protein, 20 aa, Giardia lamblia
IEGQIHFGWHAFPKPTPLIL

SEQ ID NO: 3157578 - protein, 35 aa, Giardia lamblia
IEGRERARCLGHPDVLLSCYICKEHSELCVTGSAD

SEQ ID NO: 3157579 - protein, 25 aa, Giardia lamblia
IEGTLKRLKSFKVDARSRSPEDIDD

SEQ ID NO: 3157580 - protein, 20 aa, Giardia lamblia
IEGVDTCLCCGTHAGNTGEC

SEQ ID NO: 3157581 - protein, 26 aa, Giardia lamblia
IEHSVLRFPPLIKLAGCAHMTTAAVS

SEQ ID NO: 3157582 - protein, 20 aa, Giardia lamblia
IEHYGCPPVLPTADSLELPG

SEQ ID NO: 3157583 - protein, 17 aa, Giardia lamblia
IEIGSSFIKNLSELYAS

SEQ ID NO: 3157584 - protein, 25 aa, Giardia lamblia
IEIRYGHEGLRLLGMAYEGRGPWAE

SEQ ID NO: 3157585 - protein, 20 aa, Giardia lamblia
IEIVLHLPLACEDKGVPYVF

SEQ ID NO: 3157586 - protein, 27 aa, Giardia lamblia
IEIVMYYIKHFFTIESLRILADPLISS

SEQ ID NO: 3157587 - protein, 22 aa, Giardia lamblia
IEKKLVEKFVFGKADNLSKQFF

SEQ ID NO: 3157588 - protein, 26 aa, Giardia lamblia
IEKRCQEFYGNVAMYNLSPVMIKLLS

SEQ ID NO: 3157589 - protein, 25 aa, Giardia lamblia
IEKSISLKVPFRLGNVQPTMSKLMT

SEQ ID NO: 3157590 - protein, 31 aa, Giardia lamblia
IEKVSKAGLCLYDWVTAMVKYYAVAKDVEPK

SEQ ID NO: 3157591 - protein, 17 aa, Giardia lamblia
IELCTTRTWVLLPDIQF

SEQ ID NO: 3157592 - protein, 25 aa, Giardia lamblia
IELDAPELVCLLAPLEENTPVPGYG

SEQ ID NO: 3157593 - protein, 34 aa, Giardia lamblia
IELDISFLVDSLFLRCFNTAQLLFHCYSSEHSGV

SEQ ID NO: 3157594 - protein, 25 aa, Giardia lamblia
IELHSRFFKLVSWYDNECGYSAKLV

SEQ ID NO: 3157595 - protein, 22 aa, Giardia lamblia
IELHVPRFLVSDNFSLSRRNDL

SEQ ID NO: 3157596 - protein, 17 aa, Giardia lamblia
IELKNCVLLLVERMGPD

SEQ ID NO: 3157597 - protein, 18 aa, Giardia lamblia
IELLCMLHFSLIISTDVF

SEQ ID NO: 3157598 - protein, 21 aa, Giardia lamblia
IELLGPVPMATSFNSQLLTDD

SEQ ID NO: 3157599 - protein, 26 aa, Giardia lamblia
IELLRKMQVHMKLAANMIATLKEQNQ

SEQ ID NO: 3157600 - protein, 23 aa, Giardia lamblia
IELNRRRLDLFNHTSMTNLPLAD

SEQ ID NO: 3157601 - protein, 25 aa, Giardia lamblia
IELNVYPRRKFKGITALMIAVLMNS

SEQ ID NO: 3157602 - protein, 22 aa, Giardia lamblia
IELPRACVMADKIAQTAQYFSF

SEQ ID NO: 3157603 - protein, 17 aa, Giardia lamblia
IELPTILEHGLPQPSVD

SEQ ID NO: 3157604 - protein, 17 aa, Giardia lamblia
IELRRKQAMLVDELIDF

SEQ ID NO: 3157605 - protein, 18 aa, Giardia lamblia
IELSEFLRSLVTFSPAFI

SEQ ID NO: 3157606 - protein, 31 aa, Giardia lamblia
IELSYSEFLAAWGLKPVRIFIQKDPDTSMEL

SEQ ID NO: 3157607 - protein, 17 aa, Giardia lamblia
IEMFTELMCNPDKLQAA

SEQ ID NO: 3157608 - protein, 17 aa, Giardia lamblia
IEMKHVIAAATSSIKSY

SEQ ID NO: 3157609 - protein, 25 aa, Giardia lamblia
IEMPPCIINSFVSRNFFIENTGDTE

SEQ ID NO: 3157610 - protein, 17 aa, Giardia lamblia
IENFCSSAFLSAKNSEP

SEQ ID NO: 3157611 - protein, 18 aa, Giardia lamblia
IENLRLLHEENMRDLVAR

SEQ ID NO: 3157612 - protein, 26 aa, Giardia lamblia
IENSSVWRKQCLDALAHILSYTNELE

SEQ ID NO: 3157613 - protein, 19 aa, Giardia lamblia
IENTRLFAEYGPLFSAEAI

SEQ ID NO: 3157614 - protein, 19 aa, Giardia lamblia
IEPGLPLYSLGSSQPSSQV

SEQ ID NO: 3157615 - protein, 24 aa, Giardia lamblia
IEPHISLAGAHLVAESFDLAEKAA

SEQ ID NO: 3157616 - protein, 17 aa, Giardia lamblia
IEPLDMFAKHDLMEVSR

SEQ ID NO: 3157617 - protein, 20 aa, Giardia lamblia
IEPRDILRLDISVDKLNKQG

SEQ ID NO: 3157618 - protein, 17 aa, Giardia lamblia
IEPRFLHTFKHMLNNLS

SEQ ID NO: 3157619 - protein, 34 aa, Giardia lamblia
IEPRMSSTLFIKMTPRFAKPCVALIGLRPSYEVS

SEQ ID NO: 3157620 - protein, 26 aa, Giardia lamblia
IEQFLRLEFNISLLPSSLYMTSPSST

SEQ ID NO: 3157621 - protein, 30 aa, Giardia lamblia
IEQGALVQWCLICASFHILQNYNMIGDFLP

SEQ ID NO: 3157622 - protein, 24 aa, Giardia lamblia
IEQKSKPYVVYTFTISTEKGVFEV

SEQ ID NO: 3157623 - protein, 17 aa, Giardia lamblia
IEQNRLTKIDAIQTEIE

SEQ ID NO: 3157624 - protein, 18 aa, Giardia lamblia
IEQRLGFIPKAIRIPINK

SEQ ID NO: 3157625 - protein, 22 aa, Giardia lamblia
IEQRNLYLIGLLIYELCLLTPY

SEQ ID NO: 3157626 - protein, 17 aa, Giardia lamblia
IERADALYGCYRTTTPG

SEQ ID NO: 3157627 - protein, 39 aa, Giardia lamblia
IERELRLFGILECSRLSNYIKLLSSFAISEFICTACTRI

SEQ ID NO: 3157628 - protein, 20 aa, Giardia lamblia
IERLIFVVTAYIYRTVSFGF

SEQ ID NO: 3157629 - protein, 18 aa, Giardia lamblia
IERVCAMPLSARSTHDKG

SEQ ID NO: 3157630 - protein, 17 aa, Giardia lamblia
IERYKYTVQPLITEEET

SEQ ID NO: 3157631 - protein, 32 aa, Giardia lamblia
IESAIQFLFKVWDYIEEAFALRNSCLNGIRTC

SEQ ID NO: 3157632 - protein, 18 aa, Giardia lamblia
IESCSWYRARDIYLEALT

SEQ ID NO: 3157633 - protein, 17 aa, Giardia lamblia
IESLLAMSTSKANDMDQ

SEQ ID NO: 3157634 - protein, 18 aa, Giardia lamblia
IESLRTALSLLTRKHEVE

SEQ ID NO: 3157635 - protein, 24 aa, Giardia lamblia
IESPEEFKAIWSSMYTELVTITAG

SEQ ID NO: 3157636 - protein, 18 aa, Giardia lamblia
IESQLPLQNEYELLMTKY

SEQ ID NO: 3157637 - protein, 20 aa, Giardia lamblia
IESRCKWQKTYGNWFDESDA

SEQ ID NO: 3157638 - protein, 21 aa, Giardia lamblia
IESREKYLRMIADTEQQNHVY

SEQ ID NO: 3157639 - protein, 17 aa, Giardia lamblia
IESSLAMQEKPTLSSKN

SEQ ID NO: 3157640 - protein, 23 aa, Giardia lamblia
IESYNRLRLLGRTSLEKPDKQVE

SEQ ID NO: 3157641 - protein, 17 aa, Giardia lamblia
IETAKLVIRYDSGAQNM

SEQ ID NO: 3157642 - protein, 22 aa, Giardia lamblia
IETEKGWTAIMYAIKYDNMTAF

SEQ ID NO: 3157643 - protein, 28 aa, Giardia lamblia
IETGRITLPDAIHVCFDISKDKQSRDDL

SEQ ID NO: 3157644 - protein, 18 aa, Giardia lamblia
IETGRWDIIYSSFSTLSD

SEQ ID NO: 3157645 - protein, 17 aa, Giardia lamblia
IETGTRPGLPLRENLYA

SEQ ID NO: 3157646 - protein, 23 aa, Giardia lamblia
IETKGGAIAYHVSDYINAILNQK

SEQ ID NO: 3157647 - protein, 18 aa, Giardia lamblia
IETLKMSMTLSESVVSPN

SEQ ID NO: 3157648 - protein, 17 aa, Giardia lamblia
IETLLRREGKLCTDCGQ

SEQ ID NO: 3157649 - protein, 17 aa, Giardia lamblia
IETRGGFISPLEAAVTG

SEQ ID NO: 3157650 - protein, 17 aa, Giardia lamblia
IETRVLYDKALILEKRL

SEQ ID NO: 3157651 - protein, 29 aa, Giardia lamblia
IETVAWIRSMPRVIDWRPCSLAEVYGVYM

SEQ ID NO: 3157652 - protein, 20 aa, Giardia lamblia
IETVRMILSSGVSMGKQDNK

SEQ ID NO: 3157653 - protein, 19 aa, Giardia lamblia
IEVAIRCHNYAIAEILIPK

SEQ ID NO: 3157654 - protein, 32 aa, Giardia lamblia
IEVCSIGFWITIKMFSSMAWVPRGRLLHNPLK

SEQ ID NO: 3157655 - protein, 21 aa, Giardia lamblia
IEVCSLLLKKEQCLRTQDGTT

SEQ ID NO: 3157656 - protein, 18 aa, Giardia lamblia
IEVISRWALTTQGKKGRG

SEQ ID NO: 3157657 - protein, 18 aa, Giardia lamblia
IEVLFSRPQLDKISIDRR

SEQ ID NO: 3157658 - protein, 24 aa, Giardia lamblia
IEVLKILIPHEFGMRMITGDSLNG

SEQ ID NO: 3157659 - protein, 22 aa, Giardia lamblia
IEVNNKLFLVHKVTLSNIGRLG

SEQ ID NO: 3157660 - protein, 17 aa, Giardia lamblia
IEVPRSIGDRSGTDHPN

SEQ ID NO: 3157661 - protein, 25 aa, Giardia lamblia
IEVPYHPHWPKFVPLSLTVKTHIYN

SEQ ID NO: 3157662 - protein, 21 aa, Giardia lamblia
IEVYQTVLLRHGLMTVGQTSS

SEQ ID NO: 3157663 - protein, 17 aa, Giardia lamblia
IEWFTEIALSKRLPLSA

SEQ ID NO: 3157664 - protein, 30 aa, Giardia lamblia
IEYSIYFLVDYWIRMSFFFHVTDFEICNKD

SEQ ID NO: 3157665 - protein, 17 aa, Giardia lamblia
IFAHLGLLFTPSFESVV

SEQ ID NO: 3157666 - protein, 29 aa, Giardia lamblia
IFALKEIDESLCLASSMSLTGELDIYPQL

SEQ ID NO: 3157667 - protein, 26 aa, Giardia lamblia
IFAYGTAFGSIFIRQIVPGEEISSSI

SEQ ID NO: 3157668 - protein, 20 aa, Giardia lamblia
IFDEIIARSFGIIGEPESNP

SEQ ID NO: 3157669 - protein, 24 aa, Giardia lamblia
IFDLPPNCLHSAEFTTVPEGVEED

SEQ ID NO: 3157670 - protein, 17 aa, Giardia lamblia
IFEREPKYIPIFERMLE

SEQ ID NO: 3157671 - protein, 20 aa, Giardia lamblia
IFFDEMDAVQLSREIADRVL

SEQ ID NO: 3157672 - protein, 17 aa, Giardia lamblia
IFFVHGAGFSGLSFGPL

SEQ ID NO: 3157673 - protein, 18 aa, Giardia lamblia
IFFYAFLQMHAHTQLQDS

SEQ ID NO: 3157674 - protein, 17 aa, Giardia lamblia
IFFYANSRDDLCITHLA

SEQ ID NO: 3157675 - protein, 17 aa, Giardia lamblia
IFGATALITAIRNNQLE

SEQ ID NO: 3157676 - protein, 26 aa, Giardia lamblia
IFIELPGFISRIVMIRKFLGDKLRYE

SEQ ID NO: 3157677 - protein, 26 aa, Giardia lamblia
IFIKDLRIVLIAPRYQCMITDVTTDI

SEQ ID NO: 3157678 - protein, 26 aa, Giardia lamblia
IFIKKVYRNSANFARQIGVSTHDPGP

SEQ ID NO: 3157679 - protein, 24 aa, Giardia lamblia
IFKKLKDKWKITAASNVIVRPHDT

SEQ ID NO: 3157680 - protein, 20 aa, Giardia lamblia
IFLFHACAHNPSGIDFTEAQ

SEQ ID NO: 3157681 - protein, 25 aa, Giardia lamblia
IFLKCYDMVRFFLQENNLLYISLDE

SEQ ID NO: 3157682 - protein, 24 aa, Giardia lamblia
IFLKQLKLFYKMGANPEVVQKSLS

SEQ ID NO: 3157683 - protein, 17 aa, Giardia lamblia
IFLYPKYVAENEMLINP

SEQ ID NO: 3157684 - protein, 22 aa, Giardia lamblia
IFMDRCAARKPITIFGTGEQTR

SEQ ID NO: 3157685 - protein, 25 aa, Giardia lamblia
IFMFKHLPISLSRSILICQLYSQAV

SEQ ID NO: 3157686 - protein, 21 aa, Giardia lamblia
IFNLRIRAFLPSILQQSKKFR

SEQ ID NO: 3157687 - protein, 25 aa, Giardia lamblia
IFNNYAIMWCNFITKYVAICKHLDF

SEQ ID NO: 3157688 - protein, 17 aa, Giardia lamblia
IFNQRRSLLSGNAIVHY

SEQ ID NO: 3157689 - protein, 26 aa, Giardia lamblia
IFNVYRWRPTWHDLKGWGDPHPLPSI

SEQ ID NO: 3157690 - protein, 27 aa, Giardia lamblia
IFPELGYGCFRLFKYLPVIVRGSYPHA

SEQ ID NO: 3157691 - protein, 18 aa, Giardia lamblia
IFPSEWHANLPICQEASG

SEQ ID NO: 3157692 - protein, 17 aa, Giardia lamblia
IFPSVTMLKIVDCQIDE

SEQ ID NO: 3157693 - protein, 17 aa, Giardia lamblia
IFQIQWRLRSADDKLDQ

SEQ ID NO: 3157694 - protein, 19 aa, Giardia lamblia
IFRGPGPRKFMLLMEQKGW

SEQ ID NO: 3157695 - protein, 26 aa, Giardia lamblia
IFRRFFWRWHHIFSLACEQRSLEKGD

SEQ ID NO: 3157696 - protein, 29 aa, Giardia lamblia
IFSDLLWPEFSVRAFKDCLDEFASRTRRF

SEQ ID NO: 3157697 - protein, 28 aa, Giardia lamblia
IFSEECFHLSLYMRLFTARVLTIMEQDK

SEQ ID NO: 3157698 - protein, 21 aa, Giardia lamblia
IFSKDVLKTYINFISCVLMSC

SEQ ID NO: 3157699 - protein, 21 aa, Giardia lamblia
IFSMVFNWYDGIPIDIYCLLF

SEQ ID NO: 3157700 - protein, 24 aa, Giardia lamblia
IFSPKLLLERLVKISKNYLSRLLL

SEQ ID NO: 3157701 - protein, 27 aa, Giardia lamblia
IFTKRDLEHAMELAISLGTLYTRDILN

SEQ ID NO: 3157702 - protein, 28 aa, Giardia lamblia
IFTKTVEVLLRILEPLVGLGTELGAGAS

SEQ ID NO: 3157703 - protein, 18 aa, Giardia lamblia
IFTMPRLQHIARQILESL

SEQ ID NO: 3157704 - protein, 27 aa, Giardia lamblia
IFTSDRVMLHYCSFKNIMTIAHLSDSL

SEQ ID NO: 3157705 - protein, 23 aa, Giardia lamblia
IFTVLKFFGQRTFQEVQNIVNKY

SEQ ID NO: 3157706 - protein, 24 aa, Giardia lamblia
IFVPRLKSGVPDYLKEQRRDNILV

SEQ ID NO: 3157707 - protein, 26 aa, Giardia lamblia
IFVPTVVKNLEWIPATSFQNNEAFTH

SEQ ID NO: 3157708 - protein, 24 aa, Giardia lamblia
IFVRELLKRIFVLTPEDRITADEL

SEQ ID NO: 3157709 - protein, 17 aa, Giardia lamblia
IFYRNGRVYSLDASSRK

SEQ ID NO: 3157710 - protein, 19 aa, Giardia lamblia
IGACRFFLGKHHFKNRKLQ

SEQ ID NO: 3157711 - protein, 20 aa, Giardia lamblia
IGAHMLLAGYRGHLAIIRMA

SEQ ID NO: 3157712 - protein, 22 aa, Giardia lamblia
IGAIIDSRCNFSFTHGLLSILR

SEQ ID NO: 3157713 - protein, 24 aa, Giardia lamblia
IGAIRHVINFDFPKDIDTYIHRIG

SEQ ID NO: 3157714 - protein, 19 aa, Giardia lamblia
IGALGGRILLEKPISDSGV

SEQ ID NO: 3157715 - protein, 18 aa, Giardia lamblia
IGALLFYESLGFRKMRLF

SEQ ID NO: 3157716 - protein, 20 aa, Giardia lamblia
IGANVWRLSPSPPDVDSSSP

SEQ ID NO: 3157717 - protein, 19 aa, Giardia lamblia
IGCSFSRRSLLLSHNTSRA

SEQ ID NO: 3157718 - protein, 22 aa, Giardia lamblia
IGDIFLKRGLLSLLLTPAQAKF

SEQ ID NO: 3157719 - protein, 18 aa, Giardia lamblia
IGDLRVQMHPSLFEPVFP

SEQ ID NO: 3157720 - protein, 25 aa, Giardia lamblia
IGDMGCGKAALAQAIVPKYSPGVAV

SEQ ID NO: 3157721 - protein, 24 aa, Giardia lamblia
IGEGKSGICGVRYNDNGKLYLAVW

SEQ ID NO: 3157722 - protein, 28 aa, Giardia lamblia
IGEIVRLKAPTMPAGCLEKLGFTLDGRG

SEQ ID NO: 3157723 - protein, 24 aa, Giardia lamblia
IGEVRRLKELFARGTDASGNTALI

SEQ ID NO: 3157724 - protein, 25 aa, Giardia lamblia
IGFELCLSENYVLIFSFPSLFGQTL

SEQ ID NO: 3157725 - protein, 22 aa, Giardia lamblia
IGFGKYRIAYSVDFSTDKAHGS

SEQ ID NO: 3157726 - protein, 19 aa, Giardia lamblia
IGGAMPYSLVPPTTDNSNE

SEQ ID NO: 3157727 - protein, 19 aa, Giardia lamblia
IGGAQPCICCERVMCAQCG

SEQ ID NO: 3157728 - protein, 23 aa, Giardia lamblia
IGGLLRWQVDLVEAARFMQESDE

SEQ ID NO: 3157729 - protein, 18 aa, Giardia lamblia
IGGQSEFRNIWVHYYVDK

SEQ ID NO: 3157730 - protein, 18 aa, Giardia lamblia
IGGTCLNIDPVAGLSKFL

SEQ ID NO: 3157731 - protein, 18 aa, Giardia lamblia
IGGVPRYDVKLVQDGITY

SEQ ID NO: 3157732 - protein, 18 aa, Giardia lamblia
IGHGACIRNMVLSSDSTS

SEQ ID NO: 3157733 - protein, 33 aa, Giardia lamblia
IGHGTSQYMCCCCKCTRPEVDMQGFNLCRIQLL

SEQ ID NO: 3157734 - protein, 18 aa, Giardia lamblia
IGHLLAVSLIKDFKFPIA

SEQ ID NO: 3157735 - protein, 23 aa, Giardia lamblia
IGHMPVRLRYDLVHTEKDVPREE

SEQ ID NO: 3157736 - protein, 22 aa, Giardia lamblia
IGHSHGALLVRLYMQLYDDWHQ

SEQ ID NO: 3157737 - protein, 25 aa, Giardia lamblia
IGIKCANGVVLMCHKAAENPLVDYP

SEQ ID NO: 3157738 - protein, 21 aa, Giardia lamblia
IGIKPSKGVLLYGVPGTGKTA

SEQ ID NO: 3157739 - protein, 18 aa, Giardia lamblia
IGKLLVAKMLSCYYNLLS

SEQ ID NO: 3157740 - protein, 18 aa, Giardia lamblia
IGKLVKYINGLWTWESPP

SEQ ID NO: 3157741 - protein, 24 aa, Giardia lamblia
IGKRKVPCGDAFIVDFDDQTVTRV

SEQ ID NO: 3157742 - protein, 17 aa, Giardia lamblia
IGKTCRIFTKSADTTVS

SEQ ID NO: 3157743 - protein, 23 aa, Giardia lamblia
IGLKGDSLFLWTLMLQGPPGTLF

SEQ ID NO: 3157744 - protein, 18 aa, Giardia lamblia
IGLLYGLLHARFVTTDQG

SEQ ID NO: 3157745 - protein, 27 aa, Giardia lamblia
IGMLFNWQEVQALLTALTSSTEWSAMH

SEQ ID NO: 3157746 - protein, 26 aa, Giardia lamblia
IGNNVINRLFARVPREVDEDGNTLLI

SEQ ID NO: 3157747 - protein, 24 aa, Giardia lamblia
IGNVDCVRALLSREAGMQRYDGWT

SEQ ID NO: 3157748 - protein, 28 aa, Giardia lamblia
IGNVRKHTRYTFKILNFVKPTSMFLEGA

SEQ ID NO: 3157749 - protein, 17 aa, Giardia lamblia
IGQYKGIPKEAPTKNRG

SEQ ID NO: 3157750 - protein, 21 aa, Giardia lamblia
IGRGYVVLVGISREDVIEDMH

SEQ ID NO: 3157751 - protein, 23 aa, Giardia lamblia
IGSETIPMISLRQINAPSQATSR

SEQ ID NO: 3157752 - protein, 17 aa, Giardia lamblia
IGSFCVRLMELAEESTR

SEQ ID NO: 3157753 - protein, 22 aa, Giardia lamblia
IGSKGGDIGIAMLMENKNLTTV

SEQ ID NO: 3157754 - protein, 20 aa, Giardia lamblia
IGSKSHWAKLVAGWMEHKRE

SEQ ID NO: 3157755 - protein, 19 aa, Giardia lamblia
IGSLRGHMGPVLSVSYEPF

SEQ ID NO: 3157756 - protein, 24 aa, Giardia lamblia
IGSTTCKFVPLAIDARPVGDQFQV

SEQ ID NO: 3157757 - protein, 26 aa, Giardia lamblia
IGTDLGELVCIEFCLNLEANMRPTSG

SEQ ID NO: 3157758 - protein, 19 aa, Giardia lamblia
IGTFPDYYSAGLKEILETL

SEQ ID NO: 3157759 - protein, 19 aa, Giardia lamblia
IGTGHWRRYIGSIGSAEKE

SEQ ID NO: 3157760 - protein, 24 aa, Giardia lamblia
IGTRPDYLPLLSALLPSLKTIDGV

SEQ ID NO: 3157761 - protein, 22 aa, Giardia lamblia
IGVLIKRSFPQSQFVIVSLKDG

SEQ ID NO: 3157762 - protein, 24 aa, Giardia lamblia
IGVLREEFRSCLTDIKSLKQHLRE

SEQ ID NO: 3157763 - protein, 24 aa, Giardia lamblia
IGVPRSTYPLGYMFFGMTVYLTVL

SEQ ID NO: 3157764 - protein, 25 aa, Giardia lamblia
IGVSIKRVGPFSISSMRPSEIQRSS

SEQ ID NO: 3157765 - protein, 19 aa, Giardia lamblia
IGVVYYQRLRHMVSDKYQV

SEQ ID NO: 3157766 - protein, 17 aa, Giardia lamblia
IGVYSLIPFYARFQDAQ

SEQ ID NO: 3157767 - protein, 20 aa, Giardia lamblia
IGYDIIEIFCSVLPADTLLD

SEQ ID NO: 3157768 - protein, 22 aa, Giardia lamblia
IGYSNGRLSTGFVPLTSLETPD

SEQ ID NO: 3157769 - protein, 17 aa, Giardia lamblia
IGYTCILSLKRHNSTAR

SEQ ID NO: 3157770 - protein, 24 aa, Giardia lamblia
IHDIKQRHVLSFALNVSTVEPLKT

SEQ ID NO: 3157771 - protein, 24 aa, Giardia lamblia
IHDKASEVLYVIMEFCTNGDLSSI

SEQ ID NO: 3157772 - protein, 25 aa, Giardia lamblia
IHDYFYFREHLLLKFTLLGEDLYTH

SEQ ID NO: 3157773 - protein, 17 aa, Giardia lamblia
IHEFQYLLKRQASNGAT

SEQ ID NO: 3157774 - protein, 20 aa, Giardia lamblia
IHERFLPPSYTYVSHNPTTS

SEQ ID NO: 3157775 - protein, 37 aa, Giardia lamblia
IHFPTRPKRCITAYFKRLYKSRHSGLLRALDEFNSRM

SEQ ID NO: 3157776 - protein, 28 aa, Giardia lamblia
IHFYICPKLAEVWAMSFVPGRYESIEDI

SEQ ID NO: 3157777 - protein, 17 aa, Giardia lamblia
IHGGGLIRLMRQRPTVP

SEQ ID NO: 3157778 - protein, 29 aa, Giardia lamblia
IHGLHCYRSAEVPLYLALQLFDTQQATIC

SEQ ID NO: 3157779 - protein, 26 aa, Giardia lamblia
IHGPVNFLRCRAIQPYNVVKTVRDTI

SEQ ID NO: 3157780 - protein, 24 aa, Giardia lamblia
IHGTDFRIFIRMQREAEIQRYIGF

SEQ ID NO: 3157781 - protein, 26 aa, Giardia lamblia
IHHTHLVSFCNWHFQGDYIVTVCTDD

SEQ ID NO: 3157782 - protein, 17 aa, Giardia lamblia
IHIPTLLHWTRETRLWG

SEQ ID NO: 3157783 - protein, 24 aa, Giardia lamblia
IHKPRPLPQHIEKFLSDEIKQTTT

SEQ ID NO: 3157784 - protein, 19 aa, Giardia lamblia
IHKRFSAKYPRQELRMTYN

SEQ ID NO: 3157785 - protein, 17 aa, Giardia lamblia
IHLATPVGAKIALEDLV

SEQ ID NO: 3157786 - protein, 34 aa, Giardia lamblia
IHNHFACCFPDFIFCRRELRFTAMQGKVSQNPFA

SEQ ID NO: 3157787 - protein, 20 aa, Giardia lamblia
IHNSPGIRPPLHVGTNRTTD

SEQ ID NO: 3157788 - protein, 25 aa, Giardia lamblia
IHNVRCRPCEASIPLSYLQGLDRCY

SEQ ID NO: 3157789 - protein, 23 aa, Giardia lamblia
IHPCHHLYLPVFHQLQAWCTLLK

SEQ ID NO: 3157790 - protein, 19 aa, Giardia lamblia
IHPNIPNLMVYAGGMDSKI

SEQ ID NO: 3157791 - protein, 24 aa, Giardia lamblia
IHPPIKVLFNIAVLHANSLVKSII

SEQ ID NO: 3157792 - protein, 17 aa, Giardia lamblia
IHPTCKKSKILTQILRH

SEQ ID NO: 3157793 - protein, 18 aa, Giardia lamblia
IHRARLNQYGSYSIVHSS

SEQ ID NO: 3157794 - protein, 22 aa, Giardia lamblia
IHRDIKPGNVFLTRDGSIKLGD

SEQ ID NO: 3157795 - protein, 24 aa, Giardia lamblia
IHREKRVLVCFDILELLQTNIGSK

SEQ ID NO: 3157796 - protein, 19 aa, Giardia lamblia
IHRIWPRKEDRLLVETEYL

SEQ ID NO: 3157797 - protein, 17 aa, Giardia lamblia
IHRKLRLIKTVHLTSIL

SEQ ID NO: 3157798 - protein, 18 aa, Giardia lamblia
IHRLMKMYYARRRNELGS

SEQ ID NO: 3157799 - protein, 21 aa, Giardia lamblia
IHRLREGFDAKGYVSVTALSN

SEQ ID NO: 3157800 - protein, 26 aa, Giardia lamblia
IHRLSVPRAKLLILRTKFPLPPDEVP

SEQ ID NO: 3157801 - protein, 20 aa, Giardia lamblia
IHRMPAQNQVLFRIPTNMAP

SEQ ID NO: 3157802 - protein, 22 aa, Giardia lamblia
IHRYIMPRRIFMVSETRCKLAD

SEQ ID NO: 3157803 - protein, 24 aa, Giardia lamblia
IHSDRIYPALPYKPSFIPDNPMND

SEQ ID NO: 3157804 - protein, 27 aa, Giardia lamblia
IHSNFRCCAELLAPYEGGIVNNVGETA

SEQ ID NO: 3157805 - protein, 26 aa, Giardia lamblia
IHTLRERLAKCFFYEPDGLLISPMER

SEQ ID NO: 3157806 - protein, 17 aa, Giardia lamblia
IHTLTLACTRLESSGAS

SEQ ID NO: 3157807 - protein, 24 aa, Giardia lamblia
IHTNLRGIIPLGVPTPYTTVSAFP

SEQ ID NO: 3157808 - protein, 18 aa, Giardia lamblia
IHTVFAAILINFTRCLGI

SEQ ID NO: 3157809 - protein, 25 aa, Giardia lamblia
IHVPPEYNGSPGLYVTRLESTCREL

SEQ ID NO: 3157810 - protein, 27 aa, Giardia lamblia
IHYGVFCSEFKGAVSVMELSEDKSLLT

SEQ ID NO: 3157811 - protein, 24 aa, Giardia lamblia
IHYYRPKGSILLSDLVTEYRIQHM

SEQ ID NO: 3157812 - protein, 20 aa, Giardia lamblia
IIAPGCSKDIFITRTGVSNK

SEQ ID NO: 3157813 - protein, 23 aa, Giardia lamblia
IIAPHLRKLRKKDLGLPNVADAT

SEQ ID NO: 3157814 - protein, 17 aa, Giardia lamblia
IIATHDGKFHWDECLAV

SEQ ID NO: 3157815 - protein, 17 aa, Giardia lamblia
IIAYRIPVSDFIAQTER

SEQ ID NO: 3157816 - protein, 23 aa, Giardia lamblia
IICAMSGDVAPYMYIKPKNQAQN

SEQ ID NO: 3157817 - protein, 17 aa, Giardia lamblia
IICYRRINHDPERIEEI

SEQ ID NO: 3157818 - protein, 27 aa, Giardia lamblia
IIDAFYAKRLDLYRVRRNNQIIDMDDR

SEQ ID NO: 3157819 - protein, 21 aa, Giardia lamblia
IIDEATLFFVHRVESNYILSN

SEQ ID NO: 3157820 - protein, 24 aa, Giardia lamblia
IIDECARTSLPGVYAIGDCATIHY

SEQ ID NO: 3157821 - protein, 18 aa, Giardia lamblia
IIDIAISMDETWFITIGE

SEQ ID NO: 3157822 - protein, 17 aa, Giardia lamblia
IIDPRTHTQFLFEEEDF

SEQ ID NO: 3157823 - protein, 17 aa, Giardia lamblia
IIEELKDKLAFADSGDI

SEQ ID NO: 3157824 - protein, 19 aa, Giardia lamblia
IIEERRKNIEFAALQQQQA

SEQ ID NO: 3157825 - protein, 32 aa, Giardia lamblia
IIEGDWVCLQNCHLCLSWMPNLARFVENLATM

SEQ ID NO: 3157826 - protein, 26 aa, Giardia lamblia
IIEKTNLGSIIKYFALKADTVAASIV

SEQ ID NO: 3157827 - protein, 26 aa, Giardia lamblia
IIETYYWRKNIILVLELCERDIGAVL

SEQ ID NO: 3157828 - protein, 19 aa, Giardia lamblia
IIFGTSVRVYFNLKTAIPQ

SEQ ID NO: 3157829 - protein, 29 aa, Giardia lamblia
IIFIDCGECWKLLQKYGSAIAATEKFSEQ

SEQ ID NO: 3157830 - protein, 24 aa, Giardia lamblia
IIFLRTYVPITIIKFCYEMLNHYY

SEQ ID NO: 3157831 - protein, 19 aa, Giardia lamblia
IIFNSRVSLDMLLQAHAMY

SEQ ID NO: 3157832 - protein, 23 aa, Giardia lamblia
IIFPEMIGMTVSVYNGRQFIPVE

SEQ ID NO: 3157833 - protein, 18 aa, Giardia lamblia
IIFVPGINLDHLEWYMQD

SEQ ID NO: 3157834 - protein, 22 aa, Giardia lamblia
IIGECYEDCLLVKQGEDQAKVD

SEQ ID NO: 3157835 - protein, 23 aa, Giardia lamblia
IIGHGPYATVFKCRHKATEETHI

SEQ ID NO: 3157836 - protein, 18 aa, Giardia lamblia
IIGLIPCLVKDLDNDITL

SEQ ID NO: 3157837 - protein, 30 aa, Giardia lamblia
IIGTYRGADRFRLKFSFSQPLSQVKTIPLD

SEQ ID NO: 3157838 - protein, 19 aa, Giardia lamblia
IIHACPKLTYLDDRPVFDD

SEQ ID NO: 3157839 - protein, 19 aa, Giardia lamblia
IIIKSGSLLDLALDAGENL

SEQ ID NO: 3157840 - protein, 22 aa, Giardia lamblia
IIKAGACLIGRVDNVMDDRGVF

SEQ ID NO: 3157841 - protein, 25 aa, Giardia lamblia
IIKFCYEMLNHYYVYDEYTREYIIP

SEQ ID NO: 3157842 - protein, 22 aa, Giardia lamblia
IIKKARYAFESIPFPTYNLQSR

SEQ ID NO: 3157843 - protein, 32 aa, Giardia lamblia
IIKRRIAQQWFTSVEIWLLITQLLEGVKAYQS

SEQ ID NO: 3157844 - protein, 26 aa, Giardia lamblia
IIKSPKAVVYFAEFTQKVYTRCTAKS

SEQ ID NO: 3157845 - protein, 22 aa, Giardia lamblia
IIKTLWNEIGIQLAEREVTAQY

SEQ ID NO: 3157846 - protein, 20 aa, Giardia lamblia
IILEFSRYNSDLKRYLIVEL

SEQ ID NO: 3157847 - protein, 25 aa, Giardia lamblia
IILEKVKCPCCDDIIEMRILNDCID

SEQ ID NO: 3157848 - protein, 18 aa, Giardia lamblia
IILPGSHKEYLVKGLDKH

SEQ ID NO: 3157849 - protein, 17 aa, Giardia lamblia
IILRKQFNHCVYALEKV

SEQ ID NO: 3157850 - protein, 18 aa, Giardia lamblia
IILTRLRQLVPLVNLIGQ

SEQ ID NO: 3157851 - protein, 25 aa, Giardia lamblia
IINNFRINMFYDFKYNLYRPPYYNE

SEQ ID NO: 3157852 - protein, 27 aa, Giardia lamblia
IINTLLLSPKFYQHWLTSNHVSYLSDL

SEQ ID NO: 3157853 - protein, 26 aa, Giardia lamblia
IIPIYPGCTILRCSEIAKERAALLAF

SEQ ID NO: 3157854 - protein, 25 aa, Giardia lamblia
IIPLTRRYRIPGDKSSSFQTGNSIL

SEQ ID NO: 3157855 - protein, 17 aa, Giardia lamblia
IIPTIKSSPKFSMASKP

SEQ ID NO: 3157856 - protein, 24 aa, Giardia lamblia
IIPVRCFTCGKVIGSLYEKYLKLL

SEQ ID NO: 3157857 - protein, 22 aa, Giardia lamblia
IIQFPEIHAIALNKGLIPVCYR

SEQ ID NO: 3157858 - protein, 25 aa, Giardia lamblia
IIQKYWRRALAKSKVNAMKQADLVF

SEQ ID NO: 3157859 - protein, 18 aa, Giardia lamblia
IIRILLERESRMTTNKGV

SEQ ID NO: 3157860 - protein, 22 aa, Giardia lamblia
IIRIRSMCYYFSGGSPPKSRFY

SEQ ID NO: 3157861 - protein, 28 aa, Giardia lamblia
IIRVFGLRLPEEWKVIVAAYKRRFGHTL

SEQ ID NO: 3157862 - protein, 17 aa, Giardia lamblia
IISAFKDAFSGFLPILV

SEQ ID NO: 3157863 - protein, 20 aa, Giardia lamblia
IISASSFDWESQLRFYWDRI

SEQ ID NO: 3157864 - protein, 25 aa, Giardia lamblia
IISDVCNREQLLLVCRGVLSLAFVE

SEQ ID NO: 3157865 - protein, 27 aa, Giardia lamblia
IISGSRPFISYYIELGMDGRRLHISCR

SEQ ID NO: 3157866 - protein, 25 aa, Giardia lamblia
IISHLRTSFDYIYLPLLKAPSYTKN

SEQ ID NO: 3157867 - protein, 21 aa, Giardia lamblia
IISKKRFSFLYSDSYETEIEF

SEQ ID NO: 3157868 - protein, 23 aa, Giardia lamblia
IISNLPPGHLINECGINSTNNSI

SEQ ID NO: 3157869 - protein, 24 aa, Giardia lamblia
IISTLEARAGIIAAANPVSGQYVS

SEQ ID NO: 3157870 - protein, 18 aa, Giardia lamblia
IISVKSDQLEWVADAALK

SEQ ID NO: 3157871 - protein, 17 aa, Giardia lamblia
IITGNMIYEHPLVRKLD

SEQ ID NO: 3157872 - protein, 17 aa, Giardia lamblia
IITLSALVSELGGTPGL

SEQ ID NO: 3157873 - protein, 25 aa, Giardia lamblia
IITLTKQRLEEVVALQERISVKEKE

SEQ ID NO: 3157874 - protein, 22 aa, Giardia lamblia
IITPRTRLIIRIAGHTYHIAFT

SEQ ID NO: 3157875 - protein, 25 aa, Giardia lamblia
IIYAKGLRLLHPICLDTWNYGKEYI

SEQ ID NO: 3157876 - protein, 22 aa, Giardia lamblia
IIYELCALQPPYVATSLDSLKA

SEQ ID NO: 3157877 - protein, 21 aa, Giardia lamblia
IIYELCTFQAPFVATDVSSML

SEQ ID NO: 3157878 - protein, 26 aa, Giardia lamblia
IIYELCTFRPFCLALNPMDALQKLGK

SEQ ID NO: 3157879 - protein, 27 aa, Giardia lamblia
IIYMLPLQCLNCVSIDPSTIRQNRLKL

SEQ ID NO: 3157880 - protein, 17 aa, Giardia lamblia
IIYNSVFLPYAPITDYR

SEQ ID NO: 3157881 - protein, 21 aa, Giardia lamblia
IIYQLCTLRNFADVFKNDISY

SEQ ID NO: 3157882 - protein, 35 aa, Giardia lamblia
IKAANLPYPLRRFSLTYVQNRVVLIGGSQYSQKTS

SEQ ID NO: 3157883 - protein, 22 aa, Giardia lamblia
IKAEMREKLQLSLSTIEDQKRE

SEQ ID NO: 3157884 - protein, 24 aa, Giardia lamblia
IKAENLLLRKGRQSVVITDFGLSA

SEQ ID NO: 3157885 - protein, 19 aa, Giardia lamblia
IKAERTEIIRLLLPFEKAR

SEQ ID NO: 3157886 - protein, 22 aa, Giardia lamblia
IKAFVLRIYAVIYAFVMGKKPA

SEQ ID NO: 3157887 - protein, 17 aa, Giardia lamblia
IKAIPPLYPIEGKMRNE

SEQ ID NO: 3157888 - protein, 19 aa, Giardia lamblia
IKALENRLAQFSDRMNTTD

SEQ ID NO: 3157889 - protein, 21 aa, Giardia lamblia
IKALLDAAGRHKTFRTYQLLP

SEQ ID NO: 3157890 - protein, 24 aa, Giardia lamblia
IKANEPMYMVDFCPGKSMDPNKAR

SEQ ID NO: 3157891 - protein, 18 aa, Giardia lamblia
IKANVTFKPGREPINGTA

SEQ ID NO: 3157892 - protein, 24 aa, Giardia lamblia
IKAPSEQAMLIWSTGSSLTIIANS

SEQ ID NO: 3157893 - protein, 21 aa, Giardia lamblia
IKARALRMIAGCLLNAECRRT

SEQ ID NO: 3157894 - protein, 18 aa, Giardia lamblia
IKAREADCELLQVRAKLE

SEQ ID NO: 3157895 - protein, 19 aa, Giardia lamblia
IKARKAVEDRMLFDTEERR

SEQ ID NO: 3157896 - protein, 21 aa, Giardia lamblia
IKASGGYLHHVYVSKGDPTIQ

SEQ ID NO: 3157897 - protein, 19 aa, Giardia lamblia
IKCLPSLAEHVFVTEHRGI

SEQ ID NO: 3157898 - protein, 25 aa, Giardia lamblia
IKCQKESIADFFAKFDAFSKATKLN

SEQ ID NO: 3157899 - protein, 24 aa, Giardia lamblia
IKDIFYQLIKAVAYIHKRNILHRD

SEQ ID NO: 3157900 - protein, 20 aa, Giardia lamblia
IKDLIDCLRKAGVSLPTPSE

SEQ ID NO: 3157901 - protein, 26 aa, Giardia lamblia
IKDLPKNASCRLVLHAHGHKGYGFAE

SEQ ID NO: 3157902 - protein, 17 aa, Giardia lamblia
IKDLQLQLLNAEVETSK

SEQ ID NO: 3157903 - protein, 19 aa, Giardia lamblia
IKDPCAFKNILANLKGGHY

SEQ ID NO: 3157904 - protein, 23 aa, Giardia lamblia
IKDRPSNMFYPSRALSGAEYHAY

SEQ ID NO: 3157905 - protein, 17 aa, Giardia lamblia
IKEAMTIARNALSSQQS

SEQ ID NO: 3157906 - protein, 19 aa, Giardia lamblia
IKEEPWCRVYEALQNRKVA

SEQ ID NO: 3157907 - protein, 19 aa, Giardia lamblia
IKEKAKAIGKISSALMKKV

SEQ ID NO: 3157908 - protein, 24 aa, Giardia lamblia
IKEKLKDFQGALKIEQEARLAVED

SEQ ID NO: 3157909 - protein, 23 aa, Giardia lamblia
IKELVYGPGLQFLIIDSLPPDVV

SEQ ID NO: 3157910 - protein, 24 aa, Giardia lamblia
IKFLNCYFSSVLILFTHVNTSTRV

SEQ ID NO: 3157911 - protein, 42 aa, Giardia lamblia
IKFLNQWCYGAPFTPFEACLACTGILHPLPFTRSIDNSSPEC

SEQ ID NO: 3157912 - protein, 21 aa, Giardia lamblia
IKGKCSCWVLQAIFSCGYVHD

SEQ ID NO: 3157913 - protein, 21 aa, Giardia lamblia
IKGPLALLFLALRANAAIITS

SEQ ID NO: 3157914 - protein, 17 aa, Giardia lamblia
IKGSLCTPAPSTATTSL

SEQ ID NO: 3157915 - protein, 18 aa, Giardia lamblia
IKHGSVIDSVCYEPIVVL

SEQ ID NO: 3157916 - protein, 24 aa, Giardia lamblia
IKHSLKLRSLRQGYTPTVKSSANF

SEQ ID NO: 3157917 - protein, 23 aa, Giardia lamblia
IKHYRFLTESDFSEISYYPAALS

SEQ ID NO: 3157918 - protein, 20 aa, Giardia lamblia
IKIAKDHGFQNIADYIASFD

SEQ ID NO: 3157919 - protein, 23 aa, Giardia lamblia
IKIDGRHIFMYPGKLEHAELKQP

SEQ ID NO: 3157920 - protein, 22 aa, Giardia lamblia
IKILCPEIIITSAIGPASPPTS

SEQ ID NO: 3157921 - protein, 18 aa, Giardia lamblia
IKILTNLLAGPNCINLLD

SEQ ID NO: 3157922 - protein, 21 aa, Giardia lamblia
IKIMRKSEMLYPWDPKPGEPV

SEQ ID NO: 3157923 - protein, 17 aa, Giardia lamblia
IKIPELTDRMFSALESA

SEQ ID NO: 3157924 - protein, 23 aa, Giardia lamblia
IKIWDITTTLGMLADEKGSILNV

SEQ ID NO: 3157925 - protein, 20 aa, Giardia lamblia
IKKALRISVHLEGVVEVSKA

SEQ ID NO: 3157926 - protein, 24 aa, Giardia lamblia
IKKCPDCKGNGVVVITQQMGPMIT

SEQ ID NO: 3157927 - protein, 31 aa, Giardia lamblia
IKKIRRPWEKRMRGHVGSYRYAEKDPHARPG

SEQ ID NO: 3157928 - protein, 19 aa, Giardia lamblia
IKKLIPYEGKILVGNGHKP

SEQ ID NO: 3157929 - protein, 19 aa, Giardia lamblia
IKKLLKKYQRSLTHEQAPI

SEQ ID NO: 3157930 - protein, 27 aa, Giardia lamblia
IKKLSQAGIPCFYGLLTSLPLFIKHAT

SEQ ID NO: 3157931 - protein, 17 aa, Giardia lamblia
IKKMYPYICEANALADF

SEQ ID NO: 3157932 - protein, 17 aa, Giardia lamblia
IKKPTLRLNIKAYTQLK

SEQ ID NO: 3157933 - protein, 17 aa, Giardia lamblia
IKLGMTIFDTTFNRCKV

SEQ ID NO: 3157934 - protein, 20 aa, Giardia lamblia
IKLGQALPTHNMIILSHDQL

SEQ ID NO: 3157935 - protein, 26 aa, Giardia lamblia
IKLGSWMALYHPRFPLDVDNAQERTA

SEQ ID NO: 3157936 - protein, 27 aa, Giardia lamblia
IKLKEWELEKQLGFGGTFGIWHMYSGR

SEQ ID NO: 3157937 - protein, 22 aa, Giardia lamblia
IKLKKVVYLFVLNYHKMNPDTP

SEQ ID NO: 3157938 - protein, 19 aa, Giardia lamblia
IKLLDCNDVYFDMIKFTHR

SEQ ID NO: 3157939 - protein, 17 aa, Giardia lamblia
IKLLLPHESGMHDRYGA

SEQ ID NO: 3157940 - protein, 17 aa, Giardia lamblia
IKLPCGHTITLNQELFG

SEQ ID NO: 3157941 - protein, 18 aa, Giardia lamblia
IKLPYLVMLIKNMRKYFS

SEQ ID NO: 3157942 - protein, 22 aa, Giardia lamblia
IKMNLFCDALSILLSIPEEEPF

SEQ ID NO: 3157943 - protein, 21 aa, Giardia lamblia
IKMTNEIICYLDGSDSEEGPQ

SEQ ID NO: 3157944 - protein, 22 aa, Giardia lamblia
IKNNLPGIFGLAQLQSGGSKQP

SEQ ID NO: 3157945 - protein, 22 aa, Giardia lamblia
IKNNRLGVFCFLKEAGSTENEE

SEQ ID NO: 3157946 - protein, 26 aa, Giardia lamblia
IKNRLFEIVPGMQLEPGVSVHSPSDL

SEQ ID NO: 3157947 - protein, 20 aa, Giardia lamblia
IKNSCNVYLAFNNRILPDHI

SEQ ID NO: 3157948 - protein, 21 aa, Giardia lamblia
IKPDNFLIGLGRRKTTVYIID

SEQ ID NO: 3157949 - protein, 17 aa, Giardia lamblia
IKPEIMQLFCGYAPDYL

SEQ ID NO: 3157950 - protein, 24 aa, Giardia lamblia
IKPILCDRKRSGLLEAPTGTGKTI

SEQ ID NO: 3157951 - protein, 18 aa, Giardia lamblia
IKPMKFSVSPVVRVAVEP

SEQ ID NO: 3157952 - protein, 17 aa, Giardia lamblia
IKPPKSILLYGAPGTGK

SEQ ID NO: 3157953 - protein, 23 aa, Giardia lamblia
IKPRGRQAMNLYYMPTHPGAYIA

SEQ ID NO: 3157954 - protein, 24 aa, Giardia lamblia
IKPVKFMREQHVFMDFTSIGPGPN

SEQ ID NO: 3157955 - protein, 17 aa, Giardia lamblia
IKPVVDWNLFSASESAR

SEQ ID NO: 3157956 - protein, 25 aa, Giardia lamblia
IKQAEQWSCYGIDLAVDEVISQLID

SEQ ID NO: 3157957 - protein, 18 aa, Giardia lamblia
IKQATAMVHLAGCKNFNG

SEQ ID NO: 3157958 - protein, 21 aa, Giardia lamblia
IKQELDRLTARRTRLTRSLKE

SEQ ID NO: 3157959 - protein, 20 aa, Giardia lamblia
IKQGSVCWHGVDINNDMKTI

SEQ ID NO: 3157960 - protein, 24 aa, Giardia lamblia
IKQHPKLTLPQAISLYSDSRSCTL

SEQ ID NO: 3157961 - protein, 21 aa, Giardia lamblia
IKQKRLAGRSVLLAGPSSTGK

SEQ ID NO: 3157962 - protein, 20 aa, Giardia lamblia
IKQQFEYFAETAIKSVDKRI

SEQ ID NO: 3157963 - protein, 22 aa, Giardia lamblia
IKQRQCYHVTPITGLDFKLLRQ

SEQ ID NO: 3157964 - protein, 17 aa, Giardia lamblia
IKQYFKRNMAQLGGSEW

SEQ ID NO: 3157965 - protein, 19 aa, Giardia lamblia
IKRAVKLLRTKNRELTRAY

SEQ ID NO: 3157966 - protein, 20 aa, Giardia lamblia
IKRFCRIEKIPGATVEDCCV

SEQ ID NO: 3157967 - protein, 22 aa, Giardia lamblia
IKRFTHEILPAKQLLFYKNSPH

SEQ ID NO: 3157968 - protein, 19 aa, Giardia lamblia
IKRILKYMLGPYCTPRLGM

SEQ ID NO: 3157969 - protein, 23 aa, Giardia lamblia
IKRLEKEKMQFLSKMNEYKKENE

SEQ ID NO: 3157970 - protein, 25 aa, Giardia lamblia
IKRREIPYVKAMRIMSRVVSRFDDD

SEQ ID NO: 3157971 - protein, 23 aa, Giardia lamblia
IKRRSQLKAGHIGDVRIAKSLFP

SEQ ID NO: 3157972 - protein, 34 aa, Giardia lamblia
IKRSFLQFQQLFRLPRCIDKILALENANAVDKTQ

SEQ ID NO: 3157973 - protein, 17 aa, Giardia lamblia
IKRYCLLSMLQTRKYKA

SEQ ID NO: 3157974 - protein, 19 aa, Giardia lamblia
IKSDALFFLESQEIARAIV

SEQ ID NO: 3157975 - protein, 21 aa, Giardia lamblia
IKSFGCDSMLYKVEGPTRSSR

SEQ ID NO: 3157976 - protein, 18 aa, Giardia lamblia
IKSLCMFEIYGFDVMLDS

SEQ ID NO: 3157977 - protein, 17 aa, Giardia lamblia
IKSPARHSAPTHQEPLP

SEQ ID NO: 3157978 - protein, 17 aa, Giardia lamblia
IKSSPKFSMASKPKPRS

SEQ ID NO: 3157979 - protein, 24 aa, Giardia lamblia
IKTCDIVGLAFDFCVRYSAIDARR

SEQ ID NO: 3157980 - protein, 17 aa, Giardia lamblia
IKTEIQKAVNLINKGIQ

SEQ ID NO: 3157981 - protein, 29 aa, Giardia lamblia
IKTHLCDIGRSTVLLKWKKKQYIDKGPNA

SEQ ID NO: 3157982 - protein, 38 aa, Giardia lamblia
IKTLNSILCVGEFKVSPKEIKWLLKHVQKNMAQDLQRQ

SEQ ID NO: 3157983 - protein, 17 aa, Giardia lamblia
IKTMICGIIGGEAGVRG

SEQ ID NO: 3157984 - protein, 22 aa, Giardia lamblia
IKTNALRFILHQPLPHQNNNYN

SEQ ID NO: 3157985 - protein, 21 aa, Giardia lamblia
IKTNTCLDCGGGIGRVSHYAL

SEQ ID NO: 3157986 - protein, 19 aa, Giardia lamblia
IKTPQMIEDFAPRGKYDRF

SEQ ID NO: 3157987 - protein, 26 aa, Giardia lamblia
IKTQGRELKGFMAMFDGRGSKDAAVE

SEQ ID NO: 3157988 - protein, 23 aa, Giardia lamblia
IKTTMRATLEWALHQIPEDQAEV

SEQ ID NO: 3157989 - protein, 17 aa, Giardia lamblia
IKVLVAFEHGIYDNGGQ

SEQ ID NO: 3157990 - protein, 21 aa, Giardia lamblia
IKVPEFRYFPLHSSLASQIKT

SEQ ID NO: 3157991 - protein, 22 aa, Giardia lamblia
IKVPEFRYFPLHSSLASQIKTF

SEQ ID NO: 3157992 - protein, 25 aa, Giardia lamblia
IKVSDAFCTLLDFVILSDNQELRDS

SEQ ID NO: 3157993 - protein, 25 aa, Giardia lamblia
IKVYKELRYRITLVAQGHVFRRPNF

SEQ ID NO: 3157994 - protein, 26 aa, Giardia lamblia
IKVYKELRYRITLVAQGHVFRRPNFE

SEQ ID NO: 3157995 - protein, 19 aa, Giardia lamblia
IKYLAPLLKEYKSIVQAID

SEQ ID NO: 3157996 - protein, 24 aa, Giardia lamblia
IKYLMRMHDSGVRFQLAMFPPADV

SEQ ID NO: 3157997 - protein, 17 aa, Giardia lamblia
IKYPKSIYLLRGNHEDE

SEQ ID NO: 3157998 - protein, 18 aa, Giardia lamblia
IKYRKVQQASIISLYSAP

SEQ ID NO: 3157999 - protein, 17 aa, Giardia lamblia
IKYSFFIGTTEVRGSLK

SEQ ID NO: 3158000 - protein, 21 aa, Giardia lamblia
IKYSGPESVRLDALEAQQAAL

SEQ ID NO: 3158001 - protein, 23 aa, Giardia lamblia
IKYSRKPQIIFCLDIHSHASIPD

SEQ ID NO: 3158002 - protein, 22 aa, Giardia lamblia
IKYTCGKGERGFHRNVLGNDSR

SEQ ID NO: 3158003 - protein, 18 aa, Giardia lamblia
ILAAELGNAYALTVLSAH

SEQ ID NO: 3158004 - protein, 31 aa, Giardia lamblia
ILAARKGHPDCIKLFLEKEGGMADYYGWTAL

SEQ ID NO: 3158005 - protein, 17 aa, Giardia lamblia
ILADPALCDAGFLAKFV

SEQ ID NO: 3158006 - protein, 19 aa, Giardia lamblia
ILADVCLELDTLMLVFEIY

SEQ ID NO: 3158007 - protein, 18 aa, Giardia lamblia
ILAEELAMSYVMDCHSMA

SEQ ID NO: 3158008 - protein, 24 aa, Giardia lamblia
ILAGFSTVLNACFLQLKIAKKYDL

SEQ ID NO: 3158009 - protein, 19 aa, Giardia lamblia
ILAHLRKTITPRLLDATEI

SEQ ID NO: 3158010 - protein, 18 aa, Giardia lamblia
ILAPYECPDVTNVDITNT

SEQ ID NO: 3158011 - protein, 17 aa, Giardia lamblia
ILAQIAAGLAYLHSQIK

SEQ ID NO: 3158012 - protein, 19 aa, Giardia lamblia
ILASIEWLGHKPFKFTHTS

SEQ ID NO: 3158013 - protein, 20 aa, Giardia lamblia
ILAVWYWKMHQAGMQDTEGR

SEQ ID NO: 3158014 - protein, 18 aa, Giardia lamblia
ILAWAMNVTARLLPGTVV

SEQ ID NO: 3158015 - protein, 21 aa, Giardia lamblia
ILCCSCGVPIEPNPTSMCLPC

SEQ ID NO: 3158016 - protein, 26 aa, Giardia lamblia
ILCHPLINRWVYRERYLDYNIHNDIP

SEQ ID NO: 3158017 - protein, 24 aa, Giardia lamblia
ILCIGFRPVTEMILESAERHGVKL

SEQ ID NO: 3158018 - protein, 17 aa, Giardia lamblia
ILCKPPNLAGGYSPLGK

SEQ ID NO: 3158019 - protein, 25 aa, Giardia lamblia
ILDKKWREERDFKDKQRLARLKPSV

SEQ ID NO: 3158020 - protein, 27 aa, Giardia lamblia
ILDKLRASLRVLLAFKEDFECELKAAI

SEQ ID NO: 3158021 - protein, 24 aa, Giardia lamblia
ILDLLRREGKALTELEHSKYKNRY

SEQ ID NO: 3158022 - protein, 17 aa, Giardia lamblia
ILDMSVCNSDLRVQLAQ

SEQ ID NO: 3158023 - protein, 25 aa, Giardia lamblia
ILDQRGRSAIYYATDGSVYKDVNLS

SEQ ID NO: 3158024 - protein, 23 aa, Giardia lamblia
ILDRYRYGIIRCENLRRYSETQL

SEQ ID NO: 3158025 - protein, 24 aa, Giardia lamblia
ILDSGGWCALAYAIYAEFTDCIKI

SEQ ID NO: 3158026 - protein, 20 aa, Giardia lamblia
ILDTCRRFGTTLTVAHLKPI

SEQ ID NO: 3158027 - protein, 17 aa, Giardia lamblia
ILEAFKSSNYNLSTMID

SEQ ID NO: 3158028 - protein, 24 aa, Giardia lamblia
ILEDCKQLHLLVAPLLDATSTRDS

SEQ ID NO: 3158029 - protein, 24 aa, Giardia lamblia
ILEDLEMYFSTGLVHRIVDTDEKI

SEQ ID NO: 3158030 - protein, 18 aa, Giardia lamblia
ILEDRGLVRFIYTQNIDE

SEQ ID NO: 3158031 - protein, 26 aa, Giardia lamblia
ILELIPRARYLTIDSEFFCGQEMAMP

SEQ ID NO: 3158032 - protein, 26 aa, Giardia lamblia
ILELITEFFRFMGLHSTAGTLEVEAG

SEQ ID NO: 3158033 - protein, 33 aa, Giardia lamblia
ILELPIKHPEVFKRLGIPMPKGVLLYGAPGCGK

SEQ ID NO: 3158034 - protein, 21 aa, Giardia lamblia
ILELRGRMTSSPRPGECGSPV

SEQ ID NO: 3158035 - protein, 27 aa, Giardia lamblia
ILEQVMRRFVAMPGVLSGLYEECIEGI

SEQ ID NO: 3158036 - protein, 24 aa, Giardia lamblia
ILERDCLRESLGLQHDRDPDRTRI

SEQ ID NO: 3158037 - protein, 17 aa, Giardia lamblia
ILERGRDQLKYALDKNT

SEQ ID NO: 3158038 - protein, 21 aa, Giardia lamblia
ILESLDFLHRLNILHLDLKHE

SEQ ID NO: 3158039 - protein, 30 aa, Giardia lamblia
ILESLPGKQIFKALLNFGVPSRHKDQLGCD

SEQ ID NO: 3158040 - protein, 19 aa, Giardia lamblia
ILETIFLVMCDRHAETDEG

SEQ ID NO: 3158041 - protein, 18 aa, Giardia lamblia
ILETMRELGFKWRIGGLN

SEQ ID NO: 3158042 - protein, 23 aa, Giardia lamblia
ILETRCPSLFKDVYVDLSTYYNV

SEQ ID NO: 3158043 - protein, 24 aa, Giardia lamblia
ILFSPKRVMPLVEFLKANIGYMRA

SEQ ID NO: 3158044 - protein, 26 aa, Giardia lamblia
ILFVHKRLAAVELFTLCYKDKVLRLR

SEQ ID NO: 3158045 - protein, 20 aa, Giardia lamblia
ILGDKGVIPGLLSRDTTVTM

SEQ ID NO: 3158046 - protein, 23 aa, Giardia lamblia
ILGLEGLHSIGYCHRDIKPSNIL

SEQ ID NO: 3158047 - protein, 18 aa, Giardia lamblia
ILGRSEVVELLLPHEGGM

SEQ ID NO: 3158048 - protein, 18 aa, Giardia lamblia
ILGSTVLDSVSLHGLIKD

SEQ ID NO: 3158049 - protein, 26 aa, Giardia lamblia
ILGTFRCASCGEVIPNVAQDYKFTEP

SEQ ID NO: 3158050 - protein, 17 aa, Giardia lamblia
ILHDPVRAMQLLADVAY

SEQ ID NO: 3158051 - protein, 17 aa, Giardia lamblia
ILHIIDRELSVYLKQLL

SEQ ID NO: 3158052 - protein, 18 aa, Giardia lamblia
ILHRDIKAGNIFLTSAPD

SEQ ID NO: 3158053 - protein, 17 aa, Giardia lamblia
ILHRDIKLSNILIAHDG

SEQ ID NO: 3158054 - protein, 17 aa, Giardia lamblia
ILIYDIRTSGIVFDSSA

SEQ ID NO: 3158055 - protein, 23 aa, Giardia lamblia
ILKESRLSMRDCGSTALMLATRN

SEQ ID NO: 3158056 - protein, 29 aa, Giardia lamblia
ILKEYGLEMCVNFPPELNALIDEVSALDR

SEQ ID NO: 3158057 - protein, 19 aa, Giardia lamblia
ILKFHVIIPTIKSSPKFSM

SEQ ID NO: 3158058 - protein, 23 aa, Giardia lamblia
ILKHEIDRLQSLAHKDLKLHDET

SEQ ID NO: 3158059 - protein, 21 aa, Giardia lamblia
ILKNRSNLFNISRWCDNFVLT

SEQ ID NO: 3158060 - protein, 26 aa, Giardia lamblia
ILKPHSSLRVGFRFVSNSILTTKLRV

SEQ ID NO: 3158061 - protein, 18 aa, Giardia lamblia
ILKRNRRSVTMSVPSKLR

SEQ ID NO: 3158062 - protein, 21 aa, Giardia lamblia
ILKSRFSFTNMTPVQECAIPL

SEQ ID NO: 3158063 - protein, 17 aa, Giardia lamblia
ILKTIPAKVERWESQVK

SEQ ID NO: 3158064 - protein, 21 aa, Giardia lamblia
ILKYRKDFIKWYFDQPEMHPN

SEQ ID NO: 3158065 - protein, 20 aa, Giardia lamblia
ILLCECIISYSVLEEDVLDS

SEQ ID NO: 3158066 - protein, 17 aa, Giardia lamblia
ILLDQVWAIVSEVTRNP

SEQ ID NO: 3158067 - protein, 26 aa, Giardia lamblia
ILLEDCDFTFHFGRRYSLIGRNGTGK

SEQ ID NO: 3158068 - protein, 28 aa, Giardia lamblia
ILLEKTARIPICYRIVGMSATLSNISDL

SEQ ID NO: 3158069 - protein, 19 aa, Giardia lamblia
ILLEQCADGDRERVSLQEK

SEQ ID NO: 3158070 - protein, 20 aa, Giardia lamblia
ILLGCTRYTKGVDMWAIGCI

SEQ ID NO: 3158071 - protein, 19 aa, Giardia lamblia
ILLGKWPGQLTIASNQIRW

SEQ ID NO: 3158072 - protein, 17 aa, Giardia lamblia
ILLGRPADTTGYTREDF

SEQ ID NO: 3158073 - protein, 19 aa, Giardia lamblia
ILLHPWLQQEMIKPALAKG

SEQ ID NO: 3158074 - protein, 24 aa, Giardia lamblia
ILLLFKRYFSMGTLPNVLSDSRAF

SEQ ID NO: 3158075 - protein, 25 aa, Giardia lamblia
ILLPLSPVAMHAWSELTRIGTDIKS

SEQ ID NO: 3158076 - protein, 26 aa, Giardia lamblia
ILLRHGRLAPRISRPSPSRSSPRPAL

SEQ ID NO: 3158077 - protein, 17 aa, Giardia lamblia
ILMALKLHNSDVLADPW

SEQ ID NO: 3158078 - protein, 17 aa, Giardia lamblia
ILMGIHFISSSPMDISA

SEQ ID NO: 3158079 - protein, 27 aa, Giardia lamblia
ILMGSCRGSVCCTRFNSGVSDFYEKMR

SEQ ID NO: 3158080 - protein, 24 aa, Giardia lamblia
ILNEIDRRDIIAISELQTRNHING

SEQ ID NO: 3158081 - protein, 19 aa, Giardia lamblia
ILNGLLDDVFSCGSSETVA

SEQ ID NO: 3158082 - protein, 22 aa, Giardia lamblia
ILNHPLRCVVPASNPVVSNDII

SEQ ID NO: 3158083 - protein, 17 aa, Giardia lamblia
ILNKCRCIEFLAELEAN

SEQ ID NO: 3158084 - protein, 34 aa, Giardia lamblia
ILNKIPCCSSFSMLDMVRFYLAALRLLRDSDPGK

SEQ ID NO: 3158085 - protein, 25 aa, Giardia lamblia
ILNLKPRPMAGGAIVSNAMLFCGSC

SEQ ID NO: 3158086 - protein, 18 aa, Giardia lamblia
ILNLLPFEYMPDIQISGH

SEQ ID NO: 3158087 - protein, 22 aa, Giardia lamblia
ILNRYKLLKMVGSATFSNVFSC

SEQ ID NO: 3158088 - protein, 21 aa, Giardia lamblia
ILNSIMSSVAFWKKPLPTDKN

SEQ ID NO: 3158089 - protein, 19 aa, Giardia lamblia
ILNTGRVSASYAIVISSQD

SEQ ID NO: 3158090 - protein, 27 aa, Giardia lamblia
ILPCGMSISCGFLFSSRIPEQGIKQGR

SEQ ID NO: 3158091 - protein, 17 aa, Giardia lamblia
ILPDHIVIFRDGVSDSQ

SEQ ID NO: 3158092 - protein, 17 aa, Giardia lamblia
ILPEDRSPEEQPRRKPP

SEQ ID NO: 3158093 - protein, 23 aa, Giardia lamblia
ILPFNCGSLGFLTPFSPKDIDKK

SEQ ID NO: 3158094 - protein, 18 aa, Giardia lamblia
ILPHDGFQPMADAPYEIP

SEQ ID NO: 3158095 - protein, 21 aa, Giardia lamblia
ILPHNYRYAVSVKETKQTSCM

SEQ ID NO: 3158096 - protein, 24 aa, Giardia lamblia
ILPIKRPSIYINRSDIERILAPAL

SEQ ID NO: 3158097 - protein, 17 aa, Giardia lamblia
ILPLSGLSPKDLGDIRN

SEQ ID NO: 3158098 - protein, 26 aa, Giardia lamblia
ILPQQRLRNIFITWKAHVSELNAHKS

SEQ ID NO: 3158099 - protein, 20 aa, Giardia lamblia
ILPSSSWEKHSFAVAKVKEV

SEQ ID NO: 3158100 - protein, 17 aa, Giardia lamblia
ILQAAGWINAPEVESND

SEQ ID NO: 3158101 - protein, 20 aa, Giardia lamblia
ILQAFRRRAEVQTKEEAKYE

SEQ ID NO: 3158102 - protein, 17 aa, Giardia lamblia
ILQCVRLGLVSPQHELD

SEQ ID NO: 3158103 - protein, 18 aa, Giardia lamblia
ILQDFAHRERILIDSYVS

SEQ ID NO: 3158104 - protein, 22 aa, Giardia lamblia
ILQELMPLYFPRDYEAEEDDIL

SEQ ID NO: 3158105 - protein, 19 aa, Giardia lamblia
ILQLCLKIDLKAGNVSQLE

SEQ ID NO: 3158106 - protein, 26 aa, Giardia lamblia
ILQLKHILLHPSLRYTLASVPNLTLT

SEQ ID NO: 3158107 - protein, 23 aa, Giardia lamblia
ILQRLCTSIWSRTRVLQGEELLT

SEQ ID NO: 3158108 - protein, 24 aa, Giardia lamblia
ILRAHKIRVKEFLKDADDEARHER

SEQ ID NO: 3158109 - protein, 18 aa, Giardia lamblia
ILRDMKSAIGYQSNEVGR

SEQ ID NO: 3158110 - protein, 25 aa, Giardia lamblia
ILRIIMPQDRMQTFAAYSALSSMDT

SEQ ID NO: 3158111 - protein, 18 aa, Giardia lamblia
ILRITRPVAQEVASMVYS

SEQ ID NO: 3158112 - protein, 18 aa, Giardia lamblia
ILRKHLAYHVHICILAAK

SEQ ID NO: 3158113 - protein, 17 aa, Giardia lamblia
ILRKQLETLQENYQAAI

SEQ ID NO: 3158114 - protein, 20 aa, Giardia lamblia
ILRLRSLREEQLSLALPASD

SEQ ID NO: 3158115 - protein, 23 aa, Giardia lamblia
ILRNAEFHLLESYPFDFFSTKPS

SEQ ID NO: 3158116 - protein, 30 aa, Giardia lamblia
ILRRLQSTCKFEYPKILGILKQKDHDKWIT

SEQ ID NO: 3158117 - protein, 18 aa, Giardia lamblia
ILRRVSTKDLGLLFMHIR

SEQ ID NO: 3158118 - protein, 23 aa, Giardia lamblia
ILRSAEKFYNLGIKRELQDPHFL

SEQ ID NO: 3158119 - protein, 17 aa, Giardia lamblia
ILRVGSWRPRRPGTEVK

SEQ ID NO: 3158120 - protein, 17 aa, Giardia lamblia
ILRYKAVHQEGDFVYIR

SEQ ID NO: 3158121 - protein, 28 aa, Giardia lamblia
ILSCKSIFFHGARLCFALELCNTSLKSI

SEQ ID NO: 3158122 - protein, 30 aa, Giardia lamblia
ILSDIDFDFSFKLCQYIFCMPDTDEATTLK

SEQ ID NO: 3158123 - protein, 24 aa, Giardia lamblia
ILSEFARDIYLCLSDNNMRVRHMA

SEQ ID NO: 3158124 - protein, 23 aa, Giardia lamblia
ILSEKKFKLLSFFRDYLENRSIV

SEQ ID NO: 3158125 - protein, 23 aa, Giardia lamblia
ILSEKRFDLTVAKRVTRNQTPIP

SEQ ID NO: 3158126 - protein, 26 aa, Giardia lamblia
ILSGNAVWLMRLLKASCESDGRRDKP

SEQ ID NO: 3158127 - protein, 18 aa, Giardia lamblia
ILSHLAEALLYYHSPQKD

SEQ ID NO: 3158128 - protein, 25 aa, Giardia lamblia
ILSIGELQSFFSILRIHKAGIQCVF

SEQ ID NO: 3158129 - protein, 26 aa, Giardia lamblia
ILSLFPELGIYGEHRYTALMAASENG

SEQ ID NO: 3158130 - protein, 24 aa, Giardia lamblia
ILSLLPYICTYGVFECCTSAESTK

SEQ ID NO: 3158131 - protein, 17 aa, Giardia lamblia
ILSQISMGLAYLHTPAG

SEQ ID NO: 3158132 - protein, 26 aa, Giardia lamblia
ILSQVLHLTLDVIFPSGPCSTSSSTV

SEQ ID NO: 3158133 - protein, 19 aa, Giardia lamblia
ILSSSRVSDPLAYLHVPLT

SEQ ID NO: 3158134 - protein, 17 aa, Giardia lamblia
ILSSVMCGDILWRNENY

SEQ ID NO: 3158135 - protein, 19 aa, Giardia lamblia
ILTDLVDWYGNTRLMQAVA

SEQ ID NO: 3158136 - protein, 24 aa, Giardia lamblia
ILTFMRISYLFYRFYDILHDPQIW

SEQ ID NO: 3158137 - protein, 32 aa, Giardia lamblia
ILTLDVGSWVRLQYALRLMRDRLAEGVGPTPA

SEQ ID NO: 3158138 - protein, 25 aa, Giardia lamblia
ILTYASEVLPHIVDIQRMLRALQKE

SEQ ID NO: 3158139 - protein, 17 aa, Giardia lamblia
ILVELEAGCSAFMRLEW

SEQ ID NO: 3158140 - protein, 25 aa, Giardia lamblia
ILVHVTDLYLAQGLQALAPNQILNK

SEQ ID NO: 3158141 - protein, 21 aa, Giardia lamblia
ILVKRVRSLLDRSIREAQHCC

SEQ ID NO: 3158142 - protein, 19 aa, Giardia lamblia
ILVQACINTYASWVVRTLF

SEQ ID NO: 3158143 - protein, 26 aa, Giardia lamblia
ILVTAEWGWTATMSKIMKHQALRDDT

SEQ ID NO: 3158144 - protein, 24 aa, Giardia lamblia
ILVVGKAYAGKTCCIKRLVHNTFT

SEQ ID NO: 3158145 - protein, 21 aa, Giardia lamblia
ILYALCLLDKLARLGYKLTGS

SEQ ID NO: 3158146 - protein, 17 aa, Giardia lamblia
ILYCKQQALRRLRDEQT

SEQ ID NO: 3158147 - protein, 19 aa, Giardia lamblia
ILYFMFRTPTSIKQLILGD

SEQ ID NO: 3158148 - protein, 17 aa, Giardia lamblia
ILYHVLVSTVNFKKGMA

SEQ ID NO: 3158149 - protein, 17 aa, Giardia lamblia
ILYREDDETLTLRKSLR

SEQ ID NO: 3158150 - protein, 17 aa, Giardia lamblia
IMAAVLVAFGKAVLGAH

SEQ ID NO: 3158151 - protein, 18 aa, Giardia lamblia
IMAMKGAATYYLPISHAS

SEQ ID NO: 3158152 - protein, 17 aa, Giardia lamblia
IMASSVSDWIIRLYYSF

SEQ ID NO: 3158153 - protein, 21 aa, Giardia lamblia
IMCLLCNKPKYTFPHVDVYEL

SEQ ID NO: 3158154 - protein, 18 aa, Giardia lamblia
IMCTTNGLSGRLFCDFLA

SEQ ID NO: 3158155 - protein, 19 aa, Giardia lamblia
IMECERLRKEVQHQRLARL

SEQ ID NO: 3158156 - protein, 25 aa, Giardia lamblia
IMECPSPYFKPLVYTLAFFHATIQE

SEQ ID NO: 3158157 - protein, 22 aa, Giardia lamblia
IMEDGPRPYLGLTEQTEDLYLE

SEQ ID NO: 3158158 - protein, 19 aa, Giardia lamblia
IMEHGAITRGYRLVFHTGQ

SEQ ID NO: 3158159 - protein, 19 aa, Giardia lamblia
IMELATLFSKTSCISLGGS

SEQ ID NO: 3158160 - protein, 18 aa, Giardia lamblia
IMEPIAFALQELHPRIEI

SEQ ID NO: 3158161 - protein, 19 aa, Giardia lamblia
IMFNTALDYELCVLNTHAY

SEQ ID NO: 3158162 - protein, 24 aa, Giardia lamblia
IMGENRTSVAYIWHATNQTLIGVL

SEQ ID NO: 3158163 - protein, 20 aa, Giardia lamblia
IMHCSSILLDETFVLPQTEA

SEQ ID NO: 3158164 - protein, 17 aa, Giardia lamblia
IMIASKVWDDISCSSRS

SEQ ID NO: 3158165 - protein, 26 aa, Giardia lamblia
IMKHAFFSGVNWSWFEKKVVKAPIVP

SEQ ID NO: 3158166 - protein, 21 aa, Giardia lamblia
IMKYCPHEQVVKWILESLPGK

SEQ ID NO: 3158167 - protein, 25 aa, Giardia lamblia
IMLGDFDAAMSFVKRYAGRKSGDGS

SEQ ID NO: 3158168 - protein, 18 aa, Giardia lamblia
IMLLTAYLRLYGETKVLP

SEQ ID NO: 3158169 - protein, 18 aa, Giardia lamblia
IMMGRYRIAELLRDSEGV

SEQ ID NO: 3158170 - protein, 18 aa, Giardia lamblia
IMMMSATLFASYECTDTS

SEQ ID NO: 3158171 - protein, 34 aa, Giardia lamblia
IMMPCKASGGMTLRLPILLVLRSILLPCNFNAVL

SEQ ID NO: 3158172 - protein, 22 aa, Giardia lamblia
IMNLCCLDMLHLHDIETSLFRY

SEQ ID NO: 3158173 - protein, 17 aa, Giardia lamblia
IMPSLQVVFKIAERNIC

SEQ ID NO: 3158174 - protein, 19 aa, Giardia lamblia
IMRGQYLRFEHAGIKYDIK

SEQ ID NO: 3158175 - protein, 17 aa, Giardia lamblia
IMRSTLVNAERVIKGLI

SEQ ID NO: 3158176 - protein, 27 aa, Giardia lamblia
IMSFEEFLRQRARNAAIEELQQRDTQA

SEQ ID NO: 3158177 - protein, 17 aa, Giardia lamblia
IMTKRSVLGRLRQTKEG

SEQ ID NO: 3158178 - protein, 19 aa, Giardia lamblia
IMTLLRPIIRNETDAILCP

SEQ ID NO: 3158179 - protein, 18 aa, Giardia lamblia
IMTSCGPPYLSSQVGEQQ

SEQ ID NO: 3158180 - protein, 21 aa, Giardia lamblia
IMVFPATGMPIGINIPNYDDV

SEQ ID NO: 3158181 - protein, 21 aa, Giardia lamblia
IMVGLDECQLLFGGDLGSACV

SEQ ID NO: 3158182 - protein, 19 aa, Giardia lamblia
IMVNRALVHPNIMRYQYIL

SEQ ID NO: 3158183 - protein, 23 aa, Giardia lamblia
IMYDELPNLFPSRSEGEIVDLYR

SEQ ID NO: 3158184 - protein, 31 aa, Giardia lamblia
IMYRRILAERVRFSLILKEDYYHMLATAYPV

SEQ ID NO: 3158185 - protein, 24 aa, Giardia lamblia
INACIEPLRLSYPIAKESQVGFRQ

SEQ ID NO: 3158186 - protein, 18 aa, Giardia lamblia
INAFCWALNMMRPDCAWK

SEQ ID NO: 3158187 - protein, 19 aa, Giardia lamblia
INAFVFFNELCDWTAYGRF

SEQ ID NO: 3158188 - protein, 25 aa, Giardia lamblia
INARLRVARVFAAREKYILAASEWS

SEQ ID NO: 3158189 - protein, 19 aa, Giardia lamblia
INCDETGDLFDLYDQKHPR

SEQ ID NO: 3158190 - protein, 29 aa, Giardia lamblia
INDIRWKLKCLCALYCIRNNNAEQALNLC

SEQ ID NO: 3158191 - protein, 24 aa, Giardia lamblia
INDPEFTLRFAFISDTGTVVYTKE

SEQ ID NO: 3158192 - protein, 17 aa, Giardia lamblia
INDPSFYLTNPMIANAV

SEQ ID NO: 3158193 - protein, 24 aa, Giardia lamblia
INDRSRCSYSLVSEAATLRPLSDE

SEQ ID NO: 3158194 - protein, 26 aa, Giardia lamblia
INDSYFPVTVAFIFDSMLHGLAELTH

SEQ ID NO: 3158195 - protein, 24 aa, Giardia lamblia
INEFVKCLVYRAGKAQTRQTLSLR

SEQ ID NO: 3158196 - protein, 22 aa, Giardia lamblia
INELLLGGGRVFFKVTLYSLLA

SEQ ID NO: 3158197 - protein, 25 aa, Giardia lamblia
INERLAENIAALRIDLEQQRHLGGP

SEQ ID NO: 3158198 - protein, 21 aa, Giardia lamblia
INFPNRVNVAITRAVSHLIVF

SEQ ID NO: 3158199 - protein, 19 aa, Giardia lamblia
INFTRCLEITRTLLTSPSL

SEQ ID NO: 3158200 - protein, 17 aa, Giardia lamblia
INGCTALMISVRLRLTP

SEQ ID NO: 3158201 - protein, 17 aa, Giardia lamblia
INGDILFDERLLPPDSE

SEQ ID NO: 3158202 - protein, 20 aa, Giardia lamblia
INGECARMLVLVAYAGSAYK

SEQ ID NO: 3158203 - protein, 20 aa, Giardia lamblia
INGILGRHGYPSFSQEHITS

SEQ ID NO: 3158204 - protein, 19 aa, Giardia lamblia
INGLWTWESPPSKVVLVTK

SEQ ID NO: 3158205 - protein, 26 aa, Giardia lamblia
INIPLVDFYNHFKVILANNTFLVDAT

SEQ ID NO: 3158206 - protein, 25 aa, Giardia lamblia
INIVFSFSPKCVGFHHFKVGLVIYP

SEQ ID NO: 3158207 - protein, 18 aa, Giardia lamblia
INIWLDVIPQLIARLHSP

SEQ ID NO: 3158208 - protein, 22 aa, Giardia lamblia
INKHDGPLCTRTFPAYSVPGYT

SEQ ID NO: 3158209 - protein, 25 aa, Giardia lamblia
INKILKLLCEAIAWSSLPRDTFNMI

SEQ ID NO: 3158210 - protein, 20 aa, Giardia lamblia
INKIRTHRLLNFIVKSELAQ

SEQ ID NO: 3158211 - protein, 19 aa, Giardia lamblia
INKRICVVQGDLTALRTEA

SEQ ID NO: 3158212 - protein, 25 aa, Giardia lamblia
INLDLRTCIWMHWAQIQALGGQPEM

SEQ ID NO: 3158213 - protein, 17 aa, Giardia lamblia
INLGRFPTVTGIYRKLI

SEQ ID NO: 3158214 - protein, 34 aa, Giardia lamblia
INLLPYQKCRTDLMGRTALMYAAEAGQFEAAQHL

SEQ ID NO: 3158215 - protein, 24 aa, Giardia lamblia
INLNLSWHFWLTFMDSIIPASFSR

SEQ ID NO: 3158216 - protein, 20 aa, Giardia lamblia
INLPGPPAGVLPVHRSSSDP

SEQ ID NO: 3158217 - protein, 17 aa, Giardia lamblia
INLRTGAVSHLPADDEL

SEQ ID NO: 3158218 - protein, 28 aa, Giardia lamblia
INLSLNRFLCFSTSHALLILEQESYLEF

SEQ ID NO: 3158219 - protein, 25 aa, Giardia lamblia
INLSLSALGLVISKLVEGATHIPYR

SEQ ID NO: 3158220 - protein, 29 aa, Giardia lamblia
INLTCGTFVCARCAGIHREFDHRVKSVSN

SEQ ID NO: 3158221 - protein, 17 aa, Giardia lamblia
INLTFTVLMRLAVDYFL

SEQ ID NO: 3158222 - protein, 19 aa, Giardia lamblia
INLTICMQTVFLGFINNCN

SEQ ID NO: 3158223 - protein, 17 aa, Giardia lamblia
INMLYLQNLEDFLHKLN

SEQ ID NO: 3158224 - protein, 30 aa, Giardia lamblia
INMPGASEWQWKYRIHISLEELHNSDLVGI

SEQ ID NO: 3158225 - protein, 20 aa, Giardia lamblia
INMPKYRDFAHHLPDDLRKE

SEQ ID NO: 3158226 - protein, 17 aa, Giardia lamblia
INNAVFMRCNKATLNAL

SEQ ID NO: 3158227 - protein, 19 aa, Giardia lamblia
INNRIKEAMTIARNALSSQ

SEQ ID NO: 3158228 - protein, 26 aa, Giardia lamblia
INPCYNLPSFDTFWLQFDLSAYSKSS

SEQ ID NO: 3158229 - protein, 27 aa, Giardia lamblia
INPDKRPPVELLLDYALLHTPALVQPG

SEQ ID NO: 3158230 - protein, 21 aa, Giardia lamblia
INPEVFTLTFIQLSETMGGAS

SEQ ID NO: 3158231 - protein, 24 aa, Giardia lamblia
INPGRLMFYIPQYIADTIGEYYVQ

SEQ ID NO: 3158232 - protein, 26 aa, Giardia lamblia
INPNSCQAWFALGMSTLRLAADSNSS

SEQ ID NO: 3158233 - protein, 18 aa, Giardia lamblia
INPPVSIEERLRKLLFDR

SEQ ID NO: 3158234 - protein, 21 aa, Giardia lamblia
INPSVSFRYLELMPFRAELRA

SEQ ID NO: 3158235 - protein, 28 aa, Giardia lamblia
INPVGPCLYCGSPIYGLPGRVSAATGDI

SEQ ID NO: 3158236 - protein, 18 aa, Giardia lamblia
INPYETINYFLFSNITLG

SEQ ID NO: 3158237 - protein, 18 aa, Giardia lamblia
INQMRSGLEARLHALEDK

SEQ ID NO: 3158238 - protein, 25 aa, Giardia lamblia
INRAYDYYKGCCHQTVGQGPFTRLK

SEQ ID NO: 3158239 - protein, 20 aa, Giardia lamblia
INRDCLRKTFKCAMAGSVLQ

SEQ ID NO: 3158240 - protein, 18 aa, Giardia lamblia
INRDRFVLSNGHASPLIY

SEQ ID NO: 3158241 - protein, 23 aa, Giardia lamblia
INRGGEISEMFALNVIQPALVTI

SEQ ID NO: 3158242 - protein, 28 aa, Giardia lamblia
INRPSDRLRKYFGVVAIFRALVDILQKT

SEQ ID NO: 3158243 - protein, 26 aa, Giardia lamblia
INSDVKKRRAVVEMSQAITDLDDLNA

SEQ ID NO: 3158244 - protein, 19 aa, Giardia lamblia
INSPMMREMLQSNPELAAH

SEQ ID NO: 3158245 - protein, 23 aa, Giardia lamblia
INSRSQGFLALFNGDTGEISIEV

SEQ ID NO: 3158246 - protein, 25 aa, Giardia lamblia
INTRFFGDRLNVMSANKRKVMSAEI

SEQ ID NO: 3158247 - protein, 25 aa, Giardia lamblia
INTSLCALGDVIAALSRKKVASYVP

SEQ ID NO: 3158248 - protein, 20 aa, Giardia lamblia
INTTCIMEPIAFALQELHPR

SEQ ID NO: 3158249 - protein, 21 aa, Giardia lamblia
INTVICQRALLQFMQHTFDAF

SEQ ID NO: 3158250 - protein, 18 aa, Giardia lamblia
INVAAFLDYMAYVTKFYR

SEQ ID NO: 3158251 - protein, 23 aa, Giardia lamblia
INVFDLRPALRYGEGLSLTQSHR

SEQ ID NO: 3158252 - protein, 19 aa, Giardia lamblia
INVQRLFPSPPRGHPGRSP

SEQ ID NO: 3158253 - protein, 24 aa, Giardia lamblia
INVTLRFAYDKSIGKIGGGQRVAI

SEQ ID NO: 3158254 - protein, 17 aa, Giardia lamblia
IPAEYRTSFLLATLFRV

SEQ ID NO: 3158255 - protein, 17 aa, Giardia lamblia
IPAGGYSTVESIIRKRD

SEQ ID NO: 3158256 - protein, 17 aa, Giardia lamblia
IPAKISLFRKLAIIETP

SEQ ID NO: 3158257 - protein, 18 aa, Giardia lamblia
IPALTAIQSRVMSRDIAG

SEQ ID NO: 3158258 - protein, 17 aa, Giardia lamblia
IPAPRVLALSVIDETNE

SEQ ID NO: 3158259 - protein, 30 aa, Giardia lamblia
IPASILGYRITWSFVKTFFARVFDSVHSLF

SEQ ID NO: 3158260 - protein, 20 aa, Giardia lamblia
IPASIRTQLLLDRDPHGNIA

SEQ ID NO: 3158261 - protein, 20 aa, Giardia lamblia
IPCDLRPSVTSLELQIPPDD

SEQ ID NO: 3158262 - protein, 19 aa, Giardia lamblia
IPCEFKPLNAVYLAYHDIV

SEQ ID NO: 3158263 - protein, 22 aa, Giardia lamblia
IPCGHFCTCRVCDRSLTRRQCP

SEQ ID NO: 3158264 - protein, 23 aa, Giardia lamblia
IPCLSSLFPMLGHFGITDSVGVI

SEQ ID NO: 3158265 - protein, 17 aa, Giardia lamblia
IPCSNTWEASLMGLLSM

SEQ ID NO: 3158266 - protein, 21 aa, Giardia lamblia
IPCYTDGKAIKLCKLDILYYL

SEQ ID NO: 3158267 - protein, 17 aa, Giardia lamblia
IPDETYYELNLLKKDDL

SEQ ID NO: 3158268 - protein, 23 aa, Giardia lamblia
IPDNCGKTALMYAAESGNLEICK

SEQ ID NO: 3158269 - protein, 17 aa, Giardia lamblia
IPDSFFFEKTAHLSETI

SEQ ID NO: 3158270 - protein, 18 aa, Giardia lamblia
IPEAAPDLPQRYTVDSVL

SEQ ID NO: 3158271 - protein, 25 aa, Giardia lamblia
IPEAKRSSSSFGFHSPTWGSPAVKH

SEQ ID NO: 3158272 - protein, 25 aa, Giardia lamblia
IPEDPRLGSVLFEAASRGTLTPCAR

SEQ ID NO: 3158273 - protein, 18 aa, Giardia lamblia
IPEHSFNPGDPMAIVVAM

SEQ ID NO: 3158274 - protein, 19 aa, Giardia lamblia
IPEIPSLITHKFTNHVLRT

SEQ ID NO: 3158275 - protein, 19 aa, Giardia lamblia
IPEKVMTKMIQRVASQVDR

SEQ ID NO: 3158276 - protein, 19 aa, Giardia lamblia
IPELESFYADLPIELNDPG

SEQ ID NO: 3158277 - protein, 25 aa, Giardia lamblia
IPELIAEILALIGIANALNYIPLTC

SEQ ID NO: 3158278 - protein, 24 aa, Giardia lamblia
IPELKRASISSIILRGDVAGEDPA

SEQ ID NO: 3158279 - protein, 28 aa, Giardia lamblia
IPEQAYCLMAQFMARYLIPKEEAKELLI

SEQ ID NO: 3158280 - protein, 17 aa, Giardia lamblia
IPFDHIDGYLVFIQAII

SEQ ID NO: 3158281 - protein, 17 aa, Giardia lamblia
IPFIKYITARNFQASSS

SEQ ID NO: 3158282 - protein, 33 aa, Giardia lamblia
IPFIVCASDLCHLTFKFTLQLGSKKVSLSPHRG

SEQ ID NO: 3158283 - protein, 21 aa, Giardia lamblia
IPFVAGIKARALRMIAGCLLN

SEQ ID NO: 3158284 - protein, 18 aa, Giardia lamblia
IPGGSPLFLLISASILPE

SEQ ID NO: 3158285 - protein, 26 aa, Giardia lamblia
IPGTSFGEICSFSIDDQKLAIAVGSA

SEQ ID NO: 3158286 - protein, 23 aa, Giardia lamblia
IPIFLRSEGWRLINEAIEVAEKG

SEQ ID NO: 3158287 - protein, 22 aa, Giardia lamblia
IPIGAALVRFTGPLEVHFTVGE

SEQ ID NO: 3158288 - protein, 22 aa, Giardia lamblia
IPILEPHSFVGTTLVSPEKFSG

SEQ ID NO: 3158289 - protein, 17 aa, Giardia lamblia
IPILLRLSTLLQKHSAR

SEQ ID NO: 3158290 - protein, 23 aa, Giardia lamblia
IPIQKRLSIRLGTGDCLSKGYST

SEQ ID NO: 3158291 - protein, 19 aa, Giardia lamblia
IPISGLLPTKAHDFPRDGT

SEQ ID NO: 3158292 - protein, 17 aa, Giardia lamblia
IPKDISVYSCTEEPSQQ

SEQ ID NO: 3158293 - protein, 21 aa, Giardia lamblia
IPKDLAGILKLPGFGPKMGHL

SEQ ID NO: 3158294 - protein, 38 aa, Giardia lamblia
IPKNMKTRMLLYTIVCYLRLGKSLHFFQLHRAAHGVLD

SEQ ID NO: 3158295 - protein, 23 aa, Giardia lamblia
IPKNNMDQTIWFQAIRTNNIEFV

SEQ ID NO: 3158296 - protein, 20 aa, Giardia lamblia
IPKSRYKKLVKEWEAQKKLN

SEQ ID NO: 3158297 - protein, 26 aa, Giardia lamblia
IPKSYKARVAYPFSDKRIMRLGTIGK

SEQ ID NO: 3158298 - protein, 34 aa, Giardia lamblia
IPLLQRLISLQWQRLDGLGALILLPTAELCVQTF

SEQ ID NO: 3158299 - protein, 17 aa, Giardia lamblia
IPLLVGATKLIFSGDTH

SEQ ID NO: 3158300 - protein, 19 aa, Giardia lamblia
IPLQSVIVMNLVLKSNPEL

SEQ ID NO: 3158301 - protein, 26 aa, Giardia lamblia
IPLRDGRDALMLAAFMANYEAVSVLV

SEQ ID NO: 3158302 - protein, 17 aa, Giardia lamblia
IPLRHELQLAGMHSRIL

SEQ ID NO: 3158303 - protein, 18 aa, Giardia lamblia
IPLSGSRLRELKAQGEKL

SEQ ID NO: 3158304 - protein, 21 aa, Giardia lamblia
IPLSHLNNICMARHRQVQEFT

SEQ ID NO: 3158305 - protein, 19 aa, Giardia lamblia
IPLSYTFWNYRRDFLSSHQ

SEQ ID NO: 3158306 - protein, 19 aa, Giardia lamblia
IPMHAIKDIDIEAANLLAK

SEQ ID NO: 3158307 - protein, 18 aa, Giardia lamblia
IPMLEKYLRCLAKARLDY

SEQ ID NO: 3158308 - protein, 19 aa, Giardia lamblia
IPMTAKLNILFGDKSVGII

SEQ ID NO: 3158309 - protein, 19 aa, Giardia lamblia
IPMVELLLPQEKRLQAYDG

SEQ ID NO: 3158310 - protein, 24 aa, Giardia lamblia
IPNDKLNVCGAFPSACGKTSTSMA

SEQ ID NO: 3158311 - protein, 32 aa, Giardia lamblia
IPNLRHLWLKLPCPVSQRPAATVYERFTSMLY

SEQ ID NO: 3158312 - protein, 20 aa, Giardia lamblia
IPNLRWEEYKVLEDTTTVTL

SEQ ID NO: 3158313 - protein, 19 aa, Giardia lamblia
IPNNWRQYICESILENVPI

SEQ ID NO: 3158314 - protein, 21 aa, Giardia lamblia
IPNPDHRGLAFALNNLSLETI

SEQ ID NO: 3158315 - protein, 19 aa, Giardia lamblia
IPNPGSWAFPERYSIHGLQ

SEQ ID NO: 3158316 - protein, 21 aa, Giardia lamblia
IPNPQLRPSMHELRTLYDSLS

SEQ ID NO: 3158317 - protein, 19 aa, Giardia lamblia
IPPAFRYLLNNPFTRHQML

SEQ ID NO: 3158318 - protein, 20 aa, Giardia lamblia
IPPFHQKWFLCQVCEDEGDY

SEQ ID NO: 3158319 - protein, 22 aa, Giardia lamblia
IPPGCGVVGITGMKQVPRVSGS

SEQ ID NO: 3158320 - protein, 24 aa, Giardia lamblia
IPPLKYLLHICKYGEYKGLKLHSP

SEQ ID NO: 3158321 - protein, 19 aa, Giardia lamblia
IPPNVKITSSIGVREMALK

SEQ ID NO: 3158322 - protein, 19 aa, Giardia lamblia
IPPPCSLSDLVYVGLEDGR

SEQ ID NO: 3158323 - protein, 32 aa, Giardia lamblia
IPPQSSFNASAWKELLCVQRSIFDQATLSNMY

SEQ ID NO: 3158324 - protein, 22 aa, Giardia lamblia
IPPRFLCGYRRMFHPNVSSDGR

SEQ ID NO: 3158325 - protein, 26 aa, Giardia lamblia
IPPYSPELIGIWGLVFSPEDPNLVAV

SEQ ID NO: 3158326 - protein, 26 aa, Giardia lamblia
IPQGWLRFAPQTLKMLSNWIQHLMRR

SEQ ID NO: 3158327 - protein, 17 aa, Giardia lamblia
IPQPDFSPTGGYKSSNR

SEQ ID NO: 3158328 - protein, 19 aa, Giardia lamblia
IPQQIWRADTCKKNEEWRH

SEQ ID NO: 3158329 - protein, 22 aa, Giardia lamblia
IPRINLEKFRPIATLTQVELAE

SEQ ID NO: 3158330 - protein, 17 aa, Giardia lamblia
IPRKCSATNRLIGPKDH

SEQ ID NO: 3158331 - protein, 20 aa, Giardia lamblia
IPRTISYLFQFFEESNSPTF

SEQ ID NO: 3158332 - protein, 20 aa, Giardia lamblia
IPSCVLDIFDSAVPHEDDVN

SEQ ID NO: 3158333 - protein, 23 aa, Giardia lamblia
IPSELKLSGSEFLSLLLESFDSY

SEQ ID NO: 3158334 - protein, 20 aa, Giardia lamblia
IPSHIKQLIILNRHAILSPY

SEQ ID NO: 3158335 - protein, 32 aa, Giardia lamblia
IPSIRRFIRLLSELCLHLGIPNYAVLSAVADH

SEQ ID NO: 3158336 - protein, 23 aa, Giardia lamblia
IPSKNICRICRYPLYKPVVLNCA

SEQ ID NO: 3158337 - protein, 21 aa, Giardia lamblia
IPSTECLYARKLPVLNADELI

SEQ ID NO: 3158338 - protein, 17 aa, Giardia lamblia
IPSTLIHHFYFQPIRPV

SEQ ID NO: 3158339 - protein, 18 aa, Giardia lamblia
IPTAGSMVHFMRRHMRTP

SEQ ID NO: 3158340 - protein, 19 aa, Giardia lamblia
IPTCIFIKKVYRNSANFAR

SEQ ID NO: 3158341 - protein, 18 aa, Giardia lamblia
IPTDLAYLMGHFDIAIFL

SEQ ID NO: 3158342 - protein, 21 aa, Giardia lamblia
IPTKVCNDVVMIYLYPGISGQ

SEQ ID NO: 3158343 - protein, 21 aa, Giardia lamblia
IPTLLHWTRETRLWGEYAYLL

SEQ ID NO: 3158344 - protein, 20 aa, Giardia lamblia
IPTNACIRGSKFKSVSMPGD

SEQ ID NO: 3158345 - protein, 19 aa, Giardia lamblia
IPTNFRAALGPANEHTIDE

SEQ ID NO: 3158346 - protein, 28 aa, Giardia lamblia
IPTNMAPILPCYLKLLKQQRINALLAVE

SEQ ID NO: 3158347 - protein, 26 aa, Giardia lamblia
IPTTARFALVKVDSRFKAANEGLACN

SEQ ID NO: 3158348 - protein, 20 aa, Giardia lamblia
IPTVFGLDKIPGMKLTKEQE

SEQ ID NO: 3158349 - protein, 17 aa, Giardia lamblia
IPVAEYYPRTQRDGQTG

SEQ ID NO: 3158350 - protein, 19 aa, Giardia lamblia
IPVELSLTLPHEEPNLEAC

SEQ ID NO: 3158351 - protein, 18 aa, Giardia lamblia
IPVIRDMARQVLKALDYI

SEQ ID NO: 3158352 - protein, 17 aa, Giardia lamblia
IPVKRIKMILKTAYKFT

SEQ ID NO: 3158353 - protein, 18 aa, Giardia lamblia
IPVNPCPLPASIPRPRRE

SEQ ID NO: 3158354 - protein, 17 aa, Giardia lamblia
IPVQILYINKKVHLVIE

SEQ ID NO: 3158355 - protein, 23 aa, Giardia lamblia
IPVRFYPNGIFIKRGPFRAYEHD

SEQ ID NO: 3158356 - protein, 21 aa, Giardia lamblia
IPVTRRVSAVRFWNYNKSPTT

SEQ ID NO: 3158357 - protein, 19 aa, Giardia lamblia
IPVVAARIYPKLSQNLIIT

SEQ ID NO: 3158358 - protein, 20 aa, Giardia lamblia
IPVVYFRQSVYVDFVPPLLF

SEQ ID NO: 3158359 - protein, 27 aa, Giardia lamblia
IPWGSLKYLIGLCMYGGRVSDNYDRRV

SEQ ID NO: 3158360 - protein, 22 aa, Giardia lamblia
IPWTCVSILQAAGWINAPEVES

SEQ ID NO: 3158361 - protein, 20 aa, Giardia lamblia
IPYDSRFDGLFKHLIVAISI

SEQ ID NO: 3158362 - protein, 21 aa, Giardia lamblia
IPYGVPKRVRFTLFSENEKNS

SEQ ID NO: 3158363 - protein, 17 aa, Giardia lamblia
IPYICPDSDAVSECSVC

SEQ ID NO: 3158364 - protein, 18 aa, Giardia lamblia
IPYQARMVARFVKAGRVK

SEQ ID NO: 3158365 - protein, 18 aa, Giardia lamblia
IPYREMAFHSTLATGFSP

SEQ ID NO: 3158366 - protein, 17 aa, Giardia lamblia
IPYVIDVLLYTFDGASR

SEQ ID NO: 3158367 - protein, 26 aa, Giardia lamblia
IQACMPHCDGSGLIYTWHRLDAEALG

SEQ ID NO: 3158368 - protein, 18 aa, Giardia lamblia
IQAGILWIAVDPGGCDPN

SEQ ID NO: 3158369 - protein, 23 aa, Giardia lamblia
IQAKLEEFLAIRASAKQKKPELV

SEQ ID NO: 3158370 - protein, 23 aa, Giardia lamblia
IQALRPTIFIAVPRILNRLFEGI

SEQ ID NO: 3158371 - protein, 23 aa, Giardia lamblia
IQARTHASYVFPPAYFPIPDVYE

SEQ ID NO: 3158372 - protein, 18 aa, Giardia lamblia
IQCSGQSNLMVWMEKASF

SEQ ID NO: 3158373 - protein, 25 aa, Giardia lamblia
IQDEARLQTPLSLGVIDVLSMEKAE

SEQ ID NO: 3158374 - protein, 27 aa, Giardia lamblia
IQDLRGAIRVAVRLRPSTAVTSPGGTD

SEQ ID NO: 3158375 - protein, 25 aa, Giardia lamblia
IQDSRGRTALMYAAYAGNLRVVELL

SEQ ID NO: 3158376 - protein, 18 aa, Giardia lamblia
IQDSVGWTALHYSAVNAD

SEQ ID NO: 3158377 - protein, 24 aa, Giardia lamblia
IQDTKGRTALMFAAANGCAQACDY

SEQ ID NO: 3158378 - protein, 19 aa, Giardia lamblia
IQERILRLLSSIFSKNLGR

SEQ ID NO: 3158379 - protein, 19 aa, Giardia lamblia
IQFEFPSSCIDNCSLDADD

SEQ ID NO: 3158380 - protein, 17 aa, Giardia lamblia
IQGCLGCLSLCKQRNRE

SEQ ID NO: 3158381 - protein, 23 aa, Giardia lamblia
IQGDFNSVVPLPSWSTSITASTK

SEQ ID NO: 3158382 - protein, 26 aa, Giardia lamblia
IQGHLECVKLLYLREYPVLIRNNFNL

SEQ ID NO: 3158383 - protein, 25 aa, Giardia lamblia
IQHPRLLRCYGCRVNPRRDTVTLFE

SEQ ID NO: 3158384 - protein, 27 aa, Giardia lamblia
IQHTVRPDSKCFFELYRNVSTDAGNPK

SEQ ID NO: 3158385 - protein, 37 aa, Giardia lamblia
IQIDGRGYDICWIPGFRLTTATLRGKLGLQILPETTK

SEQ ID NO: 3158386 - protein, 25 aa, Giardia lamblia
IQIFKKLTFSMSVFHAVTQERRKFG

SEQ ID NO: 3158387 - protein, 17 aa, Giardia lamblia
IQIRDELALNLGLLDHV

SEQ ID NO: 3158388 - protein, 17 aa, Giardia lamblia
IQISGLIYNRSLTYVCF

SEQ ID NO: 3158389 - protein, 24 aa, Giardia lamblia
IQKLKSVICSSALEDGITPMDFDL

SEQ ID NO: 3158390 - protein, 20 aa, Giardia lamblia
IQKMVRIMKLYGGKQAPTEW

SEQ ID NO: 3158391 - protein, 33 aa, Giardia lamblia
IQKPPSGACTFAFTPDLSRVFCGSRRGVVDTYE

SEQ ID NO: 3158392 - protein, 17 aa, Giardia lamblia
IQKSCLCKVYEYGRLSP

SEQ ID NO: 3158393 - protein, 23 aa, Giardia lamblia
IQLELLYLFPWLKSAHITEDLLI

SEQ ID NO: 3158394 - protein, 17 aa, Giardia lamblia
IQLFNRLSLEGLTHISD

SEQ ID NO: 3158395 - protein, 31 aa, Giardia lamblia
IQLKRKDIEIARLNERVELLLNTSPEAGDTV

SEQ ID NO: 3158396 - protein, 19 aa, Giardia lamblia
IQLTMPWVLIKKAETKNGH

SEQ ID NO: 3158397 - protein, 23 aa, Giardia lamblia
IQMATELLFFINRECIPYNSPNS

SEQ ID NO: 3158398 - protein, 19 aa, Giardia lamblia
IQNKIGWTALMYACSRDHL

SEQ ID NO: 3158399 - protein, 17 aa, Giardia lamblia
IQNNLLELRESYPEIHN

SEQ ID NO: 3158400 - protein, 26 aa, Giardia lamblia
IQNNLRELFTLLGLIHPAVFCDYDRF

SEQ ID NO: 3158401 - protein, 25 aa, Giardia lamblia
IQPFCDVQLPFTFTPKSLKLVKAKF

SEQ ID NO: 3158402 - protein, 19 aa, Giardia lamblia
IQPFLLMQLFIPKDQIFSL

SEQ ID NO: 3158403 - protein, 19 aa, Giardia lamblia
IQPPERFHEVVAGRELPPQ

SEQ ID NO: 3158404 - protein, 22 aa, Giardia lamblia
IQPRICAGSKWVFISYKNTCYR

SEQ ID NO: 3158405 - protein, 17 aa, Giardia lamblia
IQPTCARSGDGLYQGLD

SEQ ID NO: 3158406 - protein, 25 aa, Giardia lamblia
IQPTDPCSITFGGPVHFPAFAQTVS

SEQ ID NO: 3158407 - protein, 23 aa, Giardia lamblia
IQQECTRVLYILADITAASDEYV

SEQ ID NO: 3158408 - protein, 23 aa, Giardia lamblia
IQQFKLSSPILSLAVNNNKEIFT

SEQ ID NO: 3158409 - protein, 19 aa, Giardia lamblia
IQQYSHFRIPADSHRYQQQ

SEQ ID NO: 3158410 - protein, 23 aa, Giardia lamblia
IQRGEGMIIWEFRESSQLESLDL

SEQ ID NO: 3158411 - protein, 20 aa, Giardia lamblia
IQRHIKEIFSDDIISTLRSL

SEQ ID NO: 3158412 - protein, 19 aa, Giardia lamblia
IQRMFKFDIQFTTEVLPDI

SEQ ID NO: 3158413 - protein, 18 aa, Giardia lamblia
IQRNWGPVRFEWVAERVH

SEQ ID NO: 3158414 - protein, 23 aa, Giardia lamblia
IQRSYCIETTFGGITKAGSPKFG

SEQ ID NO: 3158415 - protein, 18 aa, Giardia lamblia
IQSACWAATGSMLAFITI

SEQ ID NO: 3158416 - protein, 18 aa, Giardia lamblia
IQSASSFFRDAMTCDPKS

SEQ ID NO: 3158417 - protein, 20 aa, Giardia lamblia
IQSCIACLYGNIDVDESSPA

SEQ ID NO: 3158418 - protein, 18 aa, Giardia lamblia
IQSFSCETNLQPGNSHAP

SEQ ID NO: 3158419 - protein, 25 aa, Giardia lamblia
IQSNGRIKPIFARMYARMHSLLKSY

SEQ ID NO: 3158420 - protein, 24 aa, Giardia lamblia
IQSNRLAGSLGRSDLNNEPEGKPV

SEQ ID NO: 3158421 - protein, 17 aa, Giardia lamblia
IQSPAFGHLSAVRRSLQ

SEQ ID NO: 3158422 - protein, 20 aa, Giardia lamblia
IQSRIRVVIRKRPINPKELS

SEQ ID NO: 3158423 - protein, 18 aa, Giardia lamblia
IQSRRGWTALQDAAYSGQ

SEQ ID NO: 3158424 - protein, 22 aa, Giardia lamblia
IQSVRTGVCFLFLMHTSASLSI

SEQ ID NO: 3158425 - protein, 27 aa, Giardia lamblia
IQTAWGTTALMWACQFGHIDCVRMLIP

SEQ ID NO: 3158426 - protein, 23 aa, Giardia lamblia
IQTCCLPNLPLGHVGDVCHAEGI

SEQ ID NO: 3158427 - protein, 19 aa, Giardia lamblia
IQTLRAALFSANKQAADLQ

SEQ ID NO: 3158428 - protein, 19 aa, Giardia lamblia
IQYALKFLTDRGYQAMQTP

SEQ ID NO: 3158429 - protein, 17 aa, Giardia lamblia
IQYCDRFSLPRGVVTEE

SEQ ID NO: 3158430 - protein, 19 aa, Giardia lamblia
IQYESIIPVGYSRERPQSS

SEQ ID NO: 3158431 - protein, 17 aa, Giardia lamblia
IQYGTPVLLEDVGEQID

SEQ ID NO: 3158432 - protein, 18 aa, Giardia lamblia
IQYILKMDPRWLPVSEKE

SEQ ID NO: 3158433 - protein, 24 aa, Giardia lamblia
IQYLCKIVDGAHSFNNLLASDAFW

SEQ ID NO: 3158434 - protein, 24 aa, Giardia lamblia
IQYTKGRALCLINVMNYIVVGYEF

SEQ ID NO: 3158435 - protein, 19 aa, Giardia lamblia
IRAALPAFIGATAFIGASR

SEQ ID NO: 3158436 - protein, 22 aa, Giardia lamblia
IRAENVLLRDALRSRTSTYVPQ

SEQ ID NO: 3158437 - protein, 18 aa, Giardia lamblia
IRALVRGGIKIGRIEDST

SEQ ID NO: 3158438 - protein, 19 aa, Giardia lamblia
IRANIIIDACDLHHGKKAA

SEQ ID NO: 3158439 - protein, 25 aa, Giardia lamblia
IRAPWRVWPQMRHDSTKLGVPLSLV

SEQ ID NO: 3158440 - protein, 17 aa, Giardia lamblia
IRCTALLSQVRAKPYAD

SEQ ID NO: 3158441 - protein, 24 aa, Giardia lamblia
IRDAKAKFVRIISEKEFYDLVVKK

SEQ ID NO: 3158442 - protein, 24 aa, Giardia lamblia
IRDDGCIKLCDFGFSKSCGLNEVA

SEQ ID NO: 3158443 - protein, 22 aa, Giardia lamblia
IRDELALNLGLLDHVCHDTKSQ

SEQ ID NO: 3158444 - protein, 19 aa, Giardia lamblia
IRDFLFYRGGCYSVNGPLT

SEQ ID NO: 3158445 - protein, 18 aa, Giardia lamblia
IRDIWGEDVYEIKFPPKV

SEQ ID NO: 3158446 - protein, 17 aa, Giardia lamblia
IRDKLAFLENKAKSYEY

SEQ ID NO: 3158447 - protein, 24 aa, Giardia lamblia
IRDKLKAMLMRWFSTKLAQPETSN

SEQ ID NO: 3158448 - protein, 27 aa, Giardia lamblia
IRDRLLMSISFFSWRKVHGYNTLLTCF

SEQ ID NO: 3158449 - protein, 20 aa, Giardia lamblia
IREIIKRIYAAGLDQVGNED

SEQ ID NO: 3158450 - protein, 18 aa, Giardia lamblia
IREKLFGFSERRWNALKT

SEQ ID NO: 3158451 - protein, 17 aa, Giardia lamblia
IREKNLAQGLDIFGKSI

SEQ ID NO: 3158452 - protein, 21 aa, Giardia lamblia
IRELIDWDYYLARLSGAIYKI

SEQ ID NO: 3158453 - protein, 26 aa, Giardia lamblia
IRELVKVRFVLDYKIREYSRQVEPRD

SEQ ID NO: 3158454 - protein, 18 aa, Giardia lamblia
IRESSLLQFVNDPHCLQY

SEQ ID NO: 3158455 - protein, 19 aa, Giardia lamblia
IRFKQRPVIDLLTRYPEEH

SEQ ID NO: 3158456 - protein, 20 aa, Giardia lamblia
IRFNAELKLQAIQLAIGSLN

SEQ ID NO: 3158457 - protein, 17 aa, Giardia lamblia
IRFPLPPLIDPLVSLMQ

SEQ ID NO: 3158458 - protein, 33 aa, Giardia lamblia
IRFTAHLIGTCRLCLKDIIFKDVHVQGRLQFSD

SEQ ID NO: 3158459 - protein, 21 aa, Giardia lamblia
IRGAFGRRSRAILSVESQGKS

SEQ ID NO: 3158460 - protein, 30 aa, Giardia lamblia
IRGGLPLSKFSASIIYQLAKLVPMVSTGPN

SEQ ID NO: 3158461 - protein, 24 aa, Giardia lamblia
IRGLRPSALTALEIEARVLPRMEH

SEQ ID NO: 3158462 - protein, 18 aa, Giardia lamblia
IRGQTALMYAVSHLHYSV

SEQ ID NO: 3158463 - protein, 32 aa, Giardia lamblia
IRGRYTLHCLIGKGAFAKVWKAADEVTGGFVA

SEQ ID NO: 3158464 - protein, 17 aa, Giardia lamblia
IRHLILVLLTELRLTTE

SEQ ID NO: 3158465 - protein, 17 aa, Giardia lamblia
IRHPRFIAGGGSIEMYL

SEQ ID NO: 3158466 - protein, 18 aa, Giardia lamblia
IRHWSYEYFTTWHNDEWT

SEQ ID NO: 3158467 - protein, 22 aa, Giardia lamblia
IRIGRRKCMTNLGHLRTNLSTY

SEQ ID NO: 3158468 - protein, 20 aa, Giardia lamblia
IRIKIRREESLSYMSQATAG

SEQ ID NO: 3158469 - protein, 17 aa, Giardia lamblia
IRILAPLERNLTDKKGR

SEQ ID NO: 3158470 - protein, 25 aa, Giardia lamblia
IRIMHSNVLFGQWISMGLNQPRGAM

SEQ ID NO: 3158471 - protein, 27 aa, Giardia lamblia
IRITALTFDTCLAVKYAASEAGYDIGS

SEQ ID NO: 3158472 - protein, 17 aa, Giardia lamblia
IRIWGLNFGECQKLIRF

SEQ ID NO: 3158473 - protein, 17 aa, Giardia lamblia
IRIYAMFTITTGKPGTS

SEQ ID NO: 3158474 - protein, 18 aa, Giardia lamblia
IRKAILILAHMRYSDHGS

SEQ ID NO: 3158475 - protein, 19 aa, Giardia lamblia
IRKDGNFALQLAIEQNHPD

SEQ ID NO: 3158476 - protein, 17 aa, Giardia lamblia
IRKDIASRLGITCSVGV

SEQ ID NO: 3158477 - protein, 21 aa, Giardia lamblia
IRKIYKQNLADYVQLHGQLDA

SEQ ID NO: 3158478 - protein, 22 aa, Giardia lamblia
IRKKAALALLHCYRVNPASVDT

SEQ ID NO: 3158479 - protein, 28 aa, Giardia lamblia
IRKSDLLRFLRALGLPFTLKDVADYTSQ

SEQ ID NO: 3158480 - protein, 27 aa, Giardia lamblia
IRKVDEVLVMLRILDFRQLPQTRRTVM

SEQ ID NO: 3158481 - protein, 17 aa, Giardia lamblia
IRLAELGACLGSNYEIS

SEQ ID NO: 3158482 - protein, 18 aa, Giardia lamblia
IRLEPSFRDPTALKVFTS

SEQ ID NO: 3158483 - protein, 19 aa, Giardia lamblia
IRLLAPLEGGLRRKDGKLA

SEQ ID NO: 3158484 - protein, 17 aa, Giardia lamblia
IRLLLPYAAGIPDKNGW

SEQ ID NO: 3158485 - protein, 17 aa, Giardia lamblia
IRLLNSLIFLSSLVDPL

SEQ ID NO: 3158486 - protein, 17 aa, Giardia lamblia
IRLLVEVEENLRANDGR

SEQ ID NO: 3158487 - protein, 20 aa, Giardia lamblia
IRLLYPYEHGLLPDAEKIVL

SEQ ID NO: 3158488 - protein, 17 aa, Giardia lamblia
IRLNLEPGSPCGAVAAQ

SEQ ID NO: 3158489 - protein, 24 aa, Giardia lamblia
IRLNMPADRPWKALIDRWMEHDRH

SEQ ID NO: 3158490 - protein, 17 aa, Giardia lamblia
IRLNYNLKTQASLPLSW

SEQ ID NO: 3158491 - protein, 27 aa, Giardia lamblia
IRLTSLCLLGRRLFTEWDVQVKGELTI

SEQ ID NO: 3158492 - protein, 22 aa, Giardia lamblia
IRLVSLLEKRSAVCDGETMTDL

SEQ ID NO: 3158493 - protein, 20 aa, Giardia lamblia
IRLWIHENMRVYYDRLVDDH

SEQ ID NO: 3158494 - protein, 17 aa, Giardia lamblia
IRLYYSFQDDLYLYLVM

SEQ ID NO: 3158495 - protein, 17 aa, Giardia lamblia
IRMRDCSGWTALMSAAW

SEQ ID NO: 3158496 - protein, 21 aa, Giardia lamblia
IRNASELDLLFTHVTVNGKGF

SEQ ID NO: 3158497 - protein, 28 aa, Giardia lamblia
IRNKRPECARLLLEYEGSMKHNGMNVLQ

SEQ ID NO: 3158498 - protein, 18 aa, Giardia lamblia
IRNMLINWIKHRRVLDEQ

SEQ ID NO: 3158499 - protein, 24 aa, Giardia lamblia
IRNSKCTPAIFWQHHTDLLDLDKT

SEQ ID NO: 3158500 - protein, 18 aa, Giardia lamblia
IRNYLTPQLSQKGIKYAG

SEQ ID NO: 3158501 - protein, 17 aa, Giardia lamblia
IRPANPYKARMSTHELV

SEQ ID NO: 3158502 - protein, 18 aa, Giardia lamblia
IRPEDRITAGDLLQLPFI

SEQ ID NO: 3158503 - protein, 18 aa, Giardia lamblia
IRPEYSREYDIHRKDVLK

SEQ ID NO: 3158504 - protein, 24 aa, Giardia lamblia
IRPFCIPEHAKVMYTNGIAASGIS

SEQ ID NO: 3158505 - protein, 17 aa, Giardia lamblia
IRPFFGILPDRKTMDVI

SEQ ID NO: 3158506 - protein, 17 aa, Giardia lamblia
IRPGYTIMNEKTGKCSC

SEQ ID NO: 3158507 - protein, 32 aa, Giardia lamblia
IRPNDPMIRKQIVKEFYNFLCMYTDTPSVPEL

SEQ ID NO: 3158508 - protein, 19 aa, Giardia lamblia
IRPPISAPHRSHVAFTNGK

SEQ ID NO: 3158509 - protein, 22 aa, Giardia lamblia
IRPRDFCSSPELLDIIGERTLG

SEQ ID NO: 3158510 - protein, 19 aa, Giardia lamblia
IRPSALRYRHAHVVHPELK

SEQ ID NO: 3158511 - protein, 17 aa, Giardia lamblia
IRPSCLHGDSSQKERAT

SEQ ID NO: 3158512 - protein, 19 aa, Giardia lamblia
IRPSECTRGSPVKKEKTPL

SEQ ID NO: 3158513 - protein, 19 aa, Giardia lamblia
IRQSKAWMNLAAKIEHTTF

SEQ ID NO: 3158514 - protein, 19 aa, Giardia lamblia
IRRIYGIDRVKRGLNMELY

SEQ ID NO: 3158515 - protein, 22 aa, Giardia lamblia
IRRKDSLFRLLRTLPGVNFERA

SEQ ID NO: 3158516 - protein, 24 aa, Giardia lamblia
IRRLKEKRKILASFDMSIHMDTVY

SEQ ID NO: 3158517 - protein, 26 aa, Giardia lamblia
IRRLVYDCKFETRIPTAFKNFTAIQD

SEQ ID NO: 3158518 - protein, 29 aa, Giardia lamblia
IRRYELDRMRYAFAIAKFNSIQTASNIYS

SEQ ID NO: 3158519 - protein, 22 aa, Giardia lamblia
IRSDPKLAYESLFILASLADLT

SEQ ID NO: 3158520 - protein, 19 aa, Giardia lamblia
IRSELLKRYTVLYYGSLPN

SEQ ID NO: 3158521 - protein, 24 aa, Giardia lamblia
IRSFAYKITEDWFNGIAGDIQKTF

SEQ ID NO: 3158522 - protein, 22 aa, Giardia lamblia
IRSGTLPVFLVVGMGEAAELAQ

SEQ ID NO: 3158523 - protein, 17 aa, Giardia lamblia
IRSGTSFYSNCYPAGSA

SEQ ID NO: 3158524 - protein, 30 aa, Giardia lamblia
IRSICTEAGMYCLRDKRRLISEADFLKAIN

SEQ ID NO: 3158525 - protein, 18 aa, Giardia lamblia
IRSLCAQQASAILLLDVL

SEQ ID NO: 3158526 - protein, 20 aa, Giardia lamblia
IRSLGSKYFKVHNESDDGNT

SEQ ID NO: 3158527 - protein, 18 aa, Giardia lamblia
IRSLPTVHRFIVFLFSVI

SEQ ID NO: 3158528 - protein, 20 aa, Giardia lamblia
IRSLSSISLINCKLCADTSS

SEQ ID NO: 3158529 - protein, 25 aa, Giardia lamblia
IRSLVGSSCISFFRSRGLSVACFFD

SEQ ID NO: 3158530 - protein, 20 aa, Giardia lamblia
IRSPAGWTALMSAARHGYDD

SEQ ID NO: 3158531 - protein, 18 aa, Giardia lamblia
IRSPTEHTLRHILAADHV

SEQ ID NO: 3158532 - protein, 17 aa, Giardia lamblia
IRSREISPLDARGPHTA

SEQ ID NO: 3158533 - protein, 20 aa, Giardia lamblia
IRSSVLVSLCRHCEAFASMA

SEQ ID NO: 3158534 - protein, 17 aa, Giardia lamblia
IRTAETLSNVAASLQQT

SEQ ID NO: 3158535 - protein, 31 aa, Giardia lamblia
IRTAGECKNMFAPKLLRLALQHLTGQESDVP

SEQ ID NO: 3158536 - protein, 18 aa, Giardia lamblia
IRTGERLDLSSSMTEAIR

SEQ ID NO: 3158537 - protein, 35 aa, Giardia lamblia
IRTISLAHLRLDTSLSELLIFLGDADKFPMVKEIS

SEQ ID NO: 3158538 - protein, 20 aa, Giardia lamblia
IRTSSGRTALMLAAQNGSYE

SEQ ID NO: 3158539 - protein, 27 aa, Giardia lamblia
IRVGNEILVEMLLEFCEDTETQGTLSL

SEQ ID NO: 3158540 - protein, 19 aa, Giardia lamblia
IRVHPLPTWYDSTSLGELE

SEQ ID NO: 3158541 - protein, 17 aa, Giardia lamblia
IRVKLASAGFMKSSMLA

SEQ ID NO: 3158542 - protein, 17 aa, Giardia lamblia
IRVRAMQILTELFLCAL

SEQ ID NO: 3158543 - protein, 18 aa, Giardia lamblia
IRVSEEVILTAYYITVSS

SEQ ID NO: 3158544 - protein, 18 aa, Giardia lamblia
IRYFLQSSVQNFNALQAL

SEQ ID NO: 3158545 - protein, 27 aa, Giardia lamblia
IRYIKFFYLRRWKLSLRASREAIYLEK

SEQ ID NO: 3158546 - protein, 27 aa, Giardia lamblia
IRYLRAECARLYTPEEVNGERDIVNYP

SEQ ID NO: 3158547 - protein, 19 aa, Giardia lamblia
IRYPRRLVCNSIPSEQVDD

SEQ ID NO: 3158548 - protein, 20 aa, Giardia lamblia
IRYRRISKALLPVEGIYTFP

SEQ ID NO: 3158549 - protein, 18 aa, Giardia lamblia
IRYSLSLSSSNSFIQNSP

SEQ ID NO: 3158550 - protein, 25 aa, Giardia lamblia
IRYWSYFICGFFRYPYSAVPRFTSL

SEQ ID NO: 3158551 - protein, 21 aa, Giardia lamblia
IRYYRSWCTESTLNIAMEAGL

SEQ ID NO: 3158552 - protein, 19 aa, Giardia lamblia
ISAANAFIYRKAIAEYVTS

SEQ ID NO: 3158553 - protein, 18 aa, Giardia lamblia
ISAEFRDPSLCTFVGVCI

SEQ ID NO: 3158554 - protein, 20 aa, Giardia lamblia
ISAGVGLDLSKKVLDAKTTL

SEQ ID NO: 3158555 - protein, 19 aa, Giardia lamblia
ISAIILKDPSDFLALSDQM

SEQ ID NO: 3158556 - protein, 20 aa, Giardia lamblia
ISAKAVIFCLGSREKHRFNA

SEQ ID NO: 3158557 - protein, 20 aa, Giardia lamblia
ISALQRYTGEVGIANLKLKS

SEQ ID NO: 3158558 - protein, 32 aa, Giardia lamblia
ISANGFLSHCWKLYPNHKWELLPVQKNGPMSR

SEQ ID NO: 3158559 - protein, 24 aa, Giardia lamblia
ISAPCPAKLLTRDKQLVWVIDGTV

SEQ ID NO: 3158560 - protein, 20 aa, Giardia lamblia
ISARGLIKLCHDELKEIKRR

SEQ ID NO: 3158561 - protein, 20 aa, Giardia lamblia
ISARVRAECTKEHRIALEQA

SEQ ID NO: 3158562 - protein, 21 aa, Giardia lamblia
ISARYGVSADFLFDTLDGSGL

SEQ ID NO: 3158563 - protein, 20 aa, Giardia lamblia
ISAVPVKDGDSYIGYIDRFT

SEQ ID NO: 3158564 - protein, 17 aa, Giardia lamblia
ISCGSTVTGIRKINRLA

SEQ ID NO: 3158565 - protein, 22 aa, Giardia lamblia
ISCINALLVFSSRVWPEDMSKL

SEQ ID NO: 3158566 - protein, 21 aa, Giardia lamblia
ISCLTFPHSIDLAGTTSGFSF

SEQ ID NO: 3158567 - protein, 17 aa, Giardia lamblia
ISCNKHVPVFAVCYENG

SEQ ID NO: 3158568 - protein, 19 aa, Giardia lamblia
ISCRSDVFYSASITDDAIG

SEQ ID NO: 3158569 - protein, 23 aa, Giardia lamblia
ISCSTCKKDTISYSLTRSLQLPL

SEQ ID NO: 3158570 - protein, 18 aa, Giardia lamblia
ISDKIKLEKAKLLKQQQH

SEQ ID NO: 3158571 - protein, 23 aa, Giardia lamblia
ISDLHSFNALYSFIKRTIHTLAL

SEQ ID NO: 3158572 - protein, 34 aa, Giardia lamblia
ISDRRLLVRLQKTCTALYYWSPDLASVSWLAQFV

SEQ ID NO: 3158573 - protein, 19 aa, Giardia lamblia
ISDSIYPLSALTSMVMTFF

SEQ ID NO: 3158574 - protein, 26 aa, Giardia lamblia
ISDVELEACIPNPCKHDGYECEAFAD

SEQ ID NO: 3158575 - protein, 19 aa, Giardia lamblia
ISEDGFILAVISLVGHPPI

SEQ ID NO: 3158576 - protein, 27 aa, Giardia lamblia
ISEFICTACTRIAIRPVRLPCNHLACK

SEQ ID NO: 3158577 - protein, 20 aa, Giardia lamblia
ISEFKCRAFKDISISNIALI

SEQ ID NO: 3158578 - protein, 18 aa, Giardia lamblia
ISEFYKQHIRTVTEPLLQ

SEQ ID NO: 3158579 - protein, 25 aa, Giardia lamblia
ISEKLRLKRYFILFDQEQRTARIET

SEQ ID NO: 3158580 - protein, 27 aa, Giardia lamblia
ISELFKLSIHYKIKLAPGQSRNDAFEQ

SEQ ID NO: 3158581 - protein, 21 aa, Giardia lamblia
ISELQAAMVRHFTNELREQSK

SEQ ID NO: 3158582 - protein, 23 aa, Giardia lamblia
ISEPAKCLIIQLKRFRNEGHSVL

SEQ ID NO: 3158583 - protein, 19 aa, Giardia lamblia
ISESGVWLCCDEFNRIDAP

SEQ ID NO: 3158584 - protein, 22 aa, Giardia lamblia
ISESPASHLVYMAPEILRREKY

SEQ ID NO: 3158585 - protein, 23 aa, Giardia lamblia
ISETCPRNVFTIENRRVVVKDSN

SEQ ID NO: 3158586 - protein, 25 aa, Giardia lamblia
ISFLFKRPSIRDALRPANSTIVANI

SEQ ID NO: 3158587 - protein, 24 aa, Giardia lamblia
ISFMRCKYVYKFLHLPVQSGSDRI

SEQ ID NO: 3158588 - protein, 31 aa, Giardia lamblia
ISFPSMTELFLRNGYMVDILLILQLFPNLKC

SEQ ID NO: 3158589 - protein, 21 aa, Giardia lamblia
ISFSARLKKVPIQDVKHYGDP

SEQ ID NO: 3158590 - protein, 20 aa, Giardia lamblia
ISGCTMLMRCCFFNNHKEIP

SEQ ID NO: 3158591 - protein, 18 aa, Giardia lamblia
ISGGFLFVNPDCYAFNKV

SEQ ID NO: 3158592 - protein, 19 aa, Giardia lamblia
ISGHEIFKVATLHINKHNF

SEQ ID NO: 3158593 - protein, 25 aa, Giardia lamblia
ISGISRLVIHLSRDSPLFKIDPKSA

SEQ ID NO: 3158594 - protein, 26 aa, Giardia lamblia
ISGLIPPIVSRCFCIRVPGFSDEEIV

SEQ ID NO: 3158595 - protein, 19 aa, Giardia lamblia
ISGPLPPERCYLSPEVWAD

SEQ ID NO: 3158596 - protein, 24 aa, Giardia lamblia
ISGRTQGSGFAFLVLATHSDAVAL

SEQ ID NO: 3158597 - protein, 25 aa, Giardia lamblia
ISGTGSKAYIGWKLAIEQRQRARSA

SEQ ID NO: 3158598 - protein, 18 aa, Giardia lamblia
ISGVLAIHMANRWNHSEV

SEQ ID NO: 3158599 - protein, 22 aa, Giardia lamblia
ISHRTALALLFQFLAQNYSSTL

SEQ ID NO: 3158600 - protein, 26 aa, Giardia lamblia
ISIAFKSIQCLLCSGNEPRCTSESNS

SEQ ID NO: 3158601 - protein, 21 aa, Giardia lamblia
ISIGEKFLCVELDYGNIKHFN

SEQ ID NO: 3158602 - protein, 28 aa, Giardia lamblia
ISIIKELLKLEVLLLIASDNKVQMKDIM

SEQ ID NO: 3158603 - protein, 19 aa, Giardia lamblia
ISIKGQRDITCNTAGVSVT

SEQ ID NO: 3158604 - protein, 17 aa, Giardia lamblia
ISILEGKYFRWEGPPDS

SEQ ID NO: 3158605 - protein, 17 aa, Giardia lamblia
ISILVATSTLAWGLNLP

SEQ ID NO: 3158606 - protein, 21 aa, Giardia lamblia
ISIPCQLAALLELQEDHKKCD

SEQ ID NO: 3158607 - protein, 25 aa, Giardia lamblia
ISIRNEGHFPFLLYIEPLEQVIKRW

SEQ ID NO: 3158608 - protein, 17 aa, Giardia lamblia
ISISGGQVLGIYEPESH

SEQ ID NO: 3158609 - protein, 26 aa, Giardia lamblia
ISKALLPVEGIYTFPVPADGAKAQQK

SEQ ID NO: 3158610 - protein, 19 aa, Giardia lamblia
ISKDAKTALILAAQNKHWD

SEQ ID NO: 3158611 - protein, 21 aa, Giardia lamblia
ISKESLLFLVLARNMLGNVYP

SEQ ID NO: 3158612 - protein, 17 aa, Giardia lamblia
ISKEWELWNALPEWPLR

SEQ ID NO: 3158613 - protein, 21 aa, Giardia lamblia
ISKGASCTPCSSVQDLTTPLL

SEQ ID NO: 3158614 - protein, 23 aa, Giardia lamblia
ISKGESLFCRPCDFTRDMLSSQT

SEQ ID NO: 3158615 - protein, 19 aa, Giardia lamblia
ISKGSLFSKEQMVIHSLTL

SEQ ID NO: 3158616 - protein, 17 aa, Giardia lamblia
ISKHMLLERFENNRKAD

SEQ ID NO: 3158617 - protein, 24 aa, Giardia lamblia
ISKHRVVVRHMFFYPEDVKYFAPV

SEQ ID NO: 3158618 - protein, 19 aa, Giardia lamblia
ISKIWITMGTFNSERGKTK

SEQ ID NO: 3158619 - protein, 25 aa, Giardia lamblia
ISKLSRIRRKACIVFNPSDTKRIHE

SEQ ID NO: 3158620 - protein, 21 aa, Giardia lamblia
ISKPELLPMMPSAKSAPSIDQ

SEQ ID NO: 3158621 - protein, 18 aa, Giardia lamblia
ISKRALEIIMGYPQNVIA

SEQ ID NO: 3158622 - protein, 17 aa, Giardia lamblia
ISKSLMALFSSVRACAL

SEQ ID NO: 3158623 - protein, 21 aa, Giardia lamblia
ISKTCRDFAACCLDRDKTNRW

SEQ ID NO: 3158624 - protein, 18 aa, Giardia lamblia
ISLARLAHILLNVLASHS

SEQ ID NO: 3158625 - protein, 18 aa, Giardia lamblia
ISLEAMPTRAYLDETVVP

SEQ ID NO: 3158626 - protein, 21 aa, Giardia lamblia
ISLEEFCKYGGNVINKRAAQR

SEQ ID NO: 3158627 - protein, 26 aa, Giardia lamblia
ISLEESLCGFSYTFTHLNKEKVTIYV

SEQ ID NO: 3158628 - protein, 17 aa, Giardia lamblia
ISLETAAGPTFCITYLM

SEQ ID NO: 3158629 - protein, 17 aa, Giardia lamblia
ISLETAIRCGLEDHIDK

SEQ ID NO: 3158630 - protein, 31 aa, Giardia lamblia
ISLHSVKYFKYRSVCGSLNLFVYLSDTTLQA

SEQ ID NO: 3158631 - protein, 26 aa, Giardia lamblia
ISLKCDKGWSALMLAVKLRRYKIASL

SEQ ID NO: 3158632 - protein, 20 aa, Giardia lamblia
ISLKDRFFLLESFKVDVLAN

SEQ ID NO: 3158633 - protein, 17 aa, Giardia lamblia
ISLKKACQHPCNHALIS

SEQ ID NO: 3158634 - protein, 28 aa, Giardia lamblia
ISLLEIKGQAPAQGWNMKKATIARNYNK

SEQ ID NO: 3158635 - protein, 17 aa, Giardia lamblia
ISLLLIKFTAIYKASQS

SEQ ID NO: 3158636 - protein, 20 aa, Giardia lamblia
ISLVDPCYQLYLPTSQTLSM

SEQ ID NO: 3158637 - protein, 23 aa, Giardia lamblia
ISMEPASLIKHFSKEPSSSSKRS

SEQ ID NO: 3158638 - protein, 17 aa, Giardia lamblia
ISMLPTWTLPTLKDSLS

SEQ ID NO: 3158639 - protein, 24 aa, Giardia lamblia
ISMPDGRDAFMLASSRGNIEVMKV

SEQ ID NO: 3158640 - protein, 17 aa, Giardia lamblia
ISNAFGNFVYKNQFKYY

SEQ ID NO: 3158641 - protein, 30 aa, Giardia lamblia
ISNDIYRVMCGVPMLLLAYGVTSAGKTYTL

SEQ ID NO: 3158642 - protein, 17 aa, Giardia lamblia
ISNMGSTFISFVDETLH

SEQ ID NO: 3158643 - protein, 36 aa, Giardia lamblia
ISNMKLDYIFLLELFHAIECKSETKLPESEFLPAGN

SEQ ID NO: 3158644 - protein, 23 aa, Giardia lamblia
ISPDCLPTVVIDLQLPLDTVLSR

SEQ ID NO: 3158645 - protein, 17 aa, Giardia lamblia
ISPDIFAARMIQVLIAD

SEQ ID NO: 3158646 - protein, 24 aa, Giardia lamblia
ISPECADFLSCCFKIDPHERHSCA

SEQ ID NO: 3158647 - protein, 25 aa, Giardia lamblia
ISPGPEFFEDLLIKYFAKNVTIQQI

SEQ ID NO: 3158648 - protein, 25 aa, Giardia lamblia
ISPIWKGAVKGIASFMNSKKSLWIT

SEQ ID NO: 3158649 - protein, 24 aa, Giardia lamblia
ISPRHGECMIGLTQDFLTGIYLLS

SEQ ID NO: 3158650 - protein, 17 aa, Giardia lamblia
ISPRSKDTVRHRSKKGP

SEQ ID NO: 3158651 - protein, 18 aa, Giardia lamblia
ISPSITVNMISYFRNGLI

SEQ ID NO: 3158652 - protein, 17 aa, Giardia lamblia
ISPSPFACNTVRNSVAF

SEQ ID NO: 3158653 - protein, 21 aa, Giardia lamblia
ISQCLPCFTEISLLAAVQVNP

SEQ ID NO: 3158654 - protein, 17 aa, Giardia lamblia
ISQKCVQQAQLISSLQA

SEQ ID NO: 3158655 - protein, 19 aa, Giardia lamblia
ISQMIKLSAERPVISGKQL

SEQ ID NO: 3158656 - protein, 27 aa, Giardia lamblia
ISQSFAERILQVFPRIFIDELSGMEKL

SEQ ID NO: 3158657 - protein, 19 aa, Giardia lamblia
ISQYFGWKVDVREVPFTEV

SEQ ID NO: 3158658 - protein, 24 aa, Giardia lamblia
ISQYVMCPWYFSPLPEEFFASRTV

SEQ ID NO: 3158659 - protein, 20 aa, Giardia lamblia
ISRARLESLLSKPLKPLSKL

SEQ ID NO: 3158660 - protein, 21 aa, Giardia lamblia
ISRDSLFLDIIYNQVTRETLW

SEQ ID NO: 3158661 - protein, 21 aa, Giardia lamblia
ISRGIKRHFLKLMAGDVNPEQ

SEQ ID NO: 3158662 - protein, 25 aa, Giardia lamblia
ISRGLHFSVPFSFKLSKDNSSAFLP

SEQ ID NO: 3158663 - protein, 33 aa, Giardia lamblia
ISRKKRLRTLLSYKCMEEINLYYGGNDLQVPGV

SEQ ID NO: 3158664 - protein, 18 aa, Giardia lamblia
ISRQLLKWVLERPPSPAP

SEQ ID NO: 3158665 - protein, 22 aa, Giardia lamblia
ISRTECRYIIYGIGYGSALSAP

SEQ ID NO: 3158666 - protein, 23 aa, Giardia lamblia
ISSAGRLSTRITLVDSSCAFSTR

SEQ ID NO: 3158667 - protein, 21 aa, Giardia lamblia
ISSDLNFGILLQMHRMNLDAV

SEQ ID NO: 3158668 - protein, 24 aa, Giardia lamblia
ISSIKRKLDNIAITFINCSFGPIK

SEQ ID NO: 3158669 - protein, 20 aa, Giardia lamblia
ISSILPRPSVFGYSLEFYDK

SEQ ID NO: 3158670 - protein, 18 aa, Giardia lamblia
ISSNLLNLQCDLIKSKGE

SEQ ID NO: 3158671 - protein, 18 aa, Giardia lamblia
ISSRGWTALMYAASANHA

SEQ ID NO: 3158672 - protein, 24 aa, Giardia lamblia
ISSRSGDILITFLIDPLLFIEKEL

SEQ ID NO: 3158673 - protein, 26 aa, Giardia lamblia
ISSVKSLRPLSIFIWQINVYHKHRHP

SEQ ID NO: 3158674 - protein, 25 aa, Giardia lamblia
ISTCHECSYSTPTFATRRLRDEEDR

SEQ ID NO: 3158675 - protein, 25 aa, Giardia lamblia
ISTDQGKCTLTFAAFNPEIVRSRAQ

SEQ ID NO: 3158676 - protein, 28 aa, Giardia lamblia
ISTEMRQSLRLARRIGLELKHHNIIHAM

SEQ ID NO: 3158677 - protein, 25 aa, Giardia lamblia
ISTESRRPLPKCYSEKLTSVIDLML

SEQ ID NO: 3158678 - protein, 25 aa, Giardia lamblia
ISTHLRTGFRPCSLTDRLKLPIESS

SEQ ID NO: 3158679 - protein, 18 aa, Giardia lamblia
ISTICVDYGILIDFTQVN

SEQ ID NO: 3158680 - protein, 26 aa, Giardia lamblia
ISTIQLLKLGRYFFENGFTVLSSTSD

SEQ ID NO: 3158681 - protein, 19 aa, Giardia lamblia
ISTIRCRGGNIKRRALRLS

SEQ ID NO: 3158682 - protein, 25 aa, Giardia lamblia
ISTLRRFLLDLADPYFSTYLLTDKT

SEQ ID NO: 3158683 - protein, 19 aa, Giardia lamblia
ISTRLPDSLRRSTSTHVSL

SEQ ID NO: 3158684 - protein, 24 aa, Giardia lamblia
ISTRVLACALSIHGDSGGLVLPPL

SEQ ID NO: 3158685 - protein, 28 aa, Giardia lamblia
ISTRVRHGYPLKGLIVLATGLGKTYLSI

SEQ ID NO: 3158686 - protein, 27 aa, Giardia lamblia
ISTSFLREIYSLSALTLRLADSLSDCL

SEQ ID NO: 3158687 - protein, 19 aa, Giardia lamblia
ISTSRKGSVGRRNEPGRSN

SEQ ID NO: 3158688 - protein, 19 aa, Giardia lamblia
ISTTFGWTDLMYAAATNDV

SEQ ID NO: 3158689 - protein, 24 aa, Giardia lamblia
ISTVAWCYVELFTADDQLAGLPCG

SEQ ID NO: 3158690 - protein, 18 aa, Giardia lamblia
ISVFYYRLKLTCQTVAEE

SEQ ID NO: 3158691 - protein, 19 aa, Giardia lamblia
ISVKKEELVGVMAKIDALG

SEQ ID NO: 3158692 - protein, 19 aa, Giardia lamblia
ISVLGRYIAGLEMGNGQAA

SEQ ID NO: 3158693 - protein, 31 aa, Giardia lamblia
ISVPTVAVPLKLSAFFPSLEFRSCSLATLKE

SEQ ID NO: 3158694 - protein, 25 aa, Giardia lamblia
ISVRLRLTPITKFLAAKESGIIDLQ

SEQ ID NO: 3158695 - protein, 20 aa, Giardia lamblia
ISVSTPAVFNVHCAATEPNV

SEQ ID NO: 3158696 - protein, 22 aa, Giardia lamblia
ISVTRSAIYMDLLYTRQETALL

SEQ ID NO: 3158697 - protein, 17 aa, Giardia lamblia
ISVWCLASMQASLQDEN

SEQ ID NO: 3158698 - protein, 18 aa, Giardia lamblia
ISVYNFYVLYNLELLFNY

SEQ ID NO: 3158699 - protein, 18 aa, Giardia lamblia
ISWCLTTTIDFLRMYERD

SEQ ID NO: 3158700 - protein, 18 aa, Giardia lamblia
ISYHEFFGYYSFSDWIDG

SEQ ID NO: 3158701 - protein, 26 aa, Giardia lamblia
ISYKNTCYRYSVNVCDVRQGGIRRLE

SEQ ID NO: 3158702 - protein, 21 aa, Giardia lamblia
ISYLAPHEVRETNIFGWNALM

SEQ ID NO: 3158703 - protein, 23 aa, Giardia lamblia
ISYPICLQESIPPNSETDEDMYF

SEQ ID NO: 3158704 - protein, 32 aa, Giardia lamblia
ITADGPWSFIFFPLAHRIECHGLAMVRDTFSV

SEQ ID NO: 3158705 - protein, 22 aa, Giardia lamblia
ITAELPPIVVKGSLEEANDKSA

SEQ ID NO: 3158706 - protein, 26 aa, Giardia lamblia
ITAKCALLVMRILRLSFWSKSSQLLG

SEQ ID NO: 3158707 - protein, 18 aa, Giardia lamblia
ITALEDYEAPPLPDVPTD

SEQ ID NO: 3158708 - protein, 17 aa, Giardia lamblia
ITALMLAAQRGHIGCVE

SEQ ID NO: 3158709 - protein, 19 aa, Giardia lamblia
ITANIKFKLTLDYHSLQLS

SEQ ID NO: 3158710 - protein, 20 aa, Giardia lamblia
ITAPMVACIIANPRCVLQEL

SEQ ID NO: 3158711 - protein, 18 aa, Giardia lamblia
ITAYDCLEKLIGQVEARL

SEQ ID NO: 3158712 - protein, 18 aa, Giardia lamblia
ITCASSFIKDGTFPGMDE

SEQ ID NO: 3158713 - protein, 17 aa, Giardia lamblia
ITCEEIEPLLLTLSKQS

SEQ ID NO: 3158714 - protein, 20 aa, Giardia lamblia
ITCLKLLQDDMIMVGSSFGR

SEQ ID NO: 3158715 - protein, 18 aa, Giardia lamblia
ITDELCKKISSRRGSSVR

SEQ ID NO: 3158716 - protein, 28 aa, Giardia lamblia
ITDELLPPSFRPMRREGTKSFLERQKMI

SEQ ID NO: 3158717 - protein, 24 aa, Giardia lamblia
ITDKVAAYCKMLSTELPRKLKSKI

SEQ ID NO: 3158718 - protein, 25 aa, Giardia lamblia
ITDLKRWRFEGKINREVSISYLAHK

SEQ ID NO: 3158719 - protein, 24 aa, Giardia lamblia
ITDLWKLLLALILSSAFEKSPSEQ

SEQ ID NO: 3158720 - protein, 17 aa, Giardia lamblia
ITDRYNKTLGRLLIEHM

SEQ ID NO: 3158721 - protein, 17 aa, Giardia lamblia
ITEAGLGALRAERGEIH

SEQ ID NO: 3158722 - protein, 25 aa, Giardia lamblia
ITEFLKRTKEIINMLKRQQRQQGLY

SEQ ID NO: 3158723 - protein, 17 aa, Giardia lamblia
ITEIDCKDCEIDALKKQ

SEQ ID NO: 3158724 - protein, 27 aa, Giardia lamblia
ITEPCRLCQLIYIGVRTRFQLLKLGRK

SEQ ID NO: 3158725 - protein, 25 aa, Giardia lamblia
ITEPLLPLQQAWLVIPGQRKSPADS

SEQ ID NO: 3158726 - protein, 21 aa, Giardia lamblia
ITERPIRSMIDTSALSGLRLT

SEQ ID NO: 3158727 - protein, 19 aa, Giardia lamblia
ITETSRLLISFTKVKDLTD

SEQ ID NO: 3158728 - protein, 31 aa, Giardia lamblia
ITFQFPSLLEIIPLFPASTILYFITEEPQSA

SEQ ID NO: 3158729 - protein, 19 aa, Giardia lamblia
ITGDACARTTAFHEEPCFT

SEQ ID NO: 3158730 - protein, 19 aa, Giardia lamblia
ITGDEKWLLATAQTILLVY

SEQ ID NO: 3158731 - protein, 25 aa, Giardia lamblia
ITGELPRTSCLTLGQAIQQLYIQQA

SEQ ID NO: 3158732 - protein, 24 aa, Giardia lamblia
ITGGCGFIGSHFVEACHVLGMTVY

SEQ ID NO: 3158733 - protein, 19 aa, Giardia lamblia
ITGIQAEKVFPLRNYKESG

SEQ ID NO: 3158734 - protein, 18 aa, Giardia lamblia
ITGKSVEIFKEILTGVFG

SEQ ID NO: 3158735 - protein, 19 aa, Giardia lamblia
ITHFYSHPSYFARILEASA

SEQ ID NO: 3158736 - protein, 25 aa, Giardia lamblia
ITHGYCPYGRRCNFLHQSPDGLVCD

SEQ ID NO: 3158737 - protein, 21 aa, Giardia lamblia
ITICLNTAIICGSEFDKELTK

SEQ ID NO: 3158738 - protein, 18 aa, Giardia lamblia
ITICSQVYAKLCDYVVNL

SEQ ID NO: 3158739 - protein, 25 aa, Giardia lamblia
ITINDCLMCSGCVTSAEEVFFRELN

SEQ ID NO: 3158740 - protein, 24 aa, Giardia lamblia
ITIQCGQCGNQIGEVFWNRLCTEH

SEQ ID NO: 3158741 - protein, 24 aa, Giardia lamblia
ITIRSVLFAYELAKTAVRKDALSR

SEQ ID NO: 3158742 - protein, 21 aa, Giardia lamblia
ITKGTCLPNNIIQSPELNIDT

SEQ ID NO: 3158743 - protein, 28 aa, Giardia lamblia
ITLFLHPRYHKVAGLERFLGGLTLLRLI

SEQ ID NO: 3158744 - protein, 23 aa, Giardia lamblia
ITLNLRYGFNHMLYQKSMIAVQR

SEQ ID NO: 3158745 - protein, 24 aa, Giardia lamblia
ITLPDGRNALMLAAEAGCVESLTI

SEQ ID NO: 3158746 - protein, 17 aa, Giardia lamblia
ITLRRSRLLSILCECIA

SEQ ID NO: 3158747 - protein, 17 aa, Giardia lamblia
ITMYRVIGHLLAVSLIK

SEQ ID NO: 3158748 - protein, 23 aa, Giardia lamblia
ITNFRGQNALSFAKTSEARELLS

SEQ ID NO: 3158749 - protein, 20 aa, Giardia lamblia
ITNLPGPESNYFLTVENDEL

SEQ ID NO: 3158750 - protein, 17 aa, Giardia lamblia
ITNRMQRHLNFLVFPEM

SEQ ID NO: 3158751 - protein, 19 aa, Giardia lamblia
ITPLPGFLPTSAESIRLAL

SEQ ID NO: 3158752 - protein, 21 aa, Giardia lamblia
ITPNMVFSVMAADTFYRNTPI

SEQ ID NO: 3158753 - protein, 20 aa, Giardia lamblia
ITPQCLKKVMAEKLGEIVSR

SEQ ID NO: 3158754 - protein, 23 aa, Giardia lamblia
ITPQMSSSGLLIPPELQTLHVEL

SEQ ID NO: 3158755 - protein, 17 aa, Giardia lamblia
ITPRSGHSVVVQTDLSL

SEQ ID NO: 3158756 - protein, 18 aa, Giardia lamblia
ITPSKWGTIGLLTGGTSG

SEQ ID NO: 3158757 - protein, 22 aa, Giardia lamblia
ITPVGTCLCMGTEFSVFNTHDL

SEQ ID NO: 3158758 - protein, 17 aa, Giardia lamblia
ITQFFKLNIFDILFDNT

SEQ ID NO: 3158759 - protein, 17 aa, Giardia lamblia
ITQGAIFKEMKKRYPNF

SEQ ID NO: 3158760 - protein, 18 aa, Giardia lamblia
ITQTKKVIVYKVFTGGTI

SEQ ID NO: 3158761 - protein, 24 aa, Giardia lamblia
ITRFPNCPTSLVIQGDSILIPITY

SEQ ID NO: 3158762 - protein, 18 aa, Giardia lamblia
ITRLPSSVFTKFKTILDA

SEQ ID NO: 3158763 - protein, 23 aa, Giardia lamblia
ITRLTALGRLEWANEVQNLAALG

SEQ ID NO: 3158764 - protein, 20 aa, Giardia lamblia
ITRNISYLANVHFVLWELSK

SEQ ID NO: 3158765 - protein, 25 aa, Giardia lamblia
ITRSYYRGSCCALLVYDITRRASFE

SEQ ID NO: 3158766 - protein, 17 aa, Giardia lamblia
ITRVMKIQALEVPQYSN

SEQ ID NO: 3158767 - protein, 25 aa, Giardia lamblia
ITRYNIRKLMIVLSYERPATENGTD

SEQ ID NO: 3158768 - protein, 19 aa, Giardia lamblia
ITSAVIRRHEGVLAELDAS

SEQ ID NO: 3158769 - protein, 18 aa, Giardia lamblia
ITSCKLDKSGELAVVTSH

SEQ ID NO: 3158770 - protein, 18 aa, Giardia lamblia
ITSIIEPTIRQLIGSREA

SEQ ID NO: 3158771 - protein, 23 aa, Giardia lamblia
ITSKFSTTRLSTFETKTFDPDDP

SEQ ID NO: 3158772 - protein, 22 aa, Giardia lamblia
ITSLEALKCLTYIKQLETIVLT

SEQ ID NO: 3158773 - protein, 25 aa, Giardia lamblia
ITSPAGIFYYKFIRDSSISTKKQDS

SEQ ID NO: 3158774 - protein, 26 aa, Giardia lamblia
ITSPQVPRCLSPTLAYSGMHPLDNSM

SEQ ID NO: 3158775 - protein, 20 aa, Giardia lamblia
ITSRERLAFATSDPKIQELY

SEQ ID NO: 3158776 - protein, 18 aa, Giardia lamblia
ITSSIGVREMALKPIQSI

SEQ ID NO: 3158777 - protein, 18 aa, Giardia lamblia
ITSTGALKIYVRVVNPSA

SEQ ID NO: 3158778 - protein, 24 aa, Giardia lamblia
ITTIRILLESGKMPQSHVRDALTA

SEQ ID NO: 3158779 - protein, 19 aa, Giardia lamblia
ITTIVKFYQKVFVIRSKQR

SEQ ID NO: 3158780 - protein, 27 aa, Giardia lamblia
ITTLKLKMRRPLMFLPADSLRITDQAT

SEQ ID NO: 3158781 - protein, 18 aa, Giardia lamblia
ITTSHAFNQLQSGDKGVS

SEQ ID NO: 3158782 - protein, 23 aa, Giardia lamblia
ITTTGLFRRGHVGQKLSSSCSED

SEQ ID NO: 3158783 - protein, 18 aa, Giardia lamblia
ITTVFDMEGSSIRGTPRS

SEQ ID NO: 3158784 - protein, 22 aa, Giardia lamblia
ITVPAEPILPIASQSTQTPGRL

SEQ ID NO: 3158785 - protein, 31 aa, Giardia lamblia
ITVPFVKCIYMFKKELKARRLTTIPRCDQPG

SEQ ID NO: 3158786 - protein, 25 aa, Giardia lamblia
ITVSGFREAIRFGILSEKEEESRYY

SEQ ID NO: 3158787 - protein, 20 aa, Giardia lamblia
ITVTTAIRLLFVDSMLSSTD

SEQ ID NO: 3158788 - protein, 18 aa, Giardia lamblia
ITYSRLKGQAALIQQSQL

SEQ ID NO: 3158789 - protein, 17 aa, Giardia lamblia
IVADPMLVDQVAADPSV

SEQ ID NO: 3158790 - protein, 18 aa, Giardia lamblia
IVALSAMVAVAGLQRSCA

SEQ ID NO: 3158791 - protein, 27 aa, Giardia lamblia
IVANGEWRGMTALMFAARNGNHGIVSL

SEQ ID NO: 3158792 - protein, 19 aa, Giardia lamblia
IVARLAVELQESYDIQLCC

SEQ ID NO: 3158793 - protein, 20 aa, Giardia lamblia
IVCEQCFIASQLRTCPLCRS

SEQ ID NO: 3158794 - protein, 23 aa, Giardia lamblia
IVCLPCEHICHFASLAQLEASKK

SEQ ID NO: 3158795 - protein, 17 aa, Giardia lamblia
IVDASGIVVTRQNWLLV

SEQ ID NO: 3158796 - protein, 17 aa, Giardia lamblia
IVDDSFFDYVFDLSNNL

SEQ ID NO: 3158797 - protein, 31 aa, Giardia lamblia
IVDEVHHIIAPKYCSSISLLTSHPKLRLLVG

SEQ ID NO: 3158798 - protein, 20 aa, Giardia lamblia
IVDNEGWTALMLAAQRGNIH

SEQ ID NO: 3158799 - protein, 18 aa, Giardia lamblia
IVDRLVIDFLNNHDINTI

SEQ ID NO: 3158800 - protein, 17 aa, Giardia lamblia
IVDSGSTMMIWGDRSPS

SEQ ID NO: 3158801 - protein, 21 aa, Giardia lamblia
IVDSIPTLPAFIGDDEADKWE

SEQ ID NO: 3158802 - protein, 23 aa, Giardia lamblia
IVDSRGWSALAYAISKEHTDIVK

SEQ ID NO: 3158803 - protein, 25 aa, Giardia lamblia
IVEAAKAKLAKWCEEAIATGSFGTT

SEQ ID NO: 3158804 - protein, 17 aa, Giardia lamblia
IVEALAVHEARHTDSNG

SEQ ID NO: 3158805 - protein, 18 aa, Giardia lamblia
IVEARWPLNDLLVNLDSR

SEQ ID NO: 3158806 - protein, 18 aa, Giardia lamblia
IVEGPIFPPPTVQDGGLG

SEQ ID NO: 3158807 - protein, 19 aa, Giardia lamblia
IVEHERFVAAHSIQSANDG

SEQ ID NO: 3158808 - protein, 18 aa, Giardia lamblia
IVELRPAPVSAVATLSNS

SEQ ID NO: 3158809 - protein, 32 aa, Giardia lamblia
IVEPSRMVIPGFGFPPSARGQPKIIPEDPASD

SEQ ID NO: 3158810 - protein, 30 aa, Giardia lamblia
IVERLHGILKPFLLRRVKTEVLAQLPPKEE

SEQ ID NO: 3158811 - protein, 18 aa, Giardia lamblia
IVERRGRTLINDLLLDPV

SEQ ID NO: 3158812 - protein, 29 aa, Giardia lamblia
IVETIEIVQSIYILPGLRNNKLTTWSTAC

SEQ ID NO: 3158813 - protein, 26 aa, Giardia lamblia
IVEVFNWDICDGLGDIPIWVEAAGVS

SEQ ID NO: 3158814 - protein, 25 aa, Giardia lamblia
IVEVLRPHLDFDLSEPYVVVADVDI

SEQ ID NO: 3158815 - protein, 22 aa, Giardia lamblia
IVFSDCKGYVVVIGDTTRPFVL

SEQ ID NO: 3158816 - protein, 18 aa, Giardia lamblia
IVFYLPRGHIQLLMTLVW

SEQ ID NO: 3158817 - protein, 18 aa, Giardia lamblia
IVGFSLGQRSLVFSFPTL

SEQ ID NO: 3158818 - protein, 18 aa, Giardia lamblia
IVGPRLSILRPPRTFYLE

SEQ ID NO: 3158819 - protein, 23 aa, Giardia lamblia
IVGTPEYLAPEIIRSTGHDMSAD

SEQ ID NO: 3158820 - protein, 21 aa, Giardia lamblia
IVGVACCDVALFVARQDERVQ

SEQ ID NO: 3158821 - protein, 20 aa, Giardia lamblia
IVHPAARCLVDIAKSQDSEI

SEQ ID NO: 3158822 - protein, 21 aa, Giardia lamblia
IVHPYMLRVMEIIYDQEVQKV

SEQ ID NO: 3158823 - protein, 18 aa, Giardia lamblia
IVIAESFGNNAIADALRD

SEQ ID NO: 3158824 - protein, 25 aa, Giardia lamblia
IVIANASGVFTIWDRRSHLRCVYSS

SEQ ID NO: 3158825 - protein, 17 aa, Giardia lamblia
IVIDLGLSRVSRYYPAL

SEQ ID NO: 3158826 - protein, 39 aa, Giardia lamblia
IVIKGAHLCANWLSVLPSWLMESSVSFKLKYNEELLSHV

SEQ ID NO: 3158827 - protein, 20 aa, Giardia lamblia
IVKHNRLLSRTDYYTPEVAA

SEQ ID NO: 3158828 - protein, 21 aa, Giardia lamblia
IVKLLCPFEEKIITDKGVTAL

SEQ ID NO: 3158829 - protein, 20 aa, Giardia lamblia
IVKVWSFWERFRLNKNKLFL

SEQ ID NO: 3158830 - protein, 27 aa, Giardia lamblia
IVKYRGCFLEQNYLYIILELVDFGSLQ

SEQ ID NO: 3158831 - protein, 19 aa, Giardia lamblia
IVLCDFLYNEAMLEMIYAS

SEQ ID NO: 3158832 - protein, 18 aa, Giardia lamblia
IVLHLGYSCTTAYPLFYS

SEQ ID NO: 3158833 - protein, 18 aa, Giardia lamblia
IVLQSGIIQSMFMLFLSN

SEQ ID NO: 3158834 - protein, 26 aa, Giardia lamblia
IVLVLSWLAKMRKLHGERPISELVAE

SEQ ID NO: 3158835 - protein, 26 aa, Giardia lamblia
IVMECPRGGSLRAHFDESIAILREYE

SEQ ID NO: 3158836 - protein, 17 aa, Giardia lamblia
IVMPRRSVPLSLNVKYE

SEQ ID NO: 3158837 - protein, 18 aa, Giardia lamblia
IVPFFKFYKGVGRHSQAR

SEQ ID NO: 3158838 - protein, 17 aa, Giardia lamblia
IVPLHGLPNITQLLSQV

SEQ ID NO: 3158839 - protein, 19 aa, Giardia lamblia
IVPLRCWNPACLSFNTAPI

SEQ ID NO: 3158840 - protein, 17 aa, Giardia lamblia
IVPPDWYDVDRVRIPYT

SEQ ID NO: 3158841 - protein, 26 aa, Giardia lamblia
IVPPRVSPSLVIPIQYSLALRTLMHD

SEQ ID NO: 3158842 - protein, 17 aa, Giardia lamblia
IVPRPGRMVELECETEE

SEQ ID NO: 3158843 - protein, 17 aa, Giardia lamblia
IVPRYPVVARWRDDCEF

SEQ ID NO: 3158844 - protein, 18 aa, Giardia lamblia
IVPVIPQLILPIKQALDT

SEQ ID NO: 3158845 - protein, 23 aa, Giardia lamblia
IVQLQAGLYYNIFVVLRQGAQAD

SEQ ID NO: 3158846 - protein, 31 aa, Giardia lamblia
IVQRWLSGRTLCVCATIAFGMGINKPNVRLV

SEQ ID NO: 3158847 - protein, 23 aa, Giardia lamblia
IVQYRINLIEWQRKDAIAQTKDY

SEQ ID NO: 3158848 - protein, 25 aa, Giardia lamblia
IVRALELYAKFQFKVIPVVNAEGSF

SEQ ID NO: 3158849 - protein, 23 aa, Giardia lamblia
IVRGDHSLEELIVLKRNIASLTQ

SEQ ID NO: 3158850 - protein, 29 aa, Giardia lamblia
IVRILAPRELCQFKMIQSYCGVVQDITDG

SEQ ID NO: 3158851 - protein, 24 aa, Giardia lamblia
IVRNICMLELLISEDERNNCLMRH

SEQ ID NO: 3158852 - protein, 18 aa, Giardia lamblia
IVRNSSALPQHVALLTKP

SEQ ID NO: 3158853 - protein, 18 aa, Giardia lamblia
IVRRAEVTLGKTIDQALS

SEQ ID NO: 3158854 - protein, 22 aa, Giardia lamblia
IVRVYCFRHVQGGLRDMSGCTA

SEQ ID NO: 3158855 - protein, 34 aa, Giardia lamblia
IVSCSVDGMILISRIRYPGLPFMTKPVPRSSLGL

SEQ ID NO: 3158856 - protein, 18 aa, Giardia lamblia
IVSFLLARIAELQSTHQI

SEQ ID NO: 3158857 - protein, 17 aa, Giardia lamblia
IVSLVSFSKFPSVEGAL

SEQ ID NO: 3158858 - protein, 21 aa, Giardia lamblia
IVSMPEFQSAVQIMTESCVEE

SEQ ID NO: 3158859 - protein, 24 aa, Giardia lamblia
IVSPEIYTSPALTSCKLVSEDIYR

SEQ ID NO: 3158860 - protein, 24 aa, Giardia lamblia
IVSQMYRYLYRYADADGSDPYTIL

SEQ ID NO: 3158861 - protein, 23 aa, Giardia lamblia
IVSQRLLTTFYWHRRSPEAFRCL

SEQ ID NO: 3158862 - protein, 18 aa, Giardia lamblia
IVSRCARFAFSSLPRPLI

SEQ ID NO: 3158863 - protein, 29 aa, Giardia lamblia
IVSSRFWPGCIYYVFARTLIWGSAYEGTG

SEQ ID NO: 3158864 - protein, 18 aa, Giardia lamblia
IVSTGVERCPTMAPAPKI

SEQ ID NO: 3158865 - protein, 19 aa, Giardia lamblia
IVTCYLLISLQGRLVDESG

SEQ ID NO: 3158866 - protein, 26 aa, Giardia lamblia
IVTEESRPRLAIAVRQLADLQIISVE

SEQ ID NO: 3158867 - protein, 17 aa, Giardia lamblia
IVTKMFRDNGIVPPVNI

SEQ ID NO: 3158868 - protein, 20 aa, Giardia lamblia
IVTNSAYRTVFWLWEEQLVD

SEQ ID NO: 3158869 - protein, 44 aa, Giardia lamblia
IVTPLEFRVSLEVWPRFQKLYSNWLPKCFTKLYLLKLKPYEKAL

SEQ ID NO: 3158870 - protein, 24 aa, Giardia lamblia
IVTVSRKGFLNVWAPGAGHEDEEH

SEQ ID NO: 3158871 - protein, 25 aa, Giardia lamblia
IVTWRKVIKDDKCICIVMDRYDCSL

SEQ ID NO: 3158872 - protein, 24 aa, Giardia lamblia
IVVCSSCFTTIVPSLYLKAHRDTN

SEQ ID NO: 3158873 - protein, 22 aa, Giardia lamblia
IVVLKKRLSEMSKKLIDQLNTL

SEQ ID NO: 3158874 - protein, 17 aa, Giardia lamblia
IVVLRLVSHPNIVKLKE

SEQ ID NO: 3158875 - protein, 24 aa, Giardia lamblia
IVVPISTLSAWQMALSDWCPNMTV

SEQ ID NO: 3158876 - protein, 18 aa, Giardia lamblia
IVVPRLSSFHGSKLVTVA

SEQ ID NO: 3158877 - protein, 18 aa, Giardia lamblia
IVVRRLMSIGTRPDYLPL

SEQ ID NO: 3158878 - protein, 17 aa, Giardia lamblia
IVVVHLPQGTSFLTSLN

SEQ ID NO: 3158879 - protein, 29 aa, Giardia lamblia
IVWSAIRPCVFVLAFNKREHIVFTVTLKE

SEQ ID NO: 3158880 - protein, 17 aa, Giardia lamblia
IVYATSEFKGVFEQGCA

SEQ ID NO: 3158881 - protein, 30 aa, Giardia lamblia
IVYCLPDPARSALLSEVLRLRVIGDYLRQE

SEQ ID NO: 3158882 - protein, 21 aa, Giardia lamblia
IVYEFTRLSDFYRLTDGTSGY

SEQ ID NO: 3158883 - protein, 17 aa, Giardia lamblia
IVYKILKVHTAFPGEKL

SEQ ID NO: 3158884 - protein, 20 aa, Giardia lamblia
IVYLRRAVRFLAGKLKLGVI

SEQ ID NO: 3158885 - protein, 21 aa, Giardia lamblia
IWALGCYLYELIFKKRPFTTG

SEQ ID NO: 3158886 - protein, 25 aa, Giardia lamblia
IWAVGICLYELIFGHPPHHKLSPTK

SEQ ID NO: 3158887 - protein, 18 aa, Giardia lamblia
IWDELRLFESVDTRLLRR

SEQ ID NO: 3158888 - protein, 18 aa, Giardia lamblia
IWDVCRPDDPFASLPHIH

SEQ ID NO: 3158889 - protein, 23 aa, Giardia lamblia
IWEHGVFRLKVTFTNNYPAEPPA

SEQ ID NO: 3158890 - protein, 20 aa, Giardia lamblia
IWHRAESKYKTLLFNAESDL

SEQ ID NO: 3158891 - protein, 27 aa, Giardia lamblia
IWIITPNCRYRIFTIGLPVENIGHNTI

SEQ ID NO: 3158892 - protein, 18 aa, Giardia lamblia
IWIVPAINAEGIRCGHYR

SEQ ID NO: 3158893 - protein, 17 aa, Giardia lamblia
IWMIGAILYELLTLQQL

SEQ ID NO: 3158894 - protein, 20 aa, Giardia lamblia
IWNLGLLLFNCLAREHFFKN

SEQ ID NO: 3158895 - protein, 21 aa, Giardia lamblia
IWPALAEAWLRGTRSERYNPA

SEQ ID NO: 3158896 - protein, 23 aa, Giardia lamblia
IWQRNNFLLVPSFYGDERDKVLY

SEQ ID NO: 3158897 - protein, 21 aa, Giardia lamblia
IWSIACIWAEMLMKTPLFPGD

SEQ ID NO: 3158898 - protein, 28 aa, Giardia lamblia
IWSLGCFMYEFYLGVPYIQGTCLSEILH

SEQ ID NO: 3158899 - protein, 17 aa, Giardia lamblia
IWSLGVILYELVTGTRP

SEQ ID NO: 3158900 - protein, 18 aa, Giardia lamblia
IWTCRSCSKTMAGGAYSL

SEQ ID NO: 3158901 - protein, 20 aa, Giardia lamblia
IWTSEFSRDMSFFATAGQNG

SEQ ID NO: 3158902 - protein, 24 aa, Giardia lamblia
IYADSRLSVDIQRTIVPEASNGYI

SEQ ID NO: 3158903 - protein, 23 aa, Giardia lamblia
IYAEFPASHYAMYVDLDEAGNLE

SEQ ID NO: 3158904 - protein, 17 aa, Giardia lamblia
IYAQYGILKEFLADCKY

SEQ ID NO: 3158905 - protein, 19 aa, Giardia lamblia
IYASGFFGAFRLIDMCVGP

SEQ ID NO: 3158906 - protein, 18 aa, Giardia lamblia
IYCDLSDIEWRWLYRHGI

SEQ ID NO: 3158907 - protein, 28 aa, Giardia lamblia
IYCISFCLCPQYPLLAAGLDNGACLILS

SEQ ID NO: 3158908 - protein, 20 aa, Giardia lamblia
IYCPLDVYYAILARNTLYNM

SEQ ID NO: 3158909 - protein, 18 aa, Giardia lamblia
IYCYLLLTREYICLASRD

SEQ ID NO: 3158910 - protein, 18 aa, Giardia lamblia
IYDAAVLEIDDSVMEAKW

SEQ ID NO: 3158911 - protein, 17 aa, Giardia lamblia
IYEEFPVIASPDYFIER

SEQ ID NO: 3158912 - protein, 17 aa, Giardia lamblia
IYELCCVEYAYSSINEK

SEQ ID NO: 3158913 - protein, 23 aa, Giardia lamblia
IYELIEYIFRESGCENIGGISAI

SEQ ID NO: 3158914 - protein, 24 aa, Giardia lamblia
IYEPEEFPFLSARKLLYALNAEGE

SEQ ID NO: 3158915 - protein, 29 aa, Giardia lamblia
IYESLDLAWKCLRVLPINLLSRISDSILE

SEQ ID NO: 3158916 - protein, 18 aa, Giardia lamblia
IYETIFQIQWRLRSADDK

SEQ ID NO: 3158917 - protein, 25 aa, Giardia lamblia
IYFHLRFNNEKCVVRFHGLLLDDTY

SEQ ID NO: 3158918 - protein, 19 aa, Giardia lamblia
IYFIRSCKSNVSDYWVREM

SEQ ID NO: 3158919 - protein, 19 aa, Giardia lamblia
IYIDGFLKPWDICAFMGIA

SEQ ID NO: 3158920 - protein, 19 aa, Giardia lamblia
IYIQNMLRLSSAVILDNDT

SEQ ID NO: 3158921 - protein, 25 aa, Giardia lamblia
IYKAYPRPSTVAGYGSGQLTAQGSL

SEQ ID NO: 3158922 - protein, 23 aa, Giardia lamblia
IYKELSDDFRIYPGHNHDVTLGE

SEQ ID NO: 3158923 - protein, 22 aa, Giardia lamblia
IYKERCLVTVPELELIRYQEKL

SEQ ID NO: 3158924 - protein, 19 aa, Giardia lamblia
IYKLCKQILEALKELYKVL

SEQ ID NO: 3158925 - protein, 26 aa, Giardia lamblia
IYLDHRRYEIVVAIRGSYSLADMVTD

SEQ ID NO: 3158926 - protein, 23 aa, Giardia lamblia
IYLEQVYDLLAFEAGETGPQVKS

SEQ ID NO: 3158927 - protein, 18 aa, Giardia lamblia
IYLIDLAKTYGLSEDKIK

SEQ ID NO: 3158928 - protein, 18 aa, Giardia lamblia
IYLIQTVKYKVCLNEDTA

SEQ ID NO: 3158929 - protein, 19 aa, Giardia lamblia
IYLNLRVVIAGKWKGTKQH

SEQ ID NO: 3158930 - protein, 20 aa, Giardia lamblia
IYLPDEYKGWSLTEPLPQNI

SEQ ID NO: 3158931 - protein, 17 aa, Giardia lamblia
IYLRCVCNHPFTALEHD

SEQ ID NO: 3158932 - protein, 24 aa, Giardia lamblia
IYLRDYMKFQFLHFFEEVDASETI

SEQ ID NO: 3158933 - protein, 19 aa, Giardia lamblia
IYLRLSRTNLMIRYFNGNI

SEQ ID NO: 3158934 - protein, 27 aa, Giardia lamblia
IYLSDRVCPMLPPLFSNIICSLNPAVP

SEQ ID NO: 3158935 - protein, 20 aa, Giardia lamblia
IYNCLGTSLINCDGKKCQST

SEQ ID NO: 3158936 - protein, 23 aa, Giardia lamblia
IYNDSRIAICGANGSGKSTILKL

SEQ ID NO: 3158937 - protein, 32 aa, Giardia lamblia
IYPERFSTEVFWDCSAQLILAVDVLNKYKDGT

SEQ ID NO: 3158938 - protein, 18 aa, Giardia lamblia
IYPHLSYYLDLLSQDLSK

SEQ ID NO: 3158939 - protein, 22 aa, Giardia lamblia
IYPVYRFGCINTKDKSVLPLLY

SEQ ID NO: 3158940 - protein, 33 aa, Giardia lamblia
IYQAECIKGSMTGYGKPAGYSALDIYTLKEDFK

SEQ ID NO: 3158941 - protein, 17 aa, Giardia lamblia
IYQSCFDTYKSVLLQTY

SEQ ID NO: 3158942 - protein, 18 aa, Giardia lamblia
IYQTMFPYALFGPSENAF

SEQ ID NO: 3158943 - protein, 17 aa, Giardia lamblia
IYRDARSLLKYSSQEAI

SEQ ID NO: 3158944 - protein, 32 aa, Giardia lamblia
IYREVTRLSLKLGAIRFICCKKDKIRSNLSNI

SEQ ID NO: 3158945 - protein, 31 aa, Giardia lamblia
IYRGESFSFFRGWKSQCLFDSLNSFVTTIYE

SEQ ID NO: 3158946 - protein, 19 aa, Giardia lamblia
IYRHQRLPTHIEIIQLTDL

SEQ ID NO: 3158947 - protein, 17 aa, Giardia lamblia
IYRILRPAGKALVTLWA

SEQ ID NO: 3158948 - protein, 26 aa, Giardia lamblia
IYRKEDINTFAMNWCVENLNGNPTVL

SEQ ID NO: 3158949 - protein, 25 aa, Giardia lamblia
IYRRPLRVAPLYVIKNIVTEIISME

SEQ ID NO: 3158950 - protein, 19 aa, Giardia lamblia
IYSKEMFTHVVTHRKDSIH

SEQ ID NO: 3158951 - protein, 19 aa, Giardia lamblia
IYSKVFYIYGCNDSTRQFL

SEQ ID NO: 3158952 - protein, 17 aa, Giardia lamblia
IYSLITFIQPNILGDYD

SEQ ID NO: 3158953 - protein, 24 aa, Giardia lamblia
IYSLRGCPYLVVREIRLDGLDQHS

SEQ ID NO: 3158954 - protein, 27 aa, Giardia lamblia
IYSNASVDPWPGLKDALLLETKIMNDI

SEQ ID NO: 3158955 - protein, 21 aa, Giardia lamblia
IYSTKECFGFILERNGCIPIR

SEQ ID NO: 3158956 - protein, 18 aa, Giardia lamblia
IYSVVSMIRILAEIDTRE

SEQ ID NO: 3158957 - protein, 17 aa, Giardia lamblia
IYTEVSNHFGFEGVSDY

SEQ ID NO: 3158958 - protein, 31 aa, Giardia lamblia
IYTKANCTMIRYKKAITLPIRLRELRARVDG

SEQ ID NO: 3158959 - protein, 23 aa, Giardia lamblia
IYTKASGIGAPYCVDIGNIFLEL

SEQ ID NO: 3158960 - protein, 19 aa, Giardia lamblia
IYTKHCFNKPPSPVTDPDG

SEQ ID NO: 3158961 - protein, 21 aa, Giardia lamblia
IYTPFQALYVFLAYYSSFDYD

SEQ ID NO: 3158962 - protein, 30 aa, Giardia lamblia
IYTPQGELIDPCPHHSRQILYELAKRYKAQ

SEQ ID NO: 3158963 - protein, 23 aa, Giardia lamblia
IYVKRTALMDVLTRITKTRDNIS

SEQ ID NO: 3158964 - protein, 23 aa, Giardia lamblia
IYVLKYLYPRNVLLLRGNHECDA

SEQ ID NO: 3158965 - protein, 25 aa, Giardia lamblia
KAAALEYIIRSPVFKSHTGYNLTSE

SEQ ID NO: 3158966 - protein, 17 aa, Giardia lamblia
KAAATEIAQLAVAKQIK

SEQ ID NO: 3158967 - protein, 20 aa, Giardia lamblia
KAACAYSLLFDEVRQNVAEI

SEQ ID NO: 3158968 - protein, 25 aa, Giardia lamblia
KAADRYKYRYAVLAEKYSKMREEFD

SEQ ID NO: 3158969 - protein, 18 aa, Giardia lamblia
KAAFGFNKDLMGGVHSLF

SEQ ID NO: 3158970 - protein, 25 aa, Giardia lamblia
KAAGDWLLKSEEVIGRLEGEIAHLE

SEQ ID NO: 3158971 - protein, 20 aa, Giardia lamblia
KAAGFKARLKSIQRKIEGAT

SEQ ID NO: 3158972 - protein, 20 aa, Giardia lamblia
KAAGGKLELLKSLQKHIVEA

SEQ ID NO: 3158973 - protein, 20 aa, Giardia lamblia
KAAGPRGFVSADLVFGDDSS

SEQ ID NO: 3158974 - protein, 23 aa, Giardia lamblia
KAAHAKWTKNVFERLAPDVRVTI

SEQ ID NO: 3158975 - protein, 20 aa, Giardia lamblia
KAAIEASAFDHPNIVRIHAI

SEQ ID NO: 3158976 - protein, 19 aa, Giardia lamblia
KAAIGPGRTALMIAAQLGN

SEQ ID NO: 3158977 - protein, 18 aa, Giardia lamblia
KAAIYADVLDYHRWVKRG

SEQ ID NO: 3158978 - protein, 22 aa, Giardia lamblia
KAAKEITGLFTYSSDIVTGLTC

SEQ ID NO: 3158979 - protein, 17 aa, Giardia lamblia
KAAKIGMELMLDTSGTE

SEQ ID NO: 3158980 - protein, 21 aa, Giardia lamblia
KAAKNRTHFLILYSLSAAANN

SEQ ID NO: 3158981 - protein, 19 aa, Giardia lamblia
KAALNEAFESLRAEYRTKK

SEQ ID NO: 3158982 - protein, 23 aa, Giardia lamblia
KAAMLQSVIPLAVAKGVASNADT

SEQ ID NO: 3158983 - protein, 18 aa, Giardia lamblia
KAAPPANSIPCFDEQEDR

SEQ ID NO: 3158984 - protein, 21 aa, Giardia lamblia
KAATLALARDKECWKAYLRRA

SEQ ID NO: 3158985 - protein, 24 aa, Giardia lamblia
KAAWYSRPQFVLDLKARLLGRRDY

SEQ ID NO: 3158986 - protein, 20 aa, Giardia lamblia
KADADWDINQFRAEYHALLA

SEQ ID NO: 3158987 - protein, 30 aa, Giardia lamblia
KADAIINLEACLRILKHRDNYFLTSILSMQ

SEQ ID NO: 3158988 - protein, 23 aa, Giardia lamblia
KADAVFFQFPVHWYSSPPSLKVF

SEQ ID NO: 3158989 - protein, 22 aa, Giardia lamblia
KADAVFFQFPVYWFSSPPSLKV

SEQ ID NO: 3158990 - protein, 19 aa, Giardia lamblia
KADCALCCEIYDSRNDHKL

SEQ ID NO: 3158991 - protein, 26 aa, Giardia lamblia
KADENELRYAIPGGLIAIGTFIDPSY

SEQ ID NO: 3158992 - protein, 18 aa, Giardia lamblia
KADGDRCTALMLAATNGF

SEQ ID NO: 3158993 - protein, 19 aa, Giardia lamblia
KADIWSLGCVIYELCCVEY

SEQ ID NO: 3158994 - protein, 30 aa, Giardia lamblia
KADIWSLGCVMHHVCTRAVPFIATTKEGLT

SEQ ID NO: 3158995 - protein, 19 aa, Giardia lamblia
KADMLLQLDSMKIKRDELL

SEQ ID NO: 3158996 - protein, 24 aa, Giardia lamblia
KADPRPAKKFSQFNLLLSGHPVKA

SEQ ID NO: 3158997 - protein, 24 aa, Giardia lamblia
KADRPSVATFLFQKERHICDKDGI

SEQ ID NO: 3158998 - protein, 20 aa, Giardia lamblia
KADTRPAPPASLNNTTVAIP

SEQ ID NO: 3158999 - protein, 17 aa, Giardia lamblia
KADVLSFLIKREATCLA

SEQ ID NO: 3159000 - protein, 18 aa, Giardia lamblia
KADVWSLGCVVYELCTLR

SEQ ID NO: 3159001 - protein, 24 aa, Giardia lamblia
KAEAALYPHLRFPNVTSAPSTPRG

SEQ ID NO: 3159002 - protein, 18 aa, Giardia lamblia
KAEARTGLSKEFVSNYLK

SEQ ID NO: 3159003 - protein, 21 aa, Giardia lamblia
KAEHLRRGEALDMNIDAAEKL

SEQ ID NO: 3159004 - protein, 25 aa, Giardia lamblia
KAEINRLNDELTWINGQILEERSKV

SEQ ID NO: 3159005 - protein, 18 aa, Giardia lamblia
KAEIRWLKNQMASQNNTV

SEQ ID NO: 3159006 - protein, 18 aa, Giardia lamblia
KAEISRLSSEYYIADSLA

SEQ ID NO: 3159007 - protein, 18 aa, Giardia lamblia
KAELDRYLLQPLKNPERF

SEQ ID NO: 3159008 - protein, 22 aa, Giardia lamblia
KAELVSGSASQGHWATQSSIDK

SEQ ID NO: 3159009 - protein, 20 aa, Giardia lamblia
KAENAITCFNEDVSSLLRRL

SEQ ID NO: 3159010 - protein, 22 aa, Giardia lamblia
KAESFLQSSFYHFIKKEVEYCV

SEQ ID NO: 3159011 - protein, 24 aa, Giardia lamblia
KAESPAKRFSVYKSPSQYAAEGAT

SEQ ID NO: 3159012 - protein, 22 aa, Giardia lamblia
KAFDAWKPTRMTGTSYKVKPSL

SEQ ID NO: 3159013 - protein, 17 aa, Giardia lamblia
KAFEARYISRYHAVVAA

SEQ ID NO: 3159014 - protein, 32 aa, Giardia lamblia
KAFPNLERLSVRGCNVHHSFLSSLLELSTIVE

SEQ ID NO: 3159015 - protein, 25 aa, Giardia lamblia
KAGARKWLARKGLLVRGVLEDSVVA

SEQ ID NO: 3159016 - protein, 21 aa, Giardia lamblia
KAGETALHIAIRRGLVSAISL

SEQ ID NO: 3159017 - protein, 18 aa, Giardia lamblia
KAGHWSCVKQLAQYEVGL

SEQ ID NO: 3159018 - protein, 30 aa, Giardia lamblia
KAGKGRAGTVAICILLAMAYMQDSAREIND

SEQ ID NO: 3159019 - protein, 25 aa, Giardia lamblia
KAGLGRTGSLIALYMMQRYDFTGRE

SEQ ID NO: 3159020 - protein, 20 aa, Giardia lamblia
KAGNVLVYAMAWMCYNSALR

SEQ ID NO: 3159021 - protein, 22 aa, Giardia lamblia
KAGVKRLRWEKNSCSSLFPRTR

SEQ ID NO: 3159022 - protein, 17 aa, Giardia lamblia
KAGVSLPTPSECLVKVT

SEQ ID NO: 3159023 - protein, 18 aa, Giardia lamblia
KAHEYMNEMKLRAAQEAE

SEQ ID NO: 3159024 - protein, 18 aa, Giardia lamblia
KAHPKILTILLQILDEGR

SEQ ID NO: 3159025 - protein, 17 aa, Giardia lamblia
KAHTCLPIQPSDLASFD

SEQ ID NO: 3159026 - protein, 17 aa, Giardia lamblia
KAIAWLIAHNQYAIIPQ

SEQ ID NO: 3159027 - protein, 18 aa, Giardia lamblia
KAIGPRLLHTTQFGYMCP

SEQ ID NO: 3159028 - protein, 17 aa, Giardia lamblia
KAIKAATSELCRNLREN

SEQ ID NO: 3159029 - protein, 24 aa, Giardia lamblia
KAIKLCKLDILYYLSNNTNAKEII

SEQ ID NO: 3159030 - protein, 20 aa, Giardia lamblia
KAIKRLLPYNKRVWDHENRT

SEQ ID NO: 3159031 - protein, 18 aa, Giardia lamblia
KAILKVVQIHGMIDTVTT

SEQ ID NO: 3159032 - protein, 22 aa, Giardia lamblia
KAISPEMLKAVYADIGEMSILR

SEQ ID NO: 3159033 - protein, 23 aa, Giardia lamblia
KAITCGMCLNSLCQMSLLKTQVG

SEQ ID NO: 3159034 - protein, 20 aa, Giardia lamblia
KAKDCLRKHDREGAKRHLYR

SEQ ID NO: 3159035 - protein, 17 aa, Giardia lamblia
KAKDLFFVNAYSLEAPM

SEQ ID NO: 3159036 - protein, 32 aa, Giardia lamblia
KAKEALKEAVILPMMFPQLFQGKREPWRGILL

SEQ ID NO: 3159037 - protein, 20 aa, Giardia lamblia
KAKFLPLAFVFSEGAEFQEF

SEQ ID NO: 3159038 - protein, 20 aa, Giardia lamblia
KAKGWLGLGEARPEKKWGHG

SEQ ID NO: 3159039 - protein, 21 aa, Giardia lamblia
KAKITPLMWESFVGNVAAVHQ

SEQ ID NO: 3159040 - protein, 17 aa, Giardia lamblia
KAKKLARLVEQVAELAE

SEQ ID NO: 3159041 - protein, 21 aa, Giardia lamblia
KAKLKSLARKCGNNLESAASP

SEQ ID NO: 3159042 - protein, 21 aa, Giardia lamblia
KAKMIAELKMCLKMKQQEVDN

SEQ ID NO: 3159043 - protein, 17 aa, Giardia lamblia
KAKREEIDFVIRPNSEE

SEQ ID NO: 3159044 - protein, 21 aa, Giardia lamblia
KAKSMCSLCQMQYGTDTDTSQ

SEQ ID NO: 3159045 - protein, 27 aa, Giardia lamblia
KAKTDARGRTALMYAAAAGHTDVVKLL

SEQ ID NO: 3159046 - protein, 24 aa, Giardia lamblia
KAKVSLILVRVYVIIKCLMEDLVR

SEQ ID NO: 3159047 - protein, 23 aa, Giardia lamblia
KAKWFDPTILRGFLSYASVTITA

SEQ ID NO: 3159048 - protein, 19 aa, Giardia lamblia
KALDTPAFSRVCQAQDNES

SEQ ID NO: 3159049 - protein, 19 aa, Giardia lamblia
KALELVWMHAPFYKEQARF

SEQ ID NO: 3159050 - protein, 18 aa, Giardia lamblia
KALENRFTKFSSEMNRAD

SEQ ID NO: 3159051 - protein, 27 aa, Giardia lamblia
KALGGKLGRTVVCFNCDTSIERSDLSR

SEQ ID NO: 3159052 - protein, 25 aa, Giardia lamblia
KALLHKGSDVSLYLTVLTTSMEQVI

SEQ ID NO: 3159053 - protein, 23 aa, Giardia lamblia
KALLNKWLACICNSKAQDVFLFF

SEQ ID NO: 3159054 - protein, 18 aa, Giardia lamblia
KALSSLADALAYLHSPIR

SEQ ID NO: 3159055 - protein, 27 aa, Giardia lamblia
KALTYRRVKALFNPRRRCHKLSSTKRK

SEQ ID NO: 3159056 - protein, 17 aa, Giardia lamblia
KALVLKNNISGVIDVMV

SEQ ID NO: 3159057 - protein, 26 aa, Giardia lamblia
KALYKYNWRTGTGFLSTIDDLYLNGF

SEQ ID NO: 3159058 - protein, 21 aa, Giardia lamblia
KALYRPSWGDYDSWKTRFRVD

SEQ ID NO: 3159059 - protein, 21 aa, Giardia lamblia
KAMAGCISALMLELETACDES

SEQ ID NO: 3159060 - protein, 20 aa, Giardia lamblia
KAMECCKNKETLAFLQSLYD

SEQ ID NO: 3159061 - protein, 22 aa, Giardia lamblia
KAMKLMIAAVVSKDLMKLEDFK

SEQ ID NO: 3159062 - protein, 25 aa, Giardia lamblia
KAMRLLKQVMLGAVQQHKLLTNYKV

SEQ ID NO: 3159063 - protein, 20 aa, Giardia lamblia
KAMRTKRGLTAMMVAVHCSE

SEQ ID NO: 3159064 - protein, 29 aa, Giardia lamblia
KANCFSMDRCGISFELSTPFDSNYYKASG

SEQ ID NO: 3159065 - protein, 24 aa, Giardia lamblia
KANIVPGLCKIFDEIIVNASDNKQ

SEQ ID NO: 3159066 - protein, 27 aa, Giardia lamblia
KANLFLRSYCKIGLTATPLREDDEMTN

SEQ ID NO: 3159067 - protein, 22 aa, Giardia lamblia
KAPDCVKLLAPYELLIKNIDNK

SEQ ID NO: 3159068 - protein, 17 aa, Giardia lamblia
KAPHIDGVVLRDPETRK

SEQ ID NO: 3159069 - protein, 19 aa, Giardia lamblia
KAPLPRTADRSDIVNAFAA

SEQ ID NO: 3159070 - protein, 17 aa, Giardia lamblia
KAQLHNISEFLWFREAV

SEQ ID NO: 3159071 - protein, 19 aa, Giardia lamblia
KAQVAAFLRKAGEAVHPDA

SEQ ID NO: 3159072 - protein, 23 aa, Giardia lamblia
KARAAGLERFTRLLIADTTVDWL

SEQ ID NO: 3159073 - protein, 18 aa, Giardia lamblia
KARAVLIDMEEGVLNSLL

SEQ ID NO: 3159074 - protein, 19 aa, Giardia lamblia
KARFKNEMTDDLEAWLTAC

SEQ ID NO: 3159075 - protein, 19 aa, Giardia lamblia
KARHDRRVPVPPRLREVQR

SEQ ID NO: 3159076 - protein, 22 aa, Giardia lamblia
KARKIHNTFGRKEFLAATNTNT

SEQ ID NO: 3159077 - protein, 24 aa, Giardia lamblia
KARLMKLIESLQCEIADLRQQNTD

SEQ ID NO: 3159078 - protein, 21 aa, Giardia lamblia
KARLRYLEHLVASQERAAGAA

SEQ ID NO: 3159079 - protein, 24 aa, Giardia lamblia
KARNRKTPKYGVLFSAPQVSKVDI

SEQ ID NO: 3159080 - protein, 21 aa, Giardia lamblia
KARTKLVIDEQVILFSRNGAS

SEQ ID NO: 3159081 - protein, 18 aa, Giardia lamblia
KASACSVCSRCRRGTLAS

SEQ ID NO: 3159082 - protein, 22 aa, Giardia lamblia
KASALKVARALGKIKADGYTPF

SEQ ID NO: 3159083 - protein, 25 aa, Giardia lamblia
KASFPECNRCLIAGTGHCYHKSETK

SEQ ID NO: 3159084 - protein, 19 aa, Giardia lamblia
KASGLNIRSKDQLQSFIDS

SEQ ID NO: 3159085 - protein, 23 aa, Giardia lamblia
KASGSLGHLPCFSELTAQDYQGL

SEQ ID NO: 3159086 - protein, 28 aa, Giardia lamblia
KASGVLRFKMFLEYVIVASVQKEFEPLE

SEQ ID NO: 3159087 - protein, 20 aa, Giardia lamblia
KASHWLVGGDGWAYDIDFAG

SEQ ID NO: 3159088 - protein, 19 aa, Giardia lamblia
KASISFLRQFILDRLTLAI

SEQ ID NO: 3159089 - protein, 21 aa, Giardia lamblia
KASKEKFGAIVVKRDTTILAQ

SEQ ID NO: 3159090 - protein, 20 aa, Giardia lamblia
KASNELIILTRLMRAAHTNS

SEQ ID NO: 3159091 - protein, 18 aa, Giardia lamblia
KASPIRYRSFFLLTEESR

SEQ ID NO: 3159092 - protein, 26 aa, Giardia lamblia
KASQAPRIFAFTSFLCNMIQNRLDAA

SEQ ID NO: 3159093 - protein, 35 aa, Giardia lamblia
KASSGIAKKCLQDACGLSTNFLAPVAHATGFAEGS

SEQ ID NO: 3159094 - protein, 24 aa, Giardia lamblia
KASTKRIGARLSIDDKPAETERIS

SEQ ID NO: 3159095 - protein, 20 aa, Giardia lamblia
KASTSLQTWQMRMVSEAETA

SEQ ID NO: 3159096 - protein, 17 aa, Giardia lamblia
KATDPTIIPGMMDALHR

SEQ ID NO: 3159097 - protein, 23 aa, Giardia lamblia
KATHPPFHIGMYSALPFASSVSQ

SEQ ID NO: 3159098 - protein, 25 aa, Giardia lamblia
KATLCIDESFFLGCLLFPSACVYYF

SEQ ID NO: 3159099 - protein, 26 aa, Giardia lamblia
KATLRRPMGICISSTKPGVVYITDTG

SEQ ID NO: 3159100 - protein, 17 aa, Giardia lamblia
KATRISVLVAQLLTKNV

SEQ ID NO: 3159101 - protein, 19 aa, Giardia lamblia
KATSLPLLLKAYAAEQPHP

SEQ ID NO: 3159102 - protein, 20 aa, Giardia lamblia
KAVLSLPCVLLDSEHLALIL

SEQ ID NO: 3159103 - protein, 18 aa, Giardia lamblia
KAVTICRNRSKSVSDEPA

SEQ ID NO: 3159104 - protein, 25 aa, Giardia lamblia
KAWKRVNECTIEFEVDGPYSCMVLS

SEQ ID NO: 3159105 - protein, 17 aa, Giardia lamblia
KAWLNIIALSALNIFTS

SEQ ID NO: 3159106 - protein, 21 aa, Giardia lamblia
KAYIYQHAFCRFCTVEYSLDP

SEQ ID NO: 3159107 - protein, 31 aa, Giardia lamblia
KAYNVPTQCCKKVHAVIHMPWFVNPDAGRPK

SEQ ID NO: 3159108 - protein, 19 aa, Giardia lamblia
KAYPDIEVFCAQKDSHLNE

SEQ ID NO: 3159109 - protein, 17 aa, Giardia lamblia
KAYQFLADLFIKREEEI

SEQ ID NO: 3159110 - protein, 17 aa, Giardia lamblia
KCADGSPLFDGYRARLT

SEQ ID NO: 3159111 - protein, 25 aa, Giardia lamblia
KCAHGLSCSFVHKFLPQQKMWEDMK

SEQ ID NO: 3159112 - protein, 27 aa, Giardia lamblia
KCCDSGRGAVLFAIARGKLSEGIDFKY

SEQ ID NO: 3159113 - protein, 19 aa, Giardia lamblia
KCCECPNWERHGCHCPPNN

SEQ ID NO: 3159114 - protein, 17 aa, Giardia lamblia
KCCKRWFDCAECHREQS

SEQ ID NO: 3159115 - protein, 22 aa, Giardia lamblia
KCDFDLTPFVRWPRQVRIQRQK

SEQ ID NO: 3159116 - protein, 19 aa, Giardia lamblia
KCEDEILSLIAAYNLQHFQ

SEQ ID NO: 3159117 - protein, 18 aa, Giardia lamblia
KCEIYFNSSVLYELFTLK

SEQ ID NO: 3159118 - protein, 22 aa, Giardia lamblia
KCERMNVQFSIDIYRIGSAISP

SEQ ID NO: 3159119 - protein, 17 aa, Giardia lamblia
KCFSESALWSIAAAVAS

SEQ ID NO: 3159120 - protein, 24 aa, Giardia lamblia
KCGDFLLSAEIVRLKQELHETKIA

SEQ ID NO: 3159121 - protein, 17 aa, Giardia lamblia
KCGEKTKEIGICPEDRV

SEQ ID NO: 3159122 - protein, 17 aa, Giardia lamblia
KCGKGWYDISVKSKDVY

SEQ ID NO: 3159123 - protein, 25 aa, Giardia lamblia
KCIEELKFRGAYVMTEDEKQRVNKL

SEQ ID NO: 3159124 - protein, 17 aa, Giardia lamblia
KCIIFRRQFLDALEGDK

SEQ ID NO: 3159125 - protein, 31 aa, Giardia lamblia
KCIRIKIMIASGYASMVWEYLLMMIFRGLLD

SEQ ID NO: 3159126 - protein, 22 aa, Giardia lamblia
KCISYCGPGGAGHMVKMVHNGC

SEQ ID NO: 3159127 - protein, 22 aa, Giardia lamblia
KCNQECKLLCPVNKTGKRCVVA

SEQ ID NO: 3159128 - protein, 19 aa, Giardia lamblia
KCQALACSDNARFEDHLNA

SEQ ID NO: 3159129 - protein, 22 aa, Giardia lamblia
KCRDAQGRTALMCAAAAGCNEI

SEQ ID NO: 3159130 - protein, 20 aa, Giardia lamblia
KCREAFRLENGISVLVQIIS

SEQ ID NO: 3159131 - protein, 18 aa, Giardia lamblia
KCRLRLKKIKEMHIRMHR

SEQ ID NO: 3159132 - protein, 19 aa, Giardia lamblia
KCSENLCAHIRDPLQMVES

SEQ ID NO: 3159133 - protein, 23 aa, Giardia lamblia
KCSERKARCTALDKELKSLKEAL

SEQ ID NO: 3159134 - protein, 21 aa, Giardia lamblia
KCSVSLDALRNTRVCAQEHAL

SEQ ID NO: 3159135 - protein, 19 aa, Giardia lamblia
KCVERMKWLFSDLPEEKRV

SEQ ID NO: 3159136 - protein, 19 aa, Giardia lamblia
KCYDYILHMVVSIRSPTIH

SEQ ID NO: 3159137 - protein, 26 aa, Giardia lamblia
KCYQNVILPAQFLVMYSPQWFFEEVI

SEQ ID NO: 3159138 - protein, 20 aa, Giardia lamblia
KDACTPTYGVDWFYKDIEVP

SEQ ID NO: 3159139 - protein, 25 aa, Giardia lamblia
KDADGHSVFDFAIAIGNAEILHILL

SEQ ID NO: 3159140 - protein, 21 aa, Giardia lamblia
KDAEGRAPILFAKTKETRDLL

SEQ ID NO: 3159141 - protein, 17 aa, Giardia lamblia
KDAEILSLRRKLEDYVE

SEQ ID NO: 3159142 - protein, 25 aa, Giardia lamblia
KDAGFNEMYIRLAYSSNKGNVIDAI

SEQ ID NO: 3159143 - protein, 23 aa, Giardia lamblia
KDALLKVLKRIGSNGDLEQTKPI

SEQ ID NO: 3159144 - protein, 20 aa, Giardia lamblia
KDALLPNGLSFDFLSTMTRR

SEQ ID NO: 3159145 - protein, 17 aa, Giardia lamblia
KDALMIIDHGSFLGGPY

SEQ ID NO: 3159146 - protein, 21 aa, Giardia lamblia
KDAQGGIFLTVENYDEMNEAA

SEQ ID NO: 3159147 - protein, 24 aa, Giardia lamblia
KDCKLPLKLMEKLMILVNTIELCR

SEQ ID NO: 3159148 - protein, 21 aa, Giardia lamblia
KDCLMETYYHVCFNSHPNVVK

SEQ ID NO: 3159149 - protein, 19 aa, Giardia lamblia
KDCNYFKKRLEEARRDLGK

SEQ ID NO: 3159150 - protein, 25 aa, Giardia lamblia
KDCPQRRRTFLFSATFPSAVQALQN

SEQ ID NO: 3159151 - protein, 24 aa, Giardia lamblia
KDCSKEILERHSIISTKLGQEYII

SEQ ID NO: 3159152 - protein, 19 aa, Giardia lamblia
KDDAKVEILDLTNIYDPQR

SEQ ID NO: 3159153 - protein, 23 aa, Giardia lamblia
KDDDMKPDMGMLYEDKHSNKYTK

SEQ ID NO: 3159154 - protein, 19 aa, Giardia lamblia
KDDEISRLQKLLYSYQPSP

SEQ ID NO: 3159155 - protein, 21 aa, Giardia lamblia
KDDRIQFIISQSFAERILQVF

SEQ ID NO: 3159156 - protein, 34 aa, Giardia lamblia
KDDYHCANWAGCPFRLSIRHYKKRPDVYELTILQ

SEQ ID NO: 3159157 - protein, 25 aa, Giardia lamblia
KDEGRLQDVNGWTALMHATRERVHP

SEQ ID NO: 3159158 - protein, 36 aa, Giardia lamblia
KDEHARLLASIKDSISFIRRCAEATVEGGEDAEGNI

SEQ ID NO: 3159159 - protein, 25 aa, Giardia lamblia
KDEIKLRLYHEYVHIDPSELSSEAL

SEQ ID NO: 3159160 - protein, 21 aa, Giardia lamblia
KDEKAEAAGCLVEVEEQILLW

SEQ ID NO: 3159161 - protein, 20 aa, Giardia lamblia
KDEKLPRSLAHFTPGIAQLV

SEQ ID NO: 3159162 - protein, 25 aa, Giardia lamblia
KDEKLRLNEEIINLKANLHLREEEF

SEQ ID NO: 3159163 - protein, 17 aa, Giardia lamblia
KDEKLTCENIIVVCSSC

SEQ ID NO: 3159164 - protein, 23 aa, Giardia lamblia
KDELRRAALTLADRENAGREELV

SEQ ID NO: 3159165 - protein, 28 aa, Giardia lamblia
KDENSCSFCGVSYLILHEVERLKRRIAE

SEQ ID NO: 3159166 - protein, 17 aa, Giardia lamblia
KDEPCYAYLLSELAKAV

SEQ ID NO: 3159167 - protein, 33 aa, Giardia lamblia
KDEPELHSWPVFYEIVSLLIYPCCIHSKSNVRA

SEQ ID NO: 3159168 - protein, 19 aa, Giardia lamblia
KDEQLRIATNEYKENMEKL

SEQ ID NO: 3159169 - protein, 26 aa, Giardia lamblia
KDERCWNCIILGPAGTAWENGKLCIR

SEQ ID NO: 3159170 - protein, 20 aa, Giardia lamblia
KDEVPACNIPSYREEDESAS

SEQ ID NO: 3159171 - protein, 31 aa, Giardia lamblia
KDEYTALMIAASRGYSDIVLQLLPKEAGIVT

SEQ ID NO: 3159172 - protein, 37 aa, Giardia lamblia
KDEYYRLAREAGYRSRAAYKLIQLDAQYGFLSSTKCL

SEQ ID NO: 3159173 - protein, 25 aa, Giardia lamblia
KDFDASSSLTSWPLCTSDFHINFNE

SEQ ID NO: 3159174 - protein, 19 aa, Giardia lamblia
KDFGLRTGLVIGGVDLMQQ

SEQ ID NO: 3159175 - protein, 19 aa, Giardia lamblia
KDFIFGLRYSGLPSELISD

SEQ ID NO: 3159176 - protein, 27 aa, Giardia lamblia
KDFKGYSAILYAIKWGYVEVVKRLLES

SEQ ID NO: 3159177 - protein, 20 aa, Giardia lamblia
KDFNLCFDLSGIQRKYGAPN

SEQ ID NO: 3159178 - protein, 17 aa, Giardia lamblia
KDFPVYPGINVAELLPT

SEQ ID NO: 3159179 - protein, 25 aa, Giardia lamblia
KDFRKLLKWREKVIAHICEITVPVE

SEQ ID NO: 3159180 - protein, 35 aa, Giardia lamblia
KDFRRDRLCLVRSRLCNYLNLYPTEFVTAAETAGA

SEQ ID NO: 3159181 - protein, 19 aa, Giardia lamblia
KDFTGRIIADVAQFKLSEG

SEQ ID NO: 3159182 - protein, 23 aa, Giardia lamblia
KDGEFRKILMFAIELNDYELLQD

SEQ ID NO: 3159183 - protein, 17 aa, Giardia lamblia
KDGIFVVGDMDGWIHCY

SEQ ID NO: 3159184 - protein, 17 aa, Giardia lamblia
KDGLSCTEAVFRPRMAF

SEQ ID NO: 3159185 - protein, 17 aa, Giardia lamblia
KDGRTALMIAATYNRAE

SEQ ID NO: 3159186 - protein, 26 aa, Giardia lamblia
KDGSLPLMLYKNLRPTNILTDEDITA

SEQ ID NO: 3159187 - protein, 21 aa, Giardia lamblia
KDGSTPLHFAAAMESLRSIVL

SEQ ID NO: 3159188 - protein, 21 aa, Giardia lamblia
KDHFKIALGQLHQCKNLTDKV

SEQ ID NO: 3159189 - protein, 25 aa, Giardia lamblia
KDIFRRAFMSRIFPPDKLAELGQTH

SEQ ID NO: 3159190 - protein, 21 aa, Giardia lamblia
KDIIIRKGNRAFLDPRNNTLT

SEQ ID NO: 3159191 - protein, 25 aa, Giardia lamblia
KDIIKKQGRRFIKIRDKEVEWNDNF

SEQ ID NO: 3159192 - protein, 19 aa, Giardia lamblia
KDIKMHFVSWYKQAATAVA

SEQ ID NO: 3159193 - protein, 21 aa, Giardia lamblia
KDIKYPKAHALLCEHSLFAKC

SEQ ID NO: 3159194 - protein, 19 aa, Giardia lamblia
KDILAEWAKAYQFLADLFI

SEQ ID NO: 3159195 - protein, 19 aa, Giardia lamblia
KDIPFMPGTAFPDPHRTNF

SEQ ID NO: 3159196 - protein, 17 aa, Giardia lamblia
KDIPSRLLAPGISAAEI

SEQ ID NO: 3159197 - protein, 23 aa, Giardia lamblia
KDIRQVFQPYGFIQLKVRKGNNL

SEQ ID NO: 3159198 - protein, 25 aa, Giardia lamblia
KDISKLLNWFEIWIVPAINAEGIRC

SEQ ID NO: 3159199 - protein, 17 aa, Giardia lamblia
KDISVAYGYSDGVIDIL

SEQ ID NO: 3159200 - protein, 19 aa, Giardia lamblia
KDKCRPVTEGNTFKVMTTS

SEQ ID NO: 3159201 - protein, 18 aa, Giardia lamblia
KDKMCLLTAVEPYFNSTD

SEQ ID NO: 3159202 - protein, 24 aa, Giardia lamblia
KDKNGRTALQYANLQYADIATATM

SEQ ID NO: 3159203 - protein, 17 aa, Giardia lamblia
KDKNGWTALMHAAYNNH

SEQ ID NO: 3159204 - protein, 17 aa, Giardia lamblia
KDKNGWTALMHAIHNSH

SEQ ID NO: 3159205 - protein, 25 aa, Giardia lamblia
KDKTSIRAGEDISLLLEQTNAAKSI

SEQ ID NO: 3159206 - protein, 20 aa, Giardia lamblia
KDKYMSLSAEFRDYKLKKES

SEQ ID NO: 3159207 - protein, 27 aa, Giardia lamblia
KDLCDLWLRYMTMYSVNGKTAMANIMA

SEQ ID NO: 3159208 - protein, 23 aa, Giardia lamblia
KDLDPRIATMALYEMASTRLFLH

SEQ ID NO: 3159209 - protein, 25 aa, Giardia lamblia
KDLETPCGYFVPALVDKVLTSLSSA

SEQ ID NO: 3159210 - protein, 20 aa, Giardia lamblia
KDLHTYYSVCLANAKIMTKR

SEQ ID NO: 3159211 - protein, 27 aa, Giardia lamblia
KDLIKKLLKSMFEWLALKTNEAGRSQQ

SEQ ID NO: 3159212 - protein, 18 aa, Giardia lamblia
KDLKRLGSEAEVKAAGKV

SEQ ID NO: 3159213 - protein, 17 aa, Giardia lamblia
KDLKRLLPEQAARNIFE

SEQ ID NO: 3159214 - protein, 28 aa, Giardia lamblia
KDLLKSVIKAEAFLVEFPNKKLALQTSI

SEQ ID NO: 3159215 - protein, 19 aa, Giardia lamblia
KDLMAHEAELRQEARIYQR

SEQ ID NO: 3159216 - protein, 28 aa, Giardia lamblia
KDLNIIGIKCKWVDKVLDRLFRIIDDPT

SEQ ID NO: 3159217 - protein, 20 aa, Giardia lamblia
KDLPLPTVILYLDATPETCY

SEQ ID NO: 3159218 - protein, 25 aa, Giardia lamblia
KDLRLPDGRNALILAAQHNALDAIH

SEQ ID NO: 3159219 - protein, 25 aa, Giardia lamblia
KDLTLPFRKAMSMSQHFNPLKSSVI

SEQ ID NO: 3159220 - protein, 18 aa, Giardia lamblia
KDLVTGLPLLALDDETSP

SEQ ID NO: 3159221 - protein, 21 aa, Giardia lamblia
KDLWQNFFFMCGIPHGSGNVT

SEQ ID NO: 3159222 - protein, 18 aa, Giardia lamblia
KDMGKGFNIMFEKNSKQL

SEQ ID NO: 3159223 - protein, 18 aa, Giardia lamblia
KDNDPLLVIAELKVLSEL

SEQ ID NO: 3159224 - protein, 23 aa, Giardia lamblia
KDNIDCIELLIPKEARMQTKTGI

SEQ ID NO: 3159225 - protein, 23 aa, Giardia lamblia
KDNIRIIGVEDIRKSQYRPRRSM

SEQ ID NO: 3159226 - protein, 17 aa, Giardia lamblia
KDNLGVTALMYAAQAGR

SEQ ID NO: 3159227 - protein, 20 aa, Giardia lamblia
KDNMTALLFAIRGNKPDLIQ

SEQ ID NO: 3159228 - protein, 26 aa, Giardia lamblia
KDNPGMIPLAFQRIFDFIAQAKDDQF

SEQ ID NO: 3159229 - protein, 20 aa, Giardia lamblia
KDNRWRRKLSPRHTGYTSQF

SEQ ID NO: 3159230 - protein, 17 aa, Giardia lamblia
KDPKDVFIDGWRPDLSG

SEQ ID NO: 3159231 - protein, 19 aa, Giardia lamblia
KDPKDVFVDGWTPDLSGVA

SEQ ID NO: 3159232 - protein, 21 aa, Giardia lamblia
KDPNKRPSVNQILKLPFLQER

SEQ ID NO: 3159233 - protein, 26 aa, Giardia lamblia
KDQCLPGDCPRNVICGQLQIKEFKEL

SEQ ID NO: 3159234 - protein, 17 aa, Giardia lamblia
KDQLHMGASKWNTENLC

SEQ ID NO: 3159235 - protein, 24 aa, Giardia lamblia
KDQYGRTALMYAILYTAQDAAGVL

SEQ ID NO: 3159236 - protein, 33 aa, Giardia lamblia
KDRAKSAWRFVKFRVCVKYGYIKKLVPQFNKLS

SEQ ID NO: 3159237 - protein, 24 aa, Giardia lamblia
KDRAMALAACLSEFQKICDNGVTL

SEQ ID NO: 3159238 - protein, 21 aa, Giardia lamblia
KDREIDAYKALVSIDPEEFMR

SEQ ID NO: 3159239 - protein, 24 aa, Giardia lamblia
KDRGGDTALMYALRNRHIDTAVVL

SEQ ID NO: 3159240 - protein, 24 aa, Giardia lamblia
KDRMPLTLGPAVSLLLPRLLNYGT

SEQ ID NO: 3159241 - protein, 17 aa, Giardia lamblia
KDRPSIFQERARVSVST

SEQ ID NO: 3159242 - protein, 25 aa, Giardia lamblia
KDRRGRQAIANSLRPNDIVYRHLLP

SEQ ID NO: 3159243 - protein, 22 aa, Giardia lamblia
KDRVQEVFMFCGLDGQGCDKIA

SEQ ID NO: 3159244 - protein, 20 aa, Giardia lamblia
KDSQGEIVQIGRIVHRRLTP

SEQ ID NO: 3159245 - protein, 24 aa, Giardia lamblia
KDSQGRTALIYAIQSGQSQLCRLL

SEQ ID NO: 3159246 - protein, 20 aa, Giardia lamblia
KDSVVIKLCCSVPQHTLVQV

SEQ ID NO: 3159247 - protein, 22 aa, Giardia lamblia
KDTEMVHLLASFEHSLRNSSGY

SEQ ID NO: 3159248 - protein, 20 aa, Giardia lamblia
KDTPACFVYCRSSGRRAHRS

SEQ ID NO: 3159249 - protein, 17 aa, Giardia lamblia
KDTQSILNISTLHREKV

SEQ ID NO: 3159250 - protein, 18 aa, Giardia lamblia
KDVARPIFKELLDTHYAP

SEQ ID NO: 3159251 - protein, 25 aa, Giardia lamblia
KDVDYCLLFGAFPRKAGMERAELLS

SEQ ID NO: 3159252 - protein, 19 aa, Giardia lamblia
KDVGIGANVWRLSPSPPDV

SEQ ID NO: 3159253 - protein, 18 aa, Giardia lamblia
KDVHVCSQPNEFIQLLGN

SEQ ID NO: 3159254 - protein, 23 aa, Giardia lamblia
KDVKEVICWTCQQYGPIGEVCVN

SEQ ID NO: 3159255 - protein, 21 aa, Giardia lamblia
KDVKRYPFSKIFRSKAHTDAV

SEQ ID NO: 3159256 - protein, 21 aa, Giardia lamblia
KDVPGMQFWGCDPNNGIFYTV

SEQ ID NO: 3159257 - protein, 21 aa, Giardia lamblia
KDVSPLFGSYIDRAESQILTL

SEQ ID NO: 3159258 - protein, 18 aa, Giardia lamblia
KDVVSMSLLAKALSKETG

SEQ ID NO: 3159259 - protein, 22 aa, Giardia lamblia
KDVYEALEPICVQNKWVSWWTD

SEQ ID NO: 3159260 - protein, 18 aa, Giardia lamblia
KDYLECIREQIPNDPRPE

SEQ ID NO: 3159261 - protein, 19 aa, Giardia lamblia
KDYLEDVGDSFDLVPVAAW

SEQ ID NO: 3159262 - protein, 20 aa, Giardia lamblia
KDYSSLVLDSHMFDDPKAVQ

SEQ ID NO: 3159263 - protein, 25 aa, Giardia lamblia
KEAARLCVDMPGGGKVVLRDADAKK

SEQ ID NO: 3159264 - protein, 22 aa, Giardia lamblia
KEAETLLDLGPHRNILTIRGYA

SEQ ID NO: 3159265 - protein, 18 aa, Giardia lamblia
KEAGMRRSDGWTSLMYCA

SEQ ID NO: 3159266 - protein, 22 aa, Giardia lamblia
KEAIKLLCHSISLENVYLQADG

SEQ ID NO: 3159267 - protein, 20 aa, Giardia lamblia
KEAKDRAHREIEAFQRQEEA

SEQ ID NO: 3159268 - protein, 29 aa, Giardia lamblia
KEAKGLINMNECFNRVLGSSLLGRLRDIY

SEQ ID NO: 3159269 - protein, 42 aa, Giardia lamblia
KEALKEAVILPFKFPQLFQGKREPWRGILLYGCPGTGKSFLA

SEQ ID NO: 3159270 - protein, 19 aa, Giardia lamblia
KEAMRRIGIFRSDGILMGI

SEQ ID NO: 3159271 - protein, 27 aa, Giardia lamblia
KEANLFSRLAHRCLPKTVSVYNNPLTS

SEQ ID NO: 3159272 - protein, 19 aa, Giardia lamblia
KEAPNFVGVEMSTQTRRVA

SEQ ID NO: 3159273 - protein, 20 aa, Giardia lamblia
KEARGLFNKRNTMYLRQTHR

SEQ ID NO: 3159274 - protein, 21 aa, Giardia lamblia
KEARMLTKRIHEHGAGFCALM

SEQ ID NO: 3159275 - protein, 25 aa, Giardia lamblia
KEATFCRASGLAVIPMPQYVIDLDV

SEQ ID NO: 3159276 - protein, 18 aa, Giardia lamblia
KEAVVFNMKLHGVGASAS

SEQ ID NO: 3159277 - protein, 18 aa, Giardia lamblia
KECEVCDGFKLFITSKLP

SEQ ID NO: 3159278 - protein, 17 aa, Giardia lamblia
KECEVYRAQLSRADTTR

SEQ ID NO: 3159279 - protein, 19 aa, Giardia lamblia
KECVSFLLERESGLIDKYG

SEQ ID NO: 3159280 - protein, 24 aa, Giardia lamblia
KEDDFRIANLGARTSSIYSNEGPR

SEQ ID NO: 3159281 - protein, 17 aa, Giardia lamblia
KEDDIMLEQAVNRYGVH

SEQ ID NO: 3159282 - protein, 18 aa, Giardia lamblia
KEDDIVWGDFYQEDSPRK

SEQ ID NO: 3159283 - protein, 23 aa, Giardia lamblia
KEDLKEIYRRLAPPKNKDQQIVF

SEQ ID NO: 3159284 - protein, 17 aa, Giardia lamblia
KEDRFLLQLIKTARSPP

SEQ ID NO: 3159285 - protein, 22 aa, Giardia lamblia
KEDRLLQRYPFTVVSRRNCFPM

SEQ ID NO: 3159286 - protein, 25 aa, Giardia lamblia
KEDRYKLKLLSLLMKHLKINQCIVF

SEQ ID NO: 3159287 - protein, 27 aa, Giardia lamblia
KEDSPVLCDVVARIATPPASVVLDAHD

SEQ ID NO: 3159288 - protein, 20 aa, Giardia lamblia
KEDSRPKSAVSFTTVSNTSP

SEQ ID NO: 3159289 - protein, 26 aa, Giardia lamblia
KEEARDPPQFKFGFVPASTDDKNPTG

SEQ ID NO: 3159290 - protein, 19 aa, Giardia lamblia
KEEGHECVCFFGKMHHKKR

SEQ ID NO: 3159291 - protein, 20 aa, Giardia lamblia
KEEKRAASLSARTAKSKKHK

SEQ ID NO: 3159292 - protein, 23 aa, Giardia lamblia
KEEKREDMTMCIVIRQTTSILAY

SEQ ID NO: 3159293 - protein, 18 aa, Giardia lamblia
KEELRECTFKPKISETSK

SEQ ID NO: 3159294 - protein, 26 aa, Giardia lamblia
KEELSRALCCQIDFSVQRITKLEFLP

SEQ ID NO: 3159295 - protein, 17 aa, Giardia lamblia
KEELVGVMAKIDALGSW

SEQ ID NO: 3159296 - protein, 19 aa, Giardia lamblia
KEEMVSYGFGANGRVHPDV

SEQ ID NO: 3159297 - protein, 24 aa, Giardia lamblia
KEESEIILGANFVYLRDKDDFELR

SEQ ID NO: 3159298 - protein, 23 aa, Giardia lamblia
KEETRTVGGLPVLAAKNIILAKY

SEQ ID NO: 3159299 - protein, 24 aa, Giardia lamblia
KEEVTKILKMCRGELDDDDEEAKE

SEQ ID NO: 3159300 - protein, 18 aa, Giardia lamblia
KEFFKSMAPKADKESGKN

SEQ ID NO: 3159301 - protein, 25 aa, Giardia lamblia
KEFILACLSIDYTFRPSAQSLLQAS

SEQ ID NO: 3159302 - protein, 22 aa, Giardia lamblia
KEFKSNEYYTIYGQVTAHCVHN

SEQ ID NO: 3159303 - protein, 27 aa, Giardia lamblia
KEFLADCKYPGFSFTDIFMPAFKRYKA

SEQ ID NO: 3159304 - protein, 20 aa, Giardia lamblia
KEFLERCTKASTDPETDDTL

SEQ ID NO: 3159305 - protein, 24 aa, Giardia lamblia
KEFRELLREIGLLMMYEATRSLEL

SEQ ID NO: 3159306 - protein, 25 aa, Giardia lamblia
KEFSKDEIMKFLTFDDRDSMQTCIF

SEQ ID NO: 3159307 - protein, 20 aa, Giardia lamblia
KEFVDTIGMMMRLNPEDRPS

SEQ ID NO: 3159308 - protein, 25 aa, Giardia lamblia
KEGGMRGSYGWTALMIAAWNNKQDC

SEQ ID NO: 3159309 - protein, 23 aa, Giardia lamblia
KEGIPPDQQRLIFSGKQLEDNRT

SEQ ID NO: 3159310 - protein, 24 aa, Giardia lamblia
KEGIPSRILGAFAQGLSDLTTSSR

SEQ ID NO: 3159311 - protein, 18 aa, Giardia lamblia
KEGLSLKDALINKVRKEA

SEQ ID NO: 3159312 - protein, 17 aa, Giardia lamblia
KEGLVITEAGAVYLPST

SEQ ID NO: 3159313 - protein, 21 aa, Giardia lamblia
KEGRNIHDFIKLFINDRSLIS

SEQ ID NO: 3159314 - protein, 31 aa, Giardia lamblia
KEGRRLSADCCARIAIDVSMGLQAIHKAGYV

SEQ ID NO: 3159315 - protein, 17 aa, Giardia lamblia
KEHESLKAIIEQYINAK

SEQ ID NO: 3159316 - protein, 17 aa, Giardia lamblia
KEHKHALFRAAIHYERH

SEQ ID NO: 3159317 - protein, 17 aa, Giardia lamblia
KEHLHPVNVVLSMRDAE

SEQ ID NO: 3159318 - protein, 19 aa, Giardia lamblia
KEHLQLCISHYCKLALHGN

SEQ ID NO: 3159319 - protein, 21 aa, Giardia lamblia
KEHMEEAGMQTCCGWTALMFA

SEQ ID NO: 3159320 - protein, 20 aa, Giardia lamblia
KEHNALRRRGKDADEMLQGL

SEQ ID NO: 3159321 - protein, 18 aa, Giardia lamblia
KEHVALLAKMRKLQKYKE

SEQ ID NO: 3159322 - protein, 19 aa, Giardia lamblia
KEIAKLCTIDGLQADVLVE

SEQ ID NO: 3159323 - protein, 18 aa, Giardia lamblia
KEIEELGQALALQEQTVT

SEQ ID NO: 3159324 - protein, 26 aa, Giardia lamblia
KEIEELRYRFSLLDADKSGSITFDEL

SEQ ID NO: 3159325 - protein, 17 aa, Giardia lamblia
KEIEFHSYLSGNIYSQT

SEQ ID NO: 3159326 - protein, 17 aa, Giardia lamblia
KEIHKATILDDRPVGGS

SEQ ID NO: 3159327 - protein, 17 aa, Giardia lamblia
KEIIRDMILKGIEDKSI

SEQ ID NO: 3159328 - protein, 21 aa, Giardia lamblia
KEILAEFKIVVPRLSSFHGSK

SEQ ID NO: 3159329 - protein, 17 aa, Giardia lamblia
KEIMAGAEPLRLDVIEA

SEQ ID NO: 3159330 - protein, 20 aa, Giardia lamblia
KEIRITVSALTMKEEDWGLR

SEQ ID NO: 3159331 - protein, 27 aa, Giardia lamblia
KEISLTWSCLLCERGFRSVDAVKGHMR

SEQ ID NO: 3159332 - protein, 19 aa, Giardia lamblia
KEIYERLNPVTAKIKSIIG

SEQ ID NO: 3159333 - protein, 20 aa, Giardia lamblia
KEIYERYSVTLLERKEKHTM

SEQ ID NO: 3159334 - protein, 18 aa, Giardia lamblia
KEKAILTVVDYVTCYTSF

SEQ ID NO: 3159335 - protein, 23 aa, Giardia lamblia
KEKEVAMFFAIGHMRKHAMLTGD

SEQ ID NO: 3159336 - protein, 25 aa, Giardia lamblia
KEKGLKDSNGWTALMYTARTGHADC

SEQ ID NO: 3159337 - protein, 25 aa, Giardia lamblia
KEKKKIPLLWGPMANEFEKVQKSTL

SEQ ID NO: 3159338 - protein, 20 aa, Giardia lamblia
KEKRGFSRMKSGTITTTDTS

SEQ ID NO: 3159339 - protein, 21 aa, Giardia lamblia
KEKRSILTLSSLEYTADAFPF

SEQ ID NO: 3159340 - protein, 21 aa, Giardia lamblia
KEKTGWTALMFAMKIGSIDCV

SEQ ID NO: 3159341 - protein, 18 aa, Giardia lamblia
KEKTSGSVRFCIKSALDG

SEQ ID NO: 3159342 - protein, 19 aa, Giardia lamblia
KELCIKYGRERGGNIYRML

SEQ ID NO: 3159343 - protein, 22 aa, Giardia lamblia
KELCLARLMSFMGHQHANHLTY

SEQ ID NO: 3159344 - protein, 17 aa, Giardia lamblia
KELDNDYMRMFRSAKIT

SEQ ID NO: 3159345 - protein, 23 aa, Giardia lamblia
KELDRMERIFAGKQAEIDFVTAY

SEQ ID NO: 3159346 - protein, 25 aa, Giardia lamblia
KELDRMGFNIGQRCVDEYLANSSSI

SEQ ID NO: 3159347 - protein, 22 aa, Giardia lamblia
KELDSSFLPASRKSVRESTGKS

SEQ ID NO: 3159348 - protein, 17 aa, Giardia lamblia
KELDYCNGEIEGKDKRT

SEQ ID NO: 3159349 - protein, 22 aa, Giardia lamblia
KELERLKLLHHYRSRADEGALE

SEQ ID NO: 3159350 - protein, 18 aa, Giardia lamblia
KELFELYITTIYKASKLK

SEQ ID NO: 3159351 - protein, 17 aa, Giardia lamblia
KELGGLIAGLKEALREH

SEQ ID NO: 3159352 - protein, 21 aa, Giardia lamblia
KELHERLNGVLGRDATGVVYS

SEQ ID NO: 3159353 - protein, 23 aa, Giardia lamblia
KELHERLNGVLGRDATGVVYSLE

SEQ ID NO: 3159354 - protein, 22 aa, Giardia lamblia
KELHLGRIIPIGNIPKEAITGQ

SEQ ID NO: 3159355 - protein, 27 aa, Giardia lamblia
KELIAKWNKAWAFKAFAAKSATELVSS

SEQ ID NO: 3159356 - protein, 22 aa, Giardia lamblia
KELIDLLIACYETFEVKEIRTV

SEQ ID NO: 3159357 - protein, 24 aa, Giardia lamblia
KELIKKGGQCTIKIGENEVEYNPD

SEQ ID NO: 3159358 - protein, 29 aa, Giardia lamblia
KELIPDGLLRPDALISLTVPKNCSLWLPP

SEQ ID NO: 3159359 - protein, 26 aa, Giardia lamblia
KELIPRLESLVVHWTRQIKELLSGVH

SEQ ID NO: 3159360 - protein, 47 aa, Giardia lamblia
KELISRPPLTEKLLSRPPFKYILDICKAVSAATGFPSPESCNYDDIT

SEQ ID NO: 3159361 - protein, 18 aa, Giardia lamblia
KELKEFKSQIGQESRLQN

SEQ ID NO: 3159362 - protein, 23 aa, Giardia lamblia
KELKITMKSGYWGVGFSALSWAT

SEQ ID NO: 3159363 - protein, 17 aa, Giardia lamblia
KELKLKLEATGLAHKKV

SEQ ID NO: 3159364 - protein, 20 aa, Giardia lamblia
KELKQLVSQFGRVVSFRAPK

SEQ ID NO: 3159365 - protein, 17 aa, Giardia lamblia
KELKRKLEELDRLNKVR

SEQ ID NO: 3159366 - protein, 17 aa, Giardia lamblia
KELLDLIPAGKRVRISS

SEQ ID NO: 3159367 - protein, 20 aa, Giardia lamblia
KELMDKLMLVDLPKAAEALN

SEQ ID NO: 3159368 - protein, 23 aa, Giardia lamblia
KELSRILWYYMILDEGHKLKDNM

SEQ ID NO: 3159369 - protein, 17 aa, Giardia lamblia
KELSTGLAHISLKGTSS

SEQ ID NO: 3159370 - protein, 19 aa, Giardia lamblia
KELTSMILSGQFSHGTVEK

SEQ ID NO: 3159371 - protein, 25 aa, Giardia lamblia
KELYDEVYGSYKLRNFLTSGTGLTL

SEQ ID NO: 3159372 - protein, 19 aa, Giardia lamblia
KELYNELHRRKSLVRIKFV

SEQ ID NO: 3159373 - protein, 25 aa, Giardia lamblia
KEMGLSVTLYDIWGRDLSNEQRDTK

SEQ ID NO: 3159374 - protein, 24 aa, Giardia lamblia
KEMKALWRPRFREDPERYYPRVVF

SEQ ID NO: 3159375 - protein, 18 aa, Giardia lamblia
KEMQRIVAAQRLRLANVF

SEQ ID NO: 3159376 - protein, 20 aa, Giardia lamblia
KEMTMAASGINFSKLSEQER

SEQ ID NO: 3159377 - protein, 24 aa, Giardia lamblia
KENGYLKQRLNQIALGSDESTSRN

SEQ ID NO: 3159378 - protein, 17 aa, Giardia lamblia
KENMHLFGFKINWGLVE

SEQ ID NO: 3159379 - protein, 23 aa, Giardia lamblia
KENRTARDYIMLISPTATDAQRE

SEQ ID NO: 3159380 - protein, 22 aa, Giardia lamblia
KENVELCSLKLIYTAQTLVSGP

SEQ ID NO: 3159381 - protein, 24 aa, Giardia lamblia
KEPDVSTAIYLRRMRQMIDNDSNT

SEQ ID NO: 3159382 - protein, 19 aa, Giardia lamblia
KEPLDMPFLPYSEAARTPQ

SEQ ID NO: 3159383 - protein, 21 aa, Giardia lamblia
KEPLISCKILEHLVKESGITD

SEQ ID NO: 3159384 - protein, 21 aa, Giardia lamblia
KEQEIAMIYNLFEATLACGIR

SEQ ID NO: 3159385 - protein, 25 aa, Giardia lamblia
KEQGQWKGGLLLHYELVQNILEYMF

SEQ ID NO: 3159386 - protein, 25 aa, Giardia lamblia
KEQMRRAAECSRTLELENNSYKAKL

SEQ ID NO: 3159387 - protein, 26 aa, Giardia lamblia
KERAKELQERLGLLSIPQQNTRHPIN

SEQ ID NO: 3159388 - protein, 18 aa, Giardia lamblia
KERCTEKDLLVESLERQT

SEQ ID NO: 3159389 - protein, 22 aa, Giardia lamblia
KERDKAALGIRLVDDSDQELDS

SEQ ID NO: 3159390 - protein, 20 aa, Giardia lamblia
KERHRLMLGQSCCVMKSSIH

SEQ ID NO: 3159391 - protein, 34 aa, Giardia lamblia
KERIAMSVLKRSFSPRHFLDLVADYAYVLYDDAA

SEQ ID NO: 3159392 - protein, 19 aa, Giardia lamblia
KERLACLLTALTRSVSSLI

SEQ ID NO: 3159393 - protein, 22 aa, Giardia lamblia
KERLLEEMLKRGEIYSNKTIET

SEQ ID NO: 3159394 - protein, 19 aa, Giardia lamblia
KERLRRIEIVSPERASRVE

SEQ ID NO: 3159395 - protein, 25 aa, Giardia lamblia
KERPVKPLLWLGQWFLSNNRKKPLL

SEQ ID NO: 3159396 - protein, 23 aa, Giardia lamblia
KERTLKDLNGWSALVHASYGGHA

SEQ ID NO: 3159397 - protein, 24 aa, Giardia lamblia
KESERKAKERQLMAKKIAALIEAN

SEQ ID NO: 3159398 - protein, 24 aa, Giardia lamblia
KESHLLVYFPRFAMGTERAFKRLS

SEQ ID NO: 3159399 - protein, 30 aa, Giardia lamblia
KESICPSPRSFDCSMGIVLDDLVANQHRLK

SEQ ID NO: 3159400 - protein, 18 aa, Giardia lamblia
KESILAEMECQKAILESV

SEQ ID NO: 3159401 - protein, 24 aa, Giardia lamblia
KESKLRACGMSGVSDTSAVRADEE

SEQ ID NO: 3159402 - protein, 21 aa, Giardia lamblia
KESLQRINLLTCELQTRNDEL

SEQ ID NO: 3159403 - protein, 26 aa, Giardia lamblia
KESRKLCSANKLALYYALVEGNLEIA

SEQ ID NO: 3159404 - protein, 19 aa, Giardia lamblia
KESRLTTTQLYYGGEFYEL

SEQ ID NO: 3159405 - protein, 23 aa, Giardia lamblia
KETAFLSGLDSFLAREVEHRTHA

SEQ ID NO: 3159406 - protein, 23 aa, Giardia lamblia
KETARPIFWIHAAHNSRVRAFKE

SEQ ID NO: 3159407 - protein, 23 aa, Giardia lamblia
KETEALAFFKALRAQNCLSTHVH

SEQ ID NO: 3159408 - protein, 23 aa, Giardia lamblia
KETGKPVSYCMAGVRKADMSFGT

SEQ ID NO: 3159409 - protein, 18 aa, Giardia lamblia
KETGVVVRHCPVTGEPWT

SEQ ID NO: 3159410 - protein, 26 aa, Giardia lamblia
KETKVAFQVTFCYSFINAEVTASEMV

SEQ ID NO: 3159411 - protein, 24 aa, Giardia lamblia
KETLQLERWGFYYFDRLENGIPIL

SEQ ID NO: 3159412 - protein, 23 aa, Giardia lamblia
KETLRTCELSIVLVMQQLYICRL

SEQ ID NO: 3159413 - protein, 30 aa, Giardia lamblia
KETNLWNCTVCGEPATFVQLHIDAFYWFLL

SEQ ID NO: 3159414 - protein, 25 aa, Giardia lamblia
KETPLCIQTAVPIAARLTKIELSKS

SEQ ID NO: 3159415 - protein, 24 aa, Giardia lamblia
KETPLSRKVFKSENLNGSDVEDVF

SEQ ID NO: 3159416 - protein, 26 aa, Giardia lamblia
KETRFMLPCGFFKHRISTVHELKTLF

SEQ ID NO: 3159417 - protein, 19 aa, Giardia lamblia
KETVLLKRRAPDGRTQLAL

SEQ ID NO: 3159418 - protein, 21 aa, Giardia lamblia
KETVNFLILRYNEYMRNLDNP

SEQ ID NO: 3159419 - protein, 28 aa, Giardia lamblia
KEVASVIGDCRWRRASEVIEDFRINFAK

SEQ ID NO: 3159420 - protein, 22 aa, Giardia lamblia
KEVDKRSALLDAIIQTFIPQCE

SEQ ID NO: 3159421 - protein, 26 aa, Giardia lamblia
KEVHPGSRVFYMNGLAYGRTYHKTDI

SEQ ID NO: 3159422 - protein, 30 aa, Giardia lamblia
KEVINPRIDCPRSLDGISIRSSSVSRSYTH

SEQ ID NO: 3159423 - protein, 29 aa, Giardia lamblia
KEVLKASLEFCTFRASLLSAAGLDCSHVT

SEQ ID NO: 3159424 - protein, 20 aa, Giardia lamblia
KEVMRNTAPLSISQLQQNLP

SEQ ID NO: 3159425 - protein, 17 aa, Giardia lamblia
KEVRSFNTYRFAEKALK

SEQ ID NO: 3159426 - protein, 27 aa, Giardia lamblia
KEWELWNALPEWPLRGKKPYTCCLRAD

SEQ ID NO: 3159427 - protein, 17 aa, Giardia lamblia
KEWKYTLEYANILRRHN

SEQ ID NO: 3159428 - protein, 17 aa, Giardia lamblia
KEWPKDRRGSLRRQLGC

SEQ ID NO: 3159429 - protein, 25 aa, Giardia lamblia
KEYCMNTRLPANISELDRYDLTLLF

SEQ ID NO: 3159430 - protein, 25 aa, Giardia lamblia
KEYIIPSLWSILGLSKCLVVEIKAT

SEQ ID NO: 3159431 - protein, 20 aa, Giardia lamblia
KEYKLQIFIYVRYRPATFQI

SEQ ID NO: 3159432 - protein, 20 aa, Giardia lamblia
KEYLERCIALLTSHSTVVVA

SEQ ID NO: 3159433 - protein, 20 aa, Giardia lamblia
KEYMREYASNHLKPSLVTQM

SEQ ID NO: 3159434 - protein, 18 aa, Giardia lamblia
KEYSAISVFLGRDEGRNR

SEQ ID NO: 3159435 - protein, 17 aa, Giardia lamblia
KEYVCVLQFKDLAALKD

SEQ ID NO: 3159436 - protein, 23 aa, Giardia lamblia
KEYWDPRKCLFGITRLFEQLTSR

SEQ ID NO: 3159437 - protein, 19 aa, Giardia lamblia
KFANLSKERNSLFKELSTV

SEQ ID NO: 3159438 - protein, 18 aa, Giardia lamblia
KFAQALMYPGAFANEEEE

SEQ ID NO: 3159439 - protein, 25 aa, Giardia lamblia
KFCEACYKIQLTYVRDLDTSRPTSE

SEQ ID NO: 3159440 - protein, 29 aa, Giardia lamblia
KFDHVRQWLHICGPIDALWIESMNTVLDD

SEQ ID NO: 3159441 - protein, 21 aa, Giardia lamblia
KFDSGTGWPSFVSPLDYRVVA

SEQ ID NO: 3159442 - protein, 20 aa, Giardia lamblia
KFEIQRRWCLAELRAKEEKE

SEQ ID NO: 3159443 - protein, 21 aa, Giardia lamblia
KFEQLKHLFNLKDPDGIVAIL

SEQ ID NO: 3159444 - protein, 27 aa, Giardia lamblia
KFFCSLPLACLINSIALCIHGGIHAPE

SEQ ID NO: 3159445 - protein, 17 aa, Giardia lamblia
KFFICTLTANDFEQTSW

SEQ ID NO: 3159446 - protein, 26 aa, Giardia lamblia
KFFISCADWSCKIWADDIRTPILTTA

SEQ ID NO: 3159447 - protein, 18 aa, Giardia lamblia
KFFSINFRLTPPYHILFD

SEQ ID NO: 3159448 - protein, 19 aa, Giardia lamblia
KFGAIMAVLADCIRSAQVY

SEQ ID NO: 3159449 - protein, 19 aa, Giardia lamblia
KFGDLRSDLARVLTPASLH

SEQ ID NO: 3159450 - protein, 17 aa, Giardia lamblia
KFGYQLALRYGVQLREY

SEQ ID NO: 3159451 - protein, 19 aa, Giardia lamblia
KFHASIRKNSLAGIETDLA

SEQ ID NO: 3159452 - protein, 19 aa, Giardia lamblia
KFHNFRARAVTKLNMPVFQ

SEQ ID NO: 3159453 - protein, 23 aa, Giardia lamblia
KFIPRCTKESLEVVVKLLGESTH

SEQ ID NO: 3159454 - protein, 18 aa, Giardia lamblia
KFIRQYLVDSAVALQLTE

SEQ ID NO: 3159455 - protein, 24 aa, Giardia lamblia
KFIVQQHCRAHPYVGEAIDYLTMY

SEQ ID NO: 3159456 - protein, 26 aa, Giardia lamblia
KFKMFKIKDSDSWFSAVSEGKAKLVA

SEQ ID NO: 3159457 - protein, 21 aa, Giardia lamblia
KFKPSEIAAGCIAMSRRLTRK

SEQ ID NO: 3159458 - protein, 22 aa, Giardia lamblia
KFKRLSEYVNYIKAELVNTDMK

SEQ ID NO: 3159459 - protein, 21 aa, Giardia lamblia
KFKTILDAIGFSTSTKELAIR

SEQ ID NO: 3159460 - protein, 26 aa, Giardia lamblia
KFLAKKAEAPLLLWPINPMNKNKIND

SEQ ID NO: 3159461 - protein, 22 aa, Giardia lamblia
KFLETSLEWRAAAASYLDMDDP

SEQ ID NO: 3159462 - protein, 18 aa, Giardia lamblia
KFLLISMMQQKRKPIPSC

SEQ ID NO: 3159463 - protein, 17 aa, Giardia lamblia
KFLPAFITLFPVLMSSR

SEQ ID NO: 3159464 - protein, 25 aa, Giardia lamblia
KFMNIPAIEILYPMEYKLIDKENRT

SEQ ID NO: 3159465 - protein, 19 aa, Giardia lamblia
KFMYPTIVSTEWLGDHVQK

SEQ ID NO: 3159466 - protein, 24 aa, Giardia lamblia
KFNAIGCVELLAGCEAGIQDRSKV

SEQ ID NO: 3159467 - protein, 18 aa, Giardia lamblia
KFNLTQRIGRGFTLRELQ

SEQ ID NO: 3159468 - protein, 19 aa, Giardia lamblia
KFNTLSPFHHEFMDCYYNN

SEQ ID NO: 3159469 - protein, 17 aa, Giardia lamblia
KFPDMLARVRRVKQTRK

SEQ ID NO: 3159470 - protein, 18 aa, Giardia lamblia
KFPTFASLVKLWKNEFMR

SEQ ID NO: 3159471 - protein, 24 aa, Giardia lamblia
KFQVVLLIIRYVIELVKKLEFSSA

SEQ ID NO: 3159472 - protein, 30 aa, Giardia lamblia
KFRKTVDRWGRTALMYAARAGHSEILELLL

SEQ ID NO: 3159473 - protein, 19 aa, Giardia lamblia
KFRLGEGSVISGWEIGASG

SEQ ID NO: 3159474 - protein, 22 aa, Giardia lamblia
KFRYVNWPGPLMKYTIQRKTVL

SEQ ID NO: 3159475 - protein, 26 aa, Giardia lamblia
KFSALGRVRYLACVDVSLESIVEAIM

SEQ ID NO: 3159476 - protein, 21 aa, Giardia lamblia
KFSCMQNRFFGFKKKLSSSQS

SEQ ID NO: 3159477 - protein, 25 aa, Giardia lamblia
KFSTVCPRLKIILCSDNDAKRLLAD

SEQ ID NO: 3159478 - protein, 25 aa, Giardia lamblia
KFTGLPEEWQKLGLIPESMISTITD

SEQ ID NO: 3159479 - protein, 19 aa, Giardia lamblia
KFTPLYHFFGYEGRCAAPS

SEQ ID NO: 3159480 - protein, 21 aa, Giardia lamblia
KFTSRFIKALLLTIQTFNGKM

SEQ ID NO: 3159481 - protein, 17 aa, Giardia lamblia
KFVCLPCNHLIIHRVRE

SEQ ID NO: 3159482 - protein, 23 aa, Giardia lamblia
KFVFEDVPLFMGLINDLCPNIKL

SEQ ID NO: 3159483 - protein, 20 aa, Giardia lamblia
KFVGVNIMKTDFAKAVFSAE

SEQ ID NO: 3159484 - protein, 23 aa, Giardia lamblia
KFYDSLRVLYSILLADCDELVEV

SEQ ID NO: 3159485 - protein, 32 aa, Giardia lamblia
KGADCTIIPSSILLKLHLDTCAEDTPESALDA

SEQ ID NO: 3159486 - protein, 19 aa, Giardia lamblia
KGAFSKVFLAYTPEFQRRA

SEQ ID NO: 3159487 - protein, 20 aa, Giardia lamblia
KGALATRLLGKQVIIPPGTS

SEQ ID NO: 3159488 - protein, 17 aa, Giardia lamblia
KGANVLLPSDGTELSMR

SEQ ID NO: 3159489 - protein, 32 aa, Giardia lamblia
KGASNTVCFQELFKPAIGLFMQKCHTQTYKTK

SEQ ID NO: 3159490 - protein, 19 aa, Giardia lamblia
KGAWIVNGWKQDGSYIEIN

SEQ ID NO: 3159491 - protein, 26 aa, Giardia lamblia
KGAYFRIEEAFSLFVQIVSGVAYLHA

SEQ ID NO: 3159492 - protein, 17 aa, Giardia lamblia
KGCKSLVLASHLGRPKG

SEQ ID NO: 3159493 - protein, 23 aa, Giardia lamblia
KGCTDFLVDMCHPMHALTDADVP

SEQ ID NO: 3159494 - protein, 20 aa, Giardia lamblia
KGCTEMASILVPYEKGLTDS

SEQ ID NO: 3159495 - protein, 29 aa, Giardia lamblia
KGDALSPSFRQLALLEMLQLVNKELSKSP

SEQ ID NO: 3159496 - protein, 20 aa, Giardia lamblia
KGDRSVGVLTKIDIVDKGTE

SEQ ID NO: 3159497 - protein, 21 aa, Giardia lamblia
KGDVARLLAERSALKKRIEDL

SEQ ID NO: 3159498 - protein, 18 aa, Giardia lamblia
KGDVDSIIFNTRMVYSSF

SEQ ID NO: 3159499 - protein, 21 aa, Giardia lamblia
KGEACSVSLVAPDTGAEAARF

SEQ ID NO: 3159500 - protein, 22 aa, Giardia lamblia
KGEESFKRTLRMVPVSESYASV

SEQ ID NO: 3159501 - protein, 21 aa, Giardia lamblia
KGETALMVAVRAGNLAAAHIL

SEQ ID NO: 3159502 - protein, 26 aa, Giardia lamblia
KGEVGSKTKYGWTALMFATVQNYLNL

SEQ ID NO: 3159503 - protein, 25 aa, Giardia lamblia
KGFLPQITSIAWRPDVSVLTVGTSL

SEQ ID NO: 3159504 - protein, 20 aa, Giardia lamblia
KGGCGMTALMHAAMYNRPTA

SEQ ID NO: 3159505 - protein, 27 aa, Giardia lamblia
KGGEMTTDCGWNPLMHSIIRQNMHEFN

SEQ ID NO: 3159506 - protein, 21 aa, Giardia lamblia
KGGIIKFNVLKMGQNAADVIL

SEQ ID NO: 3159507 - protein, 35 aa, Giardia lamblia
KGGIWSNASLKTFWRELANLISPEKQVLWKALDDS

SEQ ID NO: 3159508 - protein, 18 aa, Giardia lamblia
KGGLSVALAEQIALELSP

SEQ ID NO: 3159509 - protein, 21 aa, Giardia lamblia
KGGRRHARYTFLVLHQDYSDQ

SEQ ID NO: 3159510 - protein, 23 aa, Giardia lamblia
KGHDSCVRALVPYEGGLADDEGH

SEQ ID NO: 3159511 - protein, 20 aa, Giardia lamblia
KGHIEAASLLVSYEKNLIDD

SEQ ID NO: 3159512 - protein, 19 aa, Giardia lamblia
KGHINAIRLLLPYEQDLRD

SEQ ID NO: 3159513 - protein, 26 aa, Giardia lamblia
KGHLECIKLLLEKEGGMRDSGGWTAL

SEQ ID NO: 3159514 - protein, 20 aa, Giardia lamblia
KGHTALMMAAQLGYLRIVQE

SEQ ID NO: 3159515 - protein, 21 aa, Giardia lamblia
KGICGYCLDVTVGVSAPLQIQ

SEQ ID NO: 3159516 - protein, 18 aa, Giardia lamblia
KGIKEFIRSPSLGLSNPR

SEQ ID NO: 3159517 - protein, 22 aa, Giardia lamblia
KGIKLIKTRCRDVLTQDMRTLL

SEQ ID NO: 3159518 - protein, 19 aa, Giardia lamblia
KGISFDIVYGDTILLALAH

SEQ ID NO: 3159519 - protein, 22 aa, Giardia lamblia
KGITPPLTHDVHCHLTKQFLVS

SEQ ID NO: 3159520 - protein, 20 aa, Giardia lamblia
KGKPTARFTKTFVRNNNIRC

SEQ ID NO: 3159521 - protein, 18 aa, Giardia lamblia
KGKTALMIAVEMDAIDAV

SEQ ID NO: 3159522 - protein, 30 aa, Giardia lamblia
KGLARCPYCRTIISEIFNPYFLQLTDNSKH

SEQ ID NO: 3159523 - protein, 29 aa, Giardia lamblia
KGLHEMRFKKGAVLAGRYEIYKTIFEDSA

SEQ ID NO: 3159524 - protein, 25 aa, Giardia lamblia
KGLIPVCYRIIYGSLTPVIEGDASR

SEQ ID NO: 3159525 - protein, 26 aa, Giardia lamblia
KGLKSYIPFHIASIIRRHEHLEASAI

SEQ ID NO: 3159526 - protein, 19 aa, Giardia lamblia
KGLPDYSDGKFILVGPSAV

SEQ ID NO: 3159527 - protein, 24 aa, Giardia lamblia
KGLPPISFQRMFVGSNVLAPYIIS

SEQ ID NO: 3159528 - protein, 24 aa, Giardia lamblia
KGLTESIRRMWEPDSVLVPLYGEG

SEQ ID NO: 3159529 - protein, 17 aa, Giardia lamblia
KGLYPGSSLLVINPTTG

SEQ ID NO: 3159530 - protein, 19 aa, Giardia lamblia
KGMIKSFIQICETMQNKKL

SEQ ID NO: 3159531 - protein, 18 aa, Giardia lamblia
KGNLPGHVIASTPGHTFG

SEQ ID NO: 3159532 - protein, 18 aa, Giardia lamblia
KGNNCCPNVFWLDAAHNI

SEQ ID NO: 3159533 - protein, 21 aa, Giardia lamblia
KGNPLPVFIHQDLKPDSILVS

SEQ ID NO: 3159534 - protein, 20 aa, Giardia lamblia
KGPAGAFLASYVKVDKLSQV

SEQ ID NO: 3159535 - protein, 25 aa, Giardia lamblia
KGPFMFSVGSARAYELLDEYKQRVN

SEQ ID NO: 3159536 - protein, 27 aa, Giardia lamblia
KGPKQLKTAYLWSNYHMLSPIYDDCKF

SEQ ID NO: 3159537 - protein, 26 aa, Giardia lamblia
KGPQIPRYVMRVSHCAFLSIVDNARI

SEQ ID NO: 3159538 - protein, 19 aa, Giardia lamblia
KGQCVRLATRSVWEPSTDN

SEQ ID NO: 3159539 - protein, 20 aa, Giardia lamblia
KGQILGPLARYDPRVQARDA

SEQ ID NO: 3159540 - protein, 17 aa, Giardia lamblia
KGQLICESTLWDIAAQL

SEQ ID NO: 3159541 - protein, 18 aa, Giardia lamblia
KGRACAQEGPSHLQGRPA

SEQ ID NO: 3159542 - protein, 28 aa, Giardia lamblia
KGRRDARGRTALMYAAEAGHLVIAEALL

SEQ ID NO: 3159543 - protein, 22 aa, Giardia lamblia
KGSCANLESWDKAWVIGLAKHR

SEQ ID NO: 3159544 - protein, 19 aa, Giardia lamblia
KGSEVKWADTVLDDNEERY

SEQ ID NO: 3159545 - protein, 24 aa, Giardia lamblia
KGSEWFPECKSILEFAQKAANFTN

SEQ ID NO: 3159546 - protein, 18 aa, Giardia lamblia
KGSGISIASTFKVTELIL

SEQ ID NO: 3159547 - protein, 20 aa, Giardia lamblia
KGSQSVFCSSVYSVDERPTT

SEQ ID NO: 3159548 - protein, 17 aa, Giardia lamblia
KGSRKALTELLTKFKVL

SEQ ID NO: 3159549 - protein, 19 aa, Giardia lamblia
KGSSAFGIITPSAITAMKS

SEQ ID NO: 3159550 - protein, 23 aa, Giardia lamblia
KGSVKIGRWVIRDGTALMIAAVR

SEQ ID NO: 3159551 - protein, 19 aa, Giardia lamblia
KGTAPELLKSLGVTTKAEV

SEQ ID NO: 3159552 - protein, 18 aa, Giardia lamblia
KGTFRFKELEAEHSALQN

SEQ ID NO: 3159553 - protein, 24 aa, Giardia lamblia
KGTICKRCKYLLIPHQTATLSVYR

SEQ ID NO: 3159554 - protein, 19 aa, Giardia lamblia
KGTISLIISDVCNREQLLL

SEQ ID NO: 3159555 - protein, 19 aa, Giardia lamblia
KGTRALSNYLFTNGIWHPI

SEQ ID NO: 3159556 - protein, 18 aa, Giardia lamblia
KGTSAWHYFSSESYNPLS

SEQ ID NO: 3159557 - protein, 22 aa, Giardia lamblia
KGTSRAALYTMWRDAAFRRYAE

SEQ ID NO: 3159558 - protein, 19 aa, Giardia lamblia
KGTVQCLFFGMGSDGVVGA

SEQ ID NO: 3159559 - protein, 25 aa, Giardia lamblia
KGVIAKDMLKGFIITLRTFRRRGYI

SEQ ID NO: 3159560 - protein, 23 aa, Giardia lamblia
KGVPPCKNCPLESVQELPADFPF

SEQ ID NO: 3159561 - protein, 18 aa, Giardia lamblia
KGWYQCKGTTRWGDSLVF

SEQ ID NO: 3159562 - protein, 22 aa, Giardia lamblia
KGYADICKLLAPGEAKLQKADG

SEQ ID NO: 3159563 - protein, 27 aa, Giardia lamblia
KGYISRDFADGVLLAEVIHHFLPKLVE

SEQ ID NO: 3159564 - protein, 22 aa, Giardia lamblia
KGYKHVFCCSTAKQGYASTAMF

SEQ ID NO: 3159565 - protein, 18 aa, Giardia lamblia
KGYLNSRIDDLYAELKKG

SEQ ID NO: 3159566 - protein, 24 aa, Giardia lamblia
KGYLSEKRMLLGMESIDKMLQIRI

SEQ ID NO: 3159567 - protein, 17 aa, Giardia lamblia
KGYREIVELLDPTDENG

SEQ ID NO: 3159568 - protein, 17 aa, Giardia lamblia
KGYVDCISLLHAEGNLT

SEQ ID NO: 3159569 - protein, 17 aa, Giardia lamblia
KGYWRIAECERIMHQLD

SEQ ID NO: 3159570 - protein, 18 aa, Giardia lamblia
KHAAIIIGGLQPCSRPHS

SEQ ID NO: 3159571 - protein, 27 aa, Giardia lamblia
KHAIDPLLWQEYVKQLEFLTTSIKLSS

SEQ ID NO: 3159572 - protein, 18 aa, Giardia lamblia
KHAIFKRHIKGVSRASIF

SEQ ID NO: 3159573 - protein, 20 aa, Giardia lamblia
KHAVLLKIQGLRALYDTLVK

SEQ ID NO: 3159574 - protein, 24 aa, Giardia lamblia
KHAYKIYGDMGTDIERCFDKRMAP

SEQ ID NO: 3159575 - protein, 19 aa, Giardia lamblia
KHAYLRAFIIDPLFVQHKD

SEQ ID NO: 3159576 - protein, 23 aa, Giardia lamblia
KHDCLKLVLAKERYIPDDDGNYV

SEQ ID NO: 3159577 - protein, 18 aa, Giardia lamblia
KHDVCGRSLMLLTEDDLK

SEQ ID NO: 3159578 - protein, 22 aa, Giardia lamblia
KHECASCGYPSAKMRRYNWSYK

SEQ ID NO: 3159579 - protein, 21 aa, Giardia lamblia
KHEEELRLSLKESQDAFPQDV

SEQ ID NO: 3159580 - protein, 26 aa, Giardia lamblia
KHEKDVLKWTFLMCAAAKGDVATVKK

SEQ ID NO: 3159581 - protein, 22 aa, Giardia lamblia
KHELRKQLNLIKVQIKETDGLV

SEQ ID NO: 3159582 - protein, 30 aa, Giardia lamblia
KHERAEMIITQLKRLLMGISDVCLTGTERV

SEQ ID NO: 3159583 - protein, 24 aa, Giardia lamblia
KHFDPRKAASIAVYKQSRYAFSSY

SEQ ID NO: 3159584 - protein, 26 aa, Giardia lamblia
KHFYQLKTLQTWIAFRKYKRYCRNRK

SEQ ID NO: 3159585 - protein, 26 aa, Giardia lamblia
KHGGAVKCFASLRLNEVLAAHMNKSF

SEQ ID NO: 3159586 - protein, 37 aa, Giardia lamblia
KHGKTALILAIELRKPAFVRILLPLEHTLCLENGSSP

SEQ ID NO: 3159587 - protein, 20 aa, Giardia lamblia
KHGRGGQSSVRFARLREEAR

SEQ ID NO: 3159588 - protein, 26 aa, Giardia lamblia
KHGRRECLRLLLAEAGQVNSDGETAL

SEQ ID NO: 3159589 - protein, 19 aa, Giardia lamblia
KHHPTWHVIVGKNFGSYIT

SEQ ID NO: 3159590 - protein, 21 aa, Giardia lamblia
KHILSSLMVHKRCKKCKTLDW

SEQ ID NO: 3159591 - protein, 26 aa, Giardia lamblia
KHKDAWKRDVYESFKVRTKIYTKIKT

SEQ ID NO: 3159592 - protein, 20 aa, Giardia lamblia
KHKDGVVAPELLKTSGTLPV

SEQ ID NO: 3159593 - protein, 22 aa, Giardia lamblia
KHKNCSMKLLLNVHPLGHTFPG

SEQ ID NO: 3159594 - protein, 17 aa, Giardia lamblia
KHKYGVGAFNVNNMEQI

SEQ ID NO: 3159595 - protein, 26 aa, Giardia lamblia
KHLIELFSACSFRKIKVIPFTHFTLI

SEQ ID NO: 3159596 - protein, 18 aa, Giardia lamblia
KHLIGAIMKLREREQSDF

SEQ ID NO: 3159597 - protein, 25 aa, Giardia lamblia
KHLNKSLKQLLAWSKAYANSKLVTN

SEQ ID NO: 3159598 - protein, 20 aa, Giardia lamblia
KHLRDPVSVVAKNIVPPSVG

SEQ ID NO: 3159599 - protein, 18 aa, Giardia lamblia
KHMIACESCAKGLARCPY

SEQ ID NO: 3159600 - protein, 17 aa, Giardia lamblia
KHNETGLVYAIKHNRVD

SEQ ID NO: 3159601 - protein, 23 aa, Giardia lamblia
KHNPFLRRYALIVMELGDTDLRS

SEQ ID NO: 3159602 - protein, 19 aa, Giardia lamblia
KHNVPLVLFSGCTDIYLTL

SEQ ID NO: 3159603 - protein, 20 aa, Giardia lamblia
KHPSRLSYFRACSLLKQALA

SEQ ID NO: 3159604 - protein, 18 aa, Giardia lamblia
KHQFFKKTLFEMILSADY

SEQ ID NO: 3159605 - protein, 25 aa, Giardia lamblia
KHRFCYRGYTALMWAVYTNSAHFTK

SEQ ID NO: 3159606 - protein, 20 aa, Giardia lamblia
KHRRRKVKKHTVQSYKNEPT

SEQ ID NO: 3159607 - protein, 25 aa, Giardia lamblia
KHRSMKSIGILLEFLTTEKNGDHNN

SEQ ID NO: 3159608 - protein, 18 aa, Giardia lamblia
KHSAKRPFVPLRRPAEGF

SEQ ID NO: 3159609 - protein, 22 aa, Giardia lamblia
KHSEFKTVIARLLPGVTETILP

SEQ ID NO: 3159610 - protein, 24 aa, Giardia lamblia
KHSFGNDVLLEFLEQVVLELLEVK

SEQ ID NO: 3159611 - protein, 18 aa, Giardia lamblia
KHSLEFITSNFVVLSKYE

SEQ ID NO: 3159612 - protein, 29 aa, Giardia lamblia
KHSMKRLPCTTIRLLLEYCSGGNCVKLLI

SEQ ID NO: 3159613 - protein, 17 aa, Giardia lamblia
KHSPRRMQRLFEEDATG

SEQ ID NO: 3159614 - protein, 21 aa, Giardia lamblia
KHSSKCPISYIDIVNLKSPLR

SEQ ID NO: 3159615 - protein, 17 aa, Giardia lamblia
KHTLCFNPETGQGISLR

SEQ ID NO: 3159616 - protein, 17 aa, Giardia lamblia
KHTSRVWDVIWASTNGG

SEQ ID NO: 3159617 - protein, 19 aa, Giardia lamblia
KHVDPAISLMKLDKVPDQS

SEQ ID NO: 3159618 - protein, 17 aa, Giardia lamblia
KHVKISVSAVYYAQTAG

SEQ ID NO: 3159619 - protein, 24 aa, Giardia lamblia
KHVLRGHKNWVLRVAYSPCATRLA

SEQ ID NO: 3159620 - protein, 19 aa, Giardia lamblia
KHVYLPDEDTFLLIDTLTK

SEQ ID NO: 3159621 - protein, 22 aa, Giardia lamblia
KHVYRIRPAIVSYCDLISQKSR

SEQ ID NO: 3159622 - protein, 20 aa, Giardia lamblia
KHYMCGCGFMATETHISRTE

SEQ ID NO: 3159623 - protein, 18 aa, Giardia lamblia
KHYSGFVGDSWSLGCSIC

SEQ ID NO: 3159624 - protein, 25 aa, Giardia lamblia
KIADFGFCRPLELVSITGSASVQKV

SEQ ID NO: 3159625 - protein, 17 aa, Giardia lamblia
KIADLCASHCVIRNFVR

SEQ ID NO: 3159626 - protein, 17 aa, Giardia lamblia
KIAELFNKYKVGSVVDI

SEQ ID NO: 3159627 - protein, 18 aa, Giardia lamblia
KIALAEKTMYCFDNEAIR

SEQ ID NO: 3159628 - protein, 18 aa, Giardia lamblia
KIARPDAVHLLRGNHETE

SEQ ID NO: 3159629 - protein, 18 aa, Giardia lamblia
KIARQELRITSLQEKIKS

SEQ ID NO: 3159630 - protein, 18 aa, Giardia lamblia
KIATLLAKLFKATTDPQI

SEQ ID NO: 3159631 - protein, 17 aa, Giardia lamblia
KIAVATMTDWHTTGKHE

SEQ ID NO: 3159632 - protein, 27 aa, Giardia lamblia
KIDEIHPFYRYWFNIMYDKDHFKIALG

SEQ ID NO: 3159633 - protein, 24 aa, Giardia lamblia
KIDGFRFDGVMSLMYYHRSAGVGY

SEQ ID NO: 3159634 - protein, 26 aa, Giardia lamblia
KIDIWALGCAIYRFCHGTDIFSQPQK

SEQ ID NO: 3159635 - protein, 17 aa, Giardia lamblia
KIDKICHLGEYDQVVTA

SEQ ID NO: 3159636 - protein, 35 aa, Giardia lamblia
KIDPTVRIPRTFKRFCGLIVQLLYKLTIRAEDSNR

SEQ ID NO: 3159637 - protein, 23 aa, Giardia lamblia
KIDSETLLAYKAMRVPSDEQGQF

SEQ ID NO: 3159638 - protein, 20 aa, Giardia lamblia
KIDSWSVGVILIQILTGKTS

SEQ ID NO: 3159639 - protein, 23 aa, Giardia lamblia
KIEAIWKTVSFEFKVLSGDRYKS

SEQ ID NO: 3159640 - protein, 34 aa, Giardia lamblia
KIEDSPLIKAARMGDAFGVRMNMERWKRKPDALG

SEQ ID NO: 3159641 - protein, 20 aa, Giardia lamblia
KIEQKDCFIKLEAVEQKSAF

SEQ ID NO: 3159642 - protein, 23 aa, Giardia lamblia
KIESLLPLYDDWRAANGNTGLMV

SEQ ID NO: 3159643 - protein, 27 aa, Giardia lamblia
KIESLYDIFKYSLPIKETEIIDYFFPK

SEQ ID NO: 3159644 - protein, 19 aa, Giardia lamblia
KIETYMIGRIVLLLCDLSP

SEQ ID NO: 3159645 - protein, 24 aa, Giardia lamblia
KIFGRTGLIPDMRAFTASSADTTL

SEQ ID NO: 3159646 - protein, 23 aa, Giardia lamblia
KIGASTYYWCFASKRSQAARTEL

SEQ ID NO: 3159647 - protein, 22 aa, Giardia lamblia
KIGDFGLARAFGIPIRQFTHEI

SEQ ID NO: 3159648 - protein, 18 aa, Giardia lamblia
KIGHWLTYRETALMRAAE

SEQ ID NO: 3159649 - protein, 26 aa, Giardia lamblia
KIHGQRVPGIVFMRGGSVGVLPVLID

SEQ ID NO: 3159650 - protein, 20 aa, Giardia lamblia
KIHHSVVFPHGYEIPRDPAN

SEQ ID NO: 3159651 - protein, 17 aa, Giardia lamblia
KIHKLRDLLSHLDLQCK

SEQ ID NO: 3159652 - protein, 18 aa, Giardia lamblia
KIHLGAGIVVEMTYAEAK

SEQ ID NO: 3159653 - protein, 25 aa, Giardia lamblia
KIHQFPIPFCKSLCFTNAGNLLVAG

SEQ ID NO: 3159654 - protein, 31 aa, Giardia lamblia
KIHYTCPRCRVIFCRPHPGIQYPQLLHDPAA

SEQ ID NO: 3159655 - protein, 18 aa, Giardia lamblia
KIIHCHKDAVMTISAGLC

SEQ ID NO: 3159656 - protein, 17 aa, Giardia lamblia
KIIKSRNTIFIIMDRRC

SEQ ID NO: 3159657 - protein, 17 aa, Giardia lamblia
KIINWWRYATVTGAFNS

SEQ ID NO: 3159658 - protein, 20 aa, Giardia lamblia
KIKQTILTMRQWIPDIQRSI

SEQ ID NO: 3159659 - protein, 20 aa, Giardia lamblia
KIKSLREALGSLKIAYRSLL

SEQ ID NO: 3159660 - protein, 19 aa, Giardia lamblia
KILDIADCFADIGRVNEAT

SEQ ID NO: 3159661 - protein, 18 aa, Giardia lamblia
KILKLITEIDCKDCEIDA

SEQ ID NO: 3159662 - protein, 18 aa, Giardia lamblia
KILRRKDDEISRLQKLLY

SEQ ID NO: 3159663 - protein, 27 aa, Giardia lamblia
KILSLDRFTYPTLYRHTGVPYPSLIMP

SEQ ID NO: 3159664 - protein, 18 aa, Giardia lamblia
KILTEMLLGFSKQIISHI

SEQ ID NO: 3159665 - protein, 19 aa, Giardia lamblia
KILTILLQILDEGRLTDGK

SEQ ID NO: 3159666 - protein, 42 aa, Giardia lamblia
KILVEPEAGMTMLSEWRGATALMWAARLGHYEACELLVSEAG

SEQ ID NO: 3159667 - protein, 17 aa, Giardia lamblia
KIMSTKSLDEFYRVEAS

SEQ ID NO: 3159668 - protein, 17 aa, Giardia lamblia
KINEFNVADKFARKAVE

SEQ ID NO: 3159669 - protein, 19 aa, Giardia lamblia
KINPSDCSDWFYSDRKGRI

SEQ ID NO: 3159670 - protein, 20 aa, Giardia lamblia
KINPTLIMPGGRTYQLRHKL

SEQ ID NO: 3159671 - protein, 19 aa, Giardia lamblia
KINQCIVFVNSVQRCEALY

SEQ ID NO: 3159672 - protein, 17 aa, Giardia lamblia
KIPDALRTLTRIGNQAL

SEQ ID NO: 3159673 - protein, 17 aa, Giardia lamblia
KIPEYPKITSVLPAQLR

SEQ ID NO: 3159674 - protein, 18 aa, Giardia lamblia
KIQAALENFRMEYDNEAE

SEQ ID NO: 3159675 - protein, 25 aa, Giardia lamblia
KIQKRPCMVCASCYIHRVCQCLLNF

SEQ ID NO: 3159676 - protein, 30 aa, Giardia lamblia
KIQVKFPTPWKGVKVLTLIAKYGGLLTKMG

SEQ ID NO: 3159677 - protein, 18 aa, Giardia lamblia
KIRAGDLRGDWTGDSVAQ

SEQ ID NO: 3159678 - protein, 17 aa, Giardia lamblia
KIRAICERYNVVVETEE

SEQ ID NO: 3159679 - protein, 17 aa, Giardia lamblia
KIRELEGKVALLESALK

SEQ ID NO: 3159680 - protein, 17 aa, Giardia lamblia
KIRTCLASSTPKAAGAS

SEQ ID NO: 3159681 - protein, 19 aa, Giardia lamblia
KIRVYLCHDCQRVSADLSF

SEQ ID NO: 3159682 - protein, 27 aa, Giardia lamblia
KISDKAEDSWFMYLKQECFYTRETTAL

SEQ ID NO: 3159683 - protein, 25 aa, Giardia lamblia
KISEISRLKEEIAILEERIQAKDNK

SEQ ID NO: 3159684 - protein, 18 aa, Giardia lamblia
KISFKHKYDLEIVTKKYE

SEQ ID NO: 3159685 - protein, 19 aa, Giardia lamblia
KISLKYSKRLCQVVSAAET

SEQ ID NO: 3159686 - protein, 23 aa, Giardia lamblia
KITAHLSTIFAFTLLDDYLISSG

SEQ ID NO: 3159687 - protein, 18 aa, Giardia lamblia
KITLMPSISAQSIRKQLA

SEQ ID NO: 3159688 - protein, 26 aa, Giardia lamblia
KITVPLHLLKVALPLYSKQSTQVEYV

SEQ ID NO: 3159689 - protein, 25 aa, Giardia lamblia
KIVERYDLKGSWVGRHTKLHAPDDR

SEQ ID NO: 3159690 - protein, 19 aa, Giardia lamblia
KIVGSCYALAFATDCEPLN

SEQ ID NO: 3159691 - protein, 22 aa, Giardia lamblia
KIVKHDAVAIFSRLSKDQKDKL

SEQ ID NO: 3159692 - protein, 18 aa, Giardia lamblia
KIYKRKNLNISLEKSLDI

SEQ ID NO: 3159693 - protein, 31 aa, Giardia lamblia
KIYRDFGDEIYLKSSRPLDCEKLCTNTSAPD

SEQ ID NO: 3159694 - protein, 18 aa, Giardia lamblia
KIYREIKILTNLLAGPNC

SEQ ID NO: 3159695 - protein, 18 aa, Giardia lamblia
KIYTCIAGSVSHAQFLVN

SEQ ID NO: 3159696 - protein, 20 aa, Giardia lamblia
KIYYHFASDPSREYTLNLPC

SEQ ID NO: 3159697 - protein, 19 aa, Giardia lamblia
KKAAEEFATEMARRELQYY

SEQ ID NO: 3159698 - protein, 18 aa, Giardia lamblia
KKAEIALREIAAPTADEM

SEQ ID NO: 3159699 - protein, 20 aa, Giardia lamblia
KKAISLLCIERAHDSLLSYV

SEQ ID NO: 3159700 - protein, 22 aa, Giardia lamblia
KKALISYDFTNPLLIKQHTIPA

SEQ ID NO: 3159701 - protein, 17 aa, Giardia lamblia
KKALPLLLDTTVLPDFD

SEQ ID NO: 3159702 - protein, 17 aa, Giardia lamblia
KKAMLSNKIKLTAMKLH

SEQ ID NO: 3159703 - protein, 21 aa, Giardia lamblia
KKARRSPRLQVQSHKEEHRIH

SEQ ID NO: 3159704 - protein, 20 aa, Giardia lamblia
KKCDWNHCIRELRKGRIRPY

SEQ ID NO: 3159705 - protein, 25 aa, Giardia lamblia
KKCGDCALQCPCFVKGRTEPAHINA

SEQ ID NO: 3159706 - protein, 23 aa, Giardia lamblia
KKCQEHLKILYGMEKATWLIVDD

SEQ ID NO: 3159707 - protein, 24 aa, Giardia lamblia
KKDELRIAFIASEYSSPSRLKIAQ

SEQ ID NO: 3159708 - protein, 23 aa, Giardia lamblia
KKDLKGLSLSLVRKFSLQLLIAF

SEQ ID NO: 3159709 - protein, 23 aa, Giardia lamblia
KKDLRKGHAFEGGVGKKAMKKQG

SEQ ID NO: 3159710 - protein, 24 aa, Giardia lamblia
KKDYDRLSSLLIEFNSLMNNVRVS

SEQ ID NO: 3159711 - protein, 18 aa, Giardia lamblia
KKEADALSLVGYVTNNED

SEQ ID NO: 3159712 - protein, 19 aa, Giardia lamblia
KKEETLCLQALRNLQFQVV

SEQ ID NO: 3159713 - protein, 24 aa, Giardia lamblia
KKEKGLRDKTGWTALMIAAEKGSL

SEQ ID NO: 3159714 - protein, 25 aa, Giardia lamblia
KKELKELKMQYALQLIRAQELIDKI

SEQ ID NO: 3159715 - protein, 21 aa, Giardia lamblia
KKERSRFERKFNEYKQKLNVK

SEQ ID NO: 3159716 - protein, 29 aa, Giardia lamblia
KKEVKCMKNDGSSALMWAASVGNVEMVKL

SEQ ID NO: 3159717 - protein, 19 aa, Giardia lamblia
KKFDCVIYIPSSVDDLIDG

SEQ ID NO: 3159718 - protein, 25 aa, Giardia lamblia
KKFKVLPTLCRYLAKKHLKAKIRTR

SEQ ID NO: 3159719 - protein, 25 aa, Giardia lamblia
KKFPDLSSLLLLRLSQQPEKLHPQH

SEQ ID NO: 3159720 - protein, 17 aa, Giardia lamblia
KKFSHWDNLPILLRRTL

SEQ ID NO: 3159721 - protein, 19 aa, Giardia lamblia
KKGAQSIIFCKTRKFVDEC

SEQ ID NO: 3159722 - protein, 18 aa, Giardia lamblia
KKGGAVVRIVRKKEERKT

SEQ ID NO: 3159723 - protein, 24 aa, Giardia lamblia
KKGKGHLSIEDWVTIVTTFGLNAD

SEQ ID NO: 3159724 - protein, 18 aa, Giardia lamblia
KKGLAKMSEKELFNLFHA

SEQ ID NO: 3159725 - protein, 19 aa, Giardia lamblia
KKGLGLATRGTIAAAEAAD

SEQ ID NO: 3159726 - protein, 18 aa, Giardia lamblia
KKGLLCPQNPNRKDIINA

SEQ ID NO: 3159727 - protein, 19 aa, Giardia lamblia
KKGPFQSLMSMAWEPYPEM

SEQ ID NO: 3159728 - protein, 18 aa, Giardia lamblia
KKGPGRRSKYMNILDFVK

SEQ ID NO: 3159729 - protein, 21 aa, Giardia lamblia
KKGRHLRAMRMGKEYDVWLLS

SEQ ID NO: 3159730 - protein, 20 aa, Giardia lamblia
KKGRTALMRAAETNDKGSVD

SEQ ID NO: 3159731 - protein, 23 aa, Giardia lamblia
KKHLAEFFRFAVSTADGDTIKQF

SEQ ID NO: 3159732 - protein, 22 aa, Giardia lamblia
KKHLAMIKALENRFTKFSSEMN

SEQ ID NO: 3159733 - protein, 19 aa, Giardia lamblia
KKHRFKRLNSVSGAPRRHS

SEQ ID NO: 3159734 - protein, 19 aa, Giardia lamblia
KKIAVAWNKKYNFIMVVGA

SEQ ID NO: 3159735 - protein, 19 aa, Giardia lamblia
KKIEELPDNLYYVVDSAGK

SEQ ID NO: 3159736 - protein, 21 aa, Giardia lamblia
KKIGGRRGAMFSFGLKLYRFS

SEQ ID NO: 3159737 - protein, 21 aa, Giardia lamblia
KKIKCLEEQIAEMENTLGSTL

SEQ ID NO: 3159738 - protein, 17 aa, Giardia lamblia
KKILGLKQGMDYSTQEA

SEQ ID NO: 3159739 - protein, 18 aa, Giardia lamblia
KKILKLDPYKVGDDGRSM

SEQ ID NO: 3159740 - protein, 25 aa, Giardia lamblia
KKILKPSWKNSLLLMNQAGFLRSLL

SEQ ID NO: 3159741 - protein, 18 aa, Giardia lamblia
KKIQCLQQTVFKECQERS

SEQ ID NO: 3159742 - protein, 22 aa, Giardia lamblia
KKIQRVEALISRNEEALEPVQK

SEQ ID NO: 3159743 - protein, 19 aa, Giardia lamblia
KKISEIHIDLRLRILDSPG

SEQ ID NO: 3159744 - protein, 20 aa, Giardia lamblia
KKIYARKTVKYGKLDQRGVE

SEQ ID NO: 3159745 - protein, 19 aa, Giardia lamblia
KKKAPAFSLSGRHAVAASN

SEQ ID NO: 3159746 - protein, 23 aa, Giardia lamblia
KKKKFSLKLSDFGFAVQLNTKQP

SEQ ID NO: 3159747 - protein, 21 aa, Giardia lamblia
KKLDFLRDILDTELMPVPTST

SEQ ID NO: 3159748 - protein, 23 aa, Giardia lamblia
KKLGEKRKAYLAKLSEREAHRMR

SEQ ID NO: 3159749 - protein, 22 aa, Giardia lamblia
KKLGRPFGCSLLIGGLDGSTPR

SEQ ID NO: 3159750 - protein, 20 aa, Giardia lamblia
KKLHRRLDDVLGRDATDTVY

SEQ ID NO: 3159751 - protein, 20 aa, Giardia lamblia
KKLKEMRDPLSGTRSLITIE

SEQ ID NO: 3159752 - protein, 23 aa, Giardia lamblia
KKLKVSVLGLLERYERVIYTGKE

SEQ ID NO: 3159753 - protein, 26 aa, Giardia lamblia
KKLLLELGLTRLVAWFEQCYLPPEAT

SEQ ID NO: 3159754 - protein, 19 aa, Giardia lamblia
KKLLNNIIETCIMFHNHTV

SEQ ID NO: 3159755 - protein, 24 aa, Giardia lamblia
KKLLRFKTIFSLLSLIDQRSSTKV

SEQ ID NO: 3159756 - protein, 20 aa, Giardia lamblia
KKLPCINPLITGQRTLDGLF

SEQ ID NO: 3159757 - protein, 26 aa, Giardia lamblia
KKLPPPERLRYINSIIGYFVDNVVTF

SEQ ID NO: 3159758 - protein, 19 aa, Giardia lamblia
KKLRDVSVLPDIVTESGAR

SEQ ID NO: 3159759 - protein, 19 aa, Giardia lamblia
KKLVAQKKPYKYLVSCTLM

SEQ ID NO: 3159760 - protein, 24 aa, Giardia lamblia
KKLVPRAPMEFNTSLLSSAPGLTS

SEQ ID NO: 3159761 - protein, 19 aa, Giardia lamblia
KKMGVMLMSTYRDVYVAQI

SEQ ID NO: 3159762 - protein, 22 aa, Giardia lamblia
KKMNAELVARMEHLSIMDSAET

SEQ ID NO: 3159763 - protein, 24 aa, Giardia lamblia
KKMQPIKVKPRIPSAPTKKNLSGI

SEQ ID NO: 3159764 - protein, 17 aa, Giardia lamblia
KKMTALMHAAQQGHTGP

SEQ ID NO: 3159765 - protein, 21 aa, Giardia lamblia
KKNEPRPLGPIQQQRITFQFP

SEQ ID NO: 3159766 - protein, 26 aa, Giardia lamblia
KKNFIRFSFTPDYMKFGMTSGLDRDH

SEQ ID NO: 3159767 - protein, 20 aa, Giardia lamblia
KKNMSFPDAYALLRSRRSCI

SEQ ID NO: 3159768 - protein, 26 aa, Giardia lamblia
KKNNYRLARLLARWEGGYQNTHGMTA

SEQ ID NO: 3159769 - protein, 20 aa, Giardia lamblia
KKNPAVWRYRGWVSSSEEES

SEQ ID NO: 3159770 - protein, 24 aa, Giardia lamblia
KKNRNLYGVYLLDMLMKRTLDDPF

SEQ ID NO: 3159771 - protein, 25 aa, Giardia lamblia
KKNTRLCTISGLAQFEYLLPKAPET

SEQ ID NO: 3159772 - protein, 31 aa, Giardia lamblia
KKPCPLCRRPILFWITECYDLATMSFTLAPN

SEQ ID NO: 3159773 - protein, 17 aa, Giardia lamblia
KKPELVTKLPPAVPQQH

SEQ ID NO: 3159774 - protein, 23 aa, Giardia lamblia
KKPLVFGGIRVGIDIEKTQTRFL

SEQ ID NO: 3159775 - protein, 17 aa, Giardia lamblia
KKPRLGLSDLIDMPQIR

SEQ ID NO: 3159776 - protein, 23 aa, Giardia lamblia
KKPRPGDQGLRIANCELNTLSGI

SEQ ID NO: 3159777 - protein, 23 aa, Giardia lamblia
KKPRSRSRVMFAGIDMSETGSAL

SEQ ID NO: 3159778 - protein, 27 aa, Giardia lamblia
KKPSQWTPELNDFLARCLDKDPDSRWS

SEQ ID NO: 3159779 - protein, 18 aa, Giardia lamblia
KKPSWRIPWMEVPVPGVK

SEQ ID NO: 3159780 - protein, 26 aa, Giardia lamblia
KKQLECMYYSYPFMKDVPHDANLLKE

SEQ ID NO: 3159781 - protein, 20 aa, Giardia lamblia
KKQMQIAWPYEIFADSVVCR

SEQ ID NO: 3159782 - protein, 26 aa, Giardia lamblia
KKQTFPQRLIFSIIRQVAMGLAHLHK

SEQ ID NO: 3159783 - protein, 19 aa, Giardia lamblia
KKRDDAFLVKSYDNSQAYD

SEQ ID NO: 3159784 - protein, 18 aa, Giardia lamblia
KKRLEEARRDLGKQQRYC

SEQ ID NO: 3159785 - protein, 30 aa, Giardia lamblia
KKRLVGYSLECPPFYTAFFEMDVIKATAEF

SEQ ID NO: 3159786 - protein, 23 aa, Giardia lamblia
KKRLYRRFMRLSKGQKYIERQTL

SEQ ID NO: 3159787 - protein, 20 aa, Giardia lamblia
KKRYPNFQLTLRQIQSKLQK

SEQ ID NO: 3159788 - protein, 20 aa, Giardia lamblia
KKSQGFRVLREMHYEERATK

SEQ ID NO: 3159789 - protein, 24 aa, Giardia lamblia
KKSRRIKDCCEIFAACLDSDSTVH

SEQ ID NO: 3159790 - protein, 20 aa, Giardia lamblia
KKSTREIVVKDFLTMNKNMD

SEQ ID NO: 3159791 - protein, 19 aa, Giardia lamblia
KKTALALAIQNDFYEAIKI

SEQ ID NO: 3159792 - protein, 19 aa, Giardia lamblia
KKTDCVVALKPYEKPEARS

SEQ ID NO: 3159793 - protein, 27 aa, Giardia lamblia
KKTEIRLLSGVCIFIATKFEENYGEAL

SEQ ID NO: 3159794 - protein, 37 aa, Giardia lamblia
KKTILCTKCNSLVFCNECWKDLKAIDICCPKCSEAAA

SEQ ID NO: 3159795 - protein, 19 aa, Giardia lamblia
KKTKTAFGGCCGSKPKQKK

SEQ ID NO: 3159796 - protein, 32 aa, Giardia lamblia
KKTLLQNSIIKLCMRFHISIETWSKRYKEESG

SEQ ID NO: 3159797 - protein, 37 aa, Giardia lamblia
KKTPTNMLLPIAQFVTLISFLLRRQFDKTIDNYYTQT

SEQ ID NO: 3159798 - protein, 21 aa, Giardia lamblia
KKTRTACAIERPQEQVDAETS

SEQ ID NO: 3159799 - protein, 24 aa, Giardia lamblia
KKTSEILFWIPLQYIEDVDPWPKY

SEQ ID NO: 3159800 - protein, 22 aa, Giardia lamblia
KKTTIKAMLGWDSHPEYCDDLF

SEQ ID NO: 3159801 - protein, 21 aa, Giardia lamblia
KKTVFPGILPKILQVLLDARK

SEQ ID NO: 3159802 - protein, 22 aa, Giardia lamblia
KKVAKCMYCNVRITDGKLYEDV

SEQ ID NO: 3159803 - protein, 22 aa, Giardia lamblia
KKVAMLPVRILLIDPVLMSADH

SEQ ID NO: 3159804 - protein, 27 aa, Giardia lamblia
KKVTTLAFSPLRLVLFSADESGAINVF

SEQ ID NO: 3159805 - protein, 18 aa, Giardia lamblia
KKYGFSLYQGGVVPGSTV

SEQ ID NO: 3159806 - protein, 25 aa, Giardia lamblia
KKYIDVTGVARINYERTMSPSRGAN

SEQ ID NO: 3159807 - protein, 18 aa, Giardia lamblia
KKYIQRYPPLKIMCHQAD

SEQ ID NO: 3159808 - protein, 20 aa, Giardia lamblia
KKYKFILTNLRIFKAEGTSE

SEQ ID NO: 3159809 - protein, 17 aa, Giardia lamblia
KKYLTRRIRDLTDEIDE

SEQ ID NO: 3159810 - protein, 23 aa, Giardia lamblia
KKYPTKTCDIFKDLLENINKTNA

SEQ ID NO: 3159811 - protein, 19 aa, Giardia lamblia
KKYRKAHLGTWLKANPLEG

SEQ ID NO: 3159812 - protein, 18 aa, Giardia lamblia
KLAAFRSSPNYQIVAKLL

SEQ ID NO: 3159813 - protein, 17 aa, Giardia lamblia
KLADIFFETQLARTQFR

SEQ ID NO: 3159814 - protein, 31 aa, Giardia lamblia
KLAEKRNLCSMSLELYNIMGVMLDVTSKKEV

SEQ ID NO: 3159815 - protein, 26 aa, Giardia lamblia
KLAEVAARQRLLLNYEAYCADFKPVC

SEQ ID NO: 3159816 - protein, 24 aa, Giardia lamblia
KLAIEAFALTCLFHNKRKTIEDCI

SEQ ID NO: 3159817 - protein, 22 aa, Giardia lamblia
KLAILVKIFIDEEIRNRADSAM

SEQ ID NO: 3159818 - protein, 19 aa, Giardia lamblia
KLALSLSQLCNFMPSDIMT

SEQ ID NO: 3159819 - protein, 26 aa, Giardia lamblia
KLALYKATNIIKFFTMRRDELLRGKE

SEQ ID NO: 3159820 - protein, 24 aa, Giardia lamblia
KLARLELLVLLLAKIDRLDTFSRL

SEQ ID NO: 3159821 - protein, 20 aa, Giardia lamblia
KLARLRRIMLRSLAEVNRKV

SEQ ID NO: 3159822 - protein, 22 aa, Giardia lamblia
KLASIKGPLGIHAEQNAGLVQG

SEQ ID NO: 3159823 - protein, 18 aa, Giardia lamblia
KLCETVLYYKNKNFKLVF

SEQ ID NO: 3159824 - protein, 25 aa, Giardia lamblia
KLCFEIGRASAFLREDCNNITWRFP

SEQ ID NO: 3159825 - protein, 28 aa, Giardia lamblia
KLCIGCDICVKKCPFDAIRIINLPSSLD

SEQ ID NO: 3159826 - protein, 18 aa, Giardia lamblia
KLCKELDAKILKEVELIG

SEQ ID NO: 3159827 - protein, 19 aa, Giardia lamblia
KLDAFLVDFSFSMKALAPS

SEQ ID NO: 3159828 - protein, 23 aa, Giardia lamblia
KLDASELIFQWKEINLQVNDPDY

SEQ ID NO: 3159829 - protein, 17 aa, Giardia lamblia
KLDAWRLTAKNVVDSGL

SEQ ID NO: 3159830 - protein, 17 aa, Giardia lamblia
KLDEASSLVSRLQNRLV

SEQ ID NO: 3159831 - protein, 17 aa, Giardia lamblia
KLDHYRACEQCVREDLA

SEQ ID NO: 3159832 - protein, 42 aa, Giardia lamblia
KLDKKVWVAWACGRTRGHYRAKCTPIGWIPYYEDLKSLFRSE

SEQ ID NO: 3159833 - protein, 20 aa, Giardia lamblia
KLDQMLCYLLTIPESLLKVP

SEQ ID NO: 3159834 - protein, 22 aa, Giardia lamblia
KLDVRRKVHFEEQFKLVDARFS

SEQ ID NO: 3159835 - protein, 23 aa, Giardia lamblia
KLEAKGYFEIVSFLRDSSRTSST

SEQ ID NO: 3159836 - protein, 21 aa, Giardia lamblia
KLEAVKLLIEYEKGMKSTRES

SEQ ID NO: 3159837 - protein, 24 aa, Giardia lamblia
KLEGKLCDQRGWTAMMYAAQNGHL

SEQ ID NO: 3159838 - protein, 18 aa, Giardia lamblia
KLEHKRDQSRLLSCAFAV

SEQ ID NO: 3159839 - protein, 18 aa, Giardia lamblia
KLEKADIWTPGKSNPARV

SEQ ID NO: 3159840 - protein, 21 aa, Giardia lamblia
KLEKDYASVIAKLADKEDKIV

SEQ ID NO: 3159841 - protein, 18 aa, Giardia lamblia
KLEKKRCLLQQGKDAKLH

SEQ ID NO: 3159842 - protein, 26 aa, Giardia lamblia
KLEPSFVCPNCKATGSIMVQKTLINQ

SEQ ID NO: 3159843 - protein, 21 aa, Giardia lamblia
KLEQAKALLLRSIAEDDMLAV

SEQ ID NO: 3159844 - protein, 20 aa, Giardia lamblia
KLEQEVRATQSLLIRSLAST

SEQ ID NO: 3159845 - protein, 21 aa, Giardia lamblia
KLERAEKLISGLGGEKDRWTQ

SEQ ID NO: 3159846 - protein, 22 aa, Giardia lamblia
KLEYNYRLLAARDVESQNLMVQ

SEQ ID NO: 3159847 - protein, 18 aa, Giardia lamblia
KLFDVMQILVPQLYQKNI

SEQ ID NO: 3159848 - protein, 21 aa, Giardia lamblia
KLFSFKYNKRLVYSCKDVKRL

SEQ ID NO: 3159849 - protein, 23 aa, Giardia lamblia
KLFTNTLLRFLINSVSRKNELLA

SEQ ID NO: 3159850 - protein, 17 aa, Giardia lamblia
KLGDCLRAPSPPGPYAA

SEQ ID NO: 3159851 - protein, 19 aa, Giardia lamblia
KLGIGIELLTDVDLAAIQG

SEQ ID NO: 3159852 - protein, 22 aa, Giardia lamblia
KLGLSGIGGHGFRAKEKPASAS

SEQ ID NO: 3159853 - protein, 29 aa, Giardia lamblia
KLGQCSICLDACCTMECLPCGHKCACVEC

SEQ ID NO: 3159854 - protein, 25 aa, Giardia lamblia
KLGRTRLAKYFVHYDADQRHQLEKE

SEQ ID NO: 3159855 - protein, 18 aa, Giardia lamblia
KLGSEVLAARKELDQIRQ

SEQ ID NO: 3159856 - protein, 24 aa, Giardia lamblia
KLHAGETPLLYALKSGDKRLATIS

SEQ ID NO: 3159857 - protein, 20 aa, Giardia lamblia
KLHFCSIDTWLDGVCKSVCP

SEQ ID NO: 3159858 - protein, 20 aa, Giardia lamblia
KLHQYLVEFLTKVSANKKKA

SEQ ID NO: 3159859 - protein, 18 aa, Giardia lamblia
KLIATRSAGLTVDDVSKA

SEQ ID NO: 3159860 - protein, 23 aa, Giardia lamblia
KLIDCPMGTVLIKQGDPGDYFYI

SEQ ID NO: 3159861 - protein, 25 aa, Giardia lamblia
KLIFKSEHPLTDFIVFDKTIIAIDI

SEQ ID NO: 3159862 - protein, 18 aa, Giardia lamblia
KLIKQARKEWPLLKKVEH

SEQ ID NO: 3159863 - protein, 24 aa, Giardia lamblia
KLILDMISELPLDAVDIFCLYMSR

SEQ ID NO: 3159864 - protein, 17 aa, Giardia lamblia
KLINLRYSYSGGEEGDT

SEQ ID NO: 3159865 - protein, 25 aa, Giardia lamblia
KLITLKEFRIRAGSSSCAASINNSS

SEQ ID NO: 3159866 - protein, 20 aa, Giardia lamblia
KLITLRAGSIYVLDETMAKA

SEQ ID NO: 3159867 - protein, 22 aa, Giardia lamblia
KLKKKCLEYEISPPAIISLEAE

SEQ ID NO: 3159868 - protein, 24 aa, Giardia lamblia
KLKPPRKIIVTGFELTNQRYSSTI

SEQ ID NO: 3159869 - protein, 32 aa, Giardia lamblia
KLKPSIAEVFFSYRFFDVYGESLTDPPQYATP

SEQ ID NO: 3159870 - protein, 20 aa, Giardia lamblia
KLKQIVSMLLKDCATEDTTL

SEQ ID NO: 3159871 - protein, 19 aa, Giardia lamblia
KLKRCTDAIEADMRRHYIL

SEQ ID NO: 3159872 - protein, 24 aa, Giardia lamblia
KLKRETSDALNLISDLQMGLYAKN

SEQ ID NO: 3159873 - protein, 30 aa, Giardia lamblia
KLKRQIADLLKRVAAAEAERDRYKQQITKG

SEQ ID NO: 3159874 - protein, 19 aa, Giardia lamblia
KLKYMRRALFKAREEASTK

SEQ ID NO: 3159875 - protein, 21 aa, Giardia lamblia
KLLACNECIYLIQTVKYKVCL

SEQ ID NO: 3159876 - protein, 24 aa, Giardia lamblia
KLLACPLRINSMLIDGSHCLIVGP

SEQ ID NO: 3159877 - protein, 20 aa, Giardia lamblia
KLLARRKVNAMMIAAENNAA

SEQ ID NO: 3159878 - protein, 20 aa, Giardia lamblia
KLLCYKRCLMQIDSLVSGVL

SEQ ID NO: 3159879 - protein, 17 aa, Giardia lamblia
KLLDVKIPHMGHAQASN

SEQ ID NO: 3159880 - protein, 21 aa, Giardia lamblia
KLLEDRPWFEPTLGDSPSDEF

SEQ ID NO: 3159881 - protein, 20 aa, Giardia lamblia
KLLEEGKVAALIMAGGQATR

SEQ ID NO: 3159882 - protein, 20 aa, Giardia lamblia
KLLEHRDWEALTCFFEDFPD

SEQ ID NO: 3159883 - protein, 22 aa, Giardia lamblia
KLLEIFLEVPIPYSQGKSAARA

SEQ ID NO: 3159884 - protein, 20 aa, Giardia lamblia
KLLELEGFYVPPSFDYFIDS

SEQ ID NO: 3159885 - protein, 34 aa, Giardia lamblia
KLLEPCVVLSKFLAKNRVDLMVRYILSINRAGKA

SEQ ID NO: 3159886 - protein, 23 aa, Giardia lamblia
KLLGEGLQGLPTVVISGYGEDEA

SEQ ID NO: 3159887 - protein, 20 aa, Giardia lamblia
KLLIDYEGHLTLNMGYTPLM

SEQ ID NO: 3159888 - protein, 23 aa, Giardia lamblia
KLLKRNITRYALAKEKQIRKLSQ

SEQ ID NO: 3159889 - protein, 17 aa, Giardia lamblia
KLLLAPSQRQAGCSRTI

SEQ ID NO: 3159890 - protein, 20 aa, Giardia lamblia
KLLNEIEEFVGLARPSPLTV

SEQ ID NO: 3159891 - protein, 20 aa, Giardia lamblia
KLLPRKVPRTTDLFFTSTSG

SEQ ID NO: 3159892 - protein, 19 aa, Giardia lamblia
KLLRGRRHANKRSWSRGKE

SEQ ID NO: 3159893 - protein, 17 aa, Giardia lamblia
KLLRKAPQVYIDYSKRA

SEQ ID NO: 3159894 - protein, 19 aa, Giardia lamblia
KLLRLKVERLTSDQQLAAK

SEQ ID NO: 3159895 - protein, 19 aa, Giardia lamblia
KLLRPDLFDKSGAYIKGAS

SEQ ID NO: 3159896 - protein, 17 aa, Giardia lamblia
KLLRTSPYRKAFSKSPI

SEQ ID NO: 3159897 - protein, 20 aa, Giardia lamblia
KLLSAGMPKNRNRIIDALYA

SEQ ID NO: 3159898 - protein, 25 aa, Giardia lamblia
KLLSRSEFLSVFGLVLEAQSADSQI

SEQ ID NO: 3159899 - protein, 19 aa, Giardia lamblia
KLLSSRWFIDAVHTGGIES

SEQ ID NO: 3159900 - protein, 19 aa, Giardia lamblia
KLLTCNTSADSSSQLQKIS

SEQ ID NO: 3159901 - protein, 20 aa, Giardia lamblia
KLLTFEVTSKIIAHHSLEIQ

SEQ ID NO: 3159902 - protein, 18 aa, Giardia lamblia
KLMEGCARRTDSTGTTGL

SEQ ID NO: 3159903 - protein, 19 aa, Giardia lamblia
KLMLGEVVTTVPTIGFNVE

SEQ ID NO: 3159904 - protein, 18 aa, Giardia lamblia
KLMPVGSLTTSRISQQTF

SEQ ID NO: 3159905 - protein, 27 aa, Giardia lamblia
KLMRAKNERVCIILTTYAMISNDGEYI

SEQ ID NO: 3159906 - protein, 19 aa, Giardia lamblia
KLMYACLEIDPAQRMTASE

SEQ ID NO: 3159907 - protein, 21 aa, Giardia lamblia
KLMYYKCFPVHTAEYRAPELL

SEQ ID NO: 3159908 - protein, 20 aa, Giardia lamblia
KLNAGDTFLLDSGCEVNGYA

SEQ ID NO: 3159909 - protein, 17 aa, Giardia lamblia
KLNIPRPTDEVFDMPVV

SEQ ID NO: 3159910 - protein, 21 aa, Giardia lamblia
KLNLFRGNGYPFIFNNYAIMW

SEQ ID NO: 3159911 - protein, 17 aa, Giardia lamblia
KLNNLLLQFKGTTSNAL

SEQ ID NO: 3159912 - protein, 22 aa, Giardia lamblia
KLNRPNFATLLVKYEAGLVNDD

SEQ ID NO: 3159913 - protein, 26 aa, Giardia lamblia
KLPDPRLTEKLVLCSYDLLHEVNAYL

SEQ ID NO: 3159914 - protein, 26 aa, Giardia lamblia
KLPFAQLCIPLGCGARDAVGATALMH

SEQ ID NO: 3159915 - protein, 23 aa, Giardia lamblia
KLPFLQERIRRLLPEDYWNEEFS

SEQ ID NO: 3159916 - protein, 30 aa, Giardia lamblia
KLPGGENFKYGWKIGSPAGCGRGIDISAYM

SEQ ID NO: 3159917 - protein, 25 aa, Giardia lamblia
KLPKTLAGLSKFLSSRMKKADTANM

SEQ ID NO: 3159918 - protein, 24 aa, Giardia lamblia
KLPLGEFAVSLGLLKLPNHNILRR

SEQ ID NO: 3159919 - protein, 23 aa, Giardia lamblia
KLPLNELHQILSFASYLLDSKVQ

SEQ ID NO: 3159920 - protein, 25 aa, Giardia lamblia
KLPNAEALLVHFLSAMNALRLTDDR

SEQ ID NO: 3159921 - protein, 20 aa, Giardia lamblia
KLPQPFHVTTILCEYIKVYS

SEQ ID NO: 3159922 - protein, 25 aa, Giardia lamblia
KLPRNYNCGYLFRKLGKHEVFRITQ

SEQ ID NO: 3159923 - protein, 18 aa, Giardia lamblia
KLQNLFLAEPLVRTLFYD

SEQ ID NO: 3159924 - protein, 18 aa, Giardia lamblia
KLQQAMEALAIHKPDNPC

SEQ ID NO: 3159925 - protein, 20 aa, Giardia lamblia
KLRAKCSIPDYYSECSAVYK

SEQ ID NO: 3159926 - protein, 17 aa, Giardia lamblia
KLRFPDLQHVIGHLLDS

SEQ ID NO: 3159927 - protein, 18 aa, Giardia lamblia
KLRGGSARTIFITCLASI

SEQ ID NO: 3159928 - protein, 22 aa, Giardia lamblia
KLRGQCFAQDFSLTVFSHVMGT

SEQ ID NO: 3159929 - protein, 23 aa, Giardia lamblia
KLRGQFKAPVYVTTARTNAAGKG

SEQ ID NO: 3159930 - protein, 20 aa, Giardia lamblia
KLRLHCKSLLDENIRISSQW

SEQ ID NO: 3159931 - protein, 24 aa, Giardia lamblia
KLRMLMADRKLDGYLESSSGIASS

SEQ ID NO: 3159932 - protein, 25 aa, Giardia lamblia
KLRPLSYPGAHVFLLCFSVVSSTSF

SEQ ID NO: 3159933 - protein, 32 aa, Giardia lamblia
KLRPYERFYTERKCEQCVINAETIQKLTTRLA

SEQ ID NO: 3159934 - protein, 17 aa, Giardia lamblia
KLRSLDILNRVIPCQSG

SEQ ID NO: 3159935 - protein, 23 aa, Giardia lamblia
KLRSMLPNASFDLNIDDKVLTEL

SEQ ID NO: 3159936 - protein, 25 aa, Giardia lamblia
KLRVIKHLFRSAGLNVDNPTFLVLQ

SEQ ID NO: 3159937 - protein, 21 aa, Giardia lamblia
KLSANEIRNYLTPQLSQKGIK

SEQ ID NO: 3159938 - protein, 27 aa, Giardia lamblia
KLSEFPKADIIHFLDIYLGCANPVVES

SEQ ID NO: 3159939 - protein, 31 aa, Giardia lamblia
KLSELPSAFRFLAVEPCNFLMIGHEDGSLTA

SEQ ID NO: 3159940 - protein, 19 aa, Giardia lamblia
KLSFMGALKYLDSYLGSSS

SEQ ID NO: 3159941 - protein, 21 aa, Giardia lamblia
KLSGLFDCYDTFASQFVSFYD

SEQ ID NO: 3159942 - protein, 26 aa, Giardia lamblia
KLSGLYWVLCSIFILHGRQPTDVFLQ

SEQ ID NO: 3159943 - protein, 21 aa, Giardia lamblia
KLSISNSVFISRHFIKETRFL

SEQ ID NO: 3159944 - protein, 19 aa, Giardia lamblia
KLSKIPFSLLKPGLKALIL

SEQ ID NO: 3159945 - protein, 25 aa, Giardia lamblia
KLSKRGMCGQMILKKSRTIKSRASS

SEQ ID NO: 3159946 - protein, 29 aa, Giardia lamblia
KLSLDAAGVPAEYSGLMVEISRGIKRHFL

SEQ ID NO: 3159947 - protein, 18 aa, Giardia lamblia
KLSNRAILCDRFTENFNR

SEQ ID NO: 3159948 - protein, 22 aa, Giardia lamblia
KLSPKLLASVLDELSQAVTTSG

SEQ ID NO: 3159949 - protein, 26 aa, Giardia lamblia
KLSQLPKGRCNLPKITLKDALDVLRN

SEQ ID NO: 3159950 - protein, 24 aa, Giardia lamblia
KLSRELVSLVTYFKDAVIPRERQL

SEQ ID NO: 3159951 - protein, 21 aa, Giardia lamblia
KLSSGLIFKSELDSITICLPS

SEQ ID NO: 3159952 - protein, 18 aa, Giardia lamblia
KLSTPISTYGQYILTSNK

SEQ ID NO: 3159953 - protein, 25 aa, Giardia lamblia
KLSVFRRFLFFLVFSTRRKAMRRNT

SEQ ID NO: 3159954 - protein, 19 aa, Giardia lamblia
KLSVSHLVSTKPALRPGTG

SEQ ID NO: 3159955 - protein, 24 aa, Giardia lamblia
KLTAFEARDPYLISWNTAALEKTP

SEQ ID NO: 3159956 - protein, 38 aa, Giardia lamblia
KLTASDYTGEFIIRVRSMLEIEYNYLLKKVEKIQNTIT

SEQ ID NO: 3159957 - protein, 20 aa, Giardia lamblia
KLTCPSEFLLLSLLSHALDL

SEQ ID NO: 3159958 - protein, 24 aa, Giardia lamblia
KLTDDFNYNYALLLERDKTIDILE

SEQ ID NO: 3159959 - protein, 20 aa, Giardia lamblia
KLTDRLGIEHAQLRTVRDLV

SEQ ID NO: 3159960 - protein, 17 aa, Giardia lamblia
KLTEEFTRTLKEIIKGV

SEQ ID NO: 3159961 - protein, 17 aa, Giardia lamblia
KLTGMAFRVPVPDVSVV

SEQ ID NO: 3159962 - protein, 24 aa, Giardia lamblia
KLTHKPTGVGFVTFCLPEAAFRAK

SEQ ID NO: 3159963 - protein, 19 aa, Giardia lamblia
KLTITFPPELSKIAFCVIW

SEQ ID NO: 3159964 - protein, 25 aa, Giardia lamblia
KLTSIEARTLLGRVHTMELLLDQSA

SEQ ID NO: 3159965 - protein, 19 aa, Giardia lamblia
KLTSLFCPANQQAKKAKSN

SEQ ID NO: 3159966 - protein, 25 aa, Giardia lamblia
KLTSLHLCPSCQSPVSTTRCQCCDI

SEQ ID NO: 3159967 - protein, 19 aa, Giardia lamblia
KLTVSLSLQVSRDAYVPIL

SEQ ID NO: 3159968 - protein, 18 aa, Giardia lamblia
KLVAFTHLIRLCNDVSIQ

SEQ ID NO: 3159969 - protein, 23 aa, Giardia lamblia
KLVAKAREEFVLSPMSALGYQAV

SEQ ID NO: 3159970 - protein, 24 aa, Giardia lamblia
KLVDKGCIVLLMFYVKNDEEEDAM

SEQ ID NO: 3159971 - protein, 23 aa, Giardia lamblia
KLVEAVVAYRRWFVDARGKPNPS

SEQ ID NO: 3159972 - protein, 23 aa, Giardia lamblia
KLVKHTLLVYGYVRGTYMDPAQH

SEQ ID NO: 3159973 - protein, 19 aa, Giardia lamblia
KLVRSCTETTYLPASGGRE

SEQ ID NO: 3159974 - protein, 24 aa, Giardia lamblia
KLVVPPRCNQAFLGALTPTELSHM

SEQ ID NO: 3159975 - protein, 30 aa, Giardia lamblia
KLVYAKCKELYKLRTLAQMLLQRRTDLEAF

SEQ ID NO: 3159976 - protein, 24 aa, Giardia lamblia
KLWEKLRTAGLIYKDKYEGWYCVA

SEQ ID NO: 3159977 - protein, 26 aa, Giardia lamblia
KLYAYAIKTPINWRKIATALNQDRNR

SEQ ID NO: 3159978 - protein, 23 aa, Giardia lamblia
KLYDLKHCGSWSGSLESLAGSYG

SEQ ID NO: 3159979 - protein, 20 aa, Giardia lamblia
KLYIFVALGKTPGRGRWDRD

SEQ ID NO: 3159980 - protein, 20 aa, Giardia lamblia
KLYLNRKISILVATSTLAWG

SEQ ID NO: 3159981 - protein, 20 aa, Giardia lamblia
KLYLSRSMLINRLAYAAASH

SEQ ID NO: 3159982 - protein, 20 aa, Giardia lamblia
KLYMLLRHINALRSQHKADS

SEQ ID NO: 3159983 - protein, 24 aa, Giardia lamblia
KLYRPEYRQSSSSYCHFRPDLGNT

SEQ ID NO: 3159984 - protein, 19 aa, Giardia lamblia
KLYRPLDCSEVGIRASLVS

SEQ ID NO: 3159985 - protein, 20 aa, Giardia lamblia
KMAFFGWRDQYIINQEELLI

SEQ ID NO: 3159986 - protein, 18 aa, Giardia lamblia
KMDGWVSVLVLTGQAHEG

SEQ ID NO: 3159987 - protein, 26 aa, Giardia lamblia
KMEIMPRLGALYPYHQERLSQCSDMD

SEQ ID NO: 3159988 - protein, 32 aa, Giardia lamblia
KMEKKRKTLFCPANQRKSFYVFIDDSTMPTPD

SEQ ID NO: 3159989 - protein, 19 aa, Giardia lamblia
KMFILPQIRELLAENPVVL

SEQ ID NO: 3159990 - protein, 27 aa, Giardia lamblia
KMFLKARPSIALHFLVTPACDQYVEQL

SEQ ID NO: 3159991 - protein, 30 aa, Giardia lamblia
KMFSKLLFILLRRYHTFFGTERFEGTSFHA

SEQ ID NO: 3159992 - protein, 19 aa, Giardia lamblia
KMGHVKCVKALIHEEVGMQ

SEQ ID NO: 3159993 - protein, 19 aa, Giardia lamblia
KMGSCDWVNRGVPGSSRHG

SEQ ID NO: 3159994 - protein, 20 aa, Giardia lamblia
KMHIEPPFRKPAATVIVEAY

SEQ ID NO: 3159995 - protein, 22 aa, Giardia lamblia
KMHQPRAFLQSSFTHIRPNPSF

SEQ ID NO: 3159996 - protein, 23 aa, Giardia lamblia
KMIARVRVSISMKERKISHLQTQ

SEQ ID NO: 3159997 - protein, 20 aa, Giardia lamblia
KMKGQQRLSQDVLASRFTEL

SEQ ID NO: 3159998 - protein, 17 aa, Giardia lamblia
KMLGEAFSSERRAQAAA

SEQ ID NO: 3159999 - protein, 18 aa, Giardia lamblia
KMLRHCKQGIPIEVMGLL

SEQ ID NO: 3160000 - protein, 25 aa, Giardia lamblia
KMLYFDMRINPCVDQIIGQIITHDM

SEQ ID NO: 3160001 - protein, 26 aa, Giardia lamblia
KMPEVLSHPWFRDGIGSTELVAKFIK

SEQ ID NO: 3160002 - protein, 17 aa, Giardia lamblia
KMQKLKRSWEVDETAYK

SEQ ID NO: 3160003 - protein, 17 aa, Giardia lamblia
KMQSRQVVETEILENKI

SEQ ID NO: 3160004 - protein, 25 aa, Giardia lamblia
KMRIPRPPRCSAFDCHTPQLIVGGV

SEQ ID NO: 3160005 - protein, 18 aa, Giardia lamblia
KMRMTAFYDPFLLFDTPE

SEQ ID NO: 3160006 - protein, 19 aa, Giardia lamblia
KMSAFSMTSCNSINSFRSA

SEQ ID NO: 3160007 - protein, 18 aa, Giardia lamblia
KMSDVFDVLSTVGMVQKQ

SEQ ID NO: 3160008 - protein, 18 aa, Giardia lamblia
KMSGDFVAVVTHNLKMKI

SEQ ID NO: 3160009 - protein, 19 aa, Giardia lamblia
KMSIARGYFSVKIDDDISL

SEQ ID NO: 3160010 - protein, 31 aa, Giardia lamblia
KMSPCILSTLLRSIYHRRFLAAILAGDILPD

SEQ ID NO: 3160011 - protein, 21 aa, Giardia lamblia
KMTVWGRGKRGEVLTSYKHMK

SEQ ID NO: 3160012 - protein, 19 aa, Giardia lamblia
KMVQLLLEYESGYQDSDGN

SEQ ID NO: 3160013 - protein, 23 aa, Giardia lamblia
KMYKEVKALAEVVTKSKELADSL

SEQ ID NO: 3160014 - protein, 20 aa, Giardia lamblia
KMYLPTLAFGILMTSSNYDD

SEQ ID NO: 3160015 - protein, 18 aa, Giardia lamblia
KMYSNIWFYYLGGSSLKL

SEQ ID NO: 3160016 - protein, 23 aa, Giardia lamblia
KNACGHTALMYAALCNHSIIVSL

SEQ ID NO: 3160017 - protein, 25 aa, Giardia lamblia
KNAEIVRLLIDYEVGMVNNEGCTAL

SEQ ID NO: 3160018 - protein, 17 aa, Giardia lamblia
KNAHAVQVLAPYEHSIC

SEQ ID NO: 3160019 - protein, 18 aa, Giardia lamblia
KNALLFRTARNPSDAIEA

SEQ ID NO: 3160020 - protein, 17 aa, Giardia lamblia
KNAYLLGKFLPGLQGSG

SEQ ID NO: 3160021 - protein, 25 aa, Giardia lamblia
KNCKWKSSDDVLKFSLTEDQYRRLK

SEQ ID NO: 3160022 - protein, 24 aa, Giardia lamblia
KNCMHQCAICHRPWLILNSAGVCR

SEQ ID NO: 3160023 - protein, 23 aa, Giardia lamblia
KNCPECIKQLLKKEGNMQDNDGG

SEQ ID NO: 3160024 - protein, 18 aa, Giardia lamblia
KNDAERDLAEAIPALEAA

SEQ ID NO: 3160025 - protein, 19 aa, Giardia lamblia
KNDGLPFSCREYSVRHLDS

SEQ ID NO: 3160026 - protein, 26 aa, Giardia lamblia
KNDYPFPKGFTALMFATLFKQQSVVQ

SEQ ID NO: 3160027 - protein, 30 aa, Giardia lamblia
KNEELKVLTLRLADLEFKLTESELMRTTAK

SEQ ID NO: 3160028 - protein, 19 aa, Giardia lamblia
KNEPLWPVIRDGRGEVLSL

SEQ ID NO: 3160029 - protein, 20 aa, Giardia lamblia
KNERNCMCGFTVGSTRGLLN

SEQ ID NO: 3160030 - protein, 20 aa, Giardia lamblia
KNEYLTICERMTALNHRLYE

SEQ ID NO: 3160031 - protein, 25 aa, Giardia lamblia
KNFILLCSLLMRMSVPVLDTHGMER

SEQ ID NO: 3160032 - protein, 18 aa, Giardia lamblia
KNFLKTLPLVSSLRSPAM

SEQ ID NO: 3160033 - protein, 19 aa, Giardia lamblia
KNFNGETALMIAVKERFYD

SEQ ID NO: 3160034 - protein, 17 aa, Giardia lamblia
KNFPQLKKFNGRDVQDL

SEQ ID NO: 3160035 - protein, 21 aa, Giardia lamblia
KNGHLEVAEMLISYEDPTDDD

SEQ ID NO: 3160036 - protein, 17 aa, Giardia lamblia
KNGITALMRATCNNNLE

SEQ ID NO: 3160037 - protein, 21 aa, Giardia lamblia
KNGQVYKGRFYQDLFDGTGEM

SEQ ID NO: 3160038 - protein, 20 aa, Giardia lamblia
KNGTDWFSIFPFEKDTSPCY

SEQ ID NO: 3160039 - protein, 20 aa, Giardia lamblia
KNHAVPCIAFKSSTHVHKGH

SEQ ID NO: 3160040 - protein, 25 aa, Giardia lamblia
KNIAAVKILICYETGLVNPYTGATA

SEQ ID NO: 3160041 - protein, 18 aa, Giardia lamblia
KNIDLLVDTAIEFSGFTS

SEQ ID NO: 3160042 - protein, 19 aa, Giardia lamblia
KNIDRRKLLNTAEGNEEIL

SEQ ID NO: 3160043 - protein, 19 aa, Giardia lamblia
KNIEAAVCDGVRKELEEKL

SEQ ID NO: 3160044 - protein, 21 aa, Giardia lamblia
KNILPDFIVGAKWGVSKQSQH

SEQ ID NO: 3160045 - protein, 18 aa, Giardia lamblia
KNINRRKLLDIAKGNSEM

SEQ ID NO: 3160046 - protein, 18 aa, Giardia lamblia
KNINRRKLLEIVNRRGSN

SEQ ID NO: 3160047 - protein, 19 aa, Giardia lamblia
KNIPMKKAEDILRRIEALS

SEQ ID NO: 3160048 - protein, 20 aa, Giardia lamblia
KNIRDNCERFSNLKTVVCLK

SEQ ID NO: 3160049 - protein, 24 aa, Giardia lamblia
KNKELRQQFFLLLSKEELLSTLEI

SEQ ID NO: 3160050 - protein, 19 aa, Giardia lamblia
KNKICAYKHDNESMFEDLR

SEQ ID NO: 3160051 - protein, 27 aa, Giardia lamblia
KNKPTRPEHCVSYSILLVQRMYDVDPF

SEQ ID NO: 3160052 - protein, 25 aa, Giardia lamblia
KNLDIWRQLWRVVERSDILFQVVDC

SEQ ID NO: 3160053 - protein, 24 aa, Giardia lamblia
KNLEEMPGTIVLKKLSEILEFYTI

SEQ ID NO: 3160054 - protein, 19 aa, Giardia lamblia
KNLILKRVYYSVGGGALQD

SEQ ID NO: 3160055 - protein, 17 aa, Giardia lamblia
KNLKYWPVHIRDKCRLR

SEQ ID NO: 3160056 - protein, 17 aa, Giardia lamblia
KNLLGYNSDELFGTGTS

SEQ ID NO: 3160057 - protein, 28 aa, Giardia lamblia
KNLLRIPRRPAWCVGMSKEELQSREQEA

SEQ ID NO: 3160058 - protein, 20 aa, Giardia lamblia
KNLMLFFRDGCCTTVEGTTA

SEQ ID NO: 3160059 - protein, 19 aa, Giardia lamblia
KNLQVGKLINLRYSYSGGE

SEQ ID NO: 3160060 - protein, 21 aa, Giardia lamblia
KNLRKAFDICEQEAEKSAKEN

SEQ ID NO: 3160061 - protein, 19 aa, Giardia lamblia
KNLRLFEASLSFVGGFLVP

SEQ ID NO: 3160062 - protein, 17 aa, Giardia lamblia
KNLRRVAKELSENISDE

SEQ ID NO: 3160063 - protein, 21 aa, Giardia lamblia
KNLSLTGAILLQFKTPHITTV

SEQ ID NO: 3160064 - protein, 17 aa, Giardia lamblia
KNLSWFVKYLKTYKFIY

SEQ ID NO: 3160065 - protein, 24 aa, Giardia lamblia
KNLVREVLDEMGINSFIETQETRH

SEQ ID NO: 3160066 - protein, 25 aa, Giardia lamblia
KNMDSLKEAYSLALPLAKQLPWASK

SEQ ID NO: 3160067 - protein, 17 aa, Giardia lamblia
KNMRKYFSFEVQILDDK

SEQ ID NO: 3160068 - protein, 24 aa, Giardia lamblia
KNNARRTSNVHAFVPSKHRPSTTQ

SEQ ID NO: 3160069 - protein, 23 aa, Giardia lamblia
KNNCKGIPAAFLFNKDGELVWSG

SEQ ID NO: 3160070 - protein, 18 aa, Giardia lamblia
KNNFPLRIFSDISSGLAI

SEQ ID NO: 3160071 - protein, 23 aa, Giardia lamblia
KNNNISMVWALLGYQKRLQDDGK

SEQ ID NO: 3160072 - protein, 17 aa, Giardia lamblia
KNNSLLPAVFVPEAEGS

SEQ ID NO: 3160073 - protein, 19 aa, Giardia lamblia
KNPAIDLISSFKLRLDDTT

SEQ ID NO: 3160074 - protein, 21 aa, Giardia lamblia
KNPAIDLISSFKLRLDDTTKD

SEQ ID NO: 3160075 - protein, 24 aa, Giardia lamblia
KNPEKCIRDLMASFLLPEIDRRVL

SEQ ID NO: 3160076 - protein, 25 aa, Giardia lamblia
KNPKRKLFRWEGGETVRAIAHDCLC

SEQ ID NO: 3160077 - protein, 24 aa, Giardia lamblia
KNQSLKGLLAYAGVQDQYGRTALM

SEQ ID NO: 3160078 - protein, 18 aa, Giardia lamblia
KNQTALVAVLPRILSLHS

SEQ ID NO: 3160079 - protein, 21 aa, Giardia lamblia
KNRGPLCIHCSAGVGRSSTFA

SEQ ID NO: 3160080 - protein, 23 aa, Giardia lamblia
KNRLYREFFNCITPQMSSSGLLI

SEQ ID NO: 3160081 - protein, 43 aa, Giardia lamblia
KNRQISCDLCSKRATLQCLACRSHWCTYEHFLLDSESIHFYIC

SEQ ID NO: 3160082 - protein, 24 aa, Giardia lamblia
KNRYYRPFMKRIYAQREEAIATSY

SEQ ID NO: 3160083 - protein, 18 aa, Giardia lamblia
KNSAALQERVDALEADAT

SEQ ID NO: 3160084 - protein, 24 aa, Giardia lamblia
KNSEIARLQDLVMRAESAQRSSAE

SEQ ID NO: 3160085 - protein, 26 aa, Giardia lamblia
KNSGVSFHESVLWKVASQLLKALVDL

SEQ ID NO: 3160086 - protein, 32 aa, Giardia lamblia
KNSLFPEDQIWDWFVQICMALKHVHDRKILHR

SEQ ID NO: 3160087 - protein, 23 aa, Giardia lamblia
KNSLYARLRSAAVTNTLSLGEIA

SEQ ID NO: 3160088 - protein, 19 aa, Giardia lamblia
KNSMKLHIKTGIFDFGNNY

SEQ ID NO: 3160089 - protein, 26 aa, Giardia lamblia
KNSQSMWLKAQTELVLCQKKRDEELA

SEQ ID NO: 3160090 - protein, 25 aa, Giardia lamblia
KNSRKFFTSLCVNVFAKLNVVENAS

SEQ ID NO: 3160091 - protein, 25 aa, Giardia lamblia
KNSSIYRFLEKSAVNEVFPVDETIT

SEQ ID NO: 3160092 - protein, 17 aa, Giardia lamblia
KNSVSFGAVSYADPAAP

SEQ ID NO: 3160093 - protein, 25 aa, Giardia lamblia
KNTEAMKLILSKGGASFMADARSAL

SEQ ID NO: 3160094 - protein, 25 aa, Giardia lamblia
KNTNFLELFLIRTWLKRDEDGMSPI

SEQ ID NO: 3160095 - protein, 17 aa, Giardia lamblia
KNVASPEELNWLLCQAF

SEQ ID NO: 3160096 - protein, 18 aa, Giardia lamblia
KNVASVIGNWSFPVQDVL

SEQ ID NO: 3160097 - protein, 25 aa, Giardia lamblia
KNVELRLKLCQRVGRGAMGAGRSAE

SEQ ID NO: 3160098 - protein, 23 aa, Giardia lamblia
KNVEMVHILLPYEKQMQDKAGWT

SEQ ID NO: 3160099 - protein, 30 aa, Giardia lamblia
KNVESWYRDVFRICPTRRDASTGEEKPLAI

SEQ ID NO: 3160100 - protein, 22 aa, Giardia lamblia
KNVTNPLAFHGMHTIWCYSMIH

SEQ ID NO: 3160101 - protein, 17 aa, Giardia lamblia
KNYCHPNNLPGFTASAF

SEQ ID NO: 3160102 - protein, 17 aa, Giardia lamblia
KNYELVLRIPLNTAGGD

SEQ ID NO: 3160103 - protein, 38 aa, Giardia lamblia
KNYFGRAGPKGVVFTRVLHCPKRKLVEYEDLMSSRPES

SEQ ID NO: 3160104 - protein, 26 aa, Giardia lamblia
KPAFEELFLSLSLSPNCIGYKALAID

SEQ ID NO: 3160105 - protein, 20 aa, Giardia lamblia
KPALARGEIRCIGATTTEEY

SEQ ID NO: 3160106 - protein, 19 aa, Giardia lamblia
KPARLALTGAQKKEQAAEQ

SEQ ID NO: 3160107 - protein, 24 aa, Giardia lamblia
KPAVPERVGQRFAVINMVSKYETQ

SEQ ID NO: 3160108 - protein, 25 aa, Giardia lamblia
KPAYTRLAARQAMHMRKKIGGRTSN

SEQ ID NO: 3160109 - protein, 22 aa, Giardia lamblia
KPCDEKQDIWSLGCILLEMCSL

SEQ ID NO: 3160110 - protein, 18 aa, Giardia lamblia
KPCINIHSLKCRHLSEAA

SEQ ID NO: 3160111 - protein, 24 aa, Giardia lamblia
KPDFFLVAEILHYITTVVAPSNAI

SEQ ID NO: 3160112 - protein, 25 aa, Giardia lamblia
KPDIWLVDKCKAIDVGVIQPRQMDA

SEQ ID NO: 3160113 - protein, 24 aa, Giardia lamblia
KPEMLDPALLRTGRADRKIFMDYP

SEQ ID NO: 3160114 - protein, 24 aa, Giardia lamblia
KPEVLPPCLPSFFELGTSPLEPSL

SEQ ID NO: 3160115 - protein, 20 aa, Giardia lamblia
KPFFGESMCLNHAAARHRAK

SEQ ID NO: 3160116 - protein, 23 aa, Giardia lamblia
KPFKCHLTESAIYHIIRTYMDIA

SEQ ID NO: 3160117 - protein, 19 aa, Giardia lamblia
KPGASEPLATNKAGIPQPY

SEQ ID NO: 3160118 - protein, 18 aa, Giardia lamblia
KPGDHVFITLKFQPTLEL

SEQ ID NO: 3160119 - protein, 17 aa, Giardia lamblia
KPGVTAFAFNMGEDRNS

SEQ ID NO: 3160120 - protein, 19 aa, Giardia lamblia
KPGYIGHCSHCCKYHGDAH

SEQ ID NO: 3160121 - protein, 17 aa, Giardia lamblia
KPIEAVNIAGCFINIAL

SEQ ID NO: 3160122 - protein, 20 aa, Giardia lamblia
KPIGEIICGLLVPDPSDRMS

SEQ ID NO: 3160123 - protein, 19 aa, Giardia lamblia
KPIPSCYSRDLAEVIERML

SEQ ID NO: 3160124 - protein, 17 aa, Giardia lamblia
KPIRILKHYKRYHADPL

SEQ ID NO: 3160125 - protein, 19 aa, Giardia lamblia
KPIYSEVAAMMIKNGKVDL

SEQ ID NO: 3160126 - protein, 18 aa, Giardia lamblia
KPIYSRTSSFFFGQCLGV

SEQ ID NO: 3160127 - protein, 23 aa, Giardia lamblia
KPKERRLSISVLSGINYDPVATE

SEQ ID NO: 3160128 - protein, 26 aa, Giardia lamblia
KPKIQDLLPKGGRCLVVGAGSSELSF

SEQ ID NO: 3160129 - protein, 20 aa, Giardia lamblia
KPKKPMLVQQRFDPRQRRGT

SEQ ID NO: 3160130 - protein, 19 aa, Giardia lamblia
KPKQCTIDSFFSPRSSNPE

SEQ ID NO: 3160131 - protein, 19 aa, Giardia lamblia
KPKRARSYGTARKATKKTA

SEQ ID NO: 3160132 - protein, 19 aa, Giardia lamblia
KPKTLRSLRKYTQNPDFDP

SEQ ID NO: 3160133 - protein, 17 aa, Giardia lamblia
KPLCIKDELPFFEKGDA

SEQ ID NO: 3160134 - protein, 18 aa, Giardia lamblia
KPLCTVVNDLNGRVCYCE

SEQ ID NO: 3160135 - protein, 17 aa, Giardia lamblia
KPLEAVVSPAYKDMIFR

SEQ ID NO: 3160136 - protein, 20 aa, Giardia lamblia
KPLIEACPFKVSAAVYKELV

SEQ ID NO: 3160137 - protein, 17 aa, Giardia lamblia
KPLRRTQGTPGRNLTVS

SEQ ID NO: 3160138 - protein, 25 aa, Giardia lamblia
KPLSKLRRPPMHLVGAATKVKEDVA

SEQ ID NO: 3160139 - protein, 18 aa, Giardia lamblia
KPLTAFFIYFKEQSVGMT

SEQ ID NO: 3160140 - protein, 21 aa, Giardia lamblia
KPMTVGGCRNGCPNPQSQSSI

SEQ ID NO: 3160141 - protein, 26 aa, Giardia lamblia
KPNNARLNVFFKFCVEELLVHLPANA

SEQ ID NO: 3160142 - protein, 24 aa, Giardia lamblia
KPNPPPRRKGALFTLTSVSATGSA

SEQ ID NO: 3160143 - protein, 21 aa, Giardia lamblia
KPNQLCYYLFDALFINGTSIL

SEQ ID NO: 3160144 - protein, 19 aa, Giardia lamblia
KPPEFLKIESSLAMQEKPT

SEQ ID NO: 3160145 - protein, 18 aa, Giardia lamblia
KPPEIVFLTSSGRFETNR

SEQ ID NO: 3160146 - protein, 24 aa, Giardia lamblia
KPPLKARAYTVEDIALARKNPANP

SEQ ID NO: 3160147 - protein, 26 aa, Giardia lamblia
KPPQVLPSMRCLNKFVAMKDSTTTHI

SEQ ID NO: 3160148 - protein, 18 aa, Giardia lamblia
KPPSLGITCVYIQSHAEK

SEQ ID NO: 3160149 - protein, 20 aa, Giardia lamblia
KPPSLVRGAPELQRSSLQTP

SEQ ID NO: 3160150 - protein, 33 aa, Giardia lamblia
KPQRFPSYLVWDCFKQKACKDIAHDTEGCACFL

SEQ ID NO: 3160151 - protein, 22 aa, Giardia lamblia
KPRAFYKGIVFPLANTDAHVVV

SEQ ID NO: 3160152 - protein, 20 aa, Giardia lamblia
KPREIFSCLGNDVDHGVQTN

SEQ ID NO: 3160153 - protein, 18 aa, Giardia lamblia
KPRILSLTCLKCISDKPE

SEQ ID NO: 3160154 - protein, 20 aa, Giardia lamblia
KPRPRAGLVRTRKRLIPRNR

SEQ ID NO: 3160155 - protein, 18 aa, Giardia lamblia
KPRQANCVVEIAQRFSPK

SEQ ID NO: 3160156 - protein, 19 aa, Giardia lamblia
KPSGAWAGSVIKSIPINSA

SEQ ID NO: 3160157 - protein, 19 aa, Giardia lamblia
KPSILEMTEILRVQRNPLC

SEQ ID NO: 3160158 - protein, 19 aa, Giardia lamblia
KPSNIFLSQALTVFIVDPL

SEQ ID NO: 3160159 - protein, 17 aa, Giardia lamblia
KPSVIHLIMEYCDDGTL

SEQ ID NO: 3160160 - protein, 21 aa, Giardia lamblia
KPSVSAFERPLAKTDLSYPLP

SEQ ID NO: 3160161 - protein, 20 aa, Giardia lamblia
KPTGTFLFGKADFSVTSSAS

SEQ ID NO: 3160162 - protein, 26 aa, Giardia lamblia
KPTPKRRSTLPAARSFTSLGVAVSEI

SEQ ID NO: 3160163 - protein, 26 aa, Giardia lamblia
KPTSDIKPAGAFFINKKILGPIDSDT

SEQ ID NO: 3160164 - protein, 19 aa, Giardia lamblia
KPTVYSLIFQRIEDLGFIF

SEQ ID NO: 3160165 - protein, 24 aa, Giardia lamblia
KPVPRSSLGLNHIVRSRKHQETLD

SEQ ID NO: 3160166 - protein, 17 aa, Giardia lamblia
KPWECFEGQVDCIMPCA

SEQ ID NO: 3160167 - protein, 25 aa, Giardia lamblia
KPYCQPLAPFGCCNEICTTCGEVKA

SEQ ID NO: 3160168 - protein, 29 aa, Giardia lamblia
KPYIPQSLGRVGWRVCLVVDSSPKEAFLD

SEQ ID NO: 3160169 - protein, 23 aa, Giardia lamblia
KPYKFHVKLCVLDYHKQTATPVF

SEQ ID NO: 3160170 - protein, 20 aa, Giardia lamblia
KQAARRKSMIIARKNASALG

SEQ ID NO: 3160171 - protein, 23 aa, Giardia lamblia
KQAEDLLAFIVCLLSTAKRESFA

SEQ ID NO: 3160172 - protein, 33 aa, Giardia lamblia
KQAELGCEAVLKREDEALWALVYPHLNRDDVND

SEQ ID NO: 3160173 - protein, 23 aa, Giardia lamblia
KQAELRAGIMPYLLNALTNEDLL

SEQ ID NO: 3160174 - protein, 22 aa, Giardia lamblia
KQAKKVAGLIIQRRLFISPTLS

SEQ ID NO: 3160175 - protein, 19 aa, Giardia lamblia
KQCRFPHDCYLQHKILAAV

SEQ ID NO: 3160176 - protein, 24 aa, Giardia lamblia
KQDGCYRSLITLHMGDPSLNTAGI

SEQ ID NO: 3160177 - protein, 19 aa, Giardia lamblia
KQDLAVLLAAHYELLHPAR

SEQ ID NO: 3160178 - protein, 26 aa, Giardia lamblia
KQDVQGRTALMYAVLGGSLKCVRLLV

SEQ ID NO: 3160179 - protein, 19 aa, Giardia lamblia
KQEACKEHDWVPDIPSRTE

SEQ ID NO: 3160180 - protein, 19 aa, Giardia lamblia
KQECFYTRETTALVFAILK

SEQ ID NO: 3160181 - protein, 27 aa, Giardia lamblia
KQEERSVCYLATFCYGGILNIYGVLMS

SEQ ID NO: 3160182 - protein, 19 aa, Giardia lamblia
KQEHLLRVGRLVSSDTQTQ

SEQ ID NO: 3160183 - protein, 21 aa, Giardia lamblia
KQFCNFVSAFYMPREVITIQC

SEQ ID NO: 3160184 - protein, 23 aa, Giardia lamblia
KQFEKRLSYITVRLASDSSGPSH

SEQ ID NO: 3160185 - protein, 29 aa, Giardia lamblia
KQFLLGIYMKNVWPAAAIMHMNAGNTILR

SEQ ID NO: 3160186 - protein, 17 aa, Giardia lamblia
KQFQSAALIFSSDKHMA

SEQ ID NO: 3160187 - protein, 18 aa, Giardia lamblia
KQFSMSTIVEAYESKAFV

SEQ ID NO: 3160188 - protein, 17 aa, Giardia lamblia
KQGGFWVVPLIGKCTRP

SEQ ID NO: 3160189 - protein, 24 aa, Giardia lamblia
KQGGRPWVVIPFHSKIPAQQAMYP

SEQ ID NO: 3160190 - protein, 19 aa, Giardia lamblia
KQGKYPFYAAIEKKQKNIA

SEQ ID NO: 3160191 - protein, 20 aa, Giardia lamblia
KQGMSALIFAVYRGDVPLVQ

SEQ ID NO: 3160192 - protein, 21 aa, Giardia lamblia
KQGRTALVISVQHGHNRCVDL

SEQ ID NO: 3160193 - protein, 22 aa, Giardia lamblia
KQGRVRYGLPQGAMANLTEMER

SEQ ID NO: 3160194 - protein, 19 aa, Giardia lamblia
KQHKESLFYQETRYSDLSM

SEQ ID NO: 3160195 - protein, 40 aa, Giardia lamblia
KQHLCDSCQEAGASVFCLNCQGWLCSRCEANIHHNKLFVR

SEQ ID NO: 3160196 - protein, 18 aa, Giardia lamblia
KQHLRILEKNVFASYSII

SEQ ID NO: 3160197 - protein, 21 aa, Giardia lamblia
KQIEMCIQYGTPVLLEDVGEQ

SEQ ID NO: 3160198 - protein, 25 aa, Giardia lamblia
KQIISHIRCCFVGKGQLLFTRSSTK

SEQ ID NO: 3160199 - protein, 17 aa, Giardia lamblia
KQIKAVCQISQDECVSS

SEQ ID NO: 3160200 - protein, 18 aa, Giardia lamblia
KQILELTNKLSLTAGTPS

SEQ ID NO: 3160201 - protein, 24 aa, Giardia lamblia
KQIWWVIKEIHIYLIDGALHPVLG

SEQ ID NO: 3160202 - protein, 30 aa, Giardia lamblia
KQIYDLFLSYCMVCGYTLSPNTTADAFRAK

SEQ ID NO: 3160203 - protein, 19 aa, Giardia lamblia
KQKAKRDEQAITFTTIDTF

SEQ ID NO: 3160204 - protein, 24 aa, Giardia lamblia
KQKRVLSPVWFKAVETGAHVAIFV

SEQ ID NO: 3160205 - protein, 25 aa, Giardia lamblia
KQKTPAFEIHKDFRLYLTTIPFPQF

SEQ ID NO: 3160206 - protein, 19 aa, Giardia lamblia
KQLCANLHMTFKLSSSHYL

SEQ ID NO: 3160207 - protein, 20 aa, Giardia lamblia
KQLDCAKDLLAESRIVDNEG

SEQ ID NO: 3160208 - protein, 18 aa, Giardia lamblia
KQLDYCPEQSRKNIANLQ

SEQ ID NO: 3160209 - protein, 23 aa, Giardia lamblia
KQLEALYRQRELILQQKKQKTQQ

SEQ ID NO: 3160210 - protein, 23 aa, Giardia lamblia
KQLEHAKRKVIYENKALTDRLRS

SEQ ID NO: 3160211 - protein, 21 aa, Giardia lamblia
KQLKNSVAIISAFKDAFSGFL

SEQ ID NO: 3160212 - protein, 25 aa, Giardia lamblia
KQLLGGKFRMILSLLDRYDLTDVDC

SEQ ID NO: 3160213 - protein, 24 aa, Giardia lamblia
KQLLLSEIVQFCFQASHKPMDMQL

SEQ ID NO: 3160214 - protein, 26 aa, Giardia lamblia
KQLRGARRLTMRWDTRAGCRAKRPRG

SEQ ID NO: 3160215 - protein, 18 aa, Giardia lamblia
KQLRSGRITVTCNLPSEL

SEQ ID NO: 3160216 - protein, 20 aa, Giardia lamblia
KQLSRAVAELQDLNAAKDEE

SEQ ID NO: 3160217 - protein, 20 aa, Giardia lamblia
KQLTELTGLVASQAVQIEGL

SEQ ID NO: 3160218 - protein, 22 aa, Giardia lamblia
KQLTYLHVCSMQFTEQTSKNNA

SEQ ID NO: 3160219 - protein, 24 aa, Giardia lamblia
KQLYEVLKILCAQPSASQQQYQSV

SEQ ID NO: 3160220 - protein, 19 aa, Giardia lamblia
KQNIFKLSFFSLSRFIMRR

SEQ ID NO: 3160221 - protein, 20 aa, Giardia lamblia
KQNLTCINNYFLTRTFLVTE

SEQ ID NO: 3160222 - protein, 17 aa, Giardia lamblia
KQNRNVLYYAFKSEHTK

SEQ ID NO: 3160223 - protein, 32 aa, Giardia lamblia
KQPDMHKVAAVCFVAKVSRVFFRNLGPVERIY

SEQ ID NO: 3160224 - protein, 18 aa, Giardia lamblia
KQPHVLLSRSYQEHTQSS

SEQ ID NO: 3160225 - protein, 19 aa, Giardia lamblia
KQPIPDWFNRTIDEMLSDK

SEQ ID NO: 3160226 - protein, 21 aa, Giardia lamblia
KQPLDNFVCWTEVESPVASIP

SEQ ID NO: 3160227 - protein, 18 aa, Giardia lamblia
KQPPPPLYFVPLMNRYNI

SEQ ID NO: 3160228 - protein, 21 aa, Giardia lamblia
KQPSIPSRIVAAIPQVTNSKA

SEQ ID NO: 3160229 - protein, 24 aa, Giardia lamblia
KQQLSSLISYFWVNGQAMTDGVPF

SEQ ID NO: 3160230 - protein, 22 aa, Giardia lamblia
KQQSGALICSWQGRTPLMCAAE

SEQ ID NO: 3160231 - protein, 19 aa, Giardia lamblia
KQQYECLISEKNKSITELN

SEQ ID NO: 3160232 - protein, 24 aa, Giardia lamblia
KQRAEVIGISVAIQTDFREIEIQT

SEQ ID NO: 3160233 - protein, 18 aa, Giardia lamblia
KQRIFLMNLWESSLSLIV

SEQ ID NO: 3160234 - protein, 22 aa, Giardia lamblia
KQRLRDELIIEYGRRIHTLEEQ

SEQ ID NO: 3160235 - protein, 19 aa, Giardia lamblia
KQSEVVVCHFFHPEFNTCK

SEQ ID NO: 3160236 - protein, 26 aa, Giardia lamblia
KQSFKGTPRAIAWAPGSDWFVISTQD

SEQ ID NO: 3160237 - protein, 18 aa, Giardia lamblia
KQSIEIMANDLDRKSTEI

SEQ ID NO: 3160238 - protein, 17 aa, Giardia lamblia
KQSLCRFTWTSDNAKFF

SEQ ID NO: 3160239 - protein, 25 aa, Giardia lamblia
KQSTIEMIMPFRGIIIIEGIHALNP

SEQ ID NO: 3160240 - protein, 25 aa, Giardia lamblia
KQTAPRFSLVPSISNSVSRRESRQG

SEQ ID NO: 3160241 - protein, 33 aa, Giardia lamblia
KQTARLEHFAALFTRIMKRAALDTFVQNCRAQM

SEQ ID NO: 3160242 - protein, 18 aa, Giardia lamblia
KQTELPLSRTLRPDLSKM

SEQ ID NO: 3160243 - protein, 18 aa, Giardia lamblia
KQTKTGWTALMAAAARGH

SEQ ID NO: 3160244 - protein, 29 aa, Giardia lamblia
KQTVFAVKFTEAWMCKNFQTAVEHALAGK

SEQ ID NO: 3160245 - protein, 17 aa, Giardia lamblia
KQVLWKALDDSLIQYKE

SEQ ID NO: 3160246 - protein, 19 aa, Giardia lamblia
KQVNCPFCHAPSTICKKSQ

SEQ ID NO: 3160247 - protein, 18 aa, Giardia lamblia
KQVNFWTIHSSLCTENDA

SEQ ID NO: 3160248 - protein, 26 aa, Giardia lamblia
KQWGHELCIPDSLLLNCKQKEAVRCM

SEQ ID NO: 3160249 - protein, 17 aa, Giardia lamblia
KQYAEKTIREYDLKLGD

SEQ ID NO: 3160250 - protein, 19 aa, Giardia lamblia
KQYSSGRLKVVHTGHEFSS

SEQ ID NO: 3160251 - protein, 17 aa, Giardia lamblia
KRAEEIWTSENFEQTKQ

SEQ ID NO: 3160252 - protein, 18 aa, Giardia lamblia
KRAETQLIQKGFGKEVFA

SEQ ID NO: 3160253 - protein, 28 aa, Giardia lamblia
KRAFSAIKKSFCGSGRDGRSRSRSKSVR

SEQ ID NO: 3160254 - protein, 23 aa, Giardia lamblia
KRAGNIYKPDFMASGSSWDAEAP

SEQ ID NO: 3160255 - protein, 19 aa, Giardia lamblia
KRAGNKMARTKHTARKTTS

SEQ ID NO: 3160256 - protein, 19 aa, Giardia lamblia
KRAGRSMGPIQTRQFGDGY

SEQ ID NO: 3160257 - protein, 17 aa, Giardia lamblia
KRAKGRSTLEVHLANPL

SEQ ID NO: 3160258 - protein, 26 aa, Giardia lamblia
KRALDSVPVLAQFEAFYRLRDDSTPL

SEQ ID NO: 3160259 - protein, 17 aa, Giardia lamblia
KRALLHANMPRFIKFMI

SEQ ID NO: 3160260 - protein, 19 aa, Giardia lamblia
KRALVSRSKSQARRLNEVA

SEQ ID NO: 3160261 - protein, 17 aa, Giardia lamblia
KRASKIRRLFGLPTTKV

SEQ ID NO: 3160262 - protein, 18 aa, Giardia lamblia
KRAYLQNYIDSMVTGGEP

SEQ ID NO: 3160263 - protein, 17 aa, Giardia lamblia
KRAYRKALVYFEKSNDY

SEQ ID NO: 3160264 - protein, 18 aa, Giardia lamblia
KRCDALHFFCTISAKTDT

SEQ ID NO: 3160265 - protein, 23 aa, Giardia lamblia
KRCQDRWTALMFAAYYGKVDVVR

SEQ ID NO: 3160266 - protein, 18 aa, Giardia lamblia
KRCRIFIQPVGNLIWDEL

SEQ ID NO: 3160267 - protein, 21 aa, Giardia lamblia
KRDAVTLAMQMVFSRISSITI

SEQ ID NO: 3160268 - protein, 20 aa, Giardia lamblia
KRDFLEAELAELNAQLQTLM

SEQ ID NO: 3160269 - protein, 24 aa, Giardia lamblia
KRDLTLPPLFMVIRSFDVNKPGYD

SEQ ID NO: 3160270 - protein, 20 aa, Giardia lamblia
KRDTTILAQRLFNLDPINSM

SEQ ID NO: 3160271 - protein, 20 aa, Giardia lamblia
KRDVLRKFCEACYKIQLTYV

SEQ ID NO: 3160272 - protein, 21 aa, Giardia lamblia
KREALRMKLLKLKRQVGEMER

SEQ ID NO: 3160273 - protein, 18 aa, Giardia lamblia
KREEEIYAATEGCKGGWR

SEQ ID NO: 3160274 - protein, 19 aa, Giardia lamblia
KREEIDFVIRPNSEEKTIS

SEQ ID NO: 3160275 - protein, 22 aa, Giardia lamblia
KREHVLAFILTFIADWKNLTPM

SEQ ID NO: 3160276 - protein, 23 aa, Giardia lamblia
KREKRPIPEATILTIIDHVTSAL

SEQ ID NO: 3160277 - protein, 18 aa, Giardia lamblia
KRELAQLFAEYERQQDAK

SEQ ID NO: 3160278 - protein, 19 aa, Giardia lamblia
KRELEAKTECLLQEYDALQ

SEQ ID NO: 3160279 - protein, 23 aa, Giardia lamblia
KRELPLQEALGILRQVGKALEHL

SEQ ID NO: 3160280 - protein, 23 aa, Giardia lamblia
KREQGELTLRYSAETNMKDERIV

SEQ ID NO: 3160281 - protein, 22 aa, Giardia lamblia
KRERKILDSWQLTSVYGPNLIP

SEQ ID NO: 3160282 - protein, 21 aa, Giardia lamblia
KRFPEHSNLHFVISRVLLPLV

SEQ ID NO: 3160283 - protein, 17 aa, Giardia lamblia
KRFVMNLLKQREELQDL

SEQ ID NO: 3160284 - protein, 19 aa, Giardia lamblia
KRGACIYVAECCAELKTVR

SEQ ID NO: 3160285 - protein, 22 aa, Giardia lamblia
KRGDILAACCLTEELYLQDCTG

SEQ ID NO: 3160286 - protein, 22 aa, Giardia lamblia
KRGDLPEACVQLISLGEVHVQE

SEQ ID NO: 3160287 - protein, 24 aa, Giardia lamblia
KRGDPKAAMSLATRRAIFWNAALT

SEQ ID NO: 3160288 - protein, 18 aa, Giardia lamblia
KRGRSASKQSRKFSSPVC

SEQ ID NO: 3160289 - protein, 21 aa, Giardia lamblia
KRGRTALMRAAEYGHIDAIVI

SEQ ID NO: 3160290 - protein, 17 aa, Giardia lamblia
KRGTPQLSFSDVKVEKA

SEQ ID NO: 3160291 - protein, 20 aa, Giardia lamblia
KRGWMFIPPYNSFDVIEGQG

SEQ ID NO: 3160292 - protein, 24 aa, Giardia lamblia
KRHDFCYKGMPGLSLHLQNSEDHT

SEQ ID NO: 3160293 - protein, 26 aa, Giardia lamblia
KRHEPYKLGFDAPRGQDILGAILAEE

SEQ ID NO: 3160294 - protein, 18 aa, Giardia lamblia
KRHIKGVSRASIFQKDKA

SEQ ID NO: 3160295 - protein, 18 aa, Giardia lamblia
KRHLPTIYSLIISTPDEV

SEQ ID NO: 3160296 - protein, 19 aa, Giardia lamblia
KRHPLRFARALRMIAESAC

SEQ ID NO: 3160297 - protein, 18 aa, Giardia lamblia
KRHTGVITSHQFKQALSG

SEQ ID NO: 3160298 - protein, 17 aa, Giardia lamblia
KRIAFVQSIYTIGPIGY

SEQ ID NO: 3160299 - protein, 18 aa, Giardia lamblia
KRICAYHLEDSCRLTCCS

SEQ ID NO: 3160300 - protein, 26 aa, Giardia lamblia
KRIHEHGAGFCALMAASHYGNIECAK

SEQ ID NO: 3160301 - protein, 31 aa, Giardia lamblia
KRIQDKLAKFFVVIFRRLKVDPHVVAYALCL

SEQ ID NO: 3160302 - protein, 23 aa, Giardia lamblia
KRIQEIRPLWNSLRQASYNQAAK

SEQ ID NO: 3160303 - protein, 18 aa, Giardia lamblia
KRIQTMCYHYIDGLIWVF

SEQ ID NO: 3160304 - protein, 18 aa, Giardia lamblia
KRISALERLVEARDDAIQ

SEQ ID NO: 3160305 - protein, 27 aa, Giardia lamblia
KRISRFNFLPPYLFVVINRFLWEEQAQ

SEQ ID NO: 3160306 - protein, 17 aa, Giardia lamblia
KRITCTRFESSVEHMTF

SEQ ID NO: 3160307 - protein, 21 aa, Giardia lamblia
KRITSPRSIVAMRRRAIRFSD

SEQ ID NO: 3160308 - protein, 20 aa, Giardia lamblia
KRKAELAVTFGDAAKSNEVT

SEQ ID NO: 3160309 - protein, 25 aa, Giardia lamblia
KRKCGVPSATALILAAMCGQAEIVY

SEQ ID NO: 3160310 - protein, 20 aa, Giardia lamblia
KRKHFPSVDWLISYSRCTET

SEQ ID NO: 3160311 - protein, 22 aa, Giardia lamblia
KRKIERELEGFGIRLNKRPPLI

SEQ ID NO: 3160312 - protein, 21 aa, Giardia lamblia
KRKIPSDTVLLAILQIAEAIT

SEQ ID NO: 3160313 - protein, 25 aa, Giardia lamblia
KRKKKCPRVVLSVVFGSSQNQWEKV

SEQ ID NO: 3160314 - protein, 22 aa, Giardia lamblia
KRKLDALERAVRSPVITSPTVV

SEQ ID NO: 3160315 - protein, 26 aa, Giardia lamblia
KRKLIDLLELKKCRDRAHRLMLEMGK

SEQ ID NO: 3160316 - protein, 19 aa, Giardia lamblia
KRKLVLETYSKVGRDLPKI

SEQ ID NO: 3160317 - protein, 27 aa, Giardia lamblia
KRKNIYSNRCGFFGGINCIILVANVML

SEQ ID NO: 3160318 - protein, 22 aa, Giardia lamblia
KRKSIRGCIVGPDLHALSVVLV

SEQ ID NO: 3160319 - protein, 20 aa, Giardia lamblia
KRLAPSIHRVAMLRLAIAES

SEQ ID NO: 3160320 - protein, 17 aa, Giardia lamblia
KRLEEYQAENKHLKEVI

SEQ ID NO: 3160321 - protein, 20 aa, Giardia lamblia
KRLFMTVPFEAVATDVSIPI

SEQ ID NO: 3160322 - protein, 21 aa, Giardia lamblia
KRLINLLIFINGRRVQYPRLK

SEQ ID NO: 3160323 - protein, 17 aa, Giardia lamblia
KRLKEKDAHLVQASSEL

SEQ ID NO: 3160324 - protein, 19 aa, Giardia lamblia
KRLKSFLDEISALKSPSDS

SEQ ID NO: 3160325 - protein, 18 aa, Giardia lamblia
KRLLPEQAARNIFELRQP

SEQ ID NO: 3160326 - protein, 20 aa, Giardia lamblia
KRLNSGTIYMIGDSLTSDVT

SEQ ID NO: 3160327 - protein, 19 aa, Giardia lamblia
KRLNTELSRYYSRQLREII

SEQ ID NO: 3160328 - protein, 21 aa, Giardia lamblia
KRLPMDGCVREDITTFMADEI

SEQ ID NO: 3160329 - protein, 21 aa, Giardia lamblia
KRLQKELLDRQLAEYNLPEFA

SEQ ID NO: 3160330 - protein, 20 aa, Giardia lamblia
KRLRDVSSGLELVSRLSLKT

SEQ ID NO: 3160331 - protein, 23 aa, Giardia lamblia
KRLRVRDFPYYKAVDKPVVVCGW

SEQ ID NO: 3160332 - protein, 23 aa, Giardia lamblia
KRLSELYATVSSSLEYVQTLQDI

SEQ ID NO: 3160333 - protein, 18 aa, Giardia lamblia
KRLSEYKNGLLQKKLKTL

SEQ ID NO: 3160334 - protein, 19 aa, Giardia lamblia
KRLSGLLLDAIYGVATKDS

SEQ ID NO: 3160335 - protein, 29 aa, Giardia lamblia
KRLSSGVIGCGYDRVGLKAMVVTNDRCML

SEQ ID NO: 3160336 - protein, 20 aa, Giardia lamblia
KRLTCYDGFEPSGRIHIAQG

SEQ ID NO: 3160337 - protein, 21 aa, Giardia lamblia
KRLTPLLKHDINLFAYHLPMD

SEQ ID NO: 3160338 - protein, 24 aa, Giardia lamblia
KRLTRYLMPYPHTSEFVRRRAASL

SEQ ID NO: 3160339 - protein, 26 aa, Giardia lamblia
KRLYEYMKERFEPIKIEIERLRAKER

SEQ ID NO: 3160340 - protein, 17 aa, Giardia lamblia
KRMANLFEYITSFEENP

SEQ ID NO: 3160341 - protein, 19 aa, Giardia lamblia
KRMASMPAVGAAPAAASTA

SEQ ID NO: 3160342 - protein, 26 aa, Giardia lamblia
KRMDTLRMMYKVGFGPSSSHTMGPRF

SEQ ID NO: 3160343 - protein, 17 aa, Giardia lamblia
KRMEKIVSAAPEFVKNV

SEQ ID NO: 3160344 - protein, 24 aa, Giardia lamblia
KRNDGKCALILAVNAREEQCVRIM

SEQ ID NO: 3160345 - protein, 25 aa, Giardia lamblia
KRNDKLRASIGFKIYATDLETAIPG

SEQ ID NO: 3160346 - protein, 20 aa, Giardia lamblia
KRNLLSRIMASWCQAKMLNK

SEQ ID NO: 3160347 - protein, 20 aa, Giardia lamblia
KRPAANELLRYPKIQETGEQ

SEQ ID NO: 3160348 - protein, 17 aa, Giardia lamblia
KRPIGSVSFTTPGNITS

SEQ ID NO: 3160349 - protein, 17 aa, Giardia lamblia
KRPIPALKQPIIDILSV

SEQ ID NO: 3160350 - protein, 19 aa, Giardia lamblia
KRPKVRYPGYSVAARPLLN

SEQ ID NO: 3160351 - protein, 17 aa, Giardia lamblia
KRPLCSVPGIPRTAEDC

SEQ ID NO: 3160352 - protein, 19 aa, Giardia lamblia
KRPPSCQRTNRSGPSTSHR

SEQ ID NO: 3160353 - protein, 22 aa, Giardia lamblia
KRPSASELLLCPKFKEVGVVTA

SEQ ID NO: 3160354 - protein, 19 aa, Giardia lamblia
KRPSNAMVVQQYIASLSGA

SEQ ID NO: 3160355 - protein, 21 aa, Giardia lamblia
KRPYFRAACLYYCPTLEVIND

SEQ ID NO: 3160356 - protein, 21 aa, Giardia lamblia
KRPYVDEFLETMAKYYELAIF

SEQ ID NO: 3160357 - protein, 17 aa, Giardia lamblia
KRQGLLMLPYATIYIPY

SEQ ID NO: 3160358 - protein, 22 aa, Giardia lamblia
KRQLELETSRGLQLERELSNIT

SEQ ID NO: 3160359 - protein, 18 aa, Giardia lamblia
KRQLERQDRIILELEASN

SEQ ID NO: 3160360 - protein, 18 aa, Giardia lamblia
KRQSLLEDVRAEFNKVCE

SEQ ID NO: 3160361 - protein, 25 aa, Giardia lamblia
KRQSSWRLVVPMPKILEFSKRLPES

SEQ ID NO: 3160362 - protein, 20 aa, Giardia lamblia
KRQVNEFSNKLLEAKQAQQE

SEQ ID NO: 3160363 - protein, 27 aa, Giardia lamblia
KRREGNTIGMYACSYACSVSNGEAKQE

SEQ ID NO: 3160364 - protein, 24 aa, Giardia lamblia
KRRFWDDRVLPLFPPYHFSCPAEP

SEQ ID NO: 3160365 - protein, 20 aa, Giardia lamblia
KRRGELKIIKSFQTRVFSQF

SEQ ID NO: 3160366 - protein, 27 aa, Giardia lamblia
KRRIYDALSTFIALEIIQKVNKMLYWN

SEQ ID NO: 3160367 - protein, 27 aa, Giardia lamblia
KRRIYIEKLKIRCDILTDRVGSLTCAA

SEQ ID NO: 3160368 - protein, 24 aa, Giardia lamblia
KRRKEISEDALVRSRTLGPYLRQI

SEQ ID NO: 3160369 - protein, 24 aa, Giardia lamblia
KRRKHFLHCFDFLSKEISAVYYAL

SEQ ID NO: 3160370 - protein, 25 aa, Giardia lamblia
KRRKIPVPIAMILSVLRQVAAALAY

SEQ ID NO: 3160371 - protein, 20 aa, Giardia lamblia
KRRQIREMSQELKVLDELIK

SEQ ID NO: 3160372 - protein, 20 aa, Giardia lamblia
KRRRCSSARQESGRVYQAAA

SEQ ID NO: 3160373 - protein, 18 aa, Giardia lamblia
KRRRSGGSINVFTLAGAK

SEQ ID NO: 3160374 - protein, 22 aa, Giardia lamblia
KRRSEFQIRNWLKNYDERCIDC

SEQ ID NO: 3160375 - protein, 17 aa, Giardia lamblia
KRRTASLQSELQAQQTD

SEQ ID NO: 3160376 - protein, 20 aa, Giardia lamblia
KRSCSSSLIADRDRLQSDMA

SEQ ID NO: 3160377 - protein, 24 aa, Giardia lamblia
KRSDKDRCIYYYHIITGRGLHSSS

SEQ ID NO: 3160378 - protein, 22 aa, Giardia lamblia
KRSDLCSLGSYYTSPGGSDELL

SEQ ID NO: 3160379 - protein, 20 aa, Giardia lamblia
KRSKTGAVQGKWHKKRKYNL

SEQ ID NO: 3160380 - protein, 20 aa, Giardia lamblia
KRSLEEALRRSHDASLIVDG

SEQ ID NO: 3160381 - protein, 22 aa, Giardia lamblia
KRSLRPALPEHVPKSLLPEGTT

SEQ ID NO: 3160382 - protein, 20 aa, Giardia lamblia
KRSLRRCIYSFKLPGQKIPL

SEQ ID NO: 3160383 - protein, 17 aa, Giardia lamblia
KRSLSLGRLKKKDRSRA

SEQ ID NO: 3160384 - protein, 20 aa, Giardia lamblia
KRSQQSPVIRGCDTKDDPLL

SEQ ID NO: 3160385 - protein, 17 aa, Giardia lamblia
KRSSSCSKINPMSGTGR

SEQ ID NO: 3160386 - protein, 21 aa, Giardia lamblia
KRTALFYAAERGYDSLVSLLI

SEQ ID NO: 3160387 - protein, 20 aa, Giardia lamblia
KRTALRASCEALGLTCNGVV

SEQ ID NO: 3160388 - protein, 28 aa, Giardia lamblia
KRTAPFYVESLVGFNMFPGCEHVETVAI

SEQ ID NO: 3160389 - protein, 21 aa, Giardia lamblia
KRTAQRLKEITAFHEQIAANI

SEQ ID NO: 3160390 - protein, 23 aa, Giardia lamblia
KRTIWAVPMSFSLIDNNYKQVSV

SEQ ID NO: 3160391 - protein, 24 aa, Giardia lamblia
KRTKNSVCTGDWDMAKILDAVLHG

SEQ ID NO: 3160392 - protein, 25 aa, Giardia lamblia
KRTSKGWTALMFAAVAGNLWAVKQL

SEQ ID NO: 3160393 - protein, 26 aa, Giardia lamblia
KRTYLPYWSEQVFKLPEPGSEDNGRV

SEQ ID NO: 3160394 - protein, 17 aa, Giardia lamblia
KRVCFGITDTIRCLEMS

SEQ ID NO: 3160395 - protein, 19 aa, Giardia lamblia
KRVECKLMVAERLAGENAE

SEQ ID NO: 3160396 - protein, 21 aa, Giardia lamblia
KRVEGLSLRLSKDHKPDDPTE

SEQ ID NO: 3160397 - protein, 19 aa, Giardia lamblia
KRVHILNSLGRCRLQNADL

SEQ ID NO: 3160398 - protein, 18 aa, Giardia lamblia
KRVLRFFLDNNLIKRTAQ

SEQ ID NO: 3160399 - protein, 21 aa, Giardia lamblia
KRVPCVAGMFLLAAEDLISLL

SEQ ID NO: 3160400 - protein, 22 aa, Giardia lamblia
KRWYERSLLKVLCEEFVEYDEE

SEQ ID NO: 3160401 - protein, 17 aa, Giardia lamblia
KRYAELTSRAAGILARS

SEQ ID NO: 3160402 - protein, 33 aa, Giardia lamblia
KRYGGTSILMPFTFPVGLFVKLKELSPSIPMTI

SEQ ID NO: 3160403 - protein, 19 aa, Giardia lamblia
KRYLKLAIHNDLTKTSMIA

SEQ ID NO: 3160404 - protein, 21 aa, Giardia lamblia
KRYQKAMCLIASGIEQDPYFR

SEQ ID NO: 3160405 - protein, 19 aa, Giardia lamblia
KRYRMSVCHKQPYQHLYLK

SEQ ID NO: 3160406 - protein, 24 aa, Giardia lamblia
KRYYSRLNEELTLITQISSRLRAD

SEQ ID NO: 3160407 - protein, 25 aa, Giardia lamblia
KSAAKRCVKDLWSQVPKGLLSRANS

SEQ ID NO: 3160408 - protein, 17 aa, Giardia lamblia
KSAALQWLVDTRAEVPP

SEQ ID NO: 3160409 - protein, 19 aa, Giardia lamblia
KSAARACLKTISQVSDEKV

SEQ ID NO: 3160410 - protein, 17 aa, Giardia lamblia
KSADLLGQMRRHLEYFG

SEQ ID NO: 3160411 - protein, 17 aa, Giardia lamblia
KSAEAATLMALKNEVAL

SEQ ID NO: 3160412 - protein, 17 aa, Giardia lamblia
KSAELVRLYLGANDSEE

SEQ ID NO: 3160413 - protein, 17 aa, Giardia lamblia
KSAGAIPPHGARTTFTC

SEQ ID NO: 3160414 - protein, 18 aa, Giardia lamblia
KSALLKFTCTIAERGIYV

SEQ ID NO: 3160415 - protein, 17 aa, Giardia lamblia
KSALLLKKVNSISHCTG

SEQ ID NO: 3160416 - protein, 20 aa, Giardia lamblia
KSAQVYARYYIDLVESEKKA

SEQ ID NO: 3160417 - protein, 24 aa, Giardia lamblia
KSARAEPAISTGIDLVGVVKVGED

SEQ ID NO: 3160418 - protein, 20 aa, Giardia lamblia
KSCLHYCIDSGSYLILETIF

SEQ ID NO: 3160419 - protein, 17 aa, Giardia lamblia
KSDIWALGVTFYELMNM

SEQ ID NO: 3160420 - protein, 22 aa, Giardia lamblia
KSDLQLRFDALMKANPQLHQLI

SEQ ID NO: 3160421 - protein, 21 aa, Giardia lamblia
KSDQVSLWLGSHVMVEFPHGE

SEQ ID NO: 3160422 - protein, 18 aa, Giardia lamblia
KSEASICSMTVHPAIDGD

SEQ ID NO: 3160423 - protein, 26 aa, Giardia lamblia
KSEELKLKLEEEIHRRTKLSSEVDEL

SEQ ID NO: 3160424 - protein, 19 aa, Giardia lamblia
KSEISQWGQPALEEHSCAS

SEQ ID NO: 3160425 - protein, 17 aa, Giardia lamblia
KSELDSITICLPSAFRH

SEQ ID NO: 3160426 - protein, 18 aa, Giardia lamblia
KSELEWLTEPVMQQIKQA

SEQ ID NO: 3160427 - protein, 23 aa, Giardia lamblia
KSESGLLPLARLQTCQSALGSLR

SEQ ID NO: 3160428 - protein, 25 aa, Giardia lamblia
KSEVGCRLLLTGKIYASFPEAIEGA

SEQ ID NO: 3160429 - protein, 23 aa, Giardia lamblia
KSFCPKCNYISLISPEVKPFFHC

SEQ ID NO: 3160430 - protein, 17 aa, Giardia lamblia
KSFCPSTSVLSAIAAFM

SEQ ID NO: 3160431 - protein, 18 aa, Giardia lamblia
KSFDELSTRFVLQSDQDA

SEQ ID NO: 3160432 - protein, 17 aa, Giardia lamblia
KSFTCISKADIKKAYAA

SEQ ID NO: 3160433 - protein, 23 aa, Giardia lamblia
KSGEEHDHRLGLQSISSQVDTVS

SEQ ID NO: 3160434 - protein, 18 aa, Giardia lamblia
KSGEKIKIGLGKKTGGTP

SEQ ID NO: 3160435 - protein, 24 aa, Giardia lamblia
KSGLATICGAMWEVLIPIQDISMD

SEQ ID NO: 3160436 - protein, 29 aa, Giardia lamblia
KSGLQSGVRYCLNCVAQLELLDELRSTNA

SEQ ID NO: 3160437 - protein, 22 aa, Giardia lamblia
KSGRTALSYALEHMAVDTISLL

SEQ ID NO: 3160438 - protein, 22 aa, Giardia lamblia
KSGRVSINYETFRHIIAGHTID

SEQ ID NO: 3160439 - protein, 19 aa, Giardia lamblia
KSGTEGFIALRVADMPEAS

SEQ ID NO: 3160440 - protein, 17 aa, Giardia lamblia
KSGVPSSLFDSVAPKTI

SEQ ID NO: 3160441 - protein, 20 aa, Giardia lamblia
KSHCLERYSLHKIPHEDLGF

SEQ ID NO: 3160442 - protein, 20 aa, Giardia lamblia
KSHMTAMLYAAVNGHGDIVQ

SEQ ID NO: 3160443 - protein, 17 aa, Giardia lamblia
KSIDCVRLLLEEEKMMI

SEQ ID NO: 3160444 - protein, 25 aa, Giardia lamblia
KSIDTRTKWEAVTNLSFLTCSIEDV

SEQ ID NO: 3160445 - protein, 23 aa, Giardia lamblia
KSIEYQPSFARYVALGLVYRDMR

SEQ ID NO: 3160446 - protein, 26 aa, Giardia lamblia
KSIFSSPRWYGAYIKRASRFSNPTDD

SEQ ID NO: 3160447 - protein, 18 aa, Giardia lamblia
KSIHEFRFYIPTKCLHID

SEQ ID NO: 3160448 - protein, 19 aa, Giardia lamblia
KSILLERGLETSVATTRAN

SEQ ID NO: 3160449 - protein, 17 aa, Giardia lamblia
KSIPESFTLEKKDKESL

SEQ ID NO: 3160450 - protein, 21 aa, Giardia lamblia
KSIPNSFLIYNIPPEKRDPKE

SEQ ID NO: 3160451 - protein, 36 aa, Giardia lamblia
KSITCPPASAVVEGFKACGVGLWNRGGNKGGLAATI

SEQ ID NO: 3160452 - protein, 24 aa, Giardia lamblia
KSKAAMAMCSWVHAMNKYYHVAKQ

SEQ ID NO: 3160453 - protein, 21 aa, Giardia lamblia
KSKCYAYLLYMRKRYEQITGW

SEQ ID NO: 3160454 - protein, 18 aa, Giardia lamblia
KSKDCVDLLVSEKDLQAS

SEQ ID NO: 3160455 - protein, 21 aa, Giardia lamblia
KSKKFRKVHNRDKRLARLEKR

SEQ ID NO: 3160456 - protein, 17 aa, Giardia lamblia
KSKKYPALYYAIVSGHI

SEQ ID NO: 3160457 - protein, 20 aa, Giardia lamblia
KSKMKWRRVDPQNTYFRPNY

SEQ ID NO: 3160458 - protein, 17 aa, Giardia lamblia
KSKNCPVCEEVGFPIGK

SEQ ID NO: 3160459 - protein, 18 aa, Giardia lamblia
KSKTPRRGIELSLMSSPD

SEQ ID NO: 3160460 - protein, 19 aa, Giardia lamblia
KSLAELLNQIWAKGHPQPQ

SEQ ID NO: 3160461 - protein, 17 aa, Giardia lamblia
KSLAVLPAINAPTEALQ

SEQ ID NO: 3160462 - protein, 19 aa, Giardia lamblia
KSLFCRRLVEHAQDSGLKA

SEQ ID NO: 3160463 - protein, 17 aa, Giardia lamblia
KSLHRPSGHGGPNPRRR

SEQ ID NO: 3160464 - protein, 18 aa, Giardia lamblia
KSLIAFQHLLFIVLRQKF

SEQ ID NO: 3160465 - protein, 17 aa, Giardia lamblia
KSLIKESRMKDQQGLTA

SEQ ID NO: 3160466 - protein, 20 aa, Giardia lamblia
KSLLESISLLQAELITDDFS

SEQ ID NO: 3160467 - protein, 19 aa, Giardia lamblia
KSLLHLSFIPTGLWYDKTH

SEQ ID NO: 3160468 - protein, 22 aa, Giardia lamblia
KSLPSLLLNYSLTSPFHSAAKF

SEQ ID NO: 3160469 - protein, 22 aa, Giardia lamblia
KSLRACNRIDKLVSGLIVMADS

SEQ ID NO: 3160470 - protein, 24 aa, Giardia lamblia
KSLRECVGSLPLYAIMNALMCLTT

SEQ ID NO: 3160471 - protein, 28 aa, Giardia lamblia
KSLSLKSNRLMAIPESIFTPVLNIEELY

SEQ ID NO: 3160472 - protein, 19 aa, Giardia lamblia
KSLSSIVFRNCTCLTQNIL

SEQ ID NO: 3160473 - protein, 24 aa, Giardia lamblia
KSLTKRFAGFITKMAHDEHGEHAG

SEQ ID NO: 3160474 - protein, 17 aa, Giardia lamblia
KSLWITCNQRWHSTHDN

SEQ ID NO: 3160475 - protein, 17 aa, Giardia lamblia
KSMMSFAGASIREPTTM

SEQ ID NO: 3160476 - protein, 20 aa, Giardia lamblia
KSMPKYIALLALSAGIDARI

SEQ ID NO: 3160477 - protein, 20 aa, Giardia lamblia
KSNALDALRLLCAEEANISE

SEQ ID NO: 3160478 - protein, 18 aa, Giardia lamblia
KSNKVHFFSFDWNIPSFL

SEQ ID NO: 3160479 - protein, 17 aa, Giardia lamblia
KSNLKSNYAYYFSPSSE

SEQ ID NO: 3160480 - protein, 24 aa, Giardia lamblia
KSNPKILLSIRIWRTREEAQLHTH

SEQ ID NO: 3160481 - protein, 19 aa, Giardia lamblia
KSNPYEFYGTVLSKSRSTS

SEQ ID NO: 3160482 - protein, 19 aa, Giardia lamblia
KSNVSDYWVREMKEKLFNN

SEQ ID NO: 3160483 - protein, 20 aa, Giardia lamblia
KSNYIKWLLPESLRSVDSQG

SEQ ID NO: 3160484 - protein, 20 aa, Giardia lamblia
KSPHCMICSESSTTDSFARI

SEQ ID NO: 3160485 - protein, 22 aa, Giardia lamblia
KSPKGSLLIVDFVKKVGNEDLY

SEQ ID NO: 3160486 - protein, 26 aa, Giardia lamblia
KSPLYKFPVLFLSTAVVMNIAKSALL

SEQ ID NO: 3160487 - protein, 21 aa, Giardia lamblia
KSPRLLYQLVHQLLTHNGYTI

SEQ ID NO: 3160488 - protein, 17 aa, Giardia lamblia
KSQDLAIEIAKLSDNVA

SEQ ID NO: 3160489 - protein, 21 aa, Giardia lamblia
KSQHFRMLKSAFQADDGLESL

SEQ ID NO: 3160490 - protein, 17 aa, Giardia lamblia
KSQICNFGHESISDGDV

SEQ ID NO: 3160491 - protein, 19 aa, Giardia lamblia
KSQMMSDIIYFELTPANIY

SEQ ID NO: 3160492 - protein, 22 aa, Giardia lamblia
KSQQLPLVFHAGLLAFVRKYNT

SEQ ID NO: 3160493 - protein, 25 aa, Giardia lamblia
KSQRARLLLRQGAKCYLHRRNGERK

SEQ ID NO: 3160494 - protein, 18 aa, Giardia lamblia
KSRDTCAMIQNYINDSAV

SEQ ID NO: 3160495 - protein, 24 aa, Giardia lamblia
KSRENSTLILPGYLWSLAVLEEKD

SEQ ID NO: 3160496 - protein, 18 aa, Giardia lamblia
KSRGSCDGQRVFTKSSAG

SEQ ID NO: 3160497 - protein, 18 aa, Giardia lamblia
KSRIVLKALILAHLRLQA

SEQ ID NO: 3160498 - protein, 22 aa, Giardia lamblia
KSRKHPPASALAISQPLPPNLS

SEQ ID NO: 3160499 - protein, 21 aa, Giardia lamblia
KSRLIRTPLDYNITFYDDPLR

SEQ ID NO: 3160500 - protein, 20 aa, Giardia lamblia
KSRRATTRPGSSVKAGVQDV

SEQ ID NO: 3160501 - protein, 18 aa, Giardia lamblia
KSRVFELQEQLMTNQLEK

SEQ ID NO: 3160502 - protein, 18 aa, Giardia lamblia
KSSFATEFLKMYQKELGV

SEQ ID NO: 3160503 - protein, 23 aa, Giardia lamblia
KSSIHGHGLFALVYIPRGKNVIE

SEQ ID NO: 3160504 - protein, 24 aa, Giardia lamblia
KSSINYDGCRLVIEPYKRGPGRIA

SEQ ID NO: 3160505 - protein, 23 aa, Giardia lamblia
KSSKQWAGRLCHLSLLKGLISLA

SEQ ID NO: 3160506 - protein, 19 aa, Giardia lamblia
KSSLLKAAYKYTINPNEYA

SEQ ID NO: 3160507 - protein, 18 aa, Giardia lamblia
KSSLSLSLDSIFSTNASK

SEQ ID NO: 3160508 - protein, 24 aa, Giardia lamblia
KSSPFEGPLYQHAQHAIARNEVSD

SEQ ID NO: 3160509 - protein, 22 aa, Giardia lamblia
KSSPGKSGLCLNESTQPIKSKS

SEQ ID NO: 3160510 - protein, 23 aa, Giardia lamblia
KSSRFDDFSQYYAVLVGTIASAD

SEQ ID NO: 3160511 - protein, 25 aa, Giardia lamblia
KSSRFPFGCIYKGMWNADRRHGLGR

SEQ ID NO: 3160512 - protein, 22 aa, Giardia lamblia
KSSRRAAIDLGKSIHFHADGDF

SEQ ID NO: 3160513 - protein, 18 aa, Giardia lamblia
KSSSMPIHNSPGIRPPLH

SEQ ID NO: 3160514 - protein, 24 aa, Giardia lamblia
KSSTADCFSCPSSEEISNEVNSTV

SEQ ID NO: 3160515 - protein, 20 aa, Giardia lamblia
KSSVTPCLIHRLSPSHASSA

SEQ ID NO: 3160516 - protein, 18 aa, Giardia lamblia
KSSVVKQAIVCFDAGELK

SEQ ID NO: 3160517 - protein, 18 aa, Giardia lamblia
KSTFCKHLKKYLIDQGFE

SEQ ID NO: 3160518 - protein, 26 aa, Giardia lamblia
KSTFLKEMLRRIFVVKPENRVSAKEL

SEQ ID NO: 3160519 - protein, 20 aa, Giardia lamblia
KSTKRKSSFHSVFNATGTNF

SEQ ID NO: 3160520 - protein, 22 aa, Giardia lamblia
KSTKSLAPWSRDFIKRVEQLQK

SEQ ID NO: 3160521 - protein, 17 aa, Giardia lamblia
KSTLSLTSFWSRSLAMK

SEQ ID NO: 3160522 - protein, 17 aa, Giardia lamblia
KSTMLCALDISRPKKTV

SEQ ID NO: 3160523 - protein, 21 aa, Giardia lamblia
KSVAVADLWPYEDCSNNCMSC

SEQ ID NO: 3160524 - protein, 18 aa, Giardia lamblia
KSVDPTCKNRIIQILQQY

SEQ ID NO: 3160525 - protein, 22 aa, Giardia lamblia
KSVEIFKEILTGVFGSRAIKQS

SEQ ID NO: 3160526 - protein, 19 aa, Giardia lamblia
KSVLIKQYLVRGSGRKDLS

SEQ ID NO: 3160527 - protein, 26 aa, Giardia lamblia
KSVSILLKRECGMLLLDGTSALLMAT

SEQ ID NO: 3160528 - protein, 24 aa, Giardia lamblia
KSWFKDLRTAYTLWYDEDEHSERT

SEQ ID NO: 3160529 - protein, 18 aa, Giardia lamblia
KSWYEWWEAAGFFSPDMQ

SEQ ID NO: 3160530 - protein, 17 aa, Giardia lamblia
KSYAEMRMELRATRHQF

SEQ ID NO: 3160531 - protein, 31 aa, Giardia lamblia
KSYERLKCDLMDLRLLLLCKEHVNDYISATE

SEQ ID NO: 3160532 - protein, 25 aa, Giardia lamblia
KSYHPTMGLLPKREYDRTGPGIVPT

SEQ ID NO: 3160533 - protein, 24 aa, Giardia lamblia
KSYLDLSCPKCFERYGPSRRIIAL

SEQ ID NO: 3160534 - protein, 21 aa, Giardia lamblia
KSYRAVCWTEKPLPSNAEETC

SEQ ID NO: 3160535 - protein, 22 aa, Giardia lamblia
KSYVCSFCSLMQPLPPSYAQIT

SEQ ID NO: 3160536 - protein, 18 aa, Giardia lamblia
KTAAFGISLLSLVNPQKS

SEQ ID NO: 3160537 - protein, 18 aa, Giardia lamblia
KTAAFTIGMLQRIDIGLK

SEQ ID NO: 3160538 - protein, 29 aa, Giardia lamblia
KTALMCAAEFGHFECCKLLLGGEGLIHTQ

SEQ ID NO: 3160539 - protein, 17 aa, Giardia lamblia
KTALMWAAEAGHTAVAL

SEQ ID NO: 3160540 - protein, 17 aa, Giardia lamblia
KTALMYAASAGKVKVLQ

SEQ ID NO: 3160541 - protein, 18 aa, Giardia lamblia
KTALVIASFLGHKAIVEK

SEQ ID NO: 3160542 - protein, 25 aa, Giardia lamblia
KTALWKGVLLLPFINSSELISAAQK

SEQ ID NO: 3160543 - protein, 23 aa, Giardia lamblia
KTAPRPGGPTAIRSVPRPGAQSR

SEQ ID NO: 3160544 - protein, 24 aa, Giardia lamblia
KTDCLGRCALMYAIETHNATLISS

SEQ ID NO: 3160545 - protein, 22 aa, Giardia lamblia
KTDDLTCVILTYTSWVDNASHI

SEQ ID NO: 3160546 - protein, 22 aa, Giardia lamblia
KTDHFFRFRGLYAEYTLQCLRK

SEQ ID NO: 3160547 - protein, 24 aa, Giardia lamblia
KTDKVMELYDRFSVTDQKRLYELQ

SEQ ID NO: 3160548 - protein, 17 aa, Giardia lamblia
KTDLKLELEISGVDISY

SEQ ID NO: 3160549 - protein, 18 aa, Giardia lamblia
KTDPDCHVPYRNSMMTMF

SEQ ID NO: 3160550 - protein, 26 aa, Giardia lamblia
KTDRVGFTSGFKWKDFVTDLESVLQY

SEQ ID NO: 3160551 - protein, 19 aa, Giardia lamblia
KTDSFMISVFYYRLKLTCQ

SEQ ID NO: 3160552 - protein, 25 aa, Giardia lamblia
KTDTRGRTALMYGAMKGSVEATELM

SEQ ID NO: 3160553 - protein, 24 aa, Giardia lamblia
KTEARSGPGARFGFIQRINQKAAA

SEQ ID NO: 3160554 - protein, 19 aa, Giardia lamblia
KTECCERMSDFISHLKQEK

SEQ ID NO: 3160555 - protein, 17 aa, Giardia lamblia
KTEEEVIAIPIEGVVQS

SEQ ID NO: 3160556 - protein, 21 aa, Giardia lamblia
KTELCNLLMTRYERLVEKTKE

SEQ ID NO: 3160557 - protein, 27 aa, Giardia lamblia
KTERGKVCTERGWTALMYAACHNNADV

SEQ ID NO: 3160558 - protein, 20 aa, Giardia lamblia
KTFDIWGTPLPEKRTIDFTG

SEQ ID NO: 3160559 - protein, 21 aa, Giardia lamblia
KTFLLECAKDMQAHSVAYRVA

SEQ ID NO: 3160560 - protein, 27 aa, Giardia lamblia
KTFTPFLSSILIEFSKVSPLHIAPVAH

SEQ ID NO: 3160561 - protein, 20 aa, Giardia lamblia
KTGAYRGIVRLIDQYKSEEL

SEQ ID NO: 3160562 - protein, 25 aa, Giardia lamblia
KTGDCKICDFNMCRSVQTARAKTLA

SEQ ID NO: 3160563 - protein, 24 aa, Giardia lamblia
KTGEFRPRRFFSIDRVYRNETLDA

SEQ ID NO: 3160564 - protein, 19 aa, Giardia lamblia
KTGFTAAINHLDKIFIRKQ

SEQ ID NO: 3160565 - protein, 19 aa, Giardia lamblia
KTGGKLGARKGITIPTRIL

SEQ ID NO: 3160566 - protein, 22 aa, Giardia lamblia
KTGKVKTVLVLKEKCSQLESQV

SEQ ID NO: 3160567 - protein, 17 aa, Giardia lamblia
KTGLCLIIDECESMDAG

SEQ ID NO: 3160568 - protein, 19 aa, Giardia lamblia
KTHLPEVQVRYAVKCNMHP

SEQ ID NO: 3160569 - protein, 19 aa, Giardia lamblia
KTIEDCIRSLSSISLINCK

SEQ ID NO: 3160570 - protein, 17 aa, Giardia lamblia
KTIFARTNLLTDANRSL

SEQ ID NO: 3160571 - protein, 23 aa, Giardia lamblia
KTILHRIYANFMMMRSYIRSIIK

SEQ ID NO: 3160572 - protein, 22 aa, Giardia lamblia
KTIRHSPDFGMSQLRKEDAAHD

SEQ ID NO: 3160573 - protein, 21 aa, Giardia lamblia
KTIRYGKYVIIYSLDGKFIGR

SEQ ID NO: 3160574 - protein, 24 aa, Giardia lamblia
KTKDGRTALMLAVEKNSMEAANVI

SEQ ID NO: 3160575 - protein, 18 aa, Giardia lamblia
KTKEGITALMYASYLNHA

SEQ ID NO: 3160576 - protein, 21 aa, Giardia lamblia
KTKGKIIIKGCNVANRSATVI

SEQ ID NO: 3160577 - protein, 26 aa, Giardia lamblia
KTKNPVFVSCGWKRYQTIPYYSMEQQ

SEQ ID NO: 3160578 - protein, 23 aa, Giardia lamblia
KTKSGYVKLIIDLEGAAVGDFQG

SEQ ID NO: 3160579 - protein, 25 aa, Giardia lamblia
KTKVMKYKLLVDSIQVEIKQFCGST

SEQ ID NO: 3160580 - protein, 26 aa, Giardia lamblia
KTKYNILPDICWCICNLTRHIRDKDF

SEQ ID NO: 3160581 - protein, 17 aa, Giardia lamblia
KTLAGTLAYLAPDVCSN

SEQ ID NO: 3160582 - protein, 23 aa, Giardia lamblia
KTLASLCKEFVMLPSTSGPMGPV

SEQ ID NO: 3160583 - protein, 28 aa, Giardia lamblia
KTLCFGLRLAELLDWPHIFASSRTGAFI

SEQ ID NO: 3160584 - protein, 19 aa, Giardia lamblia
KTLIPDRRSAELLEVYKVG

SEQ ID NO: 3160585 - protein, 18 aa, Giardia lamblia
KTLIPVKNQMSFLEIIVR

SEQ ID NO: 3160586 - protein, 24 aa, Giardia lamblia
KTLMKIFSVCIAKQMLAPFLLALP

SEQ ID NO: 3160587 - protein, 26 aa, Giardia lamblia
KTLMPKATAISLFTLFGHEQGVNSVC

SEQ ID NO: 3160588 - protein, 17 aa, Giardia lamblia
KTLNLLITAGRKNKTAI

SEQ ID NO: 3160589 - protein, 17 aa, Giardia lamblia
KTLPFSENFIADSCSSV

SEQ ID NO: 3160590 - protein, 17 aa, Giardia lamblia
KTLPLADGAVFGRNSVI

SEQ ID NO: 3160591 - protein, 19 aa, Giardia lamblia
KTLRLNGVYQCSVQKANRM

SEQ ID NO: 3160592 - protein, 19 aa, Giardia lamblia
KTLSIICASLTTGHDAVAK

SEQ ID NO: 3160593 - protein, 17 aa, Giardia lamblia
KTLSMWLLNENIYDQMS

SEQ ID NO: 3160594 - protein, 17 aa, Giardia lamblia
KTMEIESLLAMSTSKAN

SEQ ID NO: 3160595 - protein, 17 aa, Giardia lamblia
KTMPIVLISGGIGQTPL

SEQ ID NO: 3160596 - protein, 25 aa, Giardia lamblia
KTMRLLMDALHEFCTSIIPSKVLAV

SEQ ID NO: 3160597 - protein, 18 aa, Giardia lamblia
KTMYCFDNEAIRFLAARA

SEQ ID NO: 3160598 - protein, 21 aa, Giardia lamblia
KTNEIFACKEIDYGCLSDKYK

SEQ ID NO: 3160599 - protein, 31 aa, Giardia lamblia
KTPTVIRKTMKICRIRAFYMLKVKFTQNTIG

SEQ ID NO: 3160600 - protein, 20 aa, Giardia lamblia
KTPVPITMILSVMKQVAAAL

SEQ ID NO: 3160601 - protein, 17 aa, Giardia lamblia
KTPYLSEWVRGSKLAPK

SEQ ID NO: 3160602 - protein, 22 aa, Giardia lamblia
KTQMFIRDGFLPDEFNEKFQST

SEQ ID NO: 3160603 - protein, 17 aa, Giardia lamblia
KTQVAAIKPILCDRKRS

SEQ ID NO: 3160604 - protein, 25 aa, Giardia lamblia
KTQYKELARTLWLQSKPEMVEQVRT

SEQ ID NO: 3160605 - protein, 21 aa, Giardia lamblia
KTRHRLGIGATPMSIPSSISL

SEQ ID NO: 3160606 - protein, 21 aa, Giardia lamblia
KTRIVSVDVPSGWSVDAQEWG

SEQ ID NO: 3160607 - protein, 24 aa, Giardia lamblia
KTRNEANIAYKARVDAEERLRKNE

SEQ ID NO: 3160608 - protein, 26 aa, Giardia lamblia
KTRRGNRKVACIGAWHPANVQYTVAR

SEQ ID NO: 3160609 - protein, 20 aa, Giardia lamblia
KTSALSRMIKILAVKERTIN

SEQ ID NO: 3160610 - protein, 26 aa, Giardia lamblia
KTSCDWRTVEIINRISSQSPDIYQAV

SEQ ID NO: 3160611 - protein, 19 aa, Giardia lamblia
KTSDLLLDIVFKPFDYFPD

SEQ ID NO: 3160612 - protein, 18 aa, Giardia lamblia
KTSFGGGHTVGFCNAYQN

SEQ ID NO: 3160613 - protein, 21 aa, Giardia lamblia
KTSLYDWKDSYSIIDSATMNK

SEQ ID NO: 3160614 - protein, 18 aa, Giardia lamblia
KTSNIFLMEDFDVKVGDF

SEQ ID NO: 3160615 - protein, 26 aa, Giardia lamblia
KTTFHPSPVWSRERPAPLTSYDENEI

SEQ ID NO: 3160616 - protein, 25 aa, Giardia lamblia
KTTRECLKMVLSKLGNHDGLMTTGG

SEQ ID NO: 3160617 - protein, 23 aa, Giardia lamblia
KTTRLKPSMIKKNTCNVSNAQRR

SEQ ID NO: 3160618 - protein, 22 aa, Giardia lamblia
KTVEFQDIFIPTADTVRSSYLV

SEQ ID NO: 3160619 - protein, 17 aa, Giardia lamblia
KTVPGPFALSVFIQPNI

SEQ ID NO: 3160620 - protein, 20 aa, Giardia lamblia
KTVREILSIFTANQVRMLFC

SEQ ID NO: 3160621 - protein, 23 aa, Giardia lamblia
KTVRGRFLFSSSISNKSSSTPMR

SEQ ID NO: 3160622 - protein, 26 aa, Giardia lamblia
KTYCSRFLHKQGIVLPILRAGFVQPE

SEQ ID NO: 3160623 - protein, 19 aa, Giardia lamblia
KTYPAMISSAASLGGSATG

SEQ ID NO: 3160624 - protein, 33 aa, Giardia lamblia
KTYTPPFMAARAEFLSVRRRYLAASKSPLTVYD

SEQ ID NO: 3160625 - protein, 24 aa, Giardia lamblia
KVACVEALLDREARMQTNERFAAG

SEQ ID NO: 3160626 - protein, 26 aa, Giardia lamblia
KVAFQLPKLLGIEAYLKRNTRSGHMS

SEQ ID NO: 3160627 - protein, 19 aa, Giardia lamblia
KVAGNQGSRQWYADNVMFP

SEQ ID NO: 3160628 - protein, 19 aa, Giardia lamblia
KVALAECIVTAAAKSKDAY

SEQ ID NO: 3160629 - protein, 19 aa, Giardia lamblia
KVAVEVAANTMDFWCQVNY

SEQ ID NO: 3160630 - protein, 24 aa, Giardia lamblia
KVAYIFRLGQLWTDKKSIVARIPM

SEQ ID NO: 3160631 - protein, 18 aa, Giardia lamblia
KVDARGKTACKIASDYSY

SEQ ID NO: 3160632 - protein, 24 aa, Giardia lamblia
KVDELRTSFQQHWDKLENGTPANR

SEQ ID NO: 3160633 - protein, 20 aa, Giardia lamblia
KVDGIDRFPVTLAEVEAFLL

SEQ ID NO: 3160634 - protein, 18 aa, Giardia lamblia
KVDHLDFQAMQRRTQAQL

SEQ ID NO: 3160635 - protein, 23 aa, Giardia lamblia
KVDKCNMLERLLRDENAKVQGFM

SEQ ID NO: 3160636 - protein, 22 aa, Giardia lamblia
KVEHIRRYLAVDVFVDTLKCNG

SEQ ID NO: 3160637 - protein, 20 aa, Giardia lamblia
KVEPLRLEAMYTKAHAAIRA

SEQ ID NO: 3160638 - protein, 18 aa, Giardia lamblia
KVERAQCEKGVMKGPGSA

SEQ ID NO: 3160639 - protein, 17 aa, Giardia lamblia
KVFCRFRPFNEKFEPIS

SEQ ID NO: 3160640 - protein, 17 aa, Giardia lamblia
KVFDRFTHTQVLMFIFA

SEQ ID NO: 3160641 - protein, 26 aa, Giardia lamblia
KVGEPCSISIYVHRLYGIKPLYNANV

SEQ ID NO: 3160642 - protein, 17 aa, Giardia lamblia
KVGGWAALVFAARCDRS

SEQ ID NO: 3160643 - protein, 26 aa, Giardia lamblia
KVGLHRVCPDRCFLWQVSSTRKSSGW

SEQ ID NO: 3160644 - protein, 19 aa, Giardia lamblia
KVGVSRALLGRTLSGSGEI

SEQ ID NO: 3160645 - protein, 26 aa, Giardia lamblia
KVGVVCVHLFRPFCGDKLLEAIPTSC

SEQ ID NO: 3160646 - protein, 19 aa, Giardia lamblia
KVHEVFSLIRARLSNPRSL

SEQ ID NO: 3160647 - protein, 20 aa, Giardia lamblia
KVIELDKAWVSKDYEASQLS

SEQ ID NO: 3160648 - protein, 22 aa, Giardia lamblia
KVIPADEIFSLLNHARPVYPVA

SEQ ID NO: 3160649 - protein, 23 aa, Giardia lamblia
KVIPVVNAEGSFGGFLSLTDIFS

SEQ ID NO: 3160650 - protein, 18 aa, Giardia lamblia
KVIREVRDKLKVFAAQNR

SEQ ID NO: 3160651 - protein, 20 aa, Giardia lamblia
KVKGQFEYGRIVFGEMILRD

SEQ ID NO: 3160652 - protein, 21 aa, Giardia lamblia
KVKKLTSLFVRNLDSKVTEDL

SEQ ID NO: 3160653 - protein, 17 aa, Giardia lamblia
KVKLLIQALDKVAFRRL

SEQ ID NO: 3160654 - protein, 18 aa, Giardia lamblia
KVKSLVVITAGFKEIGGE

SEQ ID NO: 3160655 - protein, 20 aa, Giardia lamblia
KVLCEWEKDKGRKGPALFSF

SEQ ID NO: 3160656 - protein, 27 aa, Giardia lamblia
KVLEPEPQVLHLLKFTYTPSGFMASGA

SEQ ID NO: 3160657 - protein, 23 aa, Giardia lamblia
KVLIKYRHDLLMFLYIGQQRLKL

SEQ ID NO: 3160658 - protein, 27 aa, Giardia lamblia
KVLITLRVAFFHGMCNQILNSANSLTE

SEQ ID NO: 3160659 - protein, 25 aa, Giardia lamblia
KVLLDLRPSCIYISEMGFVLVDTVR

SEQ ID NO: 3160660 - protein, 17 aa, Giardia lamblia
KVLRLKTIETMDAAMLE

SEQ ID NO: 3160661 - protein, 18 aa, Giardia lamblia
KVLTWSVGMLVSDLYSLV

SEQ ID NO: 3160662 - protein, 20 aa, Giardia lamblia
KVMIKRYEKEILRLRQELKM

SEQ ID NO: 3160663 - protein, 25 aa, Giardia lamblia
KVMLECLYDAAVFQYEHEQTFKRIA

SEQ ID NO: 3160664 - protein, 23 aa, Giardia lamblia
KVMSQSLFLFEWSNPDERPVVSV

SEQ ID NO: 3160665 - protein, 23 aa, Giardia lamblia
KVNNIWPLLLKHIGGDRELGLEL

SEQ ID NO: 3160666 - protein, 24 aa, Giardia lamblia
KVPECDYPYLGIPWQSRNVYASQQ

SEQ ID NO: 3160667 - protein, 24 aa, Giardia lamblia
KVPHVPCSIDLPVEDCIVFVDPLD

SEQ ID NO: 3160668 - protein, 22 aa, Giardia lamblia
KVPLAGCAIGPISKNTIQEAAL

SEQ ID NO: 3160669 - protein, 17 aa, Giardia lamblia
KVPRKAFAFSSRKYIKK

SEQ ID NO: 3160670 - protein, 22 aa, Giardia lamblia
KVQADVLRRLKKKNADIRKNTN

SEQ ID NO: 3160671 - protein, 19 aa, Giardia lamblia
KVQDLRLELLIQKLMEREE

SEQ ID NO: 3160672 - protein, 19 aa, Giardia lamblia
KVQEYRPGMSYMVEAFATW

SEQ ID NO: 3160673 - protein, 26 aa, Giardia lamblia
KVREALARKRMRAYSRLKQLTTKADT

SEQ ID NO: 3160674 - protein, 26 aa, Giardia lamblia
KVRHKVVFTCLSYYLLKRHVIEDSTQ

SEQ ID NO: 3160675 - protein, 23 aa, Giardia lamblia
KVRQAREMGLCPIREDIYSQCFD

SEQ ID NO: 3160676 - protein, 25 aa, Giardia lamblia
KVRRAEHSYEFDRVYSMDATQQDIW

SEQ ID NO: 3160677 - protein, 24 aa, Giardia lamblia
KVSAFKLNSFYSEVIGKITTDMNN

SEQ ID NO: 3160678 - protein, 25 aa, Giardia lamblia
KVSCEAEGLIGLILDSSSKITMCPA

SEQ ID NO: 3160679 - protein, 24 aa, Giardia lamblia
KVSDKLRAVKVFSLAKLDEDQRER

SEQ ID NO: 3160680 - protein, 27 aa, Giardia lamblia
KVSEIERLIDLVRRFGISFDPIAIHFP

SEQ ID NO: 3160681 - protein, 19 aa, Giardia lamblia
KVSELEEANRILISENENL

SEQ ID NO: 3160682 - protein, 34 aa, Giardia lamblia
KVSHCAAPSASLSRLPWKPGTTVQIDNLPLPTVE

SEQ ID NO: 3160683 - protein, 18 aa, Giardia lamblia
KVSHPHWPIPPEYEERYF

SEQ ID NO: 3160684 - protein, 25 aa, Giardia lamblia
KVSILNCYEDMQLIDMFLLKLPPDL

SEQ ID NO: 3160685 - protein, 27 aa, Giardia lamblia
KVSRLIRESAWRCYLKPFEAIEKVNKL

SEQ ID NO: 3160686 - protein, 17 aa, Giardia lamblia
KVSRVSCTIANKSTEIE

SEQ ID NO: 3160687 - protein, 19 aa, Giardia lamblia
KVSSSLRKSLLTSSVNCET

SEQ ID NO: 3160688 - protein, 26 aa, Giardia lamblia
KVSTPRGSHHFRIPGAPVTPEVDGSK

SEQ ID NO: 3160689 - protein, 24 aa, Giardia lamblia
KVSYFRLNKITGMYEVSASDMPGA

SEQ ID NO: 3160690 - protein, 22 aa, Giardia lamblia
KVTFRIGYSAMWGVGYDPLINT

SEQ ID NO: 3160691 - protein, 35 aa, Giardia lamblia
KVTKQLLQHFGIVVNRLVDLSDLLASVAKCESSFM

SEQ ID NO: 3160692 - protein, 17 aa, Giardia lamblia
KVTVHFVGLGTHPAVRL

SEQ ID NO: 3160693 - protein, 17 aa, Giardia lamblia
KVVDLLLSREVGIAENS

SEQ ID NO: 3160694 - protein, 18 aa, Giardia lamblia
KVWSELFPQDSLQISHSQ

SEQ ID NO: 3160695 - protein, 20 aa, Giardia lamblia
KVYKPFREWCEEIDENLDVR

SEQ ID NO: 3160696 - protein, 21 aa, Giardia lamblia
KWEDFPSLVWSDYSQEYVQAF

SEQ ID NO: 3160697 - protein, 27 aa, Giardia lamblia
KWEHIPKSLCWYGNVVPRHKLKTQSRV

SEQ ID NO: 3160698 - protein, 18 aa, Giardia lamblia
KWEPYFFEHYDPKEYSLW

SEQ ID NO: 3160699 - protein, 25 aa, Giardia lamblia
KWFANRPSQALIWLVTNIDNNRIRQ

SEQ ID NO: 3160700 - protein, 19 aa, Giardia lamblia
KWMAQIHQMERDYGDQIAY

SEQ ID NO: 3160701 - protein, 21 aa, Giardia lamblia
KWNCPICAETIGLSTMYIDAY

SEQ ID NO: 3160702 - protein, 20 aa, Giardia lamblia
KWNDEVKKLSAYDSKQEDFS

SEQ ID NO: 3160703 - protein, 20 aa, Giardia lamblia
KWPDNDLPEIYGLDSNATIF

SEQ ID NO: 3160704 - protein, 20 aa, Giardia lamblia
KWQHKDFLKNLGVSVLTRFP

SEQ ID NO: 3160705 - protein, 27 aa, Giardia lamblia
KWRLRRRSRPYPAGRRGHIMVGLDECQ

SEQ ID NO: 3160706 - protein, 23 aa, Giardia lamblia
KWSRARFRVLGVFQGRYALCREG

SEQ ID NO: 3160707 - protein, 25 aa, Giardia lamblia
KYAATRLFPDFSVALEYKGLDLVRR

SEQ ID NO: 3160708 - protein, 20 aa, Giardia lamblia
KYAKIAISFDPSGYAVGGDK

SEQ ID NO: 3160709 - protein, 20 aa, Giardia lamblia
KYANRCVIHPAAMVLFSRGL

SEQ ID NO: 3160710 - protein, 17 aa, Giardia lamblia
KYARSPAFATLKHVTGA

SEQ ID NO: 3160711 - protein, 31 aa, Giardia lamblia
KYAYKLYGDMGADLSRCFDERMAPILRTLWR

SEQ ID NO: 3160712 - protein, 19 aa, Giardia lamblia
KYDIARLLVPYASRCQTTD

SEQ ID NO: 3160713 - protein, 20 aa, Giardia lamblia
KYDSMKLFLETEARSLRDEM

SEQ ID NO: 3160714 - protein, 21 aa, Giardia lamblia
KYDVPEIISILVNKEGGEQTD

SEQ ID NO: 3160715 - protein, 20 aa, Giardia lamblia
KYECGSLKAALNSANARIAT

SEQ ID NO: 3160716 - protein, 23 aa, Giardia lamblia
KYERRLQDAISIERRELLEKGHI

SEQ ID NO: 3160717 - protein, 18 aa, Giardia lamblia
KYGDLRTQLDTAIMDDFF

SEQ ID NO: 3160718 - protein, 18 aa, Giardia lamblia
KYGIFGMDVPPFVRLVAP

SEQ ID NO: 3160719 - protein, 27 aa, Giardia lamblia
KYGKALGEEECKLLLAMMNKAFQALPL

SEQ ID NO: 3160720 - protein, 18 aa, Giardia lamblia
KYGQTVLFGTPLICRYYP

SEQ ID NO: 3160721 - protein, 31 aa, Giardia lamblia
KYGSGFTALMCAARLGFVQAVELLVKKEANM

SEQ ID NO: 3160722 - protein, 18 aa, Giardia lamblia
KYGSYVIEKAILKVVQIH

SEQ ID NO: 3160723 - protein, 21 aa, Giardia lamblia
KYICEPCGKLFSSQNAYKQHE

SEQ ID NO: 3160724 - protein, 25 aa, Giardia lamblia
KYIDIANRISKFCGFTVQDTISSVT

SEQ ID NO: 3160725 - protein, 17 aa, Giardia lamblia
KYIDMGLDIAKAAGQND

SEQ ID NO: 3160726 - protein, 17 aa, Giardia lamblia
KYIIAALLLEGFNVKYL

SEQ ID NO: 3160727 - protein, 22 aa, Giardia lamblia
KYIPESVVWRVLAHMMAALCYY

SEQ ID NO: 3160728 - protein, 18 aa, Giardia lamblia
KYIQTILEQVMRRFVAMP

SEQ ID NO: 3160729 - protein, 17 aa, Giardia lamblia
KYKCGSLEAALNGANAR

SEQ ID NO: 3160730 - protein, 18 aa, Giardia lamblia
KYKCGSLEAALNGANARI

SEQ ID NO: 3160731 - protein, 23 aa, Giardia lamblia
KYKDLVVFRHIVLPEARRTRTEL

SEQ ID NO: 3160732 - protein, 20 aa, Giardia lamblia
KYKEFSEAVAQTGKFPLAYQ

SEQ ID NO: 3160733 - protein, 19 aa, Giardia lamblia
KYKEKEMTCEELSSQYSSM

SEQ ID NO: 3160734 - protein, 28 aa, Giardia lamblia
KYKFLQNLRCLVSFDMSTLLTISIITVI

SEQ ID NO: 3160735 - protein, 21 aa, Giardia lamblia
KYKLEEGYHAFCGLIEGLLVA

SEQ ID NO: 3160736 - protein, 17 aa, Giardia lamblia
KYKSWSECVTLKEVKSL

SEQ ID NO: 3160737 - protein, 19 aa, Giardia lamblia
KYLDWDLLSKIYFLDSRVK

SEQ ID NO: 3160738 - protein, 25 aa, Giardia lamblia
KYLGRRSFAIFMLRRLQNCIMLQKA

SEQ ID NO: 3160739 - protein, 25 aa, Giardia lamblia
KYLKFLEVFEEQFLKQDFNTRRSIY

SEQ ID NO: 3160740 - protein, 24 aa, Giardia lamblia
KYLKRWDSVEPIEILLSSLPAPWS

SEQ ID NO: 3160741 - protein, 20 aa, Giardia lamblia
KYLPDDGSGRIHALEKDKEA

SEQ ID NO: 3160742 - protein, 18 aa, Giardia lamblia
KYLPFKQLAVSVAFFPSG

SEQ ID NO: 3160743 - protein, 19 aa, Giardia lamblia
KYLPQFSTALEEFVTVHNE

SEQ ID NO: 3160744 - protein, 26 aa, Giardia lamblia
KYLTLECKGWLTGIVAELCRDEENAK

SEQ ID NO: 3160745 - protein, 19 aa, Giardia lamblia
KYMLIYALVKLQILRGYIV

SEQ ID NO: 3160746 - protein, 17 aa, Giardia lamblia
KYNVALMRLQAPSVTLG

SEQ ID NO: 3160747 - protein, 29 aa, Giardia lamblia
KYPPQARTVIFAFLALRMIVETLRCTTMV

SEQ ID NO: 3160748 - protein, 17 aa, Giardia lamblia
KYQLHYRIGRGAFGELY

SEQ ID NO: 3160749 - protein, 18 aa, Giardia lamblia
KYRFGECISNGFNGKVHK

SEQ ID NO: 3160750 - protein, 19 aa, Giardia lamblia
KYRKSVIFYHELSKEKKDS

SEQ ID NO: 3160751 - protein, 25 aa, Giardia lamblia
KYRTHPVHGRYMINLQSLFNISQSS

SEQ ID NO: 3160752 - protein, 19 aa, Giardia lamblia
KYSDALKNIISLCLVQRPK

SEQ ID NO: 3160753 - protein, 23 aa, Giardia lamblia
KYSLRKCSYIVLDELDELLDAGF

SEQ ID NO: 3160754 - protein, 27 aa, Giardia lamblia
KYSSEISLRLARGISLEKPVLLPVSLV

SEQ ID NO: 3160755 - protein, 26 aa, Giardia lamblia
KYSVSEFLAGQALIYQWSLLGLPKDN

SEQ ID NO: 3160756 - protein, 18 aa, Giardia lamblia
KYTALALAMQEGHVEVAK

SEQ ID NO: 3160757 - protein, 17 aa, Giardia lamblia
KYTPLYCNAFYNSSDVY

SEQ ID NO: 3160758 - protein, 34 aa, Giardia lamblia
KYVAICKHLDFLIANCLYKDINIIDTRPSEPHIN

SEQ ID NO: 3160759 - protein, 19 aa, Giardia lamblia
KYVELDNMRGLIKKKNEQL

SEQ ID NO: 3160760 - protein, 19 aa, Giardia lamblia
KYVSTVMQAFRGCLRPTTF

SEQ ID NO: 3160761 - protein, 27 aa, Giardia lamblia
KYWTGLHSFLYWKSRVYGWFYSPPLGA

SEQ ID NO: 3160762 - protein, 20 aa, Giardia lamblia
KYYAQNCSPRVPPQVRASLI

SEQ ID NO: 3160763 - protein, 24 aa, Giardia lamblia
KYYDPGSILIFLSGKREIERCIDG

SEQ ID NO: 3160764 - protein, 18 aa, Giardia lamblia
KYYEIIKAARPVDSLAQY

SEQ ID NO: 3160765 - protein, 19 aa, Giardia lamblia
KYYKCACGVMVTASHNPSK

SEQ ID NO: 3160766 - protein, 24 aa, Giardia lamblia
LAADGLRGSATWAPSEAQPALGPF

SEQ ID NO: 3160767 - protein, 25 aa, Giardia lamblia
LAADGLRGSATWAPSEAQPALGPFP

SEQ ID NO: 3160768 - protein, 30 aa, Giardia lamblia
LAAEAGWVDGCREFIYQAGRHVRHTGRGYL

SEQ ID NO: 3160769 - protein, 18 aa, Giardia lamblia
LAAEGFLKAAMFYEDKVW

SEQ ID NO: 3160770 - protein, 19 aa, Giardia lamblia
LAAENEWLEQEIAQMERKI

SEQ ID NO: 3160771 - protein, 18 aa, Giardia lamblia
LAAFAAGAKVVYPAASKL

SEQ ID NO: 3160772 - protein, 18 aa, Giardia lamblia
LAAFPVVVPPRYLAESLS

SEQ ID NO: 3160773 - protein, 22 aa, Giardia lamblia
LAAGNLRLAKMITEAYSGDSGS

SEQ ID NO: 3160774 - protein, 19 aa, Giardia lamblia
LAAINGKRLYKEQIGLDSS

SEQ ID NO: 3160775 - protein, 26 aa, Giardia lamblia
LAAIRMLREAFLILVEHDSRYSAESV

SEQ ID NO: 3160776 - protein, 23 aa, Giardia lamblia
LAAKPRSSLNIPADFEDLPPQTF

SEQ ID NO: 3160777 - protein, 18 aa, Giardia lamblia
LAAKSPMRSVVGPMSPPM

SEQ ID NO: 3160778 - protein, 25 aa, Giardia lamblia
LAAKTGDISSVFNFRNQYIKMVDAR

SEQ ID NO: 3160779 - protein, 26 aa, Giardia lamblia
LAALMNRSKLIPALMEKEAMIKRHDG

SEQ ID NO: 3160780 - protein, 28 aa, Giardia lamblia
LAAMIKLGMPVPLGFTITCQTCVEYQKT

SEQ ID NO: 3160781 - protein, 17 aa, Giardia lamblia
LAAQPVLRVRRVIIESM

SEQ ID NO: 3160782 - protein, 18 aa, Giardia lamblia
LAAQRPGLFSNMQRLNVT

SEQ ID NO: 3160783 - protein, 19 aa, Giardia lamblia
LAASFRASQGIIPGSVGDL

SEQ ID NO: 3160784 - protein, 25 aa, Giardia lamblia
LAASLGHRSICDFLARFEGRQTTPK

SEQ ID NO: 3160785 - protein, 17 aa, Giardia lamblia
LAASVSVVMGRMETLSQ

SEQ ID NO: 3160786 - protein, 44 aa, Giardia lamblia
LAAVCNEGEACKRLVPYEMNLVLPDGRTPLMLAAAAGAVDSTIN

SEQ ID NO: 3160787 - protein, 24 aa, Giardia lamblia
LACGRSCLPEVVLQAIRDGSVAAC

SEQ ID NO: 3160788 - protein, 17 aa, Giardia lamblia
LACHPFSPLLLIGEYTG

SEQ ID NO: 3160789 - protein, 25 aa, Giardia lamblia
LACMSYEEFCQWASSTGTCMVNSAE

SEQ ID NO: 3160790 - protein, 18 aa, Giardia lamblia
LADAALFIQNLIRGAAAQ

SEQ ID NO: 3160791 - protein, 24 aa, Giardia lamblia
LADFDYRSPLPLTKDGFPTTKSTD

SEQ ID NO: 3160792 - protein, 19 aa, Giardia lamblia
LADHERLLGDLGYYKGLVT

SEQ ID NO: 3160793 - protein, 24 aa, Giardia lamblia
LADLWKFAIASLICNDLLKYIIDD

SEQ ID NO: 3160794 - protein, 20 aa, Giardia lamblia
LADNEARPSDDLSRIGNNSL

SEQ ID NO: 3160795 - protein, 18 aa, Giardia lamblia
LADPRAAYPGRFLQSPQC

SEQ ID NO: 3160796 - protein, 23 aa, Giardia lamblia
LADQPFIIRLIEILFDRTTGRLA

SEQ ID NO: 3160797 - protein, 25 aa, Giardia lamblia
LADSFGWTALMFAARAGHYDICELL

SEQ ID NO: 3160798 - protein, 24 aa, Giardia lamblia
LADVCRLAALGQNFLIKSDLSLSV

SEQ ID NO: 3160799 - protein, 19 aa, Giardia lamblia
LADVRKEINFCKQIKVDVK

SEQ ID NO: 3160800 - protein, 21 aa, Giardia lamblia
LADYKSAFFNFALPSLQLSEP

SEQ ID NO: 3160801 - protein, 18 aa, Giardia lamblia
LAEAGRARMVVAQTKGGN

SEQ ID NO: 3160802 - protein, 26 aa, Giardia lamblia
LAEAKRLVSLLSRRLGALSGCTGRSA

SEQ ID NO: 3160803 - protein, 24 aa, Giardia lamblia
LAEAYRLVTHGQIFNVKRAPNASI

SEQ ID NO: 3160804 - protein, 18 aa, Giardia lamblia
LAECNLNVSQACKEFILA

SEQ ID NO: 3160805 - protein, 18 aa, Giardia lamblia
LAEDFLKRGLKTAVIGVP

SEQ ID NO: 3160806 - protein, 20 aa, Giardia lamblia
LAEGAAWLAILTLDKFPRKV

SEQ ID NO: 3160807 - protein, 29 aa, Giardia lamblia
LAEHSSIIWDCCWHCTGTSVVTCSQDTTI

SEQ ID NO: 3160808 - protein, 23 aa, Giardia lamblia
LAEKILAVPYGWDSATKSPFTKK

SEQ ID NO: 3160809 - protein, 21 aa, Giardia lamblia
LAEKMPVDWICYSHINTESDI

SEQ ID NO: 3160810 - protein, 29 aa, Giardia lamblia
LAEKSLLRPGARVGPPLPMNFGKLTCMDA

SEQ ID NO: 3160811 - protein, 18 aa, Giardia lamblia
LAELEWRSKDSESIHGDP

SEQ ID NO: 3160812 - protein, 17 aa, Giardia lamblia
LAELKRLRDAHEEEIRQ

SEQ ID NO: 3160813 - protein, 22 aa, Giardia lamblia
LAELLLNYRIISFKTSIDKQWL

SEQ ID NO: 3160814 - protein, 18 aa, Giardia lamblia
LAENRLFKWSPRGLPCYI

SEQ ID NO: 3160815 - protein, 18 aa, Giardia lamblia
LAERAAQGIQVFVITFRT

SEQ ID NO: 3160816 - protein, 17 aa, Giardia lamblia
LAERDHQIELLKQKLQS

SEQ ID NO: 3160817 - protein, 17 aa, Giardia lamblia
LAEREGIAVGQLTRDFH

SEQ ID NO: 3160818 - protein, 19 aa, Giardia lamblia
LAERLLLHKCSELWQLALV

SEQ ID NO: 3160819 - protein, 28 aa, Giardia lamblia
LAESIAFPRLANLLPRSRTKDPRVCNAL

SEQ ID NO: 3160820 - protein, 24 aa, Giardia lamblia
LAESLRFQGAFPVARERPLQPGVG

SEQ ID NO: 3160821 - protein, 24 aa, Giardia lamblia
LAESTRAPLTLGMANELLNTALKL

SEQ ID NO: 3160822 - protein, 27 aa, Giardia lamblia
LAETVSQLKALRFEYLTKEQLRKLLVV

SEQ ID NO: 3160823 - protein, 18 aa, Giardia lamblia
LAEYDCFFISTLSIFGDM

SEQ ID NO: 3160824 - protein, 18 aa, Giardia lamblia
LAFDDVLAALLGLQEGGE

SEQ ID NO: 3160825 - protein, 24 aa, Giardia lamblia
LAFKECPREYTLTIEGCEIRGETD

SEQ ID NO: 3160826 - protein, 22 aa, Giardia lamblia
LAFSVTRRLLAFVVNTDNMPKI

SEQ ID NO: 3160827 - protein, 18 aa, Giardia lamblia
LAFTPTLGQWHGSERELS

SEQ ID NO: 3160828 - protein, 25 aa, Giardia lamblia
LAGAARPSSLLSFDIVQIHEAQIGG

SEQ ID NO: 3160829 - protein, 23 aa, Giardia lamblia
LAGELKPGLSKTIEVLFRPESCA

SEQ ID NO: 3160830 - protein, 21 aa, Giardia lamblia
LAGGSPTFVAYVLLYEYTAIG

SEQ ID NO: 3160831 - protein, 19 aa, Giardia lamblia
LAGLVRSATSFAMERAIEK

SEQ ID NO: 3160832 - protein, 31 aa, Giardia lamblia
LAGMAKGSGCDFIRSVLAPSFQQYFEGLTGS

SEQ ID NO: 3160833 - protein, 19 aa, Giardia lamblia
LAGNSRKIFLGSVDIPLAE

SEQ ID NO: 3160834 - protein, 20 aa, Giardia lamblia
LAGNYKLAKILIGYEKDLLK

SEQ ID NO: 3160835 - protein, 24 aa, Giardia lamblia
LAGRCLTIDMELCEGGTLATLLHD

SEQ ID NO: 3160836 - protein, 32 aa, Giardia lamblia
LAGRGFCSEIDFWLRHEADIIQLFCKLADDAL

SEQ ID NO: 3160837 - protein, 21 aa, Giardia lamblia
LAGSARPGLWRVKELGATEAA

SEQ ID NO: 3160838 - protein, 21 aa, Giardia lamblia
LAGSARPGLWRVKELGATGAA

SEQ ID NO: 3160839 - protein, 24 aa, Giardia lamblia
LAGYRGHLAIIRMADKHLLSEVHL

SEQ ID NO: 3160840 - protein, 24 aa, Giardia lamblia
LAHEARALLYLNHDHVVKTYNTII

SEQ ID NO: 3160841 - protein, 17 aa, Giardia lamblia
LAHKASISFLRQFILDR

SEQ ID NO: 3160842 - protein, 18 aa, Giardia lamblia
LAHLVFKRCTTSTIRNDL

SEQ ID NO: 3160843 - protein, 17 aa, Giardia lamblia
LAHMCPKLFELGNRSVV

SEQ ID NO: 3160844 - protein, 19 aa, Giardia lamblia
LAHPHLLVYHEAYVIPGER

SEQ ID NO: 3160845 - protein, 25 aa, Giardia lamblia
LAHPWVAMVNLTFGIHPLVPDKPAV

SEQ ID NO: 3160846 - protein, 20 aa, Giardia lamblia
LAHRCWRDIFFCGTELDHYE

SEQ ID NO: 3160847 - protein, 28 aa, Giardia lamblia
LAHVAEWQCYLAWAVLRASIHTADAEAF

SEQ ID NO: 3160848 - protein, 19 aa, Giardia lamblia
LAIANGRAMTNPDLASSLP

SEQ ID NO: 3160849 - protein, 19 aa, Giardia lamblia
LAIDSWAAGLVLLICIIGD

SEQ ID NO: 3160850 - protein, 25 aa, Giardia lamblia
LAIFYCKLGRALLRISQNPIPGSDS

SEQ ID NO: 3160851 - protein, 17 aa, Giardia lamblia
LAIKARNTAAIKLLAPL

SEQ ID NO: 3160852 - protein, 20 aa, Giardia lamblia
LAIMRKYRGAPNGGELVGTV

SEQ ID NO: 3160853 - protein, 24 aa, Giardia lamblia
LAIRTLKMSYIWQKASTEAVDFKN

SEQ ID NO: 3160854 - protein, 18 aa, Giardia lamblia
LAITGYRFVHSMDQEPMF

SEQ ID NO: 3160855 - protein, 19 aa, Giardia lamblia
LAIVANVRPEYMLVNLPFG

SEQ ID NO: 3160856 - protein, 23 aa, Giardia lamblia
LAIVRAGLLLGLRVGIAAHPPVK

SEQ ID NO: 3160857 - protein, 22 aa, Giardia lamblia
LAKAFKAKRLVEFPTTTQTETE

SEQ ID NO: 3160858 - protein, 18 aa, Giardia lamblia
LAKCISCRSDVFYSASIT

SEQ ID NO: 3160859 - protein, 24 aa, Giardia lamblia
LAKDALEFFNGFTVILRGQKITFS

SEQ ID NO: 3160860 - protein, 24 aa, Giardia lamblia
LAKGRTVLYIPSFEDLDPVEGSRN

SEQ ID NO: 3160861 - protein, 18 aa, Giardia lamblia
LAKIPEMANEDWSRFIPT

SEQ ID NO: 3160862 - protein, 17 aa, Giardia lamblia
LAKKYNVSWLNYVVEKT

SEQ ID NO: 3160863 - protein, 26 aa, Giardia lamblia
LAKPYRLSSILIDLTNTLLLAGPESI

SEQ ID NO: 3160864 - protein, 23 aa, Giardia lamblia
LAKQKRLLVLSATRALVPLLSSK

SEQ ID NO: 3160865 - protein, 22 aa, Giardia lamblia
LAKSFEVVGGIISKSAAIMASL

SEQ ID NO: 3160866 - protein, 17 aa, Giardia lamblia
LAKYKFTSRFIKALLLT

SEQ ID NO: 3160867 - protein, 17 aa, Giardia lamblia
LALADIWHHVRAEVRSL

SEQ ID NO: 3160868 - protein, 18 aa, Giardia lamblia
LALDYNNQELARFLAERE

SEQ ID NO: 3160869 - protein, 19 aa, Giardia lamblia
LALGCKMYGESMLHLGDAC

SEQ ID NO: 3160870 - protein, 20 aa, Giardia lamblia
LALHFCDKYNILAVKIGSKF

SEQ ID NO: 3160871 - protein, 23 aa, Giardia lamblia
LALKEYWRVGNVPGITYVDENGK

SEQ ID NO: 3160872 - protein, 24 aa, Giardia lamblia
LALLEKARHVIAIEIDPRMVSELK

SEQ ID NO: 3160873 - protein, 22 aa, Giardia lamblia
LALLEVLDGWCITEVEDAKAVI

SEQ ID NO: 3160874 - protein, 17 aa, Giardia lamblia
LALLTKVEDEWELIKKQ

SEQ ID NO: 3160875 - protein, 28 aa, Giardia lamblia
LALQRPRSSYYLLHRMRLSMCGISNSTD

SEQ ID NO: 3160876 - protein, 17 aa, Giardia lamblia
LALRALTSWKSRLQSLE

SEQ ID NO: 3160877 - protein, 31 aa, Giardia lamblia
LALRDRRIRVCMSDFRKARDKVLYKKIQEVG

SEQ ID NO: 3160878 - protein, 17 aa, Giardia lamblia
LALSLILFELYGDEPSA

SEQ ID NO: 3160879 - protein, 18 aa, Giardia lamblia
LALSQCLSNLIRAAMKEQ

SEQ ID NO: 3160880 - protein, 26 aa, Giardia lamblia
LALSSAEFLMGFLLSAPVPLQRTVLM

SEQ ID NO: 3160881 - protein, 18 aa, Giardia lamblia
LALTNVICAVTRNGMTGA

SEQ ID NO: 3160882 - protein, 17 aa, Giardia lamblia
LALVKVVLDTLNNKAQM

SEQ ID NO: 3160883 - protein, 23 aa, Giardia lamblia
LAMDSCGPTVVVIYLGPSQAYSC

SEQ ID NO: 3160884 - protein, 25 aa, Giardia lamblia
LAMGSLRSALYLRTRDTLAKATDGD

SEQ ID NO: 3160885 - protein, 17 aa, Giardia lamblia
LAMIKARDPRIFDKDVR

SEQ ID NO: 3160886 - protein, 17 aa, Giardia lamblia
LAMSKFIVQQHCRAHPY

SEQ ID NO: 3160887 - protein, 23 aa, Giardia lamblia
LANACRFLCDKPVCLPNIKISDK

SEQ ID NO: 3160888 - protein, 18 aa, Giardia lamblia
LANCGICLLIERITNLSE

SEQ ID NO: 3160889 - protein, 23 aa, Giardia lamblia
LANDGFFKLCDFNLAREINTVTG

SEQ ID NO: 3160890 - protein, 23 aa, Giardia lamblia
LANETRLPLAYRNKERLGAAMLR

SEQ ID NO: 3160891 - protein, 24 aa, Giardia lamblia
LANFELCMGMSSWATKTGDPAYMA

SEQ ID NO: 3160892 - protein, 25 aa, Giardia lamblia
LANFPNLRILYLQGNRIQDVRDLAP

SEQ ID NO: 3160893 - protein, 26 aa, Giardia lamblia
LANHEECCFLLAPYEALICTKDGVSP

SEQ ID NO: 3160894 - protein, 18 aa, Giardia lamblia
LANILIDFLLEYATTPVE

SEQ ID NO: 3160895 - protein, 25 aa, Giardia lamblia
LANLISRPRLRGFYRPLNSYYAVNC

SEQ ID NO: 3160896 - protein, 17 aa, Giardia lamblia
LANMAKWIEMFRDATMI

SEQ ID NO: 3160897 - protein, 27 aa, Giardia lamblia
LANPYGLCALDIAIIHGHYDIVLLLAP

SEQ ID NO: 3160898 - protein, 17 aa, Giardia lamblia
LANRAGYTALMFASQMG

SEQ ID NO: 3160899 - protein, 20 aa, Giardia lamblia
LANRIQEFDLLTAEILGLKS

SEQ ID NO: 3160900 - protein, 24 aa, Giardia lamblia
LANSLPPIREILTKKGVFTESCVE

SEQ ID NO: 3160901 - protein, 17 aa, Giardia lamblia
LANYPLYVTKYAPCGKC

SEQ ID NO: 3160902 - protein, 23 aa, Giardia lamblia
LAPAKTKFSWTEAFRKKADAAIY

SEQ ID NO: 3160903 - protein, 20 aa, Giardia lamblia
LAPEEHILLFRGYNKHAVLL

SEQ ID NO: 3160904 - protein, 19 aa, Giardia lamblia
LAPERDHRFFMAPIGSVVT

SEQ ID NO: 3160905 - protein, 18 aa, Giardia lamblia
LAPGESINALLYARKDRG

SEQ ID NO: 3160906 - protein, 24 aa, Giardia lamblia
LAPILKFLATTGFAAHADLADVFI

SEQ ID NO: 3160907 - protein, 30 aa, Giardia lamblia
LAPSDHKMLRWWSLREHPTINMWAAGHDGG

SEQ ID NO: 3160908 - protein, 26 aa, Giardia lamblia
LAQAKEVYKQYTLLNELVGLRINFEK

SEQ ID NO: 3160909 - protein, 28 aa, Giardia lamblia
LAQFWLPPHLNLSLGQMKHLEYILKLDE

SEQ ID NO: 3160910 - protein, 18 aa, Giardia lamblia
LAQIVACVMSRRSILSRE

SEQ ID NO: 3160911 - protein, 20 aa, Giardia lamblia
LAQPVITDFINGFNCTIFAY

SEQ ID NO: 3160912 - protein, 19 aa, Giardia lamblia
LAQQLPYQIPLVAPQSNLR

SEQ ID NO: 3160913 - protein, 27 aa, Giardia lamblia
LAQYESRLHSKMGYTALMLAAQNNHVE

SEQ ID NO: 3160914 - protein, 28 aa, Giardia lamblia
LARDKECWKAYLRRARICEELDDIARAV

SEQ ID NO: 3160915 - protein, 23 aa, Giardia lamblia
LARELGAKLIIVFSKSGNSTGRV

SEQ ID NO: 3160916 - protein, 22 aa, Giardia lamblia
LARGAQHICELLLLVKDDSTIE

SEQ ID NO: 3160917 - protein, 17 aa, Giardia lamblia
LARILIMVVKSFLKKRG

SEQ ID NO: 3160918 - protein, 27 aa, Giardia lamblia
LARKNIYKRRFLKIVSTLRSARDSLRL

SEQ ID NO: 3160919 - protein, 23 aa, Giardia lamblia
LARLMRRRRILKLGELAEFEEAY

SEQ ID NO: 3160920 - protein, 18 aa, Giardia lamblia
LARNCGKMLVFDRKTTIQ

SEQ ID NO: 3160921 - protein, 19 aa, Giardia lamblia
LARRIIKLIQPLYEYSVVI

SEQ ID NO: 3160922 - protein, 24 aa, Giardia lamblia
LASACSGRIILICDTGNNCIRCLD

SEQ ID NO: 3160923 - protein, 28 aa, Giardia lamblia
LASAFILKNHERFCFTFFAALGAMQRVA

SEQ ID NO: 3160924 - protein, 28 aa, Giardia lamblia
LASFDLIKAIYKYGFEIPSPVQQYSIPK

SEQ ID NO: 3160925 - protein, 18 aa, Giardia lamblia
LASFPEGIPSLGQTSKVH

SEQ ID NO: 3160926 - protein, 20 aa, Giardia lamblia
LASGPSMYNWLSKFLRDTLA

SEQ ID NO: 3160927 - protein, 17 aa, Giardia lamblia
LASLLVADSQWIYFSSD

SEQ ID NO: 3160928 - protein, 25 aa, Giardia lamblia
LASLPETLSTLAFAERCKSLPDRSR

SEQ ID NO: 3160929 - protein, 31 aa, Giardia lamblia
LASMCGIGRPVVWNLSGLDAFAEKCKSRENS

SEQ ID NO: 3160930 - protein, 19 aa, Giardia lamblia
LASMYLPTQPFRWRKQLLD

SEQ ID NO: 3160931 - protein, 21 aa, Giardia lamblia
LASNCGLDLSPFVEKVTFVIH

SEQ ID NO: 3160932 - protein, 25 aa, Giardia lamblia
LASRRGGSVPSNIRRIRTLNQSGPT

SEQ ID NO: 3160933 - protein, 18 aa, Giardia lamblia
LASSHLRKLKTLDMPCAI

SEQ ID NO: 3160934 - protein, 19 aa, Giardia lamblia
LASSSWDGTTRVWSTFSPS

SEQ ID NO: 3160935 - protein, 18 aa, Giardia lamblia
LASTIEWLTHEFPVEASP

SEQ ID NO: 3160936 - protein, 18 aa, Giardia lamblia
LASTIVRIRSAIWKAYSD

SEQ ID NO: 3160937 - protein, 22 aa, Giardia lamblia
LASTRIKAIASLILSRILPERW

SEQ ID NO: 3160938 - protein, 19 aa, Giardia lamblia
LASVLRMLVINAIHISVLN

SEQ ID NO: 3160939 - protein, 19 aa, Giardia lamblia
LATARRFLHTEAKARLLDG

SEQ ID NO: 3160940 - protein, 17 aa, Giardia lamblia
LATEVRNIYSLMAAQKD

SEQ ID NO: 3160941 - protein, 18 aa, Giardia lamblia
LATEYAYQTLAVLQDEVS

SEQ ID NO: 3160942 - protein, 19 aa, Giardia lamblia
LATFPEDFYGATLYTTIQR

SEQ ID NO: 3160943 - protein, 18 aa, Giardia lamblia
LATFRKRLLTPGVLDKCA

SEQ ID NO: 3160944 - protein, 18 aa, Giardia lamblia
LATILAVQEAGLVNKNDE

SEQ ID NO: 3160945 - protein, 19 aa, Giardia lamblia
LATLIAAYDNPQNWINSRF

SEQ ID NO: 3160946 - protein, 19 aa, Giardia lamblia
LATLLLIEGGIYRKDGWSA

SEQ ID NO: 3160947 - protein, 23 aa, Giardia lamblia
LATLRSGDPFEYLSTFLTSASSS

SEQ ID NO: 3160948 - protein, 25 aa, Giardia lamblia
LATNWRRCMSSASRWSVPSSNDTAL

SEQ ID NO: 3160949 - protein, 18 aa, Giardia lamblia
LATPEYDAIAGIPQVSPK

SEQ ID NO: 3160950 - protein, 27 aa, Giardia lamblia
LATRYYYPEIMAFLSPFEGHIADSTGI

SEQ ID NO: 3160951 - protein, 24 aa, Giardia lamblia
LATSFRNSPFVALKVVTAGSAHEK

SEQ ID NO: 3160952 - protein, 20 aa, Giardia lamblia
LATSIGRRKPLISVESPDLE

SEQ ID NO: 3160953 - protein, 18 aa, Giardia lamblia
LAVDAAVIRNSIVGSTLN

SEQ ID NO: 3160954 - protein, 29 aa, Giardia lamblia
LAVIEEGYCKKCMLASLTRFGVSSPPGEG

SEQ ID NO: 3160955 - protein, 19 aa, Giardia lamblia
LAVKLVERFGAKLSMRKDM

SEQ ID NO: 3160956 - protein, 18 aa, Giardia lamblia
LAVLLPVMELCQVNGTKS

SEQ ID NO: 3160957 - protein, 17 aa, Giardia lamblia
LAVLPAINAPTEALQVN

SEQ ID NO: 3160958 - protein, 18 aa, Giardia lamblia
LAVLRRVGVCTAPHDIHF

SEQ ID NO: 3160959 - protein, 20 aa, Giardia lamblia
LAVNRLALRQTFGVQKWPET

SEQ ID NO: 3160960 - protein, 19 aa, Giardia lamblia
LAVQIKVCQSAQQAETSRL

SEQ ID NO: 3160961 - protein, 23 aa, Giardia lamblia
LAVQKCRTDAIILLSPLAAGYVE

SEQ ID NO: 3160962 - protein, 17 aa, Giardia lamblia
LAVSVAFFPSGPGSDSL

SEQ ID NO: 3160963 - protein, 24 aa, Giardia lamblia
LAVTTRFPGAVYFIMMEMDAHVIV

SEQ ID NO: 3160964 - protein, 27 aa, Giardia lamblia
LAWNRNEKGCLIPGYYTQSKFTLIHSY

SEQ ID NO: 3160965 - protein, 24 aa, Giardia lamblia
LAWRKCKKPSLIREIKLACLDAFT

SEQ ID NO: 3160966 - protein, 21 aa, Giardia lamblia
LAYFTNFRVYLLIGGTDTAKQ

SEQ ID NO: 3160967 - protein, 23 aa, Giardia lamblia
LAYLRLLKKNVCSEASNRLTSQK

SEQ ID NO: 3160968 - protein, 19 aa, Giardia lamblia
LAYNKCYWNGTYLRVQVAR

SEQ ID NO: 3160969 - protein, 26 aa, Giardia lamblia
LAYNVGRLCCELCFAGSKCKAVKGEY

SEQ ID NO: 3160970 - protein, 17 aa, Giardia lamblia
LCAKEAVEIARRDKLFD

SEQ ID NO: 3160971 - protein, 17 aa, Giardia lamblia
LCAKSCTDLAATRQREY

SEQ ID NO: 3160972 - protein, 24 aa, Giardia lamblia
LCAMIDKLRILQAITNTEQALTGI

SEQ ID NO: 3160973 - protein, 23 aa, Giardia lamblia
LCCIKYRSAAPYIPRKLQGTPFE

SEQ ID NO: 3160974 - protein, 25 aa, Giardia lamblia
LCCRYCGRRWFKHDIQVHEKNCRLK

SEQ ID NO: 3160975 - protein, 18 aa, Giardia lamblia
LCCYCHVQPMSLIYWPCR

SEQ ID NO: 3160976 - protein, 23 aa, Giardia lamblia
LCDIDGRTALMMAAERNHVDCVL

SEQ ID NO: 3160977 - protein, 26 aa, Giardia lamblia
LCDKKGRTALMYAAKRGSHGLVHKLV

SEQ ID NO: 3160978 - protein, 25 aa, Giardia lamblia
LCDNKGRSALMYAAELGNAVLAALL

SEQ ID NO: 3160979 - protein, 19 aa, Giardia lamblia
LCDPAGLSCTFYNRPKSNE

SEQ ID NO: 3160980 - protein, 17 aa, Giardia lamblia
LCECIADINIRIRIKDF

SEQ ID NO: 3160981 - protein, 21 aa, Giardia lamblia
LCEDEKMLSIIFGRSYNGTIT

SEQ ID NO: 3160982 - protein, 17 aa, Giardia lamblia
LCEGGTLATLLHDVRGL

SEQ ID NO: 3160983 - protein, 17 aa, Giardia lamblia
LCERILPYILREESMHA

SEQ ID NO: 3160984 - protein, 23 aa, Giardia lamblia
LCFQCKGLCTFQRKEERHSLETH

SEQ ID NO: 3160985 - protein, 20 aa, Giardia lamblia
LCFYFYKLIDWKNVRLGCIL

SEQ ID NO: 3160986 - protein, 17 aa, Giardia lamblia
LCGIMAYRDDFCVSSDF

SEQ ID NO: 3160987 - protein, 19 aa, Giardia lamblia
LCGLYSCENKDSIAHATMS

SEQ ID NO: 3160988 - protein, 25 aa, Giardia lamblia
LCGNRRHICELVFPTLLAKKCLAFG

SEQ ID NO: 3160989 - protein, 17 aa, Giardia lamblia
LCGRRLLEKLSVGIKEN

SEQ ID NO: 3160990 - protein, 18 aa, Giardia lamblia
LCGWDKLSPTLVRQEKLG

SEQ ID NO: 3160991 - protein, 26 aa, Giardia lamblia
LCHDCQRVSADLSFHFISLQCHFCYS

SEQ ID NO: 3160992 - protein, 18 aa, Giardia lamblia
LCHGARAALQIYPENNDQ

SEQ ID NO: 3160993 - protein, 18 aa, Giardia lamblia
LCHYNGFAWIMFQPLSTE

SEQ ID NO: 3160994 - protein, 25 aa, Giardia lamblia
LCIDMKPTYGNLWSYCKAKTVHLGY

SEQ ID NO: 3160995 - protein, 19 aa, Giardia lamblia
LCKEFGLTIKKHFATLSDF

SEQ ID NO: 3160996 - protein, 26 aa, Giardia lamblia
LCKEYKVHLCKKFTRRTLGELTGQVR

SEQ ID NO: 3160997 - protein, 18 aa, Giardia lamblia
LCKHRLNSLPGFATSSLR

SEQ ID NO: 3160998 - protein, 22 aa, Giardia lamblia
LCLARGDTSLFILSRPEQKVYH

SEQ ID NO: 3160999 - protein, 24 aa, Giardia lamblia
LCLGEVVYNLGILVSEELKMPYKS

SEQ ID NO: 3161000 - protein, 17 aa, Giardia lamblia
LCLLLPDEFDLIRVQAL

SEQ ID NO: 3161001 - protein, 17 aa, Giardia lamblia
LCLQALRNLQFQVVKKP

SEQ ID NO: 3161002 - protein, 19 aa, Giardia lamblia
LCLQCKLLPNSGNKTTKLL

SEQ ID NO: 3161003 - protein, 18 aa, Giardia lamblia
LCLSNVAVRLCVTPIDLV

SEQ ID NO: 3161004 - protein, 17 aa, Giardia lamblia
LCLYDCMASSKISLTPV

SEQ ID NO: 3161005 - protein, 18 aa, Giardia lamblia
LCNIKYSILPDGSVCDRL

SEQ ID NO: 3161006 - protein, 19 aa, Giardia lamblia
LCNKSLLAGSSCFDAAQLI

SEQ ID NO: 3161007 - protein, 17 aa, Giardia lamblia
LCNNAKILKQYKYLDKT

SEQ ID NO: 3161008 - protein, 34 aa, Giardia lamblia
LCNYPEKLLPAILSRCCAFRFLPVPRESCLLMLE

SEQ ID NO: 3161009 - protein, 24 aa, Giardia lamblia
LCPECADLLTPVCRSVRGRCGHEY

SEQ ID NO: 3161010 - protein, 18 aa, Giardia lamblia
LCPGIPNYSGLPYSMIFA

SEQ ID NO: 3161011 - protein, 20 aa, Giardia lamblia
LCQTLNLFLRPPAEVLSKDL

SEQ ID NO: 3161012 - protein, 19 aa, Giardia lamblia
LCREGDKSGNVILRRFNEV

SEQ ID NO: 3161013 - protein, 24 aa, Giardia lamblia
LCRGDARLILLRKYIKNLKTISSN

SEQ ID NO: 3161014 - protein, 18 aa, Giardia lamblia
LCRGRSMALCSWIAGRSC

SEQ ID NO: 3161015 - protein, 18 aa, Giardia lamblia
LCRPYELSRYLAHPHLLV

SEQ ID NO: 3161016 - protein, 23 aa, Giardia lamblia
LCSDAEVVLFIWTTFGYFLGRFA

SEQ ID NO: 3161017 - protein, 21 aa, Giardia lamblia
LCSDDDFSLVAFLRSFISLLK

SEQ ID NO: 3161018 - protein, 19 aa, Giardia lamblia
LCSFVTRVGGTIIATIRER

SEQ ID NO: 3161019 - protein, 20 aa, Giardia lamblia
LCSGCGALQPISRPTNYFKL

SEQ ID NO: 3161020 - protein, 18 aa, Giardia lamblia
LCSLEIDPTGEFLLLGAN

SEQ ID NO: 3161021 - protein, 20 aa, Giardia lamblia
LCSNHKCELIETGGDWIQCD

SEQ ID NO: 3161022 - protein, 19 aa, Giardia lamblia
LCSPDKYPSGFTDLMDAVL

SEQ ID NO: 3161023 - protein, 17 aa, Giardia lamblia
LCSTKLDIVHRTTGMRE

SEQ ID NO: 3161024 - protein, 17 aa, Giardia lamblia
LCSVAKMHAEKRIAYLA

SEQ ID NO: 3161025 - protein, 18 aa, Giardia lamblia
LCSYGLKAPLAKLQSSSG

SEQ ID NO: 3161026 - protein, 32 aa, Giardia lamblia
LCSYLLRYPTQWYDKRGFSVLAHAVSLGNHAL

SEQ ID NO: 3161027 - protein, 19 aa, Giardia lamblia
LCTCSRTSHDIKRREIPYV

SEQ ID NO: 3161028 - protein, 19 aa, Giardia lamblia
LCTDCGQTALMNAVANNQF

SEQ ID NO: 3161029 - protein, 19 aa, Giardia lamblia
LCTEVNRMYSWRLSDDPYD

SEQ ID NO: 3161030 - protein, 26 aa, Giardia lamblia
LCTFVGVCIPEFLSLYETERLVQRLA

SEQ ID NO: 3161031 - protein, 24 aa, Giardia lamblia
LCTLRAPCWDPAALAADPVPALER

SEQ ID NO: 3161032 - protein, 18 aa, Giardia lamblia
LCTVKYIVEHKVNWRDSY

SEQ ID NO: 3161033 - protein, 17 aa, Giardia lamblia
LCVGIRTSGGVALAVQK

SEQ ID NO: 3161034 - protein, 18 aa, Giardia lamblia
LCVHGCLASNFSLEKLKE

SEQ ID NO: 3161035 - protein, 18 aa, Giardia lamblia
LCVQPELSDAGRKIQSEK

SEQ ID NO: 3161036 - protein, 17 aa, Giardia lamblia
LCVQTFTVLNVLGRKYK

SEQ ID NO: 3161037 - protein, 25 aa, Giardia lamblia
LCVSFPRSKAAAVYIFKILDFNCKG

SEQ ID NO: 3161038 - protein, 19 aa, Giardia lamblia
LCYHAKRIYKESCKNREEV

SEQ ID NO: 3161039 - protein, 19 aa, Giardia lamblia
LDAAAYWLFTQPYFYGLII

SEQ ID NO: 3161040 - protein, 24 aa, Giardia lamblia
LDACIPYLVDECRITDNLGESALM

SEQ ID NO: 3161041 - protein, 18 aa, Giardia lamblia
LDACRDALADPEMARKEN

SEQ ID NO: 3161042 - protein, 19 aa, Giardia lamblia
LDADGRSPLSIAASEGACN

SEQ ID NO: 3161043 - protein, 21 aa, Giardia lamblia
LDADLAYKADYGLLPGKLPLA

SEQ ID NO: 3161044 - protein, 26 aa, Giardia lamblia
LDAFNFPSWCGLALSLSSMLASHVDG

SEQ ID NO: 3161045 - protein, 24 aa, Giardia lamblia
LDAIELMRPSSLYIQTSSKEEIDY

SEQ ID NO: 3161046 - protein, 27 aa, Giardia lamblia
LDAIPARLRRRMGIVFMDEDPRDAELV

SEQ ID NO: 3161047 - protein, 23 aa, Giardia lamblia
LDAKCICIFSIHGGGLIRLMRQR

SEQ ID NO: 3161048 - protein, 30 aa, Giardia lamblia
LDAMIKHKLELQSRIGFLERVVKDKDEAIE

SEQ ID NO: 3161049 - protein, 19 aa, Giardia lamblia
LDANFPILEEGELGIDPTG

SEQ ID NO: 3161050 - protein, 18 aa, Giardia lamblia
LDAPVIAAVVARVCGRDA

SEQ ID NO: 3161051 - protein, 21 aa, Giardia lamblia
LDATCQTCIGLYKERDKLKAE

SEQ ID NO: 3161052 - protein, 17 aa, Giardia lamblia
LDATEIYNQYAPVNTPE

SEQ ID NO: 3161053 - protein, 24 aa, Giardia lamblia
LDAVARLSAKFLSALTELSDSTKV

SEQ ID NO: 3161054 - protein, 20 aa, Giardia lamblia
LDAVDIFCLYMSRLFSILKD

SEQ ID NO: 3161055 - protein, 18 aa, Giardia lamblia
LDCQWKFDPALSADSPLS

SEQ ID NO: 3161056 - protein, 19 aa, Giardia lamblia
LDCRGCGVCVEACPKDALA

SEQ ID NO: 3161057 - protein, 22 aa, Giardia lamblia
LDCRRREKAEAMRRGYEQRMEQ

SEQ ID NO: 3161058 - protein, 21 aa, Giardia lamblia
LDDAFECFSRAVIAVQKQLAC

SEQ ID NO: 3161059 - protein, 17 aa, Giardia lamblia
LDDCKHVYLPDEDTFLL

SEQ ID NO: 3161060 - protein, 27 aa, Giardia lamblia
LDDEESCAMLLRWEKSLELPGGKNPLM

SEQ ID NO: 3161061 - protein, 21 aa, Giardia lamblia
LDDELFCRLFDVEKGILEDAG

SEQ ID NO: 3161062 - protein, 23 aa, Giardia lamblia
LDDFKIANIVARSRRGREMVAAY

SEQ ID NO: 3161063 - protein, 26 aa, Giardia lamblia
LDDHVFKCLPLFTSQRSWLMADRWWT

SEQ ID NO: 3161064 - protein, 17 aa, Giardia lamblia
LDDLIVFNPLTKDALVK

SEQ ID NO: 3161065 - protein, 24 aa, Giardia lamblia
LDDVLKIIIPRNFPPPEGSSNNAK

SEQ ID NO: 3161066 - protein, 37 aa, Giardia lamblia
LDEALMRPGRFEVHLEIGLPDCRGREQILRIHTKNLV

SEQ ID NO: 3161067 - protein, 38 aa, Giardia lamblia
LDEALMRPGRFEVHLEIGLPDCRGREQILRIHTKNLVA

SEQ ID NO: 3161068 - protein, 18 aa, Giardia lamblia
LDEELCKAATRVQDSSTC

SEQ ID NO: 3161069 - protein, 23 aa, Giardia lamblia
LDEILDREVEVFRVDQKDAQRTG

SEQ ID NO: 3161070 - protein, 18 aa, Giardia lamblia
LDEIQALGGNDLDKRTYL

SEQ ID NO: 3161071 - protein, 17 aa, Giardia lamblia
LDEKTQCTKIIKNLNKD

SEQ ID NO: 3161072 - protein, 17 aa, Giardia lamblia
LDELRELLDSERRRIKK

SEQ ID NO: 3161073 - protein, 20 aa, Giardia lamblia
LDELSARKAPLMTAIAVREQ

SEQ ID NO: 3161074 - protein, 22 aa, Giardia lamblia
LDEPLCGPVFDPYEKYFLMSVH

SEQ ID NO: 3161075 - protein, 23 aa, Giardia lamblia
LDESIKIVFCTNRPEALDPALMR

SEQ ID NO: 3161076 - protein, 17 aa, Giardia lamblia
LDEVILLKKELLSRNEV

SEQ ID NO: 3161077 - protein, 18 aa, Giardia lamblia
LDEYKKLFRDIAGKASRY

SEQ ID NO: 3161078 - protein, 17 aa, Giardia lamblia
LDFAISLTIPGYLSPSI

SEQ ID NO: 3161079 - protein, 17 aa, Giardia lamblia
LDFILLDYLKLERLFNS

SEQ ID NO: 3161080 - protein, 18 aa, Giardia lamblia
LDFIPKLEQAGVQPVLLQ

SEQ ID NO: 3161081 - protein, 23 aa, Giardia lamblia
LDFSRQICSAFAYIHNLNKELPN

SEQ ID NO: 3161082 - protein, 18 aa, Giardia lamblia
LDFYSMVISRCIAAKFLL

SEQ ID NO: 3161083 - protein, 30 aa, Giardia lamblia
LDGETALIRAIRWSRPEAVQELVKDEYDLN

SEQ ID NO: 3161084 - protein, 18 aa, Giardia lamblia
LDGLPHILVKSVPCRMNI

SEQ ID NO: 3161085 - protein, 17 aa, Giardia lamblia
LDGMDWSNVVAAGGAVL

SEQ ID NO: 3161086 - protein, 24 aa, Giardia lamblia
LDGMWPGTTSQVFIFENIALPIAD

SEQ ID NO: 3161087 - protein, 20 aa, Giardia lamblia
LDGTASRKGGGRPSSGITTW

SEQ ID NO: 3161088 - protein, 25 aa, Giardia lamblia
LDGWEIYEGTALMIAAAYGYTELVK

SEQ ID NO: 3161089 - protein, 21 aa, Giardia lamblia
LDHAVMCRNTYAIELLVNSFE

SEQ ID NO: 3161090 - protein, 18 aa, Giardia lamblia
LDHKSCSMIGTISPSEGY

SEQ ID NO: 3161091 - protein, 21 aa, Giardia lamblia
LDHKVDLSLADRVESEVGDFI

SEQ ID NO: 3161092 - protein, 33 aa, Giardia lamblia
LDHLSEADGTYCLKRLRTLSLRGASEGDVDVFI

SEQ ID NO: 3161093 - protein, 22 aa, Giardia lamblia
LDHTYCAAFLLAKRAKLNYTHG

SEQ ID NO: 3161094 - protein, 18 aa, Giardia lamblia
LDHVVKLYQLDSVLPSEK

SEQ ID NO: 3161095 - protein, 21 aa, Giardia lamblia
LDIAMLYSMYLSQRYPTPRGY

SEQ ID NO: 3161096 - protein, 26 aa, Giardia lamblia
LDICCGSGVIGQCLAQVVLKKMINVQ

SEQ ID NO: 3161097 - protein, 23 aa, Giardia lamblia
LDIFFPAKIRQIFITERNIYEAY

SEQ ID NO: 3161098 - protein, 18 aa, Giardia lamblia
LDIGCGTGSLAFPLLEKN

SEQ ID NO: 3161099 - protein, 22 aa, Giardia lamblia
LDILKLSSMSLRVENLRTNESL

SEQ ID NO: 3161100 - protein, 17 aa, Giardia lamblia
LDILLTMEVDYLPDAPH

SEQ ID NO: 3161101 - protein, 25 aa, Giardia lamblia
LDIMGDQLLLEWFVDNYKNYGASLE

SEQ ID NO: 3161102 - protein, 26 aa, Giardia lamblia
LDINGAHILPLVQFMQVYGKIQRLAF

SEQ ID NO: 3161103 - protein, 22 aa, Giardia lamblia
LDIPNVRLVLNYDLPGNVDDYT

SEQ ID NO: 3161104 - protein, 18 aa, Giardia lamblia
LDIQRVQMELTRMDRSTQ

SEQ ID NO: 3161105 - protein, 19 aa, Giardia lamblia
LDISLAHAISVASNPSYAV

SEQ ID NO: 3161106 - protein, 27 aa, Giardia lamblia
LDKATIYERIEYIYLVSCDSNLYLVSQ

SEQ ID NO: 3161107 - protein, 28 aa, Giardia lamblia
LDKDEYRAAAALLCCKEELERISRRGFT

SEQ ID NO: 3161108 - protein, 24 aa, Giardia lamblia
LDKELIRLILRDGPQAESQNMSLI

SEQ ID NO: 3161109 - protein, 24 aa, Giardia lamblia
LDKISPCVAEAIETRVLYDKALIL

SEQ ID NO: 3161110 - protein, 19 aa, Giardia lamblia
LDKLGLRRFKGLRRDRSES

SEQ ID NO: 3161111 - protein, 20 aa, Giardia lamblia
LDKRCPICRVSINSVEKVFI

SEQ ID NO: 3161112 - protein, 20 aa, Giardia lamblia
LDKRNSRVSFSMDASTPSKR

SEQ ID NO: 3161113 - protein, 23 aa, Giardia lamblia
LDKSLRSIIKLVLENPSVECIHA

SEQ ID NO: 3161114 - protein, 18 aa, Giardia lamblia
LDKYIRQVKIDWHTIAAR

SEQ ID NO: 3161115 - protein, 17 aa, Giardia lamblia
LDLAVTGDNPFKVSELE

SEQ ID NO: 3161116 - protein, 19 aa, Giardia lamblia
LDLEITKLQAAVKYLKAKL

SEQ ID NO: 3161117 - protein, 25 aa, Giardia lamblia
LDLGESVTMNMLLKLSANEIRNYLT

SEQ ID NO: 3161118 - protein, 18 aa, Giardia lamblia
LDLIAPVLSLKSLESLDI

SEQ ID NO: 3161119 - protein, 25 aa, Giardia lamblia
LDLKDLKLCHGEYPKDMQATLGDRL

SEQ ID NO: 3161120 - protein, 17 aa, Giardia lamblia
LDLKTANMEKLYEEYKK

SEQ ID NO: 3161121 - protein, 17 aa, Giardia lamblia
LDLPRFANMFPDQDVNE

SEQ ID NO: 3161122 - protein, 19 aa, Giardia lamblia
LDLQNVWIGAVNIFGQSKV

SEQ ID NO: 3161123 - protein, 21 aa, Giardia lamblia
LDLRITLAQQRLFSIAPPEPN

SEQ ID NO: 3161124 - protein, 19 aa, Giardia lamblia
LDLRSVIISANRSTGKPAI

SEQ ID NO: 3161125 - protein, 17 aa, Giardia lamblia
LDLSSNMLKEIAIDCPN

SEQ ID NO: 3161126 - protein, 21 aa, Giardia lamblia
LDMAAKRAMFELSEAGGCSLS

SEQ ID NO: 3161127 - protein, 19 aa, Giardia lamblia
LDMDRELWLEKYPAQTALV

SEQ ID NO: 3161128 - protein, 18 aa, Giardia lamblia
LDMESSFDIGAKMIEQLT

SEQ ID NO: 3161129 - protein, 19 aa, Giardia lamblia
LDMSTLINRAEPGSVCASR

SEQ ID NO: 3161130 - protein, 19 aa, Giardia lamblia
LDNKECMSLLAGNGLQFLL

SEQ ID NO: 3161131 - protein, 25 aa, Giardia lamblia
LDNLALACYVNYGRLFFSSKSAPDT

SEQ ID NO: 3161132 - protein, 17 aa, Giardia lamblia
LDNLFSVAIRRSSRLPQ

SEQ ID NO: 3161133 - protein, 17 aa, Giardia lamblia
LDNLMAIKGDALGKTAS

SEQ ID NO: 3161134 - protein, 20 aa, Giardia lamblia
LDPDICFRDCSAYMVDMLQP

SEQ ID NO: 3161135 - protein, 36 aa, Giardia lamblia
LDPKRRMDYCIREFRIVSFKSLRQVAQIPGREPPSH

SEQ ID NO: 3161136 - protein, 24 aa, Giardia lamblia
LDPQVCALCKGKAAVIASTPCNHI

SEQ ID NO: 3161137 - protein, 18 aa, Giardia lamblia
LDPRLVIGGGCFEAHLST

SEQ ID NO: 3161138 - protein, 22 aa, Giardia lamblia
LDPSNMLNVHFTFLGPSDSPFS

SEQ ID NO: 3161139 - protein, 17 aa, Giardia lamblia
LDPTLIVPRQYTPKTDA

SEQ ID NO: 3161140 - protein, 18 aa, Giardia lamblia
LDPTVLLNKYMEGEKKTE

SEQ ID NO: 3161141 - protein, 25 aa, Giardia lamblia
LDPYYRTLRGFCILIEKEWRSFGHM

SEQ ID NO: 3161142 - protein, 26 aa, Giardia lamblia
LDQGRGRGLAGWRTPFGPFGVSHTDV

SEQ ID NO: 3161143 - protein, 25 aa, Giardia lamblia
LDQLKARAYAVASCYVSFQKTRGGS

SEQ ID NO: 3161144 - protein, 27 aa, Giardia lamblia
LDQYDLRSVYSLALIDFIGRALKASVE

SEQ ID NO: 3161145 - protein, 17 aa, Giardia lamblia
LDRCFEPNDLFGADLYY

SEQ ID NO: 3161146 - protein, 23 aa, Giardia lamblia
LDRELRWAEVSVYTESIVRSVLC

SEQ ID NO: 3161147 - protein, 19 aa, Giardia lamblia
LDRFLCSIYGSFRHFLTTE

SEQ ID NO: 3161148 - protein, 31 aa, Giardia lamblia
LDRLRHPHCFPTLRFLLEMQDYILDRQPLRC

SEQ ID NO: 3161149 - protein, 22 aa, Giardia lamblia
LDRPSYPAVLLFIDEIDSEQAE

SEQ ID NO: 3161150 - protein, 23 aa, Giardia lamblia
LDRRDIKSISLLAARESRLLTKE

SEQ ID NO: 3161151 - protein, 17 aa, Giardia lamblia
LDRRGFYPYVARCTKAA

SEQ ID NO: 3161152 - protein, 18 aa, Giardia lamblia
LDRRYVTTGWNWGSLAVS

SEQ ID NO: 3161153 - protein, 17 aa, Giardia lamblia
LDRSDKSNMLWSGYMQK

SEQ ID NO: 3161154 - protein, 20 aa, Giardia lamblia
LDRYDLIVCYCMLSQQRGPA

SEQ ID NO: 3161155 - protein, 17 aa, Giardia lamblia
LDRYLKIGRQILTTASP

SEQ ID NO: 3161156 - protein, 20 aa, Giardia lamblia
LDRYLSALLALWGSSGPEAP

SEQ ID NO: 3161157 - protein, 29 aa, Giardia lamblia
LDSAIRRRFEKRIEIVLPDAAARKNILRS

SEQ ID NO: 3161158 - protein, 23 aa, Giardia lamblia
LDSEARFKARVVAQTVSKQEARK

SEQ ID NO: 3161159 - protein, 19 aa, Giardia lamblia
LDSEYVLRACCSIPTVELC

SEQ ID NO: 3161160 - protein, 17 aa, Giardia lamblia
LDSFLLISILGEGRSGS

SEQ ID NO: 3161161 - protein, 18 aa, Giardia lamblia
LDSFWCWKNLGDESYLRK

SEQ ID NO: 3161162 - protein, 20 aa, Giardia lamblia
LDSIFSLLLRREEVDPVTFY

SEQ ID NO: 3161163 - protein, 26 aa, Giardia lamblia
LDSKLKEFLFRFDAECYTAALDRLSP

SEQ ID NO: 3161164 - protein, 33 aa, Giardia lamblia
LDSKSYYRCAFFNCPARRTITFFYSLSSDGTET

SEQ ID NO: 3161165 - protein, 23 aa, Giardia lamblia
LDSLDLKRAYTMKMGNKVREARE

SEQ ID NO: 3161166 - protein, 21 aa, Giardia lamblia
LDSPTLFALRELIQDYVIEQK

SEQ ID NO: 3161167 - protein, 24 aa, Giardia lamblia
LDSRLWPSFIFLIRLLDFSPAFDI

SEQ ID NO: 3161168 - protein, 22 aa, Giardia lamblia
LDSRPAFTSEYFPEVPAGWSGN

SEQ ID NO: 3161169 - protein, 26 aa, Giardia lamblia
LDSSLNFWFEVCDLDADGIISFNDFD

SEQ ID NO: 3161170 - protein, 32 aa, Giardia lamblia
LDTCPHTNLLKTVRWFISVVERLLATNTSVVP

SEQ ID NO: 3161171 - protein, 17 aa, Giardia lamblia
LDTFVRLHDPYAWPDFR

SEQ ID NO: 3161172 - protein, 25 aa, Giardia lamblia
LDTIPDLDLLGSMSYIPDLNSTSIS

SEQ ID NO: 3161173 - protein, 18 aa, Giardia lamblia
LDTLALAAAVTRFGPGDG

SEQ ID NO: 3161174 - protein, 22 aa, Giardia lamblia
LDTLDMALRYSLTPDSVRVNQV

SEQ ID NO: 3161175 - protein, 18 aa, Giardia lamblia
LDTLHTWSTAALSCPMVK

SEQ ID NO: 3161176 - protein, 20 aa, Giardia lamblia
LDTLRFKLVLYGHSMPITSM

SEQ ID NO: 3161177 - protein, 22 aa, Giardia lamblia
LDTLYWRLQLIAQQERSEGKQS

SEQ ID NO: 3161178 - protein, 26 aa, Giardia lamblia
LDTQASFISVQWLVVRSSINTHMLDF

SEQ ID NO: 3161179 - protein, 20 aa, Giardia lamblia
LDTRPSCGIPEIERDRFLAV

SEQ ID NO: 3161180 - protein, 19 aa, Giardia lamblia
LDTSDCAVMYRLLSEDNEP

SEQ ID NO: 3161181 - protein, 26 aa, Giardia lamblia
LDTSKYFLCPLIESMLAGDSWFSENT

SEQ ID NO: 3161182 - protein, 26 aa, Giardia lamblia
LDVAIDCLRDCFGLKDVRHGNGDLEQ

SEQ ID NO: 3161183 - protein, 19 aa, Giardia lamblia
LDVAMSLASEIQRDTNNIA

SEQ ID NO: 3161184 - protein, 19 aa, Giardia lamblia
LDVFEIFNYQSFFTVLSYV

SEQ ID NO: 3161185 - protein, 18 aa, Giardia lamblia
LDVLARMRANLQARQHAS

SEQ ID NO: 3161186 - protein, 18 aa, Giardia lamblia
LDVLPGLHHPGVLRYHQV

SEQ ID NO: 3161187 - protein, 17 aa, Giardia lamblia
LDVLSFYIGTEKTWSDM

SEQ ID NO: 3161188 - protein, 24 aa, Giardia lamblia
LDVNPRIISILRRYKPSLTSVSRS

SEQ ID NO: 3161189 - protein, 21 aa, Giardia lamblia
LDVQRLLARISPRTTSGDDSS

SEQ ID NO: 3161190 - protein, 19 aa, Giardia lamblia
LDVSYEFTHADVLSCLEDT

SEQ ID NO: 3161191 - protein, 18 aa, Giardia lamblia
LDWCKEYDQSDCVEYVIR

SEQ ID NO: 3161192 - protein, 20 aa, Giardia lamblia
LDYAHIIFSKDVLKTYINFI

SEQ ID NO: 3161193 - protein, 19 aa, Giardia lamblia
LDYLFPAILARLEQFNMTQ

SEQ ID NO: 3161194 - protein, 26 aa, Giardia lamblia
LDYRKRPDLAKARRVIATMDVLGMYC

SEQ ID NO: 3161195 - protein, 32 aa, Giardia lamblia
LDYVLGLRIEDIFKRRLQSVIVESKLAKSVHH

SEQ ID NO: 3161196 - protein, 20 aa, Giardia lamblia
LEAALVCATRAFQLNSTSEP

SEQ ID NO: 3161197 - protein, 23 aa, Giardia lamblia
LEAAMRLSEDFLNIYKRTYDIVA

SEQ ID NO: 3161198 - protein, 24 aa, Giardia lamblia
LEADPEWYALLSALSSRDILYFRN

SEQ ID NO: 3161199 - protein, 18 aa, Giardia lamblia
LEAEHLVLPFSDMEFEPN

SEQ ID NO: 3161200 - protein, 26 aa, Giardia lamblia
LEAEKLRLSNLMLLKREACNTSVIRN

SEQ ID NO: 3161201 - protein, 17 aa, Giardia lamblia
LEAELEELRAYHDFIKP

SEQ ID NO: 3161202 - protein, 27 aa, Giardia lamblia
LEAELRHYRRLYFSLKAHYEAMVNLLP

SEQ ID NO: 3161203 - protein, 18 aa, Giardia lamblia
LEAGISDERGCTALMMAA

SEQ ID NO: 3161204 - protein, 26 aa, Giardia lamblia
LEAIELGKPTGYIFAAPRRQGFSSSG

SEQ ID NO: 3161205 - protein, 17 aa, Giardia lamblia
LEAIKLPDALSYVDVYK

SEQ ID NO: 3161206 - protein, 42 aa, Giardia lamblia
LEAKMTLGTFICRTWKLTDATALMMAACYGYADIVRLLAKYE

SEQ ID NO: 3161207 - protein, 31 aa, Giardia lamblia
LEALIRLSESFAKMRLSPVVTVEDVEYAIDI

SEQ ID NO: 3161208 - protein, 24 aa, Giardia lamblia
LEALKKIRLPLIITTYSKKLVNLV

SEQ ID NO: 3161209 - protein, 19 aa, Giardia lamblia
LEALTLRRSTLMTDSFAMI

SEQ ID NO: 3161210 - protein, 27 aa, Giardia lamblia
LEALYAMSGLIKFFYVYTGRGNESPTL

SEQ ID NO: 3161211 - protein, 17 aa, Giardia lamblia
LEAMSRFYKDVVYEECL

SEQ ID NO: 3161212 - protein, 17 aa, Giardia lamblia
LEAQLLERNARLITMAK

SEQ ID NO: 3161213 - protein, 18 aa, Giardia lamblia
LEASQLLDSYDFTFREQV

SEQ ID NO: 3161214 - protein, 17 aa, Giardia lamblia
LEASRIPLSGSRLRELK

SEQ ID NO: 3161215 - protein, 19 aa, Giardia lamblia
LEASRLAPIGIYTSGKSTS

SEQ ID NO: 3161216 - protein, 19 aa, Giardia lamblia
LEATLVWALGSYFSTTIPE

SEQ ID NO: 3161217 - protein, 19 aa, Giardia lamblia
LEAYLREKEERELKECTFH

SEQ ID NO: 3161218 - protein, 18 aa, Giardia lamblia
LECAKLLVERERDIKDKY

SEQ ID NO: 3161219 - protein, 20 aa, Giardia lamblia
LECAMLLLEKERCMQDNDGW

SEQ ID NO: 3161220 - protein, 18 aa, Giardia lamblia
LECCYIMQNARFFKFTDM

SEQ ID NO: 3161221 - protein, 26 aa, Giardia lamblia
LECDFTLKIEPSRWVFDHEGQGNSDT

SEQ ID NO: 3161222 - protein, 20 aa, Giardia lamblia
LECEVKLASGVLAKTSRLTR

SEQ ID NO: 3161223 - protein, 17 aa, Giardia lamblia
LECKPPLTTARMLDKLV

SEQ ID NO: 3161224 - protein, 21 aa, Giardia lamblia
LECPKDIVFQKLDQMLCYLLT

SEQ ID NO: 3161225 - protein, 18 aa, Giardia lamblia
LECVKILLHEEAGMTQSS

SEQ ID NO: 3161226 - protein, 19 aa, Giardia lamblia
LECYPRNELILTLIDKEPA

SEQ ID NO: 3161227 - protein, 29 aa, Giardia lamblia
LEDAIRRYYFVSAHARLLHLFWETIHEDT

SEQ ID NO: 3161228 - protein, 17 aa, Giardia lamblia
LEDAYALSVQENMNLQH

SEQ ID NO: 3161229 - protein, 25 aa, Giardia lamblia
LEDCEECWKRFGSQEIETEEAVARA

SEQ ID NO: 3161230 - protein, 20 aa, Giardia lamblia
LEDGSAFGPYLSGICKHIHD

SEQ ID NO: 3161231 - protein, 26 aa, Giardia lamblia
LEDLPACFLDLGWYRLTAEQGQIIRE

SEQ ID NO: 3161232 - protein, 17 aa, Giardia lamblia
LEDLPLCCIKYRSAAPY

SEQ ID NO: 3161233 - protein, 23 aa, Giardia lamblia
LEDLRFQNFWLYQTEAGDYFLVW

SEQ ID NO: 3161234 - protein, 20 aa, Giardia lamblia
LEDPFSIAATGDFINYADDD

SEQ ID NO: 3161235 - protein, 17 aa, Giardia lamblia
LEDREAILASQRKELEV

SEQ ID NO: 3161236 - protein, 21 aa, Giardia lamblia
LEECLCLARKLGAHAILHAGD

SEQ ID NO: 3161237 - protein, 24 aa, Giardia lamblia
LEECLCLARKLGAHAILHAGDFFN

SEQ ID NO: 3161238 - protein, 23 aa, Giardia lamblia
LEEFKRQVDALLRENNELKRKVD

SEQ ID NO: 3161239 - protein, 24 aa, Giardia lamblia
LEEFSIEIQNVYTLFEAESENPAI

SEQ ID NO: 3161240 - protein, 22 aa, Giardia lamblia
LEEKGLKFGTGRVPSAYLSAHW

SEQ ID NO: 3161241 - protein, 19 aa, Giardia lamblia
LEELAEWYNPDLLAVLPAS

SEQ ID NO: 3161242 - protein, 29 aa, Giardia lamblia
LEELRASGYLDKAVSCTEIDLGDIAHGST

SEQ ID NO: 3161243 - protein, 27 aa, Giardia lamblia
LEEMKGSIRVIVRMRPMLQHEKEELKT

SEQ ID NO: 3161244 - protein, 25 aa, Giardia lamblia
LEEQSYRGVVSFLRDLAPETIIGCF

SEQ ID NO: 3161245 - protein, 20 aa, Giardia lamblia
LEERAGLPLSSPSPSDAPIT

SEQ ID NO: 3161246 - protein, 18 aa, Giardia lamblia
LEERRLPFTRGIENEIHN

SEQ ID NO: 3161247 - protein, 22 aa, Giardia lamblia
LEEYIFRIPLHQLFFEMLFDPK

SEQ ID NO: 3161248 - protein, 18 aa, Giardia lamblia
LEEYKALLSRMGKQHNIR

SEQ ID NO: 3161249 - protein, 18 aa, Giardia lamblia
LEFLPGVLAVLPYEHHYR

SEQ ID NO: 3161250 - protein, 20 aa, Giardia lamblia
LEFVNSLITRDFCIDVSVLD

SEQ ID NO: 3161251 - protein, 17 aa, Giardia lamblia
LEGFLPISEIVWDESSS

SEQ ID NO: 3161252 - protein, 22 aa, Giardia lamblia
LEGFPRSLAEFHASSQASSSLQ

SEQ ID NO: 3161253 - protein, 24 aa, Giardia lamblia
LEGGIKDSFGWTALIYAVSNGSID

SEQ ID NO: 3161254 - protein, 23 aa, Giardia lamblia
LEGHGNAVMRACFMSHGQQLVSV

SEQ ID NO: 3161255 - protein, 17 aa, Giardia lamblia
LEGKLSLIDSFSGILPD

SEQ ID NO: 3161256 - protein, 18 aa, Giardia lamblia
LEGKMIVVGEATLRCVCL

SEQ ID NO: 3161257 - protein, 20 aa, Giardia lamblia
LEGLLRRALSVFKTVHDEKS

SEQ ID NO: 3161258 - protein, 17 aa, Giardia lamblia
LEGPASVAFSSESEESS

SEQ ID NO: 3161259 - protein, 20 aa, Giardia lamblia
LEGRREILERSLAHVNKRNT

SEQ ID NO: 3161260 - protein, 19 aa, Giardia lamblia
LEGVEVFRAAILGIGTDGH

SEQ ID NO: 3161261 - protein, 19 aa, Giardia lamblia
LEGVSMGKVIEGCERGWLA

SEQ ID NO: 3161262 - protein, 26 aa, Giardia lamblia
LEHAMTISGLFLQCASWSEAGLADAR

SEQ ID NO: 3161263 - protein, 17 aa, Giardia lamblia
LEHDLSVDVTLLRQQLA

SEQ ID NO: 3161264 - protein, 24 aa, Giardia lamblia
LEHEKCIRDKNGWTALMRAAQKNS

SEQ ID NO: 3161265 - protein, 29 aa, Giardia lamblia
LEHEVGIRCFMGWTALTWGLDCQNPAAID

SEQ ID NO: 3161266 - protein, 31 aa, Giardia lamblia
LEHGQKDLYGWSSLIYSCLSNNLQSAMLLRS

SEQ ID NO: 3161267 - protein, 18 aa, Giardia lamblia
LEHLSEYPPASAGMSSYN

SEQ ID NO: 3161268 - protein, 19 aa, Giardia lamblia
LEHPGQLPAYSALKGQICL

SEQ ID NO: 3161269 - protein, 20 aa, Giardia lamblia
LEHRAVDYLSFLCLEASQLL

SEQ ID NO: 3161270 - protein, 17 aa, Giardia lamblia
LEHRMLYEKGDASFPGL

SEQ ID NO: 3161271 - protein, 26 aa, Giardia lamblia
LEHRPEERYALLLAHDYLHSPAAAYA

SEQ ID NO: 3161272 - protein, 26 aa, Giardia lamblia
LEHTCPGILPLCVKDLFNNLQSVTNR

SEQ ID NO: 3161273 - protein, 18 aa, Giardia lamblia
LEHTLCLENGSSPLDAIM

SEQ ID NO: 3161274 - protein, 23 aa, Giardia lamblia
LEIAYSQILMKWSKKLELYIIKL

SEQ ID NO: 3161275 - protein, 18 aa, Giardia lamblia
LEIIPPYYEIFLTSLGYP

SEQ ID NO: 3161276 - protein, 23 aa, Giardia lamblia
LEIIPYSLCENAGFDSTCILAQL

SEQ ID NO: 3161277 - protein, 18 aa, Giardia lamblia
LEIKRLRELLSAQKDAQG

SEQ ID NO: 3161278 - protein, 17 aa, Giardia lamblia
LEILGSIINGFATPLKV

SEQ ID NO: 3161279 - protein, 20 aa, Giardia lamblia
LEIPYPIQSCIACLYGNIDV

SEQ ID NO: 3161280 - protein, 17 aa, Giardia lamblia
LEISRKFIRQYLVDSAV

SEQ ID NO: 3161281 - protein, 22 aa, Giardia lamblia
LEIYKNRYLFVFLAQKKDEEES

SEQ ID NO: 3161282 - protein, 22 aa, Giardia lamblia
LEIYKRVATNSVSLGPDVPLEK

SEQ ID NO: 3161283 - protein, 24 aa, Giardia lamblia
LEKDGLEDFSFLKTENLHLINRTI

SEQ ID NO: 3161284 - protein, 18 aa, Giardia lamblia
LEKDKIFTLYEVSAAQLE

SEQ ID NO: 3161285 - protein, 21 aa, Giardia lamblia
LEKDLEGAIFVYANEKLVYAE

SEQ ID NO: 3161286 - protein, 24 aa, Giardia lamblia
LEKEKRIKTNVGWTALMAAAQKGH

SEQ ID NO: 3161287 - protein, 24 aa, Giardia lamblia
LEKHPDIPICIHLDHGDTLESVKM

SEQ ID NO: 3161288 - protein, 35 aa, Giardia lamblia
LEKKLAIANAEIDRLRACLQTPPLSSFSVQPSLTS

SEQ ID NO: 3161289 - protein, 21 aa, Giardia lamblia
LEKLHGITCVVNLTGRTEGDC

SEQ ID NO: 3161290 - protein, 26 aa, Giardia lamblia
LEKLHLCRSIPKTAFFKGILLSSEGV

SEQ ID NO: 3161291 - protein, 17 aa, Giardia lamblia
LEKNVFASYSIIDAHKL

SEQ ID NO: 3161292 - protein, 22 aa, Giardia lamblia
LEKRASLKLRLPHSSPIQFMEV

SEQ ID NO: 3161293 - protein, 23 aa, Giardia lamblia
LEKRREEELQRTPDCAVSDKLAD

SEQ ID NO: 3161294 - protein, 19 aa, Giardia lamblia
LEKRVASEVADVFQSAYER

SEQ ID NO: 3161295 - protein, 28 aa, Giardia lamblia
LEKVKEIWMKIGMGDAWNATDTADTTDT

SEQ ID NO: 3161296 - protein, 25 aa, Giardia lamblia
LEKYKSRTTILFGLTNRKEQIRIGN

SEQ ID NO: 3161297 - protein, 20 aa, Giardia lamblia
LEKYPSISILRRHPKPTEEQ

SEQ ID NO: 3161298 - protein, 21 aa, Giardia lamblia
LELCNLCKPKFVTENRDMKEF

SEQ ID NO: 3161299 - protein, 25 aa, Giardia lamblia
LELCPHKAARIFGLHPRTLYHWMSQ

SEQ ID NO: 3161300 - protein, 23 aa, Giardia lamblia
LELEHLECAAILLKYEGIDNRAP

SEQ ID NO: 3161301 - protein, 25 aa, Giardia lamblia
LELEKRNRLLAARELEVSKLRAMCV

SEQ ID NO: 3161302 - protein, 24 aa, Giardia lamblia
LELFCSNRVLATYFLPNYKEIQRI

SEQ ID NO: 3161303 - protein, 27 aa, Giardia lamblia
LELFKQENLRLVTALSDYESIITEKDT

SEQ ID NO: 3161304 - protein, 17 aa, Giardia lamblia
LELGIKLAEEIRDYIQT

SEQ ID NO: 3161305 - protein, 30 aa, Giardia lamblia
LELGSVRSDLDCKVRELAEITQRYQDEIRK

SEQ ID NO: 3161306 - protein, 20 aa, Giardia lamblia
LELISLASMYGYKLLEVPIC

SEQ ID NO: 3161307 - protein, 17 aa, Giardia lamblia
LELKAGTPSLYSRGNIR

SEQ ID NO: 3161308 - protein, 25 aa, Giardia lamblia
LELKHYNCAYAIAIAGNHVILDDTK

SEQ ID NO: 3161309 - protein, 23 aa, Giardia lamblia
LELKLKELDELFCNPEPHEQIRE

SEQ ID NO: 3161310 - protein, 18 aa, Giardia lamblia
LELKVSRLREVCTMLAGA

SEQ ID NO: 3161311 - protein, 21 aa, Giardia lamblia
LELLCDHTVFFYCLGTSATIP

SEQ ID NO: 3161312 - protein, 17 aa, Giardia lamblia
LELLGDCDIIMRYLLTE

SEQ ID NO: 3161313 - protein, 17 aa, Giardia lamblia
LELLREIGHIAIDGSTA

SEQ ID NO: 3161314 - protein, 17 aa, Giardia lamblia
LELLRRVDLLQYQIDQK

SEQ ID NO: 3161315 - protein, 25 aa, Giardia lamblia
LELLTISQLRWVPRAASVLYKANMK

SEQ ID NO: 3161316 - protein, 18 aa, Giardia lamblia
LELMWAALLCEYDNVITD

SEQ ID NO: 3161317 - protein, 26 aa, Giardia lamblia
LELPCTMESLASLMFLTGARPANIQS

SEQ ID NO: 3161318 - protein, 19 aa, Giardia lamblia
LELPTEWSEESYVSLRNKV

SEQ ID NO: 3161319 - protein, 19 aa, Giardia lamblia
LELRAEIAALTEKQALVPE

SEQ ID NO: 3161320 - protein, 27 aa, Giardia lamblia
LELREAVPLTLWLYNIYYYYSRLDWST

SEQ ID NO: 3161321 - protein, 17 aa, Giardia lamblia
LELRNAYISQKTALVTL

SEQ ID NO: 3161322 - protein, 17 aa, Giardia lamblia
LELSIRKDIFINVSQQD

SEQ ID NO: 3161323 - protein, 19 aa, Giardia lamblia
LELYAQRYGTYGTRFVVDL

SEQ ID NO: 3161324 - protein, 18 aa, Giardia lamblia
LELYVRTPLKAILSGEHS

SEQ ID NO: 3161325 - protein, 23 aa, Giardia lamblia
LEMKCMEDMGIRPLVKEPQYSSN

SEQ ID NO: 3161326 - protein, 20 aa, Giardia lamblia
LEMLVTDGFYLVKASVDPLL

SEQ ID NO: 3161327 - protein, 28 aa, Giardia lamblia
LEMQRFGKFDWVPLLKPQNIRDMVVLEP

SEQ ID NO: 3161328 - protein, 17 aa, Giardia lamblia
LEMSAVEKLIVWDDLPY

SEQ ID NO: 3161329 - protein, 20 aa, Giardia lamblia
LEMVALPKLFHVVFTSAEKA

SEQ ID NO: 3161330 - protein, 17 aa, Giardia lamblia
LENADLREVIRMRVNPV

SEQ ID NO: 3161331 - protein, 19 aa, Giardia lamblia
LENDIGRAFNCTFCDLFVK

SEQ ID NO: 3161332 - protein, 25 aa, Giardia lamblia
LENDWPELARILAPREGGFAYKPGS

SEQ ID NO: 3161333 - protein, 17 aa, Giardia lamblia
LENGIPILHYVPEGRGH

SEQ ID NO: 3161334 - protein, 26 aa, Giardia lamblia
LENKIKFGRKALNESYQLDKDKLTNR

SEQ ID NO: 3161335 - protein, 17 aa, Giardia lamblia
LENLKKDIIVLVTENNP

SEQ ID NO: 3161336 - protein, 26 aa, Giardia lamblia
LENQYQKIFLFKAIFDEIIDKACMEP

SEQ ID NO: 3161337 - protein, 19 aa, Giardia lamblia
LENSIRLGSPVLIENLQDD

SEQ ID NO: 3161338 - protein, 35 aa, Giardia lamblia
LENTHYIFIVVHFWDFQPLVSRAIEFNGTRRQLQL

SEQ ID NO: 3161339 - protein, 19 aa, Giardia lamblia
LENVFGLDSLRHMIDKSGI

SEQ ID NO: 3161340 - protein, 25 aa, Giardia lamblia
LENVKHNAERFILARDEEIARLAEE

SEQ ID NO: 3161341 - protein, 24 aa, Giardia lamblia
LEPDSLRYNLTILLTAITNLLISL

SEQ ID NO: 3161342 - protein, 22 aa, Giardia lamblia
LEPIKKATIRKVMARSYGAAKK

SEQ ID NO: 3161343 - protein, 40 aa, Giardia lamblia
LEPMRKPVRFSHCMHVFCADCVHYLFALWERTCPICNERS

SEQ ID NO: 3161344 - protein, 20 aa, Giardia lamblia
LEPRIKRRSRRKSYKGLQAL

SEQ ID NO: 3161345 - protein, 17 aa, Giardia lamblia
LEPSVSASDRFSSYYSF

SEQ ID NO: 3161346 - protein, 23 aa, Giardia lamblia
LEPTVKAAFSFPNMGPLKADDNA

SEQ ID NO: 3161347 - protein, 31 aa, Giardia lamblia
LEPVPTPDSFCHRLTIDTCLYVEGLDIYMTC

SEQ ID NO: 3161348 - protein, 19 aa, Giardia lamblia
LEQAFPCSVDNITLPSSKH

SEQ ID NO: 3161349 - protein, 17 aa, Giardia lamblia
LEQAKQLPFAMAQVGTV

SEQ ID NO: 3161350 - protein, 17 aa, Giardia lamblia
LEQCAAMLSEPLRRSLV

SEQ ID NO: 3161351 - protein, 24 aa, Giardia lamblia
LEQESRPALFDRAPSKRSTVGSLS

SEQ ID NO: 3161352 - protein, 24 aa, Giardia lamblia
LEQFRGAAVDVCLTAQEVHSFLAG

SEQ ID NO: 3161353 - protein, 35 aa, Giardia lamblia
LEQGISVTLEFKELFAVAIDHGFSVTEMIDGTFAL

SEQ ID NO: 3161354 - protein, 19 aa, Giardia lamblia
LEQHVWRTLSRFGLLLLLL

SEQ ID NO: 3161355 - protein, 17 aa, Giardia lamblia
LEQKVARIHALETRIQD

SEQ ID NO: 3161356 - protein, 21 aa, Giardia lamblia
LEQLKRVTLYLTDVAHLKGSK

SEQ ID NO: 3161357 - protein, 22 aa, Giardia lamblia
LEQLYRNKLRPMNKPTKPSNNH

SEQ ID NO: 3161358 - protein, 24 aa, Giardia lamblia
LEQMDRLQAELLRKDDALKNGQGD

SEQ ID NO: 3161359 - protein, 18 aa, Giardia lamblia
LEQSCFIGTATKNIASYD

SEQ ID NO: 3161360 - protein, 18 aa, Giardia lamblia
LEQTGCLTEDLTSALDQS

SEQ ID NO: 3161361 - protein, 28 aa, Giardia lamblia
LEQYQSCAIESWFLSSFLDKFHIRSSLS

SEQ ID NO: 3161362 - protein, 19 aa, Giardia lamblia
LERAGRLALVTSPTKSTRV

SEQ ID NO: 3161363 - protein, 22 aa, Giardia lamblia
LERCLTEYKKIVLVSVDNVRSF

SEQ ID NO: 3161364 - protein, 24 aa, Giardia lamblia
LERECAASLPLHLESHFRSFMNTM

SEQ ID NO: 3161365 - protein, 29 aa, Giardia lamblia
LERERGRSAPRPASSLAEVGLIGAGVGMR

SEQ ID NO: 3161366 - protein, 18 aa, Giardia lamblia
LERESVLAHRKREADAAE

SEQ ID NO: 3161367 - protein, 24 aa, Giardia lamblia
LERIKELHRLLTIITSLHRLERLE

SEQ ID NO: 3161368 - protein, 22 aa, Giardia lamblia
LERILLKVTCMDLFRVLNFSAE

SEQ ID NO: 3161369 - protein, 20 aa, Giardia lamblia
LERLPVSQFLLGKVRGSKRL

SEQ ID NO: 3161370 - protein, 17 aa, Giardia lamblia
LERLRAEGPFSIQRCAE

SEQ ID NO: 3161371 - protein, 22 aa, Giardia lamblia
LERPGVYLLESFYCLYVFININ

SEQ ID NO: 3161372 - protein, 17 aa, Giardia lamblia
LERQRFRYLRMLIPVAL

SEQ ID NO: 3161373 - protein, 23 aa, Giardia lamblia
LERTKLLELRAIKAEDERDIIST

SEQ ID NO: 3161374 - protein, 17 aa, Giardia lamblia
LERYARNSSAETCNNCK

SEQ ID NO: 3161375 - protein, 17 aa, Giardia lamblia
LERYCRLNFGANHCLIV

SEQ ID NO: 3161376 - protein, 18 aa, Giardia lamblia
LERYNFPVSDYAYKRAMS

SEQ ID NO: 3161377 - protein, 20 aa, Giardia lamblia
LESEGFKLHWIDVDDEGLVK

SEQ ID NO: 3161378 - protein, 21 aa, Giardia lamblia
LESEVLRRLGLYEDTAKHATV

SEQ ID NO: 3161379 - protein, 18 aa, Giardia lamblia
LESHFRSFMNTMLTTETT

SEQ ID NO: 3161380 - protein, 20 aa, Giardia lamblia
LESIAFSLTLGDNVSTGRLW

SEQ ID NO: 3161381 - protein, 21 aa, Giardia lamblia
LESIYDPRLSFITRKNERILS

SEQ ID NO: 3161382 - protein, 23 aa, Giardia lamblia
LESLAGSYGVRWQGFQHQAGSDA

SEQ ID NO: 3161383 - protein, 26 aa, Giardia lamblia
LESLCILMPVEFGLRQDSGKSALEWA

SEQ ID NO: 3161384 - protein, 36 aa, Giardia lamblia
LESLPFSRPFMVLAFPLLWCLNGEYISDEERRLARR

SEQ ID NO: 3161385 - protein, 21 aa, Giardia lamblia
LESNAALLYALFPYPKDSVPT

SEQ ID NO: 3161386 - protein, 24 aa, Giardia lamblia
LESNCNTVSRLASLISTDSQAMSK

SEQ ID NO: 3161387 - protein, 24 aa, Giardia lamblia
LESNTLFLQYDWRDIPQESEGDNS

SEQ ID NO: 3161388 - protein, 27 aa, Giardia lamblia
LESPQLLGICLKKIRGLQHVRVVDAGF

SEQ ID NO: 3161389 - protein, 22 aa, Giardia lamblia
LESRSNSIVALFSQVSHLNAFI

SEQ ID NO: 3161390 - protein, 20 aa, Giardia lamblia
LESVSVLRRLLSPDRKTVAK

SEQ ID NO: 3161391 - protein, 18 aa, Giardia lamblia
LETAIRCGLEDHIDKRQE

SEQ ID NO: 3161392 - protein, 20 aa, Giardia lamblia
LETALFLAVEKEYTHIHDLL

SEQ ID NO: 3161393 - protein, 17 aa, Giardia lamblia
LETAMALAESVGLLDPA

SEQ ID NO: 3161394 - protein, 18 aa, Giardia lamblia
LETELSLLREKRIERAKL

SEQ ID NO: 3161395 - protein, 22 aa, Giardia lamblia
LETFARCLARLAGRLTGISDLD

SEQ ID NO: 3161396 - protein, 18 aa, Giardia lamblia
LETGERTNLILSMADSKN

SEQ ID NO: 3161397 - protein, 22 aa, Giardia lamblia
LETGTRLARRTILLSLLNSYGI

SEQ ID NO: 3161398 - protein, 18 aa, Giardia lamblia
LETIAMGFEALDLENNDA

SEQ ID NO: 3161399 - protein, 25 aa, Giardia lamblia
LETITLLLCYKINYPNDIFLIRGNH

SEQ ID NO: 3161400 - protein, 20 aa, Giardia lamblia
LETITLLYLLKLMYPTQIYL

SEQ ID NO: 3161401 - protein, 24 aa, Giardia lamblia
LETLIDLLLCKYEVPSTASANNCS

SEQ ID NO: 3161402 - protein, 21 aa, Giardia lamblia
LETLSFSQLHTFDYGGVHEAV

SEQ ID NO: 3161403 - protein, 17 aa, Giardia lamblia
LETMIRTSRLRRLQFSK

SEQ ID NO: 3161404 - protein, 18 aa, Giardia lamblia
LETPLAVSYRSYHSSLAL

SEQ ID NO: 3161405 - protein, 21 aa, Giardia lamblia
LETRISGLYGKIKETTADRDK

SEQ ID NO: 3161406 - protein, 20 aa, Giardia lamblia
LETYLRLFADIFLSDEEYVY

SEQ ID NO: 3161407 - protein, 18 aa, Giardia lamblia
LETYQLCVVCMDRLSDCV

SEQ ID NO: 3161408 - protein, 19 aa, Giardia lamblia
LEVAKQRFTKFIQENNEKK

SEQ ID NO: 3161409 - protein, 24 aa, Giardia lamblia
LEVERYFACPVNMKQHVARKPVPK

SEQ ID NO: 3161410 - protein, 22 aa, Giardia lamblia
LEVKKKICEEIGIEIDSENNIL

SEQ ID NO: 3161411 - protein, 24 aa, Giardia lamblia
LEVKQQILELACESTVHYGLSSMA

SEQ ID NO: 3161412 - protein, 17 aa, Giardia lamblia
LEVLERIKYEEMLEQEQ

SEQ ID NO: 3161413 - protein, 25 aa, Giardia lamblia
LEVPGHEWSPMVIPLRVRRYNQIEE

SEQ ID NO: 3161414 - protein, 18 aa, Giardia lamblia
LEVSRLMTRAMHLAMTDQ

SEQ ID NO: 3161415 - protein, 27 aa, Giardia lamblia
LEVTRKYLQDTWRLALDPPDPEKKKKK

SEQ ID NO: 3161416 - protein, 21 aa, Giardia lamblia
LEVVEALLPYEGMLQDYEGKT

SEQ ID NO: 3161417 - protein, 20 aa, Giardia lamblia
LEVVKLLFEKEGHLIDKSDE

SEQ ID NO: 3161418 - protein, 18 aa, Giardia lamblia
LEVVPRLLAETAGLPADE

SEQ ID NO: 3161419 - protein, 21 aa, Giardia lamblia
LEWRDRKLLFHAFLEMKVRAL

SEQ ID NO: 3161420 - protein, 18 aa, Giardia lamblia
LEYAIFLATEPIREDILE

SEQ ID NO: 3161421 - protein, 17 aa, Giardia lamblia
LEYEQWRKFFSLYGLCK

SEQ ID NO: 3161422 - protein, 25 aa, Giardia lamblia
LEYIRASLRLYDWIVTKELLGQKKV

SEQ ID NO: 3161423 - protein, 17 aa, Giardia lamblia
LEYLFNILRSLPLTESV

SEQ ID NO: 3161424 - protein, 22 aa, Giardia lamblia
LEYRKSHNSTIIFDRNKLKYMR

SEQ ID NO: 3161425 - protein, 26 aa, Giardia lamblia
LFAGMSNGCLVAWDMRYEPSPLARVV

SEQ ID NO: 3161426 - protein, 18 aa, Giardia lamblia
LFAQLVSALHYLHKTNEH

SEQ ID NO: 3161427 - protein, 24 aa, Giardia lamblia
LFASLSILVGVPFDIHLVDSSGTL

SEQ ID NO: 3161428 - protein, 18 aa, Giardia lamblia
LFATMPLCCLINKEIFCT

SEQ ID NO: 3161429 - protein, 19 aa, Giardia lamblia
LFCFMHRDLDPDKLLAQYS

SEQ ID NO: 3161430 - protein, 17 aa, Giardia lamblia
LFCLKLLAEYGPLRDGQ

SEQ ID NO: 3161431 - protein, 17 aa, Giardia lamblia
LFCMVPYSASLDYSISM

SEQ ID NO: 3161432 - protein, 25 aa, Giardia lamblia
LFCQCLCLFTKLFLDSKTLFYDTDI

SEQ ID NO: 3161433 - protein, 19 aa, Giardia lamblia
LFCQLVILANYLVESVPEE

SEQ ID NO: 3161434 - protein, 22 aa, Giardia lamblia
LFDEHIVRAGAHIKQRSSSEST

SEQ ID NO: 3161435 - protein, 19 aa, Giardia lamblia
LFDFSRYACLSNFAHAGAG

SEQ ID NO: 3161436 - protein, 18 aa, Giardia lamblia
LFDGEYSYGAVLRGRKTL

SEQ ID NO: 3161437 - protein, 17 aa, Giardia lamblia
LFDKCYGYIDIIKDDLK

SEQ ID NO: 3161438 - protein, 20 aa, Giardia lamblia
LFDLQENKWHSVTITGLAPS

SEQ ID NO: 3161439 - protein, 18 aa, Giardia lamblia
LFDTVPLLLQDTPLTDSV

SEQ ID NO: 3161440 - protein, 17 aa, Giardia lamblia
LFEEAGVVFSGLSTESS

SEQ ID NO: 3161441 - protein, 28 aa, Giardia lamblia
LFERHKLMFSFQLCTSIITTEYPPDTIP

SEQ ID NO: 3161442 - protein, 27 aa, Giardia lamblia
LFESVLGIPGFLVWSAVPIMISHYSNI

SEQ ID NO: 3161443 - protein, 19 aa, Giardia lamblia
LFFELPTYAFLRRIVLAAQ

SEQ ID NO: 3161444 - protein, 17 aa, Giardia lamblia
LFFRRFGSHAVTITSVS

SEQ ID NO: 3161445 - protein, 17 aa, Giardia lamblia
LFGHLGKLLAQITELSA

SEQ ID NO: 3161446 - protein, 18 aa, Giardia lamblia
LFGLSAKETLDFLRANLI

SEQ ID NO: 3161447 - protein, 25 aa, Giardia lamblia
LFGTPLICRYYPIMFQPGRRVNDWD

SEQ ID NO: 3161448 - protein, 17 aa, Giardia lamblia
LFHPCLNVRAILSSSPL

SEQ ID NO: 3161449 - protein, 26 aa, Giardia lamblia
LFIDEFRLLRHFGWTTLMIGTVFTFT

SEQ ID NO: 3161450 - protein, 30 aa, Giardia lamblia
LFISDKIRFPCLFPSATRVDPSDPRRGYEG

SEQ ID NO: 3161451 - protein, 18 aa, Giardia lamblia
LFKLYKHTARKLVPAQDA

SEQ ID NO: 3161452 - protein, 20 aa, Giardia lamblia
LFKQELRKYLDPRIDEDALF

SEQ ID NO: 3161453 - protein, 25 aa, Giardia lamblia
LFKTGRITWNDVIAWMNCGSTDIPL

SEQ ID NO: 3161454 - protein, 25 aa, Giardia lamblia
LFKWSPRGLPCYIPLPQNVADVKLK

SEQ ID NO: 3161455 - protein, 26 aa, Giardia lamblia
LFLEVEHLRMVASFVPEKEETIRKQL

SEQ ID NO: 3161456 - protein, 27 aa, Giardia lamblia
LFLGASLCGLRLGLQTNTAFNPDGEMS

SEQ ID NO: 3161457 - protein, 18 aa, Giardia lamblia
LFLLIAGLLHPNPKARMS

SEQ ID NO: 3161458 - protein, 19 aa, Giardia lamblia
LFLRHYIVEVLRPHLDFDL

SEQ ID NO: 3161459 - protein, 19 aa, Giardia lamblia
LFLVNGAIYSGDFLNCKRH

SEQ ID NO: 3161460 - protein, 18 aa, Giardia lamblia
LFLYSRRAVGLSTETIAL

SEQ ID NO: 3161461 - protein, 20 aa, Giardia lamblia
LFNEFIYRITTNEFEERNLP

SEQ ID NO: 3161462 - protein, 19 aa, Giardia lamblia
LFNISRWCDNFVLTMMLAY

SEQ ID NO: 3161463 - protein, 18 aa, Giardia lamblia
LFNLERFSYDLISQLRYS

SEQ ID NO: 3161464 - protein, 18 aa, Giardia lamblia
LFNLLNFIEPEVFPNIDV

SEQ ID NO: 3161465 - protein, 17 aa, Giardia lamblia
LFNNWLAKYKDLILNLT

SEQ ID NO: 3161466 - protein, 25 aa, Giardia lamblia
LFPCSCTALSIARAAKHYDVVNLLS

SEQ ID NO: 3161467 - protein, 19 aa, Giardia lamblia
LFPDPRVRISDGYISAGAD

SEQ ID NO: 3161468 - protein, 22 aa, Giardia lamblia
LFPESIPFLVHYLKDKPDGRGM

SEQ ID NO: 3161469 - protein, 18 aa, Giardia lamblia
LFPIAFKIVTLLNLDFFI

SEQ ID NO: 3161470 - protein, 18 aa, Giardia lamblia
LFPILPMDHDLRINVAIS

SEQ ID NO: 3161471 - protein, 17 aa, Giardia lamblia
LFPYEKLIVRKDGSTAL

SEQ ID NO: 3161472 - protein, 18 aa, Giardia lamblia
LFQLRTSKLLEVLSGHTG

SEQ ID NO: 3161473 - protein, 21 aa, Giardia lamblia
LFRAEAFVKLPYDNLEDAHKY

SEQ ID NO: 3161474 - protein, 17 aa, Giardia lamblia
LFREISNMLSLSLKDVA

SEQ ID NO: 3161475 - protein, 18 aa, Giardia lamblia
LFRHENLRTYDHFYDGFL

SEQ ID NO: 3161476 - protein, 20 aa, Giardia lamblia
LFRPKDYFIAGGILAKDLNL

SEQ ID NO: 3161477 - protein, 21 aa, Giardia lamblia
LFRQLPPGLITSARNLRRSTI

SEQ ID NO: 3161478 - protein, 18 aa, Giardia lamblia
LFRQRFEGLPSSFTGITG

SEQ ID NO: 3161479 - protein, 20 aa, Giardia lamblia
LFRRSLASMRWRLHQADLEA

SEQ ID NO: 3161480 - protein, 19 aa, Giardia lamblia
LFRYMKKKYCTSSEMKKAT

SEQ ID NO: 3161481 - protein, 28 aa, Giardia lamblia
LFSAIAGDLKLTFSDGGLAQVLTPIGNM

SEQ ID NO: 3161482 - protein, 17 aa, Giardia lamblia
LFSGCTDIYLTLASVYG

SEQ ID NO: 3161483 - protein, 23 aa, Giardia lamblia
LFSLFNTVPMFGVWINTPLIQSI

SEQ ID NO: 3161484 - protein, 20 aa, Giardia lamblia
LFTAVFWNRCECVKVLAPTE

SEQ ID NO: 3161485 - protein, 17 aa, Giardia lamblia
LFTESKTLASRVQQQQA

SEQ ID NO: 3161486 - protein, 18 aa, Giardia lamblia
LFTNRLLLLLSLDAEVVK

SEQ ID NO: 3161487 - protein, 26 aa, Giardia lamblia
LFTQRLLLRRLCAFINQGTLSLSDNS

SEQ ID NO: 3161488 - protein, 27 aa, Giardia lamblia
LFVALKNKCSFSYKYLISKEGNLSIGT

SEQ ID NO: 3161489 - protein, 26 aa, Giardia lamblia
LFVRHKLAFAFDICLSLQRTSGEISN

SEQ ID NO: 3161490 - protein, 17 aa, Giardia lamblia
LFYLRDDICKWRLMLLY

SEQ ID NO: 3161491 - protein, 30 aa, Giardia lamblia
LFYMLRHVDCLHYLEFGRVAGAFVYNNGVI

SEQ ID NO: 3161492 - protein, 24 aa, Giardia lamblia
LFYPHIDLKYMIGYSVDEDTSLTA

SEQ ID NO: 3161493 - protein, 19 aa, Giardia lamblia
LFYRGGCYSVNGPLTQAIC

SEQ ID NO: 3161494 - protein, 17 aa, Giardia lamblia
LGAAFAISRACFTNYEG

SEQ ID NO: 3161495 - protein, 32 aa, Giardia lamblia
LGAEFQKTSRCRFIFCRFFNVYGPRQDPSSPY

SEQ ID NO: 3161496 - protein, 23 aa, Giardia lamblia
LGALRFSPSRARIRHLSLECNRL

SEQ ID NO: 3161497 - protein, 21 aa, Giardia lamblia
LGANWTREFDKYMSAAEDHYL

SEQ ID NO: 3161498 - protein, 20 aa, Giardia lamblia
LGAQEKYAFLFGEDSVESSA

SEQ ID NO: 3161499 - protein, 17 aa, Giardia lamblia
LGASDVRSFPFVTHPGP

SEQ ID NO: 3161500 - protein, 27 aa, Giardia lamblia
LGASNFIRRRRCKDLTEQSSPLSFQAS

SEQ ID NO: 3161501 - protein, 18 aa, Giardia lamblia
LGASVPKGVFPINFGERA

SEQ ID NO: 3161502 - protein, 23 aa, Giardia lamblia
LGCIILEICTLKPIPWSTEHLKD

SEQ ID NO: 3161503 - protein, 26 aa, Giardia lamblia
LGCILYECLTGMPAFMGDVELAIMQA

SEQ ID NO: 3161504 - protein, 24 aa, Giardia lamblia
LGCILYELCCLDPAINLSVDDDAA

SEQ ID NO: 3161505 - protein, 26 aa, Giardia lamblia
LGCLLFPSACVYYFYGAEVQTLSLRL

SEQ ID NO: 3161506 - protein, 27 aa, Giardia lamblia
LGCMIFEILCLKTAFQAKNINTLIMKI

SEQ ID NO: 3161507 - protein, 22 aa, Giardia lamblia
LGCSTYRFLQQYTRRRSSRPAI

SEQ ID NO: 3161508 - protein, 18 aa, Giardia lamblia
LGCTIWAICTLKHPRFSR

SEQ ID NO: 3161509 - protein, 24 aa, Giardia lamblia
LGCTMYEIMMKRVLVEDNPEEPLE

SEQ ID NO: 3161510 - protein, 19 aa, Giardia lamblia
LGCTSCIVICRRFSVNTHF

SEQ ID NO: 3161511 - protein, 25 aa, Giardia lamblia
LGDAFLKCSLALHLHALHPTLTEGA

SEQ ID NO: 3161512 - protein, 17 aa, Giardia lamblia
LGDGSAPIWPANSDGCN

SEQ ID NO: 3161513 - protein, 26 aa, Giardia lamblia
LGDHCIKNLVTCDPFLRSYPRYPTPD

SEQ ID NO: 3161514 - protein, 17 aa, Giardia lamblia
LGDIPIWVEAAGVSRNG

SEQ ID NO: 3161515 - protein, 19 aa, Giardia lamblia
LGDLFDFVPANFILPMEFG

SEQ ID NO: 3161516 - protein, 28 aa, Giardia lamblia
LGDPISMLLEIQMIYSLYLGKDTLEYGH

SEQ ID NO: 3161517 - protein, 24 aa, Giardia lamblia
LGDRYEIISRLGVGSFGVVYKVKR

SEQ ID NO: 3161518 - protein, 18 aa, Giardia lamblia
LGEAPAWSLKGRHPQKGE

SEQ ID NO: 3161519 - protein, 19 aa, Giardia lamblia
LGFCFARCITPMGTLPENI

SEQ ID NO: 3161520 - protein, 23 aa, Giardia lamblia
LGFEVQDALAFLKMDNLYIDTFD

SEQ ID NO: 3161521 - protein, 17 aa, Giardia lamblia
LGFSQVVSHLLDYESGY

SEQ ID NO: 3161522 - protein, 23 aa, Giardia lamblia
LGFYPHRRRTLLFHPDGERCIYS

SEQ ID NO: 3161523 - protein, 17 aa, Giardia lamblia
LGGCACFPLQFNPPDLL

SEQ ID NO: 3161524 - protein, 20 aa, Giardia lamblia
LGGLFPGLVSLLIGVLKNDK

SEQ ID NO: 3161525 - protein, 17 aa, Giardia lamblia
LGGLIAGLKEALREHKD

SEQ ID NO: 3161526 - protein, 21 aa, Giardia lamblia
LGGLTLLRLIRCRITNIEEAA

SEQ ID NO: 3161527 - protein, 24 aa, Giardia lamblia
LGGNSRATLMINISPSNDMIQETV

SEQ ID NO: 3161528 - protein, 17 aa, Giardia lamblia
LGGSSGISLDRSEKRAV

SEQ ID NO: 3161529 - protein, 24 aa, Giardia lamblia
LGGSVCRECKATGHGRLIQIPMVL

SEQ ID NO: 3161530 - protein, 18 aa, Giardia lamblia
LGHLSRLTELYVVGNPLT

SEQ ID NO: 3161531 - protein, 21 aa, Giardia lamblia
LGHPRVPPSLIKAEAKIKDTD

SEQ ID NO: 3161532 - protein, 24 aa, Giardia lamblia
LGHTECAHFLLNKEAPIKHSTGRR

SEQ ID NO: 3161533 - protein, 25 aa, Giardia lamblia
LGHVECIPLLLAESYATTAAGTTAL

SEQ ID NO: 3161534 - protein, 19 aa, Giardia lamblia
LGICAALRKLGSKTDLVLR

SEQ ID NO: 3161535 - protein, 27 aa, Giardia lamblia
LGIDGTCLRASGLTPLMRAVISGKDLD

SEQ ID NO: 3161536 - protein, 17 aa, Giardia lamblia
LGILRPTTIIFPPSDEP

SEQ ID NO: 3161537 - protein, 17 aa, Giardia lamblia
LGIMLYAMLIGKLPFPS

SEQ ID NO: 3161538 - protein, 17 aa, Giardia lamblia
LGIPVKRIKMILKTAYK

SEQ ID NO: 3161539 - protein, 25 aa, Giardia lamblia
LGIPVYKGRVFLGTFLPRSEPYIYF

SEQ ID NO: 3161540 - protein, 17 aa, Giardia lamblia
LGISRITDETVKLRETA

SEQ ID NO: 3161541 - protein, 17 aa, Giardia lamblia
LGISTVLKGFYCPMIQS

SEQ ID NO: 3161542 - protein, 43 aa, Giardia lamblia
LGKELRFALLDTLSRLTICTNLSRFGASIIHPILEVIMEADPC

SEQ ID NO: 3161543 - protein, 17 aa, Giardia lamblia
LGKGLKQGINMLRIIVD

SEQ ID NO: 3161544 - protein, 19 aa, Giardia lamblia
LGKISRATLLRRMQQNNSA

SEQ ID NO: 3161545 - protein, 21 aa, Giardia lamblia
LGKKCLGMFSSHLALGANSLI

SEQ ID NO: 3161546 - protein, 18 aa, Giardia lamblia
LGKLFLKADEFLSITEQY

SEQ ID NO: 3161547 - protein, 24 aa, Giardia lamblia
LGKSVGDRLLLSGYFRDDPPNIAL

SEQ ID NO: 3161548 - protein, 18 aa, Giardia lamblia
LGLDHPFRMDESALPEYD

SEQ ID NO: 3161549 - protein, 32 aa, Giardia lamblia
LGLDPARLRFRQHLPKQLAHYARDCWDCDCLL

SEQ ID NO: 3161550 - protein, 18 aa, Giardia lamblia
LGLEFEHFTITYTATDNK

SEQ ID NO: 3161551 - protein, 28 aa, Giardia lamblia
LGLGEARPEKKWGHGIPEAELERLRKKN

SEQ ID NO: 3161552 - protein, 19 aa, Giardia lamblia
LGLGEPLGLYARDSSVQIR

SEQ ID NO: 3161553 - protein, 19 aa, Giardia lamblia
LGLIGIGGLMASGSYTSHR

SEQ ID NO: 3161554 - protein, 18 aa, Giardia lamblia
LGLIPLRTAGSLSAISYW

SEQ ID NO: 3161555 - protein, 23 aa, Giardia lamblia
LGLLPRSIVELFNLIEADTSQSQ

SEQ ID NO: 3161556 - protein, 21 aa, Giardia lamblia
LGLLSEFPTFVPKLLGLQLPR

SEQ ID NO: 3161557 - protein, 19 aa, Giardia lamblia
LGLLSGFRCLDLVTPLQCC

SEQ ID NO: 3161558 - protein, 17 aa, Giardia lamblia
LGLNGNFIGLAGIDGPA

SEQ ID NO: 3161559 - protein, 17 aa, Giardia lamblia
LGLPHLFDSSFRRFSLN

SEQ ID NO: 3161560 - protein, 31 aa, Giardia lamblia
LGLSSPVCSTVLCIREIIDIIANACLQDKHL

SEQ ID NO: 3161561 - protein, 23 aa, Giardia lamblia
LGLTPVVCLLASYLSELTLLDPR

SEQ ID NO: 3161562 - protein, 27 aa, Giardia lamblia
LGLTRRLKYAVLRARELEGKLKSQEKY

SEQ ID NO: 3161563 - protein, 21 aa, Giardia lamblia
LGMQRRYFLKLLLHGYILEAQ

SEQ ID NO: 3161564 - protein, 26 aa, Giardia lamblia
LGMSPRIGNSCYLVIVGSKVSFLLDC

SEQ ID NO: 3161565 - protein, 18 aa, Giardia lamblia
LGMTALFLCESHYLVVGS

SEQ ID NO: 3161566 - protein, 20 aa, Giardia lamblia
LGNCFPPDVCVESIACKATI

SEQ ID NO: 3161567 - protein, 24 aa, Giardia lamblia
LGNDRKYLLGVKVPIASSILLNDK

SEQ ID NO: 3161568 - protein, 25 aa, Giardia lamblia
LGNGEIRTGKVLECHGSQAVLQVFE

SEQ ID NO: 3161569 - protein, 18 aa, Giardia lamblia
LGNIAAIKLLMAKEGGMT

SEQ ID NO: 3161570 - protein, 22 aa, Giardia lamblia
LGNLKDFRFWWASQEAKEACAN

SEQ ID NO: 3161571 - protein, 23 aa, Giardia lamblia
LGNLMAAIPLCPRMSKLVVKSVL

SEQ ID NO: 3161572 - protein, 25 aa, Giardia lamblia
LGNMSGGLTQFWASWLDLASTVQTD

SEQ ID NO: 3161573 - protein, 20 aa, Giardia lamblia
LGNSHSTGFFAIYDGHGGQE

SEQ ID NO: 3161574 - protein, 30 aa, Giardia lamblia
LGPDVPLEKSIRFSTRIEVIEEGENGVIER

SEQ ID NO: 3161575 - protein, 25 aa, Giardia lamblia
LGPEEPLTRLAIRPLVQKALQKQFL

SEQ ID NO: 3161576 - protein, 28 aa, Giardia lamblia
LGPQFTLKLKWLQKGLFDPHNEEYEWFY

SEQ ID NO: 3161577 - protein, 18 aa, Giardia lamblia
LGPSPVFAAFLDDLAADM

SEQ ID NO: 3161578 - protein, 24 aa, Giardia lamblia
LGPSQAYSCIIFVDICTCTTQTPL

SEQ ID NO: 3161579 - protein, 19 aa, Giardia lamblia
LGPTLRGSALYYRVLHMGV

SEQ ID NO: 3161580 - protein, 20 aa, Giardia lamblia
LGQGRFAASVLQDSSGGEDV

SEQ ID NO: 3161581 - protein, 24 aa, Giardia lamblia
LGQKADCSGLLSATEFINRVLQDL

SEQ ID NO: 3161582 - protein, 26 aa, Giardia lamblia
LGQKAGVTALCFDRSSDGVIAACSDS

SEQ ID NO: 3161583 - protein, 17 aa, Giardia lamblia
LGRCLTDAIAASDNVEA

SEQ ID NO: 3161584 - protein, 19 aa, Giardia lamblia
LGRDELRGDSRNGTRPRSS

SEQ ID NO: 3161585 - protein, 17 aa, Giardia lamblia
LGRLALRCLDWEESRVS

SEQ ID NO: 3161586 - protein, 18 aa, Giardia lamblia
LGRLYKAVCDVGGCMVII

SEQ ID NO: 3161587 - protein, 25 aa, Giardia lamblia
LGRMNAKIRQCEGMKNTVEERRQVG

SEQ ID NO: 3161588 - protein, 21 aa, Giardia lamblia
LGRPIESVIILDNCAASYMFQ

SEQ ID NO: 3161589 - protein, 23 aa, Giardia lamblia
LGRQRDCPYSRSISIKLHDLNAY

SEQ ID NO: 3161590 - protein, 19 aa, Giardia lamblia
LGSCLYSYSLCSFICSCLQ

SEQ ID NO: 3161591 - protein, 30 aa, Giardia lamblia
LGSCNICLNKISSMKCYPCNHTVCCEECAE

SEQ ID NO: 3161592 - protein, 21 aa, Giardia lamblia
LGSICIPKPLFITTTMIGLEF

SEQ ID NO: 3161593 - protein, 18 aa, Giardia lamblia
LGSLKIAYRSLLENMNET

SEQ ID NO: 3161594 - protein, 18 aa, Giardia lamblia
LGSLLKRLDDIYAGRYDM

SEQ ID NO: 3161595 - protein, 18 aa, Giardia lamblia
LGSLSLEGDKAWFRTGNQ

SEQ ID NO: 3161596 - protein, 24 aa, Giardia lamblia
LGSPLPGPYSLGFQLVINVNESPG

SEQ ID NO: 3161597 - protein, 18 aa, Giardia lamblia
LGSPRQHLLLGFEDGTLV

SEQ ID NO: 3161598 - protein, 19 aa, Giardia lamblia
LGSRFCRNPENIGQEDKDR

SEQ ID NO: 3161599 - protein, 27 aa, Giardia lamblia
LGTDGKPCQRCHQCLEHITLQTLFKTI

SEQ ID NO: 3161600 - protein, 19 aa, Giardia lamblia
LGTFLPRSEPYIYFMSEEC

SEQ ID NO: 3161601 - protein, 18 aa, Giardia lamblia
LGTRELARAIAVTRHVGH

SEQ ID NO: 3161602 - protein, 24 aa, Giardia lamblia
LGTSHLKLALSTVAKSGTIPPKPP

SEQ ID NO: 3161603 - protein, 24 aa, Giardia lamblia
LGVCTICLSDLCIMTCIPCGHRCA

SEQ ID NO: 3161604 - protein, 19 aa, Giardia lamblia
LGVEFREPYEVKKYGSSIS

SEQ ID NO: 3161605 - protein, 25 aa, Giardia lamblia
LGVFVRTSHRIIWFSPANESYNVSI

SEQ ID NO: 3161606 - protein, 20 aa, Giardia lamblia
LGVLDFICKKGKAFMPSAKC

SEQ ID NO: 3161607 - protein, 22 aa, Giardia lamblia
LGVPMDCWRDLAIAALLSNELD

SEQ ID NO: 3161608 - protein, 23 aa, Giardia lamblia
LGVPSCASPGFSHLPHPATPVYF

SEQ ID NO: 3161609 - protein, 19 aa, Giardia lamblia
LGVRTASFLKVIKFCSNDD

SEQ ID NO: 3161610 - protein, 18 aa, Giardia lamblia
LGVYTASCSVIFEHDYSK

SEQ ID NO: 3161611 - protein, 17 aa, Giardia lamblia
LGYKAGCTHVMRFIDHR

SEQ ID NO: 3161612 - protein, 19 aa, Giardia lamblia
LGYKAKRGYVVYRVRVRRG

SEQ ID NO: 3161613 - protein, 25 aa, Giardia lamblia
LGYSVPEPVPLVHRGPLTFAAELHA

SEQ ID NO: 3161614 - protein, 19 aa, Giardia lamblia
LGYYLCSLAPVVSGSDSAL

SEQ ID NO: 3161615 - protein, 22 aa, Giardia lamblia
LHAHSARIVAPVVPPELDPEQI

SEQ ID NO: 3161616 - protein, 17 aa, Giardia lamblia
LHAKFGSVVLRDFIVGT

SEQ ID NO: 3161617 - protein, 26 aa, Giardia lamblia
LHALCGPRGTILCAPRSCILSAITDM

SEQ ID NO: 3161618 - protein, 24 aa, Giardia lamblia
LHANMPRFIKFMIQDVNLHPYIMV

SEQ ID NO: 3161619 - protein, 29 aa, Giardia lamblia
LHAVRLTKVLLLRQLRLKVFSDRHTLSTP

SEQ ID NO: 3161620 - protein, 24 aa, Giardia lamblia
LHAYGYCVDVIFIILSLLNRDNLA

SEQ ID NO: 3161621 - protein, 19 aa, Giardia lamblia
LHCGLPFETVAKMVIPQRK

SEQ ID NO: 3161622 - protein, 18 aa, Giardia lamblia
LHCVKLLLCEMGIQNSGM

SEQ ID NO: 3161623 - protein, 24 aa, Giardia lamblia
LHDKIRRMRQARADLEAAEEYIRA

SEQ ID NO: 3161624 - protein, 30 aa, Giardia lamblia
LHDPYAWPDFRPRPHLLLSPSNIIVGPDDS

SEQ ID NO: 3161625 - protein, 17 aa, Giardia lamblia
LHDRAGQRYFLFMEQVK

SEQ ID NO: 3161626 - protein, 24 aa, Giardia lamblia
LHDRKCPLCTTPITSFFSLNYDLP

SEQ ID NO: 3161627 - protein, 24 aa, Giardia lamblia
LHDTHYRTALMIACEANNIEAVHL

SEQ ID NO: 3161628 - protein, 20 aa, Giardia lamblia
LHEADACFIYCRTSAARALL

SEQ ID NO: 3161629 - protein, 17 aa, Giardia lamblia
LHEIFVLCPPITDSKRI

SEQ ID NO: 3161630 - protein, 20 aa, Giardia lamblia
LHELLVFKSVQTVRELFTVD

SEQ ID NO: 3161631 - protein, 18 aa, Giardia lamblia
LHESCLSLLNKAMELKLA

SEQ ID NO: 3161632 - protein, 17 aa, Giardia lamblia
LHFFCTISAKTDTMSAI

SEQ ID NO: 3161633 - protein, 21 aa, Giardia lamblia
LHFFSIRGFRSHSLGCLFCLR

SEQ ID NO: 3161634 - protein, 18 aa, Giardia lamblia
LHFVMCLQCGSRPRYDGM

SEQ ID NO: 3161635 - protein, 19 aa, Giardia lamblia
LHGILPRRSPLGTLEYTSQ

SEQ ID NO: 3161636 - protein, 23 aa, Giardia lamblia
LHGMPHDRVFGVYKEGYYTLINT

SEQ ID NO: 3161637 - protein, 18 aa, Giardia lamblia
LHGPSLLSELVRSMLSAL

SEQ ID NO: 3161638 - protein, 17 aa, Giardia lamblia
LHGVYAYISQVGHVNAC

SEQ ID NO: 3161639 - protein, 25 aa, Giardia lamblia
LHHDEFYPYLLAFLISHDTKKALRF

SEQ ID NO: 3161640 - protein, 25 aa, Giardia lamblia
LHHDPLELLPLVSTYCSLDNNASTN

SEQ ID NO: 3161641 - protein, 17 aa, Giardia lamblia
LHHIVELAGQLGKKYAF

SEQ ID NO: 3161642 - protein, 19 aa, Giardia lamblia
LHHLLECVYEYRGDERLSF

SEQ ID NO: 3161643 - protein, 17 aa, Giardia lamblia
LHHRSNLRDVPEQNEED

SEQ ID NO: 3161644 - protein, 22 aa, Giardia lamblia
LHICAMKNYAPVAVILSGKEAG

SEQ ID NO: 3161645 - protein, 27 aa, Giardia lamblia
LHICDPRGRTALHYAVEAKNTNFLELF

SEQ ID NO: 3161646 - protein, 19 aa, Giardia lamblia
LHIHLSPGATPLMVAVIRG

SEQ ID NO: 3161647 - protein, 17 aa, Giardia lamblia
LHKALDYGIFEFKTTRD

SEQ ID NO: 3161648 - protein, 21 aa, Giardia lamblia
LHKCSELWQLALVGVMNEDPA

SEQ ID NO: 3161649 - protein, 18 aa, Giardia lamblia
LHKDAEFVIEPYHTSVRL

SEQ ID NO: 3161650 - protein, 17 aa, Giardia lamblia
LHKGMTPLLLAIQSSSL

SEQ ID NO: 3161651 - protein, 26 aa, Giardia lamblia
LHKGTCLRIAGAYWRTGYAREHCTPN

SEQ ID NO: 3161652 - protein, 17 aa, Giardia lamblia
LHKKMLLLANSLNVDDD

SEQ ID NO: 3161653 - protein, 24 aa, Giardia lamblia
LHKYREFLHAAFILGGVDNTGFHC

SEQ ID NO: 3161654 - protein, 18 aa, Giardia lamblia
LHLDLFLLIAGLLHPNPK

SEQ ID NO: 3161655 - protein, 17 aa, Giardia lamblia
LHLGALFTSLGALRKKR

SEQ ID NO: 3161656 - protein, 18 aa, Giardia lamblia
LHLLLQRYFSLLKDSLNE

SEQ ID NO: 3161657 - protein, 22 aa, Giardia lamblia
LHLPTQFFKNFRCERACSLGVR

SEQ ID NO: 3161658 - protein, 17 aa, Giardia lamblia
LHLPWLVNALHRAYAVT

SEQ ID NO: 3161659 - protein, 18 aa, Giardia lamblia
LHLTASMGVSTWLNNFTA

SEQ ID NO: 3161660 - protein, 19 aa, Giardia lamblia
LHMVELMLMPSRLDVDTTL

SEQ ID NO: 3161661 - protein, 17 aa, Giardia lamblia
LHNLMIFSISYDNLMQC

SEQ ID NO: 3161662 - protein, 25 aa, Giardia lamblia
LHNRLEIVEILAPYEAGMQQSCDNA

SEQ ID NO: 3161663 - protein, 17 aa, Giardia lamblia
LHNSLWCSQPFVPDNLS

SEQ ID NO: 3161664 - protein, 17 aa, Giardia lamblia
LHPKAMVLYGYDMPPLL

SEQ ID NO: 3161665 - protein, 23 aa, Giardia lamblia
LHPNLYASLVCKLVHVSEQELRR

SEQ ID NO: 3161666 - protein, 25 aa, Giardia lamblia
LHRAKWRPDPSLKLQNGDIHSGLVS

SEQ ID NO: 3161667 - protein, 22 aa, Giardia lamblia
LHRGQGFYCMAVYATASYVWRL

SEQ ID NO: 3161668 - protein, 23 aa, Giardia lamblia
LHRRKSLVRIKFVRIVNDIYFSN

SEQ ID NO: 3161669 - protein, 18 aa, Giardia lamblia
LHSACGDVAWSHIRCHSL

SEQ ID NO: 3161670 - protein, 19 aa, Giardia lamblia
LHSGHLKIAGDVMSKSKKN

SEQ ID NO: 3161671 - protein, 25 aa, Giardia lamblia
LHSGLLCSFELPFNMLAFDIVGVAV

SEQ ID NO: 3161672 - protein, 21 aa, Giardia lamblia
LHSIFLSKYKKAVDVLTQSLQ

SEQ ID NO: 3161673 - protein, 24 aa, Giardia lamblia
LHSKGCSHRDLKLENILILEPYDL

SEQ ID NO: 3161674 - protein, 20 aa, Giardia lamblia
LHSLLPWGNHKVLICQNWTI

SEQ ID NO: 3161675 - protein, 19 aa, Giardia lamblia
LHSQLLLKEATFCRASGLA

SEQ ID NO: 3161676 - protein, 22 aa, Giardia lamblia
LHSRPAGSFCCRPTLCHIRNTS

SEQ ID NO: 3161677 - protein, 19 aa, Giardia lamblia
LHSTYKLAADRWVQLGNSK

SEQ ID NO: 3161678 - protein, 18 aa, Giardia lamblia
LHTGYPLEVVCCNSANGF

SEQ ID NO: 3161679 - protein, 24 aa, Giardia lamblia
LHTKARCPMCLSTQSVNLPPCTLY

SEQ ID NO: 3161680 - protein, 18 aa, Giardia lamblia
LHTKKMTKSIEMADDETL

SEQ ID NO: 3161681 - protein, 23 aa, Giardia lamblia
LHTKSQCQIYIPIIKQYAKSIAK

SEQ ID NO: 3161682 - protein, 20 aa, Giardia lamblia
LHTRRCTTLEKVIPELSLDH

SEQ ID NO: 3161683 - protein, 25 aa, Giardia lamblia
LHTTRLEEHLKKRLDERDKQISVLT

SEQ ID NO: 3161684 - protein, 17 aa, Giardia lamblia
LHVASLFEDWIQNPADR

SEQ ID NO: 3161685 - protein, 24 aa, Giardia lamblia
LHVFGEPLIAFGERLVIFTTFASL

SEQ ID NO: 3161686 - protein, 25 aa, Giardia lamblia
LHVSPELRELILLCLEHSPKDRITM

SEQ ID NO: 3161687 - protein, 17 aa, Giardia lamblia
LHYAAARSALRKPVSDM

SEQ ID NO: 3161688 - protein, 17 aa, Giardia lamblia
LHYLRSKLDAFMLRHQV

SEQ ID NO: 3161689 - protein, 22 aa, Giardia lamblia
LHYRQYKFVRFDGSVKDVDRNS

SEQ ID NO: 3161690 - protein, 26 aa, Giardia lamblia
LIAANCLTGLPGAVVRVIYRNRLSPA

SEQ ID NO: 3161691 - protein, 23 aa, Giardia lamblia
LIACGTETGVLLIYHSFSMQLVR

SEQ ID NO: 3161692 - protein, 17 aa, Giardia lamblia
LIAEGVCAAEAEMVTQK

SEQ ID NO: 3161693 - protein, 18 aa, Giardia lamblia
LIAGLGTEKVRWGQAADK

SEQ ID NO: 3161694 - protein, 17 aa, Giardia lamblia
LIALKPLIIFVTTKHET

SEQ ID NO: 3161695 - protein, 19 aa, Giardia lamblia
LICAACIGDADAVRSNLQE

SEQ ID NO: 3161696 - protein, 25 aa, Giardia lamblia
LICRFKECMRKVFLDKSTHGSSAEV

SEQ ID NO: 3161697 - protein, 18 aa, Giardia lamblia
LICSSKRCLAYVRDNFSV

SEQ ID NO: 3161698 - protein, 21 aa, Giardia lamblia
LICTSCASSALYTEKALLTIT

SEQ ID NO: 3161699 - protein, 20 aa, Giardia lamblia
LIDFCLFPVMVNSCLCYLNT

SEQ ID NO: 3161700 - protein, 24 aa, Giardia lamblia
LIDIPQDCRSLFTVEQDKAVSSVG

SEQ ID NO: 3161701 - protein, 18 aa, Giardia lamblia
LIDKEARMLTKRIHEHGA

SEQ ID NO: 3161702 - protein, 20 aa, Giardia lamblia
LIDPECQGVRFLKRLEEKNG

SEQ ID NO: 3161703 - protein, 25 aa, Giardia lamblia
LIDVGRSVYNYALIEQGVTCFPDSP

SEQ ID NO: 3161704 - protein, 22 aa, Giardia lamblia
LIDYYHCIEMRPDLVDHETGVK

SEQ ID NO: 3161705 - protein, 28 aa, Giardia lamblia
LIEAVKLCPPRQWKMIANYVKGRTDIQV

SEQ ID NO: 3161706 - protein, 17 aa, Giardia lamblia
LIEEVTILKRKLASLKK

SEQ ID NO: 3161707 - protein, 37 aa, Giardia lamblia
LIEFFKTLQPHVLRWPGLEPHHPITLALKRKADKLRA

SEQ ID NO: 3161708 - protein, 26 aa, Giardia lamblia
LIEFIKRVYTPFGIDFALSLSLRPEK

SEQ ID NO: 3161709 - protein, 26 aa, Giardia lamblia
LIEICLKIYICTGKRHEPYKLGFDAP

SEQ ID NO: 3161710 - protein, 28 aa, Giardia lamblia
LIELDMPMCVGCVFQTMKAKLEPLVTSH

SEQ ID NO: 3161711 - protein, 23 aa, Giardia lamblia
LIELPLKAYTSFCVAENVCAVVG

SEQ ID NO: 3161712 - protein, 23 aa, Giardia lamblia
LIEMGPRYTLELIKIESGLTTGL

SEQ ID NO: 3161713 - protein, 17 aa, Giardia lamblia
LIEVLNFQPYKDSCTSG

SEQ ID NO: 3161714 - protein, 19 aa, Giardia lamblia
LIEYWIYSYMLYRYFIDVF

SEQ ID NO: 3161715 - protein, 17 aa, Giardia lamblia
LIFLYAIQGEISFKQKD

SEQ ID NO: 3161716 - protein, 18 aa, Giardia lamblia
LIFRGMLAPSEYPCYTHV

SEQ ID NO: 3161717 - protein, 18 aa, Giardia lamblia
LIFRLIEKGALLSVDSVI

SEQ ID NO: 3161718 - protein, 18 aa, Giardia lamblia
LIFSEARTKQCVTQLMLE

SEQ ID NO: 3161719 - protein, 30 aa, Giardia lamblia
LIFTGCLDKFLRVYIPGSREPLCSHYVVNS

SEQ ID NO: 3161720 - protein, 17 aa, Giardia lamblia
LIGAPVIIANQFDSKEA

SEQ ID NO: 3161721 - protein, 19 aa, Giardia lamblia
LIGAQCLKAPEEAKPSTNI

SEQ ID NO: 3161722 - protein, 24 aa, Giardia lamblia
LIGEGRFAKVFLCIPPDSGDLYAV

SEQ ID NO: 3161723 - protein, 26 aa, Giardia lamblia
LIGHKRFISSLAWQPLPLLPVENIPK

SEQ ID NO: 3161724 - protein, 19 aa, Giardia lamblia
LIGLPCSSCGASISEDLRG

SEQ ID NO: 3161725 - protein, 24 aa, Giardia lamblia
LIGNLFCHVYLAIMRKYRGAPNGG

SEQ ID NO: 3161726 - protein, 20 aa, Giardia lamblia
LIGPHGYAQCCFYGQRCRFL

SEQ ID NO: 3161727 - protein, 19 aa, Giardia lamblia
LIGRLCSLNPALVTPEIRH

SEQ ID NO: 3161728 - protein, 18 aa, Giardia lamblia
LIGTSVEKHVPFPSVSSH

SEQ ID NO: 3161729 - protein, 17 aa, Giardia lamblia
LIHAILFSPKRVMPLVE

SEQ ID NO: 3161730 - protein, 25 aa, Giardia lamblia
LIHCMLKYKLEFDSDFVPLLKRIHR

SEQ ID NO: 3161731 - protein, 23 aa, Giardia lamblia
LIHLCPYIYVFGTFAKKRWYERS

SEQ ID NO: 3161732 - protein, 19 aa, Giardia lamblia
LIHLLRVMLSWDARKRFSV

SEQ ID NO: 3161733 - protein, 18 aa, Giardia lamblia
LIIPAAYSKRGSQPARNA

SEQ ID NO: 3161734 - protein, 18 aa, Giardia lamblia
LIIPEVLSRMSVEERTPK

SEQ ID NO: 3161735 - protein, 20 aa, Giardia lamblia
LIIQGLRRIYNLGFMVKLSF

SEQ ID NO: 3161736 - protein, 20 aa, Giardia lamblia
LIIREVEGALPVADTVWDYK

SEQ ID NO: 3161737 - protein, 22 aa, Giardia lamblia
LIKDSGAVVGRINELFSTNGFR

SEQ ID NO: 3161738 - protein, 20 aa, Giardia lamblia
LIKEECHEAVIGTQGGRSSA

SEQ ID NO: 3161739 - protein, 24 aa, Giardia lamblia
LIKEKFKHVHSFQVPKTQDRVAGA

SEQ ID NO: 3161740 - protein, 31 aa, Giardia lamblia
LIKQLKPKELVLMLKICASYGRHLLDNPSSL

SEQ ID NO: 3161741 - protein, 18 aa, Giardia lamblia
LIKRLVFDLREAYKEAFI

SEQ ID NO: 3161742 - protein, 18 aa, Giardia lamblia
LILAARNGHAAVCKLLVG

SEQ ID NO: 3161743 - protein, 18 aa, Giardia lamblia
LILARKAYLQFVKSTALQ

SEQ ID NO: 3161744 - protein, 18 aa, Giardia lamblia
LILAYGLDEHLNYYTPRD

SEQ ID NO: 3161745 - protein, 20 aa, Giardia lamblia
LILCGDFLQLPPVVRSNNPL

SEQ ID NO: 3161746 - protein, 18 aa, Giardia lamblia
LILCRNARQEAASFMISG

SEQ ID NO: 3161747 - protein, 25 aa, Giardia lamblia
LILGARSRFPLLIDELVERYAGMQD

SEQ ID NO: 3161748 - protein, 18 aa, Giardia lamblia
LILKSVAVADLWPYEDCS

SEQ ID NO: 3161749 - protein, 18 aa, Giardia lamblia
LILNGFGSIVLDDSDKRY

SEQ ID NO: 3161750 - protein, 24 aa, Giardia lamblia
LILVCKKCKKVFRIDVTKFDPQAD

SEQ ID NO: 3161751 - protein, 18 aa, Giardia lamblia
LILVSLCVIPMVNYAPLV

SEQ ID NO: 3161752 - protein, 21 aa, Giardia lamblia
LIMCAEARLTFSLQPPQILMF

SEQ ID NO: 3161753 - protein, 18 aa, Giardia lamblia
LIMRLLKDDSAVIRFEAF

SEQ ID NO: 3161754 - protein, 29 aa, Giardia lamblia
LINASVALLKWVRIYLLMGRVVPFLDCRL

SEQ ID NO: 3161755 - protein, 24 aa, Giardia lamblia
LINHKLPFIRLFNIGKTYNGNDFP

SEQ ID NO: 3161756 - protein, 19 aa, Giardia lamblia
LINRAEPGSVCASRGASED

SEQ ID NO: 3161757 - protein, 17 aa, Giardia lamblia
LIPFCIDTSKTFPTYFL

SEQ ID NO: 3161758 - protein, 18 aa, Giardia lamblia
LIPKEARFLDSNGQTALM

SEQ ID NO: 3161759 - protein, 18 aa, Giardia lamblia
LIPKEGRMQDKDGMTALM

SEQ ID NO: 3161760 - protein, 24 aa, Giardia lamblia
LIPKEGVSIMQYCGSPDTREAVQA

SEQ ID NO: 3161761 - protein, 18 aa, Giardia lamblia
LIPLEACLQDGNGTTALI

SEQ ID NO: 3161762 - protein, 20 aa, Giardia lamblia
LIPLEFGIVDNEGWTALMLA

SEQ ID NO: 3161763 - protein, 18 aa, Giardia lamblia
LIPYEYRLINAPSPDLRL

SEQ ID NO: 3161764 - protein, 22 aa, Giardia lamblia
LIQPQLCLRFNDLDSIGLSGRH

SEQ ID NO: 3161765 - protein, 19 aa, Giardia lamblia
LIQRLKCIKKQESSSKNMM

SEQ ID NO: 3161766 - protein, 19 aa, Giardia lamblia
LIRADGGLCLIDEFEKISV

SEQ ID NO: 3161767 - protein, 23 aa, Giardia lamblia
LIREGRLPHMIFYGKPGTGKTTL

SEQ ID NO: 3161768 - protein, 24 aa, Giardia lamblia
LIRELRARMIYAHMTASNSEEKQI

SEQ ID NO: 3161769 - protein, 25 aa, Giardia lamblia
LIRHVAINCAERGVLLTRVRDELRM

SEQ ID NO: 3161770 - protein, 27 aa, Giardia lamblia
LIRLAEARARIRFSNFVTANDILEVSR

SEQ ID NO: 3161771 - protein, 17 aa, Giardia lamblia
LIRRGLRNDVALAQTGQ

SEQ ID NO: 3161772 - protein, 20 aa, Giardia lamblia
LIRRRFPVMQSLPDLVHMTI

SEQ ID NO: 3161773 - protein, 22 aa, Giardia lamblia
LIRSIQAYNMLLMKDIGHGNLL

SEQ ID NO: 3161774 - protein, 25 aa, Giardia lamblia
LIRTNRMCGSIESFEEPAAEYTNWT

SEQ ID NO: 3161775 - protein, 27 aa, Giardia lamblia
LISALPRLRLIGLMTIGAPDASEYSFR

SEQ ID NO: 3161776 - protein, 22 aa, Giardia lamblia
LISARLLAPAIAWEESQGYAKL

SEQ ID NO: 3161777 - protein, 24 aa, Giardia lamblia
LISCEVKQGYALLTRSAQFGVLNH

SEQ ID NO: 3161778 - protein, 19 aa, Giardia lamblia
LISDDGWSALMLAATEGHM

SEQ ID NO: 3161779 - protein, 24 aa, Giardia lamblia
LISDSRFKICVSVTIIGQKGQGIR

SEQ ID NO: 3161780 - protein, 25 aa, Giardia lamblia
LISDSRFKICVSVTIIGQKGQGIRS

SEQ ID NO: 3161781 - protein, 17 aa, Giardia lamblia
LISEADFLKAINKVVKD

SEQ ID NO: 3161782 - protein, 18 aa, Giardia lamblia
LISEGRLEEAESYKKMIS

SEQ ID NO: 3161783 - protein, 18 aa, Giardia lamblia
LISHIGAPIDGYALTYMG

SEQ ID NO: 3161784 - protein, 19 aa, Giardia lamblia
LISLARPLAFSSMEYSDGL

SEQ ID NO: 3161785 - protein, 23 aa, Giardia lamblia
LISRIYRDDCSSLSMESLGVVSA

SEQ ID NO: 3161786 - protein, 19 aa, Giardia lamblia
LISSDAFGVNALVYSPETC

SEQ ID NO: 3161787 - protein, 17 aa, Giardia lamblia
LISSILADVCLELDTLM

SEQ ID NO: 3161788 - protein, 17 aa, Giardia lamblia
LITAFSEEIIKFVAGGE

SEQ ID NO: 3161789 - protein, 18 aa, Giardia lamblia
LITDGVVNYWVRLAALVT

SEQ ID NO: 3161790 - protein, 17 aa, Giardia lamblia
LITDLKTIISRTQNMLQ

SEQ ID NO: 3161791 - protein, 20 aa, Giardia lamblia
LITELMARIKALEAKQNVSA

SEQ ID NO: 3161792 - protein, 17 aa, Giardia lamblia
LITEYNKLVLLLDSQSL

SEQ ID NO: 3161793 - protein, 18 aa, Giardia lamblia
LITGGRTHLKFWKMAQTF

SEQ ID NO: 3161794 - protein, 25 aa, Giardia lamblia
LITLKRPNFVGTRKPAEVFVDDWSP

SEQ ID NO: 3161795 - protein, 25 aa, Giardia lamblia
LITQFVTCYIRLFYYRKATLSKAEL

SEQ ID NO: 3161796 - protein, 18 aa, Giardia lamblia
LITQLPFVQIVPAEASRI

SEQ ID NO: 3161797 - protein, 19 aa, Giardia lamblia
LIVCNNEISNLIVPYEQYF

SEQ ID NO: 3161798 - protein, 18 aa, Giardia lamblia
LIVCYCMLSQQRGPAAAR

SEQ ID NO: 3161799 - protein, 18 aa, Giardia lamblia
LIVDNCSNFAQKVLALVC

SEQ ID NO: 3161800 - protein, 23 aa, Giardia lamblia
LIVKIFKFCGSIVLPYVPMVYSA

SEQ ID NO: 3161801 - protein, 18 aa, Giardia lamblia
LIVPVPMYLENHVRFGRL

SEQ ID NO: 3161802 - protein, 32 aa, Giardia lamblia
LIVSWTCSTIRGGFKLRFNGISSQPDYHPSMA

SEQ ID NO: 3161803 - protein, 17 aa, Giardia lamblia
LIYDCPEGTYVKLLQYN

SEQ ID NO: 3161804 - protein, 18 aa, Giardia lamblia
LIYEQHFPNGIVGIDYDR

SEQ ID NO: 3161805 - protein, 19 aa, Giardia lamblia
LIYETVAFHLSRRILEAAS

SEQ ID NO: 3161806 - protein, 19 aa, Giardia lamblia
LIYFAPWPAIEDILVFMSI

SEQ ID NO: 3161807 - protein, 17 aa, Giardia lamblia
LIYGYGETSLVPLYRSI

SEQ ID NO: 3161808 - protein, 19 aa, Giardia lamblia
LKAAAEAAGNIKLDEASSD

SEQ ID NO: 3161809 - protein, 17 aa, Giardia lamblia
LKAALNSANARIATLEA

SEQ ID NO: 3161810 - protein, 18 aa, Giardia lamblia
LKADGFTDLMIAAVLNRV

SEQ ID NO: 3161811 - protein, 20 aa, Giardia lamblia
LKAECEIHNVEFISGFLQSP

SEQ ID NO: 3161812 - protein, 20 aa, Giardia lamblia
LKAEHASIVRALKQRAQEQI

SEQ ID NO: 3161813 - protein, 21 aa, Giardia lamblia
LKAELARTREEAMQIIKEKDA

SEQ ID NO: 3161814 - protein, 20 aa, Giardia lamblia
LKAELHIKAAELTELKDKLV

SEQ ID NO: 3161815 - protein, 17 aa, Giardia lamblia
LKAELLGARAIITERES

SEQ ID NO: 3161816 - protein, 29 aa, Giardia lamblia
LKAGSCVLQGCSLRTLIDLNVESDQLENI

SEQ ID NO: 3161817 - protein, 21 aa, Giardia lamblia
LKAGTPSLYSRGNIRTTVTNY

SEQ ID NO: 3161818 - protein, 20 aa, Giardia lamblia
LKAHIARLGHYLPLDATVPE

SEQ ID NO: 3161819 - protein, 23 aa, Giardia lamblia
LKAHRANCYKVILDCSDENVGFY

SEQ ID NO: 3161820 - protein, 18 aa, Giardia lamblia
LKAIESILSLLRTPGATG

SEQ ID NO: 3161821 - protein, 29 aa, Giardia lamblia
LKAKSCYWRFSAHKSYITAMAFTQSGMFL

SEQ ID NO: 3161822 - protein, 27 aa, Giardia lamblia
LKALKLRLQGMKSRISSLCEGLGEIIT

SEQ ID NO: 3161823 - protein, 18 aa, Giardia lamblia
LKALPLQLEEFFVGKHYH

SEQ ID NO: 3161824 - protein, 18 aa, Giardia lamblia
LKANLHLREEEFRRASAR

SEQ ID NO: 3161825 - protein, 18 aa, Giardia lamblia
LKANLSKSIDNPVEVKNS

SEQ ID NO: 3161826 - protein, 18 aa, Giardia lamblia
LKASAAAQASVLARSQNG

SEQ ID NO: 3161827 - protein, 26 aa, Giardia lamblia
LKASELVDAVCFLVPVAVTTHKDIIT

SEQ ID NO: 3161828 - protein, 20 aa, Giardia lamblia
LKASVKRIYKELSDDFRIYP

SEQ ID NO: 3161829 - protein, 17 aa, Giardia lamblia
LKAVKAFFYTPSSSPLE

SEQ ID NO: 3161830 - protein, 24 aa, Giardia lamblia
LKAVTVPIEIFEFGKIAQGKKKAC

SEQ ID NO: 3161831 - protein, 25 aa, Giardia lamblia
LKAYSADLNRVFKHARLQILEGEMA

SEQ ID NO: 3161832 - protein, 22 aa, Giardia lamblia
LKCAVNLPLIEGVAVKPLGNSD

SEQ ID NO: 3161833 - protein, 17 aa, Giardia lamblia
LKCGLPRDYKHTPIINR

SEQ ID NO: 3161834 - protein, 18 aa, Giardia lamblia
LKCLDLSSNMLKEIAIDC

SEQ ID NO: 3161835 - protein, 25 aa, Giardia lamblia
LKDAFGRTALYYAEHPYWRVSKYNK

SEQ ID NO: 3161836 - protein, 18 aa, Giardia lamblia
LKDALAERLGINVCLSTV

SEQ ID NO: 3161837 - protein, 23 aa, Giardia lamblia
LKDDGTVVLGGFSMAEPLGRKAV

SEQ ID NO: 3161838 - protein, 20 aa, Giardia lamblia
LKDFLERRCLSLKYVRVMVL

SEQ ID NO: 3161839 - protein, 18 aa, Giardia lamblia
LKDGCCGKCGTPIYGKFA

SEQ ID NO: 3161840 - protein, 17 aa, Giardia lamblia
LKDKLAFADSGDIVASE

SEQ ID NO: 3161841 - protein, 18 aa, Giardia lamblia
LKDKNGWTALMHAAHNGH

SEQ ID NO: 3161842 - protein, 22 aa, Giardia lamblia
LKDLYTAYNVAHWSRSYRAMRA

SEQ ID NO: 3161843 - protein, 33 aa, Giardia lamblia
LKDMCLTNIAYLFKINCINLIVRNICMLELLIS

SEQ ID NO: 3161844 - protein, 18 aa, Giardia lamblia
LKDNNGWTALMHAAHCNH

SEQ ID NO: 3161845 - protein, 19 aa, Giardia lamblia
LKDPLMAAVAHIRSIEDTT

SEQ ID NO: 3161846 - protein, 23 aa, Giardia lamblia
LKDQRRLLSELVEQVRQQGSDLK

SEQ ID NO: 3161847 - protein, 32 aa, Giardia lamblia
LKDQRRLNVGLTRCRCALIIVGNATALAIDST

SEQ ID NO: 3161848 - protein, 28 aa, Giardia lamblia
LKDRVFKYKSGYLRKAIQLRESEDARLR

SEQ ID NO: 3161849 - protein, 21 aa, Giardia lamblia
LKDRYSELVLACKKLKQRVVI

SEQ ID NO: 3161850 - protein, 21 aa, Giardia lamblia
LKEAGANFVVCQWGFDDEANH

SEQ ID NO: 3161851 - protein, 18 aa, Giardia lamblia
LKEAGIHTIQSLLMHTKK

SEQ ID NO: 3161852 - protein, 18 aa, Giardia lamblia
LKEARATDNYGWTALMMA

SEQ ID NO: 3161853 - protein, 18 aa, Giardia lamblia
LKEDLAHMNTTMGEFADM

SEQ ID NO: 3161854 - protein, 25 aa, Giardia lamblia
LKEEGVCGIFFNRLFHKLQYGPQKH

SEQ ID NO: 3161855 - protein, 21 aa, Giardia lamblia
LKEEKRTALSQIEHSTAELSR

SEQ ID NO: 3161856 - protein, 19 aa, Giardia lamblia
LKEELRANILTQLSEQQII

SEQ ID NO: 3161857 - protein, 18 aa, Giardia lamblia
LKEFERAKESAALADKEE

SEQ ID NO: 3161858 - protein, 21 aa, Giardia lamblia
LKEGLRSGLLTMITEDSEVMN

SEQ ID NO: 3161859 - protein, 38 aa, Giardia lamblia
LKEGTAQCAGCFAAIYGAWSRFSGIAVQSLDFMQRLAA

SEQ ID NO: 3161860 - protein, 21 aa, Giardia lamblia
LKEIEALYLYAAYSHTVKDGC

SEQ ID NO: 3161861 - protein, 29 aa, Giardia lamblia
LKEIRKCYGRSRIGEPILDLKQVLRATMV

SEQ ID NO: 3161862 - protein, 18 aa, Giardia lamblia
LKEITAFHEQIAANIEHG

SEQ ID NO: 3161863 - protein, 18 aa, Giardia lamblia
LKEKDAHLVQASSELGSL

SEQ ID NO: 3161864 - protein, 20 aa, Giardia lamblia
LKEKREVVLIDEYVDSGHTI

SEQ ID NO: 3161865 - protein, 24 aa, Giardia lamblia
LKELIRNCLRFTPSSRIGLASIST

SEQ ID NO: 3161866 - protein, 17 aa, Giardia lamblia
LKELISISGNDVRSCLN

SEQ ID NO: 3161867 - protein, 17 aa, Giardia lamblia
LKELPLPSIQALDQLNK

SEQ ID NO: 3161868 - protein, 21 aa, Giardia lamblia
LKELQTIFVNRTFPMPPGLFS

SEQ ID NO: 3161869 - protein, 17 aa, Giardia lamblia
LKEPRKTVSSVRARDKI

SEQ ID NO: 3161870 - protein, 18 aa, Giardia lamblia
LKERERYVQILKEASHER

SEQ ID NO: 3161871 - protein, 21 aa, Giardia lamblia
LKERKAPVIAGYNLFMHSLLV

SEQ ID NO: 3161872 - protein, 23 aa, Giardia lamblia
LKERLSDMEGMLSAGGSGEDVDG

SEQ ID NO: 3161873 - protein, 21 aa, Giardia lamblia
LKESEALVLYLRTVVESKDDK

SEQ ID NO: 3161874 - protein, 17 aa, Giardia lamblia
LKEVLESGLSLSEHRKR

SEQ ID NO: 3161875 - protein, 26 aa, Giardia lamblia
LKFMSYDLGQAFVLKRDLFREGVLSK

SEQ ID NO: 3161876 - protein, 22 aa, Giardia lamblia
LKGHINSARMLKSYEAKLARPD

SEQ ID NO: 3161877 - protein, 17 aa, Giardia lamblia
LKGKSAWETGASDPSPL

SEQ ID NO: 3161878 - protein, 23 aa, Giardia lamblia
LKGRSMRADSLGGLHGAHDGVYR

SEQ ID NO: 3161879 - protein, 32 aa, Giardia lamblia
LKGRTALMHAACNYLPISDGCRLLISAEACCQ

SEQ ID NO: 3161880 - protein, 17 aa, Giardia lamblia
LKGSKLFDVLNNSKTSL

SEQ ID NO: 3161881 - protein, 24 aa, Giardia lamblia
LKGSNRPLGLISRGSSPPFQGTEP

SEQ ID NO: 3161882 - protein, 17 aa, Giardia lamblia
LKGVYSKNYEHIHGNVM

SEQ ID NO: 3161883 - protein, 18 aa, Giardia lamblia
LKHAELFFDCVRLDHILG

SEQ ID NO: 3161884 - protein, 17 aa, Giardia lamblia
LKHCIRESGSYSGSAPT

SEQ ID NO: 3161885 - protein, 20 aa, Giardia lamblia
LKHEARCISVDSCLNSKSST

SEQ ID NO: 3161886 - protein, 17 aa, Giardia lamblia
LKHFLDAVVVLYSESIR

SEQ ID NO: 3161887 - protein, 17 aa, Giardia lamblia
LKHFLLFVREFQLIEAN

SEQ ID NO: 3161888 - protein, 18 aa, Giardia lamblia
LKHFPFKVICGPDEKPQI

SEQ ID NO: 3161889 - protein, 21 aa, Giardia lamblia
LKHHKCYPRAVSLSGSPKYVD

SEQ ID NO: 3161890 - protein, 20 aa, Giardia lamblia
LKHIPAMDPHVWVQTVRDSV

SEQ ID NO: 3161891 - protein, 17 aa, Giardia lamblia
LKHKEIVCLLRNYEAGE

SEQ ID NO: 3161892 - protein, 17 aa, Giardia lamblia
LKHLIKLQIDIVLVINK

SEQ ID NO: 3161893 - protein, 17 aa, Giardia lamblia
LKHTLNRVAEIIDTAEV

SEQ ID NO: 3161894 - protein, 19 aa, Giardia lamblia
LKHYFIITGGAIDVKKIKR

SEQ ID NO: 3161895 - protein, 20 aa, Giardia lamblia
LKIAAYYGHEEAVKLLLGEL

SEQ ID NO: 3161896 - protein, 19 aa, Giardia lamblia
LKIADFLALGEFGDALRPK

SEQ ID NO: 3161897 - protein, 20 aa, Giardia lamblia
LKIATFLIPYEGFKEQEADF

SEQ ID NO: 3161898 - protein, 25 aa, Giardia lamblia
LKIEKMRLETEWKGVLEQCEKLKRQ

SEQ ID NO: 3161899 - protein, 24 aa, Giardia lamblia
LKIFDVIRCTKLALELQIYETTKL

SEQ ID NO: 3161900 - protein, 18 aa, Giardia lamblia
LKIHGIGIGYDWSPHAKD

SEQ ID NO: 3161901 - protein, 24 aa, Giardia lamblia
LKIIENRASLGLIMAVSPYIESFL

SEQ ID NO: 3161902 - protein, 19 aa, Giardia lamblia
LKIKQYDAIMSKITEFLYL

SEQ ID NO: 3161903 - protein, 25 aa, Giardia lamblia
LKIKTLPTLCVFDKGILKKKFLGFD

SEQ ID NO: 3161904 - protein, 19 aa, Giardia lamblia
LKILFSYPTRELAKDALEF

SEQ ID NO: 3161905 - protein, 19 aa, Giardia lamblia
LKIQGLRALYDTLVKENAS

SEQ ID NO: 3161906 - protein, 19 aa, Giardia lamblia
LKISKHLANSCLGTSTGSG

SEQ ID NO: 3161907 - protein, 25 aa, Giardia lamblia
LKIYSLCRRSSFLRMCSAAITKEYR

SEQ ID NO: 3161908 - protein, 17 aa, Giardia lamblia
LKKAISFSNLQVSRIAN

SEQ ID NO: 3161909 - protein, 19 aa, Giardia lamblia
LKKALQWYNGLLKQKVTSE

SEQ ID NO: 3161910 - protein, 18 aa, Giardia lamblia
LKKDLLRQASSRFSQLSA

SEQ ID NO: 3161911 - protein, 29 aa, Giardia lamblia
LKKERARKRITAFVLTKERFDEFREEVDN

SEQ ID NO: 3161912 - protein, 20 aa, Giardia lamblia
LKKHGVTELCYFKERRLQRY

SEQ ID NO: 3161913 - protein, 25 aa, Giardia lamblia
LKKKPKLRHCFNFPAKHVGSPSSLP

SEQ ID NO: 3161914 - protein, 18 aa, Giardia lamblia
LKKKRPKGLEKKPSPVEW

SEQ ID NO: 3161915 - protein, 17 aa, Giardia lamblia
LKKKSAKIEELKAELSH

SEQ ID NO: 3161916 - protein, 19 aa, Giardia lamblia
LKKLLNGIITQAAALSTPI

SEQ ID NO: 3161917 - protein, 24 aa, Giardia lamblia
LKKLPESIIPPRLWTQFNGLLLKY

SEQ ID NO: 3161918 - protein, 22 aa, Giardia lamblia
LKKLWSLIKHPNLLVVTAVARA

SEQ ID NO: 3161919 - protein, 19 aa, Giardia lamblia
LKKMLLGLCDRLRDEHLPL

SEQ ID NO: 3161920 - protein, 24 aa, Giardia lamblia
LKKPFKRMRHSEGIDWLNDHGITK

SEQ ID NO: 3161921 - protein, 26 aa, Giardia lamblia
LKKREAIEMTRLIAIANSVYSLIVDN

SEQ ID NO: 3161922 - protein, 19 aa, Giardia lamblia
LKKRKEQIEYLKNGGDPSL

SEQ ID NO: 3161923 - protein, 23 aa, Giardia lamblia
LKKSINCRFRILLSGTPIQNNLR

SEQ ID NO: 3161924 - protein, 19 aa, Giardia lamblia
LKKVLSRQPGSEVLEKLSA

SEQ ID NO: 3161925 - protein, 20 aa, Giardia lamblia
LKKWGPCLYTLVGDDLVMQG

SEQ ID NO: 3161926 - protein, 20 aa, Giardia lamblia
LKLAEACTALEKERDNAYKA

SEQ ID NO: 3161927 - protein, 18 aa, Giardia lamblia
LKLAELLTDDEGVRITGT

SEQ ID NO: 3161928 - protein, 20 aa, Giardia lamblia
LKLAERVRHLTGSMNEIRVR

SEQ ID NO: 3161929 - protein, 17 aa, Giardia lamblia
LKLAKAVQEQVSNEIAG

SEQ ID NO: 3161930 - protein, 23 aa, Giardia lamblia
LKLDGHLVFWMPYLVNEFTEDDI

SEQ ID NO: 3161931 - protein, 24 aa, Giardia lamblia
LKLDRARNAVVLWYVTELMRRLRQ

SEQ ID NO: 3161932 - protein, 21 aa, Giardia lamblia
LKLDYPSAIVEHVVEWISTFG

SEQ ID NO: 3161933 - protein, 17 aa, Giardia lamblia
LKLERDVFHNDLLSYLT

SEQ ID NO: 3161934 - protein, 20 aa, Giardia lamblia
LKLICQKLRDKNRALERQLH

SEQ ID NO: 3161935 - protein, 20 aa, Giardia lamblia
LKLIEEEIWAFVDAEEEKKM

SEQ ID NO: 3161936 - protein, 19 aa, Giardia lamblia
LKLKLEATGLAHKKVEELE

SEQ ID NO: 3161937 - protein, 17 aa, Giardia lamblia
LKLKRLRETLKASKFDQ

SEQ ID NO: 3161938 - protein, 17 aa, Giardia lamblia
LKLKTSLIEAERLLQAI

SEQ ID NO: 3161939 - protein, 17 aa, Giardia lamblia
LKLLYQQDADRFSAVAQ

SEQ ID NO: 3161940 - protein, 20 aa, Giardia lamblia
LKLNGFNTRFSRLGSDAREF

SEQ ID NO: 3161941 - protein, 20 aa, Giardia lamblia
LKLNGLIGLATLRLAEEQEL

SEQ ID NO: 3161942 - protein, 27 aa, Giardia lamblia
LKLNLTVKPIFPCLDKSDDDYAVLQSS

SEQ ID NO: 3161943 - protein, 34 aa, Giardia lamblia
LKLSNPEWVRYIFLPAHIYVSAMGILTFDYAACF

SEQ ID NO: 3161944 - protein, 28 aa, Giardia lamblia
LKLSSEQDIYFNFSAVIDRANYEEMRRE

SEQ ID NO: 3161945 - protein, 17 aa, Giardia lamblia
LKLSYPIEHGQIKDWDM

SEQ ID NO: 3161946 - protein, 18 aa, Giardia lamblia
LKLTKIFLDVDFNVLEVT

SEQ ID NO: 3161947 - protein, 20 aa, Giardia lamblia
LKLTPLMCAARAGDVYSVEK

SEQ ID NO: 3161948 - protein, 17 aa, Giardia lamblia
LKLVPQLLQEDGRAELL

SEQ ID NO: 3161949 - protein, 17 aa, Giardia lamblia
LKLVTIYVVKMSEKRAK

SEQ ID NO: 3161950 - protein, 18 aa, Giardia lamblia
LKMCPTPLAAQRLILLLI

SEQ ID NO: 3161951 - protein, 20 aa, Giardia lamblia
LKMFLGCASGTITGCEPECS

SEQ ID NO: 3161952 - protein, 19 aa, Giardia lamblia
LKMLRPYKRVELSHVSGFI

SEQ ID NO: 3161953 - protein, 17 aa, Giardia lamblia
LKMQNWELAELLRTTEG

SEQ ID NO: 3161954 - protein, 19 aa, Giardia lamblia
LKMSMTMGPSMESVRPQIA

SEQ ID NO: 3161955 - protein, 23 aa, Giardia lamblia
LKNDRVSDSMVCISAVREQMNAS

SEQ ID NO: 3161956 - protein, 20 aa, Giardia lamblia
LKNIISLCLVQRPKDRVSIF

SEQ ID NO: 3161957 - protein, 23 aa, Giardia lamblia
LKNILRNLCKLIAQKLQEQNLVP

SEQ ID NO: 3161958 - protein, 22 aa, Giardia lamblia
LKNIRGLEAMIKKGGDDKPYRD

SEQ ID NO: 3161959 - protein, 22 aa, Giardia lamblia
LKNIYGTTALMIAASKGYLDFV

SEQ ID NO: 3161960 - protein, 27 aa, Giardia lamblia
LKNLLPYIKLNVAFVFTNGDTSAILKA

SEQ ID NO: 3161961 - protein, 17 aa, Giardia lamblia
LKNLMATICDMALKLSM

SEQ ID NO: 3161962 - protein, 18 aa, Giardia lamblia
LKNMAVRFTSAYDRHSRV

SEQ ID NO: 3161963 - protein, 19 aa, Giardia lamblia
LKNNDEWTALMISAKMGFA

SEQ ID NO: 3161964 - protein, 22 aa, Giardia lamblia
LKNNEMETALMLASRNGHKNCV

SEQ ID NO: 3161965 - protein, 19 aa, Giardia lamblia
LKNPACLLKNAPQIPGKNR

SEQ ID NO: 3161966 - protein, 17 aa, Giardia lamblia
LKNQYLLSYDKLTSGIA

SEQ ID NO: 3161967 - protein, 32 aa, Giardia lamblia
LKNSKMCTAKHTICKEVFNLTRILAKANQSFS

SEQ ID NO: 3161968 - protein, 18 aa, Giardia lamblia
LKPESYKDFFTRYHCDAI

SEQ ID NO: 3161969 - protein, 17 aa, Giardia lamblia
LKPIEFDIVLFPEAEKN

SEQ ID NO: 3161970 - protein, 19 aa, Giardia lamblia
LKPPEYAYGFRYVKEKRHT

SEQ ID NO: 3161971 - protein, 20 aa, Giardia lamblia
LKPPKCPSLRESDVPSDYAL

SEQ ID NO: 3161972 - protein, 17 aa, Giardia lamblia
LKPQIVTEYKFSDIDYD

SEQ ID NO: 3161973 - protein, 20 aa, Giardia lamblia
LKPSTLCISQPIYKDIELSL

SEQ ID NO: 3161974 - protein, 24 aa, Giardia lamblia
LKPVHNLHSGFTFEHYMPDTSTSD

SEQ ID NO: 3161975 - protein, 17 aa, Giardia lamblia
LKQAATLYLTFVAALFS

SEQ ID NO: 3161976 - protein, 19 aa, Giardia lamblia
LKQDLNRFRMLYMREVDRK

SEQ ID NO: 3161977 - protein, 22 aa, Giardia lamblia
LKQLVCGGNLPVYVRAYGELGL

SEQ ID NO: 3161978 - protein, 19 aa, Giardia lamblia
LKQMFAKPFIRAMNDHVDG

SEQ ID NO: 3161979 - protein, 18 aa, Giardia lamblia
LKQPDFNGLDAMKSEDEH

SEQ ID NO: 3161980 - protein, 19 aa, Giardia lamblia
LKQPQSIFISGLTDKKMDI

SEQ ID NO: 3161981 - protein, 17 aa, Giardia lamblia
LKQQLRNRFRVEQMETQ

SEQ ID NO: 3161982 - protein, 17 aa, Giardia lamblia
LKQSSQLIVAYKRKEDD

SEQ ID NO: 3161983 - protein, 20 aa, Giardia lamblia
LKQVLRSVVSQALLRWKEVL

SEQ ID NO: 3161984 - protein, 19 aa, Giardia lamblia
LKRASCLMPKTLRSKADTE

SEQ ID NO: 3161985 - protein, 22 aa, Giardia lamblia
LKREDFKVAQLLTKLEGADVSS

SEQ ID NO: 3161986 - protein, 22 aa, Giardia lamblia
LKRIIWQRLQLVRIYTKKRNCP

SEQ ID NO: 3161987 - protein, 19 aa, Giardia lamblia
LKRIREFTLVEPIATLEQV

SEQ ID NO: 3161988 - protein, 20 aa, Giardia lamblia
LKRKISTTLTNVEYAIPLKK

SEQ ID NO: 3161989 - protein, 21 aa, Giardia lamblia
LKRKLAEYEKGGTLGSTLGSP

SEQ ID NO: 3161990 - protein, 21 aa, Giardia lamblia
LKRLHNHISKTMCYDNDVLSE

SEQ ID NO: 3161991 - protein, 19 aa, Giardia lamblia
LKRPIPIACSEELARFINK

SEQ ID NO: 3161992 - protein, 21 aa, Giardia lamblia
LKRSIQLIYRALRELRPAAKI

SEQ ID NO: 3161993 - protein, 30 aa, Giardia lamblia
LKRSLSDRRRPICTWDELMSVSDGTAQRRG

SEQ ID NO: 3161994 - protein, 19 aa, Giardia lamblia
LKRTCTRCGHLRVSSEYRT

SEQ ID NO: 3161995 - protein, 23 aa, Giardia lamblia
LKRVTLIFFKLYYLNKIANIGTS

SEQ ID NO: 3161996 - protein, 26 aa, Giardia lamblia
LKRYIARLMGPLSIYPYWKGAPVTAP

SEQ ID NO: 3161997 - protein, 25 aa, Giardia lamblia
LKSAESAMCLFDYDDPFLITEPLND

SEQ ID NO: 3161998 - protein, 26 aa, Giardia lamblia
LKSDIWSFGCVIYYMCTGQPCFWGRT

SEQ ID NO: 3161999 - protein, 20 aa, Giardia lamblia
LKSELCCNCQTLTTRMLSLE

SEQ ID NO: 3162000 - protein, 19 aa, Giardia lamblia
LKSFLHAFNPVFNPKSNPF

SEQ ID NO: 3162001 - protein, 30 aa, Giardia lamblia
LKSGLIDYEAFLGLFAFKGDIPPEAERGTS

SEQ ID NO: 3162002 - protein, 18 aa, Giardia lamblia
LKSGMQMHGVLLASDNFA

SEQ ID NO: 3162003 - protein, 22 aa, Giardia lamblia
LKSGNRLGLKFSPRDLEIARHA

SEQ ID NO: 3162004 - protein, 20 aa, Giardia lamblia
LKSHEHALVSIREANLAKDQ

SEQ ID NO: 3162005 - protein, 35 aa, Giardia lamblia
LKSKIPATKDFPCKRCEQYLNLFACKMTVTDQGVQ

SEQ ID NO: 3162006 - protein, 19 aa, Giardia lamblia
LKSLIAAGTCLCKQDRTGM

SEQ ID NO: 3162007 - protein, 21 aa, Giardia lamblia
LKSPLRLGVLCDDINSIPIGC

SEQ ID NO: 3162008 - protein, 20 aa, Giardia lamblia
LKSQFFRVTFDRNITDDTHT

SEQ ID NO: 3162009 - protein, 19 aa, Giardia lamblia
LKSQLKGHLEVLCSKMTEL

SEQ ID NO: 3162010 - protein, 20 aa, Giardia lamblia
LKSQRMNQSFNETPIKPKRP

SEQ ID NO: 3162011 - protein, 17 aa, Giardia lamblia
LKSRIVVPIQLHSMATA

SEQ ID NO: 3162012 - protein, 18 aa, Giardia lamblia
LKSSGTRFIEFLQKCVFD

SEQ ID NO: 3162013 - protein, 20 aa, Giardia lamblia
LKSSIQSAAPYLQELADDLG

SEQ ID NO: 3162014 - protein, 25 aa, Giardia lamblia
LKSSYSILTPDLWKKEQLDHVQDIR

SEQ ID NO: 3162015 - protein, 19 aa, Giardia lamblia
LKSYMRTPAAFYVAQLLSQ

SEQ ID NO: 3162016 - protein, 22 aa, Giardia lamblia
LKTCNGETALMFLASLGELPCE

SEQ ID NO: 3162017 - protein, 19 aa, Giardia lamblia
LKTDLDNLMAIKGDALGKT

SEQ ID NO: 3162018 - protein, 20 aa, Giardia lamblia
LKTFLFKFAIVHADGNISFE

SEQ ID NO: 3162019 - protein, 19 aa, Giardia lamblia
LKTGFAVETVMRTLQYPEE

SEQ ID NO: 3162020 - protein, 18 aa, Giardia lamblia
LKTGRHLLAGGDAAPRPF

SEQ ID NO: 3162021 - protein, 17 aa, Giardia lamblia
LKTKVKQGARPAIPSHY

SEQ ID NO: 3162022 - protein, 19 aa, Giardia lamblia
LKTLATCSAQLRINPTSTK

SEQ ID NO: 3162023 - protein, 20 aa, Giardia lamblia
LKTLCSHKDLEMDRLTHMLN

SEQ ID NO: 3162024 - protein, 19 aa, Giardia lamblia
LKTLFLDMGVPPTLASQAL

SEQ ID NO: 3162025 - protein, 17 aa, Giardia lamblia
LKTLILLARKSEKSFLH

SEQ ID NO: 3162026 - protein, 21 aa, Giardia lamblia
LKTLPLVSSLRSPAMRERHWQ

SEQ ID NO: 3162027 - protein, 35 aa, Giardia lamblia
LKTLRSKCALFPFERPQKDMIGKFLLSVAEAENVS

SEQ ID NO: 3162028 - protein, 21 aa, Giardia lamblia
LKTNILFRELQFWGIMTQDEI

SEQ ID NO: 3162029 - protein, 19 aa, Giardia lamblia
LKTQSRVLSFLFQFDKDEN

SEQ ID NO: 3162030 - protein, 17 aa, Giardia lamblia
LKTRLGKDYFSRIYELI

SEQ ID NO: 3162031 - protein, 27 aa, Giardia lamblia
LKTRPAPKPKTFEGLETVKLNRNLAKC

SEQ ID NO: 3162032 - protein, 43 aa, Giardia lamblia
LKTSKFRSFNYRNAFIFKDEHTLQLKLPYGVASQENYSFDFYK

SEQ ID NO: 3162033 - protein, 17 aa, Giardia lamblia
LKTSRILSTSQMLGNQK

SEQ ID NO: 3162034 - protein, 20 aa, Giardia lamblia
LKTTEDYVFKVGQLAQQHED

SEQ ID NO: 3162035 - protein, 21 aa, Giardia lamblia
LKTTPCFRAPEQIKIDPEFPL

SEQ ID NO: 3162036 - protein, 18 aa, Giardia lamblia
LKVDADSRRSFSTESEAQ

SEQ ID NO: 3162037 - protein, 19 aa, Giardia lamblia
LKVDERVLFAILNGCKERK

SEQ ID NO: 3162038 - protein, 30 aa, Giardia lamblia
LKVDFPDQLKMCTYNMVYFGFYSLFDGLLE

SEQ ID NO: 3162039 - protein, 18 aa, Giardia lamblia
LKVEFAIHPLILGLTTDY

SEQ ID NO: 3162040 - protein, 18 aa, Giardia lamblia
LKVEGIKDIYCNPYTLEI

SEQ ID NO: 3162041 - protein, 20 aa, Giardia lamblia
LKVFDYPSGKQFYEIYMNPL

SEQ ID NO: 3162042 - protein, 17 aa, Giardia lamblia
LKVGRSLLEKRLASGTT

SEQ ID NO: 3162043 - protein, 18 aa, Giardia lamblia
LKVGSGLSTTFKKRRRIF

SEQ ID NO: 3162044 - protein, 20 aa, Giardia lamblia
LKVIFPEASVDQFPGLCKKD

SEQ ID NO: 3162045 - protein, 33 aa, Giardia lamblia
LKVLECKSTIKVQFKKAVGLNWPIGNVKMPASE

SEQ ID NO: 3162046 - protein, 17 aa, Giardia lamblia
LKVLFILLTHTHFDHVF

SEQ ID NO: 3162047 - protein, 25 aa, Giardia lamblia
LKVLNKLCAVTTFPDHNVGGFCDPL

SEQ ID NO: 3162048 - protein, 18 aa, Giardia lamblia
LKVLRSLLERLCGNMNKA

SEQ ID NO: 3162049 - protein, 20 aa, Giardia lamblia
LKVQYNTAIKERDILHTKLR

SEQ ID NO: 3162050 - protein, 24 aa, Giardia lamblia
LKVRENCRIAEDMLDKKEREVRSL

SEQ ID NO: 3162051 - protein, 22 aa, Giardia lamblia
LKVRITEKFVHLPLAIGQDLAI

SEQ ID NO: 3162052 - protein, 33 aa, Giardia lamblia
LKVSESDMIRWNIARARAMVGAREAVAAASALS

SEQ ID NO: 3162053 - protein, 18 aa, Giardia lamblia
LKYAQQFMYSSGFDSSHR

SEQ ID NO: 3162054 - protein, 21 aa, Giardia lamblia
LKYLVASIIYGGRVIDDLDRR

SEQ ID NO: 3162055 - protein, 22 aa, Giardia lamblia
LKYLYEETRMLSFEKNNPEEAE

SEQ ID NO: 3162056 - protein, 21 aa, Giardia lamblia
LKYMLCQGSEPNTHMANSEIL

SEQ ID NO: 3162057 - protein, 17 aa, Giardia lamblia
LKYMLGPYCTPRLGMPV

SEQ ID NO: 3162058 - protein, 17 aa, Giardia lamblia
LKYPIIIPDKHIDEPRI

SEQ ID NO: 3162059 - protein, 21 aa, Giardia lamblia
LKYQCTSVFTGLDIAYCLILQ

SEQ ID NO: 3162060 - protein, 20 aa, Giardia lamblia
LKYSAAINIVRKFRDCGQLE

SEQ ID NO: 3162061 - protein, 19 aa, Giardia lamblia
LKYTKSGKEYSRISFIDLA

SEQ ID NO: 3162062 - protein, 21 aa, Giardia lamblia
LKYVEPFKTLYAHLIGDKATE

SEQ ID NO: 3162063 - protein, 22 aa, Giardia lamblia
LKYYHQLCGKNLVTAPVLSSFI

SEQ ID NO: 3162064 - protein, 25 aa, Giardia lamblia
LKYYTKLGDCIIHLAEQGVLSADTI

SEQ ID NO: 3162065 - protein, 21 aa, Giardia lamblia
LLADGESPCFDDIDLWSQLSH

SEQ ID NO: 3162066 - protein, 24 aa, Giardia lamblia
LLAELTRELLVCVARKKGKLLPGG

SEQ ID NO: 3162067 - protein, 29 aa, Giardia lamblia
LLAGSYKLPFTKQNVRARLGLKKIEPTVK

SEQ ID NO: 3162068 - protein, 24 aa, Giardia lamblia
LLAHEMIHFFATCLDRYFGGVSEL

SEQ ID NO: 3162069 - protein, 20 aa, Giardia lamblia
LLAIRPDDYLDFDARNGSVS

SEQ ID NO: 3162070 - protein, 25 aa, Giardia lamblia
LLAIYKAIIGLYCDLLGQYDPNLYF

SEQ ID NO: 3162071 - protein, 17 aa, Giardia lamblia
LLAKSRSSRRSRWDEDD

SEQ ID NO: 3162072 - protein, 17 aa, Giardia lamblia
LLAKTFISLCATLEQAK

SEQ ID NO: 3162073 - protein, 18 aa, Giardia lamblia
LLALACGDKRIRLVQITG

SEQ ID NO: 3162074 - protein, 18 aa, Giardia lamblia
LLALRLAISGTKRYGAYS

SEQ ID NO: 3162075 - protein, 22 aa, Giardia lamblia
LLALSRICAGVGMYEQGAMCCD

SEQ ID NO: 3162076 - protein, 28 aa, Giardia lamblia
LLANFRAKCSFCAPELLSEIDEYDEKVD

SEQ ID NO: 3162077 - protein, 19 aa, Giardia lamblia
LLAPKSSQNELQWYDQAVL

SEQ ID NO: 3162078 - protein, 23 aa, Giardia lamblia
LLAPRLNARLFMRYLTQDEPLSK

SEQ ID NO: 3162079 - protein, 32 aa, Giardia lamblia
LLASVAKCESSFMRDPLEAMSSVTKALAAEWS

SEQ ID NO: 3162080 - protein, 17 aa, Giardia lamblia
LLASYALAYARTTSALG

SEQ ID NO: 3162081 - protein, 18 aa, Giardia lamblia
LLAVLAEDAVVFFDWSRS

SEQ ID NO: 3162082 - protein, 24 aa, Giardia lamblia
LLCDSIKLCKEVLERICKGDRVSK

SEQ ID NO: 3162083 - protein, 18 aa, Giardia lamblia
LLCGCLALDPVERYTAED

SEQ ID NO: 3162084 - protein, 20 aa, Giardia lamblia
LLCKLRLRIDPDLIGLSAES

SEQ ID NO: 3162085 - protein, 18 aa, Giardia lamblia
LLCKQPSPMWANTSLSQF

SEQ ID NO: 3162086 - protein, 17 aa, Giardia lamblia
LLCPLPRNQSIARPNVS

SEQ ID NO: 3162087 - protein, 17 aa, Giardia lamblia
LLCSRSGADTVLLNLLS

SEQ ID NO: 3162088 - protein, 18 aa, Giardia lamblia
LLCYLKLSYPSKITLLRG

SEQ ID NO: 3162089 - protein, 17 aa, Giardia lamblia
LLDCVVYLHSMFKANAD

SEQ ID NO: 3162090 - protein, 25 aa, Giardia lamblia
LLDDSIKTHIPWRDSKLTRLLKNVL

SEQ ID NO: 3162091 - protein, 23 aa, Giardia lamblia
LLDECPKVTGIEFRRGKVVANEF

SEQ ID NO: 3162092 - protein, 23 aa, Giardia lamblia
LLDELRNIIALKDFQVFDRISFD

SEQ ID NO: 3162093 - protein, 26 aa, Giardia lamblia
LLDENIRISSQWQQEREKLLQQIGTL

SEQ ID NO: 3162094 - protein, 20 aa, Giardia lamblia
LLDGTCYMCITYRRDRPKVT

SEQ ID NO: 3162095 - protein, 33 aa, Giardia lamblia
LLDIAEMMGRFSWPILSSCMGFLRKNDGSLAAI

SEQ ID NO: 3162096 - protein, 18 aa, Giardia lamblia
LLDIFRKDIQLIDLHEVH

SEQ ID NO: 3162097 - protein, 18 aa, Giardia lamblia
LLDKEARLQRAADGWTAL

SEQ ID NO: 3162098 - protein, 25 aa, Giardia lamblia
LLDKLGDALSIFGRKEILHINIMEI

SEQ ID NO: 3162099 - protein, 21 aa, Giardia lamblia
LLDKSKCKLADAVQSNVPQSS

SEQ ID NO: 3162100 - protein, 21 aa, Giardia lamblia
LLDLIARRLDTEFDEVRRQAD

SEQ ID NO: 3162101 - protein, 19 aa, Giardia lamblia
LLDLLKANNFRGFNIDWTR

SEQ ID NO: 3162102 - protein, 25 aa, Giardia lamblia
LLDLYSFAFPWAWDTQTAIHSFTGL

SEQ ID NO: 3162103 - protein, 26 aa, Giardia lamblia
LLDNNGCVRLCDFGNAMSFSMDEESK

SEQ ID NO: 3162104 - protein, 21 aa, Giardia lamblia
LLDRLFADFCERLDKANKTSP

SEQ ID NO: 3162105 - protein, 20 aa, Giardia lamblia
LLDSHAMLKLLERAFTPLTD

SEQ ID NO: 3162106 - protein, 18 aa, Giardia lamblia
LLDSRFYTQFQYISLATF

SEQ ID NO: 3162107 - protein, 24 aa, Giardia lamblia
LLDSRGYPALGIAIELDAPELVCL

SEQ ID NO: 3162108 - protein, 22 aa, Giardia lamblia
LLDTDMRKIFAIGDEAHVTERQ

SEQ ID NO: 3162109 - protein, 19 aa, Giardia lamblia
LLDTFPTTIPISAKQRTDL

SEQ ID NO: 3162110 - protein, 22 aa, Giardia lamblia
LLDVRKRLNFFLKRTNGTKRTF

SEQ ID NO: 3162111 - protein, 22 aa, Giardia lamblia
LLECASIQLQLCHPNINSPIDA

SEQ ID NO: 3162112 - protein, 24 aa, Giardia lamblia
LLEDRVPVLFVCGPLHSGKSYTVE

SEQ ID NO: 3162113 - protein, 17 aa, Giardia lamblia
LLEEVDGHLSLSALSQR

SEQ ID NO: 3162114 - protein, 17 aa, Giardia lamblia
LLEHARAELARQASSTG

SEQ ID NO: 3162115 - protein, 25 aa, Giardia lamblia
LLEITRYELHVMSRLGVDPTVTLET

SEQ ID NO: 3162116 - protein, 27 aa, Giardia lamblia
LLEKYLRALVLSAKFGALKELKYLYEE

SEQ ID NO: 3162117 - protein, 20 aa, Giardia lamblia
LLENEFQQIVSMALVIVSKL

SEQ ID NO: 3162118 - protein, 17 aa, Giardia lamblia
LLEQLVPLYKAMHAQVN

SEQ ID NO: 3162119 - protein, 20 aa, Giardia lamblia
LLEQMREFFSGYTEVDRLAY

SEQ ID NO: 3162120 - protein, 19 aa, Giardia lamblia
LLERECKFQTKAGLTALMI

SEQ ID NO: 3162121 - protein, 18 aa, Giardia lamblia
LLEREKQNLLRMQTARDL

SEQ ID NO: 3162122 - protein, 19 aa, Giardia lamblia
LLERFRLLSDTHILQSFQP

SEQ ID NO: 3162123 - protein, 17 aa, Giardia lamblia
LLERIWEAVEQLHDSSL

SEQ ID NO: 3162124 - protein, 22 aa, Giardia lamblia
LLESFYCLYVFININPISPLYN

SEQ ID NO: 3162125 - protein, 18 aa, Giardia lamblia
LLESITFMNGKLTRREFY

SEQ ID NO: 3162126 - protein, 23 aa, Giardia lamblia
LLETASFKNAYLRMDGNIPVDAR

SEQ ID NO: 3162127 - protein, 20 aa, Giardia lamblia
LLEVEEAVFLDSIKQSEVVV

SEQ ID NO: 3162128 - protein, 25 aa, Giardia lamblia
LLEYCSGGNCVKLLIKCSERKVFLP

SEQ ID NO: 3162129 - protein, 17 aa, Giardia lamblia
LLFDSFFNVLVWTGSSV

SEQ ID NO: 3162130 - protein, 18 aa, Giardia lamblia
LLFFDRLFFFLEVRHLGP

SEQ ID NO: 3162131 - protein, 17 aa, Giardia lamblia
LLFFKIGAVGKRQMDLA

SEQ ID NO: 3162132 - protein, 29 aa, Giardia lamblia
LLFHCKCGGDGHSCCLDARRKNGLPDTYI

SEQ ID NO: 3162133 - protein, 18 aa, Giardia lamblia
LLFLHGYSFFTDLYATLL

SEQ ID NO: 3162134 - protein, 20 aa, Giardia lamblia
LLFQLKRKKTQLVLATQQCK

SEQ ID NO: 3162135 - protein, 23 aa, Giardia lamblia
LLGDGRSALIVAIDVADLDTLRM

SEQ ID NO: 3162136 - protein, 19 aa, Giardia lamblia
LLGELGLQVGEGFTALMMA

SEQ ID NO: 3162137 - protein, 18 aa, Giardia lamblia
LLGELPVIHRVLTTAERE

SEQ ID NO: 3162138 - protein, 20 aa, Giardia lamblia
LLGFSKRLSGLLLDAIYGVA

SEQ ID NO: 3162139 - protein, 18 aa, Giardia lamblia
LLGFSLKFANLTNNSAVN

SEQ ID NO: 3162140 - protein, 17 aa, Giardia lamblia
LLGGSIFFYVFPTTHNL

SEQ ID NO: 3162141 - protein, 25 aa, Giardia lamblia
LLGGVKYATAISCMAFTTLLHQDGP

SEQ ID NO: 3162142 - protein, 18 aa, Giardia lamblia
LLGHRVAGVTLKACRISE

SEQ ID NO: 3162143 - protein, 18 aa, Giardia lamblia
LLGIAGRPFLTLMGDDLS

SEQ ID NO: 3162144 - protein, 18 aa, Giardia lamblia
LLGLKYLHEQGIIHKDIK

SEQ ID NO: 3162145 - protein, 18 aa, Giardia lamblia
LLGLRYLHKQHVIHRDIK

SEQ ID NO: 3162146 - protein, 24 aa, Giardia lamblia
LLGRLRDIYKLSLALEDAAELVSI

SEQ ID NO: 3162147 - protein, 19 aa, Giardia lamblia
LLGSCRGLSLSAAPPRQLG

SEQ ID NO: 3162148 - protein, 27 aa, Giardia lamblia
LLGSYYTLSFSYIFKYAGDIVYFAHTY

SEQ ID NO: 3162149 - protein, 19 aa, Giardia lamblia
LLGTCVDRVGIFKPVLQDI

SEQ ID NO: 3162150 - protein, 17 aa, Giardia lamblia
LLGTLARVPIYDKSMLI

SEQ ID NO: 3162151 - protein, 19 aa, Giardia lamblia
LLHACLDPDPSKRPTAWDI

SEQ ID NO: 3162152 - protein, 17 aa, Giardia lamblia
LLHCYRVNPASVDTENI

SEQ ID NO: 3162153 - protein, 19 aa, Giardia lamblia
LLHECPFDTSARMAAAENA

SEQ ID NO: 3162154 - protein, 18 aa, Giardia lamblia
LLHFYKIKYPQLFYMRKS

SEQ ID NO: 3162155 - protein, 18 aa, Giardia lamblia
LLHHYRSRADEGALEDVL

SEQ ID NO: 3162156 - protein, 27 aa, Giardia lamblia
LLHLYKYKPALCKLVLEHPTETISIID

SEQ ID NO: 3162157 - protein, 17 aa, Giardia lamblia
LLHQGSFVGHIEDVVID

SEQ ID NO: 3162158 - protein, 24 aa, Giardia lamblia
LLHRAELRALAAVSTELRHIATLA

SEQ ID NO: 3162159 - protein, 19 aa, Giardia lamblia
LLHRLFPYQSVKQHYNGST

SEQ ID NO: 3162160 - protein, 17 aa, Giardia lamblia
LLIDFGLAQTLREVREF

SEQ ID NO: 3162161 - protein, 20 aa, Giardia lamblia
LLIEKEAKKGLTRNFFGELP

SEQ ID NO: 3162162 - protein, 23 aa, Giardia lamblia
LLIGEYTGGISIWDLRINTKSKK

SEQ ID NO: 3162163 - protein, 31 aa, Giardia lamblia
LLIHGYRPVFRFLDAHHKPLLVKVLEAQDAG

SEQ ID NO: 3162164 - protein, 19 aa, Giardia lamblia
LLIHPSGNYCFQKIIESSD

SEQ ID NO: 3162165 - protein, 25 aa, Giardia lamblia
LLIIARVYLTAAFQFHQSELEAVGC

SEQ ID NO: 3162166 - protein, 23 aa, Giardia lamblia
LLIPREKMMVMRDGSSALMLAVC

SEQ ID NO: 3162167 - protein, 25 aa, Giardia lamblia
LLIPYECKMHESCNGKTALMAAAAA

SEQ ID NO: 3162168 - protein, 17 aa, Giardia lamblia
LLISEMLKPDYNSRPTL

SEQ ID NO: 3162169 - protein, 41 aa, Giardia lamblia
LLISIPYFKECLLMCSACDNCGFKSIEVKSAGAIPPHGART

SEQ ID NO: 3162170 - protein, 18 aa, Giardia lamblia
LLIYELCLLTPYNYYSPI

SEQ ID NO: 3162171 - protein, 25 aa, Giardia lamblia
LLIYQEFTDRVPVSIALSKDYVAIV

SEQ ID NO: 3162172 - protein, 29 aa, Giardia lamblia
LLKADFFSCIIKFKINYGVSMQHVDGCTE

SEQ ID NO: 3162173 - protein, 17 aa, Giardia lamblia
LLKAFADEVERVGSPTA

SEQ ID NO: 3162174 - protein, 17 aa, Giardia lamblia
LLKCFRPSLSDPGTVVI

SEQ ID NO: 3162175 - protein, 17 aa, Giardia lamblia
LLKCQRVQPQISLSDGI

SEQ ID NO: 3162176 - protein, 23 aa, Giardia lamblia
LLKECKYFKMLGLDIPKSSEKIY

SEQ ID NO: 3162177 - protein, 25 aa, Giardia lamblia
LLKGLPWEVTYRLSLNSSATSEIGD

SEQ ID NO: 3162178 - protein, 36 aa, Giardia lamblia
LLKGVPFKSECFRIDSSVAFSQDWLSLRQQLASKFY

SEQ ID NO: 3162179 - protein, 24 aa, Giardia lamblia
LLKKAPAERLILFFKRQSEWADSR

SEQ ID NO: 3162180 - protein, 18 aa, Giardia lamblia
LLKKSGLTANGFLFTNLP

SEQ ID NO: 3162181 - protein, 24 aa, Giardia lamblia
LLKLRRRTVSTLQILAHIREKRHF

SEQ ID NO: 3162182 - protein, 19 aa, Giardia lamblia
LLKMLKRIHPLVINLRSAY

SEQ ID NO: 3162183 - protein, 23 aa, Giardia lamblia
LLKNIWYFFEDRIVQFEQKTSNA

SEQ ID NO: 3162184 - protein, 17 aa, Giardia lamblia
LLKQCKEEAASMPPYIS

SEQ ID NO: 3162185 - protein, 20 aa, Giardia lamblia
LLKQQRINALLAVENDFISN

SEQ ID NO: 3162186 - protein, 17 aa, Giardia lamblia
LLKRMNYTRSIAVSSIV

SEQ ID NO: 3162187 - protein, 17 aa, Giardia lamblia
LLKRRARRLQSLLDETP

SEQ ID NO: 3162188 - protein, 22 aa, Giardia lamblia
LLKSVNHPLVLKVYDVQMNITR

SEQ ID NO: 3162189 - protein, 22 aa, Giardia lamblia
LLKTCRELYEKDAVAADLECAL

SEQ ID NO: 3162190 - protein, 18 aa, Giardia lamblia
LLLAERLVAEILFADVVS

SEQ ID NO: 3162191 - protein, 18 aa, Giardia lamblia
LLLCPKFKEVGVVTAEDH

SEQ ID NO: 3162192 - protein, 22 aa, Giardia lamblia
LLLDIRGGACVKDDAKVEILDL

SEQ ID NO: 3162193 - protein, 18 aa, Giardia lamblia
LLLEKEGGMQRRSLVNAA

SEQ ID NO: 3162194 - protein, 17 aa, Giardia lamblia
LLLEKEGGMRDRNGKTA

SEQ ID NO: 3162195 - protein, 26 aa, Giardia lamblia
LLLHLLMAKELFCTALPRMPRDYITR

SEQ ID NO: 3162196 - protein, 20 aa, Giardia lamblia
LLLIKCILQPSASTTQFDSH

SEQ ID NO: 3162197 - protein, 18 aa, Giardia lamblia
LLLKDAFRHQREERARLE

SEQ ID NO: 3162198 - protein, 19 aa, Giardia lamblia
LLLKSVWDVVDLVFSQIEA

SEQ ID NO: 3162199 - protein, 19 aa, Giardia lamblia
LLLLMATALPAEYVSICKK

SEQ ID NO: 3162200 - protein, 19 aa, Giardia lamblia
LLLLRKWRRRTNLGREMSW

SEQ ID NO: 3162201 - protein, 24 aa, Giardia lamblia
LLLMDIPSYLGLLLRAHQTQIEPF

SEQ ID NO: 3162202 - protein, 25 aa, Giardia lamblia
LLLNLRLNTNLPFPAQFTQSTSKTS

SEQ ID NO: 3162203 - protein, 19 aa, Giardia lamblia
LLLNPVRPRSFQIEFSPIS

SEQ ID NO: 3162204 - protein, 29 aa, Giardia lamblia
LLLNTGTVWDTEWKDRELLVDETLTRLHR

SEQ ID NO: 3162205 - protein, 27 aa, Giardia lamblia
LLLPLEKGIYCLHGLTAYNLLIKEHDF

SEQ ID NO: 3162206 - protein, 26 aa, Giardia lamblia
LLLQGHGLRCKEMEESLRLFNEENDL

SEQ ID NO: 3162207 - protein, 18 aa, Giardia lamblia
LLLRGVTQYVCMLKEDRY

SEQ ID NO: 3162208 - protein, 18 aa, Giardia lamblia
LLLRRWIDSYTNPLYQLP

SEQ ID NO: 3162209 - protein, 17 aa, Giardia lamblia
LLLSEACLLDHTGYTAC

SEQ ID NO: 3162210 - protein, 26 aa, Giardia lamblia
LLLSICLGEGLLAINLLIETNRYIEV

SEQ ID NO: 3162211 - protein, 25 aa, Giardia lamblia
LLLSQDHLLPFLAKERCITRNISYL

SEQ ID NO: 3162212 - protein, 18 aa, Giardia lamblia
LLLTGGGGYTARSAAKCW

SEQ ID NO: 3162213 - protein, 18 aa, Giardia lamblia
LLLTVPFGAGSADIYEEI

SEQ ID NO: 3162214 - protein, 17 aa, Giardia lamblia
LLMDRATAMSSRLDHIE

SEQ ID NO: 3162215 - protein, 40 aa, Giardia lamblia
LLMNAADIAFGFNIYPLIMPICRRLFEITTRLNCVDIVTP

SEQ ID NO: 3162216 - protein, 18 aa, Giardia lamblia
LLMRCEGGMRDSEEWTAL

SEQ ID NO: 3162217 - protein, 18 aa, Giardia lamblia
LLMRCEGGMRSSNDLTAL

SEQ ID NO: 3162218 - protein, 19 aa, Giardia lamblia
LLMRCEGGMRSSNEWTALM

SEQ ID NO: 3162219 - protein, 21 aa, Giardia lamblia
LLMRCEGGMRSSNGWTALMWA

SEQ ID NO: 3162220 - protein, 19 aa, Giardia lamblia
LLMRYIIEQGIGFVRAEDT

SEQ ID NO: 3162221 - protein, 20 aa, Giardia lamblia
LLNCKQKEAVRCMAASSFLS

SEQ ID NO: 3162222 - protein, 23 aa, Giardia lamblia
LLNEIYCLRDILYGEQGEINEVL

SEQ ID NO: 3162223 - protein, 18 aa, Giardia lamblia
LLNEIYRYSHIIYVAANY

SEQ ID NO: 3162224 - protein, 26 aa, Giardia lamblia
LLNHARPVYPVAVDAFYKAVKLADDE

SEQ ID NO: 3162225 - protein, 21 aa, Giardia lamblia
LLNKFGNLRARTENKQPRIAA

SEQ ID NO: 3162226 - protein, 22 aa, Giardia lamblia
LLNKRGKTAMMYAAEAGHYDVV

SEQ ID NO: 3162227 - protein, 20 aa, Giardia lamblia
LLNPVKMYIFSYIRKIYMFT

SEQ ID NO: 3162228 - protein, 20 aa, Giardia lamblia
LLNRASAVAYGINESDSDIY

SEQ ID NO: 3162229 - protein, 18 aa, Giardia lamblia
LLNSLIFLSSLVDPLEDL

SEQ ID NO: 3162230 - protein, 17 aa, Giardia lamblia
LLPGGGVAFLRAAQVME

SEQ ID NO: 3162231 - protein, 18 aa, Giardia lamblia
LLPHKAKLIKFSAPDNKF

SEQ ID NO: 3162232 - protein, 23 aa, Giardia lamblia
LLPKFGGSLGQMIRRSFREIQRT

SEQ ID NO: 3162233 - protein, 29 aa, Giardia lamblia
LLPKSTCVWRLLIILKEIYGVDVSHGMVA

SEQ ID NO: 3162234 - protein, 27 aa, Giardia lamblia
LLPNGQRIFREDALRFGYKGPARNGTY

SEQ ID NO: 3162235 - protein, 19 aa, Giardia lamblia
LLPNKWVLDIGAIQHATLH

SEQ ID NO: 3162236 - protein, 18 aa, Giardia lamblia
LLPPMHFLNACPSSSSTE

SEQ ID NO: 3162237 - protein, 34 aa, Giardia lamblia
LLPPSLKPQMPYVAQRWTSHPAVIMHQPENAAYR

SEQ ID NO: 3162238 - protein, 17 aa, Giardia lamblia
LLPRAALPPLETSNQPE

SEQ ID NO: 3162239 - protein, 22 aa, Giardia lamblia
LLPRAQRPLPLLLNEYDDIQHE

SEQ ID NO: 3162240 - protein, 18 aa, Giardia lamblia
LLPRDKIVNSLRAFAAEV

SEQ ID NO: 3162241 - protein, 24 aa, Giardia lamblia
LLPSEYKQAGFSYLAPETVQSKSL

SEQ ID NO: 3162242 - protein, 19 aa, Giardia lamblia
LLPSPVLLHPLFLFAENCP

SEQ ID NO: 3162243 - protein, 17 aa, Giardia lamblia
LLPSRRGSFEGRLFRGQ

SEQ ID NO: 3162244 - protein, 23 aa, Giardia lamblia
LLPVGEMYFLNIIRIPPQLTEAN

SEQ ID NO: 3162245 - protein, 21 aa, Giardia lamblia
LLPYERCMQDAGGQTALMSSV

SEQ ID NO: 3162246 - protein, 24 aa, Giardia lamblia
LLQACLKGVPLFAHELAVSPSFKR

SEQ ID NO: 3162247 - protein, 19 aa, Giardia lamblia
LLQACPLLFLKEGDVKTPR

SEQ ID NO: 3162248 - protein, 17 aa, Giardia lamblia
LLQDGKNLLGYNSDELF

SEQ ID NO: 3162249 - protein, 23 aa, Giardia lamblia
LLQKFTGIIGHLIVVEAINVRQS

SEQ ID NO: 3162250 - protein, 21 aa, Giardia lamblia
LLQKLRAGMNVVVGIIGICFL

SEQ ID NO: 3162251 - protein, 26 aa, Giardia lamblia
LLQLLPKCRCGKTFISKDTLLHHMKV

SEQ ID NO: 3162252 - protein, 45 aa, Giardia lamblia
LLQLQTICMKLPHCVNIIDRACNWACALFEKYFILTIEKILSDFP

SEQ ID NO: 3162253 - protein, 21 aa, Giardia lamblia
LLQRHPRCCFYVDEAAGAEVA

SEQ ID NO: 3162254 - protein, 22 aa, Giardia lamblia
LLQRRPRSAVKPEWNDLQQDHS

SEQ ID NO: 3162255 - protein, 19 aa, Giardia lamblia
LLRAFICTRNKAGVSRSLL

SEQ ID NO: 3162256 - protein, 19 aa, Giardia lamblia
LLRCSESLLDTKVCTGIQQ

SEQ ID NO: 3162257 - protein, 18 aa, Giardia lamblia
LLRDGCSATVRYGDVLST

SEQ ID NO: 3162258 - protein, 24 aa, Giardia lamblia
LLRKTCLYPDVVAVLSQDDSVLKE

SEQ ID NO: 3162259 - protein, 28 aa, Giardia lamblia
LLRNKFRLCTRRRMPVLTPLEVRALRCL

SEQ ID NO: 3162260 - protein, 20 aa, Giardia lamblia
LLRPGMETPLMRSAAVGNVS

SEQ ID NO: 3162261 - protein, 25 aa, Giardia lamblia
LLRPKCLNCNSLACKVSQLETDLKN

SEQ ID NO: 3162262 - protein, 21 aa, Giardia lamblia
LLRQRIQCLEKAPQQDVHRAS

SEQ ID NO: 3162263 - protein, 31 aa, Giardia lamblia
LLRRGESYAKHLFRARFPLTHEIDTPSIGSA

SEQ ID NO: 3162264 - protein, 24 aa, Giardia lamblia
LLRSHLGDSFPILDRRYVTTGWNW

SEQ ID NO: 3162265 - protein, 23 aa, Giardia lamblia
LLRSIDPAMAFSRTLVAKARGVL

SEQ ID NO: 3162266 - protein, 21 aa, Giardia lamblia
LLRSRCVQTAMANAGITLPSR

SEQ ID NO: 3162267 - protein, 24 aa, Giardia lamblia
LLSATMLSSFGWIYHLHVPSTLSP

SEQ ID NO: 3162268 - protein, 19 aa, Giardia lamblia
LLSCKPVVYLLNMSEADYS

SEQ ID NO: 3162269 - protein, 19 aa, Giardia lamblia
LLSDSSLQDNLRMLLNASK

SEQ ID NO: 3162270 - protein, 17 aa, Giardia lamblia
LLSDTHILQSFQPLKAS

SEQ ID NO: 3162271 - protein, 17 aa, Giardia lamblia
LLSELMPVVLRVVLPRL

SEQ ID NO: 3162272 - protein, 19 aa, Giardia lamblia
LLSFLTIFSQNFHKLQEFS

SEQ ID NO: 3162273 - protein, 17 aa, Giardia lamblia
LLSGIMCDTLILRSPTT

SEQ ID NO: 3162274 - protein, 24 aa, Giardia lamblia
LLSIAEIQYQLSIQHAKHTMEYTK

SEQ ID NO: 3162275 - protein, 39 aa, Giardia lamblia
LLSIGRYQWPFNVHAFIPLKLLPGFDFVTAINRADFYYD

SEQ ID NO: 3162276 - protein, 23 aa, Giardia lamblia
LLSKIYFLDSRVKTLLSNMHDIA

SEQ ID NO: 3162277 - protein, 23 aa, Giardia lamblia
LLSLKDRYDCAVAEMEDMRRELE

SEQ ID NO: 3162278 - protein, 22 aa, Giardia lamblia
LLSMRAPMGVRRRFRDREANPF

SEQ ID NO: 3162279 - protein, 25 aa, Giardia lamblia
LLSNYTCLIFDGFPNSVCDSDIIED

SEQ ID NO: 3162280 - protein, 28 aa, Giardia lamblia
LLSPEMTKRLLICFALISRNSTYRMNCL

SEQ ID NO: 3162281 - protein, 20 aa, Giardia lamblia
LLSQACGRASRPLAEALCYW

SEQ ID NO: 3162282 - protein, 17 aa, Giardia lamblia
LLSQFLYSFYKTFEASG

SEQ ID NO: 3162283 - protein, 25 aa, Giardia lamblia
LLSRDGRMYLVHCEDCSASRTVPAI

SEQ ID NO: 3162284 - protein, 18 aa, Giardia lamblia
LLSREPFMITSIGDIFLK

SEQ ID NO: 3162285 - protein, 18 aa, Giardia lamblia
LLSRGLCVQPELSDAGRK

SEQ ID NO: 3162286 - protein, 17 aa, Giardia lamblia
LLSRIALELPTQPAAPA

SEQ ID NO: 3162287 - protein, 18 aa, Giardia lamblia
LLSRSAIANKLLRKIQTR

SEQ ID NO: 3162288 - protein, 19 aa, Giardia lamblia
LLSSKYKLVEVLFYHTCFG

SEQ ID NO: 3162289 - protein, 17 aa, Giardia lamblia
LLSSLWKERTTNIVDTL

SEQ ID NO: 3162290 - protein, 26 aa, Giardia lamblia
LLSSRRRSPSIVGMGGTPRPDPYAKA

SEQ ID NO: 3162291 - protein, 20 aa, Giardia lamblia
LLSSVCGSSYWADVTNSSLE

SEQ ID NO: 3162292 - protein, 23 aa, Giardia lamblia
LLSTKWTPALGVSAILLSIQSLL

SEQ ID NO: 3162293 - protein, 19 aa, Giardia lamblia
LLSVPNCDLFLTVSQLEAK

SEQ ID NO: 3162294 - protein, 18 aa, Giardia lamblia
LLSYCSTIVRGDENINLT

SEQ ID NO: 3162295 - protein, 17 aa, Giardia lamblia
LLTALSYLHCPRKDETY

SEQ ID NO: 3162296 - protein, 19 aa, Giardia lamblia
LLTDVDLAAIQGFQKEARE

SEQ ID NO: 3162297 - protein, 24 aa, Giardia lamblia
LLTEFSPRVYLNFRKTFKKNRIEL

SEQ ID NO: 3162298 - protein, 19 aa, Giardia lamblia
LLTEGRKVYAPDDIVQMLM

SEQ ID NO: 3162299 - protein, 23 aa, Giardia lamblia
LLTELSFATSLCRLLVTNNPDDV

SEQ ID NO: 3162300 - protein, 23 aa, Giardia lamblia
LLTGNLPRFGNWNPRSRSSIIFN

SEQ ID NO: 3162301 - protein, 19 aa, Giardia lamblia
LLTGQGLGRRRRMAIERAI

SEQ ID NO: 3162302 - protein, 17 aa, Giardia lamblia
LLTGSRIGGHGDLSKEY

SEQ ID NO: 3162303 - protein, 25 aa, Giardia lamblia
LLTHERSDLMALKLELEAERDSLQV

SEQ ID NO: 3162304 - protein, 22 aa, Giardia lamblia
LLTKRAVSFYGCEDFFTLLDGT

SEQ ID NO: 3162305 - protein, 29 aa, Giardia lamblia
LLTKRQWYDLKMRGVLPFKNVGIVRAALL

SEQ ID NO: 3162306 - protein, 17 aa, Giardia lamblia
LLTKVEDEWELIKKQNA

SEQ ID NO: 3162307 - protein, 18 aa, Giardia lamblia
LLTLVFKCVDLVDLILTS

SEQ ID NO: 3162308 - protein, 18 aa, Giardia lamblia
LLTLWSCPNYCYRAGNVA

SEQ ID NO: 3162309 - protein, 18 aa, Giardia lamblia
LLTNAKFVTGQGMSALVI

SEQ ID NO: 3162310 - protein, 19 aa, Giardia lamblia
LLTNFAYAFVAYACHELGA

SEQ ID NO: 3162311 - protein, 24 aa, Giardia lamblia
LLTNGFYGDMRWLVGPHTYIDLSA

SEQ ID NO: 3162312 - protein, 26 aa, Giardia lamblia
LLTPDGRTALMLAIEGKYLEGIDLLV

SEQ ID NO: 3162313 - protein, 25 aa, Giardia lamblia
LLTPECDMWSLGALVYELCTGTPLI

SEQ ID NO: 3162314 - protein, 25 aa, Giardia lamblia
LLTQLSEIVMHIGFLYTSNAMHIDP

SEQ ID NO: 3162315 - protein, 22 aa, Giardia lamblia
LLTRRIREGIEMITGPVDVVGI

SEQ ID NO: 3162316 - protein, 18 aa, Giardia lamblia
LLTSGKFDDGWMLIDNQL

SEQ ID NO: 3162317 - protein, 18 aa, Giardia lamblia
LLTSLRLRGFDFCEALNL

SEQ ID NO: 3162318 - protein, 20 aa, Giardia lamblia
LLTVEGYSALYLALLSNHVG

SEQ ID NO: 3162319 - protein, 17 aa, Giardia lamblia
LLVAAPIIQHPRYIKYI

SEQ ID NO: 3162320 - protein, 23 aa, Giardia lamblia
LLVDTRLWFQSQLKEELVALSDY

SEQ ID NO: 3162321 - protein, 18 aa, Giardia lamblia
LLVEMGICNDLSNSEMSH

SEQ ID NO: 3162322 - protein, 24 aa, Giardia lamblia
LLVERRKFGSLGYNIQYQFTQSDY

SEQ ID NO: 3162323 - protein, 17 aa, Giardia lamblia
LLVFSIPANDNMKEFLS

SEQ ID NO: 3162324 - protein, 26 aa, Giardia lamblia
LLVLPCGSLSRPLVALLQPWEPALCG

SEQ ID NO: 3162325 - protein, 18 aa, Giardia lamblia
LLVNQCFYIDNLYQQVTA

SEQ ID NO: 3162326 - protein, 18 aa, Giardia lamblia
LLVPYEMHIRDKYGCLPL

SEQ ID NO: 3162327 - protein, 28 aa, Giardia lamblia
LLVRDCEGRTALDWAVAAGQVDAVRVLS

SEQ ID NO: 3162328 - protein, 24 aa, Giardia lamblia
LLVSARSKRDLGFSLAQEKPSRTA

SEQ ID NO: 3162329 - protein, 19 aa, Giardia lamblia
LLVSKEAKCMGFYEPEIPE

SEQ ID NO: 3162330 - protein, 25 aa, Giardia lamblia
LLVTLFLCVLCKRPIPALKQPIIDI

SEQ ID NO: 3162331 - protein, 17 aa, Giardia lamblia
LLVTYGFTEGDSVHIKT

SEQ ID NO: 3162332 - protein, 25 aa, Giardia lamblia
LLYDHYLALVCKRHVNIADISDTAA

SEQ ID NO: 3162333 - protein, 18 aa, Giardia lamblia
LLYEGICRGLSAVKAAAS

SEQ ID NO: 3162334 - protein, 21 aa, Giardia lamblia
LLYELCTFQAFVTGRTPNDVL

SEQ ID NO: 3162335 - protein, 19 aa, Giardia lamblia
LLYGAPRAATVITTVESSF

SEQ ID NO: 3162336 - protein, 18 aa, Giardia lamblia
LLYGCPGTGKSFLAKAVA

SEQ ID NO: 3162337 - protein, 20 aa, Giardia lamblia
LLYGYIRQGVVTECPHCSLC

SEQ ID NO: 3162338 - protein, 20 aa, Giardia lamblia
LLYHFVDAVSPFLTFDPLPR

SEQ ID NO: 3162339 - protein, 17 aa, Giardia lamblia
LLYLPLWVWQVYEQNLL

SEQ ID NO: 3162340 - protein, 17 aa, Giardia lamblia
LLYMSPQDVWGLGCILY

SEQ ID NO: 3162341 - protein, 17 aa, Giardia lamblia
LLYQQDADRFSAVAQSI

SEQ ID NO: 3162342 - protein, 18 aa, Giardia lamblia
LMAACANGFDEIVSVLLP

SEQ ID NO: 3162343 - protein, 26 aa, Giardia lamblia
LMAAICAGCEAAVKILAPVQAGRADS

SEQ ID NO: 3162344 - protein, 19 aa, Giardia lamblia
LMAQKGRLVDVFSSLLNIY

SEQ ID NO: 3162345 - protein, 17 aa, Giardia lamblia
LMARWKLANQELSSTAE

SEQ ID NO: 3162346 - protein, 25 aa, Giardia lamblia
LMCAAKYGRLDVVTFLLEAESRIVT

SEQ ID NO: 3162347 - protein, 19 aa, Giardia lamblia
LMDAARLGNIAAIKLLMAK

SEQ ID NO: 3162348 - protein, 23 aa, Giardia lamblia
LMEAARWARLECIELLVEQEHGM

SEQ ID NO: 3162349 - protein, 23 aa, Giardia lamblia
LMECAKRGDVIGVRASREDYCKV

SEQ ID NO: 3162350 - protein, 18 aa, Giardia lamblia
LMECPLDLQVPAKKQNTG

SEQ ID NO: 3162351 - protein, 19 aa, Giardia lamblia
LMEGLSSFLHTGRSTALIR

SEQ ID NO: 3162352 - protein, 34 aa, Giardia lamblia
LMFPDSYAMYRFSRPLLRMAICTLSPKGHIRVKG

SEQ ID NO: 3162353 - protein, 19 aa, Giardia lamblia
LMHQTRLVWQTSVLPKMKA

SEQ ID NO: 3162354 - protein, 18 aa, Giardia lamblia
LMHVRMPAVPRLYTILRE

SEQ ID NO: 3162355 - protein, 25 aa, Giardia lamblia
LMIAARTGFLDGVRLLIREVRIRNM

SEQ ID NO: 3162356 - protein, 17 aa, Giardia lamblia
LMIAASRGYSDIVKILM

SEQ ID NO: 3162357 - protein, 24 aa, Giardia lamblia
LMIFLPKIAVLFLEPEFVFNNGAA

SEQ ID NO: 3162358 - protein, 24 aa, Giardia lamblia
LMIQKICLIQAFTRGYLVHRRYCI

SEQ ID NO: 3162359 - protein, 26 aa, Giardia lamblia
LMIQKLPWIPGGWMFTADRRVIRLSE

SEQ ID NO: 3162360 - protein, 35 aa, Giardia lamblia
LMKEVPNDVSLCLAVRTLFDFPNLFTAANVQHLSA

SEQ ID NO: 3162361 - protein, 25 aa, Giardia lamblia
LMKYISLLFCDGFAAPATPNTTQVK

SEQ ID NO: 3162362 - protein, 31 aa, Giardia lamblia
LMLAAKLDVSSCIPILLPYLSDCRRDDSVTP

SEQ ID NO: 3162363 - protein, 18 aa, Giardia lamblia
LMLAARGGHLACVQELIP

SEQ ID NO: 3162364 - protein, 31 aa, Giardia lamblia
LMLAIRLQREAELRILLPYELTILDKQDEQP

SEQ ID NO: 3162365 - protein, 21 aa, Giardia lamblia
LMLAVTYGWIDLVKELAPTEA

SEQ ID NO: 3162366 - protein, 17 aa, Giardia lamblia
LMLKDIISQKELHISDL

SEQ ID NO: 3162367 - protein, 27 aa, Giardia lamblia
LMLRGKMAILQACCFVPGKSEGSAEKV

SEQ ID NO: 3162368 - protein, 30 aa, Giardia lamblia
LMLSPWKRYSSLIINWACFEVRHIAALRGK

SEQ ID NO: 3162369 - protein, 18 aa, Giardia lamblia
LMLVLRFAPLPKVVEMMD

SEQ ID NO: 3162370 - protein, 26 aa, Giardia lamblia
LMLYERRLGDTKGMTALMYAAIHGNV

SEQ ID NO: 3162371 - protein, 18 aa, Giardia lamblia
LMMAVERGLNFAIPLLIS

SEQ ID NO: 3162372 - protein, 18 aa, Giardia lamblia
LMMRAFKLDHNDFLTKMS

SEQ ID NO: 3162373 - protein, 24 aa, Giardia lamblia
LMMSMDYYSYISLVRDLRLGTDPA

SEQ ID NO: 3162374 - protein, 32 aa, Giardia lamblia
LMNDLLHRCSHAWRAAGVNIFRLNEAQSHRSG

SEQ ID NO: 3162375 - protein, 18 aa, Giardia lamblia
LMNIFPLEHRMLYEKGDA

SEQ ID NO: 3162376 - protein, 19 aa, Giardia lamblia
LMNKWPLLSCTIGYHPTRA

SEQ ID NO: 3162377 - protein, 19 aa, Giardia lamblia
LMNLEEVMNTPGLEVPEDP

SEQ ID NO: 3162378 - protein, 18 aa, Giardia lamblia
LMPSIALTICAKADAKYP

SEQ ID NO: 3162379 - protein, 32 aa, Giardia lamblia
LMPSSVYCKGLTVGESCWFLFETGIVGSITLS

SEQ ID NO: 3162380 - protein, 18 aa, Giardia lamblia
LMQAVALGNEADIKAYLI

SEQ ID NO: 3162381 - protein, 19 aa, Giardia lamblia
LMQKEARIQTHFGTTALMD

SEQ ID NO: 3162382 - protein, 19 aa, Giardia lamblia
LMQSEDFLSALHRDASKTI

SEQ ID NO: 3162383 - protein, 32 aa, Giardia lamblia
LMREFEADLANFLLKYVISIIFPSQQEPACIL

SEQ ID NO: 3162384 - protein, 25 aa, Giardia lamblia
LMRGDSSLFPFGFHVTGMPICGAAK

SEQ ID NO: 3162385 - protein, 19 aa, Giardia lamblia
LMRNKRRVLAAKKALFVKY

SEQ ID NO: 3162386 - protein, 28 aa, Giardia lamblia
LMRQEGKSYCELALWQVAAQLIDTMTYC

SEQ ID NO: 3162387 - protein, 22 aa, Giardia lamblia
LMRRDTHPFFLPTDYDKDGRIK

SEQ ID NO: 3162388 - protein, 21 aa, Giardia lamblia
LMSEICFYASCGSIFTDILYF

SEQ ID NO: 3162389 - protein, 31 aa, Giardia lamblia
LMSPRASEFITYAYKRVCNPLEHINDDIPSS

SEQ ID NO: 3162390 - protein, 19 aa, Giardia lamblia
LMSRFGRPSVLRASPYNSD

SEQ ID NO: 3162391 - protein, 30 aa, Giardia lamblia
LMSSQCTRDAKIVFLYSFTKYGRVQADTQS

SEQ ID NO: 3162392 - protein, 31 aa, Giardia lamblia
LMSSVYRRSIGCFRLLLEAEAGMQGKDGATA

SEQ ID NO: 3162393 - protein, 18 aa, Giardia lamblia
LMTAAKLGNFEAAELLAP

SEQ ID NO: 3162394 - protein, 23 aa, Giardia lamblia
LMTLKICGQVIIHMLRYLVVRSV

SEQ ID NO: 3162395 - protein, 25 aa, Giardia lamblia
LMTSFSKEHLFMFAKDYQTQTGTDL

SEQ ID NO: 3162396 - protein, 29 aa, Giardia lamblia
LMVATRASALPVIRILAEYEACLINNDGC

SEQ ID NO: 3162397 - protein, 25 aa, Giardia lamblia
LMVFHGASVLVCMGPGQSRLVGKKI

SEQ ID NO: 3162398 - protein, 24 aa, Giardia lamblia
LMVKQRRPGLVYCLLSQAGKQDSH

SEQ ID NO: 3162399 - protein, 27 aa, Giardia lamblia
LMYAARYGHYECCKVLARYETGMKNRH

SEQ ID NO: 3162400 - protein, 24 aa, Giardia lamblia
LMYDRCISTLLLAVSVVTKGPIVA

SEQ ID NO: 3162401 - protein, 26 aa, Giardia lamblia
LMYEAAPCPRCNSPAFRLSPADSPLG

SEQ ID NO: 3162402 - protein, 22 aa, Giardia lamblia
LMYELCTLTPPPFDSGTLTETP

SEQ ID NO: 3162403 - protein, 18 aa, Giardia lamblia
LMYVSARRLCMLKAQIAC

SEQ ID NO: 3162404 - protein, 20 aa, Giardia lamblia
LNACMTREKIFIVFENKVFV

SEQ ID NO: 3162405 - protein, 18 aa, Giardia lamblia
LNAECRRTARKIGAVPII

SEQ ID NO: 3162406 - protein, 24 aa, Giardia lamblia
LNAEFINLPLLVLVSEGQVESSRA

SEQ ID NO: 3162407 - protein, 25 aa, Giardia lamblia
LNAKGKMYLCPQCFSPYCKACKMEM

SEQ ID NO: 3162408 - protein, 22 aa, Giardia lamblia
LNALELLLPYLADCRDHQHQTA

SEQ ID NO: 3162409 - protein, 29 aa, Giardia lamblia
LNAPKKYGSICNFFFNIVRQCLRINPVGP

SEQ ID NO: 3162410 - protein, 24 aa, Giardia lamblia
LNAYPEKLNTAILLLTDAINLCPC

SEQ ID NO: 3162411 - protein, 21 aa, Giardia lamblia
LNCLKSWKAYAEKRLCDEVTA

SEQ ID NO: 3162412 - protein, 18 aa, Giardia lamblia
LNDALCELREKPLSVAPS

SEQ ID NO: 3162413 - protein, 26 aa, Giardia lamblia
LNDGEIPFLFTFESLLPFTVSPITGI

SEQ ID NO: 3162414 - protein, 18 aa, Giardia lamblia
LNDRIRILGERRSTVLMN

SEQ ID NO: 3162415 - protein, 17 aa, Giardia lamblia
LNDRLSALTAQLNTFSQ

SEQ ID NO: 3162416 - protein, 19 aa, Giardia lamblia
LNEAKRFVAESAGREQGLS

SEQ ID NO: 3162417 - protein, 28 aa, Giardia lamblia
LNEIFLRMRELRALYPVTEEQLNDETIL

SEQ ID NO: 3162418 - protein, 17 aa, Giardia lamblia
LNEKYVIEITNLKRTLR

SEQ ID NO: 3162419 - protein, 19 aa, Giardia lamblia
LNENGCLLYLFTYHASYMI

SEQ ID NO: 3162420 - protein, 19 aa, Giardia lamblia
LNERAHVLLTKFNSHITEI

SEQ ID NO: 3162421 - protein, 29 aa, Giardia lamblia
LNERIGRLLGKVCTIRIGAKTELEAEEKK

SEQ ID NO: 3162422 - protein, 18 aa, Giardia lamblia
LNESINFINRGMDLEAAT

SEQ ID NO: 3162423 - protein, 17 aa, Giardia lamblia
LNESLPFYDREQYYGDH

SEQ ID NO: 3162424 - protein, 26 aa, Giardia lamblia
LNESQARLGLELKQRIEERFRAGRQK

SEQ ID NO: 3162425 - protein, 25 aa, Giardia lamblia
LNETNIPFLLGYYYVGKILNDYVHE

SEQ ID NO: 3162426 - protein, 18 aa, Giardia lamblia
LNEVKYLPDDGSGRIHAL

SEQ ID NO: 3162427 - protein, 27 aa, Giardia lamblia
LNEVYELRKRFDYMRERFEPMQKEVEK

SEQ ID NO: 3162428 - protein, 26 aa, Giardia lamblia
LNFITCLRGALQLDLTKASPIRYRSF

SEQ ID NO: 3162429 - protein, 18 aa, Giardia lamblia
LNFLKREMSLTVNYNTLG

SEQ ID NO: 3162430 - protein, 22 aa, Giardia lamblia
LNFLQWIYSPQMEKLDFQFKDD

SEQ ID NO: 3162431 - protein, 19 aa, Giardia lamblia
LNFRDCSIVVLDEADMLLS

SEQ ID NO: 3162432 - protein, 19 aa, Giardia lamblia
LNFYRTRIGTTECMLFTLP

SEQ ID NO: 3162433 - protein, 21 aa, Giardia lamblia
LNGERDWKPYLLLQTDPQMIL

SEQ ID NO: 3162434 - protein, 20 aa, Giardia lamblia
LNGFTAKNYVAFTADARDTQ

SEQ ID NO: 3162435 - protein, 19 aa, Giardia lamblia
LNGIRTCLDQGSLDSALKL

SEQ ID NO: 3162436 - protein, 19 aa, Giardia lamblia
LNGMLVFCLLTLISDTILT

SEQ ID NO: 3162437 - protein, 26 aa, Giardia lamblia
LNGNTAICGTVWWRAPEQCFGLNKHY

SEQ ID NO: 3162438 - protein, 18 aa, Giardia lamblia
LNGSNVREAVHIRRFIHN

SEQ ID NO: 3162439 - protein, 18 aa, Giardia lamblia
LNGTKSRLSSTIHHSKPQ

SEQ ID NO: 3162440 - protein, 19 aa, Giardia lamblia
LNGVLALCSLRAIRVKHRG

SEQ ID NO: 3162441 - protein, 23 aa, Giardia lamblia
LNHIKMLFEIAFLRQADVAQCIC

SEQ ID NO: 3162442 - protein, 19 aa, Giardia lamblia
LNHKFSLAIVKEAQEQAKK

SEQ ID NO: 3162443 - protein, 23 aa, Giardia lamblia
LNHVECLDVLKVEAGIQTHSGET

SEQ ID NO: 3162444 - protein, 20 aa, Giardia lamblia
LNIDKYVRRYYDLITPNTKF

SEQ ID NO: 3162445 - protein, 19 aa, Giardia lamblia
LNIKLPRFYSNPKNKAIFD

SEQ ID NO: 3162446 - protein, 18 aa, Giardia lamblia
LNILKSAESAMCLFDYDD

SEQ ID NO: 3162447 - protein, 19 aa, Giardia lamblia
LNIQDARGFSPIDYAIVSP

SEQ ID NO: 3162448 - protein, 17 aa, Giardia lamblia
LNISRNSAYHWYHETYV

SEQ ID NO: 3162449 - protein, 25 aa, Giardia lamblia
LNKAELPFSLCLTLVPLESVDQNLP

SEQ ID NO: 3162450 - protein, 23 aa, Giardia lamblia
LNKELPNGLPILSVVHGDVKPAN

SEQ ID NO: 3162451 - protein, 18 aa, Giardia lamblia
LNKIPRMITDVCYPTLKP

SEQ ID NO: 3162452 - protein, 24 aa, Giardia lamblia
LNKLQPVCNILGLTRKLYTKKDQV

SEQ ID NO: 3162453 - protein, 22 aa, Giardia lamblia
LNKNKLFLATGMIKQMTDAQRI

SEQ ID NO: 3162454 - protein, 18 aa, Giardia lamblia
LNLACIEVLAPLEAALSG

SEQ ID NO: 3162455 - protein, 25 aa, Giardia lamblia
LNLAEFYLWCKICDISRHEFQRIYD

SEQ ID NO: 3162456 - protein, 26 aa, Giardia lamblia
LNLDGDCALAFALDRRDIKSISLLAA

SEQ ID NO: 3162457 - protein, 28 aa, Giardia lamblia
LNLECQGMSPVHIAPRFVEGTFIPEQAY

SEQ ID NO: 3162458 - protein, 25 aa, Giardia lamblia
LNLEHVFKHLLSYSAGAIIDHILSR

SEQ ID NO: 3162459 - protein, 19 aa, Giardia lamblia
LNLELALSLILFELYGDEP

SEQ ID NO: 3162460 - protein, 20 aa, Giardia lamblia
LNLILARIILNSIFVYDSSS

SEQ ID NO: 3162461 - protein, 23 aa, Giardia lamblia
LNLKVQHVNGWEVVKENPKYKQR

SEQ ID NO: 3162462 - protein, 19 aa, Giardia lamblia
LNLLAKIPLSYTFWNYRRD

SEQ ID NO: 3162463 - protein, 31 aa, Giardia lamblia
LNLLERLQKIIFFPPFRVCVDQRHLGNVSRY

SEQ ID NO: 3162464 - protein, 19 aa, Giardia lamblia
LNLLIKANRPISSNIPMNA

SEQ ID NO: 3162465 - protein, 22 aa, Giardia lamblia
LNLLKRLELRSEDTRLMHSKGR

SEQ ID NO: 3162466 - protein, 17 aa, Giardia lamblia
LNLPPSLLSRFDLIYLL

SEQ ID NO: 3162467 - protein, 17 aa, Giardia lamblia
LNLSPSAAWALGFGTTK

SEQ ID NO: 3162468 - protein, 20 aa, Giardia lamblia
LNLWREAYLGVCVLPKDTYK

SEQ ID NO: 3162469 - protein, 20 aa, Giardia lamblia
LNMRACLHAPDALPDDFTDL

SEQ ID NO: 3162470 - protein, 24 aa, Giardia lamblia
LNNRRIISALDFLCLYDCMASSKI

SEQ ID NO: 3162471 - protein, 25 aa, Giardia lamblia
LNPAVPRMAFSIVVQLDVDGRLLPQ

SEQ ID NO: 3162472 - protein, 20 aa, Giardia lamblia
LNPKFMLGRYFTTLKNRLKR

SEQ ID NO: 3162473 - protein, 27 aa, Giardia lamblia
LNPKLSEWYSGPSFLDLLDELKVPKRD

SEQ ID NO: 3162474 - protein, 20 aa, Giardia lamblia
LNPLAFEVMAAKLLNIDSVL

SEQ ID NO: 3162475 - protein, 17 aa, Giardia lamblia
LNPLEMRLHAALQESLG

SEQ ID NO: 3162476 - protein, 26 aa, Giardia lamblia
LNPLFQYYLEAVVSFSNILSSCLRSG

SEQ ID NO: 3162477 - protein, 24 aa, Giardia lamblia
LNPLKLARIGFCTKPKAISDKEFA

SEQ ID NO: 3162478 - protein, 22 aa, Giardia lamblia
LNQCLAQIPLADCDVISDHRKE

SEQ ID NO: 3162479 - protein, 24 aa, Giardia lamblia
LNQLQCLKQAFKEIAVALRRVLKL

SEQ ID NO: 3162480 - protein, 24 aa, Giardia lamblia
LNQRSELQRPLSISDLISPNQQTM

SEQ ID NO: 3162481 - protein, 25 aa, Giardia lamblia
LNQSELYPLLPFKACYYCNKLMHML

SEQ ID NO: 3162482 - protein, 20 aa, Giardia lamblia
LNRIDGRKQGYAYINLGTKE

SEQ ID NO: 3162483 - protein, 20 aa, Giardia lamblia
LNRILSVKFVQDMAVCEIEK

SEQ ID NO: 3162484 - protein, 17 aa, Giardia lamblia
LNRITAMHFRECKGCKY

SEQ ID NO: 3162485 - protein, 22 aa, Giardia lamblia
LNRKKLRLQIEEEALRRESEAR

SEQ ID NO: 3162486 - protein, 27 aa, Giardia lamblia
LNRRICPRTSEDFQLLYDEVAVWVRQQ

SEQ ID NO: 3162487 - protein, 17 aa, Giardia lamblia
LNRRKVDGAQDVAMVTS

SEQ ID NO: 3162488 - protein, 26 aa, Giardia lamblia
LNRRSFVRILARFESRIHGPQNLLPI

SEQ ID NO: 3162489 - protein, 25 aa, Giardia lamblia
LNSFYTGLLPFEFLAHARAGRDGVI

SEQ ID NO: 3162490 - protein, 19 aa, Giardia lamblia
LNSGIKFASQQSRNLAGLS

SEQ ID NO: 3162491 - protein, 17 aa, Giardia lamblia
LNSGKWGTGKIERAVET

SEQ ID NO: 3162492 - protein, 18 aa, Giardia lamblia
LNSLPGFATSSLRLMNRS

SEQ ID NO: 3162493 - protein, 18 aa, Giardia lamblia
LNSMARRASNRARIEQRV

SEQ ID NO: 3162494 - protein, 25 aa, Giardia lamblia
LNSPNRRVLCALAIGYPAVQMPPAD

SEQ ID NO: 3162495 - protein, 18 aa, Giardia lamblia
LNSRCIRSVLTECNVQRP

SEQ ID NO: 3162496 - protein, 28 aa, Giardia lamblia
LNSRELPCTWPIIMLDGSIDPLWIEALN

SEQ ID NO: 3162497 - protein, 27 aa, Giardia lamblia
LNSRSSLHVIYRPEFFTETVTKQFATG

SEQ ID NO: 3162498 - protein, 18 aa, Giardia lamblia
LNSTRLGVIFQEENECPT

SEQ ID NO: 3162499 - protein, 26 aa, Giardia lamblia
LNTEVVKICFNWVRDPKICDSMIDWE

SEQ ID NO: 3162500 - protein, 18 aa, Giardia lamblia
LNTIPRSEGILRKLGVPI

SEQ ID NO: 3162501 - protein, 26 aa, Giardia lamblia
LNTIPWKSSFVRVMPYISNYDHSMVK

SEQ ID NO: 3162502 - protein, 29 aa, Giardia lamblia
LNTKEFDYAPYIPEFLSYPAKGDRQDWKQ

SEQ ID NO: 3162503 - protein, 17 aa, Giardia lamblia
LNTKLAKYFPVLSAQVK

SEQ ID NO: 3162504 - protein, 18 aa, Giardia lamblia
LNTLKHYFIITGGAIDVK

SEQ ID NO: 3162505 - protein, 25 aa, Giardia lamblia
LNTVCDIWRTYRRVISHNEALRKTQ

SEQ ID NO: 3162506 - protein, 26 aa, Giardia lamblia
LNTYLEVFFFFALAWGVGSNIATEDD

SEQ ID NO: 3162507 - protein, 26 aa, Giardia lamblia
LNVDICLNNRLAIRNTLLLAEYLRAD

SEQ ID NO: 3162508 - protein, 25 aa, Giardia lamblia
LNVRPTCRGVLKGVVIFNSMELGEF

SEQ ID NO: 3162509 - protein, 18 aa, Giardia lamblia
LNYEAGPVKPSRPEREPD

SEQ ID NO: 3162510 - protein, 17 aa, Giardia lamblia
LNYLKRFDTSGINVMHY

SEQ ID NO: 3162511 - protein, 20 aa, Giardia lamblia
LNYLNARAGSISEQQLGIRL

SEQ ID NO: 3162512 - protein, 26 aa, Giardia lamblia
LNYNRLENFIQFPFAKLKNLEIFSAV

SEQ ID NO: 3162513 - protein, 27 aa, Giardia lamblia
LNYRHFIKFELPYSFTVDGDCSNKIPL

SEQ ID NO: 3162514 - protein, 21 aa, Giardia lamblia
LNYSLCLAATCKVTEALERLM

SEQ ID NO: 3162515 - protein, 17 aa, Giardia lamblia
LNYYRNGPVSQQEVDKR

SEQ ID NO: 3162516 - protein, 25 aa, Giardia lamblia
LPAEKFLFRFTEPFDNSIDCALANA

SEQ ID NO: 3162517 - protein, 17 aa, Giardia lamblia
LPAEVVSCMQLVTYLTP

SEQ ID NO: 3162518 - protein, 23 aa, Giardia lamblia
LPALMPSTAFILKCLEFTDTGEE

SEQ ID NO: 3162519 - protein, 28 aa, Giardia lamblia
LPAMRRELRCASCMGHVYKPENQHEWGI

SEQ ID NO: 3162520 - protein, 17 aa, Giardia lamblia
LPCNHLIIHRVRENKIH

SEQ ID NO: 3162521 - protein, 26 aa, Giardia lamblia
LPCTHTFHRICLIRWLHYDNTSCPLC

SEQ ID NO: 3162522 - protein, 17 aa, Giardia lamblia
LPCVMKMLPDEHDQMTA

SEQ ID NO: 3162523 - protein, 19 aa, Giardia lamblia
LPCYLEAAGEQAIQYELVN

SEQ ID NO: 3162524 - protein, 20 aa, Giardia lamblia
LPDAHPVLLPHLEKDVKITT

SEQ ID NO: 3162525 - protein, 18 aa, Giardia lamblia
LPDALSYVDVYKMMQDYA

SEQ ID NO: 3162526 - protein, 17 aa, Giardia lamblia
LPDESKRYFQVDFDFGE

SEQ ID NO: 3162527 - protein, 21 aa, Giardia lamblia
LPDKRDAYMIAAQVGSYDALV

SEQ ID NO: 3162528 - protein, 21 aa, Giardia lamblia
LPDLKMKVHLQLDKYSRELAS

SEQ ID NO: 3162529 - protein, 25 aa, Giardia lamblia
LPDLVAKLWRAELRTSSDGPAPPRA

SEQ ID NO: 3162530 - protein, 22 aa, Giardia lamblia
LPDNLKALFRPISMVVPNYALI

SEQ ID NO: 3162531 - protein, 20 aa, Giardia lamblia
LPDNLKALFRSVSCMVPDYS

SEQ ID NO: 3162532 - protein, 26 aa, Giardia lamblia
LPDPPFLPRRGHTCVSIGKYILLFGG

SEQ ID NO: 3162533 - protein, 22 aa, Giardia lamblia
LPDPPGAPLLELFDLDTELASE

SEQ ID NO: 3162534 - protein, 17 aa, Giardia lamblia
LPDPTGRYEILKIHSKG

SEQ ID NO: 3162535 - protein, 17 aa, Giardia lamblia
LPDRSGQMTTFINFHDC

SEQ ID NO: 3162536 - protein, 17 aa, Giardia lamblia
LPDSLRRSTSTHVSLYE

SEQ ID NO: 3162537 - protein, 17 aa, Giardia lamblia
LPDSMVLSSASIIHTEK

SEQ ID NO: 3162538 - protein, 28 aa, Giardia lamblia
LPDTMKFRIVREIIRMINPICDDSMIDA

SEQ ID NO: 3162539 - protein, 23 aa, Giardia lamblia
LPEADVLALLWRAMELLSEEPTV

SEQ ID NO: 3162540 - protein, 29 aa, Giardia lamblia
LPEAIFMRHITKVAGALSCQVIEVSPQNA

SEQ ID NO: 3162541 - protein, 17 aa, Giardia lamblia
LPEAMIAASARMQDNEG

SEQ ID NO: 3162542 - protein, 17 aa, Giardia lamblia
LPEESPKMYGLHPNAEI

SEQ ID NO: 3162543 - protein, 21 aa, Giardia lamblia
LPEEVRKSIPESFTLEKKDKE

SEQ ID NO: 3162544 - protein, 25 aa, Giardia lamblia
LPEEYRECIDLMKRGDLPEACVQLI

SEQ ID NO: 3162545 - protein, 24 aa, Giardia lamblia
LPEHHKLRHLNIAFNPIKALDVSR

SEQ ID NO: 3162546 - protein, 27 aa, Giardia lamblia
LPEKLLCGRQHLFLSLCDLVVHLPPDT

SEQ ID NO: 3162547 - protein, 29 aa, Giardia lamblia
LPEKWLQQLEKRSGGSIVNAFQYNNDTAE

SEQ ID NO: 3162548 - protein, 28 aa, Giardia lamblia
LPENDLWLKPDRNIGVTSCIIIAPHLRK

SEQ ID NO: 3162549 - protein, 24 aa, Giardia lamblia
LPEPFIKRLVKTLITISNEYTEKA

SEQ ID NO: 3162550 - protein, 21 aa, Giardia lamblia
LPEPQVEMFMHHRSSQEQQSQ

SEQ ID NO: 3162551 - protein, 21 aa, Giardia lamblia
LPEQMVYSIMTIRKALFESTS

SEQ ID NO: 3162552 - protein, 28 aa, Giardia lamblia
LPESSIKWYMWQLLHAVRIAHASGTFHR

SEQ ID NO: 3162553 - protein, 19 aa, Giardia lamblia
LPFHERPFFATKIRELCDL

SEQ ID NO: 3162554 - protein, 24 aa, Giardia lamblia
LPFPDARFNLAMLARLTLDLQTAW

SEQ ID NO: 3162555 - protein, 19 aa, Giardia lamblia
LPFSEEVLRSYALQLLTGI

SEQ ID NO: 3162556 - protein, 17 aa, Giardia lamblia
LPFSLGIQHSKACAEVV

SEQ ID NO: 3162557 - protein, 23 aa, Giardia lamblia
LPGAEESLECGIIPRSQGHLVIP

SEQ ID NO: 3162558 - protein, 19 aa, Giardia lamblia
LPGGKNPLMVCIEHGGTNA

SEQ ID NO: 3162559 - protein, 23 aa, Giardia lamblia
LPGRVSGAISCYSLLMADSLAII

SEQ ID NO: 3162560 - protein, 17 aa, Giardia lamblia
LPHILVKSVPCRMNISF

SEQ ID NO: 3162561 - protein, 19 aa, Giardia lamblia
LPHLCERVALRNAKISLVW

SEQ ID NO: 3162562 - protein, 26 aa, Giardia lamblia
LPHNGSKKGAIGMLGRMEMIKEDRML

SEQ ID NO: 3162563 - protein, 25 aa, Giardia lamblia
LPHTRENFNLPPLVEGHSVPVDKGT

SEQ ID NO: 3162564 - protein, 19 aa, Giardia lamblia
LPIAAKLYHREYGLQNAGG

SEQ ID NO: 3162565 - protein, 21 aa, Giardia lamblia
LPIAYTIKVGMYDGTYKPELD

SEQ ID NO: 3162566 - protein, 17 aa, Giardia lamblia
LPICKELQSHLVPAESY

SEQ ID NO: 3162567 - protein, 24 aa, Giardia lamblia
LPIDRDIVNRMLLIYETVAFHLSR

SEQ ID NO: 3162568 - protein, 25 aa, Giardia lamblia
LPIIKALRLSPALIARTGCEVQIIR

SEQ ID NO: 3162569 - protein, 20 aa, Giardia lamblia
LPINILRHISAYMSDSRHDL

SEQ ID NO: 3162570 - protein, 17 aa, Giardia lamblia
LPINRRLPFAIRQHNPL

SEQ ID NO: 3162571 - protein, 17 aa, Giardia lamblia
LPIPSMPQCFVAVAESG

SEQ ID NO: 3162572 - protein, 19 aa, Giardia lamblia
LPIVPRPPVAAAVAAISVR

SEQ ID NO: 3162573 - protein, 19 aa, Giardia lamblia
LPIYKARPRTFLNDDSRHT

SEQ ID NO: 3162574 - protein, 22 aa, Giardia lamblia
LPKELRKLASMQLKLFSELIEC

SEQ ID NO: 3162575 - protein, 24 aa, Giardia lamblia
LPKFLVDDIELFMGIIQDLFPGVQ

SEQ ID NO: 3162576 - protein, 17 aa, Giardia lamblia
LPKHVDPAISLMKLDKV

SEQ ID NO: 3162577 - protein, 24 aa, Giardia lamblia
LPKIPGVSKLRCDSASGVTDVASS

SEQ ID NO: 3162578 - protein, 22 aa, Giardia lamblia
LPKNFLLPFISKVALTRYLPTI

SEQ ID NO: 3162579 - protein, 18 aa, Giardia lamblia
LPKQDFLKLFVAKATSEK

SEQ ID NO: 3162580 - protein, 27 aa, Giardia lamblia
LPKRIANPVICCLNFELEWQAEKDNAE

SEQ ID NO: 3162581 - protein, 18 aa, Giardia lamblia
LPKRRPQSAAAMYTQSHE

SEQ ID NO: 3162582 - protein, 24 aa, Giardia lamblia
LPKRVVAETFLLVVPRFLETDMTA

SEQ ID NO: 3162583 - protein, 25 aa, Giardia lamblia
LPKSNLLVVLTFKFNSFKENQRRVL

SEQ ID NO: 3162584 - protein, 21 aa, Giardia lamblia
LPKTHPIYALPSVSIRAQLWD

SEQ ID NO: 3162585 - protein, 26 aa, Giardia lamblia
LPLALEAFAGLDFVALFVVPTTHLLT

SEQ ID NO: 3162586 - protein, 26 aa, Giardia lamblia
LPLELMPVPVPLDYVTFLRSEYEDRE

SEQ ID NO: 3162587 - protein, 20 aa, Giardia lamblia
LPLEQLDTILVFLLNHATNF

SEQ ID NO: 3162588 - protein, 17 aa, Giardia lamblia
LPLFDFQAFVHPILLFA

SEQ ID NO: 3162589 - protein, 17 aa, Giardia lamblia
LPLGASNFIRRRRCKDL

SEQ ID NO: 3162590 - protein, 20 aa, Giardia lamblia
LPLGMLPEDVFGRPAIIDKY

SEQ ID NO: 3162591 - protein, 19 aa, Giardia lamblia
LPLLDVGDWVITDAFGAYT

SEQ ID NO: 3162592 - protein, 19 aa, Giardia lamblia
LPLLQGRVANAKAELRNLS

SEQ ID NO: 3162593 - protein, 33 aa, Giardia lamblia
LPLQWRQTDAAMHWKRVFSRLRNDYIRAIISHL

SEQ ID NO: 3162594 - protein, 24 aa, Giardia lamblia
LPLSRFILLRSIMILCCHIMDAID

SEQ ID NO: 3162595 - protein, 26 aa, Giardia lamblia
LPLTNPEYFVDLGIEPPRSCILHGPS

SEQ ID NO: 3162596 - protein, 18 aa, Giardia lamblia
LPLVQRIRDSKAMHQQDT

SEQ ID NO: 3162597 - protein, 26 aa, Giardia lamblia
LPMDHDLRINVAISIFDNLLLSLERQ

SEQ ID NO: 3162598 - protein, 25 aa, Giardia lamblia
LPMHSFRSSFNLSKMEAMQERVVVF

SEQ ID NO: 3162599 - protein, 18 aa, Giardia lamblia
LPMVPKIISLILENIQNC

SEQ ID NO: 3162600 - protein, 21 aa, Giardia lamblia
LPNAAGLMFNISFTKATAGTA

SEQ ID NO: 3162601 - protein, 21 aa, Giardia lamblia
LPNAAGLMFNISFTKATVGTA

SEQ ID NO: 3162602 - protein, 20 aa, Giardia lamblia
LPNAHIFMRVINFVSIHSGA

SEQ ID NO: 3162603 - protein, 25 aa, Giardia lamblia
LPNGERLPAFLFEFTEEERKAAGPE

SEQ ID NO: 3162604 - protein, 24 aa, Giardia lamblia
LPNKEKYGAIPVIELIRQMVDHGG

SEQ ID NO: 3162605 - protein, 19 aa, Giardia lamblia
LPNLLKYIISLDHTYFSCP

SEQ ID NO: 3162606 - protein, 19 aa, Giardia lamblia
LPNMEPLMARFDYANRLRS

SEQ ID NO: 3162607 - protein, 19 aa, Giardia lamblia
LPNQVSFVYVLSLMDKPVE

SEQ ID NO: 3162608 - protein, 23 aa, Giardia lamblia
LPNRPLSISGLKAMQSDTENSVI

SEQ ID NO: 3162609 - protein, 17 aa, Giardia lamblia
LPPAPAAQEVPVSSIVD

SEQ ID NO: 3162610 - protein, 25 aa, Giardia lamblia
LPPDTKVSWRWMVYSPGIDMYPRNA

SEQ ID NO: 3162611 - protein, 21 aa, Giardia lamblia
LPPEDIEAILARKRREAEDVR

SEQ ID NO: 3162612 - protein, 19 aa, Giardia lamblia
LPPEIARILGTNYDADDIP

SEQ ID NO: 3162613 - protein, 23 aa, Giardia lamblia
LPPELKPASLGHLQLGDPVANTA

SEQ ID NO: 3162614 - protein, 20 aa, Giardia lamblia
LPPEPLKCIQYITKGAPNLV

SEQ ID NO: 3162615 - protein, 23 aa, Giardia lamblia
LPPEVFQGQGILPVSDMWMLGCL

SEQ ID NO: 3162616 - protein, 19 aa, Giardia lamblia
LPPFVRIGKLVSLDTKTTY

SEQ ID NO: 3162617 - protein, 17 aa, Giardia lamblia
LPPLLSFSLPVLPPKEN

SEQ ID NO: 3162618 - protein, 20 aa, Giardia lamblia
LPPLRVKLLKIESSTTADIT

SEQ ID NO: 3162619 - protein, 25 aa, Giardia lamblia
LPPQCRCSIVVKPLKMVRGNACNDV

SEQ ID NO: 3162620 - protein, 20 aa, Giardia lamblia
LPPRAGSTISAPRGASQPLP

SEQ ID NO: 3162621 - protein, 19 aa, Giardia lamblia
LPPRPVHPHATYPTEEPGD

SEQ ID NO: 3162622 - protein, 23 aa, Giardia lamblia
LPPSLLSRFDLIYLLLDNRHDTE

SEQ ID NO: 3162623 - protein, 18 aa, Giardia lamblia
LPPSLVFNSVAGYQTDPL

SEQ ID NO: 3162624 - protein, 19 aa, Giardia lamblia
LPPSRGGVGGIAIVETPSA

SEQ ID NO: 3162625 - protein, 21 aa, Giardia lamblia
LPPVELLVIGSLRNLTSMFDP

SEQ ID NO: 3162626 - protein, 28 aa, Giardia lamblia
LPPVETMPSRTLCSPKRIANPAASLEKT

SEQ ID NO: 3162627 - protein, 19 aa, Giardia lamblia
LPPVHPPLHLTSAKKKSLI

SEQ ID NO: 3162628 - protein, 18 aa, Giardia lamblia
LPQEKRLQAYDGQTALMI

SEQ ID NO: 3162629 - protein, 18 aa, Giardia lamblia
LPQETPLMHAARIGDLGV

SEQ ID NO: 3162630 - protein, 18 aa, Giardia lamblia
LPQFISISAPVLPTVTYR

SEQ ID NO: 3162631 - protein, 22 aa, Giardia lamblia
LPQLFLKKWKLYDDGTLCLLFN

SEQ ID NO: 3162632 - protein, 23 aa, Giardia lamblia
LPQLRTVSCLGIKSSAEKVAITL

SEQ ID NO: 3162633 - protein, 17 aa, Giardia lamblia
LPQLSYCVSKFVEKDPT

SEQ ID NO: 3162634 - protein, 18 aa, Giardia lamblia
LPQNLYIQSACWAATGSM

SEQ ID NO: 3162635 - protein, 18 aa, Giardia lamblia
LPQPHKSIFTRIMTNKEL

SEQ ID NO: 3162636 - protein, 24 aa, Giardia lamblia
LPQQMTMLYGRRMCVLKRISTEGV

SEQ ID NO: 3162637 - protein, 29 aa, Giardia lamblia
LPQTFLTRYIFYARMMRPQLTKECQDIIS

SEQ ID NO: 3162638 - protein, 19 aa, Giardia lamblia
LPQVPNFFAPFPDPIPLPV

SEQ ID NO: 3162639 - protein, 21 aa, Giardia lamblia
LPREVLYVMRLNHMNTALISA

SEQ ID NO: 3162640 - protein, 17 aa, Giardia lamblia
LPRGAVQRMQNCRIAVY

SEQ ID NO: 3162641 - protein, 17 aa, Giardia lamblia
LPRGDCLILSNDHPTVL

SEQ ID NO: 3162642 - protein, 22 aa, Giardia lamblia
LPRHSLQPGQSHFVGPFQDPSS

SEQ ID NO: 3162643 - protein, 19 aa, Giardia lamblia
LPRNLIILFGDFNTHVAST

SEQ ID NO: 3162644 - protein, 18 aa, Giardia lamblia
LPRQCKYADNQGQTAFMR

SEQ ID NO: 3162645 - protein, 26 aa, Giardia lamblia
LPRQYKLPDFYGAISPQSLFSSDGEA

SEQ ID NO: 3162646 - protein, 18 aa, Giardia lamblia
LPSACLHTYTALESNARK

SEQ ID NO: 3162647 - protein, 24 aa, Giardia lamblia
LPSCPHSNMMLDYIAYLQAYTPKL

SEQ ID NO: 3162648 - protein, 19 aa, Giardia lamblia
LPSDLGFQLGVPDMKKLKQ

SEQ ID NO: 3162649 - protein, 18 aa, Giardia lamblia
LPSERGRRAPESRQQQQQ

SEQ ID NO: 3162650 - protein, 25 aa, Giardia lamblia
LPSHPLPPIMPYHCYLYRLSSSQLR

SEQ ID NO: 3162651 - protein, 19 aa, Giardia lamblia
LPSKDRFDLLYSVYDEKTG

SEQ ID NO: 3162652 - protein, 18 aa, Giardia lamblia
LPSPEITGTIYATADTNI

SEQ ID NO: 3162653 - protein, 25 aa, Giardia lamblia
LPSQKSLNWLVSFVDNVFRARHVYL

SEQ ID NO: 3162654 - protein, 28 aa, Giardia lamblia
LPSSMNTRGSGLFDYPVSTDSLFQRHRH

SEQ ID NO: 3162655 - protein, 18 aa, Giardia lamblia
LPSTLGGPKFSLSGRTKR

SEQ ID NO: 3162656 - protein, 33 aa, Giardia lamblia
LPSVIYGGACFTRFKSPVCFLTHSRSDKNGPSD

SEQ ID NO: 3162657 - protein, 24 aa, Giardia lamblia
LPTASELHLRFIWANLANAIMLKI

SEQ ID NO: 3162658 - protein, 17 aa, Giardia lamblia
LPTDIPGLLTYMDETPG

SEQ ID NO: 3162659 - protein, 19 aa, Giardia lamblia
LPTDLFRYTPPLIEDLQRE

SEQ ID NO: 3162660 - protein, 22 aa, Giardia lamblia
LPTEFLRASAIACQIVITNRGD

SEQ ID NO: 3162661 - protein, 17 aa, Giardia lamblia
LPTKMQLMALRQRYAAS

SEQ ID NO: 3162662 - protein, 17 aa, Giardia lamblia
LPTKYPNVYLVAVTEEE

SEQ ID NO: 3162663 - protein, 17 aa, Giardia lamblia
LPTLKHRIINPVITEKG

SEQ ID NO: 3162664 - protein, 19 aa, Giardia lamblia
LPTRCSPFFDDRIFSSEAW

SEQ ID NO: 3162665 - protein, 31 aa, Giardia lamblia
LPTTDLPLFFNYCWDKFYIHQSAFPYSLKDH

SEQ ID NO: 3162666 - protein, 27 aa, Giardia lamblia
LPTTLRLMTLWFRYGSYDEVETEIING

SEQ ID NO: 3162667 - protein, 20 aa, Giardia lamblia
LPTYKGIMHVSVRLGTASKA

SEQ ID NO: 3162668 - protein, 17 aa, Giardia lamblia
LPVALQKLREEHARRLE

SEQ ID NO: 3162669 - protein, 26 aa, Giardia lamblia
LPVDCLDYRAGYAPVLYNDEDNDDYI

SEQ ID NO: 3162670 - protein, 27 aa, Giardia lamblia
LPVDLATCIKHNFPHYSMLINDVLTEQ

SEQ ID NO: 3162671 - protein, 18 aa, Giardia lamblia
LPVGMEYSIPISFKPTST

SEQ ID NO: 3162672 - protein, 25 aa, Giardia lamblia
LPVIKRSGPVNLHRPSGSLIGGHVA

SEQ ID NO: 3162673 - protein, 17 aa, Giardia lamblia
LPVKPEHATTIIAALEK

SEQ ID NO: 3162674 - protein, 17 aa, Giardia lamblia
LPVKSVVTAIHRAQSRL

SEQ ID NO: 3162675 - protein, 25 aa, Giardia lamblia
LPVLESTVPFFGEYVYGLSSVVHYT

SEQ ID NO: 3162676 - protein, 23 aa, Giardia lamblia
LPVMREGFGYALLSSMGITEETP

SEQ ID NO: 3162677 - protein, 25 aa, Giardia lamblia
LPVPPEHWAELQGFFSAAERVANKH

SEQ ID NO: 3162678 - protein, 25 aa, Giardia lamblia
LPVSDMWMLGCLLFEGCNGSNPFLE

SEQ ID NO: 3162679 - protein, 18 aa, Giardia lamblia
LPVSIGISRTYPNSIIRL

SEQ ID NO: 3162680 - protein, 27 aa, Giardia lamblia
LPVSNFCPKLLLPNLLRLSMTHHNTSV

SEQ ID NO: 3162681 - protein, 25 aa, Giardia lamblia
LPVSPRTALFLMVAYYYGVQREACL

SEQ ID NO: 3162682 - protein, 26 aa, Giardia lamblia
LPVVDLISIIACHRVVDVFYPGDSES

SEQ ID NO: 3162683 - protein, 26 aa, Giardia lamblia
LPWAKEIIEILFVEGLVKILYATETF

SEQ ID NO: 3162684 - protein, 26 aa, Giardia lamblia
LPYCLDVMLHIGIKFHSMRSSDDAVA

SEQ ID NO: 3162685 - protein, 20 aa, Giardia lamblia
LPYEARYKLKRFTITANERF

SEQ ID NO: 3162686 - protein, 17 aa, Giardia lamblia
LPYGFSSNYTYKDDMAD

SEQ ID NO: 3162687 - protein, 17 aa, Giardia lamblia
LPYTEYISTRWYRSPEC

SEQ ID NO: 3162688 - protein, 18 aa, Giardia lamblia
LQADLEFVHLLANLEYVQ

SEQ ID NO: 3162689 - protein, 25 aa, Giardia lamblia
LQAEIDRLNVCIAKLHTQTAELDTV

SEQ ID NO: 3162690 - protein, 17 aa, Giardia lamblia
LQAELVSLVGGYRTAAT

SEQ ID NO: 3162691 - protein, 20 aa, Giardia lamblia
LQAIGLLLMKDFNIKLAEER

SEQ ID NO: 3162692 - protein, 17 aa, Giardia lamblia
LQAKYDVLNDIKLDPTV

SEQ ID NO: 3162693 - protein, 25 aa, Giardia lamblia
LQALSESLSEVFINFGRGKKKLGRP

SEQ ID NO: 3162694 - protein, 23 aa, Giardia lamblia
LQAMLPPPLTLLLDTKAELAEFD

SEQ ID NO: 3162695 - protein, 22 aa, Giardia lamblia
LQARALLAMRLILHRVLLSSFY

SEQ ID NO: 3162696 - protein, 18 aa, Giardia lamblia
LQAVEPYLSSSLDMNLYA

SEQ ID NO: 3162697 - protein, 17 aa, Giardia lamblia
LQAYDGQTALMIGTQAN

SEQ ID NO: 3162698 - protein, 27 aa, Giardia lamblia
LQAYLTFRYHHVFDPLSFEVVPFHPFN

SEQ ID NO: 3162699 - protein, 27 aa, Giardia lamblia
LQCAECLRKKITLDRCAEDLETVKEKL

SEQ ID NO: 3162700 - protein, 28 aa, Giardia lamblia
LQCRSFQEFVDYLSVNGLYPLRSRTSLI

SEQ ID NO: 3162701 - protein, 21 aa, Giardia lamblia
LQDAFKCYVVIQITDDEKFLR

SEQ ID NO: 3162702 - protein, 24 aa, Giardia lamblia
LQDDGKRTALMYAADAGNFDICRI

SEQ ID NO: 3162703 - protein, 18 aa, Giardia lamblia
LQDELADLTKDYATRRKQ

SEQ ID NO: 3162704 - protein, 29 aa, Giardia lamblia
LQDGYELLEGIPLKGLVPLSQERYLKAKK

SEQ ID NO: 3162705 - protein, 23 aa, Giardia lamblia
LQDIDGWTALMFAVHSRNTECVR

SEQ ID NO: 3162706 - protein, 19 aa, Giardia lamblia
LQDIEGWTSLMNAVIVCSL

SEQ ID NO: 3162707 - protein, 23 aa, Giardia lamblia
LQDKLECIGVLQGVEQRMVNYSG

SEQ ID NO: 3162708 - protein, 17 aa, Giardia lamblia
LQDLCRLTISYAQKHPE

SEQ ID NO: 3162709 - protein, 17 aa, Giardia lamblia
LQDLLGKIVHELIKVLI

SEQ ID NO: 3162710 - protein, 20 aa, Giardia lamblia
LQDLYFKRLQMVKQYLNEYN

SEQ ID NO: 3162711 - protein, 25 aa, Giardia lamblia
LQDMKRKYFSLKKKEYEQMLRDGTA

SEQ ID NO: 3162712 - protein, 17 aa, Giardia lamblia
LQDQMNVILHELKGLTV

SEQ ID NO: 3162713 - protein, 25 aa, Giardia lamblia
LQDQVCATSLSIAKCASNSATAPVH

SEQ ID NO: 3162714 - protein, 24 aa, Giardia lamblia
LQDVEGRSALFYATLHNHPSIVRE

SEQ ID NO: 3162715 - protein, 17 aa, Giardia lamblia
LQEALELARCFTENTVP

SEQ ID NO: 3162716 - protein, 20 aa, Giardia lamblia
LQEAQAWWRANSEAILESLA

SEQ ID NO: 3162717 - protein, 21 aa, Giardia lamblia
LQECDCALLLMSEKDASEEGA

SEQ ID NO: 3162718 - protein, 17 aa, Giardia lamblia
LQEEFSKEHDLRVASEK

SEQ ID NO: 3162719 - protein, 25 aa, Giardia lamblia
LQEELPEECTFKPAILSYSKQLDTK

SEQ ID NO: 3162720 - protein, 25 aa, Giardia lamblia
LQEFQCLRAAAYVAHALSTVGRNAI

SEQ ID NO: 3162721 - protein, 18 aa, Giardia lamblia
LQEGISLGSHLQSRLHLE

SEQ ID NO: 3162722 - protein, 20 aa, Giardia lamblia
LQEIDKLGVCLSDKTEYTYE

SEQ ID NO: 3162723 - protein, 30 aa, Giardia lamblia
LQEISRLEFIPGYSADLFLLLTQMLAVDEA

SEQ ID NO: 3162724 - protein, 19 aa, Giardia lamblia
LQEKLHCQSRPFHLSGERA

SEQ ID NO: 3162725 - protein, 24 aa, Giardia lamblia
LQENLRRFKGYKAPDGEWRGHTAL

SEQ ID NO: 3162726 - protein, 18 aa, Giardia lamblia
LQEPKKAHAYAMPGQLLA

SEQ ID NO: 3162727 - protein, 25 aa, Giardia lamblia
LQEQHRLEIFSSFQRQQEECRKRSY

SEQ ID NO: 3162728 - protein, 18 aa, Giardia lamblia
LQEYIEGLRNAYSELESK

SEQ ID NO: 3162729 - protein, 20 aa, Giardia lamblia
LQFAQKIYQALVVIRAAMRQ

SEQ ID NO: 3162730 - protein, 24 aa, Giardia lamblia
LQFTARILCLLNFRDVICRATRGQ

SEQ ID NO: 3162731 - protein, 23 aa, Giardia lamblia
LQGELVAIVLRRGIIAALSVTKL

SEQ ID NO: 3162732 - protein, 18 aa, Giardia lamblia
LQGPRAMKALNILRMTES

SEQ ID NO: 3162733 - protein, 26 aa, Giardia lamblia
LQHFPFKIMPQRVFSAYTQTTRKPVS

SEQ ID NO: 3162734 - protein, 18 aa, Giardia lamblia
LQHRLCPEKSLLDDALLS

SEQ ID NO: 3162735 - protein, 21 aa, Giardia lamblia
LQIATHLKIIFTDNKIVDSGY

SEQ ID NO: 3162736 - protein, 22 aa, Giardia lamblia
LQIEILDFSQLIEKTFDLESPY

SEQ ID NO: 3162737 - protein, 21 aa, Giardia lamblia
LQIKLAKQFIEEVAGRVHDTD

SEQ ID NO: 3162738 - protein, 17 aa, Giardia lamblia
LQILRGYIVIFVNSVTT

SEQ ID NO: 3162739 - protein, 22 aa, Giardia lamblia
LQIPAFMITLFKRFPEHSNLHF

SEQ ID NO: 3162740 - protein, 17 aa, Giardia lamblia
LQIPGIQGLVLVDEEDV

SEQ ID NO: 3162741 - protein, 17 aa, Giardia lamblia
LQIPKEVLNRLDAYSPL

SEQ ID NO: 3162742 - protein, 20 aa, Giardia lamblia
LQKGVCVYHYRRPYSSVTTE

SEQ ID NO: 3162743 - protein, 22 aa, Giardia lamblia
LQKIKMQLTYDVFTSHMHEAAD

SEQ ID NO: 3162744 - protein, 42 aa, Giardia lamblia
LQKPWVFCNAGGWKYDELKAHMTACGLPVFPQVDRGSRALTG

SEQ ID NO: 3162745 - protein, 17 aa, Giardia lamblia
LQKTARVVDQFIEDEHR

SEQ ID NO: 3162746 - protein, 31 aa, Giardia lamblia
LQLAHKCILNSFYGYAMRKGSRWYSLEMAAA

SEQ ID NO: 3162747 - protein, 19 aa, Giardia lamblia
LQLCFAERENREFGVPRSD

SEQ ID NO: 3162748 - protein, 18 aa, Giardia lamblia
LQLCSRICSVLDEGFDPK

SEQ ID NO: 3162749 - protein, 22 aa, Giardia lamblia
LQLDFFTALPLTTRRALKAASV

SEQ ID NO: 3162750 - protein, 20 aa, Giardia lamblia
LQLEEYRPVPAVSQDLKNTA

SEQ ID NO: 3162751 - protein, 17 aa, Giardia lamblia
LQLHDWDPLVALDDYTA

SEQ ID NO: 3162752 - protein, 17 aa, Giardia lamblia
LQLMPPRYMFVDFDGID

SEQ ID NO: 3162753 - protein, 18 aa, Giardia lamblia
LQLPDTRLKQIAASLDDT

SEQ ID NO: 3162754 - protein, 18 aa, Giardia lamblia
LQLPTSICFLVCDEISRD

SEQ ID NO: 3162755 - protein, 18 aa, Giardia lamblia
LQLYHFTATLLRKNTKDV

SEQ ID NO: 3162756 - protein, 19 aa, Giardia lamblia
LQMARGVAYVHSRNIIHRD

SEQ ID NO: 3162757 - protein, 17 aa, Giardia lamblia
LQMGPSMSRSIPELLFY

SEQ ID NO: 3162758 - protein, 18 aa, Giardia lamblia
LQNAGGWTALMDAAANGC

SEQ ID NO: 3162759 - protein, 22 aa, Giardia lamblia
LQNCPVFTVAVHRLMEVTNPTK

SEQ ID NO: 3162760 - protein, 20 aa, Giardia lamblia
LQNELRLISDHVRTNNENIS

SEQ ID NO: 3162761 - protein, 17 aa, Giardia lamblia
LQNKLGFDDSITLAYTL

SEQ ID NO: 3162762 - protein, 22 aa, Giardia lamblia
LQNLEKYLPGGHVYEENVEKGD

SEQ ID NO: 3162763 - protein, 24 aa, Giardia lamblia
LQPCSRPHSRPMTGPAPKARSGSA

SEQ ID NO: 3162764 - protein, 20 aa, Giardia lamblia
LQPEELKNLMATICDMALKL

SEQ ID NO: 3162765 - protein, 17 aa, Giardia lamblia
LQPILMRIHETSQNYEK

SEQ ID NO: 3162766 - protein, 17 aa, Giardia lamblia
LQPKVVLHRDIKPANLL

SEQ ID NO: 3162767 - protein, 24 aa, Giardia lamblia
LQPLCEFRLKLLPKSGGRWRPIAV

SEQ ID NO: 3162768 - protein, 21 aa, Giardia lamblia
LQPLRDCVMEDALNKELLSAE

SEQ ID NO: 3162769 - protein, 24 aa, Giardia lamblia
LQPNIARALPFERAYLDFVEGRDA

SEQ ID NO: 3162770 - protein, 25 aa, Giardia lamblia
LQPNVRIAQIFVEFSSSLLGNQTSL

SEQ ID NO: 3162771 - protein, 17 aa, Giardia lamblia
LQQALATLRCAQLQLPP

SEQ ID NO: 3162772 - protein, 19 aa, Giardia lamblia
LQQEMIKPALAKGILILDP

SEQ ID NO: 3162773 - protein, 19 aa, Giardia lamblia
LQQGDGSFCYASCTSQAWA

SEQ ID NO: 3162774 - protein, 17 aa, Giardia lamblia
LQQLLAIGENNKIFAAT

SEQ ID NO: 3162775 - protein, 19 aa, Giardia lamblia
LQQRLVILRSAEKFYNLGI

SEQ ID NO: 3162776 - protein, 23 aa, Giardia lamblia
LQQRYKFTLDILGQLARGAQHIC

SEQ ID NO: 3162777 - protein, 20 aa, Giardia lamblia
LQQTVFKECQERSDLLYTLS

SEQ ID NO: 3162778 - protein, 21 aa, Giardia lamblia
LQRAADGWTALMIAVMHADLE

SEQ ID NO: 3162779 - protein, 28 aa, Giardia lamblia
LQREPTLLCLRDLWRFLTLHDYDQKLEE

SEQ ID NO: 3162780 - protein, 17 aa, Giardia lamblia
LQRGIRGLTMMSAYLDE

SEQ ID NO: 3162781 - protein, 24 aa, Giardia lamblia
LQRINCLPHLFMFVDTCAKVLEIE

SEQ ID NO: 3162782 - protein, 18 aa, Giardia lamblia
LQRLDMDVSYEIDEALFD

SEQ ID NO: 3162783 - protein, 17 aa, Giardia lamblia
LQRLSYLAIQRNDSNSA

SEQ ID NO: 3162784 - protein, 24 aa, Giardia lamblia
LQRLYERLGVIPPELPGYSEDITH

SEQ ID NO: 3162785 - protein, 23 aa, Giardia lamblia
LQRMCFTEDALIFRLLGSLLKRL

SEQ ID NO: 3162786 - protein, 19 aa, Giardia lamblia
LQRMDAYNAYFLLQKEMEP

SEQ ID NO: 3162787 - protein, 21 aa, Giardia lamblia
LQRPRIQSLLLTGPIMSILQG

SEQ ID NO: 3162788 - protein, 29 aa, Giardia lamblia
LQRYGPRICLVMGPAYYKQMLTQREMVLT

SEQ ID NO: 3162789 - protein, 17 aa, Giardia lamblia
LQSAAEWFDAVDSNSVD

SEQ ID NO: 3162790 - protein, 23 aa, Giardia lamblia
LQSDMAHGWKVRESDGFLPHSSS

SEQ ID NO: 3162791 - protein, 23 aa, Giardia lamblia
LQSELRRSYAQAILVLLDLTKHS

SEQ ID NO: 3162792 - protein, 24 aa, Giardia lamblia
LQSEVTKLVRILQELGYPARSLGP

SEQ ID NO: 3162793 - protein, 20 aa, Giardia lamblia
LQSFAKLAIRGWSQYDQHLG

SEQ ID NO: 3162794 - protein, 18 aa, Giardia lamblia
LQSFLPLNLLITNVGKRC

SEQ ID NO: 3162795 - protein, 20 aa, Giardia lamblia
LQSLAYRTLQHGVLSTKPLR

SEQ ID NO: 3162796 - protein, 18 aa, Giardia lamblia
LQSLLGDYGFGFTSNPLE

SEQ ID NO: 3162797 - protein, 24 aa, Giardia lamblia
LQSQLGRLKEALVATQTASDGSSK

SEQ ID NO: 3162798 - protein, 28 aa, Giardia lamblia
LQSQLLCLATALGVPVSSRIPCQTMDEL

SEQ ID NO: 3162799 - protein, 21 aa, Giardia lamblia
LQSRFGAVSALTFDILNDIDP

SEQ ID NO: 3162800 - protein, 20 aa, Giardia lamblia
LQSRLEETLARGGEAADFDA

SEQ ID NO: 3162801 - protein, 19 aa, Giardia lamblia
LQTALPYKAIYDLPRVAWA

SEQ ID NO: 3162802 - protein, 32 aa, Giardia lamblia
LQTDKALLFFVRWRLTSCIHQWVTFVYETVPQ

SEQ ID NO: 3162803 - protein, 23 aa, Giardia lamblia
LQTGRSFGKYNGILGLDYMAGVP

SEQ ID NO: 3162804 - protein, 19 aa, Giardia lamblia
LQTQLSKGIKMVEFKLVND

SEQ ID NO: 3162805 - protein, 32 aa, Giardia lamblia
LQTQWLEMVRSWWPLTRCILLNRASAVAYGIN

SEQ ID NO: 3162806 - protein, 34 aa, Giardia lamblia
LQTRREPLDYLAMMRLWKGLYYLLWKEDKVDMQF

SEQ ID NO: 3162807 - protein, 19 aa, Giardia lamblia
LQTTFCAKEICQGDVHSTV

SEQ ID NO: 3162808 - protein, 27 aa, Giardia lamblia
LQVDPMYRPSILELLLEPQINDVMRSV

SEQ ID NO: 3162809 - protein, 30 aa, Giardia lamblia
LQVEPQLVFWACREVQDFNSCFPGFETVST

SEQ ID NO: 3162810 - protein, 21 aa, Giardia lamblia
LQVKDLLPWQSELLLKTVPLE

SEQ ID NO: 3162811 - protein, 18 aa, Giardia lamblia
LQVNRWIKEKEKGSKLIV

SEQ ID NO: 3162812 - protein, 19 aa, Giardia lamblia
LQVPGSMSFLLDDDSGIGT

SEQ ID NO: 3162813 - protein, 17 aa, Giardia lamblia
LQVRICSLIGQGIPQFY

SEQ ID NO: 3162814 - protein, 19 aa, Giardia lamblia
LQYALRCGQLDIAHMLAPE

SEQ ID NO: 3162815 - protein, 28 aa, Giardia lamblia
LQYGCINASWSRLRYLIPEMKMSRVTWL

SEQ ID NO: 3162816 - protein, 17 aa, Giardia lamblia
LQYKMLISPGTINKHKT

SEQ ID NO: 3162817 - protein, 19 aa, Giardia lamblia
LQYSVSLSLIVPGPSNIPA

SEQ ID NO: 3162818 - protein, 28 aa, Giardia lamblia
LQYYIKLWIKRQCGYVLELSKGTVSIPD

SEQ ID NO: 3162819 - protein, 20 aa, Giardia lamblia
LRAALPAVCRAVLQEQSGTK

SEQ ID NO: 3162820 - protein, 17 aa, Giardia lamblia
LRAATIAYYGNIVEGIN

SEQ ID NO: 3162821 - protein, 22 aa, Giardia lamblia
LRAEEDFHRAREAELLREVDAL

SEQ ID NO: 3162822 - protein, 18 aa, Giardia lamblia
LRAGGMPGAQKSTCDKEI

SEQ ID NO: 3162823 - protein, 25 aa, Giardia lamblia
LRALDCWSVGAIMWYLVKLEYPRFH

SEQ ID NO: 3162824 - protein, 18 aa, Giardia lamblia
LRALGTFTDVVRELGVEN

SEQ ID NO: 3162825 - protein, 18 aa, Giardia lamblia
LRALKSVLVNAGKLKRSD

SEQ ID NO: 3162826 - protein, 18 aa, Giardia lamblia
LRALTSWKSRLQSLELSF

SEQ ID NO: 3162827 - protein, 17 aa, Giardia lamblia
LRALWTMRHRWAERHNP

SEQ ID NO: 3162828 - protein, 18 aa, Giardia lamblia
LRAMISFVGAVHSQYIDE

SEQ ID NO: 3162829 - protein, 23 aa, Giardia lamblia
LRANTSLKYREEMMDEFKERMAA

SEQ ID NO: 3162830 - protein, 19 aa, Giardia lamblia
LRASYPHLIFFANGGVWNL

SEQ ID NO: 3162831 - protein, 23 aa, Giardia lamblia
LRAVPEAVPSMVASVHKLVASVI

SEQ ID NO: 3162832 - protein, 18 aa, Giardia lamblia
LRCQDVYDGVRFVMVAVN

SEQ ID NO: 3162833 - protein, 26 aa, Giardia lamblia
LRCVCGVGAHAFRVFSKTMIPAPEST

SEQ ID NO: 3162834 - protein, 21 aa, Giardia lamblia
LRDACAQRDIFLLSLLLKLLV

SEQ ID NO: 3162835 - protein, 24 aa, Giardia lamblia
LRDAGYRSAWDIIEAGLDRLKQTV

SEQ ID NO: 3162836 - protein, 26 aa, Giardia lamblia
LRDATPLLLLSVRVLDYILFDQTSSP

SEQ ID NO: 3162837 - protein, 24 aa, Giardia lamblia
LRDCFKTDRGLVSFILCLSEATKA

SEQ ID NO: 3162838 - protein, 26 aa, Giardia lamblia
LRDDICKWRLMLLYFGQEIERSGAPI

SEQ ID NO: 3162839 - protein, 18 aa, Giardia lamblia
LRDDPAFRNSIVLSSTII

SEQ ID NO: 3162840 - protein, 27 aa, Giardia lamblia
LRDFTGLPCRARSVLCRRVEETKEELS

SEQ ID NO: 3162841 - protein, 23 aa, Giardia lamblia
LRDHSGYMAFCYAFMTHNMPLAS

SEQ ID NO: 3162842 - protein, 22 aa, Giardia lamblia
LRDIKGRTALMKAAATGQLSIA

SEQ ID NO: 3162843 - protein, 18 aa, Giardia lamblia
LRDKFELTDEERNIYQAE

SEQ ID NO: 3162844 - protein, 26 aa, Giardia lamblia
LRDKIMRISSCFIKRHPEELDELCTL

SEQ ID NO: 3162845 - protein, 19 aa, Giardia lamblia
LRDKKGRSAAEYAKSEVAK

SEQ ID NO: 3162846 - protein, 18 aa, Giardia lamblia
LRDKNGWTALMHAIHNSH

SEQ ID NO: 3162847 - protein, 17 aa, Giardia lamblia
LRDLFCFTSAVNRTQAW

SEQ ID NO: 3162848 - protein, 17 aa, Giardia lamblia
LRDLHEWLDSVLNESTT

SEQ ID NO: 3162849 - protein, 19 aa, Giardia lamblia
LRDLQLRFPYMEFPGSCPG

SEQ ID NO: 3162850 - protein, 18 aa, Giardia lamblia
LRDNGGWTALMSAAANGH

SEQ ID NO: 3162851 - protein, 24 aa, Giardia lamblia
LRDPLGRTALMLAAQRGSVSAIRF

SEQ ID NO: 3162852 - protein, 20 aa, Giardia lamblia
LRDPLSLIAGDLFKDNEVTF

SEQ ID NO: 3162853 - protein, 25 aa, Giardia lamblia
LRDRRGRSALHYATEAARHANAEIK

SEQ ID NO: 3162854 - protein, 17 aa, Giardia lamblia
LRDTCLAAMPQKDSSEG

SEQ ID NO: 3162855 - protein, 18 aa, Giardia lamblia
LRDTVSLMLSVDPNARPS

SEQ ID NO: 3162856 - protein, 18 aa, Giardia lamblia
LRDYMQARNGLKPNDTLM

SEQ ID NO: 3162857 - protein, 21 aa, Giardia lamblia
LREAFRVFDRNGDGYVNAAEL

SEQ ID NO: 3162858 - protein, 18 aa, Giardia lamblia
LREALQCLKATDPTIIPG

SEQ ID NO: 3162859 - protein, 25 aa, Giardia lamblia
LREALRNKILMRLGIVDSVEDYRRY

SEQ ID NO: 3162860 - protein, 17 aa, Giardia lamblia
LREDFCGGMDIRVSDPV

SEQ ID NO: 3162861 - protein, 25 aa, Giardia lamblia
LREDFPFLRIILYRLEKGAVQARQT

SEQ ID NO: 3162862 - protein, 18 aa, Giardia lamblia
LREDRTMLAVNEYIIHSL

SEQ ID NO: 3162863 - protein, 17 aa, Giardia lamblia
LREELRNVLVPRLRSEQ

SEQ ID NO: 3162864 - protein, 18 aa, Giardia lamblia
LREGLKYAAEHPLTTSED

SEQ ID NO: 3162865 - protein, 17 aa, Giardia lamblia
LREGRVTSNRFVEEIEK

SEQ ID NO: 3162866 - protein, 23 aa, Giardia lamblia
LREKGHHGISLQVQMSMALTLLK

SEQ ID NO: 3162867 - protein, 18 aa, Giardia lamblia
LRELKICDYLSQVERDFH

SEQ ID NO: 3162868 - protein, 44 aa, Giardia lamblia
LRELQEMKLRYSLLMKGMLKVCHRFSVSVDMFYSDPFESAAAQI

SEQ ID NO: 3162869 - protein, 25 aa, Giardia lamblia
LRELSGLPLKSGISVAETVSSSHLP

SEQ ID NO: 3162870 - protein, 23 aa, Giardia lamblia
LREMPILIRFIFNNYIIDLDCRN

SEQ ID NO: 3162871 - protein, 18 aa, Giardia lamblia
LRENIKMEMVLNNYDAVT

SEQ ID NO: 3162872 - protein, 19 aa, Giardia lamblia
LRERPVKLSCDISVTICRG

SEQ ID NO: 3162873 - protein, 25 aa, Giardia lamblia
LRESCRELEADNARILADHDLDAIY

SEQ ID NO: 3162874 - protein, 20 aa, Giardia lamblia
LRESRVAGIEVMHVKMSAYS

SEQ ID NO: 3162875 - protein, 19 aa, Giardia lamblia
LRETLSRQLILLRSKVVVV

SEQ ID NO: 3162876 - protein, 18 aa, Giardia lamblia
LREYIRFLVQHSLVDVIV

SEQ ID NO: 3162877 - protein, 22 aa, Giardia lamblia
LRFFPCRVKILTAMTRLAEGPD

SEQ ID NO: 3162878 - protein, 21 aa, Giardia lamblia
LRFGPKKIRAQYNIEEAGYVA

SEQ ID NO: 3162879 - protein, 29 aa, Giardia lamblia
LRFLDYCPQLRALPDLVFSILKTDMLDLS

SEQ ID NO: 3162880 - protein, 21 aa, Giardia lamblia
LRFLGTREFLRPMTAPPVLKS

SEQ ID NO: 3162881 - protein, 24 aa, Giardia lamblia
LRFVKSSASSALIRGSKGSLVDDS

SEQ ID NO: 3162882 - protein, 19 aa, Giardia lamblia
LRFYWDRIQDTILVKQSSN

SEQ ID NO: 3162883 - protein, 18 aa, Giardia lamblia
LRGAKSMFGVCDCNGSLG

SEQ ID NO: 3162884 - protein, 19 aa, Giardia lamblia
LRGASQALLVHSVDLEKKL

SEQ ID NO: 3162885 - protein, 26 aa, Giardia lamblia
LRGDRCAKCQLPFCVSCSPLRDQIFY

SEQ ID NO: 3162886 - protein, 22 aa, Giardia lamblia
LRGELRAKDKLVDRLKQSIASQ

SEQ ID NO: 3162887 - protein, 24 aa, Giardia lamblia
LRGEVKRYKKAYLAKSQAYNEQEE

SEQ ID NO: 3162888 - protein, 19 aa, Giardia lamblia
LRGGYLECYNVPKEITAQI

SEQ ID NO: 3162889 - protein, 20 aa, Giardia lamblia
LRGIMRGIFVACRDTAKKYG

SEQ ID NO: 3162890 - protein, 22 aa, Giardia lamblia
LRGKCVICKSIVKDSIVLSLHR

SEQ ID NO: 3162891 - protein, 21 aa, Giardia lamblia
LRGKEKYGFLYMFSKQGNVTL

SEQ ID NO: 3162892 - protein, 21 aa, Giardia lamblia
LRGNDALRARLVDAEREIADL

SEQ ID NO: 3162893 - protein, 25 aa, Giardia lamblia
LRGRSLPLTIARAAVHGDSSGCRIT

SEQ ID NO: 3162894 - protein, 21 aa, Giardia lamblia
LRGSKKLKVKSIKPAKPSKKD

SEQ ID NO: 3162895 - protein, 27 aa, Giardia lamblia
LRGSSYLCARLMLKFSTTDHPLDRDSI

SEQ ID NO: 3162896 - protein, 22 aa, Giardia lamblia
LRGTPIAWKMKGQQRLSQDVLA

SEQ ID NO: 3162897 - protein, 27 aa, Giardia lamblia
LRGVYFKQPWMLMNIYLDLQTMCPELV

SEQ ID NO: 3162898 - protein, 22 aa, Giardia lamblia
LRHAFMIWHFFTVRLINNDSRI

SEQ ID NO: 3162899 - protein, 19 aa, Giardia lamblia
LRHELQLAGMHSRILSTVT

SEQ ID NO: 3162900 - protein, 17 aa, Giardia lamblia
LRHGHPYYQILEVDGIG

SEQ ID NO: 3162901 - protein, 20 aa, Giardia lamblia
LRHIATLAGSLASQLVEQAS

SEQ ID NO: 3162902 - protein, 21 aa, Giardia lamblia
LRHNYYFLTGFVWTIPFDSHR

SEQ ID NO: 3162903 - protein, 21 aa, Giardia lamblia
LRHPFFKDIGEIVRLKAPTMP

SEQ ID NO: 3162904 - protein, 21 aa, Giardia lamblia
LRIACDMEVFEGWGMSETAAH

SEQ ID NO: 3162905 - protein, 19 aa, Giardia lamblia
LRIDELEQILAHSHATAVK

SEQ ID NO: 3162906 - protein, 18 aa, Giardia lamblia
LRIFKAVLYSSLGACLVS

SEQ ID NO: 3162907 - protein, 19 aa, Giardia lamblia
LRIFSDISSGLAISDVSNL

SEQ ID NO: 3162908 - protein, 24 aa, Giardia lamblia
LRIIKELMKRIFATPHLHHKSVPF

SEQ ID NO: 3162909 - protein, 18 aa, Giardia lamblia
LRIKSLLQPVCFEADDSG

SEQ ID NO: 3162910 - protein, 17 aa, Giardia lamblia
LRILLRHPGLALEDLQC

SEQ ID NO: 3162911 - protein, 17 aa, Giardia lamblia
LRILNIAKYSGANAYNS

SEQ ID NO: 3162912 - protein, 25 aa, Giardia lamblia
LRILPEGYEIVGFTEIPGFTNFVDN

SEQ ID NO: 3162913 - protein, 20 aa, Giardia lamblia
LRISCKLGISATPVQNSLVE

SEQ ID NO: 3162914 - protein, 22 aa, Giardia lamblia
LRITLDKTRVGELIEALNGKTA

SEQ ID NO: 3162915 - protein, 20 aa, Giardia lamblia
LRKDSLTSGIVLPSLSDLAP

SEQ ID NO: 3162916 - protein, 17 aa, Giardia lamblia
LRKDVDFARNEAAFERQ

SEQ ID NO: 3162917 - protein, 19 aa, Giardia lamblia
LRKELRRMQIISMALLDEE

SEQ ID NO: 3162918 - protein, 18 aa, Giardia lamblia
LRKGVGNDLVKELQYDFA

SEQ ID NO: 3162919 - protein, 26 aa, Giardia lamblia
LRKKGLHPCDHWPGPVPQKPEYVRTK

SEQ ID NO: 3162920 - protein, 18 aa, Giardia lamblia
LRKLFTMEKYQVVCKALR

SEQ ID NO: 3162921 - protein, 18 aa, Giardia lamblia
LRKLLAARLGVSYEQVCR

SEQ ID NO: 3162922 - protein, 20 aa, Giardia lamblia
LRKLPAWQLAFEHLAQMKAI

SEQ ID NO: 3162923 - protein, 18 aa, Giardia lamblia
LRKLRKSYGALLISMPEE

SEQ ID NO: 3162924 - protein, 20 aa, Giardia lamblia
LRKMALDYIIYYYSTEILPV

SEQ ID NO: 3162925 - protein, 22 aa, Giardia lamblia
LRKMSKEHLIGLCQQLQEELKV

SEQ ID NO: 3162926 - protein, 20 aa, Giardia lamblia
LRKPLLRHAFDPHERGSNLS

SEQ ID NO: 3162927 - protein, 26 aa, Giardia lamblia
LRKQDGRTALKFALERGHTECVDLLR

SEQ ID NO: 3162928 - protein, 18 aa, Giardia lamblia
LRKRIEAIVQTYMNAISL

SEQ ID NO: 3162929 - protein, 24 aa, Giardia lamblia
LRKRIPAEFGAMFYMHSLTLQNFP

SEQ ID NO: 3162930 - protein, 20 aa, Giardia lamblia
LRKSLLGMLDDRYVELYHLS

SEQ ID NO: 3162931 - protein, 25 aa, Giardia lamblia
LRKTFKCAMAGSVLQPNVRIAQIFV

SEQ ID NO: 3162932 - protein, 20 aa, Giardia lamblia
LRKTMSPGLFDGRARSYQPT

SEQ ID NO: 3162933 - protein, 20 aa, Giardia lamblia
LRKTTPGVRLFMLKNNDLLE

SEQ ID NO: 3162934 - protein, 18 aa, Giardia lamblia
LRKWRYILPEDRSPEEQP

SEQ ID NO: 3162935 - protein, 20 aa, Giardia lamblia
LRLACSGDLILPESHDDFCI

SEQ ID NO: 3162936 - protein, 20 aa, Giardia lamblia
LRLAGPQTRLCFSPATSMTS

SEQ ID NO: 3162937 - protein, 20 aa, Giardia lamblia
LRLAISGTKRYGAYSHCKQL

SEQ ID NO: 3162938 - protein, 20 aa, Giardia lamblia
LRLAPKYTEPSAFGLQVLTI

SEQ ID NO: 3162939 - protein, 30 aa, Giardia lamblia
LRLASSLDKKVEMGFYWSTQLYNDAMCLAR

SEQ ID NO: 3162940 - protein, 17 aa, Giardia lamblia
LRLERESVLAHRKREAD

SEQ ID NO: 3162941 - protein, 26 aa, Giardia lamblia
LRLEVASYFYIRAGDYVSYNFCESLL

SEQ ID NO: 3162942 - protein, 20 aa, Giardia lamblia
LRLGELKLAELLTDDEGVRI

SEQ ID NO: 3162943 - protein, 18 aa, Giardia lamblia
LRLGYGIHRARLNQYGSY

SEQ ID NO: 3162944 - protein, 21 aa, Giardia lamblia
LRLHIKCQICREVNSICVNSD

SEQ ID NO: 3162945 - protein, 20 aa, Giardia lamblia
LRLHQCADPGCLFTAEELVV

SEQ ID NO: 3162946 - protein, 18 aa, Giardia lamblia
LRLKACDAAPVSSTPVKI

SEQ ID NO: 3162947 - protein, 25 aa, Giardia lamblia
LRLLAEGSISPDLVAKILAGMHTGE

SEQ ID NO: 3162948 - protein, 18 aa, Giardia lamblia
LRLLAPREGQITNFRGQN

SEQ ID NO: 3162949 - protein, 25 aa, Giardia lamblia
LRLLEPFLPIPVELTPEISLSREFL

SEQ ID NO: 3162950 - protein, 24 aa, Giardia lamblia
LRLLKSCLTCLKSSPDLWKELGLD

SEQ ID NO: 3162951 - protein, 21 aa, Giardia lamblia
LRLLSESWMERNINRECGELQ

SEQ ID NO: 3162952 - protein, 21 aa, Giardia lamblia
LRLLSSPVLINALRDMQSEYS

SEQ ID NO: 3162953 - protein, 17 aa, Giardia lamblia
LRLLVAAPIIQHPRYIK

SEQ ID NO: 3162954 - protein, 20 aa, Giardia lamblia
LRLLYATVSFHLRIMAIFNY

SEQ ID NO: 3162955 - protein, 21 aa, Giardia lamblia
LRLNKYGGVELTTFNNVVTAM

SEQ ID NO: 3162956 - protein, 31 aa, Giardia lamblia
LRLPGRLPGVPKEKGGLGLLMPGFYHDELRR

SEQ ID NO: 3162957 - protein, 17 aa, Giardia lamblia
LRLQCAIEASYLDETEL

SEQ ID NO: 3162958 - protein, 24 aa, Giardia lamblia
LRLRGFDFCEALNLLLLNRIPQKL

SEQ ID NO: 3162959 - protein, 21 aa, Giardia lamblia
LRLRQELKMLQSLEGSQLDGN

SEQ ID NO: 3162960 - protein, 18 aa, Giardia lamblia
LRLSGMRRMYGLAMTLGK

SEQ ID NO: 3162961 - protein, 18 aa, Giardia lamblia
LRLSVLPEEGHRKHKHDS

SEQ ID NO: 3162962 - protein, 25 aa, Giardia lamblia
LRLTAKRYEGISCVMQEMSGLTDTI

SEQ ID NO: 3162963 - protein, 17 aa, Giardia lamblia
LRLVLAAGKNIYIATVR

SEQ ID NO: 3162964 - protein, 31 aa, Giardia lamblia
LRLYDVLPIRNCPGVEDCTDYLSVQSKSTNA

SEQ ID NO: 3162965 - protein, 17 aa, Giardia lamblia
LRMDKEIERANRKADRE

SEQ ID NO: 3162966 - protein, 17 aa, Giardia lamblia
LRMLRAEVETLRAQKSI

SEQ ID NO: 3162967 - protein, 21 aa, Giardia lamblia
LRMQELFNMKSPDRHISSIDV

SEQ ID NO: 3162968 - protein, 20 aa, Giardia lamblia
LRMRRILEGTPKAVSKLRSI

SEQ ID NO: 3162969 - protein, 18 aa, Giardia lamblia
LRMYHLMRSAVNKQTSAD

SEQ ID NO: 3162970 - protein, 23 aa, Giardia lamblia
LRNDALRARHWLQVEQLTGQTLF

SEQ ID NO: 3162971 - protein, 25 aa, Giardia lamblia
LRNFHGRTALHFAVELGNFEVAQEL

SEQ ID NO: 3162972 - protein, 24 aa, Giardia lamblia
LRNHSGSILSFLVEVDFTSMHTRE

SEQ ID NO: 3162973 - protein, 24 aa, Giardia lamblia
LRNILSTRCGIMLSNSAWSNLWKQ

SEQ ID NO: 3162974 - protein, 18 aa, Giardia lamblia
LRNLELIISDWVYETYKD

SEQ ID NO: 3162975 - protein, 33 aa, Giardia lamblia
LRNLSSVGGYISCSFNILIRVSGQPEPILVRLS

SEQ ID NO: 3162976 - protein, 17 aa, Giardia lamblia
LRNRVRMALSAHAISPW

SEQ ID NO: 3162977 - protein, 18 aa, Giardia lamblia
LRNSCLNGIRTCLDQGSL

SEQ ID NO: 3162978 - protein, 25 aa, Giardia lamblia
LRNTRVCAQEHALLVTALKDELSME

SEQ ID NO: 3162979 - protein, 29 aa, Giardia lamblia
LRNVLRRVFHILVSRGWWDAIGGIDGLCQ

SEQ ID NO: 3162980 - protein, 19 aa, Giardia lamblia
LRNYKFFKHFYQLKTLQTW

SEQ ID NO: 3162981 - protein, 17 aa, Giardia lamblia
LRPAELSTYSIVLPPVS

SEQ ID NO: 3162982 - protein, 30 aa, Giardia lamblia
LRPDEKLCLEEFLSSAIFDIIGFELCLSEN

SEQ ID NO: 3162983 - protein, 20 aa, Giardia lamblia
LRPGGKLFFNLTHNYESRPV

SEQ ID NO: 3162984 - protein, 17 aa, Giardia lamblia
LRPGQEITLEVARIDVD

SEQ ID NO: 3162985 - protein, 17 aa, Giardia lamblia
LRPIAHRLGTVPRPASM

SEQ ID NO: 3162986 - protein, 25 aa, Giardia lamblia
LRPIVVLRGMLRRGIAVHHSGLLPW

SEQ ID NO: 3162987 - protein, 19 aa, Giardia lamblia
LRPKSIIGCVNLRNIQRSL

SEQ ID NO: 3162988 - protein, 17 aa, Giardia lamblia
LRPLLTDIMRLPRLSDS

SEQ ID NO: 3162989 - protein, 18 aa, Giardia lamblia
LRPNDIVYRHLLPNDTLL

SEQ ID NO: 3162990 - protein, 19 aa, Giardia lamblia
LRPSARSSSTFARSSGELQ

SEQ ID NO: 3162991 - protein, 18 aa, Giardia lamblia
LRPSMSQYEVERCIHDFI

SEQ ID NO: 3162992 - protein, 21 aa, Giardia lamblia
LRPTTEIARLILASSEPQDDG

SEQ ID NO: 3162993 - protein, 20 aa, Giardia lamblia
LRPYQSLKPPKCPSLRESDV

SEQ ID NO: 3162994 - protein, 20 aa, Giardia lamblia
LRQAARWLAEDVHPRVLVDG

SEQ ID NO: 3162995 - protein, 18 aa, Giardia lamblia
LRQAIRQHQEEIIQLQQT

SEQ ID NO: 3162996 - protein, 32 aa, Giardia lamblia
LRQAKIWYRRVSCHICISYWRQHFIEAQLAKK

SEQ ID NO: 3162997 - protein, 23 aa, Giardia lamblia
LRQAQQLLAKRMHPMTIIEGFRA

SEQ ID NO: 3162998 - protein, 18 aa, Giardia lamblia
LRQDNRVMAMELTELREK

SEQ ID NO: 3162999 - protein, 24 aa, Giardia lamblia
LRQDSGKSALEWALSPNAKGDRTN

SEQ ID NO: 3163000 - protein, 22 aa, Giardia lamblia
LRQEKKRLLKEIQRMKDDRAKM

SEQ ID NO: 3163001 - protein, 19 aa, Giardia lamblia
LRQKAKRSIKFTVQKTTAL

SEQ ID NO: 3163002 - protein, 18 aa, Giardia lamblia
LRQKLAALRLELTSAKSI

SEQ ID NO: 3163003 - protein, 21 aa, Giardia lamblia
LRQKLAHARDVLMALRTERQQ

SEQ ID NO: 3163004 - protein, 19 aa, Giardia lamblia
LRQKLAIKLHAELREKMAP

SEQ ID NO: 3163005 - protein, 19 aa, Giardia lamblia
LRQLPHCPVLCITSEQRSY

SEQ ID NO: 3163006 - protein, 21 aa, Giardia lamblia
LRQLYPQNFYVAAAAGPITAQ

SEQ ID NO: 3163007 - protein, 18 aa, Giardia lamblia
LRQPVPVYSPPLLTEYRS

SEQ ID NO: 3163008 - protein, 24 aa, Giardia lamblia
LRQREVLKHPDLFINDLISGSTVD

SEQ ID NO: 3163009 - protein, 18 aa, Giardia lamblia
LRRARKVIFLVGAGISVS

SEQ ID NO: 3163010 - protein, 24 aa, Giardia lamblia
LRRDVIEFKQQLSALASQGVGAAQ

SEQ ID NO: 3163011 - protein, 17 aa, Giardia lamblia
LRRFPKIIQPAADEEIL

SEQ ID NO: 3163012 - protein, 20 aa, Giardia lamblia
LRRGRMIRNALTHWRLICYK

SEQ ID NO: 3163013 - protein, 21 aa, Giardia lamblia
LRRIYEKEIPEASRSKAFELC

SEQ ID NO: 3163014 - protein, 18 aa, Giardia lamblia
LRRKAELNAPGFNTTKGL

SEQ ID NO: 3163015 - protein, 17 aa, Giardia lamblia
LRRKRRLQREASNARRA

SEQ ID NO: 3163016 - protein, 25 aa, Giardia lamblia
LRRKVAELRADMSQMLEDLMIISSY

SEQ ID NO: 3163017 - protein, 18 aa, Giardia lamblia
LRRLPLDKFNVVNTGFPS

SEQ ID NO: 3163018 - protein, 24 aa, Giardia lamblia
LRRQLTRRLGFLFGLNDTIPSELK

SEQ ID NO: 3163019 - protein, 17 aa, Giardia lamblia
LRRSCTDARVPFDDASE

SEQ ID NO: 3163020 - protein, 18 aa, Giardia lamblia
LRRSSVIIKSMLEISQTL

SEQ ID NO: 3163021 - protein, 19 aa, Giardia lamblia
LRRSVEHNAPCSLSATDYS

SEQ ID NO: 3163022 - protein, 25 aa, Giardia lamblia
LRRVIPLKLLVQVGRELEIELFSEK

SEQ ID NO: 3163023 - protein, 22 aa, Giardia lamblia
LRRVIWKAIEIFIMEPNVLQVK

SEQ ID NO: 3163024 - protein, 22 aa, Giardia lamblia
LRRVRKMLVIDQILRLRAAVGA

SEQ ID NO: 3163025 - protein, 18 aa, Giardia lamblia
LRRVRYEAAAAQFIPSDT

SEQ ID NO: 3163026 - protein, 20 aa, Giardia lamblia
LRSAILGIVERIERFHISLS

SEQ ID NO: 3163027 - protein, 19 aa, Giardia lamblia
LRSAPFVKKMPSLQILILD

SEQ ID NO: 3163028 - protein, 17 aa, Giardia lamblia
LRSAPLNSLGPSTGPSD

SEQ ID NO: 3163029 - protein, 18 aa, Giardia lamblia
LRSEHFETAELLRGLESS

SEQ ID NO: 3163030 - protein, 17 aa, Giardia lamblia
LRSEVAKQFAARRAELV

SEQ ID NO: 3163031 - protein, 17 aa, Giardia lamblia
LRSEYQSEYLIPSQGVQ

SEQ ID NO: 3163032 - protein, 20 aa, Giardia lamblia
LRSFEIPKALVVEGDPWTPE

SEQ ID NO: 3163033 - protein, 21 aa, Giardia lamblia
LRSFLPLALLGCAPLDNTQVL

SEQ ID NO: 3163034 - protein, 20 aa, Giardia lamblia
LRSFRFFSWNNNYHRLPDTI

SEQ ID NO: 3163035 - protein, 22 aa, Giardia lamblia
LRSHGLALIPIVGHANDKVYKI

SEQ ID NO: 3163036 - protein, 23 aa, Giardia lamblia
LRSIENTNFFLLEHLQTVETSQE

SEQ ID NO: 3163037 - protein, 18 aa, Giardia lamblia
LRSIVLMHGALKRARDSA

SEQ ID NO: 3163038 - protein, 20 aa, Giardia lamblia
LRSLCVPIKVLSLSEVLPHY

SEQ ID NO: 3163039 - protein, 20 aa, Giardia lamblia
LRSLFRNRPEMREWFCAVYG

SEQ ID NO: 3163040 - protein, 17 aa, Giardia lamblia
LRSLKGITHKNILVYTS

SEQ ID NO: 3163041 - protein, 19 aa, Giardia lamblia
LRSLKRCVLYSANDTGAIT

SEQ ID NO: 3163042 - protein, 21 aa, Giardia lamblia
LRSLLFPVIVQSSIKGFDIMR

SEQ ID NO: 3163043 - protein, 29 aa, Giardia lamblia
LRSLLQTDIRPSFLLSHCDPAASQGQIPE

SEQ ID NO: 3163044 - protein, 19 aa, Giardia lamblia
LRSLLRALEDIRFGYPTAL

SEQ ID NO: 3163045 - protein, 18 aa, Giardia lamblia
LRSLMLKMHRAPMLTETT

SEQ ID NO: 3163046 - protein, 20 aa, Giardia lamblia
LRSLPCSKRNGLYGSEQTEL

SEQ ID NO: 3163047 - protein, 18 aa, Giardia lamblia
LRSLRPCTTLSIHSISCM

SEQ ID NO: 3163048 - protein, 24 aa, Giardia lamblia
LRSNESFAPYDPVSMIQESQPYSE

SEQ ID NO: 3163049 - protein, 21 aa, Giardia lamblia
LRSPCLSPRLSNSVETTSIGI

SEQ ID NO: 3163050 - protein, 22 aa, Giardia lamblia
LRSPVDLRQLKGVYSKNYEHIH

SEQ ID NO: 3163051 - protein, 20 aa, Giardia lamblia
LRSSHTYVITSCILPCLLES

SEQ ID NO: 3163052 - protein, 20 aa, Giardia lamblia
LRSSYALQRIHLMETEPIPN

SEQ ID NO: 3163053 - protein, 20 aa, Giardia lamblia
LRSTREFIGFEAGTTALDIA

SEQ ID NO: 3163054 - protein, 19 aa, Giardia lamblia
LRSVFPYMHTDTVKKRYRT

SEQ ID NO: 3163055 - protein, 17 aa, Giardia lamblia
LRSVRRAAQAAAKSPQA

SEQ ID NO: 3163056 - protein, 17 aa, Giardia lamblia
LRTALSLLTRKHEVEHK

SEQ ID NO: 3163057 - protein, 20 aa, Giardia lamblia
LRTCGFPMVVPKQNQLGSPR

SEQ ID NO: 3163058 - protein, 36 aa, Giardia lamblia
LRTDFPLDAACAIYAQCTIHWLDLLNYLNARAGSIS

SEQ ID NO: 3163059 - protein, 19 aa, Giardia lamblia
LRTEIEFLRSEPKYQPDDR

SEQ ID NO: 3163060 - protein, 24 aa, Giardia lamblia
LRTEVKLLAKAVVKLQTGDIAAQE

SEQ ID NO: 3163061 - protein, 24 aa, Giardia lamblia
LRTFCITEGMLGAGNFTTRACAVP

SEQ ID NO: 3163062 - protein, 19 aa, Giardia lamblia
LRTFTLLLDRMEGASLKLT

SEQ ID NO: 3163063 - protein, 22 aa, Giardia lamblia
LRTGELRKGQNLLNDIAAVLQQ

SEQ ID NO: 3163064 - protein, 18 aa, Giardia lamblia
LRTHCHIVISKAYSSCPS

SEQ ID NO: 3163065 - protein, 21 aa, Giardia lamblia
LRTIRMPQYRSILLRYENIPI

SEQ ID NO: 3163066 - protein, 25 aa, Giardia lamblia
LRTKDGRGAWDFATTKAARDALKQV

SEQ ID NO: 3163067 - protein, 25 aa, Giardia lamblia
LRTKECSLDAAKDCINSPLYLSHLD

SEQ ID NO: 3163068 - protein, 19 aa, Giardia lamblia
LRTKRAPSEAMLRAQNELT

SEQ ID NO: 3163069 - protein, 24 aa, Giardia lamblia
LRTRAGIRTVHFLLFGLKELDASG

SEQ ID NO: 3163070 - protein, 19 aa, Giardia lamblia
LRTRELIEGAILLQNTSIP

SEQ ID NO: 3163071 - protein, 22 aa, Giardia lamblia
LRTRLVERASIISSRMEAEAEH

SEQ ID NO: 3163072 - protein, 18 aa, Giardia lamblia
LRTRSFAKYLLEVSPDVV

SEQ ID NO: 3163073 - protein, 20 aa, Giardia lamblia
LRTVKAFPKHDFTSFVQNPS

SEQ ID NO: 3163074 - protein, 21 aa, Giardia lamblia
LRVAYQILRAVGIMHSLGWSH

SEQ ID NO: 3163075 - protein, 24 aa, Giardia lamblia
LRVDKCITVAFGVFADTLPVIAIA

SEQ ID NO: 3163076 - protein, 24 aa, Giardia lamblia
LRVECKRLNFISTNLIYDILLRCL

SEQ ID NO: 3163077 - protein, 22 aa, Giardia lamblia
LRVEFLHSCYDDMLTALKINGA

SEQ ID NO: 3163078 - protein, 17 aa, Giardia lamblia
LRVGRTHDVAIKFIPGY

SEQ ID NO: 3163079 - protein, 19 aa, Giardia lamblia
LRVKSKRTPMSRRYFSPEK

SEQ ID NO: 3163080 - protein, 17 aa, Giardia lamblia
LRVLIADKRLRRRIIDE

SEQ ID NO: 3163081 - protein, 22 aa, Giardia lamblia
LRVLITLPLVHYILSFWDCYNL

SEQ ID NO: 3163082 - protein, 30 aa, Giardia lamblia
LRVMLSWDARKRFSVPECMAHPFFEEEPRE

SEQ ID NO: 3163083 - protein, 18 aa, Giardia lamblia
LRVNHAFDKFERTRSPAN

SEQ ID NO: 3163084 - protein, 17 aa, Giardia lamblia
LRVPTSIAITGQTSTGE

SEQ ID NO: 3163085 - protein, 21 aa, Giardia lamblia
LRVQHKIAQLKSAIKKDLYAL

SEQ ID NO: 3163086 - protein, 17 aa, Giardia lamblia
LRVQLILMLILRLVLST

SEQ ID NO: 3163087 - protein, 17 aa, Giardia lamblia
LRVSLQHALSEGEKSRQ

SEQ ID NO: 3163088 - protein, 17 aa, Giardia lamblia
LRVSLTGSFAGSFTGSF

SEQ ID NO: 3163089 - protein, 25 aa, Giardia lamblia
LRVSNPRGGLTMRDKCLVLDSSAQA

SEQ ID NO: 3163090 - protein, 18 aa, Giardia lamblia
LRVTALMLAAARPNNSRM

SEQ ID NO: 3163091 - protein, 19 aa, Giardia lamblia
LRVVGCRRYASLAEAACTK

SEQ ID NO: 3163092 - protein, 18 aa, Giardia lamblia
LRYGVPIDSDLTAQITTL

SEQ ID NO: 3163093 - protein, 21 aa, Giardia lamblia
LRYLHDPAKHGGRVIVHRDVR

SEQ ID NO: 3163094 - protein, 18 aa, Giardia lamblia
LRYLSAILSHLTCMDSMH

SEQ ID NO: 3163095 - protein, 20 aa, Giardia lamblia
LRYMGKGMGPWDGNLDTTWD

SEQ ID NO: 3163096 - protein, 17 aa, Giardia lamblia
LRYPRKAYYYKKQADQI

SEQ ID NO: 3163097 - protein, 19 aa, Giardia lamblia
LRYQPFIIAKLKGYIPLAN

SEQ ID NO: 3163098 - protein, 19 aa, Giardia lamblia
LRYRSGKVVLVLNGGITMN

SEQ ID NO: 3163099 - protein, 18 aa, Giardia lamblia
LSAAALGKLFLKADEFLS

SEQ ID NO: 3163100 - protein, 31 aa, Giardia lamblia; identical to SEQ ID NO: 3075987

SEQ ID NO: 3163101 - protein, 21 aa, Giardia lamblia
LSADYWLKFTTVKGKEGLSLK

SEQ ID NO: 3163102 - protein, 17 aa, Giardia lamblia
LSAERPVISGKQLPLSV

SEQ ID NO: 3163103 - protein, 24 aa, Giardia lamblia
LSAGLLILRSALLGSQDEGFQTNV

SEQ ID NO: 3163104 - protein, 32 aa, Giardia lamblia
LSAGLSFKAFCFSRLLSLDAHRSSSLSTGMDV

SEQ ID NO: 3163105 - protein, 23 aa, Giardia lamblia
LSAIPSQILIKLFFELPTYAFLR

SEQ ID NO: 3163106 - protein, 17 aa, Giardia lamblia
LSAKELGAFKTLTRPNE

SEQ ID NO: 3163107 - protein, 20 aa, Giardia lamblia
LSAKGALYINGRQIAAGSTH

SEQ ID NO: 3163108 - protein, 28 aa, Giardia lamblia
LSAKVSALMRTGTGLSRHVHTDSVMPKI

SEQ ID NO: 3163109 - protein, 24 aa, Giardia lamblia
LSALAIIERFCEYCVEVNGERKKK

SEQ ID NO: 3163110 - protein, 18 aa, Giardia lamblia
LSALMFAAIYNRLFAVEY

SEQ ID NO: 3163111 - protein, 17 aa, Giardia lamblia
LSAPVPLQRTVLMTIAP

SEQ ID NO: 3163112 - protein, 22 aa, Giardia lamblia
LSARGYSALMWAIMGGSRECFD

SEQ ID NO: 3163113 - protein, 18 aa, Giardia lamblia
LSARLVAAQEKIRDLTSQ

SEQ ID NO: 3163114 - protein, 19 aa, Giardia lamblia
LSASGFVRAGERFEESASR

SEQ ID NO: 3163115 - protein, 17 aa, Giardia lamblia
LSASLAYSEQQCANMAK

SEQ ID NO: 3163116 - protein, 18 aa, Giardia lamblia
LSATYNFEHSGSYMPLRR

SEQ ID NO: 3163117 - protein, 19 aa, Giardia lamblia
LSCAVKLSSMLEGATVRIP

SEQ ID NO: 3163118 - protein, 17 aa, Giardia lamblia
LSCCDEVSTDLKGSPIY

SEQ ID NO: 3163119 - protein, 23 aa, Giardia lamblia
LSCLQAEVIKQFFNLNSKLTAFL

SEQ ID NO: 3163120 - protein, 19 aa, Giardia lamblia
LSDALKLAKAVQEQVSNEI

SEQ ID NO: 3163121 - protein, 25 aa, Giardia lamblia
LSDARLEAPLVYIGKRDDIFNTYNS

SEQ ID NO: 3163122 - protein, 17 aa, Giardia lamblia
LSDCYLIMEGLLAAKDI

SEQ ID NO: 3163123 - protein, 17 aa, Giardia lamblia
LSDDSCLDELVNVQPYM

SEQ ID NO: 3163124 - protein, 19 aa, Giardia lamblia
LSDEALCYEVARCTTGQEE

SEQ ID NO: 3163125 - protein, 24 aa, Giardia lamblia
LSDFVVGCPGNWNHSKRTALRASC

SEQ ID NO: 3163126 - protein, 17 aa, Giardia lamblia
LSDGMVLQPAYRQSLSK

SEQ ID NO: 3163127 - protein, 17 aa, Giardia lamblia
LSDICNDILKLLQEQFV

SEQ ID NO: 3163128 - protein, 22 aa, Giardia lamblia
LSDICSLTALFVDKAPQTNIRY

SEQ ID NO: 3163129 - protein, 18 aa, Giardia lamblia
LSDILFQPMIGYQKNAPV

SEQ ID NO: 3163130 - protein, 32 aa, Giardia lamblia
LSDIRRLNVSITRAKRLVVIIGNSITLEKDPT

SEQ ID NO: 3163131 - protein, 24 aa, Giardia lamblia
LSDKANEMMSMFVAQLTGMISKLS

SEQ ID NO: 3163132 - protein, 18 aa, Giardia lamblia
LSDLKLANASLEKDAQLA

SEQ ID NO: 3163133 - protein, 22 aa, Giardia lamblia
LSDMPRPAAFIEAIRRYEGIAM

SEQ ID NO: 3163134 - protein, 19 aa, Giardia lamblia
LSDNPGIGCVDHLRSYALH

SEQ ID NO: 3163135 - protein, 22 aa, Giardia lamblia
LSDPGTPRWSLLQTDPEATKTG

SEQ ID NO: 3163136 - protein, 18 aa, Giardia lamblia
LSDRIVLTKGEIEQGVTY

SEQ ID NO: 3163137 - protein, 18 aa, Giardia lamblia
LSDTRAYDLLAAFHSSNY

SEQ ID NO: 3163138 - protein, 17 aa, Giardia lamblia
LSEARIIELARINTRLE

SEQ ID NO: 3163139 - protein, 17 aa, Giardia lamblia
LSEAWRPDLNAINDGFI

SEQ ID NO: 3163140 - protein, 17 aa, Giardia lamblia
LSEERQRRIALEKERIA

SEQ ID NO: 3163141 - protein, 19 aa, Giardia lamblia
LSEGSAFQAEFSRLTRAVL

SEQ ID NO: 3163142 - protein, 20 aa, Giardia lamblia
LSEHVELLPSPVLLHPLFLF

SEQ ID NO: 3163143 - protein, 22 aa, Giardia lamblia
LSEKGDCEMVSFTGKALITDGV

SEQ ID NO: 3163144 - protein, 19 aa, Giardia lamblia
LSEKVKCLPKVRELEEERA

SEQ ID NO: 3163145 - protein, 23 aa, Giardia lamblia
LSELPINHPIAAFIATAATAQDD

SEQ ID NO: 3163146 - protein, 21 aa, Giardia lamblia
LSELPVDYEAKMVLDDYELDA

SEQ ID NO: 3163147 - protein, 17 aa, Giardia lamblia
LSEMCPRIPVLQKSTEH

SEQ ID NO: 3163148 - protein, 23 aa, Giardia lamblia
LSEPKPLPTVLASSGGADDSSAS

SEQ ID NO: 3163149 - protein, 34 aa, Giardia lamblia
LSERLSLPCWARRSREIWEQVLVLLIVSSSRPLL

SEQ ID NO: 3163150 - protein, 18 aa, Giardia lamblia
LSETFVWSVVGQVASALA

SEQ ID NO: 3163151 - protein, 23 aa, Giardia lamblia
LSEVQRLKGELTLSKAALADTIV

SEQ ID NO: 3163152 - protein, 22 aa, Giardia lamblia
LSEVRKQAACLVQNKPLLYSGE

SEQ ID NO: 3163153 - protein, 18 aa, Giardia lamblia
LSEYCPDPEAVRCDLFWR

SEQ ID NO: 3163154 - protein, 21 aa, Giardia lamblia
LSEYTRPIFPLASEFIDTSPI

SEQ ID NO: 3163155 - protein, 20 aa, Giardia lamblia
LSFASLRPLSRSQLNTYIPP

SEQ ID NO: 3163156 - protein, 22 aa, Giardia lamblia
LSFDKLELGGVCGAPTGAGVTT

SEQ ID NO: 3163157 - protein, 21 aa, Giardia lamblia
LSFDKRFMLPAGVSVEPEKVS

SEQ ID NO: 3163158 - protein, 23 aa, Giardia lamblia
LSFELPEALPSITKTLRYTHSHA

SEQ ID NO: 3163159 - protein, 23 aa, Giardia lamblia
LSFFHKHYLRVFVLVNKRNKCKS

SEQ ID NO: 3163160 - protein, 24 aa, Giardia lamblia
LSFLIKREATCLAPGGLTALHVAA

SEQ ID NO: 3163161 - protein, 19 aa, Giardia lamblia
LSFTAEVQISFSEEKELEY

SEQ ID NO: 3163162 - protein, 28 aa, Giardia lamblia
LSFTGMEPRASYSHAQRIPACVDENDNV

SEQ ID NO: 3163163 - protein, 17 aa, Giardia lamblia
LSFVCPMFVEYQNLPPV

SEQ ID NO: 3163164 - protein, 17 aa, Giardia lamblia
LSFVGIRRQDDCDLSPI

SEQ ID NO: 3163165 - protein, 19 aa, Giardia lamblia
LSFVRCCITDTLLEELLGA

SEQ ID NO: 3163166 - protein, 19 aa, Giardia lamblia
LSFYEALYMYPALDSKHSG

SEQ ID NO: 3163167 - protein, 20 aa, Giardia lamblia
LSGAFMRRDRMLKRRTEIMI

SEQ ID NO: 3163168 - protein, 23 aa, Giardia lamblia
LSGCTALMRSAHYGYTAIVSLLL

SEQ ID NO: 3163169 - protein, 20 aa, Giardia lamblia
LSGEYSILLEQCADGDRERV

SEQ ID NO: 3163170 - protein, 27 aa, Giardia lamblia
LSGGQRSRLNFALLTFQTLPSLLILDE

SEQ ID NO: 3163171 - protein, 26 aa, Giardia lamblia
LSGKLSLAGFEAFFRTGLPASMKRGT

SEQ ID NO: 3163172 - protein, 18 aa, Giardia lamblia
LSGLAEVHTVFLLEKILG

SEQ ID NO: 3163173 - protein, 21 aa, Giardia lamblia
LSGLGTGKCMIEFLDPNEEEM

SEQ ID NO: 3163174 - protein, 18 aa, Giardia lamblia
LSGLKKHVKISVSAVYYA

SEQ ID NO: 3163175 - protein, 20 aa, Giardia lamblia
LSGRIIYRGTVRDYLDRHVY

SEQ ID NO: 3163176 - protein, 21 aa, Giardia lamblia
LSGRLELVRALLPLERLALSF

SEQ ID NO: 3163177 - protein, 17 aa, Giardia lamblia
LSGRTSLSKFSERSNAS

SEQ ID NO: 3163178 - protein, 18 aa, Giardia lamblia
LSGSASMIAATRKIPSDC

SEQ ID NO: 3163179 - protein, 18 aa, Giardia lamblia
LSGTSSFGAAAARAAAVG

SEQ ID NO: 3163180 - protein, 17 aa, Giardia lamblia
LSGTVGMFTTRQNSAVP

SEQ ID NO: 3163181 - protein, 17 aa, Giardia lamblia
LSGVAFDSLHILGSKKS

SEQ ID NO: 3163182 - protein, 28 aa, Giardia lamblia
LSHEKRLTTPEGWTSLMSAAKNGFTDIV

SEQ ID NO: 3163183 - protein, 24 aa, Giardia lamblia
LSHETSEIFTLYGVNAPKTKLATN

SEQ ID NO: 3163184 - protein, 17 aa, Giardia lamblia
LSHFYERAGRVICLGNS

SEQ ID NO: 3163185 - protein, 21 aa, Giardia lamblia
LSHPALDPWFVIDRTLLESSY

SEQ ID NO: 3163186 - protein, 18 aa, Giardia lamblia
LSHPHVLRCYQVLCDGEF

SEQ ID NO: 3163187 - protein, 27 aa, Giardia lamblia
LSHSECLCILTAFLALLQEVGTQYPNI

SEQ ID NO: 3163188 - protein, 18 aa, Giardia lamblia
LSIATGFLEVLRIFADLK

SEQ ID NO: 3163189 - protein, 17 aa, Giardia lamblia
LSICSGGDDWVTMYEAY

SEQ ID NO: 3163190 - protein, 21 aa, Giardia lamblia
LSIEIKRAFSTLDAAIRTHPL

SEQ ID NO: 3163191 - protein, 17 aa, Giardia lamblia
LSIFLLDRFLCSIYGSF

SEQ ID NO: 3163192 - protein, 17 aa, Giardia lamblia
LSIHSAETFDAALELVF

SEQ ID NO: 3163193 - protein, 28 aa, Giardia lamblia
LSIIIYQLLLCFAHAGVSTSSRFKDFYL

SEQ ID NO: 3163194 - protein, 19 aa, Giardia lamblia
LSIIRCVDSNVLLLDIYDH

SEQ ID NO: 3163195 - protein, 17 aa, Giardia lamblia
LSISLPIIHQVCLSPHP

SEQ ID NO: 3163196 - protein, 22 aa, Giardia lamblia
LSKAGITFPMWFFGVQNQSDLV

SEQ ID NO: 3163197 - protein, 19 aa, Giardia lamblia
LSKAHMVEVKPQIPEKTID

SEQ ID NO: 3163198 - protein, 17 aa, Giardia lamblia
LSKFCGEVLRNGDDLFE

SEQ ID NO: 3163199 - protein, 18 aa, Giardia lamblia
LSKGYSTFMYEMVSMSHI

SEQ ID NO: 3163200 - protein, 17 aa, Giardia lamblia
LSKIQPWFDDIGYQDNC

SEQ ID NO: 3163201 - protein, 19 aa, Giardia lamblia
LSKKALMSCFSRQESGKEF

SEQ ID NO: 3163202 - protein, 27 aa, Giardia lamblia
LSKMKCRRGCLSLSHFINHLTQQGIDG

SEQ ID NO: 3163203 - protein, 23 aa, Giardia lamblia
LSKPVCPASMGVSVVNVAVPTTA

SEQ ID NO: 3163204 - protein, 18 aa, Giardia lamblia
LSKRATFRQGEMKGLFLT

SEQ ID NO: 3163205 - protein, 21 aa, Giardia lamblia
LSKRGIPITSLTKGSHPLPVV

SEQ ID NO: 3163206 - protein, 22 aa, Giardia lamblia
LSKRLPLSAVVRATSLMDRYFS

SEQ ID NO: 3163207 - protein, 22 aa, Giardia lamblia
LSKRPRSAIASSARESISKITA

SEQ ID NO: 3163208 - protein, 24 aa, Giardia lamblia
LSKTDCYEIFGGTLTYEINGMSDV

SEQ ID NO: 3163209 - protein, 22 aa, Giardia lamblia
LSKTEFWCMSSLDTPVSSLEQL

SEQ ID NO: 3163210 - protein, 25 aa, Giardia lamblia
LSKTFSEPFLWAILLDISSALQHIH

SEQ ID NO: 3163211 - protein, 31 aa, Giardia lamblia
LSKTHFTSFIWPVMKRIMAAVLVAFGKAVLG

SEQ ID NO: 3163212 - protein, 31 aa, Giardia lamblia
LSKVCSIQKYICERARYHGCQAMVATQMVES

SEQ ID NO: 3163213 - protein, 21 aa, Giardia lamblia
LSKYSCLRGASQALLVHSVDL

SEQ ID NO: 3163214 - protein, 19 aa, Giardia lamblia
LSLALKMQNWELAELLRTT

SEQ ID NO: 3163215 - protein, 18 aa, Giardia lamblia
LSLALRKLRKSYGALLIS

SEQ ID NO: 3163216 - protein, 20 aa, Giardia lamblia
LSLCISRFFLHVYVEPLVSV

SEQ ID NO: 3163217 - protein, 34 aa, Giardia lamblia
LSLCSRPSKVPADMWTKGKLVAMHMRKQLCANLH

SEQ ID NO: 3163218 - protein, 21 aa, Giardia lamblia
LSLDHYSKLIASLQVEVAEAR

SEQ ID NO: 3163219 - protein, 21 aa, Giardia lamblia
LSLEGDKAWFRTGNQHMEGQV

SEQ ID NO: 3163220 - protein, 27 aa, Giardia lamblia
LSLFFRLSSLIPFCAVTHTLCLRLSSV

SEQ ID NO: 3163221 - protein, 20 aa, Giardia lamblia
LSLFTSLGILDFTGNGLLLK

SEQ ID NO: 3163222 - protein, 17 aa, Giardia lamblia
LSLHIIENVYLWDNVRI

SEQ ID NO: 3163223 - protein, 27 aa, Giardia lamblia
LSLHRRINRCIFRLSSLKKFLHDSYEL

SEQ ID NO: 3163224 - protein, 20 aa, Giardia lamblia
LSLKFPISLKDAAQLVQCSV

SEQ ID NO: 3163225 - protein, 27 aa, Giardia lamblia
LSLKNRYRFSCLVDRMLPISQLRASFG

SEQ ID NO: 3163226 - protein, 28 aa, Giardia lamblia
LSLKRRSLCYPLLLLQLFSSRVNGAAKL

SEQ ID NO: 3163227 - protein, 20 aa, Giardia lamblia
LSLLPAPPLPFLDPTDETKN

SEQ ID NO: 3163228 - protein, 18 aa, Giardia lamblia
LSLPFPRQHITAPSVQSQ

SEQ ID NO: 3163229 - protein, 23 aa, Giardia lamblia
LSLPKKLSLVFQRDILPENIKED

SEQ ID NO: 3163230 - protein, 21 aa, Giardia lamblia
LSLPPGRNGPYFLKNGFATLN

SEQ ID NO: 3163231 - protein, 21 aa, Giardia lamblia
LSLQFPGLPVALAEHSPNSSV

SEQ ID NO: 3163232 - protein, 22 aa, Giardia lamblia
LSLRAPCCTDLHEYLHADEGDA

SEQ ID NO: 3163233 - protein, 29 aa, Giardia lamblia
LSLSSPEFLPLILLMDLSRVCTILQNDLL

SEQ ID NO: 3163234 - protein, 19 aa, Giardia lamblia
LSLVPRGSVFRRYCLCVSM

SEQ ID NO: 3163235 - protein, 24 aa, Giardia lamblia
LSMCKLLAEHCHLRDVDYERALKF

SEQ ID NO: 3163236 - protein, 19 aa, Giardia lamblia
LSMGLPRQIFKMHSLMAPR

SEQ ID NO: 3163237 - protein, 24 aa, Giardia lamblia
LSMQASCVPIVLSCMPTISQYLDK

SEQ ID NO: 3163238 - protein, 18 aa, Giardia lamblia
LSMSVLIELELYREEAGV

SEQ ID NO: 3163239 - protein, 19 aa, Giardia lamblia
LSMTAQSWVRRDKDKMCLL

SEQ ID NO: 3163240 - protein, 19 aa, Giardia lamblia
LSNALHIRSDMTLGDIARS

SEQ ID NO: 3163241 - protein, 45 aa, Giardia lamblia
LSNCGLEKVPACLRALPCLQELDLSRNRLTHCASQFITANLPFLK

SEQ ID NO: 3163242 - protein, 21 aa, Giardia lamblia
LSNDTSFLFGKEHAIDDYSTI

SEQ ID NO: 3163243 - protein, 27 aa, Giardia lamblia
LSNGDVVLWNLVTLRPRIILHAFHGFD

SEQ ID NO: 3163244 - protein, 24 aa, Giardia lamblia
LSNGEIYLIPNLVSMEKVTPICVA

SEQ ID NO: 3163245 - protein, 27 aa, Giardia lamblia
LSNGVLLCLSLRYAMIHSQYGSLYAYR

SEQ ID NO: 3163246 - protein, 22 aa, Giardia lamblia
LSNIITYRFARALALDSGEKVL

SEQ ID NO: 3163247 - protein, 21 aa, Giardia lamblia
LSNKCLRLAELTQEIISEIAG

SEQ ID NO: 3163248 - protein, 23 aa, Giardia lamblia
LSNKEFKAINSIRALNMTKEKEE

SEQ ID NO: 3163249 - protein, 30 aa, Giardia lamblia
LSNLFPAAYFCALFWRYYENLKGNKDKSFS

SEQ ID NO: 3163250 - protein, 18 aa, Giardia lamblia
LSNNPGLCEVLAPLEKDI

SEQ ID NO: 3163251 - protein, 24 aa, Giardia lamblia
LSNRCSNCTHVILPPSDPVPGIIY

SEQ ID NO: 3163252 - protein, 25 aa, Giardia lamblia
LSNVISIPVCRNLKYTTNLSRVLGS

SEQ ID NO: 3163253 - protein, 20 aa, Giardia lamblia
LSNYAAACVRLGELDEAERS

SEQ ID NO: 3163254 - protein, 18 aa, Giardia lamblia
LSPAAAIRFIDNVDGQRY

SEQ ID NO: 3163255 - protein, 20 aa, Giardia lamblia
LSPCLCTTPLDKLCNHVLSS

SEQ ID NO: 3163256 - protein, 18 aa, Giardia lamblia
LSPCPDMSSTSYSTAPTS

SEQ ID NO: 3163257 - protein, 20 aa, Giardia lamblia
LSPCPIEYVPGGIVSLPDPT

SEQ ID NO: 3163258 - protein, 17 aa, Giardia lamblia
LSPEERKLRLVVKQYSF

SEQ ID NO: 3163259 - protein, 23 aa, Giardia lamblia
LSPEFKKSFIEILRLHKQMPEAD

SEQ ID NO: 3163260 - protein, 25 aa, Giardia lamblia
LSPEGRCALEYAILEEQLKSIPILL

SEQ ID NO: 3163261 - protein, 22 aa, Giardia lamblia
LSPEGYSALSLAAAANSALVCE

SEQ ID NO: 3163262 - protein, 22 aa, Giardia lamblia
LSPEQLYGIFGIQDIGMLFNWQ

SEQ ID NO: 3163263 - protein, 24 aa, Giardia lamblia
LSPHYPPVLPIDWLEDRGTSLCIE

SEQ ID NO: 3163264 - protein, 18 aa, Giardia lamblia
LSPICLKSYIDSAPPIHP

SEQ ID NO: 3163265 - protein, 24 aa, Giardia lamblia
LSPIPARRLPAMALQNNPRIVSAP

SEQ ID NO: 3163266 - protein, 23 aa, Giardia lamblia
LSPLRPESCARRARMHMRVYSSM

SEQ ID NO: 3163267 - protein, 25 aa, Giardia lamblia
LSPQNKSDCTWSFTTEAAQDPTQDP

SEQ ID NO: 3163268 - protein, 19 aa, Giardia lamblia
LSPSAAWALGFGTTKQLFS

SEQ ID NO: 3163269 - protein, 19 aa, Giardia lamblia
LSPTAICFYNMYSDLVSKL

SEQ ID NO: 3163270 - protein, 21 aa, Giardia lamblia
LSPVECLDWHLGATRTGVVPP

SEQ ID NO: 3163271 - protein, 18 aa, Giardia lamblia
LSPYLARLSHYFNDDASA

SEQ ID NO: 3163272 - protein, 23 aa, Giardia lamblia
LSQAAWEAILLFIFDQQYSNFFK

SEQ ID NO: 3163273 - protein, 24 aa, Giardia lamblia
LSQDCFKSVLLETVILPQQRLRNI

SEQ ID NO: 3163274 - protein, 18 aa, Giardia lamblia
LSQDIAFTYKSEIRTVLA

SEQ ID NO: 3163275 - protein, 22 aa, Giardia lamblia
LSQEPRHVFNLTSSEVLLLSDP

SEQ ID NO: 3163276 - protein, 17 aa, Giardia lamblia
LSQIVSALRYLHGNPLG

SEQ ID NO: 3163277 - protein, 24 aa, Giardia lamblia
LSQPASVLTPCFGQANEHLSSVTF

SEQ ID NO: 3163278 - protein, 17 aa, Giardia lamblia
LSQPCIVYPRQLYSGKQ

SEQ ID NO: 3163279 - protein, 21 aa, Giardia lamblia
LSQRDKIVLRRGSGQKDSSAR

SEQ ID NO: 3163280 - protein, 24 aa, Giardia lamblia
LSRADGRRAIDIAISAQNYAIADM

SEQ ID NO: 3163281 - protein, 19 aa, Giardia lamblia
LSRCPAEITAPVPVCEAEH

SEQ ID NO: 3163282 - protein, 22 aa, Giardia lamblia
LSREQRKACSRQEFANFKDPLA

SEQ ID NO: 3163283 - protein, 20 aa, Giardia lamblia
LSRFCFKDNDPLLVIAELKV

SEQ ID NO: 3163284 - protein, 21 aa, Giardia lamblia
LSRILPERWCVGITAVPCPTA

SEQ ID NO: 3163285 - protein, 21 aa, Giardia lamblia
LSRIMPFPSAISVYHPTTISI

SEQ ID NO: 3163286 - protein, 17 aa, Giardia lamblia
LSRKGTPKSTAMKEDPA

SEQ ID NO: 3163287 - protein, 22 aa, Giardia lamblia
LSRLGSILLLATFRAYPVGAIV

SEQ ID NO: 3163288 - protein, 18 aa, Giardia lamblia
LSRPAAPRTLCKQLMVSL

SEQ ID NO: 3163289 - protein, 27 aa, Giardia lamblia
LSRQLSEKVFLLGALTIRQSCNISTIS

SEQ ID NO: 3163290 - protein, 25 aa, Giardia lamblia
LSRSDLPIGCVSNTLALALNEQSLQ

SEQ ID NO: 3163291 - protein, 22 aa, Giardia lamblia
LSRSYFSPVRGLIILDVTAKST

SEQ ID NO: 3163292 - protein, 17 aa, Giardia lamblia
LSSCLQHFCMAGVSKKT

SEQ ID NO: 3163293 - protein, 22 aa, Giardia lamblia
LSSDIDAWIGFAATGNDWELEQ

SEQ ID NO: 3163294 - protein, 23 aa, Giardia lamblia
LSSEQRSAFFLDIPPTCARIRAY

SEQ ID NO: 3163295 - protein, 23 aa, Giardia lamblia
LSSETVLDLKIAFQTLNDKLVDQ

SEQ ID NO: 3163296 - protein, 24 aa, Giardia lamblia
LSSGHGGHLLKILNSMVDSKKTTE

SEQ ID NO: 3163297 - protein, 18 aa, Giardia lamblia
LSSHFNRYQLIKAAVDVS

SEQ ID NO: 3163298 - protein, 25 aa, Giardia lamblia
LSSHMKLKVANLITHTSDHTELENV

SEQ ID NO: 3163299 - protein, 30 aa, Giardia lamblia
LSSHYKIANLIKRWLHVIVVKLSDVVHFDT

SEQ ID NO: 3163300 - protein, 24 aa, Giardia lamblia
LSSIIGSGSIRWTGVSISNDITSA

SEQ ID NO: 3163301 - protein, 18 aa, Giardia lamblia
LSSIPSLARSTSRSTQNL

SEQ ID NO: 3163302 - protein, 22 aa, Giardia lamblia
LSSKKVIKAICALRRYGVSSFA

SEQ ID NO: 3163303 - protein, 17 aa, Giardia lamblia
LSSKSHHKSIFGDERSK

SEQ ID NO: 3163304 - protein, 19 aa, Giardia lamblia
LSSKWCYFKLSHVGGSSCS

SEQ ID NO: 3163305 - protein, 26 aa, Giardia lamblia
LSSLFLSGRLRYVLLVVPSTLQTQWL

SEQ ID NO: 3163306 - protein, 27 aa, Giardia lamblia
LSSLHSLFRLNLDYIVNFPRIKHIMTN

SEQ ID NO: 3163307 - protein, 17 aa, Giardia lamblia
LSSLKYLLLSLVQGSSP

SEQ ID NO: 3163308 - protein, 17 aa, Giardia lamblia
LSSLLAVIRNYNKTAGV

SEQ ID NO: 3163309 - protein, 17 aa, Giardia lamblia
LSSLLQAAVEWAANLMN

SEQ ID NO: 3163310 - protein, 24 aa, Giardia lamblia
LSSLNDLLPMFQLLDFNASHNVIV

SEQ ID NO: 3163311 - protein, 18 aa, Giardia lamblia
LSSLTFSMSRSFKFDRIF

SEQ ID NO: 3163312 - protein, 24 aa, Giardia lamblia
LSSLYKLFGHTCLNVIKRKADHEM

SEQ ID NO: 3163313 - protein, 18 aa, Giardia lamblia
LSSNCCPHLVLTGAAVYV

SEQ ID NO: 3163314 - protein, 19 aa, Giardia lamblia
LSSPLAYSCPGSFHNDVNG

SEQ ID NO: 3163315 - protein, 18 aa, Giardia lamblia
LSSPVFKDLVYLDFTADC

SEQ ID NO: 3163316 - protein, 23 aa, Giardia lamblia
LSSRRVRLCFDSGMDDCDYTKLF

SEQ ID NO: 3163317 - protein, 20 aa, Giardia lamblia
LSSSKIKANVTFKPGREPIN

SEQ ID NO: 3163318 - protein, 18 aa, Giardia lamblia
LSSSQLRFICQRYSEQNV

SEQ ID NO: 3163319 - protein, 30 aa, Giardia lamblia
LSSTKCLIDLCAAPGSWSQVAAMKMPVGSL

SEQ ID NO: 3163320 - protein, 17 aa, Giardia lamblia
LSSVGGYTDLSKLSAKS

SEQ ID NO: 3163321 - protein, 25 aa, Giardia lamblia
LSSVMMPLRAIGLIAEPENLKKDHP

SEQ ID NO: 3163322 - protein, 18 aa, Giardia lamblia
LSSWTEWHKAVGTELKLR

SEQ ID NO: 3163323 - protein, 17 aa, Giardia lamblia
LSTGLPTTCHTFNEMRK

SEQ ID NO: 3163324 - protein, 23 aa, Giardia lamblia
LSTICPKAMRLLKDLQLEQTNVI

SEQ ID NO: 3163325 - protein, 18 aa, Giardia lamblia
LSTISITNSSVWSNFPAK

SEQ ID NO: 3163326 - protein, 17 aa, Giardia lamblia
LSTISSCLAFDPLDRPS

SEQ ID NO: 3163327 - protein, 23 aa, Giardia lamblia
LSTKCDIWSLGILLLDMVSLALY

SEQ ID NO: 3163328 - protein, 23 aa, Giardia lamblia
LSTLCSKFALLHNRAHTVANQHL

SEQ ID NO: 3163329 - protein, 19 aa, Giardia lamblia
LSTLKSQGFINYFGYQRFG

SEQ ID NO: 3163330 - protein, 17 aa, Giardia lamblia
LSTMKWSSANGGAVLCG

SEQ ID NO: 3163331 - protein, 18 aa, Giardia lamblia
LSTVEFMSELQLNRYKYA

SEQ ID NO: 3163332 - protein, 25 aa, Giardia lamblia
LSVAARYCWCDSLVELLDLKENDDT

SEQ ID NO: 3163333 - protein, 20 aa, Giardia lamblia
LSVAFSRVSPKLFAAGNASG

SEQ ID NO: 3163334 - protein, 17 aa, Giardia lamblia
LSVAIFAPREHSICKQK

SEQ ID NO: 3163335 - protein, 19 aa, Giardia lamblia
LSVARSLLYTADLPAPPPI

SEQ ID NO: 3163336 - protein, 18 aa, Giardia lamblia
LSVFPGVAFHSAISCAAY

SEQ ID NO: 3163337 - protein, 22 aa, Giardia lamblia
LSVFQLGWPLVYQNQGVVRNDL

SEQ ID NO: 3163338 - protein, 26 aa, Giardia lamblia
LSVHEFYKANGLLAMVNPKKACQRTT

SEQ ID NO: 3163339 - protein, 21 aa, Giardia lamblia
LSVKEVFQYLLSESLKPLGRI

SEQ ID NO: 3163340 - protein, 19 aa, Giardia lamblia
LSVLCREALMVPIRELQRA

SEQ ID NO: 3163341 - protein, 18 aa, Giardia lamblia
LSVLECKDLICASQGEAV

SEQ ID NO: 3163342 - protein, 17 aa, Giardia lamblia
LSVNTDLSWMLSPDYNA

SEQ ID NO: 3163343 - protein, 19 aa, Giardia lamblia
LSVSFASSILLSFVATLHE

SEQ ID NO: 3163344 - protein, 19 aa, Giardia lamblia
LSVSVGLTGEVVYNPAPRK

SEQ ID NO: 3163345 - protein, 17 aa, Giardia lamblia
LSVTRQDLLASIEAIEQ

SEQ ID NO: 3163346 - protein, 17 aa, Giardia lamblia
LSVYFLGPIYAYNNLYA

SEQ ID NO: 3163347 - protein, 20 aa, Giardia lamblia
LSVYYGHYDLVKLLYPKEHH

SEQ ID NO: 3163348 - protein, 18 aa, Giardia lamblia
LSWLHLAGMLALVDSGIP

SEQ ID NO: 3163349 - protein, 20 aa, Giardia lamblia
LSWLRQPHVLVCRGPAAVLR

SEQ ID NO: 3163350 - protein, 18 aa, Giardia lamblia
LSYEAPISEETQCPEGAR

SEQ ID NO: 3163351 - protein, 19 aa, Giardia lamblia
LSYFRACSLLKQALALNSS

SEQ ID NO: 3163352 - protein, 17 aa, Giardia lamblia
LSYISALGQVTRLSSTF

SEQ ID NO: 3163353 - protein, 27 aa, Giardia lamblia
LSYKMHAGACLSCCSFYSSQGRQDQNF

SEQ ID NO: 3163354 - protein, 25 aa, Giardia lamblia
LSYLLKFKPVRSMDYFNDAGILMGS

SEQ ID NO: 3163355 - protein, 23 aa, Giardia lamblia
LSYLRFGNRLREVAATDLNTVSS

SEQ ID NO: 3163356 - protein, 20 aa, Giardia lamblia
LSYRAPCKARMAKTTRFSPV

SEQ ID NO: 3163357 - protein, 23 aa, Giardia lamblia
LSYSFKESISFGGHGVVYSPPAL

SEQ ID NO: 3163358 - protein, 17 aa, Giardia lamblia
LSYSFLLGASMLGENSN

SEQ ID NO: 3163359 - protein, 17 aa, Giardia lamblia
LTAAAAFDGYNQVVPGQ

SEQ ID NO: 3163360 - protein, 22 aa, Giardia lamblia
LTACAFGLLICFEDVEKFTSSL

SEQ ID NO: 3163361 - protein, 26 aa, Giardia lamblia
LTACKVKLASCTEAQREIDLLKERLR

SEQ ID NO: 3163362 - protein, 17 aa, Giardia lamblia
LTAEMRFEGDLRPVVAT

SEQ ID NO: 3163363 - protein, 18 aa, Giardia lamblia
LTAIISIIQDCMVRGLPA

SEQ ID NO: 3163364 - protein, 19 aa, Giardia lamblia
LTAKMCKKIASSGCNVLLL

SEQ ID NO: 3163365 - protein, 18 aa, Giardia lamblia
LTALMWAAANGRTEVVKL

SEQ ID NO: 3163366 - protein, 18 aa, Giardia lamblia
LTAMAHAAILGRSEVVEL

SEQ ID NO: 3163367 - protein, 17 aa, Giardia lamblia
LTATIRALPCSDTSKHI

SEQ ID NO: 3163368 - protein, 18 aa, Giardia lamblia
LTATSILKQLDFASKDPE

SEQ ID NO: 3163369 - protein, 19 aa, Giardia lamblia
LTAYMLSVINGHWEAAEFL

SEQ ID NO: 3163370 - protein, 23 aa, Giardia lamblia
LTCGLVACWSCDDYTVIGRFTAK

SEQ ID NO: 3163371 - protein, 19 aa, Giardia lamblia
LTCLMNMEMRHGHKTPVIM

SEQ ID NO: 3163372 - protein, 17 aa, Giardia lamblia
LTCRISQLTALPWQLVC

SEQ ID NO: 3163373 - protein, 24 aa, Giardia lamblia
LTDAEMLRVLKNCESFVDDLKAKT

SEQ ID NO: 3163374 - protein, 20 aa, Giardia lamblia
LTDFDLAKRLTLGATVDHYK

SEQ ID NO: 3163375 - protein, 19 aa, Giardia lamblia
LTDLQLVFCHMYRASLSFI

SEQ ID NO: 3163376 - protein, 19 aa, Giardia lamblia
LTDNMGWTALMFAALWGHV

SEQ ID NO: 3163377 - protein, 18 aa, Giardia lamblia
LTDPCVDIGSAITGISAL

SEQ ID NO: 3163378 - protein, 23 aa, Giardia lamblia
LTDSKGRTALMIAAQQGSLEMAK

SEQ ID NO: 3163379 - protein, 26 aa, Giardia lamblia
LTDVPLPLNCYSRMYVPLDPVLDKYI

SEQ ID NO: 3163380 - protein, 17 aa, Giardia lamblia
LTEALYISDSRDYVRVF

SEQ ID NO: 3163381 - protein, 17 aa, Giardia lamblia
LTEARLMLTTSGSLLKA

SEQ ID NO: 3163382 - protein, 26 aa, Giardia lamblia
LTEASALYDRVFKDLAPTASSSTVVA

SEQ ID NO: 3163383 - protein, 18 aa, Giardia lamblia
LTEDEIRRRRESRAPRPL

SEQ ID NO: 3163384 - protein, 25 aa, Giardia lamblia
LTEHICKTPADILRLVQRGNSVRST

SEQ ID NO: 3163385 - protein, 22 aa, Giardia lamblia
LTEIVRLKEMLFQKQKIGDMYL

SEQ ID NO: 3163386 - protein, 20 aa, Giardia lamblia
LTEIYLRKNAITDLREVVYL

SEQ ID NO: 3163387 - protein, 18 aa, Giardia lamblia
LTEKELQAYIAVAKNLRP

SEQ ID NO: 3163388 - protein, 25 aa, Giardia lamblia
LTEKIYRLKAYFVDLLFANDSELVA

SEQ ID NO: 3163389 - protein, 20 aa, Giardia lamblia
LTELGFDLNKALAVYNLAIP

SEQ ID NO: 3163390 - protein, 22 aa, Giardia lamblia
LTELRKVYRSVISRTQAIEPKA

SEQ ID NO: 3163391 - protein, 18 aa, Giardia lamblia
LTESELMRTTAKEADIDG

SEQ ID NO: 3163392 - protein, 25 aa, Giardia lamblia
LTETKRLLQMVTEAMGYEGGFPTTT

SEQ ID NO: 3163393 - protein, 27 aa, Giardia lamblia
LTEVKAHLPVAESFGFDADLRAATSGQ

SEQ ID NO: 3163394 - protein, 24 aa, Giardia lamblia
LTEYLRCFSRYTELILLDEEKWAS

SEQ ID NO: 3163395 - protein, 22 aa, Giardia lamblia
LTEYRSKVEFTIGWTESVLDSP

SEQ ID NO: 3163396 - protein, 26 aa, Giardia lamblia
LTEYSCKDASTLCPINSENLPQGCAA

SEQ ID NO: 3163397 - protein, 19 aa, Giardia lamblia
LTFHTWLSTFLHRKETYEK

SEQ ID NO: 3163398 - protein, 25 aa, Giardia lamblia
LTFQRISFCILELLRIPQATRLIDS

SEQ ID NO: 3163399 - protein, 21 aa, Giardia lamblia
LTFRQEARRAAVTAELNRRMG

SEQ ID NO: 3163400 - protein, 21 aa, Giardia lamblia
LTFTVLMRLAVDYFLNPAYLK

SEQ ID NO: 3163401 - protein, 27 aa, Giardia lamblia
LTFYEGRYSFTLKWSCSLPNAQTGGYT

SEQ ID NO: 3163402 - protein, 17 aa, Giardia lamblia
LTGCLVLLISTQSYSIT

SEQ ID NO: 3163403 - protein, 17 aa, Giardia lamblia
LTGEGYSPLHLALLLNH

SEQ ID NO: 3163404 - protein, 17 aa, Giardia lamblia
LTGEYAVAEVSAVAKAL

SEQ ID NO: 3163405 - protein, 26 aa, Giardia lamblia
LTGNFIQILSFFRCNMDIYDFSSNQD

SEQ ID NO: 3163406 - protein, 17 aa, Giardia lamblia
LTGVPTLAVESDRLACL

SEQ ID NO: 3163407 - protein, 18 aa, Giardia lamblia
LTGVVLWKDILSVQTGPM

SEQ ID NO: 3163408 - protein, 24 aa, Giardia lamblia
LTHHRASVCRVVWVPPAYGNFIIS

SEQ ID NO: 3163409 - protein, 24 aa, Giardia lamblia
LTHNNLRGQMIFDHDSDSDGSLLT

SEQ ID NO: 3163410 - protein, 17 aa, Giardia lamblia
LTICTTAPGVNDSAVTN

SEQ ID NO: 3163411 - protein, 23 aa, Giardia lamblia
LTIDELRQPPLVQKRIHESETMR

SEQ ID NO: 3163412 - protein, 23 aa, Giardia lamblia
LTILCEDCQMAAESAEGTERNTK

SEQ ID NO: 3163413 - protein, 26 aa, Giardia lamblia
LTILLKRVPSLIGLHLNNLIDVDALR

SEQ ID NO: 3163414 - protein, 18 aa, Giardia lamblia
LTISRLTWIKHLYSTIKT

SEQ ID NO: 3163415 - protein, 17 aa, Giardia lamblia
LTKEADVSIFKRKDKIV

SEQ ID NO: 3163416 - protein, 27 aa, Giardia lamblia
LTKEEAYSAVAVFVFVVNYCCKMFSCT

SEQ ID NO: 3163417 - protein, 17 aa, Giardia lamblia
LTKEFDIPISYNKSISR

SEQ ID NO: 3163418 - protein, 27 aa, Giardia lamblia
LTKELKEAKEIFMYTVSMKNDEIERLK

SEQ ID NO: 3163419 - protein, 23 aa, Giardia lamblia
LTKELRPIFLDTLIISTMHAEEI

SEQ ID NO: 3163420 - protein, 23 aa, Giardia lamblia
LTKKEFIATFSLAYTNIFQHDTM

SEQ ID NO: 3163421 - protein, 19 aa, Giardia lamblia
LTKMDGWTALMSAARHGAY

SEQ ID NO: 3163422 - protein, 21 aa, Giardia lamblia
LTKMLPICLEKRMLSVDLTMA

SEQ ID NO: 3163423 - protein, 23 aa, Giardia lamblia
LTKRFPSVVSEVIIESHPKIQPD

SEQ ID NO: 3163424 - protein, 26 aa, Giardia lamblia
LTKTSFPCLLHFDPGFHLSVCLQNLG

SEQ ID NO: 3163425 - protein, 19 aa, Giardia lamblia
LTKVYFIVMAYFPYNLHDL

SEQ ID NO: 3163426 - protein, 28 aa, Giardia lamblia
LTLAELKFPVCALHGLMTLDQRIYNMKL

SEQ ID NO: 3163427 - protein, 19 aa, Giardia lamblia
LTLFSLRVSNIKEIINRLL

SEQ ID NO: 3163428 - protein, 25 aa, Giardia lamblia
LTLIKGKPAFAFGAFGWSNRAVPDI

SEQ ID NO: 3163429 - protein, 26 aa, Giardia lamblia
LTLLDPRFLRYRNFEIAMASVELAVL

SEQ ID NO: 3163430 - protein, 17 aa, Giardia lamblia
LTLNLKTSYFAKHVTAL

SEQ ID NO: 3163431 - protein, 17 aa, Giardia lamblia
LTLNTILTINAHESTVS

SEQ ID NO: 3163432 - protein, 25 aa, Giardia lamblia
LTLRKRSMTHLFGITASRRNTLQAF

SEQ ID NO: 3163433 - protein, 17 aa, Giardia lamblia
LTLRLADSLSDCLYTRF

SEQ ID NO: 3163434 - protein, 22 aa, Giardia lamblia
LTLSRGCAHNGLISDDLMELIL

SEQ ID NO: 3163435 - protein, 23 aa, Giardia lamblia
LTLYAKHHRLHLTLPHPIDPKSV

SEQ ID NO: 3163436 - protein, 18 aa, Giardia lamblia
LTLYVGTEISRIITKQRA

SEQ ID NO: 3163437 - protein, 18 aa, Giardia lamblia
LTMRVVELERLLESNTST

SEQ ID NO: 3163438 - protein, 23 aa, Giardia lamblia
LTNAEILCDMFANVVTASDSAST

SEQ ID NO: 3163439 - protein, 24 aa, Giardia lamblia
LTNDCIYISFSTGDILRLNYPQLN

SEQ ID NO: 3163440 - protein, 17 aa, Giardia lamblia
LTNGCFRTVKKSLAPAF

SEQ ID NO: 3163441 - protein, 17 aa, Giardia lamblia
LTNKVPLDFTNLRNETG

SEQ ID NO: 3163442 - protein, 19 aa, Giardia lamblia
LTNMRVFEEQPLYTAMFLA

SEQ ID NO: 3163443 - protein, 18 aa, Giardia lamblia
LTNPGLAKYQGWVKEQSS

SEQ ID NO: 3163444 - protein, 18 aa, Giardia lamblia
LTNQFIYCPINYREAALL

SEQ ID NO: 3163445 - protein, 19 aa, Giardia lamblia
LTNRHGYNALMYAVTLGDL

SEQ ID NO: 3163446 - protein, 23 aa, Giardia lamblia
LTNRLSSLNLFAPLSTKSPDLTH

SEQ ID NO: 3163447 - protein, 17 aa, Giardia lamblia
LTNTPSLSESSDPVVAS

SEQ ID NO: 3163448 - protein, 17 aa, Giardia lamblia
LTPDGRKYPALTCVHLP

SEQ ID NO: 3163449 - protein, 24 aa, Giardia lamblia
LTPKSGLPFSSRLSPCPDMSSTSY

SEQ ID NO: 3163450 - protein, 27 aa, Giardia lamblia
LTPLEVRALRCLILFVRNSRIVSLSLF

SEQ ID NO: 3163451 - protein, 25 aa, Giardia lamblia
LTPPTAWAPFHLWPNIPTRPSYFPP

SEQ ID NO: 3163452 - protein, 17 aa, Giardia lamblia
LTPRCLVLINPNNPTGS

SEQ ID NO: 3163453 - protein, 29 aa, Giardia lamblia
LTPRLPRISKSVIFLSSFADHFCMTGGTD

SEQ ID NO: 3163454 - protein, 17 aa, Giardia lamblia
LTPSGPFGTIFADAIVQ

SEQ ID NO: 3163455 - protein, 17 aa, Giardia lamblia
LTPWIERERPIIYTELR

SEQ ID NO: 3163456 - protein, 19 aa, Giardia lamblia
LTPYEGLDFSHVSSKGRRF

SEQ ID NO: 3163457 - protein, 23 aa, Giardia lamblia
LTPYPTFCAMTIRTGTRRINGLT

SEQ ID NO: 3163458 - protein, 22 aa, Giardia lamblia
LTQERLFEVLSMAQSLDSLCVY

SEQ ID NO: 3163459 - protein, 25 aa, Giardia lamblia
LTQILKHLFPTGGKSAKRVCSFINR

SEQ ID NO: 3163460 - protein, 17 aa, Giardia lamblia
LTQMLFRGANAVGYTAY

SEQ ID NO: 3163461 - protein, 17 aa, Giardia lamblia
LTQRIGRGFTLRELQGV

SEQ ID NO: 3163462 - protein, 21 aa, Giardia lamblia
LTRAGAFTKRYGAFAPTRRQE

SEQ ID NO: 3163463 - protein, 17 aa, Giardia lamblia
LTRCISEATVPESSLSS

SEQ ID NO: 3163464 - protein, 19 aa, Giardia lamblia
LTREYICLASRDSMQIIES

SEQ ID NO: 3163465 - protein, 19 aa, Giardia lamblia
LTRFPLTNVAHAKQDNCSL

SEQ ID NO: 3163466 - protein, 20 aa, Giardia lamblia
LTRRKETALMVAVKGGSLPC

SEQ ID NO: 3163467 - protein, 24 aa, Giardia lamblia
LTRSRLPLLVPLRLPPDPSTTAGT

SEQ ID NO: 3163468 - protein, 23 aa, Giardia lamblia
LTSARLLVPYEVMLQDAKRNTAL

SEQ ID NO: 3163469 - protein, 24 aa, Giardia lamblia
LTSDAPRPTCYVTSPELVRDALSG

SEQ ID NO: 3163470 - protein, 18 aa, Giardia lamblia
LTSELRRGHRITAIRLLE

SEQ ID NO: 3163471 - protein, 23 aa, Giardia lamblia
LTSEPCITRFIFAADSIRKDETY

SEQ ID NO: 3163472 - protein, 22 aa, Giardia lamblia
LTSFSLAGLWMLIPEIANSTPR

SEQ ID NO: 3163473 - protein, 22 aa, Giardia lamblia
LTSGRRASSRGVHQAPEPLSAY

SEQ ID NO: 3163474 - protein, 24 aa, Giardia lamblia
LTSHLLYLLLVCFQDLHTVKPGRS

SEQ ID NO: 3163475 - protein, 24 aa, Giardia lamblia
LTSHPKLRLLVGLTATLVHRDDPT

SEQ ID NO: 3163476 - protein, 19 aa, Giardia lamblia
LTSIEARTLLGRVHTMELL

SEQ ID NO: 3163477 - protein, 26 aa, Giardia lamblia
LTSILDWALTNGIGFSNFISLGNKAD

SEQ ID NO: 3163478 - protein, 17 aa, Giardia lamblia
LTSISFKSGKVAVDSVD

SEQ ID NO: 3163479 - protein, 24 aa, Giardia lamblia
LTSKWAQNCVDTYHMLYSAYEKIK

SEQ ID NO: 3163480 - protein, 24 aa, Giardia lamblia
LTSLMLAIIRRKWTSVEMLVPLEK

SEQ ID NO: 3163481 - protein, 17 aa, Giardia lamblia
LTSLPPLYRCYLENDYL

SEQ ID NO: 3163482 - protein, 17 aa, Giardia lamblia
LTSPFHSAAKFKVIPAD

SEQ ID NO: 3163483 - protein, 23 aa, Giardia lamblia
LTSQRLNNVILKLKGYGVKVTLA

SEQ ID NO: 3163484 - protein, 23 aa, Giardia lamblia
LTSSCIQCELSASNGESIDVDML

SEQ ID NO: 3163485 - protein, 18 aa, Giardia lamblia
LTSVPLLEILAKHSNLGR

SEQ ID NO: 3163486 - protein, 17 aa, Giardia lamblia
LTSVYGPNLIPFGGSNT

SEQ ID NO: 3163487 - protein, 28 aa, Giardia lamblia
LTTAQFRRLRFGDAPLHMSQPELSSFRK

SEQ ID NO: 3163488 - protein, 18 aa, Giardia lamblia
LTTARVCFKNIGHMPVRL

SEQ ID NO: 3163489 - protein, 18 aa, Giardia lamblia
LTTCGQYTMEIANLKAEL

SEQ ID NO: 3163490 - protein, 25 aa, Giardia lamblia
LTTGEELRLLAILEQGDYEALDALH

SEQ ID NO: 3163491 - protein, 26 aa, Giardia lamblia
LTTIDLPTIIPYIFTSDRVMLHYCSF

SEQ ID NO: 3163492 - protein, 24 aa, Giardia lamblia
LTTLRRPDFLGGKEPAEVFIDGWR

SEQ ID NO: 3163493 - protein, 24 aa, Giardia lamblia
LTTLRRPNFLGGKEPAEVFVDGWR

SEQ ID NO: 3163494 - protein, 18 aa, Giardia lamblia
LTTPIPIRPHNRGESHLE

SEQ ID NO: 3163495 - protein, 29 aa, Giardia lamblia
LTTPVLKSWALQILEALNYMHTCQPKIIH

SEQ ID NO: 3163496 - protein, 25 aa, Giardia lamblia
LTTRYCATCKILSLMPLDYETFVHC

SEQ ID NO: 3163497 - protein, 20 aa, Giardia lamblia
LTTSDGRTALMLAASDCDTV

SEQ ID NO: 3163498 - protein, 32 aa, Giardia lamblia
LTTTITTFVERRFGFSVPRQYPGARGALDVPD

SEQ ID NO: 3163499 - protein, 25 aa, Giardia lamblia
LTTYWELGRALGHDCTQGISLERLI

SEQ ID NO: 3163500 - protein, 17 aa, Giardia lamblia
LTVAKGRIRTLVSELRA

SEQ ID NO: 3163501 - protein, 24 aa, Giardia lamblia
LTVEFIWISNWFKRILDMQKSGMA

SEQ ID NO: 3163502 - protein, 20 aa, Giardia lamblia
LTVYIAKVSLHFSEAQGAVL

SEQ ID NO: 3163503 - protein, 19 aa, Giardia lamblia
LTWIKHLYSTIKTQRNSSC

SEQ ID NO: 3163504 - protein, 22 aa, Giardia lamblia
LTYKLVAFVLHRGTELDSGHYL

SEQ ID NO: 3163505 - protein, 18 aa, Giardia lamblia
LTYKRLVKAIKYAYMALT

SEQ ID NO: 3163506 - protein, 18 aa, Giardia lamblia
LTYLATRLLETTVYHNSY

SEQ ID NO: 3163507 - protein, 19 aa, Giardia lamblia
LTYLRLAHVLIKMIEQTEG

SEQ ID NO: 3163508 - protein, 19 aa, Giardia lamblia
LVADCNHISSEIGFPSTSV

SEQ ID NO: 3163509 - protein, 19 aa, Giardia lamblia
LVADDGLRFLVARKYGGST

SEQ ID NO: 3163510 - protein, 25 aa, Giardia lamblia
LVAECTRLNAELSRQRIRSSSPRVS

SEQ ID NO: 3163511 - protein, 25 aa, Giardia lamblia
LVAGTRLILRISFAHLCHAYAEASA

SEQ ID NO: 3163512 - protein, 18 aa, Giardia lamblia
LVAHADRLHREWTSLAKR

SEQ ID NO: 3163513 - protein, 23 aa, Giardia lamblia
LVAKMLSCYYNLLSSQYLSRDIF

SEQ ID NO: 3163514 - protein, 31 aa, Giardia lamblia
LVAKMTCAYLWGFNVSWGYVHMCTLCSVAKM

SEQ ID NO: 3163515 - protein, 20 aa, Giardia lamblia
LVALNLRASGAINITQGQCD

SEQ ID NO: 3163516 - protein, 18 aa, Giardia lamblia
LVAQRYTGITAFDPDQIN

SEQ ID NO: 3163517 - protein, 31 aa, Giardia lamblia
LVCPDAVYFWNCMTGEFSPGFARDVSLTSTY

SEQ ID NO: 3163518 - protein, 18 aa, Giardia lamblia
LVCRGVLSLAFVESEYVN

SEQ ID NO: 3163519 - protein, 25 aa, Giardia lamblia
LVCSREIKVFQLIGAEVNQEAKRVE

SEQ ID NO: 3163520 - protein, 27 aa, Giardia lamblia
LVCTKACRLRVACNYEKIMEIYSTIPY

SEQ ID NO: 3163521 - protein, 23 aa, Giardia lamblia
LVDARFSEIFHRITGGKARLTLS

SEQ ID NO: 3163522 - protein, 25 aa, Giardia lamblia
LVDKNGLTALDWAINCHKSVDPTCK

SEQ ID NO: 3163523 - protein, 22 aa, Giardia lamblia
LVDMAAYLGSFVVMDEWAAIEK

SEQ ID NO: 3163524 - protein, 26 aa, Giardia lamblia
LVDWLFKRKYMPSIKIMRKSEMLYPW

SEQ ID NO: 3163525 - protein, 18 aa, Giardia lamblia
LVDYPFEIVTAISEDFSC

SEQ ID NO: 3163526 - protein, 23 aa, Giardia lamblia
LVEAIPKRCSWRRYTGEDLSEHQ
